United States Patent 10,058,623 (COMPOSITIONS AND METHODS FOR MODULATING UTRN EXPRESSION) - sequence listing, part 8

SEQ ID NO: 250361 - DNA, 15 bp, Homo sapiens
caatactgcctaaca

SEQ ID NO: 250362 - DNA, 15 bp, Homo sapiens
gcaatactgcctaac

SEQ ID NO: 250363 - DNA, 15 bp, Homo sapiens
tgcaatactgcctaa

SEQ ID NO: 250364 - DNA, 15 bp, Homo sapiens
ctgcaatactgccta

SEQ ID NO: 250365 - DNA, 15 bp, Homo sapiens
gctgcaatactgcct

SEQ ID NO: 250366 - DNA, 15 bp, Homo sapiens
tgctgcaatactgcc

SEQ ID NO: 250367 - DNA, 15 bp, Homo sapiens
gtgctgcaatactgc

SEQ ID NO: 250368 - DNA, 15 bp, Homo sapiens
tgtgctgcaatactg

SEQ ID NO: 250369 - DNA, 15 bp, Homo sapiens
ttgtgctgcaatact

SEQ ID NO: 250370 - DNA, 15 bp, Homo sapiens
gttgtgctgcaatac

SEQ ID NO: 250371 - DNA, 15 bp, Homo sapiens
agttgtgctgcaata

SEQ ID NO: 250372 - DNA, 15 bp, Homo sapiens
aagttgtgctgcaat

SEQ ID NO: 250373 - DNA, 15 bp, Homo sapiens
aaagttgtgctgcaa

SEQ ID NO: 250374 - DNA, 15 bp, Homo sapiens
aaaagttgtgctgca

SEQ ID NO: 250375 - DNA, 15 bp, Homo sapiens
aaaaagttgtgctgc

SEQ ID NO: 250376 - DNA, 15 bp, Homo sapiens
aaaaaagttgtgctg

SEQ ID NO: 250377 - DNA, 15 bp, Homo sapiens
aaaaaaagttgtgct

SEQ ID NO: 250378 - DNA, 15 bp, Homo sapiens
caaaaaaagttgtgc

SEQ ID NO: 250379 - DNA, 15 bp, Homo sapiens
acaaaaaaagttgtg

SEQ ID NO: 250380 - DNA, 15 bp, Homo sapiens
aacaaaaaaagttgt

SEQ ID NO: 250381 - DNA, 15 bp, Homo sapiens
aaacaaaaaaagttg

SEQ ID NO: 250382 - DNA, 15 bp, Homo sapiens
aaaacaaaaaaagtt

SEQ ID NO: 250383 - DNA, 15 bp, Homo sapiens
taaaacaaaaaaagt

SEQ ID NO: 250384 - DNA, 15 bp, Homo sapiens
ataaaacaaaaaaag

SEQ ID NO: 250385 - DNA, 15 bp, Homo sapiens
aataaaacaaaaaaa

SEQ ID NO: 250386 - DNA, 15 bp, Homo sapiens
caaataaaacaaaaa

SEQ ID NO: 250387 - DNA, 15 bp, Homo sapiens
acaaataaaacaaaa

SEQ ID NO: 250388 - DNA, 15 bp, Homo sapiens
aacaaataaaacaaa

SEQ ID NO: 250389 - DNA, 15 bp, Homo sapiens
caacaaataaaacaa

SEQ ID NO: 250390 - DNA, 15 bp, Homo sapiens
ccaacaaataaaaca

SEQ ID NO: 250391 - DNA, 15 bp, Homo sapiens
accaacaaataaaac

SEQ ID NO: 250392 - DNA, 15 bp, Homo sapiens
caccaacaaataaaa

SEQ ID NO: 250393 - DNA, 15 bp, Homo sapiens
gcaccaacaaataaa

SEQ ID NO: 250394 - DNA, 15 bp, Homo sapiens
agcaccaacaaataa

SEQ ID NO: 250395 - DNA, 15 bp, Homo sapiens
tagcaccaacaaata

SEQ ID NO: 250396 - DNA, 15 bp, Homo sapiens
gtagcaccaacaaat

SEQ ID NO: 250397 - DNA, 15 bp, Homo sapiens
tgtagcaccaacaaa

SEQ ID NO: 250398 - DNA, 15 bp, Homo sapiens
ctgtagcaccaacaa

SEQ ID NO: 250399 - DNA, 15 bp, Homo sapiens
actgtagcaccaaca

SEQ ID NO: 250400 - DNA, 15 bp, Homo sapiens
gactgtagcaccaac

SEQ ID NO: 250401 - DNA, 15 bp, Homo sapiens
agactgtagcaccaa

SEQ ID NO: 250402 - DNA, 15 bp, Homo sapiens
aagactgtagcacca

SEQ ID NO: 250403 - DNA, 15 bp, Homo sapiens
taagactgtagcacc

SEQ ID NO: 250404 - DNA, 15 bp, Homo sapiens
ataagactgtagcac

SEQ ID NO: 250405 - DNA, 15 bp, Homo sapiens
tataagactgtagca

SEQ ID NO: 250406 - DNA, 15 bp, Homo sapiens
atataagactgtagc

SEQ ID NO: 250407 - DNA, 15 bp, Homo sapiens
aatataagactgtag

SEQ ID NO: 250408 - DNA, 15 bp, Homo sapiens
taatataagactgta

SEQ ID NO: 250409 - DNA, 15 bp, Homo sapiens
ataatataagactgt

SEQ ID NO: 250410 - DNA, 15 bp, Homo sapiens
aataatataagactg

SEQ ID NO: 250411 - DNA, 15 bp, Homo sapiens
aaataatataagact

SEQ ID NO: 250412 - DNA, 15 bp, Homo sapiens
caaataatataagac

SEQ ID NO: 250413 - DNA, 15 bp, Homo sapiens
acaaataatataaga

SEQ ID NO: 250414 - DNA, 15 bp, Homo sapiens
cacaaataatataag

SEQ ID NO: 250415 - DNA, 15 bp, Homo sapiens
acacaaataatataa

SEQ ID NO: 250416 - DNA, 15 bp, Homo sapiens
aacacaaataatata

SEQ ID NO: 250417 - DNA, 15 bp, Homo sapiens
aaacacaaataatat

SEQ ID NO: 250418 - DNA, 15 bp, Homo sapiens
aaaacacaaataata

SEQ ID NO: 250419 - DNA, 15 bp, Homo sapiens
taaaacacaaataat

SEQ ID NO: 250420 - DNA, 15 bp, Homo sapiens
gtaaaacacaaataa

SEQ ID NO: 250421 - DNA, 15 bp, Homo sapiens
agtaaaacacaaata

SEQ ID NO: 250422 - DNA, 15 bp, Homo sapiens
aagtaaaacacaaat

SEQ ID NO: 250423 - DNA, 15 bp, Homo sapiens
aaagtaaaacacaaa

SEQ ID NO: 250424 - DNA, 15 bp, Homo sapiens
gaaagtaaaacacaa

SEQ ID NO: 250425 - DNA, 15 bp, Homo sapiens
agaaagtaaaacaca

SEQ ID NO: 250426 - DNA, 15 bp, Homo sapiens
cagaaagtaaaacac

SEQ ID NO: 250427 - DNA, 15 bp, Homo sapiens
acagaaagtaaaaca

SEQ ID NO: 250428 - DNA, 15 bp, Homo sapiens
cacagaaagtaaaac

SEQ ID NO: 250429 - DNA, 15 bp, Homo sapiens
ccacagaaagtaaaa

SEQ ID NO: 250430 - DNA, 15 bp, Homo sapiens
gccacagaaagtaaa

SEQ ID NO: 250431 - DNA, 15 bp, Homo sapiens
agccacagaaagtaa

SEQ ID NO: 250432 - DNA, 15 bp, Homo sapiens
aagccacagaaagta

SEQ ID NO: 250433 - DNA, 15 bp, Homo sapiens
taagccacagaaagt

SEQ ID NO: 250434 - DNA, 15 bp, Homo sapiens
ataagccacagaaag

SEQ ID NO: 250435 - DNA, 15 bp, Homo sapiens
gataagccacagaaa

SEQ ID NO: 250436 - DNA, 15 bp, Homo sapiens
tgataagccacagaa

SEQ ID NO: 250437 - DNA, 15 bp, Homo sapiens
ctgataagccacaga

SEQ ID NO: 250438 - DNA, 15 bp, Homo sapiens
actgataagccacag

SEQ ID NO: 250439 - DNA, 15 bp, Homo sapiens
cactgataagccaca

SEQ ID NO: 250440 - DNA, 15 bp, Homo sapiens
acactgataagccac

SEQ ID NO: 250441 - DNA, 15 bp, Homo sapiens
aacactgataagcca

SEQ ID NO: 250442 - DNA, 15 bp, Homo sapiens
taacactgataagcc

SEQ ID NO: 250443 - DNA, 15 bp, Homo sapiens
ataacactgataagc

SEQ ID NO: 250444 - DNA, 15 bp, Homo sapiens
tataacactgataag

SEQ ID NO: 250445 - DNA, 15 bp, Homo sapiens
atataacactgataa

SEQ ID NO: 250446 - DNA, 15 bp, Homo sapiens
aatataacactgata

SEQ ID NO: 250447 - DNA, 15 bp, Homo sapiens
caatataacactgat

SEQ ID NO: 250448 - DNA, 15 bp, Homo sapiens
acaatataacactga

SEQ ID NO: 250449 - DNA, 15 bp, Homo sapiens
aacaatataacactg

SEQ ID NO: 250450 - DNA, 15 bp, Homo sapiens
taacaatataacact

SEQ ID NO: 250451 - DNA, 15 bp, Homo sapiens
ataacaatataacac

SEQ ID NO: 250452 - DNA, 15 bp, Homo sapiens
cataacaatataaca

SEQ ID NO: 250453 - DNA, 15 bp, Homo sapiens
tcataacaatataac

SEQ ID NO: 250454 - DNA, 15 bp, Homo sapiens
ttcataacaatataa

SEQ ID NO: 250455 - DNA, 15 bp, Homo sapiens
attcataacaatata

SEQ ID NO: 250456 - DNA, 15 bp, Homo sapiens
tattcataacaatat

SEQ ID NO: 250457 - DNA, 15 bp, Homo sapiens
ttattcataacaata

SEQ ID NO: 250458 - DNA, 15 bp, Homo sapiens
attattcataacaat

SEQ ID NO: 250459 - DNA, 15 bp, Homo sapiens
tattattcataacaa

SEQ ID NO: 250460 - DNA, 15 bp, Homo sapiens
ttattattcataaca

SEQ ID NO: 250461 - DNA, 15 bp, Homo sapiens
attattattcataac

SEQ ID NO: 250462 - DNA, 15 bp, Homo sapiens
tattattattcataa

SEQ ID NO: 250463 - DNA, 15 bp, Homo sapiens
ctattattattcata

SEQ ID NO: 250464 - DNA, 15 bp, Homo sapiens
tctattattattcat

SEQ ID NO: 250465 - DNA, 15 bp, Homo sapiens
atctattattattca

SEQ ID NO: 250466 - DNA, 15 bp, Homo sapiens
tatctattattattc

SEQ ID NO: 250467 - DNA, 15 bp, Homo sapiens
ctatctattattatt

SEQ ID NO: 250468 - DNA, 15 bp, Homo sapiens
cctatctattattat

SEQ ID NO: 250469 - DNA, 15 bp, Homo sapiens
acctatctattatta

SEQ ID NO: 250470 - DNA, 15 bp, Homo sapiens
cacctatctattatt

SEQ ID NO: 250471 - DNA, 15 bp, Homo sapiens
ccacctatctattat

SEQ ID NO: 250472 - DNA, 15 bp, Homo sapiens
tccacctatctatta

SEQ ID NO: 250473 - DNA, 15 bp, Homo sapiens
ttccacctatctatt

SEQ ID NO: 250474 - DNA, 15 bp, Homo sapiens
cttccacctatctat

SEQ ID NO: 250475 - DNA, 15 bp, Homo sapiens
ccttccacctatcta

SEQ ID NO: 250476 - DNA, 15 bp, Homo sapiens
tccttccacctatct

SEQ ID NO: 250477 - DNA, 15 bp, Homo sapiens
atccttccacctatc

SEQ ID NO: 250478 - DNA, 15 bp, Homo sapiens
tatccttccacctat

SEQ ID NO: 250479 - DNA, 15 bp, Homo sapiens
atatccttccaccta

SEQ ID NO: 250480 - DNA, 15 bp, Homo sapiens
tatatccttccacct

SEQ ID NO: 250481 - DNA, 15 bp, Homo sapiens
gtatatccttccacc

SEQ ID NO: 250482 - DNA, 15 bp, Homo sapiens
agtatatccttccac

SEQ ID NO: 250483 - DNA, 15 bp, Homo sapiens
tagtatatccttcca

SEQ ID NO: 250484 - DNA, 15 bp, Homo sapiens
gtagtatatccttcc

SEQ ID NO: 250485 - DNA, 15 bp, Homo sapiens
agtagtatatccttc

SEQ ID NO: 250486 - DNA, 15 bp, Homo sapiens
aagtagtatatcctt

SEQ ID NO: 250487 - DNA, 15 bp, Homo sapiens
gaagtagtatatcct

SEQ ID NO: 250488 - DNA, 15 bp, Homo sapiens
agaagtagtatatcc

SEQ ID NO: 250489 - DNA, 15 bp, Homo sapiens
aagaagtagtatatc

SEQ ID NO: 250490 - DNA, 15 bp, Homo sapiens
taagaagtagtatat

SEQ ID NO: 250491 - DNA, 15 bp, Homo sapiens
ttaagaagtagtata

SEQ ID NO: 250492 - DNA, 15 bp, Homo sapiens
gttaagaagtagtat

SEQ ID NO: 250493 - DNA, 15 bp, Homo sapiens
ggttaagaagtagta

SEQ ID NO: 250494 - DNA, 15 bp, Homo sapiens
aggttaagaagtagt

SEQ ID NO: 250495 - DNA, 15 bp, Homo sapiens
aaggttaagaagtag

SEQ ID NO: 250496 - DNA, 15 bp, Homo sapiens
taaggttaagaagta

SEQ ID NO: 250497 - DNA, 15 bp, Homo sapiens
ataaggttaagaagt

SEQ ID NO: 250498 - DNA, 15 bp, Homo sapiens
aataaggttaagaag

SEQ ID NO: 250499 - DNA, 15 bp, Homo sapiens
caataaggttaagaa

SEQ ID NO: 250500 - DNA, 15 bp, Homo sapiens
ccaataaggttaaga

SEQ ID NO: 250501 - DNA, 15 bp, Homo sapiens
gccaataaggttaag

SEQ ID NO: 250502 - DNA, 15 bp, Homo sapiens
agccaataaggttaa

SEQ ID NO: 250503 - DNA, 15 bp, Homo sapiens
aagccaataaggtta

SEQ ID NO: 250504 - DNA, 15 bp, Homo sapiens
taagccaataaggtt

SEQ ID NO: 250505 - DNA, 15 bp, Homo sapiens
ttaagccaataaggt

SEQ ID NO: 250506 - DNA, 15 bp, Homo sapiens
attaagccaataagg

SEQ ID NO: 250507 - DNA, 15 bp, Homo sapiens
tattaagccaataag

SEQ ID NO: 250508 - DNA, 15 bp, Homo sapiens
atattaagccaataa

SEQ ID NO: 250509 - DNA, 15 bp, Homo sapiens
aatattaagccaata

SEQ ID NO: 250510 - DNA, 15 bp, Homo sapiens
aaatattaagccaat

SEQ ID NO: 250511 - DNA, 15 bp, Homo sapiens
aaaatattaagccaa

SEQ ID NO: 250512 - DNA, 15 bp, Homo sapiens
taaaatattaagcca

SEQ ID NO: 250513 - DNA, 15 bp, Homo sapiens
ttaaaatattaagcc

SEQ ID NO: 250514 - DNA, 15 bp, Homo sapiens
attaaaatattaagc

SEQ ID NO: 250515 - DNA, 15 bp, Homo sapiens
ttattaaaatattaa

SEQ ID NO: 250516 - DNA, 15 bp, Homo sapiens
attattaaaatatta

SEQ ID NO: 250517 - DNA, 15 bp, Homo sapiens
cattattaaaatatt

SEQ ID NO: 250518 - DNA, 15 bp, Homo sapiens
acattattaaaatat

SEQ ID NO: 250519 - DNA, 15 bp, Homo sapiens
gacattattaaaata

SEQ ID NO: 250520 - DNA, 15 bp, Homo sapiens
ggacattattaaaat

SEQ ID NO: 250521 - DNA, 15 bp, Homo sapiens
tggacattattaaaa

SEQ ID NO: 250522 - DNA, 15 bp, Homo sapiens
atggacattattaaa

SEQ ID NO: 250523 - DNA, 15 bp, Homo sapiens
tatggacattattaa

SEQ ID NO: 250524 - DNA, 15 bp, Homo sapiens
ttatggacattatta

SEQ ID NO: 250525 - DNA, 15 bp, Homo sapiens
tttatggacattatt

SEQ ID NO: 250526 - DNA, 15 bp, Homo sapiens
ttttatggacattat

SEQ ID NO: 250527 - DNA, 15 bp, Homo sapiens
attttatggacatta

SEQ ID NO: 250528 - DNA, 15 bp, Homo sapiens
cattttatggacatt

SEQ ID NO: 250529 - DNA, 15 bp, Homo sapiens
gcattttatggacat

SEQ ID NO: 250530 - DNA, 15 bp, Homo sapiens
tgcattttatggaca

SEQ ID NO: 250531 - DNA, 15 bp, Homo sapiens
ctgcattttatggac

SEQ ID NO: 250532 - DNA, 15 bp, Homo sapiens
tctgcattttatgga

SEQ ID NO: 250533 - DNA, 15 bp, Homo sapiens
ctctgcattttatgg

SEQ ID NO: 250534 - DNA, 15 bp, Homo sapiens
tctctgcattttatg

SEQ ID NO: 250535 - DNA, 15 bp, Homo sapiens
atctctgcattttat

SEQ ID NO: 250536 - DNA, 15 bp, Homo sapiens
aatctctgcatttta

SEQ ID NO: 250537 - DNA, 15 bp, Homo sapiens
taatctctgcatttt

SEQ ID NO: 250538 - DNA, 15 bp, Homo sapiens
ataatctctgcattt

SEQ ID NO: 250539 - DNA, 15 bp, Homo sapiens
tataatctctgcatt

SEQ ID NO: 250540 - DNA, 15 bp, Homo sapiens
atataatctctgcat

SEQ ID NO: 250541 - DNA, 15 bp, Homo sapiens
catataatctctgca

SEQ ID NO: 250542 - DNA, 15 bp, Homo sapiens
acatataatctctgc

SEQ ID NO: 250543 - DNA, 15 bp, Homo sapiens
aacatataatctctg

SEQ ID NO: 250544 - DNA, 15 bp, Homo sapiens
taacatataatctct

SEQ ID NO: 250545 - DNA, 15 bp, Homo sapiens
ataacatataatctc

SEQ ID NO: 250546 - DNA, 15 bp, Homo sapiens
gataacatataatct

SEQ ID NO: 250547 - DNA, 15 bp, Homo sapiens
ggataacatataatc

SEQ ID NO: 250548 - DNA, 15 bp, Homo sapiens
gggataacatataat

SEQ ID NO: 250549 - DNA, 15 bp, Homo sapiens
tgggataacatataa

SEQ ID NO: 250550 - DNA, 15 bp, Homo sapiens
ctgggataacatata

SEQ ID NO: 250551 - DNA, 15 bp, Homo sapiens
gctgggataacatat

SEQ ID NO: 250552 - DNA, 15 bp, Homo sapiens
agctgggataacata

SEQ ID NO: 250553 - DNA, 15 bp, Homo sapiens
cagctgggataacat

SEQ ID NO: 250554 - DNA, 15 bp, Homo sapiens
ccagctgggataaca

SEQ ID NO: 250555 - DNA, 15 bp, Homo sapiens
cccagctgggataac

SEQ ID NO: 250556 - DNA, 15 bp, Homo sapiens
ccccagctgggataa

SEQ ID NO: 250557 - DNA, 15 bp, Homo sapiens
gccccagctgggata

SEQ ID NO: 250558 - DNA, 15 bp, Homo sapiens
agccccagctgggat

SEQ ID NO: 250559 - DNA, 15 bp, Homo sapiens
gagccccagctggga

SEQ ID NO: 250560 - DNA, 15 bp, Homo sapiens
agagccccagctggg

SEQ ID NO: 250561 - DNA, 15 bp, Homo sapiens
aagagccccagctgg

SEQ ID NO: 250562 - DNA, 15 bp, Homo sapiens
gaagagccccagctg

SEQ ID NO: 250563 - DNA, 15 bp, Homo sapiens
tgaagagccccagct

SEQ ID NO: 250564 - DNA, 15 bp, Homo sapiens
ctgaagagccccagc

SEQ ID NO: 250565 - DNA, 15 bp, Homo sapiens
tctgaagagccccag

SEQ ID NO: 250566 - DNA, 15 bp, Homo sapiens
ctctgaagagcccca

SEQ ID NO: 250567 - DNA, 15 bp, Homo sapiens
actctgaagagcccc

SEQ ID NO: 250568 - DNA, 15 bp, Homo sapiens
tactctgaagagccc

SEQ ID NO: 250569 - DNA, 15 bp, Homo sapiens
ttactctgaagagcc

SEQ ID NO: 250570 - DNA, 15 bp, Homo sapiens
cttactctgaagagc

SEQ ID NO: 250571 - DNA, 15 bp, Homo sapiens
ccttactctgaagag

SEQ ID NO: 250572 - DNA, 15 bp, Homo sapiens
cccttactctgaaga

SEQ ID NO: 250573 - DNA, 15 bp, Homo sapiens
ccccttactctgaag

SEQ ID NO: 250574 - DNA, 15 bp, Homo sapiens
cccccttactctgaa

SEQ ID NO: 250575 - DNA, 15 bp, Homo sapiens
gcccccttactctga

SEQ ID NO: 250576 - DNA, 15 bp, Homo sapiens
tgcccccttactctg

SEQ ID NO: 250577 - DNA, 15 bp, Homo sapiens
gtgcccccttactct

SEQ ID NO: 250578 - DNA, 15 bp, Homo sapiens
agtgcccccttactc

SEQ ID NO: 250579 - DNA, 15 bp, Homo sapiens
aagtgcccccttact

SEQ ID NO: 250580 - DNA, 15 bp, Homo sapiens
aaagtgcccccttac

SEQ ID NO: 250581 - DNA, 15 bp, Homo sapiens
aaaagtgccccctta

SEQ ID NO: 250582 - DNA, 15 bp, Homo sapiens
taaaagtgccccctt

SEQ ID NO: 250583 - DNA, 15 bp, Homo sapiens
ttaaaagtgccccct

SEQ ID NO: 250584 - DNA, 15 bp, Homo sapiens
attaaaagtgccccc

SEQ ID NO: 250585 - DNA, 15 bp, Homo sapiens
tattaaaagtgcccc

SEQ ID NO: 250586 - DNA, 15 bp, Homo sapiens
ttattaaaagtgccc

SEQ ID NO: 250587 - DNA, 15 bp, Homo sapiens
attattaaaagtgcc

SEQ ID NO: 250588 - DNA, 15 bp, Homo sapiens
aattattaaaagtgc

SEQ ID NO: 250589 - DNA, 15 bp, Homo sapiens
taattattaaaagtg

SEQ ID NO: 250590 - DNA, 15 bp, Homo sapiens
ataattattaaaagt

SEQ ID NO: 250591 - DNA, 15 bp, Homo sapiens
tataattattaaaag

SEQ ID NO: 250592 - DNA, 15 bp, Homo sapiens
gtataattattaaaa

SEQ ID NO: 250593 - DNA, 15 bp, Homo sapiens
ggtataattattaaa

SEQ ID NO: 250594 - DNA, 15 bp, Homo sapiens
tggtataattattaa

SEQ ID NO: 250595 - DNA, 15 bp, Homo sapiens
ctggtataattatta

SEQ ID NO: 250596 - DNA, 15 bp, Homo sapiens
cctggtataattatt

SEQ ID NO: 250597 - DNA, 15 bp, Homo sapiens
tcctggtataattat

SEQ ID NO: 250598 - DNA, 15 bp, Homo sapiens
atcctggtataatta

SEQ ID NO: 250599 - DNA, 15 bp, Homo sapiens
catcctggtataatt

SEQ ID NO: 250600 - DNA, 15 bp, Homo sapiens
gcatcctggtataat

SEQ ID NO: 250601 - DNA, 15 bp, Homo sapiens
agcatcctggtataa

SEQ ID NO: 250602 - DNA, 15 bp, Homo sapiens
cagcatcctggtata

SEQ ID NO: 250603 - DNA, 15 bp, Homo sapiens
tcagcatcctggtat

SEQ ID NO: 250604 - DNA, 15 bp, Homo sapiens
atcagcatcctggta

SEQ ID NO: 250605 - DNA, 15 bp, Homo sapiens
tatcagcatcctggt

SEQ ID NO: 250606 - DNA, 15 bp, Homo sapiens
atatcagcatcctgg

SEQ ID NO: 250607 - DNA, 15 bp, Homo sapiens
catatcagcatcctg

SEQ ID NO: 250608 - DNA, 15 bp, Homo sapiens
acatatcagcatcct

SEQ ID NO: 250609 - DNA, 15 bp, Homo sapiens
tacatatcagcatcc

SEQ ID NO: 250610 - DNA, 15 bp, Homo sapiens
ttacatatcagcatc

SEQ ID NO: 250611 - DNA, 15 bp, Homo sapiens
attacatatcagcat

SEQ ID NO: 250612 - DNA, 15 bp, Homo sapiens
aattacatatcagca

SEQ ID NO: 250613 - DNA, 15 bp, Homo sapiens
gaattacatatcagc

SEQ ID NO: 250614 - DNA, 15 bp, Homo sapiens
ggaattacatatcag

SEQ ID NO: 250615 - DNA, 15 bp, Homo sapiens
aggaattacatatca

SEQ ID NO: 250616 - DNA, 15 bp, Homo sapiens
caggaattacatatc

SEQ ID NO: 250617 - DNA, 15 bp, Homo sapiens
acaggaattacatat

SEQ ID NO: 250618 - DNA, 15 bp, Homo sapiens
tacaggaattacata

SEQ ID NO: 250619 - DNA, 15 bp, Homo sapiens
atacaggaattacat

SEQ ID NO: 250620 - DNA, 15 bp, Homo sapiens
tatacaggaattaca

SEQ ID NO: 250621 - DNA, 15 bp, Homo sapiens
gtatacaggaattac

SEQ ID NO: 250622 - DNA, 15 bp, Homo sapiens
tgtatacaggaatta

SEQ ID NO: 250623 - DNA, 15 bp, Homo sapiens
ctgtatacaggaatt

SEQ ID NO: 250624 - DNA, 15 bp, Homo sapiens
actgtatacaggaat

SEQ ID NO: 250625 - DNA, 15 bp, Homo sapiens
gactgtatacaggaa

SEQ ID NO: 250626 - DNA, 15 bp, Homo sapiens
agactgtatacagga

SEQ ID NO: 250627 - DNA, 15 bp, Homo sapiens
tagactgtatacagg

SEQ ID NO: 250628 - DNA, 15 bp, Homo sapiens
ctagactgtatacag

SEQ ID NO: 250629 - DNA, 15 bp, Homo sapiens
actagactgtataca

SEQ ID NO: 250630 - DNA, 15 bp, Homo sapiens
tactagactgtatac

SEQ ID NO: 250631 - DNA, 15 bp, Homo sapiens
atactagactgtata

SEQ ID NO: 250632 - DNA, 15 bp, Homo sapiens
tatactagactgtat

SEQ ID NO: 250633 - DNA, 15 bp, Homo sapiens
ttatactagactgta

SEQ ID NO: 250634 - DNA, 15 bp, Homo sapiens
tttatactagactgt

SEQ ID NO: 250635 - DNA, 15 bp, Homo sapiens
ctttatactagactg

SEQ ID NO: 250636 - DNA, 15 bp, Homo sapiens
gctttatactagact

SEQ ID NO: 250637 - DNA, 15 bp, Homo sapiens
tgctttatactagac

SEQ ID NO: 250638 - DNA, 15 bp, Homo sapiens
ctgctttatactaga

SEQ ID NO: 250639 - DNA, 15 bp, Homo sapiens
cctgctttatactag

SEQ ID NO: 250640 - DNA, 15 bp, Homo sapiens
tcctgctttatacta

SEQ ID NO: 250641 - DNA, 15 bp, Homo sapiens
atcctgctttatact

SEQ ID NO: 250642 - DNA, 15 bp, Homo sapiens
aatcctgctttatac

SEQ ID NO: 250643 - DNA, 15 bp, Homo sapiens
aaatcctgctttata

SEQ ID NO: 250644 - DNA, 15 bp, Homo sapiens
taaatcctgctttat

SEQ ID NO: 250645 - DNA, 15 bp, Homo sapiens
ataaatcctgcttta

SEQ ID NO: 250646 - DNA, 15 bp, Homo sapiens
tataaatcctgcttt

SEQ ID NO: 250647 - DNA, 15 bp, Homo sapiens
gtataaatcctgctt

SEQ ID NO: 250648 - DNA, 15 bp, Homo sapiens
agtataaatcctgct

SEQ ID NO: 250649 - DNA, 15 bp, Homo sapiens
cagtataaatcctgc

SEQ ID NO: 250650 - DNA, 15 bp, Homo sapiens
gcagtataaatcctg

SEQ ID NO: 250651 - DNA, 15 bp, Homo sapiens
agcagtataaatcct

SEQ ID NO: 250652 - DNA, 15 bp, Homo sapiens
aagcagtataaatcc

SEQ ID NO: 250653 - DNA, 15 bp, Homo sapiens
caagcagtataaatc

SEQ ID NO: 250654 - DNA, 15 bp, Homo sapiens
tcaagcagtataaat

SEQ ID NO: 250655 - DNA, 15 bp, Homo sapiens
ttcaagcagtataaa

SEQ ID NO: 250656 - DNA, 15 bp, Homo sapiens
cttcaagcagtataa

SEQ ID NO: 250657 - DNA, 15 bp, Homo sapiens
ccttcaagcagtata

SEQ ID NO: 250658 - DNA, 15 bp, Homo sapiens
tccttcaagcagtat

SEQ ID NO: 250659 - DNA, 15 bp, Homo sapiens
atccttcaagcagta

SEQ ID NO: 250660 - DNA, 15 bp, Homo sapiens
tatccttcaagcagt

SEQ ID NO: 250661 - DNA, 15 bp, Homo sapiens
ctatccttcaagcag

SEQ ID NO: 250662 - DNA, 15 bp, Homo sapiens
actatccttcaagca

SEQ ID NO: 250663 - DNA, 15 bp, Homo sapiens
aactatccttcaagc

SEQ ID NO: 250664 - DNA, 15 bp, Homo sapiens
aaactatccttcaag

SEQ ID NO: 250665 - DNA, 15 bp, Homo sapiens
aaaactatccttcaa

SEQ ID NO: 250666 - DNA, 15 bp, Homo sapiens
gaaaactatccttca

SEQ ID NO: 250667 - DNA, 15 bp, Homo sapiens
tgaaaactatccttc

SEQ ID NO: 250668 - DNA, 15 bp, Homo sapiens
ttgaaaactatcctt

SEQ ID NO: 250669 - DNA, 15 bp, Homo sapiens
tttgaaaactatcct

SEQ ID NO: 250670 - DNA, 15 bp, Homo sapiens
ttttgaaaactatcc

SEQ ID NO: 250671 - DNA, 15 bp, Homo sapiens
attttgaaaactatc

SEQ ID NO: 250672 - DNA, 15 bp, Homo sapiens
tattttgaaaactat

SEQ ID NO: 250673 - DNA, 15 bp, Homo sapiens
ctattttgaaaacta

SEQ ID NO: 250674 - DNA, 15 bp, Homo sapiens
cctattttgaaaact

SEQ ID NO: 250675 - DNA, 15 bp, Homo sapiens
gcctattttgaaaac

SEQ ID NO: 250676 - DNA, 15 bp, Homo sapiens
tgcctattttgaaaa

SEQ ID NO: 250677 - DNA, 15 bp, Homo sapiens
ttgcctattttgaaa

SEQ ID NO: 250678 - DNA, 15 bp, Homo sapiens
tttgcctattttgaa

SEQ ID NO: 250679 - DNA, 15 bp, Homo sapiens
ttttgcctattttga

SEQ ID NO: 250680 - DNA, 15 bp, Homo sapiens
tttttgcctattttg

SEQ ID NO: 250681 - DNA, 15 bp, Homo sapiens
atttttgcctatttt

SEQ ID NO: 250682 - DNA, 15 bp, Homo sapiens
gatttttgcctattt

SEQ ID NO: 250683 - DNA, 15 bp, Homo sapiens
agatttttgcctatt

SEQ ID NO: 250684 - DNA, 15 bp, Homo sapiens
aagatttttgcctat

SEQ ID NO: 250685 - DNA, 15 bp, Homo sapiens
taagatttttgccta

SEQ ID NO: 250686 - DNA, 15 bp, Homo sapiens
ttaagatttttgcct

SEQ ID NO: 250687 - DNA, 15 bp, Homo sapiens
gttaagatttttgcc

SEQ ID NO: 250688 - DNA, 15 bp, Homo sapiens
agttaagatttttgc

SEQ ID NO: 250689 - DNA, 15 bp, Homo sapiens
gagttaagatttttg

SEQ ID NO: 250690 - DNA, 15 bp, Homo sapiens
agagttaagattttt

SEQ ID NO: 250691 - DNA, 15 bp, Homo sapiens
aagagttaagatttt

SEQ ID NO: 250692 - DNA, 15 bp, Homo sapiens
taagagttaagattt

SEQ ID NO: 250693 - DNA, 15 bp, Homo sapiens
ataagagttaagatt

SEQ ID NO: 250694 - DNA, 15 bp, Homo sapiens
tataagagttaagat

SEQ ID NO: 250695 - DNA, 15 bp, Homo sapiens
gtataagagttaaga

SEQ ID NO: 250696 - DNA, 15 bp, Homo sapiens
tgtataagagttaag

SEQ ID NO: 250697 - DNA, 15 bp, Homo sapiens
ttgtataagagttaa

SEQ ID NO: 250698 - DNA, 15 bp, Homo sapiens
tttgtataagagtta

SEQ ID NO: 250699 - DNA, 15 bp, Homo sapiens
atttgtataagagtt

SEQ ID NO: 250700 - DNA, 15 bp, Homo sapiens
tatttgtataagagt

SEQ ID NO: 250701 - DNA, 15 bp, Homo sapiens
gtatttgtataagag

SEQ ID NO: 250702 - DNA, 15 bp, Homo sapiens
tgtatttgtataaga

SEQ ID NO: 250703 - DNA, 15 bp, Homo sapiens
ttgtatttgtataag

SEQ ID NO: 250704 - DNA, 15 bp, Homo sapiens
tttgtatttgtataa

SEQ ID NO: 250705 - DNA, 15 bp, Homo sapiens
ttttgtatttgtata

SEQ ID NO: 250706 - DNA, 15 bp, Homo sapiens
tttttgtatttgtat

SEQ ID NO: 250707 - DNA, 15 bp, Homo sapiens
ctttttgtatttgta

SEQ ID NO: 250708 - DNA, 15 bp, Homo sapiens
tctttttgtatttgt

SEQ ID NO: 250709 - DNA, 15 bp, Homo sapiens
ctctttttgtatttg

SEQ ID NO: 250710 - DNA, 15 bp, Homo sapiens
gctctttttgtattt

SEQ ID NO: 250711 - DNA, 15 bp, Homo sapiens
tgctctttttgtatt

SEQ ID NO: 250712 - DNA, 15 bp, Homo sapiens
atgctctttttgtat

SEQ ID NO: 250713 - DNA, 15 bp, Homo sapiens
catgctctttttgta

SEQ ID NO: 250714 - DNA, 15 bp, Homo sapiens
acatgctctttttgt

SEQ ID NO: 250715 - DNA, 15 bp, Homo sapiens
aacatgctctttttg

SEQ ID NO: 250716 - DNA, 15 bp, Homo sapiens
aaacatgctcttttt

SEQ ID NO: 250717 - DNA, 15 bp, Homo sapiens
gaaacatgctctttt

SEQ ID NO: 250718 - DNA, 15 bp, Homo sapiens
tgaaacatgctcttt

SEQ ID NO: 250719 - DNA, 15 bp, Homo sapiens
atgaaacatgctctt

SEQ ID NO: 250720 - DNA, 15 bp, Homo sapiens
aatgaaacatgctct

SEQ ID NO: 250721 - DNA, 15 bp, Homo sapiens
aaatgaaacatgctc

SEQ ID NO: 250722 - DNA, 15 bp, Homo sapiens
taaatgaaacatgct

SEQ ID NO: 250723 - DNA, 15 bp, Homo sapiens
ttaaatgaaacatgc

SEQ ID NO: 250724 - DNA, 15 bp, Homo sapiens
gttaaatgaaacatg

SEQ ID NO: 250725 - DNA, 15 bp, Homo sapiens
agttaaatgaaacat

SEQ ID NO: 250726 - DNA, 15 bp, Homo sapiens
gagttaaatgaaaca

SEQ ID NO: 250727 - DNA, 15 bp, Homo sapiens
tgagttaaatgaaac

SEQ ID NO: 250728 - DNA, 15 bp, Homo sapiens
atgagttaaatgaaa

SEQ ID NO: 250729 - DNA, 15 bp, Homo sapiens
tatgagttaaatgaa

SEQ ID NO: 250730 - DNA, 15 bp, Homo sapiens
ctatgagttaaatga

SEQ ID NO: 250731 - DNA, 15 bp, Homo sapiens
actatgagttaaatg

SEQ ID NO: 250732 - DNA, 15 bp, Homo sapiens
tactatgagttaaat

SEQ ID NO: 250733 - DNA, 15 bp, Homo sapiens
ttactatgagttaaa

SEQ ID NO: 250734 - DNA, 15 bp, Homo sapiens
cttactatgagttaa

SEQ ID NO: 250735 - DNA, 15 bp, Homo sapiens
ccttactatgagtta

SEQ ID NO: 250736 - DNA, 15 bp, Homo sapiens
cccttactatgagtt

SEQ ID NO: 250737 - DNA, 15 bp, Homo sapiens
tcccttactatgagt

SEQ ID NO: 250738 - DNA, 15 bp, Homo sapiens
ttcccttactatgag

SEQ ID NO: 250739 - DNA, 15 bp, Homo sapiens
gttcccttactatga

SEQ ID NO: 250740 - DNA, 15 bp, Homo sapiens
ggttcccttactatg

SEQ ID NO: 250741 - DNA, 15 bp, Homo sapiens
tggttcccttactat

SEQ ID NO: 250742 - DNA, 15 bp, Homo sapiens
ctggttcccttacta

SEQ ID NO: 250743 - DNA, 15 bp, Homo sapiens
actggttcccttact

SEQ ID NO: 250744 - DNA, 15 bp, Homo sapiens
tactggttcccttac

SEQ ID NO: 250745 - DNA, 15 bp, Homo sapiens
ttactggttccctta

SEQ ID NO: 250746 - DNA, 15 bp, Homo sapiens
cttactggttccctt

SEQ ID NO: 250747 - DNA, 15 bp, Homo sapiens
tcttactggttccct

SEQ ID NO: 250748 - DNA, 15 bp, Homo sapiens
ttcttactggttccc

SEQ ID NO: 250749 - DNA, 15 bp, Homo sapiens
cttcttactggttcc

SEQ ID NO: 250750 - DNA, 15 bp, Homo sapiens
acttcttactggttc

SEQ ID NO: 250751 - DNA, 15 bp, Homo sapiens
aacttcttactggtt

SEQ ID NO: 250752 - DNA, 15 bp, Homo sapiens
taacttcttactggt

SEQ ID NO: 250753 - DNA, 15 bp, Homo sapiens
ataacttcttactgg

SEQ ID NO: 250754 - DNA, 15 bp, Homo sapiens
tataacttcttactg

SEQ ID NO: 250755 - DNA, 15 bp, Homo sapiens
ttataacttcttact

SEQ ID NO: 250756 - DNA, 15 bp, Homo sapiens
attataacttcttac

SEQ ID NO: 250757 - DNA, 15 bp, Homo sapiens
tattataacttctta

SEQ ID NO: 250758 - DNA, 15 bp, Homo sapiens
ctattataacttctt

SEQ ID NO: 250759 - DNA, 15 bp, Homo sapiens
cctattataacttct

SEQ ID NO: 250760 - DNA, 15 bp, Homo sapiens
acctattataacttc

SEQ ID NO: 250761 - DNA, 15 bp, Homo sapiens
aacctattataactt

SEQ ID NO: 250762 - DNA, 15 bp, Homo sapiens
gaacctattataact

SEQ ID NO: 250763 - DNA, 15 bp, Homo sapiens
ggaacctattataac

SEQ ID NO: 250764 - DNA, 15 bp, Homo sapiens
tggaacctattataa

SEQ ID NO: 250765 - DNA, 15 bp, Homo sapiens
ttggaacctattata

SEQ ID NO: 250766 - DNA, 15 bp, Homo sapiens
tttggaacctattat

SEQ ID NO: 250767 - DNA, 15 bp, Homo sapiens
ctttggaacctatta

SEQ ID NO: 250768 - DNA, 15 bp, Homo sapiens
tctttggaacctatt

SEQ ID NO: 250769 - DNA, 15 bp, Homo sapiens
ctctttggaacctat

SEQ ID NO: 250770 - DNA, 15 bp, Homo sapiens
tctctttggaaccta

SEQ ID NO: 250771 - DNA, 15 bp, Homo sapiens
ttctctttggaacct

SEQ ID NO: 250772 - DNA, 15 bp, Homo sapiens
attctctttggaacc

SEQ ID NO: 250773 - DNA, 15 bp, Homo sapiens
tattctctttggaac

SEQ ID NO: 250774 - DNA, 15 bp, Homo sapiens
gtattctctttggaa

SEQ ID NO: 250775 - DNA, 15 bp, Homo sapiens
tgtattctctttgga

SEQ ID NO: 250776 - DNA, 15 bp, Homo sapiens
ttgtattctctttgg

SEQ ID NO: 250777 - DNA, 15 bp, Homo sapiens
tttgtattctctttg

SEQ ID NO: 250778 - DNA, 15 bp, Homo sapiens
ttttgtattctcttt

SEQ ID NO: 250779 - DNA, 15 bp, Homo sapiens
attttgtattctctt

SEQ ID NO: 250780 - DNA, 15 bp, Homo sapiens
cattttgtattctct

SEQ ID NO: 250781 - DNA, 15 bp, Homo sapiens
acattttgtattctc

SEQ ID NO: 250782 - DNA, 15 bp, Homo sapiens
gacattttgtattct

SEQ ID NO: 250783 - DNA, 15 bp, Homo sapiens
tgacattttgtattc

SEQ ID NO: 250784 - DNA, 15 bp, Homo sapiens
gtgacattttgtatt

SEQ ID NO: 250785 - DNA, 15 bp, Homo sapiens
tgtgacattttgtat

SEQ ID NO: 250786 - DNA, 15 bp, Homo sapiens
atgtgacattttgta

SEQ ID NO: 250787 - DNA, 15 bp, Homo sapiens
tatgtgacattttgt

SEQ ID NO: 250788 - DNA, 15 bp, Homo sapiens
atatgtgacattttg

SEQ ID NO: 250789 - DNA, 15 bp, Homo sapiens
aatatgtgacatttt

SEQ ID NO: 250790 - DNA, 15 bp, Homo sapiens
aaatatgtgacattt

SEQ ID NO: 250791 - DNA, 15 bp, Homo sapiens
taaatatgtgacatt

SEQ ID NO: 250792 - DNA, 15 bp, Homo sapiens
ataaatatgtgacat

SEQ ID NO: 250793 - DNA, 15 bp, Homo sapiens
tataaatatgtgaca

SEQ ID NO: 250794 - DNA, 15 bp, Homo sapiens
ctataaatatgtgac

SEQ ID NO: 250795 - DNA, 15 bp, Homo sapiens
actataaatatgtga

SEQ ID NO: 250796 - DNA, 15 bp, Homo sapiens
cactataaatatgtg

SEQ ID NO: 250797 - DNA, 15 bp, Homo sapiens
tcactataaatatgt

SEQ ID NO: 250798 - DNA, 15 bp, Homo sapiens
ctcactataaatatg

SEQ ID NO: 250799 - DNA, 15 bp, Homo sapiens
tctcactataaatat

SEQ ID NO: 250800 - DNA, 15 bp, Homo sapiens
atctcactataaata

SEQ ID NO: 250801 - DNA, 15 bp, Homo sapiens
aatctcactataaat

SEQ ID NO: 250802 - DNA, 15 bp, Homo sapiens
taatctcactataaa

SEQ ID NO: 250803 - DNA, 15 bp, Homo sapiens
ctaatctcactataa

SEQ ID NO: 250804 - DNA, 15 bp, Homo sapiens
cctaatctcactata

SEQ ID NO: 250805 - DNA, 15 bp, Homo sapiens
ccctaatctcactat

SEQ ID NO: 250806 - DNA, 15 bp, Homo sapiens
tccctaatctcacta

SEQ ID NO: 250807 - DNA, 15 bp, Homo sapiens
atccctaatctcact

SEQ ID NO: 250808 - DNA, 15 bp, Homo sapiens
catccctaatctcac

SEQ ID NO: 250809 - DNA, 15 bp, Homo sapiens
gcatccctaatctca

SEQ ID NO: 250810 - DNA, 15 bp, Homo sapiens
agcatccctaatctc

SEQ ID NO: 250811 - DNA, 15 bp, Homo sapiens
tagcatccctaatct

SEQ ID NO: 250812 - DNA, 15 bp, Homo sapiens
ttagcatccctaatc

SEQ ID NO: 250813 - DNA, 15 bp, Homo sapiens
tttagcatccctaat

SEQ ID NO: 250814 - DNA, 15 bp, Homo sapiens
ttttagcatccctaa

SEQ ID NO: 250815 - DNA, 15 bp, Homo sapiens
attttagcatcccta

SEQ ID NO: 250816 - DNA, 15 bp, Homo sapiens
cattttagcatccct

SEQ ID NO: 250817 - DNA, 15 bp, Homo sapiens
tcattttagcatccc

SEQ ID NO: 250818 - DNA, 15 bp, Homo sapiens
ttcattttagcatcc

SEQ ID NO: 250819 - DNA, 15 bp, Homo sapiens
attcattttagcatc

SEQ ID NO: 250820 - DNA, 15 bp, Homo sapiens
aattcattttagcat

SEQ ID NO: 250821 - DNA, 15 bp, Homo sapiens
aaattcattttagca

SEQ ID NO: 250822 - DNA, 15 bp, Homo sapiens
taaattcattttagc

SEQ ID NO: 250823 - DNA, 15 bp, Homo sapiens
gtaaattcattttag

SEQ ID NO: 250824 - DNA, 15 bp, Homo sapiens
ggtaaattcatttta

SEQ ID NO: 250825 - DNA, 15 bp, Homo sapiens
aggtaaattcatttt

SEQ ID NO: 250826 - DNA, 15 bp, Homo sapiens
gaggtaaattcattt

SEQ ID NO: 250827 - DNA, 15 bp, Homo sapiens
agaggtaaattcatt

SEQ ID NO: 250828 - DNA, 15 bp, Homo sapiens
cagaggtaaattcat

SEQ ID NO: 250829 - DNA, 15 bp, Homo sapiens
ccagaggtaaattca

SEQ ID NO: 250830 - DNA, 15 bp, Homo sapiens
tccagaggtaaattc

SEQ ID NO: 250831 - DNA, 15 bp, Homo sapiens
atccagaggtaaatt

SEQ ID NO: 250832 - DNA, 15 bp, Homo sapiens
catccagaggtaaat

SEQ ID NO: 250833 - DNA, 15 bp, Homo sapiens
gcatccagaggtaaa

SEQ ID NO: 250834 - DNA, 15 bp, Homo sapiens
tgcatccagaggtaa

SEQ ID NO: 250835 - DNA, 15 bp, Homo sapiens
ttgcatccagaggta

SEQ ID NO: 250836 - DNA, 15 bp, Homo sapiens
tttgcatccagaggt

SEQ ID NO: 250837 - DNA, 15 bp, Homo sapiens
ctttgcatccagagg

SEQ ID NO: 250838 - DNA, 15 bp, Homo sapiens
gctttgcatccagag

SEQ ID NO: 250839 - DNA, 15 bp, Homo sapiens
agctttgcatccaga

SEQ ID NO: 250840 - DNA, 15 bp, Homo sapiens
cagctttgcatccag

SEQ ID NO: 250841 - DNA, 15 bp, Homo sapiens
tcagctttgcatcca

SEQ ID NO: 250842 - DNA, 15 bp, Homo sapiens
gtcagctttgcatcc

SEQ ID NO: 250843 - DNA, 15 bp, Homo sapiens
tgtcagctttgcatc

SEQ ID NO: 250844 - DNA, 15 bp, Homo sapiens
ttgtcagctttgcat

SEQ ID NO: 250845 - DNA, 15 bp, Homo sapiens
tttgtcagctttgca

SEQ ID NO: 250846 - DNA, 15 bp, Homo sapiens
gtttgtcagctttgc

SEQ ID NO: 250847 - DNA, 15 bp, Homo sapiens
agtttgtcagctttg

SEQ ID NO: 250848 - DNA, 15 bp, Homo sapiens
cagtttgtcagcttt

SEQ ID NO: 250849 - DNA, 15 bp, Homo sapiens
ccagtttgtcagctt

SEQ ID NO: 250850 - DNA, 15 bp, Homo sapiens
accagtttgtcagct

SEQ ID NO: 250851 - DNA, 15 bp, Homo sapiens
gaccagtttgtcagc

SEQ ID NO: 250852 - DNA, 15 bp, Homo sapiens
tgaccagtttgtcag

SEQ ID NO: 250853 - DNA, 15 bp, Homo sapiens
ttgaccagtttgtca

SEQ ID NO: 250854 - DNA, 15 bp, Homo sapiens
attgaccagtttgtc

SEQ ID NO: 250855 - DNA, 15 bp, Homo sapiens
tattgaccagtttgt

SEQ ID NO: 250856 - DNA, 15 bp, Homo sapiens
atattgaccagtttg

SEQ ID NO: 250857 - DNA, 15 bp, Homo sapiens
gatattgaccagttt

SEQ ID NO: 250858 - DNA, 15 bp, Homo sapiens
ggatattgaccagtt

SEQ ID NO: 250859 - DNA, 15 bp, Homo sapiens
tggatattgaccagt

SEQ ID NO: 250860 - DNA, 15 bp, Homo sapiens
gtggatattgaccag

SEQ ID NO: 250861 - DNA, 15 bp, Homo sapiens
tgtggatattgacca

SEQ ID NO: 250862 - DNA, 15 bp, Homo sapiens
ctgtggatattgacc

SEQ ID NO: 250863 - DNA, 15 bp, Homo sapiens
cctgtggatattgac

SEQ ID NO: 250864 - DNA, 15 bp, Homo sapiens
tcctgtggatattga

SEQ ID NO: 250865 - DNA, 15 bp, Homo sapiens
gtcctgtggatattg

SEQ ID NO: 250866 - DNA, 15 bp, Homo sapiens
tgtcctgtggatatt

SEQ ID NO: 250867 - DNA, 15 bp, Homo sapiens
ttgtcctgtggatat

SEQ ID NO: 250868 - DNA, 15 bp, Homo sapiens
attgtcctgtggata

SEQ ID NO: 250869 - DNA, 15 bp, Homo sapiens
tattgtcctgtggat

SEQ ID NO: 250870 - DNA, 15 bp, Homo sapiens
ttattgtcctgtgga

SEQ ID NO: 250871 - DNA, 15 bp, Homo sapiens
attattgtcctgtgg

SEQ ID NO: 250872 - DNA, 15 bp, Homo sapiens
gattattgtcctgtg

SEQ ID NO: 250873 - DNA, 15 bp, Homo sapiens
tgattattgtcctgt

SEQ ID NO: 250874 - DNA, 15 bp, Homo sapiens
ttgattattgtcctg

SEQ ID NO: 250875 - DNA, 15 bp, Homo sapiens
attgattattgtcct

SEQ ID NO: 250876 - DNA, 15 bp, Homo sapiens
aattgattattgtcc

SEQ ID NO: 250877 - DNA, 15 bp, Homo sapiens
caattgattattgtc

SEQ ID NO: 250878 - DNA, 15 bp, Homo sapiens
gcaattgattattgt

SEQ ID NO: 250879 - DNA, 15 bp, Homo sapiens
tgcaattgattattg

SEQ ID NO: 250880 - DNA, 15 bp, Homo sapiens
atgcaattgattatt

SEQ ID NO: 250881 - DNA, 15 bp, Homo sapiens
aatgcaattgattat

SEQ ID NO: 250882 - DNA, 15 bp, Homo sapiens
gaatgcaattgatta

SEQ ID NO: 250883 - DNA, 15 bp, Homo sapiens
ggaatgcaattgatt

SEQ ID NO: 250884 - DNA, 15 bp, Homo sapiens
tggaatgcaattgat

SEQ ID NO: 250885 - DNA, 15 bp, Homo sapiens
gtggaatgcaattga

SEQ ID NO: 250886 - DNA, 15 bp, Homo sapiens
agtggaatgcaattg

SEQ ID NO: 250887 - DNA, 15 bp, Homo sapiens
cagtggaatgcaatt

SEQ ID NO: 250888 - DNA, 15 bp, Homo sapiens
ccagtggaatgcaat

SEQ ID NO: 250889 - DNA, 15 bp, Homo sapiens
cccagtggaatgcaa

SEQ ID NO: 250890 - DNA, 15 bp, Homo sapiens
gcccagtggaatgca

SEQ ID NO: 250891 - DNA, 15 bp, Homo sapiens
tgcccagtggaatgc

SEQ ID NO: 250892 - DNA, 15 bp, Homo sapiens
gtgcccagtggaatg

SEQ ID NO: 250893 - DNA, 15 bp, Homo sapiens
tgtgcccagtggaat

SEQ ID NO: 250894 - DNA, 15 bp, Homo sapiens
ttgtgcccagtggaa

SEQ ID NO: 250895 - DNA, 15 bp, Homo sapiens
attgtgcccagtgga

SEQ ID NO: 250896 - DNA, 15 bp, Homo sapiens
aattgtgcccagtgg

SEQ ID NO: 250897 - DNA, 15 bp, Homo sapiens
aaattgtgcccagtg

SEQ ID NO: 250898 - DNA, 15 bp, Homo sapiens
caaattgtgcccagt

SEQ ID NO: 250899 - DNA, 15 bp, Homo sapiens
gcaaattgtgcccag

SEQ ID NO: 250900 - DNA, 15 bp, Homo sapiens
tgcaaattgtgccca

SEQ ID NO: 250901 - DNA, 15 bp, Homo sapiens
atgcaaattgtgccc

SEQ ID NO: 250902 - DNA, 15 bp, Homo sapiens
aatgcaaattgtgcc

SEQ ID NO: 250903 - DNA, 15 bp, Homo sapiens
aaatgcaaattgtgc

SEQ ID NO: 250904 - DNA, 15 bp, Homo sapiens
taaatgcaaattgtg

SEQ ID NO: 250905 - DNA, 15 bp, Homo sapiens
ataaatgcaaattgt

SEQ ID NO: 250906 - DNA, 15 bp, Homo sapiens
tataaatgcaaattg

SEQ ID NO: 250907 - DNA, 15 bp, Homo sapiens
atataaatgcaaatt

SEQ ID NO: 250908 - DNA, 15 bp, Homo sapiens
catataaatgcaaat

SEQ ID NO: 250909 - DNA, 15 bp, Homo sapiens
ccatataaatgcaaa

SEQ ID NO: 250910 - DNA, 15 bp, Homo sapiens
tccatataaatgcaa

SEQ ID NO: 250911 - DNA, 15 bp, Homo sapiens
gtccatataaatgca

SEQ ID NO: 250912 - DNA, 15 bp, Homo sapiens
tgtccatataaatgc

SEQ ID NO: 250913 - DNA, 15 bp, Homo sapiens
ctgtccatataaatg

SEQ ID NO: 250914 - DNA, 15 bp, Homo sapiens
tctgtccatataaat

SEQ ID NO: 250915 - DNA, 15 bp, Homo sapiens
ttctgtccatataaa

SEQ ID NO: 250916 - DNA, 15 bp, Homo sapiens
tttctgtccatataa

SEQ ID NO: 250917 - DNA, 15 bp, Homo sapiens
atttctgtccatata

SEQ ID NO: 250918 - DNA, 15 bp, Homo sapiens
gatttctgtccatat

SEQ ID NO: 250919 - DNA, 15 bp, Homo sapiens
tgatttctgtccata

SEQ ID NO: 250920 - DNA, 15 bp, Homo sapiens
atgatttctgtccat

SEQ ID NO: 250921 - DNA, 15 bp, Homo sapiens
aatgatttctgtcca

SEQ ID NO: 250922 - DNA, 15 bp, Homo sapiens
aaatgatttctgtcc

SEQ ID NO: 250923 - DNA, 15 bp, Homo sapiens
caaatgatttctgtc

SEQ ID NO: 250924 - DNA, 15 bp, Homo sapiens
gcaaatgatttctgt

SEQ ID NO: 250925 - DNA, 15 bp, Homo sapiens
tgcaaatgatttctg

SEQ ID NO: 250926 - DNA, 15 bp, Homo sapiens
atgcaaatgatttct

SEQ ID NO: 250927 - DNA, 15 bp, Homo sapiens
aatgcaaatgatttc

SEQ ID NO: 250928 - DNA, 15 bp, Homo sapiens
taatgcaaatgattt

SEQ ID NO: 250929 - DNA, 15 bp, Homo sapiens
gtaatgcaaatgatt

SEQ ID NO: 250930 - DNA, 15 bp, Homo sapiens
agtaatgcaaatgat

SEQ ID NO: 250931 - DNA, 15 bp, Homo sapiens
tagtaatgcaaatga

SEQ ID NO: 250932 - DNA, 15 bp, Homo sapiens
atagtaatgcaaatg

SEQ ID NO: 250933 - DNA, 15 bp, Homo sapiens
gatagtaatgcaaat

SEQ ID NO: 250934 - DNA, 15 bp, Homo sapiens
agatagtaatgcaaa

SEQ ID NO: 250935 - DNA, 15 bp, Homo sapiens
cagatagtaatgcaa

SEQ ID NO: 250936 - DNA, 15 bp, Homo sapiens
acagatagtaatgca

SEQ ID NO: 250937 - DNA, 15 bp, Homo sapiens
aacagatagtaatgc

SEQ ID NO: 250938 - DNA, 15 bp, Homo sapiens
aaacagatagtaatg

SEQ ID NO: 250939 - DNA, 15 bp, Homo sapiens
aaaacagatagtaat

SEQ ID NO: 250940 - DNA, 15 bp, Homo sapiens
gaaaacagatagtaa

SEQ ID NO: 250941 - DNA, 15 bp, Homo sapiens
agaaaacagatagta

SEQ ID NO: 250942 - DNA, 15 bp, Homo sapiens
aagaaaacagatagt

SEQ ID NO: 250943 - DNA, 15 bp, Homo sapiens
gaagaaaacagatag

SEQ ID NO: 250944 - DNA, 15 bp, Homo sapiens
tgaagaaaacagata

SEQ ID NO: 250945 - DNA, 15 bp, Homo sapiens
ctgaagaaaacagat

SEQ ID NO: 250946 - DNA, 15 bp, Homo sapiens
actgaagaaaacaga

SEQ ID NO: 250947 - DNA, 15 bp, Homo sapiens
aactgaagaaaacag

SEQ ID NO: 250948 - DNA, 15 bp, Homo sapiens
aaactgaagaaaaca

SEQ ID NO: 250949 - DNA, 15 bp, Homo sapiens
caaactgaagaaaac

SEQ ID NO: 250950 - DNA, 15 bp, Homo sapiens
gcaaactgaagaaaa

SEQ ID NO: 250951 - DNA, 15 bp, Homo sapiens
tgcaaactgaagaaa

SEQ ID NO: 250952 - DNA, 15 bp, Homo sapiens
ctgcaaactgaagaa

SEQ ID NO: 250953 - DNA, 15 bp, Homo sapiens
tctgcaaactgaaga

SEQ ID NO: 250954 - DNA, 15 bp, Homo sapiens
ctctgcaaactgaag

SEQ ID NO: 250955 - DNA, 15 bp, Homo sapiens
actctgcaaactgaa

SEQ ID NO: 250956 - DNA, 15 bp, Homo sapiens
aactctgcaaactga

SEQ ID NO: 250957 - DNA, 15 bp, Homo sapiens
aaactctgcaaactg

SEQ ID NO: 250958 - DNA, 15 bp, Homo sapiens
taaactctgcaaact

SEQ ID NO: 250959 - DNA, 15 bp, Homo sapiens
ttaaactctgcaaac

SEQ ID NO: 250960 - DNA, 15 bp, Homo sapiens
tttaaactctgcaaa

SEQ ID NO: 250961 - DNA, 15 bp, Homo sapiens
ttttaaactctgcaa

SEQ ID NO: 250962 - DNA, 15 bp, Homo sapiens
attttaaactctgca

SEQ ID NO: 250963 - DNA, 15 bp, Homo sapiens
tattttaaactctgc

SEQ ID NO: 250964 - DNA, 15 bp, Homo sapiens
ctattttaaactctg

SEQ ID NO: 250965 - DNA, 15 bp, Homo sapiens
gctattttaaactct

SEQ ID NO: 250966 - DNA, 15 bp, Homo sapiens
agctattttaaactc

SEQ ID NO: 250967 - DNA, 15 bp, Homo sapiens
gagctattttaaact

SEQ ID NO: 250968 - DNA, 15 bp, Homo sapiens
tgagctattttaaac

SEQ ID NO: 250969 - DNA, 15 bp, Homo sapiens
ctgagctattttaaa

SEQ ID NO: 250970 - DNA, 15 bp, Homo sapiens
tctgagctattttaa

SEQ ID NO: 250971 - DNA, 15 bp, Homo sapiens
ctctgagctatttta

SEQ ID NO: 250972 - DNA, 15 bp, Homo sapiens
tctctgagctatttt

SEQ ID NO: 250973 - DNA, 15 bp, Homo sapiens
atctctgagctattt

SEQ ID NO: 250974 - DNA, 15 bp, Homo sapiens
tatctctgagctatt

SEQ ID NO: 250975 - DNA, 15 bp, Homo sapiens
ttatctctgagctat

SEQ ID NO: 250976 - DNA, 15 bp, Homo sapiens
attatctctgagcta

SEQ ID NO: 250977 - DNA, 15 bp, Homo sapiens
aattatctctgagct

SEQ ID NO: 250978 - DNA, 15 bp, Homo sapiens
aaattatctctgagc

SEQ ID NO: 250979 - DNA, 15 bp, Homo sapiens
taaattatctctgag

SEQ ID NO: 250980 - DNA, 15 bp, Homo sapiens
ttaaattatctctga

SEQ ID NO: 250981 - DNA, 15 bp, Homo sapiens
cttaaattatctctg

SEQ ID NO: 250982 - DNA, 15 bp, Homo sapiens
gcttaaattatctct

SEQ ID NO: 250983 - DNA, 15 bp, Homo sapiens
agcttaaattatctc

SEQ ID NO: 250984 - DNA, 15 bp, Homo sapiens
aagcttaaattatct

SEQ ID NO: 250985 - DNA, 15 bp, Homo sapiens
aaagcttaaattatc

SEQ ID NO: 250986 - DNA, 15 bp, Homo sapiens
caaagcttaaattat

SEQ ID NO: 250987 - DNA, 15 bp, Homo sapiens
gcaaagcttaaatta

SEQ ID NO: 250988 - DNA, 15 bp, Homo sapiens
tgcaaagcttaaatt

SEQ ID NO: 250989 - DNA, 15 bp, Homo sapiens
ctgcaaagcttaaat

SEQ ID NO: 250990 - DNA, 15 bp, Homo sapiens
cctgcaaagcttaaa

SEQ ID NO: 250991 - DNA, 15 bp, Homo sapiens
tcctgcaaagcttaa

SEQ ID NO: 250992 - DNA, 15 bp, Homo sapiens
atcctgcaaagctta

SEQ ID NO: 250993 - DNA, 15 bp, Homo sapiens
tatcctgcaaagctt

SEQ ID NO: 250994 - DNA, 15 bp, Homo sapiens
gtatcctgcaaagct

SEQ ID NO: 250995 - DNA, 15 bp, Homo sapiens
ggtatcctgcaaagc

SEQ ID NO: 250996 - DNA, 15 bp, Homo sapiens
gggtatcctgcaaag

SEQ ID NO: 250997 - DNA, 15 bp, Homo sapiens
tgggtatcctgcaaa

SEQ ID NO: 250998 - DNA, 15 bp, Homo sapiens
gtgggtatcctgcaa

SEQ ID NO: 250999 - DNA, 15 bp, Homo sapiens
agtgggtatcctgca

SEQ ID NO: 251000 - DNA, 15 bp, Homo sapiens
gagtgggtatcctgc

SEQ ID NO: 251001 - DNA, 15 bp, Homo sapiens
tgagtgggtatcctg

SEQ ID NO: 251002 - DNA, 15 bp, Homo sapiens
atgagtgggtatcct

SEQ ID NO: 251003 - DNA, 15 bp, Homo sapiens
aatgagtgggtatcc

SEQ ID NO: 251004 - DNA, 15 bp, Homo sapiens
aaatgagtgggtatc

SEQ ID NO: 251005 - DNA, 15 bp, Homo sapiens
aaaatgagtgggtat

SEQ ID NO: 251006 - DNA, 15 bp, Homo sapiens
aaaaatgagtgggta

SEQ ID NO: 251007 - DNA, 15 bp, Homo sapiens
aaaaaatgagtgggt

SEQ ID NO: 251008 - DNA, 15 bp, Homo sapiens
caaaaaatgagtggg

SEQ ID NO: 251009 - DNA, 15 bp, Homo sapiens
gcaaaaaatgagtgg

SEQ ID NO: 251010 - DNA, 15 bp, Homo sapiens
ggcaaaaaatgagtg

SEQ ID NO: 251011 - DNA, 15 bp, Homo sapiens
gggcaaaaaatgagt

SEQ ID NO: 251012 - DNA, 15 bp, Homo sapiens
tgggcaaaaaatgag

SEQ ID NO: 251013 - DNA, 15 bp, Homo sapiens
gtgggcaaaaaatga

SEQ ID NO: 251014 - DNA, 15 bp, Homo sapiens
tgtgggcaaaaaatg

SEQ ID NO: 251015 - DNA, 15 bp, Homo sapiens
ttgtgggcaaaaaat

SEQ ID NO: 251016 - DNA, 15 bp, Homo sapiens
gttgtgggcaaaaaa

SEQ ID NO: 251017 - DNA, 15 bp, Homo sapiens
tgttgtgggcaaaaa

SEQ ID NO: 251018 - DNA, 15 bp, Homo sapiens
ttgttgtgggcaaaa

SEQ ID NO: 251019 - DNA, 15 bp, Homo sapiens
tttgttgtgggcaaa

SEQ ID NO: 251020 - DNA, 15 bp, Homo sapiens
ctttgttgtgggcaa

SEQ ID NO: 251021 - DNA, 15 bp, Homo sapiens
tctttgttgtgggca

SEQ ID NO: 251022 - DNA, 15 bp, Homo sapiens
gtctttgttgtgggc

SEQ ID NO: 251023 - DNA, 15 bp, Homo sapiens
ggtctttgttgtggg

SEQ ID NO: 251024 - DNA, 15 bp, Homo sapiens
aggtctttgttgtgg

SEQ ID NO: 251025 - DNA, 15 bp, Homo sapiens
aaggtctttgttgtg

SEQ ID NO: 251026 - DNA, 15 bp, Homo sapiens
gaaggtctttgttgt

SEQ ID NO: 251027 - DNA, 15 bp, Homo sapiens
tgaaggtctttgttg

SEQ ID NO: 251028 - DNA, 15 bp, Homo sapiens
gtgaaggtctttgtt

SEQ ID NO: 251029 - DNA, 15 bp, Homo sapiens
tgtgaaggtctttgt

SEQ ID NO: 251030 - DNA, 15 bp, Homo sapiens
ttgtgaaggtctttg

SEQ ID NO: 251031 - DNA, 15 bp, Homo sapiens
attgtgaaggtcttt

SEQ ID NO: 251032 - DNA, 15 bp, Homo sapiens
aattgtgaaggtctt

SEQ ID NO: 251033 - DNA, 15 bp, Homo sapiens
aaattgtgaaggtct

SEQ ID NO: 251034 - DNA, 15 bp, Homo sapiens
aaaattgtgaaggtc

SEQ ID NO: 251035 - DNA, 15 bp, Homo sapiens
aaaaattgtgaaggt

SEQ ID NO: 251036 - DNA, 15 bp, Homo sapiens
gaaaaattgtgaagg

SEQ ID NO: 251037 - DNA, 15 bp, Homo sapiens
ggaaaaattgtgaag

SEQ ID NO: 251038 - DNA, 15 bp, Homo sapiens
gggaaaaattgtgaa

SEQ ID NO: 251039 - DNA, 15 bp, Homo sapiens
agggaaaaattgtga

SEQ ID NO: 251040 - DNA, 15 bp, Homo sapiens
cagggaaaaattgtg

SEQ ID NO: 251041 - DNA, 15 bp, Homo sapiens
gcagggaaaaattgt

SEQ ID NO: 251042 - DNA, 15 bp, Homo sapiens
tgcagggaaaaattg

SEQ ID NO: 251043 - DNA, 15 bp, Homo sapiens
gtgcagggaaaaatt

SEQ ID NO: 251044 - DNA, 15 bp, Homo sapiens
tgtgcagggaaaaat

SEQ ID NO: 251045 - DNA, 15 bp, Homo sapiens
ctgtgcagggaaaaa

SEQ ID NO: 251046 - DNA, 15 bp, Homo sapiens
cctgtgcagggaaaa

SEQ ID NO: 251047 - DNA, 15 bp, Homo sapiens
gcctgtgcagggaaa

SEQ ID NO: 251048 - DNA, 15 bp, Homo sapiens
tgcctgtgcagggaa

SEQ ID NO: 251049 - DNA, 15 bp, Homo sapiens
ttgcctgtgcaggga

SEQ ID NO: 251050 - DNA, 15 bp, Homo sapiens
tttgcctgtgcaggg

SEQ ID NO: 251051 - DNA, 15 bp, Homo sapiens
ttttgcctgtgcagg

SEQ ID NO: 251052 - DNA, 15 bp, Homo sapiens
gttttgcctgtgcag

SEQ ID NO: 251053 - DNA, 15 bp, Homo sapiens
agttttgcctgtgca

SEQ ID NO: 251054 - DNA, 15 bp, Homo sapiens
cagttttgcctgtgc

SEQ ID NO: 251055 - DNA, 15 bp, Homo sapiens
ccagttttgcctgtg

SEQ ID NO: 251056 - DNA, 15 bp, Homo sapiens
tccagttttgcctgt

SEQ ID NO: 251057 - DNA, 15 bp, Homo sapiens
atccagttttgcctg

SEQ ID NO: 251058 - DNA, 15 bp, Homo sapiens
catccagttttgcct

SEQ ID NO: 251059 - DNA, 15 bp, Homo sapiens
ccatccagttttgcc

SEQ ID NO: 251060 - DNA, 15 bp, Homo sapiens
gccatccagttttgc

SEQ ID NO: 251061 - DNA, 15 bp, Homo sapiens
agccatccagttttg

SEQ ID NO: 251062 - DNA, 15 bp, Homo sapiens
cagccatccagtttt

SEQ ID NO: 251063 - DNA, 15 bp, Homo sapiens
ccagccatccagttt

SEQ ID NO: 251064 - DNA, 15 bp, Homo sapiens
gccagccatccagtt

SEQ ID NO: 251065 - DNA, 15 bp, Homo sapiens
ggccagccatccagt

SEQ ID NO: 251066 - DNA, 15 bp, Homo sapiens
tggccagccatccag

SEQ ID NO: 251067 - DNA, 15 bp, Homo sapiens
ctggccagccatcca

SEQ ID NO: 251068 - DNA, 15 bp, Homo sapiens
gctggccagccatcc

SEQ ID NO: 251069 - DNA, 15 bp, Homo sapiens
ggctggccagccatc

SEQ ID NO: 251070 - DNA, 15 bp, Homo sapiens
aggctggccagccat

SEQ ID NO: 251071 - DNA, 15 bp, Homo sapiens
taggctggccagcca

SEQ ID NO: 251072 - DNA, 15 bp, Homo sapiens
ctaggctggccagcc

SEQ ID NO: 251073 - DNA, 15 bp, Homo sapiens
actaggctggccagc

SEQ ID NO: 251074 - DNA, 15 bp, Homo sapiens
aactaggctggccag

SEQ ID NO: 251075 - DNA, 15 bp, Homo sapiens
taactaggctggcca

SEQ ID NO: 251076 - DNA, 15 bp, Homo sapiens
gtaactaggctggcc

SEQ ID NO: 251077 - DNA, 15 bp, Homo sapiens
tgtaactaggctggc

SEQ ID NO: 251078 - DNA, 15 bp, Homo sapiens
atgtaactaggctgg

SEQ ID NO: 251079 - DNA, 15 bp, Homo sapiens
catgtaactaggctg

SEQ ID NO: 251080 - DNA, 15 bp, Homo sapiens
acatgtaactaggct

SEQ ID NO: 251081 - DNA, 15 bp, Homo sapiens
gacatgtaactaggc

SEQ ID NO: 251082 - DNA, 15 bp, Homo sapiens
tgacatgtaactagg

SEQ ID NO: 251083 - DNA, 15 bp, Homo sapiens
gtgacatgtaactag

SEQ ID NO: 251084 - DNA, 15 bp, Homo sapiens
tgtgacatgtaacta

SEQ ID NO: 251085 - DNA, 15 bp, Homo sapiens
atgtgacatgtaact

SEQ ID NO: 251086 - DNA, 15 bp, Homo sapiens
catgtgacatgtaac

SEQ ID NO: 251087 - DNA, 15 bp, Homo sapiens
acatgtgacatgtaa

SEQ ID NO: 251088 - DNA, 15 bp, Homo sapiens
aacatgtgacatgta

SEQ ID NO: 251089 - DNA, 15 bp, Homo sapiens
gaacatgtgacatgt

SEQ ID NO: 251090 - DNA, 15 bp, Homo sapiens
agaacatgtgacatg

SEQ ID NO: 251091 - DNA, 15 bp, Homo sapiens
gagaacatgtgacat

SEQ ID NO: 251092 - DNA, 15 bp, Homo sapiens
tgagaacatgtgaca

SEQ ID NO: 251093 - DNA, 15 bp, Homo sapiens
gtgagaacatgtgac

SEQ ID NO: 251094 - DNA, 15 bp, Homo sapiens
agtgagaacatgtga

SEQ ID NO: 251095 - DNA, 15 bp, Homo sapiens
tagtgagaacatgtg

SEQ ID NO: 251096 - DNA, 15 bp, Homo sapiens
atagtgagaacatgt

SEQ ID NO: 251097 - DNA, 15 bp, Homo sapiens
aatagtgagaacatg

SEQ ID NO: 251098 - DNA, 15 bp, Homo sapiens
caatagtgagaacat

SEQ ID NO: 251099 - DNA, 15 bp, Homo sapiens
acaatagtgagaaca

SEQ ID NO: 251100 - DNA, 15 bp, Homo sapiens
aacaatagtgagaac

SEQ ID NO: 251101 - DNA, 15 bp, Homo sapiens
aaacaatagtgagaa

SEQ ID NO: 251102 - DNA, 15 bp, Homo sapiens
caaacaatagtgaga

SEQ ID NO: 251103 - DNA, 15 bp, Homo sapiens
gcaaacaatagtgag

SEQ ID NO: 251104 - DNA, 15 bp, Homo sapiens
agcaaacaatagtga

SEQ ID NO: 251105 - DNA, 15 bp, Homo sapiens
aagcaaacaatagtg

SEQ ID NO: 251106 - DNA, 15 bp, Homo sapiens
gaagcaaacaatagt

SEQ ID NO: 251107 - DNA, 15 bp, Homo sapiens
tgaagcaaacaatag

SEQ ID NO: 251108 - DNA, 15 bp, Homo sapiens
atgaagcaaacaata

SEQ ID NO: 251109 - DNA, 15 bp, Homo sapiens
tatgaagcaaacaat

SEQ ID NO: 251110 - DNA, 15 bp, Homo sapiens
atatgaagcaaacaa

SEQ ID NO: 251111 - DNA, 15 bp, Homo sapiens
catatgaagcaaaca

SEQ ID NO: 251112 - DNA, 15 bp, Homo sapiens
tcatatgaagcaaac

SEQ ID NO: 251113 - DNA, 15 bp, Homo sapiens
atcatatgaagcaaa

SEQ ID NO: 251114 - DNA, 15 bp, Homo sapiens
aatcatatgaagcaa

SEQ ID NO: 251115 - DNA, 15 bp, Homo sapiens
aaatcatatgaagca

SEQ ID NO: 251116 - DNA, 15 bp, Homo sapiens
aaaatcatatgaagc

SEQ ID NO: 251117 - DNA, 15 bp, Homo sapiens
caaaatcatatgaag

SEQ ID NO: 251118 - DNA, 15 bp, Homo sapiens
acaaaatcatatgaa

SEQ ID NO: 251119 - DNA, 15 bp, Homo sapiens
tacaaaatcatatga

SEQ ID NO: 251120 - DNA, 15 bp, Homo sapiens
gtacaaaatcatatg

SEQ ID NO: 251121 - DNA, 15 bp, Homo sapiens
agtacaaaatcatat

SEQ ID NO: 251122 - DNA, 15 bp, Homo sapiens
aagtacaaaatcata

SEQ ID NO: 251123 - DNA, 15 bp, Homo sapiens
taagtacaaaatcat

SEQ ID NO: 251124 - DNA, 15 bp, Homo sapiens
ttaagtacaaaatca

SEQ ID NO: 251125 - DNA, 15 bp, Homo sapiens
gttaagtacaaaatc

SEQ ID NO: 251126 - DNA, 15 bp, Homo sapiens
agttaagtacaaaat

SEQ ID NO: 251127 - DNA, 15 bp, Homo sapiens
cagttaagtacaaaa

SEQ ID NO: 251128 - DNA, 15 bp, Homo sapiens
acagttaagtacaaa

SEQ ID NO: 251129 - DNA, 15 bp, Homo sapiens
aacagttaagtacaa

SEQ ID NO: 251130 - DNA, 15 bp, Homo sapiens
taacagttaagtaca

SEQ ID NO: 251131 - DNA, 15 bp, Homo sapiens
ttaacagttaagtac

SEQ ID NO: 251132 - DNA, 15 bp, Homo sapiens
attaacagttaagta

SEQ ID NO: 251133 - DNA, 15 bp, Homo sapiens
aattaacagttaagt

SEQ ID NO: 251134 - DNA, 15 bp, Homo sapiens
caattaacagttaag

SEQ ID NO: 251135 - DNA, 15 bp, Homo sapiens
gcaattaacagttaa

SEQ ID NO: 251136 - DNA, 15 bp, Homo sapiens
agcaattaacagtta

SEQ ID NO: 251137 - DNA, 15 bp, Homo sapiens
tagcaattaacagtt

SEQ ID NO: 251138 - DNA, 15 bp, Homo sapiens
gtagcaattaacagt

SEQ ID NO: 251139 - DNA, 15 bp, Homo sapiens
agtagcaattaacag

SEQ ID NO: 251140 - DNA, 15 bp, Homo sapiens
aagtagcaattaaca

SEQ ID NO: 251141 - DNA, 15 bp, Homo sapiens
aaagtagcaattaac

SEQ ID NO: 251142 - DNA, 15 bp, Homo sapiens
caaagtagcaattaa

SEQ ID NO: 251143 - DNA, 15 bp, Homo sapiens
acaaagtagcaatta

SEQ ID NO: 251144 - DNA, 15 bp, Homo sapiens
aacaaagtagcaatt

SEQ ID NO: 251145 - DNA, 15 bp, Homo sapiens
aaacaaagtagcaat

SEQ ID NO: 251146 - DNA, 15 bp, Homo sapiens
aaaacaaagtagcaa

SEQ ID NO: 251147 - DNA, 15 bp, Homo sapiens
aaaaacaaagtagca

SEQ ID NO: 251148 - DNA, 15 bp, Homo sapiens
aaaaaacaaagtagc

SEQ ID NO: 251149 - DNA, 15 bp, Homo sapiens
caaaaaacaaagtag

SEQ ID NO: 251150 - DNA, 15 bp, Homo sapiens
acaaaaaacaaagta

SEQ ID NO: 251151 - DNA, 15 bp, Homo sapiens
aacaaaaaacaaagt

SEQ ID NO: 251152 - DNA, 15 bp, Homo sapiens
aacaaaacaaaaaac

SEQ ID NO: 251153 - DNA, 15 bp, Homo sapiens
aaacaaaacaaaaaa

SEQ ID NO: 251154 - DNA, 15 bp, Homo sapiens
aaaaaaacaaaacaa

SEQ ID NO: 251155 - DNA, 15 bp, Homo sapiens
aaaaaaaacaaaaca

SEQ ID NO: 251156 - DNA, 15 bp, Homo sapiens
aaaaaaaaacaaaac

SEQ ID NO: 251157 - DNA, 15 bp, Homo sapiens
taaaaaaaaaaaaac

SEQ ID NO: 251158 - DNA, 15 bp, Homo sapiens
aaaattaaaaaaaaa

SEQ ID NO: 251159 - DNA, 15 bp, Homo sapiens
taaaattaaaaaaaa

SEQ ID NO: 251160 - DNA, 15 bp, Homo sapiens
gaataaaattaaaaa

SEQ ID NO: 251161 - DNA, 15 bp, Homo sapiens
agaataaaattaaaa

SEQ ID NO: 251162 - DNA, 15 bp, Homo sapiens
aagaataaaattaaa

SEQ ID NO: 251163 - DNA, 15 bp, Homo sapiens
caagaataaaattaa

SEQ ID NO: 251164 - DNA, 15 bp, Homo sapiens
ccaagaataaaatta

SEQ ID NO: 251165 - DNA, 15 bp, Homo sapiens
tccaagaataaaatt

SEQ ID NO: 251166 - DNA, 15 bp, Homo sapiens
atccaagaataaaat

SEQ ID NO: 251167 - DNA, 15 bp, Homo sapiens
tatccaagaataaaa

SEQ ID NO: 251168 - DNA, 15 bp, Homo sapiens
ctatccaagaataaa

SEQ ID NO: 251169 - DNA, 15 bp, Homo sapiens
tctatccaagaataa

SEQ ID NO: 251170 - DNA, 15 bp, Homo sapiens
atctatccaagaata

SEQ ID NO: 251171 - DNA, 15 bp, Homo sapiens
aatctatccaagaat

SEQ ID NO: 251172 - DNA, 15 bp, Homo sapiens
gaatctatccaagaa

SEQ ID NO: 251173 - DNA, 15 bp, Homo sapiens
ggaatctatccaaga

SEQ ID NO: 251174 - DNA, 15 bp, Homo sapiens
gggaatctatccaag

SEQ ID NO: 251175 - DNA, 15 bp, Homo sapiens
tgggaatctatccaa

SEQ ID NO: 251176 - DNA, 15 bp, Homo sapiens
atgggaatctatcca

SEQ ID NO: 251177 - DNA, 15 bp, Homo sapiens
catgggaatctatcc

SEQ ID NO: 251178 - DNA, 15 bp, Homo sapiens
ccatgggaatctatc

SEQ ID NO: 251179 - DNA, 15 bp, Homo sapiens
gccatgggaatctat

SEQ ID NO: 251180 - DNA, 15 bp, Homo sapiens
agccatgggaatcta

SEQ ID NO: 251181 - DNA, 15 bp, Homo sapiens
cagccatgggaatct

SEQ ID NO: 251182 - DNA, 15 bp, Homo sapiens
acagccatgggaatc

SEQ ID NO: 251183 - DNA, 15 bp, Homo sapiens
aacagccatgggaat

SEQ ID NO: 251184 - DNA, 15 bp, Homo sapiens
caacagccatgggaa

SEQ ID NO: 251185 - DNA, 15 bp, Homo sapiens
gcaacagccatggga

SEQ ID NO: 251186 - DNA, 15 bp, Homo sapiens
ggcaacagccatggg

SEQ ID NO: 251187 - DNA, 15 bp, Homo sapiens
aggcaacagccatgg

SEQ ID NO: 251188 - DNA, 15 bp, Homo sapiens
aaggcaacagccatg

SEQ ID NO: 251189 - DNA, 15 bp, Homo sapiens
aaaggcaacagccat

SEQ ID NO: 251190 - DNA, 15 bp, Homo sapiens
aaaaggcaacagcca

SEQ ID NO: 251191 - DNA, 15 bp, Homo sapiens
taaaaggcaacagcc

SEQ ID NO: 251192 - DNA, 15 bp, Homo sapiens
ttaaaaggcaacagc

SEQ ID NO: 251193 - DNA, 15 bp, Homo sapiens
tttaaaaggcaacag

SEQ ID NO: 251194 - DNA, 15 bp, Homo sapiens
ctttaaaaggcaaca

SEQ ID NO: 251195 - DNA, 15 bp, Homo sapiens
tctttaaaaggcaac

SEQ ID NO: 251196 - DNA, 15 bp, Homo sapiens
ctctttaaaaggcaa

SEQ ID NO: 251197 - DNA, 15 bp, Homo sapiens
tctctttaaaaggca

SEQ ID NO: 251198 - DNA, 15 bp, Homo sapiens
ctctctttaaaaggc

SEQ ID NO: 251199 - DNA, 15 bp, Homo sapiens
cctctctttaaaagg

SEQ ID NO: 251200 - DNA, 15 bp, Homo sapiens
tcctctctttaaaag

SEQ ID NO: 251201 - DNA, 15 bp, Homo sapiens
atcctctctttaaaa

SEQ ID NO: 251202 - DNA, 15 bp, Homo sapiens
aatcctctctttaaa

SEQ ID NO: 251203 - DNA, 15 bp, Homo sapiens
aaatcctctctttaa

SEQ ID NO: 251204 - DNA, 15 bp, Homo sapiens
aaaatcctctcttta

SEQ ID NO: 251205 - DNA, 15 bp, Homo sapiens
aaaaatcctctcttt

SEQ ID NO: 251206 - DNA, 15 bp, Homo sapiens
taaaaatcctctctt

SEQ ID NO: 251207 - DNA, 15 bp, Homo sapiens
ctaaaaatcctctct

SEQ ID NO: 251208 - DNA, 15 bp, Homo sapiens
actaaaaatcctctc

SEQ ID NO: 251209 - DNA, 15 bp, Homo sapiens
tactaaaaatcctct

SEQ ID NO: 251210 - DNA, 15 bp, Homo sapiens
ttactaaaaatcctc

SEQ ID NO: 251211 - DNA, 15 bp, Homo sapiens
attactaaaaatcct

SEQ ID NO: 251212 - DNA, 15 bp, Homo sapiens
tattactaaaaatcc

SEQ ID NO: 251213 - DNA, 15 bp, Homo sapiens
ttattactaaaaatc

SEQ ID NO: 251214 - DNA, 15 bp, Homo sapiens
tttattactaaaaat

SEQ ID NO: 251215 - DNA, 15 bp, Homo sapiens
ttttattactaaaaa

SEQ ID NO: 251216 - DNA, 15 bp, Homo sapiens
attttattactaaaa

SEQ ID NO: 251217 - DNA, 15 bp, Homo sapiens
gattttattactaaa

SEQ ID NO: 251218 - DNA, 15 bp, Homo sapiens
tgattttattactaa

SEQ ID NO: 251219 - DNA, 15 bp, Homo sapiens
atgattttattacta

SEQ ID NO: 251220 - DNA, 15 bp, Homo sapiens
tatgattttattact

SEQ ID NO: 251221 - DNA, 15 bp, Homo sapiens
ttatgattttattac

SEQ ID NO: 251222 - DNA, 15 bp, Homo sapiens
attatgattttatta

SEQ ID NO: 251223 - DNA, 15 bp, Homo sapiens
aaaattatgatttta

SEQ ID NO: 251224 - DNA, 15 bp, Homo sapiens
taaaattatgatttt

SEQ ID NO: 251225 - DNA, 15 bp, Homo sapiens
ataaaattatgattt

SEQ ID NO: 251226 - DNA, 15 bp, Homo sapiens
aataaaattatgatt

SEQ ID NO: 251227 - DNA, 15 bp, Homo sapiens
aaataaaattatgat

SEQ ID NO: 251228 - DNA, 15 bp, Homo sapiens
aaaataaaattatga

SEQ ID NO: 251229 - DNA, 15 bp, Homo sapiens
taaaataaaattatg

SEQ ID NO: 251230 - DNA, 15 bp, Homo sapiens
ctaaaataaaattat

SEQ ID NO: 251231 - DNA, 15 bp, Homo sapiens
tctaaaataaaatta

SEQ ID NO: 251232 - DNA, 15 bp, Homo sapiens
ctctaaaataaaatt

SEQ ID NO: 251233 - DNA, 15 bp, Homo sapiens
gctctaaaataaaat

SEQ ID NO: 251234 - DNA, 15 bp, Homo sapiens
agctctaaaataaaa

SEQ ID NO: 251235 - DNA, 15 bp, Homo sapiens
aagctctaaaataaa

SEQ ID NO: 251236 - DNA, 15 bp, Homo sapiens
taagctctaaaataa

SEQ ID NO: 251237 - DNA, 15 bp, Homo sapiens
ataagctctaaaata

SEQ ID NO: 251238 - DNA, 15 bp, Homo sapiens
gataagctctaaaat

SEQ ID NO: 251239 - DNA, 15 bp, Homo sapiens
tgataagctctaaaa

SEQ ID NO: 251240 - DNA, 15 bp, Homo sapiens
ttgataagctctaaa

SEQ ID NO: 251241 - DNA, 15 bp, Homo sapiens
cttgataagctctaa

SEQ ID NO: 251242 - DNA, 15 bp, Homo sapiens
gcttgataagctcta

SEQ ID NO: 251243 - DNA, 15 bp, Homo sapiens
agcttgataagctct

SEQ ID NO: 251244 - DNA, 15 bp, Homo sapiens
cagcttgataagctc

SEQ ID NO: 251245 - DNA, 15 bp, Homo sapiens
gcagcttgataagct

SEQ ID NO: 251246 - DNA, 15 bp, Homo sapiens
tgcagcttgataagc

SEQ ID NO: 251247 - DNA, 15 bp, Homo sapiens
gtgcagcttgataag

SEQ ID NO: 251248 - DNA, 15 bp, Homo sapiens
tgtgcagcttgataa

SEQ ID NO: 251249 - DNA, 15 bp, Homo sapiens
ttgtgcagcttgata

SEQ ID NO: 251250 - DNA, 15 bp, Homo sapiens
attgtgcagcttgat

SEQ ID NO: 251251 - DNA, 15 bp, Homo sapiens
tattgtgcagcttga

SEQ ID NO: 251252 - DNA, 15 bp, Homo sapiens
atattgtgcagcttg

SEQ ID NO: 251253 - DNA, 15 bp, Homo sapiens
catattgtgcagctt

SEQ ID NO: 251254 - DNA, 15 bp, Homo sapiens
tcatattgtgcagct

SEQ ID NO: 251255 - DNA, 15 bp, Homo sapiens
ttcatattgtgcagc

SEQ ID NO: 251256 - DNA, 15 bp, Homo sapiens
cttcatattgtgcag

SEQ ID NO: 251257 - DNA, 15 bp, Homo sapiens
acttcatattgtgca

SEQ ID NO: 251258 - DNA, 15 bp, Homo sapiens
gacttcatattgtgc

SEQ ID NO: 251259 - DNA, 15 bp, Homo sapiens
ggacttcatattgtg

SEQ ID NO: 251260 - DNA, 15 bp, Homo sapiens
gggacttcatattgt

SEQ ID NO: 251261 - DNA, 15 bp, Homo sapiens
tgggacttcatattg

SEQ ID NO: 251262 - DNA, 15 bp, Homo sapiens
gtgggacttcatatt

SEQ ID NO: 251263 - DNA, 15 bp, Homo sapiens
agtgggacttcatat

SEQ ID NO: 251264 - DNA, 15 bp, Homo sapiens
gagtgggacttcata

SEQ ID NO: 251265 - DNA, 15 bp, Homo sapiens
ggagtgggacttcat

SEQ ID NO: 251266 - DNA, 15 bp, Homo sapiens
gggagtgggacttca

SEQ ID NO: 251267 - DNA, 15 bp, Homo sapiens
agggagtgggacttc

SEQ ID NO: 251268 - DNA, 15 bp, Homo sapiens
cagggagtgggactt

SEQ ID NO: 251269 - DNA, 15 bp, Homo sapiens
acagggagtgggact

SEQ ID NO: 251270 - DNA, 15 bp, Homo sapiens
aacagggagtgggac

SEQ ID NO: 251271 - DNA, 15 bp, Homo sapiens
gaacagggagtggga

SEQ ID NO: 251272 - DNA, 15 bp, Homo sapiens
tgaacagggagtggg

SEQ ID NO: 251273 - DNA, 15 bp, Homo sapiens
atgaacagggagtgg

SEQ ID NO: 251274 - DNA, 15 bp, Homo sapiens
tatgaacagggagtg

SEQ ID NO: 251275 - DNA, 15 bp, Homo sapiens
atatgaacagggagt

SEQ ID NO: 251276 - DNA, 15 bp, Homo sapiens
aatatgaacagggag

SEQ ID NO: 251277 - DNA, 15 bp, Homo sapiens
aaatatgaacaggga

SEQ ID NO: 251278 - DNA, 15 bp, Homo sapiens
caaatatgaacaggg

SEQ ID NO: 251279 - DNA, 15 bp, Homo sapiens
tcaaatatgaacagg

SEQ ID NO: 251280 - DNA, 15 bp, Homo sapiens
ctcaaatatgaacag

SEQ ID NO: 251281 - DNA, 15 bp, Homo sapiens
tctcaaatatgaaca

SEQ ID NO: 251282 - DNA, 15 bp, Homo sapiens
atctcaaatatgaac

SEQ ID NO: 251283 - DNA, 15 bp, Homo sapiens
aatctcaaatatgaa

SEQ ID NO: 251284 - DNA, 15 bp, Homo sapiens
taatctcaaatatga

SEQ ID NO: 251285 - DNA, 15 bp, Homo sapiens
ttaatctcaaatatg

SEQ ID NO: 251286 - DNA, 15 bp, Homo sapiens
attaatctcaaatat

SEQ ID NO: 251287 - DNA, 15 bp, Homo sapiens
aattaatctcaaata

SEQ ID NO: 251288 - DNA, 15 bp, Homo sapiens
taattaatctcaaat

SEQ ID NO: 251289 - DNA, 15 bp, Homo sapiens
ctaattaatctcaaa

SEQ ID NO: 251290 - DNA, 15 bp, Homo sapiens
tctaattaatctcaa

SEQ ID NO: 251291 - DNA, 15 bp, Homo sapiens
ttctaattaatctca

SEQ ID NO: 251292 - DNA, 15 bp, Homo sapiens
gttctaattaatctc

SEQ ID NO: 251293 - DNA, 15 bp, Homo sapiens
ggttctaattaatct

SEQ ID NO: 251294 - DNA, 15 bp, Homo sapiens
gggttctaattaatc

SEQ ID NO: 251295 - DNA, 15 bp, Homo sapiens
tgggttctaattaat

SEQ ID NO: 251296 - DNA, 15 bp, Homo sapiens
ttgggttctaattaa

SEQ ID NO: 251297 - DNA, 15 bp, Homo sapiens
cttgggttctaatta

SEQ ID NO: 251298 - DNA, 15 bp, Homo sapiens
gcttgggttctaatt

SEQ ID NO: 251299 - DNA, 15 bp, Homo sapiens
agcttgggttctaat

SEQ ID NO: 251300 - DNA, 15 bp, Homo sapiens
cagcttgggttctaa

SEQ ID NO: 251301 - DNA, 15 bp, Homo sapiens
acagcttgggttcta

SEQ ID NO: 251302 - DNA, 15 bp, Homo sapiens
aacagcttgggttct

SEQ ID NO: 251303 - DNA, 15 bp, Homo sapiens
caacagcttgggttc

SEQ ID NO: 251304 - DNA, 15 bp, Homo sapiens
acaacagcttgggtt

SEQ ID NO: 251305 - DNA, 15 bp, Homo sapiens
aacaacagcttgggt

SEQ ID NO: 251306 - DNA, 15 bp, Homo sapiens
taacaacagcttggg

SEQ ID NO: 251307 - DNA, 15 bp, Homo sapiens
ataacaacagcttgg

SEQ ID NO: 251308 - DNA, 15 bp, Homo sapiens
aataacaacagcttg

SEQ ID NO: 251309 - DNA, 15 bp, Homo sapiens
aaataacaacagctt

SEQ ID NO: 251310 - DNA, 15 bp, Homo sapiens
aaaataacaacagct

SEQ ID NO: 251311 - DNA, 15 bp, Homo sapiens
caaaataacaacagc

SEQ ID NO: 251312 - DNA, 15 bp, Homo sapiens
ccaaaataacaacag

SEQ ID NO: 251313 - DNA, 15 bp, Homo sapiens
cccaaaataacaaca

SEQ ID NO: 251314 - DNA, 15 bp, Homo sapiens
ccccaaaataacaac

SEQ ID NO: 251315 - DNA, 15 bp, Homo sapiens
cccccaaaataacaa

SEQ ID NO: 251316 - DNA, 15 bp, Homo sapiens
tcccccaaaataaca

SEQ ID NO: 251317 - DNA, 15 bp, Homo sapiens
ttcccccaaaataac

SEQ ID NO: 251318 - DNA, 15 bp, Homo sapiens
tttcccccaaaataa

SEQ ID NO: 251319 - DNA, 15 bp, Homo sapiens
ttttcccccaaaata

SEQ ID NO: 251320 - DNA, 15 bp, Homo sapiens
attttcccccaaaat

SEQ ID NO: 251321 - DNA, 15 bp, Homo sapiens
cattttcccccaaaa

SEQ ID NO: 251322 - DNA, 15 bp, Homo sapiens
gcattttcccccaaa

SEQ ID NO: 251323 - DNA, 15 bp, Homo sapiens
agcattttcccccaa

SEQ ID NO: 251324 - DNA, 15 bp, Homo sapiens
tagcattttccccca

SEQ ID NO: 251325 - DNA, 15 bp, Homo sapiens
gtagcattttccccc

SEQ ID NO: 251326 - DNA, 15 bp, Homo sapiens
agtagcattttcccc

SEQ ID NO: 251327 - DNA, 15 bp, Homo sapiens
aagtagcattttccc

SEQ ID NO: 251328 - DNA, 15 bp, Homo sapiens
aaagtagcattttcc

SEQ ID NO: 251329 - DNA, 15 bp, Homo sapiens
aaaagtagcattttc

SEQ ID NO: 251330 - DNA, 15 bp, Homo sapiens
ataaaagtagcattt

SEQ ID NO: 251331 - DNA, 15 bp, Homo sapiens
aataaaagtagcatt

SEQ ID NO: 251332 - DNA, 15 bp, Homo sapiens
gaataaaagtagcat

SEQ ID NO: 251333 - DNA, 15 bp, Homo sapiens
agaataaaagtagca

SEQ ID NO: 251334 - DNA, 15 bp, Homo sapiens
cagaataaaagtagc

SEQ ID NO: 251335 - DNA, 15 bp, Homo sapiens
acagaataaaagtag

SEQ ID NO: 251336 - DNA, 15 bp, Homo sapiens
aacagaataaaagta

SEQ ID NO: 251337 - DNA, 15 bp, Homo sapiens
aaacagaataaaagt

SEQ ID NO: 251338 - DNA, 15 bp, Homo sapiens
aaaacagaataaaag

SEQ ID NO: 251339 - DNA, 15 bp, Homo sapiens
caaaacagaataaaa

SEQ ID NO: 251340 - DNA, 15 bp, Homo sapiens
ccaaaacagaataaa

SEQ ID NO: 251341 - DNA, 15 bp, Homo sapiens
accaaaacagaataa

SEQ ID NO: 251342 - DNA, 15 bp, Homo sapiens
aaccaaaacagaata

SEQ ID NO: 251343 - DNA, 15 bp, Homo sapiens
caaccaaaacagaat

SEQ ID NO: 251344 - DNA, 15 bp, Homo sapiens
gcaaccaaaacagaa

SEQ ID NO: 251345 - DNA, 15 bp, Homo sapiens
ggcaaccaaaacaga

SEQ ID NO: 251346 - DNA, 15 bp, Homo sapiens
aggcaaccaaaacag

SEQ ID NO: 251347 - DNA, 15 bp, Homo sapiens
taggcaaccaaaaca

SEQ ID NO: 251348 - DNA, 15 bp, Homo sapiens
gtaggcaaccaaaac

SEQ ID NO: 251349 - DNA, 15 bp, Homo sapiens
agtaggcaaccaaaa

SEQ ID NO: 251350 - DNA, 15 bp, Homo sapiens
gagtaggcaaccaaa

SEQ ID NO: 251351 - DNA, 15 bp, Homo sapiens
agagtaggcaaccaa

SEQ ID NO: 251352 - DNA, 15 bp, Homo sapiens
cagagtaggcaacca

SEQ ID NO: 251353 - DNA, 15 bp, Homo sapiens
ccagagtaggcaacc

SEQ ID NO: 251354 - DNA, 15 bp, Homo sapiens
cccagagtaggcaac

SEQ ID NO: 251355 - DNA, 15 bp, Homo sapiens
tcccagagtaggcaa

SEQ ID NO: 251356 - DNA, 15 bp, Homo sapiens
ctcccagagtaggca

SEQ ID NO: 251357 - DNA, 15 bp, Homo sapiens
tctcccagagtaggc

SEQ ID NO: 251358 - DNA, 15 bp, Homo sapiens
ttctcccagagtagg

SEQ ID NO: 251359 - DNA, 15 bp, Homo sapiens
gttctcccagagtag

SEQ ID NO: 251360 - DNA, 15 bp, Homo sapiens
agttctcccagagta

SEQ ID NO: 251361 - DNA, 15 bp, Homo sapiens
aagttctcccagagt

SEQ ID NO: 251362 - DNA, 15 bp, Homo sapiens
gaagttctcccagag

SEQ ID NO: 251363 - DNA, 15 bp, Homo sapiens
tgaagttctcccaga

SEQ ID NO: 251364 - DNA, 15 bp, Homo sapiens
ctgaagttctcccag

SEQ ID NO: 251365 - DNA, 15 bp, Homo sapiens
cctgaagttctccca

SEQ ID NO: 251366 - DNA, 15 bp, Homo sapiens
gcctgaagttctccc

SEQ ID NO: 251367 - DNA, 15 bp, Homo sapiens
tgcctgaagttctcc

SEQ ID NO: 251368 - DNA, 15 bp, Homo sapiens
atgcctgaagttctc

SEQ ID NO: 251369 - DNA, 15 bp, Homo sapiens
aatgcctgaagttct

SEQ ID NO: 251370 - DNA, 15 bp, Homo sapiens
aaatgcctgaagttc

SEQ ID NO: 251371 - DNA, 15 bp, Homo sapiens
aaaatgcctgaagtt

SEQ ID NO: 251372 - DNA, 15 bp, Homo sapiens
caaaatgcctgaagt

SEQ ID NO: 251373 - DNA, 15 bp, Homo sapiens
ccaaaatgcctgaag

SEQ ID NO: 251374 - DNA, 15 bp, Homo sapiens
gccaaaatgcctgaa

SEQ ID NO: 251375 - DNA, 15 bp, Homo sapiens
tgccaaaatgcctga

SEQ ID NO: 251376 - DNA, 15 bp, Homo sapiens
ttgccaaaatgcctg

SEQ ID NO: 251377 - DNA, 15 bp, Homo sapiens
cttgccaaaatgcct

SEQ ID NO: 251378 - DNA, 15 bp, Homo sapiens
tcttgccaaaatgcc

SEQ ID NO: 251379 - DNA, 15 bp, Homo sapiens
ctcttgccaaaatgc

SEQ ID NO: 251380 - DNA, 15 bp, Homo sapiens
cctcttgccaaaatg

SEQ ID NO: 251381 - DNA, 15 bp, Homo sapiens
tcctcttgccaaaat

SEQ ID NO: 251382 - DNA, 15 bp, Homo sapiens
ctcctcttgccaaaa

SEQ ID NO: 251383 - DNA, 15 bp, Homo sapiens
gctcctcttgccaaa

SEQ ID NO: 251384 - DNA, 15 bp, Homo sapiens
agctcctcttgccaa

SEQ ID NO: 251385 - DNA, 15 bp, Homo sapiens
cagctcctcttgcca

SEQ ID NO: 251386 - DNA, 15 bp, Homo sapiens
tcagctcctcttgcc

SEQ ID NO: 251387 - DNA, 15 bp, Homo sapiens
ctcagctcctcttgc

SEQ ID NO: 251388 - DNA, 15 bp, Homo sapiens
gctcagctcctcttg

SEQ ID NO: 251389 - DNA, 15 bp, Homo sapiens
agctcagctcctctt

SEQ ID NO: 251390 - DNA, 15 bp, Homo sapiens
tagctcagctcctct

SEQ ID NO: 251391 - DNA, 15 bp, Homo sapiens
atagctcagctcctc

SEQ ID NO: 251392 - DNA, 15 bp, Homo sapiens
gatagctcagctcct

SEQ ID NO: 251393 - DNA, 15 bp, Homo sapiens
agatagctcagctcc

SEQ ID NO: 251394 - DNA, 15 bp, Homo sapiens
cagatagctcagctc

SEQ ID NO: 251395 - DNA, 15 bp, Homo sapiens
gcagatagctcagct

SEQ ID NO: 251396 - DNA, 15 bp, Homo sapiens
tgcagatagctcagc

SEQ ID NO: 251397 - DNA, 15 bp, Homo sapiens
ctgcagatagctcag

SEQ ID NO: 251398 - DNA, 15 bp, Homo sapiens
gctgcagatagctca

SEQ ID NO: 251399 - DNA, 15 bp, Homo sapiens
agctgcagatagctc

SEQ ID NO: 251400 - DNA, 15 bp, Homo sapiens
cagctgcagatagct

SEQ ID NO: 251401 - DNA, 15 bp, Homo sapiens
acagctgcagatagc

SEQ ID NO: 251402 - DNA, 15 bp, Homo sapiens
aacagctgcagatag

SEQ ID NO: 251403 - DNA, 15 bp, Homo sapiens
gaacagctgcagata

SEQ ID NO: 251404 - DNA, 15 bp, Homo sapiens
tgaacagctgcagat

SEQ ID NO: 251405 - DNA, 15 bp, Homo sapiens
ttgaacagctgcaga

SEQ ID NO: 251406 - DNA, 15 bp, Homo sapiens
tttgaacagctgcag

SEQ ID NO: 251407 - DNA, 15 bp, Homo sapiens
atttgaacagctgca

SEQ ID NO: 251408 - DNA, 15 bp, Homo sapiens
tatttgaacagctgc

SEQ ID NO: 251409 - DNA, 15 bp, Homo sapiens
gtatttgaacagctg

SEQ ID NO: 251410 - DNA, 15 bp, Homo sapiens
agtatttgaacagct

SEQ ID NO: 251411 - DNA, 15 bp, Homo sapiens
aagtatttgaacagc

SEQ ID NO: 251412 - DNA, 15 bp, Homo sapiens
aaagtatttgaacag

SEQ ID NO: 251413 - DNA, 15 bp, Homo sapiens
taaagtatttgaaca

SEQ ID NO: 251414 - DNA, 15 bp, Homo sapiens
ttaaagtatttgaac

SEQ ID NO: 251415 - DNA, 15 bp, Homo sapiens
cttaaagtatttgaa

SEQ ID NO: 251416 - DNA, 15 bp, Homo sapiens
gcttaaagtatttga

SEQ ID NO: 251417 - DNA, 15 bp, Homo sapiens
ggcttaaagtatttg

SEQ ID NO: 251418 - DNA, 15 bp, Homo sapiens
aggcttaaagtattt

SEQ ID NO: 251419 - DNA, 15 bp, Homo sapiens
aaggcttaaagtatt

SEQ ID NO: 251420 - DNA, 15 bp, Homo sapiens
aaaggcttaaagtat

SEQ ID NO: 251421 - DNA, 15 bp, Homo sapiens
caaaggcttaaagta

SEQ ID NO: 251422 - DNA, 15 bp, Homo sapiens
ccaaaggcttaaagt

SEQ ID NO: 251423 - DNA, 15 bp, Homo sapiens
cccaaaggcttaaag

SEQ ID NO: 251424 - DNA, 15 bp, Homo sapiens
acccaaaggcttaaa

SEQ ID NO: 251425 - DNA, 15 bp, Homo sapiens
aacccaaaggcttaa

SEQ ID NO: 251426 - DNA, 15 bp, Homo sapiens
gaacccaaaggctta

SEQ ID NO: 251427 - DNA, 15 bp, Homo sapiens
tgaacccaaaggctt

SEQ ID NO: 251428 - DNA, 15 bp, Homo sapiens
atgaacccaaaggct

SEQ ID NO: 251429 - DNA, 15 bp, Homo sapiens
aatgaacccaaaggc

SEQ ID NO: 251430 - DNA, 15 bp, Homo sapiens
caatgaacccaaagg

SEQ ID NO: 251431 - DNA, 15 bp, Homo sapiens
acaatgaacccaaag

SEQ ID NO: 251432 - DNA, 15 bp, Homo sapiens
cacaatgaacccaaa

SEQ ID NO: 251433 - DNA, 15 bp, Homo sapiens
ccacaatgaacccaa

SEQ ID NO: 251434 - DNA, 15 bp, Homo sapiens
tccacaatgaaccca

SEQ ID NO: 251435 - DNA, 15 bp, Homo sapiens
atccacaatgaaccc

SEQ ID NO: 251436 - DNA, 15 bp, Homo sapiens
aatccacaatgaacc

SEQ ID NO: 251437 - DNA, 15 bp, Homo sapiens
aaatccacaatgaac

SEQ ID NO: 251438 - DNA, 15 bp, Homo sapiens
aaaatccacaatgaa

SEQ ID NO: 251439 - DNA, 15 bp, Homo sapiens
caaaatccacaatga

SEQ ID NO: 251440 - DNA, 15 bp, Homo sapiens
gcaaaatccacaatg

SEQ ID NO: 251441 - DNA, 15 bp, Homo sapiens
agcaaaatccacaat

SEQ ID NO: 251442 - DNA, 15 bp, Homo sapiens
aagcaaaatccacaa

SEQ ID NO: 251443 - DNA, 15 bp, Homo sapiens
aaagcaaaatccaca

SEQ ID NO: 251444 - DNA, 15 bp, Homo sapiens
taaagcaaaatccac

SEQ ID NO: 251445 - DNA, 15 bp, Homo sapiens
ttaaagcaaaatcca

SEQ ID NO: 251446 - DNA, 15 bp, Homo sapiens
gttaaagcaaaatcc

SEQ ID NO: 251447 - DNA, 15 bp, Homo sapiens
ggttaaagcaaaatc

SEQ ID NO: 251448 - DNA, 15 bp, Homo sapiens
gggttaaagcaaaat

SEQ ID NO: 251449 - DNA, 15 bp, Homo sapiens
agggttaaagcaaaa

SEQ ID NO: 251450 - DNA, 15 bp, Homo sapiens
gagggttaaagcaaa

SEQ ID NO: 251451 - DNA, 15 bp, Homo sapiens
agagggttaaagcaa

SEQ ID NO: 251452 - DNA, 15 bp, Homo sapiens
gagagggttaaagca

SEQ ID NO: 251453 - DNA, 15 bp, Homo sapiens
ggagagggttaaagc

SEQ ID NO: 251454 - DNA, 15 bp, Homo sapiens
gggagagggttaaag

SEQ ID NO: 251455 - DNA, 15 bp, Homo sapiens
ggggagagggttaaa

SEQ ID NO: 251456 - DNA, 15 bp, Homo sapiens
gggggagagggttaa

SEQ ID NO: 251457 - DNA, 15 bp, Homo sapiens
cgggggagagggtta

SEQ ID NO: 251458 - DNA, 15 bp, Homo sapiens
tcgggggagagggtt

SEQ ID NO: 251459 - DNA, 15 bp, Homo sapiens
gtcgggggagagggt

SEQ ID NO: 251460 - DNA, 15 bp, Homo sapiens
agtcgggggagaggg

SEQ ID NO: 251461 - DNA, 15 bp, Homo sapiens
aagtcgggggagagg

SEQ ID NO: 251462 - DNA, 15 bp, Homo sapiens
taagtcgggggagag

SEQ ID NO: 251463 - DNA, 15 bp, Homo sapiens
ttaagtcgggggaga

SEQ ID NO: 251464 - DNA, 15 bp, Homo sapiens
tttaagtcgggggag

SEQ ID NO: 251465 - DNA, 15 bp, Homo sapiens
ttttaagtcggggga

SEQ ID NO: 251466 - DNA, 15 bp, Homo sapiens
tttttaagtcggggg

SEQ ID NO: 251467 - DNA, 15 bp, Homo sapiens
ttttttaagtcgggg

SEQ ID NO: 251468 - DNA, 15 bp, Homo sapiens
tttttttaagtcggg

SEQ ID NO: 251469 - DNA, 15 bp, Homo sapiens
ttttttttaagtcgg

SEQ ID NO: 251470 - DNA, 15 bp, Homo sapiens
tttttttttaagtcg

SEQ ID NO: 251471 - DNA, 15 bp, Homo sapiens
ttttttttttaagtc

SEQ ID NO: 251472 - DNA, 15 bp, Homo sapiens
gttttttttttaagt

SEQ ID NO: 251473 - DNA, 15 bp, Homo sapiens
ctgttttttttttaa

SEQ ID NO: 251474 - DNA, 15 bp, Homo sapiens
gctgtttttttttta

SEQ ID NO: 251475 - DNA, 15 bp, Homo sapiens
tgctgtttttttttt

SEQ ID NO: 251476 - DNA, 15 bp, Homo sapiens
ctgctgttttttttt

SEQ ID NO: 251477 - DNA, 15 bp, Homo sapiens
gctgctgtttttttt

SEQ ID NO: 251478 - DNA, 15 bp, Homo sapiens
ggctgctgttttttt

SEQ ID NO: 251479 - DNA, 15 bp, Homo sapiens
tggctgctgtttttt

SEQ ID NO: 251480 - DNA, 15 bp, Homo sapiens
ttggctgctgttttt

SEQ ID NO: 251481 - DNA, 15 bp, Homo sapiens
gttggctgctgtttt

SEQ ID NO: 251482 - DNA, 15 bp, Homo sapiens
agttggctgctgttt

SEQ ID NO: 251483 - DNA, 15 bp, Homo sapiens
cagttggctgctgtt

SEQ ID NO: 251484 - DNA, 15 bp, Homo sapiens
gcagttggctgctgt

SEQ ID NO: 251485 - DNA, 15 bp, Homo sapiens
tgcagttggctgctg

SEQ ID NO: 251486 - DNA, 15 bp, Homo sapiens
atgcagttggctgct

SEQ ID NO: 251487 - DNA, 15 bp, Homo sapiens
aatgcagttggctgc

SEQ ID NO: 251488 - DNA, 15 bp, Homo sapiens
caatgcagttggctg

SEQ ID NO: 251489 - DNA, 15 bp, Homo sapiens
gcaatgcagttggct

SEQ ID NO: 251490 - DNA, 15 bp, Homo sapiens
ggcaatgcagttggc

SEQ ID NO: 251491 - DNA, 15 bp, Homo sapiens
aggcaatgcagttgg

SEQ ID NO: 251492 - DNA, 15 bp, Homo sapiens
caggcaatgcagttg

SEQ ID NO: 251493 - DNA, 15 bp, Homo sapiens
acaggcaatgcagtt

SEQ ID NO: 251494 - DNA, 15 bp, Homo sapiens
aacaggcaatgcagt

SEQ ID NO: 251495 - DNA, 15 bp, Homo sapiens
aaacaggcaatgcag

SEQ ID NO: 251496 - DNA, 15 bp, Homo sapiens
aaaacaggcaatgca

SEQ ID NO: 251497 - DNA, 15 bp, Homo sapiens
aaaaacaggcaatgc

SEQ ID NO: 251498 - DNA, 15 bp, Homo sapiens
aaaaaacaggcaatg

SEQ ID NO: 251499 - DNA, 15 bp, Homo sapiens
aaaaaaacaggcaat

SEQ ID NO: 251500 - DNA, 15 bp, Homo sapiens
aaaaaaaacaggcaa

SEQ ID NO: 251501 - DNA, 15 bp, Homo sapiens
taaaaaaaacaggca

SEQ ID NO: 251502 - DNA, 15 bp, Homo sapiens
ataaaaaaaacaggc

SEQ ID NO: 251503 - DNA, 15 bp, Homo sapiens
aataaaaaaaacagg

SEQ ID NO: 251504 - DNA, 15 bp, Homo sapiens
aaataaaaaaaacag

SEQ ID NO: 251505 - DNA, 15 bp, Homo sapiens
gaaataaaaaaaaca

SEQ ID NO: 251506 - DNA, 15 bp, Homo sapiens
agaaataaaaaaaac

SEQ ID NO: 251507 - DNA, 15 bp, Homo sapiens
cagaaataaaaaaaa

SEQ ID NO: 251508 - DNA, 15 bp, Homo sapiens
acagaaataaaaaaa

SEQ ID NO: 251509 - DNA, 15 bp, Homo sapiens
aacagaaataaaaaa

SEQ ID NO: 251510 - DNA, 15 bp, Homo sapiens
caacagaaataaaaa

SEQ ID NO: 251511 - DNA, 15 bp, Homo sapiens
acaacagaaataaaa

SEQ ID NO: 251512 - DNA, 15 bp, Homo sapiens
aacaacagaaataaa

SEQ ID NO: 251513 - DNA, 15 bp, Homo sapiens
aaacaacagaaataa

SEQ ID NO: 251514 - DNA, 15 bp, Homo sapiens
caaacaacagaaata

SEQ ID NO: 251515 - DNA, 15 bp, Homo sapiens
ccaaacaacagaaat

SEQ ID NO: 251516 - DNA, 15 bp, Homo sapiens
accaaacaacagaaa

SEQ ID NO: 251517 - DNA, 15 bp, Homo sapiens
taccaaacaacagaa

SEQ ID NO: 251518 - DNA, 15 bp, Homo sapiens
ttaccaaacaacaga

SEQ ID NO: 251519 - DNA, 15 bp, Homo sapiens
cttaccaaacaacag

SEQ ID NO: 251520 - DNA, 15 bp, Homo sapiens
gcttaccaaacaaca

SEQ ID NO: 251521 - DNA, 15 bp, Homo sapiens
tgcttaccaaacaac

SEQ ID NO: 251522 - DNA, 15 bp, Homo sapiens
ctgcttaccaaacaa

SEQ ID NO: 251523 - DNA, 15 bp, Homo sapiens
gctgcttaccaaaca

SEQ ID NO: 251524 - DNA, 15 bp, Homo sapiens
tgctgcttaccaaac

SEQ ID NO: 251525 - DNA, 15 bp, Homo sapiens
ctgctgcttaccaaa

SEQ ID NO: 251526 - DNA, 15 bp, Homo sapiens
actgctgcttaccaa

SEQ ID NO: 251527 - DNA, 15 bp, Homo sapiens
aactgctgcttacca

SEQ ID NO: 251528 - DNA, 15 bp, Homo sapiens
taactgctgcttacc

SEQ ID NO: 251529 - DNA, 15 bp, Homo sapiens
ataactgctgcttac

SEQ ID NO: 251530 - DNA, 15 bp, Homo sapiens
tataactgctgctta

SEQ ID NO: 251531 - DNA, 15 bp, Homo sapiens
gtataactgctgctt

SEQ ID NO: 251532 - DNA, 15 bp, Homo sapiens
agtataactgctgct

SEQ ID NO: 251533 - DNA, 15 bp, Homo sapiens
aagtataactgctgc

SEQ ID NO: 251534 - DNA, 15 bp, Homo sapiens
aaagtataactgctg

SEQ ID NO: 251535 - DNA, 15 bp, Homo sapiens
aaaagtataactgct

SEQ ID NO: 251536 - DNA, 15 bp, Homo sapiens
caaaagtataactgc

SEQ ID NO: 251537 - DNA, 15 bp, Homo sapiens
acaaaagtataactg

SEQ ID NO: 251538 - DNA, 15 bp, Homo sapiens
tacaaaagtataact

SEQ ID NO: 251539 - DNA, 15 bp, Homo sapiens
ttacaaaagtataac

SEQ ID NO: 251540 - DNA, 15 bp, Homo sapiens
gttacaaaagtataa

SEQ ID NO: 251541 - DNA, 15 bp, Homo sapiens
ggttacaaaagtata

SEQ ID NO: 251542 - DNA, 15 bp, Homo sapiens
tggttacaaaagtat

SEQ ID NO: 251543 - DNA, 15 bp, Homo sapiens
ctggttacaaaagta

SEQ ID NO: 251544 - DNA, 15 bp, Homo sapiens
tctggttacaaaagt

SEQ ID NO: 251545 - DNA, 15 bp, Homo sapiens
ctctggttacaaaag

SEQ ID NO: 251546 - DNA, 15 bp, Homo sapiens
cctctggttacaaaa

SEQ ID NO: 251547 - DNA, 15 bp, Homo sapiens
gcctctggttacaaa

SEQ ID NO: 251548 - DNA, 15 bp, Homo sapiens
agcctctggttacaa

SEQ ID NO: 251549 - DNA, 15 bp, Homo sapiens
cagcctctggttaca

SEQ ID NO: 251550 - DNA, 15 bp, Homo sapiens
acagcctctggttac

SEQ ID NO: 251551 - DNA, 15 bp, Homo sapiens
tacagcctctggtta

SEQ ID NO: 251552 - DNA, 15 bp, Homo sapiens
atacagcctctggtt

SEQ ID NO: 251553 - DNA, 15 bp, Homo sapiens
aatacagcctctggt

SEQ ID NO: 251554 - DNA, 15 bp, Homo sapiens
aaatacagcctctgg

SEQ ID NO: 251555 - DNA, 15 bp, Homo sapiens
taaatacagcctctg

SEQ ID NO: 251556 - DNA, 15 bp, Homo sapiens
ataaatacagcctct

SEQ ID NO: 251557 - DNA, 15 bp, Homo sapiens
aataaatacagcctc

SEQ ID NO: 251558 - DNA, 15 bp, Homo sapiens
aaataaatacagcct

SEQ ID NO: 251559 - DNA, 15 bp, Homo sapiens
aaaataaatacagcc

SEQ ID NO: 251560 - DNA, 15 bp, Homo sapiens
gaaaataaatacagc

SEQ ID NO: 251561 - DNA, 15 bp, Homo sapiens
agaaaataaatacag

SEQ ID NO: 251562 - DNA, 15 bp, Homo sapiens
cagaaaataaataca

SEQ ID NO: 251563 - DNA, 15 bp, Homo sapiens
acagaaaataaatac

SEQ ID NO: 251564 - DNA, 15 bp, Homo sapiens
cacagaaaataaata

SEQ ID NO: 251565 - DNA, 15 bp, Homo sapiens
acacagaaaataaat

SEQ ID NO: 251566 - DNA, 15 bp, Homo sapiens
aacacagaaaataaa

SEQ ID NO: 251567 - DNA, 15 bp, Homo sapiens
caacacagaaaataa

SEQ ID NO: 251568 - DNA, 15 bp, Homo sapiens
ccaacacagaaaata

SEQ ID NO: 251569 - DNA, 15 bp, Homo sapiens
gccaacacagaaaat

SEQ ID NO: 251570 - DNA, 15 bp, Homo sapiens
tgccaacacagaaaa

SEQ ID NO: 251571 - DNA, 15 bp, Homo sapiens
ctgccaacacagaaa

SEQ ID NO: 251572 - DNA, 15 bp, Homo sapiens
actgccaacacagaa

SEQ ID NO: 251573 - DNA, 15 bp, Homo sapiens
aactgccaacacaga

SEQ ID NO: 251574 - DNA, 15 bp, Homo sapiens
gaactgccaacacag

SEQ ID NO: 251575 - DNA, 15 bp, Homo sapiens
agaactgccaacaca

SEQ ID NO: 251576 - DNA, 15 bp, Homo sapiens
cagaactgccaacac

SEQ ID NO: 251577 - DNA, 15 bp, Homo sapiens
gcagaactgccaaca

SEQ ID NO: 251578 - DNA, 15 bp, Homo sapiens
ggcagaactgccaac

SEQ ID NO: 251579 - DNA, 15 bp, Homo sapiens
aggcagaactgccaa

SEQ ID NO: 251580 - DNA, 15 bp, Homo sapiens
taggcagaactgcca

SEQ ID NO: 251581 - DNA, 15 bp, Homo sapiens
ttaggcagaactgcc

SEQ ID NO: 251582 - DNA, 15 bp, Homo sapiens
attaggcagaactgc

SEQ ID NO: 251583 - DNA, 15 bp, Homo sapiens
cattaggcagaactg

SEQ ID NO: 251584 - DNA, 15 bp, Homo sapiens
tcattaggcagaact

SEQ ID NO: 251585 - DNA, 15 bp, Homo sapiens
ttcattaggcagaac

SEQ ID NO: 251586 - DNA, 15 bp, Homo sapiens
attcattaggcagaa

SEQ ID NO: 251587 - DNA, 15 bp, Homo sapiens
gattcattaggcaga

SEQ ID NO: 251588 - DNA, 15 bp, Homo sapiens
tgattcattaggcag

SEQ ID NO: 251589 - DNA, 15 bp, Homo sapiens
ttgattcattaggca

SEQ ID NO: 251590 - DNA, 15 bp, Homo sapiens
gttgattcattaggc

SEQ ID NO: 251591 - DNA, 15 bp, Homo sapiens
agttgattcattagg

SEQ ID NO: 251592 - DNA, 15 bp, Homo sapiens
cagttgattcattag

SEQ ID NO: 251593 - DNA, 15 bp, Homo sapiens
ccagttgattcatta

SEQ ID NO: 251594 - DNA, 15 bp, Homo sapiens
accagttgattcatt

SEQ ID NO: 251595 - DNA, 15 bp, Homo sapiens
taccagttgattcat

SEQ ID NO: 251596 - DNA, 15 bp, Homo sapiens
ataccagttgattca

SEQ ID NO: 251597 - DNA, 15 bp, Homo sapiens
aataccagttgattc

SEQ ID NO: 251598 - DNA, 15 bp, Homo sapiens
caataccagttgatt

SEQ ID NO: 251599 - DNA, 15 bp, Homo sapiens
tcaataccagttgat

SEQ ID NO: 251600 - DNA, 15 bp, Homo sapiens
ttcaataccagttga

SEQ ID NO: 251601 - DNA, 15 bp, Homo sapiens
attcaataccagttg

SEQ ID NO: 251602 - DNA, 15 bp, Homo sapiens
aattcaataccagtt

SEQ ID NO: 251603 - DNA, 15 bp, Homo sapiens
gaattcaataccagt

SEQ ID NO: 251604 - DNA, 15 bp, Homo sapiens
tgaattcaataccag

SEQ ID NO: 251605 - DNA, 15 bp, Homo sapiens
gtgaattcaatacca

SEQ ID NO: 251606 - DNA, 15 bp, Homo sapiens
tgtgaattcaatacc

SEQ ID NO: 251607 - DNA, 15 bp, Homo sapiens
ttgtgaattcaatac

SEQ ID NO: 251608 - DNA, 15 bp, Homo sapiens
tttgtgaattcaata

SEQ ID NO: 251609 - DNA, 15 bp, Homo sapiens
ctttgtgaattcaat

SEQ ID NO: 251610 - DNA, 15 bp, Homo sapiens
cctttgtgaattcaa

SEQ ID NO: 251611 - DNA, 15 bp, Homo sapiens
ccctttgtgaattca

SEQ ID NO: 251612 - DNA, 15 bp, Homo sapiens
tccctttgtgaattc

SEQ ID NO: 251613 - DNA, 15 bp, Homo sapiens
ctccctttgtgaatt

SEQ ID NO: 251614 - DNA, 15 bp, Homo sapiens
tctccctttgtgaat

SEQ ID NO: 251615 - DNA, 15 bp, Homo sapiens
atctccctttgtgaa

SEQ ID NO: 251616 - DNA, 15 bp, Homo sapiens
catctccctttgtga

SEQ ID NO: 251617 - DNA, 15 bp, Homo sapiens
gcatctccctttgtg

SEQ ID NO: 251618 - DNA, 15 bp, Homo sapiens
ggcatctccctttgt

SEQ ID NO: 251619 - DNA, 15 bp, Homo sapiens
gggcatctccctttg

SEQ ID NO: 251620 - DNA, 15 bp, Homo sapiens
cgggcatctcccttt

SEQ ID NO: 251621 - DNA, 15 bp, Homo sapiens
acgggcatctccctt

SEQ ID NO: 251622 - DNA, 15 bp, Homo sapiens
aacgggcatctccct

SEQ ID NO: 251623 - DNA, 15 bp, Homo sapiens
gaacgggcatctccc

SEQ ID NO: 251624 - DNA, 15 bp, Homo sapiens
ggaacgggcatctcc

SEQ ID NO: 251625 - DNA, 15 bp, Homo sapiens
gggaacgggcatctc

SEQ ID NO: 251626 - DNA, 15 bp, Homo sapiens
agggaacgggcatct

SEQ ID NO: 251627 - DNA, 15 bp, Homo sapiens
gagggaacgggcatc

SEQ ID NO: 251628 - DNA, 15 bp, Homo sapiens
ggagggaacgggcat

SEQ ID NO: 251629 - DNA, 15 bp, Homo sapiens
gggagggaacgggca

SEQ ID NO: 251630 - DNA, 15 bp, Homo sapiens
agggagggaacgggc

SEQ ID NO: 251631 - DNA, 15 bp, Homo sapiens
gagggagggaacggg

SEQ ID NO: 251632 - DNA, 15 bp, Homo sapiens
ggagggagggaacgg

SEQ ID NO: 251633 - DNA, 15 bp, Homo sapiens
tggagggagggaacg

SEQ ID NO: 251634 - DNA, 15 bp, Homo sapiens
atggagggagggaac

SEQ ID NO: 251635 - DNA, 15 bp, Homo sapiens
gatggagggagggaa

SEQ ID NO: 251636 - DNA, 15 bp, Homo sapiens
agatggagggaggga

SEQ ID NO: 251637 - DNA, 15 bp, Homo sapiens
cagatggagggaggg

SEQ ID NO: 251638 - DNA, 15 bp, Homo sapiens
acagatggagggagg

SEQ ID NO: 251639 - DNA, 15 bp, Homo sapiens
aacagatggagggag

SEQ ID NO: 251640 - DNA, 15 bp, Homo sapiens
aaacagatggaggga

SEQ ID NO: 251641 - DNA, 15 bp, Homo sapiens
caaacagatggaggg

SEQ ID NO: 251642 - DNA, 15 bp, Homo sapiens
gcaaacagatggagg

SEQ ID NO: 251643 - DNA, 15 bp, Homo sapiens
ggcaaacagatggag

SEQ ID NO: 251644 - DNA, 15 bp, Homo sapiens
tggcaaacagatgga

SEQ ID NO: 251645 - DNA, 15 bp, Homo sapiens
ttggcaaacagatgg

SEQ ID NO: 251646 - DNA, 15 bp, Homo sapiens
tttggcaaacagatg

SEQ ID NO: 251647 - DNA, 15 bp, Homo sapiens
atttggcaaacagat

SEQ ID NO: 251648 - DNA, 15 bp, Homo sapiens
catttggcaaacaga

SEQ ID NO: 251649 - DNA, 15 bp, Homo sapiens
acatttggcaaacag

SEQ ID NO: 251650 - DNA, 15 bp, Homo sapiens
cacatttggcaaaca

SEQ ID NO: 251651 - DNA, 15 bp, Homo sapiens
acacatttggcaaac

SEQ ID NO: 251652 - DNA, 15 bp, Homo sapiens
cacacatttggcaaa

SEQ ID NO: 251653 - DNA, 15 bp, Homo sapiens
acacacatttggcaa

SEQ ID NO: 251654 - DNA, 15 bp, Homo sapiens
cacacacatttggca

SEQ ID NO: 251655 - DNA, 15 bp, Homo sapiens
acacacacatttggc

SEQ ID NO: 251656 - DNA, 15 bp, Homo sapiens
aacacacacatttgg

SEQ ID NO: 251657 - DNA, 15 bp, Homo sapiens
gaacacacacatttg

SEQ ID NO: 251658 - DNA, 15 bp, Homo sapiens
ggaacacacacattt

SEQ ID NO: 251659 - DNA, 15 bp, Homo sapiens
cggaacacacacatt

SEQ ID NO: 251660 - DNA, 15 bp, Homo sapiens
acggaacacacacat

SEQ ID NO: 251661 - DNA, 15 bp, Homo sapiens
gacggaacacacaca

SEQ ID NO: 251662 - DNA, 15 bp, Homo sapiens
tgacggaacacacac

SEQ ID NO: 251663 - DNA, 15 bp, Homo sapiens
ctgacggaacacaca

SEQ ID NO: 251664 - DNA, 15 bp, Homo sapiens
gctgacggaacacac

SEQ ID NO: 251665 - DNA, 15 bp, Homo sapiens
agctgacggaacaca

SEQ ID NO: 251666 - DNA, 15 bp, Homo sapiens
gagctgacggaacac

SEQ ID NO: 251667 - DNA, 15 bp, Homo sapiens
agagctgacggaaca

SEQ ID NO: 251668 - DNA, 15 bp, Homo sapiens
gagagctgacggaac

SEQ ID NO: 251669 - DNA, 15 bp, Homo sapiens
tgagagctgacggaa

SEQ ID NO: 251670 - DNA, 15 bp, Homo sapiens
ctgagagctgacgga

SEQ ID NO: 251671 - DNA, 15 bp, Homo sapiens
actgagagctgacgg

SEQ ID NO: 251672 - DNA, 15 bp, Homo sapiens
tactgagagctgacg

SEQ ID NO: 251673 - DNA, 15 bp, Homo sapiens
ctactgagagctgac

SEQ ID NO: 251674 - DNA, 15 bp, Homo sapiens
actactgagagctga

SEQ ID NO: 251675 - DNA, 15 bp, Homo sapiens
cactactgagagctg

SEQ ID NO: 251676 - DNA, 15 bp, Homo sapiens
ccactactgagagct

SEQ ID NO: 251677 - DNA, 15 bp, Homo sapiens
accactactgagagc

SEQ ID NO: 251678 - DNA, 15 bp, Homo sapiens
aaccactactgagag

SEQ ID NO: 251679 - DNA, 15 bp, Homo sapiens
aaaccactactgaga

SEQ ID NO: 251680 - DNA, 15 bp, Homo sapiens
gaaaccactactgag

SEQ ID NO: 251681 - DNA, 15 bp, Homo sapiens
tgaaaccactactga

SEQ ID NO: 251682 - DNA, 15 bp, Homo sapiens
gtgaaaccactactg

SEQ ID NO: 251683 - DNA, 15 bp, Homo sapiens
agtgaaaccactact

SEQ ID NO: 251684 - DNA, 15 bp, Homo sapiens
tagtgaaaccactac

SEQ ID NO: 251685 - DNA, 15 bp, Homo sapiens
ttagtgaaaccacta

SEQ ID NO: 251686 - DNA, 15 bp, Homo sapiens
tttagtgaaaccact

SEQ ID NO: 251687 - DNA, 15 bp, Homo sapiens
ttttagtgaaaccac

SEQ ID NO: 251688 - DNA, 15 bp, Homo sapiens
tttttagtgaaacca

SEQ ID NO: 251689 - DNA, 15 bp, Homo sapiens
ctttttagtgaaacc

SEQ ID NO: 251690 - DNA, 15 bp, Homo sapiens
tctttttagtgaaac

SEQ ID NO: 251691 - DNA, 15 bp, Homo sapiens
ctctttttagtgaaa

SEQ ID NO: 251692 - DNA, 15 bp, Homo sapiens
gctctttttagtgaa

SEQ ID NO: 251693 - DNA, 15 bp, Homo sapiens
ggctctttttagtga

SEQ ID NO: 251694 - DNA, 15 bp, Homo sapiens
tggctctttttagtg

SEQ ID NO: 251695 - DNA, 15 bp, Homo sapiens
atggctctttttagt

SEQ ID NO: 251696 - DNA, 15 bp, Homo sapiens
aatggctctttttag

SEQ ID NO: 251697 - DNA, 15 bp, Homo sapiens
taatggctcttttta

SEQ ID NO: 251698 - DNA, 15 bp, Homo sapiens
ctaatggctcttttt

SEQ ID NO: 251699 - DNA, 15 bp, Homo sapiens
gctaatggctctttt

SEQ ID NO: 251700 - DNA, 15 bp, Homo sapiens
tgctaatggctcttt

SEQ ID NO: 251701 - DNA, 15 bp, Homo sapiens
ttgctaatggctctt

SEQ ID NO: 251702 - DNA, 15 bp, Homo sapiens
cttgctaatggctct

SEQ ID NO: 251703 - DNA, 15 bp, Homo sapiens
tcttgctaatggctc

SEQ ID NO: 251704 - DNA, 15 bp, Homo sapiens
ctcttgctaatggct

SEQ ID NO: 251705 - DNA, 15 bp, Homo sapiens
cctcttgctaatggc

SEQ ID NO: 251706 - DNA, 15 bp, Homo sapiens
acctcttgctaatgg

SEQ ID NO: 251707 - DNA, 15 bp, Homo sapiens
cacctcttgctaatg

SEQ ID NO: 251708 - DNA, 15 bp, Homo sapiens
acacctcttgctaat

SEQ ID NO: 251709 - DNA, 15 bp, Homo sapiens
aacacctcttgctaa

SEQ ID NO: 251710 - DNA, 15 bp, Homo sapiens
gaacacctcttgcta

SEQ ID NO: 251711 - DNA, 15 bp, Homo sapiens
tgaacacctcttgct

SEQ ID NO: 251712 - DNA, 15 bp, Homo sapiens
gtgaacacctcttgc

SEQ ID NO: 251713 - DNA, 15 bp, Homo sapiens
ggtgaacacctcttg

SEQ ID NO: 251714 - DNA, 15 bp, Homo sapiens
aggtgaacacctctt

SEQ ID NO: 251715 - DNA, 15 bp, Homo sapiens
aaggtgaacacctct

SEQ ID NO: 251716 - DNA, 15 bp, Homo sapiens
caaggtgaacacctc

SEQ ID NO: 251717 - DNA, 15 bp, Homo sapiens
tcaaggtgaacacct

SEQ ID NO: 251718 - DNA, 15 bp, Homo sapiens
ttcaaggtgaacacc

SEQ ID NO: 251719 - DNA, 15 bp, Homo sapiens
attcaaggtgaacac

SEQ ID NO: 251720 - DNA, 15 bp, Homo sapiens
aattcaaggtgaaca

SEQ ID NO: 251721 - DNA, 15 bp, Homo sapiens
gaattcaaggtgaac

SEQ ID NO: 251722 - DNA, 15 bp, Homo sapiens
agaattcaaggtgaa

SEQ ID NO: 251723 - DNA, 15 bp, Homo sapiens
aagaattcaaggtga

SEQ ID NO: 251724 - DNA, 15 bp, Homo sapiens
taagaattcaaggtg

SEQ ID NO: 251725 - DNA, 15 bp, Homo sapiens
ctaagaattcaaggt

SEQ ID NO: 251726 - DNA, 15 bp, Homo sapiens
actaagaattcaagg

SEQ ID NO: 251727 - DNA, 15 bp, Homo sapiens
gactaagaattcaag

SEQ ID NO: 251728 - DNA, 15 bp, Homo sapiens
ggactaagaattcaa

SEQ ID NO: 251729 - DNA, 15 bp, Homo sapiens
aggactaagaattca

SEQ ID NO: 251730 - DNA, 15 bp, Homo sapiens
gaggactaagaattc

SEQ ID NO: 251731 - DNA, 15 bp, Homo sapiens
ggaggactaagaatt

SEQ ID NO: 251732 - DNA, 15 bp, Homo sapiens
cggaggactaagaat

SEQ ID NO: 251733 - DNA, 15 bp, Homo sapiens
gcggaggactaagaa

SEQ ID NO: 251734 - DNA, 15 bp, Homo sapiens
ggcggaggactaaga

SEQ ID NO: 251735 - DNA, 15 bp, Homo sapiens
aggcggaggactaag

SEQ ID NO: 251736 - DNA, 15 bp, Homo sapiens
caggcggaggactaa

SEQ ID NO: 251737 - DNA, 15 bp, Homo sapiens
tcaggcggaggacta

SEQ ID NO: 251738 - DNA, 15 bp, Homo sapiens
gtcaggcggaggact

SEQ ID NO: 251739 - DNA, 15 bp, Homo sapiens
agtcaggcggaggac

SEQ ID NO: 251740 - DNA, 15 bp, Homo sapiens
cagtcaggcggagga

SEQ ID NO: 251741 - DNA, 15 bp, Homo sapiens
tcagtcaggcggagg

SEQ ID NO: 251742 - DNA, 15 bp, Homo sapiens
ctcagtcaggcggag

SEQ ID NO: 251743 - DNA, 15 bp, Homo sapiens
tctcagtcaggcgga

SEQ ID NO: 251744 - DNA, 15 bp, Homo sapiens
ttctcagtcaggcgg

SEQ ID NO: 251745 - DNA, 15 bp, Homo sapiens
tttctcagtcaggcg

SEQ ID NO: 251746 - DNA, 15 bp, Homo sapiens
atttctcagtcaggc

SEQ ID NO: 251747 - DNA, 15 bp, Homo sapiens
tatttctcagtcagg

SEQ ID NO: 251748 - DNA, 15 bp, Homo sapiens
ctatttctcagtcag

SEQ ID NO: 251749 - DNA, 15 bp, Homo sapiens
actatttctcagtca

SEQ ID NO: 251750 - DNA, 15 bp, Homo sapiens
cactatttctcagtc

SEQ ID NO: 251751 - DNA, 15 bp, Homo sapiens
ccactatttctcagt

SEQ ID NO: 251752 - DNA, 15 bp, Homo sapiens
accactatttctcag

SEQ ID NO: 251753 - DNA, 15 bp, Homo sapiens
taccactatttctca

SEQ ID NO: 251754 - DNA, 15 bp, Homo sapiens
ataccactatttctc

SEQ ID NO: 251755 - DNA, 15 bp, Homo sapiens
aataccactatttct

SEQ ID NO: 251756 - DNA, 15 bp, Homo sapiens
aaataccactatttc

SEQ ID NO: 251757 - DNA, 15 bp, Homo sapiens
aaaataccactattt

SEQ ID NO: 251758 - DNA, 15 bp, Homo sapiens
gaaaataccactatt

SEQ ID NO: 251759 - DNA, 15 bp, Homo sapiens
ggaaaataccactat

SEQ ID NO: 251760 - DNA, 15 bp, Homo sapiens
aggaaaataccacta

SEQ ID NO: 251761 - DNA, 15 bp, Homo sapiens
gaggaaaataccact

SEQ ID NO: 251762 - DNA, 15 bp, Homo sapiens
agaggaaaataccac

SEQ ID NO: 251763 - DNA, 15 bp, Homo sapiens
aagaggaaaatacca

SEQ ID NO: 251764 - DNA, 15 bp, Homo sapiens
caagaggaaaatacc

SEQ ID NO: 251765 - DNA, 15 bp, Homo sapiens
acaagaggaaaatac

SEQ ID NO: 251766 - DNA, 15 bp, Homo sapiens
cacaagaggaaaata

SEQ ID NO: 251767 - DNA, 15 bp, Homo sapiens
tcacaagaggaaaat

SEQ ID NO: 251768 - DNA, 15 bp, Homo sapiens
atcacaagaggaaaa

SEQ ID NO: 251769 - DNA, 15 bp, Homo sapiens
aatcacaagaggaaa

SEQ ID NO: 251770 - DNA, 15 bp, Homo sapiens
gaatcacaagaggaa

SEQ ID NO: 251771 - DNA, 15 bp, Homo sapiens
ggaatcacaagagga

SEQ ID NO: 251772 - DNA, 15 bp, Homo sapiens
cggaatcacaagagg

SEQ ID NO: 251773 - DNA, 15 bp, Homo sapiens
acggaatcacaagag

SEQ ID NO: 251774 - DNA, 15 bp, Homo sapiens
tacggaatcacaaga

SEQ ID NO: 251775 - DNA, 15 bp, Homo sapiens
ctacggaatcacaag

SEQ ID NO: 251776 - DNA, 15 bp, Homo sapiens
cctacggaatcacaa

SEQ ID NO: 251777 - DNA, 15 bp, Homo sapiens
ccctacggaatcaca

SEQ ID NO: 251778 - DNA, 15 bp, Homo sapiens
cccctacggaatcac

SEQ ID NO: 251779 - DNA, 15 bp, Homo sapiens
acccctacggaatca

SEQ ID NO: 251780 - DNA, 15 bp, Homo sapiens
aacccctacggaatc

SEQ ID NO: 251781 - DNA, 15 bp, Homo sapiens
caacccctacggaat

SEQ ID NO: 251782 - DNA, 15 bp, Homo sapiens
acaacccctacggaa

SEQ ID NO: 251783 - DNA, 15 bp, Homo sapiens
cacaacccctacgga

SEQ ID NO: 251784 - DNA, 15 bp, Homo sapiens
acacaacccctacgg

SEQ ID NO: 251785 - DNA, 15 bp, Homo sapiens
cacacaacccctacg

SEQ ID NO: 251786 - DNA, 15 bp, Homo sapiens
tcacacaacccctac

SEQ ID NO: 251787 - DNA, 15 bp, Homo sapiens
ctcacacaaccccta

SEQ ID NO: 251788 - DNA, 15 bp, Homo sapiens
cctcacacaacccct

SEQ ID NO: 251789 - DNA, 15 bp, Homo sapiens
acctcacacaacccc

SEQ ID NO: 251790 - DNA, 15 bp, Homo sapiens
cacctcacacaaccc

SEQ ID NO: 251791 - DNA, 15 bp, Homo sapiens
tcacctcacacaacc

SEQ ID NO: 251792 - DNA, 15 bp, Homo sapiens
ttcacctcacacaac

SEQ ID NO: 251793 - DNA, 15 bp, Homo sapiens
cttcacctcacacaa

SEQ ID NO: 251794 - DNA, 15 bp, Homo sapiens
tcttcacctcacaca

SEQ ID NO: 251795 - DNA, 15 bp, Homo sapiens
gtcttcacctcacac

SEQ ID NO: 251796 - DNA, 15 bp, Homo sapiens
ggtcttcacctcaca

SEQ ID NO: 251797 - DNA, 15 bp, Homo sapiens
gggtcttcacctcac

SEQ ID NO: 251798 - DNA, 15 bp, Homo sapiens
tgggtcttcacctca

SEQ ID NO: 251799 - DNA, 15 bp, Homo sapiens
gtgggtcttcacctc

SEQ ID NO: 251800 - DNA, 15 bp, Homo sapiens
tgtgggtcttcacct

SEQ ID NO: 251801 - DNA, 15 bp, Homo sapiens
gtgtgggtcttcacc

SEQ ID NO: 251802 - DNA, 15 bp, Homo sapiens
ggtgtgggtcttcac

SEQ ID NO: 251803 - DNA, 15 bp, Homo sapiens
aggtgtgggtcttca

SEQ ID NO: 251804 - DNA, 15 bp, Homo sapiens
caggtgtgggtcttc

SEQ ID NO: 251805 - DNA, 15 bp, Homo sapiens
acaggtgtgggtctt

SEQ ID NO: 251806 - DNA, 15 bp, Homo sapiens
tacaggtgtgggtct

SEQ ID NO: 251807 - DNA, 15 bp, Homo sapiens
ttacaggtgtgggtc

SEQ ID NO: 251808 - DNA, 15 bp, Homo sapiens
attacaggtgtgggt

SEQ ID NO: 251809 - DNA, 15 bp, Homo sapiens
aattacaggtgtggg

SEQ ID NO: 251810 - DNA, 15 bp, Homo sapiens
gaattacaggtgtgg

SEQ ID NO: 251811 - DNA, 15 bp, Homo sapiens
ggaattacaggtgtg

SEQ ID NO: 251812 - DNA, 15 bp, Homo sapiens
tggaattacaggtgt

SEQ ID NO: 251813 - DNA, 15 bp, Homo sapiens
ctggaattacaggtg

SEQ ID NO: 251814 - DNA, 15 bp, Homo sapiens
tctggaattacaggt

SEQ ID NO: 251815 - DNA, 15 bp, Homo sapiens
ctctggaattacagg

SEQ ID NO: 251816 - DNA, 15 bp, Homo sapiens
tctctggaattacag

SEQ ID NO: 251817 - DNA, 15 bp, Homo sapiens
ttctctggaattaca

SEQ ID NO: 251818 - DNA, 15 bp, Homo sapiens
tttctctggaattac

SEQ ID NO: 251819 - DNA, 15 bp, Homo sapiens
ctttctctggaatta

SEQ ID NO: 251820 - DNA, 15 bp, Homo sapiens
gctttctctggaatt

SEQ ID NO: 251821 - DNA, 15 bp, Homo sapiens
tgctttctctggaat

SEQ ID NO: 251822 - DNA, 15 bp, Homo sapiens
atgctttctctggaa

SEQ ID NO: 251823 - DNA, 15 bp, Homo sapiens
tatgctttctctgga

SEQ ID NO: 251824 - DNA, 15 bp, Homo sapiens
atatgctttctctgg

SEQ ID NO: 251825 - DNA, 15 bp, Homo sapiens
aatatgctttctctg

SEQ ID NO: 251826 - DNA, 15 bp, Homo sapiens
aaatatgctttctct

SEQ ID NO: 251827 - DNA, 15 bp, Homo sapiens
caaatatgctttctc

SEQ ID NO: 251828 - DNA, 15 bp, Homo sapiens
acaaatatgctttct

SEQ ID NO: 251829 - DNA, 15 bp, Homo sapiens
aacaaatatgctttc

SEQ ID NO: 251830 - DNA, 15 bp, Homo sapiens
caacaaatatgcttt

SEQ ID NO: 251831 - DNA, 15 bp, Homo sapiens
acaacaaatatgctt

SEQ ID NO: 251832 - DNA, 15 bp, Homo sapiens
aacaacaaatatgct

SEQ ID NO: 251833 - DNA, 15 bp, Homo sapiens
aaacaacaaatatgc

SEQ ID NO: 251834 - DNA, 15 bp, Homo sapiens
taaacaacaaatatg

SEQ ID NO: 251835 - DNA, 15 bp, Homo sapiens
ttaaacaacaaatat

SEQ ID NO: 251836 - DNA, 15 bp, Homo sapiens
cttaaacaacaaata

SEQ ID NO: 251837 - DNA, 15 bp, Homo sapiens
acttaaacaacaaat

SEQ ID NO: 251838 - DNA, 15 bp, Homo sapiens
tacttaaacaacaaa

SEQ ID NO: 251839 - DNA, 15 bp, Homo sapiens
atacttaaacaacaa

SEQ ID NO: 251840 - DNA, 15 bp, Homo sapiens
tatacttaaacaaca

SEQ ID NO: 251841 - DNA, 15 bp, Homo sapiens
ttatacttaaacaac

SEQ ID NO: 251842 - DNA, 15 bp, Homo sapiens
gttatacttaaacaa

SEQ ID NO: 251843 - DNA, 15 bp, Homo sapiens
cgttatacttaaaca

SEQ ID NO: 251844 - DNA, 15 bp, Homo sapiens
acgttatacttaaac

SEQ ID NO: 251845 - DNA, 15 bp, Homo sapiens
gacgttatacttaaa

SEQ ID NO: 251846 - DNA, 15 bp, Homo sapiens
agacgttatacttaa

SEQ ID NO: 251847 - DNA, 15 bp, Homo sapiens
cagacgttatactta

SEQ ID NO: 251848 - DNA, 15 bp, Homo sapiens
ccagacgttatactt

SEQ ID NO: 251849 - DNA, 15 bp, Homo sapiens
gccagacgttatact

SEQ ID NO: 251850 - DNA, 15 bp, Homo sapiens
agccagacgttatac

SEQ ID NO: 251851 - DNA, 15 bp, Homo sapiens
gagccagacgttata

SEQ ID NO: 251852 - DNA, 15 bp, Homo sapiens
agagccagacgttat

SEQ ID NO: 251853 - DNA, 15 bp, Homo sapiens
tagagccagacgtta

SEQ ID NO: 251854 - DNA, 15 bp, Homo sapiens
gtagagccagacgtt

SEQ ID NO: 251855 - DNA, 15 bp, Homo sapiens
tgtagagccagacgt

SEQ ID NO: 251856 - DNA, 15 bp, Homo sapiens
atgtagagccagacg

SEQ ID NO: 251857 - DNA, 15 bp, Homo sapiens
aatgtagagccagac

SEQ ID NO: 251858 - DNA, 15 bp, Homo sapiens
taatgtagagccaga

SEQ ID NO: 251859 - DNA, 15 bp, Homo sapiens
gtaatgtagagccag

SEQ ID NO: 251860 - DNA, 15 bp, Homo sapiens
ggtaatgtagagcca

SEQ ID NO: 251861 - DNA, 15 bp, Homo sapiens
cggtaatgtagagcc

SEQ ID NO: 251862 - DNA, 15 bp, Homo sapiens
tcggtaatgtagagc

SEQ ID NO: 251863 - DNA, 15 bp, Homo sapiens
atcggtaatgtagag

SEQ ID NO: 251864 - DNA, 15 bp, Homo sapiens
catcggtaatgtaga

SEQ ID NO: 251865 - DNA, 15 bp, Homo sapiens
ccatcggtaatgtag

SEQ ID NO: 251866 - DNA, 15 bp, Homo sapiens
gccatcggtaatgta

SEQ ID NO: 251867 - DNA, 15 bp, Homo sapiens
agccatcggtaatgt

SEQ ID NO: 251868 - DNA, 15 bp, Homo sapiens
aagccatcggtaatg

SEQ ID NO: 251869 - DNA, 15 bp, Homo sapiens
aaagccatcggtaat

SEQ ID NO: 251870 - DNA, 15 bp, Homo sapiens
taaagccatcggtaa

SEQ ID NO: 251871 - DNA, 15 bp, Homo sapiens
ctaaagccatcggta

SEQ ID NO: 251872 - DNA, 15 bp, Homo sapiens
actaaagccatcggt

SEQ ID NO: 251873 - DNA, 15 bp, Homo sapiens
aactaaagccatcgg

SEQ ID NO: 251874 - DNA, 15 bp, Homo sapiens
aaactaaagccatcg

SEQ ID NO: 251875 - DNA, 15 bp, Homo sapiens
caaactaaagccatc

SEQ ID NO: 251876 - DNA, 15 bp, Homo sapiens
ccaaactaaagccat

SEQ ID NO: 251877 - DNA, 15 bp, Homo sapiens
accaaactaaagcca

SEQ ID NO: 251878 - DNA, 15 bp, Homo sapiens
aaccaaactaaagcc

SEQ ID NO: 251879 - DNA, 15 bp, Homo sapiens
gaaccaaactaaagc

SEQ ID NO: 251880 - DNA, 15 bp, Homo sapiens
agaaccaaactaaag

SEQ ID NO: 251881 - DNA, 15 bp, Homo sapiens
aagaaccaaactaaa

SEQ ID NO: 251882 - DNA, 15 bp, Homo sapiens
caagaaccaaactaa

SEQ ID NO: 251883 - DNA, 15 bp, Homo sapiens
tcaagaaccaaacta

SEQ ID NO: 251884 - DNA, 15 bp, Homo sapiens
ctcaagaaccaaact

SEQ ID NO: 251885 - DNA, 15 bp, Homo sapiens
gctcaagaaccaaac

SEQ ID NO: 251886 - DNA, 15 bp, Homo sapiens
ggctcaagaaccaaa

SEQ ID NO: 251887 - DNA, 15 bp, Homo sapiens
aggctcaagaaccaa

SEQ ID NO: 251888 - DNA, 15 bp, Homo sapiens
aaggctcaagaacca

SEQ ID NO: 251889 - DNA, 15 bp, Homo sapiens
caaggctcaagaacc

SEQ ID NO: 251890 - DNA, 15 bp, Homo sapiens
ccaaggctcaagaac

SEQ ID NO: 251891 - DNA, 15 bp, Homo sapiens
accaaggctcaagaa

SEQ ID NO: 251892 - DNA, 15 bp, Homo sapiens
aaccaaggctcaaga

SEQ ID NO: 251893 - DNA, 15 bp, Homo sapiens
aaaccaaggctcaag

SEQ ID NO: 251894 - DNA, 15 bp, Homo sapiens
caaaccaaggctcaa

SEQ ID NO: 251895 - DNA, 15 bp, Homo sapiens
gcaaaccaaggctca

SEQ ID NO: 251896 - DNA, 15 bp, Homo sapiens
agcaaaccaaggctc

SEQ ID NO: 251897 - DNA, 15 bp, Homo sapiens
gagcaaaccaaggct

SEQ ID NO: 251898 - DNA, 15 bp, Homo sapiens
ggagcaaaccaaggc

SEQ ID NO: 251899 - DNA, 15 bp, Homo sapiens
tggagcaaaccaagg

SEQ ID NO: 251900 - DNA, 15 bp, Homo sapiens
atggagcaaaccaag

SEQ ID NO: 251901 - DNA, 15 bp, Homo sapiens
gatggagcaaaccaa

SEQ ID NO: 251902 - DNA, 15 bp, Homo sapiens
tgatggagcaaacca

SEQ ID NO: 251903 - DNA, 15 bp, Homo sapiens
atgatggagcaaacc

SEQ ID NO: 251904 - DNA, 15 bp, Homo sapiens
catgatggagcaaac

SEQ ID NO: 251905 - DNA, 15 bp, Homo sapiens
tcatgatggagcaaa

SEQ ID NO: 251906 - DNA, 15 bp, Homo sapiens
atcatgatggagcaa

SEQ ID NO: 251907 - DNA, 15 bp, Homo sapiens
catcatgatggagca

SEQ ID NO: 251908 - DNA, 15 bp, Homo sapiens
ccatcatgatggagc

SEQ ID NO: 251909 - DNA, 15 bp, Homo sapiens
cccatcatgatggag

SEQ ID NO: 251910 - DNA, 15 bp, Homo sapiens
tcccatcatgatgga

SEQ ID NO: 251911 - DNA, 15 bp, Homo sapiens
atcccatcatgatgg

SEQ ID NO: 251912 - DNA, 15 bp, Homo sapiens
catcccatcatgatg

SEQ ID NO: 251913 - DNA, 15 bp, Homo sapiens
acatcccatcatgat

SEQ ID NO: 251914 - DNA, 15 bp, Homo sapiens
gacatcccatcatga

SEQ ID NO: 251915 - DNA, 15 bp, Homo sapiens
agacatcccatcatg

SEQ ID NO: 251916 - DNA, 15 bp, Homo sapiens
cagacatcccatcat

SEQ ID NO: 251917 - DNA, 15 bp, Homo sapiens
acagacatcccatca

SEQ ID NO: 251918 - DNA, 15 bp, Homo sapiens
gacagacatcccatc

SEQ ID NO: 251919 - DNA, 15 bp, Homo sapiens
agacagacatcccat

SEQ ID NO: 251920 - DNA, 15 bp, Homo sapiens
gagacagacatccca

SEQ ID NO: 251921 - DNA, 15 bp, Homo sapiens
agagacagacatccc

SEQ ID NO: 251922 - DNA, 15 bp, Homo sapiens
cagagacagacatcc

SEQ ID NO: 251923 - DNA, 15 bp, Homo sapiens
ccagagacagacatc

SEQ ID NO: 251924 - DNA, 15 bp, Homo sapiens
tccagagacagacat

SEQ ID NO: 251925 - DNA, 15 bp, Homo sapiens
gtccagagacagaca

SEQ ID NO: 251926 - DNA, 15 bp, Homo sapiens
tgtccagagacagac

SEQ ID NO: 251927 - DNA, 15 bp, Homo sapiens
ctgtccagagacaga

SEQ ID NO: 251928 - DNA, 15 bp, Homo sapiens
actgtccagagacag

SEQ ID NO: 251929 - DNA, 15 bp, Homo sapiens
tactgtccagagaca

SEQ ID NO: 251930 - DNA, 15 bp, Homo sapiens
gtactgtccagagac

SEQ ID NO: 251931 - DNA, 15 bp, Homo sapiens
agtactgtccagaga

SEQ ID NO: 251932 - DNA, 15 bp, Homo sapiens
cagtactgtccagag

SEQ ID NO: 251933 - DNA, 15 bp, Homo sapiens
acagtactgtccaga

SEQ ID NO: 251934 - DNA, 15 bp, Homo sapiens
aacagtactgtccag

SEQ ID NO: 251935 - DNA, 15 bp, Homo sapiens
caacagtactgtcca

SEQ ID NO: 251936 - DNA, 15 bp, Homo sapiens
acaacagtactgtcc

SEQ ID NO: 251937 - DNA, 15 bp, Homo sapiens
gacaacagtactgtc

SEQ ID NO: 251938 - DNA, 15 bp, Homo sapiens
cgacaacagtactgt

SEQ ID NO: 251939 - DNA, 15 bp, Homo sapiens
acgacaacagtactg

SEQ ID NO: 251940 - DNA, 15 bp, Homo sapiens
cacgacaacagtact

SEQ ID NO: 251941 - DNA, 15 bp, Homo sapiens
ccacgacaacagtac

SEQ ID NO: 251942 - DNA, 15 bp, Homo sapiens
cccacgacaacagta

SEQ ID NO: 251943 - DNA, 15 bp, Homo sapiens
ccccacgacaacagt

SEQ ID NO: 251944 - DNA, 15 bp, Homo sapiens
tccccacgacaacag

SEQ ID NO: 251945 - DNA, 15 bp, Homo sapiens
atccccacgacaaca

SEQ ID NO: 251946 - DNA, 15 bp, Homo sapiens
aatccccacgacaac

SEQ ID NO: 251947 - DNA, 15 bp, Homo sapiens
caatccccacgacaa

SEQ ID NO: 251948 - DNA, 15 bp, Homo sapiens
tcaatccccacgaca

SEQ ID NO: 251949 - DNA, 15 bp, Homo sapiens
ttcaatccccacgac

SEQ ID NO: 251950 - DNA, 15 bp, Homo sapiens
tttcaatccccacga

SEQ ID NO: 251951 - DNA, 15 bp, Homo sapiens
atttcaatccccacg

SEQ ID NO: 251952 - DNA, 15 bp, Homo sapiens
aatttcaatccccac

SEQ ID NO: 251953 - DNA, 15 bp, Homo sapiens
gaatttcaatcccca

SEQ ID NO: 251954 - DNA, 15 bp, Homo sapiens
ggaatttcaatcccc

SEQ ID NO: 251955 - DNA, 15 bp, Homo sapiens
gggaatttcaatccc

SEQ ID NO: 251956 - DNA, 15 bp, Homo sapiens
agggaatttcaatcc

SEQ ID NO: 251957 - DNA, 15 bp, Homo sapiens
cagggaatttcaatc

SEQ ID NO: 251958 - DNA, 15 bp, Homo sapiens
tcagggaatttcaat

SEQ ID NO: 251959 - DNA, 15 bp, Homo sapiens
ttcagggaatttcaa

SEQ ID NO: 251960 - DNA, 15 bp, Homo sapiens
tttcagggaatttca

SEQ ID NO: 251961 - DNA, 15 bp, Homo sapiens
ctttcagggaatttc

SEQ ID NO: 251962 - DNA, 15 bp, Homo sapiens
tctttcagggaattt

SEQ ID NO: 251963 - DNA, 15 bp, Homo sapiens
ctctttcagggaatt

SEQ ID NO: 251964 - DNA, 15 bp, Homo sapiens
tctctttcagggaat

SEQ ID NO: 251965 - DNA, 15 bp, Homo sapiens
ttctctttcagggaa

SEQ ID NO: 251966 - DNA, 15 bp, Homo sapiens
cttctctttcaggga

SEQ ID NO: 251967 - DNA, 15 bp, Homo sapiens
tcttctctttcaggg

SEQ ID NO: 251968 - DNA, 15 bp, Homo sapiens
gtcttctctttcagg

SEQ ID NO: 251969 - DNA, 15 bp, Homo sapiens
tgtcttctctttcag

SEQ ID NO: 251970 - DNA, 15 bp, Homo sapiens
ttgtcttctctttca

SEQ ID NO: 251971 - DNA, 15 bp, Homo sapiens
cttgtcttctctttc

SEQ ID NO: 251972 - DNA, 15 bp, Homo sapiens
tcttgtcttctcttt

SEQ ID NO: 251973 - DNA, 15 bp, Homo sapiens
ctcttgtcttctctt

SEQ ID NO: 251974 - DNA, 15 bp, Homo sapiens
tctcttgtcttctct

SEQ ID NO: 251975 - DNA, 15 bp, Homo sapiens
atctcttgtcttctc

SEQ ID NO: 251976 - DNA, 15 bp, Homo sapiens
gatctcttgtcttct

SEQ ID NO: 251977 - DNA, 15 bp, Homo sapiens
tgatctcttgtcttc

SEQ ID NO: 251978 - DNA, 15 bp, Homo sapiens
ttgatctcttgtctt

SEQ ID NO: 251979 - DNA, 15 bp, Homo sapiens
attgatctcttgtct

SEQ ID NO: 251980 - DNA, 15 bp, Homo sapiens
cattgatctcttgtc

SEQ ID NO: 251981 - DNA, 15 bp, Homo sapiens
tcattgatctcttgt

SEQ ID NO: 251982 - DNA, 15 bp, Homo sapiens
ttcattgatctcttg

SEQ ID NO: 251983 - DNA, 15 bp, Homo sapiens
gttcattgatctctt

SEQ ID NO: 251984 - DNA, 15 bp, Homo sapiens
ggttcattgatctct

SEQ ID NO: 251985 - DNA, 15 bp, Homo sapiens
gggttcattgatctc

SEQ ID NO: 251986 - DNA, 15 bp, Homo sapiens
agggttcattgatct

SEQ ID NO: 251987 - DNA, 15 bp, Homo sapiens
tagggttcattgatc

SEQ ID NO: 251988 - DNA, 15 bp, Homo sapiens
ctagggttcattgat

SEQ ID NO: 251989 - DNA, 15 bp, Homo sapiens
actagggttcattga

SEQ ID NO: 251990 - DNA, 15 bp, Homo sapiens
tactagggttcattg

SEQ ID NO: 251991 - DNA, 15 bp, Homo sapiens
ctactagggttcatt

SEQ ID NO: 251992 - DNA, 15 bp, Homo sapiens
cctactagggttcat

SEQ ID NO: 251993 - DNA, 15 bp, Homo sapiens
acctactagggttca

SEQ ID NO: 251994 - DNA, 15 bp, Homo sapiens
aacctactagggttc

SEQ ID NO: 251995 - DNA, 15 bp, Homo sapiens
gaacctactagggtt

SEQ ID NO: 251996 - DNA, 15 bp, Homo sapiens
agaacctactagggt

SEQ ID NO: 251997 - DNA, 15 bp, Homo sapiens
gagaacctactaggg

SEQ ID NO: 251998 - DNA, 15 bp, Homo sapiens
agagaacctactagg

SEQ ID NO: 251999 - DNA, 15 bp, Homo sapiens
gagagaacctactag

SEQ ID NO: 252000 - DNA, 15 bp, Homo sapiens
tgagagaacctacta

SEQ ID NO: 252001 - DNA, 15 bp, Homo sapiens
ctgagagaacctact

SEQ ID NO: 252002 - DNA, 15 bp, Homo sapiens
tctgagagaacctac

SEQ ID NO: 252003 - DNA, 15 bp, Homo sapiens
gtctgagagaaccta

SEQ ID NO: 252004 - DNA, 15 bp, Homo sapiens
agtctgagagaacct

SEQ ID NO: 252005 - DNA, 15 bp, Homo sapiens
cagtctgagagaacc

SEQ ID NO: 252006 - DNA, 15 bp, Homo sapiens
ccagtctgagagaac

SEQ ID NO: 252007 - DNA, 15 bp, Homo sapiens
cccagtctgagagaa

SEQ ID NO: 252008 - DNA, 15 bp, Homo sapiens
tcccagtctgagaga

SEQ ID NO: 252009 - DNA, 15 bp, Homo sapiens
ctcccagtctgagag

SEQ ID NO: 252010 - DNA, 15 bp, Homo sapiens
gctcccagtctgaga

SEQ ID NO: 252011 - DNA, 15 bp, Homo sapiens
ggctcccagtctgag

SEQ ID NO: 252012 - DNA, 15 bp, Homo sapiens
gggctcccagtctga

SEQ ID NO: 252013 - DNA, 15 bp, Homo sapiens
tgggctcccagtctg

SEQ ID NO: 252014 - DNA, 15 bp, Homo sapiens
atgggctcccagtct

SEQ ID NO: 252015 - DNA, 15 bp, Homo sapiens
catgggctcccagtc

SEQ ID NO: 252016 - DNA, 15 bp, Homo sapiens
tcatgggctcccagt

SEQ ID NO: 252017 - DNA, 15 bp, Homo sapiens
atcatgggctcccag

SEQ ID NO: 252018 - DNA, 15 bp, Homo sapiens
catcatgggctccca

SEQ ID NO: 252019 - DNA, 15 bp, Homo sapiens
gcatcatgggctccc

SEQ ID NO: 252020 - DNA, 15 bp, Homo sapiens
ggcatcatgggctcc

SEQ ID NO: 252021 - DNA, 15 bp, Homo sapiens
aggcatcatgggctc

SEQ ID NO: 252022 - DNA, 15 bp, Homo sapiens
aaggcatcatgggct

SEQ ID NO: 252023 - DNA, 15 bp, Homo sapiens
taaggcatcatgggc

SEQ ID NO: 252024 - DNA, 15 bp, Homo sapiens
gtaaggcatcatggg

SEQ ID NO: 252025 - DNA, 15 bp, Homo sapiens
agtaaggcatcatgg

SEQ ID NO: 252026 - DNA, 15 bp, Homo sapiens
cagtaaggcatcatg

SEQ ID NO: 252027 - DNA, 15 bp, Homo sapiens
ccagtaaggcatcat

SEQ ID NO: 252028 - DNA, 15 bp, Homo sapiens
tccagtaaggcatca

SEQ ID NO: 252029 - DNA, 15 bp, Homo sapiens
ttccagtaaggcatc

SEQ ID NO: 252030 - DNA, 15 bp, Homo sapiens
attccagtaaggcat

SEQ ID NO: 252031 - DNA, 15 bp, Homo sapiens
aattccagtaaggca

SEQ ID NO: 252032 - DNA, 15 bp, Homo sapiens
caattccagtaaggc

SEQ ID NO: 252033 - DNA, 15 bp, Homo sapiens
gcaattccagtaagg

SEQ ID NO: 252034 - DNA, 15 bp, Homo sapiens
tgcaattccagtaag

SEQ ID NO: 252035 - DNA, 15 bp, Homo sapiens
atgcaattccagtaa

SEQ ID NO: 252036 - DNA, 15 bp, Homo sapiens
aatgcaattccagta

SEQ ID NO: 252037 - DNA, 15 bp, Homo sapiens
taatgcaattccagt

SEQ ID NO: 252038 - DNA, 15 bp, Homo sapiens
gtaatgcaattccag

SEQ ID NO: 252039 - DNA, 15 bp, Homo sapiens
ggtaatgcaattcca

SEQ ID NO: 252040 - DNA, 15 bp, Homo sapiens
aggtaatgcaattcc

SEQ ID NO: 252041 - DNA, 15 bp, Homo sapiens
gaggtaatgcaattc

SEQ ID NO: 252042 - DNA, 15 bp, Homo sapiens
ggaggtaatgcaatt

SEQ ID NO: 252043 - DNA, 15 bp, Homo sapiens
aggaggtaatgcaat

SEQ ID NO: 252044 - DNA, 15 bp, Homo sapiens
gaggaggtaatgcaa

SEQ ID NO: 252045 - DNA, 15 bp, Homo sapiens
tgaggaggtaatgca

SEQ ID NO: 252046 - DNA, 15 bp, Homo sapiens
ctgaggaggtaatgc

SEQ ID NO: 252047 - DNA, 15 bp, Homo sapiens
gctgaggaggtaatg

SEQ ID NO: 252048 - DNA, 15 bp, Homo sapiens
tgctgaggaggtaat

SEQ ID NO: 252049 - DNA, 15 bp, Homo sapiens
ttgctgaggaggtaa

SEQ ID NO: 252050 - DNA, 15 bp, Homo sapiens
tttgctgaggaggta

SEQ ID NO: 252051 - DNA, 15 bp, Homo sapiens
atttgctgaggaggt

SEQ ID NO: 252052 - DNA, 15 bp, Homo sapiens
gatttgctgaggagg

SEQ ID NO: 252053 - DNA, 15 bp, Homo sapiens
ggatttgctgaggag

SEQ ID NO: 252054 - DNA, 15 bp, Homo sapiens
aggatttgctgagga

SEQ ID NO: 252055 - DNA, 15 bp, Homo sapiens
aaggatttgctgagg

SEQ ID NO: 252056 - DNA, 15 bp, Homo sapiens
gaaggatttgctgag

SEQ ID NO: 252057 - DNA, 15 bp, Homo sapiens
ggaaggatttgctga

SEQ ID NO: 252058 - DNA, 15 bp, Homo sapiens
tggaaggatttgctg

SEQ ID NO: 252059 - DNA, 15 bp, Homo sapiens
atggaaggatttgct

SEQ ID NO: 252060 - DNA, 15 bp, Homo sapiens
tatggaaggatttgc

SEQ ID NO: 252061 - DNA, 15 bp, Homo sapiens
atatggaaggatttg

SEQ ID NO: 252062 - DNA, 15 bp, Homo sapiens
aatatggaaggattt

SEQ ID NO: 252063 - DNA, 15 bp, Homo sapiens
aaatatggaaggatt

SEQ ID NO: 252064 - DNA, 15 bp, Homo sapiens
caaatatggaaggat

SEQ ID NO: 252065 - DNA, 15 bp, Homo sapiens
acaaatatggaagga

SEQ ID NO: 252066 - DNA, 15 bp, Homo sapiens
aacaaatatggaagg

SEQ ID NO: 252067 - DNA, 15 bp, Homo sapiens
caacaaatatggaag

SEQ ID NO: 252068 - DNA, 15 bp, Homo sapiens
ccaacaaatatggaa

SEQ ID NO: 252069 - DNA, 15 bp, Homo sapiens
accaacaaatatgga

SEQ ID NO: 252070 - DNA, 15 bp, Homo sapiens
taccaacaaatatgg

SEQ ID NO: 252071 - DNA, 15 bp, Homo sapiens
ttaccaacaaatatg

SEQ ID NO: 252072 - DNA, 15 bp, Homo sapiens
attaccaacaaatat

SEQ ID NO: 252073 - DNA, 15 bp, Homo sapiens
tattaccaacaaata

SEQ ID NO: 252074 - DNA, 15 bp, Homo sapiens
ctattaccaacaaat

SEQ ID NO: 252075 - DNA, 15 bp, Homo sapiens
cctattaccaacaaa

SEQ ID NO: 252076 - DNA, 15 bp, Homo sapiens
ccctattaccaacaa

SEQ ID NO: 252077 - DNA, 15 bp, Homo sapiens
tccctattaccaaca

SEQ ID NO: 252078 - DNA, 15 bp, Homo sapiens
ctccctattaccaac

SEQ ID NO: 252079 - DNA, 15 bp, Homo sapiens
cctccctattaccaa

SEQ ID NO: 252080 - DNA, 15 bp, Homo sapiens
tcctccctattacca

SEQ ID NO: 252081 - DNA, 15 bp, Homo sapiens
ttcctccctattacc

SEQ ID NO: 252082 - DNA, 15 bp, Homo sapiens
tttcctccctattac

SEQ ID NO: 252083 - DNA, 15 bp, Homo sapiens
atttcctccctatta

SEQ ID NO: 252084 - DNA, 15 bp, Homo sapiens
aatttcctccctatt

SEQ ID NO: 252085 - DNA, 15 bp, Homo sapiens
gaatttcctccctat

SEQ ID NO: 252086 - DNA, 15 bp, Homo sapiens
agaatttcctcccta

SEQ ID NO: 252087 - DNA, 15 bp, Homo sapiens
aagaatttcctccct

SEQ ID NO: 252088 - DNA, 15 bp, Homo sapiens
aaagaatttcctccc

SEQ ID NO: 252089 - DNA, 15 bp, Homo sapiens
aaaagaatttcctcc

SEQ ID NO: 252090 - DNA, 15 bp, Homo sapiens
aaaaagaatttcctc

SEQ ID NO: 252091 - DNA, 15 bp, Homo sapiens
caaaaagaatttcct

SEQ ID NO: 252092 - DNA, 15 bp, Homo sapiens
tcaaaaagaatttcc

SEQ ID NO: 252093 - DNA, 15 bp, Homo sapiens
ctcaaaaagaatttc

SEQ ID NO: 252094 - DNA, 15 bp, Homo sapiens
tctcaaaaagaattt

SEQ ID NO: 252095 - DNA, 15 bp, Homo sapiens
gtctcaaaaagaatt

SEQ ID NO: 252096 - DNA, 15 bp, Homo sapiens
agtctcaaaaagaat

SEQ ID NO: 252097 - DNA, 15 bp, Homo sapiens
gagtctcaaaaagaa

SEQ ID NO: 252098 - DNA, 15 bp, Homo sapiens
agagtctcaaaaaga

SEQ ID NO: 252099 - DNA, 15 bp, Homo sapiens
cagagtctcaaaaag

SEQ ID NO: 252100 - DNA, 15 bp, Homo sapiens
gcagagtctcaaaaa

SEQ ID NO: 252101 - DNA, 15 bp, Homo sapiens
tgcagagtctcaaaa

SEQ ID NO: 252102 - DNA, 15 bp, Homo sapiens
atgcagagtctcaaa

SEQ ID NO: 252103 - DNA, 15 bp, Homo sapiens
aatgcagagtctcaa

SEQ ID NO: 252104 - DNA, 15 bp, Homo sapiens
aaatgcagagtctca

SEQ ID NO: 252105 - DNA, 15 bp, Homo sapiens
gaaatgcagagtctc

SEQ ID NO: 252106 - DNA, 15 bp, Homo sapiens
agaaatgcagagtct

SEQ ID NO: 252107 - DNA, 15 bp, Homo sapiens
cagaaatgcagagtc

SEQ ID NO: 252108 - DNA, 15 bp, Homo sapiens
acagaaatgcagagt

SEQ ID NO: 252109 - DNA, 15 bp, Homo sapiens
tacagaaatgcagag

SEQ ID NO: 252110 - DNA, 15 bp, Homo sapiens
ttacagaaatgcaga

SEQ ID NO: 252111 - DNA, 15 bp, Homo sapiens
tttacagaaatgcag

SEQ ID NO: 252112 - DNA, 15 bp, Homo sapiens
ctttacagaaatgca

SEQ ID NO: 252113 - DNA, 15 bp, Homo sapiens
gctttacagaaatgc

SEQ ID NO: 252114 - DNA, 15 bp, Homo sapiens
agctttacagaaatg

SEQ ID NO: 252115 - DNA, 15 bp, Homo sapiens
gagctttacagaaat

SEQ ID NO: 252116 - DNA, 15 bp, Homo sapiens
agagctttacagaaa

SEQ ID NO: 252117 - DNA, 15 bp, Homo sapiens
cagagctttacagaa

SEQ ID NO: 252118 - DNA, 15 bp, Homo sapiens
tcagagctttacaga

SEQ ID NO: 252119 - DNA, 15 bp, Homo sapiens
ctcagagctttacag

SEQ ID NO: 252120 - DNA, 15 bp, Homo sapiens
gctcagagctttaca

SEQ ID NO: 252121 - DNA, 15 bp, Homo sapiens
ggctcagagctttac

SEQ ID NO: 252122 - DNA, 15 bp, Homo sapiens
aggctcagagcttta

SEQ ID NO: 252123 - DNA, 15 bp, Homo sapiens
taggctcagagcttt

SEQ ID NO: 252124 - DNA, 15 bp, Homo sapiens
ttaggctcagagctt

SEQ ID NO: 252125 - DNA, 15 bp, Homo sapiens
attaggctcagagct

SEQ ID NO: 252126 - DNA, 15 bp, Homo sapiens
cattaggctcagagc

SEQ ID NO: 252127 - DNA, 15 bp, Homo sapiens
tcattaggctcagag

SEQ ID NO: 252128 - DNA, 15 bp, Homo sapiens
atcattaggctcaga

SEQ ID NO: 252129 - DNA, 15 bp, Homo sapiens
catcattaggctcag

SEQ ID NO: 252130 - DNA, 15 bp, Homo sapiens
tcatcattaggctca

SEQ ID NO: 252131 - DNA, 15 bp, Homo sapiens
ttcatcattaggctc

SEQ ID NO: 252132 - DNA, 15 bp, Homo sapiens
attcatcattaggct

SEQ ID NO: 252133 - DNA, 15 bp, Homo sapiens
tattcatcattaggc

SEQ ID NO: 252134 - DNA, 15 bp, Homo sapiens
ctattcatcattagg

SEQ ID NO: 252135 - DNA, 15 bp, Homo sapiens
actattcatcattag

SEQ ID NO: 252136 - DNA, 15 bp, Homo sapiens
tactattcatcatta

SEQ ID NO: 252137 - DNA, 15 bp, Homo sapiens
ttactattcatcatt

SEQ ID NO: 252138 - DNA, 15 bp, Homo sapiens
cttactattcatcat

SEQ ID NO: 252139 - DNA, 15 bp, Homo sapiens
tcttactattcatca

SEQ ID NO: 252140 - DNA, 15 bp, Homo sapiens
ttcttactattcatc

SEQ ID NO: 252141 - DNA, 15 bp, Homo sapiens
attcttactattcat

SEQ ID NO: 252142 - DNA, 15 bp, Homo sapiens
aattcttactattca

SEQ ID NO: 252143 - DNA, 15 bp, Homo sapiens
aaattcttactattc

SEQ ID NO: 252144 - DNA, 15 bp, Homo sapiens
taaattcttactatt

SEQ ID NO: 252145 - DNA, 15 bp, Homo sapiens
ctaaattcttactat

SEQ ID NO: 252146 - DNA, 15 bp, Homo sapiens
cctaaattcttacta

SEQ ID NO: 252147 - DNA, 15 bp, Homo sapiens
acctaaattcttact

SEQ ID NO: 252148 - DNA, 15 bp, Homo sapiens
gacctaaattcttac

SEQ ID NO: 252149 - DNA, 15 bp, Homo sapiens
tgacctaaattctta

SEQ ID NO: 252150 - DNA, 15 bp, Homo sapiens
ttgacctaaattctt

SEQ ID NO: 252151 - DNA, 15 bp, Homo sapiens
tttgacctaaattct

SEQ ID NO: 252152 - DNA, 15 bp, Homo sapiens
gtttgacctaaattc

SEQ ID NO: 252153 - DNA, 15 bp, Homo sapiens
tgtttgacctaaatt

SEQ ID NO: 252154 - DNA, 15 bp, Homo sapiens
ttgtttgacctaaat

SEQ ID NO: 252155 - DNA, 15 bp, Homo sapiens
gttgtttgacctaaa

SEQ ID NO: 252156 - DNA, 15 bp, Homo sapiens
agttgtttgacctaa

SEQ ID NO: 252157 - DNA, 15 bp, Homo sapiens
aagttgtttgaccta

SEQ ID NO: 252158 - DNA, 15 bp, Homo sapiens
gaagttgtttgacct

SEQ ID NO: 252159 - DNA, 15 bp, Homo sapiens
tgaagttgtttgacc

SEQ ID NO: 252160 - DNA, 15 bp, Homo sapiens
ctgaagttgtttgac

SEQ ID NO: 252161 - DNA, 15 bp, Homo sapiens
actgaagttgtttga

SEQ ID NO: 252162 - DNA, 15 bp, Homo sapiens
tactgaagttgtttg

SEQ ID NO: 252163 - DNA, 15 bp, Homo sapiens
gtactgaagttgttt

SEQ ID NO: 252164 - DNA, 15 bp, Homo sapiens
ggtactgaagttgtt

SEQ ID NO: 252165 - DNA, 15 bp, Homo sapiens
gggtactgaagttgt

SEQ ID NO: 252166 - DNA, 15 bp, Homo sapiens
cgggtactgaagttg

SEQ ID NO: 252167 - DNA, 15 bp, Homo sapiens
ccgggtactgaagtt

SEQ ID NO: 252168 - DNA, 15 bp, Homo sapiens
gccgggtactgaagt

SEQ ID NO: 252169 - DNA, 15 bp, Homo sapiens
agccgggtactgaag

SEQ ID NO: 252170 - DNA, 15 bp, Homo sapiens
gagccgggtactgaa

SEQ ID NO: 252171 - DNA, 15 bp, Homo sapiens
ggagccgggtactga

SEQ ID NO: 252172 - DNA, 15 bp, Homo sapiens
tggagccgggtactg

SEQ ID NO: 252173 - DNA, 15 bp, Homo sapiens
atggagccgggtact

SEQ ID NO: 252174 - DNA, 15 bp, Homo sapiens
catggagccgggtac

SEQ ID NO: 252175 - DNA, 15 bp, Homo sapiens
ccatggagccgggta

SEQ ID NO: 252176 - DNA, 15 bp, Homo sapiens
accatggagccgggt

SEQ ID NO: 252177 - DNA, 15 bp, Homo sapiens
gaccatggagccggg

SEQ ID NO: 252178 - DNA, 15 bp, Homo sapiens
agaccatggagccgg

SEQ ID NO: 252179 - DNA, 15 bp, Homo sapiens
aagaccatggagccg

SEQ ID NO: 252180 - DNA, 15 bp, Homo sapiens
aaagaccatggagcc

SEQ ID NO: 252181 - DNA, 15 bp, Homo sapiens
aaaagaccatggagc

SEQ ID NO: 252182 - DNA, 15 bp, Homo sapiens
caaaagaccatggag

SEQ ID NO: 252183 - DNA, 15 bp, Homo sapiens
tcaaaagaccatgga

SEQ ID NO: 252184 - DNA, 15 bp, Homo sapiens
ctcaaaagaccatgg

SEQ ID NO: 252185 - DNA, 15 bp, Homo sapiens
gctcaaaagaccatg

SEQ ID NO: 252186 - DNA, 15 bp, Homo sapiens
tgctcaaaagaccat

SEQ ID NO: 252187 - DNA, 15 bp, Homo sapiens
ttgctcaaaagacca

SEQ ID NO: 252188 - DNA, 15 bp, Homo sapiens
attgctcaaaagacc

SEQ ID NO: 252189 - DNA, 15 bp, Homo sapiens
aattgctcaaaagac

SEQ ID NO: 252190 - DNA, 15 bp, Homo sapiens
aaattgctcaaaaga

SEQ ID NO: 252191 - DNA, 15 bp, Homo sapiens
caaattgctcaaaag

SEQ ID NO: 252192 - DNA, 15 bp, Homo sapiens
acaaattgctcaaaa

SEQ ID NO: 252193 - DNA, 15 bp, Homo sapiens
tacaaattgctcaaa

SEQ ID NO: 252194 - DNA, 15 bp, Homo sapiens
ctacaaattgctcaa

SEQ ID NO: 252195 - DNA, 15 bp, Homo sapiens
actacaaattgctca

SEQ ID NO: 252196 - DNA, 15 bp, Homo sapiens
tactacaaattgctc

SEQ ID NO: 252197 - DNA, 15 bp, Homo sapiens
atactacaaattgct

SEQ ID NO: 252198 - DNA, 15 bp, Homo sapiens
gatactacaaattgc

SEQ ID NO: 252199 - DNA, 15 bp, Homo sapiens
tgatactacaaattg

SEQ ID NO: 252200 - DNA, 15 bp, Homo sapiens
gtgatactacaaatt

SEQ ID NO: 252201 - DNA, 15 bp, Homo sapiens
agtgatactacaaat

SEQ ID NO: 252202 - DNA, 15 bp, Homo sapiens
tagtgatactacaaa

SEQ ID NO: 252203 - DNA, 15 bp, Homo sapiens
gtagtgatactacaa

SEQ ID NO: 252204 - DNA, 15 bp, Homo sapiens
ggtagtgatactaca

SEQ ID NO: 252205 - DNA, 15 bp, Homo sapiens
tggtagtgatactac

SEQ ID NO: 252206 - DNA, 15 bp, Homo sapiens
atggtagtgatacta

SEQ ID NO: 252207 - DNA, 15 bp, Homo sapiens
gatggtagtgatact

SEQ ID NO: 252208 - DNA, 15 bp, Homo sapiens
tgatggtagtgatac

SEQ ID NO: 252209 - DNA, 15 bp, Homo sapiens
ttgatggtagtgata

SEQ ID NO: 252210 - DNA, 15 bp, Homo sapiens
tttgatggtagtgat

SEQ ID NO: 252211 - DNA, 15 bp, Homo sapiens
gtttgatggtagtga

SEQ ID NO: 252212 - DNA, 15 bp, Homo sapiens
ggtttgatggtagtg

SEQ ID NO: 252213 - DNA, 15 bp, Homo sapiens
cggtttgatggtagt

SEQ ID NO: 252214 - DNA, 15 bp, Homo sapiens
tcggtttgatggtag

SEQ ID NO: 252215 - DNA, 15 bp, Homo sapiens
ttcggtttgatggta

SEQ ID NO: 252216 - DNA, 15 bp, Homo sapiens
tttcggtttgatggt

SEQ ID NO: 252217 - DNA, 15 bp, Homo sapiens
ctttcggtttgatgg

SEQ ID NO: 252218 - DNA, 15 bp, Homo sapiens
cctttcggtttgatg

SEQ ID NO: 252219 - DNA, 15 bp, Homo sapiens
ccctttcggtttgat

SEQ ID NO: 252220 - DNA, 15 bp, Homo sapiens
accctttcggtttga

SEQ ID NO: 252221 - DNA, 15 bp, Homo sapiens
caccctttcggtttg

SEQ ID NO: 252222 - DNA, 15 bp, Homo sapiens
ccaccctttcggttt

SEQ ID NO: 252223 - DNA, 15 bp, Homo sapiens
tccaccctttcggtt

SEQ ID NO: 252224 - DNA, 15 bp, Homo sapiens
ttccaccctttcggt

SEQ ID NO: 252225 - DNA, 15 bp, Homo sapiens
attccaccctttcgg

SEQ ID NO: 252226 - DNA, 15 bp, Homo sapiens
cattccaccctttcg

SEQ ID NO: 252227 - DNA, 15 bp, Homo sapiens
ccattccaccctttc

SEQ ID NO: 252228 - DNA, 15 bp, Homo sapiens
accattccacccttt

SEQ ID NO: 252229 - DNA, 15 bp, Homo sapiens
aaccattccaccctt

SEQ ID NO: 252230 - DNA, 15 bp, Homo sapiens
aaaccattccaccct

SEQ ID NO: 252231 - DNA, 15 bp, Homo sapiens
aaaaccattccaccc

SEQ ID NO: 252232 - DNA, 15 bp, Homo sapiens
caaaaccattccacc

SEQ ID NO: 252233 - DNA, 15 bp, Homo sapiens
acaaaaccattccac

SEQ ID NO: 252234 - DNA, 15 bp, Homo sapiens
aacaaaaccattcca

SEQ ID NO: 252235 - DNA, 15 bp, Homo sapiens
caacaaaaccattcc

SEQ ID NO: 252236 - DNA, 15 bp, Homo sapiens
ccaacaaaaccattc

SEQ ID NO: 252237 - DNA, 15 bp, Homo sapiens
accaacaaaaccatt

SEQ ID NO: 252238 - DNA, 15 bp, Homo sapiens
caccaacaaaaccat

SEQ ID NO: 252239 - DNA, 15 bp, Homo sapiens
acaccaacaaaacca

SEQ ID NO: 252240 - DNA, 15 bp, Homo sapiens
aacaccaacaaaacc

SEQ ID NO: 252241 - DNA, 15 bp, Homo sapiens
gaacaccaacaaaac

SEQ ID NO: 252242 - DNA, 15 bp, Homo sapiens
tgaacaccaacaaaa

SEQ ID NO: 252243 - DNA, 15 bp, Homo sapiens
ctgaacaccaacaaa

SEQ ID NO: 252244 - DNA, 15 bp, Homo sapiens
actgaacaccaacaa

SEQ ID NO: 252245 - DNA, 15 bp, Homo sapiens
tactgaacaccaaca

SEQ ID NO: 252246 - DNA, 15 bp, Homo sapiens
ctactgaacaccaac

SEQ ID NO: 252247 - DNA, 15 bp, Homo sapiens
actactgaacaccaa

SEQ ID NO: 252248 - DNA, 15 bp, Homo sapiens
cactactgaacacca

SEQ ID NO: 252249 - DNA, 15 bp, Homo sapiens
ccactactgaacacc

SEQ ID NO: 252250 - DNA, 15 bp, Homo sapiens
tccactactgaacac

SEQ ID NO: 252251 - DNA, 15 bp, Homo sapiens
gtccactactgaaca

SEQ ID NO: 252252 - DNA, 15 bp, Homo sapiens
ggtccactactgaac

SEQ ID NO: 252253 - DNA, 15 bp, Homo sapiens
tggtccactactgaa

SEQ ID NO: 252254 - DNA, 15 bp, Homo sapiens
atggtccactactga

SEQ ID NO: 252255 - DNA, 15 bp, Homo sapiens
catggtccactactg

SEQ ID NO: 252256 - DNA, 15 bp, Homo sapiens
tcatggtccactact

SEQ ID NO: 252257 - DNA, 15 bp, Homo sapiens
ttcatggtccactac

SEQ ID NO: 252258 - DNA, 15 bp, Homo sapiens
cttcatggtccacta

SEQ ID NO: 252259 - DNA, 15 bp, Homo sapiens
acttcatggtccact

SEQ ID NO: 252260 - DNA, 15 bp, Homo sapiens
tacttcatggtccac

SEQ ID NO: 252261 - DNA, 15 bp, Homo sapiens
ctacttcatggtcca

SEQ ID NO: 252262 - DNA, 15 bp, Homo sapiens
tctacttcatggtcc

SEQ ID NO: 252263 - DNA, 15 bp, Homo sapiens
ttctacttcatggtc

SEQ ID NO: 252264 - DNA, 15 bp, Homo sapiens
cttctacttcatggt

SEQ ID NO: 252265 - DNA, 15 bp, Homo sapiens
acttctacttcatgg

SEQ ID NO: 252266 - DNA, 15 bp, Homo sapiens
tacttctacttcatg

SEQ ID NO: 252267 - DNA, 15 bp, Homo sapiens
atacttctacttcat

SEQ ID NO: 252268 - DNA, 15 bp, Homo sapiens
aatacttctacttca

SEQ ID NO: 252269 - DNA, 15 bp, Homo sapiens
aaatacttctacttc

SEQ ID NO: 252270 - DNA, 15 bp, Homo sapiens
caaatacttctactt

SEQ ID NO: 252271 - DNA, 15 bp, Homo sapiens
acaaatacttctact

SEQ ID NO: 252272 - DNA, 15 bp, Homo sapiens
gacaaatacttctac

SEQ ID NO: 252273 - DNA, 15 bp, Homo sapiens
agacaaatacttcta

SEQ ID NO: 252274 - DNA, 15 bp, Homo sapiens
agagacaaatacttc

SEQ ID NO: 252275 - DNA, 15 bp, Homo sapiens
cagagacaaatactt

SEQ ID NO: 252276 - DNA, 15 bp, Homo sapiens
gcagagacaaatact

SEQ ID NO: 252277 - DNA, 15 bp, Homo sapiens
tgcagagacaaatac

SEQ ID NO: 252278 - DNA, 15 bp, Homo sapiens
atgcagagacaaata

SEQ ID NO: 252279 - DNA, 15 bp, Homo sapiens
aatgcagagacaaat

SEQ ID NO: 252280 - DNA, 15 bp, Homo sapiens
caatgcagagacaaa

SEQ ID NO: 252281 - DNA, 15 bp, Homo sapiens
ccaatgcagagacaa

SEQ ID NO: 252282 - DNA, 15 bp, Homo sapiens
tccaatgcagagaca

SEQ ID NO: 252283 - DNA, 15 bp, Homo sapiens
ctccaatgcagagac

SEQ ID NO: 252284 - DNA, 15 bp, Homo sapiens
actccaatgcagaga

SEQ ID NO: 252285 - DNA, 15 bp, Homo sapiens
gactccaatgcagag

SEQ ID NO: 252286 - DNA, 15 bp, Homo sapiens
tgactccaatgcaga

SEQ ID NO: 252287 - DNA, 15 bp, Homo sapiens
ttgactccaatgcag

SEQ ID NO: 252288 - DNA, 15 bp, Homo sapiens
cttgactccaatgca

SEQ ID NO: 252289 - DNA, 15 bp, Homo sapiens
tcttgactccaatgc

SEQ ID NO: 252290 - DNA, 15 bp, Homo sapiens
ttcttgactccaatg

SEQ ID NO: 252291 - DNA, 15 bp, Homo sapiens
attcttgactccaat

SEQ ID NO: 252292 - DNA, 15 bp, Homo sapiens
gattcttgactccaa

SEQ ID NO: 252293 - DNA, 15 bp, Homo sapiens
agattcttgactcca

SEQ ID NO: 252294 - DNA, 15 bp, Homo sapiens
cagattcttgactcc

SEQ ID NO: 252295 - DNA, 15 bp, Homo sapiens
ccagattcttgactc

SEQ ID NO: 252296 - DNA, 15 bp, Homo sapiens
cccagattcttgact

SEQ ID NO: 252297 - DNA, 15 bp, Homo sapiens
acccagattcttgac

SEQ ID NO: 252298 - DNA, 15 bp, Homo sapiens
tacccagattcttga

SEQ ID NO: 252299 - DNA, 15 bp, Homo sapiens
ctacccagattcttg

SEQ ID NO: 252300 - DNA, 15 bp, Homo sapiens
tctacccagattctt

SEQ ID NO: 252301 - DNA, 15 bp, Homo sapiens
ctctacccagattct

SEQ ID NO: 252302 - DNA, 15 bp, Homo sapiens
cctctacccagattc

SEQ ID NO: 252303 - DNA, 15 bp, Homo sapiens
tcctctacccagatt

SEQ ID NO: 252304 - DNA, 15 bp, Homo sapiens
ctcctctacccagat

SEQ ID NO: 252305 - DNA, 15 bp, Homo sapiens
gctcctctacccaga

SEQ ID NO: 252306 - DNA, 15 bp, Homo sapiens
ggctcctctacccag

SEQ ID NO: 252307 - DNA, 15 bp, Homo sapiens
gggctcctctaccca

SEQ ID NO: 252308 - DNA, 15 bp, Homo sapiens
cgggctcctctaccc

SEQ ID NO: 252309 - DNA, 15 bp, Homo sapiens
tcgggctcctctacc

SEQ ID NO: 252310 - DNA, 15 bp, Homo sapiens
gtcgggctcctctac

SEQ ID NO: 252311 - DNA, 15 bp, Homo sapiens
tgtcgggctcctcta

SEQ ID NO: 252312 - DNA, 15 bp, Homo sapiens
ttgtcgggctcctct

SEQ ID NO: 252313 - DNA, 15 bp, Homo sapiens
gttgtcgggctcctc

SEQ ID NO: 252314 - DNA, 15 bp, Homo sapiens
agttgtcgggctcct

SEQ ID NO: 252315 - DNA, 15 bp, Homo sapiens
aagttgtcgggctcc

SEQ ID NO: 252316 - DNA, 15 bp, Homo sapiens
aaagttgtcgggctc

SEQ ID NO: 252317 - DNA, 15 bp, Homo sapiens
gaaagttgtcgggct

SEQ ID NO: 252318 - DNA, 15 bp, Homo sapiens
ggaaagttgtcgggc

SEQ ID NO: 252319 - DNA, 15 bp, Homo sapiens
tggaaagttgtcggg

SEQ ID NO: 252320 - DNA, 15 bp, Homo sapiens
atggaaagttgtcgg

SEQ ID NO: 252321 - DNA, 15 bp, Homo sapiens
gatggaaagttgtcg

SEQ ID NO: 252322 - DNA, 15 bp, Homo sapiens
agatggaaagttgtc

SEQ ID NO: 252323 - DNA, 15 bp, Homo sapiens
gagatggaaagttgt

SEQ ID NO: 252324 - DNA, 15 bp, Homo sapiens
agagatggaaagttg

SEQ ID NO: 252325 - DNA, 15 bp, Homo sapiens
aagagatggaaagtt

SEQ ID NO: 252326 - DNA, 15 bp, Homo sapiens
aaagagatggaaagt

SEQ ID NO: 252327 - DNA, 15 bp, Homo sapiens
gaaagagatggaaag

SEQ ID NO: 252328 - DNA, 15 bp, Homo sapiens
ggaaagagatggaaa

SEQ ID NO: 252329 - DNA, 15 bp, Homo sapiens
tggaaagagatggaa

SEQ ID NO: 252330 - DNA, 15 bp, Homo sapiens
ttggaaagagatgga

SEQ ID NO: 252331 - DNA, 15 bp, Homo sapiens
cttggaaagagatgg

SEQ ID NO: 252332 - DNA, 15 bp, Homo sapiens
tcttggaaagagatg

SEQ ID NO: 252333 - DNA, 15 bp, Homo sapiens
gtcttggaaagagat

SEQ ID NO: 252334 - DNA, 15 bp, Homo sapiens
tgtcttggaaagaga

SEQ ID NO: 252335 - DNA, 15 bp, Homo sapiens
ctgtcttggaaagag

SEQ ID NO: 252336 - DNA, 15 bp, Homo sapiens
tctgtcttggaaaga

SEQ ID NO: 252337 - DNA, 15 bp, Homo sapiens
atctgtcttggaaag

SEQ ID NO: 252338 - DNA, 15 bp, Homo sapiens
gatctgtcttggaaa

SEQ ID NO: 252339 - DNA, 15 bp, Homo sapiens
agatctgtcttggaa

SEQ ID NO: 252340 - DNA, 15 bp, Homo sapiens
aagatctgtcttgga

SEQ ID NO: 252341 - DNA, 15 bp, Homo sapiens
gaagatctgtcttgg

SEQ ID NO: 252342 - DNA, 15 bp, Homo sapiens
tgaagatctgtcttg

SEQ ID NO: 252343 - DNA, 15 bp, Homo sapiens
gtgaagatctgtctt

SEQ ID NO: 252344 - DNA, 15 bp, Homo sapiens
tgtgaagatctgtct

SEQ ID NO: 252345 - DNA, 15 bp, Homo sapiens
atgtgaagatctgtc

SEQ ID NO: 252346 - DNA, 15 bp, Homo sapiens
aatgtgaagatctgt

SEQ ID NO: 252347 - DNA, 15 bp, Homo sapiens
caatgtgaagatctg

SEQ ID NO: 252348 - DNA, 15 bp, Homo sapiens
acaatgtgaagatct

SEQ ID NO: 252349 - DNA, 15 bp, Homo sapiens
tacaatgtgaagatc

SEQ ID NO: 252350 - DNA, 15 bp, Homo sapiens
ctacaatgtgaagat

SEQ ID NO: 252351 - DNA, 15 bp, Homo sapiens
actacaatgtgaaga

SEQ ID NO: 252352 - DNA, 15 bp, Homo sapiens
aactacaatgtgaag

SEQ ID NO: 252353 - DNA, 15 bp, Homo sapiens
taactacaatgtgaa

SEQ ID NO: 252354 - DNA, 15 bp, Homo sapiens
gtaactacaatgtga

SEQ ID NO: 252355 - DNA, 15 bp, Homo sapiens
tgtaactacaatgtg

SEQ ID NO: 252356 - DNA, 15 bp, Homo sapiens
atgtaactacaatgt

SEQ ID NO: 252357 - DNA, 15 bp, Homo sapiens
aatgtaactacaatg

SEQ ID NO: 252358 - DNA, 15 bp, Homo sapiens
taatgtaactacaat

SEQ ID NO: 252359 - DNA, 15 bp, Homo sapiens
ataatgtaactacaa

SEQ ID NO: 252360 - DNA, 15 bp, Homo sapiens
aataatgtaactaca

SEQ ID NO: 252361 - DNA, 15 bp, Homo sapiens
aaataatgtaactac

SEQ ID NO: 252362 - DNA, 15 bp, Homo sapiens
aaaataatgtaacta

SEQ ID NO: 252363 - DNA, 15 bp, Homo sapiens
caaaataatgtaact

SEQ ID NO: 252364 - DNA, 15 bp, Homo sapiens
acaaaataatgtaac

SEQ ID NO: 252365 - DNA, 15 bp, Homo sapiens
aacaaaataatgtaa

SEQ ID NO: 252366 - DNA, 15 bp, Homo sapiens
aaacaaaataatgta

SEQ ID NO: 252367 - DNA, 15 bp, Homo sapiens
caaacaaaataatgt

SEQ ID NO: 252368 - DNA, 15 bp, Homo sapiens
tcaaacaaaataatg

SEQ ID NO: 252369 - DNA, 15 bp, Homo sapiens
ctcaaacaaaataat

SEQ ID NO: 252370 - DNA, 15 bp, Homo sapiens
tctcaaacaaaataa

SEQ ID NO: 252371 - DNA, 15 bp, Homo sapiens
atctcaaacaaaata

SEQ ID NO: 252372 - DNA, 15 bp, Homo sapiens
gatctcaaacaaaat

SEQ ID NO: 252373 - DNA, 15 bp, Homo sapiens
agatctcaaacaaaa

SEQ ID NO: 252374 - DNA, 15 bp, Homo sapiens
aagatctcaaacaaa

SEQ ID NO: 252375 - DNA, 15 bp, Homo sapiens
caagatctcaaacaa

SEQ ID NO: 252376 - DNA, 15 bp, Homo sapiens
ccaagatctcaaaca

SEQ ID NO: 252377 - DNA, 15 bp, Homo sapiens
tccaagatctcaaac

SEQ ID NO: 252378 - DNA, 15 bp, Homo sapiens
ttccaagatctcaaa

SEQ ID NO: 252379 - DNA, 15 bp, Homo sapiens
attccaagatctcaa

SEQ ID NO: 252380 - DNA, 15 bp, Homo sapiens
aattccaagatctca

SEQ ID NO: 252381 - DNA, 15 bp, Homo sapiens
aaattccaagatctc

SEQ ID NO: 252382 - DNA, 15 bp, Homo sapiens
gaaattccaagatct

SEQ ID NO: 252383 - DNA, 15 bp, Homo sapiens
ggaaattccaagatc

SEQ ID NO: 252384 - DNA, 15 bp, Homo sapiens
tggaaattccaagat

SEQ ID NO: 252385 - DNA, 15 bp, Homo sapiens
ctggaaattccaaga

SEQ ID NO: 252386 - DNA, 15 bp, Homo sapiens
cctggaaattccaag

SEQ ID NO: 252387 - DNA, 15 bp, Homo sapiens
tcctggaaattccaa

SEQ ID NO: 252388 - DNA, 15 bp, Homo sapiens
atcctggaaattcca

SEQ ID NO: 252389 - DNA, 15 bp, Homo sapiens
tatcctggaaattcc

SEQ ID NO: 252390 - DNA, 15 bp, Homo sapiens
gtatcctggaaattc

SEQ ID NO: 252391 - DNA, 15 bp, Homo sapiens
tgtatcctggaaatt

SEQ ID NO: 252392 - DNA, 15 bp, Homo sapiens
atgtatcctggaaat

SEQ ID NO: 252393 - DNA, 15 bp, Homo sapiens
tatgtatcctggaaa

SEQ ID NO: 252394 - DNA, 15 bp, Homo sapiens
gtatgtatcctggaa

SEQ ID NO: 252395 - DNA, 15 bp, Homo sapiens
ggtatgtatcctgga

SEQ ID NO: 252396 - DNA, 15 bp, Homo sapiens
gggtatgtatcctgg

SEQ ID NO: 252397 - DNA, 15 bp, Homo sapiens
tgggtatgtatcctg

SEQ ID NO: 252398 - DNA, 15 bp, Homo sapiens
ttgggtatgtatcct

SEQ ID NO: 252399 - DNA, 15 bp, Homo sapiens
attgggtatgtatcc

SEQ ID NO: 252400 - DNA, 15 bp, Homo sapiens
aattgggtatgtatc

SEQ ID NO: 252401 - DNA, 15 bp, Homo sapiens
caattgggtatgtat

SEQ ID NO: 252402 - DNA, 15 bp, Homo sapiens
gcaattgggtatgta

SEQ ID NO: 252403 - DNA, 15 bp, Homo sapiens
agcaattgggtatgt

SEQ ID NO: 252404 - DNA, 15 bp, Homo sapiens
tagcaattgggtatg

SEQ ID NO: 252405 - DNA, 15 bp, Homo sapiens
ttagcaattgggtat

SEQ ID NO: 252406 - DNA, 15 bp, Homo sapiens
attagcaattgggta

SEQ ID NO: 252407 - DNA, 15 bp, Homo sapiens
tattagcaattgggt

SEQ ID NO: 252408 - DNA, 15 bp, Homo sapiens
atattagcaattggg

SEQ ID NO: 252409 - DNA, 15 bp, Homo sapiens
aatattagcaattgg

SEQ ID NO: 252410 - DNA, 15 bp, Homo sapiens
aaatattagcaattg

SEQ ID NO: 252411 - DNA, 15 bp, Homo sapiens
gaaatattagcaatt

SEQ ID NO: 252412 - DNA, 15 bp, Homo sapiens
ggaaatattagcaat

SEQ ID NO: 252413 - DNA, 15 bp, Homo sapiens
cggaaatattagcaa

SEQ ID NO: 252414 - DNA, 15 bp, Homo sapiens
ccggaaatattagca

SEQ ID NO: 252415 - DNA, 15 bp, Homo sapiens
cccggaaatattagc

SEQ ID NO: 252416 - DNA, 15 bp, Homo sapiens
tcccggaaatattag

SEQ ID NO: 252417 - DNA, 15 bp, Homo sapiens
atcccggaaatatta

SEQ ID NO: 252418 - DNA, 15 bp, Homo sapiens
tatcccggaaatatt

SEQ ID NO: 252419 - DNA, 15 bp, Homo sapiens
gtatcccggaaatat

SEQ ID NO: 252420 - DNA, 15 bp, Homo sapiens
cgtatcccggaaata

SEQ ID NO: 252421 - DNA, 15 bp, Homo sapiens
acgtatcccggaaat

SEQ ID NO: 252422 - DNA, 15 bp, Homo sapiens
tacgtatcccggaaa

SEQ ID NO: 252423 - DNA, 15 bp, Homo sapiens
gtacgtatcccggaa

SEQ ID NO: 252424 - DNA, 15 bp, Homo sapiens
ggtacgtatcccgga

SEQ ID NO: 252425 - DNA, 15 bp, Homo sapiens
gggtacgtatcccgg

SEQ ID NO: 252426 - DNA, 15 bp, Homo sapiens
tgggtacgtatcccg

SEQ ID NO: 252427 - DNA, 15 bp, Homo sapiens
ttgggtacgtatccc

SEQ ID NO: 252428 - DNA, 15 bp, Homo sapiens
gttgggtacgtatcc

SEQ ID NO: 252429 - DNA, 15 bp, Homo sapiens
agttgggtacgtatc

SEQ ID NO: 252430 - DNA, 15 bp, Homo sapiens
cagttgggtacgtat

SEQ ID NO: 252431 - DNA, 15 bp, Homo sapiens
gcagttgggtacgta

SEQ ID NO: 252432 - DNA, 15 bp, Homo sapiens
tgcagttgggtacgt

SEQ ID NO: 252433 - DNA, 15 bp, Homo sapiens
ttgcagttgggtacg

SEQ ID NO: 252434 - DNA, 15 bp, Homo sapiens
tttgcagttgggtac

SEQ ID NO: 252435 - DNA, 15 bp, Homo sapiens
atttgcagttgggta

SEQ ID NO: 252436 - DNA, 15 bp, Homo sapiens
tatttgcagttgggt

SEQ ID NO: 252437 - DNA, 15 bp, Homo sapiens
gtatttgcagttggg

SEQ ID NO: 252438 - DNA, 15 bp, Homo sapiens
tgtatttgcagttgg

SEQ ID NO: 252439 - DNA, 15 bp, Homo sapiens
gtgtatttgcagttg

SEQ ID NO: 252440 - DNA, 15 bp, Homo sapiens
tgtgtatttgcagtt

SEQ ID NO: 252441 - DNA, 15 bp, Homo sapiens
gtgtgtatttgcagt

SEQ ID NO: 252442 - DNA, 15 bp, Homo sapiens
agtgtgtatttgcag

SEQ ID NO: 252443 - DNA, 15 bp, Homo sapiens
aagtgtgtatttgca

SEQ ID NO: 252444 - DNA, 15 bp, Homo sapiens
aaagtgtgtatttgc

SEQ ID NO: 252445 - DNA, 15 bp, Homo sapiens
taaagtgtgtatttg

SEQ ID NO: 252446 - DNA, 15 bp, Homo sapiens
ttaaagtgtgtattt

SEQ ID NO: 252447 - DNA, 15 bp, Homo sapiens
tttaaagtgtgtatt

SEQ ID NO: 252448 - DNA, 15 bp, Homo sapiens
atttaaagtgtgtat

SEQ ID NO: 252449 - DNA, 15 bp, Homo sapiens
tatttaaagtgtgta

SEQ ID NO: 252450 - DNA, 15 bp, Homo sapiens
atatttaaagtgtgt

SEQ ID NO: 252451 - DNA, 15 bp, Homo sapiens
aatatttaaagtgtg

SEQ ID NO: 252452 - DNA, 15 bp, Homo sapiens
aaatatttaaagtgt

SEQ ID NO: 252453 - DNA, 15 bp, Homo sapiens
aaaatatttaaagtg

SEQ ID NO: 252454 - DNA, 15 bp, Homo sapiens
aaaaatatttaaagt

SEQ ID NO: 252455 - DNA, 15 bp, Homo sapiens
gaaaaatatttaaag

SEQ ID NO: 252456 - DNA, 15 bp, Homo sapiens
tgaaaaatatttaaa

SEQ ID NO: 252457 - DNA, 15 bp, Homo sapiens
ttgaaaaatatttaa

SEQ ID NO: 252458 - DNA, 15 bp, Homo sapiens
tttgaaaaatattta

SEQ ID NO: 252459 - DNA, 15 bp, Homo sapiens
ctttgaaaaatattt

SEQ ID NO: 252460 - DNA, 15 bp, Homo sapiens
cctttgaaaaatatt

SEQ ID NO: 252461 - DNA, 15 bp, Homo sapiens
acctttgaaaaatat

SEQ ID NO: 252462 - DNA, 15 bp, Homo sapiens
tacctttgaaaaata

SEQ ID NO: 252463 - DNA, 15 bp, Homo sapiens
ttacctttgaaaaat

SEQ ID NO: 252464 - DNA, 15 bp, Homo sapiens
cttacctttgaaaaa

SEQ ID NO: 252465 - DNA, 15 bp, Homo sapiens
acttacctttgaaaa

SEQ ID NO: 252466 - DNA, 15 bp, Homo sapiens
tacttacctttgaaa

SEQ ID NO: 252467 - DNA, 15 bp, Homo sapiens
atacttacctttgaa

SEQ ID NO: 252468 - DNA, 15 bp, Homo sapiens
catacttacctttga

SEQ ID NO: 252469 - DNA, 15 bp, Homo sapiens
tcatacttacctttg

SEQ ID NO: 252470 - DNA, 15 bp, Homo sapiens
ctcatacttaccttt

SEQ ID NO: 252471 - DNA, 15 bp, Homo sapiens
actcatacttacctt

SEQ ID NO: 252472 - DNA, 15 bp, Homo sapiens
aactcatacttacct

SEQ ID NO: 252473 - DNA, 15 bp, Homo sapiens
taactcatacttacc

SEQ ID NO: 252474 - DNA, 15 bp, Homo sapiens
ataactcatacttac

SEQ ID NO: 252475 - DNA, 15 bp, Homo sapiens
aataactcatactta

SEQ ID NO: 252476 - DNA, 15 bp, Homo sapiens
aaataactcatactt

SEQ ID NO: 252477 - DNA, 15 bp, Homo sapiens
caaataactcatact

SEQ ID NO: 252478 - DNA, 15 bp, Homo sapiens
ccaaataactcatac

SEQ ID NO: 252479 - DNA, 15 bp, Homo sapiens
cccaaataactcata

SEQ ID NO: 252480 - DNA, 15 bp, Homo sapiens
ccccaaataactcat

SEQ ID NO: 252481 - DNA, 15 bp, Homo sapiens
accccaaataactca

SEQ ID NO: 252482 - DNA, 15 bp, Homo sapiens
aaccccaaataactc

SEQ ID NO: 252483 - DNA, 15 bp, Homo sapiens
aaaccccaaataact

SEQ ID NO: 252484 - DNA, 15 bp, Homo sapiens
aaaaccccaaataac

SEQ ID NO: 252485 - DNA, 15 bp, Homo sapiens
aaaaaccccaaataa

SEQ ID NO: 252486 - DNA, 15 bp, Homo sapiens
caaaaaccccaaata

SEQ ID NO: 252487 - DNA, 15 bp, Homo sapiens
acaaaaaccccaaat

SEQ ID NO: 252488 - DNA, 15 bp, Homo sapiens
aacaaaaaccccaaa

SEQ ID NO: 252489 - DNA, 15 bp, Homo sapiens
taacaaaaaccccaa

SEQ ID NO: 252490 - DNA, 15 bp, Homo sapiens
gtaacaaaaacccca

SEQ ID NO: 252491 - DNA, 15 bp, Homo sapiens
ggtaacaaaaacccc

SEQ ID NO: 252492 - DNA, 15 bp, Homo sapiens
aggtaacaaaaaccc

SEQ ID NO: 252493 - DNA, 15 bp, Homo sapiens
caggtaacaaaaacc

SEQ ID NO: 252494 - DNA, 15 bp, Homo sapiens
acaggtaacaaaaac

SEQ ID NO: 252495 - DNA, 15 bp, Homo sapiens
cacaggtaacaaaaa

SEQ ID NO: 252496 - DNA, 15 bp, Homo sapiens
acacaggtaacaaaa

SEQ ID NO: 252497 - DNA, 15 bp, Homo sapiens
tacacaggtaacaaa

SEQ ID NO: 252498 - DNA, 15 bp, Homo sapiens
atacacaggtaacaa

SEQ ID NO: 252499 - DNA, 15 bp, Homo sapiens
tatacacaggtaaca

SEQ ID NO: 252500 - DNA, 15 bp, Homo sapiens
atatacacaggtaac

SEQ ID NO: 252501 - DNA, 15 bp, Homo sapiens
tatatacacaggtaa

SEQ ID NO: 252502 - DNA, 15 bp, Homo sapiens
atatatacacaggta

SEQ ID NO: 252503 - DNA, 15 bp, Homo sapiens
tatatatacacaggt

SEQ ID NO: 252504 - DNA, 15 bp, Homo sapiens
ttatatatacacagg

SEQ ID NO: 252505 - DNA, 15 bp, Homo sapiens
gttatatatacacag

SEQ ID NO: 252506 - DNA, 15 bp, Homo sapiens
tgttatatatacaca

SEQ ID NO: 252507 - DNA, 15 bp, Homo sapiens
ctgttatatatacac

SEQ ID NO: 252508 - DNA, 15 bp, Homo sapiens
actgttatatataca

SEQ ID NO: 252509 - DNA, 15 bp, Homo sapiens
cactgttatatatac

SEQ ID NO: 252510 - DNA, 15 bp, Homo sapiens
tcactgttatatata

SEQ ID NO: 252511 - DNA, 15 bp, Homo sapiens
atcactgttatatat

SEQ ID NO: 252512 - DNA, 15 bp, Homo sapiens
catcactgttatata

SEQ ID NO: 252513 - DNA, 15 bp, Homo sapiens
tcatcactgttatat

SEQ ID NO: 252514 - DNA, 15 bp, Homo sapiens
atcatcactgttata

SEQ ID NO: 252515 - DNA, 15 bp, Homo sapiens
tatcatcactgttat

SEQ ID NO: 252516 - DNA, 15 bp, Homo sapiens
atatcatcactgtta

SEQ ID NO: 252517 - DNA, 15 bp, Homo sapiens
aatatcatcactgtt

SEQ ID NO: 252518 - DNA, 15 bp, Homo sapiens
gaatatcatcactgt

SEQ ID NO: 252519 - DNA, 15 bp, Homo sapiens
aagaatatcatcact

SEQ ID NO: 252520 - DNA, 15 bp, Homo sapiens
aaagaatatcatcac

SEQ ID NO: 252521 - DNA, 15 bp, Homo sapiens
aaaagaatatcatca

SEQ ID NO: 252522 - DNA, 15 bp, Homo sapiens
gaaaagaatatcatc

SEQ ID NO: 252523 - DNA, 15 bp, Homo sapiens
ggaaaagaatatcat

SEQ ID NO: 252524 - DNA, 15 bp, Homo sapiens
gggaaaagaatatca

SEQ ID NO: 252525 - DNA, 15 bp, Homo sapiens
tgggaaaagaatatc

SEQ ID NO: 252526 - DNA, 15 bp, Homo sapiens
ctgggaaaagaatat

SEQ ID NO: 252527 - DNA, 15 bp, Homo sapiens
actgggaaaagaata

SEQ ID NO: 252528 - DNA, 15 bp, Homo sapiens
cactgggaaaagaat

SEQ ID NO: 252529 - DNA, 15 bp, Homo sapiens
tcactgggaaaagaa

SEQ ID NO: 252530 - DNA, 15 bp, Homo sapiens
gtcactgggaaaaga

SEQ ID NO: 252531 - DNA, 15 bp, Homo sapiens
tgtcactgggaaaag

SEQ ID NO: 252532 - DNA, 15 bp, Homo sapiens
atgtcactgggaaaa

SEQ ID NO: 252533 - DNA, 15 bp, Homo sapiens
catgtcactgggaaa

SEQ ID NO: 252534 - DNA, 15 bp, Homo sapiens
gcatgtcactgggaa

SEQ ID NO: 252535 - DNA, 15 bp, Homo sapiens
ggcatgtcactggga

SEQ ID NO: 252536 - DNA, 15 bp, Homo sapiens
gggcatgtcactggg

SEQ ID NO: 252537 - DNA, 15 bp, Homo sapiens
ggggcatgtcactgg

SEQ ID NO: 252538 - DNA, 15 bp, Homo sapiens
tggggcatgtcactg

SEQ ID NO: 252539 - DNA, 15 bp, Homo sapiens
ctggggcatgtcact

SEQ ID NO: 252540 - DNA, 15 bp, Homo sapiens
actggggcatgtcac

SEQ ID NO: 252541 - DNA, 15 bp, Homo sapiens
aactggggcatgtca

SEQ ID NO: 252542 - DNA, 15 bp, Homo sapiens
aaactggggcatgtc

SEQ ID NO: 252543 - DNA, 15 bp, Homo sapiens
aaaactggggcatgt

SEQ ID NO: 252544 - DNA, 15 bp, Homo sapiens
aaaaactggggcatg

SEQ ID NO: 252545 - DNA, 15 bp, Homo sapiens
caaaaactggggcat

SEQ ID NO: 252546 - DNA, 15 bp, Homo sapiens
tcaaaaactggggca

SEQ ID NO: 252547 - DNA, 15 bp, Homo sapiens
atcaaaaactggggc

SEQ ID NO: 252548 - DNA, 15 bp, Homo sapiens
tatcaaaaactgggg

SEQ ID NO: 252549 - DNA, 15 bp, Homo sapiens
atatcaaaaactggg

SEQ ID NO: 252550 - DNA, 15 bp, Homo sapiens
tatatcaaaaactgg

SEQ ID NO: 252551 - DNA, 15 bp, Homo sapiens
atatatcaaaaactg

SEQ ID NO: 252552 - DNA, 15 bp, Homo sapiens
aatatatcaaaaact

SEQ ID NO: 252553 - DNA, 15 bp, Homo sapiens
taatatatcaaaaac

SEQ ID NO: 252554 - DNA, 15 bp, Homo sapiens
gtaatatatcaaaaa

SEQ ID NO: 252555 - DNA, 15 bp, Homo sapiens
tgtaatatatcaaaa

SEQ ID NO: 252556 - DNA, 15 bp, Homo sapiens
atgtaatatatcaaa

SEQ ID NO: 252557 - DNA, 15 bp, Homo sapiens
tatgtaatatatcaa

SEQ ID NO: 252558 - DNA, 15 bp, Homo sapiens
ctatgtaatatatca

SEQ ID NO: 252559 - DNA, 15 bp, Homo sapiens
cctatgtaatatatc

SEQ ID NO: 252560 - DNA, 15 bp, Homo sapiens
gcctatgtaatatat

SEQ ID NO: 252561 - DNA, 15 bp, Homo sapiens
agcctatgtaatata

SEQ ID NO: 252562 - DNA, 15 bp, Homo sapiens
aagcctatgtaatat

SEQ ID NO: 252563 - DNA, 15 bp, Homo sapiens
caagcctatgtaata

SEQ ID NO: 252564 - DNA, 15 bp, Homo sapiens
tcaagcctatgtaat

SEQ ID NO: 252565 - DNA, 15 bp, Homo sapiens
ttcaagcctatgtaa

SEQ ID NO: 252566 - DNA, 15 bp, Homo sapiens
tttcaagcctatgta

SEQ ID NO: 252567 - DNA, 15 bp, Homo sapiens
ttttcaagcctatgt

SEQ ID NO: 252568 - DNA, 15 bp, Homo sapiens
tttttcaagcctatg

SEQ ID NO: 252569 - DNA, 15 bp, Homo sapiens
atttttcaagcctat

SEQ ID NO: 252570 - DNA, 15 bp, Homo sapiens
tatttttcaagccta

SEQ ID NO: 252571 - DNA, 15 bp, Homo sapiens
ttatttttcaagcct

SEQ ID NO: 252572 - DNA, 15 bp, Homo sapiens
attatttttcaagcc

SEQ ID NO: 252573 - DNA, 15 bp, Homo sapiens
aattatttttcaagc

SEQ ID NO: 252574 - DNA, 15 bp, Homo sapiens
aaattatttttcaag

SEQ ID NO: 252575 - DNA, 15 bp, Homo sapiens
gaaattatttttcaa

SEQ ID NO: 252576 - DNA, 15 bp, Homo sapiens
agaaattatttttca

SEQ ID NO: 252577 - DNA, 15 bp, Homo sapiens
gagaaattatttttc

SEQ ID NO: 252578 - DNA, 15 bp, Homo sapiens
agagaaattattttt

SEQ ID NO: 252579 - DNA, 15 bp, Homo sapiens
aagagaaattatttt

SEQ ID NO: 252580 - DNA, 15 bp, Homo sapiens
caagagaaattattt

SEQ ID NO: 252581 - DNA, 15 bp, Homo sapiens
tcaagagaaattatt

SEQ ID NO: 252582 - DNA, 15 bp, Homo sapiens
ttcaagagaaattat

SEQ ID NO: 252583 - DNA, 15 bp, Homo sapiens
attcaagagaaatta

SEQ ID NO: 252584 - DNA, 15 bp, Homo sapiens
aattcaagagaaatt

SEQ ID NO: 252585 - DNA, 15 bp, Homo sapiens
aaattcaagagaaat

SEQ ID NO: 252586 - DNA, 15 bp, Homo sapiens
caaattcaagagaaa

SEQ ID NO: 252587 - DNA, 15 bp, Homo sapiens
tcaaattcaagagaa

SEQ ID NO: 252588 - DNA, 15 bp, Homo sapiens
atcaaattcaagaga

SEQ ID NO: 252589 - DNA, 15 bp, Homo sapiens
aatcaaattcaagag

SEQ ID NO: 252590 - DNA, 15 bp, Homo sapiens
aaatcaaattcaaga

SEQ ID NO: 252591 - DNA, 15 bp, Homo sapiens
aaaatcaaattcaag

SEQ ID NO: 252592 - DNA, 15 bp, Homo sapiens
taaaatcaaattcaa

SEQ ID NO: 252593 - DNA, 15 bp, Homo sapiens
ataaaatcaaattca

SEQ ID NO: 252594 - DNA, 15 bp, Homo sapiens
cataaaatcaaattc

SEQ ID NO: 252595 - DNA, 15 bp, Homo sapiens
tcataaaatcaaatt

SEQ ID NO: 252596 - DNA, 15 bp, Homo sapiens
ttcataaaatcaaat

SEQ ID NO: 252597 - DNA, 15 bp, Homo sapiens
attcataaaatcaaa

SEQ ID NO: 252598 - DNA, 15 bp, Homo sapiens
cattcataaaatcaa

SEQ ID NO: 252599 - DNA, 15 bp, Homo sapiens
acattcataaaatca

SEQ ID NO: 252600 - DNA, 15 bp, Homo sapiens
aacattcataaaatc

SEQ ID NO: 252601 - DNA, 15 bp, Homo sapiens
caacattcataaaat

SEQ ID NO: 252602 - DNA, 15 bp, Homo sapiens
acaacattcataaaa

SEQ ID NO: 252603 - DNA, 15 bp, Homo sapiens
tacaacattcataaa

SEQ ID NO: 252604 - DNA, 15 bp, Homo sapiens
ttacaacattcataa

SEQ ID NO: 252605 - DNA, 15 bp, Homo sapiens
attacaacattcata

SEQ ID NO: 252606 - DNA, 15 bp, Homo sapiens
tattacaacattcat

SEQ ID NO: 252607 - DNA, 15 bp, Homo sapiens
atattacaacattca

SEQ ID NO: 252608 - DNA, 15 bp, Homo sapiens
gatattacaacattc

SEQ ID NO: 252609 - DNA, 15 bp, Homo sapiens
tgatattacaacatt

SEQ ID NO: 252610 - DNA, 15 bp, Homo sapiens
gtgatattacaacat

SEQ ID NO: 252611 - DNA, 15 bp, Homo sapiens
agtgatattacaaca

SEQ ID NO: 252612 - DNA, 15 bp, Homo sapiens
gagtgatattacaac

SEQ ID NO: 252613 - DNA, 15 bp, Homo sapiens
agagtgatattacaa

SEQ ID NO: 252614 - DNA, 15 bp, Homo sapiens
gagagtgatattaca

SEQ ID NO: 252615 - DNA, 15 bp, Homo sapiens
agagagtgatattac

SEQ ID NO: 252616 - DNA, 15 bp, Homo sapiens
aagagagtgatatta

SEQ ID NO: 252617 - DNA, 15 bp, Homo sapiens
taagagagtgatatt

SEQ ID NO: 252618 - DNA, 15 bp, Homo sapiens
ctaagagagtgatat

SEQ ID NO: 252619 - DNA, 15 bp, Homo sapiens
cctaagagagtgata

SEQ ID NO: 252620 - DNA, 15 bp, Homo sapiens
acctaagagagtgat

SEQ ID NO: 252621 - DNA, 15 bp, Homo sapiens
tacctaagagagtga

SEQ ID NO: 252622 - DNA, 15 bp, Homo sapiens
gtacctaagagagtg

SEQ ID NO: 252623 - DNA, 15 bp, Homo sapiens
agtacctaagagagt

SEQ ID NO: 252624 - DNA, 15 bp, Homo sapiens
tagtacctaagagag

SEQ ID NO: 252625 - DNA, 15 bp, Homo sapiens
atagtacctaagaga

SEQ ID NO: 252626 - DNA, 15 bp, Homo sapiens
catagtacctaagag

SEQ ID NO: 252627 - DNA, 15 bp, Homo sapiens
gcatagtacctaaga

SEQ ID NO: 252628 - DNA, 15 bp, Homo sapiens
agcatagtacctaag

SEQ ID NO: 252629 - DNA, 15 bp, Homo sapiens
cagcatagtacctaa

SEQ ID NO: 252630 - DNA, 15 bp, Homo sapiens
ccagcatagtaccta

SEQ ID NO: 252631 - DNA, 15 bp, Homo sapiens
accagcatagtacct

SEQ ID NO: 252632 - DNA, 15 bp, Homo sapiens
aaccagcatagtacc

SEQ ID NO: 252633 - DNA, 15 bp, Homo sapiens
gaaccagcatagtac

SEQ ID NO: 252634 - DNA, 15 bp, Homo sapiens
tgaaccagcatagta

SEQ ID NO: 252635 - DNA, 15 bp, Homo sapiens
atgaaccagcatagt

SEQ ID NO: 252636 - DNA, 15 bp, Homo sapiens
aatgaaccagcatag

SEQ ID NO: 252637 - DNA, 15 bp, Homo sapiens
aaatgaaccagcata

SEQ ID NO: 252638 - DNA, 15 bp, Homo sapiens
taaatgaaccagcat

SEQ ID NO: 252639 - DNA, 15 bp, Homo sapiens
ctaaatgaaccagca

SEQ ID NO: 252640 - DNA, 15 bp, Homo sapiens
actaaatgaaccagc

SEQ ID NO: 252641 - DNA, 15 bp, Homo sapiens
aactaaatgaaccag

SEQ ID NO: 252642 - DNA, 15 bp, Homo sapiens
aaactaaatgaacca

SEQ ID NO: 252643 - DNA, 15 bp, Homo sapiens
taaactaaatgaacc

SEQ ID NO: 252644 - DNA, 15 bp, Homo sapiens
gtaaactaaatgaac

SEQ ID NO: 252645 - DNA, 15 bp, Homo sapiens
agtaaactaaatgaa

SEQ ID NO: 252646 - DNA, 15 bp, Homo sapiens
tagtaaactaaatga

SEQ ID NO: 252647 - DNA, 15 bp, Homo sapiens
ttagtaaactaaatg

SEQ ID NO: 252648 - DNA, 15 bp, Homo sapiens
tttagtaaactaaat

SEQ ID NO: 252649 - DNA, 15 bp, Homo sapiens
atttagtaaactaaa

SEQ ID NO: 252650 - DNA, 15 bp, Homo sapiens
tatttagtaaactaa

SEQ ID NO: 252651 - DNA, 15 bp, Homo sapiens
ctatttagtaaacta

SEQ ID NO: 252652 - DNA, 15 bp, Homo sapiens
actatttagtaaact

SEQ ID NO: 252653 - DNA, 15 bp, Homo sapiens
aactatttagtaaac

SEQ ID NO: 252654 - DNA, 15 bp, Homo sapiens
aaactatttagtaaa

SEQ ID NO: 252655 - DNA, 15 bp, Homo sapiens
aaaactatttagtaa

SEQ ID NO: 252656 - DNA, 15 bp, Homo sapiens
taaaactatttagta

SEQ ID NO: 252657 - DNA, 15 bp, Homo sapiens
ataaaactatttagt

SEQ ID NO: 252658 - DNA, 15 bp, Homo sapiens
tataaaactatttag

SEQ ID NO: 252659 - DNA, 15 bp, Homo sapiens
ttataaaactattta

SEQ ID NO: 252660 - DNA, 15 bp, Homo sapiens
cttataaaactattt

SEQ ID NO: 252661 - DNA, 15 bp, Homo sapiens
tcttataaaactatt

SEQ ID NO: 252662 - DNA, 15 bp, Homo sapiens
ttcttataaaactat

SEQ ID NO: 252663 - DNA, 15 bp, Homo sapiens
gttcttataaaacta

SEQ ID NO: 252664 - DNA, 15 bp, Homo sapiens
agttcttataaaact

SEQ ID NO: 252665 - DNA, 15 bp, Homo sapiens
tagttcttataaaac

SEQ ID NO: 252666 - DNA, 15 bp, Homo sapiens
ctagttcttataaaa

SEQ ID NO: 252667 - DNA, 15 bp, Homo sapiens
cctagttcttataaa

SEQ ID NO: 252668 - DNA, 15 bp, Homo sapiens
acctagttcttataa

SEQ ID NO: 252669 - DNA, 15 bp, Homo sapiens
cacctagttcttata

SEQ ID NO: 252670 - DNA, 15 bp, Homo sapiens
acacctagttcttat

SEQ ID NO: 252671 - DNA, 15 bp, Homo sapiens
gacacctagttctta

SEQ ID NO: 252672 - DNA, 15 bp, Homo sapiens
tgacacctagttctt

SEQ ID NO: 252673 - DNA, 15 bp, Homo sapiens
atgacacctagttct

SEQ ID NO: 252674 - DNA, 15 bp, Homo sapiens
aatgacacctagttc

SEQ ID NO: 252675 - DNA, 15 bp, Homo sapiens
aaatgacacctagtt

SEQ ID NO: 252676 - DNA, 15 bp, Homo sapiens
taaatgacacctagt

SEQ ID NO: 252677 - DNA, 15 bp, Homo sapiens
ttaaatgacacctag

SEQ ID NO: 252678 - DNA, 15 bp, Homo sapiens
cttaaatgacaccta

SEQ ID NO: 252679 - DNA, 15 bp, Homo sapiens
tcttaaatgacacct

SEQ ID NO: 252680 - DNA, 15 bp, Homo sapiens
ttcttaaatgacacc

SEQ ID NO: 252681 - DNA, 15 bp, Homo sapiens
cttcttaaatgacac

SEQ ID NO: 252682 - DNA, 15 bp, Homo sapiens
acttcttaaatgaca

SEQ ID NO: 252683 - DNA, 15 bp, Homo sapiens
gacttcttaaatgac

SEQ ID NO: 252684 - DNA, 15 bp, Homo sapiens
agacttcttaaatga

SEQ ID NO: 252685 - DNA, 15 bp, Homo sapiens
aagacttcttaaatg

SEQ ID NO: 252686 - DNA, 15 bp, Homo sapiens
aaagacttcttaaat

SEQ ID NO: 252687 - DNA, 15 bp, Homo sapiens
caaagacttcttaaa

SEQ ID NO: 252688 - DNA, 15 bp, Homo sapiens
ccaaagacttcttaa

SEQ ID NO: 252689 - DNA, 15 bp, Homo sapiens
tccaaagacttctta

SEQ ID NO: 252690 - DNA, 15 bp, Homo sapiens
ctccaaagacttctt

SEQ ID NO: 252691 - DNA, 15 bp, Homo sapiens
gctccaaagacttct

SEQ ID NO: 252692 - DNA, 15 bp, Homo sapiens
tgctccaaagacttc

SEQ ID NO: 252693 - DNA, 15 bp, Homo sapiens
gtgctccaaagactt

SEQ ID NO: 252694 - DNA, 15 bp, Homo sapiens
agtgctccaaagact

SEQ ID NO: 252695 - DNA, 15 bp, Homo sapiens
tagtgctccaaagac

SEQ ID NO: 252696 - DNA, 15 bp, Homo sapiens
atagtgctccaaaga

SEQ ID NO: 252697 - DNA, 15 bp, Homo sapiens
aatagtgctccaaag

SEQ ID NO: 252698 - DNA, 15 bp, Homo sapiens
taatagtgctccaaa

SEQ ID NO: 252699 - DNA, 15 bp, Homo sapiens
ttaatagtgctccaa

SEQ ID NO: 252700 - DNA, 15 bp, Homo sapiens
tttaatagtgctcca

SEQ ID NO: 252701 - DNA, 15 bp, Homo sapiens
atttaatagtgctcc

SEQ ID NO: 252702 - DNA, 15 bp, Homo sapiens
catttaatagtgctc

SEQ ID NO: 252703 - DNA, 15 bp, Homo sapiens
acatttaatagtgct

SEQ ID NO: 252704 - DNA, 15 bp, Homo sapiens
aacatttaatagtgc

SEQ ID NO: 252705 - DNA, 15 bp, Homo sapiens
taacatttaatagtg

SEQ ID NO: 252706 - DNA, 15 bp, Homo sapiens
ataacatttaatagt

SEQ ID NO: 252707 - DNA, 15 bp, Homo sapiens
cataacatttaatag

SEQ ID NO: 252708 - DNA, 15 bp, Homo sapiens
tcataacatttaata

SEQ ID NO: 252709 - DNA, 15 bp, Homo sapiens
ttcataacatttaat

SEQ ID NO: 252710 - DNA, 15 bp, Homo sapiens
attcataacatttaa

SEQ ID NO: 252711 - DNA, 15 bp, Homo sapiens
gattcataacattta

SEQ ID NO: 252712 - DNA, 15 bp, Homo sapiens
agattcataacattt

SEQ ID NO: 252713 - DNA, 15 bp, Homo sapiens
tagattcataacatt

SEQ ID NO: 252714 - DNA, 15 bp, Homo sapiens
gtagattcataacat

SEQ ID NO: 252715 - DNA, 15 bp, Homo sapiens
ggtagattcataaca

SEQ ID NO: 252716 - DNA, 15 bp, Homo sapiens
gggtagattcataac

SEQ ID NO: 252717 - DNA, 15 bp, Homo sapiens
agggtagattcataa

SEQ ID NO: 252718 - DNA, 15 bp, Homo sapiens
cagggtagattcata

SEQ ID NO: 252719 - DNA, 15 bp, Homo sapiens
tcagggtagattcat

SEQ ID NO: 252720 - DNA, 15 bp, Homo sapiens
gtcagggtagattca

SEQ ID NO: 252721 - DNA, 15 bp, Homo sapiens
ggtcagggtagattc

SEQ ID NO: 252722 - DNA, 15 bp, Homo sapiens
aggtcagggtagatt

SEQ ID NO: 252723 - DNA, 15 bp, Homo sapiens
taggtcagggtagat

SEQ ID NO: 252724 - DNA, 15 bp, Homo sapiens
ctaggtcagggtaga

SEQ ID NO: 252725 - DNA, 15 bp, Homo sapiens
tctaggtcagggtag

SEQ ID NO: 252726 - DNA, 15 bp, Homo sapiens
atctaggtcagggta

SEQ ID NO: 252727 - DNA, 15 bp, Homo sapiens
tatctaggtcagggt

SEQ ID NO: 252728 - DNA, 15 bp, Homo sapiens
ttatctaggtcaggg

SEQ ID NO: 252729 - DNA, 15 bp, Homo sapiens
cttatctaggtcagg

SEQ ID NO: 252730 - DNA, 15 bp, Homo sapiens
ccttatctaggtcag

SEQ ID NO: 252731 - DNA, 15 bp, Homo sapiens
cccttatctaggtca

SEQ ID NO: 252732 - DNA, 15 bp, Homo sapiens
ccccttatctaggtc

SEQ ID NO: 252733 - DNA, 15 bp, Homo sapiens
gccccttatctaggt

SEQ ID NO: 252734 - DNA, 15 bp, Homo sapiens
tgccccttatctagg

SEQ ID NO: 252735 - DNA, 15 bp, Homo sapiens
ctgccccttatctag

SEQ ID NO: 252736 - DNA, 15 bp, Homo sapiens
actgccccttatcta

SEQ ID NO: 252737 - DNA, 15 bp, Homo sapiens
aactgccccttatct

SEQ ID NO: 252738 - DNA, 15 bp, Homo sapiens
taactgccccttatc

SEQ ID NO: 252739 - DNA, 15 bp, Homo sapiens
ttaactgccccttat

SEQ ID NO: 252740 - DNA, 15 bp, Homo sapiens
gttaactgcccctta

SEQ ID NO: 252741 - DNA, 15 bp, Homo sapiens
agttaactgcccctt

SEQ ID NO: 252742 - DNA, 15 bp, Homo sapiens
gagttaactgcccct

SEQ ID NO: 252743 - DNA, 15 bp, Homo sapiens
agagttaactgcccc

SEQ ID NO: 252744 - DNA, 15 bp, Homo sapiens
aagagttaactgccc

SEQ ID NO: 252745 - DNA, 15 bp, Homo sapiens
aaagagttaactgcc

SEQ ID NO: 252746 - DNA, 15 bp, Homo sapiens
aaaagagttaactgc

SEQ ID NO: 252747 - DNA, 15 bp, Homo sapiens
aaaaagagttaactg

SEQ ID NO: 252748 - DNA, 15 bp, Homo sapiens
taaaaagagttaact

SEQ ID NO: 252749 - DNA, 15 bp, Homo sapiens
ttaaaaagagttaac

SEQ ID NO: 252750 - DNA, 15 bp, Homo sapiens
tttaaaaagagttaa

SEQ ID NO: 252751 - DNA, 15 bp, Homo sapiens
atttaaaaagagtta

SEQ ID NO: 252752 - DNA, 15 bp, Homo sapiens
catttaaaaagagtt

SEQ ID NO: 252753 - DNA, 15 bp, Homo sapiens
acatttaaaaagagt

SEQ ID NO: 252754 - DNA, 15 bp, Homo sapiens
tacatttaaaaagag

SEQ ID NO: 252755 - DNA, 15 bp, Homo sapiens
ttacatttaaaaaga

SEQ ID NO: 252756 - DNA, 15 bp, Homo sapiens
cttacatttaaaaag

SEQ ID NO: 252757 - DNA, 15 bp, Homo sapiens
ccttacatttaaaaa

SEQ ID NO: 252758 - DNA, 15 bp, Homo sapiens
gccttacatttaaaa

SEQ ID NO: 252759 - DNA, 15 bp, Homo sapiens
ggccttacatttaaa

SEQ ID NO: 252760 - DNA, 15 bp, Homo sapiens
tggccttacatttaa

SEQ ID NO: 252761 - DNA, 15 bp, Homo sapiens
gtggccttacattta

SEQ ID NO: 252762 - DNA, 15 bp, Homo sapiens
agtggccttacattt

SEQ ID NO: 252763 - DNA, 15 bp, Homo sapiens
cagtggccttacatt

SEQ ID NO: 252764 - DNA, 15 bp, Homo sapiens
tcagtggccttacat

SEQ ID NO: 252765 - DNA, 15 bp, Homo sapiens
gtcagtggccttaca

SEQ ID NO: 252766 - DNA, 15 bp, Homo sapiens
ggtcagtggccttac

SEQ ID NO: 252767 - DNA, 15 bp, Homo sapiens
gggtcagtggcctta

SEQ ID NO: 252768 - DNA, 15 bp, Homo sapiens
tgggtcagtggcctt

SEQ ID NO: 252769 - DNA, 15 bp, Homo sapiens
gtgggtcagtggcct

SEQ ID NO: 252770 - DNA, 15 bp, Homo sapiens
ggtgggtcagtggcc

SEQ ID NO: 252771 - DNA, 15 bp, Homo sapiens
tggtgggtcagtggc

SEQ ID NO: 252772 - DNA, 15 bp, Homo sapiens
ttggtgggtcagtgg

SEQ ID NO: 252773 - DNA, 15 bp, Homo sapiens
tttggtgggtcagtg

SEQ ID NO: 252774 - DNA, 15 bp, Homo sapiens
ctttggtgggtcagt

SEQ ID NO: 252775 - DNA, 15 bp, Homo sapiens
actttggtgggtcag

SEQ ID NO: 252776 - DNA, 15 bp, Homo sapiens
gactttggtgggtca

SEQ ID NO: 252777 - DNA, 15 bp, Homo sapiens
tgactttggtgggtc

SEQ ID NO: 252778 - DNA, 15 bp, Homo sapiens
atgactttggtgggt

SEQ ID NO: 252779 - DNA, 15 bp, Homo sapiens
catgactttggtggg

SEQ ID NO: 252780 - DNA, 15 bp, Homo sapiens
tcatgactttggtgg

SEQ ID NO: 252781 - DNA, 15 bp, Homo sapiens
ttcatgactttggtg

SEQ ID NO: 252782 - DNA, 15 bp, Homo sapiens
gttcatgactttggt

SEQ ID NO: 252783 - DNA, 15 bp, Homo sapiens
agttcatgactttgg

SEQ ID NO: 252784 - DNA, 15 bp, Homo sapiens
cagttcatgactttg

SEQ ID NO: 252785 - DNA, 15 bp, Homo sapiens
acagttcatgacttt

SEQ ID NO: 252786 - DNA, 15 bp, Homo sapiens
aacagttcatgactt

SEQ ID NO: 252787 - DNA, 15 bp, Homo sapiens
aaacagttcatgact

SEQ ID NO: 252788 - DNA, 15 bp, Homo sapiens
taaacagttcatgac

SEQ ID NO: 252789 - DNA, 15 bp, Homo sapiens
gtaaacagttcatga

SEQ ID NO: 252790 - DNA, 15 bp, Homo sapiens
ggtaaacagttcatg

SEQ ID NO: 252791 - DNA, 15 bp, Homo sapiens
aggtaaacagttcat

SEQ ID NO: 252792 - DNA, 15 bp, Homo sapiens
taggtaaacagttca

SEQ ID NO: 252793 - DNA, 15 bp, Homo sapiens
ttaggtaaacagttc

SEQ ID NO: 252794 - DNA, 15 bp, Homo sapiens
cttaggtaaacagtt

SEQ ID NO: 252795 - DNA, 15 bp, Homo sapiens
tcttaggtaaacagt

SEQ ID NO: 252796 - DNA, 15 bp, Homo sapiens
ttcttaggtaaacag

SEQ ID NO: 252797 - DNA, 15 bp, Homo sapiens
tttcttaggtaaaca

SEQ ID NO: 252798 - DNA, 15 bp, Homo sapiens
gtttcttaggtaaac

SEQ ID NO: 252799 - DNA, 15 bp, Homo sapiens
agtttcttaggtaaa

SEQ ID NO: 252800 - DNA, 15 bp, Homo sapiens
aagtttcttaggtaa

SEQ ID NO: 252801 - DNA, 15 bp, Homo sapiens
taagtttcttaggta

SEQ ID NO: 252802 - DNA, 15 bp, Homo sapiens
ttaagtttcttaggt

SEQ ID NO: 252803 - DNA, 15 bp, Homo sapiens
attaagtttcttagg

SEQ ID NO: 252804 - DNA, 15 bp, Homo sapiens
aattaagtttcttag

SEQ ID NO: 252805 - DNA, 15 bp, Homo sapiens
caattaagtttctta

SEQ ID NO: 252806 - DNA, 15 bp, Homo sapiens
tcaattaagtttctt

SEQ ID NO: 252807 - DNA, 15 bp, Homo sapiens
ttcaattaagtttct

SEQ ID NO: 252808 - DNA, 15 bp, Homo sapiens
cttcaattaagtttc

SEQ ID NO: 252809 - DNA, 15 bp, Homo sapiens
gcttcaattaagttt

SEQ ID NO: 252810 - DNA, 15 bp, Homo sapiens
tgcttcaattaagtt

SEQ ID NO: 252811 - DNA, 15 bp, Homo sapiens
atgcttcaattaagt

SEQ ID NO: 252812 - DNA, 15 bp, Homo sapiens
aatgcttcaattaag

SEQ ID NO: 252813 - DNA, 15 bp, Homo sapiens
gaatgcttcaattaa

SEQ ID NO: 252814 - DNA, 15 bp, Homo sapiens
ggaatgcttcaatta

SEQ ID NO: 252815 - DNA, 15 bp, Homo sapiens
tggaatgcttcaatt

SEQ ID NO: 252816 - DNA, 15 bp, Homo sapiens
atggaatgcttcaat

SEQ ID NO: 252817 - DNA, 15 bp, Homo sapiens
aatggaatgcttcaa

SEQ ID NO: 252818 - DNA, 15 bp, Homo sapiens
aaatggaatgcttca

SEQ ID NO: 252819 - DNA, 15 bp, Homo sapiens
taaatggaatgcttc

SEQ ID NO: 252820 - DNA, 15 bp, Homo sapiens
ataaatggaatgctt

SEQ ID NO: 252821 - DNA, 15 bp, Homo sapiens
cataaatggaatgct

SEQ ID NO: 252822 - DNA, 15 bp, Homo sapiens
acataaatggaatgc

SEQ ID NO: 252823 - DNA, 15 bp, Homo sapiens
aacataaatggaatg

SEQ ID NO: 252824 - DNA, 15 bp, Homo sapiens
aaacataaatggaat

SEQ ID NO: 252825 - DNA, 15 bp, Homo sapiens
aaaacataaatggaa

SEQ ID NO: 252826 - DNA, 15 bp, Homo sapiens
taaaacataaatgga

SEQ ID NO: 252827 - DNA, 15 bp, Homo sapiens
ttaaaacataaatgg

SEQ ID NO: 252828 - DNA, 15 bp, Homo sapiens
gttaaaacataaatg

SEQ ID NO: 252829 - DNA, 15 bp, Homo sapiens
ggttaaaacataaat

SEQ ID NO: 252830 - DNA, 15 bp, Homo sapiens
aggttaaaacataaa

SEQ ID NO: 252831 - DNA, 15 bp, Homo sapiens
gaggttaaaacataa

SEQ ID NO: 252832 - DNA, 15 bp, Homo sapiens
tgaggttaaaacata

SEQ ID NO: 252833 - DNA, 15 bp, Homo sapiens
ttgaggttaaaacat

SEQ ID NO: 252834 - DNA, 15 bp, Homo sapiens
attgaggttaaaaca

SEQ ID NO: 252835 - DNA, 15 bp, Homo sapiens
aattgaggttaaaac

SEQ ID NO: 252836 - DNA, 15 bp, Homo sapiens
aaattgaggttaaaa

SEQ ID NO: 252837 - DNA, 15 bp, Homo sapiens
taaattgaggttaaa

SEQ ID NO: 252838 - DNA, 15 bp, Homo sapiens
ataaattgaggttaa

SEQ ID NO: 252839 - DNA, 15 bp, Homo sapiens
aataaattgaggtta

SEQ ID NO: 252840 - DNA, 15 bp, Homo sapiens
taataaattgaggtt

SEQ ID NO: 252841 - DNA, 15 bp, Homo sapiens
gtaataaattgaggt

SEQ ID NO: 252842 - DNA, 15 bp, Homo sapiens
ggtaataaattgagg

SEQ ID NO: 252843 - DNA, 15 bp, Homo sapiens
gggtaataaattgag

SEQ ID NO: 252844 - DNA, 15 bp, Homo sapiens
ggggtaataaattga

SEQ ID NO: 252845 - DNA, 15 bp, Homo sapiens
tggggtaataaattg

SEQ ID NO: 252846 - DNA, 15 bp, Homo sapiens
ttggggtaataaatt

SEQ ID NO: 252847 - DNA, 15 bp, Homo sapiens
tttggggtaataaat

SEQ ID NO: 252848 - DNA, 15 bp, Homo sapiens
ttttggggtaataaa

SEQ ID NO: 252849 - DNA, 15 bp, Homo sapiens
gttttggggtaataa

SEQ ID NO: 252850 - DNA, 15 bp, Homo sapiens
agttttggggtaata

SEQ ID NO: 252851 - DNA, 15 bp, Homo sapiens
aagttttggggtaat

SEQ ID NO: 252852 - DNA, 15 bp, Homo sapiens
gaagttttggggtaa

SEQ ID NO: 252853 - DNA, 15 bp, Homo sapiens
ggaagttttggggta

SEQ ID NO: 252854 - DNA, 15 bp, Homo sapiens
tggaagttttggggt

SEQ ID NO: 252855 - DNA, 15 bp, Homo sapiens
atggaagttttgggg

SEQ ID NO: 252856 - DNA, 15 bp, Homo sapiens
gatggaagttttggg

SEQ ID NO: 252857 - DNA, 15 bp, Homo sapiens
agatggaagttttgg

SEQ ID NO: 252858 - DNA, 15 bp, Homo sapiens
tagatggaagttttg

SEQ ID NO: 252859 - DNA, 15 bp, Homo sapiens
ttagatggaagtttt

SEQ ID NO: 252860 - DNA, 15 bp, Homo sapiens
gttagatggaagttt

SEQ ID NO: 252861 - DNA, 15 bp, Homo sapiens
tgttagatggaagtt

SEQ ID NO: 252862 - DNA, 15 bp, Homo sapiens
atgttagatggaagt

SEQ ID NO: 252863 - DNA, 15 bp, Homo sapiens
tatgttagatggaag

SEQ ID NO: 252864 - DNA, 15 bp, Homo sapiens
atatgttagatggaa

SEQ ID NO: 252865 - DNA, 15 bp, Homo sapiens
catatgttagatgga

SEQ ID NO: 252866 - DNA, 15 bp, Homo sapiens
tcatatgttagatgg

SEQ ID NO: 252867 - DNA, 15 bp, Homo sapiens
ttcatatgttagatg

SEQ ID NO: 252868 - DNA, 15 bp, Homo sapiens
attcatatgttagat

SEQ ID NO: 252869 - DNA, 15 bp, Homo sapiens
aattcatatgttaga

SEQ ID NO: 252870 - DNA, 15 bp, Homo sapiens
taattcatatgttag

SEQ ID NO: 252871 - DNA, 15 bp, Homo sapiens
ctaattcatatgtta

SEQ ID NO: 252872 - DNA, 15 bp, Homo sapiens
actaattcatatgtt

SEQ ID NO: 252873 - DNA, 15 bp, Homo sapiens
aactaattcatatgt

SEQ ID NO: 252874 - DNA, 15 bp, Homo sapiens
aaactaattcatatg

SEQ ID NO: 252875 - DNA, 15 bp, Homo sapiens
aaaactaattcatat

SEQ ID NO: 252876 - DNA, 15 bp, Homo sapiens
caaaactaattcata

SEQ ID NO: 252877 - DNA, 15 bp, Homo sapiens
tcaaaactaattcat

SEQ ID NO: 252878 - DNA, 15 bp, Homo sapiens
ttcaaaactaattca

SEQ ID NO: 252879 - DNA, 15 bp, Homo sapiens
tttcaaaactaattc

SEQ ID NO: 252880 - DNA, 15 bp, Homo sapiens
taaatttcaaaacta

SEQ ID NO: 252881 - DNA, 15 bp, Homo sapiens
gtaaatttcaaaact

SEQ ID NO: 252882 - DNA, 15 bp, Homo sapiens
tgtaaatttcaaaac

SEQ ID NO: 252883 - DNA, 15 bp, Homo sapiens
ctgtaaatttcaaaa

SEQ ID NO: 252884 - DNA, 15 bp, Homo sapiens
tctgtaaatttcaaa

SEQ ID NO: 252885 - DNA, 15 bp, Homo sapiens
ttctgtaaatttcaa

SEQ ID NO: 252886 - DNA, 15 bp, Homo sapiens
tttctgtaaatttca

SEQ ID NO: 252887 - DNA, 15 bp, Homo sapiens
ttttctgtaaatttc

SEQ ID NO: 252888 - DNA, 15 bp, Homo sapiens
tttttctgtaaattt

SEQ ID NO: 252889 - DNA, 15 bp, Homo sapiens
ctttttctgtaaatt

SEQ ID NO: 252890 - DNA, 15 bp, Homo sapiens
tctttttctgtaaat

SEQ ID NO: 252891 - DNA, 15 bp, Homo sapiens
ctctttttctgtaaa

SEQ ID NO: 252892 - DNA, 15 bp, Homo sapiens
tctctttttctgtaa

SEQ ID NO: 252893 - DNA, 15 bp, Homo sapiens
ttctctttttctgta

SEQ ID NO: 252894 - DNA, 15 bp, Homo sapiens
tttctctttttctgt

SEQ ID NO: 252895 - DNA, 15 bp, Homo sapiens
actttctctttttct

SEQ ID NO: 252896 - DNA, 15 bp, Homo sapiens
tactttctctttttc

SEQ ID NO: 252897 - DNA, 15 bp, Homo sapiens
atactttctcttttt

SEQ ID NO: 252898 - DNA, 15 bp, Homo sapiens
tatactttctctttt

SEQ ID NO: 252899 - DNA, 15 bp, Homo sapiens
ttatactttctcttt

SEQ ID NO: 252900 - DNA, 15 bp, Homo sapiens
tttatactttctctt

SEQ ID NO: 252901 - DNA, 15 bp, Homo sapiens
ttttatactttctct

SEQ ID NO: 252902 - DNA, 15 bp, Homo sapiens
gttttatactttctc

SEQ ID NO: 252903 - DNA, 15 bp, Homo sapiens
agttttatactttct

SEQ ID NO: 252904 - DNA, 15 bp, Homo sapiens
aagttttatactttc

SEQ ID NO: 252905 - DNA, 15 bp, Homo sapiens
caagttttatacttt

SEQ ID NO: 252906 - DNA, 15 bp, Homo sapiens
gcaagttttatactt

SEQ ID NO: 252907 - DNA, 15 bp, Homo sapiens
agcaagttttatact

SEQ ID NO: 252908 - DNA, 15 bp, Homo sapiens
aagcaagttttatac

SEQ ID NO: 252909 - DNA, 15 bp, Homo sapiens
aaagcaagttttata

SEQ ID NO: 252910 - DNA, 15 bp, Homo sapiens
aaaagcaagttttat

SEQ ID NO: 252911 - DNA, 15 bp, Homo sapiens
taaaagcaagtttta

SEQ ID NO: 252912 - DNA, 15 bp, Homo sapiens
ttaaaagcaagtttt

SEQ ID NO: 252913 - DNA, 15 bp, Homo sapiens
tttaaaagcaagttt

SEQ ID NO: 252914 - DNA, 15 bp, Homo sapiens
ctttaaaagcaagtt

SEQ ID NO: 252915 - DNA, 15 bp, Homo sapiens
actttaaaagcaagt

SEQ ID NO: 252916 - DNA, 15 bp, Homo sapiens
cactttaaaagcaag

SEQ ID NO: 252917 - DNA, 15 bp, Homo sapiens
tcactttaaaagcaa

SEQ ID NO: 252918 - DNA, 15 bp, Homo sapiens
ttcactttaaaagca

SEQ ID NO: 252919 - DNA, 15 bp, Homo sapiens
cttcactttaaaagc

SEQ ID NO: 252920 - DNA, 15 bp, Homo sapiens
tcttcactttaaaag

SEQ ID NO: 252921 - DNA, 15 bp, Homo sapiens
ttcttcactttaaaa

SEQ ID NO: 252922 - DNA, 15 bp, Homo sapiens
gttcttcactttaaa

SEQ ID NO: 252923 - DNA, 15 bp, Homo sapiens
tgttcttcactttaa

SEQ ID NO: 252924 - DNA, 15 bp, Homo sapiens
atgttcttcacttta

SEQ ID NO: 252925 - DNA, 15 bp, Homo sapiens
catgttcttcacttt

SEQ ID NO: 252926 - DNA, 15 bp, Homo sapiens
tcatgttcttcactt

SEQ ID NO: 252927 - DNA, 15 bp, Homo sapiens
ctcatgttcttcact

SEQ ID NO: 252928 - DNA, 15 bp, Homo sapiens
cctcatgttcttcac

SEQ ID NO: 252929 - DNA, 15 bp, Homo sapiens
tcctcatgttcttca

SEQ ID NO: 252930 - DNA, 15 bp, Homo sapiens
ttcctcatgttcttc

SEQ ID NO: 252931 - DNA, 15 bp, Homo sapiens
tttcctcatgttctt

SEQ ID NO: 252932 - DNA, 15 bp, Homo sapiens
ttttcctcatgttct

SEQ ID NO: 252933 - DNA, 15 bp, Homo sapiens
gttttcctcatgttc

SEQ ID NO: 252934 - DNA, 15 bp, Homo sapiens
tgttttcctcatgtt

SEQ ID NO: 252935 - DNA, 15 bp, Homo sapiens
ttgttttcctcatgt

SEQ ID NO: 252936 - DNA, 15 bp, Homo sapiens
attgttttcctcatg

SEQ ID NO: 252937 - DNA, 15 bp, Homo sapiens
aattgttttcctcat

SEQ ID NO: 252938 - DNA, 15 bp, Homo sapiens
aaattgttttcctca

SEQ ID NO: 252939 - DNA, 15 bp, Homo sapiens
taaattgttttcctc

SEQ ID NO: 252940 - DNA, 15 bp, Homo sapiens
ttaaattgttttcct

SEQ ID NO: 252941 - DNA, 15 bp, Homo sapiens
attaaattgttttcc

SEQ ID NO: 252942 - DNA, 15 bp, Homo sapiens
tattaaattgttttc

SEQ ID NO: 252943 - DNA, 15 bp, Homo sapiens
gtattaaattgtttt

SEQ ID NO: 252944 - DNA, 15 bp, Homo sapiens
tgtattaaattgttt

SEQ ID NO: 252945 - DNA, 15 bp, Homo sapiens
atgtattaaattgtt

SEQ ID NO: 252946 - DNA, 15 bp, Homo sapiens
tatgtattaaattgt

SEQ ID NO: 252947 - DNA, 15 bp, Homo sapiens
atatgtattaaattg

SEQ ID NO: 252948 - DNA, 15 bp, Homo sapiens
tatatgtattaaatt

SEQ ID NO: 252949 - DNA, 15 bp, Homo sapiens
ctatatgtattaaat

SEQ ID NO: 252950 - DNA, 15 bp, Homo sapiens
tctatatgtattaaa

SEQ ID NO: 252951 - DNA, 15 bp, Homo sapiens
ttctatatgtattaa

SEQ ID NO: 252952 - DNA, 15 bp, Homo sapiens
tttctatatgtatta

SEQ ID NO: 252953 - DNA, 15 bp, Homo sapiens
ttttctatatgtatt

SEQ ID NO: 252954 - DNA, 15 bp, Homo sapiens
attttctatatgtat

SEQ ID NO: 252955 - DNA, 15 bp, Homo sapiens
tattttctatatgta

SEQ ID NO: 252956 - DNA, 15 bp, Homo sapiens
ttattttctatatgt

SEQ ID NO: 252957 - DNA, 15 bp, Homo sapiens
attattttctatatg

SEQ ID NO: 252958 - DNA, 15 bp, Homo sapiens
tattattttctatat

SEQ ID NO: 252959 - DNA, 15 bp, Homo sapiens
ttattattttctata

SEQ ID NO: 252960 - DNA, 15 bp, Homo sapiens
attattattttctat

SEQ ID NO: 252961 - DNA, 15 bp, Homo sapiens
tattattattttcta

SEQ ID NO: 252962 - DNA, 15 bp, Homo sapiens
gtattattattttct

SEQ ID NO: 252963 - DNA, 15 bp, Homo sapiens
agtattattattttc

SEQ ID NO: 252964 - DNA, 15 bp, Homo sapiens
cagtattattatttt

SEQ ID NO: 252965 - DNA, 15 bp, Homo sapiens
ccagtattattattt

SEQ ID NO: 252966 - DNA, 15 bp, Homo sapiens
accagtattattatt

SEQ ID NO: 252967 - DNA, 15 bp, Homo sapiens
aaccagtattattat

SEQ ID NO: 252968 - DNA, 15 bp, Homo sapiens
taaccagtattatta

SEQ ID NO: 252969 - DNA, 15 bp, Homo sapiens
ttaaccagtattatt

SEQ ID NO: 252970 - DNA, 15 bp, Homo sapiens
attaaccagtattat

SEQ ID NO: 252971 - DNA, 15 bp, Homo sapiens
cattaaccagtatta

SEQ ID NO: 252972 - DNA, 15 bp, Homo sapiens
tcattaaccagtatt

SEQ ID NO: 252973 - DNA, 15 bp, Homo sapiens
ctcattaaccagtat

SEQ ID NO: 252974 - DNA, 15 bp, Homo sapiens
tctcattaaccagta

SEQ ID NO: 252975 - DNA, 15 bp, Homo sapiens
ctctcattaaccagt

SEQ ID NO: 252976 - DNA, 15 bp, Homo sapiens
cctctcattaaccag

SEQ ID NO: 252977 - DNA, 15 bp, Homo sapiens
tcctctcattaacca

SEQ ID NO: 252978 - DNA, 15 bp, Homo sapiens
ttcctctcattaacc

SEQ ID NO: 252979 - DNA, 15 bp, Homo sapiens
cttcctctcattaac

SEQ ID NO: 252980 - DNA, 15 bp, Homo sapiens
gcttcctctcattaa

SEQ ID NO: 252981 - DNA, 15 bp, Homo sapiens
agcttcctctcatta

SEQ ID NO: 252982 - DNA, 15 bp, Homo sapiens
cagcttcctctcatt

SEQ ID NO: 252983 - DNA, 15 bp, Homo sapiens
tcagcttcctctcat

SEQ ID NO: 252984 - DNA, 15 bp, Homo sapiens
ctcagcttcctctca

SEQ ID NO: 252985 - DNA, 15 bp, Homo sapiens
tctcagcttcctctc

SEQ ID NO: 252986 - DNA, 15 bp, Homo sapiens
ttctcagcttcctct

SEQ ID NO: 252987 - DNA, 15 bp, Homo sapiens
cttctcagcttcctc

SEQ ID NO: 252988 - DNA, 15 bp, Homo sapiens
tcttctcagcttcct

SEQ ID NO: 252989 - DNA, 15 bp, Homo sapiens
ctcttctcagcttcc

SEQ ID NO: 252990 - DNA, 15 bp, Homo sapiens
cctcttctcagcttc

SEQ ID NO: 252991 - DNA, 15 bp, Homo sapiens
tcctcttctcagctt

SEQ ID NO: 252992 - DNA, 15 bp, Homo sapiens
ttcctcttctcagct

SEQ ID NO: 252993 - DNA, 15 bp, Homo sapiens
gttcctcttctcagc

SEQ ID NO: 252994 - DNA, 15 bp, Homo sapiens
tgttcctcttctcag

SEQ ID NO: 252995 - DNA, 15 bp, Homo sapiens
gtgttcctcttctca

SEQ ID NO: 252996 - DNA, 15 bp, Homo sapiens
tgtgttcctcttctc

SEQ ID NO: 252997 - DNA, 15 bp, Homo sapiens
ctgtgttcctcttct

SEQ ID NO: 252998 - DNA, 15 bp, Homo sapiens
tctgtgttcctcttc

SEQ ID NO: 252999 - DNA, 15 bp, Homo sapiens
ctctgtgttcctctt

SEQ ID NO: 253000 - DNA, 15 bp, Homo sapiens
actctgtgttcctct

SEQ ID NO: 253001 - DNA, 15 bp, Homo sapiens
gactctgtgttcctc

SEQ ID NO: 253002 - DNA, 15 bp, Homo sapiens
agactctgtgttcct

SEQ ID NO: 253003 - DNA, 15 bp, Homo sapiens
tagactctgtgttcc

SEQ ID NO: 253004 - DNA, 15 bp, Homo sapiens
ttagactctgtgttc

SEQ ID NO: 253005 - DNA, 15 bp, Homo sapiens
cttagactctgtgtt

SEQ ID NO: 253006 - DNA, 15 bp, Homo sapiens
acttagactctgtgt

SEQ ID NO: 253007 - DNA, 15 bp, Homo sapiens
cacttagactctgtg

SEQ ID NO: 253008 - DNA, 15 bp, Homo sapiens
ccacttagactctgt

SEQ ID NO: 253009 - DNA, 15 bp, Homo sapiens
gccacttagactctg

SEQ ID NO: 253010 - DNA, 15 bp, Homo sapiens
tgccacttagactct

SEQ ID NO: 253011 - DNA, 15 bp, Homo sapiens
ttgccacttagactc

SEQ ID NO: 253012 - DNA, 15 bp, Homo sapiens
cttgccacttagact

SEQ ID NO: 253013 - DNA, 15 bp, Homo sapiens
tcttgccacttagac

SEQ ID NO: 253014 - DNA, 15 bp, Homo sapiens
ctcttgccacttaga

SEQ ID NO: 253015 - DNA, 15 bp, Homo sapiens
tctcttgccacttag

SEQ ID NO: 253016 - DNA, 15 bp, Homo sapiens
gtctcttgccactta

SEQ ID NO: 253017 - DNA, 15 bp, Homo sapiens
tgtctcttgccactt

SEQ ID NO: 253018 - DNA, 15 bp, Homo sapiens
gtgtctcttgccact

SEQ ID NO: 253019 - DNA, 15 bp, Homo sapiens
agtgtctcttgccac

SEQ ID NO: 253020 - DNA, 15 bp, Homo sapiens
aagtgtctcttgcca

SEQ ID NO: 253021 - DNA, 15 bp, Homo sapiens
caagtgtctcttgcc

SEQ ID NO: 253022 - DNA, 15 bp, Homo sapiens
gcaagtgtctcttgc

SEQ ID NO: 253023 - DNA, 15 bp, Homo sapiens
ggcaagtgtctcttg

SEQ ID NO: 253024 - DNA, 15 bp, Homo sapiens
aggcaagtgtctctt

SEQ ID NO: 253025 - DNA, 15 bp, Homo sapiens
caggcaagtgtctct

SEQ ID NO: 253026 - DNA, 15 bp, Homo sapiens
tcaggcaagtgtctc

SEQ ID NO: 253027 - DNA, 15 bp, Homo sapiens
ctcaggcaagtgtct

SEQ ID NO: 253028 - DNA, 15 bp, Homo sapiens
cctcaggcaagtgtc

SEQ ID NO: 253029 - DNA, 15 bp, Homo sapiens
ccctcaggcaagtgt

SEQ ID NO: 253030 - DNA, 15 bp, Homo sapiens
cccctcaggcaagtg

SEQ ID NO: 253031 - DNA, 15 bp, Homo sapiens
tcccctcaggcaagt

SEQ ID NO: 253032 - DNA, 15 bp, Homo sapiens
ctcccctcaggcaag

SEQ ID NO: 253033 - DNA, 15 bp, Homo sapiens
actcccctcaggcaa

SEQ ID NO: 253034 - DNA, 15 bp, Homo sapiens
cactcccctcaggca

SEQ ID NO: 253035 - DNA, 15 bp, Homo sapiens
ccactcccctcaggc

SEQ ID NO: 253036 - DNA, 15 bp, Homo sapiens
cccactcccctcagg

SEQ ID NO: 253037 - DNA, 15 bp, Homo sapiens
ccccactcccctcag

SEQ ID NO: 253038 - DNA, 15 bp, Homo sapiens
tccccactcccctca

SEQ ID NO: 253039 - DNA, 15 bp, Homo sapiens
ttccccactcccctc

SEQ ID NO: 253040 - DNA, 15 bp, Homo sapiens
attccccactcccct

SEQ ID NO: 253041 - DNA, 15 bp, Homo sapiens
gattccccactcccc

SEQ ID NO: 253042 - DNA, 15 bp, Homo sapiens
ggattccccactccc

SEQ ID NO: 253043 - DNA, 15 bp, Homo sapiens
tggattccccactcc

SEQ ID NO: 253044 - DNA, 15 bp, Homo sapiens
ctggattccccactc

SEQ ID NO: 253045 - DNA, 15 bp, Homo sapiens
tctggattccccact

SEQ ID NO: 253046 - DNA, 15 bp, Homo sapiens
atctggattccccac

SEQ ID NO: 253047 - DNA, 15 bp, Homo sapiens
tatctggattcccca

SEQ ID NO: 253048 - DNA, 15 bp, Homo sapiens
gtatctggattcccc

SEQ ID NO: 253049 - DNA, 15 bp, Homo sapiens
tgtatctggattccc

SEQ ID NO: 253050 - DNA, 15 bp, Homo sapiens
gtgtatctggattcc

SEQ ID NO: 253051 - DNA, 15 bp, Homo sapiens
tgtgtatctggattc

SEQ ID NO: 253052 - DNA, 15 bp, Homo sapiens
atgtgtatctggatt

SEQ ID NO: 253053 - DNA, 15 bp, Homo sapiens
catgtgtatctggat

SEQ ID NO: 253054 - DNA, 15 bp, Homo sapiens
tcatgtgtatctgga

SEQ ID NO: 253055 - DNA, 15 bp, Homo sapiens
ttcatgtgtatctgg

SEQ ID NO: 253056 - DNA, 15 bp, Homo sapiens
cttcatgtgtatctg

SEQ ID NO: 253057 - DNA, 15 bp, Homo sapiens
tcttcatgtgtatct

SEQ ID NO: 253058 - DNA, 15 bp, Homo sapiens
ctcttcatgtgtatc

SEQ ID NO: 253059 - DNA, 15 bp, Homo sapiens
tctcttcatgtgtat

SEQ ID NO: 253060 - DNA, 15 bp, Homo sapiens
ttctcttcatgtgta

SEQ ID NO: 253061 - DNA, 15 bp, Homo sapiens
cttctcttcatgtgt

SEQ ID NO: 253062 - DNA, 15 bp, Homo sapiens
tcttctcttcatgtg

SEQ ID NO: 253063 - DNA, 15 bp, Homo sapiens
ttcttctcttcatgt

SEQ ID NO: 253064 - DNA, 15 bp, Homo sapiens
tttcttctcttcatg

SEQ ID NO: 253065 - DNA, 15 bp, Homo sapiens
ctttcttctcttcat

SEQ ID NO: 253066 - DNA, 15 bp, Homo sapiens
cctttcttctcttca

SEQ ID NO: 253067 - DNA, 15 bp, Homo sapiens
ccctttcttctcttc

SEQ ID NO: 253068 - DNA, 15 bp, Homo sapiens
accctttcttctctt

SEQ ID NO: 253069 - DNA, 15 bp, Homo sapiens
taccctttcttctct

SEQ ID NO: 253070 - DNA, 15 bp, Homo sapiens
ctaccctttcttctc

SEQ ID NO: 253071 - DNA, 15 bp, Homo sapiens
tctaccctttcttct

SEQ ID NO: 253072 - DNA, 15 bp, Homo sapiens
atctaccctttcttc

SEQ ID NO: 253073 - DNA, 15 bp, Homo sapiens
aatctaccctttctt

SEQ ID NO: 253074 - DNA, 15 bp, Homo sapiens
aaatctaccctttct

SEQ ID NO: 253075 - DNA, 15 bp, Homo sapiens
caaatctaccctttc

SEQ ID NO: 253076 - DNA, 15 bp, Homo sapiens
gcaaatctacccttt

SEQ ID NO: 253077 - DNA, 15 bp, Homo sapiens
tgcaaatctaccctt

SEQ ID NO: 253078 - DNA, 15 bp, Homo sapiens
gtgcaaatctaccct

SEQ ID NO: 253079 - DNA, 15 bp, Homo sapiens
agtgcaaatctaccc

SEQ ID NO: 253080 - DNA, 15 bp, Homo sapiens
cagtgcaaatctacc

SEQ ID NO: 253081 - DNA, 15 bp, Homo sapiens
tcagtgcaaatctac

SEQ ID NO: 253082 - DNA, 15 bp, Homo sapiens
ctcagtgcaaatcta

SEQ ID NO: 253083 - DNA, 15 bp, Homo sapiens
cctcagtgcaaatct

SEQ ID NO: 253084 - DNA, 15 bp, Homo sapiens
tcctcagtgcaaatc

SEQ ID NO: 253085 - DNA, 15 bp, Homo sapiens
ttcctcagtgcaaat

SEQ ID NO: 253086 - DNA, 15 bp, Homo sapiens
tttcctcagtgcaaa

SEQ ID NO: 253087 - DNA, 15 bp, Homo sapiens
ctttcctcagtgcaa

SEQ ID NO: 253088 - DNA, 15 bp, Homo sapiens
actttcctcagtgca

SEQ ID NO: 253089 - DNA, 15 bp, Homo sapiens
aactttcctcagtgc

SEQ ID NO: 253090 - DNA, 15 bp, Homo sapiens
gaactttcctcagtg

SEQ ID NO: 253091 - DNA, 15 bp, Homo sapiens
cgaactttcctcagt

SEQ ID NO: 253092 - DNA, 15 bp, Homo sapiens
tcgaactttcctcag

SEQ ID NO: 253093 - DNA, 15 bp, Homo sapiens
gtcgaactttcctca

SEQ ID NO: 253094 - DNA, 15 bp, Homo sapiens
agtcgaactttcctc

SEQ ID NO: 253095 - DNA, 15 bp, Homo sapiens
gagtcgaactttcct

SEQ ID NO: 253096 - DNA, 15 bp, Homo sapiens
tgagtcgaactttcc

SEQ ID NO: 253097 - DNA, 15 bp, Homo sapiens
ttgagtcgaactttc

SEQ ID NO: 253098 - DNA, 15 bp, Homo sapiens
cttgagtcgaacttt

SEQ ID NO: 253099 - DNA, 15 bp, Homo sapiens
ccttgagtcgaactt

SEQ ID NO: 253100 - DNA, 15 bp, Homo sapiens
accttgagtcgaact

SEQ ID NO: 253101 - DNA, 15 bp, Homo sapiens
taccttgagtcgaac

SEQ ID NO: 253102 - DNA, 15 bp, Homo sapiens
ctaccttgagtcgaa

SEQ ID NO: 253103 - DNA, 15 bp, Homo sapiens
tctaccttgagtcga

SEQ ID NO: 253104 - DNA, 15 bp, Homo sapiens
ttctaccttgagtcg

SEQ ID NO: 253105 - DNA, 15 bp, Homo sapiens
cttctaccttgagtc

SEQ ID NO: 253106 - DNA, 15 bp, Homo sapiens
tcttctaccttgagt

SEQ ID NO: 253107 - DNA, 15 bp, Homo sapiens
ctcttctaccttgag

SEQ ID NO: 253108 - DNA, 15 bp, Homo sapiens
cctcttctaccttga

SEQ ID NO: 253109 - DNA, 15 bp, Homo sapiens
tcctcttctaccttg

SEQ ID NO: 253110 - DNA, 15 bp, Homo sapiens
ctcctcttctacctt

SEQ ID NO: 253111 - DNA, 15 bp, Homo sapiens
cctcctcttctacct

SEQ ID NO: 253112 - DNA, 15 bp, Homo sapiens
ccctcctcttctacc

SEQ ID NO: 253113 - DNA, 15 bp, Homo sapiens
tccctcctcttctac

SEQ ID NO: 253114 - DNA, 15 bp, Homo sapiens
ctccctcctcttcta

SEQ ID NO: 253115 - DNA, 15 bp, Homo sapiens
cctccctcctcttct

SEQ ID NO: 253116 - DNA, 15 bp, Homo sapiens
gcctccctcctcttc

SEQ ID NO: 253117 - DNA, 15 bp, Homo sapiens
agcctccctcctctt

SEQ ID NO: 253118 - DNA, 15 bp, Homo sapiens
gagcctccctcctct

SEQ ID NO: 253119 - DNA, 15 bp, Homo sapiens
agagcctccctcctc

SEQ ID NO: 253120 - DNA, 15 bp, Homo sapiens
cagagcctccctcct

SEQ ID NO: 253121 - DNA, 15 bp, Homo sapiens
acagagcctccctcc

SEQ ID NO: 253122 - DNA, 15 bp, Homo sapiens
tacagagcctccctc

SEQ ID NO: 253123 - DNA, 15 bp, Homo sapiens
ctacagagcctccct

SEQ ID NO: 253124 - DNA, 15 bp, Homo sapiens
tctacagagcctccc

SEQ ID NO: 253125 - DNA, 15 bp, Homo sapiens
atctacagagcctcc

SEQ ID NO: 253126 - DNA, 15 bp, Homo sapiens
aatctacagagcctc

SEQ ID NO: 253127 - DNA, 15 bp, Homo sapiens
caatctacagagcct

SEQ ID NO: 253128 - DNA, 15 bp, Homo sapiens
acaatctacagagcc

SEQ ID NO: 253129 - DNA, 15 bp, Homo sapiens
cacaatctacagagc

SEQ ID NO: 253130 - DNA, 15 bp, Homo sapiens
ccacaatctacagag

SEQ ID NO: 253131 - DNA, 15 bp, Homo sapiens
cccacaatctacaga

SEQ ID NO: 253132 - DNA, 15 bp, Homo sapiens
tcccacaatctacag

SEQ ID NO: 253133 - DNA, 15 bp, Homo sapiens
atcccacaatctaca

SEQ ID NO: 253134 - DNA, 15 bp, Homo sapiens
catcccacaatctac

SEQ ID NO: 253135 - DNA, 15 bp, Homo sapiens
tcatcccacaatcta

SEQ ID NO: 253136 - DNA, 15 bp, Homo sapiens
atcatcccacaatct

SEQ ID NO: 253137 - DNA, 15 bp, Homo sapiens
catcatcccacaatc

SEQ ID NO: 253138 - DNA, 15 bp, Homo sapiens
acatcatcccacaat

SEQ ID NO: 253139 - DNA, 15 bp, Homo sapiens
aacatcatcccacaa

SEQ ID NO: 253140 - DNA, 15 bp, Homo sapiens
taacatcatcccaca

SEQ ID NO: 253141 - DNA, 15 bp, Homo sapiens
ataacatcatcccac

SEQ ID NO: 253142 - DNA, 15 bp, Homo sapiens
aataacatcatccca

SEQ ID NO: 253143 - DNA, 15 bp, Homo sapiens
gaataacatcatccc

SEQ ID NO: 253144 - DNA, 15 bp, Homo sapiens
tgaataacatcatcc

SEQ ID NO: 253145 - DNA, 15 bp, Homo sapiens
ctgaataacatcatc

SEQ ID NO: 253146 - DNA, 15 bp, Homo sapiens
tctgaataacatcat

SEQ ID NO: 253147 - DNA, 15 bp, Homo sapiens
ctctgaataacatca

SEQ ID NO: 253148 - DNA, 15 bp, Homo sapiens
actctgaataacatc

SEQ ID NO: 253149 - DNA, 15 bp, Homo sapiens
aactctgaataacat

SEQ ID NO: 253150 - DNA, 15 bp, Homo sapiens
taactctgaataaca

SEQ ID NO: 253151 - DNA, 15 bp, Homo sapiens
ttaactctgaataac

SEQ ID NO: 253152 - DNA, 15 bp, Homo sapiens
tttaactctgaataa

SEQ ID NO: 253153 - DNA, 15 bp, Homo sapiens
gtttaactctgaata

SEQ ID NO: 253154 - DNA, 15 bp, Homo sapiens
agtttaactctgaat

SEQ ID NO: 253155 - DNA, 15 bp, Homo sapiens
aagtttaactctgaa

SEQ ID NO: 253156 - DNA, 15 bp, Homo sapiens
caagtttaactctga

SEQ ID NO: 253157 - DNA, 15 bp, Homo sapiens
acaagtttaactctg

SEQ ID NO: 253158 - DNA, 15 bp, Homo sapiens
aacaagtttaactct

SEQ ID NO: 253159 - DNA, 15 bp, Homo sapiens
aaacaagtttaactc

SEQ ID NO: 253160 - DNA, 15 bp, Homo sapiens
gaaacaagtttaact

SEQ ID NO: 253161 - DNA, 15 bp, Homo sapiens
agaaacaagtttaac

SEQ ID NO: 253162 - DNA, 15 bp, Homo sapiens
cagaaacaagtttaa

SEQ ID NO: 253163 - DNA, 15 bp, Homo sapiens
gcagaaacaagttta

SEQ ID NO: 253164 - DNA, 15 bp, Homo sapiens
tgcagaaacaagttt

SEQ ID NO: 253165 - DNA, 15 bp, Homo sapiens
ttgcagaaacaagtt

SEQ ID NO: 253166 - DNA, 15 bp, Homo sapiens
attgcagaaacaagt

SEQ ID NO: 253167 - DNA, 15 bp, Homo sapiens
gattgcagaaacaag

SEQ ID NO: 253168 - DNA, 15 bp, Homo sapiens
agattgcagaaacaa

SEQ ID NO: 253169 - DNA, 15 bp, Homo sapiens
aagattgcagaaaca

SEQ ID NO: 253170 - DNA, 15 bp, Homo sapiens
aaagattgcagaaac

SEQ ID NO: 253171 - DNA, 15 bp, Homo sapiens
caaagattgcagaaa

SEQ ID NO: 253172 - DNA, 15 bp, Homo sapiens
ccaaagattgcagaa

SEQ ID NO: 253173 - DNA, 15 bp, Homo sapiens
tccaaagattgcaga

SEQ ID NO: 253174 - DNA, 15 bp, Homo sapiens
ttccaaagattgcag

SEQ ID NO: 253175 - DNA, 15 bp, Homo sapiens
tttccaaagattgca

SEQ ID NO: 253176 - DNA, 15 bp, Homo sapiens
atttccaaagattgc

SEQ ID NO: 253177 - DNA, 15 bp, Homo sapiens
tatttccaaagattg

SEQ ID NO: 253178 - DNA, 15 bp, Homo sapiens
atatttccaaagatt

SEQ ID NO: 253179 - DNA, 15 bp, Homo sapiens
catatttccaaagat

SEQ ID NO: 253180 - DNA, 15 bp, Homo sapiens
tcatatttccaaaga

SEQ ID NO: 253181 - DNA, 15 bp, Homo sapiens
gtcatatttccaaag

SEQ ID NO: 253182 - DNA, 15 bp, Homo sapiens
cgtcatatttccaaa

SEQ ID NO: 253183 - DNA, 15 bp, Homo sapiens
tcgtcatatttccaa

SEQ ID NO: 253184 - DNA, 15 bp, Homo sapiens
ctcgtcatatttcca

SEQ ID NO: 253185 - DNA, 15 bp, Homo sapiens
tctcgtcatatttcc

SEQ ID NO: 253186 - DNA, 15 bp, Homo sapiens
gtctcgtcatatttc

SEQ ID NO: 253187 - DNA, 15 bp, Homo sapiens
agtctcgtcatattt

SEQ ID NO: 253188 - DNA, 15 bp, Homo sapiens
aagtctcgtcatatt

SEQ ID NO: 253189 - DNA, 15 bp, Homo sapiens
aaagtctcgtcatat

SEQ ID NO: 253190 - DNA, 15 bp, Homo sapiens
aaaagtctcgtcata

SEQ ID NO: 253191 - DNA, 15 bp, Homo sapiens
taaaagtctcgtcat

SEQ ID NO: 253192 - DNA, 15 bp, Homo sapiens
ttaaaagtctcgtca

SEQ ID NO: 253193 - DNA, 15 bp, Homo sapiens
cttaaaagtctcgtc

SEQ ID NO: 253194 - DNA, 15 bp, Homo sapiens
ccttaaaagtctcgt

SEQ ID NO: 253195 - DNA, 15 bp, Homo sapiens
accttaaaagtctcg

SEQ ID NO: 253196 - DNA, 15 bp, Homo sapiens
caccttaaaagtctc

SEQ ID NO: 253197 - DNA, 15 bp, Homo sapiens
acaccttaaaagtct

SEQ ID NO: 253198 - DNA, 15 bp, Homo sapiens
tacaccttaaaagtc

SEQ ID NO: 253199 - DNA, 15 bp, Homo sapiens
ctacaccttaaaagt

SEQ ID NO: 253200 - DNA, 15 bp, Homo sapiens
actacaccttaaaag

SEQ ID NO: 253201 - DNA, 15 bp, Homo sapiens
cactacaccttaaaa

SEQ ID NO: 253202 - DNA, 15 bp, Homo sapiens
tcactacaccttaaa

SEQ ID NO: 253203 - DNA, 15 bp, Homo sapiens
gtcactacaccttaa

SEQ ID NO: 253204 - DNA, 15 bp, Homo sapiens
agtcactacacctta

SEQ ID NO: 253205 - DNA, 15 bp, Homo sapiens
gagtcactacacctt

SEQ ID NO: 253206 - DNA, 15 bp, Homo sapiens
ggagtcactacacct

SEQ ID NO: 253207 - DNA, 15 bp, Homo sapiens
gggagtcactacacc

SEQ ID NO: 253208 - DNA, 15 bp, Homo sapiens
tgggagtcactacac

SEQ ID NO: 253209 - DNA, 15 bp, Homo sapiens
gtgggagtcactaca

SEQ ID NO: 253210 - DNA, 15 bp, Homo sapiens
tgtgggagtcactac

SEQ ID NO: 253211 - DNA, 15 bp, Homo sapiens
ctgtgggagtcacta

SEQ ID NO: 253212 - DNA, 15 bp, Homo sapiens
gctgtgggagtcact

SEQ ID NO: 253213 - DNA, 15 bp, Homo sapiens
tgctgtgggagtcac

SEQ ID NO: 253214 - DNA, 15 bp, Homo sapiens
gtgctgtgggagtca

SEQ ID NO: 253215 - DNA, 15 bp, Homo sapiens
agtgctgtgggagtc

SEQ ID NO: 253216 - DNA, 15 bp, Homo sapiens
tagtgctgtgggagt

SEQ ID NO: 253217 - DNA, 15 bp, Homo sapiens
gtagtgctgtgggag

SEQ ID NO: 253218 - DNA, 15 bp, Homo sapiens
agtagtgctgtggga

SEQ ID NO: 253219 - DNA, 15 bp, Homo sapiens
aagtagtgctgtggg

SEQ ID NO: 253220 - DNA, 15 bp, Homo sapiens
gaagtagtgctgtgg

SEQ ID NO: 253221 - DNA, 15 bp, Homo sapiens
agaagtagtgctgtg

SEQ ID NO: 253222 - DNA, 15 bp, Homo sapiens
cagaagtagtgctgt

SEQ ID NO: 253223 - DNA, 15 bp, Homo sapiens
gcagaagtagtgctg

SEQ ID NO: 253224 - DNA, 15 bp, Homo sapiens
agcagaagtagtgct

SEQ ID NO: 253225 - DNA, 15 bp, Homo sapiens
cagcagaagtagtgc

SEQ ID NO: 253226 - DNA, 15 bp, Homo sapiens
acagcagaagtagtg

SEQ ID NO: 253227 - DNA, 15 bp, Homo sapiens
aacagcagaagtagt

SEQ ID NO: 253228 - DNA, 15 bp, Homo sapiens
caacagcagaagtag

SEQ ID NO: 253229 - DNA, 15 bp, Homo sapiens
ccaacagcagaagta

SEQ ID NO: 253230 - DNA, 15 bp, Homo sapiens
tccaacagcagaagt

SEQ ID NO: 253231 - DNA, 15 bp, Homo sapiens
ctccaacagcagaag

SEQ ID NO: 253232 - DNA, 15 bp, Homo sapiens
cctccaacagcagaa

SEQ ID NO: 253233 - DNA, 15 bp, Homo sapiens
tcctccaacagcaga

SEQ ID NO: 253234 - DNA, 15 bp, Homo sapiens
atcctccaacagcag

SEQ ID NO: 253235 - DNA, 15 bp, Homo sapiens
aatcctccaacagca

SEQ ID NO: 253236 - DNA, 15 bp, Homo sapiens
gaatcctccaacagc

SEQ ID NO: 253237 - DNA, 15 bp, Homo sapiens
cgaatcctccaacag

SEQ ID NO: 253238 - DNA, 15 bp, Homo sapiens
acgaatcctccaaca

SEQ ID NO: 253239 - DNA, 15 bp, Homo sapiens
aacgaatcctccaac

SEQ ID NO: 253240 - DNA, 15 bp, Homo sapiens
gaacgaatcctccaa

SEQ ID NO: 253241 - DNA, 15 bp, Homo sapiens
agaacgaatcctcca

SEQ ID NO: 253242 - DNA, 15 bp, Homo sapiens
cagaacgaatcctcc

SEQ ID NO: 253243 - DNA, 15 bp, Homo sapiens
tcagaacgaatcctc

SEQ ID NO: 253244 - DNA, 15 bp, Homo sapiens
ttcagaacgaatcct

SEQ ID NO: 253245 - DNA, 15 bp, Homo sapiens
attcagaacgaatcc

SEQ ID NO: 253246 - DNA, 15 bp, Homo sapiens
cattcagaacgaatc

SEQ ID NO: 253247 - DNA, 15 bp, Homo sapiens
tcattcagaacgaat

SEQ ID NO: 253248 - DNA, 15 bp, Homo sapiens
atcattcagaacgaa

SEQ ID NO: 253249 - DNA, 15 bp, Homo sapiens
tatcattcagaacga

SEQ ID NO: 253250 - DNA, 15 bp, Homo sapiens
ttatcattcagaacg

SEQ ID NO: 253251 - DNA, 15 bp, Homo sapiens
attatcattcagaac

SEQ ID NO: 253252 - DNA, 15 bp, Homo sapiens
gattatcattcagaa

SEQ ID NO: 253253 - DNA, 15 bp, Homo sapiens
agattatcattcaga

SEQ ID NO: 253254 - DNA, 15 bp, Homo sapiens
tagattatcattcag

SEQ ID NO: 253255 - DNA, 15 bp, Homo sapiens
gtagattatcattca

SEQ ID NO: 253256 - DNA, 15 bp, Homo sapiens
tgtagattatcattc

SEQ ID NO: 253257 - DNA, 15 bp, Homo sapiens
atgtagattatcatt

SEQ ID NO: 253258 - DNA, 15 bp, Homo sapiens
gatgtagattatcat

SEQ ID NO: 253259 - DNA, 15 bp, Homo sapiens
agatgtagattatca

SEQ ID NO: 253260 - DNA, 15 bp, Homo sapiens
cagatgtagattatc

SEQ ID NO: 253261 - DNA, 15 bp, Homo sapiens
acagatgtagattat

SEQ ID NO: 253262 - DNA, 15 bp, Homo sapiens
aacagatgtagatta

SEQ ID NO: 253263 - DNA, 15 bp, Homo sapiens
aaacagatgtagatt

SEQ ID NO: 253264 - DNA, 15 bp, Homo sapiens
taaacagatgtagat

SEQ ID NO: 253265 - DNA, 15 bp, Homo sapiens
ttaaacagatgtaga

SEQ ID NO: 253266 - DNA, 15 bp, Homo sapiens
gttaaacagatgtag

SEQ ID NO: 253267 - DNA, 15 bp, Homo sapiens
tgttaaacagatgta

SEQ ID NO: 253268 - DNA, 15 bp, Homo sapiens
ctgttaaacagatgt

SEQ ID NO: 253269 - DNA, 15 bp, Homo sapiens
tctgttaaacagatg

SEQ ID NO: 253270 - DNA, 15 bp, Homo sapiens
atctgttaaacagat

SEQ ID NO: 253271 - DNA, 15 bp, Homo sapiens
tatctgttaaacaga

SEQ ID NO: 253272 - DNA, 15 bp, Homo sapiens
atatctgttaaacag

SEQ ID NO: 253273 - DNA, 15 bp, Homo sapiens
catatctgttaaaca

SEQ ID NO: 253274 - DNA, 15 bp, Homo sapiens
ccatatctgttaaac

SEQ ID NO: 253275 - DNA, 15 bp, Homo sapiens
cccatatctgttaaa

SEQ ID NO: 253276 - DNA, 15 bp, Homo sapiens
acccatatctgttaa

SEQ ID NO: 253277 - DNA, 15 bp, Homo sapiens
aacccatatctgtta

SEQ ID NO: 253278 - DNA, 15 bp, Homo sapiens
aaacccatatctgtt

SEQ ID NO: 253279 - DNA, 15 bp, Homo sapiens
taaacccatatctgt

SEQ ID NO: 253280 - DNA, 15 bp, Homo sapiens
ataaacccatatctg

SEQ ID NO: 253281 - DNA, 15 bp, Homo sapiens
aataaacccatatct

SEQ ID NO: 253282 - DNA, 15 bp, Homo sapiens
gaataaacccatatc

SEQ ID NO: 253283 - DNA, 15 bp, Homo sapiens
agaataaacccatat

SEQ ID NO: 253284 - DNA, 15 bp, Homo sapiens
cagaataaacccata

SEQ ID NO: 253285 - DNA, 15 bp, Homo sapiens
ccagaataaacccat

SEQ ID NO: 253286 - DNA, 15 bp, Homo sapiens
tccagaataaaccca

SEQ ID NO: 253287 - DNA, 15 bp, Homo sapiens
ctccagaataaaccc

SEQ ID NO: 253288 - DNA, 15 bp, Homo sapiens
gctccagaataaacc

SEQ ID NO: 253289 - DNA, 15 bp, Homo sapiens
ggctccagaataaac

SEQ ID NO: 253290 - DNA, 15 bp, Homo sapiens
aggctccagaataaa

SEQ ID NO: 253291 - DNA, 15 bp, Homo sapiens
caggctccagaataa

SEQ ID NO: 253292 - DNA, 15 bp, Homo sapiens
gcaggctccagaata

SEQ ID NO: 253293 - DNA, 15 bp, Homo sapiens
tgcaggctccagaat

SEQ ID NO: 253294 - DNA, 15 bp, Homo sapiens
atgcaggctccagaa

SEQ ID NO: 253295 - DNA, 15 bp, Homo sapiens
aatgcaggctccaga

SEQ ID NO: 253296 - DNA, 15 bp, Homo sapiens
caatgcaggctccag

SEQ ID NO: 253297 - DNA, 15 bp, Homo sapiens
tcaatgcaggctcca

SEQ ID NO: 253298 - DNA, 15 bp, Homo sapiens
atcaatgcaggctcc

SEQ ID NO: 253299 - DNA, 15 bp, Homo sapiens
gatcaatgcaggctc

SEQ ID NO: 253300 - DNA, 15 bp, Homo sapiens
agatcaatgcaggct

SEQ ID NO: 253301 - DNA, 15 bp, Homo sapiens
cagatcaatgcaggc

SEQ ID NO: 253302 - DNA, 15 bp, Homo sapiens
ccagatcaatgcagg

SEQ ID NO: 253303 - DNA, 15 bp, Homo sapiens
gccagatcaatgcag

SEQ ID NO: 253304 - DNA, 15 bp, Homo sapiens
ggccagatcaatgca

SEQ ID NO: 253305 - DNA, 15 bp, Homo sapiens
tggccagatcaatgc

SEQ ID NO: 253306 - DNA, 15 bp, Homo sapiens
gtggccagatcaatg

SEQ ID NO: 253307 - DNA, 15 bp, Homo sapiens
tgtggccagatcaat

SEQ ID NO: 253308 - DNA, 15 bp, Homo sapiens
atgtggccagatcaa

SEQ ID NO: 253309 - DNA, 15 bp, Homo sapiens
gatgtggccagatca

SEQ ID NO: 253310 - DNA, 15 bp, Homo sapiens
tgatgtggccagatc

SEQ ID NO: 253311 - DNA, 15 bp, Homo sapiens
ttgatgtggccagat

SEQ ID NO: 253312 - DNA, 15 bp, Homo sapiens
cttgatgtggccaga

SEQ ID NO: 253313 - DNA, 15 bp, Homo sapiens
gcttgatgtggccag

SEQ ID NO: 253314 - DNA, 15 bp, Homo sapiens
ggcttgatgtggcca

SEQ ID NO: 253315 - DNA, 15 bp, Homo sapiens
tggcttgatgtggcc

SEQ ID NO: 253316 - DNA, 15 bp, Homo sapiens
ctggcttgatgtggc

SEQ ID NO: 253317 - DNA, 15 bp, Homo sapiens
cctggcttgatgtgg

SEQ ID NO: 253318 - DNA, 15 bp, Homo sapiens
tcctggcttgatgtg

SEQ ID NO: 253319 - DNA, 15 bp, Homo sapiens
gtcctggcttgatgt

SEQ ID NO: 253320 - DNA, 15 bp, Homo sapiens
ggtcctggcttgatg

SEQ ID NO: 253321 - DNA, 15 bp, Homo sapiens
cggtcctggcttgat

SEQ ID NO: 253322 - DNA, 15 bp, Homo sapiens
tcggtcctggcttga

SEQ ID NO: 253323 - DNA, 15 bp, Homo sapiens
ttcggtcctggcttg

SEQ ID NO: 253324 - DNA, 15 bp, Homo sapiens
cttcggtcctggctt

SEQ ID NO: 253325 - DNA, 15 bp, Homo sapiens
ccttcggtcctggct

SEQ ID NO: 253326 - DNA, 15 bp, Homo sapiens
cccttcggtcctggc

SEQ ID NO: 253327 - DNA, 15 bp, Homo sapiens
acccttcggtcctgg

SEQ ID NO: 253328 - DNA, 15 bp, Homo sapiens
aacccttcggtcctg

SEQ ID NO: 253329 - DNA, 15 bp, Homo sapiens
gaacccttcggtcct

SEQ ID NO: 253330 - DNA, 15 bp, Homo sapiens
tgaacccttcggtcc

SEQ ID NO: 253331 - DNA, 15 bp, Homo sapiens
atgaacccttcggtc

SEQ ID NO: 253332 - DNA, 15 bp, Homo sapiens
catgaacccttcggt

SEQ ID NO: 253333 - DNA, 15 bp, Homo sapiens
tcatgaacccttcgg

SEQ ID NO: 253334 - DNA, 15 bp, Homo sapiens
gtcatgaacccttcg

SEQ ID NO: 253335 - DNA, 15 bp, Homo sapiens
tgtcatgaacccttc

SEQ ID NO: 253336 - DNA, 15 bp, Homo sapiens
ctgtcatgaaccctt

SEQ ID NO: 253337 - DNA, 15 bp, Homo sapiens
actgtcatgaaccct

SEQ ID NO: 253338 - DNA, 15 bp, Homo sapiens
gactgtcatgaaccc

SEQ ID NO: 253339 - DNA, 15 bp, Homo sapiens
tgactgtcatgaacc

SEQ ID NO: 253340 - DNA, 15 bp, Homo sapiens
gtgactgtcatgaac

SEQ ID NO: 253341 - DNA, 15 bp, Homo sapiens
tgtgactgtcatgaa

SEQ ID NO: 253342 - DNA, 15 bp, Homo sapiens
atgtgactgtcatga

SEQ ID NO: 253343 - DNA, 15 bp, Homo sapiens
aatgtgactgtcatg

SEQ ID NO: 253344 - DNA, 15 bp, Homo sapiens
aaatgtgactgtcat

SEQ ID NO: 253345 - DNA, 15 bp, Homo sapiens
aaaatgtgactgtca

SEQ ID NO: 253346 - DNA, 15 bp, Homo sapiens
taaaatgtgactgtc

SEQ ID NO: 253347 - DNA, 15 bp, Homo sapiens
ataaaatgtgactgt

SEQ ID NO: 253348 - DNA, 15 bp, Homo sapiens
tataaaatgtgactg

SEQ ID NO: 253349 - DNA, 15 bp, Homo sapiens
atataaaatgtgact

SEQ ID NO: 253350 - DNA, 15 bp, Homo sapiens
gatataaaatgtgac

SEQ ID NO: 253351 - DNA, 15 bp, Homo sapiens
agatataaaatgtga

SEQ ID NO: 253352 - DNA, 15 bp, Homo sapiens
tagatataaaatgtg

SEQ ID NO: 253353 - DNA, 15 bp, Homo sapiens
ctagatataaaatgt

SEQ ID NO: 253354 - DNA, 15 bp, Homo sapiens
cctagatataaaatg

SEQ ID NO: 253355 - DNA, 15 bp, Homo sapiens
acctagatataaaat

SEQ ID NO: 253356 - DNA, 15 bp, Homo sapiens
aacctagatataaaa

SEQ ID NO: 253357 - DNA, 15 bp, Homo sapiens
aaacctagatataaa

SEQ ID NO: 253358 - DNA, 15 bp, Homo sapiens
aaaacctagatataa

SEQ ID NO: 253359 - DNA, 15 bp, Homo sapiens
taaaacctagatata

SEQ ID NO: 253360 - DNA, 15 bp, Homo sapiens
ttaaaacctagatat

SEQ ID NO: 253361 - DNA, 15 bp, Homo sapiens
attaaaacctagata

SEQ ID NO: 253362 - DNA, 15 bp, Homo sapiens
aattaaaacctagat

SEQ ID NO: 253363 - DNA, 15 bp, Homo sapiens
aaattaaaacctaga

SEQ ID NO: 253364 - DNA, 15 bp, Homo sapiens
caaattaaaacctag

SEQ ID NO: 253365 - DNA, 15 bp, Homo sapiens
acaaattaaaaccta

SEQ ID NO: 253366 - DNA, 15 bp, Homo sapiens
tacaaattaaaacct

SEQ ID NO: 253367 - DNA, 15 bp, Homo sapiens
ctacaaattaaaacc

SEQ ID NO: 253368 - DNA, 15 bp, Homo sapiens
actacaaattaaaac

SEQ ID NO: 253369 - DNA, 15 bp, Homo sapiens
aactacaaattaaaa

SEQ ID NO: 253370 - DNA, 15 bp, Homo sapiens
aaactacaaattaaa

SEQ ID NO: 253371 - DNA, 15 bp, Homo sapiens
gaaactacaaattaa

SEQ ID NO: 253372 - DNA, 15 bp, Homo sapiens
tgaaactacaaatta

SEQ ID NO: 253373 - DNA, 15 bp, Homo sapiens
ctgaaactacaaatt

SEQ ID NO: 253374 - DNA, 15 bp, Homo sapiens
actgaaactacaaat

SEQ ID NO: 253375 - DNA, 15 bp, Homo sapiens
aactgaaactacaaa

SEQ ID NO: 253376 - DNA, 15 bp, Homo sapiens
gaactgaaactacaa

SEQ ID NO: 253377 - DNA, 15 bp, Homo sapiens
agaactgaaactaca

SEQ ID NO: 253378 - DNA, 15 bp, Homo sapiens
cagaactgaaactac

SEQ ID NO: 253379 - DNA, 15 bp, Homo sapiens
acagaactgaaacta

SEQ ID NO: 253380 - DNA, 15 bp, Homo sapiens
aacagaactgaaact

SEQ ID NO: 253381 - DNA, 15 bp, Homo sapiens
aaacagaactgaaac

SEQ ID NO: 253382 - DNA, 15 bp, Homo sapiens
caaacagaactgaaa

SEQ ID NO: 253383 - DNA, 15 bp, Homo sapiens
tcaaacagaactgaa

SEQ ID NO: 253384 - DNA, 15 bp, Homo sapiens
ttcaaacagaactga

SEQ ID NO: 253385 - DNA, 15 bp, Homo sapiens
tttcaaacagaactg

SEQ ID NO: 253386 - DNA, 15 bp, Homo sapiens
atttcaaacagaact

SEQ ID NO: 253387 - DNA, 15 bp, Homo sapiens
tatttcaaacagaac

SEQ ID NO: 253388 - DNA, 15 bp, Homo sapiens
ctatttcaaacagaa

SEQ ID NO: 253389 - DNA, 15 bp, Homo sapiens
cctatttcaaacaga

SEQ ID NO: 253390 - DNA, 15 bp, Homo sapiens
gcctatttcaaacag

SEQ ID NO: 253391 - DNA, 15 bp, Homo sapiens
tgcctatttcaaaca

SEQ ID NO: 253392 - DNA, 15 bp, Homo sapiens
ttgcctatttcaaac

SEQ ID NO: 253393 - DNA, 15 bp, Homo sapiens
tttgcctatttcaaa

SEQ ID NO: 253394 - DNA, 15 bp, Homo sapiens
ctttgcctatttcaa

SEQ ID NO: 253395 - DNA, 15 bp, Homo sapiens
gctttgcctatttca

SEQ ID NO: 253396 - DNA, 15 bp, Homo sapiens
tgctttgcctatttc

SEQ ID NO: 253397 - DNA, 15 bp, Homo sapiens
ttgctttgcctattt

SEQ ID NO: 253398 - DNA, 15 bp, Homo sapiens
tttgctttgcctatt

SEQ ID NO: 253399 - DNA, 15 bp, Homo sapiens
ctttgctttgcctat

SEQ ID NO: 253400 - DNA, 15 bp, Homo sapiens
tctttgctttgccta

SEQ ID NO: 253401 - DNA, 15 bp, Homo sapiens
atctttgctttgcct

SEQ ID NO: 253402 - DNA, 15 bp, Homo sapiens
aatctttgctttgcc

SEQ ID NO: 253403 - DNA, 15 bp, Homo sapiens
aaatctttgctttgc

SEQ ID NO: 253404 - DNA, 15 bp, Homo sapiens
gaaatctttgctttg

SEQ ID NO: 253405 - DNA, 15 bp, Homo sapiens
tgaaatctttgcttt

SEQ ID NO: 253406 - DNA, 15 bp, Homo sapiens
atgaaatctttgctt

SEQ ID NO: 253407 - DNA, 15 bp, Homo sapiens
aatgaaatctttgct

SEQ ID NO: 253408 - DNA, 15 bp, Homo sapiens
aaatgaaatctttgc

SEQ ID NO: 253409 - DNA, 15 bp, Homo sapiens
caaatgaaatctttg

SEQ ID NO: 253410 - DNA, 15 bp, Homo sapiens
acaaatgaaatcttt

SEQ ID NO: 253411 - DNA, 15 bp, Homo sapiens
cacaaatgaaatctt

SEQ ID NO: 253412 - DNA, 15 bp, Homo sapiens
acacaaatgaaatct

SEQ ID NO: 253413 - DNA, 15 bp, Homo sapiens
aacacaaatgaaatc

SEQ ID NO: 253414 - DNA, 15 bp, Homo sapiens
aaacacaaatgaaat

SEQ ID NO: 253415 - DNA, 15 bp, Homo sapiens
aaaacacaaatgaaa

SEQ ID NO: 253416 - DNA, 15 bp, Homo sapiens
aaaaacacaaatgaa

SEQ ID NO: 253417 - DNA, 15 bp, Homo sapiens
taaaaacacaaatga

SEQ ID NO: 253418 - DNA, 15 bp, Homo sapiens
gtaaaaacacaaatg

SEQ ID NO: 253419 - DNA, 15 bp, Homo sapiens
tgtaaaaacacaaat

SEQ ID NO: 253420 - DNA, 15 bp, Homo sapiens
ttgtaaaaacacaaa

SEQ ID NO: 253421 - DNA, 15 bp, Homo sapiens
attgtaaaaacacaa

SEQ ID NO: 253422 - DNA, 15 bp, Homo sapiens
cattgtaaaaacaca

SEQ ID NO: 253423 - DNA, 15 bp, Homo sapiens
acattgtaaaaacac

SEQ ID NO: 253424 - DNA, 15 bp, Homo sapiens
tacattgtaaaaaca

SEQ ID NO: 253425 - DNA, 15 bp, Homo sapiens
ctacattgtaaaaac

SEQ ID NO: 253426 - DNA, 15 bp, Homo sapiens
actacattgtaaaaa

SEQ ID NO: 253427 - DNA, 15 bp, Homo sapiens
aactacattgtaaaa

SEQ ID NO: 253428 - DNA, 15 bp, Homo sapiens
caactacattgtaaa

SEQ ID NO: 253429 - DNA, 15 bp, Homo sapiens
gcaactacattgtaa

SEQ ID NO: 253430 - DNA, 15 bp, Homo sapiens
agcaactacattgta

SEQ ID NO: 253431 - DNA, 15 bp, Homo sapiens
gagcaactacattgt

SEQ ID NO: 253432 - DNA, 15 bp, Homo sapiens
tgagcaactacattg

SEQ ID NO: 253433 - DNA, 15 bp, Homo sapiens
ttgagcaactacatt

SEQ ID NO: 253434 - DNA, 15 bp, Homo sapiens
tttgagcaactacat

SEQ ID NO: 253435 - DNA, 15 bp, Homo sapiens
atttgagcaactaca

SEQ ID NO: 253436 - DNA, 15 bp, Homo sapiens
catttgagcaactac

SEQ ID NO: 253437 - DNA, 15 bp, Homo sapiens
tcatttgagcaacta

SEQ ID NO: 253438 - DNA, 15 bp, Homo sapiens
ttcatttgagcaact

SEQ ID NO: 253439 - DNA, 15 bp, Homo sapiens
tttcatttgagcaac

SEQ ID NO: 253440 - DNA, 15 bp, Homo sapiens
atttcatttgagcaa

SEQ ID NO: 253441 - DNA, 15 bp, Homo sapiens
aatttcatttgagca

SEQ ID NO: 253442 - DNA, 15 bp, Homo sapiens
aaatttcatttgagc

SEQ ID NO: 253443 - DNA, 15 bp, Homo sapiens
taaatttcatttgag

SEQ ID NO: 253444 - DNA, 15 bp, Homo sapiens
ataaatttcatttga

SEQ ID NO: 253445 - DNA, 15 bp, Homo sapiens
aataaatttcatttg

SEQ ID NO: 253446 - DNA, 15 bp, Homo sapiens
taataaatttcattt

SEQ ID NO: 253447 - DNA, 15 bp, Homo sapiens
ataataaatttcatt

SEQ ID NO: 253448 - DNA, 15 bp, Homo sapiens
aataataaatttcat

SEQ ID NO: 253449 - DNA, 15 bp, Homo sapiens
taataataaatttca

SEQ ID NO: 253450 - DNA, 15 bp, Homo sapiens
ttaataataaatttc

SEQ ID NO: 253451 - DNA, 15 bp, Homo sapiens
tttaataataaattt

SEQ ID NO: 253452 - DNA, 15 bp, Homo sapiens
ttttaataataaatt

SEQ ID NO: 253453 - DNA, 15 bp, Homo sapiens
tttttaataataaat

SEQ ID NO: 253454 - DNA, 15 bp, Homo sapiens
ttttttaataataaa

SEQ ID NO: 253455 - DNA, 15 bp, Homo sapiens
attttttaataataa

SEQ ID NO: 253456 - DNA, 15 bp, Homo sapiens
aattttttaataata

SEQ ID NO: 253457 - DNA, 15 bp, Homo sapiens
aaattttttaataat

SEQ ID NO: 253458 - DNA, 15 bp, Homo sapiens
aaaattttttaataa

SEQ ID NO: 253459 - DNA, 15 bp, Homo sapiens
taaaaattttttaat

SEQ ID NO: 253460 - DNA, 15 bp, Homo sapiens
ataaaaattttttaa

SEQ ID NO: 253461 - DNA, 15 bp, Homo sapiens
tataaaaatttttta

SEQ ID NO: 253462 - DNA, 15 bp, Homo sapiens
ttataaaaatttttt

SEQ ID NO: 253463 - DNA, 15 bp, Homo sapiens
tttataaaaattttt

SEQ ID NO: 253464 - DNA, 15 bp, Homo sapiens
ttttataaaaatttt

SEQ ID NO: 253465 - DNA, 15 bp, Homo sapiens
tttttataaaaattt

SEQ ID NO: 253466 - DNA, 15 bp, Homo sapiens
ttttttataaaaatt

SEQ ID NO: 253467 - DNA, 15 bp, Homo sapiens
gttttttataaaaat

SEQ ID NO: 253468 - DNA, 15 bp, Homo sapiens
agttttttataaaaa

SEQ ID NO: 253469 - DNA, 15 bp, Homo sapiens
aagttttttataaaa

SEQ ID NO: 253470 - DNA, 15 bp, Homo sapiens
aaagttttttataaa

SEQ ID NO: 253471 - DNA, 15 bp, Homo sapiens
aaaagttttttataa

SEQ ID NO: 253472 - DNA, 15 bp, Homo sapiens
caaaagttttttata

SEQ ID NO: 253473 - DNA, 15 bp, Homo sapiens
acaaaagttttttat

SEQ ID NO: 253474 - DNA, 15 bp, Homo sapiens
tacaaaagtttttta

SEQ ID NO: 253475 - DNA, 15 bp, Homo sapiens
atacaaaagtttttt

SEQ ID NO: 253476 - DNA, 15 bp, Homo sapiens
tatacaaaagttttt

SEQ ID NO: 253477 - DNA, 15 bp, Homo sapiens
ctatacaaaagtttt

SEQ ID NO: 253478 - DNA, 15 bp, Homo sapiens
tctatacaaaagttt

SEQ ID NO: 253479 - DNA, 15 bp, Homo sapiens
ctctatacaaaagtt

SEQ ID NO: 253480 - DNA, 15 bp, Homo sapiens
tctctatacaaaagt

SEQ ID NO: 253481 - DNA, 15 bp, Homo sapiens
atctctatacaaaag

SEQ ID NO: 253482 - DNA, 15 bp, Homo sapiens
catctctatacaaaa

SEQ ID NO: 253483 - DNA, 15 bp, Homo sapiens
tcatctctatacaaa

SEQ ID NO: 253484 - DNA, 15 bp, Homo sapiens
ctcatctctatacaa

SEQ ID NO: 253485 - DNA, 15 bp, Homo sapiens
cctcatctctataca

SEQ ID NO: 253486 - DNA, 15 bp, Homo sapiens
acctcatctctatac

SEQ ID NO: 253487 - DNA, 15 bp, Homo sapiens
gacctcatctctata

SEQ ID NO: 253488 - DNA, 15 bp, Homo sapiens
agacctcatctctat

SEQ ID NO: 253489 - DNA, 15 bp, Homo sapiens
gagacctcatctcta

SEQ ID NO: 253490 - DNA, 15 bp, Homo sapiens
cgagacctcatctct

SEQ ID NO: 253491 - DNA, 15 bp, Homo sapiens
gcgagacctcatctc

SEQ ID NO: 253492 - DNA, 15 bp, Homo sapiens
agcgagacctcatct

SEQ ID NO: 253493 - DNA, 15 bp, Homo sapiens
tagcgagacctcatc

SEQ ID NO: 253494 - DNA, 15 bp, Homo sapiens
atagcgagacctcat

SEQ ID NO: 253495 - DNA, 15 bp, Homo sapiens
catagcgagacctca

SEQ ID NO: 253496 - DNA, 15 bp, Homo sapiens
acatagcgagacctc

SEQ ID NO: 253497 - DNA, 15 bp, Homo sapiens
aacatagcgagacct

SEQ ID NO: 253498 - DNA, 15 bp, Homo sapiens
tggcaacatagcgag

SEQ ID NO: 253499 - DNA, 15 bp, Homo sapiens
ttggcaacatagcga

SEQ ID NO: 253500 - DNA, 15 bp, Homo sapiens
cttggcaacatagcg

SEQ ID NO: 253501 - DNA, 15 bp, Homo sapiens
gcttggcaacatagc

SEQ ID NO: 253502 - DNA, 15 bp, Homo sapiens
agcttggcaacatag

SEQ ID NO: 253503 - DNA, 15 bp, Homo sapiens
cagcttggcaacata

SEQ ID NO: 253504 - DNA, 15 bp, Homo sapiens
ccagcttggcaacat

SEQ ID NO: 253505 - DNA, 15 bp, Homo sapiens
accagcttggcaaca

SEQ ID NO: 253506 - DNA, 15 bp, Homo sapiens
gaccagcttggcaac

SEQ ID NO: 253507 - DNA, 15 bp, Homo sapiens
agaccagcttggcaa

SEQ ID NO: 253508 - DNA, 15 bp, Homo sapiens
gagaccagcttggca

SEQ ID NO: 253509 - DNA, 15 bp, Homo sapiens
tgagaccagcttggc

SEQ ID NO: 253510 - DNA, 15 bp, Homo sapiens
ttgagaccagcttgg

SEQ ID NO: 253511 - DNA, 15 bp, Homo sapiens
tttgagaccagcttg

SEQ ID NO: 253512 - DNA, 15 bp, Homo sapiens
gtttgagaccagctt

SEQ ID NO: 253513 - DNA, 15 bp, Homo sapiens
agtttgagaccagct

SEQ ID NO: 253514 - DNA, 15 bp, Homo sapiens
ggagcccaggagttt

SEQ ID NO: 253515 - DNA, 15 bp, Homo sapiens
gggagcccaggagtt

SEQ ID NO: 253516 - DNA, 15 bp, Homo sapiens
tgggagcccaggagt

SEQ ID NO: 253517 - DNA, 15 bp, Homo sapiens
gtgggagcccaggag

SEQ ID NO: 253518 - DNA, 15 bp, Homo sapiens
ggtgggagcccagga

SEQ ID NO: 253519 - DNA, 15 bp, Homo sapiens
aggtgggagcccagg

SEQ ID NO: 253520 - DNA, 15 bp, Homo sapiens
gaggtgggagcccag

SEQ ID NO: 253521 - DNA, 15 bp, Homo sapiens
tgaggtgggagccca

SEQ ID NO: 253522 - DNA, 15 bp, Homo sapiens
ctgaggtgggagccc

SEQ ID NO: 253523 - DNA, 15 bp, Homo sapiens
cctgaggtgggagcc

SEQ ID NO: 253524 - DNA, 15 bp, Homo sapiens
gcctgaggtgggagc

SEQ ID NO: 253525 - DNA, 15 bp, Homo sapiens
agcctgaggtgggag

SEQ ID NO: 253526 - DNA, 15 bp, Homo sapiens
gagcctgaggtggga

SEQ ID NO: 253527 - DNA, 15 bp, Homo sapiens
ggagcctgaggtggg

SEQ ID NO: 253528 - DNA, 15 bp, Homo sapiens
gggagcctgaggtgg

SEQ ID NO: 253529 - DNA, 15 bp, Homo sapiens
tgggagcctgaggtg

SEQ ID NO: 253530 - DNA, 15 bp, Homo sapiens
ttgggagcctgaggt

SEQ ID NO: 253531 - DNA, 15 bp, Homo sapiens
tttgggagcctgagg

SEQ ID NO: 253532 - DNA, 15 bp, Homo sapiens
ctttgggagcctgag

SEQ ID NO: 253533 - DNA, 15 bp, Homo sapiens
actttgggagcctga

SEQ ID NO: 253534 - DNA, 15 bp, Homo sapiens
cactttgggagcctg

SEQ ID NO: 253535 - DNA, 15 bp, Homo sapiens
acactttgggagcct

SEQ ID NO: 253536 - DNA, 15 bp, Homo sapiens
aacactttgggagcc

SEQ ID NO: 253537 - DNA, 15 bp, Homo sapiens
caacactttgggagc

SEQ ID NO: 253538 - DNA, 15 bp, Homo sapiens
ataatcccaacactt

SEQ ID NO: 253539 - DNA, 15 bp, Homo sapiens
tataatcccaacact

SEQ ID NO: 253540 - DNA, 15 bp, Homo sapiens
ctataatcccaacac

SEQ ID NO: 253541 - DNA, 15 bp, Homo sapiens
tctataatcccaaca

SEQ ID NO: 253542 - DNA, 15 bp, Homo sapiens
atctataatcccaac

SEQ ID NO: 253543 - DNA, 15 bp, Homo sapiens
catctataatcccaa

SEQ ID NO: 253544 - DNA, 15 bp, Homo sapiens
acatctataatccca

SEQ ID NO: 253545 - DNA, 15 bp, Homo sapiens
cacatctataatccc

SEQ ID NO: 253546 - DNA, 15 bp, Homo sapiens
tcacatctataatcc

SEQ ID NO: 253547 - DNA, 15 bp, Homo sapiens
ctcacatctataatc

SEQ ID NO: 253548 - DNA, 15 bp, Homo sapiens
cctcacatctataat

SEQ ID NO: 253549 - DNA, 15 bp, Homo sapiens
gcctcacatctataa

SEQ ID NO: 253550 - DNA, 15 bp, Homo sapiens
tgcctcacatctata

SEQ ID NO: 253551 - DNA, 15 bp, Homo sapiens
gtgcctcacatctat

SEQ ID NO: 253552 - DNA, 15 bp, Homo sapiens
ggtgcctcacatcta

SEQ ID NO: 253553 - DNA, 15 bp, Homo sapiens
tggtgcctcacatct

SEQ ID NO: 253554 - DNA, 15 bp, Homo sapiens
gtggtgcctcacatc

SEQ ID NO: 253555 - DNA, 15 bp, Homo sapiens
tgtggtgcctcacat

SEQ ID NO: 253556 - DNA, 15 bp, Homo sapiens
gtgtggtgcctcaca

SEQ ID NO: 253557 - DNA, 15 bp, Homo sapiens
ggtgtggtgcctcac

SEQ ID NO: 253558 - DNA, 15 bp, Homo sapiens
aggtgtggtgcctca

SEQ ID NO: 253559 - DNA, 15 bp, Homo sapiens
caggtgtggtgcctc

SEQ ID NO: 253560 - DNA, 15 bp, Homo sapiens
ccaggtgtggtgcct

SEQ ID NO: 253561 - DNA, 15 bp, Homo sapiens
gccaggtgtggtgcc

SEQ ID NO: 253562 - DNA, 15 bp, Homo sapiens
agccaggtgtggtgc

SEQ ID NO: 253563 - DNA, 15 bp, Homo sapiens
tttagccaggtgtgg

SEQ ID NO: 253564 - DNA, 15 bp, Homo sapiens
ttttagccaggtgtg

SEQ ID NO: 253565 - DNA, 15 bp, Homo sapiens
attttagccaggtgt

SEQ ID NO: 253566 - DNA, 15 bp, Homo sapiens
aattttagccaggtg

SEQ ID NO: 253567 - DNA, 15 bp, Homo sapiens
aaattttagccaggt

SEQ ID NO: 253568 - DNA, 15 bp, Homo sapiens
taaattttagccagg

SEQ ID NO: 253569 - DNA, 15 bp, Homo sapiens
ataaattttagccag

SEQ ID NO: 253570 - DNA, 15 bp, Homo sapiens
aataaattttagcca

SEQ ID NO: 253571 - DNA, 15 bp, Homo sapiens
taataaattttagcc

SEQ ID NO: 253572 - DNA, 15 bp, Homo sapiens
ataataaattttagc

SEQ ID NO: 253573 - DNA, 15 bp, Homo sapiens
aataataaattttag

SEQ ID NO: 253574 - DNA, 15 bp, Homo sapiens
taataataaatttta

SEQ ID NO: 253575 - DNA, 15 bp, Homo sapiens
ttaataataaatttt

SEQ ID NO: 253576 - DNA, 15 bp, Homo sapiens
attaataataaattt

SEQ ID NO: 253577 - DNA, 15 bp, Homo sapiens
tattaataataaatt

SEQ ID NO: 253578 - DNA, 15 bp, Homo sapiens
atattaataataaat

SEQ ID NO: 253579 - DNA, 15 bp, Homo sapiens
aatattaataataaa

SEQ ID NO: 253580 - DNA, 15 bp, Homo sapiens
aaatattaataataa

SEQ ID NO: 253581 - DNA, 15 bp, Homo sapiens
aaaatattaataata

SEQ ID NO: 253582 - DNA, 15 bp, Homo sapiens
aaaaatattaataat

SEQ ID NO: 253583 - DNA, 15 bp, Homo sapiens
aaaaaatattaataa

SEQ ID NO: 253584 - DNA, 15 bp, Homo sapiens
taaaaaatattaata

SEQ ID NO: 253585 - DNA, 15 bp, Homo sapiens
ataaaaaatattaat

SEQ ID NO: 253586 - DNA, 15 bp, Homo sapiens
aataaaaaatattaa

SEQ ID NO: 253587 - DNA, 15 bp, Homo sapiens
aaataaaaaatatta

SEQ ID NO: 253588 - DNA, 15 bp, Homo sapiens
aaaataaaaaatatt

SEQ ID NO: 253589 - DNA, 15 bp, Homo sapiens
aaaaataaaaaatat

SEQ ID NO: 253590 - DNA, 15 bp, Homo sapiens
aaaaaataaaaaata

SEQ ID NO: 253591 - DNA, 15 bp, Homo sapiens
cactgtctcaaaaaa

SEQ ID NO: 253592 - DNA, 15 bp, Homo sapiens
acactgtctcaaaaa

SEQ ID NO: 253593 - DNA, 15 bp, Homo sapiens
gagacactgtctcaa

SEQ ID NO: 253594 - DNA, 15 bp, Homo sapiens
tgagacactgtctca

SEQ ID NO: 253595 - DNA, 15 bp, Homo sapiens
gacagagtgagacac

SEQ ID NO: 253596 - DNA, 15 bp, Homo sapiens
tgacagagtgagaca

SEQ ID NO: 253597 - DNA, 15 bp, Homo sapiens
gtagcctgggtgaca

SEQ ID NO: 253598 - DNA, 15 bp, Homo sapiens
tgtagcctgggtgac

SEQ ID NO: 253599 - DNA, 15 bp, Homo sapiens
ctgtagcctgggtga

SEQ ID NO: 253600 - DNA, 15 bp, Homo sapiens
actgtagcctgggtg

SEQ ID NO: 253601 - DNA, 15 bp, Homo sapiens
cactgtagcctgggt

SEQ ID NO: 253602 - DNA, 15 bp, Homo sapiens
gcactgtagcctggg

SEQ ID NO: 253603 - DNA, 15 bp, Homo sapiens
tgcactgtagcctgg

SEQ ID NO: 253604 - DNA, 15 bp, Homo sapiens
ctgcactgtagcctg

SEQ ID NO: 253605 - DNA, 15 bp, Homo sapiens
actgcactgtagcct

SEQ ID NO: 253606 - DNA, 15 bp, Homo sapiens
cactgcactgtagcc

SEQ ID NO: 253607 - DNA, 15 bp, Homo sapiens
tcactgcactgtagc

SEQ ID NO: 253608 - DNA, 15 bp, Homo sapiens
ttcactgcactgtag

SEQ ID NO: 253609 - DNA, 15 bp, Homo sapiens
tttcactgcactgta

SEQ ID NO: 253610 - DNA, 15 bp, Homo sapiens
gtttcactgcactgt

SEQ ID NO: 253611 - DNA, 15 bp, Homo sapiens
cgtttcactgcactg

SEQ ID NO: 253612 - DNA, 15 bp, Homo sapiens
tcgtttcactgcact

SEQ ID NO: 253613 - DNA, 15 bp, Homo sapiens
atcgtttcactgcac

SEQ ID NO: 253614 - DNA, 15 bp, Homo sapiens
gatcgtttcactgca

SEQ ID NO: 253615 - DNA, 15 bp, Homo sapiens
agatcgtttcactgc

SEQ ID NO: 253616 - DNA, 15 bp, Homo sapiens
gagatcgtttcactg

SEQ ID NO: 253617 - DNA, 15 bp, Homo sapiens
cgagatcgtttcact

SEQ ID NO: 253618 - DNA, 15 bp, Homo sapiens
ccgagatcgtttcac

SEQ ID NO: 253619 - DNA, 15 bp, Homo sapiens
gccgagatcgtttca

SEQ ID NO: 253620 - DNA, 15 bp, Homo sapiens
agccgagatcgtttc

SEQ ID NO: 253621 - DNA, 15 bp, Homo sapiens
gagccgagatcgttt

SEQ ID NO: 253622 - DNA, 15 bp, Homo sapiens
tgagccgagatcgtt

SEQ ID NO: 253623 - DNA, 15 bp, Homo sapiens
tgggaggtggaggtt

SEQ ID NO: 253624 - DNA, 15 bp, Homo sapiens
ctgggaggtggaggt

SEQ ID NO: 253625 - DNA, 15 bp, Homo sapiens
gctgggaggtggagg

SEQ ID NO: 253626 - DNA, 15 bp, Homo sapiens
agctgggaggtggag

SEQ ID NO: 253627 - DNA, 15 bp, Homo sapiens
aagctgggaggtgga

SEQ ID NO: 253628 - DNA, 15 bp, Homo sapiens
gaagctgggaggtgg

SEQ ID NO: 253629 - DNA, 15 bp, Homo sapiens
tgaagctgggaggtg

SEQ ID NO: 253630 - DNA, 15 bp, Homo sapiens
ttgaagctgggaggt

SEQ ID NO: 253631 - DNA, 15 bp, Homo sapiens
cttgaagctgggagg

SEQ ID NO: 253632 - DNA, 15 bp, Homo sapiens
gcttgaagctgggag

SEQ ID NO: 253633 - DNA, 15 bp, Homo sapiens
tgcttgaagctggga

SEQ ID NO: 253634 - DNA, 15 bp, Homo sapiens
ttgcttgaagctggg

SEQ ID NO: 253635 - DNA, 15 bp, Homo sapiens
attgcttgaagctgg

SEQ ID NO: 253636 - DNA, 15 bp, Homo sapiens
aattgcttgaagctg

SEQ ID NO: 253637 - DNA, 15 bp, Homo sapiens
gaattgcttgaagct

SEQ ID NO: 253638 - DNA, 15 bp, Homo sapiens
agaattgcttgaagc

SEQ ID NO: 253639 - DNA, 15 bp, Homo sapiens
gagaattgcttgaag

SEQ ID NO: 253640 - DNA, 15 bp, Homo sapiens
gtgaggcatgagaat

SEQ ID NO: 253641 - DNA, 15 bp, Homo sapiens
ggtgaggcatgagaa

SEQ ID NO: 253642 - DNA, 15 bp, Homo sapiens
gggtgaggcatgaga

SEQ ID NO: 253643 - DNA, 15 bp, Homo sapiens
agggtgaggcatgag

SEQ ID NO: 253644 - DNA, 15 bp, Homo sapiens
gagggtgaggcatga

SEQ ID NO: 253645 - DNA, 15 bp, Homo sapiens
ctcaggagggtgagg

SEQ ID NO: 253646 - DNA, 15 bp, Homo sapiens
actcaggagggtgag

SEQ ID NO: 253647 - DNA, 15 bp, Homo sapiens
tactcaggagggtga

SEQ ID NO: 253648 - DNA, 15 bp, Homo sapiens
ctactcaggagggtg

SEQ ID NO: 253649 - DNA, 15 bp, Homo sapiens
gctactcaggagggt

SEQ ID NO: 253650 - DNA, 15 bp, Homo sapiens
agctactcaggaggg

SEQ ID NO: 253651 - DNA, 15 bp, Homo sapiens
tagctactcaggagg

SEQ ID NO: 253652 - DNA, 15 bp, Homo sapiens
ctagctactcaggag

SEQ ID NO: 253653 - DNA, 15 bp, Homo sapiens
cctagctactcagga

SEQ ID NO: 253654 - DNA, 15 bp, Homo sapiens
tcctagctactcagg

SEQ ID NO: 253655 - DNA, 15 bp, Homo sapiens
gtcctagctactcag

SEQ ID NO: 253656 - DNA, 15 bp, Homo sapiens
agtcctagctactca

SEQ ID NO: 253657 - DNA, 15 bp, Homo sapiens
tagtcctagctactc

SEQ ID NO: 253658 - DNA, 15 bp, Homo sapiens
gtagtcctagctact

SEQ ID NO: 253659 - DNA, 15 bp, Homo sapiens
tgtagtcctagctac

SEQ ID NO: 253660 - DNA, 15 bp, Homo sapiens
ctgtagtcctagcta

SEQ ID NO: 253661 - DNA, 15 bp, Homo sapiens
gtgcctgtagtccta

SEQ ID NO: 253662 - DNA, 15 bp, Homo sapiens
ggtgcctgtagtcct

SEQ ID NO: 253663 - DNA, 15 bp, Homo sapiens
tatggtggtgggtgc

SEQ ID NO: 253664 - DNA, 15 bp, Homo sapiens
gtatggtggtgggtg

SEQ ID NO: 253665 - DNA, 15 bp, Homo sapiens
ggtatggtggtgggt

SEQ ID NO: 253666 - DNA, 15 bp, Homo sapiens
aggtatggtggtggg

SEQ ID NO: 253667 - DNA, 15 bp, Homo sapiens
caggtatggtggtgg

SEQ ID NO: 253668 - DNA, 15 bp, Homo sapiens
ccaggtatggtggtg

SEQ ID NO: 253669 - DNA, 15 bp, Homo sapiens
gccaggtatggtggt

SEQ ID NO: 253670 - DNA, 15 bp, Homo sapiens
atcgctactaaaaat

SEQ ID NO: 253671 - DNA, 15 bp, Homo sapiens
catcgctactaaaaa

SEQ ID NO: 253672 - DNA, 15 bp, Homo sapiens
ccatcgctactaaaa

SEQ ID NO: 253673 - DNA, 15 bp, Homo sapiens
cccatcgctactaaa

SEQ ID NO: 253674 - DNA, 15 bp, Homo sapiens
tcccatcgctactaa

SEQ ID NO: 253675 - DNA, 15 bp, Homo sapiens
atcccatcgctacta

SEQ ID NO: 253676 - DNA, 15 bp, Homo sapiens
aatcccatcgctact

SEQ ID NO: 253677 - DNA, 15 bp, Homo sapiens
aaatcccatcgctac

SEQ ID NO: 253678 - DNA, 15 bp, Homo sapiens
gaaatcccatcgcta

SEQ ID NO: 253679 - DNA, 15 bp, Homo sapiens
tgaaatcccatcgct

SEQ ID NO: 253680 - DNA, 15 bp, Homo sapiens
atgaaatcccatcgc

SEQ ID NO: 253681 - DNA, 15 bp, Homo sapiens
gatgaaatcccatcg

SEQ ID NO: 253682 - DNA, 15 bp, Homo sapiens
tgatgaaatcccatc

SEQ ID NO: 253683 - DNA, 15 bp, Homo sapiens
atgatgaaatcccat

SEQ ID NO: 253684 - DNA, 15 bp, Homo sapiens
tatgatgaaatccca

SEQ ID NO: 253685 - DNA, 15 bp, Homo sapiens
atatgatgaaatccc

SEQ ID NO: 253686 - DNA, 15 bp, Homo sapiens
aatatgatgaaatcc

SEQ ID NO: 253687 - DNA, 15 bp, Homo sapiens
caatatgatgaaatc

SEQ ID NO: 253688 - DNA, 15 bp, Homo sapiens
ccaatatgatgaaat

SEQ ID NO: 253689 - DNA, 15 bp, Homo sapiens
gccaatatgatgaaa

SEQ ID NO: 253690 - DNA, 15 bp, Homo sapiens
ggccaatatgatgaa

SEQ ID NO: 253691 - DNA, 15 bp, Homo sapiens
tggccaatatgatga

SEQ ID NO: 253692 - DNA, 15 bp, Homo sapiens
ctggccaatatgatg

SEQ ID NO: 253693 - DNA, 15 bp, Homo sapiens
cctggccaatatgat

SEQ ID NO: 253694 - DNA, 15 bp, Homo sapiens
gcctggccaatatga

SEQ ID NO: 253695 - DNA, 15 bp, Homo sapiens
aagcctggccaatat

SEQ ID NO: 253696 - DNA, 15 bp, Homo sapiens
caagcctggccaata

SEQ ID NO: 253697 - DNA, 15 bp, Homo sapiens
acaagcctggccaat

SEQ ID NO: 253698 - DNA, 15 bp, Homo sapiens
gacaagcctggccaa

SEQ ID NO: 253699 - DNA, 15 bp, Homo sapiens
agacaagcctggcca

SEQ ID NO: 253700 - DNA, 15 bp, Homo sapiens
gagacaagcctggcc

SEQ ID NO: 253701 - DNA, 15 bp, Homo sapiens
tgagacaagcctggc

SEQ ID NO: 253702 - DNA, 15 bp, Homo sapiens
ttgagacaagcctgg

SEQ ID NO: 253703 - DNA, 15 bp, Homo sapiens
attgagacaagcctg

SEQ ID NO: 253704 - DNA, 15 bp, Homo sapiens
gattgagacaagcct

SEQ ID NO: 253705 - DNA, 15 bp, Homo sapiens
agattgagacaagcc

SEQ ID NO: 253706 - DNA, 15 bp, Homo sapiens
gagattgagacaagc

SEQ ID NO: 253707 - DNA, 15 bp, Homo sapiens
ggagattgagacaag

SEQ ID NO: 253708 - DNA, 15 bp, Homo sapiens
aggagattgagacaa

SEQ ID NO: 253709 - DNA, 15 bp, Homo sapiens
caggagattgagaca

SEQ ID NO: 253710 - DNA, 15 bp, Homo sapiens
ttgaggtcaggagat

SEQ ID NO: 253711 - DNA, 15 bp, Homo sapiens
cttgaggtcaggaga

SEQ ID NO: 253712 - DNA, 15 bp, Homo sapiens
ttcctgtaatcccag

SEQ ID NO: 253713 - DNA, 15 bp, Homo sapiens
cttcctgtaatccca

SEQ ID NO: 253714 - DNA, 15 bp, Homo sapiens
tcttcctgtaatccc

SEQ ID NO: 253715 - DNA, 15 bp, Homo sapiens
ctcttcctgtaatcc

SEQ ID NO: 253716 - DNA, 15 bp, Homo sapiens
gctcttcctgtaatc

SEQ ID NO: 253717 - DNA, 15 bp, Homo sapiens
ggctcttcctgtaat

SEQ ID NO: 253718 - DNA, 15 bp, Homo sapiens
tggctcttcctgtaa

SEQ ID NO: 253719 - DNA, 15 bp, Homo sapiens
gtggctcttcctgta

SEQ ID NO: 253720 - DNA, 15 bp, Homo sapiens
agtggctcttcctgt

SEQ ID NO: 253721 - DNA, 15 bp, Homo sapiens
cagtggctcttcctg

SEQ ID NO: 253722 - DNA, 15 bp, Homo sapiens
gcagtggctcttcct

SEQ ID NO: 253723 - DNA, 15 bp, Homo sapiens
ggcagtggctcttcc

SEQ ID NO: 253724 - DNA, 15 bp, Homo sapiens
gggcagtggctcttc

SEQ ID NO: 253725 - DNA, 15 bp, Homo sapiens
ggggcagtggctctt

SEQ ID NO: 253726 - DNA, 15 bp, Homo sapiens
aggggcagtggctct

SEQ ID NO: 253727 - DNA, 15 bp, Homo sapiens
caggggcagtggctc

SEQ ID NO: 253728 - DNA, 15 bp, Homo sapiens
ccaggggcagtggct

SEQ ID NO: 253729 - DNA, 15 bp, Homo sapiens
gccaggggcagtggc

SEQ ID NO: 253730 - DNA, 15 bp, Homo sapiens
ggccaggggcagtgg

SEQ ID NO: 253731 - DNA, 15 bp, Homo sapiens
tggccaggggcagtg

SEQ ID NO: 253732 - DNA, 15 bp, Homo sapiens
ttggccaggggcagt

SEQ ID NO: 253733 - DNA, 15 bp, Homo sapiens
attggccaggggcag

SEQ ID NO: 253734 - DNA, 15 bp, Homo sapiens
cattggccaggggca

SEQ ID NO: 253735 - DNA, 15 bp, Homo sapiens
acattggccaggggc

SEQ ID NO: 253736 - DNA, 15 bp, Homo sapiens
aacattggccagggg

SEQ ID NO: 253737 - DNA, 15 bp, Homo sapiens
aaacattggccaggg

SEQ ID NO: 253738 - DNA, 15 bp, Homo sapiens
gaaacattggccagg

SEQ ID NO: 253739 - DNA, 15 bp, Homo sapiens
tgaaacattggccag

SEQ ID NO: 253740 - DNA, 15 bp, Homo sapiens
ttgaaacattggcca

SEQ ID NO: 253741 - DNA, 15 bp, Homo sapiens
tttgaaacattggcc

SEQ ID NO: 253742 - DNA, 15 bp, Homo sapiens
atttgaaacattggc

SEQ ID NO: 253743 - DNA, 15 bp, Homo sapiens
catttgaaacattgg

SEQ ID NO: 253744 - DNA, 15 bp, Homo sapiens
acatttgaaacattg

SEQ ID NO: 253745 - DNA, 15 bp, Homo sapiens
aacatttgaaacatt

SEQ ID NO: 253746 - DNA, 15 bp, Homo sapiens
taacatttgaaacat

SEQ ID NO: 253747 - DNA, 15 bp, Homo sapiens
ttaacatttgaaaca

SEQ ID NO: 253748 - DNA, 15 bp, Homo sapiens
cttaacatttgaaac

SEQ ID NO: 253749 - DNA, 15 bp, Homo sapiens
acttaacatttgaaa

SEQ ID NO: 253750 - DNA, 15 bp, Homo sapiens
tacttaacatttgaa

SEQ ID NO: 253751 - DNA, 15 bp, Homo sapiens
ttacttaacatttga

SEQ ID NO: 253752 - DNA, 15 bp, Homo sapiens
gttacttaacatttg

SEQ ID NO: 253753 - DNA, 15 bp, Homo sapiens
tgttacttaacattt

SEQ ID NO: 253754 - DNA, 15 bp, Homo sapiens
ttgttacttaacatt

SEQ ID NO: 253755 - DNA, 15 bp, Homo sapiens
attgttacttaacat

SEQ ID NO: 253756 - DNA, 15 bp, Homo sapiens
aattgttacttaaca

SEQ ID NO: 253757 - DNA, 15 bp, Homo sapiens
caattgttacttaac

SEQ ID NO: 253758 - DNA, 15 bp, Homo sapiens
ccaattgttacttaa

SEQ ID NO: 253759 - DNA, 15 bp, Homo sapiens
cccaattgttactta

SEQ ID NO: 253760 - DNA, 15 bp, Homo sapiens
gcccaattgttactt

SEQ ID NO: 253761 - DNA, 15 bp, Homo sapiens
tgcccaattgttact

SEQ ID NO: 253762 - DNA, 15 bp, Homo sapiens
atgcccaattgttac

SEQ ID NO: 253763 - DNA, 15 bp, Homo sapiens
aatgcccaattgtta

SEQ ID NO: 253764 - DNA, 15 bp, Homo sapiens
caatgcccaattgtt

SEQ ID NO: 253765 - DNA, 15 bp, Homo sapiens
ccaatgcccaattgt

SEQ ID NO: 253766 - DNA, 15 bp, Homo sapiens
cccaatgcccaattg

SEQ ID NO: 253767 - DNA, 15 bp, Homo sapiens
acccaatgcccaatt

SEQ ID NO: 253768 - DNA, 15 bp, Homo sapiens
aacccaatgcccaat

SEQ ID NO: 253769 - DNA, 15 bp, Homo sapiens
aaacccaatgcccaa

SEQ ID NO: 253770 - DNA, 15 bp, Homo sapiens
gaaacccaatgccca

SEQ ID NO: 253771 - DNA, 15 bp, Homo sapiens
agaaacccaatgccc

SEQ ID NO: 253772 - DNA, 15 bp, Homo sapiens
cagaaacccaatgcc

SEQ ID NO: 253773 - DNA, 15 bp, Homo sapiens
tcagaaacccaatgc

SEQ ID NO: 253774 - DNA, 15 bp, Homo sapiens
ttcagaaacccaatg

SEQ ID NO: 253775 - DNA, 15 bp, Homo sapiens
attcagaaacccaat

SEQ ID NO: 253776 - DNA, 15 bp, Homo sapiens
cattcagaaacccaa

SEQ ID NO: 253777 - DNA, 15 bp, Homo sapiens
ccattcagaaaccca

SEQ ID NO: 253778 - DNA, 15 bp, Homo sapiens
accattcagaaaccc

SEQ ID NO: 253779 - DNA, 15 bp, Homo sapiens
aaccattcagaaacc

SEQ ID NO: 253780 - DNA, 15 bp, Homo sapiens
caaccattcagaaac

SEQ ID NO: 253781 - DNA, 15 bp, Homo sapiens
tcaaccattcagaaa

SEQ ID NO: 253782 - DNA, 15 bp, Homo sapiens
atcaaccattcagaa

SEQ ID NO: 253783 - DNA, 15 bp, Homo sapiens
tatcaaccattcaga

SEQ ID NO: 253784 - DNA, 15 bp, Homo sapiens
ttatcaaccattcag

SEQ ID NO: 253785 - DNA, 15 bp, Homo sapiens
attatcaaccattca

SEQ ID NO: 253786 - DNA, 15 bp, Homo sapiens
cattatcaaccattc

SEQ ID NO: 253787 - DNA, 15 bp, Homo sapiens
tcattatcaaccatt

SEQ ID NO: 253788 - DNA, 15 bp, Homo sapiens
ctcattatcaaccat

SEQ ID NO: 253789 - DNA, 15 bp, Homo sapiens
cctcattatcaacca

SEQ ID NO: 253790 - DNA, 15 bp, Homo sapiens
tcctcattatcaacc

SEQ ID NO: 253791 - DNA, 15 bp, Homo sapiens
atcctcattatcaac

SEQ ID NO: 253792 - DNA, 15 bp, Homo sapiens
tatcctcattatcaa

SEQ ID NO: 253793 - DNA, 15 bp, Homo sapiens
ttatcctcattatca

SEQ ID NO: 253794 - DNA, 15 bp, Homo sapiens
attatcctcattatc

SEQ ID NO: 253795 - DNA, 15 bp, Homo sapiens
aattatcctcattat

SEQ ID NO: 253796 - DNA, 15 bp, Homo sapiens
aaattatcctcatta

SEQ ID NO: 253797 - DNA, 15 bp, Homo sapiens
aaaattatcctcatt

SEQ ID NO: 253798 - DNA, 15 bp, Homo sapiens
caaaattatcctcat

SEQ ID NO: 253799 - DNA, 15 bp, Homo sapiens
gcaaaattatcctca

SEQ ID NO: 253800 - DNA, 15 bp, Homo sapiens
tgcaaaattatcctc

SEQ ID NO: 253801 - DNA, 15 bp, Homo sapiens
atgcaaaattatcct

SEQ ID NO: 253802 - DNA, 15 bp, Homo sapiens
catgcaaaattatcc

SEQ ID NO: 253803 - DNA, 15 bp, Homo sapiens
acatgcaaaattatc

SEQ ID NO: 253804 - DNA, 15 bp, Homo sapiens
tacatgcaaaattat

SEQ ID NO: 253805 - DNA, 15 bp, Homo sapiens
atacatgcaaaatta

SEQ ID NO: 253806 - DNA, 15 bp, Homo sapiens
aatacatgcaaaatt

SEQ ID NO: 253807 - DNA, 15 bp, Homo sapiens
aaatacatgcaaaat

SEQ ID NO: 253808 - DNA, 15 bp, Homo sapiens
aaaatacatgcaaaa

SEQ ID NO: 253809 - DNA, 15 bp, Homo sapiens
aaaaatacatgcaaa

SEQ ID NO: 253810 - DNA, 15 bp, Homo sapiens
taaaaatacatgcaa

SEQ ID NO: 253811 - DNA, 15 bp, Homo sapiens
ttaaaaatacatgca

SEQ ID NO: 253812 - DNA, 15 bp, Homo sapiens
tttaaaaatacatgc

SEQ ID NO: 253813 - DNA, 15 bp, Homo sapiens
ttttaaaaatacatg

SEQ ID NO: 253814 - DNA, 15 bp, Homo sapiens
tttttaaaaatacat

SEQ ID NO: 253815 - DNA, 15 bp, Homo sapiens
atttttaaaaataca

SEQ ID NO: 253816 - DNA, 15 bp, Homo sapiens
aatttttaaaaatac

SEQ ID NO: 253817 - DNA, 15 bp, Homo sapiens
aaatttttaaaaata

SEQ ID NO: 253818 - DNA, 15 bp, Homo sapiens
caaatttttaaaaat

SEQ ID NO: 253819 - DNA, 15 bp, Homo sapiens
tcaaatttttaaaaa

SEQ ID NO: 253820 - DNA, 15 bp, Homo sapiens
ttcaaatttttaaaa

SEQ ID NO: 253821 - DNA, 15 bp, Homo sapiens
tttcaaatttttaaa

SEQ ID NO: 253822 - DNA, 15 bp, Homo sapiens
ttttcaaatttttaa

SEQ ID NO: 253823 - DNA, 15 bp, Homo sapiens
ttttttcaaattttt

SEQ ID NO: 253824 - DNA, 15 bp, Homo sapiens
tttttttcaaatttt

SEQ ID NO: 253825 - DNA, 15 bp, Homo sapiens
atttttttcaaattt

SEQ ID NO: 253826 - DNA, 15 bp, Homo sapiens
gatttttttcaaatt

SEQ ID NO: 253827 - DNA, 15 bp, Homo sapiens
tgatttttttcaaat

SEQ ID NO: 253828 - DNA, 15 bp, Homo sapiens
atgatttttttcaaa

SEQ ID NO: 253829 - DNA, 15 bp, Homo sapiens
aatgatttttttcaa

SEQ ID NO: 253830 - DNA, 15 bp, Homo sapiens
aaatgatttttttca

SEQ ID NO: 253831 - DNA, 15 bp, Homo sapiens
gaaatgatttttttc

SEQ ID NO: 253832 - DNA, 15 bp, Homo sapiens
agaaatgattttttt

SEQ ID NO: 253833 - DNA, 15 bp, Homo sapiens
tagaaatgatttttt

SEQ ID NO: 253834 - DNA, 15 bp, Homo sapiens
gtagaaatgattttt

SEQ ID NO: 253835 - DNA, 15 bp, Homo sapiens
agtagaaatgatttt

SEQ ID NO: 253836 - DNA, 15 bp, Homo sapiens
aagtagaaatgattt

SEQ ID NO: 253837 - DNA, 15 bp, Homo sapiens
caagtagaaatgatt

SEQ ID NO: 253838 - DNA, 15 bp, Homo sapiens
ccaagtagaaatgat

SEQ ID NO: 253839 - DNA, 15 bp, Homo sapiens
cccaagtagaaatga

SEQ ID NO: 253840 - DNA, 15 bp, Homo sapiens
acccaagtagaaatg

SEQ ID NO: 253841 - DNA, 15 bp, Homo sapiens
tacccaagtagaaat

SEQ ID NO: 253842 - DNA, 15 bp, Homo sapiens
atacccaagtagaaa

SEQ ID NO: 253843 - DNA, 15 bp, Homo sapiens
aatacccaagtagaa

SEQ ID NO: 253844 - DNA, 15 bp, Homo sapiens
aaatacccaagtaga

SEQ ID NO: 253845 - DNA, 15 bp, Homo sapiens
gaaatacccaagtag

SEQ ID NO: 253846 - DNA, 15 bp, Homo sapiens
cgaaatacccaagta

SEQ ID NO: 253847 - DNA, 15 bp, Homo sapiens
acgaaatacccaagt

SEQ ID NO: 253848 - DNA, 15 bp, Homo sapiens
aacgaaatacccaag

SEQ ID NO: 253849 - DNA, 15 bp, Homo sapiens
aaacgaaatacccaa

SEQ ID NO: 253850 - DNA, 15 bp, Homo sapiens
aaaacgaaataccca

SEQ ID NO: 253851 - DNA, 15 bp, Homo sapiens
aaaaacgaaataccc

SEQ ID NO: 253852 - DNA, 15 bp, Homo sapiens
caaaaacgaaatacc

SEQ ID NO: 253853 - DNA, 15 bp, Homo sapiens
ccaaaaacgaaatac

SEQ ID NO: 253854 - DNA, 15 bp, Homo sapiens
gccaaaaacgaaata

SEQ ID NO: 253855 - DNA, 15 bp, Homo sapiens
ggccaaaaacgaaat

SEQ ID NO: 253856 - DNA, 15 bp, Homo sapiens
aggccaaaaacgaaa

SEQ ID NO: 253857 - DNA, 15 bp, Homo sapiens
taggccaaaaacgaa

SEQ ID NO: 253858 - DNA, 15 bp, Homo sapiens
ataggccaaaaacga

SEQ ID NO: 253859 - DNA, 15 bp, Homo sapiens
tataggccaaaaacg

SEQ ID NO: 253860 - DNA, 15 bp, Homo sapiens
atataggccaaaaac

SEQ ID NO: 253861 - DNA, 15 bp, Homo sapiens
catataggccaaaaa

SEQ ID NO: 253862 - DNA, 15 bp, Homo sapiens
tcatataggccaaaa

SEQ ID NO: 253863 - DNA, 15 bp, Homo sapiens
ttcatataggccaaa

SEQ ID NO: 253864 - DNA, 15 bp, Homo sapiens
cttcatataggccaa

SEQ ID NO: 253865 - DNA, 15 bp, Homo sapiens
acttcatataggcca

SEQ ID NO: 253866 - DNA, 15 bp, Homo sapiens
aacttcatataggcc

SEQ ID NO: 253867 - DNA, 15 bp, Homo sapiens
aaacttcatataggc

SEQ ID NO: 253868 - DNA, 15 bp, Homo sapiens
aaaacttcatatagg

SEQ ID NO: 253869 - DNA, 15 bp, Homo sapiens
aaaaacttcatatag

SEQ ID NO: 253870 - DNA, 15 bp, Homo sapiens
aaaaaacttcatata

SEQ ID NO: 253871 - DNA, 15 bp, Homo sapiens
caaaaaacttcatat

SEQ ID NO: 253872 - DNA, 15 bp, Homo sapiens
tcaaaaaacttcata

SEQ ID NO: 253873 - DNA, 15 bp, Homo sapiens
atcaaaaaacttcat

SEQ ID NO: 253874 - DNA, 15 bp, Homo sapiens
aatcaaaaaacttca

SEQ ID NO: 253875 - DNA, 15 bp, Homo sapiens
aaatcaaaaaacttc

SEQ ID NO: 253876 - DNA, 15 bp, Homo sapiens
aaaatcaaaaaactt

SEQ ID NO: 253877 - DNA, 15 bp, Homo sapiens
aaaaatcaaaaaact

SEQ ID NO: 253878 - DNA, 15 bp, Homo sapiens
aaaaaatcaaaaaac

SEQ ID NO: 253879 - DNA, 15 bp, Homo sapiens
aacaaaaaatcaaaa

SEQ ID NO: 253880 - DNA, 15 bp, Homo sapiens
aaacaaaaaatcaaa

SEQ ID NO: 253881 - DNA, 15 bp, Homo sapiens
taaacaaaaaatcaa

SEQ ID NO: 253882 - DNA, 15 bp, Homo sapiens
ataaacaaaaaatca

SEQ ID NO: 253883 - DNA, 15 bp, Homo sapiens
aataaacaaaaaatc

SEQ ID NO: 253884 - DNA, 15 bp, Homo sapiens
aaataaacaaaaaat

SEQ ID NO: 253885 - DNA, 15 bp, Homo sapiens
aaaataaacaaaaaa

SEQ ID NO: 253886 - DNA, 15 bp, Homo sapiens
taaaaataaacaaaa

SEQ ID NO: 253887 - DNA, 15 bp, Homo sapiens
ttaaaaataaacaaa

SEQ ID NO: 253888 - DNA, 15 bp, Homo sapiens
tttaaaaataaacaa

SEQ ID NO: 253889 - DNA, 15 bp, Homo sapiens
ttttaaaaataaaca

SEQ ID NO: 253890 - DNA, 15 bp, Homo sapiens
aattttaaaaataaa

SEQ ID NO: 253891 - DNA, 15 bp, Homo sapiens
aaattttaaaaataa

SEQ ID NO: 253892 - DNA, 15 bp, Homo sapiens
aaaattttaaaaata

SEQ ID NO: 253893 - DNA, 15 bp, Homo sapiens
taaaattttaaaaat

SEQ ID NO: 253894 - DNA, 15 bp, Homo sapiens
gtaaaattttaaaaa

SEQ ID NO: 253895 - DNA, 15 bp, Homo sapiens
ggtaaaattttaaaa

SEQ ID NO: 253896 - DNA, 15 bp, Homo sapiens
aggtaaaattttaaa

SEQ ID NO: 253897 - DNA, 15 bp, Homo sapiens
aaggtaaaattttaa

SEQ ID NO: 253898 - DNA, 15 bp, Homo sapiens
aaaggtaaaatttta

SEQ ID NO: 253899 - DNA, 15 bp, Homo sapiens
aaaaggtaaaatttt

SEQ ID NO: 253900 - DNA, 15 bp, Homo sapiens
aaaaaggtaaaattt

SEQ ID NO: 253901 - DNA, 15 bp, Homo sapiens
aaaaaaggtaaaatt

SEQ ID NO: 253902 - DNA, 15 bp, Homo sapiens
aaaaaaaggtaaaat

SEQ ID NO: 253903 - DNA, 15 bp, Homo sapiens
aaaaaaaaggtaaaa

SEQ ID NO: 253904 - DNA, 15 bp, Homo sapiens
gaaaaaaaaggtaaa

SEQ ID NO: 253905 - DNA, 15 bp, Homo sapiens
ggaaaaaaaaggtaa

SEQ ID NO: 253906 - DNA, 15 bp, Homo sapiens
tggaaaaaaaaggta

SEQ ID NO: 253907 - DNA, 15 bp, Homo sapiens
ctggaaaaaaaaggt

SEQ ID NO: 253908 - DNA, 15 bp, Homo sapiens
gctggaaaaaaaagg

SEQ ID NO: 253909 - DNA, 15 bp, Homo sapiens
ggctggaaaaaaaag

SEQ ID NO: 253910 - DNA, 15 bp, Homo sapiens
tggctggaaaaaaaa

SEQ ID NO: 253911 - DNA, 15 bp, Homo sapiens
atggctggaaaaaaa

SEQ ID NO: 253912 - DNA, 15 bp, Homo sapiens
gatggctggaaaaaa

SEQ ID NO: 253913 - DNA, 15 bp, Homo sapiens
tgatggctggaaaaa

SEQ ID NO: 253914 - DNA, 15 bp, Homo sapiens
ttgatggctggaaaa

SEQ ID NO: 253915 - DNA, 15 bp, Homo sapiens
tttgatggctggaaa

SEQ ID NO: 253916 - DNA, 15 bp, Homo sapiens
gtttgatggctggaa

SEQ ID NO: 253917 - DNA, 15 bp, Homo sapiens
tgtttgatggctgga

SEQ ID NO: 253918 - DNA, 15 bp, Homo sapiens
gtgtttgatggctgg

SEQ ID NO: 253919 - DNA, 15 bp, Homo sapiens
tgtgtttgatggctg

SEQ ID NO: 253920 - DNA, 15 bp, Homo sapiens
ctgtgtttgatggct

SEQ ID NO: 253921 - DNA, 15 bp, Homo sapiens
tctgtgtttgatggc

SEQ ID NO: 253922 - DNA, 15 bp, Homo sapiens
gtctgtgtttgatgg

SEQ ID NO: 253923 - DNA, 15 bp, Homo sapiens
ggtctgtgtttgatg

SEQ ID NO: 253924 - DNA, 15 bp, Homo sapiens
tggtctgtgtttgat

SEQ ID NO: 253925 - DNA, 15 bp, Homo sapiens
gtggtctgtgtttga

SEQ ID NO: 253926 - DNA, 15 bp, Homo sapiens
ggtggtctgtgtttg

SEQ ID NO: 253927 - DNA, 15 bp, Homo sapiens
aggtggtctgtgttt

SEQ ID NO: 253928 - DNA, 15 bp, Homo sapiens
caggtggtctgtgtt

SEQ ID NO: 253929 - DNA, 15 bp, Homo sapiens
acaggtggtctgtgt

SEQ ID NO: 253930 - DNA, 15 bp, Homo sapiens
aacaggtggtctgtg

SEQ ID NO: 253931 - DNA, 15 bp, Homo sapiens
caacaggtggtctgt

SEQ ID NO: 253932 - DNA, 15 bp, Homo sapiens
ccaacaggtggtctg

SEQ ID NO: 253933 - DNA, 15 bp, Homo sapiens
cccaacaggtggtct

SEQ ID NO: 253934 - DNA, 15 bp, Homo sapiens
tcccaacaggtggtc

SEQ ID NO: 253935 - DNA, 15 bp, Homo sapiens
gtcccaacaggtggt

SEQ ID NO: 253936 - DNA, 15 bp, Homo sapiens
ggtcccaacaggtgg

SEQ ID NO: 253937 - DNA, 15 bp, Homo sapiens
tggtcccaacaggtg

SEQ ID NO: 253938 - DNA, 15 bp, Homo sapiens
atggtcccaacaggt

SEQ ID NO: 253939 - DNA, 15 bp, Homo sapiens
gatggtcccaacagg

SEQ ID NO: 253940 - DNA, 15 bp, Homo sapiens
ggatggtcccaacag

SEQ ID NO: 253941 - DNA, 15 bp, Homo sapiens
aggatggtcccaaca

SEQ ID NO: 253942 - DNA, 15 bp, Homo sapiens
taggatggtcccaac

SEQ ID NO: 253943 - DNA, 15 bp, Homo sapiens
ttaggatggtcccaa

SEQ ID NO: 253944 - DNA, 15 bp, Homo sapiens
tttaggatggtccca

SEQ ID NO: 253945 - DNA, 15 bp, Homo sapiens
ttttaggatggtccc

SEQ ID NO: 253946 - DNA, 15 bp, Homo sapiens
attttaggatggtcc

SEQ ID NO: 253947 - DNA, 15 bp, Homo sapiens
cattttaggatggtc

SEQ ID NO: 253948 - DNA, 15 bp, Homo sapiens
tcattttaggatggt

SEQ ID NO: 253949 - DNA, 15 bp, Homo sapiens
gtcattttaggatgg

SEQ ID NO: 253950 - DNA, 15 bp, Homo sapiens
ggtcattttaggatg

SEQ ID NO: 253951 - DNA, 15 bp, Homo sapiens
cggtcattttaggat

SEQ ID NO: 253952 - DNA, 15 bp, Homo sapiens
tcggtcattttagga

SEQ ID NO: 253953 - DNA, 15 bp, Homo sapiens
ttcggtcattttagg

SEQ ID NO: 253954 - DNA, 15 bp, Homo sapiens
gttcggtcattttag

SEQ ID NO: 253955 - DNA, 15 bp, Homo sapiens
agttcggtcatttta

SEQ ID NO: 253956 - DNA, 15 bp, Homo sapiens
gagttcggtcatttt

SEQ ID NO: 253957 - DNA, 15 bp, Homo sapiens
agagttcggtcattt

SEQ ID NO: 253958 - DNA, 15 bp, Homo sapiens
aagagttcggtcatt

SEQ ID NO: 253959 - DNA, 15 bp, Homo sapiens
aaagagttcggtcat

SEQ ID NO: 253960 - DNA, 15 bp, Homo sapiens
gaaagagttcggtca

SEQ ID NO: 253961 - DNA, 15 bp, Homo sapiens
tgaaagagttcggtc

SEQ ID NO: 253962 - DNA, 15 bp, Homo sapiens
ttgaaagagttcggt

SEQ ID NO: 253963 - DNA, 15 bp, Homo sapiens
attgaaagagttcgg

SEQ ID NO: 253964 - DNA, 15 bp, Homo sapiens
gattgaaagagttcg

SEQ ID NO: 253965 - DNA, 15 bp, Homo sapiens
ggattgaaagagttc

SEQ ID NO: 253966 - DNA, 15 bp, Homo sapiens
gggattgaaagagtt

SEQ ID NO: 253967 - DNA, 15 bp, Homo sapiens
agggattgaaagagt

SEQ ID NO: 253968 - DNA, 15 bp, Homo sapiens
aagggattgaaagag

SEQ ID NO: 253969 - DNA, 15 bp, Homo sapiens
caagggattgaaaga

SEQ ID NO: 253970 - DNA, 15 bp, Homo sapiens
ccaagggattgaaag

SEQ ID NO: 253971 - DNA, 15 bp, Homo sapiens
accaagggattgaaa

SEQ ID NO: 253972 - DNA, 15 bp, Homo sapiens
taccaagggattgaa

SEQ ID NO: 253973 - DNA, 15 bp, Homo sapiens
ttaccaagggattga

SEQ ID NO: 253974 - DNA, 15 bp, Homo sapiens
cttaccaagggattg

SEQ ID NO: 253975 - DNA, 15 bp, Homo sapiens
acttaccaagggatt

SEQ ID NO: 253976 - DNA, 15 bp, Homo sapiens
cacttaccaagggat

SEQ ID NO: 253977 - DNA, 15 bp, Homo sapiens
acacttaccaaggga

SEQ ID NO: 253978 - DNA, 15 bp, Homo sapiens
aacacttaccaaggg

SEQ ID NO: 253979 - DNA, 15 bp, Homo sapiens
taacacttaccaagg

SEQ ID NO: 253980 - DNA, 15 bp, Homo sapiens
ataacacttaccaag

SEQ ID NO: 253981 - DNA, 15 bp, Homo sapiens
aataacacttaccaa

SEQ ID NO: 253982 - DNA, 15 bp, Homo sapiens
taataacacttacca

SEQ ID NO: 253983 - DNA, 15 bp, Homo sapiens
ttaataacacttacc

SEQ ID NO: 253984 - DNA, 15 bp, Homo sapiens
attaataacacttac

SEQ ID NO: 253985 - DNA, 15 bp, Homo sapiens
tattaataacactta

SEQ ID NO: 253986 - DNA, 15 bp, Homo sapiens
ctattaataacactt

SEQ ID NO: 253987 - DNA, 15 bp, Homo sapiens
actattaataacact

SEQ ID NO: 253988 - DNA, 15 bp, Homo sapiens
tactattaataacac

SEQ ID NO: 253989 - DNA, 15 bp, Homo sapiens
ttactattaataaca

SEQ ID NO: 253990 - DNA, 15 bp, Homo sapiens
attactattaataac

SEQ ID NO: 253991 - DNA, 15 bp, Homo sapiens
tattactattaataa

SEQ ID NO: 253992 - DNA, 15 bp, Homo sapiens
ttattactattaata

SEQ ID NO: 253993 - DNA, 15 bp, Homo sapiens
tttattactattaat

SEQ ID NO: 253994 - DNA, 15 bp, Homo sapiens
atttattactattaa

SEQ ID NO: 253995 - DNA, 15 bp, Homo sapiens
aatttattactatta

SEQ ID NO: 253996 - DNA, 15 bp, Homo sapiens
taatttattactatt

SEQ ID NO: 253997 - DNA, 15 bp, Homo sapiens
ttaatttattactat

SEQ ID NO: 253998 - DNA, 15 bp, Homo sapiens
gttaatttattacta

SEQ ID NO: 253999 - DNA, 15 bp, Homo sapiens
ggttaatttattact

SEQ ID NO: 254000 - DNA, 15 bp, Homo sapiens
aggttaatttattac

SEQ ID NO: 254001 - DNA, 15 bp, Homo sapiens
taggttaatttatta

SEQ ID NO: 254002 - DNA, 15 bp, Homo sapiens
ttaggttaatttatt

SEQ ID NO: 254003 - DNA, 15 bp, Homo sapiens
tttaggttaatttat

SEQ ID NO: 254004 - DNA, 15 bp, Homo sapiens
gtttaggttaattta

SEQ ID NO: 254005 - DNA, 15 bp, Homo sapiens
tgtttaggttaattt

SEQ ID NO: 254006 - DNA, 15 bp, Homo sapiens
ttgtttaggttaatt

SEQ ID NO: 254007 - DNA, 15 bp, Homo sapiens
gttgtttaggttaat

SEQ ID NO: 254008 - DNA, 15 bp, Homo sapiens
agttgtttaggttaa

SEQ ID NO: 254009 - DNA, 15 bp, Homo sapiens
cagttgtttaggtta

SEQ ID NO: 254010 - DNA, 15 bp, Homo sapiens
tcagttgtttaggtt

SEQ ID NO: 254011 - DNA, 15 bp, Homo sapiens
ctcagttgtttaggt

SEQ ID NO: 254012 - DNA, 15 bp, Homo sapiens
tctcagttgtttagg

SEQ ID NO: 254013 - DNA, 15 bp, Homo sapiens
ttctcagttgtttag

SEQ ID NO: 254014 - DNA, 15 bp, Homo sapiens
gttctcagttgttta

SEQ ID NO: 254015 - DNA, 15 bp, Homo sapiens
ggttctcagttgttt

SEQ ID NO: 254016 - DNA, 15 bp, Homo sapiens
cggttctcagttgtt

SEQ ID NO: 254017 - DNA, 15 bp, Homo sapiens
ccggttctcagttgt

SEQ ID NO: 254018 - DNA, 15 bp, Homo sapiens
accggttctcagttg

SEQ ID NO: 254019 - DNA, 15 bp, Homo sapiens
aaccggttctcagtt

SEQ ID NO: 254020 - DNA, 15 bp, Homo sapiens
aaaccggttctcagt

SEQ ID NO: 254021 - DNA, 15 bp, Homo sapiens
aaaaccggttctcag

SEQ ID NO: 254022 - DNA, 15 bp, Homo sapiens
aaaaaccggttctca

SEQ ID NO: 254023 - DNA, 15 bp, Homo sapiens
aaaaaaccggttctc

SEQ ID NO: 254024 - DNA, 15 bp, Homo sapiens
aaaaaaaccggttct

SEQ ID NO: 254025 - DNA, 15 bp, Homo sapiens
aaaaaaaaccggttc

SEQ ID NO: 254026 - DNA, 15 bp, Homo sapiens
aaaaaaaaaccggtt

SEQ ID NO: 254027 - DNA, 15 bp, Homo sapiens
aaaaaaaaaaccggt

SEQ ID NO: 254028 - DNA, 15 bp, Homo sapiens
aaaaaaaaaaaaccg

SEQ ID NO: 254029 - DNA, 15 bp, Homo sapiens
ccttaaaaaaaaaaa

SEQ ID NO: 254030 - DNA, 15 bp, Homo sapiens
accttaaaaaaaaaa

SEQ ID NO: 254031 - DNA, 15 bp, Homo sapiens
caccttaaaaaaaaa

SEQ ID NO: 254032 - DNA, 15 bp, Homo sapiens
ccaccttaaaaaaaa

SEQ ID NO: 254033 - DNA, 15 bp, Homo sapiens
tccaccttaaaaaaa

SEQ ID NO: 254034 - DNA, 15 bp, Homo sapiens
atccaccttaaaaaa

SEQ ID NO: 254035 - DNA, 15 bp, Homo sapiens
aatccaccttaaaaa

SEQ ID NO: 254036 - DNA, 15 bp, Homo sapiens
gaatccaccttaaaa

SEQ ID NO: 254037 - DNA, 15 bp, Homo sapiens
agaatccaccttaaa

SEQ ID NO: 254038 - DNA, 15 bp, Homo sapiens
gagaatccaccttaa

SEQ ID NO: 254039 - DNA, 15 bp, Homo sapiens
cgagaatccacctta

SEQ ID NO: 254040 - DNA, 15 bp, Homo sapiens
gcgagaatccacctt

SEQ ID NO: 254041 - DNA, 15 bp, Homo sapiens
agcgagaatccacct

SEQ ID NO: 254042 - DNA, 15 bp, Homo sapiens
cagcgagaatccacc

SEQ ID NO: 254043 - DNA, 15 bp, Homo sapiens
acagcgagaatccac

SEQ ID NO: 254044 - DNA, 15 bp, Homo sapiens
aacagcgagaatcca

SEQ ID NO: 254045 - DNA, 15 bp, Homo sapiens
caacagcgagaatcc

SEQ ID NO: 254046 - DNA, 15 bp, Homo sapiens
gcaacagcgagaatc

SEQ ID NO: 254047 - DNA, 15 bp, Homo sapiens
ggcaacagcgagaat

SEQ ID NO: 254048 - DNA, 15 bp, Homo sapiens
gggcaacagcgagaa

SEQ ID NO: 254049 - DNA, 15 bp, Homo sapiens
tgggcaacagcgaga

SEQ ID NO: 254050 - DNA, 15 bp, Homo sapiens
ctgggcaacagcgag

SEQ ID NO: 254051 - DNA, 15 bp, Homo sapiens
cctgggcaacagcga

SEQ ID NO: 254052 - DNA, 15 bp, Homo sapiens
gcctgggcaacagcg

SEQ ID NO: 254053 - DNA, 15 bp, Homo sapiens
agcctgggcaacagc

SEQ ID NO: 254054 - DNA, 15 bp, Homo sapiens
tccgggaggcagagg

SEQ ID NO: 254055 - DNA, 15 bp, Homo sapiens
atccgggaggcagag

SEQ ID NO: 254056 - DNA, 15 bp, Homo sapiens
aatccgggaggcaga

SEQ ID NO: 254057 - DNA, 15 bp, Homo sapiens
gaatccgggaggcag

SEQ ID NO: 254058 - DNA, 15 bp, Homo sapiens
tgaatccgggaggca

SEQ ID NO: 254059 - DNA, 15 bp, Homo sapiens
ttgaatccgggaggc

SEQ ID NO: 254060 - DNA, 15 bp, Homo sapiens
cttgaatccgggagg

SEQ ID NO: 254061 - DNA, 15 bp, Homo sapiens
gcttgaatccgggag

SEQ ID NO: 254062 - DNA, 15 bp, Homo sapiens
tgcttgaatccggga

SEQ ID NO: 254063 - DNA, 15 bp, Homo sapiens
ttgcttgaatccggg

SEQ ID NO: 254064 - DNA, 15 bp, Homo sapiens
attgcttgaatccgg

SEQ ID NO: 254065 - DNA, 15 bp, Homo sapiens
aattgcttgaatccg

SEQ ID NO: 254066 - DNA, 15 bp, Homo sapiens
gaattgcttgaatcc

SEQ ID NO: 254067 - DNA, 15 bp, Homo sapiens
agaattgcttgaatc

SEQ ID NO: 254068 - DNA, 15 bp, Homo sapiens
gagaattgcttgaat

SEQ ID NO: 254069 - DNA, 15 bp, Homo sapiens
cctaaggcaggagaa

SEQ ID NO: 254070 - DNA, 15 bp, Homo sapiens
gcctaaggcaggaga

SEQ ID NO: 254071 - DNA, 15 bp, Homo sapiens
agcctaaggcaggag

SEQ ID NO: 254072 - DNA, 15 bp, Homo sapiens
gagcctaaggcagga

SEQ ID NO: 254073 - DNA, 15 bp, Homo sapiens
ggagcctaaggcagg

SEQ ID NO: 254074 - DNA, 15 bp, Homo sapiens
aggagcctaaggcag

SEQ ID NO: 254075 - DNA, 15 bp, Homo sapiens
caggagcctaaggca

SEQ ID NO: 254076 - DNA, 15 bp, Homo sapiens
tcaggagcctaaggc

SEQ ID NO: 254077 - DNA, 15 bp, Homo sapiens
ctcaggagcctaagg

SEQ ID NO: 254078 - DNA, 15 bp, Homo sapiens
actcaggagcctaag

SEQ ID NO: 254079 - DNA, 15 bp, Homo sapiens
tactcaggagcctaa

SEQ ID NO: 254080 - DNA, 15 bp, Homo sapiens
ctactcaggagccta

SEQ ID NO: 254081 - DNA, 15 bp, Homo sapiens
gctactcaggagcct

SEQ ID NO: 254082 - DNA, 15 bp, Homo sapiens
agctactcaggagcc

SEQ ID NO: 254083 - DNA, 15 bp, Homo sapiens
cagctactcaggagc

SEQ ID NO: 254084 - DNA, 15 bp, Homo sapiens
cggcgggcgcctgta

SEQ ID NO: 254085 - DNA, 15 bp, Homo sapiens
gcggcgggcgcctgt

SEQ ID NO: 254086 - DNA, 15 bp, Homo sapiens
ggcggcgggcgcctg

SEQ ID NO: 254087 - DNA, 15 bp, Homo sapiens
tggcggcgggcgcct

SEQ ID NO: 254088 - DNA, 15 bp, Homo sapiens
gtggcggcgggcgcc

SEQ ID NO: 254089 - DNA, 15 bp, Homo sapiens
agtggcggcgggcgc

SEQ ID NO: 254090 - DNA, 15 bp, Homo sapiens
gagtggcggcgggcg

SEQ ID NO: 254091 - DNA, 15 bp, Homo sapiens
ggagtggcggcgggc

SEQ ID NO: 254092 - DNA, 15 bp, Homo sapiens
gggagtggcggcggg

SEQ ID NO: 254093 - DNA, 15 bp, Homo sapiens
tgggagtggcggcgg

SEQ ID NO: 254094 - DNA, 15 bp, Homo sapiens
ctgggagtggcggcg

SEQ ID NO: 254095 - DNA, 15 bp, Homo sapiens
gctgggagtggcggc

SEQ ID NO: 254096 - DNA, 15 bp, Homo sapiens
agctgggagtggcgg

SEQ ID NO: 254097 - DNA, 15 bp, Homo sapiens
tagctgggagtggcg

SEQ ID NO: 254098 - DNA, 15 bp, Homo sapiens
ttagctgggagtggc

SEQ ID NO: 254099 - DNA, 15 bp, Homo sapiens
attagctgggagtgg

SEQ ID NO: 254100 - DNA, 15 bp, Homo sapiens
aattagctgggagtg

SEQ ID NO: 254101 - DNA, 15 bp, Homo sapiens
aaattagctgggagt

SEQ ID NO: 254102 - DNA, 15 bp, Homo sapiens
aaaattagctgggag

SEQ ID NO: 254103 - DNA, 15 bp, Homo sapiens
aaaaattagctggga

SEQ ID NO: 254104 - DNA, 15 bp, Homo sapiens
gaaaaattagctggg

SEQ ID NO: 254105 - DNA, 15 bp, Homo sapiens
cgaaaaattagctgg

SEQ ID NO: 254106 - DNA, 15 bp, Homo sapiens
acgaaaaattagctg

SEQ ID NO: 254107 - DNA, 15 bp, Homo sapiens
tacgaaaaattagct

SEQ ID NO: 254108 - DNA, 15 bp, Homo sapiens
atacgaaaaattagc

SEQ ID NO: 254109 - DNA, 15 bp, Homo sapiens
aatacgaaaaattag

SEQ ID NO: 254110 - DNA, 15 bp, Homo sapiens
aaatacgaaaaatta

SEQ ID NO: 254111 - DNA, 15 bp, Homo sapiens
aaaatacgaaaaatt

SEQ ID NO: 254112 - DNA, 15 bp, Homo sapiens
taaaatacgaaaaat

SEQ ID NO: 254113 - DNA, 15 bp, Homo sapiens
ttaaaatacgaaaaa

SEQ ID NO: 254114 - DNA, 15 bp, Homo sapiens
attaaaatacgaaaa

SEQ ID NO: 254115 - DNA, 15 bp, Homo sapiens
tattaaaatacgaaa

SEQ ID NO: 254116 - DNA, 15 bp, Homo sapiens
ctattaaaatacgaa

SEQ ID NO: 254117 - DNA, 15 bp, Homo sapiens
tctattaaaatacga

SEQ ID NO: 254118 - DNA, 15 bp, Homo sapiens
ctctattaaaatacg

SEQ ID NO: 254119 - DNA, 15 bp, Homo sapiens
tctctattaaaatac

SEQ ID NO: 254120 - DNA, 15 bp, Homo sapiens
gtctctattaaaata

SEQ ID NO: 254121 - DNA, 15 bp, Homo sapiens
tgtctctattaaaat

SEQ ID NO: 254122 - DNA, 15 bp, Homo sapiens
ctgtctctattaaaa

SEQ ID NO: 254123 - DNA, 15 bp, Homo sapiens
cctgtctctattaaa

SEQ ID NO: 254124 - DNA, 15 bp, Homo sapiens
ccctgtctctattaa

SEQ ID NO: 254125 - DNA, 15 bp, Homo sapiens
accctgtctctatta

SEQ ID NO: 254126 - DNA, 15 bp, Homo sapiens
aaccctgtctctatt

SEQ ID NO: 254127 - DNA, 15 bp, Homo sapiens
aaaccctgtctctat

SEQ ID NO: 254128 - DNA, 15 bp, Homo sapiens
aacacagtaaaaccc

SEQ ID NO: 254129 - DNA, 15 bp, Homo sapiens
caacacagtaaaacc

SEQ ID NO: 254130 - DNA, 15 bp, Homo sapiens
gcaacacagtaaaac

SEQ ID NO: 254131 - DNA, 15 bp, Homo sapiens
ggcaacacagtaaaa

SEQ ID NO: 254132 - DNA, 15 bp, Homo sapiens
gggcaacacagtaaa

SEQ ID NO: 254133 - DNA, 15 bp, Homo sapiens
tgggcaacacagtaa

SEQ ID NO: 254134 - DNA, 15 bp, Homo sapiens
ctgggcaacacagta

SEQ ID NO: 254135 - DNA, 15 bp, Homo sapiens
cctgggcaacacagt

SEQ ID NO: 254136 - DNA, 15 bp, Homo sapiens
ctcaggagttcgaga

SEQ ID NO: 254137 - DNA, 15 bp, Homo sapiens
gctcaggagttcgag

SEQ ID NO: 254138 - DNA, 15 bp, Homo sapiens
agctcaggagttcga

SEQ ID NO: 254139 - DNA, 15 bp, Homo sapiens
gagctcaggagttcg

SEQ ID NO: 254140 - DNA, 15 bp, Homo sapiens
attgcctgagctcag

SEQ ID NO: 254141 - DNA, 15 bp, Homo sapiens
gattgcctgagctca

SEQ ID NO: 254142 - DNA, 15 bp, Homo sapiens
ggattgcctgagctc

SEQ ID NO: 254143 - DNA, 15 bp, Homo sapiens
cgggtggattgcctg

SEQ ID NO: 254144 - DNA, 15 bp, Homo sapiens
gcgggtggattgcct

SEQ ID NO: 254145 - DNA, 15 bp, Homo sapiens
ggcgggtggattgcc

SEQ ID NO: 254146 - DNA, 15 bp, Homo sapiens
aggcgggtggattgc

SEQ ID NO: 254147 - DNA, 15 bp, Homo sapiens
gaggcgggtggattg

SEQ ID NO: 254148 - DNA, 15 bp, Homo sapiens
cgaggcgggtggatt

SEQ ID NO: 254149 - DNA, 15 bp, Homo sapiens
gagcactttgggagg

SEQ ID NO: 254150 - DNA, 15 bp, Homo sapiens
ggagcactttgggag

SEQ ID NO: 254151 - DNA, 15 bp, Homo sapiens
gggagcactttggga

SEQ ID NO: 254152 - DNA, 15 bp, Homo sapiens
cgggagcactttggg

SEQ ID NO: 254153 - DNA, 15 bp, Homo sapiens
acgggagcactttgg

SEQ ID NO: 254154 - DNA, 15 bp, Homo sapiens
cacgggagcactttg

SEQ ID NO: 254155 - DNA, 15 bp, Homo sapiens
tcacgggagcacttt

SEQ ID NO: 254156 - DNA, 15 bp, Homo sapiens
ctcacgggagcactt

SEQ ID NO: 254157 - DNA, 15 bp, Homo sapiens
gctcacgggagcact

SEQ ID NO: 254158 - DNA, 15 bp, Homo sapiens
ggctcacgggagcac

SEQ ID NO: 254159 - DNA, 15 bp, Homo sapiens
tggctcacgggagca

SEQ ID NO: 254160 - DNA, 15 bp, Homo sapiens
gtggctcacgggagc

SEQ ID NO: 254161 - DNA, 15 bp, Homo sapiens
agtggctcacgggag

SEQ ID NO: 254162 - DNA, 15 bp, Homo sapiens
cagtggctcacggga

SEQ ID NO: 254163 - DNA, 15 bp, Homo sapiens
acagtggctcacggg

SEQ ID NO: 254164 - DNA, 15 bp, Homo sapiens
cacagtggctcacgg

SEQ ID NO: 254165 - DNA, 15 bp, Homo sapiens
cggccgggcacagtg

SEQ ID NO: 254166 - DNA, 15 bp, Homo sapiens
tcggccgggcacagt

SEQ ID NO: 254167 - DNA, 15 bp, Homo sapiens
ctcggccgggcacag

SEQ ID NO: 254168 - DNA, 15 bp, Homo sapiens
tctcggccgggcaca

SEQ ID NO: 254169 - DNA, 15 bp, Homo sapiens
ttctcggccgggcac

SEQ ID NO: 254170 - DNA, 15 bp, Homo sapiens
gttctcggccgggca

SEQ ID NO: 254171 - DNA, 15 bp, Homo sapiens
agttctcggccgggc

SEQ ID NO: 254172 - DNA, 15 bp, Homo sapiens
cagttctcggccggg

SEQ ID NO: 254173 - DNA, 15 bp, Homo sapiens
acagttctcggccgg

SEQ ID NO: 254174 - DNA, 15 bp, Homo sapiens
tacagttctcggccg

SEQ ID NO: 254175 - DNA, 15 bp, Homo sapiens
atacagttctcggcc

SEQ ID NO: 254176 - DNA, 15 bp, Homo sapiens
tatacagttctcggc

SEQ ID NO: 254177 - DNA, 15 bp, Homo sapiens
atatacagttctcgg

SEQ ID NO: 254178 - DNA, 15 bp, Homo sapiens
aatatacagttctcg

SEQ ID NO: 254179 - DNA, 15 bp, Homo sapiens
caatatacagttctc

SEQ ID NO: 254180 - DNA, 15 bp, Homo sapiens
acaatatacagttct

SEQ ID NO: 254181 - DNA, 15 bp, Homo sapiens
aacaatatacagttc

SEQ ID NO: 254182 - DNA, 15 bp, Homo sapiens
taacaatatacagtt

SEQ ID NO: 254183 - DNA, 15 bp, Homo sapiens
ttaacaatatacagt

SEQ ID NO: 254184 - DNA, 15 bp, Homo sapiens
tttaacaatatacag

SEQ ID NO: 254185 - DNA, 15 bp, Homo sapiens
atttaacaatataca

SEQ ID NO: 254186 - DNA, 15 bp, Homo sapiens
tatttaacaatatac

SEQ ID NO: 254187 - DNA, 15 bp, Homo sapiens
ctatttaacaatata

SEQ ID NO: 254188 - DNA, 15 bp, Homo sapiens
cctatttaacaatat

SEQ ID NO: 254189 - DNA, 15 bp, Homo sapiens
tcctatttaacaata

SEQ ID NO: 254190 - DNA, 15 bp, Homo sapiens
ctcctatttaacaat

SEQ ID NO: 254191 - DNA, 15 bp, Homo sapiens
gctcctatttaacaa

SEQ ID NO: 254192 - DNA, 15 bp, Homo sapiens
agctcctatttaaca

SEQ ID NO: 254193 - DNA, 15 bp, Homo sapiens
tagctcctatttaac

SEQ ID NO: 254194 - DNA, 15 bp, Homo sapiens
ttagctcctatttaa

SEQ ID NO: 254195 - DNA, 15 bp, Homo sapiens
attagctcctattta

SEQ ID NO: 254196 - DNA, 15 bp, Homo sapiens
gattagctcctattt

SEQ ID NO: 254197 - DNA, 15 bp, Homo sapiens
tgattagctcctatt

SEQ ID NO: 254198 - DNA, 15 bp, Homo sapiens
gtgattagctcctat

SEQ ID NO: 254199 - DNA, 15 bp, Homo sapiens
ggtgattagctccta

SEQ ID NO: 254200 - DNA, 15 bp, Homo sapiens
tggtgattagctcct

SEQ ID NO: 254201 - DNA, 15 bp, Homo sapiens
ctggtgattagctcc

SEQ ID NO: 254202 - DNA, 15 bp, Homo sapiens
gctggtgattagctc

SEQ ID NO: 254203 - DNA, 15 bp, Homo sapiens
ggctggtgattagct

SEQ ID NO: 254204 - DNA, 15 bp, Homo sapiens
aggctggtgattagc

SEQ ID NO: 254205 - DNA, 15 bp, Homo sapiens
aaggctggtgattag

SEQ ID NO: 254206 - DNA, 15 bp, Homo sapiens
aaaggctggtgatta

SEQ ID NO: 254207 - DNA, 15 bp, Homo sapiens
gaaaggctggtgatt

SEQ ID NO: 254208 - DNA, 15 bp, Homo sapiens
agaaaggctggtgat

SEQ ID NO: 254209 - DNA, 15 bp, Homo sapiens
aagaaaggctggtga

SEQ ID NO: 254210 - DNA, 15 bp, Homo sapiens
taagaaaggctggtg

SEQ ID NO: 254211 - DNA, 15 bp, Homo sapiens
gtaagaaaggctggt

SEQ ID NO: 254212 - DNA, 15 bp, Homo sapiens
tgtaagaaaggctgg

SEQ ID NO: 254213 - DNA, 15 bp, Homo sapiens
atgtaagaaaggctg

SEQ ID NO: 254214 - DNA, 15 bp, Homo sapiens
catgtaagaaaggct

SEQ ID NO: 254215 - DNA, 15 bp, Homo sapiens
ccatgtaagaaaggc

SEQ ID NO: 254216 - DNA, 15 bp, Homo sapiens
gccatgtaagaaagg

SEQ ID NO: 254217 - DNA, 15 bp, Homo sapiens
tgccatgtaagaaag

SEQ ID NO: 254218 - DNA, 15 bp, Homo sapiens
atgccatgtaagaaa

SEQ ID NO: 254219 - DNA, 15 bp, Homo sapiens
tatgccatgtaagaa

SEQ ID NO: 254220 - DNA, 15 bp, Homo sapiens
atatgccatgtaaga

SEQ ID NO: 254221 - DNA, 15 bp, Homo sapiens
aatatgccatgtaag

SEQ ID NO: 254222 - DNA, 15 bp, Homo sapiens
taatatgccatgtaa

SEQ ID NO: 254223 - DNA, 15 bp, Homo sapiens
ttaatatgccatgta

SEQ ID NO: 254224 - DNA, 15 bp, Homo sapiens
attaatatgccatgt

SEQ ID NO: 254225 - DNA, 15 bp, Homo sapiens
cattaatatgccatg

SEQ ID NO: 254226 - DNA, 15 bp, Homo sapiens
acattaatatgccat

SEQ ID NO: 254227 - DNA, 15 bp, Homo sapiens
aacattaatatgcca

SEQ ID NO: 254228 - DNA, 15 bp, Homo sapiens
taacattaatatgcc

SEQ ID NO: 254229 - DNA, 15 bp, Homo sapiens
ttaacattaatatgc

SEQ ID NO: 254230 - DNA, 15 bp, Homo sapiens
tttaacattaatatg

SEQ ID NO: 254231 - DNA, 15 bp, Homo sapiens
ttttaacattaatat

SEQ ID NO: 254232 - DNA, 15 bp, Homo sapiens
cttttaacattaata

SEQ ID NO: 254233 - DNA, 15 bp, Homo sapiens
tcttttaacattaat

SEQ ID NO: 254234 - DNA, 15 bp, Homo sapiens
ttcttttaacattaa

SEQ ID NO: 254235 - DNA, 15 bp, Homo sapiens
attcttttaacatta

SEQ ID NO: 254236 - DNA, 15 bp, Homo sapiens
gattcttttaacatt

SEQ ID NO: 254237 - DNA, 15 bp, Homo sapiens
tgattcttttaacat

SEQ ID NO: 254238 - DNA, 15 bp, Homo sapiens
atgattcttttaaca

SEQ ID NO: 254239 - DNA, 15 bp, Homo sapiens
catgattcttttaac

SEQ ID NO: 254240 - DNA, 15 bp, Homo sapiens
acatgattcttttaa

SEQ ID NO: 254241 - DNA, 15 bp, Homo sapiens
gacatgattctttta

SEQ ID NO: 254242 - DNA, 15 bp, Homo sapiens
tgacatgattctttt

SEQ ID NO: 254243 - DNA, 15 bp, Homo sapiens
atgacatgattcttt

SEQ ID NO: 254244 - DNA, 15 bp, Homo sapiens
aatgacatgattctt

SEQ ID NO: 254245 - DNA, 15 bp, Homo sapiens
caatgacatgattct

SEQ ID NO: 254246 - DNA, 15 bp, Homo sapiens
tcaatgacatgattc

SEQ ID NO: 254247 - DNA, 15 bp, Homo sapiens
gtcaatgacatgatt

SEQ ID NO: 254248 - DNA, 15 bp, Homo sapiens
tgtcaatgacatgat

SEQ ID NO: 254249 - DNA, 15 bp, Homo sapiens
atgtcaatgacatga

SEQ ID NO: 254250 - DNA, 15 bp, Homo sapiens
aatgtcaatgacatg

SEQ ID NO: 254251 - DNA, 15 bp, Homo sapiens
aaatgtcaatgacat

SEQ ID NO: 254252 - DNA, 15 bp, Homo sapiens
taaatgtcaatgaca

SEQ ID NO: 254253 - DNA, 15 bp, Homo sapiens
ttaaatgtcaatgac

SEQ ID NO: 254254 - DNA, 15 bp, Homo sapiens
tttaaatgtcaatga

SEQ ID NO: 254255 - DNA, 15 bp, Homo sapiens
ttttaaatgtcaatg

SEQ ID NO: 254256 - DNA, 15 bp, Homo sapiens
cttttaaatgtcaat

SEQ ID NO: 254257 - DNA, 15 bp, Homo sapiens
acttttaaatgtcaa

SEQ ID NO: 254258 - DNA, 15 bp, Homo sapiens
tacttttaaatgtca

SEQ ID NO: 254259 - DNA, 15 bp, Homo sapiens
ctacttttaaatgtc

SEQ ID NO: 254260 - DNA, 15 bp, Homo sapiens
actacttttaaatgt

SEQ ID NO: 254261 - DNA, 15 bp, Homo sapiens
aactacttttaaatg

SEQ ID NO: 254262 - DNA, 15 bp, Homo sapiens
taactacttttaaat

SEQ ID NO: 254263 - DNA, 15 bp, Homo sapiens
ttaactacttttaaa

SEQ ID NO: 254264 - DNA, 15 bp, Homo sapiens
tttaactacttttaa

SEQ ID NO: 254265 - DNA, 15 bp, Homo sapiens
atttaactactttta

SEQ ID NO: 254266 - DNA, 15 bp, Homo sapiens
aatttaactactttt

SEQ ID NO: 254267 - DNA, 15 bp, Homo sapiens
aaatttaactacttt

SEQ ID NO: 254268 - DNA, 15 bp, Homo sapiens
gaaatttaactactt

SEQ ID NO: 254269 - DNA, 15 bp, Homo sapiens
agaaatttaactact

SEQ ID NO: 254270 - DNA, 15 bp, Homo sapiens
tagaaatttaactac

SEQ ID NO: 254271 - DNA, 15 bp, Homo sapiens
ttagaaatttaacta

SEQ ID NO: 254272 - DNA, 15 bp, Homo sapiens
cttagaaatttaact

SEQ ID NO: 254273 - DNA, 15 bp, Homo sapiens
ccttagaaatttaac

SEQ ID NO: 254274 - DNA, 15 bp, Homo sapiens
cccttagaaatttaa

SEQ ID NO: 254275 - DNA, 15 bp, Homo sapiens
gcccttagaaattta

SEQ ID NO: 254276 - DNA, 15 bp, Homo sapiens
tgcccttagaaattt

SEQ ID NO: 254277 - DNA, 15 bp, Homo sapiens
ttgcccttagaaatt

SEQ ID NO: 254278 - DNA, 15 bp, Homo sapiens
attgcccttagaaat

SEQ ID NO: 254279 - DNA, 15 bp, Homo sapiens
cattgcccttagaaa

SEQ ID NO: 254280 - DNA, 15 bp, Homo sapiens
gcattgcccttagaa

SEQ ID NO: 254281 - DNA, 15 bp, Homo sapiens
tgcattgcccttaga

SEQ ID NO: 254282 - DNA, 15 bp, Homo sapiens
ctgcattgcccttag

SEQ ID NO: 254283 - DNA, 15 bp, Homo sapiens
actgcattgccctta

SEQ ID NO: 254284 - DNA, 15 bp, Homo sapiens
tactgcattgccctt

SEQ ID NO: 254285 - DNA, 15 bp, Homo sapiens
ttactgcattgccct

SEQ ID NO: 254286 - DNA, 15 bp, Homo sapiens
tttactgcattgccc

SEQ ID NO: 254287 - DNA, 15 bp, Homo sapiens
gtttactgcattgcc

SEQ ID NO: 254288 - DNA, 15 bp, Homo sapiens
tgtttactgcattgc

SEQ ID NO: 254289 - DNA, 15 bp, Homo sapiens
ctgtttactgcattg

SEQ ID NO: 254290 - DNA, 15 bp, Homo sapiens
cctgtttactgcatt

SEQ ID NO: 254291 - DNA, 15 bp, Homo sapiens
acctgtttactgcat

SEQ ID NO: 254292 - DNA, 15 bp, Homo sapiens
tacctgtttactgca

SEQ ID NO: 254293 - DNA, 15 bp, Homo sapiens
atacctgtttactgc

SEQ ID NO: 254294 - DNA, 15 bp, Homo sapiens
aatacctgtttactg

SEQ ID NO: 254295 - DNA, 15 bp, Homo sapiens
caatacctgtttact

SEQ ID NO: 254296 - DNA, 15 bp, Homo sapiens
gcaatacctgtttac

SEQ ID NO: 254297 - DNA, 15 bp, Homo sapiens
ggcaatacctgttta

SEQ ID NO: 254298 - DNA, 15 bp, Homo sapiens
aggcaatacctgttt

SEQ ID NO: 254299 - DNA, 15 bp, Homo sapiens
aaggcaatacctgtt

SEQ ID NO: 254300 - DNA, 15 bp, Homo sapiens
aaaggcaatacctgt

SEQ ID NO: 254301 - DNA, 15 bp, Homo sapiens
gaaaggcaatacctg

SEQ ID NO: 254302 - DNA, 15 bp, Homo sapiens
agaaaggcaatacct

SEQ ID NO: 254303 - DNA, 15 bp, Homo sapiens
aagaaaggcaatacc

SEQ ID NO: 254304 - DNA, 15 bp, Homo sapiens
taagaaaggcaatac

SEQ ID NO: 254305 - DNA, 15 bp, Homo sapiens
ctaagaaaggcaata

SEQ ID NO: 254306 - DNA, 15 bp, Homo sapiens
cctaagaaaggcaat

SEQ ID NO: 254307 - DNA, 15 bp, Homo sapiens
tcctaagaaaggcaa

SEQ ID NO: 254308 - DNA, 15 bp, Homo sapiens
ctcctaagaaaggca

SEQ ID NO: 254309 - DNA, 15 bp, Homo sapiens
tctcctaagaaaggc

SEQ ID NO: 254310 - DNA, 15 bp, Homo sapiens
ttctcctaagaaagg

SEQ ID NO: 254311 - DNA, 15 bp, Homo sapiens
attctcctaagaaag

SEQ ID NO: 254312 - DNA, 15 bp, Homo sapiens
aattctcctaagaaa

SEQ ID NO: 254313 - DNA, 15 bp, Homo sapiens
caattctcctaagaa

SEQ ID NO: 254314 - DNA, 15 bp, Homo sapiens
acaattctcctaaga

SEQ ID NO: 254315 - DNA, 15 bp, Homo sapiens
cacaattctcctaag

SEQ ID NO: 254316 - DNA, 15 bp, Homo sapiens
acacaattctcctaa

SEQ ID NO: 254317 - DNA, 15 bp, Homo sapiens
cacacaattctccta

SEQ ID NO: 254318 - DNA, 15 bp, Homo sapiens
ccacacaattctcct

SEQ ID NO: 254319 - DNA, 15 bp, Homo sapiens
accacacaattctcc

SEQ ID NO: 254320 - DNA, 15 bp, Homo sapiens
aaccacacaattctc

SEQ ID NO: 254321 - DNA, 15 bp, Homo sapiens
aaaccacacaattct

SEQ ID NO: 254322 - DNA, 15 bp, Homo sapiens
caaaccacacaattc

SEQ ID NO: 254323 - DNA, 15 bp, Homo sapiens
tcaaaccacacaatt

SEQ ID NO: 254324 - DNA, 15 bp, Homo sapiens
ttcaaaccacacaat

SEQ ID NO: 254325 - DNA, 15 bp, Homo sapiens
tttcaaaccacacaa

SEQ ID NO: 254326 - DNA, 15 bp, Homo sapiens
atttcaaaccacaca

SEQ ID NO: 254327 - DNA, 15 bp, Homo sapiens
gatttcaaaccacac

SEQ ID NO: 254328 - DNA, 15 bp, Homo sapiens
tgatttcaaaccaca

SEQ ID NO: 254329 - DNA, 15 bp, Homo sapiens
atgatttcaaaccac

SEQ ID NO: 254330 - DNA, 15 bp, Homo sapiens
catgatttcaaacca

SEQ ID NO: 254331 - DNA, 15 bp, Homo sapiens
acatgatttcaaacc

SEQ ID NO: 254332 - DNA, 15 bp, Homo sapiens
cacatgatttcaaac

SEQ ID NO: 254333 - DNA, 15 bp, Homo sapiens
tcacatgatttcaaa

SEQ ID NO: 254334 - DNA, 15 bp, Homo sapiens
ctcacatgatttcaa

SEQ ID NO: 254335 - DNA, 15 bp, Homo sapiens
gctcacatgatttca

SEQ ID NO: 254336 - DNA, 15 bp, Homo sapiens
ggctcacatgatttc

SEQ ID NO: 254337 - DNA, 15 bp, Homo sapiens
tggctcacatgattt

SEQ ID NO: 254338 - DNA, 15 bp, Homo sapiens
tttggctcacatgat

SEQ ID NO: 254339 - DNA, 15 bp, Homo sapiens
ttttggctcacatga

SEQ ID NO: 254340 - DNA, 15 bp, Homo sapiens
tttttggctcacatg

SEQ ID NO: 254341 - DNA, 15 bp, Homo sapiens
ctttttggctcacat

SEQ ID NO: 254342 - DNA, 15 bp, Homo sapiens
tctttttggctcaca

SEQ ID NO: 254343 - DNA, 15 bp, Homo sapiens
ctctttttggctcac

SEQ ID NO: 254344 - DNA, 15 bp, Homo sapiens
actctttttggctca

SEQ ID NO: 254345 - DNA, 15 bp, Homo sapiens
aactctttttggctc

SEQ ID NO: 254346 - DNA, 15 bp, Homo sapiens
caactctttttggct

SEQ ID NO: 254347 - DNA, 15 bp, Homo sapiens
tcaactctttttggc

SEQ ID NO: 254348 - DNA, 15 bp, Homo sapiens
atcaactctttttgg

SEQ ID NO: 254349 - DNA, 15 bp, Homo sapiens
aatcaactctttttg

SEQ ID NO: 254350 - DNA, 15 bp, Homo sapiens
aaatcaactcttttt

SEQ ID NO: 254351 - DNA, 15 bp, Homo sapiens
taaatcaactctttt

SEQ ID NO: 254352 - DNA, 15 bp, Homo sapiens
gtaaatcaactcttt

SEQ ID NO: 254353 - DNA, 15 bp, Homo sapiens
tgtaaatcaactctt

SEQ ID NO: 254354 - DNA, 15 bp, Homo sapiens
ctgtaaatcaactct

SEQ ID NO: 254355 - DNA, 15 bp, Homo sapiens
cctgtaaatcaactc

SEQ ID NO: 254356 - DNA, 15 bp, Homo sapiens
ccctgtaaatcaact

SEQ ID NO: 254357 - DNA, 15 bp, Homo sapiens
tccctgtaaatcaac

SEQ ID NO: 254358 - DNA, 15 bp, Homo sapiens
ctccctgtaaatcaa

SEQ ID NO: 254359 - DNA, 15 bp, Homo sapiens
cctccctgtaaatca

SEQ ID NO: 254360 - DNA, 15 bp, Homo sapiens
tcctccctgtaaatc

SEQ ID NO: 254361 - DNA, 15 bp, Homo sapiens
ttcctccctgtaaat

SEQ ID NO: 254362 - DNA, 15 bp, Homo sapiens
attcctccctgtaaa

SEQ ID NO: 254363 - DNA, 15 bp, Homo sapiens
cattcctccctgtaa

SEQ ID NO: 254364 - DNA, 15 bp, Homo sapiens
acattcctccctgta

SEQ ID NO: 254365 - DNA, 15 bp, Homo sapiens
tacattcctccctgt

SEQ ID NO: 254366 - DNA, 15 bp, Homo sapiens
ttacattcctccctg

SEQ ID NO: 254367 - DNA, 15 bp, Homo sapiens
attacattcctccct

SEQ ID NO: 254368 - DNA, 15 bp, Homo sapiens
aattacattcctccc

SEQ ID NO: 254369 - DNA, 15 bp, Homo sapiens
caattacattcctcc

SEQ ID NO: 254370 - DNA, 15 bp, Homo sapiens
acaattacattcctc

SEQ ID NO: 254371 - DNA, 15 bp, Homo sapiens
tacaattacattcct

SEQ ID NO: 254372 - DNA, 15 bp, Homo sapiens
ctacaattacattcc

SEQ ID NO: 254373 - DNA, 15 bp, Homo sapiens
actacaattacattc

SEQ ID NO: 254374 - DNA, 15 bp, Homo sapiens
aactacaattacatt

SEQ ID NO: 254375 - DNA, 15 bp, Homo sapiens
aaactacaattacat

SEQ ID NO: 254376 - DNA, 15 bp, Homo sapiens
aaaactacaattaca

SEQ ID NO: 254377 - DNA, 15 bp, Homo sapiens
aaaaactacaattac

SEQ ID NO: 254378 - DNA, 15 bp, Homo sapiens
taaaaactacaatta

SEQ ID NO: 254379 - DNA, 15 bp, Homo sapiens
gtaaaaactacaatt

SEQ ID NO: 254380 - DNA, 15 bp, Homo sapiens
ggtaaaaactacaat

SEQ ID NO: 254381 - DNA, 15 bp, Homo sapiens
aggtaaaaactacaa

SEQ ID NO: 254382 - DNA, 15 bp, Homo sapiens
gaggtaaaaactaca

SEQ ID NO: 254383 - DNA, 15 bp, Homo sapiens
ggaggtaaaaactac

SEQ ID NO: 254384 - DNA, 15 bp, Homo sapiens
aggaggtaaaaacta

SEQ ID NO: 254385 - DNA, 15 bp, Homo sapiens
aaggaggtaaaaact

SEQ ID NO: 254386 - DNA, 15 bp, Homo sapiens
gaaggaggtaaaaac

SEQ ID NO: 254387 - DNA, 15 bp, Homo sapiens
cgaaggaggtaaaaa

SEQ ID NO: 254388 - DNA, 15 bp, Homo sapiens
acgaaggaggtaaaa

SEQ ID NO: 254389 - DNA, 15 bp, Homo sapiens
tacgaaggaggtaaa

SEQ ID NO: 254390 - DNA, 15 bp, Homo sapiens
atacgaaggaggtaa

SEQ ID NO: 254391 - DNA, 15 bp, Homo sapiens
aatacgaaggaggta

SEQ ID NO: 254392 - DNA, 15 bp, Homo sapiens
caatacgaaggaggt

SEQ ID NO: 254393 - DNA, 15 bp, Homo sapiens
tcaatacgaaggagg

SEQ ID NO: 254394 - DNA, 15 bp, Homo sapiens
ctcaatacgaaggag

SEQ ID NO: 254395 - DNA, 15 bp, Homo sapiens
actcaatacgaagga

SEQ ID NO: 254396 - DNA, 15 bp, Homo sapiens
gactcaatacgaagg

SEQ ID NO: 254397 - DNA, 15 bp, Homo sapiens
tgactcaatacgaag

SEQ ID NO: 254398 - DNA, 15 bp, Homo sapiens
atgactcaatacgaa

SEQ ID NO: 254399 - DNA, 15 bp, Homo sapiens
gatgactcaatacga

SEQ ID NO: 254400 - DNA, 15 bp, Homo sapiens
agatgactcaatacg

SEQ ID NO: 254401 - DNA, 15 bp, Homo sapiens
aagatgactcaatac

SEQ ID NO: 254402 - DNA, 15 bp, Homo sapiens
taagatgactcaata

SEQ ID NO: 254403 - DNA, 15 bp, Homo sapiens
ttaagatgactcaat

SEQ ID NO: 254404 - DNA, 15 bp, Homo sapiens
gttaagatgactcaa

SEQ ID NO: 254405 - DNA, 15 bp, Homo sapiens
ggttaagatgactca

SEQ ID NO: 254406 - DNA, 15 bp, Homo sapiens
aggttaagatgactc

SEQ ID NO: 254407 - DNA, 15 bp, Homo sapiens
aaggttaagatgact

SEQ ID NO: 254408 - DNA, 15 bp, Homo sapiens
gaaggttaagatgac

SEQ ID NO: 254409 - DNA, 15 bp, Homo sapiens
tgaaggttaagatga

SEQ ID NO: 254410 - DNA, 15 bp, Homo sapiens
ctgaaggttaagatg

SEQ ID NO: 254411 - DNA, 15 bp, Homo sapiens
gctgaaggttaagat

SEQ ID NO: 254412 - DNA, 15 bp, Homo sapiens
agctgaaggttaaga

SEQ ID NO: 254413 - DNA, 15 bp, Homo sapiens
aagctgaaggttaag

SEQ ID NO: 254414 - DNA, 15 bp, Homo sapiens
aaagctgaaggttaa

SEQ ID NO: 254415 - DNA, 15 bp, Homo sapiens
caaagctgaaggtta

SEQ ID NO: 254416 - DNA, 15 bp, Homo sapiens
gcaaagctgaaggtt

SEQ ID NO: 254417 - DNA, 15 bp, Homo sapiens
tgcaaagctgaaggt

SEQ ID NO: 254418 - DNA, 15 bp, Homo sapiens
gtgcaaagctgaagg

SEQ ID NO: 254419 - DNA, 15 bp, Homo sapiens
cgtgcaaagctgaag

SEQ ID NO: 254420 - DNA, 15 bp, Homo sapiens
gcgtgcaaagctgaa

SEQ ID NO: 254421 - DNA, 15 bp, Homo sapiens
tgcgtgcaaagctga

SEQ ID NO: 254422 - DNA, 15 bp, Homo sapiens
ttgcgtgcaaagctg

SEQ ID NO: 254423 - DNA, 15 bp, Homo sapiens
tttgcgtgcaaagct

SEQ ID NO: 254424 - DNA, 15 bp, Homo sapiens
ttttgcgtgcaaagc

SEQ ID NO: 254425 - DNA, 15 bp, Homo sapiens
tttttgcgtgcaaag

SEQ ID NO: 254426 - DNA, 15 bp, Homo sapiens
ttttttgcgtgcaaa

SEQ ID NO: 254427 - DNA, 15 bp, Homo sapiens
attttttgcgtgcaa

SEQ ID NO: 254428 - DNA, 15 bp, Homo sapiens
tattttttgcgtgca

SEQ ID NO: 254429 - DNA, 15 bp, Homo sapiens
atattttttgcgtgc

SEQ ID NO: 254430 - DNA, 15 bp, Homo sapiens
tatattttttgcgtg

SEQ ID NO: 254431 - DNA, 15 bp, Homo sapiens
atatattttttgcgt

SEQ ID NO: 254432 - DNA, 15 bp, Homo sapiens
tatatattttttgcg

SEQ ID NO: 254433 - DNA, 15 bp, Homo sapiens
tatatatattttttg

SEQ ID NO: 254434 - DNA, 15 bp, Homo sapiens
ctatatatatttttt

SEQ ID NO: 254435 - DNA, 15 bp, Homo sapiens
tctatatatattttt

SEQ ID NO: 254436 - DNA, 15 bp, Homo sapiens
atctatatatatttt

SEQ ID NO: 254437 - DNA, 15 bp, Homo sapiens
tatctatatatattt

SEQ ID NO: 254438 - DNA, 15 bp, Homo sapiens
atatctatatatatt

SEQ ID NO: 254439 - DNA, 15 bp, Homo sapiens
tatatctatatatat

SEQ ID NO: 254440 - DNA, 15 bp, Homo sapiens
gtatatctatatata

SEQ ID NO: 254441 - DNA, 15 bp, Homo sapiens
tgtatatctatatat

SEQ ID NO: 254442 - DNA, 15 bp, Homo sapiens
ttgtatatctatata

SEQ ID NO: 254443 - DNA, 15 bp, Homo sapiens
attgtatatctatat

SEQ ID NO: 254444 - DNA, 15 bp, Homo sapiens
aattgtatatctata

SEQ ID NO: 254445 - DNA, 15 bp, Homo sapiens
taattgtatatctat

SEQ ID NO: 254446 - DNA, 15 bp, Homo sapiens
gtaattgtatatcta

SEQ ID NO: 254447 - DNA, 15 bp, Homo sapiens
tgtaattgtatatct

SEQ ID NO: 254448 - DNA, 15 bp, Homo sapiens
ttgtaattgtatatc

SEQ ID NO: 254449 - DNA, 15 bp, Homo sapiens
attgtaattgtatat

SEQ ID NO: 254450 - DNA, 15 bp, Homo sapiens
tattgtaattgtata

SEQ ID NO: 254451 - DNA, 15 bp, Homo sapiens
atattgtaattgtat

SEQ ID NO: 254452 - DNA, 15 bp, Homo sapiens
tatattgtaattgta

SEQ ID NO: 254453 - DNA, 15 bp, Homo sapiens
ctatattgtaattgt

SEQ ID NO: 254454 - DNA, 15 bp, Homo sapiens
gctatattgtaattg

SEQ ID NO: 254455 - DNA, 15 bp, Homo sapiens
ggctatattgtaatt

SEQ ID NO: 254456 - DNA, 15 bp, Homo sapiens
tggctatattgtaat

SEQ ID NO: 254457 - DNA, 15 bp, Homo sapiens
ttggctatattgtaa

SEQ ID NO: 254458 - DNA, 15 bp, Homo sapiens
gttggctatattgta

SEQ ID NO: 254459 - DNA, 15 bp, Homo sapiens
agttggctatattgt

SEQ ID NO: 254460 - DNA, 15 bp, Homo sapiens
aagttggctatattg

SEQ ID NO: 254461 - DNA, 15 bp, Homo sapiens
aaagttggctatatt

SEQ ID NO: 254462 - DNA, 15 bp, Homo sapiens
taaagttggctatat

SEQ ID NO: 254463 - DNA, 15 bp, Homo sapiens
ttaaagttggctata

SEQ ID NO: 254464 - DNA, 15 bp, Homo sapiens
attaaagttggctat

SEQ ID NO: 254465 - DNA, 15 bp, Homo sapiens
gattaaagttggcta

SEQ ID NO: 254466 - DNA, 15 bp, Homo sapiens
ggattaaagttggct

SEQ ID NO: 254467 - DNA, 15 bp, Homo sapiens
tggattaaagttggc

SEQ ID NO: 254468 - DNA, 15 bp, Homo sapiens
gtggattaaagttgg

SEQ ID NO: 254469 - DNA, 15 bp, Homo sapiens
agtggattaaagttg

SEQ ID NO: 254470 - DNA, 15 bp, Homo sapiens
cagtggattaaagtt

SEQ ID NO: 254471 - DNA, 15 bp, Homo sapiens
gcagtggattaaagt

SEQ ID NO: 254472 - DNA, 15 bp, Homo sapiens
ggcagtggattaaag

SEQ ID NO: 254473 - DNA, 15 bp, Homo sapiens
aggcagtggattaaa

SEQ ID NO: 254474 - DNA, 15 bp, Homo sapiens
aaggcagtggattaa

SEQ ID NO: 254475 - DNA, 15 bp, Homo sapiens
taaggcagtggatta

SEQ ID NO: 254476 - DNA, 15 bp, Homo sapiens
ttaaggcagtggatt

SEQ ID NO: 254477 - DNA, 15 bp, Homo sapiens
tttaaggcagtggat

SEQ ID NO: 254478 - DNA, 15 bp, Homo sapiens
atttaaggcagtgga

SEQ ID NO: 254479 - DNA, 15 bp, Homo sapiens
aatttaaggcagtgg

SEQ ID NO: 254480 - DNA, 15 bp, Homo sapiens
aaatttaaggcagtg

SEQ ID NO: 254481 - DNA, 15 bp, Homo sapiens
caaatttaaggcagt

SEQ ID NO: 254482 - DNA, 15 bp, Homo sapiens
gcaaatttaaggcag

SEQ ID NO: 254483 - DNA, 15 bp, Homo sapiens
agcaaatttaaggca

SEQ ID NO: 254484 - DNA, 15 bp, Homo sapiens
aagcaaatttaaggc

SEQ ID NO: 254485 - DNA, 15 bp, Homo sapiens
aaagcaaatttaagg

SEQ ID NO: 254486 - DNA, 15 bp, Homo sapiens
aaaagcaaatttaag

SEQ ID NO: 254487 - DNA, 15 bp, Homo sapiens
caaaagcaaatttaa

SEQ ID NO: 254488 - DNA, 15 bp, Homo sapiens
ccaaaagcaaattta

SEQ ID NO: 254489 - DNA, 15 bp, Homo sapiens
gccaaaagcaaattt

SEQ ID NO: 254490 - DNA, 15 bp, Homo sapiens
agccaaaagcaaatt

SEQ ID NO: 254491 - DNA, 15 bp, Homo sapiens
gagccaaaagcaaat

SEQ ID NO: 254492 - DNA, 15 bp, Homo sapiens
tgagccaaaagcaaa

SEQ ID NO: 254493 - DNA, 15 bp, Homo sapiens
gtgagccaaaagcaa

SEQ ID NO: 254494 - DNA, 15 bp, Homo sapiens
agtgagccaaaagca

SEQ ID NO: 254495 - DNA, 15 bp, Homo sapiens
aagtgagccaaaagc

SEQ ID NO: 254496 - DNA, 15 bp, Homo sapiens
aaagtgagccaaaag

SEQ ID NO: 254497 - DNA, 15 bp, Homo sapiens
aaaagtgagccaaaa

SEQ ID NO: 254498 - DNA, 15 bp, Homo sapiens
aaaaagtgagccaaa

SEQ ID NO: 254499 - DNA, 15 bp, Homo sapiens
taaaaagtgagccaa

SEQ ID NO: 254500 - DNA, 15 bp, Homo sapiens
ataaaaagtgagcca

SEQ ID NO: 254501 - DNA, 15 bp, Homo sapiens
aataaaaagtgagcc

SEQ ID NO: 254502 - DNA, 15 bp, Homo sapiens
aaataaaaagtgagc

SEQ ID NO: 254503 - DNA, 15 bp, Homo sapiens
taaataaaaagtgag

SEQ ID NO: 254504 - DNA, 15 bp, Homo sapiens
ctaaataaaaagtga

SEQ ID NO: 254505 - DNA, 15 bp, Homo sapiens
actaaataaaaagtg

SEQ ID NO: 254506 - DNA, 15 bp, Homo sapiens
tactaaataaaaagt

SEQ ID NO: 254507 - DNA, 15 bp, Homo sapiens
gtactaaataaaaag

SEQ ID NO: 254508 - DNA, 15 bp, Homo sapiens
cgtactaaataaaaa

SEQ ID NO: 254509 - DNA, 15 bp, Homo sapiens
acgtactaaataaaa

SEQ ID NO: 254510 - DNA, 15 bp, Homo sapiens
cacgtactaaataaa

SEQ ID NO: 254511 - DNA, 15 bp, Homo sapiens
gcacgtactaaataa

SEQ ID NO: 254512 - DNA, 15 bp, Homo sapiens
ggcacgtactaaata

SEQ ID NO: 254513 - DNA, 15 bp, Homo sapiens
tggcacgtactaaat

SEQ ID NO: 254514 - DNA, 15 bp, Homo sapiens
atggcacgtactaaa

SEQ ID NO: 254515 - DNA, 15 bp, Homo sapiens
gatggcacgtactaa

SEQ ID NO: 254516 - DNA, 15 bp, Homo sapiens
tgatggcacgtacta

SEQ ID NO: 254517 - DNA, 15 bp, Homo sapiens
ttgatggcacgtact

SEQ ID NO: 254518 - DNA, 15 bp, Homo sapiens
tttgatggcacgtac

SEQ ID NO: 254519 - DNA, 15 bp, Homo sapiens
atttgatggcacgta

SEQ ID NO: 254520 - DNA, 15 bp, Homo sapiens
aatttgatggcacgt

SEQ ID NO: 254521 - DNA, 15 bp, Homo sapiens
taatttgatggcacg

SEQ ID NO: 254522 - DNA, 15 bp, Homo sapiens
ctaatttgatggcac

SEQ ID NO: 254523 - DNA, 15 bp, Homo sapiens
gctaatttgatggca

SEQ ID NO: 254524 - DNA, 15 bp, Homo sapiens
agctaatttgatggc

SEQ ID NO: 254525 - DNA, 15 bp, Homo sapiens
gagctaatttgatgg

SEQ ID NO: 254526 - DNA, 15 bp, Homo sapiens
tgagctaatttgatg

SEQ ID NO: 254527 - DNA, 15 bp, Homo sapiens
gtgagctaatttgat

SEQ ID NO: 254528 - DNA, 15 bp, Homo sapiens
ggtgagctaatttga

SEQ ID NO: 254529 - DNA, 15 bp, Homo sapiens
aggtgagctaatttg

SEQ ID NO: 254530 - DNA, 15 bp, Homo sapiens
taggtgagctaattt

SEQ ID NO: 254531 - DNA, 15 bp, Homo sapiens
ctaggtgagctaatt

SEQ ID NO: 254532 - DNA, 15 bp, Homo sapiens
actaggtgagctaat

SEQ ID NO: 254533 - DNA, 15 bp, Homo sapiens
aactaggtgagctaa

SEQ ID NO: 254534 - DNA, 15 bp, Homo sapiens
aaactaggtgagcta

SEQ ID NO: 254535 - DNA, 15 bp, Homo sapiens
taaactaggtgagct

SEQ ID NO: 254536 - DNA, 15 bp, Homo sapiens
ttaaactaggtgagc

SEQ ID NO: 254537 - DNA, 15 bp, Homo sapiens
tttaaactaggtgag

SEQ ID NO: 254538 - DNA, 15 bp, Homo sapiens
atttaaactaggtga

SEQ ID NO: 254539 - DNA, 15 bp, Homo sapiens
aatttaaactaggtg

SEQ ID NO: 254540 - DNA, 15 bp, Homo sapiens
aaatttaaactaggt

SEQ ID NO: 254541 - DNA, 15 bp, Homo sapiens
caaatttaaactagg

SEQ ID NO: 254542 - DNA, 15 bp, Homo sapiens
acaaatttaaactag

SEQ ID NO: 254543 - DNA, 15 bp, Homo sapiens
gacaaatttaaacta

SEQ ID NO: 254544 - DNA, 15 bp, Homo sapiens
agacaaatttaaact

SEQ ID NO: 254545 - DNA, 15 bp, Homo sapiens
tagacaaatttaaac

SEQ ID NO: 254546 - DNA, 15 bp, Homo sapiens
ttagacaaatttaaa

SEQ ID NO: 254547 - DNA, 15 bp, Homo sapiens
tttagacaaatttaa

SEQ ID NO: 254548 - DNA, 15 bp, Homo sapiens
atttagacaaattta

SEQ ID NO: 254549 - DNA, 15 bp, Homo sapiens
aatttagacaaattt

SEQ ID NO: 254550 - DNA, 15 bp, Homo sapiens
caatttagacaaatt

SEQ ID NO: 254551 - DNA, 15 bp, Homo sapiens
acaatttagacaaat

SEQ ID NO: 254552 - DNA, 15 bp, Homo sapiens
aacaatttagacaaa

SEQ ID NO: 254553 - DNA, 15 bp, Homo sapiens
taacaatttagacaa

SEQ ID NO: 254554 - DNA, 15 bp, Homo sapiens
ttaacaatttagaca

SEQ ID NO: 254555 - DNA, 15 bp, Homo sapiens
tttaacaatttagac

SEQ ID NO: 254556 - DNA, 15 bp, Homo sapiens
ttttaacaatttaga

SEQ ID NO: 254557 - DNA, 15 bp, Homo sapiens
cttttaacaatttag

SEQ ID NO: 254558 - DNA, 15 bp, Homo sapiens
gcttttaacaattta

SEQ ID NO: 254559 - DNA, 15 bp, Homo sapiens
agcttttaacaattt

SEQ ID NO: 254560 - DNA, 15 bp, Homo sapiens
tagcttttaacaatt

SEQ ID NO: 254561 - DNA, 15 bp, Homo sapiens
ttagcttttaacaat

SEQ ID NO: 254562 - DNA, 15 bp, Homo sapiens
tttagcttttaacaa

SEQ ID NO: 254563 - DNA, 15 bp, Homo sapiens
atttagcttttaaca

SEQ ID NO: 254564 - DNA, 15 bp, Homo sapiens
aatttagcttttaac

SEQ ID NO: 254565 - DNA, 15 bp, Homo sapiens
gaatttagcttttaa

SEQ ID NO: 254566 - DNA, 15 bp, Homo sapiens
tgaatttagctttta

SEQ ID NO: 254567 - DNA, 15 bp, Homo sapiens
atgaatttagctttt

SEQ ID NO: 254568 - DNA, 15 bp, Homo sapiens
aatgaatttagcttt

SEQ ID NO: 254569 - DNA, 15 bp, Homo sapiens
aaatgaatttagctt

SEQ ID NO: 254570 - DNA, 15 bp, Homo sapiens
aaaatgaatttagct

SEQ ID NO: 254571 - DNA, 15 bp, Homo sapiens
aaaaatgaatttagc

SEQ ID NO: 254572 - DNA, 15 bp, Homo sapiens
taaaaatgaatttag

SEQ ID NO: 254573 - DNA, 15 bp, Homo sapiens
ataaaaatgaattta

SEQ ID NO: 254574 - DNA, 15 bp, Homo sapiens
tataaaaatgaattt

SEQ ID NO: 254575 - DNA, 15 bp, Homo sapiens
atataaaaatgaatt

SEQ ID NO: 254576 - DNA, 15 bp, Homo sapiens
tatataaaaatgaat

SEQ ID NO: 254577 - DNA, 15 bp, Homo sapiens
ttatataaaaatgaa

SEQ ID NO: 254578 - DNA, 15 bp, Homo sapiens
tttatataaaaatga

SEQ ID NO: 254579 - DNA, 15 bp, Homo sapiens
gcatttttatataaa

SEQ ID NO: 254580 - DNA, 15 bp, Homo sapiens
tgcatttttatataa

SEQ ID NO: 254581 - DNA, 15 bp, Homo sapiens
ttgcatttttatata

SEQ ID NO: 254582 - DNA, 15 bp, Homo sapiens
cttgcatttttatat

SEQ ID NO: 254583 - DNA, 15 bp, Homo sapiens
tcttgcatttttata

SEQ ID NO: 254584 - DNA, 15 bp, Homo sapiens
ttcttgcatttttat

SEQ ID NO: 254585 - DNA, 15 bp, Homo sapiens
tttcttgcattttta

SEQ ID NO: 254586 - DNA, 15 bp, Homo sapiens
ttttcttgcattttt

SEQ ID NO: 254587 - DNA, 15 bp, Homo sapiens
gttttcttgcatttt

SEQ ID NO: 254588 - DNA, 15 bp, Homo sapiens
tgttttcttgcattt

SEQ ID NO: 254589 - DNA, 15 bp, Homo sapiens
gtgttttcttgcatt

SEQ ID NO: 254590 - DNA, 15 bp, Homo sapiens
tgtgttttcttgcat

SEQ ID NO: 254591 - DNA, 15 bp, Homo sapiens
ctgtgttttcttgca

SEQ ID NO: 254592 - DNA, 15 bp, Homo sapiens
tctgtgttttcttgc

SEQ ID NO: 254593 - DNA, 15 bp, Homo sapiens
gtctgtgttttcttg

SEQ ID NO: 254594 - DNA, 15 bp, Homo sapiens
cgtctgtgttttctt

SEQ ID NO: 254595 - DNA, 15 bp, Homo sapiens
tcgtctgtgttttct

SEQ ID NO: 254596 - DNA, 15 bp, Homo sapiens
ctcgtctgtgttttc

SEQ ID NO: 254597 - DNA, 15 bp, Homo sapiens
tctcgtctgtgtttt

SEQ ID NO: 254598 - DNA, 15 bp, Homo sapiens
ttctcgtctgtgttt

SEQ ID NO: 254599 - DNA, 15 bp, Homo sapiens
attctcgtctgtgtt

SEQ ID NO: 254600 - DNA, 15 bp, Homo sapiens
aattctcgtctgtgt

SEQ ID NO: 254601 - DNA, 15 bp, Homo sapiens
gaattctcgtctgtg

SEQ ID NO: 254602 - DNA, 15 bp, Homo sapiens
ggaattctcgtctgt

SEQ ID NO: 254603 - DNA, 15 bp, Homo sapiens
cggaattctcgtctg

SEQ ID NO: 254604 - DNA, 15 bp, Homo sapiens
ccggaattctcgtct

SEQ ID NO: 254605 - DNA, 15 bp, Homo sapiens
accggaattctcgtc

SEQ ID NO: 254606 - DNA, 15 bp, Homo sapiens
aaccggaattctcgt

SEQ ID NO: 254607 - DNA, 15 bp, Homo sapiens
aaaccggaattctcg

SEQ ID NO: 254608 - DNA, 15 bp, Homo sapiens
aaaaccggaattctc

SEQ ID NO: 254609 - DNA, 15 bp, Homo sapiens
caaaaccggaattct

SEQ ID NO: 254610 - DNA, 15 bp, Homo sapiens
acaaaaccggaattc

SEQ ID NO: 254611 - DNA, 15 bp, Homo sapiens
aacaaaaccggaatt

SEQ ID NO: 254612 - DNA, 15 bp, Homo sapiens
aaacaaaaccggaat

SEQ ID NO: 254613 - DNA, 15 bp, Homo sapiens
aaaacaaaaccggaa

SEQ ID NO: 254614 - DNA, 15 bp, Homo sapiens
taaaacaaaaccgga

SEQ ID NO: 254615 - DNA, 15 bp, Homo sapiens
ttaaaacaaaaccgg

SEQ ID NO: 254616 - DNA, 15 bp, Homo sapiens
attaaaacaaaaccg

SEQ ID NO: 254617 - DNA, 15 bp, Homo sapiens
aattaaaacaaaacc

SEQ ID NO: 254618 - DNA, 15 bp, Homo sapiens
aaattaaaacaaaac

SEQ ID NO: 254619 - DNA, 15 bp, Homo sapiens
gaaattaaaacaaaa

SEQ ID NO: 254620 - DNA, 15 bp, Homo sapiens
agaaattaaaacaaa

SEQ ID NO: 254621 - DNA, 15 bp, Homo sapiens
tagaaattaaaacaa

SEQ ID NO: 254622 - DNA, 15 bp, Homo sapiens
ctagaaattaaaaca

SEQ ID NO: 254623 - DNA, 15 bp, Homo sapiens
actagaaattaaaac

SEQ ID NO: 254624 - DNA, 15 bp, Homo sapiens
cactagaaattaaaa

SEQ ID NO: 254625 - DNA, 15 bp, Homo sapiens
gcactagaaattaaa

SEQ ID NO: 254626 - DNA, 15 bp, Homo sapiens
tgcactagaaattaa

SEQ ID NO: 254627 - DNA, 15 bp, Homo sapiens
ttgcactagaaatta

SEQ ID NO: 254628 - DNA, 15 bp, Homo sapiens
attgcactagaaatt

SEQ ID NO: 254629 - DNA, 15 bp, Homo sapiens
cattgcactagaaat

SEQ ID NO: 254630 - DNA, 15 bp, Homo sapiens
acattgcactagaaa

SEQ ID NO: 254631 - DNA, 15 bp, Homo sapiens
cacattgcactagaa

SEQ ID NO: 254632 - DNA, 15 bp, Homo sapiens
ccacattgcactaga

SEQ ID NO: 254633 - DNA, 15 bp, Homo sapiens
gccacattgcactag

SEQ ID NO: 254634 - DNA, 15 bp, Homo sapiens
agccacattgcacta

SEQ ID NO: 254635 - DNA, 15 bp, Homo sapiens
aagccacattgcact

SEQ ID NO: 254636 - DNA, 15 bp, Homo sapiens
aaagccacattgcac

SEQ ID NO: 254637 - DNA, 15 bp, Homo sapiens
gaaagccacattgca

SEQ ID NO: 254638 - DNA, 15 bp, Homo sapiens
tgaaagccacattgc

SEQ ID NO: 254639 - DNA, 15 bp, Homo sapiens
ttgaaagccacattg

SEQ ID NO: 254640 - DNA, 15 bp, Homo sapiens
gttgaaagccacatt

SEQ ID NO: 254641 - DNA, 15 bp, Homo sapiens
agttgaaagccacat

SEQ ID NO: 254642 - DNA, 15 bp, Homo sapiens
aagttgaaagccaca

SEQ ID NO: 254643 - DNA, 15 bp, Homo sapiens
taagttgaaagccac

SEQ ID NO: 254644 - DNA, 15 bp, Homo sapiens
ataagttgaaagcca

SEQ ID NO: 254645 - DNA, 15 bp, Homo sapiens
aataagttgaaagcc

SEQ ID NO: 254646 - DNA, 15 bp, Homo sapiens
caataagttgaaagc

SEQ ID NO: 254647 - DNA, 15 bp, Homo sapiens
acaataagttgaaag

SEQ ID NO: 254648 - DNA, 15 bp, Homo sapiens
aacaataagttgaaa

SEQ ID NO: 254649 - DNA, 15 bp, Homo sapiens
aaacaataagttgaa

SEQ ID NO: 254650 - DNA, 15 bp, Homo sapiens
taaacaataagttga

SEQ ID NO: 254651 - DNA, 15 bp, Homo sapiens
ttaaacaataagttg

SEQ ID NO: 254652 - DNA, 15 bp, Homo sapiens
gttaaacaataagtt

SEQ ID NO: 254653 - DNA, 15 bp, Homo sapiens
ggttaaacaataagt

SEQ ID NO: 254654 - DNA, 15 bp, Homo sapiens
aggttaaacaataag

SEQ ID NO: 254655 - DNA, 15 bp, Homo sapiens
taggttaaacaataa

SEQ ID NO: 254656 - DNA, 15 bp, Homo sapiens
gtaggttaaacaata

SEQ ID NO: 254657 - DNA, 15 bp, Homo sapiens
agtaggttaaacaat

SEQ ID NO: 254658 - DNA, 15 bp, Homo sapiens
aagtaggttaaacaa

SEQ ID NO: 254659 - DNA, 15 bp, Homo sapiens
gaagtaggttaaaca

SEQ ID NO: 254660 - DNA, 15 bp, Homo sapiens
ggaagtaggttaaac

SEQ ID NO: 254661 - DNA, 15 bp, Homo sapiens
aggaagtaggttaaa

SEQ ID NO: 254662 - DNA, 15 bp, Homo sapiens
gaggaagtaggttaa

SEQ ID NO: 254663 - DNA, 15 bp, Homo sapiens
agaggaagtaggtta

SEQ ID NO: 254664 - DNA, 15 bp, Homo sapiens
cagaggaagtaggtt

SEQ ID NO: 254665 - DNA, 15 bp, Homo sapiens
ccagaggaagtaggt

SEQ ID NO: 254666 - DNA, 15 bp, Homo sapiens
accagaggaagtagg

SEQ ID NO: 254667 - DNA, 15 bp, Homo sapiens
aaccagaggaagtag

SEQ ID NO: 254668 - DNA, 15 bp, Homo sapiens
caaccagaggaagta

SEQ ID NO: 254669 - DNA, 15 bp, Homo sapiens
ccaaccagaggaagt

SEQ ID NO: 254670 - DNA, 15 bp, Homo sapiens
accaaccagaggaag

SEQ ID NO: 254671 - DNA, 15 bp, Homo sapiens
gaccaaccagaggaa

SEQ ID NO: 254672 - DNA, 15 bp, Homo sapiens
ggaccaaccagagga

SEQ ID NO: 254673 - DNA, 15 bp, Homo sapiens
tggaccaaccagagg

SEQ ID NO: 254674 - DNA, 15 bp, Homo sapiens
ctggaccaaccagag

SEQ ID NO: 254675 - DNA, 15 bp, Homo sapiens
gctggaccaaccaga

SEQ ID NO: 254676 - DNA, 15 bp, Homo sapiens
cgctggaccaaccag

SEQ ID NO: 254677 - DNA, 15 bp, Homo sapiens
ccgctggaccaacca

SEQ ID NO: 254678 - DNA, 15 bp, Homo sapiens
accgctggaccaacc

SEQ ID NO: 254679 - DNA, 15 bp, Homo sapiens
aaccgctggaccaac

SEQ ID NO: 254680 - DNA, 15 bp, Homo sapiens
aaaccgctggaccaa

SEQ ID NO: 254681 - DNA, 15 bp, Homo sapiens
aaaaccgctggacca

SEQ ID NO: 254682 - DNA, 15 bp, Homo sapiens
aaaaaccgctggacc

SEQ ID NO: 254683 - DNA, 15 bp, Homo sapiens
aaaaaaccgctggac

SEQ ID NO: 254684 - DNA, 15 bp, Homo sapiens
aaaaaaaccgctgga

SEQ ID NO: 254685 - DNA, 15 bp, Homo sapiens
taaaaaaaccgctgg

SEQ ID NO: 254686 - DNA, 15 bp, Homo sapiens
ttaaaaaaaccgctg

SEQ ID NO: 254687 - DNA, 15 bp, Homo sapiens
cttaaaaaaaccgct

SEQ ID NO: 254688 - DNA, 15 bp, Homo sapiens
acttaaaaaaaccgc

SEQ ID NO: 254689 - DNA, 15 bp, Homo sapiens
aacttaaaaaaaccg

SEQ ID NO: 254690 - DNA, 15 bp, Homo sapiens
aaacttaaaaaaacc

SEQ ID NO: 254691 - DNA, 15 bp, Homo sapiens
gaaaacttaaaaaaa

SEQ ID NO: 254692 - DNA, 15 bp, Homo sapiens
agaaaacttaaaaaa

SEQ ID NO: 254693 - DNA, 15 bp, Homo sapiens
gagaaaacttaaaaa

SEQ ID NO: 254694 - DNA, 15 bp, Homo sapiens
agagaaaacttaaaa

SEQ ID NO: 254695 - DNA, 15 bp, Homo sapiens
aagagaaaacttaaa

SEQ ID NO: 254696 - DNA, 15 bp, Homo sapiens
aaagagaaaacttaa

SEQ ID NO: 254697 - DNA, 15 bp, Homo sapiens
caaagagaaaactta

SEQ ID NO: 254698 - DNA, 15 bp, Homo sapiens
ccaaagagaaaactt

SEQ ID NO: 254699 - DNA, 15 bp, Homo sapiens
cccaaagagaaaact

SEQ ID NO: 254700 - DNA, 15 bp, Homo sapiens
acccaaagagaaaac

SEQ ID NO: 254701 - DNA, 15 bp, Homo sapiens
tacccaaagagaaaa

SEQ ID NO: 254702 - DNA, 15 bp, Homo sapiens
ctacccaaagagaaa

SEQ ID NO: 254703 - DNA, 15 bp, Homo sapiens
gctacccaaagagaa

SEQ ID NO: 254704 - DNA, 15 bp, Homo sapiens
agctacccaaagaga

SEQ ID NO: 254705 - DNA, 15 bp, Homo sapiens
tagctacccaaagag

SEQ ID NO: 254706 - DNA, 15 bp, Homo sapiens
ttagctacccaaaga

SEQ ID NO: 254707 - DNA, 15 bp, Homo sapiens
cttagctacccaaag

SEQ ID NO: 254708 - DNA, 15 bp, Homo sapiens
ccttagctacccaaa

SEQ ID NO: 254709 - DNA, 15 bp, Homo sapiens
tccttagctacccaa

SEQ ID NO: 254710 - DNA, 15 bp, Homo sapiens
ctccttagctaccca

SEQ ID NO: 254711 - DNA, 15 bp, Homo sapiens
tctccttagctaccc

SEQ ID NO: 254712 - DNA, 15 bp, Homo sapiens
atctccttagctacc

SEQ ID NO: 254713 - DNA, 15 bp, Homo sapiens
catctccttagctac

SEQ ID NO: 254714 - DNA, 15 bp, Homo sapiens
gcatctccttagcta

SEQ ID NO: 254715 - DNA, 15 bp, Homo sapiens
agcatctccttagct

SEQ ID NO: 254716 - DNA, 15 bp, Homo sapiens
cagcatctccttagc

SEQ ID NO: 254717 - DNA, 15 bp, Homo sapiens
ccagcatctccttag

SEQ ID NO: 254718 - DNA, 15 bp, Homo sapiens
tccagcatctcctta

SEQ ID NO: 254719 - DNA, 15 bp, Homo sapiens
ctccagcatctcctt

SEQ ID NO: 254720 - DNA, 15 bp, Homo sapiens
cctccagcatctcct

SEQ ID NO: 254721 - DNA, 15 bp, Homo sapiens
ccctccagcatctcc

SEQ ID NO: 254722 - DNA, 15 bp, Homo sapiens
tccctccagcatctc

SEQ ID NO: 254723 - DNA, 15 bp, Homo sapiens
ttccctccagcatct

SEQ ID NO: 254724 - DNA, 15 bp, Homo sapiens
tttccctccagcatc

SEQ ID NO: 254725 - DNA, 15 bp, Homo sapiens
ttttccctccagcat

SEQ ID NO: 254726 - DNA, 15 bp, Homo sapiens
tttttccctccagca

SEQ ID NO: 254727 - DNA, 15 bp, Homo sapiens
gtttttccctccagc

SEQ ID NO: 254728 - DNA, 15 bp, Homo sapiens
tgtttttccctccag

SEQ ID NO: 254729 - DNA, 15 bp, Homo sapiens
ctgtttttccctcca

SEQ ID NO: 254730 - DNA, 15 bp, Homo sapiens
gctgtttttccctcc

SEQ ID NO: 254731 - DNA, 15 bp, Homo sapiens
tgctgtttttccctc

SEQ ID NO: 254732 - DNA, 15 bp, Homo sapiens
gtgctgtttttccct

SEQ ID NO: 254733 - DNA, 15 bp, Homo sapiens
ggtgctgtttttccc

SEQ ID NO: 254734 - DNA, 15 bp, Homo sapiens
gggtgctgtttttcc

SEQ ID NO: 254735 - DNA, 15 bp, Homo sapiens
cgggtgctgtttttc

SEQ ID NO: 254736 - DNA, 15 bp, Homo sapiens
tcgggtgctgttttt

SEQ ID NO: 254737 - DNA, 15 bp, Homo sapiens
ttcgggtgctgtttt

SEQ ID NO: 254738 - DNA, 15 bp, Homo sapiens
cttcgggtgctgttt

SEQ ID NO: 254739 - DNA, 15 bp, Homo sapiens
gcttcgggtgctgtt

SEQ ID NO: 254740 - DNA, 15 bp, Homo sapiens
ggcttcgggtgctgt

SEQ ID NO: 254741 - DNA, 15 bp, Homo sapiens
aggcttcgggtgctg

SEQ ID NO: 254742 - DNA, 15 bp, Homo sapiens
gaggcttcgggtgct

SEQ ID NO: 254743 - DNA, 15 bp, Homo sapiens
ggaggcttcgggtgc

SEQ ID NO: 254744 - DNA, 15 bp, Homo sapiens
gggaggcttcgggtg

SEQ ID NO: 254745 - DNA, 15 bp, Homo sapiens
agggaggcttcgggt

SEQ ID NO: 254746 - DNA, 15 bp, Homo sapiens
gagggaggcttcggg

SEQ ID NO: 254747 - DNA, 15 bp, Homo sapiens
agagggaggcttcgg

SEQ ID NO: 254748 - DNA, 15 bp, Homo sapiens
gagagggaggcttcg

SEQ ID NO: 254749 - DNA, 15 bp, Homo sapiens
ggagagggaggcttc

SEQ ID NO: 254750 - DNA, 15 bp, Homo sapiens
gggagagggaggctt

SEQ ID NO: 254751 - DNA, 15 bp, Homo sapiens
tgggagagggaggct

SEQ ID NO: 254752 - DNA, 15 bp, Homo sapiens
atgggagagggaggc

SEQ ID NO: 254753 - DNA, 15 bp, Homo sapiens
aatgggagagggagg

SEQ ID NO: 254754 - DNA, 15 bp, Homo sapiens
aaatgggagagggag

SEQ ID NO: 254755 - DNA, 15 bp, Homo sapiens
gaaatgggagaggga

SEQ ID NO: 254756 - DNA, 15 bp, Homo sapiens
tgaaatgggagaggg

SEQ ID NO: 254757 - DNA, 15 bp, Homo sapiens
ttgaaatgggagagg

SEQ ID NO: 254758 - DNA, 15 bp, Homo sapiens
attgaaatgggagag

SEQ ID NO: 254759 - DNA, 15 bp, Homo sapiens
tattgaaatgggaga

SEQ ID NO: 254760 - DNA, 15 bp, Homo sapiens
ttattgaaatgggag

SEQ ID NO: 254761 - DNA, 15 bp, Homo sapiens
tttattgaaatggga

SEQ ID NO: 254762 - DNA, 15 bp, Homo sapiens
ttttattgaaatggg

SEQ ID NO: 254763 - DNA, 15 bp, Homo sapiens
tttttattgaaatgg

SEQ ID NO: 254764 - DNA, 15 bp, Homo sapiens
ctttttattgaaatg

SEQ ID NO: 254765 - DNA, 15 bp, Homo sapiens
cctttttattgaaat

SEQ ID NO: 254766 - DNA, 15 bp, Homo sapiens
tcctttttattgaaa

SEQ ID NO: 254767 - DNA, 15 bp, Homo sapiens
atcctttttattgaa

SEQ ID NO: 254768 - DNA, 15 bp, Homo sapiens
catcctttttattga

SEQ ID NO: 254769 - DNA, 15 bp, Homo sapiens
gcatcctttttattg

SEQ ID NO: 254770 - DNA, 15 bp, Homo sapiens
ggcatcctttttatt

SEQ ID NO: 254771 - DNA, 15 bp, Homo sapiens
gggcatcctttttat

SEQ ID NO: 254772 - DNA, 15 bp, Homo sapiens
ggggcatccttttta

SEQ ID NO: 254773 - DNA, 15 bp, Homo sapiens
gggggcatccttttt

SEQ ID NO: 254774 - DNA, 15 bp, Homo sapiens
agggggcatcctttt

SEQ ID NO: 254775 - DNA, 15 bp, Homo sapiens
aagggggcatccttt

SEQ ID NO: 254776 - DNA, 15 bp, Homo sapiens
aaagggggcatcctt

SEQ ID NO: 254777 - DNA, 15 bp, Homo sapiens
aaaagggggcatcct

SEQ ID NO: 254778 - DNA, 15 bp, Homo sapiens
aaaaagggggcatcc

SEQ ID NO: 254779 - DNA, 15 bp, Homo sapiens
aaaaaagggggcatc

SEQ ID NO: 254780 - DNA, 15 bp, Homo sapiens
taaaaaagggggcat

SEQ ID NO: 254781 - DNA, 15 bp, Homo sapiens
ttaaaaaagggggca

SEQ ID NO: 254782 - DNA, 15 bp, Homo sapiens
attaaaaaagggggc

SEQ ID NO: 254783 - DNA, 15 bp, Homo sapiens
gattaaaaaaggggg

SEQ ID NO: 254784 - DNA, 15 bp, Homo sapiens
agattaaaaaagggg

SEQ ID NO: 254785 - DNA, 15 bp, Homo sapiens
gagattaaaaaaggg

SEQ ID NO: 254786 - DNA, 15 bp, Homo sapiens
agagattaaaaaagg

SEQ ID NO: 254787 - DNA, 15 bp, Homo sapiens
aagagattaaaaaag

SEQ ID NO: 254788 - DNA, 15 bp, Homo sapiens
aaagagattaaaaaa

SEQ ID NO: 254789 - DNA, 15 bp, Homo sapiens
taaagagattaaaaa

SEQ ID NO: 254790 - DNA, 15 bp, Homo sapiens
ttaaagagattaaaa

SEQ ID NO: 254791 - DNA, 15 bp, Homo sapiens
tttaaagagattaaa

SEQ ID NO: 254792 - DNA, 15 bp, Homo sapiens
atttaaagagattaa

SEQ ID NO: 254793 - DNA, 15 bp, Homo sapiens
catttaaagagatta

SEQ ID NO: 254794 - DNA, 15 bp, Homo sapiens
acatttaaagagatt

SEQ ID NO: 254795 - DNA, 15 bp, Homo sapiens
aacatttaaagagat

SEQ ID NO: 254796 - DNA, 15 bp, Homo sapiens
caacatttaaagaga

SEQ ID NO: 254797 - DNA, 15 bp, Homo sapiens
ccaacatttaaagag

SEQ ID NO: 254798 - DNA, 15 bp, Homo sapiens
cccaacatttaaaga

SEQ ID NO: 254799 - DNA, 15 bp, Homo sapiens
gcccaacatttaaag

SEQ ID NO: 254800 - DNA, 15 bp, Homo sapiens
agcccaacatttaaa

SEQ ID NO: 254801 - DNA, 15 bp, Homo sapiens
aagcccaacatttaa

SEQ ID NO: 254802 - DNA, 15 bp, Homo sapiens
gaagcccaacattta

SEQ ID NO: 254803 - DNA, 15 bp, Homo sapiens
agaagcccaacattt

SEQ ID NO: 254804 - DNA, 15 bp, Homo sapiens
cagaagcccaacatt

SEQ ID NO: 254805 - DNA, 15 bp, Homo sapiens
acagaagcccaacat

SEQ ID NO: 254806 - DNA, 15 bp, Homo sapiens
cacagaagcccaaca

SEQ ID NO: 254807 - DNA, 15 bp, Homo sapiens
acacagaagcccaac

SEQ ID NO: 254808 - DNA, 15 bp, Homo sapiens
cacacagaagcccaa

SEQ ID NO: 254809 - DNA, 15 bp, Homo sapiens
tcacacagaagccca

SEQ ID NO: 254810 - DNA, 15 bp, Homo sapiens
ctcacacagaagccc

SEQ ID NO: 254811 - DNA, 15 bp, Homo sapiens
actcacacagaagcc

SEQ ID NO: 254812 - DNA, 15 bp, Homo sapiens
cactcacacagaagc

SEQ ID NO: 254813 - DNA, 15 bp, Homo sapiens
acactcacacagaag

SEQ ID NO: 254814 - DNA, 15 bp, Homo sapiens
aacactcacacagaa

SEQ ID NO: 254815 - DNA, 15 bp, Homo sapiens
aaacactcacacaga

SEQ ID NO: 254816 - DNA, 15 bp, Homo sapiens
aaaacactcacacag

SEQ ID NO: 254817 - DNA, 15 bp, Homo sapiens
aaaaacactcacaca

SEQ ID NO: 254818 - DNA, 15 bp, Homo sapiens
aaaaaacactcacac

SEQ ID NO: 254819 - DNA, 15 bp, Homo sapiens
aaaaaaacactcaca

SEQ ID NO: 254820 - DNA, 15 bp, Homo sapiens
aaaaaaaacactcac

SEQ ID NO: 254821 - DNA, 15 bp, Homo sapiens
aaaaaaaaacactca

SEQ ID NO: 254822 - DNA, 15 bp, Homo sapiens
aaaaaaaaaacactc

SEQ ID NO: 254823 - DNA, 15 bp, Homo sapiens
aaaaaaaaaaacact

SEQ ID NO: 254824 - DNA, 15 bp, Homo sapiens
caaaaaaaaaaacac

SEQ ID NO: 254825 - DNA, 15 bp, Homo sapiens
ccaaaaaaaaaaaca

SEQ ID NO: 254826 - DNA, 15 bp, Homo sapiens
accaaaaaaaaaaac

SEQ ID NO: 254827 - DNA, 15 bp, Homo sapiens
caccaaaaaaaaaaa

SEQ ID NO: 254828 - DNA, 15 bp, Homo sapiens
ccaccaaaaaaaaaa

SEQ ID NO: 254829 - DNA, 15 bp, Homo sapiens
cccaccaaaaaaaaa

SEQ ID NO: 254830 - DNA, 15 bp, Homo sapiens
acccaccaaaaaaaa

SEQ ID NO: 254831 - DNA, 15 bp, Homo sapiens
cacccaccaaaaaaa

SEQ ID NO: 254832 - DNA, 15 bp, Homo sapiens
tcacccaccaaaaaa

SEQ ID NO: 254833 - DNA, 15 bp, Homo sapiens
ttcacccaccaaaaa

SEQ ID NO: 254834 - DNA, 15 bp, Homo sapiens
cttcacccaccaaaa

SEQ ID NO: 254835 - DNA, 15 bp, Homo sapiens
ccttcacccaccaaa

SEQ ID NO: 254836 - DNA, 15 bp, Homo sapiens
cccttcacccaccaa

SEQ ID NO: 254837 - DNA, 15 bp, Homo sapiens
ccccttcacccacca

SEQ ID NO: 254838 - DNA, 15 bp, Homo sapiens
gccccttcacccacc

SEQ ID NO: 254839 - DNA, 15 bp, Homo sapiens
ggccccttcacccac

SEQ ID NO: 254840 - DNA, 15 bp, Homo sapiens
aggccccttcaccca

SEQ ID NO: 254841 - DNA, 15 bp, Homo sapiens
caggccccttcaccc

SEQ ID NO: 254842 - DNA, 15 bp, Homo sapiens
gcaggccccttcacc

SEQ ID NO: 254843 - DNA, 15 bp, Homo sapiens
tgcaggccccttcac

SEQ ID NO: 254844 - DNA, 15 bp, Homo sapiens
ttgcaggccccttca

SEQ ID NO: 254845 - DNA, 15 bp, Homo sapiens
tttgcaggccccttc

SEQ ID NO: 254846 - DNA, 15 bp, Homo sapiens
ttttgcaggcccctt

SEQ ID NO: 254847 - DNA, 15 bp, Homo sapiens
cttttgcaggcccct

SEQ ID NO: 254848 - DNA, 15 bp, Homo sapiens
acttttgcaggcccc

SEQ ID NO: 254849 - DNA, 15 bp, Homo sapiens
aacttttgcaggccc

SEQ ID NO: 254850 - DNA, 15 bp, Homo sapiens
caacttttgcaggcc

SEQ ID NO: 254851 - DNA, 15 bp, Homo sapiens
ccaacttttgcaggc

SEQ ID NO: 254852 - DNA, 15 bp, Homo sapiens
tccaacttttgcagg

SEQ ID NO: 254853 - DNA, 15 bp, Homo sapiens
gtccaacttttgcag

SEQ ID NO: 254854 - DNA, 15 bp, Homo sapiens
tgtccaacttttgca

SEQ ID NO: 254855 - DNA, 15 bp, Homo sapiens
ttgtccaacttttgc

SEQ ID NO: 254856 - DNA, 15 bp, Homo sapiens
tttgtccaacttttg

SEQ ID NO: 254857 - DNA, 15 bp, Homo sapiens
gtttgtccaactttt

SEQ ID NO: 254858 - DNA, 15 bp, Homo sapiens
tgtttgtccaacttt

SEQ ID NO: 254859 - DNA, 15 bp, Homo sapiens
ttgtttgtccaactt

SEQ ID NO: 254860 - DNA, 15 bp, Homo sapiens
tttgtttgtccaact

SEQ ID NO: 254861 - DNA, 15 bp, Homo sapiens
ttttgtttgtccaac

SEQ ID NO: 254862 - DNA, 15 bp, Homo sapiens
cttttgtttgtccaa

SEQ ID NO: 254863 - DNA, 15 bp, Homo sapiens
tcttttgtttgtcca

SEQ ID NO: 254864 - DNA, 15 bp, Homo sapiens
gtcttttgtttgtcc

SEQ ID NO: 254865 - DNA, 15 bp, Homo sapiens
tgtcttttgtttgtc

SEQ ID NO: 254866 - DNA, 15 bp, Homo sapiens
atgtcttttgtttgt

SEQ ID NO: 254867 - DNA, 15 bp, Homo sapiens
tatgtcttttgtttg

SEQ ID NO: 254868 - DNA, 15 bp, Homo sapiens
ctatgtcttttgttt

SEQ ID NO: 254869 - DNA, 15 bp, Homo sapiens
tctatgtcttttgtt

SEQ ID NO: 254870 - DNA, 15 bp, Homo sapiens
ttctatgtcttttgt

SEQ ID NO: 254871 - DNA, 15 bp, Homo sapiens
gttctatgtcttttg

SEQ ID NO: 254872 - DNA, 15 bp, Homo sapiens
agttctatgtctttt

SEQ ID NO: 254873 - DNA, 15 bp, Homo sapiens
cagttctatgtcttt

SEQ ID NO: 254874 - DNA, 15 bp, Homo sapiens
ccagttctatgtctt

SEQ ID NO: 254875 - DNA, 15 bp, Homo sapiens
accagttctatgtct

SEQ ID NO: 254876 - DNA, 15 bp, Homo sapiens
aaccagttctatgtc

SEQ ID NO: 254877 - DNA, 15 bp, Homo sapiens
aaaccagttctatgt

SEQ ID NO: 254878 - DNA, 15 bp, Homo sapiens
caaaccagttctatg

SEQ ID NO: 254879 - DNA, 15 bp, Homo sapiens
gcaaaccagttctat

SEQ ID NO: 254880 - DNA, 15 bp, Homo sapiens
agcaaaccagttcta

SEQ ID NO: 254881 - DNA, 15 bp, Homo sapiens
aagcaaaccagttct

SEQ ID NO: 254882 - DNA, 15 bp, Homo sapiens
taagcaaaccagttc

SEQ ID NO: 254883 - DNA, 15 bp, Homo sapiens
ctaagcaaaccagtt

SEQ ID NO: 254884 - DNA, 15 bp, Homo sapiens
actaagcaaaccagt

SEQ ID NO: 254885 - DNA, 15 bp, Homo sapiens
aactaagcaaaccag

SEQ ID NO: 254886 - DNA, 15 bp, Homo sapiens
aaactaagcaaacca

SEQ ID NO: 254887 - DNA, 15 bp, Homo sapiens
caaactaagcaaacc

SEQ ID NO: 254888 - DNA, 15 bp, Homo sapiens
acaaactaagcaaac

SEQ ID NO: 254889 - DNA, 15 bp, Homo sapiens
tacaaactaagcaaa

SEQ ID NO: 254890 - DNA, 15 bp, Homo sapiens
ttacaaactaagcaa

SEQ ID NO: 254891 - DNA, 15 bp, Homo sapiens
tttacaaactaagca

SEQ ID NO: 254892 - DNA, 15 bp, Homo sapiens
ttttacaaactaagc

SEQ ID NO: 254893 - DNA, 15 bp, Homo sapiens
attttacaaactaag

SEQ ID NO: 254894 - DNA, 15 bp, Homo sapiens
cattttacaaactaa

SEQ ID NO: 254895 - DNA, 15 bp, Homo sapiens
tcattttacaaacta

SEQ ID NO: 254896 - DNA, 15 bp, Homo sapiens
ctcattttacaaact

SEQ ID NO: 254897 - DNA, 15 bp, Homo sapiens
cctcattttacaaac

SEQ ID NO: 254898 - DNA, 15 bp, Homo sapiens
ccctcattttacaaa

SEQ ID NO: 254899 - DNA, 15 bp, Homo sapiens
cccctcattttacaa

SEQ ID NO: 254900 - DNA, 15 bp, Homo sapiens
ccccctcattttaca

SEQ ID NO: 254901 - DNA, 15 bp, Homo sapiens
gccccctcattttac

SEQ ID NO: 254902 - DNA, 15 bp, Homo sapiens
tgccccctcatttta

SEQ ID NO: 254903 - DNA, 15 bp, Homo sapiens
ttgccccctcatttt

SEQ ID NO: 254904 - DNA, 15 bp, Homo sapiens
tttgccccctcattt

SEQ ID NO: 254905 - DNA, 15 bp, Homo sapiens
atttgccccctcatt

SEQ ID NO: 254906 - DNA, 15 bp, Homo sapiens
aatttgccccctcat

SEQ ID NO: 254907 - DNA, 15 bp, Homo sapiens
aaatttgccccctca

SEQ ID NO: 254908 - DNA, 15 bp, Homo sapiens
aaaatttgccccctc

SEQ ID NO: 254909 - DNA, 15 bp, Homo sapiens
caaaatttgccccct

SEQ ID NO: 254910 - DNA, 15 bp, Homo sapiens
tcaaaatttgccccc

SEQ ID NO: 254911 - DNA, 15 bp, Homo sapiens
atcaaaatttgcccc

SEQ ID NO: 254912 - DNA, 15 bp, Homo sapiens
catcaaaatttgccc

SEQ ID NO: 254913 - DNA, 15 bp, Homo sapiens
tcatcaaaatttgcc

SEQ ID NO: 254914 - DNA, 15 bp, Homo sapiens
atcatcaaaatttgc

SEQ ID NO: 254915 - DNA, 15 bp, Homo sapiens
tatcatcaaaatttg

SEQ ID NO: 254916 - DNA, 15 bp, Homo sapiens
atatcatcaaaattt

SEQ ID NO: 254917 - DNA, 15 bp, Homo sapiens
gatatcatcaaaatt

SEQ ID NO: 254918 - DNA, 15 bp, Homo sapiens
agatatcatcaaaat

SEQ ID NO: 254919 - DNA, 15 bp, Homo sapiens
cagatatcatcaaaa

SEQ ID NO: 254920 - DNA, 15 bp, Homo sapiens
tcagatatcatcaaa

SEQ ID NO: 254921 - DNA, 15 bp, Homo sapiens
ctcagatatcatcaa

SEQ ID NO: 254922 - DNA, 15 bp, Homo sapiens
actcagatatcatca

SEQ ID NO: 254923 - DNA, 15 bp, Homo sapiens
aactcagatatcatc

SEQ ID NO: 254924 - DNA, 15 bp, Homo sapiens
aaactcagatatcat

SEQ ID NO: 254925 - DNA, 15 bp, Homo sapiens
aaaactcagatatca

SEQ ID NO: 254926 - DNA, 15 bp, Homo sapiens
gaaaactcagatatc

SEQ ID NO: 254927 - DNA, 15 bp, Homo sapiens
agaaaactcagatat

SEQ ID NO: 254928 - DNA, 15 bp, Homo sapiens
aagaaaactcagata

SEQ ID NO: 254929 - DNA, 15 bp, Homo sapiens
aaagaaaactcagat

SEQ ID NO: 254930 - DNA, 15 bp, Homo sapiens
aaaagaaaactcaga

SEQ ID NO: 254931 - DNA, 15 bp, Homo sapiens
taaaagaaaactcag

SEQ ID NO: 254932 - DNA, 15 bp, Homo sapiens
ttaaaagaaaactca

SEQ ID NO: 254933 - DNA, 15 bp, Homo sapiens
gttaaaagaaaactc

SEQ ID NO: 254934 - DNA, 15 bp, Homo sapiens
agttaaaagaaaact

SEQ ID NO: 254935 - DNA, 15 bp, Homo sapiens
gagttaaaagaaaac

SEQ ID NO: 254936 - DNA, 15 bp, Homo sapiens
agagttaaaagaaaa

SEQ ID NO: 254937 - DNA, 15 bp, Homo sapiens
tagagttaaaagaaa

SEQ ID NO: 254938 - DNA, 15 bp, Homo sapiens
gtagagttaaaagaa

SEQ ID NO: 254939 - DNA, 15 bp, Homo sapiens
agtagagttaaaaga

SEQ ID NO: 254940 - DNA, 15 bp, Homo sapiens
tagtagagttaaaag

SEQ ID NO: 254941 - DNA, 15 bp, Homo sapiens
ttagtagagttaaaa

SEQ ID NO: 254942 - DNA, 15 bp, Homo sapiens
attagtagagttaaa

SEQ ID NO: 254943 - DNA, 15 bp, Homo sapiens
gattagtagagttaa

SEQ ID NO: 254944 - DNA, 15 bp, Homo sapiens
agattagtagagtta

SEQ ID NO: 254945 - DNA, 15 bp, Homo sapiens
gagattagtagagtt

SEQ ID NO: 254946 - DNA, 15 bp, Homo sapiens
agagattagtagagt

SEQ ID NO: 254947 - DNA, 15 bp, Homo sapiens
cagagattagtagag

SEQ ID NO: 254948 - DNA, 15 bp, Homo sapiens
tcagagattagtaga

SEQ ID NO: 254949 - DNA, 15 bp, Homo sapiens
atcagagattagtag

SEQ ID NO: 254950 - DNA, 15 bp, Homo sapiens
tatcagagattagta

SEQ ID NO: 254951 - DNA, 15 bp, Homo sapiens
gtatcagagattagt

SEQ ID NO: 254952 - DNA, 15 bp, Homo sapiens
agtatcagagattag

SEQ ID NO: 254953 - DNA, 15 bp, Homo sapiens
gagtatcagagatta

SEQ ID NO: 254954 - DNA, 15 bp, Homo sapiens
agagtatcagagatt

SEQ ID NO: 254955 - DNA, 15 bp, Homo sapiens
cagagtatcagagat

SEQ ID NO: 254956 - DNA, 15 bp, Homo sapiens
acagagtatcagaga

SEQ ID NO: 254957 - DNA, 15 bp, Homo sapiens
gacagagtatcagag

SEQ ID NO: 254958 - DNA, 15 bp, Homo sapiens
agacagagtatcaga

SEQ ID NO: 254959 - DNA, 15 bp, Homo sapiens
aagacagagtatcag

SEQ ID NO: 254960 - DNA, 15 bp, Homo sapiens
aaagacagagtatca

SEQ ID NO: 254961 - DNA, 15 bp, Homo sapiens
taaagacagagtatc

SEQ ID NO: 254962 - DNA, 15 bp, Homo sapiens
ctaaagacagagtat

SEQ ID NO: 254963 - DNA, 15 bp, Homo sapiens
cctaaagacagagta

SEQ ID NO: 254964 - DNA, 15 bp, Homo sapiens
ccctaaagacagagt

SEQ ID NO: 254965 - DNA, 15 bp, Homo sapiens
cccctaaagacagag

SEQ ID NO: 254966 - DNA, 15 bp, Homo sapiens
tcccctaaagacaga

SEQ ID NO: 254967 - DNA, 15 bp, Homo sapiens
gtcccctaaagacag

SEQ ID NO: 254968 - DNA, 15 bp, Homo sapiens
tgtcccctaaagaca

SEQ ID NO: 254969 - DNA, 15 bp, Homo sapiens
ttgtcccctaaagac

SEQ ID NO: 254970 - DNA, 15 bp, Homo sapiens
tttgtcccctaaaga

SEQ ID NO: 254971 - DNA, 15 bp, Homo sapiens
ctttgtcccctaaag

SEQ ID NO: 254972 - DNA, 15 bp, Homo sapiens
tctttgtcccctaaa

SEQ ID NO: 254973 - DNA, 15 bp, Homo sapiens
ttctttgtcccctaa

SEQ ID NO: 254974 - DNA, 15 bp, Homo sapiens
tttctttgtccccta

SEQ ID NO: 254975 - DNA, 15 bp, Homo sapiens
ctttctttgtcccct

SEQ ID NO: 254976 - DNA, 15 bp, Homo sapiens
tctttctttgtcccc

SEQ ID NO: 254977 - DNA, 15 bp, Homo sapiens
ttctttctttgtccc

SEQ ID NO: 254978 - DNA, 15 bp, Homo sapiens
tttctttctttgtcc

SEQ ID NO: 254979 - DNA, 15 bp, Homo sapiens
atttctttctttgtc

SEQ ID NO: 254980 - DNA, 15 bp, Homo sapiens
aatttctttctttgt

SEQ ID NO: 254981 - DNA, 15 bp, Homo sapiens
taatttctttctttg

SEQ ID NO: 254982 - DNA, 15 bp, Homo sapiens
gtaatttctttcttt

SEQ ID NO: 254983 - DNA, 15 bp, Homo sapiens
tgtaatttctttctt

SEQ ID NO: 254984 - DNA, 15 bp, Homo sapiens
ttgtaatttctttct

SEQ ID NO: 254985 - DNA, 15 bp, Homo sapiens
attgtaatttctttc

SEQ ID NO: 254986 - DNA, 15 bp, Homo sapiens
tattgtaatttcttt

SEQ ID NO: 254987 - DNA, 15 bp, Homo sapiens
atattgtaatttctt

SEQ ID NO: 254988 - DNA, 15 bp, Homo sapiens
gatattgtaatttct

SEQ ID NO: 254989 - DNA, 15 bp, Homo sapiens
agatattgtaatttc

SEQ ID NO: 254990 - DNA, 15 bp, Homo sapiens
tagatattgtaattt

SEQ ID NO: 254991 - DNA, 15 bp, Homo sapiens
atagatattgtaatt

SEQ ID NO: 254992 - DNA, 15 bp, Homo sapiens
aatagatattgtaat

SEQ ID NO: 254993 - DNA, 15 bp, Homo sapiens
caatagatattgtaa

SEQ ID NO: 254994 - DNA, 15 bp, Homo sapiens
acaatagatattgta

SEQ ID NO: 254995 - DNA, 15 bp, Homo sapiens
aacaatagatattgt

SEQ ID NO: 254996 - DNA, 15 bp, Homo sapiens
aaacaatagatattg

SEQ ID NO: 254997 - DNA, 15 bp, Homo sapiens
gaaacaatagatatt

SEQ ID NO: 254998 - DNA, 15 bp, Homo sapiens
ggaaacaatagatat

SEQ ID NO: 254999 - DNA, 15 bp, Homo sapiens
tggaaacaatagata

SEQ ID NO: 255000 - DNA, 15 bp, Homo sapiens
ttggaaacaatagat

SEQ ID NO: 255001 - DNA, 15 bp, Homo sapiens
tttggaaacaataga

SEQ ID NO: 255002 - DNA, 15 bp, Homo sapiens
ctttggaaacaatag

SEQ ID NO: 255003 - DNA, 15 bp, Homo sapiens
tctttggaaacaata

SEQ ID NO: 255004 - DNA, 15 bp, Homo sapiens
ctctttggaaacaat

SEQ ID NO: 255005 - DNA, 15 bp, Homo sapiens
actctttggaaacaa

SEQ ID NO: 255006 - DNA, 15 bp, Homo sapiens
aactctttggaaaca

SEQ ID NO: 255007 - DNA, 15 bp, Homo sapiens
caactctttggaaac

SEQ ID NO: 255008 - DNA, 15 bp, Homo sapiens
tcaactctttggaaa

SEQ ID NO: 255009 - DNA, 15 bp, Homo sapiens
ctcaactctttggaa

SEQ ID NO: 255010 - DNA, 15 bp, Homo sapiens
actcaactctttgga

SEQ ID NO: 255011 - DNA, 15 bp, Homo sapiens
tactcaactctttgg

SEQ ID NO: 255012 - DNA, 15 bp, Homo sapiens
atactcaactctttg

SEQ ID NO: 255013 - DNA, 15 bp, Homo sapiens
aatactcaactcttt

SEQ ID NO: 255014 - DNA, 15 bp, Homo sapiens
caatactcaactctt

SEQ ID NO: 255015 - DNA, 15 bp, Homo sapiens
ccaatactcaactct

SEQ ID NO: 255016 - DNA, 15 bp, Homo sapiens
accaatactcaactc

SEQ ID NO: 255017 - DNA, 15 bp, Homo sapiens
aaccaatactcaact

SEQ ID NO: 255018 - DNA, 15 bp, Homo sapiens
caaccaatactcaac

SEQ ID NO: 255019 - DNA, 15 bp, Homo sapiens
acaaccaatactcaa

SEQ ID NO: 255020 - DNA, 15 bp, Homo sapiens
tacaaccaatactca

SEQ ID NO: 255021 - DNA, 15 bp, Homo sapiens
ctacaaccaatactc

SEQ ID NO: 255022 - DNA, 15 bp, Homo sapiens
cctacaaccaatact

SEQ ID NO: 255023 - DNA, 15 bp, Homo sapiens
tcctacaaccaatac

SEQ ID NO: 255024 - DNA, 15 bp, Homo sapiens
atcctacaaccaata

SEQ ID NO: 255025 - DNA, 15 bp, Homo sapiens
gatcctacaaccaat

SEQ ID NO: 255026 - DNA, 15 bp, Homo sapiens
tgatcctacaaccaa

SEQ ID NO: 255027 - DNA, 15 bp, Homo sapiens
atgatcctacaacca

SEQ ID NO: 255028 - DNA, 15 bp, Homo sapiens
aatgatcctacaacc

SEQ ID NO: 255029 - DNA, 15 bp, Homo sapiens
aaatgatcctacaac

SEQ ID NO: 255030 - DNA, 15 bp, Homo sapiens
caaatgatcctacaa

SEQ ID NO: 255031 - DNA, 15 bp, Homo sapiens
tcaaatgatcctaca

SEQ ID NO: 255032 - DNA, 15 bp, Homo sapiens
ttcaaatgatcctac

SEQ ID NO: 255033 - DNA, 15 bp, Homo sapiens
gttcaaatgatccta

SEQ ID NO: 255034 - DNA, 15 bp, Homo sapiens
ggttcaaatgatcct

SEQ ID NO: 255035 - DNA, 15 bp, Homo sapiens
tggttcaaatgatcc

SEQ ID NO: 255036 - DNA, 15 bp, Homo sapiens
ctggttcaaatgatc

SEQ ID NO: 255037 - DNA, 15 bp, Homo sapiens
tctggttcaaatgat

SEQ ID NO: 255038 - DNA, 15 bp, Homo sapiens
atctggttcaaatga

SEQ ID NO: 255039 - DNA, 15 bp, Homo sapiens
gatctggttcaaatg

SEQ ID NO: 255040 - DNA, 15 bp, Homo sapiens
agatctggttcaaat

SEQ ID NO: 255041 - DNA, 15 bp, Homo sapiens
cagatctggttcaaa

SEQ ID NO: 255042 - DNA, 15 bp, Homo sapiens
gcagatctggttcaa

SEQ ID NO: 255043 - DNA, 15 bp, Homo sapiens
tgcagatctggttca

SEQ ID NO: 255044 - DNA, 15 bp, Homo sapiens
ttgcagatctggttc

SEQ ID NO: 255045 - DNA, 15 bp, Homo sapiens
tttgcagatctggtt

SEQ ID NO: 255046 - DNA, 15 bp, Homo sapiens
ttttgcagatctggt

SEQ ID NO: 255047 - DNA, 15 bp, Homo sapiens
cttttgcagatctgg

SEQ ID NO: 255048 - DNA, 15 bp, Homo sapiens
ccttttgcagatctg

SEQ ID NO: 255049 - DNA, 15 bp, Homo sapiens
cccttttgcagatct

SEQ ID NO: 255050 - DNA, 15 bp, Homo sapiens
gcccttttgcagatc

SEQ ID NO: 255051 - DNA, 15 bp, Homo sapiens
tgcccttttgcagat

SEQ ID NO: 255052 - DNA, 15 bp, Homo sapiens
ctgcccttttgcaga

SEQ ID NO: 255053 - DNA, 15 bp, Homo sapiens
cctgcccttttgcag

SEQ ID NO: 255054 - DNA, 15 bp, Homo sapiens
tcctgcccttttgca

SEQ ID NO: 255055 - DNA, 15 bp, Homo sapiens
ttcctgcccttttgc

SEQ ID NO: 255056 - DNA, 15 bp, Homo sapiens
tttcctgcccttttg

SEQ ID NO: 255057 - DNA, 15 bp, Homo sapiens
ttttcctgccctttt

SEQ ID NO: 255058 - DNA, 15 bp, Homo sapiens
gttttcctgcccttt

SEQ ID NO: 255059 - DNA, 15 bp, Homo sapiens
ggttttcctgccctt

SEQ ID NO: 255060 - DNA, 15 bp, Homo sapiens
tggttttcctgccct

SEQ ID NO: 255061 - DNA, 15 bp, Homo sapiens
ttggttttcctgccc

SEQ ID NO: 255062 - DNA, 15 bp, Homo sapiens
tttggttttcctgcc

SEQ ID NO: 255063 - DNA, 15 bp, Homo sapiens
atttggttttcctgc

SEQ ID NO: 255064 - DNA, 15 bp, Homo sapiens
gatttggttttcctg

SEQ ID NO: 255065 - DNA, 15 bp, Homo sapiens
tgatttggttttcct

SEQ ID NO: 255066 - DNA, 15 bp, Homo sapiens
ttgatttggttttcc

SEQ ID NO: 255067 - DNA, 15 bp, Homo sapiens
attgatttggttttc

SEQ ID NO: 255068 - DNA, 15 bp, Homo sapiens
gattgatttggtttt

SEQ ID NO: 255069 - DNA, 15 bp, Homo sapiens
tgattgatttggttt

SEQ ID NO: 255070 - DNA, 15 bp, Homo sapiens
ctgattgatttggtt

SEQ ID NO: 255071 - DNA, 15 bp, Homo sapiens
cctgattgatttggt

SEQ ID NO: 255072 - DNA, 15 bp, Homo sapiens
tcctgattgatttgg

SEQ ID NO: 255073 - DNA, 15 bp, Homo sapiens
atcctgattgatttg

SEQ ID NO: 255074 - DNA, 15 bp, Homo sapiens
catcctgattgattt

SEQ ID NO: 255075 - DNA, 15 bp, Homo sapiens
ccatcctgattgatt

SEQ ID NO: 255076 - DNA, 15 bp, Homo sapiens
cccatcctgattgat

SEQ ID NO: 255077 - DNA, 15 bp, Homo sapiens
tcccatcctgattga

SEQ ID NO: 255078 - DNA, 15 bp, Homo sapiens
ctcccatcctgattg

SEQ ID NO: 255079 - DNA, 15 bp, Homo sapiens
cctcccatcctgatt

SEQ ID NO: 255080 - DNA, 15 bp, Homo sapiens
tcctcccatcctgat

SEQ ID NO: 255081 - DNA, 15 bp, Homo sapiens
ctcctcccatcctga

SEQ ID NO: 255082 - DNA, 15 bp, Homo sapiens
gctcctcccatcctg

SEQ ID NO: 255083 - DNA, 15 bp, Homo sapiens
tgctcctcccatcct

SEQ ID NO: 255084 - DNA, 15 bp, Homo sapiens
atgctcctcccatcc

SEQ ID NO: 255085 - DNA, 15 bp, Homo sapiens
tatgctcctcccatc

SEQ ID NO: 255086 - DNA, 15 bp, Homo sapiens
ctatgctcctcccat

SEQ ID NO: 255087 - DNA, 15 bp, Homo sapiens
tctatgctcctccca

SEQ ID NO: 255088 - DNA, 15 bp, Homo sapiens
ttctatgctcctccc

SEQ ID NO: 255089 - DNA, 15 bp, Homo sapiens
tttctatgctcctcc

SEQ ID NO: 255090 - DNA, 15 bp, Homo sapiens
atttctatgctcctc

SEQ ID NO: 255091 - DNA, 15 bp, Homo sapiens
tatttctatgctcct

SEQ ID NO: 255092 - DNA, 15 bp, Homo sapiens
ttatttctatgctcc

SEQ ID NO: 255093 - DNA, 15 bp, Homo sapiens
cttatttctatgctc

SEQ ID NO: 255094 - DNA, 15 bp, Homo sapiens
tcttatttctatgct

SEQ ID NO: 255095 - DNA, 15 bp, Homo sapiens
atcttatttctatgc

SEQ ID NO: 255096 - DNA, 15 bp, Homo sapiens
catcttatttctatg

SEQ ID NO: 255097 - DNA, 15 bp, Homo sapiens
tcatcttatttctat

SEQ ID NO: 255098 - DNA, 15 bp, Homo sapiens
ctcatcttatttcta

SEQ ID NO: 255099 - DNA, 15 bp, Homo sapiens
gctcatcttatttct

SEQ ID NO: 255100 - DNA, 15 bp, Homo sapiens
agctcatcttatttc

SEQ ID NO: 255101 - DNA, 15 bp, Homo sapiens
gagctcatcttattt

SEQ ID NO: 255102 - DNA, 15 bp, Homo sapiens
ggagctcatcttatt

SEQ ID NO: 255103 - DNA, 15 bp, Homo sapiens
tggagctcatcttat

SEQ ID NO: 255104 - DNA, 15 bp, Homo sapiens
atggagctcatctta

SEQ ID NO: 255105 - DNA, 15 bp, Homo sapiens
catggagctcatctt

SEQ ID NO: 255106 - DNA, 15 bp, Homo sapiens
tcatggagctcatct

SEQ ID NO: 255107 - DNA, 15 bp, Homo sapiens
ttcatggagctcatc

SEQ ID NO: 255108 - DNA, 15 bp, Homo sapiens
attcatggagctcat

SEQ ID NO: 255109 - DNA, 15 bp, Homo sapiens
tattcatggagctca

SEQ ID NO: 255110 - DNA, 15 bp, Homo sapiens
ctattcatggagctc

SEQ ID NO: 255111 - DNA, 15 bp, Homo sapiens
actattcatggagct

SEQ ID NO: 255112 - DNA, 15 bp, Homo sapiens
cactattcatggagc

SEQ ID NO: 255113 - DNA, 15 bp, Homo sapiens
tcactattcatggag

SEQ ID NO: 255114 - DNA, 15 bp, Homo sapiens
ttcactattcatgga

SEQ ID NO: 255115 - DNA, 15 bp, Homo sapiens
gttcactattcatgg

SEQ ID NO: 255116 - DNA, 15 bp, Homo sapiens
agttcactattcatg

SEQ ID NO: 255117 - DNA, 15 bp, Homo sapiens
cagttcactattcat

SEQ ID NO: 255118 - DNA, 15 bp, Homo sapiens
ccagttcactattca

SEQ ID NO: 255119 - DNA, 15 bp, Homo sapiens
tccagttcactattc

SEQ ID NO: 255120 - DNA, 15 bp, Homo sapiens
gtccagttcactatt

SEQ ID NO: 255121 - DNA, 15 bp, Homo sapiens
tgtccagttcactat

SEQ ID NO: 255122 - DNA, 15 bp, Homo sapiens
ctgtccagttcacta

SEQ ID NO: 255123 - DNA, 15 bp, Homo sapiens
actgtccagttcact

SEQ ID NO: 255124 - DNA, 15 bp, Homo sapiens
cactgtccagttcac

SEQ ID NO: 255125 - DNA, 15 bp, Homo sapiens
acactgtccagttca

SEQ ID NO: 255126 - DNA, 15 bp, Homo sapiens
cacactgtccagttc

SEQ ID NO: 255127 - DNA, 15 bp, Homo sapiens
ccacactgtccagtt

SEQ ID NO: 255128 - DNA, 15 bp, Homo sapiens
accacactgtccagt

SEQ ID NO: 255129 - DNA, 15 bp, Homo sapiens
aaccacactgtccag

SEQ ID NO: 255130 - DNA, 15 bp, Homo sapiens
caaccacactgtcca

SEQ ID NO: 255131 - DNA, 15 bp, Homo sapiens
ccaaccacactgtcc

SEQ ID NO: 255132 - DNA, 15 bp, Homo sapiens
tccaaccacactgtc

SEQ ID NO: 255133 - DNA, 15 bp, Homo sapiens
ttccaaccacactgt

SEQ ID NO: 255134 - DNA, 15 bp, Homo sapiens
cttccaaccacactg

SEQ ID NO: 255135 - DNA, 15 bp, Homo sapiens
tcttccaaccacact

SEQ ID NO: 255136 - DNA, 15 bp, Homo sapiens
ttcttccaaccacac

SEQ ID NO: 255137 - DNA, 15 bp, Homo sapiens
tttcttccaaccaca

SEQ ID NO: 255138 - DNA, 15 bp, Homo sapiens
ttttcttccaaccac

SEQ ID NO: 255139 - DNA, 15 bp, Homo sapiens
attttcttccaacca

SEQ ID NO: 255140 - DNA, 15 bp, Homo sapiens
cattttcttccaacc

SEQ ID NO: 255141 - DNA, 15 bp, Homo sapiens
tcattttcttccaac

SEQ ID NO: 255142 - DNA, 15 bp, Homo sapiens
ttcattttcttccaa

SEQ ID NO: 255143 - DNA, 15 bp, Homo sapiens
cttcattttcttcca

SEQ ID NO: 255144 - DNA, 15 bp, Homo sapiens
acttcattttcttcc

SEQ ID NO: 255145 - DNA, 15 bp, Homo sapiens
cacttcattttcttc

SEQ ID NO: 255146 - DNA, 15 bp, Homo sapiens
acacttcattttctt

SEQ ID NO: 255147 - DNA, 15 bp, Homo sapiens
gacacttcattttct

SEQ ID NO: 255148 - DNA, 15 bp, Homo sapiens
ggacacttcattttc

SEQ ID NO: 255149 - DNA, 15 bp, Homo sapiens
aggacacttcatttt

SEQ ID NO: 255150 - DNA, 15 bp, Homo sapiens
aaggacacttcattt

SEQ ID NO: 255151 - DNA, 15 bp, Homo sapiens
caaggacacttcatt

SEQ ID NO: 255152 - DNA, 15 bp, Homo sapiens
ccaaggacacttcat

SEQ ID NO: 255153 - DNA, 15 bp, Homo sapiens
cccaaggacacttca

SEQ ID NO: 255154 - DNA, 15 bp, Homo sapiens
ccccaaggacacttc

SEQ ID NO: 255155 - DNA, 15 bp, Homo sapiens
tccccaaggacactt

SEQ ID NO: 255156 - DNA, 15 bp, Homo sapiens
ttccccaaggacact

SEQ ID NO: 255157 - DNA, 15 bp, Homo sapiens
cttccccaaggacac

SEQ ID NO: 255158 - DNA, 15 bp, Homo sapiens
tcttccccaaggaca

SEQ ID NO: 255159 - DNA, 15 bp, Homo sapiens
atcttccccaaggac

SEQ ID NO: 255160 - DNA, 15 bp, Homo sapiens
catcttccccaagga

SEQ ID NO: 255161 - DNA, 15 bp, Homo sapiens
gcatcttccccaagg

SEQ ID NO: 255162 - DNA, 15 bp, Homo sapiens
ggcatcttccccaag

SEQ ID NO: 255163 - DNA, 15 bp, Homo sapiens
gggcatcttccccaa

SEQ ID NO: 255164 - DNA, 15 bp, Homo sapiens
ggggcatcttcccca

SEQ ID NO: 255165 - DNA, 15 bp, Homo sapiens
aggggcatcttcccc

SEQ ID NO: 255166 - DNA, 15 bp, Homo sapiens
caggggcatcttccc

SEQ ID NO: 255167 - DNA, 15 bp, Homo sapiens
ccaggggcatcttcc

SEQ ID NO: 255168 - DNA, 15 bp, Homo sapiens
tccaggggcatcttc

SEQ ID NO: 255169 - DNA, 15 bp, Homo sapiens
ctccaggggcatctt

SEQ ID NO: 255170 - DNA, 15 bp, Homo sapiens
cctccaggggcatct

SEQ ID NO: 255171 - DNA, 15 bp, Homo sapiens
tcctccaggggcatc

SEQ ID NO: 255172 - DNA, 15 bp, Homo sapiens
ttcctccaggggcat

SEQ ID NO: 255173 - DNA, 15 bp, Homo sapiens
tttcctccaggggca

SEQ ID NO: 255174 - DNA, 15 bp, Homo sapiens
ttttcctccaggggc

SEQ ID NO: 255175 - DNA, 15 bp, Homo sapiens
attttcctccagggg

SEQ ID NO: 255176 - DNA, 15 bp, Homo sapiens
gattttcctccaggg

SEQ ID NO: 255177 - DNA, 15 bp, Homo sapiens
agattttcctccagg

SEQ ID NO: 255178 - DNA, 15 bp, Homo sapiens
gagattttcctccag

SEQ ID NO: 255179 - DNA, 15 bp, Homo sapiens
ggagattttcctcca

SEQ ID NO: 255180 - DNA, 15 bp, Homo sapiens
aggagattttcctcc

SEQ ID NO: 255181 - DNA, 15 bp, Homo sapiens
aaggagattttcctc

SEQ ID NO: 255182 - DNA, 15 bp, Homo sapiens
aaaggagattttcct

SEQ ID NO: 255183 - DNA, 15 bp, Homo sapiens
taaaggagattttcc

SEQ ID NO: 255184 - DNA, 15 bp, Homo sapiens
ataaaggagattttc

SEQ ID NO: 255185 - DNA, 15 bp, Homo sapiens
aataaaggagatttt

SEQ ID NO: 255186 - DNA, 15 bp, Homo sapiens
caataaaggagattt

SEQ ID NO: 255187 - DNA, 15 bp, Homo sapiens
ccaataaaggagatt

SEQ ID NO: 255188 - DNA, 15 bp, Homo sapiens
cccaataaaggagat

SEQ ID NO: 255189 - DNA, 15 bp, Homo sapiens
tcccaataaaggaga

SEQ ID NO: 255190 - DNA, 15 bp, Homo sapiens
ttcccaataaaggag

SEQ ID NO: 255191 - DNA, 15 bp, Homo sapiens
tttcccaataaagga

SEQ ID NO: 255192 - DNA, 15 bp, Homo sapiens
ttttcccaataaagg

SEQ ID NO: 255193 - DNA, 15 bp, Homo sapiens
tttttcccaataaag

SEQ ID NO: 255194 - DNA, 15 bp, Homo sapiens
ttttttcccaataaa

SEQ ID NO: 255195 - DNA, 15 bp, Homo sapiens
tttttttcccaataa

SEQ ID NO: 255196 - DNA, 15 bp, Homo sapiens
ctttttttcccaata

SEQ ID NO: 255197 - DNA, 15 bp, Homo sapiens
cctttttttcccaat

SEQ ID NO: 255198 - DNA, 15 bp, Homo sapiens
tcctttttttcccaa

SEQ ID NO: 255199 - DNA, 15 bp, Homo sapiens
ttcctttttttccca

SEQ ID NO: 255200 - DNA, 15 bp, Homo sapiens
cttcctttttttccc

SEQ ID NO: 255201 - DNA, 15 bp, Homo sapiens
ccttcctttttttcc

SEQ ID NO: 255202 - DNA, 15 bp, Homo sapiens
cccttcctttttttc

SEQ ID NO: 255203 - DNA, 15 bp, Homo sapiens
gcccttccttttttt

SEQ ID NO: 255204 - DNA, 15 bp, Homo sapiens
ggcccttcctttttt

SEQ ID NO: 255205 - DNA, 15 bp, Homo sapiens
gggcccttccttttt

SEQ ID NO: 255206 - DNA, 15 bp, Homo sapiens
agggcccttcctttt

SEQ ID NO: 255207 - DNA, 15 bp, Homo sapiens
gagggcccttccttt

SEQ ID NO: 255208 - DNA, 15 bp, Homo sapiens
agagggcccttcctt

SEQ ID NO: 255209 - DNA, 15 bp, Homo sapiens
cagagggcccttcct

SEQ ID NO: 255210 - DNA, 15 bp, Homo sapiens
gcagagggcccttcc

SEQ ID NO: 255211 - DNA, 15 bp, Homo sapiens
ggcagagggcccttc

SEQ ID NO: 255212 - DNA, 15 bp, Homo sapiens
aggcagagggccctt

SEQ ID NO: 255213 - DNA, 15 bp, Homo sapiens
taggcagagggccct

SEQ ID NO: 255214 - DNA, 15 bp, Homo sapiens
gtaggcagagggccc

SEQ ID NO: 255215 - DNA, 15 bp, Homo sapiens
agtaggcagagggcc

SEQ ID NO: 255216 - DNA, 15 bp, Homo sapiens
cagtaggcagagggc

SEQ ID NO: 255217 - DNA, 15 bp, Homo sapiens
acagtaggcagaggg

SEQ ID NO: 255218 - DNA, 15 bp, Homo sapiens
cacagtaggcagagg

SEQ ID NO: 255219 - DNA, 15 bp, Homo sapiens
gcacagtaggcagag

SEQ ID NO: 255220 - DNA, 15 bp, Homo sapiens
tgcacagtaggcaga

SEQ ID NO: 255221 - DNA, 15 bp, Homo sapiens
ctgcacagtaggcag

SEQ ID NO: 255222 - DNA, 15 bp, Homo sapiens
actgcacagtaggca

SEQ ID NO: 255223 - DNA, 15 bp, Homo sapiens
cactgcacagtaggc

SEQ ID NO: 255224 - DNA, 15 bp, Homo sapiens
gcactgcacagtagg

SEQ ID NO: 255225 - DNA, 15 bp, Homo sapiens
tgcactgcacagtag

SEQ ID NO: 255226 - DNA, 15 bp, Homo sapiens
atgcactgcacagta

SEQ ID NO: 255227 - DNA, 15 bp, Homo sapiens
aatgcactgcacagt

SEQ ID NO: 255228 - DNA, 15 bp, Homo sapiens
aaatgcactgcacag

SEQ ID NO: 255229 - DNA, 15 bp, Homo sapiens
taaatgcactgcaca

SEQ ID NO: 255230 - DNA, 15 bp, Homo sapiens
ttaaatgcactgcac

SEQ ID NO: 255231 - DNA, 15 bp, Homo sapiens
attaaatgcactgca

SEQ ID NO: 255232 - DNA, 15 bp, Homo sapiens
tattaaatgcactgc

SEQ ID NO: 255233 - DNA, 15 bp, Homo sapiens
ttattaaatgcactg

SEQ ID NO: 255234 - DNA, 15 bp, Homo sapiens
cttattaaatgcact

SEQ ID NO: 255235 - DNA, 15 bp, Homo sapiens
gcttattaaatgcac

SEQ ID NO: 255236 - DNA, 15 bp, Homo sapiens
ggcttattaaatgca

SEQ ID NO: 255237 - DNA, 15 bp, Homo sapiens
tggcttattaaatgc

SEQ ID NO: 255238 - DNA, 15 bp, Homo sapiens
atggcttattaaatg

SEQ ID NO: 255239 - DNA, 15 bp, Homo sapiens
catggcttattaaat

SEQ ID NO: 255240 - DNA, 15 bp, Homo sapiens
acatggcttattaaa

SEQ ID NO: 255241 - DNA, 15 bp, Homo sapiens
cacatggcttattaa

SEQ ID NO: 255242 - DNA, 15 bp, Homo sapiens
tcacatggcttatta

SEQ ID NO: 255243 - DNA, 15 bp, Homo sapiens
gtcacatggcttatt

SEQ ID NO: 255244 - DNA, 15 bp, Homo sapiens
tgtcacatggcttat

SEQ ID NO: 255245 - DNA, 15 bp, Homo sapiens
ctgtcacatggctta

SEQ ID NO: 255246 - DNA, 15 bp, Homo sapiens
gctgtcacatggctt

SEQ ID NO: 255247 - DNA, 15 bp, Homo sapiens
agctgtcacatggct

SEQ ID NO: 255248 - DNA, 15 bp, Homo sapiens
cagctgtcacatggc

SEQ ID NO: 255249 - DNA, 15 bp, Homo sapiens
acagctgtcacatgg

SEQ ID NO: 255250 - DNA, 15 bp, Homo sapiens
cacagctgtcacatg

SEQ ID NO: 255251 - DNA, 15 bp, Homo sapiens
gcacagctgtcacat

SEQ ID NO: 255252 - DNA, 15 bp, Homo sapiens
agcacagctgtcaca

SEQ ID NO: 255253 - DNA, 15 bp, Homo sapiens
aagcacagctgtcac

SEQ ID NO: 255254 - DNA, 15 bp, Homo sapiens
aaagcacagctgtca

SEQ ID NO: 255255 - DNA, 15 bp, Homo sapiens
gaaagcacagctgtc

SEQ ID NO: 255256 - DNA, 15 bp, Homo sapiens
agaaagcacagctgt

SEQ ID NO: 255257 - DNA, 15 bp, Homo sapiens
gagaaagcacagctg

SEQ ID NO: 255258 - DNA, 15 bp, Homo sapiens
agagaaagcacagct

SEQ ID NO: 255259 - DNA, 15 bp, Homo sapiens
aagagaaagcacagc

SEQ ID NO: 255260 - DNA, 15 bp, Homo sapiens
gaagagaaagcacag

SEQ ID NO: 255261 - DNA, 15 bp, Homo sapiens
tgaagagaaagcaca

SEQ ID NO: 255262 - DNA, 15 bp, Homo sapiens
atgaagagaaagcac

SEQ ID NO: 255263 - DNA, 15 bp, Homo sapiens
gatgaagagaaagca

SEQ ID NO: 255264 - DNA, 15 bp, Homo sapiens
tgatgaagagaaagc

SEQ ID NO: 255265 - DNA, 15 bp, Homo sapiens
gtgatgaagagaaag

SEQ ID NO: 255266 - DNA, 15 bp, Homo sapiens
ggtgatgaagagaaa

SEQ ID NO: 255267 - DNA, 15 bp, Homo sapiens
aggtgatgaagagaa

SEQ ID NO: 255268 - DNA, 15 bp, Homo sapiens
aaggtgatgaagaga

SEQ ID NO: 255269 - DNA, 15 bp, Homo sapiens
gaaggtgatgaagag

SEQ ID NO: 255270 - DNA, 15 bp, Homo sapiens
ggaaggtgatgaaga

SEQ ID NO: 255271 - DNA, 15 bp, Homo sapiens
aggaaggtgatgaag

SEQ ID NO: 255272 - DNA, 15 bp, Homo sapiens
gaggaaggtgatgaa

SEQ ID NO: 255273 - DNA, 15 bp, Homo sapiens
agaggaaggtgatga

SEQ ID NO: 255274 - DNA, 15 bp, Homo sapiens
aagaggaaggtgatg

SEQ ID NO: 255275 - DNA, 15 bp, Homo sapiens
aaagaggaaggtgat

SEQ ID NO: 255276 - DNA, 15 bp, Homo sapiens
aaaagaggaaggtga

SEQ ID NO: 255277 - DNA, 15 bp, Homo sapiens
aaaaagaggaaggtg

SEQ ID NO: 255278 - DNA, 15 bp, Homo sapiens
gaaaaagaggaaggt

SEQ ID NO: 255279 - DNA, 15 bp, Homo sapiens
ggaaaaagaggaagg

SEQ ID NO: 255280 - DNA, 15 bp, Homo sapiens
aggaaaaagaggaag

SEQ ID NO: 255281 - DNA, 15 bp, Homo sapiens
taggaaaaagaggaa

SEQ ID NO: 255282 - DNA, 15 bp, Homo sapiens
gtaggaaaaagagga

SEQ ID NO: 255283 - DNA, 15 bp, Homo sapiens
ggtaggaaaaagagg

SEQ ID NO: 255284 - DNA, 15 bp, Homo sapiens
tggtaggaaaaagag

SEQ ID NO: 255285 - DNA, 15 bp, Homo sapiens
ttggtaggaaaaaga

SEQ ID NO: 255286 - DNA, 15 bp, Homo sapiens
tttggtaggaaaaag

SEQ ID NO: 255287 - DNA, 15 bp, Homo sapiens
ctttggtaggaaaaa

SEQ ID NO: 255288 - DNA, 15 bp, Homo sapiens
cctttggtaggaaaa

SEQ ID NO: 255289 - DNA, 15 bp, Homo sapiens
ccctttggtaggaaa

SEQ ID NO: 255290 - DNA, 15 bp, Homo sapiens
gccctttggtaggaa

SEQ ID NO: 255291 - DNA, 15 bp, Homo sapiens
agccctttggtagga

SEQ ID NO: 255292 - DNA, 15 bp, Homo sapiens
cagccctttggtagg

SEQ ID NO: 255293 - DNA, 15 bp, Homo sapiens
tcagccctttggtag

SEQ ID NO: 255294 - DNA, 15 bp, Homo sapiens
ttcagccctttggta

SEQ ID NO: 255295 - DNA, 15 bp, Homo sapiens
tttcagccctttggt

SEQ ID NO: 255296 - DNA, 15 bp, Homo sapiens
ctttcagccctttgg

SEQ ID NO: 255297 - DNA, 15 bp, Homo sapiens
cctttcagccctttg

SEQ ID NO: 255298 - DNA, 15 bp, Homo sapiens
ccctttcagcccttt

SEQ ID NO: 255299 - DNA, 15 bp, Homo sapiens
cccctttcagccctt

SEQ ID NO: 255300 - DNA, 15 bp, Homo sapiens
acccctttcagccct

SEQ ID NO: 255301 - DNA, 15 bp, Homo sapiens
cacccctttcagccc

SEQ ID NO: 255302 - DNA, 15 bp, Homo sapiens
ccacccctttcagcc

SEQ ID NO: 255303 - DNA, 15 bp, Homo sapiens
accacccctttcagc

SEQ ID NO: 255304 - DNA, 15 bp, Homo sapiens
taccacccctttcag

SEQ ID NO: 255305 - DNA, 15 bp, Homo sapiens
gtaccacccctttca

SEQ ID NO: 255306 - DNA, 15 bp, Homo sapiens
ggtaccacccctttc

SEQ ID NO: 255307 - DNA, 15 bp, Homo sapiens
aggtaccaccccttt

SEQ ID NO: 255308 - DNA, 15 bp, Homo sapiens
aaggtaccacccctt

SEQ ID NO: 255309 - DNA, 15 bp, Homo sapiens
aaaggtaccacccct

SEQ ID NO: 255310 - DNA, 15 bp, Homo sapiens
aaaaggtaccacccc

SEQ ID NO: 255311 - DNA, 15 bp, Homo sapiens
gaaaaggtaccaccc

SEQ ID NO: 255312 - DNA, 15 bp, Homo sapiens
agaaaaggtaccacc

SEQ ID NO: 255313 - DNA, 15 bp, Homo sapiens
gagaaaaggtaccac

SEQ ID NO: 255314 - DNA, 15 bp, Homo sapiens
tgagaaaaggtacca

SEQ ID NO: 255315 - DNA, 15 bp, Homo sapiens
gtgagaaaaggtacc

SEQ ID NO: 255316 - DNA, 15 bp, Homo sapiens
ggtgagaaaaggtac

SEQ ID NO: 255317 - DNA, 15 bp, Homo sapiens
gggtgagaaaaggta

SEQ ID NO: 255318 - DNA, 15 bp, Homo sapiens
tgggtgagaaaaggt

SEQ ID NO: 255319 - DNA, 15 bp, Homo sapiens
atgggtgagaaaagg

SEQ ID NO: 255320 - DNA, 15 bp, Homo sapiens
gatgggtgagaaaag

SEQ ID NO: 255321 - DNA, 15 bp, Homo sapiens
tgatgggtgagaaaa

SEQ ID NO: 255322 - DNA, 15 bp, Homo sapiens
atgatgggtgagaaa

SEQ ID NO: 255323 - DNA, 15 bp, Homo sapiens
tatgatgggtgagaa

SEQ ID NO: 255324 - DNA, 15 bp, Homo sapiens
ttatgatgggtgaga

SEQ ID NO: 255325 - DNA, 15 bp, Homo sapiens
cttatgatgggtgag

SEQ ID NO: 255326 - DNA, 15 bp, Homo sapiens
ccttatgatgggtga

SEQ ID NO: 255327 - DNA, 15 bp, Homo sapiens
cccttatgatgggtg

SEQ ID NO: 255328 - DNA, 15 bp, Homo sapiens
acccttatgatgggt

SEQ ID NO: 255329 - DNA, 15 bp, Homo sapiens
gacccttatgatggg

SEQ ID NO: 255330 - DNA, 15 bp, Homo sapiens
tgacccttatgatgg

SEQ ID NO: 255331 - DNA, 15 bp, Homo sapiens
atgacccttatgatg

SEQ ID NO: 255332 - DNA, 15 bp, Homo sapiens
catgacccttatgat

SEQ ID NO: 255333 - DNA, 15 bp, Homo sapiens
ccatgacccttatga

SEQ ID NO: 255334 - DNA, 15 bp, Homo sapiens
accatgacccttatg

SEQ ID NO: 255335 - DNA, 15 bp, Homo sapiens
caccatgacccttat

SEQ ID NO: 255336 - DNA, 15 bp, Homo sapiens
tcaccatgaccctta

SEQ ID NO: 255337 - DNA, 15 bp, Homo sapiens
gtcaccatgaccctt

SEQ ID NO: 255338 - DNA, 15 bp, Homo sapiens
ggtcaccatgaccct

SEQ ID NO: 255339 - DNA, 15 bp, Homo sapiens
gggtcaccatgaccc

SEQ ID NO: 255340 - DNA, 15 bp, Homo sapiens
agggtcaccatgacc

SEQ ID NO: 255341 - DNA, 15 bp, Homo sapiens
gagggtcaccatgac

SEQ ID NO: 255342 - DNA, 15 bp, Homo sapiens
ggagggtcaccatga

SEQ ID NO: 255343 - DNA, 15 bp, Homo sapiens
aggagggtcaccatg

SEQ ID NO: 255344 - DNA, 15 bp, Homo sapiens
taggagggtcaccat

SEQ ID NO: 255345 - DNA, 15 bp, Homo sapiens
ataggagggtcacca

SEQ ID NO: 255346 - DNA, 15 bp, Homo sapiens
tataggagggtcacc

SEQ ID NO: 255347 - DNA, 15 bp, Homo sapiens
ttataggagggtcac

SEQ ID NO: 255348 - DNA, 15 bp, Homo sapiens
gttataggagggtca

SEQ ID NO: 255349 - DNA, 15 bp, Homo sapiens
tgttataggagggtc

SEQ ID NO: 255350 - DNA, 15 bp, Homo sapiens
ttgttataggagggt

SEQ ID NO: 255351 - DNA, 15 bp, Homo sapiens
tttgttataggaggg

SEQ ID NO: 255352 - DNA, 15 bp, Homo sapiens
ttttgttataggagg

SEQ ID NO: 255353 - DNA, 15 bp, Homo sapiens
cttttgttataggag

SEQ ID NO: 255354 - DNA, 15 bp, Homo sapiens
tcttttgttatagga

SEQ ID NO: 255355 - DNA, 15 bp, Homo sapiens
gtcttttgttatagg

SEQ ID NO: 255356 - DNA, 15 bp, Homo sapiens
tgtcttttgttatag

SEQ ID NO: 255357 - DNA, 15 bp, Homo sapiens
ctgtcttttgttata

SEQ ID NO: 255358 - DNA, 15 bp, Homo sapiens
cctgtcttttgttat

SEQ ID NO: 255359 - DNA, 15 bp, Homo sapiens
acctgtcttttgtta

SEQ ID NO: 255360 - DNA, 15 bp, Homo sapiens
gacctgtcttttgtt

SEQ ID NO: 255361 - DNA, 15 bp, Homo sapiens
tgacctgtcttttgt

SEQ ID NO: 255362 - DNA, 15 bp, Homo sapiens
ttgacctgtcttttg

SEQ ID NO: 255363 - DNA, 15 bp, Homo sapiens
gttgacctgtctttt

SEQ ID NO: 255364 - DNA, 15 bp, Homo sapiens
ggttgacctgtcttt

SEQ ID NO: 255365 - DNA, 15 bp, Homo sapiens
tggttgacctgtctt

SEQ ID NO: 255366 - DNA, 15 bp, Homo sapiens
ctggttgacctgtct

SEQ ID NO: 255367 - DNA, 15 bp, Homo sapiens
tctggttgacctgtc

SEQ ID NO: 255368 - DNA, 15 bp, Homo sapiens
ttctggttgacctgt

SEQ ID NO: 255369 - DNA, 15 bp, Homo sapiens
tttctggttgacctg

SEQ ID NO: 255370 - DNA, 15 bp, Homo sapiens
ttttctggttgacct

SEQ ID NO: 255371 - DNA, 15 bp, Homo sapiens
cttttctggttgacc

SEQ ID NO: 255372 - DNA, 15 bp, Homo sapiens
gcttttctggttgac

SEQ ID NO: 255373 - DNA, 15 bp, Homo sapiens
tgcttttctggttga

SEQ ID NO: 255374 - DNA, 15 bp, Homo sapiens
gtgcttttctggttg

SEQ ID NO: 255375 - DNA, 15 bp, Homo sapiens
tgtgcttttctggtt

SEQ ID NO: 255376 - DNA, 15 bp, Homo sapiens
ttgtgcttttctggt

SEQ ID NO: 255377 - DNA, 15 bp, Homo sapiens
cttgtgcttttctgg

SEQ ID NO: 255378 - DNA, 15 bp, Homo sapiens
tcttgtgcttttctg

SEQ ID NO: 255379 - DNA, 15 bp, Homo sapiens
ttcttgtgcttttct

SEQ ID NO: 255380 - DNA, 15 bp, Homo sapiens
tttcttgtgcttttc

SEQ ID NO: 255381 - DNA, 15 bp, Homo sapiens
atttcttgtgctttt

SEQ ID NO: 255382 - DNA, 15 bp, Homo sapiens
aatttcttgtgcttt

SEQ ID NO: 255383 - DNA, 15 bp, Homo sapiens
aaatttcttgtgctt

SEQ ID NO: 255384 - DNA, 15 bp, Homo sapiens
taaatttcttgtgct

SEQ ID NO: 255385 - DNA, 15 bp, Homo sapiens
gtaaatttcttgtgc

SEQ ID NO: 255386 - DNA, 15 bp, Homo sapiens
agtaaatttcttgtg

SEQ ID NO: 255387 - DNA, 15 bp, Homo sapiens
aagtaaatttcttgt

SEQ ID NO: 255388 - DNA, 15 bp, Homo sapiens
taagtaaatttcttg

SEQ ID NO: 255389 - DNA, 15 bp, Homo sapiens
ttaagtaaatttctt

SEQ ID NO: 255390 - DNA, 15 bp, Homo sapiens
attaagtaaatttct

SEQ ID NO: 255391 - DNA, 15 bp, Homo sapiens
gattaagtaaatttc

SEQ ID NO: 255392 - DNA, 15 bp, Homo sapiens
tgattaagtaaattt

SEQ ID NO: 255393 - DNA, 15 bp, Homo sapiens
ttgattaagtaaatt

SEQ ID NO: 255394 - DNA, 15 bp, Homo sapiens
tttgattaagtaaat

SEQ ID NO: 255395 - DNA, 15 bp, Homo sapiens
ctttgattaagtaaa

SEQ ID NO: 255396 - DNA, 15 bp, Homo sapiens
actttgattaagtaa

SEQ ID NO: 255397 - DNA, 15 bp, Homo sapiens
aactttgattaagta

SEQ ID NO: 255398 - DNA, 15 bp, Homo sapiens
aaactttgattaagt

SEQ ID NO: 255399 - DNA, 15 bp, Homo sapiens
aaaactttgattaag

SEQ ID NO: 255400 - DNA, 15 bp, Homo sapiens
taaaactttgattaa

SEQ ID NO: 255401 - DNA, 15 bp, Homo sapiens
gtaaaactttgatta

SEQ ID NO: 255402 - DNA, 15 bp, Homo sapiens
ggtaaaactttgatt

SEQ ID NO: 255403 - DNA, 15 bp, Homo sapiens
aggtaaaactttgat

SEQ ID NO: 255404 - DNA, 15 bp, Homo sapiens
caggtaaaactttga

SEQ ID NO: 255405 - DNA, 15 bp, Homo sapiens
tcaggtaaaactttg

SEQ ID NO: 255406 - DNA, 15 bp, Homo sapiens
gtcaggtaaaacttt

SEQ ID NO: 255407 - DNA, 15 bp, Homo sapiens
tgtcaggtaaaactt

SEQ ID NO: 255408 - DNA, 15 bp, Homo sapiens
atgtcaggtaaaact

SEQ ID NO: 255409 - DNA, 15 bp, Homo sapiens
catgtcaggtaaaac

SEQ ID NO: 255410 - DNA, 15 bp, Homo sapiens
tcatgtcaggtaaaa

SEQ ID NO: 255411 - DNA, 15 bp, Homo sapiens
ctcatgtcaggtaaa

SEQ ID NO: 255412 - DNA, 15 bp, Homo sapiens
tctcatgtcaggtaa

SEQ ID NO: 255413 - DNA, 15 bp, Homo sapiens
ttctcatgtcaggta

SEQ ID NO: 255414 - DNA, 15 bp, Homo sapiens
gttctcatgtcaggt

SEQ ID NO: 255415 - DNA, 15 bp, Homo sapiens
ggttctcatgtcagg

SEQ ID NO: 255416 - DNA, 15 bp, Homo sapiens
aggttctcatgtcag

SEQ ID NO: 255417 - DNA, 15 bp, Homo sapiens
aaggttctcatgtca

SEQ ID NO: 255418 - DNA, 15 bp, Homo sapiens
gaaggttctcatgtc

SEQ ID NO: 255419 - DNA, 15 bp, Homo sapiens
tgaaggttctcatgt

SEQ ID NO: 255420 - DNA, 15 bp, Homo sapiens
ctgaaggttctcatg

SEQ ID NO: 255421 - DNA, 15 bp, Homo sapiens
tctgaaggttctcat

SEQ ID NO: 255422 - DNA, 15 bp, Homo sapiens
ttctgaaggttctca

SEQ ID NO: 255423 - DNA, 15 bp, Homo sapiens
cttctgaaggttctc

SEQ ID NO: 255424 - DNA, 15 bp, Homo sapiens
tcttctgaaggttct

SEQ ID NO: 255425 - DNA, 15 bp, Homo sapiens
gtcttctgaaggttc

SEQ ID NO: 255426 - DNA, 15 bp, Homo sapiens
agtcttctgaaggtt

SEQ ID NO: 255427 - DNA, 15 bp, Homo sapiens
gagtcttctgaaggt

SEQ ID NO: 255428 - DNA, 15 bp, Homo sapiens
tgagtcttctgaagg

SEQ ID NO: 255429 - DNA, 15 bp, Homo sapiens
ttgagtcttctgaag

SEQ ID NO: 255430 - DNA, 15 bp, Homo sapiens
tttgagtcttctgaa

SEQ ID NO: 255431 - DNA, 15 bp, Homo sapiens
ctttgagtcttctga

SEQ ID NO: 255432 - DNA, 15 bp, Homo sapiens
tctttgagtcttctg

SEQ ID NO: 255433 - DNA, 15 bp, Homo sapiens
ttctttgagtcttct

SEQ ID NO: 255434 - DNA, 15 bp, Homo sapiens
tttctttgagtcttc

SEQ ID NO: 255435 - DNA, 15 bp, Homo sapiens
ttttctttgagtctt

SEQ ID NO: 255436 - DNA, 15 bp, Homo sapiens
gttttctttgagtct

SEQ ID NO: 255437 - DNA, 15 bp, Homo sapiens
tgttttctttgagtc

SEQ ID NO: 255438 - DNA, 15 bp, Homo sapiens
ctgttttctttgagt

SEQ ID NO: 255439 - DNA, 15 bp, Homo sapiens
cctgttttctttgag

SEQ ID NO: 255440 - DNA, 15 bp, Homo sapiens
ccctgttttctttga

SEQ ID NO: 255441 - DNA, 15 bp, Homo sapiens
tccctgttttctttg

SEQ ID NO: 255442 - DNA, 15 bp, Homo sapiens
ttccctgttttcttt

SEQ ID NO: 255443 - DNA, 15 bp, Homo sapiens
tttccctgttttctt

SEQ ID NO: 255444 - DNA, 15 bp, Homo sapiens
ttttccctgttttct

SEQ ID NO: 255445 - DNA, 15 bp, Homo sapiens
cttttccctgttttc

SEQ ID NO: 255446 - DNA, 15 bp, Homo sapiens
acttttccctgtttt

SEQ ID NO: 255447 - DNA, 15 bp, Homo sapiens
cacttttccctgttt

SEQ ID NO: 255448 - DNA, 15 bp, Homo sapiens
acacttttccctgtt

SEQ ID NO: 255449 - DNA, 15 bp, Homo sapiens
gacacttttccctgt

SEQ ID NO: 255450 - DNA, 15 bp, Homo sapiens
agacacttttccctg

SEQ ID NO: 255451 - DNA, 15 bp, Homo sapiens
cagacacttttccct

SEQ ID NO: 255452 - DNA, 15 bp, Homo sapiens
acagacacttttccc

SEQ ID NO: 255453 - DNA, 15 bp, Homo sapiens
aacagacacttttcc

SEQ ID NO: 255454 - DNA, 15 bp, Homo sapiens
aaacagacacttttc

SEQ ID NO: 255455 - DNA, 15 bp, Homo sapiens
aaaacagacactttt

SEQ ID NO: 255456 - DNA, 15 bp, Homo sapiens
aaaaacagacacttt

SEQ ID NO: 255457 - DNA, 15 bp, Homo sapiens
taaaaacagacactt

SEQ ID NO: 255458 - DNA, 15 bp, Homo sapiens
gtaaaaacagacact

SEQ ID NO: 255459 - DNA, 15 bp, Homo sapiens
tgtaaaaacagacac

SEQ ID NO: 255460 - DNA, 15 bp, Homo sapiens
gtgtaaaaacagaca

SEQ ID NO: 255461 - DNA, 15 bp, Homo sapiens
agtgtaaaaacagac

SEQ ID NO: 255462 - DNA, 15 bp, Homo sapiens
aagtgtaaaaacaga

SEQ ID NO: 255463 - DNA, 15 bp, Homo sapiens
taagtgtaaaaacag

SEQ ID NO: 255464 - DNA, 15 bp, Homo sapiens
ctaagtgtaaaaaca

SEQ ID NO: 255465 - DNA, 15 bp, Homo sapiens
tctaagtgtaaaaac

SEQ ID NO: 255466 - DNA, 15 bp, Homo sapiens
atctaagtgtaaaaa

SEQ ID NO: 255467 - DNA, 15 bp, Homo sapiens
aatctaagtgtaaaa

SEQ ID NO: 255468 - DNA, 15 bp, Homo sapiens
caatctaagtgtaaa

SEQ ID NO: 255469 - DNA, 15 bp, Homo sapiens
tcaatctaagtgtaa

SEQ ID NO: 255470 - DNA, 15 bp, Homo sapiens
ctcaatctaagtgta

SEQ ID NO: 255471 - DNA, 15 bp, Homo sapiens
actcaatctaagtgt

SEQ ID NO: 255472 - DNA, 15 bp, Homo sapiens
cactcaatctaagtg

SEQ ID NO: 255473 - DNA, 15 bp, Homo sapiens
tcactcaatctaagt

SEQ ID NO: 255474 - DNA, 15 bp, Homo sapiens
ctcactcaatctaag

SEQ ID NO: 255475 - DNA, 15 bp, Homo sapiens
cctcactcaatctaa

SEQ ID NO: 255476 - DNA, 15 bp, Homo sapiens
tcctcactcaatcta

SEQ ID NO: 255477 - DNA, 15 bp, Homo sapiens
ttcctcactcaatct

SEQ ID NO: 255478 - DNA, 15 bp, Homo sapiens
attcctcactcaatc

SEQ ID NO: 255479 - DNA, 15 bp, Homo sapiens
cattcctcactcaat

SEQ ID NO: 255480 - DNA, 15 bp, Homo sapiens
ccattcctcactcaa

SEQ ID NO: 255481 - DNA, 15 bp, Homo sapiens
tccattcctcactca

SEQ ID NO: 255482 - DNA, 15 bp, Homo sapiens
atccattcctcactc

SEQ ID NO: 255483 - DNA, 15 bp, Homo sapiens
catccattcctcact

SEQ ID NO: 255484 - DNA, 15 bp, Homo sapiens
tcatccattcctcac

SEQ ID NO: 255485 - DNA, 15 bp, Homo sapiens
gtcatccattcctca

SEQ ID NO: 255486 - DNA, 15 bp, Homo sapiens
agtcatccattcctc

SEQ ID NO: 255487 - DNA, 15 bp, Homo sapiens
cagtcatccattcct

SEQ ID NO: 255488 - DNA, 15 bp, Homo sapiens
gcagtcatccattcc

SEQ ID NO: 255489 - DNA, 15 bp, Homo sapiens
tgcagtcatccattc

SEQ ID NO: 255490 - DNA, 15 bp, Homo sapiens
atgcagtcatccatt

SEQ ID NO: 255491 - DNA, 15 bp, Homo sapiens
aatgcagtcatccat

SEQ ID NO: 255492 - DNA, 15 bp, Homo sapiens
caatgcagtcatcca

SEQ ID NO: 255493 - DNA, 15 bp, Homo sapiens
tcaatgcagtcatcc

SEQ ID NO: 255494 - DNA, 15 bp, Homo sapiens
ttcaatgcagtcatc

SEQ ID NO: 255495 - DNA, 15 bp, Homo sapiens
attcaatgcagtcat

SEQ ID NO: 255496 - DNA, 15 bp, Homo sapiens
aattcaatgcagtca

SEQ ID NO: 255497 - DNA, 15 bp, Homo sapiens
caattcaatgcagtc

SEQ ID NO: 255498 - DNA, 15 bp, Homo sapiens
acaattcaatgcagt

SEQ ID NO: 255499 - DNA, 15 bp, Homo sapiens
cacaattcaatgcag

SEQ ID NO: 255500 - DNA, 15 bp, Homo sapiens
tcacaattcaatgca

SEQ ID NO: 255501 - DNA, 15 bp, Homo sapiens
atcacaattcaatgc

SEQ ID NO: 255502 - DNA, 15 bp, Homo sapiens
aatcacaattcaatg

SEQ ID NO: 255503 - DNA, 15 bp, Homo sapiens
caatcacaattcaat

SEQ ID NO: 255504 - DNA, 15 bp, Homo sapiens
ccaatcacaattcaa

SEQ ID NO: 255505 - DNA, 15 bp, Homo sapiens
tccaatcacaattca

SEQ ID NO: 255506 - DNA, 15 bp, Homo sapiens
atccaatcacaattc

SEQ ID NO: 255507 - DNA, 15 bp, Homo sapiens
catccaatcacaatt

SEQ ID NO: 255508 - DNA, 15 bp, Homo sapiens
tcatccaatcacaat

SEQ ID NO: 255509 - DNA, 15 bp, Homo sapiens
ttcatccaatcacaa

SEQ ID NO: 255510 - DNA, 15 bp, Homo sapiens
tttcatccaatcaca

SEQ ID NO: 255511 - DNA, 15 bp, Homo sapiens
ctttcatccaatcac

SEQ ID NO: 255512 - DNA, 15 bp, Homo sapiens
cctttcatccaatca

SEQ ID NO: 255513 - DNA, 15 bp, Homo sapiens
ccctttcatccaatc

SEQ ID NO: 255514 - DNA, 15 bp, Homo sapiens
accctttcatccaat

SEQ ID NO: 255515 - DNA, 15 bp, Homo sapiens
taccctttcatccaa

SEQ ID NO: 255516 - DNA, 15 bp, Homo sapiens
ataccctttcatcca

SEQ ID NO: 255517 - DNA, 15 bp, Homo sapiens
tataccctttcatcc

SEQ ID NO: 255518 - DNA, 15 bp, Homo sapiens
ttataccctttcatc

SEQ ID NO: 255519 - DNA, 15 bp, Homo sapiens
attataccctttcat

SEQ ID NO: 255520 - DNA, 15 bp, Homo sapiens
aattataccctttca

SEQ ID NO: 255521 - DNA, 15 bp, Homo sapiens
aaattataccctttc

SEQ ID NO: 255522 - DNA, 15 bp, Homo sapiens
taaattatacccttt

SEQ ID NO: 255523 - DNA, 15 bp, Homo sapiens
ttaaattataccctt

SEQ ID NO: 255524 - DNA, 15 bp, Homo sapiens
attaaattataccct

SEQ ID NO: 255525 - DNA, 15 bp, Homo sapiens
cattaaattataccc

SEQ ID NO: 255526 - DNA, 15 bp, Homo sapiens
tcattaaattatacc

SEQ ID NO: 255527 - DNA, 15 bp, Homo sapiens
atcattaaattatac

SEQ ID NO: 255528 - DNA, 15 bp, Homo sapiens
tatcattaaattata

SEQ ID NO: 255529 - DNA, 15 bp, Homo sapiens
ttatcattaaattat

SEQ ID NO: 255530 - DNA, 15 bp, Homo sapiens
attatcattaaatta

SEQ ID NO: 255531 - DNA, 15 bp, Homo sapiens
tattatcattaaatt

SEQ ID NO: 255532 - DNA, 15 bp, Homo sapiens
ctattatcattaaat

SEQ ID NO: 255533 - DNA, 15 bp, Homo sapiens
tctattatcattaaa

SEQ ID NO: 255534 - DNA, 15 bp, Homo sapiens
gtctattatcattaa

SEQ ID NO: 255535 - DNA, 15 bp, Homo sapiens
agtctattatcatta

SEQ ID NO: 255536 - DNA, 15 bp, Homo sapiens
cagtctattatcatt

SEQ ID NO: 255537 - DNA, 15 bp, Homo sapiens
tcagtctattatcat

SEQ ID NO: 255538 - DNA, 15 bp, Homo sapiens
ctcagtctattatca

SEQ ID NO: 255539 - DNA, 15 bp, Homo sapiens
tctcagtctattatc

SEQ ID NO: 255540 - DNA, 15 bp, Homo sapiens
ttctcagtctattat

SEQ ID NO: 255541 - DNA, 15 bp, Homo sapiens
cttctcagtctatta

SEQ ID NO: 255542 - DNA, 15 bp, Homo sapiens
ccttctcagtctatt

SEQ ID NO: 255543 - DNA, 15 bp, Homo sapiens
cccttctcagtctat

SEQ ID NO: 255544 - DNA, 15 bp, Homo sapiens
tcccttctcagtcta

SEQ ID NO: 255545 - DNA, 15 bp, Homo sapiens
ttcccttctcagtct

SEQ ID NO: 255546 - DNA, 15 bp, Homo sapiens
attcccttctcagtc

SEQ ID NO: 255547 - DNA, 15 bp, Homo sapiens
aattcccttctcagt

SEQ ID NO: 255548 - DNA, 15 bp, Homo sapiens
gaattcccttctcag

SEQ ID NO: 255549 - DNA, 15 bp, Homo sapiens
ggaattcccttctca

SEQ ID NO: 255550 - DNA, 15 bp, Homo sapiens
tggaattcccttctc

SEQ ID NO: 255551 - DNA, 15 bp, Homo sapiens
ctggaattcccttct

SEQ ID NO: 255552 - DNA, 15 bp, Homo sapiens
gctggaattcccttc

SEQ ID NO: 255553 - DNA, 15 bp, Homo sapiens
tgctggaattccctt

SEQ ID NO: 255554 - DNA, 15 bp, Homo sapiens
ttgctggaattccct

SEQ ID NO: 255555 - DNA, 15 bp, Homo sapiens
cttgctggaattccc

SEQ ID NO: 255556 - DNA, 15 bp, Homo sapiens
ccttgctggaattcc

SEQ ID NO: 255557 - DNA, 15 bp, Homo sapiens
gccttgctggaattc

SEQ ID NO: 255558 - DNA, 15 bp, Homo sapiens
ggccttgctggaatt

SEQ ID NO: 255559 - DNA, 15 bp, Homo sapiens
aggccttgctggaat

SEQ ID NO: 255560 - DNA, 15 bp, Homo sapiens
taggccttgctggaa

SEQ ID NO: 255561 - DNA, 15 bp, Homo sapiens
ataggccttgctgga

SEQ ID NO: 255562 - DNA, 15 bp, Homo sapiens
gataggccttgctgg

SEQ ID NO: 255563 - DNA, 15 bp, Homo sapiens
agataggccttgctg

SEQ ID NO: 255564 - DNA, 15 bp, Homo sapiens
tagataggccttgct

SEQ ID NO: 255565 - DNA, 15 bp, Homo sapiens
atagataggccttgc

SEQ ID NO: 255566 - DNA, 15 bp, Homo sapiens
aatagataggccttg

SEQ ID NO: 255567 - DNA, 15 bp, Homo sapiens
gaatagataggcctt

SEQ ID NO: 255568 - DNA, 15 bp, Homo sapiens
tgaatagataggcct

SEQ ID NO: 255569 - DNA, 15 bp, Homo sapiens
ctgaatagataggcc

SEQ ID NO: 255570 - DNA, 15 bp, Homo sapiens
tctgaatagataggc

SEQ ID NO: 255571 - DNA, 15 bp, Homo sapiens
atctgaatagatagg

SEQ ID NO: 255572 - DNA, 15 bp, Homo sapiens
aatctgaatagatag

SEQ ID NO: 255573 - DNA, 15 bp, Homo sapiens
gaatctgaatagata

SEQ ID NO: 255574 - DNA, 15 bp, Homo sapiens
agaatctgaatagat

SEQ ID NO: 255575 - DNA, 15 bp, Homo sapiens
aagaatctgaataga

SEQ ID NO: 255576 - DNA, 15 bp, Homo sapiens
gaagaatctgaatag

SEQ ID NO: 255577 - DNA, 15 bp, Homo sapiens
agaagaatctgaata

SEQ ID NO: 255578 - DNA, 15 bp, Homo sapiens
aagaagaatctgaat

SEQ ID NO: 255579 - DNA, 15 bp, Homo sapiens
caagaagaatctgaa

SEQ ID NO: 255580 - DNA, 15 bp, Homo sapiens
ccaagaagaatctga

SEQ ID NO: 255581 - DNA, 15 bp, Homo sapiens
gccaagaagaatctg

SEQ ID NO: 255582 - DNA, 15 bp, Homo sapiens
agccaagaagaatct

SEQ ID NO: 255583 - DNA, 15 bp, Homo sapiens
aagccaagaagaatc

SEQ ID NO: 255584 - DNA, 15 bp, Homo sapiens
gaagccaagaagaat

SEQ ID NO: 255585 - DNA, 15 bp, Homo sapiens
agaagccaagaagaa

SEQ ID NO: 255586 - DNA, 15 bp, Homo sapiens
gagaagccaagaaga

SEQ ID NO: 255587 - DNA, 15 bp, Homo sapiens
ggagaagccaagaag

SEQ ID NO: 255588 - DNA, 15 bp, Homo sapiens
gggagaagccaagaa

SEQ ID NO: 255589 - DNA, 15 bp, Homo sapiens
agggagaagccaaga

SEQ ID NO: 255590 - DNA, 15 bp, Homo sapiens
cagggagaagccaag

SEQ ID NO: 255591 - DNA, 15 bp, Homo sapiens
gcagggagaagccaa

SEQ ID NO: 255592 - DNA, 15 bp, Homo sapiens
tgcagggagaagcca

SEQ ID NO: 255593 - DNA, 15 bp, Homo sapiens
ctgcagggagaagcc

SEQ ID NO: 255594 - DNA, 15 bp, Homo sapiens
gctgcagggagaagc

SEQ ID NO: 255595 - DNA, 15 bp, Homo sapiens
tgctgcagggagaag

SEQ ID NO: 255596 - DNA, 15 bp, Homo sapiens
atgctgcagggagaa

SEQ ID NO: 255597 - DNA, 15 bp, Homo sapiens
tatgctgcagggaga

SEQ ID NO: 255598 - DNA, 15 bp, Homo sapiens
atatgctgcagggag

SEQ ID NO: 255599 - DNA, 15 bp, Homo sapiens
aatatgctgcaggga

SEQ ID NO: 255600 - DNA, 15 bp, Homo sapiens
gaatatgctgcaggg

SEQ ID NO: 255601 - DNA, 15 bp, Homo sapiens
ggaatatgctgcagg

SEQ ID NO: 255602 - DNA, 15 bp, Homo sapiens
aggaatatgctgcag

SEQ ID NO: 255603 - DNA, 15 bp, Homo sapiens
aaggaatatgctgca

SEQ ID NO: 255604 - DNA, 15 bp, Homo sapiens
aaaggaatatgctgc

SEQ ID NO: 255605 - DNA, 15 bp, Homo sapiens
gaaaggaatatgctg

SEQ ID NO: 255606 - DNA, 15 bp, Homo sapiens
ggaaaggaatatgct

SEQ ID NO: 255607 - DNA, 15 bp, Homo sapiens
aggaaaggaatatgc

SEQ ID NO: 255608 - DNA, 15 bp, Homo sapiens
gaggaaaggaatatg

SEQ ID NO: 255609 - DNA, 15 bp, Homo sapiens
agaggaaaggaatat

SEQ ID NO: 255610 - DNA, 15 bp, Homo sapiens
tagaggaaaggaata

SEQ ID NO: 255611 - DNA, 15 bp, Homo sapiens
ctagaggaaaggaat

SEQ ID NO: 255612 - DNA, 15 bp, Homo sapiens
cctagaggaaaggaa

SEQ ID NO: 255613 - DNA, 15 bp, Homo sapiens
ccctagaggaaagga

SEQ ID NO: 255614 - DNA, 15 bp, Homo sapiens
tccctagaggaaagg

SEQ ID NO: 255615 - DNA, 15 bp, Homo sapiens
gtccctagaggaaag

SEQ ID NO: 255616 - DNA, 15 bp, Homo sapiens
tgtccctagaggaaa

SEQ ID NO: 255617 - DNA, 15 bp, Homo sapiens
ctgtccctagaggaa

SEQ ID NO: 255618 - DNA, 15 bp, Homo sapiens
cctgtccctagagga

SEQ ID NO: 255619 - DNA, 15 bp, Homo sapiens
tcctgtccctagagg

SEQ ID NO: 255620 - DNA, 15 bp, Homo sapiens
atcctgtccctagag

SEQ ID NO: 255621 - DNA, 15 bp, Homo sapiens
tatcctgtccctaga

SEQ ID NO: 255622 - DNA, 15 bp, Homo sapiens
gtatcctgtccctag

SEQ ID NO: 255623 - DNA, 15 bp, Homo sapiens
ggtatcctgtcccta

SEQ ID NO: 255624 - DNA, 15 bp, Homo sapiens
aggtatcctgtccct

SEQ ID NO: 255625 - DNA, 15 bp, Homo sapiens
caggtatcctgtccc

SEQ ID NO: 255626 - DNA, 15 bp, Homo sapiens
acaggtatcctgtcc

SEQ ID NO: 255627 - DNA, 15 bp, Homo sapiens
gacaggtatcctgtc

SEQ ID NO: 255628 - DNA, 15 bp, Homo sapiens
tgacaggtatcctgt

SEQ ID NO: 255629 - DNA, 15 bp, Homo sapiens
gtgacaggtatcctg

SEQ ID NO: 255630 - DNA, 15 bp, Homo sapiens
tgtgacaggtatcct

SEQ ID NO: 255631 - DNA, 15 bp, Homo sapiens
ctgtgacaggtatcc

SEQ ID NO: 255632 - DNA, 15 bp, Homo sapiens
cctgtgacaggtatc

SEQ ID NO: 255633 - DNA, 15 bp, Homo sapiens
tcctgtgacaggtat

SEQ ID NO: 255634 - DNA, 15 bp, Homo sapiens
ctcctgtgacaggta

SEQ ID NO: 255635 - DNA, 15 bp, Homo sapiens
tctcctgtgacaggt

SEQ ID NO: 255636 - DNA, 15 bp, Homo sapiens
ttctcctgtgacagg

SEQ ID NO: 255637 - DNA, 15 bp, Homo sapiens
attctcctgtgacag

SEQ ID NO: 255638 - DNA, 15 bp, Homo sapiens
gattctcctgtgaca

SEQ ID NO: 255639 - DNA, 15 bp, Homo sapiens
agattctcctgtgac

SEQ ID NO: 255640 - DNA, 15 bp, Homo sapiens
aagattctcctgtga

SEQ ID NO: 255641 - DNA, 15 bp, Homo sapiens
gaagattctcctgtg

SEQ ID NO: 255642 - DNA, 15 bp, Homo sapiens
tgaagattctcctgt

SEQ ID NO: 255643 - DNA, 15 bp, Homo sapiens
ctgaagattctcctg

SEQ ID NO: 255644 - DNA, 15 bp, Homo sapiens
cctgaagattctcct

SEQ ID NO: 255645 - DNA, 15 bp, Homo sapiens
tcctgaagattctcc

SEQ ID NO: 255646 - DNA, 15 bp, Homo sapiens
ctcctgaagattctc

SEQ ID NO: 255647 - DNA, 15 bp, Homo sapiens
tctcctgaagattct

SEQ ID NO: 255648 - DNA, 15 bp, Homo sapiens
ctctcctgaagattc

SEQ ID NO: 255649 - DNA, 15 bp, Homo sapiens
tctctcctgaagatt

SEQ ID NO: 255650 - DNA, 15 bp, Homo sapiens
ttctctcctgaagat

SEQ ID NO: 255651 - DNA, 15 bp, Homo sapiens
cttctctcctgaaga

SEQ ID NO: 255652 - DNA, 15 bp, Homo sapiens
ccttctctcctgaag

SEQ ID NO: 255653 - DNA, 15 bp, Homo sapiens
cccttctctcctgaa

SEQ ID NO: 255654 - DNA, 15 bp, Homo sapiens
tcccttctctcctga

SEQ ID NO: 255655 - DNA, 15 bp, Homo sapiens
ctcccttctctcctg

SEQ ID NO: 255656 - DNA, 15 bp, Homo sapiens
tctcccttctctcct

SEQ ID NO: 255657 - DNA, 15 bp, Homo sapiens
ttctcccttctctcc

SEQ ID NO: 255658 - DNA, 15 bp, Homo sapiens
cttctcccttctctc

SEQ ID NO: 255659 - DNA, 15 bp, Homo sapiens
ccttctcccttctct

SEQ ID NO: 255660 - DNA, 15 bp, Homo sapiens
accttctcccttctc

SEQ ID NO: 255661 - DNA, 15 bp, Homo sapiens
caccttctcccttct

SEQ ID NO: 255662 - DNA, 15 bp, Homo sapiens
tcaccttctcccttc

SEQ ID NO: 255663 - DNA, 15 bp, Homo sapiens
gtcaccttctccctt

SEQ ID NO: 255664 - DNA, 15 bp, Homo sapiens
tgtcaccttctccct

SEQ ID NO: 255665 - DNA, 15 bp, Homo sapiens
ctgtcaccttctccc

SEQ ID NO: 255666 - DNA, 15 bp, Homo sapiens
actgtcaccttctcc

SEQ ID NO: 255667 - DNA, 15 bp, Homo sapiens
cactgtcaccttctc

SEQ ID NO: 255668 - DNA, 15 bp, Homo sapiens
tcactgtcaccttct

SEQ ID NO: 255669 - DNA, 15 bp, Homo sapiens
ttcactgtcaccttc

SEQ ID NO: 255670 - DNA, 15 bp, Homo sapiens
gttcactgtcacctt

SEQ ID NO: 255671 - DNA, 15 bp, Homo sapiens
agttcactgtcacct

SEQ ID NO: 255672 - DNA, 15 bp, Homo sapiens
aagttcactgtcacc

SEQ ID NO: 255673 - DNA, 15 bp, Homo sapiens
caagttcactgtcac

SEQ ID NO: 255674 - DNA, 15 bp, Homo sapiens
gcaagttcactgtca

SEQ ID NO: 255675 - DNA, 15 bp, Homo sapiens
agcaagttcactgtc

SEQ ID NO: 255676 - DNA, 15 bp, Homo sapiens
tagcaagttcactgt

SEQ ID NO: 255677 - DNA, 15 bp, Homo sapiens
ctagcaagttcactg

SEQ ID NO: 255678 - DNA, 15 bp, Homo sapiens
tctagcaagttcact

SEQ ID NO: 255679 - DNA, 15 bp, Homo sapiens
atctagcaagttcac

SEQ ID NO: 255680 - DNA, 15 bp, Homo sapiens
aatctagcaagttca

SEQ ID NO: 255681 - DNA, 15 bp, Homo sapiens
aaatctagcaagttc

SEQ ID NO: 255682 - DNA, 15 bp, Homo sapiens
aaaatctagcaagtt

SEQ ID NO: 255683 - DNA, 15 bp, Homo sapiens
taaaatctagcaagt

SEQ ID NO: 255684 - DNA, 15 bp, Homo sapiens
ataaaatctagcaag

SEQ ID NO: 255685 - DNA, 15 bp, Homo sapiens
cataaaatctagcaa

SEQ ID NO: 255686 - DNA, 15 bp, Homo sapiens
ccataaaatctagca

SEQ ID NO: 255687 - DNA, 15 bp, Homo sapiens
gccataaaatctagc

SEQ ID NO: 255688 - DNA, 15 bp, Homo sapiens
agccataaaatctag

SEQ ID NO: 255689 - DNA, 15 bp, Homo sapiens
aagccataaaatcta

SEQ ID NO: 255690 - DNA, 15 bp, Homo sapiens
caagccataaaatct

SEQ ID NO: 255691 - DNA, 15 bp, Homo sapiens
gcaagccataaaatc

SEQ ID NO: 255692 - DNA, 15 bp, Homo sapiens
agcaagccataaaat

SEQ ID NO: 255693 - DNA, 15 bp, Homo sapiens
aagcaagccataaaa

SEQ ID NO: 255694 - DNA, 15 bp, Homo sapiens
aaagcaagccataaa

SEQ ID NO: 255695 - DNA, 15 bp, Homo sapiens
caaagcaagccataa

SEQ ID NO: 255696 - DNA, 15 bp, Homo sapiens
ccaaagcaagccata

SEQ ID NO: 255697 - DNA, 15 bp, Homo sapiens
cccaaagcaagccat

SEQ ID NO: 255698 - DNA, 15 bp, Homo sapiens
ccccaaagcaagcca

SEQ ID NO: 255699 - DNA, 15 bp, Homo sapiens
tccccaaagcaagcc

SEQ ID NO: 255700 - DNA, 15 bp, Homo sapiens
ttccccaaagcaagc

SEQ ID NO: 255701 - DNA, 15 bp, Homo sapiens
cttccccaaagcaag

SEQ ID NO: 255702 - DNA, 15 bp, Homo sapiens
tcttccccaaagcaa

SEQ ID NO: 255703 - DNA, 15 bp, Homo sapiens
ctcttccccaaagca

SEQ ID NO: 255704 - DNA, 15 bp, Homo sapiens
tctcttccccaaagc

SEQ ID NO: 255705 - DNA, 15 bp, Homo sapiens
ttctcttccccaaag

SEQ ID NO: 255706 - DNA, 15 bp, Homo sapiens
cttctcttccccaaa

SEQ ID NO: 255707 - DNA, 15 bp, Homo sapiens
acttctcttccccaa

SEQ ID NO: 255708 - DNA, 15 bp, Homo sapiens
aacttctcttcccca

SEQ ID NO: 255709 - DNA, 15 bp, Homo sapiens
gaacttctcttcccc

SEQ ID NO: 255710 - DNA, 15 bp, Homo sapiens
agaacttctcttccc

SEQ ID NO: 255711 - DNA, 15 bp, Homo sapiens
tagaacttctcttcc

SEQ ID NO: 255712 - DNA, 15 bp, Homo sapiens
ctagaacttctcttc

SEQ ID NO: 255713 - DNA, 15 bp, Homo sapiens
actagaacttctctt

SEQ ID NO: 255714 - DNA, 15 bp, Homo sapiens
aactagaacttctct

SEQ ID NO: 255715 - DNA, 15 bp, Homo sapiens
aaactagaacttctc

SEQ ID NO: 255716 - DNA, 15 bp, Homo sapiens
aaaactagaacttct

SEQ ID NO: 255717 - DNA, 15 bp, Homo sapiens
gaaaactagaacttc

SEQ ID NO: 255718 - DNA, 15 bp, Homo sapiens
tgaaaactagaactt

SEQ ID NO: 255719 - DNA, 15 bp, Homo sapiens
atgaaaactagaact

SEQ ID NO: 255720 - DNA, 15 bp, Homo sapiens
catgaaaactagaac

SEQ ID NO: 255721 - DNA, 15 bp, Homo sapiens
tcatgaaaactagaa

SEQ ID NO: 255722 - DNA, 15 bp, Homo sapiens
gtcatgaaaactaga

SEQ ID NO: 255723 - DNA, 15 bp, Homo sapiens
ggtcatgaaaactag

SEQ ID NO: 255724 - DNA, 15 bp, Homo sapiens
gggtcatgaaaacta

SEQ ID NO: 255725 - DNA, 15 bp, Homo sapiens
tgggtcatgaaaact

SEQ ID NO: 255726 - DNA, 15 bp, Homo sapiens
gtgggtcatgaaaac

SEQ ID NO: 255727 - DNA, 15 bp, Homo sapiens
ggtgggtcatgaaaa

SEQ ID NO: 255728 - DNA, 15 bp, Homo sapiens
aggtgggtcatgaaa

SEQ ID NO: 255729 - DNA, 15 bp, Homo sapiens
aaggtgggtcatgaa

SEQ ID NO: 255730 - DNA, 15 bp, Homo sapiens
caaggtgggtcatga

SEQ ID NO: 255731 - DNA, 15 bp, Homo sapiens
ccaaggtgggtcatg

SEQ ID NO: 255732 - DNA, 15 bp, Homo sapiens
cccaaggtgggtcat

SEQ ID NO: 255733 - DNA, 15 bp, Homo sapiens
ccccaaggtgggtca

SEQ ID NO: 255734 - DNA, 15 bp, Homo sapiens
tccccaaggtgggtc

SEQ ID NO: 255735 - DNA, 15 bp, Homo sapiens
ttccccaaggtgggt

SEQ ID NO: 255736 - DNA, 15 bp, Homo sapiens
cttccccaaggtggg

SEQ ID NO: 255737 - DNA, 15 bp, Homo sapiens
ccttccccaaggtgg

SEQ ID NO: 255738 - DNA, 15 bp, Homo sapiens
cccttccccaaggtg

SEQ ID NO: 255739 - DNA, 15 bp, Homo sapiens
ccccttccccaaggt

SEQ ID NO: 255740 - DNA, 15 bp, Homo sapiens
tccccttccccaagg

SEQ ID NO: 255741 - DNA, 15 bp, Homo sapiens
ttccccttccccaag

SEQ ID NO: 255742 - DNA, 15 bp, Homo sapiens
attccccttccccaa

SEQ ID NO: 255743 - DNA, 15 bp, Homo sapiens
aattccccttcccca

SEQ ID NO: 255744 - DNA, 15 bp, Homo sapiens
gaattccccttcccc

SEQ ID NO: 255745 - DNA, 15 bp, Homo sapiens
agaattccccttccc

SEQ ID NO: 255746 - DNA, 15 bp, Homo sapiens
cagaattccccttcc

SEQ ID NO: 255747 - DNA, 15 bp, Homo sapiens
ccagaattccccttc

SEQ ID NO: 255748 - DNA, 15 bp, Homo sapiens
accagaattcccctt

SEQ ID NO: 255749 - DNA, 15 bp, Homo sapiens
aaccagaattcccct

SEQ ID NO: 255750 - DNA, 15 bp, Homo sapiens
aaaccagaattcccc

SEQ ID NO: 255751 - DNA, 15 bp, Homo sapiens
gaaaccagaattccc

SEQ ID NO: 255752 - DNA, 15 bp, Homo sapiens
agaaaccagaattcc

SEQ ID NO: 255753 - DNA, 15 bp, Homo sapiens
tagaaaccagaattc

SEQ ID NO: 255754 - DNA, 15 bp, Homo sapiens
atagaaaccagaatt

SEQ ID NO: 255755 - DNA, 15 bp, Homo sapiens
aatagaaaccagaat

SEQ ID NO: 255756 - DNA, 15 bp, Homo sapiens
aaatagaaaccagaa

SEQ ID NO: 255757 - DNA, 15 bp, Homo sapiens
taaatagaaaccaga

SEQ ID NO: 255758 - DNA, 15 bp, Homo sapiens
ataaatagaaaccag

SEQ ID NO: 255759 - DNA, 15 bp, Homo sapiens
gataaatagaaacca

SEQ ID NO: 255760 - DNA, 15 bp, Homo sapiens
tgataaatagaaacc

SEQ ID NO: 255761 - DNA, 15 bp, Homo sapiens
gtgataaatagaaac

SEQ ID NO: 255762 - DNA, 15 bp, Homo sapiens
agtgataaatagaaa

SEQ ID NO: 255763 - DNA, 15 bp, Homo sapiens
aagtgataaatagaa

SEQ ID NO: 255764 - DNA, 15 bp, Homo sapiens
aaagtgataaataga

SEQ ID NO: 255765 - DNA, 15 bp, Homo sapiens
caaagtgataaatag

SEQ ID NO: 255766 - DNA, 15 bp, Homo sapiens
ccaaagtgataaata

SEQ ID NO: 255767 - DNA, 15 bp, Homo sapiens
tccaaagtgataaat

SEQ ID NO: 255768 - DNA, 15 bp, Homo sapiens
ttccaaagtgataaa

SEQ ID NO: 255769 - DNA, 15 bp, Homo sapiens
cttccaaagtgataa

SEQ ID NO: 255770 - DNA, 15 bp, Homo sapiens
ccttccaaagtgata

SEQ ID NO: 255771 - DNA, 15 bp, Homo sapiens
tccttccaaagtgat

SEQ ID NO: 255772 - DNA, 15 bp, Homo sapiens
ctccttccaaagtga

SEQ ID NO: 255773 - DNA, 15 bp, Homo sapiens
tctccttccaaagtg

SEQ ID NO: 255774 - DNA, 15 bp, Homo sapiens
ttctccttccaaagt

SEQ ID NO: 255775 - DNA, 15 bp, Homo sapiens
tttctccttccaaag

SEQ ID NO: 255776 - DNA, 15 bp, Homo sapiens
ctttctccttccaaa

SEQ ID NO: 255777 - DNA, 15 bp, Homo sapiens
tctttctccttccaa

SEQ ID NO: 255778 - DNA, 15 bp, Homo sapiens
ctctttctccttcca

SEQ ID NO: 255779 - DNA, 15 bp, Homo sapiens
cctctttctccttcc

SEQ ID NO: 255780 - DNA, 15 bp, Homo sapiens
ccctctttctccttc

SEQ ID NO: 255781 - DNA, 15 bp, Homo sapiens
accctctttctcctt

SEQ ID NO: 255782 - DNA, 15 bp, Homo sapiens
gaccctctttctcct

SEQ ID NO: 255783 - DNA, 15 bp, Homo sapiens
tgaccctctttctcc

SEQ ID NO: 255784 - DNA, 15 bp, Homo sapiens
ctgaccctctttctc

SEQ ID NO: 255785 - DNA, 15 bp, Homo sapiens
cctgaccctctttct

SEQ ID NO: 255786 - DNA, 15 bp, Homo sapiens
tcctgaccctctttc

SEQ ID NO: 255787 - DNA, 15 bp, Homo sapiens
ctcctgaccctcttt

SEQ ID NO: 255788 - DNA, 15 bp, Homo sapiens
tctcctgaccctctt

SEQ ID NO: 255789 - DNA, 15 bp, Homo sapiens
gtctcctgaccctct

SEQ ID NO: 255790 - DNA, 15 bp, Homo sapiens
tgtctcctgaccctc

SEQ ID NO: 255791 - DNA, 15 bp, Homo sapiens
ttgtctcctgaccct

SEQ ID NO: 255792 - DNA, 15 bp, Homo sapiens
cttgtctcctgaccc

SEQ ID NO: 255793 - DNA, 15 bp, Homo sapiens
tcttgtctcctgacc

SEQ ID NO: 255794 - DNA, 15 bp, Homo sapiens
ctcttgtctcctgac

SEQ ID NO: 255795 - DNA, 15 bp, Homo sapiens
tctcttgtctcctga

SEQ ID NO: 255796 - DNA, 15 bp, Homo sapiens
gtctcttgtctcctg

SEQ ID NO: 255797 - DNA, 15 bp, Homo sapiens
ggtctcttgtctcct

SEQ ID NO: 255798 - DNA, 15 bp, Homo sapiens
gggtctcttgtctcc

SEQ ID NO: 255799 - DNA, 15 bp, Homo sapiens
tgggtctcttgtctc

SEQ ID NO: 255800 - DNA, 15 bp, Homo sapiens
ctgggtctcttgtct

SEQ ID NO: 255801 - DNA, 15 bp, Homo sapiens
tctgggtctcttgtc

SEQ ID NO: 255802 - DNA, 15 bp, Homo sapiens
ctctgggtctcttgt

SEQ ID NO: 255803 - DNA, 15 bp, Homo sapiens
cctctgggtctcttg

SEQ ID NO: 255804 - DNA, 15 bp, Homo sapiens
acctctgggtctctt

SEQ ID NO: 255805 - DNA, 15 bp, Homo sapiens
gacctctgggtctct

SEQ ID NO: 255806 - DNA, 15 bp, Homo sapiens
tgacctctgggtctc

SEQ ID NO: 255807 - DNA, 15 bp, Homo sapiens
ctgacctctgggtct

SEQ ID NO: 255808 - DNA, 15 bp, Homo sapiens
tctgacctctgggtc

SEQ ID NO: 255809 - DNA, 15 bp, Homo sapiens
ctctgacctctgggt

SEQ ID NO: 255810 - DNA, 15 bp, Homo sapiens
tctctgacctctggg

SEQ ID NO: 255811 - DNA, 15 bp, Homo sapiens
ctctctgacctctgg

SEQ ID NO: 255812 - DNA, 15 bp, Homo sapiens
tctctctgacctctg

SEQ ID NO: 255813 - DNA, 15 bp, Homo sapiens
gtctctctgacctct

SEQ ID NO: 255814 - DNA, 15 bp, Homo sapiens
ggtctctctgacctc

SEQ ID NO: 255815 - DNA, 15 bp, Homo sapiens
aggtctctctgacct

SEQ ID NO: 255816 - DNA, 15 bp, Homo sapiens
aaggtctctctgacc

SEQ ID NO: 255817 - DNA, 15 bp, Homo sapiens
taaggtctctctgac

SEQ ID NO: 255818 - DNA, 15 bp, Homo sapiens
gtaaggtctctctga

SEQ ID NO: 255819 - DNA, 15 bp, Homo sapiens
agtaaggtctctctg

SEQ ID NO: 255820 - DNA, 15 bp, Homo sapiens
tagtaaggtctctct

SEQ ID NO: 255821 - DNA, 15 bp, Homo sapiens
gtagtaaggtctctc

SEQ ID NO: 255822 - DNA, 15 bp, Homo sapiens
agtagtaaggtctct

SEQ ID NO: 255823 - DNA, 15 bp, Homo sapiens
cagtagtaaggtctc

SEQ ID NO: 255824 - DNA, 15 bp, Homo sapiens
tcagtagtaaggtct

SEQ ID NO: 255825 - DNA, 15 bp, Homo sapiens
ctcagtagtaaggtc

SEQ ID NO: 255826 - DNA, 15 bp, Homo sapiens
cctcagtagtaaggt

SEQ ID NO: 255827 - DNA, 15 bp, Homo sapiens
gcctcagtagtaagg

SEQ ID NO: 255828 - DNA, 15 bp, Homo sapiens
ggcctcagtagtaag

SEQ ID NO: 255829 - DNA, 15 bp, Homo sapiens
aggcctcagtagtaa

SEQ ID NO: 255830 - DNA, 15 bp, Homo sapiens
aaggcctcagtagta

SEQ ID NO: 255831 - DNA, 15 bp, Homo sapiens
gaaggcctcagtagt

SEQ ID NO: 255832 - DNA, 15 bp, Homo sapiens
ggaaggcctcagtag

SEQ ID NO: 255833 - DNA, 15 bp, Homo sapiens
tggaaggcctcagta

SEQ ID NO: 255834 - DNA, 15 bp, Homo sapiens
ctggaaggcctcagt

SEQ ID NO: 255835 - DNA, 15 bp, Homo sapiens
actggaaggcctcag

SEQ ID NO: 255836 - DNA, 15 bp, Homo sapiens
gactggaaggcctca

SEQ ID NO: 255837 - DNA, 15 bp, Homo sapiens
agactggaaggcctc

SEQ ID NO: 255838 - DNA, 15 bp, Homo sapiens
gagactggaaggcct

SEQ ID NO: 255839 - DNA, 15 bp, Homo sapiens
ggagactggaaggcc

SEQ ID NO: 255840 - DNA, 15 bp, Homo sapiens
aggagactggaaggc

SEQ ID NO: 255841 - DNA, 15 bp, Homo sapiens
aaggagactggaagg

SEQ ID NO: 255842 - DNA, 15 bp, Homo sapiens
gaaggagactggaag

SEQ ID NO: 255843 - DNA, 15 bp, Homo sapiens
tgaaggagactggaa

SEQ ID NO: 255844 - DNA, 15 bp, Homo sapiens
atgaaggagactgga

SEQ ID NO: 255845 - DNA, 15 bp, Homo sapiens
aatgaaggagactgg

SEQ ID NO: 255846 - DNA, 15 bp, Homo sapiens
aaatgaaggagactg

SEQ ID NO: 255847 - DNA, 15 bp, Homo sapiens
gaaatgaaggagact

SEQ ID NO: 255848 - DNA, 15 bp, Homo sapiens
tgaaatgaaggagac

SEQ ID NO: 255849 - DNA, 15 bp, Homo sapiens
ttgaaatgaaggaga

SEQ ID NO: 255850 - DNA, 15 bp, Homo sapiens
tttgaaatgaaggag

SEQ ID NO: 255851 - DNA, 15 bp, Homo sapiens
ctttgaaatgaagga

SEQ ID NO: 255852 - DNA, 15 bp, Homo sapiens
actttgaaatgaagg

SEQ ID NO: 255853 - DNA, 15 bp, Homo sapiens
tactttgaaatgaag

SEQ ID NO: 255854 - DNA, 15 bp, Homo sapiens
gtactttgaaatgaa

SEQ ID NO: 255855 - DNA, 15 bp, Homo sapiens
agtactttgaaatga

SEQ ID NO: 255856 - DNA, 15 bp, Homo sapiens
gagtactttgaaatg

SEQ ID NO: 255857 - DNA, 15 bp, Homo sapiens
tgagtactttgaaat

SEQ ID NO: 255858 - DNA, 15 bp, Homo sapiens
ttgagtactttgaaa

SEQ ID NO: 255859 - DNA, 15 bp, Homo sapiens
gttgagtactttgaa

SEQ ID NO: 255860 - DNA, 15 bp, Homo sapiens
ggttgagtactttga

SEQ ID NO: 255861 - DNA, 15 bp, Homo sapiens
gggttgagtactttg

SEQ ID NO: 255862 - DNA, 15 bp, Homo sapiens
tgggttgagtacttt

SEQ ID NO: 255863 - DNA, 15 bp, Homo sapiens
gtgggttgagtactt

SEQ ID NO: 255864 - DNA, 15 bp, Homo sapiens
ggtgggttgagtact

SEQ ID NO: 255865 - DNA, 15 bp, Homo sapiens
tggtgggttgagtac

SEQ ID NO: 255866 - DNA, 15 bp, Homo sapiens
atggtgggttgagta

SEQ ID NO: 255867 - DNA, 15 bp, Homo sapiens
catggtgggttgagt

SEQ ID NO: 255868 - DNA, 15 bp, Homo sapiens
acatggtgggttgag

SEQ ID NO: 255869 - DNA, 15 bp, Homo sapiens
aacatggtgggttga

SEQ ID NO: 255870 - DNA, 15 bp, Homo sapiens
gaacatggtgggttg

SEQ ID NO: 255871 - DNA, 15 bp, Homo sapiens
agaacatggtgggtt

SEQ ID NO: 255872 - DNA, 15 bp, Homo sapiens
cagaacatggtgggt

SEQ ID NO: 255873 - DNA, 15 bp, Homo sapiens
tcagaacatggtggg

SEQ ID NO: 255874 - DNA, 15 bp, Homo sapiens
ctcagaacatggtgg

SEQ ID NO: 255875 - DNA, 15 bp, Homo sapiens
gctcagaacatggtg

SEQ ID NO: 255876 - DNA, 15 bp, Homo sapiens
ggctcagaacatggt

SEQ ID NO: 255877 - DNA, 15 bp, Homo sapiens
gggctcagaacatgg

SEQ ID NO: 255878 - DNA, 15 bp, Homo sapiens
agggctcagaacatg

SEQ ID NO: 255879 - DNA, 15 bp, Homo sapiens
cagggctcagaacat

SEQ ID NO: 255880 - DNA, 15 bp, Homo sapiens
tcagggctcagaaca

SEQ ID NO: 255881 - DNA, 15 bp, Homo sapiens
gtcagggctcagaac

SEQ ID NO: 255882 - DNA, 15 bp, Homo sapiens
tgtcagggctcagaa

SEQ ID NO: 255883 - DNA, 15 bp, Homo sapiens
gtgtcagggctcaga

SEQ ID NO: 255884 - DNA, 15 bp, Homo sapiens
ggtgtcagggctcag

SEQ ID NO: 255885 - DNA, 15 bp, Homo sapiens
aggtgtcagggctca

SEQ ID NO: 255886 - DNA, 15 bp, Homo sapiens
caggtgtcagggctc

SEQ ID NO: 255887 - DNA, 15 bp, Homo sapiens
acaggtgtcagggct

SEQ ID NO: 255888 - DNA, 15 bp, Homo sapiens
aacaggtgtcagggc

SEQ ID NO: 255889 - DNA, 15 bp, Homo sapiens
caacaggtgtcaggg

SEQ ID NO: 255890 - DNA, 15 bp, Homo sapiens
tcaacaggtgtcagg

SEQ ID NO: 255891 - DNA, 15 bp, Homo sapiens
ttcaacaggtgtcag

SEQ ID NO: 255892 - DNA, 15 bp, Homo sapiens
tttcaacaggtgtca

SEQ ID NO: 255893 - DNA, 15 bp, Homo sapiens
ttttcaacaggtgtc

SEQ ID NO: 255894 - DNA, 15 bp, Homo sapiens
attttcaacaggtgt

SEQ ID NO: 255895 - DNA, 15 bp, Homo sapiens
tattttcaacaggtg

SEQ ID NO: 255896 - DNA, 15 bp, Homo sapiens
gtattttcaacaggt

SEQ ID NO: 255897 - DNA, 15 bp, Homo sapiens
agtattttcaacagg

SEQ ID NO: 255898 - DNA, 15 bp, Homo sapiens
aagtattttcaacag

SEQ ID NO: 255899 - DNA, 15 bp, Homo sapiens
aaagtattttcaaca

SEQ ID NO: 255900 - DNA, 15 bp, Homo sapiens
gaaagtattttcaac

SEQ ID NO: 255901 - DNA, 15 bp, Homo sapiens
agaaagtattttcaa

SEQ ID NO: 255902 - DNA, 15 bp, Homo sapiens
aagaaagtattttca

SEQ ID NO: 255903 - DNA, 15 bp, Homo sapiens
taagaaagtattttc

SEQ ID NO: 255904 - DNA, 15 bp, Homo sapiens
ctaagaaagtatttt

SEQ ID NO: 255905 - DNA, 15 bp, Homo sapiens
tctaagaaagtattt

SEQ ID NO: 255906 - DNA, 15 bp, Homo sapiens
ttctaagaaagtatt

SEQ ID NO: 255907 - DNA, 15 bp, Homo sapiens
attctaagaaagtat

SEQ ID NO: 255908 - DNA, 15 bp, Homo sapiens
aattctaagaaagta

SEQ ID NO: 255909 - DNA, 15 bp, Homo sapiens
aaattctaagaaagt

SEQ ID NO: 255910 - DNA, 15 bp, Homo sapiens
aaaattctaagaaag

SEQ ID NO: 255911 - DNA, 15 bp, Homo sapiens
gaaaattctaagaaa

SEQ ID NO: 255912 - DNA, 15 bp, Homo sapiens
agaaaattctaagaa

SEQ ID NO: 255913 - DNA, 15 bp, Homo sapiens
gagaaaattctaaga

SEQ ID NO: 255914 - DNA, 15 bp, Homo sapiens
agagaaaattctaag

SEQ ID NO: 255915 - DNA, 15 bp, Homo sapiens
cagagaaaattctaa

SEQ ID NO: 255916 - DNA, 15 bp, Homo sapiens
acagagaaaattcta

SEQ ID NO: 255917 - DNA, 15 bp, Homo sapiens
tacagagaaaattct

SEQ ID NO: 255918 - DNA, 15 bp, Homo sapiens
ctacagagaaaattc

SEQ ID NO: 255919 - DNA, 15 bp, Homo sapiens
gctacagagaaaatt

SEQ ID NO: 255920 - DNA, 15 bp, Homo sapiens
tgctacagagaaaat

SEQ ID NO: 255921 - DNA, 15 bp, Homo sapiens
gtgctacagagaaaa

SEQ ID NO: 255922 - DNA, 15 bp, Homo sapiens
agtgctacagagaaa

SEQ ID NO: 255923 - DNA, 15 bp, Homo sapiens
cagtgctacagagaa

SEQ ID NO: 255924 - DNA, 15 bp, Homo sapiens
gcagtgctacagaga

SEQ ID NO: 255925 - DNA, 15 bp, Homo sapiens
agcagtgctacagag

SEQ ID NO: 255926 - DNA, 15 bp, Homo sapiens
aagcagtgctacaga

SEQ ID NO: 255927 - DNA, 15 bp, Homo sapiens
aaagcagtgctacag

SEQ ID NO: 255928 - DNA, 15 bp, Homo sapiens
caaagcagtgctaca

SEQ ID NO: 255929 - DNA, 15 bp, Homo sapiens
tcaaagcagtgctac

SEQ ID NO: 255930 - DNA, 15 bp, Homo sapiens
ctcaaagcagtgcta

SEQ ID NO: 255931 - DNA, 15 bp, Homo sapiens
tctcaaagcagtgct

SEQ ID NO: 255932 - DNA, 15 bp, Homo sapiens
atctcaaagcagtgc

SEQ ID NO: 255933 - DNA, 15 bp, Homo sapiens
catctcaaagcagtg

SEQ ID NO: 255934 - DNA, 15 bp, Homo sapiens
acatctcaaagcagt

SEQ ID NO: 255935 - DNA, 15 bp, Homo sapiens
tacatctcaaagcag

SEQ ID NO: 255936 - DNA, 15 bp, Homo sapiens
atacatctcaaagca

SEQ ID NO: 255937 - DNA, 15 bp, Homo sapiens
gatacatctcaaagc

SEQ ID NO: 255938 - DNA, 15 bp, Homo sapiens
agatacatctcaaag

SEQ ID NO: 255939 - DNA, 15 bp, Homo sapiens
gagatacatctcaaa

SEQ ID NO: 255940 - DNA, 15 bp, Homo sapiens
tgagatacatctcaa

SEQ ID NO: 255941 - DNA, 15 bp, Homo sapiens
ttgagatacatctca

SEQ ID NO: 255942 - DNA, 15 bp, Homo sapiens
gttgagatacatctc

SEQ ID NO: 255943 - DNA, 15 bp, Homo sapiens
tgttgagatacatct

SEQ ID NO: 255944 - DNA, 15 bp, Homo sapiens
atgttgagatacatc

SEQ ID NO: 255945 - DNA, 15 bp, Homo sapiens
catgttgagatacat

SEQ ID NO: 255946 - DNA, 15 bp, Homo sapiens
ccatgttgagataca

SEQ ID NO: 255947 - DNA, 15 bp, Homo sapiens
accatgttgagatac

SEQ ID NO: 255948 - DNA, 15 bp, Homo sapiens
caccatgttgagata

SEQ ID NO: 255949 - DNA, 15 bp, Homo sapiens
gcaccatgttgagat

SEQ ID NO: 255950 - DNA, 15 bp, Homo sapiens
agcaccatgttgaga

SEQ ID NO: 255951 - DNA, 15 bp, Homo sapiens
tagcaccatgttgag

SEQ ID NO: 255952 - DNA, 15 bp, Homo sapiens
ttagcaccatgttga

SEQ ID NO: 255953 - DNA, 15 bp, Homo sapiens
attagcaccatgttg

SEQ ID NO: 255954 - DNA, 15 bp, Homo sapiens
cattagcaccatgtt

SEQ ID NO: 255955 - DNA, 15 bp, Homo sapiens
tcattagcaccatgt

SEQ ID NO: 255956 - DNA, 15 bp, Homo sapiens
atcattagcaccatg

SEQ ID NO: 255957 - DNA, 15 bp, Homo sapiens
gatcattagcaccat

SEQ ID NO: 255958 - DNA, 15 bp, Homo sapiens
tgatcattagcacca

SEQ ID NO: 255959 - DNA, 15 bp, Homo sapiens
atgatcattagcacc

SEQ ID NO: 255960 - DNA, 15 bp, Homo sapiens
aatgatcattagcac

SEQ ID NO: 255961 - DNA, 15 bp, Homo sapiens
aaatgatcattagca

SEQ ID NO: 255962 - DNA, 15 bp, Homo sapiens
taaatgatcattagc

SEQ ID NO: 255963 - DNA, 15 bp, Homo sapiens
ttaaatgatcattag

SEQ ID NO: 255964 - DNA, 15 bp, Homo sapiens
gttaaatgatcatta

SEQ ID NO: 255965 - DNA, 15 bp, Homo sapiens
agttaaatgatcatt

SEQ ID NO: 255966 - DNA, 15 bp, Homo sapiens
aagttaaatgatcat

SEQ ID NO: 255967 - DNA, 15 bp, Homo sapiens
aaagttaaatgatca

SEQ ID NO: 255968 - DNA, 15 bp, Homo sapiens
aaaagttaaatgatc

SEQ ID NO: 255969 - DNA, 15 bp, Homo sapiens
aaaaagttaaatgat

SEQ ID NO: 255970 - DNA, 15 bp, Homo sapiens
aaaaaagttaaatga

SEQ ID NO: 255971 - DNA, 15 bp, Homo sapiens
gaaaaaagttaaatg

SEQ ID NO: 255972 - DNA, 15 bp, Homo sapiens
taagaaaaaagttaa

SEQ ID NO: 255973 - DNA, 15 bp, Homo sapiens
ttaagaaaaaagtta

SEQ ID NO: 255974 - DNA, 15 bp, Homo sapiens
tttaagaaaaaagtt

SEQ ID NO: 255975 - DNA, 15 bp, Homo sapiens
atttaagaaaaaagt

SEQ ID NO: 255976 - DNA, 15 bp, Homo sapiens
tatttaagaaaaaag

SEQ ID NO: 255977 - DNA, 15 bp, Homo sapiens
gtatttaagaaaaaa

SEQ ID NO: 255978 - DNA, 15 bp, Homo sapiens
cgtatttaagaaaaa

SEQ ID NO: 255979 - DNA, 15 bp, Homo sapiens
acgtatttaagaaaa

SEQ ID NO: 255980 - DNA, 15 bp, Homo sapiens
cacgtatttaagaaa

SEQ ID NO: 255981 - DNA, 15 bp, Homo sapiens
acacgtatttaagaa

SEQ ID NO: 255982 - DNA, 15 bp, Homo sapiens
aacacgtatttaaga

SEQ ID NO: 255983 - DNA, 15 bp, Homo sapiens
caacacgtatttaag

SEQ ID NO: 255984 - DNA, 15 bp, Homo sapiens
ccaacacgtatttaa

SEQ ID NO: 255985 - DNA, 15 bp, Homo sapiens
cccaacacgtattta

SEQ ID NO: 255986 - DNA, 15 bp, Homo sapiens
ccccaacacgtattt

SEQ ID NO: 255987 - DNA, 15 bp, Homo sapiens
tccccaacacgtatt

SEQ ID NO: 255988 - DNA, 15 bp, Homo sapiens
ttccccaacacgtat

SEQ ID NO: 255989 - DNA, 15 bp, Homo sapiens
attccccaacacgta

SEQ ID NO: 255990 - DNA, 15 bp, Homo sapiens
aattccccaacacgt

SEQ ID NO: 255991 - DNA, 15 bp, Homo sapiens
aaattccccaacacg

SEQ ID NO: 255992 - DNA, 15 bp, Homo sapiens
caaattccccaacac

SEQ ID NO: 255993 - DNA, 15 bp, Homo sapiens
ccaaattccccaaca

SEQ ID NO: 255994 - DNA, 15 bp, Homo sapiens
cccaaattccccaac

SEQ ID NO: 255995 - DNA, 15 bp, Homo sapiens
tcccaaattccccaa

SEQ ID NO: 255996 - DNA, 15 bp, Homo sapiens
ctcccaaattcccca

SEQ ID NO: 255997 - DNA, 15 bp, Homo sapiens
tctcccaaattcccc

SEQ ID NO: 255998 - DNA, 15 bp, Homo sapiens
ttctcccaaattccc

SEQ ID NO: 255999 - DNA, 15 bp, Homo sapiens
cttctcccaaattcc

SEQ ID NO: 256000 - DNA, 15 bp, Homo sapiens
tcttctcccaaattc

SEQ ID NO: 256001 - DNA, 15 bp, Homo sapiens
gtcttctcccaaatt

SEQ ID NO: 256002 - DNA, 15 bp, Homo sapiens
agtcttctcccaaat

SEQ ID NO: 256003 - DNA, 15 bp, Homo sapiens
aagtcttctcccaaa

SEQ ID NO: 256004 - DNA, 15 bp, Homo sapiens
aaagtcttctcccaa

SEQ ID NO: 256005 - DNA, 15 bp, Homo sapiens
aaaagtcttctccca

SEQ ID NO: 256006 - DNA, 15 bp, Homo sapiens
aaaaagtcttctccc

SEQ ID NO: 256007 - DNA, 15 bp, Homo sapiens
taaaaagtcttctcc

SEQ ID NO: 256008 - DNA, 15 bp, Homo sapiens
ataaaaagtcttctc

SEQ ID NO: 256009 - DNA, 15 bp, Homo sapiens
aataaaaagtcttct

SEQ ID NO: 256010 - DNA, 15 bp, Homo sapiens
aaataaaaagtcttc

SEQ ID NO: 256011 - DNA, 15 bp, Homo sapiens
gaaataaaaagtctt

SEQ ID NO: 256012 - DNA, 15 bp, Homo sapiens
tgaaataaaaagtct

SEQ ID NO: 256013 - DNA, 15 bp, Homo sapiens
ctgaaataaaaagtc

SEQ ID NO: 256014 - DNA, 15 bp, Homo sapiens
cctgaaataaaaagt

SEQ ID NO: 256015 - DNA, 15 bp, Homo sapiens
gcctgaaataaaaag

SEQ ID NO: 256016 - DNA, 15 bp, Homo sapiens
tgcctgaaataaaaa

SEQ ID NO: 256017 - DNA, 15 bp, Homo sapiens
ttgcctgaaataaaa

SEQ ID NO: 256018 - DNA, 15 bp, Homo sapiens
tttgcctgaaataaa

SEQ ID NO: 256019 - DNA, 15 bp, Homo sapiens
gtttgcctgaaataa

SEQ ID NO: 256020 - DNA, 15 bp, Homo sapiens
tgtttgcctgaaata

SEQ ID NO: 256021 - DNA, 15 bp, Homo sapiens
atgtttgcctgaaat

SEQ ID NO: 256022 - DNA, 15 bp, Homo sapiens
tatgtttgcctgaaa

SEQ ID NO: 256023 - DNA, 15 bp, Homo sapiens
ttatgtttgcctgaa

SEQ ID NO: 256024 - DNA, 15 bp, Homo sapiens
attatgtttgcctga

SEQ ID NO: 256025 - DNA, 15 bp, Homo sapiens
tattatgtttgcctg

SEQ ID NO: 256026 - DNA, 15 bp, Homo sapiens
atattatgtttgcct

SEQ ID NO: 256027 - DNA, 15 bp, Homo sapiens
aatattatgtttgcc

SEQ ID NO: 256028 - DNA, 15 bp, Homo sapiens
aaatattatgtttgc

SEQ ID NO: 256029 - DNA, 15 bp, Homo sapiens
aaaatattatgtttg

SEQ ID NO: 256030 - DNA, 15 bp, Homo sapiens
aaaaatattatgttt

SEQ ID NO: 256031 - DNA, 15 bp, Homo sapiens
aaaaaatattatgtt

SEQ ID NO: 256032 - DNA, 15 bp, Homo sapiens
gaaaaaatattatgt

SEQ ID NO: 256033 - DNA, 15 bp, Homo sapiens
tgaaaaaatattatg

SEQ ID NO: 256034 - DNA, 15 bp, Homo sapiens
atgaaaaaatattat

SEQ ID NO: 256035 - DNA, 15 bp, Homo sapiens
gatgaaaaaatatta

SEQ ID NO: 256036 - DNA, 15 bp, Homo sapiens
tgatgaaaaaatatt

SEQ ID NO: 256037 - DNA, 15 bp, Homo sapiens
atgatgaaaaaatat

SEQ ID NO: 256038 - DNA, 15 bp, Homo sapiens
gatgatgaaaaaata

SEQ ID NO: 256039 - DNA, 15 bp, Homo sapiens
ggatgatgaaaaaat

SEQ ID NO: 256040 - DNA, 15 bp, Homo sapiens
tggatgatgaaaaaa

SEQ ID NO: 256041 - DNA, 15 bp, Homo sapiens
ttggatgatgaaaaa

SEQ ID NO: 256042 - DNA, 15 bp, Homo sapiens
tttggatgatgaaaa

SEQ ID NO: 256043 - DNA, 15 bp, Homo sapiens
ctttggatgatgaaa

SEQ ID NO: 256044 - DNA, 15 bp, Homo sapiens
actttggatgatgaa

SEQ ID NO: 256045 - DNA, 15 bp, Homo sapiens
tactttggatgatga

SEQ ID NO: 256046 - DNA, 15 bp, Homo sapiens
ttactttggatgatg

SEQ ID NO: 256047 - DNA, 15 bp, Homo sapiens
gttactttggatgat

SEQ ID NO: 256048 - DNA, 15 bp, Homo sapiens
ggttactttggatga

SEQ ID NO: 256049 - DNA, 15 bp, Homo sapiens
tggttactttggatg

SEQ ID NO: 256050 - DNA, 15 bp, Homo sapiens
ttggttactttggat

SEQ ID NO: 256051 - DNA, 15 bp, Homo sapiens
tttggttactttgga

SEQ ID NO: 256052 - DNA, 15 bp, Homo sapiens
atttggttactttgg

SEQ ID NO: 256053 - DNA, 15 bp, Homo sapiens
tatttggttactttg

SEQ ID NO: 256054 - DNA, 15 bp, Homo sapiens
gtatttggttacttt

SEQ ID NO: 256055 - DNA, 15 bp, Homo sapiens
tgtatttggttactt

SEQ ID NO: 256056 - DNA, 15 bp, Homo sapiens
atgtatttggttact

SEQ ID NO: 256057 - DNA, 15 bp, Homo sapiens
aatgtatttggttac

SEQ ID NO: 256058 - DNA, 15 bp, Homo sapiens
gaatgtatttggtta

SEQ ID NO: 256059 - DNA, 15 bp, Homo sapiens
agaatgtatttggtt

SEQ ID NO: 256060 - DNA, 15 bp, Homo sapiens
cagaatgtatttggt

SEQ ID NO: 256061 - DNA, 15 bp, Homo sapiens
ccagaatgtatttgg

SEQ ID NO: 256062 - DNA, 15 bp, Homo sapiens
cccagaatgtatttg

SEQ ID NO: 256063 - DNA, 15 bp, Homo sapiens
gcccagaatgtattt

SEQ ID NO: 256064 - DNA, 15 bp, Homo sapiens
tgcccagaatgtatt

SEQ ID NO: 256065 - DNA, 15 bp, Homo sapiens
atgcccagaatgtat

SEQ ID NO: 256066 - DNA, 15 bp, Homo sapiens
aatgcccagaatgta

SEQ ID NO: 256067 - DNA, 15 bp, Homo sapiens
gaatgcccagaatgt

SEQ ID NO: 256068 - DNA, 15 bp, Homo sapiens
tgaatgcccagaatg

SEQ ID NO: 256069 - DNA, 15 bp, Homo sapiens
ttgaatgcccagaat

SEQ ID NO: 256070 - DNA, 15 bp, Homo sapiens
attgaatgcccagaa

SEQ ID NO: 256071 - DNA, 15 bp, Homo sapiens
tattgaatgcccaga

SEQ ID NO: 256072 - DNA, 15 bp, Homo sapiens
atattgaatgcccag

SEQ ID NO: 256073 - DNA, 15 bp, Homo sapiens
tatattgaatgccca

SEQ ID NO: 256074 - DNA, 15 bp, Homo sapiens
atatattgaatgccc

SEQ ID NO: 256075 - DNA, 15 bp, Homo sapiens
tatatattgaatgcc

SEQ ID NO: 256076 - DNA, 15 bp, Homo sapiens
atatatattgaatgc

SEQ ID NO: 256077 - DNA, 15 bp, Homo sapiens
aatatatattgaatg

SEQ ID NO: 256078 - DNA, 15 bp, Homo sapiens
gaatatatattgaat

SEQ ID NO: 256079 - DNA, 15 bp, Homo sapiens
tgaatatatattgaa

SEQ ID NO: 256080 - DNA, 15 bp, Homo sapiens
ttgaatatatattga

SEQ ID NO: 256081 - DNA, 15 bp, Homo sapiens
attgaatatatattg

SEQ ID NO: 256082 - DNA, 15 bp, Homo sapiens
tattgaatatatatt

SEQ ID NO: 256083 - DNA, 15 bp, Homo sapiens
ttattgaatatatat

SEQ ID NO: 256084 - DNA, 15 bp, Homo sapiens
attattgaatatata

SEQ ID NO: 256085 - DNA, 15 bp, Homo sapiens
tattattgaatatat

SEQ ID NO: 256086 - DNA, 15 bp, Homo sapiens
ttattattgaatata

SEQ ID NO: 256087 - DNA, 15 bp, Homo sapiens
cttattattgaatat

SEQ ID NO: 256088 - DNA, 15 bp, Homo sapiens
gcttattattgaata

SEQ ID NO: 256089 - DNA, 15 bp, Homo sapiens
ggcttattattgaat

SEQ ID NO: 256090 - DNA, 15 bp, Homo sapiens
aggcttattattgaa

SEQ ID NO: 256091 - DNA, 15 bp, Homo sapiens
taggcttattattga

SEQ ID NO: 256092 - DNA, 15 bp, Homo sapiens
ataggcttattattg

SEQ ID NO: 256093 - DNA, 15 bp, Homo sapiens
gataggcttattatt

SEQ ID NO: 256094 - DNA, 15 bp, Homo sapiens
agataggcttattat

SEQ ID NO: 256095 - DNA, 15 bp, Homo sapiens
aagataggcttatta

SEQ ID NO: 256096 - DNA, 15 bp, Homo sapiens
gaagataggcttatt

SEQ ID NO: 256097 - DNA, 15 bp, Homo sapiens
tgaagataggcttat

SEQ ID NO: 256098 - DNA, 15 bp, Homo sapiens
ttgaagataggctta

SEQ ID NO: 256099 - DNA, 15 bp, Homo sapiens
tttgaagataggctt

SEQ ID NO: 256100 - DNA, 15 bp, Homo sapiens
atttgaagataggct

SEQ ID NO: 256101 - DNA, 15 bp, Homo sapiens
aatttgaagataggc

SEQ ID NO: 256102 - DNA, 15 bp, Homo sapiens
caatttgaagatagg

SEQ ID NO: 256103 - DNA, 15 bp, Homo sapiens
acaatttgaagatag

SEQ ID NO: 256104 - DNA, 15 bp, Homo sapiens
aacaatttgaagata

SEQ ID NO: 256105 - DNA, 15 bp, Homo sapiens
aaacaatttgaagat

SEQ ID NO: 256106 - DNA, 15 bp, Homo sapiens
gaaacaatttgaaga

SEQ ID NO: 256107 - DNA, 15 bp, Homo sapiens
agaaacaatttgaag

SEQ ID NO: 256108 - DNA, 15 bp, Homo sapiens
aagaaacaatttgaa

SEQ ID NO: 256109 - DNA, 15 bp, Homo sapiens
aaagaaacaatttga

SEQ ID NO: 256110 - DNA, 15 bp, Homo sapiens
aaaagaaacaatttg

SEQ ID NO: 256111 - DNA, 15 bp, Homo sapiens
aaaaagaaacaattt

SEQ ID NO: 256112 - DNA, 15 bp, Homo sapiens
gaaaaagaaacaatt

SEQ ID NO: 256113 - DNA, 15 bp, Homo sapiens
agaaaaagaaacaat

SEQ ID NO: 256114 - DNA, 15 bp, Homo sapiens
tagaaaaagaaacaa

SEQ ID NO: 256115 - DNA, 15 bp, Homo sapiens
atagaaaaagaaaca

SEQ ID NO: 256116 - DNA, 15 bp, Homo sapiens
aatagaaaaagaaac

SEQ ID NO: 256117 - DNA, 15 bp, Homo sapiens
aaatagaaaaagaaa

SEQ ID NO: 256118 - DNA, 15 bp, Homo sapiens
gaaatagaaaaagaa

SEQ ID NO: 256119 - DNA, 15 bp, Homo sapiens
tgaaatagaaaaaga

SEQ ID NO: 256120 - DNA, 15 bp, Homo sapiens
ctgaaatagaaaaag

SEQ ID NO: 256121 - DNA, 15 bp, Homo sapiens
gctgaaatagaaaaa

SEQ ID NO: 256122 - DNA, 15 bp, Homo sapiens
agctgaaatagaaaa

SEQ ID NO: 256123 - DNA, 15 bp, Homo sapiens
cagctgaaatagaaa

SEQ ID NO: 256124 - DNA, 15 bp, Homo sapiens
tcagctgaaatagaa

SEQ ID NO: 256125 - DNA, 15 bp, Homo sapiens
gtcagctgaaataga

SEQ ID NO: 256126 - DNA, 15 bp, Homo sapiens
ggtcagctgaaatag

SEQ ID NO: 256127 - DNA, 15 bp, Homo sapiens
aggtcagctgaaata

SEQ ID NO: 256128 - DNA, 15 bp, Homo sapiens
caggtcagctgaaat

SEQ ID NO: 256129 - DNA, 15 bp, Homo sapiens
tcaggtcagctgaaa

SEQ ID NO: 256130 - DNA, 15 bp, Homo sapiens
ttcaggtcagctgaa

SEQ ID NO: 256131 - DNA, 15 bp, Homo sapiens
attcaggtcagctga

SEQ ID NO: 256132 - DNA, 15 bp, Homo sapiens
tattcaggtcagctg

SEQ ID NO: 256133 - DNA, 15 bp, Homo sapiens
ttattcaggtcagct

SEQ ID NO: 256134 - DNA, 15 bp, Homo sapiens
attattcaggtcagc

SEQ ID NO: 256135 - DNA, 15 bp, Homo sapiens
cattattcaggtcag

SEQ ID NO: 256136 - DNA, 15 bp, Homo sapiens
acattattcaggtca

SEQ ID NO: 256137 - DNA, 15 bp, Homo sapiens
tacattattcaggtc

SEQ ID NO: 256138 - DNA, 15 bp, Homo sapiens
gtacattattcaggt

SEQ ID NO: 256139 - DNA, 15 bp, Homo sapiens
cgtacattattcagg

SEQ ID NO: 256140 - DNA, 15 bp, Homo sapiens
acgtacattattcag

SEQ ID NO: 256141 - DNA, 15 bp, Homo sapiens
aacgtacattattca

SEQ ID NO: 256142 - DNA, 15 bp, Homo sapiens
aaacgtacattattc

SEQ ID NO: 256143 - DNA, 15 bp, Homo sapiens
aaaacgtacattatt

SEQ ID NO: 256144 - DNA, 15 bp, Homo sapiens
aaaaacgtacattat

SEQ ID NO: 256145 - DNA, 15 bp, Homo sapiens
gaaaaacgtacatta

SEQ ID NO: 256146 - DNA, 15 bp, Homo sapiens
agaaaaacgtacatt

SEQ ID NO: 256147 - DNA, 15 bp, Homo sapiens
cagaaaaacgtacat

SEQ ID NO: 256148 - DNA, 15 bp, Homo sapiens
gcagaaaaacgtaca

SEQ ID NO: 256149 - DNA, 15 bp, Homo sapiens
ggcagaaaaacgtac

SEQ ID NO: 256150 - DNA, 15 bp, Homo sapiens
aggcagaaaaacgta

SEQ ID NO: 256151 - DNA, 15 bp, Homo sapiens
taggcagaaaaacgt

SEQ ID NO: 256152 - DNA, 15 bp, Homo sapiens
gtaggcagaaaaacg

SEQ ID NO: 256153 - DNA, 15 bp, Homo sapiens
ggtaggcagaaaaac

SEQ ID NO: 256154 - DNA, 15 bp, Homo sapiens
cggtaggcagaaaaa

SEQ ID NO: 256155 - DNA, 15 bp, Homo sapiens
acggtaggcagaaaa

SEQ ID NO: 256156 - DNA, 15 bp, Homo sapiens
tacggtaggcagaaa

SEQ ID NO: 256157 - DNA, 15 bp, Homo sapiens
gtacggtaggcagaa

SEQ ID NO: 256158 - DNA, 15 bp, Homo sapiens
tgtacggtaggcaga

SEQ ID NO: 256159 - DNA, 15 bp, Homo sapiens
ctgtacggtaggcag

SEQ ID NO: 256160 - DNA, 15 bp, Homo sapiens
gctgtacggtaggca

SEQ ID NO: 256161 - DNA, 15 bp, Homo sapiens
tgctgtacggtaggc

SEQ ID NO: 256162 - DNA, 15 bp, Homo sapiens
ttgctgtacggtagg

SEQ ID NO: 256163 - DNA, 15 bp, Homo sapiens
attgctgtacggtag

SEQ ID NO: 256164 - DNA, 15 bp, Homo sapiens
gattgctgtacggta

SEQ ID NO: 256165 - DNA, 15 bp, Homo sapiens
tgattgctgtacggt

SEQ ID NO: 256166 - DNA, 15 bp, Homo sapiens
ttgattgctgtacgg

SEQ ID NO: 256167 - DNA, 15 bp, Homo sapiens
tttgattgctgtacg

SEQ ID NO: 256168 - DNA, 15 bp, Homo sapiens
ttttgattgctgtac

SEQ ID NO: 256169 - DNA, 15 bp, Homo sapiens
attttgattgctgta

SEQ ID NO: 256170 - DNA, 15 bp, Homo sapiens
gattttgattgctgt

SEQ ID NO: 256171 - DNA, 15 bp, Homo sapiens
ggattttgattgctg

SEQ ID NO: 256172 - DNA, 15 bp, Homo sapiens
cggattttgattgct

SEQ ID NO: 256173 - DNA, 15 bp, Homo sapiens
tcggattttgattgc

SEQ ID NO: 256174 - DNA, 15 bp, Homo sapiens
ttcggattttgattg

SEQ ID NO: 256175 - DNA, 15 bp, Homo sapiens
cttcggattttgatt

SEQ ID NO: 256176 - DNA, 15 bp, Homo sapiens
tcttcggattttgat

SEQ ID NO: 256177 - DNA, 15 bp, Homo sapiens
gtcttcggattttga

SEQ ID NO: 256178 - DNA, 15 bp, Homo sapiens
agtcttcggattttg

SEQ ID NO: 256179 - DNA, 15 bp, Homo sapiens
tagtcttcggatttt

SEQ ID NO: 256180 - DNA, 15 bp, Homo sapiens
gtagtcttcggattt

SEQ ID NO: 256181 - DNA, 15 bp, Homo sapiens
tgtagtcttcggatt

SEQ ID NO: 256182 - DNA, 15 bp, Homo sapiens
ttgtagtcttcggat

SEQ ID NO: 256183 - DNA, 15 bp, Homo sapiens
tttgtagtcttcgga

SEQ ID NO: 256184 - DNA, 15 bp, Homo sapiens
ttttgtagtcttcgg

SEQ ID NO: 256185 - DNA, 15 bp, Homo sapiens
tttttgtagtcttcg

SEQ ID NO: 256186 - DNA, 15 bp, Homo sapiens
ctttttgtagtcttc

SEQ ID NO: 256187 - DNA, 15 bp, Homo sapiens
gctttttgtagtctt

SEQ ID NO: 256188 - DNA, 15 bp, Homo sapiens
tgctttttgtagtct

SEQ ID NO: 256189 - DNA, 15 bp, Homo sapiens
gtgctttttgtagtc

SEQ ID NO: 256190 - DNA, 15 bp, Homo sapiens
agtgctttttgtagt

SEQ ID NO: 256191 - DNA, 15 bp, Homo sapiens
tagtgctttttgtag

SEQ ID NO: 256192 - DNA, 15 bp, Homo sapiens
atagtgctttttgta

SEQ ID NO: 256193 - DNA, 15 bp, Homo sapiens
catagtgctttttgt

SEQ ID NO: 256194 - DNA, 15 bp, Homo sapiens
acatagtgctttttg

SEQ ID NO: 256195 - DNA, 15 bp, Homo sapiens
aacatagtgcttttt

SEQ ID NO: 256196 - DNA, 15 bp, Homo sapiens
caacatagtgctttt

SEQ ID NO: 256197 - DNA, 15 bp, Homo sapiens
acaacatagtgcttt

SEQ ID NO: 256198 - DNA, 15 bp, Homo sapiens
cacaacatagtgctt

SEQ ID NO: 256199 - DNA, 15 bp, Homo sapiens
tcacaacatagtgct

SEQ ID NO: 256200 - DNA, 15 bp, Homo sapiens
ctcacaacatagtgc

SEQ ID NO: 256201 - DNA, 15 bp, Homo sapiens
actcacaacatagtg

SEQ ID NO: 256202 - DNA, 15 bp, Homo sapiens
aactcacaacatagt

SEQ ID NO: 256203 - DNA, 15 bp, Homo sapiens
taactcacaacatag

SEQ ID NO: 256204 - DNA, 15 bp, Homo sapiens
ataactcacaacata

SEQ ID NO: 256205 - DNA, 15 bp, Homo sapiens
aataactcacaacat

SEQ ID NO: 256206 - DNA, 15 bp, Homo sapiens
gaataactcacaaca

SEQ ID NO: 256207 - DNA, 15 bp, Homo sapiens
agaataactcacaac

SEQ ID NO: 256208 - DNA, 15 bp, Homo sapiens
tagaataactcacaa

SEQ ID NO: 256209 - DNA, 15 bp, Homo sapiens
gtagaataactcaca

SEQ ID NO: 256210 - DNA, 15 bp, Homo sapiens
ggtagaataactcac

SEQ ID NO: 256211 - DNA, 15 bp, Homo sapiens
tggtagaataactca

SEQ ID NO: 256212 - DNA, 15 bp, Homo sapiens
ttggtagaataactc

SEQ ID NO: 256213 - DNA, 15 bp, Homo sapiens
tttggtagaataact

SEQ ID NO: 256214 - DNA, 15 bp, Homo sapiens
ctttggtagaataac

SEQ ID NO: 256215 - DNA, 15 bp, Homo sapiens
actttggtagaataa

SEQ ID NO: 256216 - DNA, 15 bp, Homo sapiens
aactttggtagaata

SEQ ID NO: 256217 - DNA, 15 bp, Homo sapiens
taactttggtagaat

SEQ ID NO: 256218 - DNA, 15 bp, Homo sapiens
ttaactttggtagaa

SEQ ID NO: 256219 - DNA, 15 bp, Homo sapiens
attaactttggtaga

SEQ ID NO: 256220 - DNA, 15 bp, Homo sapiens
gattaactttggtag

SEQ ID NO: 256221 - DNA, 15 bp, Homo sapiens
tgattaactttggta

SEQ ID NO: 256222 - DNA, 15 bp, Homo sapiens
ttgattaactttggt

SEQ ID NO: 256223 - DNA, 15 bp, Homo sapiens
attgattaactttgg

SEQ ID NO: 256224 - DNA, 15 bp, Homo sapiens
gattgattaactttg

SEQ ID NO: 256225 - DNA, 15 bp, Homo sapiens
agattgattaacttt

SEQ ID NO: 256226 - DNA, 15 bp, Homo sapiens
cagattgattaactt

SEQ ID NO: 256227 - DNA, 15 bp, Homo sapiens
acagattgattaact

SEQ ID NO: 256228 - DNA, 15 bp, Homo sapiens
aacagattgattaac

SEQ ID NO: 256229 - DNA, 15 bp, Homo sapiens
taacagattgattaa

SEQ ID NO: 256230 - DNA, 15 bp, Homo sapiens
gtaacagattgatta

SEQ ID NO: 256231 - DNA, 15 bp, Homo sapiens
agtaacagattgatt

SEQ ID NO: 256232 - DNA, 15 bp, Homo sapiens
aagtaacagattgat

SEQ ID NO: 256233 - DNA, 15 bp, Homo sapiens
caagtaacagattga

SEQ ID NO: 256234 - DNA, 15 bp, Homo sapiens
tcaagtaacagattg

SEQ ID NO: 256235 - DNA, 15 bp, Homo sapiens
ttcaagtaacagatt

SEQ ID NO: 256236 - DNA, 15 bp, Homo sapiens
attcaagtaacagat

SEQ ID NO: 256237 - DNA, 15 bp, Homo sapiens
aattcaagtaacaga

SEQ ID NO: 256238 - DNA, 15 bp, Homo sapiens
caattcaagtaacag

SEQ ID NO: 256239 - DNA, 15 bp, Homo sapiens
gcaattcaagtaaca

SEQ ID NO: 256240 - DNA, 15 bp, Homo sapiens
cgcaattcaagtaac

SEQ ID NO: 256241 - DNA, 15 bp, Homo sapiens
acgcaattcaagtaa

SEQ ID NO: 256242 - DNA, 15 bp, Homo sapiens
aacgcaattcaagta

SEQ ID NO: 256243 - DNA, 15 bp, Homo sapiens
aaacgcaattcaagt

SEQ ID NO: 256244 - DNA, 15 bp, Homo sapiens
aaaacgcaattcaag

SEQ ID NO: 256245 - DNA, 15 bp, Homo sapiens
aaaaacgcaattcaa

SEQ ID NO: 256246 - DNA, 15 bp, Homo sapiens
aaaaaacgcaattca

SEQ ID NO: 256247 - DNA, 15 bp, Homo sapiens
aaaaaaacgcaattc

SEQ ID NO: 256248 - DNA, 15 bp, Homo sapiens
aaaaaaaacgcaatt

SEQ ID NO: 256249 - DNA, 15 bp, Homo sapiens
aaaaaaaaacgcaat

SEQ ID NO: 256250 - DNA, 15 bp, Homo sapiens
aaaaaaaaaacgcaa

SEQ ID NO: 256251 - DNA, 15 bp, Homo sapiens
aaaaaaaaaaacgca

SEQ ID NO: 256252 - DNA, 15 bp, Homo sapiens
aaaaaaaaaaaacgc

SEQ ID NO: 256253 - DNA, 15 bp, Homo sapiens
ggaaaaaaaaaaaac

SEQ ID NO: 256254 - DNA, 15 bp, Homo sapiens
cttggaaaaaaaaaa

SEQ ID NO: 256255 - DNA, 15 bp, Homo sapiens
tcttggaaaaaaaaa

SEQ ID NO: 256256 - DNA, 15 bp, Homo sapiens
ctcttggaaaaaaaa

SEQ ID NO: 256257 - DNA, 15 bp, Homo sapiens
cctcttggaaaaaaa

SEQ ID NO: 256258 - DNA, 15 bp, Homo sapiens
tcctcttggaaaaaa

SEQ ID NO: 256259 - DNA, 15 bp, Homo sapiens
ttcctcttggaaaaa

SEQ ID NO: 256260 - DNA, 15 bp, Homo sapiens
cttcctcttggaaaa

SEQ ID NO: 256261 - DNA, 15 bp, Homo sapiens
tcttcctcttggaaa

SEQ ID NO: 256262 - DNA, 15 bp, Homo sapiens
atcttcctcttggaa

SEQ ID NO: 256263 - DNA, 15 bp, Homo sapiens
tatcttcctcttgga

SEQ ID NO: 256264 - DNA, 15 bp, Homo sapiens
ttatcttcctcttgg

SEQ ID NO: 256265 - DNA, 15 bp, Homo sapiens
tttatcttcctcttg

SEQ ID NO: 256266 - DNA, 15 bp, Homo sapiens
atttatcttcctctt

SEQ ID NO: 256267 - DNA, 15 bp, Homo sapiens
catttatcttcctct

SEQ ID NO: 256268 - DNA, 15 bp, Homo sapiens
tcatttatcttcctc

SEQ ID NO: 256269 - DNA, 15 bp, Homo sapiens
ttcatttatcttcct

SEQ ID NO: 256270 - DNA, 15 bp, Homo sapiens
cttcatttatcttcc

SEQ ID NO: 256271 - DNA, 15 bp, Homo sapiens
tcttcatttatcttc

SEQ ID NO: 256272 - DNA, 15 bp, Homo sapiens
ctcttcatttatctt

SEQ ID NO: 256273 - DNA, 15 bp, Homo sapiens
cctcttcatttatct

SEQ ID NO: 256274 - DNA, 15 bp, Homo sapiens
tcctcttcatttatc

SEQ ID NO: 256275 - DNA, 15 bp, Homo sapiens
atcctcttcatttat

SEQ ID NO: 256276 - DNA, 15 bp, Homo sapiens
catcctcttcattta

SEQ ID NO: 256277 - DNA, 15 bp, Homo sapiens
ccatcctcttcattt

SEQ ID NO: 256278 - DNA, 15 bp, Homo sapiens
tccatcctcttcatt

SEQ ID NO: 256279 - DNA, 15 bp, Homo sapiens
ctccatcctcttcat

SEQ ID NO: 256280 - DNA, 15 bp, Homo sapiens
actccatcctcttca

SEQ ID NO: 256281 - DNA, 15 bp, Homo sapiens
cactccatcctcttc

SEQ ID NO: 256282 - DNA, 15 bp, Homo sapiens
acactccatcctctt

SEQ ID NO: 256283 - DNA, 15 bp, Homo sapiens
aacactccatcctct

SEQ ID NO: 256284 - DNA, 15 bp, Homo sapiens
aaacactccatcctc

SEQ ID NO: 256285 - DNA, 15 bp, Homo sapiens
caaacactccatcct

SEQ ID NO: 256286 - DNA, 15 bp, Homo sapiens
gcaaacactccatcc

SEQ ID NO: 256287 - DNA, 15 bp, Homo sapiens
ggcaaacactccatc

SEQ ID NO: 256288 - DNA, 15 bp, Homo sapiens
tggcaaacactccat

SEQ ID NO: 256289 - DNA, 15 bp, Homo sapiens
ttggcaaacactcca

SEQ ID NO: 256290 - DNA, 15 bp, Homo sapiens
cttggcaaacactcc

SEQ ID NO: 256291 - DNA, 15 bp, Homo sapiens
acttggcaaacactc

SEQ ID NO: 256292 - DNA, 15 bp, Homo sapiens
aacttggcaaacact

SEQ ID NO: 256293 - DNA, 15 bp, Homo sapiens
taacttggcaaacac

SEQ ID NO: 256294 - DNA, 15 bp, Homo sapiens
ttaacttggcaaaca

SEQ ID NO: 256295 - DNA, 15 bp, Homo sapiens
attaacttggcaaac

SEQ ID NO: 256296 - DNA, 15 bp, Homo sapiens
gattaacttggcaaa

SEQ ID NO: 256297 - DNA, 15 bp, Homo sapiens
agattaacttggcaa

SEQ ID NO: 256298 - DNA, 15 bp, Homo sapiens
cagattaacttggca

SEQ ID NO: 256299 - DNA, 15 bp, Homo sapiens
ccagattaacttggc

SEQ ID NO: 256300 - DNA, 15 bp, Homo sapiens
accagattaacttgg

SEQ ID NO: 256301 - DNA, 15 bp, Homo sapiens
gaccagattaacttg

SEQ ID NO: 256302 - DNA, 15 bp, Homo sapiens
agaccagattaactt

SEQ ID NO: 256303 - DNA, 15 bp, Homo sapiens
aagaccagattaact

SEQ ID NO: 256304 - DNA, 15 bp, Homo sapiens
gaagaccagattaac

SEQ ID NO: 256305 - DNA, 15 bp, Homo sapiens
tgaagaccagattaa

SEQ ID NO: 256306 - DNA, 15 bp, Homo sapiens
ctgaagaccagatta

SEQ ID NO: 256307 - DNA, 15 bp, Homo sapiens
actgaagaccagatt

SEQ ID NO: 256308 - DNA, 15 bp, Homo sapiens
cactgaagaccagat

SEQ ID NO: 256309 - DNA, 15 bp, Homo sapiens
acactgaagaccaga

SEQ ID NO: 256310 - DNA, 15 bp, Homo sapiens
tacactgaagaccag

SEQ ID NO: 256311 - DNA, 15 bp, Homo sapiens
gtacactgaagacca

SEQ ID NO: 256312 - DNA, 15 bp, Homo sapiens
ggtacactgaagacc

SEQ ID NO: 256313 - DNA, 15 bp, Homo sapiens
aggtacactgaagac

SEQ ID NO: 256314 - DNA, 15 bp, Homo sapiens
gaggtacactgaaga

SEQ ID NO: 256315 - DNA, 15 bp, Homo sapiens
tgaggtacactgaag

SEQ ID NO: 256316 - DNA, 15 bp, Homo sapiens
gtgaggtacactgaa

SEQ ID NO: 256317 - DNA, 15 bp, Homo sapiens
agtgaggtacactga

SEQ ID NO: 256318 - DNA, 15 bp, Homo sapiens
gagtgaggtacactg

SEQ ID NO: 256319 - DNA, 15 bp, Homo sapiens
tgagtgaggtacact

SEQ ID NO: 256320 - DNA, 15 bp, Homo sapiens
ttgagtgaggtacac

SEQ ID NO: 256321 - DNA, 15 bp, Homo sapiens
cttgagtgaggtaca

SEQ ID NO: 256322 - DNA, 15 bp, Homo sapiens
ccttgagtgaggtac

SEQ ID NO: 256323 - DNA, 15 bp, Homo sapiens
tccttgagtgaggta

SEQ ID NO: 256324 - DNA, 15 bp, Homo sapiens
ctccttgagtgaggt

SEQ ID NO: 256325 - DNA, 15 bp, Homo sapiens
actccttgagtgagg

SEQ ID NO: 256326 - DNA, 15 bp, Homo sapiens
aactccttgagtgag

SEQ ID NO: 256327 - DNA, 15 bp, Homo sapiens
caactccttgagtga

SEQ ID NO: 256328 - DNA, 15 bp, Homo sapiens
ccaactccttgagtg

SEQ ID NO: 256329 - DNA, 15 bp, Homo sapiens
accaactccttgagt

SEQ ID NO: 256330 - DNA, 15 bp, Homo sapiens
aaccaactccttgag

SEQ ID NO: 256331 - DNA, 15 bp, Homo sapiens
aaaccaactccttga

SEQ ID NO: 256332 - DNA, 15 bp, Homo sapiens
aaaaccaactccttg

SEQ ID NO: 256333 - DNA, 15 bp, Homo sapiens
caaaaccaactcctt

SEQ ID NO: 256334 - DNA, 15 bp, Homo sapiens
acaaaaccaactcct

SEQ ID NO: 256335 - DNA, 15 bp, Homo sapiens
aacaaaaccaactcc

SEQ ID NO: 256336 - DNA, 15 bp, Homo sapiens
aaacaaaaccaactc

SEQ ID NO: 256337 - DNA, 15 bp, Homo sapiens
gaaacaaaaccaact

SEQ ID NO: 256338 - DNA, 15 bp, Homo sapiens
agaaacaaaaccaac

SEQ ID NO: 256339 - DNA, 15 bp, Homo sapiens
tagaaacaaaaccaa

SEQ ID NO: 256340 - DNA, 15 bp, Homo sapiens
atagaaacaaaacca

SEQ ID NO: 256341 - DNA, 15 bp, Homo sapiens
tatagaaacaaaacc

SEQ ID NO: 256342 - DNA, 15 bp, Homo sapiens
ttatagaaacaaaac

SEQ ID NO: 256343 - DNA, 15 bp, Homo sapiens
tttatagaaacaaaa

SEQ ID NO: 256344 - DNA, 15 bp, Homo sapiens
atttatagaaacaaa

SEQ ID NO: 256345 - DNA, 15 bp, Homo sapiens
catttatagaaacaa

SEQ ID NO: 256346 - DNA, 15 bp, Homo sapiens
acatttatagaaaca

SEQ ID NO: 256347 - DNA, 15 bp, Homo sapiens
aacatttatagaaac

SEQ ID NO: 256348 - DNA, 15 bp, Homo sapiens
aaacatttatagaaa

SEQ ID NO: 256349 - DNA, 15 bp, Homo sapiens
aaaacatttatagaa

SEQ ID NO: 256350 - DNA, 15 bp, Homo sapiens
taaaacatttataga

SEQ ID NO: 256351 - DNA, 15 bp, Homo sapiens
ataaaacatttatag

SEQ ID NO: 256352 - DNA, 15 bp, Homo sapiens
aataaaacatttata

SEQ ID NO: 256353 - DNA, 15 bp, Homo sapiens
taataaaacatttat

SEQ ID NO: 256354 - DNA, 15 bp, Homo sapiens
gtaataaaacattta

SEQ ID NO: 256355 - DNA, 15 bp, Homo sapiens
agtaataaaacattt

SEQ ID NO: 256356 - DNA, 15 bp, Homo sapiens
aagtaataaaacatt

SEQ ID NO: 256357 - DNA, 15 bp, Homo sapiens
caagtaataaaacat

SEQ ID NO: 256358 - DNA, 15 bp, Homo sapiens
gcaagtaataaaaca

SEQ ID NO: 256359 - DNA, 15 bp, Homo sapiens
ggcaagtaataaaac

SEQ ID NO: 256360 - DNA, 15 bp, Homo sapiens
gggcaagtaataaaa

SEQ ID NO: 256361 - DNA, 15 bp, Homo sapiens
ggggcaagtaataaa

SEQ ID NO: 256362 - DNA, 15 bp, Homo sapiens
tggggcaagtaataa

SEQ ID NO: 256363 - DNA, 15 bp, Homo sapiens
atggggcaagtaata

SEQ ID NO: 256364 - DNA, 15 bp, Homo sapiens
gatggggcaagtaat

SEQ ID NO: 256365 - DNA, 15 bp, Homo sapiens
tgatggggcaagtaa

SEQ ID NO: 256366 - DNA, 15 bp, Homo sapiens
ctgatggggcaagta

SEQ ID NO: 256367 - DNA, 15 bp, Homo sapiens
actgatggggcaagt

SEQ ID NO: 256368 - DNA, 15 bp, Homo sapiens
cactgatggggcaag

SEQ ID NO: 256369 - DNA, 15 bp, Homo sapiens
acactgatggggcaa

SEQ ID NO: 256370 - DNA, 15 bp, Homo sapiens
cacactgatggggca

SEQ ID NO: 256371 - DNA, 15 bp, Homo sapiens
gcacactgatggggc

SEQ ID NO: 256372 - DNA, 15 bp, Homo sapiens
tgcacactgatgggg

SEQ ID NO: 256373 - DNA, 15 bp, Homo sapiens
ctgcacactgatggg

SEQ ID NO: 256374 - DNA, 15 bp, Homo sapiens
actgcacactgatgg

SEQ ID NO: 256375 - DNA, 15 bp, Homo sapiens
tactgcacactgatg

SEQ ID NO: 256376 - DNA, 15 bp, Homo sapiens
gtactgcacactgat

SEQ ID NO: 256377 - DNA, 15 bp, Homo sapiens
agtactgcacactga

SEQ ID NO: 256378 - DNA, 15 bp, Homo sapiens
cagtactgcacactg

SEQ ID NO: 256379 - DNA, 15 bp, Homo sapiens
tcagtactgcacact

SEQ ID NO: 256380 - DNA, 15 bp, Homo sapiens
ttcagtactgcacac

SEQ ID NO: 256381 - DNA, 15 bp, Homo sapiens
gttcagtactgcaca

SEQ ID NO: 256382 - DNA, 15 bp, Homo sapiens
tgttcagtactgcac

SEQ ID NO: 256383 - DNA, 15 bp, Homo sapiens
gtgttcagtactgca

SEQ ID NO: 256384 - DNA, 15 bp, Homo sapiens
tgtgttcagtactgc

SEQ ID NO: 256385 - DNA, 15 bp, Homo sapiens
atgtgttcagtactg

SEQ ID NO: 256386 - DNA, 15 bp, Homo sapiens
catgtgttcagtact

SEQ ID NO: 256387 - DNA, 15 bp, Homo sapiens
gcatgtgttcagtac

SEQ ID NO: 256388 - DNA, 15 bp, Homo sapiens
ggcatgtgttcagta

SEQ ID NO: 256389 - DNA, 15 bp, Homo sapiens
tggcatgtgttcagt

SEQ ID NO: 256390 - DNA, 15 bp, Homo sapiens
atggcatgtgttcag

SEQ ID NO: 256391 - DNA, 15 bp, Homo sapiens
aatggcatgtgttca

SEQ ID NO: 256392 - DNA, 15 bp, Homo sapiens
gaatggcatgtgttc

SEQ ID NO: 256393 - DNA, 15 bp, Homo sapiens
agaatggcatgtgtt

SEQ ID NO: 256394 - DNA, 15 bp, Homo sapiens
aagaatggcatgtgt

SEQ ID NO: 256395 - DNA, 15 bp, Homo sapiens
taagaatggcatgtg

SEQ ID NO: 256396 - DNA, 15 bp, Homo sapiens
gtaagaatggcatgt

SEQ ID NO: 256397 - DNA, 15 bp, Homo sapiens
agtaagaatggcatg

SEQ ID NO: 256398 - DNA, 15 bp, Homo sapiens
aagtaagaatggcat

SEQ ID NO: 256399 - DNA, 15 bp, Homo sapiens
caagtaagaatggca

SEQ ID NO: 256400 - DNA, 15 bp, Homo sapiens
ccaagtaagaatggc

SEQ ID NO: 256401 - DNA, 15 bp, Homo sapiens
tccaagtaagaatgg

SEQ ID NO: 256402 - DNA, 15 bp, Homo sapiens
ctccaagtaagaatg

SEQ ID NO: 256403 - DNA, 15 bp, Homo sapiens
tctccaagtaagaat

SEQ ID NO: 256404 - DNA, 15 bp, Homo sapiens
ttctccaagtaagaa

SEQ ID NO: 256405 - DNA, 15 bp, Homo sapiens
gttctccaagtaaga

SEQ ID NO: 256406 - DNA, 15 bp, Homo sapiens
tgttctccaagtaag

SEQ ID NO: 256407 - DNA, 15 bp, Homo sapiens
ttgttctccaagtaa

SEQ ID NO: 256408 - DNA, 15 bp, Homo sapiens
tttgttctccaagta

SEQ ID NO: 256409 - DNA, 15 bp, Homo sapiens
ttttgttctccaagt

SEQ ID NO: 256410 - DNA, 15 bp, Homo sapiens
attttgttctccaag

SEQ ID NO: 256411 - DNA, 15 bp, Homo sapiens
aattttgttctccaa

SEQ ID NO: 256412 - DNA, 15 bp, Homo sapiens
taattttgttctcca

SEQ ID NO: 256413 - DNA, 15 bp, Homo sapiens
ttaattttgttctcc

SEQ ID NO: 256414 - DNA, 15 bp, Homo sapiens
gttaattttgttctc

SEQ ID NO: 256415 - DNA, 15 bp, Homo sapiens
ggttaattttgttct

SEQ ID NO: 256416 - DNA, 15 bp, Homo sapiens
tggttaattttgttc

SEQ ID NO: 256417 - DNA, 15 bp, Homo sapiens
ttggttaattttgtt

SEQ ID NO: 256418 - DNA, 15 bp, Homo sapiens
tttggttaattttgt

SEQ ID NO: 256419 - DNA, 15 bp, Homo sapiens
ttttggttaattttg

SEQ ID NO: 256420 - DNA, 15 bp, Homo sapiens
gttttggttaatttt

SEQ ID NO: 256421 - DNA, 15 bp, Homo sapiens
tgttttggttaattt

SEQ ID NO: 256422 - DNA, 15 bp, Homo sapiens
gtgttttggttaatt

SEQ ID NO: 256423 - DNA, 15 bp, Homo sapiens
tgtgttttggttaat

SEQ ID NO: 256424 - DNA, 15 bp, Homo sapiens
ctgtgttttggttaa

SEQ ID NO: 256425 - DNA, 15 bp, Homo sapiens
cctgtgttttggtta

SEQ ID NO: 256426 - DNA, 15 bp, Homo sapiens
tcctgtgttttggtt

SEQ ID NO: 256427 - DNA, 15 bp, Homo sapiens
ctcctgtgttttggt

SEQ ID NO: 256428 - DNA, 15 bp, Homo sapiens
actcctgtgttttgg

SEQ ID NO: 256429 - DNA, 15 bp, Homo sapiens
tactcctgtgttttg

SEQ ID NO: 256430 - DNA, 15 bp, Homo sapiens
ttactcctgtgtttt

SEQ ID NO: 256431 - DNA, 15 bp, Homo sapiens
attactcctgtgttt

SEQ ID NO: 256432 - DNA, 15 bp, Homo sapiens
cattactcctgtgtt

SEQ ID NO: 256433 - DNA, 15 bp, Homo sapiens
acattactcctgtgt

SEQ ID NO: 256434 - DNA, 15 bp, Homo sapiens
tacattactcctgtg

SEQ ID NO: 256435 - DNA, 15 bp, Homo sapiens
ttacattactcctgt

SEQ ID NO: 256436 - DNA, 15 bp, Homo sapiens
tttacattactcctg

SEQ ID NO: 256437 - DNA, 15 bp, Homo sapiens
ttttacattactcct

SEQ ID NO: 256438 - DNA, 15 bp, Homo sapiens
tttttacattactcc

SEQ ID NO: 256439 - DNA, 15 bp, Homo sapiens
ctttttacattactc

SEQ ID NO: 256440 - DNA, 15 bp, Homo sapiens
gctttttacattact

SEQ ID NO: 256441 - DNA, 15 bp, Homo sapiens
agctttttacattac

SEQ ID NO: 256442 - DNA, 15 bp, Homo sapiens
aagctttttacatta

SEQ ID NO: 256443 - DNA, 15 bp, Homo sapiens
aaagctttttacatt

SEQ ID NO: 256444 - DNA, 15 bp, Homo sapiens
aaaagctttttacat

SEQ ID NO: 256445 - DNA, 15 bp, Homo sapiens
aaaaagctttttaca

SEQ ID NO: 256446 - DNA, 15 bp, Homo sapiens
gaaaaagctttttac

SEQ ID NO: 256447 - DNA, 15 bp, Homo sapiens
tgaaaaagcttttta

SEQ ID NO: 256448 - DNA, 15 bp, Homo sapiens
ttgaaaaagcttttt

SEQ ID NO: 256449 - DNA, 15 bp, Homo sapiens
tttgaaaaagctttt

SEQ ID NO: 256450 - DNA, 15 bp, Homo sapiens
ttttgaaaaagcttt

SEQ ID NO: 256451 - DNA, 15 bp, Homo sapiens
tttttgaaaaagctt

SEQ ID NO: 256452 - DNA, 15 bp, Homo sapiens
atttttgaaaaagct

SEQ ID NO: 256453 - DNA, 15 bp, Homo sapiens
aatttttgaaaaagc

SEQ ID NO: 256454 - DNA, 15 bp, Homo sapiens
caatttttgaaaaag

SEQ ID NO: 256455 - DNA, 15 bp, Homo sapiens
acaatttttgaaaaa

SEQ ID NO: 256456 - DNA, 15 bp, Homo sapiens
cacaatttttgaaaa

SEQ ID NO: 256457 - DNA, 15 bp, Homo sapiens
gcacaatttttgaaa

SEQ ID NO: 256458 - DNA, 15 bp, Homo sapiens
agcacaatttttgaa

SEQ ID NO: 256459 - DNA, 15 bp, Homo sapiens
cagcacaatttttga

SEQ ID NO: 256460 - DNA, 15 bp, Homo sapiens
gcagcacaatttttg

SEQ ID NO: 256461 - DNA, 15 bp, Homo sapiens
ggcagcacaattttt

SEQ ID NO: 256462 - DNA, 15 bp, Homo sapiens
tggcagcacaatttt

SEQ ID NO: 256463 - DNA, 15 bp, Homo sapiens
gtggcagcacaattt

SEQ ID NO: 256464 - DNA, 15 bp, Homo sapiens
ggtggcagcacaatt

SEQ ID NO: 256465 - DNA, 15 bp, Homo sapiens
gggtggcagcacaat

SEQ ID NO: 256466 - DNA, 15 bp, Homo sapiens
tgggtggcagcacaa

SEQ ID NO: 256467 - DNA, 15 bp, Homo sapiens
ttgggtggcagcaca

SEQ ID NO: 256468 - DNA, 15 bp, Homo sapiens
attgggtggcagcac

SEQ ID NO: 256469 - DNA, 15 bp, Homo sapiens
aattgggtggcagca

SEQ ID NO: 256470 - DNA, 15 bp, Homo sapiens
aaattgggtggcagc

SEQ ID NO: 256471 - DNA, 15 bp, Homo sapiens
taaattgggtggcag

SEQ ID NO: 256472 - DNA, 15 bp, Homo sapiens
ttaaattgggtggca

SEQ ID NO: 256473 - DNA, 15 bp, Homo sapiens
tttaaattgggtggc

SEQ ID NO: 256474 - DNA, 15 bp, Homo sapiens
ttttaaattgggtgg

SEQ ID NO: 256475 - DNA, 15 bp, Homo sapiens
cttttaaattgggtg

SEQ ID NO: 256476 - DNA, 15 bp, Homo sapiens
ccttttaaattgggt

SEQ ID NO: 256477 - DNA, 15 bp, Homo sapiens
tccttttaaattggg

SEQ ID NO: 256478 - DNA, 15 bp, Homo sapiens
atccttttaaattgg

SEQ ID NO: 256479 - DNA, 15 bp, Homo sapiens
aatccttttaaattg

SEQ ID NO: 256480 - DNA, 15 bp, Homo sapiens
taatccttttaaatt

SEQ ID NO: 256481 - DNA, 15 bp, Homo sapiens
ttaatccttttaaat

SEQ ID NO: 256482 - DNA, 15 bp, Homo sapiens
tttaatccttttaaa

SEQ ID NO: 256483 - DNA, 15 bp, Homo sapiens
atttaatccttttaa

SEQ ID NO: 256484 - DNA, 15 bp, Homo sapiens
gatttaatcctttta

SEQ ID NO: 256485 - DNA, 15 bp, Homo sapiens
tgatttaatcctttt

SEQ ID NO: 256486 - DNA, 15 bp, Homo sapiens
ttgatttaatccttt

SEQ ID NO: 256487 - DNA, 15 bp, Homo sapiens
tttgatttaatcctt

SEQ ID NO: 256488 - DNA, 15 bp, Homo sapiens
ctttgatttaatcct

SEQ ID NO: 256489 - DNA, 15 bp, Homo sapiens
tctttgatttaatcc

SEQ ID NO: 256490 - DNA, 15 bp, Homo sapiens
ttctttgatttaatc

SEQ ID NO: 256491 - DNA, 15 bp, Homo sapiens
tttctttgatttaat

SEQ ID NO: 256492 - DNA, 15 bp, Homo sapiens
ctttctttgatttaa

SEQ ID NO: 256493 - DNA, 15 bp, Homo sapiens
actttctttgattta

SEQ ID NO: 256494 - DNA, 15 bp, Homo sapiens
tactttctttgattt

SEQ ID NO: 256495 - DNA, 15 bp, Homo sapiens
atactttctttgatt

SEQ ID NO: 256496 - DNA, 15 bp, Homo sapiens
aatactttctttgat

SEQ ID NO: 256497 - DNA, 15 bp, Homo sapiens
taatactttctttga

SEQ ID NO: 256498 - DNA, 15 bp, Homo sapiens
ttaatactttctttg

SEQ ID NO: 256499 - DNA, 15 bp, Homo sapiens
cttaatactttcttt

SEQ ID NO: 256500 - DNA, 15 bp, Homo sapiens
acttaatactttctt

SEQ ID NO: 256501 - DNA, 15 bp, Homo sapiens
gacttaatactttct

SEQ ID NO: 256502 - DNA, 15 bp, Homo sapiens
tgacttaatactttc

SEQ ID NO: 256503 - DNA, 15 bp, Homo sapiens
atgacttaatacttt

SEQ ID NO: 256504 - DNA, 15 bp, Homo sapiens
catgacttaatactt

SEQ ID NO: 256505 - DNA, 15 bp, Homo sapiens
acatgacttaatact

SEQ ID NO: 256506 - DNA, 15 bp, Homo sapiens
cacatgacttaatac

SEQ ID NO: 256507 - DNA, 15 bp, Homo sapiens
acacatgacttaata

SEQ ID NO: 256508 - DNA, 15 bp, Homo sapiens
aacacatgacttaat

SEQ ID NO: 256509 - DNA, 15 bp, Homo sapiens
aaacacatgacttaa

SEQ ID NO: 256510 - DNA, 15 bp, Homo sapiens
aaaacacatgactta

SEQ ID NO: 256511 - DNA, 15 bp, Homo sapiens
gaaaacacatgactt

SEQ ID NO: 256512 - DNA, 15 bp, Homo sapiens
tgaaaacacatgact

SEQ ID NO: 256513 - DNA, 15 bp, Homo sapiens
ctgaaaacacatgac

SEQ ID NO: 256514 - DNA, 15 bp, Homo sapiens
ggtactgaaaacaca

SEQ ID NO: 256515 - DNA, 15 bp, Homo sapiens
aggtactgaaaacac

SEQ ID NO: 256516 - DNA, 15 bp, Homo sapiens
aaggtactgaaaaca

SEQ ID NO: 256517 - DNA, 15 bp, Homo sapiens
aaaggtactgaaaac

SEQ ID NO: 256518 - DNA, 15 bp, Homo sapiens
aaaaggtactgaaaa

SEQ ID NO: 256519 - DNA, 15 bp, Homo sapiens
caaaaggtactgaaa

SEQ ID NO: 256520 - DNA, 15 bp, Homo sapiens
gcaaaaggtactgaa

SEQ ID NO: 256521 - DNA, 15 bp, Homo sapiens
ggcaaaaggtactga

SEQ ID NO: 256522 - DNA, 15 bp, Homo sapiens
gggcaaaaggtactg

SEQ ID NO: 256523 - DNA, 15 bp, Homo sapiens
tgggcaaaaggtact

SEQ ID NO: 256524 - DNA, 15 bp, Homo sapiens
atgggcaaaaggtac

SEQ ID NO: 256525 - DNA, 15 bp, Homo sapiens
aatgggcaaaaggta

SEQ ID NO: 256526 - DNA, 15 bp, Homo sapiens
aaatgggcaaaaggt

SEQ ID NO: 256527 - DNA, 15 bp, Homo sapiens
caaatgggcaaaagg

SEQ ID NO: 256528 - DNA, 15 bp, Homo sapiens
ccaaatgggcaaaag

SEQ ID NO: 256529 - DNA, 15 bp, Homo sapiens
gccaaatgggcaaaa

SEQ ID NO: 256530 - DNA, 15 bp, Homo sapiens
tgccaaatgggcaaa

SEQ ID NO: 256531 - DNA, 15 bp, Homo sapiens
ttgccaaatgggcaa

SEQ ID NO: 256532 - DNA, 15 bp, Homo sapiens
attgccaaatgggca

SEQ ID NO: 256533 - DNA, 15 bp, Homo sapiens
cattgccaaatgggc

SEQ ID NO: 256534 - DNA, 15 bp, Homo sapiens
acattgccaaatggg

SEQ ID NO: 256535 - DNA, 15 bp, Homo sapiens
tacattgccaaatgg

SEQ ID NO: 256536 - DNA, 15 bp, Homo sapiens
ctacattgccaaatg

SEQ ID NO: 256537 - DNA, 15 bp, Homo sapiens
tctacattgccaaat

SEQ ID NO: 256538 - DNA, 15 bp, Homo sapiens
ctctacattgccaaa

SEQ ID NO: 256539 - DNA, 15 bp, Homo sapiens
actctacattgccaa

SEQ ID NO: 256540 - DNA, 15 bp, Homo sapiens
aactctacattgcca

SEQ ID NO: 256541 - DNA, 15 bp, Homo sapiens
gaactctacattgcc

SEQ ID NO: 256542 - DNA, 15 bp, Homo sapiens
ggaactctacattgc

SEQ ID NO: 256543 - DNA, 15 bp, Homo sapiens
tggaactctacattg

SEQ ID NO: 256544 - DNA, 15 bp, Homo sapiens
ctggaactctacatt

SEQ ID NO: 256545 - DNA, 15 bp, Homo sapiens
actggaactctacat

SEQ ID NO: 256546 - DNA, 15 bp, Homo sapiens
aactggaactctaca

SEQ ID NO: 256547 - DNA, 15 bp, Homo sapiens
aaactggaactctac

SEQ ID NO: 256548 - DNA, 15 bp, Homo sapiens
caaactggaactcta

SEQ ID NO: 256549 - DNA, 15 bp, Homo sapiens
acaaactggaactct

SEQ ID NO: 256550 - DNA, 15 bp, Homo sapiens
gacaaactggaactc

SEQ ID NO: 256551 - DNA, 15 bp, Homo sapiens
agacaaactggaact

SEQ ID NO: 256552 - DNA, 15 bp, Homo sapiens
gagacaaactggaac

SEQ ID NO: 256553 - DNA, 15 bp, Homo sapiens
tgagacaaactggaa

SEQ ID NO: 256554 - DNA, 15 bp, Homo sapiens
ttgagacaaactgga

SEQ ID NO: 256555 - DNA, 15 bp, Homo sapiens
attgagacaaactgg

SEQ ID NO: 256556 - DNA, 15 bp, Homo sapiens
tattgagacaaactg

SEQ ID NO: 256557 - DNA, 15 bp, Homo sapiens
gtattgagacaaact

SEQ ID NO: 256558 - DNA, 15 bp, Homo sapiens
ggtattgagacaaac

SEQ ID NO: 256559 - DNA, 15 bp, Homo sapiens
tggtattgagacaaa

SEQ ID NO: 256560 - DNA, 15 bp, Homo sapiens
gtggtattgagacaa

SEQ ID NO: 256561 - DNA, 15 bp, Homo sapiens
agtggtattgagaca

SEQ ID NO: 256562 - DNA, 15 bp, Homo sapiens
tagtggtattgagac

SEQ ID NO: 256563 - DNA, 15 bp, Homo sapiens
atagtggtattgaga

SEQ ID NO: 256564 - DNA, 15 bp, Homo sapiens
tatagtggtattgag

SEQ ID NO: 256565 - DNA, 15 bp, Homo sapiens
atatagtggtattga

SEQ ID NO: 256566 - DNA, 15 bp, Homo sapiens
tatatagtggtattg

SEQ ID NO: 256567 - DNA, 15 bp, Homo sapiens
atatatagtggtatt

SEQ ID NO: 256568 - DNA, 15 bp, Homo sapiens
tatatatagtggtat

SEQ ID NO: 256569 - DNA, 15 bp, Homo sapiens
ttatatatagtggta

SEQ ID NO: 256570 - DNA, 15 bp, Homo sapiens
tttatatatagtggt

SEQ ID NO: 256571 - DNA, 15 bp, Homo sapiens
ctttatatatagtgg

SEQ ID NO: 256572 - DNA, 15 bp, Homo sapiens
tctttatatatagtg

SEQ ID NO: 256573 - DNA, 15 bp, Homo sapiens
ttctttatatatagt

SEQ ID NO: 256574 - DNA, 15 bp, Homo sapiens
tttctttatatatag

SEQ ID NO: 256575 - DNA, 15 bp, Homo sapiens
gtttctttatatata

SEQ ID NO: 256576 - DNA, 15 bp, Homo sapiens
tgtttctttatatat

SEQ ID NO: 256577 - DNA, 15 bp, Homo sapiens
gtgtttctttatata

SEQ ID NO: 256578 - DNA, 15 bp, Homo sapiens
agtgtttctttatat

SEQ ID NO: 256579 - DNA, 15 bp, Homo sapiens
tagtgtttctttata

SEQ ID NO: 256580 - DNA, 15 bp, Homo sapiens
ttagtgtttctttat

SEQ ID NO: 256581 - DNA, 15 bp, Homo sapiens
tttagtgtttcttta

SEQ ID NO: 256582 - DNA, 15 bp, Homo sapiens
ttttagtgtttcttt

SEQ ID NO: 256583 - DNA, 15 bp, Homo sapiens
tttttagtgtttctt

SEQ ID NO: 256584 - DNA, 15 bp, Homo sapiens
ttttttagtgtttct

SEQ ID NO: 256585 - DNA, 15 bp, Homo sapiens
attttttagtgtttc

SEQ ID NO: 256586 - DNA, 15 bp, Homo sapiens
gattttttagtgttt

SEQ ID NO: 256587 - DNA, 15 bp, Homo sapiens
tgattttttagtgtt

SEQ ID NO: 256588 - DNA, 15 bp, Homo sapiens
gtgattttttagtgt

SEQ ID NO: 256589 - DNA, 15 bp, Homo sapiens
tgtgattttttagtg

SEQ ID NO: 256590 - DNA, 15 bp, Homo sapiens
atgtgattttttagt

SEQ ID NO: 256591 - DNA, 15 bp, Homo sapiens
aatgtgattttttag

SEQ ID NO: 256592 - DNA, 15 bp, Homo sapiens
gaatgtgatttttta

SEQ ID NO: 256593 - DNA, 15 bp, Homo sapiens
ggaatgtgatttttt

SEQ ID NO: 256594 - DNA, 15 bp, Homo sapiens
aggaatgtgattttt

SEQ ID NO: 256595 - DNA, 15 bp, Homo sapiens
caggaatgtgatttt

SEQ ID NO: 256596 - DNA, 15 bp, Homo sapiens
tcaggaatgtgattt

SEQ ID NO: 256597 - DNA, 15 bp, Homo sapiens
atcaggaatgtgatt

SEQ ID NO: 256598 - DNA, 15 bp, Homo sapiens
gatcaggaatgtgat

SEQ ID NO: 256599 - DNA, 15 bp, Homo sapiens
agatcaggaatgtga

SEQ ID NO: 256600 - DNA, 15 bp, Homo sapiens
tagatcaggaatgtg

SEQ ID NO: 256601 - DNA, 15 bp, Homo sapiens
ttagatcaggaatgt

SEQ ID NO: 256602 - DNA, 15 bp, Homo sapiens
tttagatcaggaatg

SEQ ID NO: 256603 - DNA, 15 bp, Homo sapiens
atttagatcaggaat

SEQ ID NO: 256604 - DNA, 15 bp, Homo sapiens
aatttagatcaggaa

SEQ ID NO: 256605 - DNA, 15 bp, Homo sapiens
aaatttagatcagga

SEQ ID NO: 256606 - DNA, 15 bp, Homo sapiens
caaatttagatcagg

SEQ ID NO: 256607 - DNA, 15 bp, Homo sapiens
tcaaatttagatcag

SEQ ID NO: 256608 - DNA, 15 bp, Homo sapiens
ttcaaatttagatca

SEQ ID NO: 256609 - DNA, 15 bp, Homo sapiens
gttcaaatttagatc

SEQ ID NO: 256610 - DNA, 15 bp, Homo sapiens
agttcaaatttagat

SEQ ID NO: 256611 - DNA, 15 bp, Homo sapiens
cagttcaaatttaga

SEQ ID NO: 256612 - DNA, 15 bp, Homo sapiens
ccagttcaaatttag

SEQ ID NO: 256613 - DNA, 15 bp, Homo sapiens
gccagttcaaattta

SEQ ID NO: 256614 - DNA, 15 bp, Homo sapiens
tgccagttcaaattt

SEQ ID NO: 256615 - DNA, 15 bp, Homo sapiens
gtgccagttcaaatt

SEQ ID NO: 256616 - DNA, 15 bp, Homo sapiens
ggtgccagttcaaat

SEQ ID NO: 256617 - DNA, 15 bp, Homo sapiens
aggtgccagttcaaa

SEQ ID NO: 256618 - DNA, 15 bp, Homo sapiens
aaggtgccagttcaa

SEQ ID NO: 256619 - DNA, 15 bp, Homo sapiens
taaggtgccagttca

SEQ ID NO: 256620 - DNA, 15 bp, Homo sapiens
ttaaggtgccagttc

SEQ ID NO: 256621 - DNA, 15 bp, Homo sapiens
gttaaggtgccagtt

SEQ ID NO: 256622 - DNA, 15 bp, Homo sapiens
tgttaaggtgccagt

SEQ ID NO: 256623 - DNA, 15 bp, Homo sapiens
ttgttaaggtgccag

SEQ ID NO: 256624 - DNA, 15 bp, Homo sapiens
cttgttaaggtgcca

SEQ ID NO: 256625 - DNA, 15 bp, Homo sapiens
acttgttaaggtgcc

SEQ ID NO: 256626 - DNA, 15 bp, Homo sapiens
cacttgttaaggtgc

SEQ ID NO: 256627 - DNA, 15 bp, Homo sapiens
tcacttgttaaggtg

SEQ ID NO: 256628 - DNA, 15 bp, Homo sapiens
ctcacttgttaaggt

SEQ ID NO: 256629 - DNA, 15 bp, Homo sapiens
tctcacttgttaagg

SEQ ID NO: 256630 - DNA, 15 bp, Homo sapiens
atctcacttgttaag

SEQ ID NO: 256631 - DNA, 15 bp, Homo sapiens
tatctcacttgttaa

SEQ ID NO: 256632 - DNA, 15 bp, Homo sapiens
ttatctcacttgtta

SEQ ID NO: 256633 - DNA, 15 bp, Homo sapiens
tttatctcacttgtt

SEQ ID NO: 256634 - DNA, 15 bp, Homo sapiens
ttttatctcacttgt

SEQ ID NO: 256635 - DNA, 15 bp, Homo sapiens
cttttatctcacttg

SEQ ID NO: 256636 - DNA, 15 bp, Homo sapiens
ccttttatctcactt

SEQ ID NO: 256637 - DNA, 15 bp, Homo sapiens
gccttttatctcact

SEQ ID NO: 256638 - DNA, 15 bp, Homo sapiens
agccttttatctcac

SEQ ID NO: 256639 - DNA, 15 bp, Homo sapiens
gagccttttatctca

SEQ ID NO: 256640 - DNA, 15 bp, Homo sapiens
agagccttttatctc

SEQ ID NO: 256641 - DNA, 15 bp, Homo sapiens
tagagccttttatct

SEQ ID NO: 256642 - DNA, 15 bp, Homo sapiens
atagagccttttatc

SEQ ID NO: 256643 - DNA, 15 bp, Homo sapiens
aatagagccttttat

SEQ ID NO: 256644 - DNA, 15 bp, Homo sapiens
aaatagagcctttta

SEQ ID NO: 256645 - DNA, 15 bp, Homo sapiens
aaaatagagcctttt

SEQ ID NO: 256646 - DNA, 15 bp, Homo sapiens
gaaaatagagccttt

SEQ ID NO: 256647 - DNA, 15 bp, Homo sapiens
agaaaatagagcctt

SEQ ID NO: 256648 - DNA, 15 bp, Homo sapiens
aagaaaatagagcct

SEQ ID NO: 256649 - DNA, 15 bp, Homo sapiens
aaagaaaatagagcc

SEQ ID NO: 256650 - DNA, 15 bp, Homo sapiens
aaaagaaaatagagc

SEQ ID NO: 256651 - DNA, 15 bp, Homo sapiens
taaaagaaaatagag

SEQ ID NO: 256652 - DNA, 15 bp, Homo sapiens
ttaaaagaaaataga

SEQ ID NO: 256653 - DNA, 15 bp, Homo sapiens
tttaaaagaaaatag

SEQ ID NO: 256654 - DNA, 15 bp, Homo sapiens
atttaaaagaaaata

SEQ ID NO: 256655 - DNA, 15 bp, Homo sapiens
tatttaaaagaaaat

SEQ ID NO: 256656 - DNA, 15 bp, Homo sapiens
atatttaaaagaaaa

SEQ ID NO: 256657 - DNA, 15 bp, Homo sapiens
tatatttaaaagaaa

SEQ ID NO: 256658 - DNA, 15 bp, Homo sapiens
atatatttaaaagaa

SEQ ID NO: 256659 - DNA, 15 bp, Homo sapiens
gatatatttaaaaga

SEQ ID NO: 256660 - DNA, 15 bp, Homo sapiens
agatatatttaaaag

SEQ ID NO: 256661 - DNA, 15 bp, Homo sapiens
aagatatatttaaaa

SEQ ID NO: 256662 - DNA, 15 bp, Homo sapiens
caagatatatttaaa

SEQ ID NO: 256663 - DNA, 15 bp, Homo sapiens
tcaagatatatttaa

SEQ ID NO: 256664 - DNA, 15 bp, Homo sapiens
ctcaagatatattta

SEQ ID NO: 256665 - DNA, 15 bp, Homo sapiens
tctcaagatatattt

SEQ ID NO: 256666 - DNA, 15 bp, Homo sapiens
gtctcaagatatatt

SEQ ID NO: 256667 - DNA, 15 bp, Homo sapiens
tgtctcaagatatat

SEQ ID NO: 256668 - DNA, 15 bp, Homo sapiens
atgtctcaagatata

SEQ ID NO: 256669 - DNA, 15 bp, Homo sapiens
aatgtctcaagatat

SEQ ID NO: 256670 - DNA, 15 bp, Homo sapiens
aaatgtctcaagata

SEQ ID NO: 256671 - DNA, 15 bp, Homo sapiens
taaatgtctcaagat

SEQ ID NO: 256672 - DNA, 15 bp, Homo sapiens
ctaaatgtctcaaga

SEQ ID NO: 256673 - DNA, 15 bp, Homo sapiens
actaaatgtctcaag

SEQ ID NO: 256674 - DNA, 15 bp, Homo sapiens
tactaaatgtctcaa

SEQ ID NO: 256675 - DNA, 15 bp, Homo sapiens
atactaaatgtctca

SEQ ID NO: 256676 - DNA, 15 bp, Homo sapiens
aatactaaatgtctc

SEQ ID NO: 256677 - DNA, 15 bp, Homo sapiens
taatactaaatgtct

SEQ ID NO: 256678 - DNA, 15 bp, Homo sapiens
ataatactaaatgtc

SEQ ID NO: 256679 - DNA, 15 bp, Homo sapiens
gataatactaaatgt

SEQ ID NO: 256680 - DNA, 15 bp, Homo sapiens
tgataatactaaatg

SEQ ID NO: 256681 - DNA, 15 bp, Homo sapiens
ttgataatactaaat

SEQ ID NO: 256682 - DNA, 15 bp, Homo sapiens
attgataatactaaa

SEQ ID NO: 256683 - DNA, 15 bp, Homo sapiens
cattgataatactaa

SEQ ID NO: 256684 - DNA, 15 bp, Homo sapiens
gcattgataatacta

SEQ ID NO: 256685 - DNA, 15 bp, Homo sapiens
tgcattgataatact

SEQ ID NO: 256686 - DNA, 15 bp, Homo sapiens
atgcattgataatac

SEQ ID NO: 256687 - DNA, 15 bp, Homo sapiens
aatgcattgataata

SEQ ID NO: 256688 - DNA, 15 bp, Homo sapiens
aaatgcattgataat

SEQ ID NO: 256689 - DNA, 15 bp, Homo sapiens
aaaatgcattgataa

SEQ ID NO: 256690 - DNA, 15 bp, Homo sapiens
aaaaatgcattgata

SEQ ID NO: 256691 - DNA, 15 bp, Homo sapiens
gaaaaatgcattgat

SEQ ID NO: 256692 - DNA, 15 bp, Homo sapiens
ggaaaaatgcattga

SEQ ID NO: 256693 - DNA, 15 bp, Homo sapiens
aggaaaaatgcattg

SEQ ID NO: 256694 - DNA, 15 bp, Homo sapiens
caggaaaaatgcatt

SEQ ID NO: 256695 - DNA, 15 bp, Homo sapiens
acaggaaaaatgcat

SEQ ID NO: 256696 - DNA, 15 bp, Homo sapiens
cacaggaaaaatgca

SEQ ID NO: 256697 - DNA, 15 bp, Homo sapiens
ccacaggaaaaatgc

SEQ ID NO: 256698 - DNA, 15 bp, Homo sapiens
tccacaggaaaaatg

SEQ ID NO: 256699 - DNA, 15 bp, Homo sapiens
ctccacaggaaaaat

SEQ ID NO: 256700 - DNA, 15 bp, Homo sapiens
cctccacaggaaaaa

SEQ ID NO: 256701 - DNA, 15 bp, Homo sapiens
tcctccacaggaaaa

SEQ ID NO: 256702 - DNA, 15 bp, Homo sapiens
atcctccacaggaaa

SEQ ID NO: 256703 - DNA, 15 bp, Homo sapiens
catcctccacaggaa

SEQ ID NO: 256704 - DNA, 15 bp, Homo sapiens
acatcctccacagga

SEQ ID NO: 256705 - DNA, 15 bp, Homo sapiens
cacatcctccacagg

SEQ ID NO: 256706 - DNA, 15 bp, Homo sapiens
acacatcctccacag

SEQ ID NO: 256707 - DNA, 15 bp, Homo sapiens
aacacatcctccaca

SEQ ID NO: 256708 - DNA, 15 bp, Homo sapiens
gaacacatcctccac

SEQ ID NO: 256709 - DNA, 15 bp, Homo sapiens
tgaacacatcctcca

SEQ ID NO: 256710 - DNA, 15 bp, Homo sapiens
ctgaacacatcctcc

SEQ ID NO: 256711 - DNA, 15 bp, Homo sapiens
tctgaacacatcctc

SEQ ID NO: 256712 - DNA, 15 bp, Homo sapiens
ctctgaacacatcct

SEQ ID NO: 256713 - DNA, 15 bp, Homo sapiens
actctgaacacatcc

SEQ ID NO: 256714 - DNA, 15 bp, Homo sapiens
cactctgaacacatc

SEQ ID NO: 256715 - DNA, 15 bp, Homo sapiens
ccactctgaacacat

SEQ ID NO: 256716 - DNA, 15 bp, Homo sapiens
tccactctgaacaca

SEQ ID NO: 256717 - DNA, 15 bp, Homo sapiens
ttccactctgaacac

SEQ ID NO: 256718 - DNA, 15 bp, Homo sapiens
attccactctgaaca

SEQ ID NO: 256719 - DNA, 15 bp, Homo sapiens
aattccactctgaac

SEQ ID NO: 256720 - DNA, 15 bp, Homo sapiens
gaattccactctgaa

SEQ ID NO: 256721 - DNA, 15 bp, Homo sapiens
agaattccactctga

SEQ ID NO: 256722 - DNA, 15 bp, Homo sapiens
cagaattccactctg

SEQ ID NO: 256723 - DNA, 15 bp, Homo sapiens
acagaattccactct

SEQ ID NO: 256724 - DNA, 15 bp, Homo sapiens
cacagaattccactc

SEQ ID NO: 256725 - DNA, 15 bp, Homo sapiens
ccacagaattccact

SEQ ID NO: 256726 - DNA, 15 bp, Homo sapiens
gccacagaattccac

SEQ ID NO: 256727 - DNA, 15 bp, Homo sapiens
tgccacagaattcca

SEQ ID NO: 256728 - DNA, 15 bp, Homo sapiens
ctgccacagaattcc

SEQ ID NO: 256729 - DNA, 15 bp, Homo sapiens
actgccacagaattc

SEQ ID NO: 256730 - DNA, 15 bp, Homo sapiens
gactgccacagaatt

SEQ ID NO: 256731 - DNA, 15 bp, Homo sapiens
ggactgccacagaat

SEQ ID NO: 256732 - DNA, 15 bp, Homo sapiens
aggactgccacagaa

SEQ ID NO: 256733 - DNA, 15 bp, Homo sapiens
aaggactgccacaga

SEQ ID NO: 256734 - DNA, 15 bp, Homo sapiens
aaaggactgccacag

SEQ ID NO: 256735 - DNA, 15 bp, Homo sapiens
gaaaggactgccaca

SEQ ID NO: 256736 - DNA, 15 bp, Homo sapiens
tgaaaggactgccac

SEQ ID NO: 256737 - DNA, 15 bp, Homo sapiens
atgaaaggactgcca

SEQ ID NO: 256738 - DNA, 15 bp, Homo sapiens
gatgaaaggactgcc

SEQ ID NO: 256739 - DNA, 15 bp, Homo sapiens
tgatgaaaggactgc

SEQ ID NO: 256740 - DNA, 15 bp, Homo sapiens
ttgatgaaaggactg

SEQ ID NO: 256741 - DNA, 15 bp, Homo sapiens
tttgatgaaaggact

SEQ ID NO: 256742 - DNA, 15 bp, Homo sapiens
ttttgatgaaaggac

SEQ ID NO: 256743 - DNA, 15 bp, Homo sapiens
cttttgatgaaagga

SEQ ID NO: 256744 - DNA, 15 bp, Homo sapiens
ccttttgatgaaagg

SEQ ID NO: 256745 - DNA, 15 bp, Homo sapiens
tccttttgatgaaag

SEQ ID NO: 256746 - DNA, 15 bp, Homo sapiens
atccttttgatgaaa

SEQ ID NO: 256747 - DNA, 15 bp, Homo sapiens
tatccttttgatgaa

SEQ ID NO: 256748 - DNA, 15 bp, Homo sapiens
atatccttttgatga

SEQ ID NO: 256749 - DNA, 15 bp, Homo sapiens
aatatccttttgatg

SEQ ID NO: 256750 - DNA, 15 bp, Homo sapiens
aaatatccttttgat

SEQ ID NO: 256751 - DNA, 15 bp, Homo sapiens
gaaatatccttttga

SEQ ID NO: 256752 - DNA, 15 bp, Homo sapiens
ggaaatatccttttg

SEQ ID NO: 256753 - DNA, 15 bp, Homo sapiens
aggaaatatcctttt

SEQ ID NO: 256754 - DNA, 15 bp, Homo sapiens
gaggaaatatccttt

SEQ ID NO: 256755 - DNA, 15 bp, Homo sapiens
ggaggaaatatcctt

SEQ ID NO: 256756 - DNA, 15 bp, Homo sapiens
gggaggaaatatcct

SEQ ID NO: 256757 - DNA, 15 bp, Homo sapiens
cgggaggaaatatcc

SEQ ID NO: 256758 - DNA, 15 bp, Homo sapiens
gcgggaggaaatatc

SEQ ID NO: 256759 - DNA, 15 bp, Homo sapiens
tgcgggaggaaatat

SEQ ID NO: 256760 - DNA, 15 bp, Homo sapiens
ttgcgggaggaaata

SEQ ID NO: 256761 - DNA, 15 bp, Homo sapiens
tttgcgggaggaaat

SEQ ID NO: 256762 - DNA, 15 bp, Homo sapiens
ttttgcgggaggaaa

SEQ ID NO: 256763 - DNA, 15 bp, Homo sapiens
attttgcgggaggaa

SEQ ID NO: 256764 - DNA, 15 bp, Homo sapiens
tattttgcgggagga

SEQ ID NO: 256765 - DNA, 15 bp, Homo sapiens
ttattttgcgggagg

SEQ ID NO: 256766 - DNA, 15 bp, Homo sapiens
gttattttgcgggag

SEQ ID NO: 256767 - DNA, 15 bp, Homo sapiens
ggttattttgcggga

SEQ ID NO: 256768 - DNA, 15 bp, Homo sapiens
aggttattttgcggg

SEQ ID NO: 256769 - DNA, 15 bp, Homo sapiens
taggttattttgcgg

SEQ ID NO: 256770 - DNA, 15 bp, Homo sapiens
ttaggttattttgcg

SEQ ID NO: 256771 - DNA, 15 bp, Homo sapiens
tttaggttattttgc

SEQ ID NO: 256772 - DNA, 15 bp, Homo sapiens
ttttaggttattttg

SEQ ID NO: 256773 - DNA, 15 bp, Homo sapiens
attttaggttatttt

SEQ ID NO: 256774 - DNA, 15 bp, Homo sapiens
aattttaggttattt

SEQ ID NO: 256775 - DNA, 15 bp, Homo sapiens
taattttaggttatt

SEQ ID NO: 256776 - DNA, 15 bp, Homo sapiens
ttaattttaggttat

SEQ ID NO: 256777 - DNA, 15 bp, Homo sapiens
cttaattttaggtta

SEQ ID NO: 256778 - DNA, 15 bp, Homo sapiens
acttaattttaggtt

SEQ ID NO: 256779 - DNA, 15 bp, Homo sapiens
tacttaattttaggt

SEQ ID NO: 256780 - DNA, 15 bp, Homo sapiens
ctacttaattttagg

SEQ ID NO: 256781 - DNA, 15 bp, Homo sapiens
gctacttaattttag

SEQ ID NO: 256782 - DNA, 15 bp, Homo sapiens
tgctacttaatttta

SEQ ID NO: 256783 - DNA, 15 bp, Homo sapiens
ctgctacttaatttt

SEQ ID NO: 256784 - DNA, 15 bp, Homo sapiens
actgctacttaattt

SEQ ID NO: 256785 - DNA, 15 bp, Homo sapiens
cactgctacttaatt

SEQ ID NO: 256786 - DNA, 15 bp, Homo sapiens
acactgctacttaat

SEQ ID NO: 256787 - DNA, 15 bp, Homo sapiens
cacactgctacttaa

SEQ ID NO: 256788 - DNA, 15 bp, Homo sapiens
tcacactgctactta

SEQ ID NO: 256789 - DNA, 15 bp, Homo sapiens
ttcacactgctactt

SEQ ID NO: 256790 - DNA, 15 bp, Homo sapiens
attcacactgctact

SEQ ID NO: 256791 - DNA, 15 bp, Homo sapiens
tattcacactgctac

SEQ ID NO: 256792 - DNA, 15 bp, Homo sapiens
gtattcacactgcta

SEQ ID NO: 256793 - DNA, 15 bp, Homo sapiens
agtattcacactgct

SEQ ID NO: 256794 - DNA, 15 bp, Homo sapiens
aagtattcacactgc

SEQ ID NO: 256795 - DNA, 15 bp, Homo sapiens
taagtattcacactg

SEQ ID NO: 256796 - DNA, 15 bp, Homo sapiens
ctaagtattcacact

SEQ ID NO: 256797 - DNA, 15 bp, Homo sapiens
gctaagtattcacac

SEQ ID NO: 256798 - DNA, 15 bp, Homo sapiens
tgctaagtattcaca

SEQ ID NO: 256799 - DNA, 15 bp, Homo sapiens
atgctaagtattcac

SEQ ID NO: 256800 - DNA, 15 bp, Homo sapiens
tatgctaagtattca

SEQ ID NO: 256801 - DNA, 15 bp, Homo sapiens
atatgctaagtattc

SEQ ID NO: 256802 - DNA, 15 bp, Homo sapiens
tatatgctaagtatt

SEQ ID NO: 256803 - DNA, 15 bp, Homo sapiens
ctatatgctaagtat

SEQ ID NO: 256804 - DNA, 15 bp, Homo sapiens
tctatatgctaagta

SEQ ID NO: 256805 - DNA, 15 bp, Homo sapiens
atctatatgctaagt

SEQ ID NO: 256806 - DNA, 15 bp, Homo sapiens
aatctatatgctaag

SEQ ID NO: 256807 - DNA, 15 bp, Homo sapiens
aaatctatatgctaa

SEQ ID NO: 256808 - DNA, 15 bp, Homo sapiens
taaatctatatgcta

SEQ ID NO: 256809 - DNA, 15 bp, Homo sapiens
ataaatctatatgct

SEQ ID NO: 256810 - DNA, 15 bp, Homo sapiens
cataaatctatatgc

SEQ ID NO: 256811 - DNA, 15 bp, Homo sapiens
gcataaatctatatg

SEQ ID NO: 256812 - DNA, 15 bp, Homo sapiens
agcataaatctatat

SEQ ID NO: 256813 - DNA, 15 bp, Homo sapiens
tagcataaatctata

SEQ ID NO: 256814 - DNA, 15 bp, Homo sapiens
atagcataaatctat

SEQ ID NO: 256815 - DNA, 15 bp, Homo sapiens
gatagcataaatcta

SEQ ID NO: 256816 - DNA, 15 bp, Homo sapiens
agatagcataaatct

SEQ ID NO: 256817 - DNA, 15 bp, Homo sapiens
cagatagcataaatc

SEQ ID NO: 256818 - DNA, 15 bp, Homo sapiens
ccagatagcataaat

SEQ ID NO: 256819 - DNA, 15 bp, Homo sapiens
tccagatagcataaa

SEQ ID NO: 256820 - DNA, 15 bp, Homo sapiens
atccagatagcataa

SEQ ID NO: 256821 - DNA, 15 bp, Homo sapiens
aatccagatagcata

SEQ ID NO: 256822 - DNA, 15 bp, Homo sapiens
gaatccagatagcat

SEQ ID NO: 256823 - DNA, 15 bp, Homo sapiens
agaatccagatagca

SEQ ID NO: 256824 - DNA, 15 bp, Homo sapiens
tagaatccagatagc

SEQ ID NO: 256825 - DNA, 15 bp, Homo sapiens
atagaatccagatag

SEQ ID NO: 256826 - DNA, 15 bp, Homo sapiens
aatagaatccagata

SEQ ID NO: 256827 - DNA, 15 bp, Homo sapiens
aaatagaatccagat

SEQ ID NO: 256828 - DNA, 15 bp, Homo sapiens
caaatagaatccaga

SEQ ID NO: 256829 - DNA, 15 bp, Homo sapiens
acaaatagaatccag

SEQ ID NO: 256830 - DNA, 15 bp, Homo sapiens
cacaaatagaatcca

SEQ ID NO: 256831 - DNA, 15 bp, Homo sapiens
ccacaaatagaatcc

SEQ ID NO: 256832 - DNA, 15 bp, Homo sapiens
accacaaatagaatc

SEQ ID NO: 256833 - DNA, 15 bp, Homo sapiens
aaccacaaatagaat

SEQ ID NO: 256834 - DNA, 15 bp, Homo sapiens
caaccacaaatagaa

SEQ ID NO: 256835 - DNA, 15 bp, Homo sapiens
acaaccacaaataga

SEQ ID NO: 256836 - DNA, 15 bp, Homo sapiens
tacaaccacaaatag

SEQ ID NO: 256837 - DNA, 15 bp, Homo sapiens
ctacaaccacaaata

SEQ ID NO: 256838 - DNA, 15 bp, Homo sapiens
actacaaccacaaat

SEQ ID NO: 256839 - DNA, 15 bp, Homo sapiens
aactacaaccacaaa

SEQ ID NO: 256840 - DNA, 15 bp, Homo sapiens
gaactacaaccacaa

SEQ ID NO: 256841 - DNA, 15 bp, Homo sapiens
agaactacaaccaca

SEQ ID NO: 256842 - DNA, 15 bp, Homo sapiens
tagaactacaaccac

SEQ ID NO: 256843 - DNA, 15 bp, Homo sapiens
ttagaactacaacca

SEQ ID NO: 256844 - DNA, 15 bp, Homo sapiens
attagaactacaacc

SEQ ID NO: 256845 - DNA, 15 bp, Homo sapiens
cattagaactacaac

SEQ ID NO: 256846 - DNA, 15 bp, Homo sapiens
tcattagaactacaa

SEQ ID NO: 256847 - DNA, 15 bp, Homo sapiens
atcattagaactaca

SEQ ID NO: 256848 - DNA, 15 bp, Homo sapiens
aatcattagaactac

SEQ ID NO: 256849 - DNA, 15 bp, Homo sapiens
caatcattagaacta

SEQ ID NO: 256850 - DNA, 15 bp, Homo sapiens
tcaatcattagaact

SEQ ID NO: 256851 - DNA, 15 bp, Homo sapiens
ctcaatcattagaac

SEQ ID NO: 256852 - DNA, 15 bp, Homo sapiens
actcaatcattagaa

SEQ ID NO: 256853 - DNA, 15 bp, Homo sapiens
gactcaatcattaga

SEQ ID NO: 256854 - DNA, 15 bp, Homo sapiens
agactcaatcattag

SEQ ID NO: 256855 - DNA, 15 bp, Homo sapiens
tagactcaatcatta

SEQ ID NO: 256856 - DNA, 15 bp, Homo sapiens
gtagactcaatcatt

SEQ ID NO: 256857 - DNA, 15 bp, Homo sapiens
ggtagactcaatcat

SEQ ID NO: 256858 - DNA, 15 bp, Homo sapiens
gggtagactcaatca

SEQ ID NO: 256859 - DNA, 15 bp, Homo sapiens
agggtagactcaatc

SEQ ID NO: 256860 - DNA, 15 bp, Homo sapiens
tagggtagactcaat

SEQ ID NO: 256861 - DNA, 15 bp, Homo sapiens
ctagggtagactcaa

SEQ ID NO: 256862 - DNA, 15 bp, Homo sapiens
cctagggtagactca

SEQ ID NO: 256863 - DNA, 15 bp, Homo sapiens
gcctagggtagactc

SEQ ID NO: 256864 - DNA, 15 bp, Homo sapiens
ggcctagggtagact

SEQ ID NO: 256865 - DNA, 15 bp, Homo sapiens
aggcctagggtagac

SEQ ID NO: 256866 - DNA, 15 bp, Homo sapiens
aaggcctagggtaga

SEQ ID NO: 256867 - DNA, 15 bp, Homo sapiens
caaggcctagggtag

SEQ ID NO: 256868 - DNA, 15 bp, Homo sapiens
acaaggcctagggta

SEQ ID NO: 256869 - DNA, 15 bp, Homo sapiens
gacaaggcctagggt

SEQ ID NO: 256870 - DNA, 15 bp, Homo sapiens
tgacaaggcctaggg

SEQ ID NO: 256871 - DNA, 15 bp, Homo sapiens
ctgacaaggcctagg

SEQ ID NO: 256872 - DNA, 15 bp, Homo sapiens
tctgacaaggcctag

SEQ ID NO: 256873 - DNA, 15 bp, Homo sapiens
atctgacaaggccta

SEQ ID NO: 256874 - DNA, 15 bp, Homo sapiens
tatctgacaaggcct

SEQ ID NO: 256875 - DNA, 15 bp, Homo sapiens
ctatctgacaaggcc

SEQ ID NO: 256876 - DNA, 15 bp, Homo sapiens
actatctgacaaggc

SEQ ID NO: 256877 - DNA, 15 bp, Homo sapiens
aactatctgacaagg

SEQ ID NO: 256878 - DNA, 15 bp, Homo sapiens
caactatctgacaag

SEQ ID NO: 256879 - DNA, 15 bp, Homo sapiens
tcaactatctgacaa

SEQ ID NO: 256880 - DNA, 15 bp, Homo sapiens
atcaactatctgaca

SEQ ID NO: 256881 - DNA, 15 bp, Homo sapiens
catcaactatctgac

SEQ ID NO: 256882 - DNA, 15 bp, Homo sapiens
acatcaactatctga

SEQ ID NO: 256883 - DNA, 15 bp, Homo sapiens
cacatcaactatctg

SEQ ID NO: 256884 - DNA, 15 bp, Homo sapiens
ccacatcaactatct

SEQ ID NO: 256885 - DNA, 15 bp, Homo sapiens
tccacatcaactatc

SEQ ID NO: 256886 - DNA, 15 bp, Homo sapiens
ttccacatcaactat

SEQ ID NO: 256887 - DNA, 15 bp, Homo sapiens
tttccacatcaacta

SEQ ID NO: 256888 - DNA, 15 bp, Homo sapiens
ctttccacatcaact

SEQ ID NO: 256889 - DNA, 15 bp, Homo sapiens
actttccacatcaac

SEQ ID NO: 256890 - DNA, 15 bp, Homo sapiens
cactttccacatcaa

SEQ ID NO: 256891 - DNA, 15 bp, Homo sapiens
tcactttccacatca

SEQ ID NO: 256892 - DNA, 15 bp, Homo sapiens
atcactttccacatc

SEQ ID NO: 256893 - DNA, 15 bp, Homo sapiens
tatcactttccacat

SEQ ID NO: 256894 - DNA, 15 bp, Homo sapiens
atatcactttccaca

SEQ ID NO: 256895 - DNA, 15 bp, Homo sapiens
aatatcactttccac

SEQ ID NO: 256896 - DNA, 15 bp, Homo sapiens
aaatatcactttcca

SEQ ID NO: 256897 - DNA, 15 bp, Homo sapiens
taaatatcactttcc

SEQ ID NO: 256898 - DNA, 15 bp, Homo sapiens
gtaaatatcactttc

SEQ ID NO: 256899 - DNA, 15 bp, Homo sapiens
ggtaaatatcacttt

SEQ ID NO: 256900 - DNA, 15 bp, Homo sapiens
aggtaaatatcactt

SEQ ID NO: 256901 - DNA, 15 bp, Homo sapiens
caggtaaatatcact

SEQ ID NO: 256902 - DNA, 15 bp, Homo sapiens
acaggtaaatatcac

SEQ ID NO: 256903 - DNA, 15 bp, Homo sapiens
aacaggtaaatatca

SEQ ID NO: 256904 - DNA, 15 bp, Homo sapiens
gaacaggtaaatatc

SEQ ID NO: 256905 - DNA, 15 bp, Homo sapiens
agaacaggtaaatat

SEQ ID NO: 256906 - DNA, 15 bp, Homo sapiens
aagaacaggtaaata

SEQ ID NO: 256907 - DNA, 15 bp, Homo sapiens
aaagaacaggtaaat

SEQ ID NO: 256908 - DNA, 15 bp, Homo sapiens
aaaagaacaggtaaa

SEQ ID NO: 256909 - DNA, 15 bp, Homo sapiens
taaaagaacaggtaa

SEQ ID NO: 256910 - DNA, 15 bp, Homo sapiens
ttaaaagaacaggta

SEQ ID NO: 256911 - DNA, 15 bp, Homo sapiens
cttaaaagaacaggt

SEQ ID NO: 256912 - DNA, 15 bp, Homo sapiens
tcttaaaagaacagg

SEQ ID NO: 256913 - DNA, 15 bp, Homo sapiens
atcttaaaagaacag

SEQ ID NO: 256914 - DNA, 15 bp, Homo sapiens
tatcttaaaagaaca

SEQ ID NO: 256915 - DNA, 15 bp, Homo sapiens
ctatcttaaaagaac

SEQ ID NO: 256916 - DNA, 15 bp, Homo sapiens
cctatcttaaaagaa

SEQ ID NO: 256917 - DNA, 15 bp, Homo sapiens
ccctatcttaaaaga

SEQ ID NO: 256918 - DNA, 15 bp, Homo sapiens
accctatcttaaaag

SEQ ID NO: 256919 - DNA, 15 bp, Homo sapiens
taccctatcttaaaa

SEQ ID NO: 256920 - DNA, 15 bp, Homo sapiens
ttaccctatcttaaa

SEQ ID NO: 256921 - DNA, 15 bp, Homo sapiens
tttaccctatcttaa

SEQ ID NO: 256922 - DNA, 15 bp, Homo sapiens
atttaccctatctta

SEQ ID NO: 256923 - DNA, 15 bp, Homo sapiens
aatttaccctatctt

SEQ ID NO: 256924 - DNA, 15 bp, Homo sapiens
caatttaccctatct

SEQ ID NO: 256925 - DNA, 15 bp, Homo sapiens
tcaatttaccctatc

SEQ ID NO: 256926 - DNA, 15 bp, Homo sapiens
ttcaatttaccctat

SEQ ID NO: 256927 - DNA, 15 bp, Homo sapiens
tttcaatttacccta

SEQ ID NO: 256928 - DNA, 15 bp, Homo sapiens
ttttcaatttaccct

SEQ ID NO: 256929 - DNA, 15 bp, Homo sapiens
cttttcaatttaccc

SEQ ID NO: 256930 - DNA, 15 bp, Homo sapiens
acttttcaatttacc

SEQ ID NO: 256931 - DNA, 15 bp, Homo sapiens
aacttttcaatttac

SEQ ID NO: 256932 - DNA, 15 bp, Homo sapiens
aaacttttcaattta

SEQ ID NO: 256933 - DNA, 15 bp, Homo sapiens
gaaacttttcaattt

SEQ ID NO: 256934 - DNA, 15 bp, Homo sapiens
tgaaacttttcaatt

SEQ ID NO: 256935 - DNA, 15 bp, Homo sapiens
ttgaaacttttcaat

SEQ ID NO: 256936 - DNA, 15 bp, Homo sapiens
cttgaaacttttcaa

SEQ ID NO: 256937 - DNA, 15 bp, Homo sapiens
acttgaaacttttca

SEQ ID NO: 256938 - DNA, 15 bp, Homo sapiens
tacttgaaacttttc

SEQ ID NO: 256939 - DNA, 15 bp, Homo sapiens
atacttgaaactttt

SEQ ID NO: 256940 - DNA, 15 bp, Homo sapiens
aatacttgaaacttt

SEQ ID NO: 256941 - DNA, 15 bp, Homo sapiens
gaatacttgaaactt

SEQ ID NO: 256942 - DNA, 15 bp, Homo sapiens
agaatacttgaaact

SEQ ID NO: 256943 - DNA, 15 bp, Homo sapiens
aagaatacttgaaac

SEQ ID NO: 256944 - DNA, 15 bp, Homo sapiens
gaagaatacttgaaa

SEQ ID NO: 256945 - DNA, 15 bp, Homo sapiens
agaagaatacttgaa

SEQ ID NO: 256946 - DNA, 15 bp, Homo sapiens
aagaagaatacttga

SEQ ID NO: 256947 - DNA, 15 bp, Homo sapiens
aaagaagaatacttg

SEQ ID NO: 256948 - DNA, 15 bp, Homo sapiens
caaagaagaatactt

SEQ ID NO: 256949 - DNA, 15 bp, Homo sapiens
gcaaagaagaatact

SEQ ID NO: 256950 - DNA, 15 bp, Homo sapiens
agcaaagaagaatac

SEQ ID NO: 256951 - DNA, 15 bp, Homo sapiens
tagcaaagaagaata

SEQ ID NO: 256952 - DNA, 15 bp, Homo sapiens
gtagcaaagaagaat

SEQ ID NO: 256953 - DNA, 15 bp, Homo sapiens
ggtagcaaagaagaa

SEQ ID NO: 256954 - DNA, 15 bp, Homo sapiens
aggtagcaaagaaga

SEQ ID NO: 256955 - DNA, 15 bp, Homo sapiens
aaggtagcaaagaag

SEQ ID NO: 256956 - DNA, 15 bp, Homo sapiens
aaaggtagcaaagaa

SEQ ID NO: 256957 - DNA, 15 bp, Homo sapiens
aaaaggtagcaaaga

SEQ ID NO: 256958 - DNA, 15 bp, Homo sapiens
caaaaggtagcaaag

SEQ ID NO: 256959 - DNA, 15 bp, Homo sapiens
acaaaaggtagcaaa

SEQ ID NO: 256960 - DNA, 15 bp, Homo sapiens
aacaaaaggtagcaa

SEQ ID NO: 256961 - DNA, 15 bp, Homo sapiens
taacaaaaggtagca

SEQ ID NO: 256962 - DNA, 15 bp, Homo sapiens
ttaacaaaaggtagc

SEQ ID NO: 256963 - DNA, 15 bp, Homo sapiens
gttaacaaaaggtag

SEQ ID NO: 256964 - DNA, 15 bp, Homo sapiens
agttaacaaaaggta

SEQ ID NO: 256965 - DNA, 15 bp, Homo sapiens
cagttaacaaaaggt

SEQ ID NO: 256966 - DNA, 15 bp, Homo sapiens
acagttaacaaaagg

SEQ ID NO: 256967 - DNA, 15 bp, Homo sapiens
aacagttaacaaaag

SEQ ID NO: 256968 - DNA, 15 bp, Homo sapiens
taacagttaacaaaa

SEQ ID NO: 256969 - DNA, 15 bp, Homo sapiens
ttaacagttaacaaa

SEQ ID NO: 256970 - DNA, 15 bp, Homo sapiens
attaacagttaacaa

SEQ ID NO: 256971 - DNA, 15 bp, Homo sapiens
tattaacagttaaca

SEQ ID NO: 256972 - DNA, 15 bp, Homo sapiens
atattaacagttaac

SEQ ID NO: 256973 - DNA, 15 bp, Homo sapiens
tatattaacagttaa

SEQ ID NO: 256974 - DNA, 15 bp, Homo sapiens
gtatattaacagtta

SEQ ID NO: 256975 - DNA, 15 bp, Homo sapiens
cgtatattaacagtt

SEQ ID NO: 256976 - DNA, 15 bp, Homo sapiens
acgtatattaacagt

SEQ ID NO: 256977 - DNA, 15 bp, Homo sapiens
gacgtatattaacag

SEQ ID NO: 256978 - DNA, 15 bp, Homo sapiens
agacgtatattaaca

SEQ ID NO: 256979 - DNA, 15 bp, Homo sapiens
tagacgtatattaac

SEQ ID NO: 256980 - DNA, 15 bp, Homo sapiens
ctagacgtatattaa

SEQ ID NO: 256981 - DNA, 15 bp, Homo sapiens
cctagacgtatatta

SEQ ID NO: 256982 - DNA, 15 bp, Homo sapiens
gcctagacgtatatt

SEQ ID NO: 256983 - DNA, 15 bp, Homo sapiens
tgcctagacgtatat

SEQ ID NO: 256984 - DNA, 15 bp, Homo sapiens
ctgcctagacgtata

SEQ ID NO: 256985 - DNA, 15 bp, Homo sapiens
actgcctagacgtat

SEQ ID NO: 256986 - DNA, 15 bp, Homo sapiens
aactgcctagacgta

SEQ ID NO: 256987 - DNA, 15 bp, Homo sapiens
gaactgcctagacgt

SEQ ID NO: 256988 - DNA, 15 bp, Homo sapiens
tgaactgcctagacg

SEQ ID NO: 256989 - DNA, 15 bp, Homo sapiens
ctgaactgcctagac

SEQ ID NO: 256990 - DNA, 15 bp, Homo sapiens
actgaactgcctaga

SEQ ID NO: 256991 - DNA, 15 bp, Homo sapiens
cactgaactgcctag

SEQ ID NO: 256992 - DNA, 15 bp, Homo sapiens
tcactgaactgccta

SEQ ID NO: 256993 - DNA, 15 bp, Homo sapiens
atcactgaactgcct

SEQ ID NO: 256994 - DNA, 15 bp, Homo sapiens
catcactgaactgcc

SEQ ID NO: 256995 - DNA, 15 bp, Homo sapiens
gcatcactgaactgc

SEQ ID NO: 256996 - DNA, 15 bp, Homo sapiens
agcatcactgaactg

SEQ ID NO: 256997 - DNA, 15 bp, Homo sapiens
aagcatcactgaact

SEQ ID NO: 256998 - DNA, 15 bp, Homo sapiens
aaagcatcactgaac

SEQ ID NO: 256999 - DNA, 15 bp, Homo sapiens
caaagcatcactgaa

SEQ ID NO: 257000 - DNA, 15 bp, Homo sapiens
tcaaagcatcactga

SEQ ID NO: 257001 - DNA, 15 bp, Homo sapiens
ttcaaagcatcactg

SEQ ID NO: 257002 - DNA, 15 bp, Homo sapiens
tttcaaagcatcact

SEQ ID NO: 257003 - DNA, 15 bp, Homo sapiens
ttttcaaagcatcac

SEQ ID NO: 257004 - DNA, 15 bp, Homo sapiens
attttcaaagcatca

SEQ ID NO: 257005 - DNA, 15 bp, Homo sapiens
aattttcaaagcatc

SEQ ID NO: 257006 - DNA, 15 bp, Homo sapiens
taattttcaaagcat

SEQ ID NO: 257007 - DNA, 15 bp, Homo sapiens
ataattttcaaagca

SEQ ID NO: 257008 - DNA, 15 bp, Homo sapiens
cataattttcaaagc

SEQ ID NO: 257009 - DNA, 15 bp, Homo sapiens
gcataattttcaaag

SEQ ID NO: 257010 - DNA, 15 bp, Homo sapiens
agcataattttcaaa

SEQ ID NO: 257011 - DNA, 15 bp, Homo sapiens
aagcataattttcaa

SEQ ID NO: 257012 - DNA, 15 bp, Homo sapiens
aaagcataattttca

SEQ ID NO: 257013 - DNA, 15 bp, Homo sapiens
caaagcataattttc

SEQ ID NO: 257014 - DNA, 15 bp, Homo sapiens
tcaaagcataatttt

SEQ ID NO: 257015 - DNA, 15 bp, Homo sapiens
ttcaaagcataattt

SEQ ID NO: 257016 - DNA, 15 bp, Homo sapiens
tttcaaagcataatt

SEQ ID NO: 257017 - DNA, 15 bp, Homo sapiens
ttttcaaagcataat

SEQ ID NO: 257018 - DNA, 15 bp, Homo sapiens
tttttcaaagcataa

SEQ ID NO: 257019 - DNA, 15 bp, Homo sapiens
atttttcaaagcata

SEQ ID NO: 257020 - DNA, 15 bp, Homo sapiens
catttttcaaagcat

SEQ ID NO: 257021 - DNA, 15 bp, Homo sapiens
tcatttttcaaagca

SEQ ID NO: 257022 - DNA, 15 bp, Homo sapiens
atcatttttcaaagc

SEQ ID NO: 257023 - DNA, 15 bp, Homo sapiens
tatcatttttcaaag

SEQ ID NO: 257024 - DNA, 15 bp, Homo sapiens
atatcatttttcaaa

SEQ ID NO: 257025 - DNA, 15 bp, Homo sapiens
catatcatttttcaa

SEQ ID NO: 257026 - DNA, 15 bp, Homo sapiens
acatatcatttttca

SEQ ID NO: 257027 - DNA, 15 bp, Homo sapiens
aacatatcatttttc

SEQ ID NO: 257028 - DNA, 15 bp, Homo sapiens
taacatatcattttt

SEQ ID NO: 257029 - DNA, 15 bp, Homo sapiens
cttaacatatcattt

SEQ ID NO: 257030 - DNA, 15 bp, Homo sapiens
ccttaacatatcatt

SEQ ID NO: 257031 - DNA, 15 bp, Homo sapiens
accttaacatatcat

SEQ ID NO: 257032 - DNA, 15 bp, Homo sapiens
aaccttaacatatca

SEQ ID NO: 257033 - DNA, 15 bp, Homo sapiens
caaccttaacatatc

SEQ ID NO: 257034 - DNA, 15 bp, Homo sapiens
tcaaccttaacatat

SEQ ID NO: 257035 - DNA, 15 bp, Homo sapiens
ttcaaccttaacata

SEQ ID NO: 257036 - DNA, 15 bp, Homo sapiens
tttcaaccttaacat

SEQ ID NO: 257037 - DNA, 15 bp, Homo sapiens
ttttcaaccttaaca

SEQ ID NO: 257038 - DNA, 15 bp, Homo sapiens
tttttcaaccttaac

SEQ ID NO: 257039 - DNA, 15 bp, Homo sapiens
atttttcaaccttaa

SEQ ID NO: 257040 - DNA, 15 bp, Homo sapiens
gatttttcaacctta

SEQ ID NO: 257041 - DNA, 15 bp, Homo sapiens
agatttttcaacctt

SEQ ID NO: 257042 - DNA, 15 bp, Homo sapiens
cagatttttcaacct

SEQ ID NO: 257043 - DNA, 15 bp, Homo sapiens
gcagatttttcaacc

SEQ ID NO: 257044 - DNA, 15 bp, Homo sapiens
agcagatttttcaac

SEQ ID NO: 257045 - DNA, 15 bp, Homo sapiens
gagcagatttttcaa

SEQ ID NO: 257046 - DNA, 15 bp, Homo sapiens
ggagcagatttttca

SEQ ID NO: 257047 - DNA, 15 bp, Homo sapiens
aggagcagatttttc

SEQ ID NO: 257048 - DNA, 15 bp, Homo sapiens
aaggagcagattttt

SEQ ID NO: 257049 - DNA, 15 bp, Homo sapiens
caaggagcagatttt

SEQ ID NO: 257050 - DNA, 15 bp, Homo sapiens
tcaaggagcagattt

SEQ ID NO: 257051 - DNA, 15 bp, Homo sapiens
ttcaaggagcagatt

SEQ ID NO: 257052 - DNA, 15 bp, Homo sapiens
tttcaaggagcagat

SEQ ID NO: 257053 - DNA, 15 bp, Homo sapiens
ctttcaaggagcaga

SEQ ID NO: 257054 - DNA, 15 bp, Homo sapiens
actttcaaggagcag

SEQ ID NO: 257055 - DNA, 15 bp, Homo sapiens
gactttcaaggagca

SEQ ID NO: 257056 - DNA, 15 bp, Homo sapiens
tgactttcaaggagc

SEQ ID NO: 257057 - DNA, 15 bp, Homo sapiens
ttgactttcaaggag

SEQ ID NO: 257058 - DNA, 15 bp, Homo sapiens
attgactttcaagga

SEQ ID NO: 257059 - DNA, 15 bp, Homo sapiens
tattgactttcaagg

SEQ ID NO: 257060 - DNA, 15 bp, Homo sapiens
ctattgactttcaag

SEQ ID NO: 257061 - DNA, 15 bp, Homo sapiens
tctattgactttcaa

SEQ ID NO: 257062 - DNA, 15 bp, Homo sapiens
ttctattgactttca

SEQ ID NO: 257063 - DNA, 15 bp, Homo sapiens
cttctattgactttc

SEQ ID NO: 257064 - DNA, 15 bp, Homo sapiens
acttctattgacttt

SEQ ID NO: 257065 - DNA, 15 bp, Homo sapiens
aacttctattgactt

SEQ ID NO: 257066 - DNA, 15 bp, Homo sapiens
taacttctattgact

SEQ ID NO: 257067 - DNA, 15 bp, Homo sapiens
ctaacttctattgac

SEQ ID NO: 257068 - DNA, 15 bp, Homo sapiens
gctaacttctattga

SEQ ID NO: 257069 - DNA, 15 bp, Homo sapiens
tgctaacttctattg

SEQ ID NO: 257070 - DNA, 15 bp, Homo sapiens
ttgctaacttctatt

SEQ ID NO: 257071 - DNA, 15 bp, Homo sapiens
attgctaacttctat

SEQ ID NO: 257072 - DNA, 15 bp, Homo sapiens
tattgctaacttcta

SEQ ID NO: 257073 - DNA, 15 bp, Homo sapiens
ttattgctaacttct

SEQ ID NO: 257074 - DNA, 15 bp, Homo sapiens
tttattgctaacttc

SEQ ID NO: 257075 - DNA, 15 bp, Homo sapiens
atttattgctaactt

SEQ ID NO: 257076 - DNA, 15 bp, Homo sapiens
aatttattgctaact

SEQ ID NO: 257077 - DNA, 15 bp, Homo sapiens
aaatttattgctaac

SEQ ID NO: 257078 - DNA, 15 bp, Homo sapiens
aaaatttattgctaa

SEQ ID NO: 257079 - DNA, 15 bp, Homo sapiens
taaaatttattgcta

SEQ ID NO: 257080 - DNA, 15 bp, Homo sapiens
ttaaaatttattgct

SEQ ID NO: 257081 - DNA, 15 bp, Homo sapiens
cttaaaatttattgc

SEQ ID NO: 257082 - DNA, 15 bp, Homo sapiens
gcttaaaatttattg

SEQ ID NO: 257083 - DNA, 15 bp, Homo sapiens
agcttaaaatttatt

SEQ ID NO: 257084 - DNA, 15 bp, Homo sapiens
cagcttaaaatttat

SEQ ID NO: 257085 - DNA, 15 bp, Homo sapiens
ccagcttaaaattta

SEQ ID NO: 257086 - DNA, 15 bp, Homo sapiens
gccagcttaaaattt

SEQ ID NO: 257087 - DNA, 15 bp, Homo sapiens
agccagcttaaaatt

SEQ ID NO: 257088 - DNA, 15 bp, Homo sapiens
cagccagcttaaaat

SEQ ID NO: 257089 - DNA, 15 bp, Homo sapiens
gcagccagcttaaaa

SEQ ID NO: 257090 - DNA, 15 bp, Homo sapiens
tgcagccagcttaaa

SEQ ID NO: 257091 - DNA, 15 bp, Homo sapiens
gtgcagccagcttaa

SEQ ID NO: 257092 - DNA, 15 bp, Homo sapiens
cgtgcagccagctta

SEQ ID NO: 257093 - DNA, 15 bp, Homo sapiens
tcgtgcagccagctt

SEQ ID NO: 257094 - DNA, 15 bp, Homo sapiens
ttcgtgcagccagct

SEQ ID NO: 257095 - DNA, 15 bp, Homo sapiens
cttcgtgcagccagc

SEQ ID NO: 257096 - DNA, 15 bp, Homo sapiens
tcttcgtgcagccag

SEQ ID NO: 257097 - DNA, 15 bp, Homo sapiens
ttcttcgtgcagcca

SEQ ID NO: 257098 - DNA, 15 bp, Homo sapiens
attcttcgtgcagcc

SEQ ID NO: 257099 - DNA, 15 bp, Homo sapiens
aattcttcgtgcagc

SEQ ID NO: 257100 - DNA, 15 bp, Homo sapiens
caattcttcgtgcag

SEQ ID NO: 257101 - DNA, 15 bp, Homo sapiens
tcaattcttcgtgca

SEQ ID NO: 257102 - DNA, 15 bp, Homo sapiens
ctcaattcttcgtgc

SEQ ID NO: 257103 - DNA, 15 bp, Homo sapiens
cctcaattcttcgtg

SEQ ID NO: 257104 - DNA, 15 bp, Homo sapiens
tcctcaattcttcgt

SEQ ID NO: 257105 - DNA, 15 bp, Homo sapiens
ttcctcaattcttcg

SEQ ID NO: 257106 - DNA, 15 bp, Homo sapiens
tttcctcaattcttc

SEQ ID NO: 257107 - DNA, 15 bp, Homo sapiens
ctttcctcaattctt

SEQ ID NO: 257108 - DNA, 15 bp, Homo sapiens
tctttcctcaattct

SEQ ID NO: 257109 - DNA, 15 bp, Homo sapiens
ctctttcctcaattc

SEQ ID NO: 257110 - DNA, 15 bp, Homo sapiens
tctctttcctcaatt

SEQ ID NO: 257111 - DNA, 15 bp, Homo sapiens
ctctctttcctcaat

SEQ ID NO: 257112 - DNA, 15 bp, Homo sapiens
cctctctttcctcaa

SEQ ID NO: 257113 - DNA, 15 bp, Homo sapiens
acctctctttcctca

SEQ ID NO: 257114 - DNA, 15 bp, Homo sapiens
tacctctctttcctc

SEQ ID NO: 257115 - DNA, 15 bp, Homo sapiens
atacctctctttcct

SEQ ID NO: 257116 - DNA, 15 bp, Homo sapiens
tatacctctctttcc

SEQ ID NO: 257117 - DNA, 15 bp, Homo sapiens
ttatacctctctttc

SEQ ID NO: 257118 - DNA, 15 bp, Homo sapiens
attatacctctcttt

SEQ ID NO: 257119 - DNA, 15 bp, Homo sapiens
cattatacctctctt

SEQ ID NO: 257120 - DNA, 15 bp, Homo sapiens
acattatacctctct

SEQ ID NO: 257121 - DNA, 15 bp, Homo sapiens
gacattatacctctc

SEQ ID NO: 257122 - DNA, 15 bp, Homo sapiens
tgacattatacctct

SEQ ID NO: 257123 - DNA, 15 bp, Homo sapiens
atgacattatacctc

SEQ ID NO: 257124 - DNA, 15 bp, Homo sapiens
aatgacattatacct

SEQ ID NO: 257125 - DNA, 15 bp, Homo sapiens
caatgacattatacc

SEQ ID NO: 257126 - DNA, 15 bp, Homo sapiens
tcaatgacattatac

SEQ ID NO: 257127 - DNA, 15 bp, Homo sapiens
ctcaatgacattata

SEQ ID NO: 257128 - DNA, 15 bp, Homo sapiens
tctcaatgacattat

SEQ ID NO: 257129 - DNA, 15 bp, Homo sapiens
ttctcaatgacatta

SEQ ID NO: 257130 - DNA, 15 bp, Homo sapiens
tttctcaatgacatt

SEQ ID NO: 257131 - DNA, 15 bp, Homo sapiens
ttttctcaatgacat

SEQ ID NO: 257132 - DNA, 15 bp, Homo sapiens
tttttctcaatgaca

SEQ ID NO: 257133 - DNA, 15 bp, Homo sapiens
ttttttctcaatgac

SEQ ID NO: 257134 - DNA, 15 bp, Homo sapiens
attttttctcaatga

SEQ ID NO: 257135 - DNA, 15 bp, Homo sapiens
tattttttctcaatg

SEQ ID NO: 257136 - DNA, 15 bp, Homo sapiens
ctattttttctcaat

SEQ ID NO: 257137 - DNA, 15 bp, Homo sapiens
gctattttttctcaa

SEQ ID NO: 257138 - DNA, 15 bp, Homo sapiens
tgctattttttctca

SEQ ID NO: 257139 - DNA, 15 bp, Homo sapiens
ttgctattttttctc

SEQ ID NO: 257140 - DNA, 15 bp, Homo sapiens
attgctattttttct

SEQ ID NO: 257141 - DNA, 15 bp, Homo sapiens
cattgctattttttc

SEQ ID NO: 257142 - DNA, 15 bp, Homo sapiens
gcattgctatttttt

SEQ ID NO: 257143 - DNA, 15 bp, Homo sapiens
tgcattgctattttt

SEQ ID NO: 257144 - DNA, 15 bp, Homo sapiens
ttgcattgctatttt

SEQ ID NO: 257145 - DNA, 15 bp, Homo sapiens
tttgcattgctattt

SEQ ID NO: 257146 - DNA, 15 bp, Homo sapiens
ctttgcattgctatt

SEQ ID NO: 257147 - DNA, 15 bp, Homo sapiens
gctttgcattgctat

SEQ ID NO: 257148 - DNA, 15 bp, Homo sapiens
agctttgcattgcta

SEQ ID NO: 257149 - DNA, 15 bp, Homo sapiens
aagctttgcattgct

SEQ ID NO: 257150 - DNA, 15 bp, Homo sapiens
caagctttgcattgc

SEQ ID NO: 257151 - DNA, 15 bp, Homo sapiens
tcaagctttgcattg

SEQ ID NO: 257152 - DNA, 15 bp, Homo sapiens
ttcaagctttgcatt

SEQ ID NO: 257153 - DNA, 15 bp, Homo sapiens
tttcaagctttgcat

SEQ ID NO: 257154 - DNA, 15 bp, Homo sapiens
ttttcaagctttgca

SEQ ID NO: 257155 - DNA, 15 bp, Homo sapiens
attttcaagctttgc

SEQ ID NO: 257156 - DNA, 15 bp, Homo sapiens
tattttcaagctttg

SEQ ID NO: 257157 - DNA, 15 bp, Homo sapiens
ctattttcaagcttt

SEQ ID NO: 257158 - DNA, 15 bp, Homo sapiens
cctattttcaagctt

SEQ ID NO: 257159 - DNA, 15 bp, Homo sapiens
tcctattttcaagct

SEQ ID NO: 257160 - DNA, 15 bp, Homo sapiens
ttcctattttcaagc

SEQ ID NO: 257161 - DNA, 15 bp, Homo sapiens
tttcctattttcaag

SEQ ID NO: 257162 - DNA, 15 bp, Homo sapiens
ttttcctattttcaa

SEQ ID NO: 257163 - DNA, 15 bp, Homo sapiens
cttttcctattttca

SEQ ID NO: 257164 - DNA, 15 bp, Homo sapiens
gcttttcctattttc

SEQ ID NO: 257165 - DNA, 15 bp, Homo sapiens
agcttttcctatttt

SEQ ID NO: 257166 - DNA, 15 bp, Homo sapiens
aagcttttcctattt

SEQ ID NO: 257167 - DNA, 15 bp, Homo sapiens
taagcttttcctatt

SEQ ID NO: 257168 - DNA, 15 bp, Homo sapiens
ttaagcttttcctat

SEQ ID NO: 257169 - DNA, 15 bp, Homo sapiens
cttaagcttttccta

SEQ ID NO: 257170 - DNA, 15 bp, Homo sapiens
gcttaagcttttcct

SEQ ID NO: 257171 - DNA, 15 bp, Homo sapiens
agcttaagcttttcc

SEQ ID NO: 257172 - DNA, 15 bp, Homo sapiens
tagcttaagcttttc

SEQ ID NO: 257173 - DNA, 15 bp, Homo sapiens
atagcttaagctttt

SEQ ID NO: 257174 - DNA, 15 bp, Homo sapiens
catagcttaagcttt

SEQ ID NO: 257175 - DNA, 15 bp, Homo sapiens
acatagcttaagctt

SEQ ID NO: 257176 - DNA, 15 bp, Homo sapiens
tacatagcttaagct

SEQ ID NO: 257177 - DNA, 15 bp, Homo sapiens
atacatagcttaagc

SEQ ID NO: 257178 - DNA, 15 bp, Homo sapiens
catacatagcttaag

SEQ ID NO: 257179 - DNA, 15 bp, Homo sapiens
ccatacatagcttaa

SEQ ID NO: 257180 - DNA, 15 bp, Homo sapiens
tccatacatagctta

SEQ ID NO: 257181 - DNA, 15 bp, Homo sapiens
ttccatacatagctt

SEQ ID NO: 257182 - DNA, 15 bp, Homo sapiens
cttccatacatagct

SEQ ID NO: 257183 - DNA, 15 bp, Homo sapiens
tcttccatacatagc

SEQ ID NO: 257184 - DNA, 15 bp, Homo sapiens
ctcttccatacatag

SEQ ID NO: 257185 - DNA, 15 bp, Homo sapiens
tctcttccatacata

SEQ ID NO: 257186 - DNA, 15 bp, Homo sapiens
ttctcttccatacat

SEQ ID NO: 257187 - DNA, 15 bp, Homo sapiens
cttctcttccataca

SEQ ID NO: 257188 - DNA, 15 bp, Homo sapiens
acttctcttccatac

SEQ ID NO: 257189 - DNA, 15 bp, Homo sapiens
gacttctcttccata

SEQ ID NO: 257190 - DNA, 15 bp, Homo sapiens
agacttctcttccat

SEQ ID NO: 257191 - DNA, 15 bp, Homo sapiens
tagacttctcttcca

SEQ ID NO: 257192 - DNA, 15 bp, Homo sapiens
gtagacttctcttcc

SEQ ID NO: 257193 - DNA, 15 bp, Homo sapiens
tgtagacttctcttc

SEQ ID NO: 257194 - DNA, 15 bp, Homo sapiens
ctgtagacttctctt

SEQ ID NO: 257195 - DNA, 15 bp, Homo sapiens
cctgtagacttctct

SEQ ID NO: 257196 - DNA, 15 bp, Homo sapiens
ccctgtagacttctc

SEQ ID NO: 257197 - DNA, 15 bp, Homo sapiens
gccctgtagacttct

SEQ ID NO: 257198 - DNA, 15 bp, Homo sapiens
agccctgtagacttc

SEQ ID NO: 257199 - DNA, 15 bp, Homo sapiens
cagccctgtagactt

SEQ ID NO: 257200 - DNA, 15 bp, Homo sapiens
tcagccctgtagact

SEQ ID NO: 257201 - DNA, 15 bp, Homo sapiens
ttcagccctgtagac

SEQ ID NO: 257202 - DNA, 15 bp, Homo sapiens
tttcagccctgtaga

SEQ ID NO: 257203 - DNA, 15 bp, Homo sapiens
ctttcagccctgtag

SEQ ID NO: 257204 - DNA, 15 bp, Homo sapiens
tctttcagccctgta

SEQ ID NO: 257205 - DNA, 15 bp, Homo sapiens
gtctttcagccctgt

SEQ ID NO: 257206 - DNA, 15 bp, Homo sapiens
tgtctttcagccctg

SEQ ID NO: 257207 - DNA, 15 bp, Homo sapiens
gtgtctttcagccct

SEQ ID NO: 257208 - DNA, 15 bp, Homo sapiens
ggtgtctttcagccc

SEQ ID NO: 257209 - DNA, 15 bp, Homo sapiens
aggtgtctttcagcc

SEQ ID NO: 257210 - DNA, 15 bp, Homo sapiens
gaggtgtctttcagc

SEQ ID NO: 257211 - DNA, 15 bp, Homo sapiens
ggaggtgtctttcag

SEQ ID NO: 257212 - DNA, 15 bp, Homo sapiens
tggaggtgtctttca

SEQ ID NO: 257213 - DNA, 15 bp, Homo sapiens
ctggaggtgtctttc

SEQ ID NO: 257214 - DNA, 15 bp, Homo sapiens
tctggaggtgtcttt

SEQ ID NO: 257215 - DNA, 15 bp, Homo sapiens
atctggaggtgtctt

SEQ ID NO: 257216 - DNA, 15 bp, Homo sapiens
catctggaggtgtct

SEQ ID NO: 257217 - DNA, 15 bp, Homo sapiens
tcatctggaggtgtc

SEQ ID NO: 257218 - DNA, 15 bp, Homo sapiens
ctcatctggaggtgt

SEQ ID NO: 257219 - DNA, 15 bp, Homo sapiens
cctcatctggaggtg

SEQ ID NO: 257220 - DNA, 15 bp, Homo sapiens
gcctcatctggaggt

SEQ ID NO: 257221 - DNA, 15 bp, Homo sapiens
tgcctcatctggagg

SEQ ID NO: 257222 - DNA, 15 bp, Homo sapiens
ttgcctcatctggag

SEQ ID NO: 257223 - DNA, 15 bp, Homo sapiens
attgcctcatctgga

SEQ ID NO: 257224 - DNA, 15 bp, Homo sapiens
cattgcctcatctgg

SEQ ID NO: 257225 - DNA, 15 bp, Homo sapiens
gcattgcctcatctg

SEQ ID NO: 257226 - DNA, 15 bp, Homo sapiens
tgcattgcctcatct

SEQ ID NO: 257227 - DNA, 15 bp, Homo sapiens
ttgcattgcctcatc

SEQ ID NO: 257228 - DNA, 15 bp, Homo sapiens
cttgcattgcctcat

SEQ ID NO: 257229 - DNA, 15 bp, Homo sapiens
ccttgcattgcctca

SEQ ID NO: 257230 - DNA, 15 bp, Homo sapiens
tccttgcattgcctc

SEQ ID NO: 257231 - DNA, 15 bp, Homo sapiens
ttccttgcattgcct

SEQ ID NO: 257232 - DNA, 15 bp, Homo sapiens
cttccttgcattgcc

SEQ ID NO: 257233 - DNA, 15 bp, Homo sapiens
tcttccttgcattgc

SEQ ID NO: 257234 - DNA, 15 bp, Homo sapiens
ttcttccttgcattg

SEQ ID NO: 257235 - DNA, 15 bp, Homo sapiens
attcttccttgcatt

SEQ ID NO: 257236 - DNA, 15 bp, Homo sapiens
cattcttccttgcat

SEQ ID NO: 257237 - DNA, 15 bp, Homo sapiens
tcattcttccttgca

SEQ ID NO: 257238 - DNA, 15 bp, Homo sapiens
ctcattcttccttgc

SEQ ID NO: 257239 - DNA, 15 bp, Homo sapiens
tctcattcttccttg

SEQ ID NO: 257240 - DNA, 15 bp, Homo sapiens
atctcattcttcctt

SEQ ID NO: 257241 - DNA, 15 bp, Homo sapiens
catctcattcttcct

SEQ ID NO: 257242 - DNA, 15 bp, Homo sapiens
tcatctcattcttcc

SEQ ID NO: 257243 - DNA, 15 bp, Homo sapiens
gtcatctcattcttc

SEQ ID NO: 257244 - DNA, 15 bp, Homo sapiens
ggtcatctcattctt

SEQ ID NO: 257245 - DNA, 15 bp, Homo sapiens
aggtcatctcattct

SEQ ID NO: 257246 - DNA, 15 bp, Homo sapiens
aaggtcatctcattc

SEQ ID NO: 257247 - DNA, 15 bp, Homo sapiens
caaggtcatctcatt

SEQ ID NO: 257248 - DNA, 15 bp, Homo sapiens
tcaaggtcatctcat

SEQ ID NO: 257249 - DNA, 15 bp, Homo sapiens
gtcaaggtcatctca

SEQ ID NO: 257250 - DNA, 15 bp, Homo sapiens
agtcaaggtcatctc

SEQ ID NO: 257251 - DNA, 15 bp, Homo sapiens
aagtcaaggtcatct

SEQ ID NO: 257252 - DNA, 15 bp, Homo sapiens
aaagtcaaggtcatc

SEQ ID NO: 257253 - DNA, 15 bp, Homo sapiens
aaaagtcaaggtcat

SEQ ID NO: 257254 - DNA, 15 bp, Homo sapiens
caaaagtcaaggtca

SEQ ID NO: 257255 - DNA, 15 bp, Homo sapiens
gcaaaagtcaaggtc

SEQ ID NO: 257256 - DNA, 15 bp, Homo sapiens
tgcaaaagtcaaggt

SEQ ID NO: 257257 - DNA, 15 bp, Homo sapiens
atgcaaaagtcaagg

SEQ ID NO: 257258 - DNA, 15 bp, Homo sapiens
tatgcaaaagtcaag

SEQ ID NO: 257259 - DNA, 15 bp, Homo sapiens
ttatgcaaaagtcaa

SEQ ID NO: 257260 - DNA, 15 bp, Homo sapiens
attatgcaaaagtca

SEQ ID NO: 257261 - DNA, 15 bp, Homo sapiens
gattatgcaaaagtc

SEQ ID NO: 257262 - DNA, 15 bp, Homo sapiens
ggattatgcaaaagt

SEQ ID NO: 257263 - DNA, 15 bp, Homo sapiens
tggattatgcaaaag

SEQ ID NO: 257264 - DNA, 15 bp, Homo sapiens
gtggattatgcaaaa

SEQ ID NO: 257265 - DNA, 15 bp, Homo sapiens
tgtggattatgcaaa

SEQ ID NO: 257266 - DNA, 15 bp, Homo sapiens
ctgtggattatgcaa

SEQ ID NO: 257267 - DNA, 15 bp, Homo sapiens
tctgtggattatgca

SEQ ID NO: 257268 - DNA, 15 bp, Homo sapiens
ctctgtggattatgc

SEQ ID NO: 257269 - DNA, 15 bp, Homo sapiens
gctctgtggattatg

SEQ ID NO: 257270 - DNA, 15 bp, Homo sapiens
ggctctgtggattat

SEQ ID NO: 257271 - DNA, 15 bp, Homo sapiens
aggctctgtggatta

SEQ ID NO: 257272 - DNA, 15 bp, Homo sapiens
gaggctctgtggatt

SEQ ID NO: 257273 - DNA, 15 bp, Homo sapiens
tgaggctctgtggat

SEQ ID NO: 257274 - DNA, 15 bp, Homo sapiens
ttgaggctctgtgga

SEQ ID NO: 257275 - DNA, 15 bp, Homo sapiens
tttgaggctctgtgg

SEQ ID NO: 257276 - DNA, 15 bp, Homo sapiens
ctttgaggctctgtg

SEQ ID NO: 257277 - DNA, 15 bp, Homo sapiens
tctttgaggctctgt

SEQ ID NO: 257278 - DNA, 15 bp, Homo sapiens
atctttgaggctctg

SEQ ID NO: 257279 - DNA, 15 bp, Homo sapiens
tatctttgaggctct

SEQ ID NO: 257280 - DNA, 15 bp, Homo sapiens
ttatctttgaggctc

SEQ ID NO: 257281 - DNA, 15 bp, Homo sapiens
attatctttgaggct

SEQ ID NO: 257282 - DNA, 15 bp, Homo sapiens
aattatctttgaggc

SEQ ID NO: 257283 - DNA, 15 bp, Homo sapiens
taattatctttgagg

SEQ ID NO: 257284 - DNA, 15 bp, Homo sapiens
ctaattatctttgag

SEQ ID NO: 257285 - DNA, 15 bp, Homo sapiens
gctaattatctttga

SEQ ID NO: 257286 - DNA, 15 bp, Homo sapiens
tgctaattatctttg

SEQ ID NO: 257287 - DNA, 15 bp, Homo sapiens
ctgctaattatcttt

SEQ ID NO: 257288 - DNA, 15 bp, Homo sapiens
cctgctaattatctt

SEQ ID NO: 257289 - DNA, 15 bp, Homo sapiens
acctgctaattatct

SEQ ID NO: 257290 - DNA, 15 bp, Homo sapiens
cacctgctaattatc

SEQ ID NO: 257291 - DNA, 15 bp, Homo sapiens
ccacctgctaattat

SEQ ID NO: 257292 - DNA, 15 bp, Homo sapiens
accacctgctaatta

SEQ ID NO: 257293 - DNA, 15 bp, Homo sapiens
taccacctgctaatt

SEQ ID NO: 257294 - DNA, 15 bp, Homo sapiens
ctaccacctgctaat

SEQ ID NO: 257295 - DNA, 15 bp, Homo sapiens
actaccacctgctaa

SEQ ID NO: 257296 - DNA, 15 bp, Homo sapiens
tactaccacctgcta

SEQ ID NO: 257297 - DNA, 15 bp, Homo sapiens
ctactaccacctgct

SEQ ID NO: 257298 - DNA, 15 bp, Homo sapiens
actactaccacctgc

SEQ ID NO: 257299 - DNA, 15 bp, Homo sapiens
aactactaccacctg

SEQ ID NO: 257300 - DNA, 15 bp, Homo sapiens
caactactaccacct

SEQ ID NO: 257301 - DNA, 15 bp, Homo sapiens
gcaactactaccacc

SEQ ID NO: 257302 - DNA, 15 bp, Homo sapiens
tgcaactactaccac

SEQ ID NO: 257303 - DNA, 15 bp, Homo sapiens
ctgcaactactacca

SEQ ID NO: 257304 - DNA, 15 bp, Homo sapiens
gctgcaactactacc

SEQ ID NO: 257305 - DNA, 15 bp, Homo sapiens
tgctgcaactactac

SEQ ID NO: 257306 - DNA, 15 bp, Homo sapiens
ttgctgcaactacta

SEQ ID NO: 257307 - DNA, 15 bp, Homo sapiens
cttgctgcaactact

SEQ ID NO: 257308 - DNA, 15 bp, Homo sapiens
acttgctgcaactac

SEQ ID NO: 257309 - DNA, 15 bp, Homo sapiens
cacttgctgcaacta

SEQ ID NO: 257310 - DNA, 15 bp, Homo sapiens
acacttgctgcaact

SEQ ID NO: 257311 - DNA, 15 bp, Homo sapiens
aacacttgctgcaac

SEQ ID NO: 257312 - DNA, 15 bp, Homo sapiens
caacacttgctgcaa

SEQ ID NO: 257313 - DNA, 15 bp, Homo sapiens
gcaacacttgctgca

SEQ ID NO: 257314 - DNA, 15 bp, Homo sapiens
tgcaacacttgctgc

SEQ ID NO: 257315 - DNA, 15 bp, Homo sapiens
ctgcaacacttgctg

SEQ ID NO: 257316 - DNA, 15 bp, Homo sapiens
tctgcaacacttgct

SEQ ID NO: 257317 - DNA, 15 bp, Homo sapiens
ttctgcaacacttgc

SEQ ID NO: 257318 - DNA, 15 bp, Homo sapiens
attctgcaacacttg

SEQ ID NO: 257319 - DNA, 15 bp, Homo sapiens
aattctgcaacactt

SEQ ID NO: 257320 - DNA, 15 bp, Homo sapiens
taattctgcaacact

SEQ ID NO: 257321 - DNA, 15 bp, Homo sapiens
gtaattctgcaacac

SEQ ID NO: 257322 - DNA, 15 bp, Homo sapiens
ggtaattctgcaaca

SEQ ID NO: 257323 - DNA, 15 bp, Homo sapiens
gggtaattctgcaac

SEQ ID NO: 257324 - DNA, 15 bp, Homo sapiens
cgggtaattctgcaa

SEQ ID NO: 257325 - DNA, 15 bp, Homo sapiens
ccgggtaattctgca

SEQ ID NO: 257326 - DNA, 15 bp, Homo sapiens
tccgggtaattctgc

SEQ ID NO: 257327 - DNA, 15 bp, Homo sapiens
gtccgggtaattctg

SEQ ID NO: 257328 - DNA, 15 bp, Homo sapiens
tgtccgggtaattct

SEQ ID NO: 257329 - DNA, 15 bp, Homo sapiens
ttgtccgggtaattc

SEQ ID NO: 257330 - DNA, 15 bp, Homo sapiens
tttgtccgggtaatt

SEQ ID NO: 257331 - DNA, 15 bp, Homo sapiens
ctttgtccgggtaat

SEQ ID NO: 257332 - DNA, 15 bp, Homo sapiens
tctttgtccgggtaa

SEQ ID NO: 257333 - DNA, 15 bp, Homo sapiens
ttctttgtccgggta

SEQ ID NO: 257334 - DNA, 15 bp, Homo sapiens
tttctttgtccgggt

SEQ ID NO: 257335 - DNA, 15 bp, Homo sapiens
ttttctttgtccggg

SEQ ID NO: 257336 - DNA, 15 bp, Homo sapiens
cttttctttgtccgg

SEQ ID NO: 257337 - DNA, 15 bp, Homo sapiens
tcttttctttgtccg

SEQ ID NO: 257338 - DNA, 15 bp, Homo sapiens
ttcttttctttgtcc

SEQ ID NO: 257339 - DNA, 15 bp, Homo sapiens
tttcttttctttgtc

SEQ ID NO: 257340 - DNA, 15 bp, Homo sapiens
ctttcttttctttgt

SEQ ID NO: 257341 - DNA, 15 bp, Homo sapiens
gctttcttttctttg

SEQ ID NO: 257342 - DNA, 15 bp, Homo sapiens
ggctttcttttcttt

SEQ ID NO: 257343 - DNA, 15 bp, Homo sapiens
tggctttcttttctt

SEQ ID NO: 257344 - DNA, 15 bp, Homo sapiens
gtggctttcttttct

SEQ ID NO: 257345 - DNA, 15 bp, Homo sapiens
ggtggctttcttttc

SEQ ID NO: 257346 - DNA, 15 bp, Homo sapiens
tggtggctttctttt

SEQ ID NO: 257347 - DNA, 15 bp, Homo sapiens
gtggtggctttcttt

SEQ ID NO: 257348 - DNA, 15 bp, Homo sapiens
cgtggtggctttctt

SEQ ID NO: 257349 - DNA, 15 bp, Homo sapiens
gcgtggtggctttct

SEQ ID NO: 257350 - DNA, 15 bp, Homo sapiens
agcgtggtggctttc

SEQ ID NO: 257351 - DNA, 15 bp, Homo sapiens
gagcgtggtggcttt

SEQ ID NO: 257352 - DNA, 15 bp, Homo sapiens
agagcgtggtggctt

SEQ ID NO: 257353 - DNA, 15 bp, Homo sapiens
cagagcgtggtggct

SEQ ID NO: 257354 - DNA, 15 bp, Homo sapiens
ccagagcgtggtggc

SEQ ID NO: 257355 - DNA, 15 bp, Homo sapiens
gccagagcgtggtgg

SEQ ID NO: 257356 - DNA, 15 bp, Homo sapiens
agccagagcgtggtg

SEQ ID NO: 257357 - DNA, 15 bp, Homo sapiens
tagccagagcgtggt

SEQ ID NO: 257358 - DNA, 15 bp, Homo sapiens
gtagccagagcgtgg

SEQ ID NO: 257359 - DNA, 15 bp, Homo sapiens
agtagccagagcgtg

SEQ ID NO: 257360 - DNA, 15 bp, Homo sapiens
cagtagccagagcgt

SEQ ID NO: 257361 - DNA, 15 bp, Homo sapiens
tcagtagccagagcg

SEQ ID NO: 257362 - DNA, 15 bp, Homo sapiens
atcagtagccagagc

SEQ ID NO: 257363 - DNA, 15 bp, Homo sapiens
gatcagtagccagag

SEQ ID NO: 257364 - DNA, 15 bp, Homo sapiens
tgatcagtagccaga

SEQ ID NO: 257365 - DNA, 15 bp, Homo sapiens
ctgatcagtagccag

SEQ ID NO: 257366 - DNA, 15 bp, Homo sapiens
actgatcagtagcca

SEQ ID NO: 257367 - DNA, 15 bp, Homo sapiens
tactgatcagtagcc

SEQ ID NO: 257368 - DNA, 15 bp, Homo sapiens
atactgatcagtagc

SEQ ID NO: 257369 - DNA, 15 bp, Homo sapiens
catactgatcagtag

SEQ ID NO: 257370 - DNA, 15 bp, Homo sapiens
acatactgatcagta

SEQ ID NO: 257371 - DNA, 15 bp, Homo sapiens
aacatactgatcagt

SEQ ID NO: 257372 - DNA, 15 bp, Homo sapiens
caacatactgatcag

SEQ ID NO: 257373 - DNA, 15 bp, Homo sapiens
tcaacatactgatca

SEQ ID NO: 257374 - DNA, 15 bp, Homo sapiens
ctcaacatactgatc

SEQ ID NO: 257375 - DNA, 15 bp, Homo sapiens
gctcaacatactgat

SEQ ID NO: 257376 - DNA, 15 bp, Homo sapiens
cgctcaacatactga

SEQ ID NO: 257377 - DNA, 15 bp, Homo sapiens
tcgctcaacatactg

SEQ ID NO: 257378 - DNA, 15 bp, Homo sapiens
ttcgctcaacatact

SEQ ID NO: 257379 - DNA, 15 bp, Homo sapiens
tttcgctcaacatac

SEQ ID NO: 257380 - DNA, 15 bp, Homo sapiens
ttttcgctcaacata

SEQ ID NO: 257381 - DNA, 15 bp, Homo sapiens
cttttcgctcaacat

SEQ ID NO: 257382 - DNA, 15 bp, Homo sapiens
tcttttcgctcaaca

SEQ ID NO: 257383 - DNA, 15 bp, Homo sapiens
ctcttttcgctcaac

SEQ ID NO: 257384 - DNA, 15 bp, Homo sapiens
tctcttttcgctcaa

SEQ ID NO: 257385 - DNA, 15 bp, Homo sapiens
ttctcttttcgctca

SEQ ID NO: 257386 - DNA, 15 bp, Homo sapiens
attctcttttcgctc

SEQ ID NO: 257387 - DNA, 15 bp, Homo sapiens
tattctcttttcgct

SEQ ID NO: 257388 - DNA, 15 bp, Homo sapiens
ctattctcttttcgc

SEQ ID NO: 257389 - DNA, 15 bp, Homo sapiens
cctattctcttttcg

SEQ ID NO: 257390 - DNA, 15 bp, Homo sapiens
tcctattctcttttc

SEQ ID NO: 257391 - DNA, 15 bp, Homo sapiens
ttcctattctctttt

SEQ ID NO: 257392 - DNA, 15 bp, Homo sapiens
cttcctattctcttt

SEQ ID NO: 257393 - DNA, 15 bp, Homo sapiens
acttcctattctctt

SEQ ID NO: 257394 - DNA, 15 bp, Homo sapiens
tacttcctattctct

SEQ ID NO: 257395 - DNA, 15 bp, Homo sapiens
ttacttcctattctc

SEQ ID NO: 257396 - DNA, 15 bp, Homo sapiens
tttacttcctattct

SEQ ID NO: 257397 - DNA, 15 bp, Homo sapiens
atttacttcctattc

SEQ ID NO: 257398 - DNA, 15 bp, Homo sapiens
aatttacttcctatt

SEQ ID NO: 257399 - DNA, 15 bp, Homo sapiens
taatttacttcctat

SEQ ID NO: 257400 - DNA, 15 bp, Homo sapiens
gtaatttacttccta

SEQ ID NO: 257401 - DNA, 15 bp, Homo sapiens
cgtaatttacttcct

SEQ ID NO: 257402 - DNA, 15 bp, Homo sapiens
tcgtaatttacttcc

SEQ ID NO: 257403 - DNA, 15 bp, Homo sapiens
ttcgtaatttacttc

SEQ ID NO: 257404 - DNA, 15 bp, Homo sapiens
gttcgtaatttactt

SEQ ID NO: 257405 - DNA, 15 bp, Homo sapiens
tgttcgtaatttact

SEQ ID NO: 257406 - DNA, 15 bp, Homo sapiens
gtgttcgtaatttac

SEQ ID NO: 257407 - DNA, 15 bp, Homo sapiens
tgtgttcgtaattta

SEQ ID NO: 257408 - DNA, 15 bp, Homo sapiens
gtgtgttcgtaattt

SEQ ID NO: 257409 - DNA, 15 bp, Homo sapiens
tgtgtgttcgtaatt

SEQ ID NO: 257410 - DNA, 15 bp, Homo sapiens
ttgtgtgttcgtaat

SEQ ID NO: 257411 - DNA, 15 bp, Homo sapiens
tttgtgtgttcgtaa

SEQ ID NO: 257412 - DNA, 15 bp, Homo sapiens
ttttgtgtgttcgta

SEQ ID NO: 257413 - DNA, 15 bp, Homo sapiens
cttttgtgtgttcgt

SEQ ID NO: 257414 - DNA, 15 bp, Homo sapiens
ccttttgtgtgttcg

SEQ ID NO: 257415 - DNA, 15 bp, Homo sapiens
cccttttgtgtgttc

SEQ ID NO: 257416 - DNA, 15 bp, Homo sapiens
tcccttttgtgtgtt

SEQ ID NO: 257417 - DNA, 15 bp, Homo sapiens
atcccttttgtgtgt

SEQ ID NO: 257418 - DNA, 15 bp, Homo sapiens
catcccttttgtgtg

SEQ ID NO: 257419 - DNA, 15 bp, Homo sapiens
acatcccttttgtgt

SEQ ID NO: 257420 - DNA, 15 bp, Homo sapiens
aacatcccttttgtg

SEQ ID NO: 257421 - DNA, 15 bp, Homo sapiens
aaacatcccttttgt

SEQ ID NO: 257422 - DNA, 15 bp, Homo sapiens
caaacatcccttttg

SEQ ID NO: 257423 - DNA, 15 bp, Homo sapiens
ccaaacatccctttt

SEQ ID NO: 257424 - DNA, 15 bp, Homo sapiens
accaaacatcccttt

SEQ ID NO: 257425 - DNA, 15 bp, Homo sapiens
gaccaaacatccctt

SEQ ID NO: 257426 - DNA, 15 bp, Homo sapiens
agaccaaacatccct

SEQ ID NO: 257427 - DNA, 15 bp, Homo sapiens
cagaccaaacatccc

SEQ ID NO: 257428 - DNA, 15 bp, Homo sapiens
gcagaccaaacatcc

SEQ ID NO: 257429 - DNA, 15 bp, Homo sapiens
cgcagaccaaacatc

SEQ ID NO: 257430 - DNA, 15 bp, Homo sapiens
gcgcagaccaaacat

SEQ ID NO: 257431 - DNA, 15 bp, Homo sapiens
tgcgcagaccaaaca

SEQ ID NO: 257432 - DNA, 15 bp, Homo sapiens
ctgcgcagaccaaac

SEQ ID NO: 257433 - DNA, 15 bp, Homo sapiens
cctgcgcagaccaaa

SEQ ID NO: 257434 - DNA, 15 bp, Homo sapiens
tcctgcgcagaccaa

SEQ ID NO: 257435 - DNA, 15 bp, Homo sapiens
ctcctgcgcagacca

SEQ ID NO: 257436 - DNA, 15 bp, Homo sapiens
actcctgcgcagacc

SEQ ID NO: 257437 - DNA, 15 bp, Homo sapiens
gactcctgcgcagac

SEQ ID NO: 257438 - DNA, 15 bp, Homo sapiens
ggactcctgcgcaga

SEQ ID NO: 257439 - DNA, 15 bp, Homo sapiens
tggactcctgcgcag

SEQ ID NO: 257440 - DNA, 15 bp, Homo sapiens
atggactcctgcgca

SEQ ID NO: 257441 - DNA, 15 bp, Homo sapiens
catggactcctgcgc

SEQ ID NO: 257442 - DNA, 15 bp, Homo sapiens
ccatggactcctgcg

SEQ ID NO: 257443 - DNA, 15 bp, Homo sapiens
accatggactcctgc

SEQ ID NO: 257444 - DNA, 15 bp, Homo sapiens
caccatggactcctg

SEQ ID NO: 257445 - DNA, 15 bp, Homo sapiens
tcaccatggactcct

SEQ ID NO: 257446 - DNA, 15 bp, Homo sapiens
gtcaccatggactcc

SEQ ID NO: 257447 - DNA, 15 bp, Homo sapiens
tgtcaccatggactc

SEQ ID NO: 257448 - DNA, 15 bp, Homo sapiens
ctgtcaccatggact

SEQ ID NO: 257449 - DNA, 15 bp, Homo sapiens
gctgtcaccatggac

SEQ ID NO: 257450 - DNA, 15 bp, Homo sapiens
tgctgtcaccatgga

SEQ ID NO: 257451 - DNA, 15 bp, Homo sapiens
ctgctgtcaccatgg

SEQ ID NO: 257452 - DNA, 15 bp, Homo sapiens
actgctgtcaccatg

SEQ ID NO: 257453 - DNA, 15 bp, Homo sapiens
aactgctgtcaccat

SEQ ID NO: 257454 - DNA, 15 bp, Homo sapiens
aaactgctgtcacca

SEQ ID NO: 257455 - DNA, 15 bp, Homo sapiens
aaaactgctgtcacc

SEQ ID NO: 257456 - DNA, 15 bp, Homo sapiens
caaaactgctgtcac

SEQ ID NO: 257457 - DNA, 15 bp, Homo sapiens
tcaaaactgctgtca

SEQ ID NO: 257458 - DNA, 15 bp, Homo sapiens
ttcaaaactgctgtc

SEQ ID NO: 257459 - DNA, 15 bp, Homo sapiens
tttcaaaactgctgt

SEQ ID NO: 257460 - DNA, 15 bp, Homo sapiens
ctttcaaaactgctg

SEQ ID NO: 257461 - DNA, 15 bp, Homo sapiens
tctttcaaaactgct

SEQ ID NO: 257462 - DNA, 15 bp, Homo sapiens
ctctttcaaaactgc

SEQ ID NO: 257463 - DNA, 15 bp, Homo sapiens
cctctttcaaaactg

SEQ ID NO: 257464 - DNA, 15 bp, Homo sapiens
gcctctttcaaaact

SEQ ID NO: 257465 - DNA, 15 bp, Homo sapiens
agcctctttcaaaac

SEQ ID NO: 257466 - DNA, 15 bp, Homo sapiens
gagcctctttcaaaa

SEQ ID NO: 257467 - DNA, 15 bp, Homo sapiens
tgagcctctttcaaa

SEQ ID NO: 257468 - DNA, 15 bp, Homo sapiens
ctgagcctctttcaa

SEQ ID NO: 257469 - DNA, 15 bp, Homo sapiens
gctgagcctctttca

SEQ ID NO: 257470 - DNA, 15 bp, Homo sapiens
agctgagcctctttc

SEQ ID NO: 257471 - DNA, 15 bp, Homo sapiens
cagctgagcctcttt

SEQ ID NO: 257472 - DNA, 15 bp, Homo sapiens
gcagctgagcctctt

SEQ ID NO: 257473 - DNA, 15 bp, Homo sapiens
tgcagctgagcctct

SEQ ID NO: 257474 - DNA, 15 bp, Homo sapiens
gtgcagctgagcctc

SEQ ID NO: 257475 - DNA, 15 bp, Homo sapiens
tgtgcagctgagcct

SEQ ID NO: 257476 - DNA, 15 bp, Homo sapiens
atgtgcagctgagcc

SEQ ID NO: 257477 - DNA, 15 bp, Homo sapiens
gatgtgcagctgagc

SEQ ID NO: 257478 - DNA, 15 bp, Homo sapiens
ggatgtgcagctgag

SEQ ID NO: 257479 - DNA, 15 bp, Homo sapiens
tggatgtgcagctga

SEQ ID NO: 257480 - DNA, 15 bp, Homo sapiens
ctggatgtgcagctg

SEQ ID NO: 257481 - DNA, 15 bp, Homo sapiens
cctggatgtgcagct

SEQ ID NO: 257482 - DNA, 15 bp, Homo sapiens
tcctggatgtgcagc

SEQ ID NO: 257483 - DNA, 15 bp, Homo sapiens
atcctggatgtgcag

SEQ ID NO: 257484 - DNA, 15 bp, Homo sapiens
gatcctggatgtgca

SEQ ID NO: 257485 - DNA, 15 bp, Homo sapiens
ggatcctggatgtgc

SEQ ID NO: 257486 - DNA, 15 bp, Homo sapiens
tggatcctggatgtg

SEQ ID NO: 257487 - DNA, 15 bp, Homo sapiens
ctggatcctggatgt

SEQ ID NO: 257488 - DNA, 15 bp, Homo sapiens
actggatcctggatg

SEQ ID NO: 257489 - DNA, 15 bp, Homo sapiens
aactggatcctggat

SEQ ID NO: 257490 - DNA, 15 bp, Homo sapiens
caactggatcctgga

SEQ ID NO: 257491 - DNA, 15 bp, Homo sapiens
tcaactggatcctgg

SEQ ID NO: 257492 - DNA, 15 bp, Homo sapiens
atcaactggatcctg

SEQ ID NO: 257493 - DNA, 15 bp, Homo sapiens
catcaactggatcct

SEQ ID NO: 257494 - DNA, 15 bp, Homo sapiens
ccatcaactggatcc

SEQ ID NO: 257495 - DNA, 15 bp, Homo sapiens
cccatcaactggatc

SEQ ID NO: 257496 - DNA, 15 bp, Homo sapiens
acccatcaactggat

SEQ ID NO: 257497 - DNA, 15 bp, Homo sapiens
gacccatcaactgga

SEQ ID NO: 257498 - DNA, 15 bp, Homo sapiens
agacccatcaactgg

SEQ ID NO: 257499 - DNA, 15 bp, Homo sapiens
cagacccatcaactg

SEQ ID NO: 257500 - DNA, 15 bp, Homo sapiens
ccagacccatcaact

SEQ ID NO: 257501 - DNA, 15 bp, Homo sapiens
tccagacccatcaac

SEQ ID NO: 257502 - DNA, 15 bp, Homo sapiens
ttccagacccatcaa

SEQ ID NO: 257503 - DNA, 15 bp, Homo sapiens
cttccagacccatca

SEQ ID NO: 257504 - DNA, 15 bp, Homo sapiens
acttccagacccatc

SEQ ID NO: 257505 - DNA, 15 bp, Homo sapiens
aacttccagacccat

SEQ ID NO: 257506 - DNA, 15 bp, Homo sapiens
gaacttccagaccca

SEQ ID NO: 257507 - DNA, 15 bp, Homo sapiens
agaacttccagaccc

SEQ ID NO: 257508 - DNA, 15 bp, Homo sapiens
aagaacttccagacc

SEQ ID NO: 257509 - DNA, 15 bp, Homo sapiens
gaagaacttccagac

SEQ ID NO: 257510 - DNA, 15 bp, Homo sapiens
agaagaacttccaga

SEQ ID NO: 257511 - DNA, 15 bp, Homo sapiens
gagaagaacttccag

SEQ ID NO: 257512 - DNA, 15 bp, Homo sapiens
tgagaagaacttcca

SEQ ID NO: 257513 - DNA, 15 bp, Homo sapiens
ctgagaagaacttcc

SEQ ID NO: 257514 - DNA, 15 bp, Homo sapiens
cctgagaagaacttc

SEQ ID NO: 257515 - DNA, 15 bp, Homo sapiens
gcctgagaagaactt

SEQ ID NO: 257516 - DNA, 15 bp, Homo sapiens
ggcctgagaagaact

SEQ ID NO: 257517 - DNA, 15 bp, Homo sapiens
aggcctgagaagaac

SEQ ID NO: 257518 - DNA, 15 bp, Homo sapiens
caggcctgagaagaa

SEQ ID NO: 257519 - DNA, 15 bp, Homo sapiens
tcaggcctgagaaga

SEQ ID NO: 257520 - DNA, 15 bp, Homo sapiens
atcaggcctgagaag

SEQ ID NO: 257521 - DNA, 15 bp, Homo sapiens
catcaggcctgagaa

SEQ ID NO: 257522 - DNA, 15 bp, Homo sapiens
tcatcaggcctgaga

SEQ ID NO: 257523 - DNA, 15 bp, Homo sapiens
ctcatcaggcctgag

SEQ ID NO: 257524 - DNA, 15 bp, Homo sapiens
gctcatcaggcctga

SEQ ID NO: 257525 - DNA, 15 bp, Homo sapiens
agctcatcaggcctg

SEQ ID NO: 257526 - DNA, 15 bp, Homo sapiens
tagctcatcaggcct

SEQ ID NO: 257527 - DNA, 15 bp, Homo sapiens
atagctcatcaggcc

SEQ ID NO: 257528 - DNA, 15 bp, Homo sapiens
tatagctcatcaggc

SEQ ID NO: 257529 - DNA, 15 bp, Homo sapiens
ttatagctcatcagg

SEQ ID NO: 257530 - DNA, 15 bp, Homo sapiens
tttatagctcatcag

SEQ ID NO: 257531 - DNA, 15 bp, Homo sapiens
ttttatagctcatca

SEQ ID NO: 257532 - DNA, 15 bp, Homo sapiens
attttatagctcatc

SEQ ID NO: 257533 - DNA, 15 bp, Homo sapiens
cattttatagctcat

SEQ ID NO: 257534 - DNA, 15 bp, Homo sapiens
tcattttatagctca

SEQ ID NO: 257535 - DNA, 15 bp, Homo sapiens
ctcattttatagctc

SEQ ID NO: 257536 - DNA, 15 bp, Homo sapiens
cctcattttatagct

SEQ ID NO: 257537 - DNA, 15 bp, Homo sapiens
tcctcattttatagc

SEQ ID NO: 257538 - DNA, 15 bp, Homo sapiens
gtcctcattttatag

SEQ ID NO: 257539 - DNA, 15 bp, Homo sapiens
tgtcctcattttata

SEQ ID NO: 257540 - DNA, 15 bp, Homo sapiens
catttgtcctcattt

SEQ ID NO: 257541 - DNA, 15 bp, Homo sapiens
tcatttgtcctcatt

SEQ ID NO: 257542 - DNA, 15 bp, Homo sapiens
gtcatttgtcctcat

SEQ ID NO: 257543 - DNA, 15 bp, Homo sapiens
agtcatttgtcctca

SEQ ID NO: 257544 - DNA, 15 bp, Homo sapiens
gagtcatttgtcctc

SEQ ID NO: 257545 - DNA, 15 bp, Homo sapiens
tgagtcatttgtcct

SEQ ID NO: 257546 - DNA, 15 bp, Homo sapiens
ctgagtcatttgtcc

SEQ ID NO: 257547 - DNA, 15 bp, Homo sapiens
gctgagtcatttgtc

SEQ ID NO: 257548 - DNA, 15 bp, Homo sapiens
ggctgagtcatttgt

SEQ ID NO: 257549 - DNA, 15 bp, Homo sapiens
tggctgagtcatttg

SEQ ID NO: 257550 - DNA, 15 bp, Homo sapiens
gtggctgagtcattt

SEQ ID NO: 257551 - DNA, 15 bp, Homo sapiens
tgtggctgagtcatt

SEQ ID NO: 257552 - DNA, 15 bp, Homo sapiens
ttgtggctgagtcat

SEQ ID NO: 257553 - DNA, 15 bp, Homo sapiens
tttgtggctgagtca

SEQ ID NO: 257554 - DNA, 15 bp, Homo sapiens
ttttgtggctgagtc

SEQ ID NO: 257555 - DNA, 15 bp, Homo sapiens
attttgtggctgagt

SEQ ID NO: 257556 - DNA, 15 bp, Homo sapiens
aattttgtggctgag

SEQ ID NO: 257557 - DNA, 15 bp, Homo sapiens
aaattttgtggctga

SEQ ID NO: 257558 - DNA, 15 bp, Homo sapiens
gaaattttgtggctg

SEQ ID NO: 257559 - DNA, 15 bp, Homo sapiens
ggaaattttgtggct

SEQ ID NO: 257560 - DNA, 15 bp, Homo sapiens
tggaaattttgtggc

SEQ ID NO: 257561 - DNA, 15 bp, Homo sapiens
atggaaattttgtgg

SEQ ID NO: 257562 - DNA, 15 bp, Homo sapiens
aatggaaattttgtg

SEQ ID NO: 257563 - DNA, 15 bp, Homo sapiens
caatggaaattttgt

SEQ ID NO: 257564 - DNA, 15 bp, Homo sapiens
tcaatggaaattttg

SEQ ID NO: 257565 - DNA, 15 bp, Homo sapiens
gtcaatggaaatttt

SEQ ID NO: 257566 - DNA, 15 bp, Homo sapiens
tgtcaatggaaattt

SEQ ID NO: 257567 - DNA, 15 bp, Homo sapiens
ctgtcaatggaaatt

SEQ ID NO: 257568 - DNA, 15 bp, Homo sapiens
tctgtcaatggaaat

SEQ ID NO: 257569 - DNA, 15 bp, Homo sapiens
ttctgtcaatggaaa

SEQ ID NO: 257570 - DNA, 15 bp, Homo sapiens
cttctgtcaatggaa

SEQ ID NO: 257571 - DNA, 15 bp, Homo sapiens
tcttctgtcaatgga

SEQ ID NO: 257572 - DNA, 15 bp, Homo sapiens
gtcttctgtcaatgg

SEQ ID NO: 257573 - DNA, 15 bp, Homo sapiens
agtcttctgtcaatg

SEQ ID NO: 257574 - DNA, 15 bp, Homo sapiens
cagtcttctgtcaat

SEQ ID NO: 257575 - DNA, 15 bp, Homo sapiens
gcagtcttctgtcaa

SEQ ID NO: 257576 - DNA, 15 bp, Homo sapiens
agcagtcttctgtca

SEQ ID NO: 257577 - DNA, 15 bp, Homo sapiens
aagcagtcttctgtc

SEQ ID NO: 257578 - DNA, 15 bp, Homo sapiens
aaagcagtcttctgt

SEQ ID NO: 257579 - DNA, 15 bp, Homo sapiens
aaaagcagtcttctg

SEQ ID NO: 257580 - DNA, 15 bp, Homo sapiens
aaaaagcagtcttct

SEQ ID NO: 257581 - DNA, 15 bp, Homo sapiens
caaaaagcagtcttc

SEQ ID NO: 257582 - DNA, 15 bp, Homo sapiens
acaaaaagcagtctt

SEQ ID NO: 257583 - DNA, 15 bp, Homo sapiens
gacaaaaagcagtct

SEQ ID NO: 257584 - DNA, 15 bp, Homo sapiens
tgacaaaaagcagtc

SEQ ID NO: 257585 - DNA, 15 bp, Homo sapiens
atgacaaaaagcagt

SEQ ID NO: 257586 - DNA, 15 bp, Homo sapiens
taatgacaaaaagca

SEQ ID NO: 257587 - DNA, 15 bp, Homo sapiens
ataatgacaaaaagc

SEQ ID NO: 257588 - DNA, 15 bp, Homo sapiens
cataatgacaaaaag

SEQ ID NO: 257589 - DNA, 15 bp, Homo sapiens
tcataatgacaaaaa

SEQ ID NO: 257590 - DNA, 15 bp, Homo sapiens
ttcataatgacaaaa

SEQ ID NO: 257591 - DNA, 15 bp, Homo sapiens
gttcataatgacaaa

SEQ ID NO: 257592 - DNA, 15 bp, Homo sapiens
tgttcataatgacaa

SEQ ID NO: 257593 - DNA, 15 bp, Homo sapiens
atgttcataatgaca

SEQ ID NO: 257594 - DNA, 15 bp, Homo sapiens
catgttcataatgac

SEQ ID NO: 257595 - DNA, 15 bp, Homo sapiens
ccatgttcataatga

SEQ ID NO: 257596 - DNA, 15 bp, Homo sapiens
accatgttcataatg

SEQ ID NO: 257597 - DNA, 15 bp, Homo sapiens
gaccatgttcataat

SEQ ID NO: 257598 - DNA, 15 bp, Homo sapiens
ggaccatgttcataa

SEQ ID NO: 257599 - DNA, 15 bp, Homo sapiens
gggaccatgttcata

SEQ ID NO: 257600 - DNA, 15 bp, Homo sapiens
tgggaccatgttcat

SEQ ID NO: 257601 - DNA, 15 bp, Homo sapiens
ctgggaccatgttca

SEQ ID NO: 257602 - DNA, 15 bp, Homo sapiens
actgggaccatgttc

SEQ ID NO: 257603 - DNA, 15 bp, Homo sapiens
aactgggaccatgtt

SEQ ID NO: 257604 - DNA, 15 bp, Homo sapiens
aaactgggaccatgt

SEQ ID NO: 257605 - DNA, 15 bp, Homo sapiens
aaaactgggaccatg

SEQ ID NO: 257606 - DNA, 15 bp, Homo sapiens
gaaaactgggaccat

SEQ ID NO: 257607 - DNA, 15 bp, Homo sapiens
cgaaaactgggacca

SEQ ID NO: 257608 - DNA, 15 bp, Homo sapiens
tcgaaaactgggacc

SEQ ID NO: 257609 - DNA, 15 bp, Homo sapiens
gtcgaaaactgggac

SEQ ID NO: 257610 - DNA, 15 bp, Homo sapiens
tgtcgaaaactggga

SEQ ID NO: 257611 - DNA, 15 bp, Homo sapiens
ttgtcgaaaactggg

SEQ ID NO: 257612 - DNA, 15 bp, Homo sapiens
gttgtcgaaaactgg

SEQ ID NO: 257613 - DNA, 15 bp, Homo sapiens
tgttgtcgaaaactg

SEQ ID NO: 257614 - DNA, 15 bp, Homo sapiens
gtgttgtcgaaaact

SEQ ID NO: 257615 - DNA, 15 bp, Homo sapiens
agtgttgtcgaaaac

SEQ ID NO: 257616 - DNA, 15 bp, Homo sapiens
aagtgttgtcgaaaa

SEQ ID NO: 257617 - DNA, 15 bp, Homo sapiens
taagtgttgtcgaaa

SEQ ID NO: 257618 - DNA, 15 bp, Homo sapiens
ataagtgttgtcgaa

SEQ ID NO: 257619 - DNA, 15 bp, Homo sapiens
cataagtgttgtcga

SEQ ID NO: 257620 - DNA, 15 bp, Homo sapiens
ccataagtgttgtcg

SEQ ID NO: 257621 - DNA, 15 bp, Homo sapiens
cccataagtgttgtc

SEQ ID NO: 257622 - DNA, 15 bp, Homo sapiens
acccataagtgttgt

SEQ ID NO: 257623 - DNA, 15 bp, Homo sapiens
cacccataagtgttg

SEQ ID NO: 257624 - DNA, 15 bp, Homo sapiens
ccacccataagtgtt

SEQ ID NO: 257625 - DNA, 15 bp, Homo sapiens
tccacccataagtgt

SEQ ID NO: 257626 - DNA, 15 bp, Homo sapiens
atccacccataagtg

SEQ ID NO: 257627 - DNA, 15 bp, Homo sapiens
tatccacccataagt

SEQ ID NO: 257628 - DNA, 15 bp, Homo sapiens
ttatccacccataag

SEQ ID NO: 257629 - DNA, 15 bp, Homo sapiens
cttatccacccataa

SEQ ID NO: 257630 - DNA, 15 bp, Homo sapiens
gcttatccacccata

SEQ ID NO: 257631 - DNA, 15 bp, Homo sapiens
tgcttatccacccat

SEQ ID NO: 257632 - DNA, 15 bp, Homo sapiens
atgcttatccaccca

SEQ ID NO: 257633 - DNA, 15 bp, Homo sapiens
tatgcttatccaccc

SEQ ID NO: 257634 - DNA, 15 bp, Homo sapiens
atatgcttatccacc

SEQ ID NO: 257635 - DNA, 15 bp, Homo sapiens
aatatgcttatccac

SEQ ID NO: 257636 - DNA, 15 bp, Homo sapiens
taatatgcttatcca

SEQ ID NO: 257637 - DNA, 15 bp, Homo sapiens
ttaatatgcttatcc

SEQ ID NO: 257638 - DNA, 15 bp, Homo sapiens
gttaatatgcttatc

SEQ ID NO: 257639 - DNA, 15 bp, Homo sapiens
tgttaatatgcttat

SEQ ID NO: 257640 - DNA, 15 bp, Homo sapiens
gtgttaatatgctta

SEQ ID NO: 257641 - DNA, 15 bp, Homo sapiens
tgtgttaatatgctt

SEQ ID NO: 257642 - DNA, 15 bp, Homo sapiens
atgtgttaatatgct

SEQ ID NO: 257643 - DNA, 15 bp, Homo sapiens
aatgtgttaatatgc

SEQ ID NO: 257644 - DNA, 15 bp, Homo sapiens
aaatgtgttaatatg

SEQ ID NO: 257645 - DNA, 15 bp, Homo sapiens
caaatgtgttaatat

SEQ ID NO: 257646 - DNA, 15 bp, Homo sapiens
ccaaatgtgttaata

SEQ ID NO: 257647 - DNA, 15 bp, Homo sapiens
accaaatgtgttaat

SEQ ID NO: 257648 - DNA, 15 bp, Homo sapiens
caccaaatgtgttaa

SEQ ID NO: 257649 - DNA, 15 bp, Homo sapiens
acaccaaatgtgtta

SEQ ID NO: 257650 - DNA, 15 bp, Homo sapiens
aacaccaaatgtgtt

SEQ ID NO: 257651 - DNA, 15 bp, Homo sapiens
aaacaccaaatgtgt

SEQ ID NO: 257652 - DNA, 15 bp, Homo sapiens
aaaacaccaaatgtg

SEQ ID NO: 257653 - DNA, 15 bp, Homo sapiens
gaaaacaccaaatgt

SEQ ID NO: 257654 - DNA, 15 bp, Homo sapiens
agaaaacaccaaatg

SEQ ID NO: 257655 - DNA, 15 bp, Homo sapiens
aagaaaacaccaaat

SEQ ID NO: 257656 - DNA, 15 bp, Homo sapiens
gaagaaaacaccaaa

SEQ ID NO: 257657 - DNA, 15 bp, Homo sapiens
agaagaaaacaccaa

SEQ ID NO: 257658 - DNA, 15 bp, Homo sapiens
gagaagaaaacacca

SEQ ID NO: 257659 - DNA, 15 bp, Homo sapiens
agagaagaaaacacc

SEQ ID NO: 257660 - DNA, 15 bp, Homo sapiens
aagagaagaaaacac

SEQ ID NO: 257661 - DNA, 15 bp, Homo sapiens
caagagaagaaaaca

SEQ ID NO: 257662 - DNA, 15 bp, Homo sapiens
ccaagagaagaaaac

SEQ ID NO: 257663 - DNA, 15 bp, Homo sapiens
accaagagaagaaaa

SEQ ID NO: 257664 - DNA, 15 bp, Homo sapiens
aaccaagagaagaaa

SEQ ID NO: 257665 - DNA, 15 bp, Homo sapiens
gaaccaagagaagaa

SEQ ID NO: 257666 - DNA, 15 bp, Homo sapiens
agaaccaagagaaga

SEQ ID NO: 257667 - DNA, 15 bp, Homo sapiens
aagaaccaagagaag

SEQ ID NO: 257668 - DNA, 15 bp, Homo sapiens
aaagaaccaagagaa

SEQ ID NO: 257669 - DNA, 15 bp, Homo sapiens
caaagaaccaagaga

SEQ ID NO: 257670 - DNA, 15 bp, Homo sapiens
ccaaagaaccaagag

SEQ ID NO: 257671 - DNA, 15 bp, Homo sapiens
tccaaagaaccaaga

SEQ ID NO: 257672 - DNA, 15 bp, Homo sapiens
atccaaagaaccaag

SEQ ID NO: 257673 - DNA, 15 bp, Homo sapiens
aatccaaagaaccaa

SEQ ID NO: 257674 - DNA, 15 bp, Homo sapiens
gaatccaaagaacca

SEQ ID NO: 257675 - DNA, 15 bp, Homo sapiens
ggaatccaaagaacc

SEQ ID NO: 257676 - DNA, 15 bp, Homo sapiens
aggaatccaaagaac

SEQ ID NO: 257677 - DNA, 15 bp, Homo sapiens
caggaatccaaagaa

SEQ ID NO: 257678 - DNA, 15 bp, Homo sapiens
tcaggaatccaaaga

SEQ ID NO: 257679 - DNA, 15 bp, Homo sapiens
ttcaggaatccaaag

SEQ ID NO: 257680 - DNA, 15 bp, Homo sapiens
cttcaggaatccaaa

SEQ ID NO: 257681 - DNA, 15 bp, Homo sapiens
tcttcaggaatccaa

SEQ ID NO: 257682 - DNA, 15 bp, Homo sapiens
ttcttcaggaatcca

SEQ ID NO: 257683 - DNA, 15 bp, Homo sapiens
tttcttcaggaatcc

SEQ ID NO: 257684 - DNA, 15 bp, Homo sapiens
ttttcttcaggaatc

SEQ ID NO: 257685 - DNA, 15 bp, Homo sapiens
tttttcttcaggaat

SEQ ID NO: 257686 - DNA, 15 bp, Homo sapiens
ttttttcttcaggaa

SEQ ID NO: 257687 - DNA, 15 bp, Homo sapiens
tttttttcttcagga

SEQ ID NO: 257688 - DNA, 15 bp, Homo sapiens
gtttttttcttcagg

SEQ ID NO: 257689 - DNA, 15 bp, Homo sapiens
ggtttttttcttcag

SEQ ID NO: 257690 - DNA, 15 bp, Homo sapiens
gggtttttttcttca

SEQ ID NO: 257691 - DNA, 15 bp, Homo sapiens
ggggtttttttcttc

SEQ ID NO: 257692 - DNA, 15 bp, Homo sapiens
gggggtttttttctt

SEQ ID NO: 257693 - DNA, 15 bp, Homo sapiens
agggggtttttttct

SEQ ID NO: 257694 - DNA, 15 bp, Homo sapiens
gagggggtttttttc

SEQ ID NO: 257695 - DNA, 15 bp, Homo sapiens
ggagggggttttttt

SEQ ID NO: 257696 - DNA, 15 bp, Homo sapiens
aggagggggtttttt

SEQ ID NO: 257697 - DNA, 15 bp, Homo sapiens
gaggagggggttttt

SEQ ID NO: 257698 - DNA, 15 bp, Homo sapiens
tgaggagggggtttt

SEQ ID NO: 257699 - DNA, 15 bp, Homo sapiens
ctgaggagggggttt

SEQ ID NO: 257700 - DNA, 15 bp, Homo sapiens
gctgaggagggggtt

SEQ ID NO: 257701 - DNA, 15 bp, Homo sapiens
agctgaggagggggt

SEQ ID NO: 257702 - DNA, 15 bp, Homo sapiens
gagctgaggaggggg

SEQ ID NO: 257703 - DNA, 15 bp, Homo sapiens
agagctgaggagggg

SEQ ID NO: 257704 - DNA, 15 bp, Homo sapiens
aagagctgaggaggg

SEQ ID NO: 257705 - DNA, 15 bp, Homo sapiens
gaagagctgaggagg

SEQ ID NO: 257706 - DNA, 15 bp, Homo sapiens
ggaagagctgaggag

SEQ ID NO: 257707 - DNA, 15 bp, Homo sapiens
gggaagagctgagga

SEQ ID NO: 257708 - DNA, 15 bp, Homo sapiens
ggggaagagctgagg

SEQ ID NO: 257709 - DNA, 15 bp, Homo sapiens
aggggaagagctgag

SEQ ID NO: 257710 - DNA, 15 bp, Homo sapiens
gaggggaagagctga

SEQ ID NO: 257711 - DNA, 15 bp, Homo sapiens
tgaggggaagagctg

SEQ ID NO: 257712 - DNA, 15 bp, Homo sapiens
ttgaggggaagagct

SEQ ID NO: 257713 - DNA, 15 bp, Homo sapiens
tttgaggggaagagc

SEQ ID NO: 257714 - DNA, 15 bp, Homo sapiens
gtttgaggggaagag

SEQ ID NO: 257715 - DNA, 15 bp, Homo sapiens
ggtttgaggggaaga

SEQ ID NO: 257716 - DNA, 15 bp, Homo sapiens
aggtttgaggggaag

SEQ ID NO: 257717 - DNA, 15 bp, Homo sapiens
caggtttgaggggaa

SEQ ID NO: 257718 - DNA, 15 bp, Homo sapiens
tcaggtttgagggga

SEQ ID NO: 257719 - DNA, 15 bp, Homo sapiens
ctcaggtttgagggg

SEQ ID NO: 257720 - DNA, 15 bp, Homo sapiens
tctcaggtttgaggg

SEQ ID NO: 257721 - DNA, 15 bp, Homo sapiens
ctctcaggtttgagg

SEQ ID NO: 257722 - DNA, 15 bp, Homo sapiens
cctctcaggtttgag

SEQ ID NO: 257723 - DNA, 15 bp, Homo sapiens
tcctctcaggtttga

SEQ ID NO: 257724 - DNA, 15 bp, Homo sapiens
ttcctctcaggtttg

SEQ ID NO: 257725 - DNA, 15 bp, Homo sapiens
gttcctctcaggttt

SEQ ID NO: 257726 - DNA, 15 bp, Homo sapiens
tgttcctctcaggtt

SEQ ID NO: 257727 - DNA, 15 bp, Homo sapiens
ctgttcctctcaggt

SEQ ID NO: 257728 - DNA, 15 bp, Homo sapiens
tctgttcctctcagg

SEQ ID NO: 257729 - DNA, 15 bp, Homo sapiens
ttctgttcctctcag

SEQ ID NO: 257730 - DNA, 15 bp, Homo sapiens
cttctgttcctctca

SEQ ID NO: 257731 - DNA, 15 bp, Homo sapiens
ccttctgttcctctc

SEQ ID NO: 257732 - DNA, 15 bp, Homo sapiens
cccttctgttcctct

SEQ ID NO: 257733 - DNA, 15 bp, Homo sapiens
tcccttctgttcctc

SEQ ID NO: 257734 - DNA, 15 bp, Homo sapiens
gtcccttctgttcct

SEQ ID NO: 257735 - DNA, 15 bp, Homo sapiens
cgtcccttctgttcc

SEQ ID NO: 257736 - DNA, 15 bp, Homo sapiens
gcgtcccttctgttc

SEQ ID NO: 257737 - DNA, 15 bp, Homo sapiens
agcgtcccttctgtt

SEQ ID NO: 257738 - DNA, 15 bp, Homo sapiens
aagcgtcccttctgt

SEQ ID NO: 257739 - DNA, 15 bp, Homo sapiens
gaagcgtcccttctg

SEQ ID NO: 257740 - DNA, 15 bp, Homo sapiens
agaagcgtcccttct

SEQ ID NO: 257741 - DNA, 15 bp, Homo sapiens
gagaagcgtcccttc

SEQ ID NO: 257742 - DNA, 15 bp, Homo sapiens
ggagaagcgtccctt

SEQ ID NO: 257743 - DNA, 15 bp, Homo sapiens
tggagaagcgtccct

SEQ ID NO: 257744 - DNA, 15 bp, Homo sapiens
ttggagaagcgtccc

SEQ ID NO: 257745 - DNA, 15 bp, Homo sapiens
gttggagaagcgtcc

SEQ ID NO: 257746 - DNA, 15 bp, Homo sapiens
agttggagaagcgtc

SEQ ID NO: 257747 - DNA, 15 bp, Homo sapiens
aagttggagaagcgt

SEQ ID NO: 257748 - DNA, 15 bp, Homo sapiens
gaagttggagaagcg

SEQ ID NO: 257749 - DNA, 15 bp, Homo sapiens
agaagttggagaagc

SEQ ID NO: 257750 - DNA, 15 bp, Homo sapiens
tagaagttggagaag

SEQ ID NO: 257751 - DNA, 15 bp, Homo sapiens
ttagaagttggagaa

SEQ ID NO: 257752 - DNA, 15 bp, Homo sapiens
tttagaagttggaga

SEQ ID NO: 257753 - DNA, 15 bp, Homo sapiens
gtttagaagttggag

SEQ ID NO: 257754 - DNA, 15 bp, Homo sapiens
agtttagaagttgga

SEQ ID NO: 257755 - DNA, 15 bp, Homo sapiens
tagtttagaagttgg

SEQ ID NO: 257756 - DNA, 15 bp, Homo sapiens
ttagtttagaagttg

SEQ ID NO: 257757 - DNA, 15 bp, Homo sapiens
tttagtttagaagtt

SEQ ID NO: 257758 - DNA, 15 bp, Homo sapiens
gtttagtttagaagt

SEQ ID NO: 257759 - DNA, 15 bp, Homo sapiens
cgtttagtttagaag

SEQ ID NO: 257760 - DNA, 15 bp, Homo sapiens
tcgtttagtttagaa

SEQ ID NO: 257761 - DNA, 15 bp, Homo sapiens
ctcgtttagtttaga

SEQ ID NO: 257762 - DNA, 15 bp, Homo sapiens
tctcgtttagtttag

SEQ ID NO: 257763 - DNA, 15 bp, Homo sapiens
atctcgtttagttta

SEQ ID NO: 257764 - DNA, 15 bp, Homo sapiens
aatctcgtttagttt

SEQ ID NO: 257765 - DNA, 15 bp, Homo sapiens
caatctcgtttagtt

SEQ ID NO: 257766 - DNA, 15 bp, Homo sapiens
ccaatctcgtttagt

SEQ ID NO: 257767 - DNA, 15 bp, Homo sapiens
accaatctcgtttag

SEQ ID NO: 257768 - DNA, 15 bp, Homo sapiens
taccaatctcgttta

SEQ ID NO: 257769 - DNA, 15 bp, Homo sapiens
ttaccaatctcgttt

SEQ ID NO: 257770 - DNA, 15 bp, Homo sapiens
attaccaatctcgtt

SEQ ID NO: 257771 - DNA, 15 bp, Homo sapiens
cattaccaatctcgt

SEQ ID NO: 257772 - DNA, 15 bp, Homo sapiens
tcattaccaatctcg

SEQ ID NO: 257773 - DNA, 15 bp, Homo sapiens
gtcattaccaatctc

SEQ ID NO: 257774 - DNA, 15 bp, Homo sapiens
tgtcattaccaatct

SEQ ID NO: 257775 - DNA, 15 bp, Homo sapiens
ttgtcattaccaatc

SEQ ID NO: 257776 - DNA, 15 bp, Homo sapiens
attgtcattaccaat

SEQ ID NO: 257777 - DNA, 15 bp, Homo sapiens
aattgtcattaccaa

SEQ ID NO: 257778 - DNA, 15 bp, Homo sapiens
taattgtcattacca

SEQ ID NO: 257779 - DNA, 15 bp, Homo sapiens
ttaattgtcattacc

SEQ ID NO: 257780 - DNA, 15 bp, Homo sapiens
tttaattgtcattac

SEQ ID NO: 257781 - DNA, 15 bp, Homo sapiens
gtttaattgtcatta

SEQ ID NO: 257782 - DNA, 15 bp, Homo sapiens
tgtttaattgtcatt

SEQ ID NO: 257783 - DNA, 15 bp, Homo sapiens
ttgtttaattgtcat

SEQ ID NO: 257784 - DNA, 15 bp, Homo sapiens
gttgtttaattgtca

SEQ ID NO: 257785 - DNA, 15 bp, Homo sapiens
agttgtttaattgtc

SEQ ID NO: 257786 - DNA, 15 bp, Homo sapiens
tagttgtttaattgt

SEQ ID NO: 257787 - DNA, 15 bp, Homo sapiens
ttagttgtttaattg

SEQ ID NO: 257788 - DNA, 15 bp, Homo sapiens
tttagttgtttaatt

SEQ ID NO: 257789 - DNA, 15 bp, Homo sapiens
atttagttgtttaat

SEQ ID NO: 257790 - DNA, 15 bp, Homo sapiens
catttagttgtttaa

SEQ ID NO: 257791 - DNA, 15 bp, Homo sapiens
tcatttagttgttta

SEQ ID NO: 257792 - DNA, 15 bp, Homo sapiens
gtcatttagttgttt

SEQ ID NO: 257793 - DNA, 15 bp, Homo sapiens
tgtcatttagttgtt

SEQ ID NO: 257794 - DNA, 15 bp, Homo sapiens
ctgtcatttagttgt

SEQ ID NO: 257795 - DNA, 15 bp, Homo sapiens
actgtcatttagttg

SEQ ID NO: 257796 - DNA, 15 bp, Homo sapiens
aactgtcatttagtt

SEQ ID NO: 257797 - DNA, 15 bp, Homo sapiens
taactgtcatttagt

SEQ ID NO: 257798 - DNA, 15 bp, Homo sapiens
ctaactgtcatttag

SEQ ID NO: 257799 - DNA, 15 bp, Homo sapiens
tctaactgtcattta

SEQ ID NO: 257800 - DNA, 15 bp, Homo sapiens
ttctaactgtcattt

SEQ ID NO: 257801 - DNA, 15 bp, Homo sapiens
tttctaactgtcatt

SEQ ID NO: 257802 - DNA, 15 bp, Homo sapiens
ttttctaactgtcat

SEQ ID NO: 257803 - DNA, 15 bp, Homo sapiens
cttttctaactgtca

SEQ ID NO: 257804 - DNA, 15 bp, Homo sapiens
ccttttctaactgtc

SEQ ID NO: 257805 - DNA, 15 bp, Homo sapiens
cccttttctaactgt

SEQ ID NO: 257806 - DNA, 15 bp, Homo sapiens
gcccttttctaactg

SEQ ID NO: 257807 - DNA, 15 bp, Homo sapiens
agcccttttctaact

SEQ ID NO: 257808 - DNA, 15 bp, Homo sapiens
tagcccttttctaac

SEQ ID NO: 257809 - DNA, 15 bp, Homo sapiens
ctagcccttttctaa

SEQ ID NO: 257810 - DNA, 15 bp, Homo sapiens
tctagcccttttcta

SEQ ID NO: 257811 - DNA, 15 bp, Homo sapiens
atctagcccttttct

SEQ ID NO: 257812 - DNA, 15 bp, Homo sapiens
aatctagcccttttc

SEQ ID NO: 257813 - DNA, 15 bp, Homo sapiens
caatctagccctttt

SEQ ID NO: 257814 - DNA, 15 bp, Homo sapiens
acaatctagcccttt

SEQ ID NO: 257815 - DNA, 15 bp, Homo sapiens
tacaatctagccctt

SEQ ID NO: 257816 - DNA, 15 bp, Homo sapiens
atacaatctagccct

SEQ ID NO: 257817 - DNA, 15 bp, Homo sapiens
aatacaatctagccc

SEQ ID NO: 257818 - DNA, 15 bp, Homo sapiens
caatacaatctagcc

SEQ ID NO: 257819 - DNA, 15 bp, Homo sapiens
ccaatacaatctagc

SEQ ID NO: 257820 - DNA, 15 bp, Homo sapiens
tccaatacaatctag

SEQ ID NO: 257821 - DNA, 15 bp, Homo sapiens
atccaatacaatcta

SEQ ID NO: 257822 - DNA, 15 bp, Homo sapiens
aatccaatacaatct

SEQ ID NO: 257823 - DNA, 15 bp, Homo sapiens
aaatccaatacaatc

SEQ ID NO: 257824 - DNA, 15 bp, Homo sapiens
gaaatccaatacaat

SEQ ID NO: 257825 - DNA, 15 bp, Homo sapiens
tgaaatccaatacaa

SEQ ID NO: 257826 - DNA, 15 bp, Homo sapiens
ttgaaatccaataca

SEQ ID NO: 257827 - DNA, 15 bp, Homo sapiens
cttgaaatccaatac

SEQ ID NO: 257828 - DNA, 15 bp, Homo sapiens
acttgaaatccaata

SEQ ID NO: 257829 - DNA, 15 bp, Homo sapiens
tacttgaaatccaat

SEQ ID NO: 257830 - DNA, 15 bp, Homo sapiens
atacttgaaatccaa

SEQ ID NO: 257831 - DNA, 15 bp, Homo sapiens
tatacttgaaatcca

SEQ ID NO: 257832 - DNA, 15 bp, Homo sapiens
atatacttgaaatcc

SEQ ID NO: 257833 - DNA, 15 bp, Homo sapiens
catatacttgaaatc

SEQ ID NO: 257834 - DNA, 15 bp, Homo sapiens
tcatatacttgaaat

SEQ ID NO: 257835 - DNA, 15 bp, Homo sapiens
ctcatatacttgaaa

SEQ ID NO: 257836 - DNA, 15 bp, Homo sapiens
cctcatatacttgaa

SEQ ID NO: 257837 - DNA, 15 bp, Homo sapiens
acctcatatacttga

SEQ ID NO: 257838 - DNA, 15 bp, Homo sapiens
cacctcatatacttg

SEQ ID NO: 257839 - DNA, 15 bp, Homo sapiens
gcacctcatatactt

SEQ ID NO: 257840 - DNA, 15 bp, Homo sapiens
agcacctcatatact

SEQ ID NO: 257841 - DNA, 15 bp, Homo sapiens
aagcacctcatatac

SEQ ID NO: 257842 - DNA, 15 bp, Homo sapiens
aaagcacctcatata

SEQ ID NO: 257843 - DNA, 15 bp, Homo sapiens
aaaagcacctcatat

SEQ ID NO: 257844 - DNA, 15 bp, Homo sapiens
aaaaagcacctcata

SEQ ID NO: 257845 - DNA, 15 bp, Homo sapiens
aaaaaagcacctcat

SEQ ID NO: 257846 - DNA, 15 bp, Homo sapiens
gaaaaaagcacctca

SEQ ID NO: 257847 - DNA, 15 bp, Homo sapiens
tgaaaaaagcacctc

SEQ ID NO: 257848 - DNA, 15 bp, Homo sapiens
ctgaaaaaagcacct

SEQ ID NO: 257849 - DNA, 15 bp, Homo sapiens
tctgaaaaaagcacc

SEQ ID NO: 257850 - DNA, 15 bp, Homo sapiens
ctctgaaaaaagcac

SEQ ID NO: 257851 - DNA, 15 bp, Homo sapiens
gctctgaaaaaagca

SEQ ID NO: 257852 - DNA, 15 bp, Homo sapiens
ggctctgaaaaaagc

SEQ ID NO: 257853 - DNA, 15 bp, Homo sapiens
tggctctgaaaaaag

SEQ ID NO: 257854 - DNA, 15 bp, Homo sapiens
ttggctctgaaaaaa

SEQ ID NO: 257855 - DNA, 15 bp, Homo sapiens
gttggctctgaaaaa

SEQ ID NO: 257856 - DNA, 15 bp, Homo sapiens
agttggctctgaaaa

SEQ ID NO: 257857 - DNA, 15 bp, Homo sapiens
cagttggctctgaaa

SEQ ID NO: 257858 - DNA, 15 bp, Homo sapiens
tcagttggctctgaa

SEQ ID NO: 257859 - DNA, 15 bp, Homo sapiens
gtcagttggctctga

SEQ ID NO: 257860 - DNA, 15 bp, Homo sapiens
ggtcagttggctctg

SEQ ID NO: 257861 - DNA, 15 bp, Homo sapiens
aggtcagttggctct

SEQ ID NO: 257862 - DNA, 15 bp, Homo sapiens
aaggtcagttggctc

SEQ ID NO: 257863 - DNA, 15 bp, Homo sapiens
gaaggtcagttggct

SEQ ID NO: 257864 - DNA, 15 bp, Homo sapiens
tgaaggtcagttggc

SEQ ID NO: 257865 - DNA, 15 bp, Homo sapiens
gtgaaggtcagttgg

SEQ ID NO: 257866 - DNA, 15 bp, Homo sapiens
agtgaaggtcagttg

SEQ ID NO: 257867 - DNA, 15 bp, Homo sapiens
aagtgaaggtcagtt

SEQ ID NO: 257868 - DNA, 15 bp, Homo sapiens
aaagtgaaggtcagt

SEQ ID NO: 257869 - DNA, 15 bp, Homo sapiens
aaaagtgaaggtcag

SEQ ID NO: 257870 - DNA, 15 bp, Homo sapiens
gaaaagtgaaggtca

SEQ ID NO: 257871 - DNA, 15 bp, Homo sapiens
ggaaaagtgaaggtc

SEQ ID NO: 257872 - DNA, 15 bp, Homo sapiens
aggaaaagtgaaggt

SEQ ID NO: 257873 - DNA, 15 bp, Homo sapiens
taggaaaagtgaagg

SEQ ID NO: 257874 - DNA, 15 bp, Homo sapiens
gtaggaaaagtgaag

SEQ ID NO: 257875 - DNA, 15 bp, Homo sapiens
tgtaggaaaagtgaa

SEQ ID NO: 257876 - DNA, 15 bp, Homo sapiens
ctgtaggaaaagtga

SEQ ID NO: 257877 - DNA, 15 bp, Homo sapiens
gctgtaggaaaagtg

SEQ ID NO: 257878 - DNA, 15 bp, Homo sapiens
ggctgtaggaaaagt

SEQ ID NO: 257879 - DNA, 15 bp, Homo sapiens
aggctgtaggaaaag

SEQ ID NO: 257880 - DNA, 15 bp, Homo sapiens
aaggctgtaggaaaa

SEQ ID NO: 257881 - DNA, 15 bp, Homo sapiens
gaaggctgtaggaaa

SEQ ID NO: 257882 - DNA, 15 bp, Homo sapiens
agaaggctgtaggaa

SEQ ID NO: 257883 - DNA, 15 bp, Homo sapiens
gagaaggctgtagga

SEQ ID NO: 257884 - DNA, 15 bp, Homo sapiens
ggagaaggctgtagg

SEQ ID NO: 257885 - DNA, 15 bp, Homo sapiens
gggagaaggctgtag

SEQ ID NO: 257886 - DNA, 15 bp, Homo sapiens
tgggagaaggctgta

SEQ ID NO: 257887 - DNA, 15 bp, Homo sapiens
gtgggagaaggctgt

SEQ ID NO: 257888 - DNA, 15 bp, Homo sapiens
agtgggagaaggctg

SEQ ID NO: 257889 - DNA, 15 bp, Homo sapiens
cagtgggagaaggct

SEQ ID NO: 257890 - DNA, 15 bp, Homo sapiens
gcagtgggagaaggc

SEQ ID NO: 257891 - DNA, 15 bp, Homo sapiens
ggcagtgggagaagg

SEQ ID NO: 257892 - DNA, 15 bp, Homo sapiens
gggcagtgggagaag

SEQ ID NO: 257893 - DNA, 15 bp, Homo sapiens
agggcagtgggagaa

SEQ ID NO: 257894 - DNA, 15 bp, Homo sapiens
gagggcagtgggaga

SEQ ID NO: 257895 - DNA, 15 bp, Homo sapiens
ggagggcagtgggag

SEQ ID NO: 257896 - DNA, 15 bp, Homo sapiens
tggagggcagtggga

SEQ ID NO: 257897 - DNA, 15 bp, Homo sapiens
ctggagggcagtggg

SEQ ID NO: 257898 - DNA, 15 bp, Homo sapiens
tggctggagggcagt

SEQ ID NO: 257899 - DNA, 15 bp, Homo sapiens
ttggctggagggcag

SEQ ID NO: 257900 - DNA, 15 bp, Homo sapiens
cttggctggagggca

SEQ ID NO: 257901 - DNA, 15 bp, Homo sapiens
ccttggctggagggc

SEQ ID NO: 257902 - DNA, 15 bp, Homo sapiens
gccttggctggaggg

SEQ ID NO: 257903 - DNA, 15 bp, Homo sapiens
ggccttggctggagg

SEQ ID NO: 257904 - DNA, 15 bp, Homo sapiens
aggccttggctggag

SEQ ID NO: 257905 - DNA, 15 bp, Homo sapiens
gaggccttggctgga

SEQ ID NO: 257906 - DNA, 15 bp, Homo sapiens
agaggccttggctgg

SEQ ID NO: 257907 - DNA, 15 bp, Homo sapiens
cagaggccttggctg

SEQ ID NO: 257908 - DNA, 15 bp, Homo sapiens
ccagaggccttggct

SEQ ID NO: 257909 - DNA, 15 bp, Homo sapiens
cccagaggccttggc

SEQ ID NO: 257910 - DNA, 15 bp, Homo sapiens
gcccagaggccttgg

SEQ ID NO: 257911 - DNA, 15 bp, Homo sapiens
ggcccagaggccttg

SEQ ID NO: 257912 - DNA, 15 bp, Homo sapiens
tggcccagaggcctt

SEQ ID NO: 257913 - DNA, 15 bp, Homo sapiens
gtggcccagaggcct

SEQ ID NO: 257914 - DNA, 15 bp, Homo sapiens
agtggcccagaggcc

SEQ ID NO: 257915 - DNA, 15 bp, Homo sapiens
gagtggcccagaggc

SEQ ID NO: 257916 - DNA, 15 bp, Homo sapiens
ggagtggcccagagg

SEQ ID NO: 257917 - DNA, 15 bp, Homo sapiens
aggagtggcccagag

SEQ ID NO: 257918 - DNA, 15 bp, Homo sapiens
caggagtggcccaga

SEQ ID NO: 257919 - DNA, 15 bp, Homo sapiens
ccaggagtggcccag

SEQ ID NO: 257920 - DNA, 15 bp, Homo sapiens
tccaggagtggccca

SEQ ID NO: 257921 - DNA, 15 bp, Homo sapiens
ctccaggagtggccc

SEQ ID NO: 257922 - DNA, 15 bp, Homo sapiens
gctccaggagtggcc

SEQ ID NO: 257923 - DNA, 15 bp, Homo sapiens
agctccaggagtggc

SEQ ID NO: 257924 - DNA, 15 bp, Homo sapiens
gagctccaggagtgg

SEQ ID NO: 257925 - DNA, 15 bp, Homo sapiens
tgagctccaggagtg

SEQ ID NO: 257926 - DNA, 15 bp, Homo sapiens
atgagctccaggagt

SEQ ID NO: 257927 - DNA, 15 bp, Homo sapiens
gatgagctccaggag

SEQ ID NO: 257928 - DNA, 15 bp, Homo sapiens
tgatgagctccagga

SEQ ID NO: 257929 - DNA, 15 bp, Homo sapiens
ctgatgagctccagg

SEQ ID NO: 257930 - DNA, 15 bp, Homo sapiens
actgatgagctccag

SEQ ID NO: 257931 - DNA, 15 bp, Homo sapiens
aactgatgagctcca

SEQ ID NO: 257932 - DNA, 15 bp, Homo sapiens
aaactgatgagctcc

SEQ ID NO: 257933 - DNA, 15 bp, Homo sapiens
taaactgatgagctc

SEQ ID NO: 257934 - DNA, 15 bp, Homo sapiens
ataaactgatgagct

SEQ ID NO: 257935 - DNA, 15 bp, Homo sapiens
aataaactgatgagc

SEQ ID NO: 257936 - DNA, 15 bp, Homo sapiens
taataaactgatgag

SEQ ID NO: 257937 - DNA, 15 bp, Homo sapiens
ataataaactgatga

SEQ ID NO: 257938 - DNA, 15 bp, Homo sapiens
aataataaactgatg

SEQ ID NO: 257939 - DNA, 15 bp, Homo sapiens
taataataaactgat

SEQ ID NO: 257940 - DNA, 15 bp, Homo sapiens
ttaataataaactga

SEQ ID NO: 257941 - DNA, 15 bp, Homo sapiens
attaataataaactg

SEQ ID NO: 257942 - DNA, 15 bp, Homo sapiens
gattaataataaact

SEQ ID NO: 257943 - DNA, 15 bp, Homo sapiens
agattaataataaac

SEQ ID NO: 257944 - DNA, 15 bp, Homo sapiens
cagattaataataaa

SEQ ID NO: 257945 - DNA, 15 bp, Homo sapiens
gcagattaataataa

SEQ ID NO: 257946 - DNA, 15 bp, Homo sapiens
agcagattaataata

SEQ ID NO: 257947 - DNA, 15 bp, Homo sapiens
aagcagattaataat

SEQ ID NO: 257948 - DNA, 15 bp, Homo sapiens
gaagcagattaataa

SEQ ID NO: 257949 - DNA, 15 bp, Homo sapiens
agaagcagattaata

SEQ ID NO: 257950 - DNA, 15 bp, Homo sapiens
aagaagcagattaat

SEQ ID NO: 257951 - DNA, 15 bp, Homo sapiens
gaagaagcagattaa

SEQ ID NO: 257952 - DNA, 15 bp, Homo sapiens
ggaagaagcagatta

SEQ ID NO: 257953 - DNA, 15 bp, Homo sapiens
aggaagaagcagatt

SEQ ID NO: 257954 - DNA, 15 bp, Homo sapiens
gaggaagaagcagat

SEQ ID NO: 257955 - DNA, 15 bp, Homo sapiens
agaggaagaagcaga

SEQ ID NO: 257956 - DNA, 15 bp, Homo sapiens
gagaggaagaagcag

SEQ ID NO: 257957 - DNA, 15 bp, Homo sapiens
ggagaggaagaagca

SEQ ID NO: 257958 - DNA, 15 bp, Homo sapiens
gggagaggaagaagc

SEQ ID NO: 257959 - DNA, 15 bp, Homo sapiens
agggagaggaagaag

SEQ ID NO: 257960 - DNA, 15 bp, Homo sapiens
aagggagaggaagaa

SEQ ID NO: 257961 - DNA, 15 bp, Homo sapiens
gaagggagaggaaga

SEQ ID NO: 257962 - DNA, 15 bp, Homo sapiens
ggaagggagaggaag

SEQ ID NO: 257963 - DNA, 15 bp, Homo sapiens
aggaagggagaggaa

SEQ ID NO: 257964 - DNA, 15 bp, Homo sapiens
aaggaagggagagga

SEQ ID NO: 257965 - DNA, 15 bp, Homo sapiens
aaaggaagggagagg

SEQ ID NO: 257966 - DNA, 15 bp, Homo sapiens
gaaaggaagggagag

SEQ ID NO: 257967 - DNA, 15 bp, Homo sapiens
tgaaaggaagggaga

SEQ ID NO: 257968 - DNA, 15 bp, Homo sapiens
ctgaaaggaagggag

SEQ ID NO: 257969 - DNA, 15 bp, Homo sapiens
actgaaaggaaggga

SEQ ID NO: 257970 - DNA, 15 bp, Homo sapiens
aactgaaaggaaggg

SEQ ID NO: 257971 - DNA, 15 bp, Homo sapiens
aaactgaaaggaagg

SEQ ID NO: 257972 - DNA, 15 bp, Homo sapiens
taaactgaaaggaag

SEQ ID NO: 257973 - DNA, 15 bp, Homo sapiens
gtaaactgaaaggaa

SEQ ID NO: 257974 - DNA, 15 bp, Homo sapiens
agtaaactgaaagga

SEQ ID NO: 257975 - DNA, 15 bp, Homo sapiens
tagtaaactgaaagg

SEQ ID NO: 257976 - DNA, 15 bp, Homo sapiens
ctagtaaactgaaag

SEQ ID NO: 257977 - DNA, 15 bp, Homo sapiens
tctagtaaactgaaa

SEQ ID NO: 257978 - DNA, 15 bp, Homo sapiens
ttctagtaaactgaa

SEQ ID NO: 257979 - DNA, 15 bp, Homo sapiens
tttctagtaaactga

SEQ ID NO: 257980 - DNA, 15 bp, Homo sapiens
atttctagtaaactg

SEQ ID NO: 257981 - DNA, 15 bp, Homo sapiens
tatttctagtaaact

SEQ ID NO: 257982 - DNA, 15 bp, Homo sapiens
gtatttctagtaaac

SEQ ID NO: 257983 - DNA, 15 bp, Homo sapiens
ggtatttctagtaaa

SEQ ID NO: 257984 - DNA, 15 bp, Homo sapiens
gggtatttctagtaa

SEQ ID NO: 257985 - DNA, 15 bp, Homo sapiens
agggtatttctagta

SEQ ID NO: 257986 - DNA, 15 bp, Homo sapiens
cagggtatttctagt

SEQ ID NO: 257987 - DNA, 15 bp, Homo sapiens
tcagggtatttctag

SEQ ID NO: 257988 - DNA, 15 bp, Homo sapiens
gtcagggtatttcta

SEQ ID NO: 257989 - DNA, 15 bp, Homo sapiens
ggtcagggtatttct

SEQ ID NO: 257990 - DNA, 15 bp, Homo sapiens
gggtcagggtatttc

SEQ ID NO: 257991 - DNA, 15 bp, Homo sapiens
agggtcagggtattt

SEQ ID NO: 257992 - DNA, 15 bp, Homo sapiens
aagggtcagggtatt

SEQ ID NO: 257993 - DNA, 15 bp, Homo sapiens
aaagggtcagggtat

SEQ ID NO: 257994 - DNA, 15 bp, Homo sapiens
gaaagggtcagggta

SEQ ID NO: 257995 - DNA, 15 bp, Homo sapiens
agaaagggtcagggt

SEQ ID NO: 257996 - DNA, 15 bp, Homo sapiens
gagaaagggtcaggg

SEQ ID NO: 257997 - DNA, 15 bp, Homo sapiens
agagaaagggtcagg

SEQ ID NO: 257998 - DNA, 15 bp, Homo sapiens
cagagaaagggtcag

SEQ ID NO: 257999 - DNA, 15 bp, Homo sapiens
gcagagaaagggtca

SEQ ID NO: 258000 - DNA, 15 bp, Homo sapiens
tgcagagaaagggtc

SEQ ID NO: 258001 - DNA, 15 bp, Homo sapiens
gtgcagagaaagggt

SEQ ID NO: 258002 - DNA, 15 bp, Homo sapiens
agtgcagagaaaggg

SEQ ID NO: 258003 - DNA, 15 bp, Homo sapiens
cagtgcagagaaagg

SEQ ID NO: 258004 - DNA, 15 bp, Homo sapiens
ccagtgcagagaaag

SEQ ID NO: 258005 - DNA, 15 bp, Homo sapiens
gccagtgcagagaaa

SEQ ID NO: 258006 - DNA, 15 bp, Homo sapiens
agccagtgcagagaa

SEQ ID NO: 258007 - DNA, 15 bp, Homo sapiens
aagccagtgcagaga

SEQ ID NO: 258008 - DNA, 15 bp, Homo sapiens
caagccagtgcagag

SEQ ID NO: 258009 - DNA, 15 bp, Homo sapiens
acaagccagtgcaga

SEQ ID NO: 258010 - DNA, 15 bp, Homo sapiens
tacaagccagtgcag

SEQ ID NO: 258011 - DNA, 15 bp, Homo sapiens
ttacaagccagtgca

SEQ ID NO: 258012 - DNA, 15 bp, Homo sapiens
gttacaagccagtgc

SEQ ID NO: 258013 - DNA, 15 bp, Homo sapiens
ggttacaagccagtg

SEQ ID NO: 258014 - DNA, 15 bp, Homo sapiens
gggttacaagccagt

SEQ ID NO: 258015 - DNA, 15 bp, Homo sapiens
agggttacaagccag

SEQ ID NO: 258016 - DNA, 15 bp, Homo sapiens
aagggttacaagcca

SEQ ID NO: 258017 - DNA, 15 bp, Homo sapiens
aaagggttacaagcc

SEQ ID NO: 258018 - DNA, 15 bp, Homo sapiens
aaaagggttacaagc

SEQ ID NO: 258019 - DNA, 15 bp, Homo sapiens
aaaaagggttacaag

SEQ ID NO: 258020 - DNA, 15 bp, Homo sapiens
aaaaaagggttacaa

SEQ ID NO: 258021 - DNA, 15 bp, Homo sapiens
gaaaaaagggttaca

SEQ ID NO: 258022 - DNA, 15 bp, Homo sapiens
ggaaaaaagggttac

SEQ ID NO: 258023 - DNA, 15 bp, Homo sapiens
aggaaaaaagggtta

SEQ ID NO: 258024 - DNA, 15 bp, Homo sapiens
gaggaaaaaagggtt

SEQ ID NO: 258025 - DNA, 15 bp, Homo sapiens
ggaggaaaaaagggt

SEQ ID NO: 258026 - DNA, 15 bp, Homo sapiens
gggaggaaaaaaggg

SEQ ID NO: 258027 - DNA, 15 bp, Homo sapiens
tgggaggaaaaaagg

SEQ ID NO: 258028 - DNA, 15 bp, Homo sapiens
ttgggaggaaaaaag

SEQ ID NO: 258029 - DNA, 15 bp, Homo sapiens
tttgggaggaaaaaa

SEQ ID NO: 258030 - DNA, 15 bp, Homo sapiens
atttgggaggaaaaa

SEQ ID NO: 258031 - DNA, 15 bp, Homo sapiens
tatttgggaggaaaa

SEQ ID NO: 258032 - DNA, 15 bp, Homo sapiens
gtatttgggaggaaa

SEQ ID NO: 258033 - DNA, 15 bp, Homo sapiens
agtatttgggaggaa

SEQ ID NO: 258034 - DNA, 15 bp, Homo sapiens
cagtatttgggagga

SEQ ID NO: 258035 - DNA, 15 bp, Homo sapiens
acagtatttgggagg

SEQ ID NO: 258036 - DNA, 15 bp, Homo sapiens
aacagtatttgggag

SEQ ID NO: 258037 - DNA, 15 bp, Homo sapiens
taacagtatttggga

SEQ ID NO: 258038 - DNA, 15 bp, Homo sapiens
ttaacagtatttggg

SEQ ID NO: 258039 - DNA, 15 bp, Homo sapiens
tttaacagtatttgg

SEQ ID NO: 258040 - DNA, 15 bp, Homo sapiens
ctttaacagtatttg

SEQ ID NO: 258041 - DNA, 15 bp, Homo sapiens
tctttaacagtattt

SEQ ID NO: 258042 - DNA, 15 bp, Homo sapiens
atctttaacagtatt

SEQ ID NO: 258043 - DNA, 15 bp, Homo sapiens
aatctttaacagtat

SEQ ID NO: 258044 - DNA, 15 bp, Homo sapiens
aaatctttaacagta

SEQ ID NO: 258045 - DNA, 15 bp, Homo sapiens
taaatctttaacagt

SEQ ID NO: 258046 - DNA, 15 bp, Homo sapiens
gtaaatctttaacag

SEQ ID NO: 258047 - DNA, 15 bp, Homo sapiens
ggtaaatctttaaca

SEQ ID NO: 258048 - DNA, 15 bp, Homo sapiens
aggtaaatctttaac

SEQ ID NO: 258049 - DNA, 15 bp, Homo sapiens
gaggtaaatctttaa

SEQ ID NO: 258050 - DNA, 15 bp, Homo sapiens
agaggtaaatcttta

SEQ ID NO: 258051 - DNA, 15 bp, Homo sapiens
aagaggtaaatcttt

SEQ ID NO: 258052 - DNA, 15 bp, Homo sapiens
aaagaggtaaatctt

SEQ ID NO: 258053 - DNA, 15 bp, Homo sapiens
aaaagaggtaaatct

SEQ ID NO: 258054 - DNA, 15 bp, Homo sapiens
caaaagaggtaaatc

SEQ ID NO: 258055 - DNA, 15 bp, Homo sapiens
ccaaaagaggtaaat

SEQ ID NO: 258056 - DNA, 15 bp, Homo sapiens
tccaaaagaggtaaa

SEQ ID NO: 258057 - DNA, 15 bp, Homo sapiens
ttccaaaagaggtaa

SEQ ID NO: 258058 - DNA, 15 bp, Homo sapiens
tttccaaaagaggta

SEQ ID NO: 258059 - DNA, 15 bp, Homo sapiens
gtttccaaaagaggt

SEQ ID NO: 258060 - DNA, 15 bp, Homo sapiens
tgtttccaaaagagg

SEQ ID NO: 258061 - DNA, 15 bp, Homo sapiens
atgtttccaaaagag

SEQ ID NO: 258062 - DNA, 15 bp, Homo sapiens
aatgtttccaaaaga

SEQ ID NO: 258063 - DNA, 15 bp, Homo sapiens
aaatgtttccaaaag

SEQ ID NO: 258064 - DNA, 15 bp, Homo sapiens
taaatgtttccaaaa

SEQ ID NO: 258065 - DNA, 15 bp, Homo sapiens
gtaaatgtttccaaa

SEQ ID NO: 258066 - DNA, 15 bp, Homo sapiens
tgtaaatgtttccaa

SEQ ID NO: 258067 - DNA, 15 bp, Homo sapiens
ttgtaaatgtttcca

SEQ ID NO: 258068 - DNA, 15 bp, Homo sapiens
cttgtaaatgtttcc

SEQ ID NO: 258069 - DNA, 15 bp, Homo sapiens
gcttgtaaatgtttc

SEQ ID NO: 258070 - DNA, 15 bp, Homo sapiens
agcttgtaaatgttt

SEQ ID NO: 258071 - DNA, 15 bp, Homo sapiens
tagcttgtaaatgtt

SEQ ID NO: 258072 - DNA, 15 bp, Homo sapiens
ttagcttgtaaatgt

SEQ ID NO: 258073 - DNA, 15 bp, Homo sapiens
attagcttgtaaatg

SEQ ID NO: 258074 - DNA, 15 bp, Homo sapiens
gattagcttgtaaat

SEQ ID NO: 258075 - DNA, 15 bp, Homo sapiens
ggattagcttgtaaa

SEQ ID NO: 258076 - DNA, 15 bp, Homo sapiens
aggattagcttgtaa

SEQ ID NO: 258077 - DNA, 15 bp, Homo sapiens
taggattagcttgta

SEQ ID NO: 258078 - DNA, 15 bp, Homo sapiens
gtaggattagcttgt

SEQ ID NO: 258079 - DNA, 15 bp, Homo sapiens
ggtaggattagcttg

SEQ ID NO: 258080 - DNA, 15 bp, Homo sapiens
gggtaggattagctt

SEQ ID NO: 258081 - DNA, 15 bp, Homo sapiens
cgggtaggattagct

SEQ ID NO: 258082 - DNA, 15 bp, Homo sapiens
acgggtaggattagc

SEQ ID NO: 258083 - DNA, 15 bp, Homo sapiens
gacgggtaggattag

SEQ ID NO: 258084 - DNA, 15 bp, Homo sapiens
agacgggtaggatta

SEQ ID NO: 258085 - DNA, 15 bp, Homo sapiens
gagacgggtaggatt

SEQ ID NO: 258086 - DNA, 15 bp, Homo sapiens
ggagacgggtaggat

SEQ ID NO: 258087 - DNA, 15 bp, Homo sapiens
tggagacgggtagga

SEQ ID NO: 258088 - DNA, 15 bp, Homo sapiens
gtggagacgggtagg

SEQ ID NO: 258089 - DNA, 15 bp, Homo sapiens
tgtggagacgggtag

SEQ ID NO: 258090 - DNA, 15 bp, Homo sapiens
atgtggagacgggta

SEQ ID NO: 258091 - DNA, 15 bp, Homo sapiens
aatgtggagacgggt

SEQ ID NO: 258092 - DNA, 15 bp, Homo sapiens
aaatgtggagacggg

SEQ ID NO: 258093 - DNA, 15 bp, Homo sapiens
aaaatgtggagacgg

SEQ ID NO: 258094 - DNA, 15 bp, Homo sapiens
aaaaatgtggagacg

SEQ ID NO: 258095 - DNA, 15 bp, Homo sapiens
aaaaaatgtggagac

SEQ ID NO: 258096 - DNA, 15 bp, Homo sapiens
gaaaaaatgtggaga

SEQ ID NO: 258097 - DNA, 15 bp, Homo sapiens
ggaaaaaatgtggag

SEQ ID NO: 258098 - DNA, 15 bp, Homo sapiens
gggaaaaaatgtgga

SEQ ID NO: 258099 - DNA, 15 bp, Homo sapiens
tgggaaaaaatgtgg

SEQ ID NO: 258100 - DNA, 15 bp, Homo sapiens
ctgggaaaaaatgtg

SEQ ID NO: 258101 - DNA, 15 bp, Homo sapiens
actgggaaaaaatgt

SEQ ID NO: 258102 - DNA, 15 bp, Homo sapiens
tactgggaaaaaatg

SEQ ID NO: 258103 - DNA, 15 bp, Homo sapiens
ctactgggaaaaaat

SEQ ID NO: 258104 - DNA, 15 bp, Homo sapiens
actactgggaaaaaa

SEQ ID NO: 258105 - DNA, 15 bp, Homo sapiens
aactactgggaaaaa

SEQ ID NO: 258106 - DNA, 15 bp, Homo sapiens
aaactactgggaaaa

SEQ ID NO: 258107 - DNA, 15 bp, Homo sapiens
taaactactgggaaa

SEQ ID NO: 258108 - DNA, 15 bp, Homo sapiens
ataaactactgggaa

SEQ ID NO: 258109 - DNA, 15 bp, Homo sapiens
cataaactactggga

SEQ ID NO: 258110 - DNA, 15 bp, Homo sapiens
tcataaactactggg

SEQ ID NO: 258111 - DNA, 15 bp, Homo sapiens
atcataaactactgg

SEQ ID NO: 258112 - DNA, 15 bp, Homo sapiens
aatcataaactactg

SEQ ID NO: 258113 - DNA, 15 bp, Homo sapiens
caatcataaactact

SEQ ID NO: 258114 - DNA, 15 bp, Homo sapiens
gcaatcataaactac

SEQ ID NO: 258115 - DNA, 15 bp, Homo sapiens
ggcaatcataaacta

SEQ ID NO: 258116 - DNA, 15 bp, Homo sapiens
aggcaatcataaact

SEQ ID NO: 258117 - DNA, 15 bp, Homo sapiens
caggcaatcataaac

SEQ ID NO: 258118 - DNA, 15 bp, Homo sapiens
acaggcaatcataaa

SEQ ID NO: 258119 - DNA, 15 bp, Homo sapiens
tacaggcaatcataa

SEQ ID NO: 258120 - DNA, 15 bp, Homo sapiens
ttacaggcaatcata

SEQ ID NO: 258121 - DNA, 15 bp, Homo sapiens
attacaggcaatcat

SEQ ID NO: 258122 - DNA, 15 bp, Homo sapiens
tattacaggcaatca

SEQ ID NO: 258123 - DNA, 15 bp, Homo sapiens
ctattacaggcaatc

SEQ ID NO: 258124 - DNA, 15 bp, Homo sapiens
gctattacaggcaat

SEQ ID NO: 258125 - DNA, 15 bp, Homo sapiens
tgctattacaggcaa

SEQ ID NO: 258126 - DNA, 15 bp, Homo sapiens
ctgctattacaggca

SEQ ID NO: 258127 - DNA, 15 bp, Homo sapiens
cctgctattacaggc

SEQ ID NO: 258128 - DNA, 15 bp, Homo sapiens
acctgctattacagg

SEQ ID NO: 258129 - DNA, 15 bp, Homo sapiens
aacctgctattacag

SEQ ID NO: 258130 - DNA, 15 bp, Homo sapiens
gaacctgctattaca

SEQ ID NO: 258131 - DNA, 15 bp, Homo sapiens
agaacctgctattac

SEQ ID NO: 258132 - DNA, 15 bp, Homo sapiens
gagaacctgctatta

SEQ ID NO: 258133 - DNA, 15 bp, Homo sapiens
agagaacctgctatt

SEQ ID NO: 258134 - DNA, 15 bp, Homo sapiens
gagagaacctgctat

SEQ ID NO: 258135 - DNA, 15 bp, Homo sapiens
tgagagaacctgcta

SEQ ID NO: 258136 - DNA, 15 bp, Homo sapiens
gtgagagaacctgct

SEQ ID NO: 258137 - DNA, 15 bp, Homo sapiens
ggtgagagaacctgc

SEQ ID NO: 258138 - DNA, 15 bp, Homo sapiens
aggtgagagaacctg

SEQ ID NO: 258139 - DNA, 15 bp, Homo sapiens
aaggtgagagaacct

SEQ ID NO: 258140 - DNA, 15 bp, Homo sapiens
taaggtgagagaacc

SEQ ID NO: 258141 - DNA, 15 bp, Homo sapiens
ctaaggtgagagaac

SEQ ID NO: 258142 - DNA, 15 bp, Homo sapiens
actaaggtgagagaa

SEQ ID NO: 258143 - DNA, 15 bp, Homo sapiens
cactaaggtgagaga

SEQ ID NO: 258144 - DNA, 15 bp, Homo sapiens
tcactaaggtgagag

SEQ ID NO: 258145 - DNA, 15 bp, Homo sapiens
gtcactaaggtgaga

SEQ ID NO: 258146 - DNA, 15 bp, Homo sapiens
tgtcactaaggtgag

SEQ ID NO: 258147 - DNA, 15 bp, Homo sapiens
ttgtcactaaggtga

SEQ ID NO: 258148 - DNA, 15 bp, Homo sapiens
cttgtcactaaggtg

SEQ ID NO: 258149 - DNA, 15 bp, Homo sapiens
acttgtcactaaggt

SEQ ID NO: 258150 - DNA, 15 bp, Homo sapiens
cacttgtcactaagg

SEQ ID NO: 258151 - DNA, 15 bp, Homo sapiens
gcacttgtcactaag

SEQ ID NO: 258152 - DNA, 15 bp, Homo sapiens
agcacttgtcactaa

SEQ ID NO: 258153 - DNA, 15 bp, Homo sapiens
aagcacttgtcacta

SEQ ID NO: 258154 - DNA, 15 bp, Homo sapiens
caagcacttgtcact

SEQ ID NO: 258155 - DNA, 15 bp, Homo sapiens
gcaagcacttgtcac

SEQ ID NO: 258156 - DNA, 15 bp, Homo sapiens
ggcaagcacttgtca

SEQ ID NO: 258157 - DNA, 15 bp, Homo sapiens
aggcaagcacttgtc

SEQ ID NO: 258158 - DNA, 15 bp, Homo sapiens
aaggcaagcacttgt

SEQ ID NO: 258159 - DNA, 15 bp, Homo sapiens
aaaggcaagcacttg

SEQ ID NO: 258160 - DNA, 15 bp, Homo sapiens
caaaggcaagcactt

SEQ ID NO: 258161 - DNA, 15 bp, Homo sapiens
acaaaggcaagcact

SEQ ID NO: 258162 - DNA, 15 bp, Homo sapiens
cacaaaggcaagcac

SEQ ID NO: 258163 - DNA, 15 bp, Homo sapiens
acacaaaggcaagca

SEQ ID NO: 258164 - DNA, 15 bp, Homo sapiens
cacacaaaggcaagc

SEQ ID NO: 258165 - DNA, 15 bp, Homo sapiens
gcacacaaaggcaag

SEQ ID NO: 258166 - DNA, 15 bp, Homo sapiens
agcacacaaaggcaa

SEQ ID NO: 258167 - DNA, 15 bp, Homo sapiens
gagcacacaaaggca

SEQ ID NO: 258168 - DNA, 15 bp, Homo sapiens
cgagcacacaaaggc

SEQ ID NO: 258169 - DNA, 15 bp, Homo sapiens
tcgagcacacaaagg

SEQ ID NO: 258170 - DNA, 15 bp, Homo sapiens
ttcgagcacacaaag

SEQ ID NO: 258171 - DNA, 15 bp, Homo sapiens
attcgagcacacaaa

SEQ ID NO: 258172 - DNA, 15 bp, Homo sapiens
tattcgagcacacaa

SEQ ID NO: 258173 - DNA, 15 bp, Homo sapiens
ttattcgagcacaca

SEQ ID NO: 258174 - DNA, 15 bp, Homo sapiens
attattcgagcacac

SEQ ID NO: 258175 - DNA, 15 bp, Homo sapiens
cattattcgagcaca

SEQ ID NO: 258176 - DNA, 15 bp, Homo sapiens
acattattcgagcac

SEQ ID NO: 258177 - DNA, 15 bp, Homo sapiens
aacattattcgagca

SEQ ID NO: 258178 - DNA, 15 bp, Homo sapiens
aaacattattcgagc

SEQ ID NO: 258179 - DNA, 15 bp, Homo sapiens
caaacattattcgag

SEQ ID NO: 258180 - DNA, 15 bp, Homo sapiens
ccaaacattattcga

SEQ ID NO: 258181 - DNA, 15 bp, Homo sapiens
accaaacattattcg

SEQ ID NO: 258182 - DNA, 15 bp, Homo sapiens
caccaaacattattc

SEQ ID NO: 258183 - DNA, 15 bp, Homo sapiens
ccaccaaacattatt

SEQ ID NO: 258184 - DNA, 15 bp, Homo sapiens
tccaccaaacattat

SEQ ID NO: 258185 - DNA, 15 bp, Homo sapiens
atccaccaaacatta

SEQ ID NO: 258186 - DNA, 15 bp, Homo sapiens
aatccaccaaacatt

SEQ ID NO: 258187 - DNA, 15 bp, Homo sapiens
caatccaccaaacat

SEQ ID NO: 258188 - DNA, 15 bp, Homo sapiens
gcaatccaccaaaca

SEQ ID NO: 258189 - DNA, 15 bp, Homo sapiens
ggcaatccaccaaac

SEQ ID NO: 258190 - DNA, 15 bp, Homo sapiens
gggcaatccaccaaa

SEQ ID NO: 258191 - DNA, 15 bp, Homo sapiens
ggggcaatccaccaa

SEQ ID NO: 258192 - DNA, 15 bp, Homo sapiens
tggggcaatccacca

SEQ ID NO: 258193 - DNA, 15 bp, Homo sapiens
atggggcaatccacc

SEQ ID NO: 258194 - DNA, 15 bp, Homo sapiens
gatggggcaatccac

SEQ ID NO: 258195 - DNA, 15 bp, Homo sapiens
agatggggcaatcca

SEQ ID NO: 258196 - DNA, 15 bp, Homo sapiens
gagatggggcaatcc

SEQ ID NO: 258197 - DNA, 15 bp, Homo sapiens
ggagatggggcaatc

SEQ ID NO: 258198 - DNA, 15 bp, Homo sapiens
tggagatggggcaat

SEQ ID NO: 258199 - DNA, 15 bp, Homo sapiens
gtggagatggggcaa

SEQ ID NO: 258200 - DNA, 15 bp, Homo sapiens
agtggagatggggca

SEQ ID NO: 258201 - DNA, 15 bp, Homo sapiens
cagtggagatggggc

SEQ ID NO: 258202 - DNA, 15 bp, Homo sapiens
acagtggagatgggg

SEQ ID NO: 258203 - DNA, 15 bp, Homo sapiens
cacagtggagatggg

SEQ ID NO: 258204 - DNA, 15 bp, Homo sapiens
tcacagtggagatgg

SEQ ID NO: 258205 - DNA, 15 bp, Homo sapiens
ttcacagtggagatg

SEQ ID NO: 258206 - DNA, 15 bp, Homo sapiens
gttcacagtggagat

SEQ ID NO: 258207 - DNA, 15 bp, Homo sapiens
agttcacagtggaga

SEQ ID NO: 258208 - DNA, 15 bp, Homo sapiens
tagttcacagtggag

SEQ ID NO: 258209 - DNA, 15 bp, Homo sapiens
gtagttcacagtgga

SEQ ID NO: 258210 - DNA, 15 bp, Homo sapiens
agtagttcacagtgg

SEQ ID NO: 258211 - DNA, 15 bp, Homo sapiens
aagtagttcacagtg

SEQ ID NO: 258212 - DNA, 15 bp, Homo sapiens
aaagtagttcacagt

SEQ ID NO: 258213 - DNA, 15 bp, Homo sapiens
taaagtagttcacag

SEQ ID NO: 258214 - DNA, 15 bp, Homo sapiens
ctaaagtagttcaca

SEQ ID NO: 258215 - DNA, 15 bp, Homo sapiens
cctaaagtagttcac

SEQ ID NO: 258216 - DNA, 15 bp, Homo sapiens
acctaaagtagttca

SEQ ID NO: 258217 - DNA, 15 bp, Homo sapiens
gacctaaagtagttc

SEQ ID NO: 258218 - DNA, 15 bp, Homo sapiens
tgacctaaagtagtt

SEQ ID NO: 258219 - DNA, 15 bp, Homo sapiens
atgacctaaagtagt

SEQ ID NO: 258220 - DNA, 15 bp, Homo sapiens
catgacctaaagtag

SEQ ID NO: 258221 - DNA, 15 bp, Homo sapiens
ccatgacctaaagta

SEQ ID NO: 258222 - DNA, 15 bp, Homo sapiens
gccatgacctaaagt

SEQ ID NO: 258223 - DNA, 15 bp, Homo sapiens
agccatgacctaaag

SEQ ID NO: 258224 - DNA, 15 bp, Homo sapiens
cagccatgacctaaa

SEQ ID NO: 258225 - DNA, 15 bp, Homo sapiens
acagccatgacctaa

SEQ ID NO: 258226 - DNA, 15 bp, Homo sapiens
gacagccatgaccta

SEQ ID NO: 258227 - DNA, 15 bp, Homo sapiens
agacagccatgacct

SEQ ID NO: 258228 - DNA, 15 bp, Homo sapiens
gagacagccatgacc

SEQ ID NO: 258229 - DNA, 15 bp, Homo sapiens
agagacagccatgac

SEQ ID NO: 258230 - DNA, 15 bp, Homo sapiens
gagagacagccatga

SEQ ID NO: 258231 - DNA, 15 bp, Homo sapiens
tgagagacagccatg

SEQ ID NO: 258232 - DNA, 15 bp, Homo sapiens
atgagagacagccat

SEQ ID NO: 258233 - DNA, 15 bp, Homo sapiens
aatgagagacagcca

SEQ ID NO: 258234 - DNA, 15 bp, Homo sapiens
taatgagagacagcc

SEQ ID NO: 258235 - DNA, 15 bp, Homo sapiens
ataatgagagacagc

SEQ ID NO: 258236 - DNA, 15 bp, Homo sapiens
cataatgagagacag

SEQ ID NO: 258237 - DNA, 15 bp, Homo sapiens
acataatgagagaca

SEQ ID NO: 258238 - DNA, 15 bp, Homo sapiens
cacataatgagagac

SEQ ID NO: 258239 - DNA, 15 bp, Homo sapiens
gcacataatgagaga

SEQ ID NO: 258240 - DNA, 15 bp, Homo sapiens
tgcacataatgagag

SEQ ID NO: 258241 - DNA, 15 bp, Homo sapiens
ttgcacataatgaga

SEQ ID NO: 258242 - DNA, 15 bp, Homo sapiens
tttgcacataatgag

SEQ ID NO: 258243 - DNA, 15 bp, Homo sapiens
atttgcacataatga

SEQ ID NO: 258244 - DNA, 15 bp, Homo sapiens
gatttgcacataatg

SEQ ID NO: 258245 - DNA, 15 bp, Homo sapiens
agatttgcacataat

SEQ ID NO: 258246 - DNA, 15 bp, Homo sapiens
gagatttgcacataa

SEQ ID NO: 258247 - DNA, 15 bp, Homo sapiens
ggagatttgcacata

SEQ ID NO: 258248 - DNA, 15 bp, Homo sapiens
tggagatttgcacat

SEQ ID NO: 258249 - DNA, 15 bp, Homo sapiens
gtggagatttgcaca

SEQ ID NO: 258250 - DNA, 15 bp, Homo sapiens
ggtggagatttgcac

SEQ ID NO: 258251 - DNA, 15 bp, Homo sapiens
gggtggagatttgca

SEQ ID NO: 258252 - DNA, 15 bp, Homo sapiens
tgggtggagatttgc

SEQ ID NO: 258253 - DNA, 15 bp, Homo sapiens
ctgggtggagatttg

SEQ ID NO: 258254 - DNA, 15 bp, Homo sapiens
gctgggtggagattt

SEQ ID NO: 258255 - DNA, 15 bp, Homo sapiens
tgctgggtggagatt

SEQ ID NO: 258256 - DNA, 15 bp, Homo sapiens
atgctgggtggagat

SEQ ID NO: 258257 - DNA, 15 bp, Homo sapiens
tatgctgggtggaga

SEQ ID NO: 258258 - DNA, 15 bp, Homo sapiens
ttatgctgggtggag

SEQ ID NO: 258259 - DNA, 15 bp, Homo sapiens
cttatgctgggtgga

SEQ ID NO: 258260 - DNA, 15 bp, Homo sapiens
ccttatgctgggtgg

SEQ ID NO: 258261 - DNA, 15 bp, Homo sapiens
gccttatgctgggtg

SEQ ID NO: 258262 - DNA, 15 bp, Homo sapiens
tgccttatgctgggt

SEQ ID NO: 258263 - DNA, 15 bp, Homo sapiens
ctgccttatgctggg

SEQ ID NO: 258264 - DNA, 15 bp, Homo sapiens
tctgccttatgctgg

SEQ ID NO: 258265 - DNA, 15 bp, Homo sapiens
ctctgccttatgctg

SEQ ID NO: 258266 - DNA, 15 bp, Homo sapiens
cctctgccttatgct

SEQ ID NO: 258267 - DNA, 15 bp, Homo sapiens
ccctctgccttatgc

SEQ ID NO: 258268 - DNA, 15 bp, Homo sapiens
gccctctgccttatg

SEQ ID NO: 258269 - DNA, 15 bp, Homo sapiens
tgccctctgccttat

SEQ ID NO: 258270 - DNA, 15 bp, Homo sapiens
ctgccctctgcctta

SEQ ID NO: 258271 - DNA, 15 bp, Homo sapiens
actgccctctgcctt

SEQ ID NO: 258272 - DNA, 15 bp, Homo sapiens
cactgccctctgcct

SEQ ID NO: 258273 - DNA, 15 bp, Homo sapiens
acactgccctctgcc

SEQ ID NO: 258274 - DNA, 15 bp, Homo sapiens
gacactgccctctgc

SEQ ID NO: 258275 - DNA, 15 bp, Homo sapiens
tgacactgccctctg

SEQ ID NO: 258276 - DNA, 15 bp, Homo sapiens
atgacactgccctct

SEQ ID NO: 258277 - DNA, 15 bp, Homo sapiens
aatgacactgccctc

SEQ ID NO: 258278 - DNA, 15 bp, Homo sapiens
caatgacactgccct

SEQ ID NO: 258279 - DNA, 15 bp, Homo sapiens
acaatgacactgccc

SEQ ID NO: 258280 - DNA, 15 bp, Homo sapiens
aacaatgacactgcc

SEQ ID NO: 258281 - DNA, 15 bp, Homo sapiens
gaacaatgacactgc

SEQ ID NO: 258282 - DNA, 15 bp, Homo sapiens
tgaacaatgacactg

SEQ ID NO: 258283 - DNA, 15 bp, Homo sapiens
atgaacaatgacact

SEQ ID NO: 258284 - DNA, 15 bp, Homo sapiens
aatgaacaatgacac

SEQ ID NO: 258285 - DNA, 15 bp, Homo sapiens
gaatgaacaatgaca

SEQ ID NO: 258286 - DNA, 15 bp, Homo sapiens
tgaatgaacaatgac

SEQ ID NO: 258287 - DNA, 15 bp, Homo sapiens
atgaatgaacaatga

SEQ ID NO: 258288 - DNA, 15 bp, Homo sapiens
aatgaatgaacaatg

SEQ ID NO: 258289 - DNA, 15 bp, Homo sapiens
aaatgaatgaacaat

SEQ ID NO: 258290 - DNA, 15 bp, Homo sapiens
caaatgaatgaacaa

SEQ ID NO: 258291 - DNA, 15 bp, Homo sapiens
acaaatgaatgaaca

SEQ ID NO: 258292 - DNA, 15 bp, Homo sapiens
aacaaatgaatgaac

SEQ ID NO: 258293 - DNA, 15 bp, Homo sapiens
caacaaatgaatgaa

SEQ ID NO: 258294 - DNA, 15 bp, Homo sapiens
ccaacaaatgaatga

SEQ ID NO: 258295 - DNA, 15 bp, Homo sapiens
cccaacaaatgaatg

SEQ ID NO: 258296 - DNA, 15 bp, Homo sapiens
gcccaacaaatgaat

SEQ ID NO: 258297 - DNA, 15 bp, Homo sapiens
agcccaacaaatgaa

SEQ ID NO: 258298 - DNA, 15 bp, Homo sapiens
gagcccaacaaatga

SEQ ID NO: 258299 - DNA, 15 bp, Homo sapiens
ggagcccaacaaatg

SEQ ID NO: 258300 - DNA, 15 bp, Homo sapiens
tggagcccaacaaat

SEQ ID NO: 258301 - DNA, 15 bp, Homo sapiens
ttggagcccaacaaa

SEQ ID NO: 258302 - DNA, 15 bp, Homo sapiens
cttggagcccaacaa

SEQ ID NO: 258303 - DNA, 15 bp, Homo sapiens
tcttggagcccaaca

SEQ ID NO: 258304 - DNA, 15 bp, Homo sapiens
atcttggagcccaac

SEQ ID NO: 258305 - DNA, 15 bp, Homo sapiens
aatcttggagcccaa

SEQ ID NO: 258306 - DNA, 15 bp, Homo sapiens
caatcttggagccca

SEQ ID NO: 258307 - DNA, 15 bp, Homo sapiens
acaatcttggagccc

SEQ ID NO: 258308 - DNA, 15 bp, Homo sapiens
cacaatcttggagcc

SEQ ID NO: 258309 - DNA, 15 bp, Homo sapiens
gcacaatcttggagc

SEQ ID NO: 258310 - DNA, 15 bp, Homo sapiens
tgcacaatcttggag

SEQ ID NO: 258311 - DNA, 15 bp, Homo sapiens
ctgcacaatcttgga

SEQ ID NO: 258312 - DNA, 15 bp, Homo sapiens
cctgcacaatcttgg

SEQ ID NO: 258313 - DNA, 15 bp, Homo sapiens
tcctgcacaatcttg

SEQ ID NO: 258314 - DNA, 15 bp, Homo sapiens
ctcctgcacaatctt

SEQ ID NO: 258315 - DNA, 15 bp, Homo sapiens
tctcctgcacaatct

SEQ ID NO: 258316 - DNA, 15 bp, Homo sapiens
atctcctgcacaatc

SEQ ID NO: 258317 - DNA, 15 bp, Homo sapiens
tatctcctgcacaat

SEQ ID NO: 258318 - DNA, 15 bp, Homo sapiens
ttatctcctgcacaa

SEQ ID NO: 258319 - DNA, 15 bp, Homo sapiens
tttatctcctgcaca

SEQ ID NO: 258320 - DNA, 15 bp, Homo sapiens
ttttatctcctgcac

SEQ ID NO: 258321 - DNA, 15 bp, Homo sapiens
gttttatctcctgca

SEQ ID NO: 258322 - DNA, 15 bp, Homo sapiens
tgttttatctcctgc

SEQ ID NO: 258323 - DNA, 15 bp, Homo sapiens
gtgttttatctcctg

SEQ ID NO: 258324 - DNA, 15 bp, Homo sapiens
agtgttttatctcct

SEQ ID NO: 258325 - DNA, 15 bp, Homo sapiens
tagtgttttatctcc

SEQ ID NO: 258326 - DNA, 15 bp, Homo sapiens
atagtgttttatctc

SEQ ID NO: 258327 - DNA, 15 bp, Homo sapiens
tatagtgttttatct

SEQ ID NO: 258328 - DNA, 15 bp, Homo sapiens
ttatagtgttttatc

SEQ ID NO: 258329 - DNA, 15 bp, Homo sapiens
tttatagtgttttat

SEQ ID NO: 258330 - DNA, 15 bp, Homo sapiens
ctttatagtgtttta

SEQ ID NO: 258331 - DNA, 15 bp, Homo sapiens
tctttatagtgtttt

SEQ ID NO: 258332 - DNA, 15 bp, Homo sapiens
ctctttatagtgttt

SEQ ID NO: 258333 - DNA, 15 bp, Homo sapiens
tctctttatagtgtt

SEQ ID NO: 258334 - DNA, 15 bp, Homo sapiens
gtctctttatagtgt

SEQ ID NO: 258335 - DNA, 15 bp, Homo sapiens
agtctctttatagtg

SEQ ID NO: 258336 - DNA, 15 bp, Homo sapiens
aagtctctttatagt

SEQ ID NO: 258337 - DNA, 15 bp, Homo sapiens
caagtctctttatag

SEQ ID NO: 258338 - DNA, 15 bp, Homo sapiens
tcaagtctctttata

SEQ ID NO: 258339 - DNA, 15 bp, Homo sapiens
atcaagtctctttat

SEQ ID NO: 258340 - DNA, 15 bp, Homo sapiens
aatcaagtctcttta

SEQ ID NO: 258341 - DNA, 15 bp, Homo sapiens
gaatcaagtctcttt

SEQ ID NO: 258342 - DNA, 15 bp, Homo sapiens
agaatcaagtctctt

SEQ ID NO: 258343 - DNA, 15 bp, Homo sapiens
gagaatcaagtctct

SEQ ID NO: 258344 - DNA, 15 bp, Homo sapiens
tgagaatcaagtctc

SEQ ID NO: 258345 - DNA, 15 bp, Homo sapiens
gtgagaatcaagtct

SEQ ID NO: 258346 - DNA, 15 bp, Homo sapiens
tgtgagaatcaagtc

SEQ ID NO: 258347 - DNA, 15 bp, Homo sapiens
gtgtgagaatcaagt

SEQ ID NO: 258348 - DNA, 15 bp, Homo sapiens
agtgtgagaatcaag

SEQ ID NO: 258349 - DNA, 15 bp, Homo sapiens
cagtgtgagaatcaa

SEQ ID NO: 258350 - DNA, 15 bp, Homo sapiens
tcagtgtgagaatca

SEQ ID NO: 258351 - DNA, 15 bp, Homo sapiens
ttcagtgtgagaatc

SEQ ID NO: 258352 - DNA, 15 bp, Homo sapiens
cttcagtgtgagaat

SEQ ID NO: 258353 - DNA, 15 bp, Homo sapiens
ccttcagtgtgagaa

SEQ ID NO: 258354 - DNA, 15 bp, Homo sapiens
tccttcagtgtgaga

SEQ ID NO: 258355 - DNA, 15 bp, Homo sapiens
ttccttcagtgtgag

SEQ ID NO: 258356 - DNA, 15 bp, Homo sapiens
gttccttcagtgtga

SEQ ID NO: 258357 - DNA, 15 bp, Homo sapiens
agttccttcagtgtg

SEQ ID NO: 258358 - DNA, 15 bp, Homo sapiens
gagttccttcagtgt

SEQ ID NO: 258359 - DNA, 15 bp, Homo sapiens
tgagttccttcagtg

SEQ ID NO: 258360 - DNA, 15 bp, Homo sapiens
atgagttccttcagt

SEQ ID NO: 258361 - DNA, 15 bp, Homo sapiens
tatgagttccttcag

SEQ ID NO: 258362 - DNA, 15 bp, Homo sapiens
atatgagttccttca

SEQ ID NO: 258363 - DNA, 15 bp, Homo sapiens
aatatgagttccttc

SEQ ID NO: 258364 - DNA, 15 bp, Homo sapiens
aaatatgagttcctt

SEQ ID NO: 258365 - DNA, 15 bp, Homo sapiens
gaaatatgagttcct

SEQ ID NO: 258366 - DNA, 15 bp, Homo sapiens
cgaaatatgagttcc

SEQ ID NO: 258367 - DNA, 15 bp, Homo sapiens
tcgaaatatgagttc

SEQ ID NO: 258368 - DNA, 15 bp, Homo sapiens
ctcgaaatatgagtt

SEQ ID NO: 258369 - DNA, 15 bp, Homo sapiens
tctcgaaatatgagt

SEQ ID NO: 258370 - DNA, 15 bp, Homo sapiens
ttctcgaaatatgag

SEQ ID NO: 258371 - DNA, 15 bp, Homo sapiens
gttctcgaaatatga

SEQ ID NO: 258372 - DNA, 15 bp, Homo sapiens
cgttctcgaaatatg

SEQ ID NO: 258373 - DNA, 15 bp, Homo sapiens
acgttctcgaaatat

SEQ ID NO: 258374 - DNA, 15 bp, Homo sapiens
aacgttctcgaaata

SEQ ID NO: 258375 - DNA, 15 bp, Homo sapiens
caacgttctcgaaat

SEQ ID NO: 258376 - DNA, 15 bp, Homo sapiens
gcaacgttctcgaaa

SEQ ID NO: 258377 - DNA, 15 bp, Homo sapiens
tgcaacgttctcgaa

SEQ ID NO: 258378 - DNA, 15 bp, Homo sapiens
gtgcaacgttctcga

SEQ ID NO: 258379 - DNA, 15 bp, Homo sapiens
tgtgcaacgttctcg

SEQ ID NO: 258380 - DNA, 15 bp, Homo sapiens
atgtgcaacgttctc

SEQ ID NO: 258381 - DNA, 15 bp, Homo sapiens
catgtgcaacgttct

SEQ ID NO: 258382 - DNA, 15 bp, Homo sapiens
ccatgtgcaacgttc

SEQ ID NO: 258383 - DNA, 15 bp, Homo sapiens
tccatgtgcaacgtt

SEQ ID NO: 258384 - DNA, 15 bp, Homo sapiens
gtccatgtgcaacgt

SEQ ID NO: 258385 - DNA, 15 bp, Homo sapiens
ggtccatgtgcaacg

SEQ ID NO: 258386 - DNA, 15 bp, Homo sapiens
gggtccatgtgcaac

SEQ ID NO: 258387 - DNA, 15 bp, Homo sapiens
tgggtccatgtgcaa

SEQ ID NO: 258388 - DNA, 15 bp, Homo sapiens
ttgggtccatgtgca

SEQ ID NO: 258389 - DNA, 15 bp, Homo sapiens
attgggtccatgtgc

SEQ ID NO: 258390 - DNA, 15 bp, Homo sapiens
cattgggtccatgtg

SEQ ID NO: 258391 - DNA, 15 bp, Homo sapiens
gcattgggtccatgt

SEQ ID NO: 258392 - DNA, 15 bp, Homo sapiens
ggcattgggtccatg

SEQ ID NO: 258393 - DNA, 15 bp, Homo sapiens
gggcattgggtccat

SEQ ID NO: 258394 - DNA, 15 bp, Homo sapiens
agggcattgggtcca

SEQ ID NO: 258395 - DNA, 15 bp, Homo sapiens
cagggcattgggtcc

SEQ ID NO: 258396 - DNA, 15 bp, Homo sapiens
gcagggcattgggtc

SEQ ID NO: 258397 - DNA, 15 bp, Homo sapiens
agcagggcattgggt

SEQ ID NO: 258398 - DNA, 15 bp, Homo sapiens
aagcagggcattggg

SEQ ID NO: 258399 - DNA, 15 bp, Homo sapiens
taagcagggcattgg

SEQ ID NO: 258400 - DNA, 15 bp, Homo sapiens
gtaagcagggcattg

SEQ ID NO: 258401 - DNA, 15 bp, Homo sapiens
tgtaagcagggcatt

SEQ ID NO: 258402 - DNA, 15 bp, Homo sapiens
ttgtaagcagggcat

SEQ ID NO: 258403 - DNA, 15 bp, Homo sapiens
tttgtaagcagggca

SEQ ID NO: 258404 - DNA, 15 bp, Homo sapiens
ttttgtaagcagggc

SEQ ID NO: 258405 - DNA, 15 bp, Homo sapiens
cttttgtaagcaggg

SEQ ID NO: 258406 - DNA, 15 bp, Homo sapiens
tcttttgtaagcagg

SEQ ID NO: 258407 - DNA, 15 bp, Homo sapiens
atcttttgtaagcag

SEQ ID NO: 258408 - DNA, 15 bp, Homo sapiens
aatcttttgtaagca

SEQ ID NO: 258409 - DNA, 15 bp, Homo sapiens
gaatcttttgtaagc

SEQ ID NO: 258410 - DNA, 15 bp, Homo sapiens
ggaatcttttgtaag

SEQ ID NO: 258411 - DNA, 15 bp, Homo sapiens
aggaatcttttgtaa

SEQ ID NO: 258412 - DNA, 15 bp, Homo sapiens
caggaatcttttgta

SEQ ID NO: 258413 - DNA, 15 bp, Homo sapiens
gcaggaatcttttgt

SEQ ID NO: 258414 - DNA, 15 bp, Homo sapiens
agcaggaatcttttg

SEQ ID NO: 258415 - DNA, 15 bp, Homo sapiens
cagcaggaatctttt

SEQ ID NO: 258416 - DNA, 15 bp, Homo sapiens
gcagcaggaatcttt

SEQ ID NO: 258417 - DNA, 15 bp, Homo sapiens
ggcagcaggaatctt

SEQ ID NO: 258418 - DNA, 15 bp, Homo sapiens
gggcagcaggaatct

SEQ ID NO: 258419 - DNA, 15 bp, Homo sapiens
agggcagcaggaatc

SEQ ID NO: 258420 - DNA, 15 bp, Homo sapiens
gagggcagcaggaat

SEQ ID NO: 258421 - DNA, 15 bp, Homo sapiens
tgagggcagcaggaa

SEQ ID NO: 258422 - DNA, 15 bp, Homo sapiens
ctgagggcagcagga

SEQ ID NO: 258423 - DNA, 15 bp, Homo sapiens
tctgagggcagcagg

SEQ ID NO: 258424 - DNA, 15 bp, Homo sapiens
ttctgagggcagcag

SEQ ID NO: 258425 - DNA, 15 bp, Homo sapiens
attctgagggcagca

SEQ ID NO: 258426 - DNA, 15 bp, Homo sapiens
cattctgagggcagc

SEQ ID NO: 258427 - DNA, 15 bp, Homo sapiens
ccattctgagggcag

SEQ ID NO: 258428 - DNA, 15 bp, Homo sapiens
tccattctgagggca

SEQ ID NO: 258429 - DNA, 15 bp, Homo sapiens
ttccattctgagggc

SEQ ID NO: 258430 - DNA, 15 bp, Homo sapiens
attccattctgaggg

SEQ ID NO: 258431 - DNA, 15 bp, Homo sapiens
cattccattctgagg

SEQ ID NO: 258432 - DNA, 15 bp, Homo sapiens
ccattccattctgag

SEQ ID NO: 258433 - DNA, 15 bp, Homo sapiens
accattccattctga

SEQ ID NO: 258434 - DNA, 15 bp, Homo sapiens
gaccattccattctg

SEQ ID NO: 258435 - DNA, 15 bp, Homo sapiens
agaccattccattct

SEQ ID NO: 258436 - DNA, 15 bp, Homo sapiens
aagaccattccattc

SEQ ID NO: 258437 - DNA, 15 bp, Homo sapiens
aaagaccattccatt

SEQ ID NO: 258438 - DNA, 15 bp, Homo sapiens
caaagaccattccat

SEQ ID NO: 258439 - DNA, 15 bp, Homo sapiens
gcaaagaccattcca

SEQ ID NO: 258440 - DNA, 15 bp, Homo sapiens
ggcaaagaccattcc

SEQ ID NO: 258441 - DNA, 15 bp, Homo sapiens
aggcaaagaccattc

SEQ ID NO: 258442 - DNA, 15 bp, Homo sapiens
caggcaaagaccatt

SEQ ID NO: 258443 - DNA, 15 bp, Homo sapiens
ccaggcaaagaccat

SEQ ID NO: 258444 - DNA, 15 bp, Homo sapiens
gccaggcaaagacca

SEQ ID NO: 258445 - DNA, 15 bp, Homo sapiens
agccaggcaaagacc

SEQ ID NO: 258446 - DNA, 15 bp, Homo sapiens
gagccaggcaaagac

SEQ ID NO: 258447 - DNA, 15 bp, Homo sapiens
tgagccaggcaaaga

SEQ ID NO: 258448 - DNA, 15 bp, Homo sapiens
gtgagccaggcaaag

SEQ ID NO: 258449 - DNA, 15 bp, Homo sapiens
ggtgagccaggcaaa

SEQ ID NO: 258450 - DNA, 15 bp, Homo sapiens
aggtgagccaggcaa

SEQ ID NO: 258451 - DNA, 15 bp, Homo sapiens
gaggtgagccaggca

SEQ ID NO: 258452 - DNA, 15 bp, Homo sapiens
agaggtgagccaggc

SEQ ID NO: 258453 - DNA, 15 bp, Homo sapiens
gagaggtgagccagg

SEQ ID NO: 258454 - DNA, 15 bp, Homo sapiens
agagaggtgagccag

SEQ ID NO: 258455 - DNA, 15 bp, Homo sapiens
cagagaggtgagcca

SEQ ID NO: 258456 - DNA, 15 bp, Homo sapiens
acagagaggtgagcc

SEQ ID NO: 258457 - DNA, 15 bp, Homo sapiens
gacagagaggtgagc

SEQ ID NO: 258458 - DNA, 15 bp, Homo sapiens
ggacagagaggtgag

SEQ ID NO: 258459 - DNA, 15 bp, Homo sapiens
tggacagagaggtga

SEQ ID NO: 258460 - DNA, 15 bp, Homo sapiens
gtggacagagaggtg

SEQ ID NO: 258461 - DNA, 15 bp, Homo sapiens
ggtggacagagaggt

SEQ ID NO: 258462 - DNA, 15 bp, Homo sapiens
aggtggacagagagg

SEQ ID NO: 258463 - DNA, 15 bp, Homo sapiens
gaggtggacagagag

SEQ ID NO: 258464 - DNA, 15 bp, Homo sapiens
ggaggtggacagaga

SEQ ID NO: 258465 - DNA, 15 bp, Homo sapiens
aggaggtggacagag

SEQ ID NO: 258466 - DNA, 15 bp, Homo sapiens
aaggaggtggacaga

SEQ ID NO: 258467 - DNA, 15 bp, Homo sapiens
gaaggaggtggacag

SEQ ID NO: 258468 - DNA, 15 bp, Homo sapiens
ggaaggaggtggaca

SEQ ID NO: 258469 - DNA, 15 bp, Homo sapiens
gggaaggaggtggac

SEQ ID NO: 258470 - DNA, 15 bp, Homo sapiens
agggaaggaggtgga

SEQ ID NO: 258471 - DNA, 15 bp, Homo sapiens
gagggaaggaggtgg

SEQ ID NO: 258472 - DNA, 15 bp, Homo sapiens
agagggaaggaggtg

SEQ ID NO: 258473 - DNA, 15 bp, Homo sapiens
cagagggaaggaggt

SEQ ID NO: 258474 - DNA, 15 bp, Homo sapiens
gcagagggaaggagg

SEQ ID NO: 258475 - DNA, 15 bp, Homo sapiens
agcagagggaaggag

SEQ ID NO: 258476 - DNA, 15 bp, Homo sapiens
gagcagagggaagga

SEQ ID NO: 258477 - DNA, 15 bp, Homo sapiens
ggagcagagggaagg

SEQ ID NO: 258478 - DNA, 15 bp, Homo sapiens
tggagcagagggaag

SEQ ID NO: 258479 - DNA, 15 bp, Homo sapiens
gtggagcagagggaa

SEQ ID NO: 258480 - DNA, 15 bp, Homo sapiens
ggtggagcagaggga

SEQ ID NO: 258481 - DNA, 15 bp, Homo sapiens
cggtggagcagaggg

SEQ ID NO: 258482 - DNA, 15 bp, Homo sapiens
ccggtggagcagagg

SEQ ID NO: 258483 - DNA, 15 bp, Homo sapiens
cccggtggagcagag

SEQ ID NO: 258484 - DNA, 15 bp, Homo sapiens
ccccggtggagcaga

SEQ ID NO: 258485 - DNA, 15 bp, Homo sapiens
gccccggtggagcag

SEQ ID NO: 258486 - DNA, 15 bp, Homo sapiens
tgccccggtggagca

SEQ ID NO: 258487 - DNA, 15 bp, Homo sapiens
atgccccggtggagc

SEQ ID NO: 258488 - DNA, 15 bp, Homo sapiens
gatgccccggtggag

SEQ ID NO: 258489 - DNA, 15 bp, Homo sapiens
tgatgccccggtgga

SEQ ID NO: 258490 - DNA, 15 bp, Homo sapiens
gtgatgccccggtgg

SEQ ID NO: 258491 - DNA, 15 bp, Homo sapiens
ggtgatgccccggtg

SEQ ID NO: 258492 - DNA, 15 bp, Homo sapiens
tggtgatgccccggt

SEQ ID NO: 258493 - DNA, 15 bp, Homo sapiens
atggtgatgccccgg

SEQ ID NO: 258494 - DNA, 15 bp, Homo sapiens
aatggtgatgccccg

SEQ ID NO: 258495 - DNA, 15 bp, Homo sapiens
aaatggtgatgcccc

SEQ ID NO: 258496 - DNA, 15 bp, Homo sapiens
gaaatggtgatgccc

SEQ ID NO: 258497 - DNA, 15 bp, Homo sapiens
tgaaatggtgatgcc

SEQ ID NO: 258498 - DNA, 15 bp, Homo sapiens
atgaaatggtgatgc

SEQ ID NO: 258499 - DNA, 15 bp, Homo sapiens
gatgaaatggtgatg

SEQ ID NO: 258500 - DNA, 15 bp, Homo sapiens
tgatgaaatggtgat

SEQ ID NO: 258501 - DNA, 15 bp, Homo sapiens
atgatgaaatggtga

SEQ ID NO: 258502 - DNA, 15 bp, Homo sapiens
gatgatgaaatggtg

SEQ ID NO: 258503 - DNA, 15 bp, Homo sapiens
ggatgatgaaatggt

SEQ ID NO: 258504 - DNA, 15 bp, Homo sapiens
tggatgatgaaatgg

SEQ ID NO: 258505 - DNA, 15 bp, Homo sapiens
gtggatgatgaaatg

SEQ ID NO: 258506 - DNA, 15 bp, Homo sapiens
agtggatgatgaaat

SEQ ID NO: 258507 - DNA, 15 bp, Homo sapiens
aagtggatgatgaaa

SEQ ID NO: 258508 - DNA, 15 bp, Homo sapiens
taagtggatgatgaa

SEQ ID NO: 258509 - DNA, 15 bp, Homo sapiens
ctaagtggatgatga

SEQ ID NO: 258510 - DNA, 15 bp, Homo sapiens
actaagtggatgatg

SEQ ID NO: 258511 - DNA, 15 bp, Homo sapiens
cactaagtggatgat

SEQ ID NO: 258512 - DNA, 15 bp, Homo sapiens
tcactaagtggatga

SEQ ID NO: 258513 - DNA, 15 bp, Homo sapiens
atcactaagtggatg

SEQ ID NO: 258514 - DNA, 15 bp, Homo sapiens
tatcactaagtggat

SEQ ID NO: 258515 - DNA, 15 bp, Homo sapiens
ctatcactaagtgga

SEQ ID NO: 258516 - DNA, 15 bp, Homo sapiens
tctatcactaagtgg

SEQ ID NO: 258517 - DNA, 15 bp, Homo sapiens
ttctatcactaagtg

SEQ ID NO: 258518 - DNA, 15 bp, Homo sapiens
tttctatcactaagt

SEQ ID NO: 258519 - DNA, 15 bp, Homo sapiens
atttctatcactaag

SEQ ID NO: 258520 - DNA, 15 bp, Homo sapiens
catttctatcactaa

SEQ ID NO: 258521 - DNA, 15 bp, Homo sapiens
ccatttctatcacta

SEQ ID NO: 258522 - DNA, 15 bp, Homo sapiens
gccatttctatcact

SEQ ID NO: 258523 - DNA, 15 bp, Homo sapiens
tgccatttctatcac

SEQ ID NO: 258524 - DNA, 15 bp, Homo sapiens
ttgccatttctatca

SEQ ID NO: 258525 - DNA, 15 bp, Homo sapiens
tttgccatttctatc

SEQ ID NO: 258526 - DNA, 15 bp, Homo sapiens
gtttgccatttctat

SEQ ID NO: 258527 - DNA, 15 bp, Homo sapiens
agtttgccatttcta

SEQ ID NO: 258528 - DNA, 15 bp, Homo sapiens
gagtttgccatttct

SEQ ID NO: 258529 - DNA, 15 bp, Homo sapiens
agagtttgccatttc

SEQ ID NO: 258530 - DNA, 15 bp, Homo sapiens
cagagtttgccattt

SEQ ID NO: 258531 - DNA, 15 bp, Homo sapiens
acagagtttgccatt

SEQ ID NO: 258532 - DNA, 15 bp, Homo sapiens
tacagagtttgccat

SEQ ID NO: 258533 - DNA, 15 bp, Homo sapiens
atacagagtttgcca

SEQ ID NO: 258534 - DNA, 15 bp, Homo sapiens
aatacagagtttgcc

SEQ ID NO: 258535 - DNA, 15 bp, Homo sapiens
gaatacagagtttgc

SEQ ID NO: 258536 - DNA, 15 bp, Homo sapiens
ggaatacagagtttg

SEQ ID NO: 258537 - DNA, 15 bp, Homo sapiens
tggaatacagagttt

SEQ ID NO: 258538 - DNA, 15 bp, Homo sapiens
atggaatacagagtt

SEQ ID NO: 258539 - DNA, 15 bp, Homo sapiens
aatggaatacagagt

SEQ ID NO: 258540 - DNA, 15 bp, Homo sapiens
gaatggaatacagag

SEQ ID NO: 258541 - DNA, 15 bp, Homo sapiens
ggaatggaatacaga

SEQ ID NO: 258542 - DNA, 15 bp, Homo sapiens
aggaatggaatacag

SEQ ID NO: 258543 - DNA, 15 bp, Homo sapiens
gaggaatggaataca

SEQ ID NO: 258544 - DNA, 15 bp, Homo sapiens
ggaggaatggaatac

SEQ ID NO: 258545 - DNA, 15 bp, Homo sapiens
aggaggaatggaata

SEQ ID NO: 258546 - DNA, 15 bp, Homo sapiens
caggaggaatggaat

SEQ ID NO: 258547 - DNA, 15 bp, Homo sapiens
gcaggaggaatggaa

SEQ ID NO: 258548 - DNA, 15 bp, Homo sapiens
ggcaggaggaatgga

SEQ ID NO: 258549 - DNA, 15 bp, Homo sapiens
aggcaggaggaatgg

SEQ ID NO: 258550 - DNA, 15 bp, Homo sapiens
taggcaggaggaatg

SEQ ID NO: 258551 - DNA, 15 bp, Homo sapiens
ttaggcaggaggaat

SEQ ID NO: 258552 - DNA, 15 bp, Homo sapiens
tttaggcaggaggaa

SEQ ID NO: 258553 - DNA, 15 bp, Homo sapiens
ttttaggcaggagga

SEQ ID NO: 258554 - DNA, 15 bp, Homo sapiens
tttttaggcaggagg

SEQ ID NO: 258555 - DNA, 15 bp, Homo sapiens
ctttttaggcaggag

SEQ ID NO: 258556 - DNA, 15 bp, Homo sapiens
gctttttaggcagga

SEQ ID NO: 258557 - DNA, 15 bp, Homo sapiens
tgctttttaggcagg

SEQ ID NO: 258558 - DNA, 15 bp, Homo sapiens
gtgctttttaggcag

SEQ ID NO: 258559 - DNA, 15 bp, Homo sapiens
agtgctttttaggca

SEQ ID NO: 258560 - DNA, 15 bp, Homo sapiens
aagtgctttttaggc

SEQ ID NO: 258561 - DNA, 15 bp, Homo sapiens
caagtgctttttagg

SEQ ID NO: 258562 - DNA, 15 bp, Homo sapiens
acaagtgctttttag

SEQ ID NO: 258563 - DNA, 15 bp, Homo sapiens
gacaagtgcttttta

SEQ ID NO: 258564 - DNA, 15 bp, Homo sapiens
agacaagtgcttttt

SEQ ID NO: 258565 - DNA, 15 bp, Homo sapiens
aagacaagtgctttt

SEQ ID NO: 258566 - DNA, 15 bp, Homo sapiens
taagacaagtgcttt

SEQ ID NO: 258567 - DNA, 15 bp, Homo sapiens
ctaagacaagtgctt

SEQ ID NO: 258568 - DNA, 15 bp, Homo sapiens
gctaagacaagtgct

SEQ ID NO: 258569 - DNA, 15 bp, Homo sapiens
agctaagacaagtgc

SEQ ID NO: 258570 - DNA, 15 bp, Homo sapiens
gagctaagacaagtg

SEQ ID NO: 258571 - DNA, 15 bp, Homo sapiens
agagctaagacaagt

SEQ ID NO: 258572 - DNA, 15 bp, Homo sapiens
aagagctaagacaag

SEQ ID NO: 258573 - DNA, 15 bp, Homo sapiens
aaagagctaagacaa

SEQ ID NO: 258574 - DNA, 15 bp, Homo sapiens
caaagagctaagaca

SEQ ID NO: 258575 - DNA, 15 bp, Homo sapiens
acaaagagctaagac

SEQ ID NO: 258576 - DNA, 15 bp, Homo sapiens
tacaaagagctaaga

SEQ ID NO: 258577 - DNA, 15 bp, Homo sapiens
atacaaagagctaag

SEQ ID NO: 258578 - DNA, 15 bp, Homo sapiens
tatacaaagagctaa

SEQ ID NO: 258579 - DNA, 15 bp, Homo sapiens
ctatacaaagagcta

SEQ ID NO: 258580 - DNA, 15 bp, Homo sapiens
cctatacaaagagct

SEQ ID NO: 258581 - DNA, 15 bp, Homo sapiens
acctatacaaagagc

SEQ ID NO: 258582 - DNA, 15 bp, Homo sapiens
aacctatacaaagag

SEQ ID NO: 258583 - DNA, 15 bp, Homo sapiens
caacctatacaaaga

SEQ ID NO: 258584 - DNA, 15 bp, Homo sapiens
tcaacctatacaaag

SEQ ID NO: 258585 - DNA, 15 bp, Homo sapiens
atcaacctatacaaa

SEQ ID NO: 258586 - DNA, 15 bp, Homo sapiens
catcaacctatacaa

SEQ ID NO: 258587 - DNA, 15 bp, Homo sapiens
gcatcaacctataca

SEQ ID NO: 258588 - DNA, 15 bp, Homo sapiens
tgcatcaacctatac

SEQ ID NO: 258589 - DNA, 15 bp, Homo sapiens
ttgcatcaacctata

SEQ ID NO: 258590 - DNA, 15 bp, Homo sapiens
tttgcatcaacctat

SEQ ID NO: 258591 - DNA, 15 bp, Homo sapiens
ttttgcatcaaccta

SEQ ID NO: 258592 - DNA, 15 bp, Homo sapiens
tttttgcatcaacct

SEQ ID NO: 258593 - DNA, 15 bp, Homo sapiens
atttttgcatcaacc

SEQ ID NO: 258594 - DNA, 15 bp, Homo sapiens
tatttttgcatcaac

SEQ ID NO: 258595 - DNA, 15 bp, Homo sapiens
ttatttttgcatcaa

SEQ ID NO: 258596 - DNA, 15 bp, Homo sapiens
attatttttgcatca

SEQ ID NO: 258597 - DNA, 15 bp, Homo sapiens
aattatttttgcatc

SEQ ID NO: 258598 - DNA, 15 bp, Homo sapiens
caattatttttgcat

SEQ ID NO: 258599 - DNA, 15 bp, Homo sapiens
gcaattatttttgca

SEQ ID NO: 258600 - DNA, 15 bp, Homo sapiens
tgcaattatttttgc

SEQ ID NO: 258601 - DNA, 15 bp, Homo sapiens
ctgcaattatttttg

SEQ ID NO: 258602 - DNA, 15 bp, Homo sapiens
actgcaattattttt

SEQ ID NO: 258603 - DNA, 15 bp, Homo sapiens
aactgcaattatttt

SEQ ID NO: 258604 - DNA, 15 bp, Homo sapiens
aaactgcaattattt

SEQ ID NO: 258605 - DNA, 15 bp, Homo sapiens
aaaactgcaattatt

SEQ ID NO: 258606 - DNA, 15 bp, Homo sapiens
aaaaactgcaattat

SEQ ID NO: 258607 - DNA, 15 bp, Homo sapiens
caaaaactgcaatta

SEQ ID NO: 258608 - DNA, 15 bp, Homo sapiens
gcaaaaactgcaatt

SEQ ID NO: 258609 - DNA, 15 bp, Homo sapiens
ggcaaaaactgcaat

SEQ ID NO: 258610 - DNA, 15 bp, Homo sapiens
cggcaaaaactgcaa

SEQ ID NO: 258611 - DNA, 15 bp, Homo sapiens
acggcaaaaactgca

SEQ ID NO: 258612 - DNA, 15 bp, Homo sapiens
aacggcaaaaactgc

SEQ ID NO: 258613 - DNA, 15 bp, Homo sapiens
taacggcaaaaactg

SEQ ID NO: 258614 - DNA, 15 bp, Homo sapiens
ttaacggcaaaaact

SEQ ID NO: 258615 - DNA, 15 bp, Homo sapiens
tttaacggcaaaaac

SEQ ID NO: 258616 - DNA, 15 bp, Homo sapiens
ttttaacggcaaaaa

SEQ ID NO: 258617 - DNA, 15 bp, Homo sapiens
cttttaacggcaaaa

SEQ ID NO: 258618 - DNA, 15 bp, Homo sapiens
acttttaacggcaaa

SEQ ID NO: 258619 - DNA, 15 bp, Homo sapiens
tacttttaacggcaa

SEQ ID NO: 258620 - DNA, 15 bp, Homo sapiens
ttacttttaacggca

SEQ ID NO: 258621 - DNA, 15 bp, Homo sapiens
cttacttttaacggc

SEQ ID NO: 258622 - DNA, 15 bp, Homo sapiens
acttacttttaacgg

SEQ ID NO: 258623 - DNA, 15 bp, Homo sapiens
aacttacttttaacg

SEQ ID NO: 258624 - DNA, 15 bp, Homo sapiens
taacttacttttaac

SEQ ID NO: 258625 - DNA, 15 bp, Homo sapiens
ctaacttacttttaa

SEQ ID NO: 258626 - DNA, 15 bp, Homo sapiens
cctaacttactttta

SEQ ID NO: 258627 - DNA, 15 bp, Homo sapiens
ccctaacttactttt

SEQ ID NO: 258628 - DNA, 15 bp, Homo sapiens
accctaacttacttt

SEQ ID NO: 258629 - DNA, 15 bp, Homo sapiens
taccctaacttactt

SEQ ID NO: 258630 - DNA, 15 bp, Homo sapiens
ataccctaacttact

SEQ ID NO: 258631 - DNA, 15 bp, Homo sapiens
aataccctaacttac

SEQ ID NO: 258632 - DNA, 15 bp, Homo sapiens
aaataccctaactta

SEQ ID NO: 258633 - DNA, 15 bp, Homo sapiens
gaaataccctaactt

SEQ ID NO: 258634 - DNA, 15 bp, Homo sapiens
tgaaataccctaact

SEQ ID NO: 258635 - DNA, 15 bp, Homo sapiens
atgaaataccctaac

SEQ ID NO: 258636 - DNA, 15 bp, Homo sapiens
aatgaaataccctaa

SEQ ID NO: 258637 - DNA, 15 bp, Homo sapiens
taatgaaatacccta

SEQ ID NO: 258638 - DNA, 15 bp, Homo sapiens
ttaatgaaataccct

SEQ ID NO: 258639 - DNA, 15 bp, Homo sapiens
tttaatgaaataccc

SEQ ID NO: 258640 - DNA, 15 bp, Homo sapiens
ttttaatgaaatacc

SEQ ID NO: 258641 - DNA, 15 bp, Homo sapiens
cttttaatgaaatac

SEQ ID NO: 258642 - DNA, 15 bp, Homo sapiens
acttttaatgaaata

SEQ ID NO: 258643 - DNA, 15 bp, Homo sapiens
tacttttaatgaaat

SEQ ID NO: 258644 - DNA, 15 bp, Homo sapiens
ttacttttaatgaaa

SEQ ID NO: 258645 - DNA, 15 bp, Homo sapiens
attacttttaatgaa

SEQ ID NO: 258646 - DNA, 15 bp, Homo sapiens
cattacttttaatga

SEQ ID NO: 258647 - DNA, 15 bp, Homo sapiens
ttgccattactttta

SEQ ID NO: 258648 - DNA, 15 bp, Homo sapiens
tttgccattactttt

SEQ ID NO: 258649 - DNA, 15 bp, Homo sapiens
ttttgccattacttt

SEQ ID NO: 258650 - DNA, 15 bp, Homo sapiens
tttttgccattactt

SEQ ID NO: 258651 - DNA, 15 bp, Homo sapiens
gtttttgccattact

SEQ ID NO: 258652 - DNA, 15 bp, Homo sapiens
ggtttttgccattac

SEQ ID NO: 258653 - DNA, 15 bp, Homo sapiens
aggtttttgccatta

SEQ ID NO: 258654 - DNA, 15 bp, Homo sapiens
gaggtttttgccatt

SEQ ID NO: 258655 - DNA, 15 bp, Homo sapiens
tgaggtttttgccat

SEQ ID NO: 258656 - DNA, 15 bp, Homo sapiens
ttgaggtttttgcca

SEQ ID NO: 258657 - DNA, 15 bp, Homo sapiens
attgaggtttttgcc

SEQ ID NO: 258658 - DNA, 15 bp, Homo sapiens
aattgaggtttttgc

SEQ ID NO: 258659 - DNA, 15 bp, Homo sapiens
taattgaggtttttg

SEQ ID NO: 258660 - DNA, 15 bp, Homo sapiens
gtaattgaggttttt

SEQ ID NO: 258661 - DNA, 15 bp, Homo sapiens
agtaattgaggtttt

SEQ ID NO: 258662 - DNA, 15 bp, Homo sapiens
aagtaattgaggttt

SEQ ID NO: 258663 - DNA, 15 bp, Homo sapiens
aaagtaattgaggtt

SEQ ID NO: 258664 - DNA, 15 bp, Homo sapiens
aaaagtaattgaggt

SEQ ID NO: 258665 - DNA, 15 bp, Homo sapiens
caaaagtaattgagg

SEQ ID NO: 258666 - DNA, 15 bp, Homo sapiens
gcaaaagtaattgag

SEQ ID NO: 258667 - DNA, 15 bp, Homo sapiens
tgcaaaagtaattga

SEQ ID NO: 258668 - DNA, 15 bp, Homo sapiens
agttggtgcaaaagt

SEQ ID NO: 258669 - DNA, 15 bp, Homo sapiens
aagttggtgcaaaag

SEQ ID NO: 258670 - DNA, 15 bp, Homo sapiens
taagttggtgcaaaa

SEQ ID NO: 258671 - DNA, 15 bp, Homo sapiens
ttaagttggtgcaaa

SEQ ID NO: 258672 - DNA, 15 bp, Homo sapiens
attaagttggtgcaa

SEQ ID NO: 258673 - DNA, 15 bp, Homo sapiens
gattaagttggtgca

SEQ ID NO: 258674 - DNA, 15 bp, Homo sapiens
ggattaagttggtgc

SEQ ID NO: 258675 - DNA, 15 bp, Homo sapiens
aggattaagttggtg

SEQ ID NO: 258676 - DNA, 15 bp, Homo sapiens
aaggattaagttggt

SEQ ID NO: 258677 - DNA, 15 bp, Homo sapiens
gaaggattaagttgg

SEQ ID NO: 258678 - DNA, 15 bp, Homo sapiens
agaaggattaagttg

SEQ ID NO: 258679 - DNA, 15 bp, Homo sapiens
cagaaggattaagtt

SEQ ID NO: 258680 - DNA, 15 bp, Homo sapiens
acagaaggattaagt

SEQ ID NO: 258681 - DNA, 15 bp, Homo sapiens
aacagaaggattaag

SEQ ID NO: 258682 - DNA, 15 bp, Homo sapiens
gaacagaaggattaa

SEQ ID NO: 258683 - DNA, 15 bp, Homo sapiens
agaacagaaggatta

SEQ ID NO: 258684 - DNA, 15 bp, Homo sapiens
aagaacagaaggatt

SEQ ID NO: 258685 - DNA, 15 bp, Homo sapiens
gaagaacagaaggat

SEQ ID NO: 258686 - DNA, 15 bp, Homo sapiens
ggaagaacagaagga

SEQ ID NO: 258687 - DNA, 15 bp, Homo sapiens
gggaagaacagaagg

SEQ ID NO: 258688 - DNA, 15 bp, Homo sapiens
agggaagaacagaag

SEQ ID NO: 258689 - DNA, 15 bp, Homo sapiens
aagggaagaacagaa

SEQ ID NO: 258690 - DNA, 15 bp, Homo sapiens
caagggaagaacaga

SEQ ID NO: 258691 - DNA, 15 bp, Homo sapiens
ccaagggaagaacag

SEQ ID NO: 258692 - DNA, 15 bp, Homo sapiens
gccaagggaagaaca

SEQ ID NO: 258693 - DNA, 15 bp, Homo sapiens
agccaagggaagaac

SEQ ID NO: 258694 - DNA, 15 bp, Homo sapiens
cagccaagggaagaa

SEQ ID NO: 258695 - DNA, 15 bp, Homo sapiens
ccagccaagggaaga

SEQ ID NO: 258696 - DNA, 15 bp, Homo sapiens
cccagccaagggaag

SEQ ID NO: 258697 - DNA, 15 bp, Homo sapiens
tcccagccaagggaa

SEQ ID NO: 258698 - DNA, 15 bp, Homo sapiens
gtcccagccaaggga

SEQ ID NO: 258699 - DNA, 15 bp, Homo sapiens
tgtcccagccaaggg

SEQ ID NO: 258700 - DNA, 15 bp, Homo sapiens
gtgtcccagccaagg

SEQ ID NO: 258701 - DNA, 15 bp, Homo sapiens
agtgtcccagccaag

SEQ ID NO: 258702 - DNA, 15 bp, Homo sapiens
gagtgtcccagccaa

SEQ ID NO: 258703 - DNA, 15 bp, Homo sapiens
tgagtgtcccagcca

SEQ ID NO: 258704 - DNA, 15 bp, Homo sapiens
atgagtgtcccagcc

SEQ ID NO: 258705 - DNA, 15 bp, Homo sapiens
aatgagtgtcccagc

SEQ ID NO: 258706 - DNA, 15 bp, Homo sapiens
gaatgagtgtcccag

SEQ ID NO: 258707 - DNA, 15 bp, Homo sapiens
ggaatgagtgtccca

SEQ ID NO: 258708 - DNA, 15 bp, Homo sapiens
aggaatgagtgtccc

SEQ ID NO: 258709 - DNA, 15 bp, Homo sapiens
caggaatgagtgtcc

SEQ ID NO: 258710 - DNA, 15 bp, Homo sapiens
acaggaatgagtgtc

SEQ ID NO: 258711 - DNA, 15 bp, Homo sapiens
tacaggaatgagtgt

SEQ ID NO: 258712 - DNA, 15 bp, Homo sapiens
ctacaggaatgagtg

SEQ ID NO: 258713 - DNA, 15 bp, Homo sapiens
cctacaggaatgagt

SEQ ID NO: 258714 - DNA, 15 bp, Homo sapiens
acctacaggaatgag

SEQ ID NO: 258715 - DNA, 15 bp, Homo sapiens
gacctacaggaatga

SEQ ID NO: 258716 - DNA, 15 bp, Homo sapiens
agacctacaggaatg

SEQ ID NO: 258717 - DNA, 15 bp, Homo sapiens
gagacctacaggaat

SEQ ID NO: 258718 - DNA, 15 bp, Homo sapiens
tgagacctacaggaa

SEQ ID NO: 258719 - DNA, 15 bp, Homo sapiens
ttgagacctacagga

SEQ ID NO: 258720 - DNA, 15 bp, Homo sapiens
attgagacctacagg

SEQ ID NO: 258721 - DNA, 15 bp, Homo sapiens
cattgagacctacag

SEQ ID NO: 258722 - DNA, 15 bp, Homo sapiens
acattgagacctaca

SEQ ID NO: 258723 - DNA, 15 bp, Homo sapiens
aacattgagacctac

SEQ ID NO: 258724 - DNA, 15 bp, Homo sapiens
caacattgagaccta

SEQ ID NO: 258725 - DNA, 15 bp, Homo sapiens
acaacattgagacct

SEQ ID NO: 258726 - DNA, 15 bp, Homo sapiens
gacaacattgagacc

SEQ ID NO: 258727 - DNA, 15 bp, Homo sapiens
cgacaacattgagac

SEQ ID NO: 258728 - DNA, 15 bp, Homo sapiens
tcgacaacattgaga

SEQ ID NO: 258729 - DNA, 15 bp, Homo sapiens
atcgacaacattgag

SEQ ID NO: 258730 - DNA, 15 bp, Homo sapiens
gatcgacaacattga

SEQ ID NO: 258731 - DNA, 15 bp, Homo sapiens
tgatcgacaacattg

SEQ ID NO: 258732 - DNA, 15 bp, Homo sapiens
gtgatcgacaacatt

SEQ ID NO: 258733 - DNA, 15 bp, Homo sapiens
ggtgatcgacaacat

SEQ ID NO: 258734 - DNA, 15 bp, Homo sapiens
aggtgatcgacaaca

SEQ ID NO: 258735 - DNA, 15 bp, Homo sapiens
gaggtgatcgacaac

SEQ ID NO: 258736 - DNA, 15 bp, Homo sapiens
agaggtgatcgacaa

SEQ ID NO: 258737 - DNA, 15 bp, Homo sapiens
gagaggtgatcgaca

SEQ ID NO: 258738 - DNA, 15 bp, Homo sapiens
agagaggtgatcgac

SEQ ID NO: 258739 - DNA, 15 bp, Homo sapiens
aagagaggtgatcga

SEQ ID NO: 258740 - DNA, 15 bp, Homo sapiens
aaagagaggtgatcg

SEQ ID NO: 258741 - DNA, 15 bp, Homo sapiens
aaaagagaggtgatc

SEQ ID NO: 258742 - DNA, 15 bp, Homo sapiens
taaaagagaggtgat

SEQ ID NO: 258743 - DNA, 15 bp, Homo sapiens
ttaaaagagaggtga

SEQ ID NO: 258744 - DNA, 15 bp, Homo sapiens
attaaaagagaggtg

SEQ ID NO: 258745 - DNA, 15 bp, Homo sapiens
cattaaaagagaggt

SEQ ID NO: 258746 - DNA, 15 bp, Homo sapiens
tcattaaaagagagg

SEQ ID NO: 258747 - DNA, 15 bp, Homo sapiens
ctcattaaaagagag

SEQ ID NO: 258748 - DNA, 15 bp, Homo sapiens
cctcattaaaagaga

SEQ ID NO: 258749 - DNA, 15 bp, Homo sapiens
acctcattaaaagag

SEQ ID NO: 258750 - DNA, 15 bp, Homo sapiens
aacctcattaaaaga

SEQ ID NO: 258751 - DNA, 15 bp, Homo sapiens
aaacctcattaaaag

SEQ ID NO: 258752 - DNA, 15 bp, Homo sapiens
aaaacctcattaaaa

SEQ ID NO: 258753 - DNA, 15 bp, Homo sapiens
gaaaacctcattaaa

SEQ ID NO: 258754 - DNA, 15 bp, Homo sapiens
agaaaacctcattaa

SEQ ID NO: 258755 - DNA, 15 bp, Homo sapiens
tagaaaacctcatta

SEQ ID NO: 258756 - DNA, 15 bp, Homo sapiens
atagaaaacctcatt

SEQ ID NO: 258757 - DNA, 15 bp, Homo sapiens
catagaaaacctcat

SEQ ID NO: 258758 - DNA, 15 bp, Homo sapiens
ccatagaaaacctca

SEQ ID NO: 258759 - DNA, 15 bp, Homo sapiens
gccatagaaaacctc

SEQ ID NO: 258760 - DNA, 15 bp, Homo sapiens
agccatagaaaacct

SEQ ID NO: 258761 - DNA, 15 bp, Homo sapiens
gagccatagaaaacc

SEQ ID NO: 258762 - DNA, 15 bp, Homo sapiens
ggagccatagaaaac

SEQ ID NO: 258763 - DNA, 15 bp, Homo sapiens
aggagccatagaaaa

SEQ ID NO: 258764 - DNA, 15 bp, Homo sapiens
gaggagccatagaaa

SEQ ID NO: 258765 - DNA, 15 bp, Homo sapiens
tgaggagccatagaa

SEQ ID NO: 258766 - DNA, 15 bp, Homo sapiens
atgaggagccataga

SEQ ID NO: 258767 - DNA, 15 bp, Homo sapiens
tatgaggagccatag

SEQ ID NO: 258768 - DNA, 15 bp, Homo sapiens
ctatgaggagccata

SEQ ID NO: 258769 - DNA, 15 bp, Homo sapiens
tctatgaggagccat

SEQ ID NO: 258770 - DNA, 15 bp, Homo sapiens
ttctatgaggagcca

SEQ ID NO: 258771 - DNA, 15 bp, Homo sapiens
gttctatgaggagcc

SEQ ID NO: 258772 - DNA, 15 bp, Homo sapiens
agttctatgaggagc

SEQ ID NO: 258773 - DNA, 15 bp, Homo sapiens
cagttctatgaggag

SEQ ID NO: 258774 - DNA, 15 bp, Homo sapiens
acagttctatgagga

SEQ ID NO: 258775 - DNA, 15 bp, Homo sapiens
aacagttctatgagg

SEQ ID NO: 258776 - DNA, 15 bp, Homo sapiens
gaacagttctatgag

SEQ ID NO: 258777 - DNA, 15 bp, Homo sapiens
agaacagttctatga

SEQ ID NO: 258778 - DNA, 15 bp, Homo sapiens
aagaacagttctatg

SEQ ID NO: 258779 - DNA, 15 bp, Homo sapiens
aaagaacagttctat

SEQ ID NO: 258780 - DNA, 15 bp, Homo sapiens
aaaagaacagttcta

SEQ ID NO: 258781 - DNA, 15 bp, Homo sapiens
gaaaagaacagttct

SEQ ID NO: 258782 - DNA, 15 bp, Homo sapiens
ggaaaagaacagttc

SEQ ID NO: 258783 - DNA, 15 bp, Homo sapiens
aggaaaagaacagtt

SEQ ID NO: 258784 - DNA, 15 bp, Homo sapiens
aaggaaaagaacagt

SEQ ID NO: 258785 - DNA, 15 bp, Homo sapiens
taaggaaaagaacag

SEQ ID NO: 258786 - DNA, 15 bp, Homo sapiens
gtaaggaaaagaaca

SEQ ID NO: 258787 - DNA, 15 bp, Homo sapiens
tgtaaggaaaagaac

SEQ ID NO: 258788 - DNA, 15 bp, Homo sapiens
atgtaaggaaaagaa

SEQ ID NO: 258789 - DNA, 15 bp, Homo sapiens
catgtaaggaaaaga

SEQ ID NO: 258790 - DNA, 15 bp, Homo sapiens
tcatgtaaggaaaag

SEQ ID NO: 258791 - DNA, 15 bp, Homo sapiens
gtcatgtaaggaaaa

SEQ ID NO: 258792 - DNA, 15 bp, Homo sapiens
tgtcatgtaaggaaa

SEQ ID NO: 258793 - DNA, 15 bp, Homo sapiens
gtgtcatgtaaggaa

SEQ ID NO: 258794 - DNA, 15 bp, Homo sapiens
agtgtcatgtaagga

SEQ ID NO: 258795 - DNA, 15 bp, Homo sapiens
aagtgtcatgtaagg

SEQ ID NO: 258796 - DNA, 15 bp, Homo sapiens
gaagtgtcatgtaag

SEQ ID NO: 258797 - DNA, 15 bp, Homo sapiens
agaagtgtcatgtaa

SEQ ID NO: 258798 - DNA, 15 bp, Homo sapiens
cagaagtgtcatgta

SEQ ID NO: 258799 - DNA, 15 bp, Homo sapiens
ccagaagtgtcatgt

SEQ ID NO: 258800 - DNA, 15 bp, Homo sapiens
accagaagtgtcatg

SEQ ID NO: 258801 - DNA, 15 bp, Homo sapiens
caccagaagtgtcat

SEQ ID NO: 258802 - DNA, 15 bp, Homo sapiens
gcaccagaagtgtca

SEQ ID NO: 258803 - DNA, 15 bp, Homo sapiens
agcaccagaagtgtc

SEQ ID NO: 258804 - DNA, 15 bp, Homo sapiens
aagcaccagaagtgt

SEQ ID NO: 258805 - DNA, 15 bp, Homo sapiens
caagcaccagaagtg

SEQ ID NO: 258806 - DNA, 15 bp, Homo sapiens
ccaagcaccagaagt

SEQ ID NO: 258807 - DNA, 15 bp, Homo sapiens
accaagcaccagaag

SEQ ID NO: 258808 - DNA, 15 bp, Homo sapiens
aaccaagcaccagaa

SEQ ID NO: 258809 - DNA, 15 bp, Homo sapiens
aaaccaagcaccaga

SEQ ID NO: 258810 - DNA, 15 bp, Homo sapiens
taaaccaagcaccag

SEQ ID NO: 258811 - DNA, 15 bp, Homo sapiens
ctaaaccaagcacca

SEQ ID NO: 258812 - DNA, 15 bp, Homo sapiens
cctaaaccaagcacc

SEQ ID NO: 258813 - DNA, 15 bp, Homo sapiens
gcctaaaccaagcac

SEQ ID NO: 258814 - DNA, 15 bp, Homo sapiens
tgcctaaaccaagca

SEQ ID NO: 258815 - DNA, 15 bp, Homo sapiens
gtgcctaaaccaagc

SEQ ID NO: 258816 - DNA, 15 bp, Homo sapiens
agtgcctaaaccaag

SEQ ID NO: 258817 - DNA, 15 bp, Homo sapiens
tagtgcctaaaccaa

SEQ ID NO: 258818 - DNA, 15 bp, Homo sapiens
ttagtgcctaaacca

SEQ ID NO: 258819 - DNA, 15 bp, Homo sapiens
cttagtgcctaaacc

SEQ ID NO: 258820 - DNA, 15 bp, Homo sapiens
ccttagtgcctaaac

SEQ ID NO: 258821 - DNA, 15 bp, Homo sapiens
gccttagtgcctaaa

SEQ ID NO: 258822 - DNA, 15 bp, Homo sapiens
tgccttagtgcctaa

SEQ ID NO: 258823 - DNA, 15 bp, Homo sapiens
ctgccttagtgccta

SEQ ID NO: 258824 - DNA, 15 bp, Homo sapiens
tctgccttagtgcct

SEQ ID NO: 258825 - DNA, 15 bp, Homo sapiens
ctctgccttagtgcc

SEQ ID NO: 258826 - DNA, 15 bp, Homo sapiens
actctgccttagtgc

SEQ ID NO: 258827 - DNA, 15 bp, Homo sapiens
cactctgccttagtg

SEQ ID NO: 258828 - DNA, 15 bp, Homo sapiens
acactctgccttagt

SEQ ID NO: 258829 - DNA, 15 bp, Homo sapiens
gacactctgccttag

SEQ ID NO: 258830 - DNA, 15 bp, Homo sapiens
tgacactctgcctta

SEQ ID NO: 258831 - DNA, 15 bp, Homo sapiens
ttgacactctgcctt

SEQ ID NO: 258832 - DNA, 15 bp, Homo sapiens
attgacactctgcct

SEQ ID NO: 258833 - DNA, 15 bp, Homo sapiens
cattgacactctgcc

SEQ ID NO: 258834 - DNA, 15 bp, Homo sapiens
ccattgacactctgc

SEQ ID NO: 258835 - DNA, 15 bp, Homo sapiens
accattgacactctg

SEQ ID NO: 258836 - DNA, 15 bp, Homo sapiens
taccattgacactct

SEQ ID NO: 258837 - DNA, 15 bp, Homo sapiens
ttaccattgacactc

SEQ ID NO: 258838 - DNA, 15 bp, Homo sapiens
attaccattgacact

SEQ ID NO: 258839 - DNA, 15 bp, Homo sapiens
aattaccattgacac

SEQ ID NO: 258840 - DNA, 15 bp, Homo sapiens
aaattaccattgaca

SEQ ID NO: 258841 - DNA, 15 bp, Homo sapiens
aaaattaccattgac

SEQ ID NO: 258842 - DNA, 15 bp, Homo sapiens
aaaaattaccattga

SEQ ID NO: 258843 - DNA, 15 bp, Homo sapiens
taaaaattaccattg

SEQ ID NO: 258844 - DNA, 15 bp, Homo sapiens
ttaaaaattaccatt

SEQ ID NO: 258845 - DNA, 15 bp, Homo sapiens
attaaaaattaccat

SEQ ID NO: 258846 - DNA, 15 bp, Homo sapiens
tattaaaaattacca

SEQ ID NO: 258847 - DNA, 15 bp, Homo sapiens
atattaaaaattacc

SEQ ID NO: 258848 - DNA, 15 bp, Homo sapiens
aatattaaaaattac

SEQ ID NO: 258849 - DNA, 15 bp, Homo sapiens
gaatattaaaaatta

SEQ ID NO: 258850 - DNA, 15 bp, Homo sapiens
agaatattaaaaatt

SEQ ID NO: 258851 - DNA, 15 bp, Homo sapiens
cagaatattaaaaat

SEQ ID NO: 258852 - DNA, 15 bp, Homo sapiens
acagaatattaaaaa

SEQ ID NO: 258853 - DNA, 15 bp, Homo sapiens
aacagaatattaaaa

SEQ ID NO: 258854 - DNA, 15 bp, Homo sapiens
aaacagaatattaaa

SEQ ID NO: 258855 - DNA, 15 bp, Homo sapiens
taaacagaatattaa

SEQ ID NO: 258856 - DNA, 15 bp, Homo sapiens
ataaacagaatatta

SEQ ID NO: 258857 - DNA, 15 bp, Homo sapiens
taataaacagaatat

SEQ ID NO: 258858 - DNA, 15 bp, Homo sapiens
ctaataaacagaata

SEQ ID NO: 258859 - DNA, 15 bp, Homo sapiens
actaataaacagaat

SEQ ID NO: 258860 - DNA, 15 bp, Homo sapiens
aactaataaacagaa

SEQ ID NO: 258861 - DNA, 15 bp, Homo sapiens
taactaataaacaga

SEQ ID NO: 258862 - DNA, 15 bp, Homo sapiens
ataactaataaacag

SEQ ID NO: 258863 - DNA, 15 bp, Homo sapiens
aataactaataaaca

SEQ ID NO: 258864 - DNA, 15 bp, Homo sapiens
caataactaataaac

SEQ ID NO: 258865 - DNA, 15 bp, Homo sapiens
acaataactaataaa

SEQ ID NO: 258866 - DNA, 15 bp, Homo sapiens
aacaataactaataa

SEQ ID NO: 258867 - DNA, 15 bp, Homo sapiens
aaacaataactaata

SEQ ID NO: 258868 - DNA, 15 bp, Homo sapiens
caaacaataactaat

SEQ ID NO: 258869 - DNA, 15 bp, Homo sapiens
gcaaacaataactaa

SEQ ID NO: 258870 - DNA, 15 bp, Homo sapiens
agcaaacaataacta

SEQ ID NO: 258871 - DNA, 15 bp, Homo sapiens
aagcaaacaataact

SEQ ID NO: 258872 - DNA, 15 bp, Homo sapiens
gaagcaaacaataac

SEQ ID NO: 258873 - DNA, 15 bp, Homo sapiens
agaagcaaacaataa

SEQ ID NO: 258874 - DNA, 15 bp, Homo sapiens
gagaagcaaacaata

SEQ ID NO: 258875 - DNA, 15 bp, Homo sapiens
ggagaagcaaacaat

SEQ ID NO: 258876 - DNA, 15 bp, Homo sapiens
tggagaagcaaacaa

SEQ ID NO: 258877 - DNA, 15 bp, Homo sapiens
atggagaagcaaaca

SEQ ID NO: 258878 - DNA, 15 bp, Homo sapiens
gatggagaagcaaac

SEQ ID NO: 258879 - DNA, 15 bp, Homo sapiens
tgatggagaagcaaa

SEQ ID NO: 258880 - DNA, 15 bp, Homo sapiens
atgatggagaagcaa

SEQ ID NO: 258881 - DNA, 15 bp, Homo sapiens
catgatggagaagca

SEQ ID NO: 258882 - DNA, 15 bp, Homo sapiens
ccatgatggagaagc

SEQ ID NO: 258883 - DNA, 15 bp, Homo sapiens
cccatgatggagaag

SEQ ID NO: 258884 - DNA, 15 bp, Homo sapiens
tcccatgatggagaa

SEQ ID NO: 258885 - DNA, 15 bp, Homo sapiens
atcccatgatggaga

SEQ ID NO: 258886 - DNA, 15 bp, Homo sapiens
catcccatgatggag

SEQ ID NO: 258887 - DNA, 15 bp, Homo sapiens
ccatcccatgatgga

SEQ ID NO: 258888 - DNA, 15 bp, Homo sapiens
tccatcccatgatgg

SEQ ID NO: 258889 - DNA, 15 bp, Homo sapiens
atccatcccatgatg

SEQ ID NO: 258890 - DNA, 15 bp, Homo sapiens
catccatcccatgat

SEQ ID NO: 258891 - DNA, 15 bp, Homo sapiens
tcatccatcccatga

SEQ ID NO: 258892 - DNA, 15 bp, Homo sapiens
ctcatccatcccatg

SEQ ID NO: 258893 - DNA, 15 bp, Homo sapiens
actcatccatcccat

SEQ ID NO: 258894 - DNA, 15 bp, Homo sapiens
gactcatccatccca

SEQ ID NO: 258895 - DNA, 15 bp, Homo sapiens
agactcatccatccc

SEQ ID NO: 258896 - DNA, 15 bp, Homo sapiens
cagactcatccatcc

SEQ ID NO: 258897 - DNA, 15 bp, Homo sapiens
acagactcatccatc

SEQ ID NO: 258898 - DNA, 15 bp, Homo sapiens
cacagactcatccat

SEQ ID NO: 258899 - DNA, 15 bp, Homo sapiens
acacagactcatcca

SEQ ID NO: 258900 - DNA, 15 bp, Homo sapiens
aacacagactcatcc

SEQ ID NO: 258901 - DNA, 15 bp, Homo sapiens
gaacacagactcatc

SEQ ID NO: 258902 - DNA, 15 bp, Homo sapiens
cgaacacagactcat

SEQ ID NO: 258903 - DNA, 15 bp, Homo sapiens
acgaacacagactca

SEQ ID NO: 258904 - DNA, 15 bp, Homo sapiens
gacgaacacagactc

SEQ ID NO: 258905 - DNA, 15 bp, Homo sapiens
agacgaacacagact

SEQ ID NO: 258906 - DNA, 15 bp, Homo sapiens
gagacgaacacagac

SEQ ID NO: 258907 - DNA, 15 bp, Homo sapiens
agagacgaacacaga

SEQ ID NO: 258908 - DNA, 15 bp, Homo sapiens
tagagacgaacacag

SEQ ID NO: 258909 - DNA, 15 bp, Homo sapiens
gtagagacgaacaca

SEQ ID NO: 258910 - DNA, 15 bp, Homo sapiens
agtagagacgaacac

SEQ ID NO: 258911 - DNA, 15 bp, Homo sapiens
aagtagagacgaaca

SEQ ID NO: 258912 - DNA, 15 bp, Homo sapiens
taagtagagacgaac

SEQ ID NO: 258913 - DNA, 15 bp, Homo sapiens
ctaagtagagacgaa

SEQ ID NO: 258914 - DNA, 15 bp, Homo sapiens
cctaagtagagacga

SEQ ID NO: 258915 - DNA, 15 bp, Homo sapiens
tcctaagtagagacg

SEQ ID NO: 258916 - DNA, 15 bp, Homo sapiens
gtcctaagtagagac

SEQ ID NO: 258917 - DNA, 15 bp, Homo sapiens
ggtcctaagtagaga

SEQ ID NO: 258918 - DNA, 15 bp, Homo sapiens
aggtcctaagtagag

SEQ ID NO: 258919 - DNA, 15 bp, Homo sapiens
gaggtcctaagtaga

SEQ ID NO: 258920 - DNA, 15 bp, Homo sapiens
tgaggtcctaagtag

SEQ ID NO: 258921 - DNA, 15 bp, Homo sapiens
atgaggtcctaagta

SEQ ID NO: 258922 - DNA, 15 bp, Homo sapiens
tatgaggtcctaagt

SEQ ID NO: 258923 - DNA, 15 bp, Homo sapiens
gtatgaggtcctaag

SEQ ID NO: 258924 - DNA, 15 bp, Homo sapiens
tgtatgaggtcctaa

SEQ ID NO: 258925 - DNA, 15 bp, Homo sapiens
ttgtatgaggtccta

SEQ ID NO: 258926 - DNA, 15 bp, Homo sapiens
attgtatgaggtcct

SEQ ID NO: 258927 - DNA, 15 bp, Homo sapiens
aattgtatgaggtcc

SEQ ID NO: 258928 - DNA, 15 bp, Homo sapiens
aaattgtatgaggtc

SEQ ID NO: 258929 - DNA, 15 bp, Homo sapiens
gaaattgtatgaggt

SEQ ID NO: 258930 - DNA, 15 bp, Homo sapiens
agaaattgtatgagg

SEQ ID NO: 258931 - DNA, 15 bp, Homo sapiens
cagaaattgtatgag

SEQ ID NO: 258932 - DNA, 15 bp, Homo sapiens
ccagaaattgtatga

SEQ ID NO: 258933 - DNA, 15 bp, Homo sapiens
gccagaaattgtatg

SEQ ID NO: 258934 - DNA, 15 bp, Homo sapiens
tgccagaaattgtat

SEQ ID NO: 258935 - DNA, 15 bp, Homo sapiens
gtgccagaaattgta

SEQ ID NO: 258936 - DNA, 15 bp, Homo sapiens
tgtgccagaaattgt

SEQ ID NO: 258937 - DNA, 15 bp, Homo sapiens
ctgtgccagaaattg

SEQ ID NO: 258938 - DNA, 15 bp, Homo sapiens
tctgtgccagaaatt

SEQ ID NO: 258939 - DNA, 15 bp, Homo sapiens
ctctgtgccagaaat

SEQ ID NO: 258940 - DNA, 15 bp, Homo sapiens
gctctgtgccagaaa

SEQ ID NO: 258941 - DNA, 15 bp, Homo sapiens
tgctctgtgccagaa

SEQ ID NO: 258942 - DNA, 15 bp, Homo sapiens
ctgctctgtgccaga

SEQ ID NO: 258943 - DNA, 15 bp, Homo sapiens
cctgctctgtgccag

SEQ ID NO: 258944 - DNA, 15 bp, Homo sapiens
ccctgctctgtgcca

SEQ ID NO: 258945 - DNA, 15 bp, Homo sapiens
cccctgctctgtgcc

SEQ ID NO: 258946 - DNA, 15 bp, Homo sapiens
acccctgctctgtgc

SEQ ID NO: 258947 - DNA, 15 bp, Homo sapiens
aacccctgctctgtg

SEQ ID NO: 258948 - DNA, 15 bp, Homo sapiens
caacccctgctctgt

SEQ ID NO: 258949 - DNA, 15 bp, Homo sapiens
gcaacccctgctctg

SEQ ID NO: 258950 - DNA, 15 bp, Homo sapiens
agcaacccctgctct

SEQ ID NO: 258951 - DNA, 15 bp, Homo sapiens
aagcaacccctgctc

SEQ ID NO: 258952 - DNA, 15 bp, Homo sapiens
taagcaacccctgct

SEQ ID NO: 258953 - DNA, 15 bp, Homo sapiens
ctaagcaacccctgc

SEQ ID NO: 258954 - DNA, 15 bp, Homo sapiens
cctaagcaacccctg

SEQ ID NO: 258955 - DNA, 15 bp, Homo sapiens
tcctaagcaacccct

SEQ ID NO: 258956 - DNA, 15 bp, Homo sapiens
gtcctaagcaacccc

SEQ ID NO: 258957 - DNA, 15 bp, Homo sapiens
tgtcctaagcaaccc

SEQ ID NO: 258958 - DNA, 15 bp, Homo sapiens
gtgtcctaagcaacc

SEQ ID NO: 258959 - DNA, 15 bp, Homo sapiens
tgtgtcctaagcaac

SEQ ID NO: 258960 - DNA, 15 bp, Homo sapiens
gtgtgtcctaagcaa

SEQ ID NO: 258961 - DNA, 15 bp, Homo sapiens
agtgtgtcctaagca

SEQ ID NO: 258962 - DNA, 15 bp, Homo sapiens
cagtgtgtcctaagc

SEQ ID NO: 258963 - DNA, 15 bp, Homo sapiens
tcagtgtgtcctaag

SEQ ID NO: 258964 - DNA, 15 bp, Homo sapiens
ctcagtgtgtcctaa

SEQ ID NO: 258965 - DNA, 15 bp, Homo sapiens
actcagtgtgtccta

SEQ ID NO: 258966 - DNA, 15 bp, Homo sapiens
cactcagtgtgtcct

SEQ ID NO: 258967 - DNA, 15 bp, Homo sapiens
tcactcagtgtgtcc

SEQ ID NO: 258968 - DNA, 15 bp, Homo sapiens
ttcactcagtgtgtc

SEQ ID NO: 258969 - DNA, 15 bp, Homo sapiens
attcactcagtgtgt

SEQ ID NO: 258970 - DNA, 15 bp, Homo sapiens
cattcactcagtgtg

SEQ ID NO: 258971 - DNA, 15 bp, Homo sapiens
tcattcactcagtgt

SEQ ID NO: 258972 - DNA, 15 bp, Homo sapiens
atcattcactcagtg

SEQ ID NO: 258973 - DNA, 15 bp, Homo sapiens
aatcattcactcagt

SEQ ID NO: 258974 - DNA, 15 bp, Homo sapiens
aaatcattcactcag

SEQ ID NO: 258975 - DNA, 15 bp, Homo sapiens
caaatcattcactca

SEQ ID NO: 258976 - DNA, 15 bp, Homo sapiens
tcaaatcattcactc

SEQ ID NO: 258977 - DNA, 15 bp, Homo sapiens
ctcaaatcattcact

SEQ ID NO: 258978 - DNA, 15 bp, Homo sapiens
actcaaatcattcac

SEQ ID NO: 258979 - DNA, 15 bp, Homo sapiens
aactcaaatcattca

SEQ ID NO: 258980 - DNA, 15 bp, Homo sapiens
aaactcaaatcattc

SEQ ID NO: 258981 - DNA, 15 bp, Homo sapiens
caaactcaaatcatt

SEQ ID NO: 258982 - DNA, 15 bp, Homo sapiens
tcaaactcaaatcat

SEQ ID NO: 258983 - DNA, 15 bp, Homo sapiens
ttcaaactcaaatca

SEQ ID NO: 258984 - DNA, 15 bp, Homo sapiens
cttcaaactcaaatc

SEQ ID NO: 258985 - DNA, 15 bp, Homo sapiens
ccttcaaactcaaat

SEQ ID NO: 258986 - DNA, 15 bp, Homo sapiens
accttcaaactcaaa

SEQ ID NO: 258987 - DNA, 15 bp, Homo sapiens
aaccttcaaactcaa

SEQ ID NO: 258988 - DNA, 15 bp, Homo sapiens
taaccttcaaactca

SEQ ID NO: 258989 - DNA, 15 bp, Homo sapiens
ataaccttcaaactc

SEQ ID NO: 258990 - DNA, 15 bp, Homo sapiens
tataaccttcaaact

SEQ ID NO: 258991 - DNA, 15 bp, Homo sapiens
atataaccttcaaac

SEQ ID NO: 258992 - DNA, 15 bp, Homo sapiens
tatataaccttcaaa

SEQ ID NO: 258993 - DNA, 15 bp, Homo sapiens
ctatataaccttcaa

SEQ ID NO: 258994 - DNA, 15 bp, Homo sapiens
gctatataaccttca

SEQ ID NO: 258995 - DNA, 15 bp, Homo sapiens
tgctatataaccttc

SEQ ID NO: 258996 - DNA, 15 bp, Homo sapiens
ctgctatataacctt

SEQ ID NO: 258997 - DNA, 15 bp, Homo sapiens
actgctatataacct

SEQ ID NO: 258998 - DNA, 15 bp, Homo sapiens
tactgctatataacc

SEQ ID NO: 258999 - DNA, 15 bp, Homo sapiens
gtactgctatataac

SEQ ID NO: 259000 - DNA, 15 bp, Homo sapiens
agtactgctatataa

SEQ ID NO: 259001 - DNA, 15 bp, Homo sapiens
gagtactgctatata

SEQ ID NO: 259002 - DNA, 15 bp, Homo sapiens
ggagtactgctatat

SEQ ID NO: 259003 - DNA, 15 bp, Homo sapiens
tggagtactgctata

SEQ ID NO: 259004 - DNA, 15 bp, Homo sapiens
ctggagtactgctat

SEQ ID NO: 259005 - DNA, 15 bp, Homo sapiens
tctggagtactgcta

SEQ ID NO: 259006 - DNA, 15 bp, Homo sapiens
ttctggagtactgct

SEQ ID NO: 259007 - DNA, 15 bp, Homo sapiens
cttctggagtactgc

SEQ ID NO: 259008 - DNA, 15 bp, Homo sapiens
tcttctggagtactg

SEQ ID NO: 259009 - DNA, 15 bp, Homo sapiens
atcttctggagtact

SEQ ID NO: 259010 - DNA, 15 bp, Homo sapiens
catcttctggagtac

SEQ ID NO: 259011 - DNA, 15 bp, Homo sapiens
acatcttctggagta

SEQ ID NO: 259012 - DNA, 15 bp, Homo sapiens
cacatcttctggagt

SEQ ID NO: 259013 - DNA, 15 bp, Homo sapiens
acacatcttctggag

SEQ ID NO: 259014 - DNA, 15 bp, Homo sapiens
gacacatcttctgga

SEQ ID NO: 259015 - DNA, 15 bp, Homo sapiens
ggacacatcttctgg

SEQ ID NO: 259016 - DNA, 15 bp, Homo sapiens
tggacacatcttctg

SEQ ID NO: 259017 - DNA, 15 bp, Homo sapiens
ttggacacatcttct

SEQ ID NO: 259018 - DNA, 15 bp, Homo sapiens
cttggacacatcttc

SEQ ID NO: 259019 - DNA, 15 bp, Homo sapiens
ccttggacacatctt

SEQ ID NO: 259020 - DNA, 15 bp, Homo sapiens
tccttggacacatct

SEQ ID NO: 259021 - DNA, 15 bp, Homo sapiens
ctccttggacacatc

SEQ ID NO: 259022 - DNA, 15 bp, Homo sapiens
tctccttggacacat

SEQ ID NO: 259023 - DNA, 15 bp, Homo sapiens
atctccttggacaca

SEQ ID NO: 259024 - DNA, 15 bp, Homo sapiens
aatctccttggacac

SEQ ID NO: 259025 - DNA, 15 bp, Homo sapiens
aaatctccttggaca

SEQ ID NO: 259026 - DNA, 15 bp, Homo sapiens
taaatctccttggac

SEQ ID NO: 259027 - DNA, 15 bp, Homo sapiens
ataaatctccttgga

SEQ ID NO: 259028 - DNA, 15 bp, Homo sapiens
tataaatctccttgg

SEQ ID NO: 259029 - DNA, 15 bp, Homo sapiens
ctataaatctccttg

SEQ ID NO: 259030 - DNA, 15 bp, Homo sapiens
gctataaatctcctt

SEQ ID NO: 259031 - DNA, 15 bp, Homo sapiens
tgctataaatctcct

SEQ ID NO: 259032 - DNA, 15 bp, Homo sapiens
ctgctataaatctcc

SEQ ID NO: 259033 - DNA, 15 bp, Homo sapiens
actgctataaatctc

SEQ ID NO: 259034 - DNA, 15 bp, Homo sapiens
tactgctataaatct

SEQ ID NO: 259035 - DNA, 15 bp, Homo sapiens
gtactgctataaatc

SEQ ID NO: 259036 - DNA, 15 bp, Homo sapiens
agtactgctataaat

SEQ ID NO: 259037 - DNA, 15 bp, Homo sapiens
aagtactgctataaa

SEQ ID NO: 259038 - DNA, 15 bp, Homo sapiens
aaagtactgctataa

SEQ ID NO: 259039 - DNA, 15 bp, Homo sapiens
aaaagtactgctata

SEQ ID NO: 259040 - DNA, 15 bp, Homo sapiens
gaaaagtactgctat

SEQ ID NO: 259041 - DNA, 15 bp, Homo sapiens
tgaaaagtactgcta

SEQ ID NO: 259042 - DNA, 15 bp, Homo sapiens
atgaaaagtactgct

SEQ ID NO: 259043 - DNA, 15 bp, Homo sapiens
tatgaaaagtactgc

SEQ ID NO: 259044 - DNA, 15 bp, Homo sapiens
ctatgaaaagtactg

SEQ ID NO: 259045 - DNA, 15 bp, Homo sapiens
actatgaaaagtact

SEQ ID NO: 259046 - DNA, 15 bp, Homo sapiens
tactatgaaaagtac

SEQ ID NO: 259047 - DNA, 15 bp, Homo sapiens
ttactatgaaaagta

SEQ ID NO: 259048 - DNA, 15 bp, Homo sapiens
tttactatgaaaagt

SEQ ID NO: 259049 - DNA, 15 bp, Homo sapiens
ttttactatgaaaag

SEQ ID NO: 259050 - DNA, 15 bp, Homo sapiens
gttttactatgaaaa

SEQ ID NO: 259051 - DNA, 15 bp, Homo sapiens
agttttactatgaaa

SEQ ID NO: 259052 - DNA, 15 bp, Homo sapiens
gagttttactatgaa

SEQ ID NO: 259053 - DNA, 15 bp, Homo sapiens
tgagttttactatga

SEQ ID NO: 259054 - DNA, 15 bp, Homo sapiens
atgagttttactatg

SEQ ID NO: 259055 - DNA, 15 bp, Homo sapiens
aatgagttttactat

SEQ ID NO: 259056 - DNA, 15 bp, Homo sapiens
gaatgagttttacta

SEQ ID NO: 259057 - DNA, 15 bp, Homo sapiens
tgaatgagttttact

SEQ ID NO: 259058 - DNA, 15 bp, Homo sapiens
ctgaatgagttttac

SEQ ID NO: 259059 - DNA, 15 bp, Homo sapiens
actgaatgagtttta

SEQ ID NO: 259060 - DNA, 15 bp, Homo sapiens
aactgaatgagtttt

SEQ ID NO: 259061 - DNA, 15 bp, Homo sapiens
aaactgaatgagttt

SEQ ID NO: 259062 - DNA, 15 bp, Homo sapiens
aaaactgaatgagtt

SEQ ID NO: 259063 - DNA, 15 bp, Homo sapiens
caaaactgaatgagt

SEQ ID NO: 259064 - DNA, 15 bp, Homo sapiens
ccaaaactgaatgag

SEQ ID NO: 259065 - DNA, 15 bp, Homo sapiens
gccaaaactgaatga

SEQ ID NO: 259066 - DNA, 15 bp, Homo sapiens
tgccaaaactgaatg

SEQ ID NO: 259067 - DNA, 15 bp, Homo sapiens
atgccaaaactgaat

SEQ ID NO: 259068 - DNA, 15 bp, Homo sapiens
tatgccaaaactgaa

SEQ ID NO: 259069 - DNA, 15 bp, Homo sapiens
atatgccaaaactga

SEQ ID NO: 259070 - DNA, 15 bp, Homo sapiens
aatatgccaaaactg

SEQ ID NO: 259071 - DNA, 15 bp, Homo sapiens
aaatatgccaaaact

SEQ ID NO: 259072 - DNA, 15 bp, Homo sapiens
taaatatgccaaaac

SEQ ID NO: 259073 - DNA, 15 bp, Homo sapiens
ataaatatgccaaaa

SEQ ID NO: 259074 - DNA, 15 bp, Homo sapiens
tataaatatgccaaa

SEQ ID NO: 259075 - DNA, 15 bp, Homo sapiens
ttataaatatgccaa

SEQ ID NO: 259076 - DNA, 15 bp, Homo sapiens
tttataaatatgcca

SEQ ID NO: 259077 - DNA, 15 bp, Homo sapiens
atttataaatatgcc

SEQ ID NO: 259078 - DNA, 15 bp, Homo sapiens
tatttataaatatgc

SEQ ID NO: 259079 - DNA, 15 bp, Homo sapiens
atatttataaatatg

SEQ ID NO: 259080 - DNA, 15 bp, Homo sapiens
tatatttataaatat

SEQ ID NO: 259081 - DNA, 15 bp, Homo sapiens
ttatatttataaata

SEQ ID NO: 259082 - DNA, 15 bp, Homo sapiens
attatatttataaat

SEQ ID NO: 259083 - DNA, 15 bp, Homo sapiens
tattatatttataaa

SEQ ID NO: 259084 - DNA, 15 bp, Homo sapiens
gtattatatttataa

SEQ ID NO: 259085 - DNA, 15 bp, Homo sapiens
tgtattatatttata

SEQ ID NO: 259086 - DNA, 15 bp, Homo sapiens
ctgtattatatttat

SEQ ID NO: 259087 - DNA, 15 bp, Homo sapiens
gctgtattatattta

SEQ ID NO: 259088 - DNA, 15 bp, Homo sapiens
tgctgtattatattt

SEQ ID NO: 259089 - DNA, 15 bp, Homo sapiens
ttgctgtattatatt

SEQ ID NO: 259090 - DNA, 15 bp, Homo sapiens
gttgctgtattatat

SEQ ID NO: 259091 - DNA, 15 bp, Homo sapiens
tgttgctgtattata

SEQ ID NO: 259092 - DNA, 15 bp, Homo sapiens
ttgttgctgtattat

SEQ ID NO: 259093 - DNA, 15 bp, Homo sapiens
tttgttgctgtatta

SEQ ID NO: 259094 - DNA, 15 bp, Homo sapiens
ttttgttgctgtatt

SEQ ID NO: 259095 - DNA, 15 bp, Homo sapiens
tttttgttgctgtat

SEQ ID NO: 259096 - DNA, 15 bp, Homo sapiens
atttttgttgctgta

SEQ ID NO: 259097 - DNA, 15 bp, Homo sapiens
gatttttgttgctgt

SEQ ID NO: 259098 - DNA, 15 bp, Homo sapiens
tgatttttgttgctg

SEQ ID NO: 259099 - DNA, 15 bp, Homo sapiens
ttgatttttgttgct

SEQ ID NO: 259100 - DNA, 15 bp, Homo sapiens
attgatttttgttgc

SEQ ID NO: 259101 - DNA, 15 bp, Homo sapiens
cattgatttttgttg

SEQ ID NO: 259102 - DNA, 15 bp, Homo sapiens
tcattgatttttgtt

SEQ ID NO: 259103 - DNA, 15 bp, Homo sapiens
ctcattgatttttgt

SEQ ID NO: 259104 - DNA, 15 bp, Homo sapiens
gctcattgatttttg

SEQ ID NO: 259105 - DNA, 15 bp, Homo sapiens
agctcattgattttt

SEQ ID NO: 259106 - DNA, 15 bp, Homo sapiens
tagctcattgatttt

SEQ ID NO: 259107 - DNA, 15 bp, Homo sapiens
ctagctcattgattt

SEQ ID NO: 259108 - DNA, 15 bp, Homo sapiens
actagctcattgatt

SEQ ID NO: 259109 - DNA, 15 bp, Homo sapiens
tactagctcattgat

SEQ ID NO: 259110 - DNA, 15 bp, Homo sapiens
ttactagctcattga

SEQ ID NO: 259111 - DNA, 15 bp, Homo sapiens
attactagctcattg

SEQ ID NO: 259112 - DNA, 15 bp, Homo sapiens
gattactagctcatt

SEQ ID NO: 259113 - DNA, 15 bp, Homo sapiens
tgattactagctcat

SEQ ID NO: 259114 - DNA, 15 bp, Homo sapiens
ctgattactagctca

SEQ ID NO: 259115 - DNA, 15 bp, Homo sapiens
gctgattactagctc

SEQ ID NO: 259116 - DNA, 15 bp, Homo sapiens
tgctgattactagct

SEQ ID NO: 259117 - DNA, 15 bp, Homo sapiens
atgctgattactagc

SEQ ID NO: 259118 - DNA, 15 bp, Homo sapiens
gatgctgattactag

SEQ ID NO: 259119 - DNA, 15 bp, Homo sapiens
tgatgctgattacta

SEQ ID NO: 259120 - DNA, 15 bp, Homo sapiens
ttgatgctgattact

SEQ ID NO: 259121 - DNA, 15 bp, Homo sapiens
gttgatgctgattac

SEQ ID NO: 259122 - DNA, 15 bp, Homo sapiens
tgttgatgctgatta

SEQ ID NO: 259123 - DNA, 15 bp, Homo sapiens
atgttgatgctgatt

SEQ ID NO: 259124 - DNA, 15 bp, Homo sapiens
catgttgatgctgat

SEQ ID NO: 259125 - DNA, 15 bp, Homo sapiens
tcatgttgatgctga

SEQ ID NO: 259126 - DNA, 15 bp, Homo sapiens
atcatgttgatgctg

SEQ ID NO: 259127 - DNA, 15 bp, Homo sapiens
aatcatgttgatgct

SEQ ID NO: 259128 - DNA, 15 bp, Homo sapiens
aaatcatgttgatgc

SEQ ID NO: 259129 - DNA, 15 bp, Homo sapiens
taaatcatgttgatg

SEQ ID NO: 259130 - DNA, 15 bp, Homo sapiens
ttaaatcatgttgat

SEQ ID NO: 259131 - DNA, 15 bp, Homo sapiens
attaaatcatgttga

SEQ ID NO: 259132 - DNA, 15 bp, Homo sapiens
gattaaatcatgttg

SEQ ID NO: 259133 - DNA, 15 bp, Homo sapiens
agattaaatcatgtt

SEQ ID NO: 259134 - DNA, 15 bp, Homo sapiens
aagattaaatcatgt

SEQ ID NO: 259135 - DNA, 15 bp, Homo sapiens
taagattaaatcatg

SEQ ID NO: 259136 - DNA, 15 bp, Homo sapiens
ctaagattaaatcat

SEQ ID NO: 259137 - DNA, 15 bp, Homo sapiens
tctaagattaaatca

SEQ ID NO: 259138 - DNA, 15 bp, Homo sapiens
ttctaagattaaatc

SEQ ID NO: 259139 - DNA, 15 bp, Homo sapiens
gttctaagattaaat

SEQ ID NO: 259140 - DNA, 15 bp, Homo sapiens
agttctaagattaaa

SEQ ID NO: 259141 - DNA, 15 bp, Homo sapiens
tagttctaagattaa

SEQ ID NO: 259142 - DNA, 15 bp, Homo sapiens
atagttctaagatta

SEQ ID NO: 259143 - DNA, 15 bp, Homo sapiens
tatagttctaagatt

SEQ ID NO: 259144 - DNA, 15 bp, Homo sapiens
ttatagttctaagat

SEQ ID NO: 259145 - DNA, 15 bp, Homo sapiens
tttatagttctaaga

SEQ ID NO: 259146 - DNA, 15 bp, Homo sapiens
ttttatagttctaag

SEQ ID NO: 259147 - DNA, 15 bp, Homo sapiens
attttatagttctaa

SEQ ID NO: 259148 - DNA, 15 bp, Homo sapiens
aattttatagttcta

SEQ ID NO: 259149 - DNA, 15 bp, Homo sapiens
taattttatagttct

SEQ ID NO: 259150 - DNA, 15 bp, Homo sapiens
ttaattttatagttc

SEQ ID NO: 259151 - DNA, 15 bp, Homo sapiens
tttaattttatagtt

SEQ ID NO: 259152 - DNA, 15 bp, Homo sapiens
atttaattttatagt

SEQ ID NO: 259153 - DNA, 15 bp, Homo sapiens
catttaattttatag

SEQ ID NO: 259154 - DNA, 15 bp, Homo sapiens
tcatttaattttata

SEQ ID NO: 259155 - DNA, 15 bp, Homo sapiens
ttcatttaattttat

SEQ ID NO: 259156 - DNA, 15 bp, Homo sapiens
tttcatttaatttta

SEQ ID NO: 259157 - DNA, 15 bp, Homo sapiens
ttttcatttaatttt

SEQ ID NO: 259158 - DNA, 15 bp, Homo sapiens
tttttcatttaattt

SEQ ID NO: 259159 - DNA, 15 bp, Homo sapiens
ttttttcatttaatt

SEQ ID NO: 259160 - DNA, 15 bp, Homo sapiens
attttttcatttaat

SEQ ID NO: 259161 - DNA, 15 bp, Homo sapiens
aattttttcatttaa

SEQ ID NO: 259162 - DNA, 15 bp, Homo sapiens
taattttttcattta

SEQ ID NO: 259163 - DNA, 15 bp, Homo sapiens
ttaattttttcattt

SEQ ID NO: 259164 - DNA, 15 bp, Homo sapiens
tttaattttttcatt

SEQ ID NO: 259165 - DNA, 15 bp, Homo sapiens
atttaattttttcat

SEQ ID NO: 259166 - DNA, 15 bp, Homo sapiens
catttaattttttca

SEQ ID NO: 259167 - DNA, 15 bp, Homo sapiens
ccatttaattttttc

SEQ ID NO: 259168 - DNA, 15 bp, Homo sapiens
gccatttaatttttt

SEQ ID NO: 259169 - DNA, 15 bp, Homo sapiens
tgccatttaattttt

SEQ ID NO: 259170 - DNA, 15 bp, Homo sapiens
ctgccatttaatttt

SEQ ID NO: 259171 - DNA, 15 bp, Homo sapiens
tctgccatttaattt

SEQ ID NO: 259172 - DNA, 15 bp, Homo sapiens
ttctgccatttaatt

SEQ ID NO: 259173 - DNA, 15 bp, Homo sapiens
tttctgccatttaat

SEQ ID NO: 259174 - DNA, 15 bp, Homo sapiens
ttttctgccatttaa

SEQ ID NO: 259175 - DNA, 15 bp, Homo sapiens
tttttctgccattta

SEQ ID NO: 259176 - DNA, 15 bp, Homo sapiens
ttttttctgccattt

SEQ ID NO: 259177 - DNA, 15 bp, Homo sapiens
tttttttctgccatt

SEQ ID NO: 259178 - DNA, 15 bp, Homo sapiens
ttttttttctgccat

SEQ ID NO: 259179 - DNA, 15 bp, Homo sapiens
attttttttctgcca

SEQ ID NO: 259180 - DNA, 15 bp, Homo sapiens
cattttttttctgcc

SEQ ID NO: 259181 - DNA, 15 bp, Homo sapiens
acattttttttctgc

SEQ ID NO: 259182 - DNA, 15 bp, Homo sapiens
cacattttttttctg

SEQ ID NO: 259183 - DNA, 15 bp, Homo sapiens
acacattttttttct

SEQ ID NO: 259184 - DNA, 15 bp, Homo sapiens
tacacattttttttc

SEQ ID NO: 259185 - DNA, 15 bp, Homo sapiens
gtacacatttttttt

SEQ ID NO: 259186 - DNA, 15 bp, Homo sapiens
ggtacacattttttt

SEQ ID NO: 259187 - DNA, 15 bp, Homo sapiens
tggtacacatttttt

SEQ ID NO: 259188 - DNA, 15 bp, Homo sapiens
gtggtacacattttt

SEQ ID NO: 259189 - DNA, 15 bp, Homo sapiens
agtggtacacatttt

SEQ ID NO: 259190 - DNA, 15 bp, Homo sapiens
gagtggtacacattt

SEQ ID NO: 259191 - DNA, 15 bp, Homo sapiens
agagtggtacacatt

SEQ ID NO: 259192 - DNA, 15 bp, Homo sapiens
cagagtggtacacat

SEQ ID NO: 259193 - DNA, 15 bp, Homo sapiens
acagagtggtacaca

SEQ ID NO: 259194 - DNA, 15 bp, Homo sapiens
aacagagtggtacac

SEQ ID NO: 259195 - DNA, 15 bp, Homo sapiens
gaacagagtggtaca

SEQ ID NO: 259196 - DNA, 15 bp, Homo sapiens
ggaacagagtggtac

SEQ ID NO: 259197 - DNA, 15 bp, Homo sapiens
tggaacagagtggta

SEQ ID NO: 259198 - DNA, 15 bp, Homo sapiens
atggaacagagtggt

SEQ ID NO: 259199 - DNA, 15 bp, Homo sapiens
aatggaacagagtgg

SEQ ID NO: 259200 - DNA, 15 bp, Homo sapiens
aaatggaacagagtg

SEQ ID NO: 259201 - DNA, 15 bp, Homo sapiens
taaatggaacagagt

SEQ ID NO: 259202 - DNA, 15 bp, Homo sapiens
ataaatggaacagag

SEQ ID NO: 259203 - DNA, 15 bp, Homo sapiens
tataaatggaacaga

SEQ ID NO: 259204 - DNA, 15 bp, Homo sapiens
atataaatggaacag

SEQ ID NO: 259205 - DNA, 15 bp, Homo sapiens
catataaatggaaca

SEQ ID NO: 259206 - DNA, 15 bp, Homo sapiens
acatataaatggaac

SEQ ID NO: 259207 - DNA, 15 bp, Homo sapiens
tacatataaatggaa

SEQ ID NO: 259208 - DNA, 15 bp, Homo sapiens
ctacatataaatgga

SEQ ID NO: 259209 - DNA, 15 bp, Homo sapiens
actacatataaatgg

SEQ ID NO: 259210 - DNA, 15 bp, Homo sapiens
aactacatataaatg

SEQ ID NO: 259211 - DNA, 15 bp, Homo sapiens
gaactacatataaat

SEQ ID NO: 259212 - DNA, 15 bp, Homo sapiens
tgaactacatataaa

SEQ ID NO: 259213 - DNA, 15 bp, Homo sapiens
ttgaactacatataa

SEQ ID NO: 259214 - DNA, 15 bp, Homo sapiens
tttgaactacatata

SEQ ID NO: 259215 - DNA, 15 bp, Homo sapiens
gtttgaactacatat

SEQ ID NO: 259216 - DNA, 15 bp, Homo sapiens
ggtttgaactacata

SEQ ID NO: 259217 - DNA, 15 bp, Homo sapiens
gggtttgaactacat

SEQ ID NO: 259218 - DNA, 15 bp, Homo sapiens
tgggtttgaactaca

SEQ ID NO: 259219 - DNA, 15 bp, Homo sapiens
atgggtttgaactac

SEQ ID NO: 259220 - DNA, 15 bp, Homo sapiens
catgggtttgaacta

SEQ ID NO: 259221 - DNA, 15 bp, Homo sapiens
gcatgggtttgaact

SEQ ID NO: 259222 - DNA, 15 bp, Homo sapiens
tgcatgggtttgaac

SEQ ID NO: 259223 - DNA, 15 bp, Homo sapiens
ttgcatgggtttgaa

SEQ ID NO: 259224 - DNA, 15 bp, Homo sapiens
tttgcatgggtttga

SEQ ID NO: 259225 - DNA, 15 bp, Homo sapiens
ttttgcatgggtttg

SEQ ID NO: 259226 - DNA, 15 bp, Homo sapiens
gttttgcatgggttt

SEQ ID NO: 259227 - DNA, 15 bp, Homo sapiens
agttttgcatgggtt

SEQ ID NO: 259228 - DNA, 15 bp, Homo sapiens
tagttttgcatgggt

SEQ ID NO: 259229 - DNA, 15 bp, Homo sapiens
ttagttttgcatggg

SEQ ID NO: 259230 - DNA, 15 bp, Homo sapiens
attagttttgcatgg

SEQ ID NO: 259231 - DNA, 15 bp, Homo sapiens
cattagttttgcatg

SEQ ID NO: 259232 - DNA, 15 bp, Homo sapiens
gcattagttttgcat

SEQ ID NO: 259233 - DNA, 15 bp, Homo sapiens
agcattagttttgca

SEQ ID NO: 259234 - DNA, 15 bp, Homo sapiens
tagcattagttttgc

SEQ ID NO: 259235 - DNA, 15 bp, Homo sapiens
atagcattagttttg

SEQ ID NO: 259236 - DNA, 15 bp, Homo sapiens
tatagcattagtttt

SEQ ID NO: 259237 - DNA, 15 bp, Homo sapiens
atatagcattagttt

SEQ ID NO: 259238 - DNA, 15 bp, Homo sapiens
tatatagcattagtt

SEQ ID NO: 259239 - DNA, 15 bp, Homo sapiens
gtatatagcattagt

SEQ ID NO: 259240 - DNA, 15 bp, Homo sapiens
tgtatatagcattag

SEQ ID NO: 259241 - DNA, 15 bp, Homo sapiens
gtgtatatagcatta

SEQ ID NO: 259242 - DNA, 15 bp, Homo sapiens
agtgtatatagcatt

SEQ ID NO: 259243 - DNA, 15 bp, Homo sapiens
aagtgtatatagcat

SEQ ID NO: 259244 - DNA, 15 bp, Homo sapiens
aaagtgtatatagca

SEQ ID NO: 259245 - DNA, 15 bp, Homo sapiens
aaaagtgtatatagc

SEQ ID NO: 259246 - DNA, 15 bp, Homo sapiens
taaaagtgtatatag

SEQ ID NO: 259247 - DNA, 15 bp, Homo sapiens
ttaaaagtgtatata

SEQ ID NO: 259248 - DNA, 15 bp, Homo sapiens
tttaaaagtgtatat

SEQ ID NO: 259249 - DNA, 15 bp, Homo sapiens
ttttaaaagtgtata

SEQ ID NO: 259250 - DNA, 15 bp, Homo sapiens
tttttaaaagtgtat

SEQ ID NO: 259251 - DNA, 15 bp, Homo sapiens
gtttttaaaagtgta

SEQ ID NO: 259252 - DNA, 15 bp, Homo sapiens
agtttttaaaagtgt

SEQ ID NO: 259253 - DNA, 15 bp, Homo sapiens
cagtttttaaaagtg

SEQ ID NO: 259254 - DNA, 15 bp, Homo sapiens
tcagtttttaaaagt

SEQ ID NO: 259255 - DNA, 15 bp, Homo sapiens
ttcagtttttaaaag

SEQ ID NO: 259256 - DNA, 15 bp, Homo sapiens
tttcagtttttaaaa

SEQ ID NO: 259257 - DNA, 15 bp, Homo sapiens
ctttcagtttttaaa

SEQ ID NO: 259258 - DNA, 15 bp, Homo sapiens
actttcagtttttaa

SEQ ID NO: 259259 - DNA, 15 bp, Homo sapiens
cactttcagttttta

SEQ ID NO: 259260 - DNA, 15 bp, Homo sapiens
tcactttcagttttt

SEQ ID NO: 259261 - DNA, 15 bp, Homo sapiens
ttcactttcagtttt

SEQ ID NO: 259262 - DNA, 15 bp, Homo sapiens
tttcactttcagttt

SEQ ID NO: 259263 - DNA, 15 bp, Homo sapiens
atttcactttcagtt

SEQ ID NO: 259264 - DNA, 15 bp, Homo sapiens
tatttcactttcagt

SEQ ID NO: 259265 - DNA, 15 bp, Homo sapiens
gtatttcactttcag

SEQ ID NO: 259266 - DNA, 15 bp, Homo sapiens
tgtatttcactttca

SEQ ID NO: 259267 - DNA, 15 bp, Homo sapiens
ttgtatttcactttc

SEQ ID NO: 259268 - DNA, 15 bp, Homo sapiens
tttgtatttcacttt

SEQ ID NO: 259269 - DNA, 15 bp, Homo sapiens
ctttgtatttcactt

SEQ ID NO: 259270 - DNA, 15 bp, Homo sapiens
cctttgtatttcact

SEQ ID NO: 259271 - DNA, 15 bp, Homo sapiens
acctttgtatttcac

SEQ ID NO: 259272 - DNA, 15 bp, Homo sapiens
aacctttgtatttca

SEQ ID NO: 259273 - DNA, 15 bp, Homo sapiens
taacctttgtatttc

SEQ ID NO: 259274 - DNA, 15 bp, Homo sapiens
ttaacctttgtattt

SEQ ID NO: 259275 - DNA, 15 bp, Homo sapiens
attaacctttgtatt

SEQ ID NO: 259276 - DNA, 15 bp, Homo sapiens
cattaacctttgtat

SEQ ID NO: 259277 - DNA, 15 bp, Homo sapiens
ccattaacctttgta

SEQ ID NO: 259278 - DNA, 15 bp, Homo sapiens
accattaacctttgt

SEQ ID NO: 259279 - DNA, 15 bp, Homo sapiens
aaccattaacctttg

SEQ ID NO: 259280 - DNA, 15 bp, Homo sapiens
taaccattaaccttt

SEQ ID NO: 259281 - DNA, 15 bp, Homo sapiens
gtaaccattaacctt

SEQ ID NO: 259282 - DNA, 15 bp, Homo sapiens
ggtaaccattaacct

SEQ ID NO: 259283 - DNA, 15 bp, Homo sapiens
gggtaaccattaacc

SEQ ID NO: 259284 - DNA, 15 bp, Homo sapiens
ggggtaaccattaac

SEQ ID NO: 259285 - DNA, 15 bp, Homo sapiens
tggggtaaccattaa

SEQ ID NO: 259286 - DNA, 15 bp, Homo sapiens
atggggtaaccatta

SEQ ID NO: 259287 - DNA, 15 bp, Homo sapiens
tatggggtaaccatt

SEQ ID NO: 259288 - DNA, 15 bp, Homo sapiens
ttatggggtaaccat

SEQ ID NO: 259289 - DNA, 15 bp, Homo sapiens
attatggggtaacca

SEQ ID NO: 259290 - DNA, 15 bp, Homo sapiens
aattatggggtaacc

SEQ ID NO: 259291 - DNA, 15 bp, Homo sapiens
caattatggggtaac

SEQ ID NO: 259292 - DNA, 15 bp, Homo sapiens
acaattatggggtaa

SEQ ID NO: 259293 - DNA, 15 bp, Homo sapiens
tacaattatggggta

SEQ ID NO: 259294 - DNA, 15 bp, Homo sapiens
ttacaattatggggt

SEQ ID NO: 259295 - DNA, 15 bp, Homo sapiens
cttacaattatgggg

SEQ ID NO: 259296 - DNA, 15 bp, Homo sapiens
tcttacaattatggg

SEQ ID NO: 259297 - DNA, 15 bp, Homo sapiens
ctcttacaattatgg

SEQ ID NO: 259298 - DNA, 15 bp, Homo sapiens
cctcttacaattatg

SEQ ID NO: 259299 - DNA, 15 bp, Homo sapiens
tcctcttacaattat

SEQ ID NO: 259300 - DNA, 15 bp, Homo sapiens
atcctcttacaatta

SEQ ID NO: 259301 - DNA, 15 bp, Homo sapiens
catcctcttacaatt

SEQ ID NO: 259302 - DNA, 15 bp, Homo sapiens
acatcctcttacaat

SEQ ID NO: 259303 - DNA, 15 bp, Homo sapiens
tacatcctcttacaa

SEQ ID NO: 259304 - DNA, 15 bp, Homo sapiens
ttacatcctcttaca

SEQ ID NO: 259305 - DNA, 15 bp, Homo sapiens
attacatcctcttac

SEQ ID NO: 259306 - DNA, 15 bp, Homo sapiens
aattacatcctctta

SEQ ID NO: 259307 - DNA, 15 bp, Homo sapiens
taattacatcctctt

SEQ ID NO: 259308 - DNA, 15 bp, Homo sapiens
ctaattacatcctct

SEQ ID NO: 259309 - DNA, 15 bp, Homo sapiens
cctaattacatcctc

SEQ ID NO: 259310 - DNA, 15 bp, Homo sapiens
gcctaattacatcct

SEQ ID NO: 259311 - DNA, 15 bp, Homo sapiens
tgcctaattacatcc

SEQ ID NO: 259312 - DNA, 15 bp, Homo sapiens
ctgcctaattacatc

SEQ ID NO: 259313 - DNA, 15 bp, Homo sapiens
cctgcctaattacat

SEQ ID NO: 259314 - DNA, 15 bp, Homo sapiens
tcctgcctaattaca

SEQ ID NO: 259315 - DNA, 15 bp, Homo sapiens
atcctgcctaattac

SEQ ID NO: 259316 - DNA, 15 bp, Homo sapiens
aatcctgcctaatta

SEQ ID NO: 259317 - DNA, 15 bp, Homo sapiens
gaatcctgcctaatt

SEQ ID NO: 259318 - DNA, 15 bp, Homo sapiens
tgaatcctgcctaat

SEQ ID NO: 259319 - DNA, 15 bp, Homo sapiens
ttgaatcctgcctaa

SEQ ID NO: 259320 - DNA, 15 bp, Homo sapiens
cttgaatcctgccta

SEQ ID NO: 259321 - DNA, 15 bp, Homo sapiens
ccttgaatcctgcct

SEQ ID NO: 259322 - DNA, 15 bp, Homo sapiens
tccttgaatcctgcc

SEQ ID NO: 259323 - DNA, 15 bp, Homo sapiens
ctccttgaatcctgc

SEQ ID NO: 259324 - DNA, 15 bp, Homo sapiens
gctccttgaatcctg

SEQ ID NO: 259325 - DNA, 15 bp, Homo sapiens
agctccttgaatcct

SEQ ID NO: 259326 - DNA, 15 bp, Homo sapiens
aagctccttgaatcc

SEQ ID NO: 259327 - DNA, 15 bp, Homo sapiens
gaagctccttgaatc

SEQ ID NO: 259328 - DNA, 15 bp, Homo sapiens
ggaagctccttgaat

SEQ ID NO: 259329 - DNA, 15 bp, Homo sapiens
tggaagctccttgaa

SEQ ID NO: 259330 - DNA, 15 bp, Homo sapiens
ttggaagctccttga

SEQ ID NO: 259331 - DNA, 15 bp, Homo sapiens
cttggaagctccttg

SEQ ID NO: 259332 - DNA, 15 bp, Homo sapiens
tcttggaagctcctt

SEQ ID NO: 259333 - DNA, 15 bp, Homo sapiens
atcttggaagctcct

SEQ ID NO: 259334 - DNA, 15 bp, Homo sapiens
tatcttggaagctcc

SEQ ID NO: 259335 - DNA, 15 bp, Homo sapiens
ctatcttggaagctc

SEQ ID NO: 259336 - DNA, 15 bp, Homo sapiens
actatcttggaagct

SEQ ID NO: 259337 - DNA, 15 bp, Homo sapiens
cactatcttggaagc

SEQ ID NO: 259338 - DNA, 15 bp, Homo sapiens
ccactatcttggaag

SEQ ID NO: 259339 - DNA, 15 bp, Homo sapiens
accactatcttggaa

SEQ ID NO: 259340 - DNA, 15 bp, Homo sapiens
taccactatcttgga

SEQ ID NO: 259341 - DNA, 15 bp, Homo sapiens
ttaccactatcttgg

SEQ ID NO: 259342 - DNA, 15 bp, Homo sapiens
gttaccactatcttg

SEQ ID NO: 259343 - DNA, 15 bp, Homo sapiens
tgttaccactatctt

SEQ ID NO: 259344 - DNA, 15 bp, Homo sapiens
atgttaccactatct

SEQ ID NO: 259345 - DNA, 15 bp, Homo sapiens
aatgttaccactatc

SEQ ID NO: 259346 - DNA, 15 bp, Homo sapiens
gaatgttaccactat

SEQ ID NO: 259347 - DNA, 15 bp, Homo sapiens
agaatgttaccacta

SEQ ID NO: 259348 - DNA, 15 bp, Homo sapiens
cagaatgttaccact

SEQ ID NO: 259349 - DNA, 15 bp, Homo sapiens
acagaatgttaccac

SEQ ID NO: 259350 - DNA, 15 bp, Homo sapiens
aacagaatgttacca

SEQ ID NO: 259351 - DNA, 15 bp, Homo sapiens
aaacagaatgttacc

SEQ ID NO: 259352 - DNA, 15 bp, Homo sapiens
aaaacagaatgttac

SEQ ID NO: 259353 - DNA, 15 bp, Homo sapiens
aaaaacagaatgtta

SEQ ID NO: 259354 - DNA, 15 bp, Homo sapiens
aaaaaacagaatgtt

SEQ ID NO: 259355 - DNA, 15 bp, Homo sapiens
aaaaaaacagaatgt

SEQ ID NO: 259356 - DNA, 15 bp, Homo sapiens
gaaaaaaacagaatg

SEQ ID NO: 259357 - DNA, 15 bp, Homo sapiens
tgaaaaaaacagaat

SEQ ID NO: 259358 - DNA, 15 bp, Homo sapiens
ctgaaaaaaacagaa

SEQ ID NO: 259359 - DNA, 15 bp, Homo sapiens
gctgaaaaaaacaga

SEQ ID NO: 259360 - DNA, 15 bp, Homo sapiens
agctgaaaaaaacag

SEQ ID NO: 259361 - DNA, 15 bp, Homo sapiens
cagctgaaaaaaaca

SEQ ID NO: 259362 - DNA, 15 bp, Homo sapiens
acagctgaaaaaaac

SEQ ID NO: 259363 - DNA, 15 bp, Homo sapiens
cacagctgaaaaaaa

SEQ ID NO: 259364 - DNA, 15 bp, Homo sapiens
acacagctgaaaaaa

SEQ ID NO: 259365 - DNA, 15 bp, Homo sapiens
cacacagctgaaaaa

SEQ ID NO: 259366 - DNA, 15 bp, Homo sapiens
tcacacagctgaaaa

SEQ ID NO: 259367 - DNA, 15 bp, Homo sapiens
atcacacagctgaaa

SEQ ID NO: 259368 - DNA, 15 bp, Homo sapiens
catcacacagctgaa

SEQ ID NO: 259369 - DNA, 15 bp, Homo sapiens
ccatcacacagctga

SEQ ID NO: 259370 - DNA, 15 bp, Homo sapiens
tccatcacacagctg

SEQ ID NO: 259371 - DNA, 15 bp, Homo sapiens
gtccatcacacagct

SEQ ID NO: 259372 - DNA, 15 bp, Homo sapiens
agtccatcacacagc

SEQ ID NO: 259373 - DNA, 15 bp, Homo sapiens
tagtccatcacacag

SEQ ID NO: 259374 - DNA, 15 bp, Homo sapiens
ttagtccatcacaca

SEQ ID NO: 259375 - DNA, 15 bp, Homo sapiens
attagtccatcacac

SEQ ID NO: 259376 - DNA, 15 bp, Homo sapiens
cattagtccatcaca

SEQ ID NO: 259377 - DNA, 15 bp, Homo sapiens
ccattagtccatcac

SEQ ID NO: 259378 - DNA, 15 bp, Homo sapiens
cccattagtccatca

SEQ ID NO: 259379 - DNA, 15 bp, Homo sapiens
acccattagtccatc

SEQ ID NO: 259380 - DNA, 15 bp, Homo sapiens
tacccattagtccat

SEQ ID NO: 259381 - DNA, 15 bp, Homo sapiens
atacccattagtcca

SEQ ID NO: 259382 - DNA, 15 bp, Homo sapiens
aatacccattagtcc

SEQ ID NO: 259383 - DNA, 15 bp, Homo sapiens
aaatacccattagtc

SEQ ID NO: 259384 - DNA, 15 bp, Homo sapiens
caaatacccattagt

SEQ ID NO: 259385 - DNA, 15 bp, Homo sapiens
acaaatacccattag

SEQ ID NO: 259386 - DNA, 15 bp, Homo sapiens
aacaaatacccatta

SEQ ID NO: 259387 - DNA, 15 bp, Homo sapiens
gaacaaatacccatt

SEQ ID NO: 259388 - DNA, 15 bp, Homo sapiens
agaacaaatacccat

SEQ ID NO: 259389 - DNA, 15 bp, Homo sapiens
tagaacaaataccca

SEQ ID NO: 259390 - DNA, 15 bp, Homo sapiens
atagaacaaataccc

SEQ ID NO: 259391 - DNA, 15 bp, Homo sapiens
aatagaacaaatacc

SEQ ID NO: 259392 - DNA, 15 bp, Homo sapiens
taatagaacaaatac

SEQ ID NO: 259393 - DNA, 15 bp, Homo sapiens
ataatagaacaaata

SEQ ID NO: 259394 - DNA, 15 bp, Homo sapiens
aataatagaacaaat

SEQ ID NO: 259395 - DNA, 15 bp, Homo sapiens
aaataatagaacaaa

SEQ ID NO: 259396 - DNA, 15 bp, Homo sapiens
aaaataatagaacaa

SEQ ID NO: 259397 - DNA, 15 bp, Homo sapiens
gaaaataatagaaca

SEQ ID NO: 259398 - DNA, 15 bp, Homo sapiens
agaaaataatagaac

SEQ ID NO: 259399 - DNA, 15 bp, Homo sapiens
aagaaaataatagaa

SEQ ID NO: 259400 - DNA, 15 bp, Homo sapiens
aaagaaaataataga

SEQ ID NO: 259401 - DNA, 15 bp, Homo sapiens
aaaagaaaataatag

SEQ ID NO: 259402 - DNA, 15 bp, Homo sapiens
taaaagaaaataata

SEQ ID NO: 259403 - DNA, 15 bp, Homo sapiens
ctaaaagaaaataat

SEQ ID NO: 259404 - DNA, 15 bp, Homo sapiens
tctaaaagaaaataa

SEQ ID NO: 259405 - DNA, 15 bp, Homo sapiens
gtctaaaagaaaata

SEQ ID NO: 259406 - DNA, 15 bp, Homo sapiens
ggtctaaaagaaaat

SEQ ID NO: 259407 - DNA, 15 bp, Homo sapiens
tggtctaaaagaaaa

SEQ ID NO: 259408 - DNA, 15 bp, Homo sapiens
gtggtctaaaagaaa

SEQ ID NO: 259409 - DNA, 15 bp, Homo sapiens
tgtggtctaaaagaa

SEQ ID NO: 259410 - DNA, 15 bp, Homo sapiens
gtgtggtctaaaaga

SEQ ID NO: 259411 - DNA, 15 bp, Homo sapiens
tgtgtggtctaaaag

SEQ ID NO: 259412 - DNA, 15 bp, Homo sapiens
atgtgtggtctaaaa

SEQ ID NO: 259413 - DNA, 15 bp, Homo sapiens
tatgtgtggtctaaa

SEQ ID NO: 259414 - DNA, 15 bp, Homo sapiens
atatgtgtggtctaa

SEQ ID NO: 259415 - DNA, 15 bp, Homo sapiens
catatgtgtggtcta

SEQ ID NO: 259416 - DNA, 15 bp, Homo sapiens
acatatgtgtggtct

SEQ ID NO: 259417 - DNA, 15 bp, Homo sapiens
tacatatgtgtggtc

SEQ ID NO: 259418 - DNA, 15 bp, Homo sapiens
atacatatgtgtggt

SEQ ID NO: 259419 - DNA, 15 bp, Homo sapiens
aatacatatgtgtgg

SEQ ID NO: 259420 - DNA, 15 bp, Homo sapiens
aaatacatatgtgtg

SEQ ID NO: 259421 - DNA, 15 bp, Homo sapiens
aaaatacatatgtgt

SEQ ID NO: 259422 - DNA, 15 bp, Homo sapiens
gaaaatacatatgtg

SEQ ID NO: 259423 - DNA, 15 bp, Homo sapiens
agaaaatacatatgt

SEQ ID NO: 259424 - DNA, 15 bp, Homo sapiens
cagaaaatacatatg

SEQ ID NO: 259425 - DNA, 15 bp, Homo sapiens
acagaaaatacatat

SEQ ID NO: 259426 - DNA, 15 bp, Homo sapiens
aacagaaaatacata

SEQ ID NO: 259427 - DNA, 15 bp, Homo sapiens
aaacagaaaatacat

SEQ ID NO: 259428 - DNA, 15 bp, Homo sapiens
aaaacagaaaataca

SEQ ID NO: 259429 - DNA, 15 bp, Homo sapiens
gaaaacagaaaatac

SEQ ID NO: 259430 - DNA, 15 bp, Homo sapiens
ggaaaacagaaaata

SEQ ID NO: 259431 - DNA, 15 bp, Homo sapiens
aggaaaacagaaaat

SEQ ID NO: 259432 - DNA, 15 bp, Homo sapiens
aaggaaaacagaaaa

SEQ ID NO: 259433 - DNA, 15 bp, Homo sapiens
aaaggaaaacagaaa

SEQ ID NO: 259434 - DNA, 15 bp, Homo sapiens
caaaggaaaacagaa

SEQ ID NO: 259435 - DNA, 15 bp, Homo sapiens
acaaaggaaaacaga

SEQ ID NO: 259436 - DNA, 15 bp, Homo sapiens
tacaaaggaaaacag

SEQ ID NO: 259437 - DNA, 15 bp, Homo sapiens
atacaaaggaaaaca

SEQ ID NO: 259438 - DNA, 15 bp, Homo sapiens
aatacaaaggaaaac

SEQ ID NO: 259439 - DNA, 15 bp, Homo sapiens
caaaatacaaaggaa

SEQ ID NO: 259440 - DNA, 15 bp, Homo sapiens
tcaaaatacaaagga

SEQ ID NO: 259441 - DNA, 15 bp, Homo sapiens
atcaaaatacaaagg

SEQ ID NO: 259442 - DNA, 15 bp, Homo sapiens
tacttccacttctgg

SEQ ID NO: 259443 - DNA, 15 bp, Homo sapiens
atacttccacttctg

SEQ ID NO: 259444 - DNA, 15 bp, Homo sapiens
catacttccacttct

SEQ ID NO: 259445 - DNA, 15 bp, Homo sapiens
gcatacttccacttc

SEQ ID NO: 259446 - DNA, 15 bp, Homo sapiens
agcatacttccactt

SEQ ID NO: 259447 - DNA, 15 bp, Homo sapiens
aagcatacttccact

SEQ ID NO: 259448 - DNA, 15 bp, Homo sapiens
aaagcatacttccac

SEQ ID NO: 259449 - DNA, 15 bp, Homo sapiens
taaagcatacttcca

SEQ ID NO: 259450 - DNA, 15 bp, Homo sapiens
ctaaagcatacttcc

SEQ ID NO: 259451 - DNA, 15 bp, Homo sapiens
cctaaagcatacttc

SEQ ID NO: 259452 - DNA, 15 bp, Homo sapiens
ccctaaagcatactt

SEQ ID NO: 259453 - DNA, 15 bp, Homo sapiens
tccctaaagcatact

SEQ ID NO: 259454 - DNA, 15 bp, Homo sapiens
ttccctaaagcatac

SEQ ID NO: 259455 - DNA, 15 bp, Homo sapiens
attccctaaagcata

SEQ ID NO: 259456 - DNA, 15 bp, Homo sapiens
tattccctaaagcat

SEQ ID NO: 259457 - DNA, 15 bp, Homo sapiens
atattccctaaagca

SEQ ID NO: 259458 - DNA, 15 bp, Homo sapiens
gatattccctaaagc

SEQ ID NO: 259459 - DNA, 15 bp, Homo sapiens
agatattccctaaag

SEQ ID NO: 259460 - DNA, 15 bp, Homo sapiens
tagatattccctaaa

SEQ ID NO: 259461 - DNA, 15 bp, Homo sapiens
ttagatattccctaa

SEQ ID NO: 259462 - DNA, 15 bp, Homo sapiens
cttagatattcccta

SEQ ID NO: 259463 - DNA, 15 bp, Homo sapiens
tcttagatattccct

SEQ ID NO: 259464 - DNA, 15 bp, Homo sapiens
ttcttagatattccc

SEQ ID NO: 259465 - DNA, 15 bp, Homo sapiens
tttcttagatattcc

SEQ ID NO: 259466 - DNA, 15 bp, Homo sapiens
ctttcttagatattc

SEQ ID NO: 259467 - DNA, 15 bp, Homo sapiens
tctttcttagatatt

SEQ ID NO: 259468 - DNA, 15 bp, Homo sapiens
gtctttcttagatat

SEQ ID NO: 259469 - DNA, 15 bp, Homo sapiens
ggtctttcttagata

SEQ ID NO: 259470 - DNA, 15 bp, Homo sapiens
tggtctttcttagat

SEQ ID NO: 259471 - DNA, 15 bp, Homo sapiens
ttggtctttcttaga

SEQ ID NO: 259472 - DNA, 15 bp, Homo sapiens
tttggtctttcttag

SEQ ID NO: 259473 - DNA, 15 bp, Homo sapiens
ctttggtctttctta

SEQ ID NO: 259474 - DNA, 15 bp, Homo sapiens
cctttggtctttctt

SEQ ID NO: 259475 - DNA, 15 bp, Homo sapiens
ccctttggtctttct

SEQ ID NO: 259476 - DNA, 15 bp, Homo sapiens
gccctttggtctttc

SEQ ID NO: 259477 - DNA, 15 bp, Homo sapiens
tgccctttggtcttt

SEQ ID NO: 259478 - DNA, 15 bp, Homo sapiens
ctgccctttggtctt

SEQ ID NO: 259479 - DNA, 15 bp, Homo sapiens
tctgccctttggtct

SEQ ID NO: 259480 - DNA, 15 bp, Homo sapiens
ctctgccctttggtc

SEQ ID NO: 259481 - DNA, 15 bp, Homo sapiens
tctctgccctttggt

SEQ ID NO: 259482 - DNA, 15 bp, Homo sapiens
ttctctgccctttgg

SEQ ID NO: 259483 - DNA, 15 bp, Homo sapiens
gttctctgccctttg

SEQ ID NO: 259484 - DNA, 15 bp, Homo sapiens
tgttctctgcccttt

SEQ ID NO: 259485 - DNA, 15 bp, Homo sapiens
ctgttctctgccctt

SEQ ID NO: 259486 - DNA, 15 bp, Homo sapiens
tctgttctctgccct

SEQ ID NO: 259487 - DNA, 15 bp, Homo sapiens
ctctgttctctgccc

SEQ ID NO: 259488 - DNA, 15 bp, Homo sapiens
tctctgttctctgcc

SEQ ID NO: 259489 - DNA, 15 bp, Homo sapiens
ttctctgttctctgc

SEQ ID NO: 259490 - DNA, 15 bp, Homo sapiens
attctctgttctctg

SEQ ID NO: 259491 - DNA, 15 bp, Homo sapiens
cattctctgttctct

SEQ ID NO: 259492 - DNA, 15 bp, Homo sapiens
ccattctctgttctc

SEQ ID NO: 259493 - DNA, 15 bp, Homo sapiens
cccattctctgttct

SEQ ID NO: 259494 - DNA, 15 bp, Homo sapiens
acccattctctgttc

SEQ ID NO: 259495 - DNA, 15 bp, Homo sapiens
tacccattctctgtt

SEQ ID NO: 259496 - DNA, 15 bp, Homo sapiens
ttacccattctctgt

SEQ ID NO: 259497 - DNA, 15 bp, Homo sapiens
tttacccattctctg

SEQ ID NO: 259498 - DNA, 15 bp, Homo sapiens
atttacccattctct

SEQ ID NO: 259499 - DNA, 15 bp, Homo sapiens
tatttacccattctc

SEQ ID NO: 259500 - DNA, 15 bp, Homo sapiens
ctatttacccattct

SEQ ID NO: 259501 - DNA, 15 bp, Homo sapiens
actatttacccattc

SEQ ID NO: 259502 - DNA, 15 bp, Homo sapiens
aactatttacccatt

SEQ ID NO: 259503 - DNA, 15 bp, Homo sapiens
gaactatttacccat

SEQ ID NO: 259504 - DNA, 15 bp, Homo sapiens
tgaactatttaccca

SEQ ID NO: 259505 - DNA, 15 bp, Homo sapiens
ctgaactatttaccc

SEQ ID NO: 259506 - DNA, 15 bp, Homo sapiens
cctgaactatttacc

SEQ ID NO: 259507 - DNA, 15 bp, Homo sapiens
acctgaactatttac

SEQ ID NO: 259508 - DNA, 15 bp, Homo sapiens
cacctgaactattta

SEQ ID NO: 259509 - DNA, 15 bp, Homo sapiens
tcacctgaactattt

SEQ ID NO: 259510 - DNA, 15 bp, Homo sapiens
ttcacctgaactatt

SEQ ID NO: 259511 - DNA, 15 bp, Homo sapiens
cttcacctgaactat

SEQ ID NO: 259512 - DNA, 15 bp, Homo sapiens
ccttcacctgaacta

SEQ ID NO: 259513 - DNA, 15 bp, Homo sapiens
tccttcacctgaact

SEQ ID NO: 259514 - DNA, 15 bp, Homo sapiens
atccttcacctgaac

SEQ ID NO: 259515 - DNA, 15 bp, Homo sapiens
catccttcacctgaa

SEQ ID NO: 259516 - DNA, 15 bp, Homo sapiens
tcatccttcacctga

SEQ ID NO: 259517 - DNA, 15 bp, Homo sapiens
atcatccttcacctg

SEQ ID NO: 259518 - DNA, 15 bp, Homo sapiens
gatcatccttcacct

SEQ ID NO: 259519 - DNA, 15 bp, Homo sapiens
tgatcatccttcacc

SEQ ID NO: 259520 - DNA, 15 bp, Homo sapiens
ttgatcatccttcac

SEQ ID NO: 259521 - DNA, 15 bp, Homo sapiens
tttgatcatccttca

SEQ ID NO: 259522 - DNA, 15 bp, Homo sapiens
ctttgatcatccttc

SEQ ID NO: 259523 - DNA, 15 bp, Homo sapiens
gctttgatcatcctt

SEQ ID NO: 259524 - DNA, 15 bp, Homo sapiens
agctttgatcatcct

SEQ ID NO: 259525 - DNA, 15 bp, Homo sapiens
cagctttgatcatcc

SEQ ID NO: 259526 - DNA, 15 bp, Homo sapiens
tcagctttgatcatc

SEQ ID NO: 259527 - DNA, 15 bp, Homo sapiens
ctcagctttgatcat

SEQ ID NO: 259528 - DNA, 15 bp, Homo sapiens
gctcagctttgatca

SEQ ID NO: 259529 - DNA, 15 bp, Homo sapiens
agctcagctttgatc

SEQ ID NO: 259530 - DNA, 15 bp, Homo sapiens
cagctcagctttgat

SEQ ID NO: 259531 - DNA, 15 bp, Homo sapiens
ccagctcagctttga

SEQ ID NO: 259532 - DNA, 15 bp, Homo sapiens
gccagctcagctttg

SEQ ID NO: 259533 - DNA, 15 bp, Homo sapiens
agccagctcagcttt

SEQ ID NO: 259534 - DNA, 15 bp, Homo sapiens
cagccagctcagctt

SEQ ID NO: 259535 - DNA, 15 bp, Homo sapiens
ccagccagctcagct

SEQ ID NO: 259536 - DNA, 15 bp, Homo sapiens
cccagccagctcagc

SEQ ID NO: 259537 - DNA, 15 bp, Homo sapiens
tcccagccagctcag

SEQ ID NO: 259538 - DNA, 15 bp, Homo sapiens
ctcccagccagctca

SEQ ID NO: 259539 - DNA, 15 bp, Homo sapiens
actcccagccagctc

SEQ ID NO: 259540 - DNA, 15 bp, Homo sapiens
aactcccagccagct

SEQ ID NO: 259541 - DNA, 15 bp, Homo sapiens
caactcccagccagc

SEQ ID NO: 259542 - DNA, 15 bp, Homo sapiens
acaactcccagccag

SEQ ID NO: 259543 - DNA, 15 bp, Homo sapiens
tacaactcccagcca

SEQ ID NO: 259544 - DNA, 15 bp, Homo sapiens
ctacaactcccagcc

SEQ ID NO: 259545 - DNA, 15 bp, Homo sapiens
cctacaactcccagc

SEQ ID NO: 259546 - DNA, 15 bp, Homo sapiens
tcctacaactcccag

SEQ ID NO: 259547 - DNA, 15 bp, Homo sapiens
ctcctacaactccca

SEQ ID NO: 259548 - DNA, 15 bp, Homo sapiens
cctcctacaactccc

SEQ ID NO: 259549 - DNA, 15 bp, Homo sapiens
ccctcctacaactcc

SEQ ID NO: 259550 - DNA, 15 bp, Homo sapiens
cccctcctacaactc

SEQ ID NO: 259551 - DNA, 15 bp, Homo sapiens
tcccctcctacaact

SEQ ID NO: 259552 - DNA, 15 bp, Homo sapiens
ctcccctcctacaac

SEQ ID NO: 259553 - DNA, 15 bp, Homo sapiens
tctcccctcctacaa

SEQ ID NO: 259554 - DNA, 15 bp, Homo sapiens
atctcccctcctaca

SEQ ID NO: 259555 - DNA, 15 bp, Homo sapiens
gatctcccctcctac

SEQ ID NO: 259556 - DNA, 15 bp, Homo sapiens
tgatctcccctccta

SEQ ID NO: 259557 - DNA, 15 bp, Homo sapiens
ctgatctcccctcct

SEQ ID NO: 259558 - DNA, 15 bp, Homo sapiens
cctgatctcccctcc

SEQ ID NO: 259559 - DNA, 15 bp, Homo sapiens
ccctgatctcccctc

SEQ ID NO: 259560 - DNA, 15 bp, Homo sapiens
accctgatctcccct

SEQ ID NO: 259561 - DNA, 15 bp, Homo sapiens
gaccctgatctcccc

SEQ ID NO: 259562 - DNA, 15 bp, Homo sapiens
agaccctgatctccc

SEQ ID NO: 259563 - DNA, 15 bp, Homo sapiens
cagaccctgatctcc

SEQ ID NO: 259564 - DNA, 15 bp, Homo sapiens
ccagaccctgatctc

SEQ ID NO: 259565 - DNA, 15 bp, Homo sapiens
tccagaccctgatct

SEQ ID NO: 259566 - DNA, 15 bp, Homo sapiens
atccagaccctgatc

SEQ ID NO: 259567 - DNA, 15 bp, Homo sapiens
aatccagaccctgat

SEQ ID NO: 259568 - DNA, 15 bp, Homo sapiens
aaatccagaccctga

SEQ ID NO: 259569 - DNA, 15 bp, Homo sapiens
aaaatccagaccctg

SEQ ID NO: 259570 - DNA, 15 bp, Homo sapiens
aaaaatccagaccct

SEQ ID NO: 259571 - DNA, 15 bp, Homo sapiens
taaaaatccagaccc

SEQ ID NO: 259572 - DNA, 15 bp, Homo sapiens
ttaaaaatccagacc

SEQ ID NO: 259573 - DNA, 15 bp, Homo sapiens
cttaaaaatccagac

SEQ ID NO: 259574 - DNA, 15 bp, Homo sapiens
ccttaaaaatccaga

SEQ ID NO: 259575 - DNA, 15 bp, Homo sapiens
gccttaaaaatccag

SEQ ID NO: 259576 - DNA, 15 bp, Homo sapiens
agccttaaaaatcca

SEQ ID NO: 259577 - DNA, 15 bp, Homo sapiens
cagccttaaaaatcc

SEQ ID NO: 259578 - DNA, 15 bp, Homo sapiens
gcagccttaaaaatc

SEQ ID NO: 259579 - DNA, 15 bp, Homo sapiens
ggcagccttaaaaat

SEQ ID NO: 259580 - DNA, 15 bp, Homo sapiens
aggcagccttaaaaa

SEQ ID NO: 259581 - DNA, 15 bp, Homo sapiens
caggcagccttaaaa

SEQ ID NO: 259582 - DNA, 15 bp, Homo sapiens
tcaggcagccttaaa

SEQ ID NO: 259583 - DNA, 15 bp, Homo sapiens
ctcaggcagccttaa

SEQ ID NO: 259584 - DNA, 15 bp, Homo sapiens
cctcaggcagcctta

SEQ ID NO: 259585 - DNA, 15 bp, Homo sapiens
tcctcaggcagcctt

SEQ ID NO: 259586 - DNA, 15 bp, Homo sapiens
ttcctcaggcagcct

SEQ ID NO: 259587 - DNA, 15 bp, Homo sapiens
cttcctcaggcagcc

SEQ ID NO: 259588 - DNA, 15 bp, Homo sapiens
tcttcctcaggcagc

SEQ ID NO: 259589 - DNA, 15 bp, Homo sapiens
ttcttcctcaggcag

SEQ ID NO: 259590 - DNA, 15 bp, Homo sapiens
gttcttcctcaggca

SEQ ID NO: 259591 - DNA, 15 bp, Homo sapiens
agttcttcctcaggc

SEQ ID NO: 259592 - DNA, 15 bp, Homo sapiens
cagttcttcctcagg

SEQ ID NO: 259593 - DNA, 15 bp, Homo sapiens
tcagttcttcctcag

SEQ ID NO: 259594 - DNA, 15 bp, Homo sapiens
atcagttcttcctca

SEQ ID NO: 259595 - DNA, 15 bp, Homo sapiens
catcagttcttcctc

SEQ ID NO: 259596 - DNA, 15 bp, Homo sapiens
tcatcagttcttcct

SEQ ID NO: 259597 - DNA, 15 bp, Homo sapiens
gtcatcagttcttcc

SEQ ID NO: 259598 - DNA, 15 bp, Homo sapiens
agtcatcagttcttc

SEQ ID NO: 259599 - DNA, 15 bp, Homo sapiens
gagtcatcagttctt

SEQ ID NO: 259600 - DNA, 15 bp, Homo sapiens
cgagtcatcagttct

SEQ ID NO: 259601 - DNA, 15 bp, Homo sapiens
ccgagtcatcagttc

SEQ ID NO: 259602 - DNA, 15 bp, Homo sapiens
cccgagtcatcagtt

SEQ ID NO: 259603 - DNA, 15 bp, Homo sapiens
ccccgagtcatcagt

SEQ ID NO: 259604 - DNA, 15 bp, Homo sapiens
accccgagtcatcag

SEQ ID NO: 259605 - DNA, 15 bp, Homo sapiens
taccccgagtcatca

SEQ ID NO: 259606 - DNA, 15 bp, Homo sapiens
ataccccgagtcatc

SEQ ID NO: 259607 - DNA, 15 bp, Homo sapiens
aataccccgagtcat

SEQ ID NO: 259608 - DNA, 15 bp, Homo sapiens
caataccccgagtca

SEQ ID NO: 259609 - DNA, 15 bp, Homo sapiens
ccaataccccgagtc

SEQ ID NO: 259610 - DNA, 15 bp, Homo sapiens
cccaataccccgagt

SEQ ID NO: 259611 - DNA, 15 bp, Homo sapiens
acccaataccccgag

SEQ ID NO: 259612 - DNA, 15 bp, Homo sapiens
tacccaataccccga

SEQ ID NO: 259613 - DNA, 15 bp, Homo sapiens
ctacccaataccccg

SEQ ID NO: 259614 - DNA, 15 bp, Homo sapiens
actacccaatacccc

SEQ ID NO: 259615 - DNA, 15 bp, Homo sapiens
aactacccaataccc

SEQ ID NO: 259616 - DNA, 15 bp, Homo sapiens
caactacccaatacc

SEQ ID NO: 259617 - DNA, 15 bp, Homo sapiens
ccaactacccaatac

SEQ ID NO: 259618 - DNA, 15 bp, Homo sapiens
accaactacccaata

SEQ ID NO: 259619 - DNA, 15 bp, Homo sapiens
taccaactacccaat

SEQ ID NO: 259620 - DNA, 15 bp, Homo sapiens
ttaccaactacccaa

SEQ ID NO: 259621 - DNA, 15 bp, Homo sapiens
tttaccaactaccca

SEQ ID NO: 259622 - DNA, 15 bp, Homo sapiens
atttaccaactaccc

SEQ ID NO: 259623 - DNA, 15 bp, Homo sapiens
aatttaccaactacc

SEQ ID NO: 259624 - DNA, 15 bp, Homo sapiens
caatttaccaactac

SEQ ID NO: 259625 - DNA, 15 bp, Homo sapiens
acaatttaccaacta

SEQ ID NO: 259626 - DNA, 15 bp, Homo sapiens
cacaatttaccaact

SEQ ID NO: 259627 - DNA, 15 bp, Homo sapiens
ccacaatttaccaac

SEQ ID NO: 259628 - DNA, 15 bp, Homo sapiens
gccacaatttaccaa

SEQ ID NO: 259629 - DNA, 15 bp, Homo sapiens
tgccacaatttacca

SEQ ID NO: 259630 - DNA, 15 bp, Homo sapiens
ctgccacaatttacc

SEQ ID NO: 259631 - DNA, 15 bp, Homo sapiens
cctgccacaatttac

SEQ ID NO: 259632 - DNA, 15 bp, Homo sapiens
acctgccacaattta

SEQ ID NO: 259633 - DNA, 15 bp, Homo sapiens
tacctgccacaattt

SEQ ID NO: 259634 - DNA, 15 bp, Homo sapiens
ctacctgccacaatt

SEQ ID NO: 259635 - DNA, 15 bp, Homo sapiens
tctacctgccacaat

SEQ ID NO: 259636 - DNA, 15 bp, Homo sapiens
ttctacctgccacaa

SEQ ID NO: 259637 - DNA, 15 bp, Homo sapiens
cttctacctgccaca

SEQ ID NO: 259638 - DNA, 15 bp, Homo sapiens
tcttctacctgccac

SEQ ID NO: 259639 - DNA, 15 bp, Homo sapiens
ttcttctacctgcca

SEQ ID NO: 259640 - DNA, 15 bp, Homo sapiens
cttcttctacctgcc

SEQ ID NO: 259641 - DNA, 15 bp, Homo sapiens
ccttcttctacctgc

SEQ ID NO: 259642 - DNA, 15 bp, Homo sapiens
tccttcttctacctg

SEQ ID NO: 259643 - DNA, 15 bp, Homo sapiens
ttccttcttctacct

SEQ ID NO: 259644 - DNA, 15 bp, Homo sapiens
cttccttcttctacc

SEQ ID NO: 259645 - DNA, 15 bp, Homo sapiens
ccttccttcttctac

SEQ ID NO: 259646 - DNA, 15 bp, Homo sapiens
tccttccttcttcta

SEQ ID NO: 259647 - DNA, 15 bp, Homo sapiens
atccttccttcttct

SEQ ID NO: 259648 - DNA, 15 bp, Homo sapiens
catccttccttcttc

SEQ ID NO: 259649 - DNA, 15 bp, Homo sapiens
acatccttccttctt

SEQ ID NO: 259650 - DNA, 15 bp, Homo sapiens
aacatccttccttct

SEQ ID NO: 259651 - DNA, 15 bp, Homo sapiens
taacatccttccttc

SEQ ID NO: 259652 - DNA, 15 bp, Homo sapiens
ctaacatccttcctt

SEQ ID NO: 259653 - DNA, 15 bp, Homo sapiens
cctaacatccttcct

SEQ ID NO: 259654 - DNA, 15 bp, Homo sapiens
tcctaacatccttcc

SEQ ID NO: 259655 - DNA, 15 bp, Homo sapiens
atcctaacatccttc

SEQ ID NO: 259656 - DNA, 15 bp, Homo sapiens
tatcctaacatcctt

SEQ ID NO: 259657 - DNA, 15 bp, Homo sapiens
atatcctaacatcct

SEQ ID NO: 259658 - DNA, 15 bp, Homo sapiens
aatatcctaacatcc

SEQ ID NO: 259659 - DNA, 15 bp, Homo sapiens
aaatatcctaacatc

SEQ ID NO: 259660 - DNA, 15 bp, Homo sapiens
gaaatatcctaacat

SEQ ID NO: 259661 - DNA, 15 bp, Homo sapiens
tgaaatatcctaaca

SEQ ID NO: 259662 - DNA, 15 bp, Homo sapiens
gtgaaatatcctaac

SEQ ID NO: 259663 - DNA, 15 bp, Homo sapiens
cgtgaaatatcctaa

SEQ ID NO: 259664 - DNA, 15 bp, Homo sapiens
ccgtgaaatatccta

SEQ ID NO: 259665 - DNA, 15 bp, Homo sapiens
accgtgaaatatcct

SEQ ID NO: 259666 - DNA, 15 bp, Homo sapiens
aaccgtgaaatatcc

SEQ ID NO: 259667 - DNA, 15 bp, Homo sapiens
aaaccgtgaaatatc

SEQ ID NO: 259668 - DNA, 15 bp, Homo sapiens
caaaccgtgaaatat

SEQ ID NO: 259669 - DNA, 15 bp, Homo sapiens
gcaaaccgtgaaata

SEQ ID NO: 259670 - DNA, 15 bp, Homo sapiens
tgcaaaccgtgaaat

SEQ ID NO: 259671 - DNA, 15 bp, Homo sapiens
ctgcaaaccgtgaaa

SEQ ID NO: 259672 - DNA, 15 bp, Homo sapiens
tctgcaaaccgtgaa

SEQ ID NO: 259673 - DNA, 15 bp, Homo sapiens
gtctgcaaaccgtga

SEQ ID NO: 259674 - DNA, 15 bp, Homo sapiens
agtctgcaaaccgtg

SEQ ID NO: 259675 - DNA, 15 bp, Homo sapiens
cagtctgcaaaccgt

SEQ ID NO: 259676 - DNA, 15 bp, Homo sapiens
ccagtctgcaaaccg

SEQ ID NO: 259677 - DNA, 15 bp, Homo sapiens
tccagtctgcaaacc

SEQ ID NO: 259678 - DNA, 15 bp, Homo sapiens
atccagtctgcaaac

SEQ ID NO: 259679 - DNA, 15 bp, Homo sapiens
aatccagtctgcaaa

SEQ ID NO: 259680 - DNA, 15 bp, Homo sapiens
aaatccagtctgcaa

SEQ ID NO: 259681 - DNA, 15 bp, Homo sapiens
gaaatccagtctgca

SEQ ID NO: 259682 - DNA, 15 bp, Homo sapiens
tgaaatccagtctgc

SEQ ID NO: 259683 - DNA, 15 bp, Homo sapiens
atgaaatccagtctg

SEQ ID NO: 259684 - DNA, 15 bp, Homo sapiens
gatgaaatccagtct

SEQ ID NO: 259685 - DNA, 15 bp, Homo sapiens
tgatgaaatccagtc

SEQ ID NO: 259686 - DNA, 15 bp, Homo sapiens
atgatgaaatccagt

SEQ ID NO: 259687 - DNA, 15 bp, Homo sapiens
catgatgaaatccag

SEQ ID NO: 259688 - DNA, 15 bp, Homo sapiens
tcatgatgaaatcca

SEQ ID NO: 259689 - DNA, 15 bp, Homo sapiens
gtcatgatgaaatcc

SEQ ID NO: 259690 - DNA, 15 bp, Homo sapiens
tgtcatgatgaaatc

SEQ ID NO: 259691 - DNA, 15 bp, Homo sapiens
ttgtcatgatgaaat

SEQ ID NO: 259692 - DNA, 15 bp, Homo sapiens
cttgtcatgatgaaa

SEQ ID NO: 259693 - DNA, 15 bp, Homo sapiens
tcttgtcatgatgaa

SEQ ID NO: 259694 - DNA, 15 bp, Homo sapiens
ttcttgtcatgatga

SEQ ID NO: 259695 - DNA, 15 bp, Homo sapiens
cttcttgtcatgatg

SEQ ID NO: 259696 - DNA, 15 bp, Homo sapiens
ccttcttgtcatgat

SEQ ID NO: 259697 - DNA, 15 bp, Homo sapiens
gccttcttgtcatga

SEQ ID NO: 259698 - DNA, 15 bp, Homo sapiens
ggccttcttgtcatg

SEQ ID NO: 259699 - DNA, 15 bp, Homo sapiens
tggccttcttgtcat

SEQ ID NO: 259700 - DNA, 15 bp, Homo sapiens
ctggccttcttgtca

SEQ ID NO: 259701 - DNA, 15 bp, Homo sapiens
cctggccttcttgtc

SEQ ID NO: 259702 - DNA, 15 bp, Homo sapiens
gcctggccttcttgt

SEQ ID NO: 259703 - DNA, 15 bp, Homo sapiens
ggcctggccttcttg

SEQ ID NO: 259704 - DNA, 15 bp, Homo sapiens
aggcctggccttctt

SEQ ID NO: 259705 - DNA, 15 bp, Homo sapiens
aaggcctggccttct

SEQ ID NO: 259706 - DNA, 15 bp, Homo sapiens
aaaggcctggccttc

SEQ ID NO: 259707 - DNA, 15 bp, Homo sapiens
taaaggcctggcctt

SEQ ID NO: 259708 - DNA, 15 bp, Homo sapiens
ataaaggcctggcct

SEQ ID NO: 259709 - DNA, 15 bp, Homo sapiens
cataaaggcctggcc

SEQ ID NO: 259710 - DNA, 15 bp, Homo sapiens
ccataaaggcctggc

SEQ ID NO: 259711 - DNA, 15 bp, Homo sapiens
cccataaaggcctgg

SEQ ID NO: 259712 - DNA, 15 bp, Homo sapiens
ccccataaaggcctg

SEQ ID NO: 259713 - DNA, 15 bp, Homo sapiens
tccccataaaggcct

SEQ ID NO: 259714 - DNA, 15 bp, Homo sapiens
ctccccataaaggcc

SEQ ID NO: 259715 - DNA, 15 bp, Homo sapiens
tctccccataaaggc

SEQ ID NO: 259716 - DNA, 15 bp, Homo sapiens
ctctccccataaagg

SEQ ID NO: 259717 - DNA, 15 bp, Homo sapiens
cctctccccataaag

SEQ ID NO: 259718 - DNA, 15 bp, Homo sapiens
acctctccccataaa

SEQ ID NO: 259719 - DNA, 15 bp, Homo sapiens
aacctctccccataa

SEQ ID NO: 259720 - DNA, 15 bp, Homo sapiens
gaacctctccccata

SEQ ID NO: 259721 - DNA, 15 bp, Homo sapiens
ggaacctctccccat

SEQ ID NO: 259722 - DNA, 15 bp, Homo sapiens
aggaacctctcccca

SEQ ID NO: 259723 - DNA, 15 bp, Homo sapiens
caggaacctctcccc

SEQ ID NO: 259724 - DNA, 15 bp, Homo sapiens
tcaggaacctctccc

SEQ ID NO: 259725 - DNA, 15 bp, Homo sapiens
ttcaggaacctctcc

SEQ ID NO: 259726 - DNA, 15 bp, Homo sapiens
tttcaggaacctctc

SEQ ID NO: 259727 - DNA, 15 bp, Homo sapiens
ctttcaggaacctct

SEQ ID NO: 259728 - DNA, 15 bp, Homo sapiens
tctttcaggaacctc

SEQ ID NO: 259729 - DNA, 15 bp, Homo sapiens
ctctttcaggaacct

SEQ ID NO: 259730 - DNA, 15 bp, Homo sapiens
tctctttcaggaacc

SEQ ID NO: 259731 - DNA, 15 bp, Homo sapiens
ttctctttcaggaac

SEQ ID NO: 259732 - DNA, 15 bp, Homo sapiens
attctctttcaggaa

SEQ ID NO: 259733 - DNA, 15 bp, Homo sapiens
aattctctttcagga

SEQ ID NO: 259734 - DNA, 15 bp, Homo sapiens
taattctctttcagg

SEQ ID NO: 259735 - DNA, 15 bp, Homo sapiens
ataattctctttcag

SEQ ID NO: 259736 - DNA, 15 bp, Homo sapiens
tataattctctttca

SEQ ID NO: 259737 - DNA, 15 bp, Homo sapiens
atataattctctttc

SEQ ID NO: 259738 - DNA, 15 bp, Homo sapiens
tatataattctcttt

SEQ ID NO: 259739 - DNA, 15 bp, Homo sapiens
ctatataattctctt

SEQ ID NO: 259740 - DNA, 15 bp, Homo sapiens
gctatataattctct

SEQ ID NO: 259741 - DNA, 15 bp, Homo sapiens
agctatataattctc

SEQ ID NO: 259742 - DNA, 15 bp, Homo sapiens
gagctatataattct

SEQ ID NO: 259743 - DNA, 15 bp, Homo sapiens
agagctatataattc

SEQ ID NO: 259744 - DNA, 15 bp, Homo sapiens
aagagctatataatt

SEQ ID NO: 259745 - DNA, 15 bp, Homo sapiens
caagagctatataat

SEQ ID NO: 259746 - DNA, 15 bp, Homo sapiens
acaagagctatataa

SEQ ID NO: 259747 - DNA, 15 bp, Homo sapiens
tacaagagctatata

SEQ ID NO: 259748 - DNA, 15 bp, Homo sapiens
ctacaagagctatat

SEQ ID NO: 259749 - DNA, 15 bp, Homo sapiens
cctacaagagctata

SEQ ID NO: 259750 - DNA, 15 bp, Homo sapiens
ccctacaagagctat

SEQ ID NO: 259751 - DNA, 15 bp, Homo sapiens
tccctacaagagcta

SEQ ID NO: 259752 - DNA, 15 bp, Homo sapiens
atccctacaagagct

SEQ ID NO: 259753 - DNA, 15 bp, Homo sapiens
gatccctacaagagc

SEQ ID NO: 259754 - DNA, 15 bp, Homo sapiens
tgatccctacaagag

SEQ ID NO: 259755 - DNA, 15 bp, Homo sapiens
ctgatccctacaaga

SEQ ID NO: 259756 - DNA, 15 bp, Homo sapiens
tctgatccctacaag

SEQ ID NO: 259757 - DNA, 15 bp, Homo sapiens
ctctgatccctacaa

SEQ ID NO: 259758 - DNA, 15 bp, Homo sapiens
gctctgatccctaca

SEQ ID NO: 259759 - DNA, 15 bp, Homo sapiens
tgctctgatccctac

SEQ ID NO: 259760 - DNA, 15 bp, Homo sapiens
ttgctctgatcccta

SEQ ID NO: 259761 - DNA, 15 bp, Homo sapiens
attgctctgatccct

SEQ ID NO: 259762 - DNA, 15 bp, Homo sapiens
cattgctctgatccc

SEQ ID NO: 259763 - DNA, 15 bp, Homo sapiens
ccattgctctgatcc

SEQ ID NO: 259764 - DNA, 15 bp, Homo sapiens
cccattgctctgatc

SEQ ID NO: 259765 - DNA, 15 bp, Homo sapiens
tcccattgctctgat

SEQ ID NO: 259766 - DNA, 15 bp, Homo sapiens
gtcccattgctctga

SEQ ID NO: 259767 - DNA, 15 bp, Homo sapiens
tgtcccattgctctg

SEQ ID NO: 259768 - DNA, 15 bp, Homo sapiens
atgtcccattgctct

SEQ ID NO: 259769 - DNA, 15 bp, Homo sapiens
catgtcccattgctc

SEQ ID NO: 259770 - DNA, 15 bp, Homo sapiens
ccatgtcccattgct

SEQ ID NO: 259771 - DNA, 15 bp, Homo sapiens
cccatgtcccattgc

SEQ ID NO: 259772 - DNA, 15 bp, Homo sapiens
acccatgtcccattg

SEQ ID NO: 259773 - DNA, 15 bp, Homo sapiens
gacccatgtcccatt

SEQ ID NO: 259774 - DNA, 15 bp, Homo sapiens
tgacccatgtcccat

SEQ ID NO: 259775 - DNA, 15 bp, Homo sapiens
ttgacccatgtccca

SEQ ID NO: 259776 - DNA, 15 bp, Homo sapiens
cttgacccatgtccc

SEQ ID NO: 259777 - DNA, 15 bp, Homo sapiens
acttgacccatgtcc

SEQ ID NO: 259778 - DNA, 15 bp, Homo sapiens
cacttgacccatgtc

SEQ ID NO: 259779 - DNA, 15 bp, Homo sapiens
acacttgacccatgt

SEQ ID NO: 259780 - DNA, 15 bp, Homo sapiens
aacacttgacccatg

SEQ ID NO: 259781 - DNA, 15 bp, Homo sapiens
caacacttgacccat

SEQ ID NO: 259782 - DNA, 15 bp, Homo sapiens
tcaacacttgaccca

SEQ ID NO: 259783 - DNA, 15 bp, Homo sapiens
ctcaacacttgaccc

SEQ ID NO: 259784 - DNA, 15 bp, Homo sapiens
cctcaacacttgacc

SEQ ID NO: 259785 - DNA, 15 bp, Homo sapiens
gcctcaacacttgac

SEQ ID NO: 259786 - DNA, 15 bp, Homo sapiens
tgcctcaacacttga

SEQ ID NO: 259787 - DNA, 15 bp, Homo sapiens
ctgcctcaacacttg

SEQ ID NO: 259788 - DNA, 15 bp, Homo sapiens
cctgcctcaacactt

SEQ ID NO: 259789 - DNA, 15 bp, Homo sapiens
tcctgcctcaacact

SEQ ID NO: 259790 - DNA, 15 bp, Homo sapiens
ctcctgcctcaacac

SEQ ID NO: 259791 - DNA, 15 bp, Homo sapiens
tctcctgcctcaaca

SEQ ID NO: 259792 - DNA, 15 bp, Homo sapiens
atctcctgcctcaac

SEQ ID NO: 259793 - DNA, 15 bp, Homo sapiens
gatctcctgcctcaa

SEQ ID NO: 259794 - DNA, 15 bp, Homo sapiens
tgatctcctgcctca

SEQ ID NO: 259795 - DNA, 15 bp, Homo sapiens
ctgatctcctgcctc

SEQ ID NO: 259796 - DNA, 15 bp, Homo sapiens
gctgatctcctgcct

SEQ ID NO: 259797 - DNA, 15 bp, Homo sapiens
tgctgatctcctgcc

SEQ ID NO: 259798 - DNA, 15 bp, Homo sapiens
ctgctgatctcctgc

SEQ ID NO: 259799 - DNA, 15 bp, Homo sapiens
cctgctgatctcctg

SEQ ID NO: 259800 - DNA, 15 bp, Homo sapiens
tcctgctgatctcct

SEQ ID NO: 259801 - DNA, 15 bp, Homo sapiens
ctcctgctgatctcc

SEQ ID NO: 259802 - DNA, 15 bp, Homo sapiens
tctcctgctgatctc

SEQ ID NO: 259803 - DNA, 15 bp, Homo sapiens
ttctcctgctgatct

SEQ ID NO: 259804 - DNA, 15 bp, Homo sapiens
tttctcctgctgatc

SEQ ID NO: 259805 - DNA, 15 bp, Homo sapiens
ttttctcctgctgat

SEQ ID NO: 259806 - DNA, 15 bp, Homo sapiens
cttttctcctgctga

SEQ ID NO: 259807 - DNA, 15 bp, Homo sapiens
tcttttctcctgctg

SEQ ID NO: 259808 - DNA, 15 bp, Homo sapiens
ctcttttctcctgct

SEQ ID NO: 259809 - DNA, 15 bp, Homo sapiens
tctcttttctcctgc

SEQ ID NO: 259810 - DNA, 15 bp, Homo sapiens
ttctcttttctcctg

SEQ ID NO: 259811 - DNA, 15 bp, Homo sapiens
attctcttttctcct

SEQ ID NO: 259812 - DNA, 15 bp, Homo sapiens
gattctcttttctcc

SEQ ID NO: 259813 - DNA, 15 bp, Homo sapiens
agattctcttttctc

SEQ ID NO: 259814 - DNA, 15 bp, Homo sapiens
cagattctcttttct

SEQ ID NO: 259815 - DNA, 15 bp, Homo sapiens
ccagattctcttttc

SEQ ID NO: 259816 - DNA, 15 bp, Homo sapiens
tccagattctctttt

SEQ ID NO: 259817 - DNA, 15 bp, Homo sapiens
ctccagattctcttt

SEQ ID NO: 259818 - DNA, 15 bp, Homo sapiens
gctccagattctctt

SEQ ID NO: 259819 - DNA, 15 bp, Homo sapiens
ggctccagattctct

SEQ ID NO: 259820 - DNA, 15 bp, Homo sapiens
tggctccagattctc

SEQ ID NO: 259821 - DNA, 15 bp, Homo sapiens
atggctccagattct

SEQ ID NO: 259822 - DNA, 15 bp, Homo sapiens
gatggctccagattc

SEQ ID NO: 259823 - DNA, 15 bp, Homo sapiens
ggatggctccagatt

SEQ ID NO: 259824 - DNA, 15 bp, Homo sapiens
tggatggctccagat

SEQ ID NO: 259825 - DNA, 15 bp, Homo sapiens
ttggatggctccaga

SEQ ID NO: 259826 - DNA, 15 bp, Homo sapiens
tttggatggctccag

SEQ ID NO: 259827 - DNA, 15 bp, Homo sapiens
ctttggatggctcca

SEQ ID NO: 259828 - DNA, 15 bp, Homo sapiens
tctttggatggctcc

SEQ ID NO: 259829 - DNA, 15 bp, Homo sapiens
ctctttggatggctc

SEQ ID NO: 259830 - DNA, 15 bp, Homo sapiens
tctctttggatggct

SEQ ID NO: 259831 - DNA, 15 bp, Homo sapiens
ttctctttggatggc

SEQ ID NO: 259832 - DNA, 15 bp, Homo sapiens
cttctctttggatgg

SEQ ID NO: 259833 - DNA, 15 bp, Homo sapiens
gcttctctttggatg

SEQ ID NO: 259834 - DNA, 15 bp, Homo sapiens
tgcttctctttggat

SEQ ID NO: 259835 - DNA, 15 bp, Homo sapiens
ttgcttctctttgga

SEQ ID NO: 259836 - DNA, 15 bp, Homo sapiens
attgcttctctttgg

SEQ ID NO: 259837 - DNA, 15 bp, Homo sapiens
tattgcttctctttg

SEQ ID NO: 259838 - DNA, 15 bp, Homo sapiens
ttattgcttctcttt

SEQ ID NO: 259839 - DNA, 15 bp, Homo sapiens
attattgcttctctt

SEQ ID NO: 259840 - DNA, 15 bp, Homo sapiens
tattattgcttctct

SEQ ID NO: 259841 - DNA, 15 bp, Homo sapiens
ctattattgcttctc

SEQ ID NO: 259842 - DNA, 15 bp, Homo sapiens
tctattattgcttct

SEQ ID NO: 259843 - DNA, 15 bp, Homo sapiens
ttctattattgcttc

SEQ ID NO: 259844 - DNA, 15 bp, Homo sapiens
cttctattattgctt

SEQ ID NO: 259845 - DNA, 15 bp, Homo sapiens
acttctattattgct

SEQ ID NO: 259846 - DNA, 15 bp, Homo sapiens
tacttctattattgc

SEQ ID NO: 259847 - DNA, 15 bp, Homo sapiens
ttacttctattattg

SEQ ID NO: 259848 - DNA, 15 bp, Homo sapiens
cttacttctattatt

SEQ ID NO: 259849 - DNA, 15 bp, Homo sapiens
tcttacttctattat

SEQ ID NO: 259850 - DNA, 15 bp, Homo sapiens
ctcttacttctatta

SEQ ID NO: 259851 - DNA, 15 bp, Homo sapiens
cctcttacttctatt

SEQ ID NO: 259852 - DNA, 15 bp, Homo sapiens
tcctcttacttctat

SEQ ID NO: 259853 - DNA, 15 bp, Homo sapiens
ctcctcttacttcta

SEQ ID NO: 259854 - DNA, 15 bp, Homo sapiens
actcctcttacttct

SEQ ID NO: 259855 - DNA, 15 bp, Homo sapiens
cactcctcttacttc

SEQ ID NO: 259856 - DNA, 15 bp, Homo sapiens
tcactcctcttactt

SEQ ID NO: 259857 - DNA, 15 bp, Homo sapiens
ctcactcctcttact

SEQ ID NO: 259858 - DNA, 15 bp, Homo sapiens
actcactcctcttac

SEQ ID NO: 259859 - DNA, 15 bp, Homo sapiens
cactcactcctctta

SEQ ID NO: 259860 - DNA, 15 bp, Homo sapiens
tcactcactcctctt

SEQ ID NO: 259861 - DNA, 15 bp, Homo sapiens
ctcactcactcctct

SEQ ID NO: 259862 - DNA, 15 bp, Homo sapiens
cctcactcactcctc

SEQ ID NO: 259863 - DNA, 15 bp, Homo sapiens
ccctcactcactcct

SEQ ID NO: 259864 - DNA, 15 bp, Homo sapiens
gccctcactcactcc

SEQ ID NO: 259865 - DNA, 15 bp, Homo sapiens
ggccctcactcactc

SEQ ID NO: 259866 - DNA, 15 bp, Homo sapiens
aggccctcactcact

SEQ ID NO: 259867 - DNA, 15 bp, Homo sapiens
gaggccctcactcac

SEQ ID NO: 259868 - DNA, 15 bp, Homo sapiens
tgaggccctcactca

SEQ ID NO: 259869 - DNA, 15 bp, Homo sapiens
ctgaggccctcactc

SEQ ID NO: 259870 - DNA, 15 bp, Homo sapiens
cctgaggccctcact

SEQ ID NO: 259871 - DNA, 15 bp, Homo sapiens
gcctgaggccctcac

SEQ ID NO: 259872 - DNA, 15 bp, Homo sapiens
agcctgaggccctca

SEQ ID NO: 259873 - DNA, 15 bp, Homo sapiens
gagcctgaggccctc

SEQ ID NO: 259874 - DNA, 15 bp, Homo sapiens
tgagcctgaggccct

SEQ ID NO: 259875 - DNA, 15 bp, Homo sapiens
gtgagcctgaggccc

SEQ ID NO: 259876 - DNA, 15 bp, Homo sapiens
tgtgagcctgaggcc

SEQ ID NO: 259877 - DNA, 15 bp, Homo sapiens
ctgtgagcctgaggc

SEQ ID NO: 259878 - DNA, 15 bp, Homo sapiens
tctgtgagcctgagg

SEQ ID NO: 259879 - DNA, 15 bp, Homo sapiens
ttctgtgagcctgag

SEQ ID NO: 259880 - DNA, 15 bp, Homo sapiens
attctgtgagcctga

SEQ ID NO: 259881 - DNA, 15 bp, Homo sapiens
cattctgtgagcctg

SEQ ID NO: 259882 - DNA, 15 bp, Homo sapiens
tcattctgtgagcct

SEQ ID NO: 259883 - DNA, 15 bp, Homo sapiens
ttcattctgtgagcc

SEQ ID NO: 259884 - DNA, 15 bp, Homo sapiens
tttcattctgtgagc

SEQ ID NO: 259885 - DNA, 15 bp, Homo sapiens
atttcattctgtgag

SEQ ID NO: 259886 - DNA, 15 bp, Homo sapiens
catttcattctgtga

SEQ ID NO: 259887 - DNA, 15 bp, Homo sapiens
gcatttcattctgtg

SEQ ID NO: 259888 - DNA, 15 bp, Homo sapiens
ggcatttcattctgt

SEQ ID NO: 259889 - DNA, 15 bp, Homo sapiens
tggcatttcattctg

SEQ ID NO: 259890 - DNA, 15 bp, Homo sapiens
ctggcatttcattct

SEQ ID NO: 259891 - DNA, 15 bp, Homo sapiens
tctggcatttcattc

SEQ ID NO: 259892 - DNA, 15 bp, Homo sapiens
atctggcatttcatt

SEQ ID NO: 259893 - DNA, 15 bp, Homo sapiens
catctggcatttcat

SEQ ID NO: 259894 - DNA, 15 bp, Homo sapiens
acatctggcatttca

SEQ ID NO: 259895 - DNA, 15 bp, Homo sapiens
cacatctggcatttc

SEQ ID NO: 259896 - DNA, 15 bp, Homo sapiens
tcacatctggcattt

SEQ ID NO: 259897 - DNA, 15 bp, Homo sapiens
ttcacatctggcatt

SEQ ID NO: 259898 - DNA, 15 bp, Homo sapiens
tttcacatctggcat

SEQ ID NO: 259899 - DNA, 15 bp, Homo sapiens
gtttcacatctggca

SEQ ID NO: 259900 - DNA, 15 bp, Homo sapiens
ggtttcacatctggc

SEQ ID NO: 259901 - DNA, 15 bp, Homo sapiens
aggtttcacatctgg

SEQ ID NO: 259902 - DNA, 15 bp, Homo sapiens
aaggtttcacatctg

SEQ ID NO: 259903 - DNA, 15 bp, Homo sapiens
caaggtttcacatct

SEQ ID NO: 259904 - DNA, 15 bp, Homo sapiens
tcaaggtttcacatc

SEQ ID NO: 259905 - DNA, 15 bp, Homo sapiens
ctcaaggtttcacat

SEQ ID NO: 259906 - DNA, 15 bp, Homo sapiens
gctcaaggtttcaca

SEQ ID NO: 259907 - DNA, 15 bp, Homo sapiens
agctcaaggtttcac

SEQ ID NO: 259908 - DNA, 15 bp, Homo sapiens
gagctcaaggtttca

SEQ ID NO: 259909 - DNA, 15 bp, Homo sapiens
agagctcaaggtttc

SEQ ID NO: 259910 - DNA, 15 bp, Homo sapiens
cagagctcaaggttt

SEQ ID NO: 259911 - DNA, 15 bp, Homo sapiens
gcagagctcaaggtt

SEQ ID NO: 259912 - DNA, 15 bp, Homo sapiens
ggcagagctcaaggt

SEQ ID NO: 259913 - DNA, 15 bp, Homo sapiens
aggcagagctcaagg

SEQ ID NO: 259914 - DNA, 15 bp, Homo sapiens
taggcagagctcaag

SEQ ID NO: 259915 - DNA, 15 bp, Homo sapiens
ataggcagagctcaa

SEQ ID NO: 259916 - DNA, 15 bp, Homo sapiens
tataggcagagctca

SEQ ID NO: 259917 - DNA, 15 bp, Homo sapiens
atataggcagagctc

SEQ ID NO: 259918 - DNA, 15 bp, Homo sapiens
aatataggcagagct

SEQ ID NO: 259919 - DNA, 15 bp, Homo sapiens
aaatataggcagagc

SEQ ID NO: 259920 - DNA, 15 bp, Homo sapiens
gaaatataggcagag

SEQ ID NO: 259921 - DNA, 15 bp, Homo sapiens
agaaatataggcaga

SEQ ID NO: 259922 - DNA, 15 bp, Homo sapiens
cagaaatataggcag

SEQ ID NO: 259923 - DNA, 15 bp, Homo sapiens
ccagaaatataggca

SEQ ID NO: 259924 - DNA, 15 bp, Homo sapiens
cccagaaatataggc

SEQ ID NO: 259925 - DNA, 15 bp, Homo sapiens
ccccagaaatatagg

SEQ ID NO: 259926 - DNA, 15 bp, Homo sapiens
tccccagaaatatag

SEQ ID NO: 259927 - DNA, 15 bp, Homo sapiens
ttccccagaaatata

SEQ ID NO: 259928 - DNA, 15 bp, Homo sapiens
cttccccagaaatat

SEQ ID NO: 259929 - DNA, 15 bp, Homo sapiens
tcttccccagaaata

SEQ ID NO: 259930 - DNA, 15 bp, Homo sapiens
ctcttccccagaaat

SEQ ID NO: 259931 - DNA, 15 bp, Homo sapiens
tctcttccccagaaa

SEQ ID NO: 259932 - DNA, 15 bp, Homo sapiens
ttctcttccccagaa

SEQ ID NO: 259933 - DNA, 15 bp, Homo sapiens
cttctcttccccaga

SEQ ID NO: 259934 - DNA, 15 bp, Homo sapiens
tcttctcttccccag

SEQ ID NO: 259935 - DNA, 15 bp, Homo sapiens
atcttctcttcccca

SEQ ID NO: 259936 - DNA, 15 bp, Homo sapiens
tatcttctcttcccc

SEQ ID NO: 259937 - DNA, 15 bp, Homo sapiens
ctatcttctcttccc

SEQ ID NO: 259938 - DNA, 15 bp, Homo sapiens
cctatcttctcttcc

SEQ ID NO: 259939 - DNA, 15 bp, Homo sapiens
ccctatcttctcttc

SEQ ID NO: 259940 - DNA, 15 bp, Homo sapiens
cccctatcttctctt

SEQ ID NO: 259941 - DNA, 15 bp, Homo sapiens
tcccctatcttctct

SEQ ID NO: 259942 - DNA, 15 bp, Homo sapiens
ttcccctatcttctc

SEQ ID NO: 259943 - DNA, 15 bp, Homo sapiens
tttcccctatcttct

SEQ ID NO: 259944 - DNA, 15 bp, Homo sapiens
atttcccctatcttc

SEQ ID NO: 259945 - DNA, 15 bp, Homo sapiens
catttcccctatctt

SEQ ID NO: 259946 - DNA, 15 bp, Homo sapiens
gcatttcccctatct

SEQ ID NO: 259947 - DNA, 15 bp, Homo sapiens
agcatttcccctatc

SEQ ID NO: 259948 - DNA, 15 bp, Homo sapiens
tagcatttcccctat

SEQ ID NO: 259949 - DNA, 15 bp, Homo sapiens
ttagcatttccccta

SEQ ID NO: 259950 - DNA, 15 bp, Homo sapiens
attagcatttcccct

SEQ ID NO: 259951 - DNA, 15 bp, Homo sapiens
tattagcatttcccc

SEQ ID NO: 259952 - DNA, 15 bp, Homo sapiens
ttattagcatttccc

SEQ ID NO: 259953 - DNA, 15 bp, Homo sapiens
attattagcatttcc

SEQ ID NO: 259954 - DNA, 15 bp, Homo sapiens
tattattagcatttc

SEQ ID NO: 259955 - DNA, 15 bp, Homo sapiens
ttattattagcattt

SEQ ID NO: 259956 - DNA, 15 bp, Homo sapiens
attattattagcatt

SEQ ID NO: 259957 - DNA, 15 bp, Homo sapiens
tattattattagcat

SEQ ID NO: 259958 - DNA, 15 bp, Homo sapiens
ttattattattagca

SEQ ID NO: 259959 - DNA, 15 bp, Homo sapiens
attattattattagc

SEQ ID NO: 259960 - DNA, 15 bp, Homo sapiens
tattattattattag

SEQ ID NO: 259961 - DNA, 15 bp, Homo sapiens
attttattattatta

SEQ ID NO: 259962 - DNA, 15 bp, Homo sapiens
tattttattattatt

SEQ ID NO: 259963 - DNA, 15 bp, Homo sapiens
ttattttattattat

SEQ ID NO: 259964 - DNA, 15 bp, Homo sapiens
tttattttattatta

SEQ ID NO: 259965 - DNA, 15 bp, Homo sapiens
ttttattttattatt

SEQ ID NO: 259966 - DNA, 15 bp, Homo sapiens
tttttattttattat

SEQ ID NO: 259967 - DNA, 15 bp, Homo sapiens
ttttttattttatta

SEQ ID NO: 259968 - DNA, 15 bp, Homo sapiens
tttttttattttatt

SEQ ID NO: 259969 - DNA, 15 bp, Homo sapiens
atttttttattttat

SEQ ID NO: 259970 - DNA, 15 bp, Homo sapiens
tatttttttatttta

SEQ ID NO: 259971 - DNA, 15 bp, Homo sapiens
ttatttttttatttt

SEQ ID NO: 259972 - DNA, 15 bp, Homo sapiens
tttatttttttattt

SEQ ID NO: 259973 - DNA, 15 bp, Homo sapiens
ctttatttttttatt

SEQ ID NO: 259974 - DNA, 15 bp, Homo sapiens
tctttatttttttat

SEQ ID NO: 259975 - DNA, 15 bp, Homo sapiens
ttctttattttttta

SEQ ID NO: 259976 - DNA, 15 bp, Homo sapiens
attctttattttttt

SEQ ID NO: 259977 - DNA, 15 bp, Homo sapiens
cattctttatttttt

SEQ ID NO: 259978 - DNA, 15 bp, Homo sapiens
ccattctttattttt

SEQ ID NO: 259979 - DNA, 15 bp, Homo sapiens
gccattctttatttt

SEQ ID NO: 259980 - DNA, 15 bp, Homo sapiens
ggccattctttattt

SEQ ID NO: 259981 - DNA, 15 bp, Homo sapiens
tggccattctttatt

SEQ ID NO: 259982 - DNA, 15 bp, Homo sapiens
gtggccattctttat

SEQ ID NO: 259983 - DNA, 15 bp, Homo sapiens
tgtggccattcttta

SEQ ID NO: 259984 - DNA, 15 bp, Homo sapiens
atgtggccattcttt

SEQ ID NO: 259985 - DNA, 15 bp, Homo sapiens
tatgtggccattctt

SEQ ID NO: 259986 - DNA, 15 bp, Homo sapiens
ctatgtggccattct

SEQ ID NO: 259987 - DNA, 15 bp, Homo sapiens
gctatgtggccattc

SEQ ID NO: 259988 - DNA, 15 bp, Homo sapiens
agctatgtggccatt

SEQ ID NO: 259989 - DNA, 15 bp, Homo sapiens
aagctatgtggccat

SEQ ID NO: 259990 - DNA, 15 bp, Homo sapiens
caagctatgtggcca

SEQ ID NO: 259991 - DNA, 15 bp, Homo sapiens
tcaagctatgtggcc

SEQ ID NO: 259992 - DNA, 15 bp, Homo sapiens
gtcaagctatgtggc

SEQ ID NO: 259993 - DNA, 15 bp, Homo sapiens
tgtcaagctatgtgg

SEQ ID NO: 259994 - DNA, 15 bp, Homo sapiens
gtgtcaagctatgtg

SEQ ID NO: 259995 - DNA, 15 bp, Homo sapiens
ggtgtcaagctatgt

SEQ ID NO: 259996 - DNA, 15 bp, Homo sapiens
aggtgtcaagctatg

SEQ ID NO: 259997 - DNA, 15 bp, Homo sapiens
caggtgtcaagctat

SEQ ID NO: 259998 - DNA, 15 bp, Homo sapiens
ccaggtgtcaagcta

SEQ ID NO: 259999 - DNA, 15 bp, Homo sapiens
tccaggtgtcaagct

SEQ ID NO: 260000 - DNA, 15 bp, Homo sapiens
ctccaggtgtcaagc

SEQ ID NO: 260001 - DNA, 15 bp, Homo sapiens
tctccaggtgtcaag

SEQ ID NO: 260002 - DNA, 15 bp, Homo sapiens
ttctccaggtgtcaa

SEQ ID NO: 260003 - DNA, 15 bp, Homo sapiens
cttctccaggtgtca

SEQ ID NO: 260004 - DNA, 15 bp, Homo sapiens
acttctccaggtgtc

SEQ ID NO: 260005 - DNA, 15 bp, Homo sapiens
cacttctccaggtgt

SEQ ID NO: 260006 - DNA, 15 bp, Homo sapiens
acacttctccaggtg

SEQ ID NO: 260007 - DNA, 15 bp, Homo sapiens
gacacttctccaggt

SEQ ID NO: 260008 - DNA, 15 bp, Homo sapiens
tgacacttctccagg

SEQ ID NO: 260009 - DNA, 15 bp, Homo sapiens
gtgacacttctccag

SEQ ID NO: 260010 - DNA, 15 bp, Homo sapiens
agtgacacttctcca

SEQ ID NO: 260011 - DNA, 15 bp, Homo sapiens
cagtgacacttctcc

SEQ ID NO: 260012 - DNA, 15 bp, Homo sapiens
tcagtgacacttctc

SEQ ID NO: 260013 - DNA, 15 bp, Homo sapiens
ttcagtgacacttct

SEQ ID NO: 260014 - DNA, 15 bp, Homo sapiens
cttcagtgacacttc

SEQ ID NO: 260015 - DNA, 15 bp, Homo sapiens
gcttcagtgacactt

SEQ ID NO: 260016 - DNA, 15 bp, Homo sapiens
ggcttcagtgacact

SEQ ID NO: 260017 - DNA, 15 bp, Homo sapiens
gggcttcagtgacac

SEQ ID NO: 260018 - DNA, 15 bp, Homo sapiens
tgggcttcagtgaca

SEQ ID NO: 260019 - DNA, 15 bp, Homo sapiens
ttgggcttcagtgac

SEQ ID NO: 260020 - DNA, 15 bp, Homo sapiens
cttgggcttcagtga

SEQ ID NO: 260021 - DNA, 15 bp, Homo sapiens
tcttgggcttcagtg

SEQ ID NO: 260022 - DNA, 15 bp, Homo sapiens
atcttgggcttcagt

SEQ ID NO: 260023 - DNA, 15 bp, Homo sapiens
aatcttgggcttcag

SEQ ID NO: 260024 - DNA, 15 bp, Homo sapiens
caatcttgggcttca

SEQ ID NO: 260025 - DNA, 15 bp, Homo sapiens
ccaatcttgggcttc

SEQ ID NO: 260026 - DNA, 15 bp, Homo sapiens
tccaatcttgggctt

SEQ ID NO: 260027 - DNA, 15 bp, Homo sapiens
atccaatcttgggct

SEQ ID NO: 260028 - DNA, 15 bp, Homo sapiens
catccaatcttgggc

SEQ ID NO: 260029 - DNA, 15 bp, Homo sapiens
gcatccaatcttggg

SEQ ID NO: 260030 - DNA, 15 bp, Homo sapiens
agcatccaatcttgg

SEQ ID NO: 260031 - DNA, 15 bp, Homo sapiens
aagcatccaatcttg

SEQ ID NO: 260032 - DNA, 15 bp, Homo sapiens
taagcatccaatctt

SEQ ID NO: 260033 - DNA, 15 bp, Homo sapiens
ttaagcatccaatct

SEQ ID NO: 260034 - DNA, 15 bp, Homo sapiens
gttaagcatccaatc

SEQ ID NO: 260035 - DNA, 15 bp, Homo sapiens
tgttaagcatccaat

SEQ ID NO: 260036 - DNA, 15 bp, Homo sapiens
ctgttaagcatccaa

SEQ ID NO: 260037 - DNA, 15 bp, Homo sapiens
actgttaagcatcca

SEQ ID NO: 260038 - DNA, 15 bp, Homo sapiens
cactgttaagcatcc

SEQ ID NO: 260039 - DNA, 15 bp, Homo sapiens
acactgttaagcatc

SEQ ID NO: 260040 - DNA, 15 bp, Homo sapiens
aacactgttaagcat

SEQ ID NO: 260041 - DNA, 15 bp, Homo sapiens
gaacactgttaagca

SEQ ID NO: 260042 - DNA, 15 bp, Homo sapiens
tgaacactgttaagc

SEQ ID NO: 260043 - DNA, 15 bp, Homo sapiens
atgaacactgttaag

SEQ ID NO: 260044 - DNA, 15 bp, Homo sapiens
aatgaacactgttaa

SEQ ID NO: 260045 - DNA, 15 bp, Homo sapiens
caatgaacactgtta

SEQ ID NO: 260046 - DNA, 15 bp, Homo sapiens
acaatgaacactgtt

SEQ ID NO: 260047 - DNA, 15 bp, Homo sapiens
aacaatgaacactgt

SEQ ID NO: 260048 - DNA, 15 bp, Homo sapiens
aaacaatgaacactg

SEQ ID NO: 260049 - DNA, 15 bp, Homo sapiens
aaaacaatgaacact

SEQ ID NO: 260050 - DNA, 15 bp, Homo sapiens
caaaacaatgaacac

SEQ ID NO: 260051 - DNA, 15 bp, Homo sapiens
gcaaaacaatgaaca

SEQ ID NO: 260052 - DNA, 15 bp, Homo sapiens
tgcaaaacaatgaac

SEQ ID NO: 260053 - DNA, 15 bp, Homo sapiens
ttctgcaaaacaatg

SEQ ID NO: 260054 - DNA, 15 bp, Homo sapiens
gttctgcaaaacaat

SEQ ID NO: 260055 - DNA, 15 bp, Homo sapiens
tgttctgcaaaacaa

SEQ ID NO: 260056 - DNA, 15 bp, Homo sapiens
ctgttctgcaaaaca

SEQ ID NO: 260057 - DNA, 15 bp, Homo sapiens
cctgttctgcaaaac

SEQ ID NO: 260058 - DNA, 15 bp, Homo sapiens
tcctgttctgcaaaa

SEQ ID NO: 260059 - DNA, 15 bp, Homo sapiens
ctcctgttctgcaaa

SEQ ID NO: 260060 - DNA, 15 bp, Homo sapiens
tctcctgttctgcaa

SEQ ID NO: 260061 - DNA, 15 bp, Homo sapiens
ttctcctgttctgca

SEQ ID NO: 260062 - DNA, 15 bp, Homo sapiens
attctcctgttctgc

SEQ ID NO: 260063 - DNA, 15 bp, Homo sapiens
cattctcctgttctg

SEQ ID NO: 260064 - DNA, 15 bp, Homo sapiens
tcattctcctgttct

SEQ ID NO: 260065 - DNA, 15 bp, Homo sapiens
atcattctcctgttc

SEQ ID NO: 260066 - DNA, 15 bp, Homo sapiens
catcattctcctgtt

SEQ ID NO: 260067 - DNA, 15 bp, Homo sapiens
tcatcattctcctgt

SEQ ID NO: 260068 - DNA, 15 bp, Homo sapiens
atcatcattctcctg

SEQ ID NO: 260069 - DNA, 15 bp, Homo sapiens
catcatcattctcct

SEQ ID NO: 260070 - DNA, 15 bp, Homo sapiens
gcatcatcattctcc

SEQ ID NO: 260071 - DNA, 15 bp, Homo sapiens
tgcatcatcattctc

SEQ ID NO: 260072 - DNA, 15 bp, Homo sapiens
atgcatcatcattct

SEQ ID NO: 260073 - DNA, 15 bp, Homo sapiens
aatgcatcatcattc

SEQ ID NO: 260074 - DNA, 15 bp, Homo sapiens
aaatgcatcatcatt

SEQ ID NO: 260075 - DNA, 15 bp, Homo sapiens
gaaatgcatcatcat

SEQ ID NO: 260076 - DNA, 15 bp, Homo sapiens
agaaatgcatcatca

SEQ ID NO: 260077 - DNA, 15 bp, Homo sapiens
tagaaatgcatcatc

SEQ ID NO: 260078 - DNA, 15 bp, Homo sapiens
atagaaatgcatcat

SEQ ID NO: 260079 - DNA, 15 bp, Homo sapiens
aatagaaatgcatca

SEQ ID NO: 260080 - DNA, 15 bp, Homo sapiens
gaatagaaatgcatc

SEQ ID NO: 260081 - DNA, 15 bp, Homo sapiens
ggaatagaaatgcat

SEQ ID NO: 260082 - DNA, 15 bp, Homo sapiens
tggaatagaaatgca

SEQ ID NO: 260083 - DNA, 15 bp, Homo sapiens
atggaatagaaatgc

SEQ ID NO: 260084 - DNA, 15 bp, Homo sapiens
gatggaatagaaatg

SEQ ID NO: 260085 - DNA, 15 bp, Homo sapiens
ggatggaatagaaat

SEQ ID NO: 260086 - DNA, 15 bp, Homo sapiens
gggatggaatagaaa

SEQ ID NO: 260087 - DNA, 15 bp, Homo sapiens
ggggatggaatagaa

SEQ ID NO: 260088 - DNA, 15 bp, Homo sapiens
aggggatggaataga

SEQ ID NO: 260089 - DNA, 15 bp, Homo sapiens
caggggatggaatag

SEQ ID NO: 260090 - DNA, 15 bp, Homo sapiens
acaggggatggaata

SEQ ID NO: 260091 - DNA, 15 bp, Homo sapiens
cacaggggatggaat

SEQ ID NO: 260092 - DNA, 15 bp, Homo sapiens
gcacaggggatggaa

SEQ ID NO: 260093 - DNA, 15 bp, Homo sapiens
ggcacaggggatgga

SEQ ID NO: 260094 - DNA, 15 bp, Homo sapiens
aggcacaggggatgg

SEQ ID NO: 260095 - DNA, 15 bp, Homo sapiens
aaggcacaggggatg

SEQ ID NO: 260096 - DNA, 15 bp, Homo sapiens
caaggcacaggggat

SEQ ID NO: 260097 - DNA, 15 bp, Homo sapiens
acaaggcacagggga

SEQ ID NO: 260098 - DNA, 15 bp, Homo sapiens
tacaaggcacagggg

SEQ ID NO: 260099 - DNA, 15 bp, Homo sapiens
atacaaggcacaggg

SEQ ID NO: 260100 - DNA, 15 bp, Homo sapiens
catacaaggcacagg

SEQ ID NO: 260101 - DNA, 15 bp, Homo sapiens
acatacaaggcacag

SEQ ID NO: 260102 - DNA, 15 bp, Homo sapiens
cacatacaaggcaca

SEQ ID NO: 260103 - DNA, 15 bp, Homo sapiens
ccacatacaaggcac

SEQ ID NO: 260104 - DNA, 15 bp, Homo sapiens
cccacatacaaggca

SEQ ID NO: 260105 - DNA, 15 bp, Homo sapiens
tcccacatacaaggc

SEQ ID NO: 260106 - DNA, 15 bp, Homo sapiens
atcccacatacaagg

SEQ ID NO: 260107 - DNA, 15 bp, Homo sapiens
aatcccacatacaag

SEQ ID NO: 260108 - DNA, 15 bp, Homo sapiens
taatcccacatacaa

SEQ ID NO: 260109 - DNA, 15 bp, Homo sapiens
ttaatcccacataca

SEQ ID NO: 260110 - DNA, 15 bp, Homo sapiens
tttaatcccacatac

SEQ ID NO: 260111 - DNA, 15 bp, Homo sapiens
ctttaatcccacata

SEQ ID NO: 260112 - DNA, 15 bp, Homo sapiens
tctttaatcccacat

SEQ ID NO: 260113 - DNA, 15 bp, Homo sapiens
ttctttaatcccaca

SEQ ID NO: 260114 - DNA, 15 bp, Homo sapiens
tttctttaatcccac

SEQ ID NO: 260115 - DNA, 15 bp, Homo sapiens
ttttctttaatccca

SEQ ID NO: 260116 - DNA, 15 bp, Homo sapiens
tttttctttaatccc

SEQ ID NO: 260117 - DNA, 15 bp, Homo sapiens
gactttttctttaat

SEQ ID NO: 260118 - DNA, 15 bp, Homo sapiens
tgactttttctttaa

SEQ ID NO: 260119 - DNA, 15 bp, Homo sapiens
ctgactttttcttta

SEQ ID NO: 260120 - DNA, 15 bp, Homo sapiens
tctgactttttcttt

SEQ ID NO: 260121 - DNA, 15 bp, Homo sapiens
ttctgactttttctt

SEQ ID NO: 260122 - DNA, 15 bp, Homo sapiens
tttctgactttttct

SEQ ID NO: 260123 - DNA, 15 bp, Homo sapiens
ctttctgactttttc

SEQ ID NO: 260124 - DNA, 15 bp, Homo sapiens
actttctgacttttt

SEQ ID NO: 260125 - DNA, 15 bp, Homo sapiens
aactttctgactttt

SEQ ID NO: 260126 - DNA, 15 bp, Homo sapiens
caactttctgacttt

SEQ ID NO: 260127 - DNA, 15 bp, Homo sapiens
ccaactttctgactt

SEQ ID NO: 260128 - DNA, 15 bp, Homo sapiens
tccaactttctgact

SEQ ID NO: 260129 - DNA, 15 bp, Homo sapiens
atccaactttctgac

SEQ ID NO: 260130 - DNA, 15 bp, Homo sapiens
tatccaactttctga

SEQ ID NO: 260131 - DNA, 15 bp, Homo sapiens
ctatccaactttctg

SEQ ID NO: 260132 - DNA, 15 bp, Homo sapiens
tctatccaactttct

SEQ ID NO: 260133 - DNA, 15 bp, Homo sapiens
ttctatccaactttc

SEQ ID NO: 260134 - DNA, 15 bp, Homo sapiens
tttctatccaacttt

SEQ ID NO: 260135 - DNA, 15 bp, Homo sapiens
ttttctatccaactt

SEQ ID NO: 260136 - DNA, 15 bp, Homo sapiens
attttctatccaact

SEQ ID NO: 260137 - DNA, 15 bp, Homo sapiens
cattttctatccaac

SEQ ID NO: 260138 - DNA, 15 bp, Homo sapiens
tcattttctatccaa

SEQ ID NO: 260139 - DNA, 15 bp, Homo sapiens
atcattttctatcca

SEQ ID NO: 260140 - DNA, 15 bp, Homo sapiens
aatcattttctatcc

SEQ ID NO: 260141 - DNA, 15 bp, Homo sapiens
taatcattttctatc

SEQ ID NO: 260142 - DNA, 15 bp, Homo sapiens
ataatcattttctat

SEQ ID NO: 260143 - DNA, 15 bp, Homo sapiens
cataatcattttcta

SEQ ID NO: 260144 - DNA, 15 bp, Homo sapiens
gcataatcattttct

SEQ ID NO: 260145 - DNA, 15 bp, Homo sapiens
agcataatcattttc

SEQ ID NO: 260146 - DNA, 15 bp, Homo sapiens
cagcataatcatttt

SEQ ID NO: 260147 - DNA, 15 bp, Homo sapiens
acagcataatcattt

SEQ ID NO: 260148 - DNA, 15 bp, Homo sapiens
aacagcataatcatt

SEQ ID NO: 260149 - DNA, 15 bp, Homo sapiens
aaacagcataatcat

SEQ ID NO: 260150 - DNA, 15 bp, Homo sapiens
caaacagcataatca

SEQ ID NO: 260151 - DNA, 15 bp, Homo sapiens
acaaacagcataatc

SEQ ID NO: 260152 - DNA, 15 bp, Homo sapiens
aacaaacagcataat

SEQ ID NO: 260153 - DNA, 15 bp, Homo sapiens
aaacaaacagcataa

SEQ ID NO: 260154 - DNA, 15 bp, Homo sapiens
gaaacaaacagcata

SEQ ID NO: 260155 - DNA, 15 bp, Homo sapiens
tgaaacaaacagcat

SEQ ID NO: 260156 - DNA, 15 bp, Homo sapiens
atgaaacaaacagca

SEQ ID NO: 260157 - DNA, 15 bp, Homo sapiens
aatgaaacaaacagc

SEQ ID NO: 260158 - DNA, 15 bp, Homo sapiens
aaatgaaacaaacag

SEQ ID NO: 260159 - DNA, 15 bp, Homo sapiens
taaatgaaacaaaca

SEQ ID NO: 260160 - DNA, 15 bp, Homo sapiens
gtaaatgaaacaaac

SEQ ID NO: 260161 - DNA, 15 bp, Homo sapiens
ggtaaatgaaacaaa

SEQ ID NO: 260162 - DNA, 15 bp, Homo sapiens
tggtaaatgaaacaa

SEQ ID NO: 260163 - DNA, 15 bp, Homo sapiens
gtggtaaatgaaaca

SEQ ID NO: 260164 - DNA, 15 bp, Homo sapiens
tgtggtaaatgaaac

SEQ ID NO: 260165 - DNA, 15 bp, Homo sapiens
atgtggtaaatgaaa

SEQ ID NO: 260166 - DNA, 15 bp, Homo sapiens
catgtggtaaatgaa

SEQ ID NO: 260167 - DNA, 15 bp, Homo sapiens
tcatgtggtaaatga

SEQ ID NO: 260168 - DNA, 15 bp, Homo sapiens
gtcatgtggtaaatg

SEQ ID NO: 260169 - DNA, 15 bp, Homo sapiens
agtcatgtggtaaat

SEQ ID NO: 260170 - DNA, 15 bp, Homo sapiens
cagtcatgtggtaaa

SEQ ID NO: 260171 - DNA, 15 bp, Homo sapiens
tcagtcatgtggtaa

SEQ ID NO: 260172 - DNA, 15 bp, Homo sapiens
ctcagtcatgtggta

SEQ ID NO: 260173 - DNA, 15 bp, Homo sapiens
gctcagtcatgtggt

SEQ ID NO: 260174 - DNA, 15 bp, Homo sapiens
agctcagtcatgtgg

SEQ ID NO: 260175 - DNA, 15 bp, Homo sapiens
cagctcagtcatgtg

SEQ ID NO: 260176 - DNA, 15 bp, Homo sapiens
acagctcagtcatgt

SEQ ID NO: 260177 - DNA, 15 bp, Homo sapiens
gacagctcagtcatg

SEQ ID NO: 260178 - DNA, 15 bp, Homo sapiens
tgacagctcagtcat

SEQ ID NO: 260179 - DNA, 15 bp, Homo sapiens
atgacagctcagtca

SEQ ID NO: 260180 - DNA, 15 bp, Homo sapiens
aatgacagctcagtc

SEQ ID NO: 260181 - DNA, 15 bp, Homo sapiens
aaatgacagctcagt

SEQ ID NO: 260182 - DNA, 15 bp, Homo sapiens
caaatgacagctcag

SEQ ID NO: 260183 - DNA, 15 bp, Homo sapiens
acaaatgacagctca

SEQ ID NO: 260184 - DNA, 15 bp, Homo sapiens
gacaaatgacagctc

SEQ ID NO: 260185 - DNA, 15 bp, Homo sapiens
agacaaatgacagct

SEQ ID NO: 260186 - DNA, 15 bp, Homo sapiens
gagacaaatgacagc

SEQ ID NO: 260187 - DNA, 15 bp, Homo sapiens
ggagacaaatgacag

SEQ ID NO: 260188 - DNA, 15 bp, Homo sapiens
gggagacaaatgaca

SEQ ID NO: 260189 - DNA, 15 bp, Homo sapiens
agggagacaaatgac

SEQ ID NO: 260190 - DNA, 15 bp, Homo sapiens
aagggagacaaatga

SEQ ID NO: 260191 - DNA, 15 bp, Homo sapiens
aaagggagacaaatg

SEQ ID NO: 260192 - DNA, 15 bp, Homo sapiens
caaagggagacaaat

SEQ ID NO: 260193 - DNA, 15 bp, Homo sapiens
tcaaagggagacaaa

SEQ ID NO: 260194 - DNA, 15 bp, Homo sapiens
ttcaaagggagacaa

SEQ ID NO: 260195 - DNA, 15 bp, Homo sapiens
tttcaaagggagaca

SEQ ID NO: 260196 - DNA, 15 bp, Homo sapiens
atttcaaagggagac

SEQ ID NO: 260197 - DNA, 15 bp, Homo sapiens
catttcaaagggaga

SEQ ID NO: 260198 - DNA, 15 bp, Homo sapiens
tcatttcaaagggag

SEQ ID NO: 260199 - DNA, 15 bp, Homo sapiens
ctcatttcaaaggga

SEQ ID NO: 260200 - DNA, 15 bp, Homo sapiens
tctcatttcaaaggg

SEQ ID NO: 260201 - DNA, 15 bp, Homo sapiens
ttctcatttcaaagg

SEQ ID NO: 260202 - DNA, 15 bp, Homo sapiens
tttctcatttcaaag

SEQ ID NO: 260203 - DNA, 15 bp, Homo sapiens
ttttctcatttcaaa

SEQ ID NO: 260204 - DNA, 15 bp, Homo sapiens
attttctcatttcaa

SEQ ID NO: 260205 - DNA, 15 bp, Homo sapiens
gattttctcatttca

SEQ ID NO: 260206 - DNA, 15 bp, Homo sapiens
agattttctcatttc

SEQ ID NO: 260207 - DNA, 15 bp, Homo sapiens
aagattttctcattt

SEQ ID NO: 260208 - DNA, 15 bp, Homo sapiens
taagattttctcatt

SEQ ID NO: 260209 - DNA, 15 bp, Homo sapiens
ttaagattttctcat

SEQ ID NO: 260210 - DNA, 15 bp, Homo sapiens
attaagattttctca

SEQ ID NO: 260211 - DNA, 15 bp, Homo sapiens
gattaagattttctc

SEQ ID NO: 260212 - DNA, 15 bp, Homo sapiens
tgattaagattttct

SEQ ID NO: 260213 - DNA, 15 bp, Homo sapiens
atgattaagattttc

SEQ ID NO: 260214 - DNA, 15 bp, Homo sapiens
tatgattaagatttt

SEQ ID NO: 260215 - DNA, 15 bp, Homo sapiens
ttatgattaagattt

SEQ ID NO: 260216 - DNA, 15 bp, Homo sapiens
attatgattaagatt

SEQ ID NO: 260217 - DNA, 15 bp, Homo sapiens
aattatgattaagat

SEQ ID NO: 260218 - DNA, 15 bp, Homo sapiens
aaattatgattaaga

SEQ ID NO: 260219 - DNA, 15 bp, Homo sapiens
aaaattatgattaag

SEQ ID NO: 260220 - DNA, 15 bp, Homo sapiens
gaaaattatgattaa

SEQ ID NO: 260221 - DNA, 15 bp, Homo sapiens
agaaaattatgatta

SEQ ID NO: 260222 - DNA, 15 bp, Homo sapiens
cagaaaattatgatt

SEQ ID NO: 260223 - DNA, 15 bp, Homo sapiens
acagaaaattatgat

SEQ ID NO: 260224 - DNA, 15 bp, Homo sapiens
cacagaaaattatga

SEQ ID NO: 260225 - DNA, 15 bp, Homo sapiens
tcacagaaaattatg

SEQ ID NO: 260226 - DNA, 15 bp, Homo sapiens
atcacagaaaattat

SEQ ID NO: 260227 - DNA, 15 bp, Homo sapiens
aatcacagaaaatta

SEQ ID NO: 260228 - DNA, 15 bp, Homo sapiens
aaatcacagaaaatt

SEQ ID NO: 260229 - DNA, 15 bp, Homo sapiens
taaatcacagaaaat

SEQ ID NO: 260230 - DNA, 15 bp, Homo sapiens
ttaaatcacagaaaa

SEQ ID NO: 260231 - DNA, 15 bp, Homo sapiens
tttaaatcacagaaa

SEQ ID NO: 260232 - DNA, 15 bp, Homo sapiens
catttaaatcacaga

SEQ ID NO: 260233 - DNA, 15 bp, Homo sapiens
acatttaaatcacag

SEQ ID NO: 260234 - DNA, 15 bp, Homo sapiens
tacatttaaatcaca

SEQ ID NO: 260235 - DNA, 15 bp, Homo sapiens
ctacatttaaatcac

SEQ ID NO: 260236 - DNA, 15 bp, Homo sapiens
actacatttaaatca

SEQ ID NO: 260237 - DNA, 15 bp, Homo sapiens
gactacatttaaatc

SEQ ID NO: 260238 - DNA, 15 bp, Homo sapiens
tgactacatttaaat

SEQ ID NO: 260239 - DNA, 15 bp, Homo sapiens
ctgactacatttaaa

SEQ ID NO: 260240 - DNA, 15 bp, Homo sapiens
actgactacatttaa

SEQ ID NO: 260241 - DNA, 15 bp, Homo sapiens
aactgactacattta

SEQ ID NO: 260242 - DNA, 15 bp, Homo sapiens
gaactgactacattt

SEQ ID NO: 260243 - DNA, 15 bp, Homo sapiens
agaactgactacatt

SEQ ID NO: 260244 - DNA, 15 bp, Homo sapiens
aagaactgactacat

SEQ ID NO: 260245 - DNA, 15 bp, Homo sapiens
aaagaactgactaca

SEQ ID NO: 260246 - DNA, 15 bp, Homo sapiens
taaagaactgactac

SEQ ID NO: 260247 - DNA, 15 bp, Homo sapiens
ttaaagaactgacta

SEQ ID NO: 260248 - DNA, 15 bp, Homo sapiens
tttaaagaactgact

SEQ ID NO: 260249 - DNA, 15 bp, Homo sapiens
ctttaaagaactgac

SEQ ID NO: 260250 - DNA, 15 bp, Homo sapiens
cctttaaagaactga

SEQ ID NO: 260251 - DNA, 15 bp, Homo sapiens
acctttaaagaactg

SEQ ID NO: 260252 - DNA, 15 bp, Homo sapiens
tacctttaaagaact

SEQ ID NO: 260253 - DNA, 15 bp, Homo sapiens
gtacctttaaagaac

SEQ ID NO: 260254 - DNA, 15 bp, Homo sapiens
ggtacctttaaagaa

SEQ ID NO: 260255 - DNA, 15 bp, Homo sapiens
aggtacctttaaaga

SEQ ID NO: 260256 - DNA, 15 bp, Homo sapiens
taggtacctttaaag

SEQ ID NO: 260257 - DNA, 15 bp, Homo sapiens
ttaggtacctttaaa

SEQ ID NO: 260258 - DNA, 15 bp, Homo sapiens
tttaggtacctttaa

SEQ ID NO: 260259 - DNA, 15 bp, Homo sapiens
atttaggtaccttta

SEQ ID NO: 260260 - DNA, 15 bp, Homo sapiens
catttaggtaccttt

SEQ ID NO: 260261 - DNA, 15 bp, Homo sapiens
acatttaggtacctt

SEQ ID NO: 260262 - DNA, 15 bp, Homo sapiens
cacatttaggtacct

SEQ ID NO: 260263 - DNA, 15 bp, Homo sapiens
tcacatttaggtacc

SEQ ID NO: 260264 - DNA, 15 bp, Homo sapiens
gtcacatttaggtac

SEQ ID NO: 260265 - DNA, 15 bp, Homo sapiens
tgtcacatttaggta

SEQ ID NO: 260266 - DNA, 15 bp, Homo sapiens
gtgtcacatttaggt

SEQ ID NO: 260267 - DNA, 15 bp, Homo sapiens
tgtgtcacatttagg

SEQ ID NO: 260268 - DNA, 15 bp, Homo sapiens
gtgtgtcacatttag

SEQ ID NO: 260269 - DNA, 15 bp, Homo sapiens
agtgtgtcacattta

SEQ ID NO: 260270 - DNA, 15 bp, Homo sapiens
aagtgtgtcacattt

SEQ ID NO: 260271 - DNA, 15 bp, Homo sapiens
gaagtgtgtcacatt

SEQ ID NO: 260272 - DNA, 15 bp, Homo sapiens
tgaagtgtgtcacat

SEQ ID NO: 260273 - DNA, 15 bp, Homo sapiens
ctgaagtgtgtcaca

SEQ ID NO: 260274 - DNA, 15 bp, Homo sapiens
cctgaagtgtgtcac

SEQ ID NO: 260275 - DNA, 15 bp, Homo sapiens
tcctgaagtgtgtca

SEQ ID NO: 260276 - DNA, 15 bp, Homo sapiens
ttcctgaagtgtgtc

SEQ ID NO: 260277 - DNA, 15 bp, Homo sapiens
cttcctgaagtgtgt

SEQ ID NO: 260278 - DNA, 15 bp, Homo sapiens
tcttcctgaagtgtg

SEQ ID NO: 260279 - DNA, 15 bp, Homo sapiens
atcttcctgaagtgt

SEQ ID NO: 260280 - DNA, 15 bp, Homo sapiens
aatcttcctgaagtg

SEQ ID NO: 260281 - DNA, 15 bp, Homo sapiens
aaatcttcctgaagt

SEQ ID NO: 260282 - DNA, 15 bp, Homo sapiens
taaatcttcctgaag

SEQ ID NO: 260283 - DNA, 15 bp, Homo sapiens
gtaaatcttcctgaa

SEQ ID NO: 260284 - DNA, 15 bp, Homo sapiens
cgtaaatcttcctga

SEQ ID NO: 260285 - DNA, 15 bp, Homo sapiens
gcgtaaatcttcctg

SEQ ID NO: 260286 - DNA, 15 bp, Homo sapiens
agcgtaaatcttcct

SEQ ID NO: 260287 - DNA, 15 bp, Homo sapiens
aagcgtaaatcttcc

SEQ ID NO: 260288 - DNA, 15 bp, Homo sapiens
caagcgtaaatcttc

SEQ ID NO: 260289 - DNA, 15 bp, Homo sapiens
tcaagcgtaaatctt

SEQ ID NO: 260290 - DNA, 15 bp, Homo sapiens
gtcaagcgtaaatct

SEQ ID NO: 260291 - DNA, 15 bp, Homo sapiens
agtcaagcgtaaatc

SEQ ID NO: 260292 - DNA, 15 bp, Homo sapiens
aagtcaagcgtaaat

SEQ ID NO: 260293 - DNA, 15 bp, Homo sapiens
taagtcaagcgtaaa

SEQ ID NO: 260294 - DNA, 15 bp, Homo sapiens
ctaagtcaagcgtaa

SEQ ID NO: 260295 - DNA, 15 bp, Homo sapiens
cctaagtcaagcgta

SEQ ID NO: 260296 - DNA, 15 bp, Homo sapiens
gcctaagtcaagcgt

SEQ ID NO: 260297 - DNA, 15 bp, Homo sapiens
tgcctaagtcaagcg

SEQ ID NO: 260298 - DNA, 15 bp, Homo sapiens
gtgcctaagtcaagc

SEQ ID NO: 260299 - DNA, 15 bp, Homo sapiens
agtgcctaagtcaag

SEQ ID NO: 260300 - DNA, 15 bp, Homo sapiens
tagtgcctaagtcaa

SEQ ID NO: 260301 - DNA, 15 bp, Homo sapiens
ttagtgcctaagtca

SEQ ID NO: 260302 - DNA, 15 bp, Homo sapiens
cttagtgcctaagtc

SEQ ID NO: 260303 - DNA, 15 bp, Homo sapiens
tcttagtgcctaagt

SEQ ID NO: 260304 - DNA, 15 bp, Homo sapiens
gtcttagtgcctaag

SEQ ID NO: 260305 - DNA, 15 bp, Homo sapiens
tgtcttagtgcctaa

SEQ ID NO: 260306 - DNA, 15 bp, Homo sapiens
ttgtcttagtgccta

SEQ ID NO: 260307 - DNA, 15 bp, Homo sapiens
tttgtcttagtgcct

SEQ ID NO: 260308 - DNA, 15 bp, Homo sapiens
ctttgtcttagtgcc

SEQ ID NO: 260309 - DNA, 15 bp, Homo sapiens
actttgtcttagtgc

SEQ ID NO: 260310 - DNA, 15 bp, Homo sapiens
cactttgtcttagtg

SEQ ID NO: 260311 - DNA, 15 bp, Homo sapiens
acactttgtcttagt

SEQ ID NO: 260312 - DNA, 15 bp, Homo sapiens
gacactttgtcttag

SEQ ID NO: 260313 - DNA, 15 bp, Homo sapiens
tgacactttgtctta

SEQ ID NO: 260314 - DNA, 15 bp, Homo sapiens
ctgacactttgtctt

SEQ ID NO: 260315 - DNA, 15 bp, Homo sapiens
tctgacactttgtct

SEQ ID NO: 260316 - DNA, 15 bp, Homo sapiens
ctctgacactttgtc

SEQ ID NO: 260317 - DNA, 15 bp, Homo sapiens
actctgacactttgt

SEQ ID NO: 260318 - DNA, 15 bp, Homo sapiens
tactctgacactttg

SEQ ID NO: 260319 - DNA, 15 bp, Homo sapiens
ttactctgacacttt

SEQ ID NO: 260320 - DNA, 15 bp, Homo sapiens
tttactctgacactt

SEQ ID NO: 260321 - DNA, 15 bp, Homo sapiens
atttactctgacact

SEQ ID NO: 260322 - DNA, 15 bp, Homo sapiens
gatttactctgacac

SEQ ID NO: 260323 - DNA, 15 bp, Homo sapiens
tgatttactctgaca

SEQ ID NO: 260324 - DNA, 15 bp, Homo sapiens
gtgatttactctgac

SEQ ID NO: 260325 - DNA, 15 bp, Homo sapiens
agtgatttactctga

SEQ ID NO: 260326 - DNA, 15 bp, Homo sapiens
tagtgatttactctg

SEQ ID NO: 260327 - DNA, 15 bp, Homo sapiens
ttagtgatttactct

SEQ ID NO: 260328 - DNA, 15 bp, Homo sapiens
tttagtgatttactc

SEQ ID NO: 260329 - DNA, 15 bp, Homo sapiens
ttttagtgatttact

SEQ ID NO: 260330 - DNA, 15 bp, Homo sapiens
tttttagtgatttac

SEQ ID NO: 260331 - DNA, 15 bp, Homo sapiens
atttttagtgattta

SEQ ID NO: 260332 - DNA, 15 bp, Homo sapiens
aatttttagtgattt

SEQ ID NO: 260333 - DNA, 15 bp, Homo sapiens
caatttttagtgatt

SEQ ID NO: 260334 - DNA, 15 bp, Homo sapiens
tcaatttttagtgat

SEQ ID NO: 260335 - DNA, 15 bp, Homo sapiens
ttcaatttttagtga

SEQ ID NO: 260336 - DNA, 15 bp, Homo sapiens
cttcaatttttagtg

SEQ ID NO: 260337 - DNA, 15 bp, Homo sapiens
tcttcaatttttagt

SEQ ID NO: 260338 - DNA, 15 bp, Homo sapiens
gtcttcaatttttag

SEQ ID NO: 260339 - DNA, 15 bp, Homo sapiens
tgtcttcaattttta

SEQ ID NO: 260340 - DNA, 15 bp, Homo sapiens
atgtcttcaattttt

SEQ ID NO: 260341 - DNA, 15 bp, Homo sapiens
catgtcttcaatttt

SEQ ID NO: 260342 - DNA, 15 bp, Homo sapiens
tcatgtcttcaattt

SEQ ID NO: 260343 - DNA, 15 bp, Homo sapiens
atcatgtcttcaatt

SEQ ID NO: 260344 - DNA, 15 bp, Homo sapiens
tatcatgtcttcaat

SEQ ID NO: 260345 - DNA, 15 bp, Homo sapiens
ctatcatgtcttcaa

SEQ ID NO: 260346 - DNA, 15 bp, Homo sapiens
actatcatgtcttca

SEQ ID NO: 260347 - DNA, 15 bp, Homo sapiens
gactatcatgtcttc

SEQ ID NO: 260348 - DNA, 15 bp, Homo sapiens
agactatcatgtctt

SEQ ID NO: 260349 - DNA, 15 bp, Homo sapiens
cagactatcatgtct

SEQ ID NO: 260350 - DNA, 15 bp, Homo sapiens
acagactatcatgtc

SEQ ID NO: 260351 - DNA, 15 bp, Homo sapiens
cacagactatcatgt

SEQ ID NO: 260352 - DNA, 15 bp, Homo sapiens
ccacagactatcatg

SEQ ID NO: 260353 - DNA, 15 bp, Homo sapiens
cccacagactatcat

SEQ ID NO: 260354 - DNA, 15 bp, Homo sapiens
tcccacagactatca

SEQ ID NO: 260355 - DNA, 15 bp, Homo sapiens
atcccacagactatc

SEQ ID NO: 260356 - DNA, 15 bp, Homo sapiens
catcccacagactat

SEQ ID NO: 260357 - DNA, 15 bp, Homo sapiens
acatcccacagacta

SEQ ID NO: 260358 - DNA, 15 bp, Homo sapiens
cacatcccacagact

SEQ ID NO: 260359 - DNA, 15 bp, Homo sapiens
ccacatcccacagac

SEQ ID NO: 260360 - DNA, 15 bp, Homo sapiens
gccacatcccacaga

SEQ ID NO: 260361 - DNA, 15 bp, Homo sapiens
tgccacatcccacag

SEQ ID NO: 260362 - DNA, 15 bp, Homo sapiens
ttgccacatcccaca

SEQ ID NO: 260363 - DNA, 15 bp, Homo sapiens
tttgccacatcccac

SEQ ID NO: 260364 - DNA, 15 bp, Homo sapiens
atttgccacatccca

SEQ ID NO: 260365 - DNA, 15 bp, Homo sapiens
aatttgccacatccc

SEQ ID NO: 260366 - DNA, 15 bp, Homo sapiens
taatttgccacatcc

SEQ ID NO: 260367 - DNA, 15 bp, Homo sapiens
ctaatttgccacatc

SEQ ID NO: 260368 - DNA, 15 bp, Homo sapiens
actaatttgccacat

SEQ ID NO: 260369 - DNA, 15 bp, Homo sapiens
cactaatttgccaca

SEQ ID NO: 260370 - DNA, 15 bp, Homo sapiens
acactaatttgccac

SEQ ID NO: 260371 - DNA, 15 bp, Homo sapiens
gacactaatttgcca

SEQ ID NO: 260372 - DNA, 15 bp, Homo sapiens
tgacactaatttgcc

SEQ ID NO: 260373 - DNA, 15 bp, Homo sapiens
gtgacactaatttgc

SEQ ID NO: 260374 - DNA, 15 bp, Homo sapiens
tgtgacactaatttg

SEQ ID NO: 260375 - DNA, 15 bp, Homo sapiens
ctgtgacactaattt

SEQ ID NO: 260376 - DNA, 15 bp, Homo sapiens
gctgtgacactaatt

SEQ ID NO: 260377 - DNA, 15 bp, Homo sapiens
agctgtgacactaat

SEQ ID NO: 260378 - DNA, 15 bp, Homo sapiens
tagctgtgacactaa

SEQ ID NO: 260379 - DNA, 15 bp, Homo sapiens
gtagctgtgacacta

SEQ ID NO: 260380 - DNA, 15 bp, Homo sapiens
tgtagctgtgacact

SEQ ID NO: 260381 - DNA, 15 bp, Homo sapiens
ctgtagctgtgacac

SEQ ID NO: 260382 - DNA, 15 bp, Homo sapiens
tctgtagctgtgaca

SEQ ID NO: 260383 - DNA, 15 bp, Homo sapiens
ctctgtagctgtgac

SEQ ID NO: 260384 - DNA, 15 bp, Homo sapiens
actctgtagctgtga

SEQ ID NO: 260385 - DNA, 15 bp, Homo sapiens
cactctgtagctgtg

SEQ ID NO: 260386 - DNA, 15 bp, Homo sapiens
acactctgtagctgt

SEQ ID NO: 260387 - DNA, 15 bp, Homo sapiens
tacactctgtagctg

SEQ ID NO: 260388 - DNA, 15 bp, Homo sapiens
atacactctgtagct

SEQ ID NO: 260389 - DNA, 15 bp, Homo sapiens
tatacactctgtagc

SEQ ID NO: 260390 - DNA, 15 bp, Homo sapiens
ttatacactctgtag

SEQ ID NO: 260391 - DNA, 15 bp, Homo sapiens
gttatacactctgta

SEQ ID NO: 260392 - DNA, 15 bp, Homo sapiens
ggttatacactctgt

SEQ ID NO: 260393 - DNA, 15 bp, Homo sapiens
tggttatacactctg

SEQ ID NO: 260394 - DNA, 15 bp, Homo sapiens
ctggttatacactct

SEQ ID NO: 260395 - DNA, 15 bp, Homo sapiens
cctggttatacactc

SEQ ID NO: 260396 - DNA, 15 bp, Homo sapiens
ccctggttatacact

SEQ ID NO: 260397 - DNA, 15 bp, Homo sapiens
tccctggttatacac

SEQ ID NO: 260398 - DNA, 15 bp, Homo sapiens
ctccctggttataca

SEQ ID NO: 260399 - DNA, 15 bp, Homo sapiens
tctccctggttatac

SEQ ID NO: 260400 - DNA, 15 bp, Homo sapiens
gtctccctggttata

SEQ ID NO: 260401 - DNA, 15 bp, Homo sapiens
agtctccctggttat

SEQ ID NO: 260402 - DNA, 15 bp, Homo sapiens
aagtctccctggtta

SEQ ID NO: 260403 - DNA, 15 bp, Homo sapiens
gaagtctccctggtt

SEQ ID NO: 260404 - DNA, 15 bp, Homo sapiens
tgaagtctccctggt

SEQ ID NO: 260405 - DNA, 15 bp, Homo sapiens
ctgaagtctccctgg

SEQ ID NO: 260406 - DNA, 15 bp, Homo sapiens
tctgaagtctccctg

SEQ ID NO: 260407 - DNA, 15 bp, Homo sapiens
ttctgaagtctccct

SEQ ID NO: 260408 - DNA, 15 bp, Homo sapiens
tttctgaagtctccc

SEQ ID NO: 260409 - DNA, 15 bp, Homo sapiens
ctttctgaagtctcc

SEQ ID NO: 260410 - DNA, 15 bp, Homo sapiens
tctttctgaagtctc

SEQ ID NO: 260411 - DNA, 15 bp, Homo sapiens
ttctttctgaagtct

SEQ ID NO: 260412 - DNA, 15 bp, Homo sapiens
tttctttctgaagtc

SEQ ID NO: 260413 - DNA, 15 bp, Homo sapiens
atttctttctgaagt

SEQ ID NO: 260414 - DNA, 15 bp, Homo sapiens
catttctttctgaag

SEQ ID NO: 260415 - DNA, 15 bp, Homo sapiens
gcatttctttctgaa

SEQ ID NO: 260416 - DNA, 15 bp, Homo sapiens
tgcatttctttctga

SEQ ID NO: 260417 - DNA, 15 bp, Homo sapiens
ttgcatttctttctg

SEQ ID NO: 260418 - DNA, 15 bp, Homo sapiens
cttgcatttctttct

SEQ ID NO: 260419 - DNA, 15 bp, Homo sapiens
ccttgcatttctttc

SEQ ID NO: 260420 - DNA, 15 bp, Homo sapiens
tccttgcatttcttt

SEQ ID NO: 260421 - DNA, 15 bp, Homo sapiens
gtccttgcatttctt

SEQ ID NO: 260422 - DNA, 15 bp, Homo sapiens
tgtccttgcatttct

SEQ ID NO: 260423 - DNA, 15 bp, Homo sapiens
ctgtccttgcatttc

SEQ ID NO: 260424 - DNA, 15 bp, Homo sapiens
gctgtccttgcattt

SEQ ID NO: 260425 - DNA, 15 bp, Homo sapiens
ggctgtccttgcatt

SEQ ID NO: 260426 - DNA, 15 bp, Homo sapiens
aggctgtccttgcat

SEQ ID NO: 260427 - DNA, 15 bp, Homo sapiens
caggctgtccttgca

SEQ ID NO: 260428 - DNA, 15 bp, Homo sapiens
tcaggctgtccttgc

SEQ ID NO: 260429 - DNA, 15 bp, Homo sapiens
atcaggctgtccttg

SEQ ID NO: 260430 - DNA, 15 bp, Homo sapiens
catcaggctgtcctt

SEQ ID NO: 260431 - DNA, 15 bp, Homo sapiens
gcatcaggctgtcct

SEQ ID NO: 260432 - DNA, 15 bp, Homo sapiens
tgcatcaggctgtcc

SEQ ID NO: 260433 - DNA, 15 bp, Homo sapiens
ctgcatcaggctgtc

SEQ ID NO: 260434 - DNA, 15 bp, Homo sapiens
cctgcatcaggctgt

SEQ ID NO: 260435 - DNA, 15 bp, Homo sapiens
tcctgcatcaggctg

SEQ ID NO: 260436 - DNA, 15 bp, Homo sapiens
ttcctgcatcaggct

SEQ ID NO: 260437 - DNA, 15 bp, Homo sapiens
tttcctgcatcaggc

SEQ ID NO: 260438 - DNA, 15 bp, Homo sapiens
atttcctgcatcagg

SEQ ID NO: 260439 - DNA, 15 bp, Homo sapiens
catttcctgcatcag

SEQ ID NO: 260440 - DNA, 15 bp, Homo sapiens
ccatttcctgcatca

SEQ ID NO: 260441 - DNA, 15 bp, Homo sapiens
cccatttcctgcatc

SEQ ID NO: 260442 - DNA, 15 bp, Homo sapiens
gcccatttcctgcat

SEQ ID NO: 260443 - DNA, 15 bp, Homo sapiens
agcccatttcctgca

SEQ ID NO: 260444 - DNA, 15 bp, Homo sapiens
aagcccatttcctgc

SEQ ID NO: 260445 - DNA, 15 bp, Homo sapiens
aaagcccatttcctg

SEQ ID NO: 260446 - DNA, 15 bp, Homo sapiens
aaaagcccatttcct

SEQ ID NO: 260447 - DNA, 15 bp, Homo sapiens
aaaaagcccatttcc

SEQ ID NO: 260448 - DNA, 15 bp, Homo sapiens
caaaaagcccatttc

SEQ ID NO: 260449 - DNA, 15 bp, Homo sapiens
ccaaaaagcccattt

SEQ ID NO: 260450 - DNA, 15 bp, Homo sapiens
tccaaaaagcccatt

SEQ ID NO: 260451 - DNA, 15 bp, Homo sapiens
ttccaaaaagcccat

SEQ ID NO: 260452 - DNA, 15 bp, Homo sapiens
attccaaaaagccca

SEQ ID NO: 260453 - DNA, 15 bp, Homo sapiens
aattccaaaaagccc

SEQ ID NO: 260454 - DNA, 15 bp, Homo sapiens
aaattccaaaaagcc

SEQ ID NO: 260455 - DNA, 15 bp, Homo sapiens
caaattccaaaaagc

SEQ ID NO: 260456 - DNA, 15 bp, Homo sapiens
ccaaattccaaaaag

SEQ ID NO: 260457 - DNA, 15 bp, Homo sapiens
accaaattccaaaaa

SEQ ID NO: 260458 - DNA, 15 bp, Homo sapiens
gaccaaattccaaaa

SEQ ID NO: 260459 - DNA, 15 bp, Homo sapiens
agaccaaattccaaa

SEQ ID NO: 260460 - DNA, 15 bp, Homo sapiens
cagaccaaattccaa

SEQ ID NO: 260461 - DNA, 15 bp, Homo sapiens
acagaccaaattcca

SEQ ID NO: 260462 - DNA, 15 bp, Homo sapiens
aacagaccaaattcc

SEQ ID NO: 260463 - DNA, 15 bp, Homo sapiens
caacagaccaaattc

SEQ ID NO: 260464 - DNA, 15 bp, Homo sapiens
acaacagaccaaatt

SEQ ID NO: 260465 - DNA, 15 bp, Homo sapiens
gacaacagaccaaat

SEQ ID NO: 260466 - DNA, 15 bp, Homo sapiens
tgacaacagaccaaa

SEQ ID NO: 260467 - DNA, 15 bp, Homo sapiens
gtgacaacagaccaa

SEQ ID NO: 260468 - DNA, 15 bp, Homo sapiens
ggtgacaacagacca

SEQ ID NO: 260469 - DNA, 15 bp, Homo sapiens
aggtgacaacagacc

SEQ ID NO: 260470 - DNA, 15 bp, Homo sapiens
caggtgacaacagac

SEQ ID NO: 260471 - DNA, 15 bp, Homo sapiens
tcaggtgacaacaga

SEQ ID NO: 260472 - DNA, 15 bp, Homo sapiens
atcaggtgacaacag

SEQ ID NO: 260473 - DNA, 15 bp, Homo sapiens
catcaggtgacaaca

SEQ ID NO: 260474 - DNA, 15 bp, Homo sapiens
gcatcaggtgacaac

SEQ ID NO: 260475 - DNA, 15 bp, Homo sapiens
ggcatcaggtgacaa

SEQ ID NO: 260476 - DNA, 15 bp, Homo sapiens
tggcatcaggtgaca

SEQ ID NO: 260477 - DNA, 15 bp, Homo sapiens
atggcatcaggtgac

SEQ ID NO: 260478 - DNA, 15 bp, Homo sapiens
catggcatcaggtga

SEQ ID NO: 260479 - DNA, 15 bp, Homo sapiens
acatggcatcaggtg

SEQ ID NO: 260480 - DNA, 15 bp, Homo sapiens
cacatggcatcaggt

SEQ ID NO: 260481 - DNA, 15 bp, Homo sapiens
ccacatggcatcagg

SEQ ID NO: 260482 - DNA, 15 bp, Homo sapiens
cccacatggcatcag

SEQ ID NO: 260483 - DNA, 15 bp, Homo sapiens
ccccacatggcatca

SEQ ID NO: 260484 - DNA, 15 bp, Homo sapiens
tccccacatggcatc

SEQ ID NO: 260485 - DNA, 15 bp, Homo sapiens
atccccacatggcat

SEQ ID NO: 260486 - DNA, 15 bp, Homo sapiens
gatccccacatggca

SEQ ID NO: 260487 - DNA, 15 bp, Homo sapiens
ggatccccacatggc

SEQ ID NO: 260488 - DNA, 15 bp, Homo sapiens
tggatccccacatgg

SEQ ID NO: 260489 - DNA, 15 bp, Homo sapiens
ttggatccccacatg

SEQ ID NO: 260490 - DNA, 15 bp, Homo sapiens
attggatccccacat

SEQ ID NO: 260491 - DNA, 15 bp, Homo sapiens
tattggatccccaca

SEQ ID NO: 260492 - DNA, 15 bp, Homo sapiens
ctattggatccccac

SEQ ID NO: 260493 - DNA, 15 bp, Homo sapiens
gctattggatcccca

SEQ ID NO: 260494 - DNA, 15 bp, Homo sapiens
tgctattggatcccc

SEQ ID NO: 260495 - DNA, 15 bp, Homo sapiens
ctgctattggatccc

SEQ ID NO: 260496 - DNA, 15 bp, Homo sapiens
actgctattggatcc

SEQ ID NO: 260497 - DNA, 15 bp, Homo sapiens
cactgctattggatc

SEQ ID NO: 260498 - DNA, 15 bp, Homo sapiens
gcactgctattggat

SEQ ID NO: 260499 - DNA, 15 bp, Homo sapiens
agcactgctattgga

SEQ ID NO: 260500 - DNA, 15 bp, Homo sapiens
cagcactgctattgg

SEQ ID NO: 260501 - DNA, 15 bp, Homo sapiens
acagcactgctattg

SEQ ID NO: 260502 - DNA, 15 bp, Homo sapiens
cacagcactgctatt

SEQ ID NO: 260503 - DNA, 15 bp, Homo sapiens
acacagcactgctat

SEQ ID NO: 260504 - DNA, 15 bp, Homo sapiens
aacacagcactgcta

SEQ ID NO: 260505 - DNA, 15 bp, Homo sapiens
taacacagcactgct

SEQ ID NO: 260506 - DNA, 15 bp, Homo sapiens
gtaacacagcactgc

SEQ ID NO: 260507 - DNA, 15 bp, Homo sapiens
agtaacacagcactg

SEQ ID NO: 260508 - DNA, 15 bp, Homo sapiens
cagtaacacagcact

SEQ ID NO: 260509 - DNA, 15 bp, Homo sapiens
ccagtaacacagcac

SEQ ID NO: 260510 - DNA, 15 bp, Homo sapiens
gccagtaacacagca

SEQ ID NO: 260511 - DNA, 15 bp, Homo sapiens
tgccagtaacacagc

SEQ ID NO: 260512 - DNA, 15 bp, Homo sapiens
atgccagtaacacag

SEQ ID NO: 260513 - DNA, 15 bp, Homo sapiens
tatgccagtaacaca

SEQ ID NO: 260514 - DNA, 15 bp, Homo sapiens
ttatgccagtaacac

SEQ ID NO: 260515 - DNA, 15 bp, Homo sapiens
attatgccagtaaca

SEQ ID NO: 260516 - DNA, 15 bp, Homo sapiens
aattatgccagtaac

SEQ ID NO: 260517 - DNA, 15 bp, Homo sapiens
taattatgccagtaa

SEQ ID NO: 260518 - DNA, 15 bp, Homo sapiens
ttaattatgccagta

SEQ ID NO: 260519 - DNA, 15 bp, Homo sapiens
attaattatgccagt

SEQ ID NO: 260520 - DNA, 15 bp, Homo sapiens
cattaattatgccag

SEQ ID NO: 260521 - DNA, 15 bp, Homo sapiens
acattaattatgcca

SEQ ID NO: 260522 - DNA, 15 bp, Homo sapiens
aacattaattatgcc

SEQ ID NO: 260523 - DNA, 15 bp, Homo sapiens
caacattaattatgc

SEQ ID NO: 260524 - DNA, 15 bp, Homo sapiens
ccaacattaattatg

SEQ ID NO: 260525 - DNA, 15 bp, Homo sapiens
tccaacattaattat

SEQ ID NO: 260526 - DNA, 15 bp, Homo sapiens
ttccaacattaatta

SEQ ID NO: 260527 - DNA, 15 bp, Homo sapiens
attccaacattaatt

SEQ ID NO: 260528 - DNA, 15 bp, Homo sapiens
aattccaacattaat

SEQ ID NO: 260529 - DNA, 15 bp, Homo sapiens
gaattccaacattaa

SEQ ID NO: 260530 - DNA, 15 bp, Homo sapiens
tgaattccaacatta

SEQ ID NO: 260531 - DNA, 15 bp, Homo sapiens
ctgaattccaacatt

SEQ ID NO: 260532 - DNA, 15 bp, Homo sapiens
tctgaattccaacat

SEQ ID NO: 260533 - DNA, 15 bp, Homo sapiens
ttctgaattccaaca

SEQ ID NO: 260534 - DNA, 15 bp, Homo sapiens
tttctgaattccaac

SEQ ID NO: 260535 - DNA, 15 bp, Homo sapiens
ttttctgaattccaa

SEQ ID NO: 260536 - DNA, 15 bp, Homo sapiens
gttttctgaattcca

SEQ ID NO: 260537 - DNA, 15 bp, Homo sapiens
agttttctgaattcc

SEQ ID NO: 260538 - DNA, 15 bp, Homo sapiens
aagttttctgaattc

SEQ ID NO: 260539 - DNA, 15 bp, Homo sapiens
taagttttctgaatt

SEQ ID NO: 260540 - DNA, 15 bp, Homo sapiens
gtaagttttctgaat

SEQ ID NO: 260541 - DNA, 15 bp, Homo sapiens
tgtaagttttctgaa

SEQ ID NO: 260542 - DNA, 15 bp, Homo sapiens
ctgtaagttttctga

SEQ ID NO: 260543 - DNA, 15 bp, Homo sapiens
gctgtaagttttctg

SEQ ID NO: 260544 - DNA, 15 bp, Homo sapiens
ggctgtaagttttct

SEQ ID NO: 260545 - DNA, 15 bp, Homo sapiens
aggctgtaagttttc

SEQ ID NO: 260546 - DNA, 15 bp, Homo sapiens
aaggctgtaagtttt

SEQ ID NO: 260547 - DNA, 15 bp, Homo sapiens
aaaggctgtaagttt

SEQ ID NO: 260548 - DNA, 15 bp, Homo sapiens
aaaaggctgtaagtt

SEQ ID NO: 260549 - DNA, 15 bp, Homo sapiens
caaaaggctgtaagt

SEQ ID NO: 260550 - DNA, 15 bp, Homo sapiens
ccaaaaggctgtaag

SEQ ID NO: 260551 - DNA, 15 bp, Homo sapiens
gccaaaaggctgtaa

SEQ ID NO: 260552 - DNA, 15 bp, Homo sapiens
ggccaaaaggctgta

SEQ ID NO: 260553 - DNA, 15 bp, Homo sapiens
tggccaaaaggctgt

SEQ ID NO: 260554 - DNA, 15 bp, Homo sapiens
atggccaaaaggctg

SEQ ID NO: 260555 - DNA, 15 bp, Homo sapiens
tatggccaaaaggct

SEQ ID NO: 260556 - DNA, 15 bp, Homo sapiens
atatggccaaaaggc

SEQ ID NO: 260557 - DNA, 15 bp, Homo sapiens
aatatggccaaaagg

SEQ ID NO: 260558 - DNA, 15 bp, Homo sapiens
aaatatggccaaaag

SEQ ID NO: 260559 - DNA, 15 bp, Homo sapiens
caaatatggccaaaa

SEQ ID NO: 260560 - DNA, 15 bp, Homo sapiens
tcaaatatggccaaa

SEQ ID NO: 260561 - DNA, 15 bp, Homo sapiens
ttcaaatatggccaa

SEQ ID NO: 260562 - DNA, 15 bp, Homo sapiens
attcaaatatggcca

SEQ ID NO: 260563 - DNA, 15 bp, Homo sapiens
tattcaaatatggcc

SEQ ID NO: 260564 - DNA, 15 bp, Homo sapiens
atattcaaatatggc

SEQ ID NO: 260565 - DNA, 15 bp, Homo sapiens
catattcaaatatgg

SEQ ID NO: 260566 - DNA, 15 bp, Homo sapiens
acatattcaaatatg

SEQ ID NO: 260567 - DNA, 15 bp, Homo sapiens
aacatattcaaatat

SEQ ID NO: 260568 - DNA, 15 bp, Homo sapiens
gaacatattcaaata

SEQ ID NO: 260569 - DNA, 15 bp, Homo sapiens
ggaacatattcaaat

SEQ ID NO: 260570 - DNA, 15 bp, Homo sapiens
aggaacatattcaaa

SEQ ID NO: 260571 - DNA, 15 bp, Homo sapiens
aaggaacatattcaa

SEQ ID NO: 260572 - DNA, 15 bp, Homo sapiens
caaggaacatattca

SEQ ID NO: 260573 - DNA, 15 bp, Homo sapiens
ccaaggaacatattc

SEQ ID NO: 260574 - DNA, 15 bp, Homo sapiens
accaaggaacatatt

SEQ ID NO: 260575 - DNA, 15 bp, Homo sapiens
caccaaggaacatat

SEQ ID NO: 260576 - DNA, 15 bp, Homo sapiens
acaccaaggaacata

SEQ ID NO: 260577 - DNA, 15 bp, Homo sapiens
gacaccaaggaacat

SEQ ID NO: 260578 - DNA, 15 bp, Homo sapiens
agacaccaaggaaca

SEQ ID NO: 260579 - DNA, 15 bp, Homo sapiens
cagacaccaaggaac

SEQ ID NO: 260580 - DNA, 15 bp, Homo sapiens
acagacaccaaggaa

SEQ ID NO: 260581 - DNA, 15 bp, Homo sapiens
cacagacaccaagga

SEQ ID NO: 260582 - DNA, 15 bp, Homo sapiens
ccacagacaccaagg

SEQ ID NO: 260583 - DNA, 15 bp, Homo sapiens
cccacagacaccaag

SEQ ID NO: 260584 - DNA, 15 bp, Homo sapiens
ccccacagacaccaa

SEQ ID NO: 260585 - DNA, 15 bp, Homo sapiens
tccccacagacacca

SEQ ID NO: 260586 - DNA, 15 bp, Homo sapiens
ctccccacagacacc

SEQ ID NO: 260587 - DNA, 15 bp, Homo sapiens
gctccccacagacac

SEQ ID NO: 260588 - DNA, 15 bp, Homo sapiens
agctccccacagaca

SEQ ID NO: 260589 - DNA, 15 bp, Homo sapiens
cagctccccacagac

SEQ ID NO: 260590 - DNA, 15 bp, Homo sapiens
acagctccccacaga

SEQ ID NO: 260591 - DNA, 15 bp, Homo sapiens
tacagctccccacag

SEQ ID NO: 260592 - DNA, 15 bp, Homo sapiens
ctacagctccccaca

SEQ ID NO: 260593 - DNA, 15 bp, Homo sapiens
actacagctccccac

SEQ ID NO: 260594 - DNA, 15 bp, Homo sapiens
aactacagctcccca

SEQ ID NO: 260595 - DNA, 15 bp, Homo sapiens
gaactacagctcccc

SEQ ID NO: 260596 - DNA, 15 bp, Homo sapiens
ggaactacagctccc

SEQ ID NO: 260597 - DNA, 15 bp, Homo sapiens
gggaactacagctcc

SEQ ID NO: 260598 - DNA, 15 bp, Homo sapiens
agggaactacagctc

SEQ ID NO: 260599 - DNA, 15 bp, Homo sapiens
tagggaactacagct

SEQ ID NO: 260600 - DNA, 15 bp, Homo sapiens
ctagggaactacagc

SEQ ID NO: 260601 - DNA, 15 bp, Homo sapiens
gctagggaactacag

SEQ ID NO: 260602 - DNA, 15 bp, Homo sapiens
agctagggaactaca

SEQ ID NO: 260603 - DNA, 15 bp, Homo sapiens
tagctagggaactac

SEQ ID NO: 260604 - DNA, 15 bp, Homo sapiens
gtagctagggaacta

SEQ ID NO: 260605 - DNA, 15 bp, Homo sapiens
agtagctagggaact

SEQ ID NO: 260606 - DNA, 15 bp, Homo sapiens
cagtagctagggaac

SEQ ID NO: 260607 - DNA, 15 bp, Homo sapiens
gcagtagctagggaa

SEQ ID NO: 260608 - DNA, 15 bp, Homo sapiens
ggcagtagctaggga

SEQ ID NO: 260609 - DNA, 15 bp, Homo sapiens
gggcagtagctaggg

SEQ ID NO: 260610 - DNA, 15 bp, Homo sapiens
agggcagtagctagg

SEQ ID NO: 260611 - DNA, 15 bp, Homo sapiens
aagggcagtagctag

SEQ ID NO: 260612 - DNA, 15 bp, Homo sapiens
aaagggcagtagcta

SEQ ID NO: 260613 - DNA, 15 bp, Homo sapiens
taaagggcagtagct

SEQ ID NO: 260614 - DNA, 15 bp, Homo sapiens
ataaagggcagtagc

SEQ ID NO: 260615 - DNA, 15 bp, Homo sapiens
aataaagggcagtag

SEQ ID NO: 260616 - DNA, 15 bp, Homo sapiens
taataaagggcagta

SEQ ID NO: 260617 - DNA, 15 bp, Homo sapiens
ttaataaagggcagt

SEQ ID NO: 260618 - DNA, 15 bp, Homo sapiens
tttaataaagggcag

SEQ ID NO: 260619 - DNA, 15 bp, Homo sapiens
gtttaataaagggca

SEQ ID NO: 260620 - DNA, 15 bp, Homo sapiens
tgtttaataaagggc

SEQ ID NO: 260621 - DNA, 15 bp, Homo sapiens
gtgtttaataaaggg

SEQ ID NO: 260622 - DNA, 15 bp, Homo sapiens
agtgtttaataaagg

SEQ ID NO: 260623 - DNA, 15 bp, Homo sapiens
aagtgtttaataaag

SEQ ID NO: 260624 - DNA, 15 bp, Homo sapiens
aaagtgtttaataaa

SEQ ID NO: 260625 - DNA, 15 bp, Homo sapiens
gaaagtgtttaataa

SEQ ID NO: 260626 - DNA, 15 bp, Homo sapiens
ggaaagtgtttaata

SEQ ID NO: 260627 - DNA, 15 bp, Homo sapiens
aggaaagtgtttaat

SEQ ID NO: 260628 - DNA, 15 bp, Homo sapiens
aaggaaagtgtttaa

SEQ ID NO: 260629 - DNA, 15 bp, Homo sapiens
aaaggaaagtgttta

SEQ ID NO: 260630 - DNA, 15 bp, Homo sapiens
caaaggaaagtgttt

SEQ ID NO: 260631 - DNA, 15 bp, Homo sapiens
acaaaggaaagtgtt

SEQ ID NO: 260632 - DNA, 15 bp, Homo sapiens
gacaaaggaaagtgt

SEQ ID NO: 260633 - DNA, 15 bp, Homo sapiens
tgacaaaggaaagtg

SEQ ID NO: 260634 - DNA, 15 bp, Homo sapiens
ctgacaaaggaaagt

SEQ ID NO: 260635 - DNA, 15 bp, Homo sapiens
cctgacaaaggaaag

SEQ ID NO: 260636 - DNA, 15 bp, Homo sapiens
gcctgacaaaggaaa

SEQ ID NO: 260637 - DNA, 15 bp, Homo sapiens
tgcctgacaaaggaa

SEQ ID NO: 260638 - DNA, 15 bp, Homo sapiens
gtgcctgacaaagga

SEQ ID NO: 260639 - DNA, 15 bp, Homo sapiens
agtgcctgacaaagg

SEQ ID NO: 260640 - DNA, 15 bp, Homo sapiens
aagtgcctgacaaag

SEQ ID NO: 260641 - DNA, 15 bp, Homo sapiens
aaagtgcctgacaaa

SEQ ID NO: 260642 - DNA, 15 bp, Homo sapiens
caaagtgcctgacaa

SEQ ID NO: 260643 - DNA, 15 bp, Homo sapiens
gcaaagtgcctgaca

SEQ ID NO: 260644 - DNA, 15 bp, Homo sapiens
agcaaagtgcctgac

SEQ ID NO: 260645 - DNA, 15 bp, Homo sapiens
aagcaaagtgcctga

SEQ ID NO: 260646 - DNA, 15 bp, Homo sapiens
gaagcaaagtgcctg

SEQ ID NO: 260647 - DNA, 15 bp, Homo sapiens
agaagcaaagtgcct

SEQ ID NO: 260648 - DNA, 15 bp, Homo sapiens
cagaagcaaagtgcc

SEQ ID NO: 260649 - DNA, 15 bp, Homo sapiens
gcagaagcaaagtgc

SEQ ID NO: 260650 - DNA, 15 bp, Homo sapiens
ggcagaagcaaagtg

SEQ ID NO: 260651 - DNA, 15 bp, Homo sapiens
gggcagaagcaaagt

SEQ ID NO: 260652 - DNA, 15 bp, Homo sapiens
agggcagaagcaaag

SEQ ID NO: 260653 - DNA, 15 bp, Homo sapiens
gagggcagaagcaaa

SEQ ID NO: 260654 - DNA, 15 bp, Homo sapiens
agagggcagaagcaa

SEQ ID NO: 260655 - DNA, 15 bp, Homo sapiens
tagagggcagaagca

SEQ ID NO: 260656 - DNA, 15 bp, Homo sapiens
ctagagggcagaagc

SEQ ID NO: 260657 - DNA, 15 bp, Homo sapiens
tctagagggcagaag

SEQ ID NO: 260658 - DNA, 15 bp, Homo sapiens
ctctagagggcagaa

SEQ ID NO: 260659 - DNA, 15 bp, Homo sapiens
cctctagagggcaga

SEQ ID NO: 260660 - DNA, 15 bp, Homo sapiens
acctctagagggcag

SEQ ID NO: 260661 - DNA, 15 bp, Homo sapiens
aacctctagagggca

SEQ ID NO: 260662 - DNA, 15 bp, Homo sapiens
aaacctctagagggc

SEQ ID NO: 260663 - DNA, 15 bp, Homo sapiens
taaacctctagaggg

SEQ ID NO: 260664 - DNA, 15 bp, Homo sapiens
gtaaacctctagagg

SEQ ID NO: 260665 - DNA, 15 bp, Homo sapiens
tgtaaacctctagag

SEQ ID NO: 260666 - DNA, 15 bp, Homo sapiens
ttgtaaacctctaga

SEQ ID NO: 260667 - DNA, 15 bp, Homo sapiens
attgtaaacctctag

SEQ ID NO: 260668 - DNA, 15 bp, Homo sapiens
aattgtaaacctcta

SEQ ID NO: 260669 - DNA, 15 bp, Homo sapiens
caattgtaaacctct

SEQ ID NO: 260670 - DNA, 15 bp, Homo sapiens
tcaattgtaaacctc

SEQ ID NO: 260671 - DNA, 15 bp, Homo sapiens
ttcaattgtaaacct

SEQ ID NO: 260672 - DNA, 15 bp, Homo sapiens
tttcaattgtaaacc

SEQ ID NO: 260673 - DNA, 15 bp, Homo sapiens
ttttcaattgtaaac

SEQ ID NO: 260674 - DNA, 15 bp, Homo sapiens
gttttcaattgtaaa

SEQ ID NO: 260675 - DNA, 15 bp, Homo sapiens
agttttcaattgtaa

SEQ ID NO: 260676 - DNA, 15 bp, Homo sapiens
cagttttcaattgta

SEQ ID NO: 260677 - DNA, 15 bp, Homo sapiens
acagttttcaattgt

SEQ ID NO: 260678 - DNA, 15 bp, Homo sapiens
cacagttttcaattg

SEQ ID NO: 260679 - DNA, 15 bp, Homo sapiens
acacagttttcaatt

SEQ ID NO: 260680 - DNA, 15 bp, Homo sapiens
tacacagttttcaat

SEQ ID NO: 260681 - DNA, 15 bp, Homo sapiens
gtacacagttttcaa

SEQ ID NO: 260682 - DNA, 15 bp, Homo sapiens
tgtacacagttttca

SEQ ID NO: 260683 - DNA, 15 bp, Homo sapiens
ctgtacacagttttc

SEQ ID NO: 260684 - DNA, 15 bp, Homo sapiens
actgtacacagtttt

SEQ ID NO: 260685 - DNA, 15 bp, Homo sapiens
aactgtacacagttt

SEQ ID NO: 260686 - DNA, 15 bp, Homo sapiens
caactgtacacagtt

SEQ ID NO: 260687 - DNA, 15 bp, Homo sapiens
tcaactgtacacagt

SEQ ID NO: 260688 - DNA, 15 bp, Homo sapiens
gtcaactgtacacag

SEQ ID NO: 260689 - DNA, 15 bp, Homo sapiens
ggtcaactgtacaca

SEQ ID NO: 260690 - DNA, 15 bp, Homo sapiens
gggtcaactgtacac

SEQ ID NO: 260691 - DNA, 15 bp, Homo sapiens
agggtcaactgtaca

SEQ ID NO: 260692 - DNA, 15 bp, Homo sapiens
aagggtcaactgtac

SEQ ID NO: 260693 - DNA, 15 bp, Homo sapiens
caagggtcaactgta

SEQ ID NO: 260694 - DNA, 15 bp, Homo sapiens
tcaagggtcaactgt

SEQ ID NO: 260695 - DNA, 15 bp, Homo sapiens
gtcaagggtcaactg

SEQ ID NO: 260696 - DNA, 15 bp, Homo sapiens
tgtcaagggtcaact

SEQ ID NO: 260697 - DNA, 15 bp, Homo sapiens
gtgtcaagggtcaac

SEQ ID NO: 260698 - DNA, 15 bp, Homo sapiens
ggtgtcaagggtcaa

SEQ ID NO: 260699 - DNA, 15 bp, Homo sapiens
gggtgtcaagggtca

SEQ ID NO: 260700 - DNA, 15 bp, Homo sapiens
tgggtgtcaagggtc

SEQ ID NO: 260701 - DNA, 15 bp, Homo sapiens
ttgggtgtcaagggt

SEQ ID NO: 260702 - DNA, 15 bp, Homo sapiens
tttgggtgtcaaggg

SEQ ID NO: 260703 - DNA, 15 bp, Homo sapiens
ttttgggtgtcaagg

SEQ ID NO: 260704 - DNA, 15 bp, Homo sapiens
gttttgggtgtcaag

SEQ ID NO: 260705 - DNA, 15 bp, Homo sapiens
agttttgggtgtcaa

SEQ ID NO: 260706 - DNA, 15 bp, Homo sapiens
aagttttgggtgtca

SEQ ID NO: 260707 - DNA, 15 bp, Homo sapiens
taagttttgggtgtc

SEQ ID NO: 260708 - DNA, 15 bp, Homo sapiens
ttaagttttgggtgt

SEQ ID NO: 260709 - DNA, 15 bp, Homo sapiens
gttaagttttgggtg

SEQ ID NO: 260710 - DNA, 15 bp, Homo sapiens
tgttaagttttgggt

SEQ ID NO: 260711 - DNA, 15 bp, Homo sapiens
atgttaagttttggg

SEQ ID NO: 260712 - DNA, 15 bp, Homo sapiens
catgttaagttttgg

SEQ ID NO: 260713 - DNA, 15 bp, Homo sapiens
acatgttaagttttg

SEQ ID NO: 260714 - DNA, 15 bp, Homo sapiens
aacatgttaagtttt

SEQ ID NO: 260715 - DNA, 15 bp, Homo sapiens
taacatgttaagttt

SEQ ID NO: 260716 - DNA, 15 bp, Homo sapiens
ttaacatgttaagtt

SEQ ID NO: 260717 - DNA, 15 bp, Homo sapiens
gttaacatgttaagt

SEQ ID NO: 260718 - DNA, 15 bp, Homo sapiens
tgttaacatgttaag

SEQ ID NO: 260719 - DNA, 15 bp, Homo sapiens
ctgttaacatgttaa

SEQ ID NO: 260720 - DNA, 15 bp, Homo sapiens
actgttaacatgtta

SEQ ID NO: 260721 - DNA, 15 bp, Homo sapiens
gactgttaacatgtt

SEQ ID NO: 260722 - DNA, 15 bp, Homo sapiens
tgactgttaacatgt

SEQ ID NO: 260723 - DNA, 15 bp, Homo sapiens
ttgactgttaacatg

SEQ ID NO: 260724 - DNA, 15 bp, Homo sapiens
attgactgttaacat

SEQ ID NO: 260725 - DNA, 15 bp, Homo sapiens
aattgactgttaaca

SEQ ID NO: 260726 - DNA, 15 bp, Homo sapiens
taattgactgttaac

SEQ ID NO: 260727 - DNA, 15 bp, Homo sapiens
ttaattgactgttaa

SEQ ID NO: 260728 - DNA, 15 bp, Homo sapiens
gttaattgactgtta

SEQ ID NO: 260729 - DNA, 15 bp, Homo sapiens
tgttaattgactgtt

SEQ ID NO: 260730 - DNA, 15 bp, Homo sapiens
gtgttaattgactgt

SEQ ID NO: 260731 - DNA, 15 bp, Homo sapiens
tgtgttaattgactg

SEQ ID NO: 260732 - DNA, 15 bp, Homo sapiens
atgtgttaattgact

SEQ ID NO: 260733 - DNA, 15 bp, Homo sapiens
tatgtgttaattgac

SEQ ID NO: 260734 - DNA, 15 bp, Homo sapiens
atatgtgttaattga

SEQ ID NO: 260735 - DNA, 15 bp, Homo sapiens
aatatgtgttaattg

SEQ ID NO: 260736 - DNA, 15 bp, Homo sapiens
aaatatgtgttaatt

SEQ ID NO: 260737 - DNA, 15 bp, Homo sapiens
caaatatgtgttaat

SEQ ID NO: 260738 - DNA, 15 bp, Homo sapiens
tcaaatatgtgttaa

SEQ ID NO: 260739 - DNA, 15 bp, Homo sapiens
atcaaatatgtgtta

SEQ ID NO: 260740 - DNA, 15 bp, Homo sapiens
tatcaaatatgtgtt

SEQ ID NO: 260741 - DNA, 15 bp, Homo sapiens
atatcaaatatgtgt

SEQ ID NO: 260742 - DNA, 15 bp, Homo sapiens
catatcaaatatgtg

SEQ ID NO: 260743 - DNA, 15 bp, Homo sapiens
gcatatcaaatatgt

SEQ ID NO: 260744 - DNA, 15 bp, Homo sapiens
agcatatcaaatatg

SEQ ID NO: 260745 - DNA, 15 bp, Homo sapiens
tagcatatcaaatat

SEQ ID NO: 260746 - DNA, 15 bp, Homo sapiens
atagcatatcaaata

SEQ ID NO: 260747 - DNA, 15 bp, Homo sapiens
catagcatatcaaat

SEQ ID NO: 260748 - DNA, 15 bp, Homo sapiens
acatagcatatcaaa

SEQ ID NO: 260749 - DNA, 15 bp, Homo sapiens
tacatagcatatcaa

SEQ ID NO: 260750 - DNA, 15 bp, Homo sapiens
ttacatagcatatca

SEQ ID NO: 260751 - DNA, 15 bp, Homo sapiens
attacatagcatatc

SEQ ID NO: 260752 - DNA, 15 bp, Homo sapiens
tattacatagcatat

SEQ ID NO: 260753 - DNA, 15 bp, Homo sapiens
atattacatagcata

SEQ ID NO: 260754 - DNA, 15 bp, Homo sapiens
tatattacatagcat

SEQ ID NO: 260755 - DNA, 15 bp, Homo sapiens
atatattacatagca

SEQ ID NO: 260756 - DNA, 15 bp, Homo sapiens
tatatattacatagc

SEQ ID NO: 260757 - DNA, 15 bp, Homo sapiens
gtatatattacatag

SEQ ID NO: 260758 - DNA, 15 bp, Homo sapiens
agtatatattacata

SEQ ID NO: 260759 - DNA, 15 bp, Homo sapiens
gagtatatattacat

SEQ ID NO: 260760 - DNA, 15 bp, Homo sapiens
agagtatatattaca

SEQ ID NO: 260761 - DNA, 15 bp, Homo sapiens
aagagtatatattac

SEQ ID NO: 260762 - DNA, 15 bp, Homo sapiens
taagagtatatatta

SEQ ID NO: 260763 - DNA, 15 bp, Homo sapiens
ataagagtatatatt

SEQ ID NO: 260764 - DNA, 15 bp, Homo sapiens
aataagagtatatat

SEQ ID NO: 260765 - DNA, 15 bp, Homo sapiens
gaataagagtatata

SEQ ID NO: 260766 - DNA, 15 bp, Homo sapiens
agaataagagtatat

SEQ ID NO: 260767 - DNA, 15 bp, Homo sapiens
tagaataagagtata

SEQ ID NO: 260768 - DNA, 15 bp, Homo sapiens
gtagaataagagtat

SEQ ID NO: 260769 - DNA, 15 bp, Homo sapiens
tgtagaataagagta

SEQ ID NO: 260770 - DNA, 15 bp, Homo sapiens
ttgtagaataagagt

SEQ ID NO: 260771 - DNA, 15 bp, Homo sapiens
gttgtagaataagag

SEQ ID NO: 260772 - DNA, 15 bp, Homo sapiens
tgttgtagaataaga

SEQ ID NO: 260773 - DNA, 15 bp, Homo sapiens
ttgttgtagaataag

SEQ ID NO: 260774 - DNA, 15 bp, Homo sapiens
tttgttgtagaataa

SEQ ID NO: 260775 - DNA, 15 bp, Homo sapiens
ctttgttgtagaata

SEQ ID NO: 260776 - DNA, 15 bp, Homo sapiens
actttgttgtagaat

SEQ ID NO: 260777 - DNA, 15 bp, Homo sapiens
tactttgttgtagaa

SEQ ID NO: 260778 - DNA, 15 bp, Homo sapiens
ttactttgttgtaga

SEQ ID NO: 260779 - DNA, 15 bp, Homo sapiens
cttactttgttgtag

SEQ ID NO: 260780 - DNA, 15 bp, Homo sapiens
gcttactttgttgta

SEQ ID NO: 260781 - DNA, 15 bp, Homo sapiens
agcttactttgttgt

SEQ ID NO: 260782 - DNA, 15 bp, Homo sapiens
tagcttactttgttg

SEQ ID NO: 260783 - DNA, 15 bp, Homo sapiens
ctagcttactttgtt

SEQ ID NO: 260784 - DNA, 15 bp, Homo sapiens
tctagcttactttgt

SEQ ID NO: 260785 - DNA, 15 bp, Homo sapiens
ctctagcttactttg

SEQ ID NO: 260786 - DNA, 15 bp, Homo sapiens
tctctagcttacttt

SEQ ID NO: 260787 - DNA, 15 bp, Homo sapiens
ttctctagcttactt

SEQ ID NO: 260788 - DNA, 15 bp, Homo sapiens
tttctctagcttact

SEQ ID NO: 260789 - DNA, 15 bp, Homo sapiens
ttttctctagcttac

SEQ ID NO: 260790 - DNA, 15 bp, Homo sapiens
cttttctctagctta

SEQ ID NO: 260791 - DNA, 15 bp, Homo sapiens
tcttttctctagctt

SEQ ID NO: 260792 - DNA, 15 bp, Homo sapiens
ttcttttctctagct

SEQ ID NO: 260793 - DNA, 15 bp, Homo sapiens
tttcttttctctagc

SEQ ID NO: 260794 - DNA, 15 bp, Homo sapiens
ttttcttttctctag

SEQ ID NO: 260795 - DNA, 15 bp, Homo sapiens
attttcttttctcta

SEQ ID NO: 260796 - DNA, 15 bp, Homo sapiens
aattttcttttctct

SEQ ID NO: 260797 - DNA, 15 bp, Homo sapiens
aaattttcttttctc

SEQ ID NO: 260798 - DNA, 15 bp, Homo sapiens
aaaattttcttttct

SEQ ID NO: 260799 - DNA, 15 bp, Homo sapiens
taaaattttcttttc

SEQ ID NO: 260800 - DNA, 15 bp, Homo sapiens
ttaaaattttctttt

SEQ ID NO: 260801 - DNA, 15 bp, Homo sapiens
cttaaaattttcttt

SEQ ID NO: 260802 - DNA, 15 bp, Homo sapiens
tcttaaaattttctt

SEQ ID NO: 260803 - DNA, 15 bp, Homo sapiens
attttcttaaaattt

SEQ ID NO: 260804 - DNA, 15 bp, Homo sapiens
tattttcttaaaatt

SEQ ID NO: 260805 - DNA, 15 bp, Homo sapiens
ctattttcttaaaat

SEQ ID NO: 260806 - DNA, 15 bp, Homo sapiens
actattttcttaaaa

SEQ ID NO: 260807 - DNA, 15 bp, Homo sapiens
tactattttcttaaa

SEQ ID NO: 260808 - DNA, 15 bp, Homo sapiens
ttactattttcttaa

SEQ ID NO: 260809 - DNA, 15 bp, Homo sapiens
tttactattttctta

SEQ ID NO: 260810 - DNA, 15 bp, Homo sapiens
ttttactattttctt

SEQ ID NO: 260811 - DNA, 15 bp, Homo sapiens
cttttactattttct

SEQ ID NO: 260812 - DNA, 15 bp, Homo sapiens
tcttttactattttc

SEQ ID NO: 260813 - DNA, 15 bp, Homo sapiens
gtcttttactatttt

SEQ ID NO: 260814 - DNA, 15 bp, Homo sapiens
tgtcttttactattt

SEQ ID NO: 260815 - DNA, 15 bp, Homo sapiens
ttgtcttttactatt

SEQ ID NO: 260816 - DNA, 15 bp, Homo sapiens
tttgtcttttactat

SEQ ID NO: 260817 - DNA, 15 bp, Homo sapiens
ttttgtcttttacta

SEQ ID NO: 260818 - DNA, 15 bp, Homo sapiens
attttgtcttttact

SEQ ID NO: 260819 - DNA, 15 bp, Homo sapiens
tattttgtcttttac

SEQ ID NO: 260820 - DNA, 15 bp, Homo sapiens
atattttgtctttta

SEQ ID NO: 260821 - DNA, 15 bp, Homo sapiens
tatattttgtctttt

SEQ ID NO: 260822 - DNA, 15 bp, Homo sapiens
atatattttgtcttt

SEQ ID NO: 260823 - DNA, 15 bp, Homo sapiens
aatatattttgtctt

SEQ ID NO: 260824 - DNA, 15 bp, Homo sapiens
aaatatattttgtct

SEQ ID NO: 260825 - DNA, 15 bp, Homo sapiens
taaatatattttgtc

SEQ ID NO: 260826 - DNA, 15 bp, Homo sapiens
ttaaatatattttgt

SEQ ID NO: 260827 - DNA, 15 bp, Homo sapiens
attaaatatattttg

SEQ ID NO: 260828 - DNA, 15 bp, Homo sapiens
tattaaatatatttt

SEQ ID NO: 260829 - DNA, 15 bp, Homo sapiens
atattaaatatattt

SEQ ID NO: 260830 - DNA, 15 bp, Homo sapiens
aatattaaatatatt

SEQ ID NO: 260831 - DNA, 15 bp, Homo sapiens
gaatattaaatatat

SEQ ID NO: 260832 - DNA, 15 bp, Homo sapiens
tgaatattaaatata

SEQ ID NO: 260833 - DNA, 15 bp, Homo sapiens
gtgaatattaaatat

SEQ ID NO: 260834 - DNA, 15 bp, Homo sapiens
agtgaatattaaata

SEQ ID NO: 260835 - DNA, 15 bp, Homo sapiens
tagtgaatattaaat

SEQ ID NO: 260836 - DNA, 15 bp, Homo sapiens
ttagtgaatattaaa

SEQ ID NO: 260837 - DNA, 15 bp, Homo sapiens
attagtgaatattaa

SEQ ID NO: 260838 - DNA, 15 bp, Homo sapiens
aattagtgaatatta

SEQ ID NO: 260839 - DNA, 15 bp, Homo sapiens
caattagtgaatatt

SEQ ID NO: 260840 - DNA, 15 bp, Homo sapiens
ccaattagtgaatat

SEQ ID NO: 260841 - DNA, 15 bp, Homo sapiens
tccaattagtgaata

SEQ ID NO: 260842 - DNA, 15 bp, Homo sapiens
ttccaattagtgaat

SEQ ID NO: 260843 - DNA, 15 bp, Homo sapiens
cttccaattagtgaa

SEQ ID NO: 260844 - DNA, 15 bp, Homo sapiens
acttccaattagtga

SEQ ID NO: 260845 - DNA, 15 bp, Homo sapiens
cacttccaattagtg

SEQ ID NO: 260846 - DNA, 15 bp, Homo sapiens
tcacttccaattagt

SEQ ID NO: 260847 - DNA, 15 bp, Homo sapiens
atcacttccaattag

SEQ ID NO: 260848 - DNA, 15 bp, Homo sapiens
gatcacttccaatta

SEQ ID NO: 260849 - DNA, 15 bp, Homo sapiens
tgatcacttccaatt

SEQ ID NO: 260850 - DNA, 15 bp, Homo sapiens
atgatcacttccaat

SEQ ID NO: 260851 - DNA, 15 bp, Homo sapiens
gatgatcacttccaa

SEQ ID NO: 260852 - DNA, 15 bp, Homo sapiens
tgatgatcacttcca

SEQ ID NO: 260853 - DNA, 15 bp, Homo sapiens
atgatgatcacttcc

SEQ ID NO: 260854 - DNA, 15 bp, Homo sapiens
tatgatgatcacttc

SEQ ID NO: 260855 - DNA, 15 bp, Homo sapiens
ttatgatgatcactt

SEQ ID NO: 260856 - DNA, 15 bp, Homo sapiens
tttatgatgatcact

SEQ ID NO: 260857 - DNA, 15 bp, Homo sapiens
ctttatgatgatcac

SEQ ID NO: 260858 - DNA, 15 bp, Homo sapiens
cctttatgatgatca

SEQ ID NO: 260859 - DNA, 15 bp, Homo sapiens
ccctttatgatgatc

SEQ ID NO: 260860 - DNA, 15 bp, Homo sapiens
accctttatgatgat

SEQ ID NO: 260861 - DNA, 15 bp, Homo sapiens
gaccctttatgatga

SEQ ID NO: 260862 - DNA, 15 bp, Homo sapiens
agaccctttatgatg

SEQ ID NO: 260863 - DNA, 15 bp, Homo sapiens
aagaccctttatgat

SEQ ID NO: 260864 - DNA, 15 bp, Homo sapiens
gaagaccctttatga

SEQ ID NO: 260865 - DNA, 15 bp, Homo sapiens
tgaagaccctttatg

SEQ ID NO: 260866 - DNA, 15 bp, Homo sapiens
atgaagaccctttat

SEQ ID NO: 260867 - DNA, 15 bp, Homo sapiens
gatgaagacccttta

SEQ ID NO: 260868 - DNA, 15 bp, Homo sapiens
ggatgaagacccttt

SEQ ID NO: 260869 - DNA, 15 bp, Homo sapiens
aggatgaagaccctt

SEQ ID NO: 260870 - DNA, 15 bp, Homo sapiens
aaggatgaagaccct

SEQ ID NO: 260871 - DNA, 15 bp, Homo sapiens
caaggatgaagaccc

SEQ ID NO: 260872 - DNA, 15 bp, Homo sapiens
acaaggatgaagacc

SEQ ID NO: 260873 - DNA, 15 bp, Homo sapiens
aacaaggatgaagac

SEQ ID NO: 260874 - DNA, 15 bp, Homo sapiens
caacaaggatgaaga

SEQ ID NO: 260875 - DNA, 15 bp, Homo sapiens
tcaacaaggatgaag

SEQ ID NO: 260876 - DNA, 15 bp, Homo sapiens
gtcaacaaggatgaa

SEQ ID NO: 260877 - DNA, 15 bp, Homo sapiens
agtcaacaaggatga

SEQ ID NO: 260878 - DNA, 15 bp, Homo sapiens
aagtcaacaaggatg

SEQ ID NO: 260879 - DNA, 15 bp, Homo sapiens
gaagtcaacaaggat

SEQ ID NO: 260880 - DNA, 15 bp, Homo sapiens
tgaagtcaacaagga

SEQ ID NO: 260881 - DNA, 15 bp, Homo sapiens
atgaagtcaacaagg

SEQ ID NO: 260882 - DNA, 15 bp, Homo sapiens
catgaagtcaacaag

SEQ ID NO: 260883 - DNA, 15 bp, Homo sapiens
acatgaagtcaacaa

SEQ ID NO: 260884 - DNA, 15 bp, Homo sapiens
aacatgaagtcaaca

SEQ ID NO: 260885 - DNA, 15 bp, Homo sapiens
caacatgaagtcaac

SEQ ID NO: 260886 - DNA, 15 bp, Homo sapiens
tcaacatgaagtcaa

SEQ ID NO: 260887 - DNA, 15 bp, Homo sapiens
atcaacatgaagtca

SEQ ID NO: 260888 - DNA, 15 bp, Homo sapiens
aatcaacatgaagtc

SEQ ID NO: 260889 - DNA, 15 bp, Homo sapiens
taatcaacatgaagt

SEQ ID NO: 260890 - DNA, 15 bp, Homo sapiens
ttaatcaacatgaag

SEQ ID NO: 260891 - DNA, 15 bp, Homo sapiens
attaatcaacatgaa

SEQ ID NO: 260892 - DNA, 15 bp, Homo sapiens
gattaatcaacatga

SEQ ID NO: 260893 - DNA, 15 bp, Homo sapiens
agattaatcaacatg

SEQ ID NO: 260894 - DNA, 15 bp, Homo sapiens
cagattaatcaacat

SEQ ID NO: 260895 - DNA, 15 bp, Homo sapiens
tcagattaatcaaca

SEQ ID NO: 260896 - DNA, 15 bp, Homo sapiens
ctcagattaatcaac

SEQ ID NO: 260897 - DNA, 15 bp, Homo sapiens
cctcagattaatcaa

SEQ ID NO: 260898 - DNA, 15 bp, Homo sapiens
ccctcagattaatca

SEQ ID NO: 260899 - DNA, 15 bp, Homo sapiens
cccctcagattaatc

SEQ ID NO: 260900 - DNA, 15 bp, Homo sapiens
ccccctcagattaat

SEQ ID NO: 260901 - DNA, 15 bp, Homo sapiens
tccccctcagattaa

SEQ ID NO: 260902 - DNA, 15 bp, Homo sapiens
ctccccctcagatta

SEQ ID NO: 260903 - DNA, 15 bp, Homo sapiens
cctccccctcagatt

SEQ ID NO: 260904 - DNA, 15 bp, Homo sapiens
tcctccccctcagat

SEQ ID NO: 260905 - DNA, 15 bp, Homo sapiens
ttcctccccctcaga

SEQ ID NO: 260906 - DNA, 15 bp, Homo sapiens
cttcctccccctcag

SEQ ID NO: 260907 - DNA, 15 bp, Homo sapiens
tcttcctccccctca

SEQ ID NO: 260908 - DNA, 15 bp, Homo sapiens
ttcttcctccccctc

SEQ ID NO: 260909 - DNA, 15 bp, Homo sapiens
cttcttcctccccct

SEQ ID NO: 260910 - DNA, 15 bp, Homo sapiens
tcttcttcctccccc

SEQ ID NO: 260911 - DNA, 15 bp, Homo sapiens
ctcttcttcctcccc

SEQ ID NO: 260912 - DNA, 15 bp, Homo sapiens
cctcttcttcctccc

SEQ ID NO: 260913 - DNA, 15 bp, Homo sapiens
tcctcttcttcctcc

SEQ ID NO: 260914 - DNA, 15 bp, Homo sapiens
ctcctcttcttcctc

SEQ ID NO: 260915 - DNA, 15 bp, Homo sapiens
gctcctcttcttcct

SEQ ID NO: 260916 - DNA, 15 bp, Homo sapiens
tgctcctcttcttcc

SEQ ID NO: 260917 - DNA, 15 bp, Homo sapiens
ctgctcctcttcttc

SEQ ID NO: 260918 - DNA, 15 bp, Homo sapiens
actgctcctcttctt

SEQ ID NO: 260919 - DNA, 15 bp, Homo sapiens
aactgctcctcttct

SEQ ID NO: 260920 - DNA, 15 bp, Homo sapiens
caactgctcctcttc

SEQ ID NO: 260921 - DNA, 15 bp, Homo sapiens
ccaactgctcctctt

SEQ ID NO: 260922 - DNA, 15 bp, Homo sapiens
accaactgctcctct

SEQ ID NO: 260923 - DNA, 15 bp, Homo sapiens
caccaactgctcctc

SEQ ID NO: 260924 - DNA, 15 bp, Homo sapiens
acaccaactgctcct

SEQ ID NO: 260925 - DNA, 15 bp, Homo sapiens
aacaccaactgctcc

SEQ ID NO: 260926 - DNA, 15 bp, Homo sapiens
caacaccaactgctc

SEQ ID NO: 260927 - DNA, 15 bp, Homo sapiens
gcaacaccaactgct

SEQ ID NO: 260928 - DNA, 15 bp, Homo sapiens
agcaacaccaactgc

SEQ ID NO: 260929 - DNA, 15 bp, Homo sapiens
cagcaacaccaactg

SEQ ID NO: 260930 - DNA, 15 bp, Homo sapiens
acagcaacaccaact

SEQ ID NO: 260931 - DNA, 15 bp, Homo sapiens
gacagcaacaccaac

SEQ ID NO: 260932 - DNA, 15 bp, Homo sapiens
agacagcaacaccaa

SEQ ID NO: 260933 - DNA, 15 bp, Homo sapiens
gagacagcaacacca

SEQ ID NO: 260934 - DNA, 15 bp, Homo sapiens
tgagacagcaacacc

SEQ ID NO: 260935 - DNA, 15 bp, Homo sapiens
ctgagacagcaacac

SEQ ID NO: 260936 - DNA, 15 bp, Homo sapiens
cctgagacagcaaca

SEQ ID NO: 260937 - DNA, 15 bp, Homo sapiens
ccctgagacagcaac

SEQ ID NO: 260938 - DNA, 15 bp, Homo sapiens
cccctgagacagcaa

SEQ ID NO: 260939 - DNA, 15 bp, Homo sapiens
acccctgagacagca

SEQ ID NO: 260940 - DNA, 15 bp, Homo sapiens
tacccctgagacagc

SEQ ID NO: 260941 - DNA, 15 bp, Homo sapiens
ttacccctgagacag

SEQ ID NO: 260942 - DNA, 15 bp, Homo sapiens
gttacccctgagaca

SEQ ID NO: 260943 - DNA, 15 bp, Homo sapiens
tgttacccctgagac

SEQ ID NO: 260944 - DNA, 15 bp, Homo sapiens
ctgttacccctgaga

SEQ ID NO: 260945 - DNA, 15 bp, Homo sapiens
tctgttacccctgag

SEQ ID NO: 260946 - DNA, 15 bp, Homo sapiens
ctctgttacccctga

SEQ ID NO: 260947 - DNA, 15 bp, Homo sapiens
cctctgttacccctg

SEQ ID NO: 260948 - DNA, 15 bp, Homo sapiens
gcctctgttacccct

SEQ ID NO: 260949 - DNA, 15 bp, Homo sapiens
tgcctctgttacccc

SEQ ID NO: 260950 - DNA, 15 bp, Homo sapiens
ctgcctctgttaccc

SEQ ID NO: 260951 - DNA, 15 bp, Homo sapiens
tctgcctctgttacc

SEQ ID NO: 260952 - DNA, 15 bp, Homo sapiens
ttctgcctctgttac

SEQ ID NO: 260953 - DNA, 15 bp, Homo sapiens
tttctgcctctgtta

SEQ ID NO: 260954 - DNA, 15 bp, Homo sapiens
ctttctgcctctgtt

SEQ ID NO: 260955 - DNA, 15 bp, Homo sapiens
cctttctgcctctgt

SEQ ID NO: 260956 - DNA, 15 bp, Homo sapiens
ccctttctgcctctg

SEQ ID NO: 260957 - DNA, 15 bp, Homo sapiens
accctttctgcctct

SEQ ID NO: 260958 - DNA, 15 bp, Homo sapiens
taccctttctgcctc

SEQ ID NO: 260959 - DNA, 15 bp, Homo sapiens
ctaccctttctgcct

SEQ ID NO: 260960 - DNA, 15 bp, Homo sapiens
tctaccctttctgcc

SEQ ID NO: 260961 - DNA, 15 bp, Homo sapiens
ctctaccctttctgc

SEQ ID NO: 260962 - DNA, 15 bp, Homo sapiens
cctctaccctttctg

SEQ ID NO: 260963 - DNA, 15 bp, Homo sapiens
tcctctaccctttct

SEQ ID NO: 260964 - DNA, 15 bp, Homo sapiens
ctcctctaccctttc

SEQ ID NO: 260965 - DNA, 15 bp, Homo sapiens
tctcctctacccttt

SEQ ID NO: 260966 - DNA, 15 bp, Homo sapiens
ttctcctctaccctt

SEQ ID NO: 260967 - DNA, 15 bp, Homo sapiens
tttctcctctaccct

SEQ ID NO: 260968 - DNA, 15 bp, Homo sapiens
ttttctcctctaccc

SEQ ID NO: 260969 - DNA, 15 bp, Homo sapiens
cttttctcctctacc

SEQ ID NO: 260970 - DNA, 15 bp, Homo sapiens
tcttttctcctctac

SEQ ID NO: 260971 - DNA, 15 bp, Homo sapiens
ctcttttctcctcta

SEQ ID NO: 260972 - DNA, 15 bp, Homo sapiens
tctcttttctcctct

SEQ ID NO: 260973 - DNA, 15 bp, Homo sapiens
ctctcttttctcctc

SEQ ID NO: 260974 - DNA, 15 bp, Homo sapiens
cctctcttttctcct

SEQ ID NO: 260975 - DNA, 15 bp, Homo sapiens
gcctctcttttctcc

SEQ ID NO: 260976 - DNA, 15 bp, Homo sapiens
tgcctctcttttctc

SEQ ID NO: 260977 - DNA, 15 bp, Homo sapiens
ctgcctctcttttct

SEQ ID NO: 260978 - DNA, 15 bp, Homo sapiens
cctgcctctcttttc

SEQ ID NO: 260979 - DNA, 15 bp, Homo sapiens
gcctgcctctctttt

SEQ ID NO: 260980 - DNA, 15 bp, Homo sapiens
tgcctgcctctcttt

SEQ ID NO: 260981 - DNA, 15 bp, Homo sapiens
gtgcctgcctctctt

SEQ ID NO: 260982 - DNA, 15 bp, Homo sapiens
cgtgcctgcctctct

SEQ ID NO: 260983 - DNA, 15 bp, Homo sapiens
acgtgcctgcctctc

SEQ ID NO: 260984 - DNA, 15 bp, Homo sapiens
aacgtgcctgcctct

SEQ ID NO: 260985 - DNA, 15 bp, Homo sapiens
gaacgtgcctgcctc

SEQ ID NO: 260986 - DNA, 15 bp, Homo sapiens
tgaacgtgcctgcct

SEQ ID NO: 260987 - DNA, 15 bp, Homo sapiens
ctgaacgtgcctgcc

SEQ ID NO: 260988 - DNA, 15 bp, Homo sapiens
actgaacgtgcctgc

SEQ ID NO: 260989 - DNA, 15 bp, Homo sapiens
cactgaacgtgcctg

SEQ ID NO: 260990 - DNA, 15 bp, Homo sapiens
gcactgaacgtgcct

SEQ ID NO: 260991 - DNA, 15 bp, Homo sapiens
agcactgaacgtgcc

SEQ ID NO: 260992 - DNA, 15 bp, Homo sapiens
aagcactgaacgtgc

SEQ ID NO: 260993 - DNA, 15 bp, Homo sapiens
taagcactgaacgtg

SEQ ID NO: 260994 - DNA, 15 bp, Homo sapiens
ttaagcactgaacgt

SEQ ID NO: 260995 - DNA, 15 bp, Homo sapiens
gttaagcactgaacg

SEQ ID NO: 260996 - DNA, 15 bp, Homo sapiens
agttaagcactgaac

SEQ ID NO: 260997 - DNA, 15 bp, Homo sapiens
aagttaagcactgaa

SEQ ID NO: 260998 - DNA, 15 bp, Homo sapiens
aaagttaagcactga

SEQ ID NO: 260999 - DNA, 15 bp, Homo sapiens
taaagttaagcactg

SEQ ID NO: 261000 - DNA, 15 bp, Homo sapiens
ttaaagttaagcact

SEQ ID NO: 261001 - DNA, 15 bp, Homo sapiens
attaaagttaagcac

SEQ ID NO: 261002 - DNA, 15 bp, Homo sapiens
aattaaagttaagca

SEQ ID NO: 261003 - DNA, 15 bp, Homo sapiens
caattaaagttaagc

SEQ ID NO: 261004 - DNA, 15 bp, Homo sapiens
tcaattaaagttaag

SEQ ID NO: 261005 - DNA, 15 bp, Homo sapiens
ttcaattaaagttaa

SEQ ID NO: 261006 - DNA, 15 bp, Homo sapiens
tttcaattaaagtta

SEQ ID NO: 261007 - DNA, 15 bp, Homo sapiens
ttttcaattaaagtt

SEQ ID NO: 261008 - DNA, 15 bp, Homo sapiens
tttttcaattaaagt

SEQ ID NO: 261009 - DNA, 15 bp, Homo sapiens
ttttttcaattaaag

SEQ ID NO: 261010 - DNA, 15 bp, Homo sapiens
gttttttcaattaaa

SEQ ID NO: 261011 - DNA, 15 bp, Homo sapiens
agttttttcaattaa

SEQ ID NO: 261012 - DNA, 15 bp, Homo sapiens
gagttttttcaatta

SEQ ID NO: 261013 - DNA, 15 bp, Homo sapiens
ggagttttttcaatt

SEQ ID NO: 261014 - DNA, 15 bp, Homo sapiens
tggagttttttcaat

SEQ ID NO: 261015 - DNA, 15 bp, Homo sapiens
gtggagttttttcaa

SEQ ID NO: 261016 - DNA, 15 bp, Homo sapiens
cgtggagttttttca

SEQ ID NO: 261017 - DNA, 15 bp, Homo sapiens
acgtggagttttttc

SEQ ID NO: 261018 - DNA, 15 bp, Homo sapiens
cacgtggagtttttt

SEQ ID NO: 261019 - DNA, 15 bp, Homo sapiens
acacgtggagttttt

SEQ ID NO: 261020 - DNA, 15 bp, Homo sapiens
tacacgtggagtttt

SEQ ID NO: 261021 - DNA, 15 bp, Homo sapiens
ctacacgtggagttt

SEQ ID NO: 261022 - DNA, 15 bp, Homo sapiens
cctacacgtggagtt

SEQ ID NO: 261023 - DNA, 15 bp, Homo sapiens
acctacacgtggagt

SEQ ID NO: 261024 - DNA, 15 bp, Homo sapiens
cacctacacgtggag

SEQ ID NO: 261025 - DNA, 15 bp, Homo sapiens
ccacctacacgtgga

SEQ ID NO: 261026 - DNA, 15 bp, Homo sapiens
tccacctacacgtgg

SEQ ID NO: 261027 - DNA, 15 bp, Homo sapiens
gtccacctacacgtg

SEQ ID NO: 261028 - DNA, 15 bp, Homo sapiens
ggtccacctacacgt

SEQ ID NO: 261029 - DNA, 15 bp, Homo sapiens
gggtccacctacacg

SEQ ID NO: 261030 - DNA, 15 bp, Homo sapiens
agggtccacctacac

SEQ ID NO: 261031 - DNA, 15 bp, Homo sapiens
gagggtccacctaca

SEQ ID NO: 261032 - DNA, 15 bp, Homo sapiens
tgagggtccacctac

SEQ ID NO: 261033 - DNA, 15 bp, Homo sapiens
gtgagggtccaccta

SEQ ID NO: 261034 - DNA, 15 bp, Homo sapiens
tgtgagggtccacct

SEQ ID NO: 261035 - DNA, 15 bp, Homo sapiens
ctgtgagggtccacc

SEQ ID NO: 261036 - DNA, 15 bp, Homo sapiens
actgtgagggtccac

SEQ ID NO: 261037 - DNA, 15 bp, Homo sapiens
aactgtgagggtcca

SEQ ID NO: 261038 - DNA, 15 bp, Homo sapiens
gaactgtgagggtcc

SEQ ID NO: 261039 - DNA, 15 bp, Homo sapiens
tgaactgtgagggtc

SEQ ID NO: 261040 - DNA, 15 bp, Homo sapiens
ttgaactgtgagggt

SEQ ID NO: 261041 - DNA, 15 bp, Homo sapiens
tttgaactgtgaggg

SEQ ID NO: 261042 - DNA, 15 bp, Homo sapiens
gtttgaactgtgagg

SEQ ID NO: 261043 - DNA, 15 bp, Homo sapiens
agtttgaactgtgag

SEQ ID NO: 261044 - DNA, 15 bp, Homo sapiens
cagtttgaactgtga

SEQ ID NO: 261045 - DNA, 15 bp, Homo sapiens
ccagtttgaactgtg

SEQ ID NO: 261046 - DNA, 15 bp, Homo sapiens
gccagtttgaactgt

SEQ ID NO: 261047 - DNA, 15 bp, Homo sapiens
cgccagtttgaactg

SEQ ID NO: 261048 - DNA, 15 bp, Homo sapiens
gcgccagtttgaact

SEQ ID NO: 261049 - DNA, 15 bp, Homo sapiens
agcgccagtttgaac

SEQ ID NO: 261050 - DNA, 15 bp, Homo sapiens
cagcgccagtttgaa

SEQ ID NO: 261051 - DNA, 15 bp, Homo sapiens
acagcgccagtttga

SEQ ID NO: 261052 - DNA, 15 bp, Homo sapiens
aacagcgccagtttg

SEQ ID NO: 261053 - DNA, 15 bp, Homo sapiens
gaacagcgccagttt

SEQ ID NO: 261054 - DNA, 15 bp, Homo sapiens
tgaacagcgccagtt

SEQ ID NO: 261055 - DNA, 15 bp, Homo sapiens
ttgaacagcgccagt

SEQ ID NO: 261056 - DNA, 15 bp, Homo sapiens
cttgaacagcgccag

SEQ ID NO: 261057 - DNA, 15 bp, Homo sapiens
gcttgaacagcgcca

SEQ ID NO: 261058 - DNA, 15 bp, Homo sapiens
cgcttgaacagcgcc

SEQ ID NO: 261059 - DNA, 15 bp, Homo sapiens
acgcttgaacagcgc

SEQ ID NO: 261060 - DNA, 15 bp, Homo sapiens
gacgcttgaacagcg

SEQ ID NO: 261061 - DNA, 15 bp, Homo sapiens
tgacgcttgaacagc

SEQ ID NO: 261062 - DNA, 15 bp, Homo sapiens
ttgacgcttgaacag

SEQ ID NO: 261063 - DNA, 15 bp, Homo sapiens
gttgacgcttgaaca

SEQ ID NO: 261064 - DNA, 15 bp, Homo sapiens
agttgacgcttgaac

SEQ ID NO: 261065 - DNA, 15 bp, Homo sapiens
cagttgacgcttgaa

SEQ ID NO: 261066 - DNA, 15 bp, Homo sapiens
acagttgacgcttga

SEQ ID NO: 261067 - DNA, 15 bp, Homo sapiens
tacagttgacgcttg

SEQ ID NO: 261068 - DNA, 15 bp, Homo sapiens
gtacagttgacgctt

SEQ ID NO: 261069 - DNA, 15 bp, Homo sapiens
tgtacagttgacgct

SEQ ID NO: 261070 - DNA, 15 bp, Homo sapiens
ctgtacagttgacgc

SEQ ID NO: 261071 - DNA, 15 bp, Homo sapiens
cctgtacagttgacg

SEQ ID NO: 261072 - DNA, 15 bp, Homo sapiens
ccctgtacagttgac

SEQ ID NO: 261073 - DNA, 15 bp, Homo sapiens
gccctgtacagttga

SEQ ID NO: 261074 - DNA, 15 bp, Homo sapiens
tgccctgtacagttg

SEQ ID NO: 261075 - DNA, 15 bp, Homo sapiens
ttgccctgtacagtt

SEQ ID NO: 261076 - DNA, 15 bp, Homo sapiens
tttgccctgtacagt

SEQ ID NO: 261077 - DNA, 15 bp, Homo sapiens
ctttgccctgtacag

SEQ ID NO: 261078 - DNA, 15 bp, Homo sapiens
tctttgccctgtaca

SEQ ID NO: 261079 - DNA, 15 bp, Homo sapiens
ttctttgccctgtac

SEQ ID NO: 261080 - DNA, 15 bp, Homo sapiens
tttctttgccctgta

SEQ ID NO: 261081 - DNA, 15 bp, Homo sapiens
atttctttgccctgt

SEQ ID NO: 261082 - DNA, 15 bp, Homo sapiens
catttctttgccctg

SEQ ID NO: 261083 - DNA, 15 bp, Homo sapiens
tcatttctttgccct

SEQ ID NO: 261084 - DNA, 15 bp, Homo sapiens
ctcatttctttgccc

SEQ ID NO: 261085 - DNA, 15 bp, Homo sapiens
cctcatttctttgcc

SEQ ID NO: 261086 - DNA, 15 bp, Homo sapiens
acctcatttctttgc

SEQ ID NO: 261087 - DNA, 15 bp, Homo sapiens
tacctcatttctttg

SEQ ID NO: 261088 - DNA, 15 bp, Homo sapiens
ttacctcatttcttt

SEQ ID NO: 261089 - DNA, 15 bp, Homo sapiens
cttacctcatttctt

SEQ ID NO: 261090 - DNA, 15 bp, Homo sapiens
tcttacctcatttct

SEQ ID NO: 261091 - DNA, 15 bp, Homo sapiens
ttcttacctcatttc

SEQ ID NO: 261092 - DNA, 15 bp, Homo sapiens
attcttacctcattt

SEQ ID NO: 261093 - DNA, 15 bp, Homo sapiens
aattcttacctcatt

SEQ ID NO: 261094 - DNA, 15 bp, Homo sapiens
taattcttacctcat

SEQ ID NO: 261095 - DNA, 15 bp, Homo sapiens
gtaattcttacctca

SEQ ID NO: 261096 - DNA, 15 bp, Homo sapiens
tgtaattcttacctc

SEQ ID NO: 261097 - DNA, 15 bp, Homo sapiens
ctgtaattcttacct

SEQ ID NO: 261098 - DNA, 15 bp, Homo sapiens
actgtaattcttacc

SEQ ID NO: 261099 - DNA, 15 bp, Homo sapiens
cactgtaattcttac

SEQ ID NO: 261100 - DNA, 15 bp, Homo sapiens
tttcactgtaattct

SEQ ID NO: 261101 - DNA, 15 bp, Homo sapiens
ttttcactgtaattc

SEQ ID NO: 261102 - DNA, 15 bp, Homo sapiens
attttcactgtaatt

SEQ ID NO: 261103 - DNA, 15 bp, Homo sapiens
aattttcactgtaat

SEQ ID NO: 261104 - DNA, 15 bp, Homo sapiens
gaattttcactgtaa

SEQ ID NO: 261105 - DNA, 15 bp, Homo sapiens
ggaattttcactgta

SEQ ID NO: 261106 - DNA, 15 bp, Homo sapiens
tggaattttcactgt

SEQ ID NO: 261107 - DNA, 15 bp, Homo sapiens
ctggaattttcactg

SEQ ID NO: 261108 - DNA, 15 bp, Homo sapiens
tctggaattttcact

SEQ ID NO: 261109 - DNA, 15 bp, Homo sapiens
atctggaattttcac

SEQ ID NO: 261110 - DNA, 15 bp, Homo sapiens
catctggaattttca

SEQ ID NO: 261111 - DNA, 15 bp, Homo sapiens
ccatctggaattttc

SEQ ID NO: 261112 - DNA, 15 bp, Homo sapiens
accatctggaatttt

SEQ ID NO: 261113 - DNA, 15 bp, Homo sapiens
aaccatctggaattt

SEQ ID NO: 261114 - DNA, 15 bp, Homo sapiens
gaaccatctggaatt

SEQ ID NO: 261115 - DNA, 15 bp, Homo sapiens
agaaccatctggaat

SEQ ID NO: 261116 - DNA, 15 bp, Homo sapiens
aagaaccatctggaa

SEQ ID NO: 261117 - DNA, 15 bp, Homo sapiens
taagaaccatctgga

SEQ ID NO: 261118 - DNA, 15 bp, Homo sapiens
ctaagaaccatctgg

SEQ ID NO: 261119 - DNA, 15 bp, Homo sapiens
actaagaaccatctg

SEQ ID NO: 261120 - DNA, 15 bp, Homo sapiens
aactaagaaccatct

SEQ ID NO: 261121 - DNA, 15 bp, Homo sapiens
aaactaagaaccatc

SEQ ID NO: 261122 - DNA, 15 bp, Homo sapiens
aaaactaagaaccat

SEQ ID NO: 261123 - DNA, 15 bp, Homo sapiens
aaaaactaagaacca

SEQ ID NO: 261124 - DNA, 15 bp, Homo sapiens
aaaaaactaagaacc

SEQ ID NO: 261125 - DNA, 15 bp, Homo sapiens
aaaaaaactaagaac

SEQ ID NO: 261126 - DNA, 15 bp, Homo sapiens
gaaaaaaactaagaa

SEQ ID NO: 261127 - DNA, 15 bp, Homo sapiens
agaaaaaaactaaga

SEQ ID NO: 261128 - DNA, 15 bp, Homo sapiens
cagaaaaaaactaag

SEQ ID NO: 261129 - DNA, 15 bp, Homo sapiens
tcagaaaaaaactaa

SEQ ID NO: 261130 - DNA, 15 bp, Homo sapiens
gtcagaaaaaaacta

SEQ ID NO: 261131 - DNA, 15 bp, Homo sapiens
tgtcagaaaaaaact

SEQ ID NO: 261132 - DNA, 15 bp, Homo sapiens
gtgtcagaaaaaaac

SEQ ID NO: 261133 - DNA, 15 bp, Homo sapiens
ggtgtcagaaaaaaa

SEQ ID NO: 261134 - DNA, 15 bp, Homo sapiens
aggtgtcagaaaaaa

SEQ ID NO: 261135 - DNA, 15 bp, Homo sapiens
aaggtgtcagaaaaa

SEQ ID NO: 261136 - DNA, 15 bp, Homo sapiens
gaaggtgtcagaaaa

SEQ ID NO: 261137 - DNA, 15 bp, Homo sapiens
agaaggtgtcagaaa

SEQ ID NO: 261138 - DNA, 15 bp, Homo sapiens
gagaaggtgtcagaa

SEQ ID NO: 261139 - DNA, 15 bp, Homo sapiens
agagaaggtgtcaga

SEQ ID NO: 261140 - DNA, 15 bp, Homo sapiens
tagagaaggtgtcag

SEQ ID NO: 261141 - DNA, 15 bp, Homo sapiens
ttagagaaggtgtca

SEQ ID NO: 261142 - DNA, 15 bp, Homo sapiens
gttagagaaggtgtc

SEQ ID NO: 261143 - DNA, 15 bp, Homo sapiens
agttagagaaggtgt

SEQ ID NO: 261144 - DNA, 15 bp, Homo sapiens
gagttagagaaggtg

SEQ ID NO: 261145 - DNA, 15 bp, Homo sapiens
tgagttagagaaggt

SEQ ID NO: 261146 - DNA, 15 bp, Homo sapiens
atgagttagagaagg

SEQ ID NO: 261147 - DNA, 15 bp, Homo sapiens
tatgagttagagaag

SEQ ID NO: 261148 - DNA, 15 bp, Homo sapiens
atatgagttagagaa

SEQ ID NO: 261149 - DNA, 15 bp, Homo sapiens
catatgagttagaga

SEQ ID NO: 261150 - DNA, 15 bp, Homo sapiens
tcatatgagttagag

SEQ ID NO: 261151 - DNA, 15 bp, Homo sapiens
ttcatatgagttaga

SEQ ID NO: 261152 - DNA, 15 bp, Homo sapiens
cttcatatgagttag

SEQ ID NO: 261153 - DNA, 15 bp, Homo sapiens
gcttcatatgagtta

SEQ ID NO: 261154 - DNA, 15 bp, Homo sapiens
agcttcatatgagtt

SEQ ID NO: 261155 - DNA, 15 bp, Homo sapiens
aagcttcatatgagt

SEQ ID NO: 261156 - DNA, 15 bp, Homo sapiens
taagcttcatatgag

SEQ ID NO: 261157 - DNA, 15 bp, Homo sapiens
ataagcttcatatga

SEQ ID NO: 261158 - DNA, 15 bp, Homo sapiens
aataagcttcatatg

SEQ ID NO: 261159 - DNA, 15 bp, Homo sapiens
aaataagcttcatat

SEQ ID NO: 261160 - DNA, 15 bp, Homo sapiens
caaataagcttcata

SEQ ID NO: 261161 - DNA, 15 bp, Homo sapiens
tcaaataagcttcat

SEQ ID NO: 261162 - DNA, 15 bp, Homo sapiens
gtcaaataagcttca

SEQ ID NO: 261163 - DNA, 15 bp, Homo sapiens
agtcaaataagcttc

SEQ ID NO: 261164 - DNA, 15 bp, Homo sapiens
aagtcaaataagctt

SEQ ID NO: 261165 - DNA, 15 bp, Homo sapiens
taagtcaaataagct

SEQ ID NO: 261166 - DNA, 15 bp, Homo sapiens
ataagtcaaataagc

SEQ ID NO: 261167 - DNA, 15 bp, Homo sapiens
aataagtcaaataag

SEQ ID NO: 261168 - DNA, 15 bp, Homo sapiens
aaataagtcaaataa

SEQ ID NO: 261169 - DNA, 15 bp, Homo sapiens
aaaataagtcaaata

SEQ ID NO: 261170 - DNA, 15 bp, Homo sapiens
aaaaataagtcaaat

SEQ ID NO: 261171 - DNA, 15 bp, Homo sapiens
caaaaataagtcaaa

SEQ ID NO: 261172 - DNA, 15 bp, Homo sapiens
acaaaaataagtcaa

SEQ ID NO: 261173 - DNA, 15 bp, Homo sapiens
aacaaaaataagtca

SEQ ID NO: 261174 - DNA, 15 bp, Homo sapiens
taacaaaaataagtc

SEQ ID NO: 261175 - DNA, 15 bp, Homo sapiens
ataacaaaaataagt

SEQ ID NO: 261176 - DNA, 15 bp, Homo sapiens
aataacaaaaataag

SEQ ID NO: 261177 - DNA, 15 bp, Homo sapiens
ctaataacaaaaata

SEQ ID NO: 261178 - DNA, 15 bp, Homo sapiens
gctaataacaaaaat

SEQ ID NO: 261179 - DNA, 15 bp, Homo sapiens
agctaataacaaaaa

SEQ ID NO: 261180 - DNA, 15 bp, Homo sapiens
aagctaataacaaaa

SEQ ID NO: 261181 - DNA, 15 bp, Homo sapiens
taagctaataacaaa

SEQ ID NO: 261182 - DNA, 15 bp, Homo sapiens
ttaagctaataacaa

SEQ ID NO: 261183 - DNA, 15 bp, Homo sapiens
cttaagctaataaca

SEQ ID NO: 261184 - DNA, 15 bp, Homo sapiens
acttaagctaataac

SEQ ID NO: 261185 - DNA, 15 bp, Homo sapiens
aacttaagctaataa

SEQ ID NO: 261186 - DNA, 15 bp, Homo sapiens
aaacttaagctaata

SEQ ID NO: 261187 - DNA, 15 bp, Homo sapiens
taaacttaagctaat

SEQ ID NO: 261188 - DNA, 15 bp, Homo sapiens
gtaaacttaagctaa

SEQ ID NO: 261189 - DNA, 15 bp, Homo sapiens
ggtaaacttaagcta

SEQ ID NO: 261190 - DNA, 15 bp, Homo sapiens
tggtaaacttaagct

SEQ ID NO: 261191 - DNA, 15 bp, Homo sapiens
ttggtaaacttaagc

SEQ ID NO: 261192 - DNA, 15 bp, Homo sapiens
attggtaaacttaag

SEQ ID NO: 261193 - DNA, 15 bp, Homo sapiens
cattggtaaacttaa

SEQ ID NO: 261194 - DNA, 15 bp, Homo sapiens
tcattggtaaactta

SEQ ID NO: 261195 - DNA, 15 bp, Homo sapiens
atcattggtaaactt

SEQ ID NO: 261196 - DNA, 15 bp, Homo sapiens
tatcattggtaaact

SEQ ID NO: 261197 - DNA, 15 bp, Homo sapiens
gtatcattggtaaac

SEQ ID NO: 261198 - DNA, 15 bp, Homo sapiens
tgtatcattggtaaa

SEQ ID NO: 261199 - DNA, 15 bp, Homo sapiens
atgtatcattggtaa

SEQ ID NO: 261200 - DNA, 15 bp, Homo sapiens
aatgtatcattggta

SEQ ID NO: 261201 - DNA, 15 bp, Homo sapiens
aaatgtatcattggt

SEQ ID NO: 261202 - DNA, 15 bp, Homo sapiens
caaatgtatcattgg

SEQ ID NO: 261203 - DNA, 15 bp, Homo sapiens
ccaaatgtatcattg

SEQ ID NO: 261204 - DNA, 15 bp, Homo sapiens
gccaaatgtatcatt

SEQ ID NO: 261205 - DNA, 15 bp, Homo sapiens
tgccaaatgtatcat

SEQ ID NO: 261206 - DNA, 15 bp, Homo sapiens
atgccaaatgtatca

SEQ ID NO: 261207 - DNA, 15 bp, Homo sapiens
gatgccaaatgtatc

SEQ ID NO: 261208 - DNA, 15 bp, Homo sapiens
agatgccaaatgtat

SEQ ID NO: 261209 - DNA, 15 bp, Homo sapiens
cagatgccaaatgta

SEQ ID NO: 261210 - DNA, 15 bp, Homo sapiens
tcagatgccaaatgt

SEQ ID NO: 261211 - DNA, 15 bp, Homo sapiens
ttcagatgccaaatg

SEQ ID NO: 261212 - DNA, 15 bp, Homo sapiens
cttcagatgccaaat

SEQ ID NO: 261213 - DNA, 15 bp, Homo sapiens
ccttcagatgccaaa

SEQ ID NO: 261214 - DNA, 15 bp, Homo sapiens
tccttcagatgccaa

SEQ ID NO: 261215 - DNA, 15 bp, Homo sapiens
ttccttcagatgcca

SEQ ID NO: 261216 - DNA, 15 bp, Homo sapiens
tttccttcagatgcc

SEQ ID NO: 261217 - DNA, 15 bp, Homo sapiens
atttccttcagatgc

SEQ ID NO: 261218 - DNA, 15 bp, Homo sapiens
catttccttcagatg

SEQ ID NO: 261219 - DNA, 15 bp, Homo sapiens
ccatttccttcagat

SEQ ID NO: 261220 - DNA, 15 bp, Homo sapiens
tccatttccttcaga

SEQ ID NO: 261221 - DNA, 15 bp, Homo sapiens
atccatttccttcag

SEQ ID NO: 261222 - DNA, 15 bp, Homo sapiens
aatccatttccttca

SEQ ID NO: 261223 - DNA, 15 bp, Homo sapiens
caatccatttccttc

SEQ ID NO: 261224 - DNA, 15 bp, Homo sapiens
ccaatccatttcctt

SEQ ID NO: 261225 - DNA, 15 bp, Homo sapiens
accaatccatttcct

SEQ ID NO: 261226 - DNA, 15 bp, Homo sapiens
aaccaatccatttcc

SEQ ID NO: 261227 - DNA, 15 bp, Homo sapiens
gaaccaatccatttc

SEQ ID NO: 261228 - DNA, 15 bp, Homo sapiens
cgaaccaatccattt

SEQ ID NO: 261229 - DNA, 15 bp, Homo sapiens
acgaaccaatccatt

SEQ ID NO: 261230 - DNA, 15 bp, Homo sapiens
aacgaaccaatccat

SEQ ID NO: 261231 - DNA, 15 bp, Homo sapiens
taacgaaccaatcca

SEQ ID NO: 261232 - DNA, 15 bp, Homo sapiens
ataacgaaccaatcc

SEQ ID NO: 261233 - DNA, 15 bp, Homo sapiens
gataacgaaccaatc

SEQ ID NO: 261234 - DNA, 15 bp, Homo sapiens
ggataacgaaccaat

SEQ ID NO: 261235 - DNA, 15 bp, Homo sapiens
tggataacgaaccaa

SEQ ID NO: 261236 - DNA, 15 bp, Homo sapiens
ctggataacgaacca

SEQ ID NO: 261237 - DNA, 15 bp, Homo sapiens
tctggataacgaacc

SEQ ID NO: 261238 - DNA, 15 bp, Homo sapiens
gtctggataacgaac

SEQ ID NO: 261239 - DNA, 15 bp, Homo sapiens
agtctggataacgaa

SEQ ID NO: 261240 - DNA, 15 bp, Homo sapiens
aagtctggataacga

SEQ ID NO: 261241 - DNA, 15 bp, Homo sapiens
caagtctggataacg

SEQ ID NO: 261242 - DNA, 15 bp, Homo sapiens
acaagtctggataac

SEQ ID NO: 261243 - DNA, 15 bp, Homo sapiens
tacaagtctggataa

SEQ ID NO: 261244 - DNA, 15 bp, Homo sapiens
atacaagtctggata

SEQ ID NO: 261245 - DNA, 15 bp, Homo sapiens
catacaagtctggat

SEQ ID NO: 261246 - DNA, 15 bp, Homo sapiens
acatacaagtctgga

SEQ ID NO: 261247 - DNA, 15 bp, Homo sapiens
aacatacaagtctgg

SEQ ID NO: 261248 - DNA, 15 bp, Homo sapiens
aaacatacaagtctg

SEQ ID NO: 261249 - DNA, 15 bp, Homo sapiens
aaaacatacaagtct

SEQ ID NO: 261250 - DNA, 15 bp, Homo sapiens
taaaacatacaagtc

SEQ ID NO: 261251 - DNA, 15 bp, Homo sapiens
ataaaacatacaagt

SEQ ID NO: 261252 - DNA, 15 bp, Homo sapiens
cataaaacatacaag

SEQ ID NO: 261253 - DNA, 15 bp, Homo sapiens
acataaaacatacaa

SEQ ID NO: 261254 - DNA, 15 bp, Homo sapiens
aacataaaacataca

SEQ ID NO: 261255 - DNA, 15 bp, Homo sapiens
aaacataaaacatac

SEQ ID NO: 261256 - DNA, 15 bp, Homo sapiens
taaacataaaacata

SEQ ID NO: 261257 - DNA, 15 bp, Homo sapiens
ataaacataaaacat

SEQ ID NO: 261258 - DNA, 15 bp, Homo sapiens
gataaacataaaaca

SEQ ID NO: 261259 - DNA, 15 bp, Homo sapiens
agataaacataaaac

SEQ ID NO: 261260 - DNA, 15 bp, Homo sapiens
gagataaacataaaa

SEQ ID NO: 261261 - DNA, 15 bp, Homo sapiens
agagataaacataaa

SEQ ID NO: 261262 - DNA, 15 bp, Homo sapiens
aagagataaacataa

SEQ ID NO: 261263 - DNA, 15 bp, Homo sapiens
aaagagataaacata

SEQ ID NO: 261264 - DNA, 15 bp, Homo sapiens
taaagagataaacat

SEQ ID NO: 261265 - DNA, 15 bp, Homo sapiens
ttaaagagataaaca

SEQ ID NO: 261266 - DNA, 15 bp, Homo sapiens
tttaaagagataaac

SEQ ID NO: 261267 - DNA, 15 bp, Homo sapiens
ttttaaagagataaa

SEQ ID NO: 261268 - DNA, 15 bp, Homo sapiens
tttttaaagagataa

SEQ ID NO: 261269 - DNA, 15 bp, Homo sapiens
ttttttaaagagata

SEQ ID NO: 261270 - DNA, 15 bp, Homo sapiens
tttttttaaagagat

SEQ ID NO: 261271 - DNA, 15 bp, Homo sapiens
ttttttttaaagaga

SEQ ID NO: 261272 - DNA, 15 bp, Homo sapiens
tttttttttaaagag

SEQ ID NO: 261273 - DNA, 15 bp, Homo sapiens
ttttttttttaaaga

SEQ ID NO: 261274 - DNA, 15 bp, Homo sapiens
tttttttttttaaag

SEQ ID NO: 261275 - DNA, 15 bp, Homo sapiens
gactttttttttttt

SEQ ID NO: 261276 - DNA, 15 bp, Homo sapiens
agacttttttttttt

SEQ ID NO: 261277 - DNA, 15 bp, Homo sapiens
aagactttttttttt

SEQ ID NO: 261278 - DNA, 15 bp, Homo sapiens
gaagacttttttttt

SEQ ID NO: 261279 - DNA, 15 bp, Homo sapiens
ggaagactttttttt

SEQ ID NO: 261280 - DNA, 15 bp, Homo sapiens
gggaagacttttttt

SEQ ID NO: 261281 - DNA, 15 bp, Homo sapiens
agggaagactttttt

SEQ ID NO: 261282 - DNA, 15 bp, Homo sapiens
cagggaagacttttt

SEQ ID NO: 261283 - DNA, 15 bp, Homo sapiens
acagggaagactttt

SEQ ID NO: 261284 - DNA, 15 bp, Homo sapiens
aacagggaagacttt

SEQ ID NO: 261285 - DNA, 15 bp, Homo sapiens
caacagggaagactt

SEQ ID NO: 261286 - DNA, 15 bp, Homo sapiens
tcaacagggaagact

SEQ ID NO: 261287 - DNA, 15 bp, Homo sapiens
ctcaacagggaagac

SEQ ID NO: 261288 - DNA, 15 bp, Homo sapiens
actcaacagggaaga

SEQ ID NO: 261289 - DNA, 15 bp, Homo sapiens
aactcaacagggaag

SEQ ID NO: 261290 - DNA, 15 bp, Homo sapiens
caactcaacagggaa

SEQ ID NO: 261291 - DNA, 15 bp, Homo sapiens
acaactcaacaggga

SEQ ID NO: 261292 - DNA, 15 bp, Homo sapiens
aacaactcaacaggg

SEQ ID NO: 261293 - DNA, 15 bp, Homo sapiens
aaacaactcaacagg

SEQ ID NO: 261294 - DNA, 15 bp, Homo sapiens
aaaacaactcaacag

SEQ ID NO: 261295 - DNA, 15 bp, Homo sapiens
aaaaacaactcaaca

SEQ ID NO: 261296 - DNA, 15 bp, Homo sapiens
caaaaacaactcaac

SEQ ID NO: 261297 - DNA, 15 bp, Homo sapiens
tcaaaaacaactcaa

SEQ ID NO: 261298 - DNA, 15 bp, Homo sapiens
ttcaaaaacaactca

SEQ ID NO: 261299 - DNA, 15 bp, Homo sapiens
tttcaaaaacaactc

SEQ ID NO: 261300 - DNA, 15 bp, Homo sapiens
atttcaaaaacaact

SEQ ID NO: 261301 - DNA, 15 bp, Homo sapiens
gatttcaaaaacaac

SEQ ID NO: 261302 - DNA, 15 bp, Homo sapiens
atgatttcaaaaaca

SEQ ID NO: 261303 - DNA, 15 bp, Homo sapiens
aatgatttcaaaaac

SEQ ID NO: 261304 - DNA, 15 bp, Homo sapiens
aaatgatttcaaaaa

SEQ ID NO: 261305 - DNA, 15 bp, Homo sapiens
aaaatgatttcaaaa

SEQ ID NO: 261306 - DNA, 15 bp, Homo sapiens
taaaatgatttcaaa

SEQ ID NO: 261307 - DNA, 15 bp, Homo sapiens
gtaaaatgatttcaa

SEQ ID NO: 261308 - DNA, 15 bp, Homo sapiens
agtaaaatgatttca

SEQ ID NO: 261309 - DNA, 15 bp, Homo sapiens
gagtaaaatgatttc

SEQ ID NO: 261310 - DNA, 15 bp, Homo sapiens
agagtaaaatgattt

SEQ ID NO: 261311 - DNA, 15 bp, Homo sapiens
cagagtaaaatgatt

SEQ ID NO: 261312 - DNA, 15 bp, Homo sapiens
acagagtaaaatgat

SEQ ID NO: 261313 - DNA, 15 bp, Homo sapiens
tacagagtaaaatga

SEQ ID NO: 261314 - DNA, 15 bp, Homo sapiens
atacagagtaaaatg

SEQ ID NO: 261315 - DNA, 15 bp, Homo sapiens
catacagagtaaaat

SEQ ID NO: 261316 - DNA, 15 bp, Homo sapiens
ccatacagagtaaaa

SEQ ID NO: 261317 - DNA, 15 bp, Homo sapiens
cccatacagagtaaa

SEQ ID NO: 261318 - DNA, 15 bp, Homo sapiens
acccatacagagtaa

SEQ ID NO: 261319 - DNA, 15 bp, Homo sapiens
aacccatacagagta

SEQ ID NO: 261320 - DNA, 15 bp, Homo sapiens
aaacccatacagagt

SEQ ID NO: 261321 - DNA, 15 bp, Homo sapiens
taaacccatacagag

SEQ ID NO: 261322 - DNA, 15 bp, Homo sapiens
ttaaacccatacaga

SEQ ID NO: 261323 - DNA, 15 bp, Homo sapiens
tttaaacccatacag

SEQ ID NO: 261324 - DNA, 15 bp, Homo sapiens
ctttaaacccataca

SEQ ID NO: 261325 - DNA, 15 bp, Homo sapiens
gctttaaacccatac

SEQ ID NO: 261326 - DNA, 15 bp, Homo sapiens
tgctttaaacccata

SEQ ID NO: 261327 - DNA, 15 bp, Homo sapiens
ctgctttaaacccat

SEQ ID NO: 261328 - DNA, 15 bp, Homo sapiens
actgctttaaaccca

SEQ ID NO: 261329 - DNA, 15 bp, Homo sapiens
aactgctttaaaccc

SEQ ID NO: 261330 - DNA, 15 bp, Homo sapiens
gaactgctttaaacc

SEQ ID NO: 261331 - DNA, 15 bp, Homo sapiens
agaactgctttaaac

SEQ ID NO: 261332 - DNA, 15 bp, Homo sapiens
aagaactgctttaaa

SEQ ID NO: 261333 - DNA, 15 bp, Homo sapiens
aaagaactgctttaa

SEQ ID NO: 261334 - DNA, 15 bp, Homo sapiens
aaaagaactgcttta

SEQ ID NO: 261335 - DNA, 15 bp, Homo sapiens
taaaagaactgcttt

SEQ ID NO: 261336 - DNA, 15 bp, Homo sapiens
ttaaaagaactgctt

SEQ ID NO: 261337 - DNA, 15 bp, Homo sapiens
attaaaagaactgct

SEQ ID NO: 261338 - DNA, 15 bp, Homo sapiens
aattaaaagaactgc

SEQ ID NO: 261339 - DNA, 15 bp, Homo sapiens
aaattaaaagaactg

SEQ ID NO: 261340 - DNA, 15 bp, Homo sapiens
caaattaaaagaact

SEQ ID NO: 261341 - DNA, 15 bp, Homo sapiens
acaaattaaaagaac

SEQ ID NO: 261342 - DNA, 15 bp, Homo sapiens
tacaaattaaaagaa

SEQ ID NO: 261343 - DNA, 15 bp, Homo sapiens
ctacaaattaaaaga

SEQ ID NO: 261344 - DNA, 15 bp, Homo sapiens
tctacaaattaaaag

SEQ ID NO: 261345 - DNA, 15 bp, Homo sapiens
atctacaaattaaaa

SEQ ID NO: 261346 - DNA, 15 bp, Homo sapiens
tatctacaaattaaa

SEQ ID NO: 261347 - DNA, 15 bp, Homo sapiens
ttatctacaaattaa

SEQ ID NO: 261348 - DNA, 15 bp, Homo sapiens
gttatctacaaatta

SEQ ID NO: 261349 - DNA, 15 bp, Homo sapiens
agttatctacaaatt

SEQ ID NO: 261350 - DNA, 15 bp, Homo sapiens
aagttatctacaaat

SEQ ID NO: 261351 - DNA, 15 bp, Homo sapiens
taagttatctacaaa

SEQ ID NO: 261352 - DNA, 15 bp, Homo sapiens
ttaagttatctacaa

SEQ ID NO: 261353 - DNA, 15 bp, Homo sapiens
tttaagttatctaca

SEQ ID NO: 261354 - DNA, 15 bp, Homo sapiens
ttttaagttatctac

SEQ ID NO: 261355 - DNA, 15 bp, Homo sapiens
tttttaagttatcta

SEQ ID NO: 261356 - DNA, 15 bp, Homo sapiens
ttttttaagttatct

SEQ ID NO: 261357 - DNA, 15 bp, Homo sapiens
attttttaagttatc

SEQ ID NO: 261358 - DNA, 15 bp, Homo sapiens
tattttttaagttat

SEQ ID NO: 261359 - DNA, 15 bp, Homo sapiens
ttattttttaagtta

SEQ ID NO: 261360 - DNA, 15 bp, Homo sapiens
tttattttttaagtt

SEQ ID NO: 261361 - DNA, 15 bp, Homo sapiens
atttattttttaagt

SEQ ID NO: 261362 - DNA, 15 bp, Homo sapiens
tatttattttttaag

SEQ ID NO: 261363 - DNA, 15 bp, Homo sapiens
attatttatttttta

SEQ ID NO: 261364 - DNA, 15 bp, Homo sapiens
aattatttatttttt

SEQ ID NO: 261365 - DNA, 15 bp, Homo sapiens
gaattatttattttt

SEQ ID NO: 261366 - DNA, 15 bp, Homo sapiens
agaattatttatttt

SEQ ID NO: 261367 - DNA, 15 bp, Homo sapiens
cagaattatttattt

SEQ ID NO: 261368 - DNA, 15 bp, Homo sapiens
acagaattatttatt

SEQ ID NO: 261369 - DNA, 15 bp, Homo sapiens
cacagaattatttat

SEQ ID NO: 261370 - DNA, 15 bp, Homo sapiens
acacagaattattta

SEQ ID NO: 261371 - DNA, 15 bp, Homo sapiens
aacacagaattattt

SEQ ID NO: 261372 - DNA, 15 bp, Homo sapiens
taacacagaattatt

SEQ ID NO: 261373 - DNA, 15 bp, Homo sapiens
gtaacacagaattat

SEQ ID NO: 261374 - DNA, 15 bp, Homo sapiens
agtaacacagaatta

SEQ ID NO: 261375 - DNA, 15 bp, Homo sapiens
gagtaacacagaatt

SEQ ID NO: 261376 - DNA, 15 bp, Homo sapiens
tgagtaacacagaat

SEQ ID NO: 261377 - DNA, 15 bp, Homo sapiens
ctgagtaacacagaa

SEQ ID NO: 261378 - DNA, 15 bp, Homo sapiens
tctgagtaacacaga

SEQ ID NO: 261379 - DNA, 15 bp, Homo sapiens
gtctgagtaacacag

SEQ ID NO: 261380 - DNA, 15 bp, Homo sapiens
tgtctgagtaacaca

SEQ ID NO: 261381 - DNA, 15 bp, Homo sapiens
ctgtctgagtaacac

SEQ ID NO: 261382 - DNA, 15 bp, Homo sapiens
gctgtctgagtaaca

SEQ ID NO: 261383 - DNA, 15 bp, Homo sapiens
agctgtctgagtaac

SEQ ID NO: 261384 - DNA, 15 bp, Homo sapiens
tagctgtctgagtaa

SEQ ID NO: 261385 - DNA, 15 bp, Homo sapiens
ctagctgtctgagta

SEQ ID NO: 261386 - DNA, 15 bp, Homo sapiens
gctagctgtctgagt

SEQ ID NO: 261387 - DNA, 15 bp, Homo sapiens
tgctagctgtctgag

SEQ ID NO: 261388 - DNA, 15 bp, Homo sapiens
atgctagctgtctga

SEQ ID NO: 261389 - DNA, 15 bp, Homo sapiens
catgctagctgtctg

SEQ ID NO: 261390 - DNA, 15 bp, Homo sapiens
ccatgctagctgtct

SEQ ID NO: 261391 - DNA, 15 bp, Homo sapiens
tccatgctagctgtc

SEQ ID NO: 261392 - DNA, 15 bp, Homo sapiens
gtccatgctagctgt

SEQ ID NO: 261393 - DNA, 15 bp, Homo sapiens
tgtccatgctagctg

SEQ ID NO: 261394 - DNA, 15 bp, Homo sapiens
gtgtccatgctagct

SEQ ID NO: 261395 - DNA, 15 bp, Homo sapiens
tgtgtccatgctagc

SEQ ID NO: 261396 - DNA, 15 bp, Homo sapiens
atgtgtccatgctag

SEQ ID NO: 261397 - DNA, 15 bp, Homo sapiens
aatgtgtccatgcta

SEQ ID NO: 261398 - DNA, 15 bp, Homo sapiens
aaatgtgtccatgct

SEQ ID NO: 261399 - DNA, 15 bp, Homo sapiens
gaaatgtgtccatgc

SEQ ID NO: 261400 - DNA, 15 bp, Homo sapiens
tgaaatgtgtccatg

SEQ ID NO: 261401 - DNA, 15 bp, Homo sapiens
atgaaatgtgtccat

SEQ ID NO: 261402 - DNA, 15 bp, Homo sapiens
tatgaaatgtgtcca

SEQ ID NO: 261403 - DNA, 15 bp, Homo sapiens
gtatgaaatgtgtcc

SEQ ID NO: 261404 - DNA, 15 bp, Homo sapiens
tgtatgaaatgtgtc

SEQ ID NO: 261405 - DNA, 15 bp, Homo sapiens
atgtatgaaatgtgt

SEQ ID NO: 261406 - DNA, 15 bp, Homo sapiens
catgtatgaaatgtg

SEQ ID NO: 261407 - DNA, 15 bp, Homo sapiens
acatgtatgaaatgt

SEQ ID NO: 261408 - DNA, 15 bp, Homo sapiens
gacatgtatgaaatg

SEQ ID NO: 261409 - DNA, 15 bp, Homo sapiens
agacatgtatgaaat

SEQ ID NO: 261410 - DNA, 15 bp, Homo sapiens
aagacatgtatgaaa

SEQ ID NO: 261411 - DNA, 15 bp, Homo sapiens
aaagacatgtatgaa

SEQ ID NO: 261412 - DNA, 15 bp, Homo sapiens
taaagacatgtatga

SEQ ID NO: 261413 - DNA, 15 bp, Homo sapiens
ttaaagacatgtatg

SEQ ID NO: 261414 - DNA, 15 bp, Homo sapiens
tttaaagacatgtat

SEQ ID NO: 261415 - DNA, 15 bp, Homo sapiens
ttttaaagacatgta

SEQ ID NO: 261416 - DNA, 15 bp, Homo sapiens
tttttaaagacatgt

SEQ ID NO: 261417 - DNA, 15 bp, Homo sapiens
atttttaaagacatg

SEQ ID NO: 261418 - DNA, 15 bp, Homo sapiens
aatttttaaagacat

SEQ ID NO: 261419 - DNA, 15 bp, Homo sapiens
gaatttttaaagaca

SEQ ID NO: 261420 - DNA, 15 bp, Homo sapiens
tgaatttttaaagac

SEQ ID NO: 261421 - DNA, 15 bp, Homo sapiens
ttgaatttttaaaga

SEQ ID NO: 261422 - DNA, 15 bp, Homo sapiens
tttgaatttttaaag

SEQ ID NO: 261423 - DNA, 15 bp, Homo sapiens
ttttgaatttttaaa

SEQ ID NO: 261424 - DNA, 15 bp, Homo sapiens
attttgaatttttaa

SEQ ID NO: 261425 - DNA, 15 bp, Homo sapiens
aattttgaattttta

SEQ ID NO: 261426 - DNA, 15 bp, Homo sapiens
taattttgaattttt

SEQ ID NO: 261427 - DNA, 15 bp, Homo sapiens
ataattttgaatttt

SEQ ID NO: 261428 - DNA, 15 bp, Homo sapiens
aataattttgaattt

SEQ ID NO: 261429 - DNA, 15 bp, Homo sapiens
taataattttgaatt

SEQ ID NO: 261430 - DNA, 15 bp, Homo sapiens
ctaataattttgaat

SEQ ID NO: 261431 - DNA, 15 bp, Homo sapiens
actaataattttgaa

SEQ ID NO: 261432 - DNA, 15 bp, Homo sapiens
aactaataattttga

SEQ ID NO: 261433 - DNA, 15 bp, Homo sapiens
taactaataattttg

SEQ ID NO: 261434 - DNA, 15 bp, Homo sapiens
ataactaataatttt

SEQ ID NO: 261435 - DNA, 15 bp, Homo sapiens
aataactaataattt

SEQ ID NO: 261436 - DNA, 15 bp, Homo sapiens
gaataactaataatt

SEQ ID NO: 261437 - DNA, 15 bp, Homo sapiens
tgaataactaataat

SEQ ID NO: 261438 - DNA, 15 bp, Homo sapiens
ctgaataactaataa

SEQ ID NO: 261439 - DNA, 15 bp, Homo sapiens
actgaataactaata

SEQ ID NO: 261440 - DNA, 15 bp, Homo sapiens
cactgaataactaat

SEQ ID NO: 261441 - DNA, 15 bp, Homo sapiens
ccactgaataactaa

SEQ ID NO: 261442 - DNA, 15 bp, Homo sapiens
accactgaataacta

SEQ ID NO: 261443 - DNA, 15 bp, Homo sapiens
aaccactgaataact

SEQ ID NO: 261444 - DNA, 15 bp, Homo sapiens
taaccactgaataac

SEQ ID NO: 261445 - DNA, 15 bp, Homo sapiens
gtaaccactgaataa

SEQ ID NO: 261446 - DNA, 15 bp, Homo sapiens
tgtaaccactgaata

SEQ ID NO: 261447 - DNA, 15 bp, Homo sapiens
ttgtaaccactgaat

SEQ ID NO: 261448 - DNA, 15 bp, Homo sapiens
tttgtaaccactgaa

SEQ ID NO: 261449 - DNA, 15 bp, Homo sapiens
atttgtaaccactga

SEQ ID NO: 261450 - DNA, 15 bp, Homo sapiens
catttgtaaccactg

SEQ ID NO: 261451 - DNA, 15 bp, Homo sapiens
ccatttgtaaccact

SEQ ID NO: 261452 - DNA, 15 bp, Homo sapiens
tccatttgtaaccac

SEQ ID NO: 261453 - DNA, 15 bp, Homo sapiens
atccatttgtaacca

SEQ ID NO: 261454 - DNA, 15 bp, Homo sapiens
tatccatttgtaacc

SEQ ID NO: 261455 - DNA, 15 bp, Homo sapiens
ttatccatttgtaac

SEQ ID NO: 261456 - DNA, 15 bp, Homo sapiens
tttatccatttgtaa

SEQ ID NO: 261457 - DNA, 15 bp, Homo sapiens
atttatccatttgta

SEQ ID NO: 261458 - DNA, 15 bp, Homo sapiens
tatttatccatttgt

SEQ ID NO: 261459 - DNA, 15 bp, Homo sapiens
gtatttatccatttg

SEQ ID NO: 261460 - DNA, 15 bp, Homo sapiens
tgtatttatccattt

SEQ ID NO: 261461 - DNA, 15 bp, Homo sapiens
ttgtatttatccatt

SEQ ID NO: 261462 - DNA, 15 bp, Homo sapiens
tttgtatttatccat

SEQ ID NO: 261463 - DNA, 15 bp, Homo sapiens
ctttgtatttatcca

SEQ ID NO: 261464 - DNA, 15 bp, Homo sapiens
cctttgtatttatcc

SEQ ID NO: 261465 - DNA, 15 bp, Homo sapiens
tcctttgtatttatc

SEQ ID NO: 261466 - DNA, 15 bp, Homo sapiens
ttcctttgtatttat

SEQ ID NO: 261467 - DNA, 15 bp, Homo sapiens
cttcctttgtattta

SEQ ID NO: 261468 - DNA, 15 bp, Homo sapiens
gcttcctttgtattt

SEQ ID NO: 261469 - DNA, 15 bp, Homo sapiens
agcttcctttgtatt

SEQ ID NO: 261470 - DNA, 15 bp, Homo sapiens
tagcttcctttgtat

SEQ ID NO: 261471 - DNA, 15 bp, Homo sapiens
atagcttcctttgta

SEQ ID NO: 261472 - DNA, 15 bp, Homo sapiens
aatagcttcctttgt

SEQ ID NO: 261473 - DNA, 15 bp, Homo sapiens
aaatagcttcctttg

SEQ ID NO: 261474 - DNA, 15 bp, Homo sapiens
caaatagcttccttt

SEQ ID NO: 261475 - DNA, 15 bp, Homo sapiens
acaaatagcttcctt

SEQ ID NO: 261476 - DNA, 15 bp, Homo sapiens
aacaaatagcttcct

SEQ ID NO: 261477 - DNA, 15 bp, Homo sapiens
gaacaaatagcttcc

SEQ ID NO: 261478 - DNA, 15 bp, Homo sapiens
tgaacaaatagcttc

SEQ ID NO: 261479 - DNA, 15 bp, Homo sapiens
atgaacaaatagctt

SEQ ID NO: 261480 - DNA, 15 bp, Homo sapiens
aatgaacaaatagct

SEQ ID NO: 261481 - DNA, 15 bp, Homo sapiens
aaatgaacaaatagc

SEQ ID NO: 261482 - DNA, 15 bp, Homo sapiens
aaaatgaacaaatag

SEQ ID NO: 261483 - DNA, 15 bp, Homo sapiens
taaaatgaacaaata

SEQ ID NO: 261484 - DNA, 15 bp, Homo sapiens
ctaaaatgaacaaat

SEQ ID NO: 261485 - DNA, 15 bp, Homo sapiens
actaaaatgaacaaa

SEQ ID NO: 261486 - DNA, 15 bp, Homo sapiens
aactaaaatgaacaa

SEQ ID NO: 261487 - DNA, 15 bp, Homo sapiens
taactaaaatgaaca

SEQ ID NO: 261488 - DNA, 15 bp, Homo sapiens
ttaactaaaatgaac

SEQ ID NO: 261489 - DNA, 15 bp, Homo sapiens
gttaactaaaatgaa

SEQ ID NO: 261490 - DNA, 15 bp, Homo sapiens
agttaactaaaatga

SEQ ID NO: 261491 - DNA, 15 bp, Homo sapiens
cagttaactaaaatg

SEQ ID NO: 261492 - DNA, 15 bp, Homo sapiens
acagttaactaaaat

SEQ ID NO: 261493 - DNA, 15 bp, Homo sapiens
gacagttaactaaaa

SEQ ID NO: 261494 - DNA, 15 bp, Homo sapiens
tgacagttaactaaa

SEQ ID NO: 261495 - DNA, 15 bp, Homo sapiens
ttgacagttaactaa

SEQ ID NO: 261496 - DNA, 15 bp, Homo sapiens
tttgacagttaacta

SEQ ID NO: 261497 - DNA, 15 bp, Homo sapiens
ttttgacagttaact

SEQ ID NO: 261498 - DNA, 15 bp, Homo sapiens
attttgacagttaac

SEQ ID NO: 261499 - DNA, 15 bp, Homo sapiens
tattttgacagttaa

SEQ ID NO: 261500 - DNA, 15 bp, Homo sapiens
atattttgacagtta

SEQ ID NO: 261501 - DNA, 15 bp, Homo sapiens
catattttgacagtt

SEQ ID NO: 261502 - DNA, 15 bp, Homo sapiens
acatattttgacagt

SEQ ID NO: 261503 - DNA, 15 bp, Homo sapiens
gacatattttgacag

SEQ ID NO: 261504 - DNA, 15 bp, Homo sapiens
tgacatattttgaca

SEQ ID NO: 261505 - DNA, 15 bp, Homo sapiens
atgacatattttgac

SEQ ID NO: 261506 - DNA, 15 bp, Homo sapiens
tatgacatattttga

SEQ ID NO: 261507 - DNA, 15 bp, Homo sapiens
atatgacatattttg

SEQ ID NO: 261508 - DNA, 15 bp, Homo sapiens
aatatgacatatttt

SEQ ID NO: 261509 - DNA, 15 bp, Homo sapiens
aaatatgacatattt

SEQ ID NO: 261510 - DNA, 15 bp, Homo sapiens
aaaatatgacatatt

SEQ ID NO: 261511 - DNA, 15 bp, Homo sapiens
aaaaatatgacatat

SEQ ID NO: 261512 - DNA, 15 bp, Homo sapiens
aaaaaatatgacata

SEQ ID NO: 261513 - DNA, 15 bp, Homo sapiens
caaaaaatatgacat

SEQ ID NO: 261514 - DNA, 15 bp, Homo sapiens
tcaaaaaatatgaca

SEQ ID NO: 261515 - DNA, 15 bp, Homo sapiens
ctcaaaaaatatgac

SEQ ID NO: 261516 - DNA, 15 bp, Homo sapiens
tctcaaaaaatatga

SEQ ID NO: 261517 - DNA, 15 bp, Homo sapiens
ctctcaaaaaatatg

SEQ ID NO: 261518 - DNA, 15 bp, Homo sapiens
tctctcaaaaaatat

SEQ ID NO: 261519 - DNA, 15 bp, Homo sapiens
ttctctcaaaaaata

SEQ ID NO: 261520 - DNA, 15 bp, Homo sapiens
gttctctcaaaaaat

SEQ ID NO: 261521 - DNA, 15 bp, Homo sapiens
tgttctctcaaaaaa

SEQ ID NO: 261522 - DNA, 15 bp, Homo sapiens
ctgttctctcaaaaa

SEQ ID NO: 261523 - DNA, 15 bp, Homo sapiens
actgttctctcaaaa

SEQ ID NO: 261524 - DNA, 15 bp, Homo sapiens
aactgttctctcaaa

SEQ ID NO: 261525 - DNA, 15 bp, Homo sapiens
aaactgttctctcaa

SEQ ID NO: 261526 - DNA, 15 bp, Homo sapiens
aaaactgttctctca

SEQ ID NO: 261527 - DNA, 15 bp, Homo sapiens
aaaaactgttctctc

SEQ ID NO: 261528 - DNA, 15 bp, Homo sapiens
caaaaactgttctct

SEQ ID NO: 261529 - DNA, 15 bp, Homo sapiens
gcaaaaactgttctc

SEQ ID NO: 261530 - DNA, 15 bp, Homo sapiens
tgcaaaaactgttct

SEQ ID NO: 261531 - DNA, 15 bp, Homo sapiens
atgcaaaaactgttc

SEQ ID NO: 261532 - DNA, 15 bp, Homo sapiens
gatgcaaaaactgtt

SEQ ID NO: 261533 - DNA, 15 bp, Homo sapiens
tgatgcaaaaactgt

SEQ ID NO: 261534 - DNA, 15 bp, Homo sapiens
ctgatgcaaaaactg

SEQ ID NO: 261535 - DNA, 15 bp, Homo sapiens
cctgatgcaaaaact

SEQ ID NO: 261536 - DNA, 15 bp, Homo sapiens
gcctgatgcaaaaac

SEQ ID NO: 261537 - DNA, 15 bp, Homo sapiens
cgcctgatgcaaaaa

SEQ ID NO: 261538 - DNA, 15 bp, Homo sapiens
tcgcctgatgcaaaa

SEQ ID NO: 261539 - DNA, 15 bp, Homo sapiens
ttcgcctgatgcaaa

SEQ ID NO: 261540 - DNA, 15 bp, Homo sapiens
cttcgcctgatgcaa

SEQ ID NO: 261541 - DNA, 15 bp, Homo sapiens
tcttcgcctgatgca

SEQ ID NO: 261542 - DNA, 15 bp, Homo sapiens
ctcttcgcctgatgc

SEQ ID NO: 261543 - DNA, 15 bp, Homo sapiens
tctcttcgcctgatg

SEQ ID NO: 261544 - DNA, 15 bp, Homo sapiens
ttctcttcgcctgat

SEQ ID NO: 261545 - DNA, 15 bp, Homo sapiens
tttctcttcgcctga

SEQ ID NO: 261546 - DNA, 15 bp, Homo sapiens
ctttctcttcgcctg

SEQ ID NO: 261547 - DNA, 15 bp, Homo sapiens
tctttctcttcgcct

SEQ ID NO: 261548 - DNA, 15 bp, Homo sapiens
ttctttctcttcgcc

SEQ ID NO: 261549 - DNA, 15 bp, Homo sapiens
cttctttctcttcgc

SEQ ID NO: 261550 - DNA, 15 bp, Homo sapiens
acttctttctcttcg

SEQ ID NO: 261551 - DNA, 15 bp, Homo sapiens
aacttctttctcttc

SEQ ID NO: 261552 - DNA, 15 bp, Homo sapiens
caacttctttctctt

SEQ ID NO: 261553 - DNA, 15 bp, Homo sapiens
ccaacttctttctct

SEQ ID NO: 261554 - DNA, 15 bp, Homo sapiens
accaacttctttctc

SEQ ID NO: 261555 - DNA, 15 bp, Homo sapiens
aaccaacttctttct

SEQ ID NO: 261556 - DNA, 15 bp, Homo sapiens
aaaccaacttctttc

SEQ ID NO: 261557 - DNA, 15 bp, Homo sapiens
aaaaccaacttcttt

SEQ ID NO: 261558 - DNA, 15 bp, Homo sapiens
taaaaccaacttctt

SEQ ID NO: 261559 - DNA, 15 bp, Homo sapiens
ataaaaccaacttct

SEQ ID NO: 261560 - DNA, 15 bp, Homo sapiens
tataaaaccaacttc

SEQ ID NO: 261561 - DNA, 15 bp, Homo sapiens
atataaaaccaactt

SEQ ID NO: 261562 - DNA, 15 bp, Homo sapiens
catataaaaccaact

SEQ ID NO: 261563 - DNA, 15 bp, Homo sapiens
acatataaaaccaac

SEQ ID NO: 261564 - DNA, 15 bp, Homo sapiens
tacatataaaaccaa

SEQ ID NO: 261565 - DNA, 15 bp, Homo sapiens
atacatataaaacca

SEQ ID NO: 261566 - DNA, 15 bp, Homo sapiens
tatacatataaaacc

SEQ ID NO: 261567 - DNA, 15 bp, Homo sapiens
atatacatataaaac

SEQ ID NO: 261568 - DNA, 15 bp, Homo sapiens
tatatacatataaaa

SEQ ID NO: 261569 - DNA, 15 bp, Homo sapiens
ttatatacatataaa

SEQ ID NO: 261570 - DNA, 15 bp, Homo sapiens
gttatatacatataa

SEQ ID NO: 261571 - DNA, 15 bp, Homo sapiens
ggttatatacatata

SEQ ID NO: 261572 - DNA, 15 bp, Homo sapiens
aggttatatacatat

SEQ ID NO: 261573 - DNA, 15 bp, Homo sapiens
aaggttatatacata

SEQ ID NO: 261574 - DNA, 15 bp, Homo sapiens
taaggttatatacat

SEQ ID NO: 261575 - DNA, 15 bp, Homo sapiens
ataaggttatataca

SEQ ID NO: 261576 - DNA, 15 bp, Homo sapiens
aataaggttatatac

SEQ ID NO: 261577 - DNA, 15 bp, Homo sapiens
aaataaggttatata

SEQ ID NO: 261578 - DNA, 15 bp, Homo sapiens
aaaataaggttatat

SEQ ID NO: 261579 - DNA, 15 bp, Homo sapiens
aaaaataaggttata

SEQ ID NO: 261580 - DNA, 15 bp, Homo sapiens
aaaaaataaggttat

SEQ ID NO: 261581 - DNA, 15 bp, Homo sapiens
gaaaaaataaggtta

SEQ ID NO: 261582 - DNA, 15 bp, Homo sapiens
agaaaaaataaggtt

SEQ ID NO: 261583 - DNA, 15 bp, Homo sapiens
gagaaaaaataaggt

SEQ ID NO: 261584 - DNA, 15 bp, Homo sapiens
agagaaaaaataagg

SEQ ID NO: 261585 - DNA, 15 bp, Homo sapiens
aagagaaaaaataag

SEQ ID NO: 261586 - DNA, 15 bp, Homo sapiens
aaagagaaaaaataa

SEQ ID NO: 261587 - DNA, 15 bp, Homo sapiens
caaagagaaaaaata

SEQ ID NO: 261588 - DNA, 15 bp, Homo sapiens
gcaaagagaaaaaat

SEQ ID NO: 261589 - DNA, 15 bp, Homo sapiens
ggcaaagagaaaaaa

SEQ ID NO: 261590 - DNA, 15 bp, Homo sapiens
aggcaaagagaaaaa

SEQ ID NO: 261591 - DNA, 15 bp, Homo sapiens
gaggcaaagagaaaa

SEQ ID NO: 261592 - DNA, 15 bp, Homo sapiens
agaggcaaagagaaa

SEQ ID NO: 261593 - DNA, 15 bp, Homo sapiens
aagaggcaaagagaa

SEQ ID NO: 261594 - DNA, 15 bp, Homo sapiens
taagaggcaaagaga

SEQ ID NO: 261595 - DNA, 15 bp, Homo sapiens
ataagaggcaaagag

SEQ ID NO: 261596 - DNA, 15 bp, Homo sapiens
aataagaggcaaaga

SEQ ID NO: 261597 - DNA, 15 bp, Homo sapiens
aaataagaggcaaag

SEQ ID NO: 261598 - DNA, 15 bp, Homo sapiens
aaaataagaggcaaa

SEQ ID NO: 261599 - DNA, 15 bp, Homo sapiens
aaaaataagaggcaa

SEQ ID NO: 261600 - DNA, 15 bp, Homo sapiens
gaaaaataagaggca

SEQ ID NO: 261601 - DNA, 15 bp, Homo sapiens
tgaaaaataagaggc

SEQ ID NO: 261602 - DNA, 15 bp, Homo sapiens
atgaaaaataagagg

SEQ ID NO: 261603 - DNA, 15 bp, Homo sapiens
catgaaaaataagag

SEQ ID NO: 261604 - DNA, 15 bp, Homo sapiens
gcatgaaaaataaga

SEQ ID NO: 261605 - DNA, 15 bp, Homo sapiens
agcatgaaaaataag

SEQ ID NO: 261606 - DNA, 15 bp, Homo sapiens
tagcatgaaaaataa

SEQ ID NO: 261607 - DNA, 15 bp, Homo sapiens
ttagcatgaaaaata

SEQ ID NO: 261608 - DNA, 15 bp, Homo sapiens
tttagcatgaaaaat

SEQ ID NO: 261609 - DNA, 15 bp, Homo sapiens
ttttagcatgaaaaa

SEQ ID NO: 261610 - DNA, 15 bp, Homo sapiens
cttttagcatgaaaa

SEQ ID NO: 261611 - DNA, 15 bp, Homo sapiens
acttttagcatgaaa

SEQ ID NO: 261612 - DNA, 15 bp, Homo sapiens
aacttttagcatgaa

SEQ ID NO: 261613 - DNA, 15 bp, Homo sapiens
taacttttagcatga

SEQ ID NO: 261614 - DNA, 15 bp, Homo sapiens
ttaacttttagcatg

SEQ ID NO: 261615 - DNA, 15 bp, Homo sapiens
tttaacttttagcat

SEQ ID NO: 261616 - DNA, 15 bp, Homo sapiens
atttaacttttagca

SEQ ID NO: 261617 - DNA, 15 bp, Homo sapiens
tatttaacttttagc

SEQ ID NO: 261618 - DNA, 15 bp, Homo sapiens
atatttaacttttag

SEQ ID NO: 261619 - DNA, 15 bp, Homo sapiens
tatatttaactttta

SEQ ID NO: 261620 - DNA, 15 bp, Homo sapiens
atatatttaactttt

SEQ ID NO: 261621 - DNA, 15 bp, Homo sapiens
tatatatttaacttt

SEQ ID NO: 261622 - DNA, 15 bp, Homo sapiens
ttatatatttaactt

SEQ ID NO: 261623 - DNA, 15 bp, Homo sapiens
gttatatatttaact

SEQ ID NO: 261624 - DNA, 15 bp, Homo sapiens
tgttatatatttaac

SEQ ID NO: 261625 - DNA, 15 bp, Homo sapiens
atgttatatatttaa

SEQ ID NO: 261626 - DNA, 15 bp, Homo sapiens
tatgttatatattta

SEQ ID NO: 261627 - DNA, 15 bp, Homo sapiens
atatgttatatattt

SEQ ID NO: 261628 - DNA, 15 bp, Homo sapiens
catatgttatatatt

SEQ ID NO: 261629 - DNA, 15 bp, Homo sapiens
acatatgttatatat

SEQ ID NO: 261630 - DNA, 15 bp, Homo sapiens
cacatatgttatata

SEQ ID NO: 261631 - DNA, 15 bp, Homo sapiens
acacatatgttatat

SEQ ID NO: 261632 - DNA, 15 bp, Homo sapiens
tacacatatgttata

SEQ ID NO: 261633 - DNA, 15 bp, Homo sapiens
atacacatatgttat

SEQ ID NO: 261634 - DNA, 15 bp, Homo sapiens
tatacacatatgtta

SEQ ID NO: 261635 - DNA, 15 bp, Homo sapiens
atatacacatatgtt

SEQ ID NO: 261636 - DNA, 15 bp, Homo sapiens
tatatacacatatgt

SEQ ID NO: 261637 - DNA, 15 bp, Homo sapiens
atatatacacatatg

SEQ ID NO: 261638 - DNA, 15 bp, Homo sapiens
tatatatacacatat

SEQ ID NO: 261639 - DNA, 15 bp, Homo sapiens
ttatatatacacata

SEQ ID NO: 261640 - DNA, 15 bp, Homo sapiens
gttatatatacacat

SEQ ID NO: 261641 - DNA, 15 bp, Homo sapiens
ggttatatatacaca

SEQ ID NO: 261642 - DNA, 15 bp, Homo sapiens
tggttatatatacac

SEQ ID NO: 261643 - DNA, 15 bp, Homo sapiens
ttggttatatataca

SEQ ID NO: 261644 - DNA, 15 bp, Homo sapiens
gttggttatatatac

SEQ ID NO: 261645 - DNA, 15 bp, Homo sapiens
agttggttatatata

SEQ ID NO: 261646 - DNA, 15 bp, Homo sapiens
tagttggttatatat

SEQ ID NO: 261647 - DNA, 15 bp, Homo sapiens
atagttggttatata

SEQ ID NO: 261648 - DNA, 15 bp, Homo sapiens
aatagttggttatat

SEQ ID NO: 261649 - DNA, 15 bp, Homo sapiens
aaatagttggttata

SEQ ID NO: 261650 - DNA, 15 bp, Homo sapiens
aaaatagttggttat

SEQ ID NO: 261651 - DNA, 15 bp, Homo sapiens
gaaaatagttggtta

SEQ ID NO: 261652 - DNA, 15 bp, Homo sapiens
agaaaatagttggtt

SEQ ID NO: 261653 - DNA, 15 bp, Homo sapiens
gagaaaatagttggt

SEQ ID NO: 261654 - DNA, 15 bp, Homo sapiens
agagaaaatagttgg

SEQ ID NO: 261655 - DNA, 15 bp, Homo sapiens
aagagaaaatagttg

SEQ ID NO: 261656 - DNA, 15 bp, Homo sapiens
aaagagaaaatagtt

SEQ ID NO: 261657 - DNA, 15 bp, Homo sapiens
caaagagaaaatagt

SEQ ID NO: 261658 - DNA, 15 bp, Homo sapiens
gcaaagagaaaatag

SEQ ID NO: 261659 - DNA, 15 bp, Homo sapiens
ggcaaagagaaaata

SEQ ID NO: 261660 - DNA, 15 bp, Homo sapiens
aggcaaagagaaaat

SEQ ID NO: 261661 - DNA, 15 bp, Homo sapiens
aaaaaataagaggca

SEQ ID NO: 261662 - DNA, 15 bp, Homo sapiens
aaaaaaataagaggc

SEQ ID NO: 261663 - DNA, 15 bp, Homo sapiens
taaaaaaataagagg

SEQ ID NO: 261664 - DNA, 15 bp, Homo sapiens
ttaaaaaaataagag

SEQ ID NO: 261665 - DNA, 15 bp, Homo sapiens
attaaaaaaataaga

SEQ ID NO: 261666 - DNA, 15 bp, Homo sapiens
cattaaaaaaataag

SEQ ID NO: 261667 - DNA, 15 bp, Homo sapiens
gcattaaaaaaataa

SEQ ID NO: 261668 - DNA, 15 bp, Homo sapiens
ggcattaaaaaaata

SEQ ID NO: 261669 - DNA, 15 bp, Homo sapiens
tggcattaaaaaaat

SEQ ID NO: 261670 - DNA, 15 bp, Homo sapiens
ttggcattaaaaaaa

SEQ ID NO: 261671 - DNA, 15 bp, Homo sapiens
tttggcattaaaaaa

SEQ ID NO: 261672 - DNA, 15 bp, Homo sapiens
ttttggcattaaaaa

SEQ ID NO: 261673 - DNA, 15 bp, Homo sapiens
ctttttggcattaaa

SEQ ID NO: 261674 - DNA, 15 bp, Homo sapiens
actttttggcattaa

SEQ ID NO: 261675 - DNA, 15 bp, Homo sapiens
aactttttggcatta

SEQ ID NO: 261676 - DNA, 15 bp, Homo sapiens
taactttttggcatt

SEQ ID NO: 261677 - DNA, 15 bp, Homo sapiens
ttaactttttggcat

SEQ ID NO: 261678 - DNA, 15 bp, Homo sapiens
tttaactttttggca

SEQ ID NO: 261679 - DNA, 15 bp, Homo sapiens
ttttaactttttggc

SEQ ID NO: 261680 - DNA, 15 bp, Homo sapiens
tttttaactttttgg

SEQ ID NO: 261681 - DNA, 15 bp, Homo sapiens
ttttttaactttttg

SEQ ID NO: 261682 - DNA, 15 bp, Homo sapiens
attttttaacttttt

SEQ ID NO: 261683 - DNA, 15 bp, Homo sapiens
tattttttaactttt

SEQ ID NO: 261684 - DNA, 15 bp, Homo sapiens
ttattttttaacttt

SEQ ID NO: 261685 - DNA, 15 bp, Homo sapiens
cttattttttaactt

SEQ ID NO: 261686 - DNA, 15 bp, Homo sapiens
tcttattttttaact

SEQ ID NO: 261687 - DNA, 15 bp, Homo sapiens
tttcttattttttaa

SEQ ID NO: 261688 - DNA, 15 bp, Homo sapiens
ttttcttatttttta

SEQ ID NO: 261689 - DNA, 15 bp, Homo sapiens
ttttttcttattttt

SEQ ID NO: 261690 - DNA, 15 bp, Homo sapiens
attttttcttatttt

SEQ ID NO: 261691 - DNA, 15 bp, Homo sapiens
tattttttcttattt

SEQ ID NO: 261692 - DNA, 15 bp, Homo sapiens
ttattttttcttatt

SEQ ID NO: 261693 - DNA, 15 bp, Homo sapiens
cttattttttcttat

SEQ ID NO: 261694 - DNA, 15 bp, Homo sapiens
tcttattttttctta

SEQ ID NO: 261695 - DNA, 15 bp, Homo sapiens
atcttattttttctt

SEQ ID NO: 261696 - DNA, 15 bp, Homo sapiens
aatcttattttttct

SEQ ID NO: 261697 - DNA, 15 bp, Homo sapiens
taatcttattttttc

SEQ ID NO: 261698 - DNA, 15 bp, Homo sapiens
ctaatcttatttttt

SEQ ID NO: 261699 - DNA, 15 bp, Homo sapiens
tctaatcttattttt

SEQ ID NO: 261700 - DNA, 15 bp, Homo sapiens
ctctaatcttatttt

SEQ ID NO: 261701 - DNA, 15 bp, Homo sapiens
actctaatcttattt

SEQ ID NO: 261702 - DNA, 15 bp, Homo sapiens
aactctaatcttatt

SEQ ID NO: 261703 - DNA, 15 bp, Homo sapiens
gaactctaatcttat

SEQ ID NO: 261704 - DNA, 15 bp, Homo sapiens
agaactctaatctta

SEQ ID NO: 261705 - DNA, 15 bp, Homo sapiens
aagaactctaatctt

SEQ ID NO: 261706 - DNA, 15 bp, Homo sapiens
gaagaactctaatct

SEQ ID NO: 261707 - DNA, 15 bp, Homo sapiens
agaagaactctaatc

SEQ ID NO: 261708 - DNA, 15 bp, Homo sapiens
tagaagaactctaat

SEQ ID NO: 261709 - DNA, 15 bp, Homo sapiens
ctagaagaactctaa

SEQ ID NO: 261710 - DNA, 15 bp, Homo sapiens
actagaagaactcta

SEQ ID NO: 261711 - DNA, 15 bp, Homo sapiens
gactagaagaactct

SEQ ID NO: 261712 - DNA, 15 bp, Homo sapiens
agactagaagaactc

SEQ ID NO: 261713 - DNA, 15 bp, Homo sapiens
tagactagaagaact

SEQ ID NO: 261714 - DNA, 15 bp, Homo sapiens
ttagactagaagaac

SEQ ID NO: 261715 - DNA, 15 bp, Homo sapiens
attagactagaagaa

SEQ ID NO: 261716 - DNA, 15 bp, Homo sapiens
aattagactagaaga

SEQ ID NO: 261717 - DNA, 15 bp, Homo sapiens
aaattagactagaag

SEQ ID NO: 261718 - DNA, 15 bp, Homo sapiens
aaaattagactagaa

SEQ ID NO: 261719 - DNA, 15 bp, Homo sapiens
aaaaattagactaga

SEQ ID NO: 261720 - DNA, 15 bp, Homo sapiens
aaaaaattagactag

SEQ ID NO: 261721 - DNA, 15 bp, Homo sapiens
aaaaaaattagacta

SEQ ID NO: 261722 - DNA, 15 bp, Homo sapiens
taaaaaaattagact

SEQ ID NO: 261723 - DNA, 15 bp, Homo sapiens
ataaaaaaattagac

SEQ ID NO: 261724 - DNA, 15 bp, Homo sapiens
cataaaaaaattaga

SEQ ID NO: 261725 - DNA, 15 bp, Homo sapiens
gcataaaaaaattag

SEQ ID NO: 261726 - DNA, 15 bp, Homo sapiens
agcataaaaaaatta

SEQ ID NO: 261727 - DNA, 15 bp, Homo sapiens
tagcataaaaaaatt

SEQ ID NO: 261728 - DNA, 15 bp, Homo sapiens
ttagcataaaaaaat

SEQ ID NO: 261729 - DNA, 15 bp, Homo sapiens
tttagcataaaaaaa

SEQ ID NO: 261730 - DNA, 15 bp, Homo sapiens
ttttagcataaaaaa

SEQ ID NO: 261731 - DNA, 15 bp, Homo sapiens
cttttagcataaaaa

SEQ ID NO: 261732 - DNA, 15 bp, Homo sapiens
ccttttagcataaaa

SEQ ID NO: 261733 - DNA, 15 bp, Homo sapiens
accttttagcataaa

SEQ ID NO: 261734 - DNA, 15 bp, Homo sapiens
aaccttttagcataa

SEQ ID NO: 261735 - DNA, 15 bp, Homo sapiens
taaccttttagcata

SEQ ID NO: 261736 - DNA, 15 bp, Homo sapiens
ttaaccttttagcat

SEQ ID NO: 261737 - DNA, 15 bp, Homo sapiens
tttaaccttttagca

SEQ ID NO: 261738 - DNA, 15 bp, Homo sapiens
atttaaccttttagc

SEQ ID NO: 261739 - DNA, 15 bp, Homo sapiens
tatttaaccttttag

SEQ ID NO: 261740 - DNA, 15 bp, Homo sapiens
gtatttaacctttta

SEQ ID NO: 261741 - DNA, 15 bp, Homo sapiens
tgtatttaacctttt

SEQ ID NO: 261742 - DNA, 15 bp, Homo sapiens
ctgtatttaaccttt

SEQ ID NO: 261743 - DNA, 15 bp, Homo sapiens
tctgtatttaacctt

SEQ ID NO: 261744 - DNA, 15 bp, Homo sapiens
ctctgtatttaacct

SEQ ID NO: 261745 - DNA, 15 bp, Homo sapiens
tctctgtatttaacc

SEQ ID NO: 261746 - DNA, 15 bp, Homo sapiens
gtctctgtatttaac

SEQ ID NO: 261747 - DNA, 15 bp, Homo sapiens
tgtctctgtatttaa

SEQ ID NO: 261748 - DNA, 15 bp, Homo sapiens
ctgtctctgtattta

SEQ ID NO: 261749 - DNA, 15 bp, Homo sapiens
tctgtctctgtattt

SEQ ID NO: 261750 - DNA, 15 bp, Homo sapiens
ctctgtctctgtatt

SEQ ID NO: 261751 - DNA, 15 bp, Homo sapiens
tctctgtctctgtat

SEQ ID NO: 261752 - DNA, 15 bp, Homo sapiens
ttctctgtctctgta

SEQ ID NO: 261753 - DNA, 15 bp, Homo sapiens
tttctctgtctctgt

SEQ ID NO: 261754 - DNA, 15 bp, Homo sapiens
ctttctctgtctctg

SEQ ID NO: 261755 - DNA, 15 bp, Homo sapiens
tctttctctgtctct

SEQ ID NO: 261756 - DNA, 15 bp, Homo sapiens
ttctttctctgtctc

SEQ ID NO: 261757 - DNA, 15 bp, Homo sapiens
attctttctctgtct

SEQ ID NO: 261758 - DNA, 15 bp, Homo sapiens
aattctttctctgtc

SEQ ID NO: 261759 - DNA, 15 bp, Homo sapiens
aaattctttctctgt

SEQ ID NO: 261760 - DNA, 15 bp, Homo sapiens
aaaattctttctctg

SEQ ID NO: 261761 - DNA, 15 bp, Homo sapiens
taaaattctttctct

SEQ ID NO: 261762 - DNA, 15 bp, Homo sapiens
ataaaattctttctc

SEQ ID NO: 261763 - DNA, 15 bp, Homo sapiens
ttataaaattctttc

SEQ ID NO: 261764 - DNA, 15 bp, Homo sapiens
tttataaaattcttt

SEQ ID NO: 261765 - DNA, 15 bp, Homo sapiens
ttttataaaattctt

SEQ ID NO: 261766 - DNA, 15 bp, Homo sapiens
tttttataaaattct

SEQ ID NO: 261767 - DNA, 15 bp, Homo sapiens
gtttttataaaattc

SEQ ID NO: 261768 - DNA, 15 bp, Homo sapiens
agtttttataaaatt

SEQ ID NO: 261769 - DNA, 15 bp, Homo sapiens
cagtttttataaaat

SEQ ID NO: 261770 - DNA, 15 bp, Homo sapiens
tcagtttttataaaa

SEQ ID NO: 261771 - DNA, 15 bp, Homo sapiens
atcagtttttataaa

SEQ ID NO: 261772 - DNA, 15 bp, Homo sapiens
catcagtttttataa

SEQ ID NO: 261773 - DNA, 15 bp, Homo sapiens
acatcagtttttata

SEQ ID NO: 261774 - DNA, 15 bp, Homo sapiens
gacatcagtttttat

SEQ ID NO: 261775 - DNA, 15 bp, Homo sapiens
agacatcagttttta

SEQ ID NO: 261776 - DNA, 15 bp, Homo sapiens
tagacatcagttttt

SEQ ID NO: 261777 - DNA, 15 bp, Homo sapiens
atagacatcagtttt

SEQ ID NO: 261778 - DNA, 15 bp, Homo sapiens
catagacatcagttt

SEQ ID NO: 261779 - DNA, 15 bp, Homo sapiens
tcatagacatcagtt

SEQ ID NO: 261780 - DNA, 15 bp, Homo sapiens
ctcatagacatcagt

SEQ ID NO: 261781 - DNA, 15 bp, Homo sapiens
gctcatagacatcag

SEQ ID NO: 261782 - DNA, 15 bp, Homo sapiens
tgctcatagacatca

SEQ ID NO: 261783 - DNA, 15 bp, Homo sapiens
ctgctcatagacatc

SEQ ID NO: 261784 - DNA, 15 bp, Homo sapiens
tctgctcatagacat

SEQ ID NO: 261785 - DNA, 15 bp, Homo sapiens
gtctgctcatagaca

SEQ ID NO: 261786 - DNA, 15 bp, Homo sapiens
ggtctgctcatagac

SEQ ID NO: 261787 - DNA, 15 bp, Homo sapiens
aggtctgctcataga

SEQ ID NO: 261788 - DNA, 15 bp, Homo sapiens
aaggtctgctcatag

SEQ ID NO: 261789 - DNA, 15 bp, Homo sapiens
taaggtctgctcata

SEQ ID NO: 261790 - DNA, 15 bp, Homo sapiens
ttaaggtctgctcat

SEQ ID NO: 261791 - DNA, 15 bp, Homo sapiens
tttaaggtctgctca

SEQ ID NO: 261792 - DNA, 15 bp, Homo sapiens
atttaaggtctgctc

SEQ ID NO: 261793 - DNA, 15 bp, Homo sapiens
aatttaaggtctgct

SEQ ID NO: 261794 - DNA, 15 bp, Homo sapiens
taatttaaggtctgc

SEQ ID NO: 261795 - DNA, 15 bp, Homo sapiens
ttaatttaaggtctg

SEQ ID NO: 261796 - DNA, 15 bp, Homo sapiens
attaatttaaggtct

SEQ ID NO: 261797 - DNA, 15 bp, Homo sapiens
cattaatttaaggtc

SEQ ID NO: 261798 - DNA, 15 bp, Homo sapiens
acattaatttaaggt

SEQ ID NO: 261799 - DNA, 15 bp, Homo sapiens
cacattaatttaagg

SEQ ID NO: 261800 - DNA, 15 bp, Homo sapiens
ccacattaatttaag

SEQ ID NO: 261801 - DNA, 15 bp, Homo sapiens
tccacattaatttaa

SEQ ID NO: 261802 - DNA, 15 bp, Homo sapiens
gtccacattaattta

SEQ ID NO: 261803 - DNA, 15 bp, Homo sapiens
agtccacattaattt

SEQ ID NO: 261804 - DNA, 15 bp, Homo sapiens
gagtccacattaatt

SEQ ID NO: 261805 - DNA, 15 bp, Homo sapiens
agagtccacattaat

SEQ ID NO: 261806 - DNA, 15 bp, Homo sapiens
tagagtccacattaa

SEQ ID NO: 261807 - DNA, 15 bp, Homo sapiens
ttagagtccacatta

SEQ ID NO: 261808 - DNA, 15 bp, Homo sapiens
attagagtccacatt

SEQ ID NO: 261809 - DNA, 15 bp, Homo sapiens
aattagagtccacat

SEQ ID NO: 261810 - DNA, 15 bp, Homo sapiens
aaattagagtccaca

SEQ ID NO: 261811 - DNA, 15 bp, Homo sapiens
aaaattagagtccac

SEQ ID NO: 261812 - DNA, 15 bp, Homo sapiens
gaaaattagagtcca

SEQ ID NO: 261813 - DNA, 15 bp, Homo sapiens
ggaaaattagagtcc

SEQ ID NO: 261814 - DNA, 15 bp, Homo sapiens
aggaaaattagagtc

SEQ ID NO: 261815 - DNA, 15 bp, Homo sapiens
aaggaaaattagagt

SEQ ID NO: 261816 - DNA, 15 bp, Homo sapiens
taaggaaaattagag

SEQ ID NO: 261817 - DNA, 15 bp, Homo sapiens
gtaaggaaaattaga

SEQ ID NO: 261818 - DNA, 15 bp, Homo sapiens
agtaaggaaaattag

SEQ ID NO: 261819 - DNA, 15 bp, Homo sapiens
gagtaaggaaaatta

SEQ ID NO: 261820 - DNA, 15 bp, Homo sapiens
tgagtaaggaaaatt

SEQ ID NO: 261821 - DNA, 15 bp, Homo sapiens
ctgagtaaggaaaat

SEQ ID NO: 261822 - DNA, 15 bp, Homo sapiens
tctgagtaaggaaaa

SEQ ID NO: 261823 - DNA, 15 bp, Homo sapiens
atctgagtaaggaaa

SEQ ID NO: 261824 - DNA, 15 bp, Homo sapiens
catctgagtaaggaa

SEQ ID NO: 261825 - DNA, 15 bp, Homo sapiens
acatctgagtaagga

SEQ ID NO: 261826 - DNA, 15 bp, Homo sapiens
aacatctgagtaagg

SEQ ID NO: 261827 - DNA, 15 bp, Homo sapiens
aaacatctgagtaag

SEQ ID NO: 261828 - DNA, 15 bp, Homo sapiens
taaacatctgagtaa

SEQ ID NO: 261829 - DNA, 15 bp, Homo sapiens
ctaaacatctgagta

SEQ ID NO: 261830 - DNA, 15 bp, Homo sapiens
tctaaacatctgagt

SEQ ID NO: 261831 - DNA, 15 bp, Homo sapiens
atctaaacatctgag

SEQ ID NO: 261832 - DNA, 15 bp, Homo sapiens
aatctaaacatctga

SEQ ID NO: 261833 - DNA, 15 bp, Homo sapiens
aaatctaaacatctg

SEQ ID NO: 261834 - DNA, 15 bp, Homo sapiens
taaatctaaacatct

SEQ ID NO: 261835 - DNA, 15 bp, Homo sapiens
ctaaatctaaacatc

SEQ ID NO: 261836 - DNA, 15 bp, Homo sapiens
tctaaatctaaacat

SEQ ID NO: 261837 - DNA, 15 bp, Homo sapiens
ttctaaatctaaaca

SEQ ID NO: 261838 - DNA, 15 bp, Homo sapiens
cttctaaatctaaac

SEQ ID NO: 261839 - DNA, 15 bp, Homo sapiens
tcttctaaatctaaa

SEQ ID NO: 261840 - DNA, 15 bp, Homo sapiens
ctcttctaaatctaa

SEQ ID NO: 261841 - DNA, 15 bp, Homo sapiens
actcttctaaatcta

SEQ ID NO: 261842 - DNA, 15 bp, Homo sapiens
gactcttctaaatct

SEQ ID NO: 261843 - DNA, 15 bp, Homo sapiens
tgactcttctaaatc

SEQ ID NO: 261844 - DNA, 15 bp, Homo sapiens
atgactcttctaaat

SEQ ID NO: 261845 - DNA, 15 bp, Homo sapiens
gatgactcttctaaa

SEQ ID NO: 261846 - DNA, 15 bp, Homo sapiens
agatgactcttctaa

SEQ ID NO: 261847 - DNA, 15 bp, Homo sapiens
gagatgactcttcta

SEQ ID NO: 261848 - DNA, 15 bp, Homo sapiens
ggagatgactcttct

SEQ ID NO: 261849 - DNA, 15 bp, Homo sapiens
tggagatgactcttc

SEQ ID NO: 261850 - DNA, 15 bp, Homo sapiens
gtggagatgactctt

SEQ ID NO: 261851 - DNA, 15 bp, Homo sapiens
tgtggagatgactct

SEQ ID NO: 261852 - DNA, 15 bp, Homo sapiens
gtgtggagatgactc

SEQ ID NO: 261853 - DNA, 15 bp, Homo sapiens
agtgtggagatgact

SEQ ID NO: 261854 - DNA, 15 bp, Homo sapiens
gagtgtggagatgac

SEQ ID NO: 261855 - DNA, 15 bp, Homo sapiens
tgagtgtggagatga

SEQ ID NO: 261856 - DNA, 15 bp, Homo sapiens
ttgagtgtggagatg

SEQ ID NO: 261857 - DNA, 15 bp, Homo sapiens
attgagtgtggagat

SEQ ID NO: 261858 - DNA, 15 bp, Homo sapiens
tattgagtgtggaga

SEQ ID NO: 261859 - DNA, 15 bp, Homo sapiens
ttattgagtgtggag

SEQ ID NO: 261860 - DNA, 15 bp, Homo sapiens
tttattgagtgtgga

SEQ ID NO: 261861 - DNA, 15 bp, Homo sapiens
atttattgagtgtgg

SEQ ID NO: 261862 - DNA, 15 bp, Homo sapiens
catttattgagtgtg

SEQ ID NO: 261863 - DNA, 15 bp, Homo sapiens
acatttattgagtgt

SEQ ID NO: 261864 - DNA, 15 bp, Homo sapiens
tacatttattgagtg

SEQ ID NO: 261865 - DNA, 15 bp, Homo sapiens
atacatttattgagt

SEQ ID NO: 261866 - DNA, 15 bp, Homo sapiens
tatacatttattgag

SEQ ID NO: 261867 - DNA, 15 bp, Homo sapiens
ctatacatttattga

SEQ ID NO: 261868 - DNA, 15 bp, Homo sapiens
tctatacatttattg

SEQ ID NO: 261869 - DNA, 15 bp, Homo sapiens
atctatacatttatt

SEQ ID NO: 261870 - DNA, 15 bp, Homo sapiens
tatctatacatttat

SEQ ID NO: 261871 - DNA, 15 bp, Homo sapiens
ctatctatacattta

SEQ ID NO: 261872 - DNA, 15 bp, Homo sapiens
tctatctatacattt

SEQ ID NO: 261873 - DNA, 15 bp, Homo sapiens
atctatctatacatt

SEQ ID NO: 261874 - DNA, 15 bp, Homo sapiens
tatctatctatacat

SEQ ID NO: 261875 - DNA, 15 bp, Homo sapiens
gtatctatctataca

SEQ ID NO: 261876 - DNA, 15 bp, Homo sapiens
tgtatctatctatac

SEQ ID NO: 261877 - DNA, 15 bp, Homo sapiens
atgtatctatctata

SEQ ID NO: 261878 - DNA, 15 bp, Homo sapiens
catgtatctatctat

SEQ ID NO: 261879 - DNA, 15 bp, Homo sapiens
ccatgtatctatcta

SEQ ID NO: 261880 - DNA, 15 bp, Homo sapiens
accatgtatctatct

SEQ ID NO: 261881 - DNA, 15 bp, Homo sapiens
taccatgtatctatc

SEQ ID NO: 261882 - DNA, 15 bp, Homo sapiens
ctaccatgtatctat

SEQ ID NO: 261883 - DNA, 15 bp, Homo sapiens
actaccatgtatcta

SEQ ID NO: 261884 - DNA, 15 bp, Homo sapiens
aactaccatgtatct

SEQ ID NO: 261885 - DNA, 15 bp, Homo sapiens
aaactaccatgtatc

SEQ ID NO: 261886 - DNA, 15 bp, Homo sapiens
caaactaccatgtat

SEQ ID NO: 261887 - DNA, 15 bp, Homo sapiens
tcaaactaccatgta

SEQ ID NO: 261888 - DNA, 15 bp, Homo sapiens
atcaaactaccatgt

SEQ ID NO: 261889 - DNA, 15 bp, Homo sapiens
tatcaaactaccatg

SEQ ID NO: 261890 - DNA, 15 bp, Homo sapiens
ttatcaaactaccat

SEQ ID NO: 261891 - DNA, 15 bp, Homo sapiens
attatcaaactacca

SEQ ID NO: 261892 - DNA, 15 bp, Homo sapiens
gattatcaaactacc

SEQ ID NO: 261893 - DNA, 15 bp, Homo sapiens
agattatcaaactac

SEQ ID NO: 261894 - DNA, 15 bp, Homo sapiens
cagattatcaaacta

SEQ ID NO: 261895 - DNA, 15 bp, Homo sapiens
gcagattatcaaact

SEQ ID NO: 261896 - DNA, 15 bp, Homo sapiens
agcagattatcaaac

SEQ ID NO: 261897 - DNA, 15 bp, Homo sapiens
aagcagattatcaaa

SEQ ID NO: 261898 - DNA, 15 bp, Homo sapiens
aaagcagattatcaa

SEQ ID NO: 261899 - DNA, 15 bp, Homo sapiens
caaagcagattatca

SEQ ID NO: 261900 - DNA, 15 bp, Homo sapiens
acaaagcagattatc

SEQ ID NO: 261901 - DNA, 15 bp, Homo sapiens
gacaaagcagattat

SEQ ID NO: 261902 - DNA, 15 bp, Homo sapiens
agacaaagcagatta

SEQ ID NO: 261903 - DNA, 15 bp, Homo sapiens
gagacaaagcagatt

SEQ ID NO: 261904 - DNA, 15 bp, Homo sapiens
agagacaaagcagat

SEQ ID NO: 261905 - DNA, 15 bp, Homo sapiens
aagagacaaagcaga

SEQ ID NO: 261906 - DNA, 15 bp, Homo sapiens
aaagagacaaagcag

SEQ ID NO: 261907 - DNA, 15 bp, Homo sapiens
caaagagacaaagca

SEQ ID NO: 261908 - DNA, 15 bp, Homo sapiens
acaaagagacaaagc

SEQ ID NO: 261909 - DNA, 15 bp, Homo sapiens
aacaaagagacaaag

SEQ ID NO: 261910 - DNA, 15 bp, Homo sapiens
gaaaacaaagagaca

SEQ ID NO: 261911 - DNA, 15 bp, Homo sapiens
tgaaaacaaagagac

SEQ ID NO: 261912 - DNA, 15 bp, Homo sapiens
ctgaaaacaaagaga

SEQ ID NO: 261913 - DNA, 15 bp, Homo sapiens
actgaaaacaaagag

SEQ ID NO: 261914 - DNA, 15 bp, Homo sapiens
aactgaaaacaaaga

SEQ ID NO: 261915 - DNA, 15 bp, Homo sapiens
taactgaaaacaaag

SEQ ID NO: 261916 - DNA, 15 bp, Homo sapiens
ctaactgaaaacaaa

SEQ ID NO: 261917 - DNA, 15 bp, Homo sapiens
actaactgaaaacaa

SEQ ID NO: 261918 - DNA, 15 bp, Homo sapiens
cactaactgaaaaca

SEQ ID NO: 261919 - DNA, 15 bp, Homo sapiens
tcactaactgaaaac

SEQ ID NO: 261920 - DNA, 15 bp, Homo sapiens
ttcactaactgaaaa

SEQ ID NO: 261921 - DNA, 15 bp, Homo sapiens
attcactaactgaaa

SEQ ID NO: 261922 - DNA, 15 bp, Homo sapiens
cattcactaactgaa

SEQ ID NO: 261923 - DNA, 15 bp, Homo sapiens
tcattcactaactga

SEQ ID NO: 261924 - DNA, 15 bp, Homo sapiens
ttcattcactaactg

SEQ ID NO: 261925 - DNA, 15 bp, Homo sapiens
tttcattcactaact

SEQ ID NO: 261926 - DNA, 15 bp, Homo sapiens
ctttcattcactaac

SEQ ID NO: 261927 - DNA, 15 bp, Homo sapiens
tctttcattcactaa

SEQ ID NO: 261928 - DNA, 15 bp, Homo sapiens
gtctttcattcacta

SEQ ID NO: 261929 - DNA, 15 bp, Homo sapiens
agtctttcattcact

SEQ ID NO: 261930 - DNA, 15 bp, Homo sapiens
aagtctttcattcac

SEQ ID NO: 261931 - DNA, 15 bp, Homo sapiens
taagtctttcattca

SEQ ID NO: 261932 - DNA, 15 bp, Homo sapiens
ttaagtctttcattc

SEQ ID NO: 261933 - DNA, 15 bp, Homo sapiens
tttaagtctttcatt

SEQ ID NO: 261934 - DNA, 15 bp, Homo sapiens
ttttaagtctttcat

SEQ ID NO: 261935 - DNA, 15 bp, Homo sapiens
attttaagtctttca

SEQ ID NO: 261936 - DNA, 15 bp, Homo sapiens
aattttaagtctttc

SEQ ID NO: 261937 - DNA, 15 bp, Homo sapiens
caattttaagtcttt

SEQ ID NO: 261938 - DNA, 15 bp, Homo sapiens
tcaattttaagtctt

SEQ ID NO: 261939 - DNA, 15 bp, Homo sapiens
atcaattttaagtct

SEQ ID NO: 261940 - DNA, 15 bp, Homo sapiens
aatcaattttaagtc

SEQ ID NO: 261941 - DNA, 15 bp, Homo sapiens
taatcaattttaagt

SEQ ID NO: 261942 - DNA, 15 bp, Homo sapiens
ttaatcaattttaag

SEQ ID NO: 261943 - DNA, 15 bp, Homo sapiens
tttaatcaattttaa

SEQ ID NO: 261944 - DNA, 15 bp, Homo sapiens
atttaatcaatttta

SEQ ID NO: 261945 - DNA, 15 bp, Homo sapiens
aatttaatcaatttt

SEQ ID NO: 261946 - DNA, 15 bp, Homo sapiens
taatttaatcaattt

SEQ ID NO: 261947 - DNA, 15 bp, Homo sapiens
ttaatttaatcaatt

SEQ ID NO: 261948 - DNA, 15 bp, Homo sapiens
tttaatttaatcaat

SEQ ID NO: 261949 - DNA, 15 bp, Homo sapiens
ttttaatttaatcaa

SEQ ID NO: 261950 - DNA, 15 bp, Homo sapiens
tttttaatttaatca

SEQ ID NO: 261951 - DNA, 15 bp, Homo sapiens
ttttttaatttaatc

SEQ ID NO: 261952 - DNA, 15 bp, Homo sapiens
tttttttaatttaat

SEQ ID NO: 261953 - DNA, 15 bp, Homo sapiens
ttttttttaatttaa

SEQ ID NO: 261954 - DNA, 15 bp, Homo sapiens
tttttttttaattta

SEQ ID NO: 261955 - DNA, 15 bp, Homo sapiens
atttttttttaattt

SEQ ID NO: 261956 - DNA, 15 bp, Homo sapiens
aatttttttttaatt

SEQ ID NO: 261957 - DNA, 15 bp, Homo sapiens
aaatttttttttaat

SEQ ID NO: 261958 - DNA, 15 bp, Homo sapiens
caaatttttttttaa

SEQ ID NO: 261959 - DNA, 15 bp, Homo sapiens
acaaattttttttta

SEQ ID NO: 261960 - DNA, 15 bp, Homo sapiens
cgacaaatttttttt

SEQ ID NO: 261961 - DNA, 15 bp, Homo sapiens
acgacaaattttttt

SEQ ID NO: 261962 - DNA, 15 bp, Homo sapiens
aacgacaaatttttt

SEQ ID NO: 261963 - DNA, 15 bp, Homo sapiens
aaacgacaaattttt

SEQ ID NO: 261964 - DNA, 15 bp, Homo sapiens
aaaacgacaaatttt

SEQ ID NO: 261965 - DNA, 15 bp, Homo sapiens
gaaaacgacaaattt

SEQ ID NO: 261966 - DNA, 15 bp, Homo sapiens
tgaaaacgacaaatt

SEQ ID NO: 261967 - DNA, 15 bp, Homo sapiens
atgaaaacgacaaat

SEQ ID NO: 261968 - DNA, 15 bp, Homo sapiens
gatgaaaacgacaaa

SEQ ID NO: 261969 - DNA, 15 bp, Homo sapiens
agatgaaaacgacaa

SEQ ID NO: 261970 - DNA, 15 bp, Homo sapiens
tagatgaaaacgaca

SEQ ID NO: 261971 - DNA, 15 bp, Homo sapiens
ttagatgaaaacgac

SEQ ID NO: 261972 - DNA, 15 bp, Homo sapiens
tttagatgaaaacga

SEQ ID NO: 261973 - DNA, 15 bp, Homo sapiens
gtttagatgaaaacg

SEQ ID NO: 261974 - DNA, 15 bp, Homo sapiens
agtttagatgaaaac

SEQ ID NO: 261975 - DNA, 15 bp, Homo sapiens
gagtttagatgaaaa

SEQ ID NO: 261976 - DNA, 15 bp, Homo sapiens
ggagtttagatgaaa

SEQ ID NO: 261977 - DNA, 15 bp, Homo sapiens
aggagtttagatgaa

SEQ ID NO: 261978 - DNA, 15 bp, Homo sapiens
gaggagtttagatga

SEQ ID NO: 261979 - DNA, 15 bp, Homo sapiens
ggaggagtttagatg

SEQ ID NO: 261980 - DNA, 15 bp, Homo sapiens
aggaggagtttagat

SEQ ID NO: 261981 - DNA, 15 bp, Homo sapiens
aaggaggagtttaga

SEQ ID NO: 261982 - DNA, 15 bp, Homo sapiens
gaaggaggagtttag

SEQ ID NO: 261983 - DNA, 15 bp, Homo sapiens
cgaaggaggagttta

SEQ ID NO: 261984 - DNA, 15 bp, Homo sapiens
ccgaaggaggagttt

SEQ ID NO: 261985 - DNA, 15 bp, Homo sapiens
cccgaaggaggagtt

SEQ ID NO: 261986 - DNA, 15 bp, Homo sapiens
gcccgaaggaggagt

SEQ ID NO: 261987 - DNA, 15 bp, Homo sapiens
ggcccgaaggaggag

SEQ ID NO: 261988 - DNA, 15 bp, Homo sapiens
aggcccgaaggagga

SEQ ID NO: 261989 - DNA, 15 bp, Homo sapiens
aaggcccgaaggagg

SEQ ID NO: 261990 - DNA, 15 bp, Homo sapiens
aaaggcccgaaggag

SEQ ID NO: 261991 - DNA, 15 bp, Homo sapiens
caaaggcccgaagga

SEQ ID NO: 261992 - DNA, 15 bp, Homo sapiens
gcaaaggcccgaagg

SEQ ID NO: 261993 - DNA, 15 bp, Homo sapiens
cgcaaaggcccgaag

SEQ ID NO: 261994 - DNA, 15 bp, Homo sapiens
ccgcaaaggcccgaa

SEQ ID NO: 261995 - DNA, 15 bp, Homo sapiens
cccgcaaaggcccga

SEQ ID NO: 261996 - DNA, 15 bp, Homo sapiens
gcccgcaaaggcccg

SEQ ID NO: 261997 - DNA, 15 bp, Homo sapiens
ggcccgcaaaggccc

SEQ ID NO: 261998 - DNA, 15 bp, Homo sapiens
aggcccgcaaaggcc

SEQ ID NO: 261999 - DNA, 15 bp, Homo sapiens
gaggcccgcaaaggc

SEQ ID NO: 262000 - DNA, 15 bp, Homo sapiens
ggaggcccgcaaagg

SEQ ID NO: 262001 - DNA, 15 bp, Homo sapiens
gggaggcccgcaaag

SEQ ID NO: 262002 - DNA, 15 bp, Homo sapiens
ggggaggcccgcaaa

SEQ ID NO: 262003 - DNA, 15 bp, Homo sapiens
aggggaggcccgcaa

SEQ ID NO: 262004 - DNA, 15 bp, Homo sapiens
aaggggaggcccgca

SEQ ID NO: 262005 - DNA, 15 bp, Homo sapiens
caaggggaggcccgc

SEQ ID NO: 262006 - DNA, 15 bp, Homo sapiens
ccaaggggaggcccg

SEQ ID NO: 262007 - DNA, 15 bp, Homo sapiens
cccaaggggaggccc

SEQ ID NO: 262008 - DNA, 15 bp, Homo sapiens
gcccaaggggaggcc

SEQ ID NO: 262009 - DNA, 15 bp, Homo sapiens
tgcccaaggggaggc

SEQ ID NO: 262010 - DNA, 15 bp, Homo sapiens
ctgcccaaggggagg

SEQ ID NO: 262011 - DNA, 15 bp, Homo sapiens
actgcccaaggggag

SEQ ID NO: 262012 - DNA, 15 bp, Homo sapiens
cactgcccaagggga

SEQ ID NO: 262013 - DNA, 15 bp, Homo sapiens
acactgcccaagggg

SEQ ID NO: 262014 - DNA, 15 bp, Homo sapiens
cacactgcccaaggg

SEQ ID NO: 262015 - DNA, 15 bp, Homo sapiens
acacactgcccaagg

SEQ ID NO: 262016 - DNA, 15 bp, Homo sapiens
cacacactgcccaag

SEQ ID NO: 262017 - DNA, 15 bp, Homo sapiens
gcacacactgcccaa

SEQ ID NO: 262018 - DNA, 15 bp, Homo sapiens
ggcacacactgccca

SEQ ID NO: 262019 - DNA, 15 bp, Homo sapiens
aggcacacactgccc

SEQ ID NO: 262020 - DNA, 15 bp, Homo sapiens
caggcacacactgcc

SEQ ID NO: 262021 - DNA, 15 bp, Homo sapiens
ccaggcacacactgc

SEQ ID NO: 262022 - DNA, 15 bp, Homo sapiens
tccaggcacacactg

SEQ ID NO: 262023 - DNA, 15 bp, Homo sapiens
gtccaggcacacact

SEQ ID NO: 262024 - DNA, 15 bp, Homo sapiens
ggtccaggcacacac

SEQ ID NO: 262025 - DNA, 15 bp, Homo sapiens
tggtccaggcacaca

SEQ ID NO: 262026 - DNA, 15 bp, Homo sapiens
atggtccaggcacac

SEQ ID NO: 262027 - DNA, 15 bp, Homo sapiens
catggtccaggcaca

SEQ ID NO: 262028 - DNA, 15 bp, Homo sapiens
gcatggtccaggcac

SEQ ID NO: 262029 - DNA, 15 bp, Homo sapiens
tgcatggtccaggca

SEQ ID NO: 262030 - DNA, 15 bp, Homo sapiens
atgcatggtccaggc

SEQ ID NO: 262031 - DNA, 15 bp, Homo sapiens
aatgcatggtccagg

SEQ ID NO: 262032 - DNA, 15 bp, Homo sapiens
aaatgcatggtccag

SEQ ID NO: 262033 - DNA, 15 bp, Homo sapiens
gaaatgcatggtcca

SEQ ID NO: 262034 - DNA, 15 bp, Homo sapiens
agaaatgcatggtcc

SEQ ID NO: 262035 - DNA, 15 bp, Homo sapiens
gagaaatgcatggtc

SEQ ID NO: 262036 - DNA, 15 bp, Homo sapiens
ggagaaatgcatggt

SEQ ID NO: 262037 - DNA, 15 bp, Homo sapiens
aggagaaatgcatgg

SEQ ID NO: 262038 - DNA, 15 bp, Homo sapiens
caggagaaatgcatg

SEQ ID NO: 262039 - DNA, 15 bp, Homo sapiens
acaggagaaatgcat

SEQ ID NO: 262040 - DNA, 15 bp, Homo sapiens
gacaggagaaatgca

SEQ ID NO: 262041 - DNA, 15 bp, Homo sapiens
agacaggagaaatgc

SEQ ID NO: 262042 - DNA, 15 bp, Homo sapiens
cagacaggagaaatg

SEQ ID NO: 262043 - DNA, 15 bp, Homo sapiens
acagacaggagaaat

SEQ ID NO: 262044 - DNA, 15 bp, Homo sapiens
aacagacaggagaaa

SEQ ID NO: 262045 - DNA, 15 bp, Homo sapiens
aaacagacaggagaa

SEQ ID NO: 262046 - DNA, 15 bp, Homo sapiens
gaaacagacaggaga

SEQ ID NO: 262047 - DNA, 15 bp, Homo sapiens
tgaaacagacaggag

SEQ ID NO: 262048 - DNA, 15 bp, Homo sapiens
gtgaaacagacagga

SEQ ID NO: 262049 - DNA, 15 bp, Homo sapiens
agtgaaacagacagg

SEQ ID NO: 262050 - DNA, 15 bp, Homo sapiens
cagtgaaacagacag

SEQ ID NO: 262051 - DNA, 15 bp, Homo sapiens
gcagtgaaacagaca

SEQ ID NO: 262052 - DNA, 15 bp, Homo sapiens
ggcagtgaaacagac

SEQ ID NO: 262053 - DNA, 15 bp, Homo sapiens
cggcagtgaaacaga

SEQ ID NO: 262054 - DNA, 15 bp, Homo sapiens
ccggcagtgaaacag

SEQ ID NO: 262055 - DNA, 15 bp, Homo sapiens
gccggcagtgaaaca

SEQ ID NO: 262056 - DNA, 15 bp, Homo sapiens
tgccggcagtgaaac

SEQ ID NO: 262057 - DNA, 15 bp, Homo sapiens
ttgccggcagtgaaa

SEQ ID NO: 262058 - DNA, 15 bp, Homo sapiens
tttgccggcagtgaa

SEQ ID NO: 262059 - DNA, 15 bp, Homo sapiens
gtttgccggcagtga

SEQ ID NO: 262060 - DNA, 15 bp, Homo sapiens
tgtttgccggcagtg

SEQ ID NO: 262061 - DNA, 15 bp, Homo sapiens
gtgtttgccggcagt

SEQ ID NO: 262062 - DNA, 15 bp, Homo sapiens
ggtgtttgccggcag

SEQ ID NO: 262063 - DNA, 15 bp, Homo sapiens
tggtgtttgccggca

SEQ ID NO: 262064 - DNA, 15 bp, Homo sapiens
gtggtgtttgccggc

SEQ ID NO: 262065 - DNA, 15 bp, Homo sapiens
agtggtgtttgccgg

SEQ ID NO: 262066 - DNA, 15 bp, Homo sapiens
gagtggtgtttgccg

SEQ ID NO: 262067 - DNA, 15 bp, Homo sapiens
cgagtggtgtttgcc

SEQ ID NO: 262068 - DNA, 15 bp, Homo sapiens
acgagtggtgtttgc

SEQ ID NO: 262069 - DNA, 15 bp, Homo sapiens
cacgagtggtgtttg

SEQ ID NO: 262070 - DNA, 15 bp, Homo sapiens
acacgagtggtgttt

SEQ ID NO: 262071 - DNA, 15 bp, Homo sapiens
cacacgagtggtgtt

SEQ ID NO: 262072 - DNA, 15 bp, Homo sapiens
acacacgagtggtgt

SEQ ID NO: 262073 - DNA, 15 bp, Homo sapiens
tacacacgagtggtg

SEQ ID NO: 262074 - DNA, 15 bp, Homo sapiens
ttacacacgagtggt

SEQ ID NO: 262075 - DNA, 15 bp, Homo sapiens
cttacacacgagtgg

SEQ ID NO: 262076 - DNA, 15 bp, Homo sapiens
acttacacacgagtg

SEQ ID NO: 262077 - DNA, 15 bp, Homo sapiens
gacttacacacgagt

SEQ ID NO: 262078 - DNA, 15 bp, Homo sapiens
tgacttacacacgag

SEQ ID NO: 262079 - DNA, 15 bp, Homo sapiens
gtgacttacacacga

SEQ ID NO: 262080 - DNA, 15 bp, Homo sapiens
cgtgacttacacacg

SEQ ID NO: 262081 - DNA, 15 bp, Homo sapiens
gcgtgacttacacac

SEQ ID NO: 262082 - DNA, 15 bp, Homo sapiens
tgcgtgacttacaca

SEQ ID NO: 262083 - DNA, 15 bp, Homo sapiens
atgcgtgacttacac

SEQ ID NO: 262084 - DNA, 15 bp, Homo sapiens
gatgcgtgacttaca

SEQ ID NO: 262085 - DNA, 15 bp, Homo sapiens
tgatgcgtgacttac

SEQ ID NO: 262086 - DNA, 15 bp, Homo sapiens
gtgatgcgtgactta

SEQ ID NO: 262087 - DNA, 15 bp, Homo sapiens
ggtgatgcgtgactt

SEQ ID NO: 262088 - DNA, 15 bp, Homo sapiens
gggtgatgcgtgact

SEQ ID NO: 262089 - DNA, 15 bp, Homo sapiens
tgggtgatgcgtgac

SEQ ID NO: 262090 - DNA, 15 bp, Homo sapiens
gtgggtgatgcgtga

SEQ ID NO: 262091 - DNA, 15 bp, Homo sapiens
tgtgggtgatgcgtg

SEQ ID NO: 262092 - DNA, 15 bp, Homo sapiens
gtgtgggtgatgcgt

SEQ ID NO: 262093 - DNA, 15 bp, Homo sapiens
agtgtgggtgatgcg

SEQ ID NO: 262094 - DNA, 15 bp, Homo sapiens
cagtgtgggtgatgc

SEQ ID NO: 262095 - DNA, 15 bp, Homo sapiens
gcagtgtgggtgatg

SEQ ID NO: 262096 - DNA, 15 bp, Homo sapiens
tgcagtgtgggtgat

SEQ ID NO: 262097 - DNA, 15 bp, Homo sapiens
ctgcagtgtgggtga

SEQ ID NO: 262098 - DNA, 15 bp, Homo sapiens
actgcagtgtgggtg

SEQ ID NO: 262099 - DNA, 15 bp, Homo sapiens
gactgcagtgtgggt

SEQ ID NO: 262100 - DNA, 15 bp, Homo sapiens
ggactgcagtgtggg

SEQ ID NO: 262101 - DNA, 15 bp, Homo sapiens
tggactgcagtgtgg

SEQ ID NO: 262102 - DNA, 15 bp, Homo sapiens
gtggactgcagtgtg

SEQ ID NO: 262103 - DNA, 15 bp, Homo sapiens
ggtggactgcagtgt

SEQ ID NO: 262104 - DNA, 15 bp, Homo sapiens
tggtggactgcagtg

SEQ ID NO: 262105 - DNA, 15 bp, Homo sapiens
atggtggactgcagt

SEQ ID NO: 262106 - DNA, 15 bp, Homo sapiens
aatggtggactgcag

SEQ ID NO: 262107 - DNA, 15 bp, Homo sapiens
gaatggtggactgca

SEQ ID NO: 262108 - DNA, 15 bp, Homo sapiens
ggaatggtggactgc

SEQ ID NO: 262109 - DNA, 15 bp, Homo sapiens
aggaatggtggactg

SEQ ID NO: 262110 - DNA, 15 bp, Homo sapiens
aaggaatggtggact

SEQ ID NO: 262111 - DNA, 15 bp, Homo sapiens
taaggaatggtggac

SEQ ID NO: 262112 - DNA, 15 bp, Homo sapiens
ctaaggaatggtgga

SEQ ID NO: 262113 - DNA, 15 bp, Homo sapiens
tctaaggaatggtgg

SEQ ID NO: 262114 - DNA, 15 bp, Homo sapiens
ctctaaggaatggtg

SEQ ID NO: 262115 - DNA, 15 bp, Homo sapiens
gctctaaggaatggt

SEQ ID NO: 262116 - DNA, 15 bp, Homo sapiens
ggctctaaggaatgg

SEQ ID NO: 262117 - DNA, 15 bp, Homo sapiens
aggctctaaggaatg

SEQ ID NO: 262118 - DNA, 15 bp, Homo sapiens
gaggctctaaggaat

SEQ ID NO: 262119 - DNA, 15 bp, Homo sapiens
agaggctctaaggaa

SEQ ID NO: 262120 - DNA, 15 bp, Homo sapiens
cagaggctctaagga

SEQ ID NO: 262121 - DNA, 15 bp, Homo sapiens
ccagaggctctaagg

SEQ ID NO: 262122 - DNA, 15 bp, Homo sapiens
cccagaggctctaag

SEQ ID NO: 262123 - DNA, 15 bp, Homo sapiens
gcccagaggctctaa

SEQ ID NO: 262124 - DNA, 15 bp, Homo sapiens
agcccagaggctcta

SEQ ID NO: 262125 - DNA, 15 bp, Homo sapiens
aagcccagaggctct

SEQ ID NO: 262126 - DNA, 15 bp, Homo sapiens
caagcccagaggctc

SEQ ID NO: 262127 - DNA, 15 bp, Homo sapiens
tcaagcccagaggct

SEQ ID NO: 262128 - DNA, 15 bp, Homo sapiens
ctcaagcccagaggc

SEQ ID NO: 262129 - DNA, 15 bp, Homo sapiens
actcaagcccagagg

SEQ ID NO: 262130 - DNA, 15 bp, Homo sapiens
cactcaagcccagag

SEQ ID NO: 262131 - DNA, 15 bp, Homo sapiens
tcactcaagcccaga

SEQ ID NO: 262132 - DNA, 15 bp, Homo sapiens
ttcactcaagcccag

SEQ ID NO: 262133 - DNA, 15 bp, Homo sapiens
attcactcaagccca

SEQ ID NO: 262134 - DNA, 15 bp, Homo sapiens
aattcactcaagccc

SEQ ID NO: 262135 - DNA, 15 bp, Homo sapiens
gaattcactcaagcc

SEQ ID NO: 262136 - DNA, 15 bp, Homo sapiens
agaattcactcaagc

SEQ ID NO: 262137 - DNA, 15 bp, Homo sapiens
aagaattcactcaag

SEQ ID NO: 262138 - DNA, 15 bp, Homo sapiens
caagaattcactcaa

SEQ ID NO: 262139 - DNA, 15 bp, Homo sapiens
gcaagaattcactca

SEQ ID NO: 262140 - DNA, 15 bp, Homo sapiens
ggcaagaattcactc

SEQ ID NO: 262141 - DNA, 15 bp, Homo sapiens
aggcaagaattcact

SEQ ID NO: 262142 - DNA, 15 bp, Homo sapiens
aaggcaagaattcac

SEQ ID NO: 262143 - DNA, 15 bp, Homo sapiens
aaaggcaagaattca

SEQ ID NO: 262144 - DNA, 15 bp, Homo sapiens
aaaaggcaagaattc

SEQ ID NO: 262145 - DNA, 15 bp, Homo sapiens
gaaaaggcaagaatt

SEQ ID NO: 262146 - DNA, 15 bp, Homo sapiens
agaaaaggcaagaat

SEQ ID NO: 262147 - DNA, 15 bp, Homo sapiens
gagaaaaggcaagaa

SEQ ID NO: 262148 - DNA, 15 bp, Homo sapiens
tgagaaaaggcaaga

SEQ ID NO: 262149 - DNA, 15 bp, Homo sapiens
ttgagaaaaggcaag

SEQ ID NO: 262150 - DNA, 15 bp, Homo sapiens
cttgagaaaaggcaa

SEQ ID NO: 262151 - DNA, 15 bp, Homo sapiens
acttgagaaaaggca

SEQ ID NO: 262152 - DNA, 15 bp, Homo sapiens
tacttgagaaaaggc

SEQ ID NO: 262153 - DNA, 15 bp, Homo sapiens
gtacttgagaaaagg

SEQ ID NO: 262154 - DNA, 15 bp, Homo sapiens
agtacttgagaaaag

SEQ ID NO: 262155 - DNA, 15 bp, Homo sapiens
aagtacttgagaaaa

SEQ ID NO: 262156 - DNA, 15 bp, Homo sapiens
gaagtacttgagaaa

SEQ ID NO: 262157 - DNA, 15 bp, Homo sapiens
agaagtacttgagaa

SEQ ID NO: 262158 - DNA, 15 bp, Homo sapiens
gagaagtacttgaga

SEQ ID NO: 262159 - DNA, 15 bp, Homo sapiens
agagaagtacttgag

SEQ ID NO: 262160 - DNA, 15 bp, Homo sapiens
tagagaagtacttga

SEQ ID NO: 262161 - DNA, 15 bp, Homo sapiens
ttagagaagtacttg

SEQ ID NO: 262162 - DNA, 15 bp, Homo sapiens
tttagagaagtactt

SEQ ID NO: 262163 - DNA, 15 bp, Homo sapiens
gtttagagaagtact

SEQ ID NO: 262164 - DNA, 15 bp, Homo sapiens
ggtttagagaagtac

SEQ ID NO: 262165 - DNA, 15 bp, Homo sapiens
aggtttagagaagta

SEQ ID NO: 262166 - DNA, 15 bp, Homo sapiens
caggtttagagaagt

SEQ ID NO: 262167 - DNA, 15 bp, Homo sapiens
ccaggtttagagaag

SEQ ID NO: 262168 - DNA, 15 bp, Homo sapiens
tccaggtttagagaa

SEQ ID NO: 262169 - DNA, 15 bp, Homo sapiens
ttccaggtttagaga

SEQ ID NO: 262170 - DNA, 15 bp, Homo sapiens
attccaggtttagag

SEQ ID NO: 262171 - DNA, 15 bp, Homo sapiens
aattccaggtttaga

SEQ ID NO: 262172 - DNA, 15 bp, Homo sapiens
gaattccaggtttag

SEQ ID NO: 262173 - DNA, 15 bp, Homo sapiens
agaattccaggttta

SEQ ID NO: 262174 - DNA, 15 bp, Homo sapiens
aagaattccaggttt

SEQ ID NO: 262175 - DNA, 15 bp, Homo sapiens
aaagaattccaggtt

SEQ ID NO: 262176 - DNA, 15 bp, Homo sapiens
gaaagaattccaggt

SEQ ID NO: 262177 - DNA, 15 bp, Homo sapiens
ggaaagaattccagg

SEQ ID NO: 262178 - DNA, 15 bp, Homo sapiens
aggaaagaattccag

SEQ ID NO: 262179 - DNA, 15 bp, Homo sapiens
gaggaaagaattcca

SEQ ID NO: 262180 - DNA, 15 bp, Homo sapiens
tgaggaaagaattcc

SEQ ID NO: 262181 - DNA, 15 bp, Homo sapiens
gtgaggaaagaattc

SEQ ID NO: 262182 - DNA, 15 bp, Homo sapiens
agtgaggaaagaatt

SEQ ID NO: 262183 - DNA, 15 bp, Homo sapiens
aagtgaggaaagaat

SEQ ID NO: 262184 - DNA, 15 bp, Homo sapiens
gaagtgaggaaagaa

SEQ ID NO: 262185 - DNA, 15 bp, Homo sapiens
tgaagtgaggaaaga

SEQ ID NO: 262186 - DNA, 15 bp, Homo sapiens
atgaagtgaggaaag

SEQ ID NO: 262187 - DNA, 15 bp, Homo sapiens
catgaagtgaggaaa

SEQ ID NO: 262188 - DNA, 15 bp, Homo sapiens
acatgaagtgaggaa

SEQ ID NO: 262189 - DNA, 15 bp, Homo sapiens
cacatgaagtgagga

SEQ ID NO: 262190 - DNA, 15 bp, Homo sapiens
ccacatgaagtgagg

SEQ ID NO: 262191 - DNA, 15 bp, Homo sapiens
tccacatgaagtgag

SEQ ID NO: 262192 - DNA, 15 bp, Homo sapiens
atccacatgaagtga

SEQ ID NO: 262193 - DNA, 15 bp, Homo sapiens
gatccacatgaagtg

SEQ ID NO: 262194 - DNA, 15 bp, Homo sapiens
agatccacatgaagt

SEQ ID NO: 262195 - DNA, 15 bp, Homo sapiens
gagatccacatgaag

SEQ ID NO: 262196 - DNA, 15 bp, Homo sapiens
agagatccacatgaa

SEQ ID NO: 262197 - DNA, 15 bp, Homo sapiens
aagagatccacatga

SEQ ID NO: 262198 - DNA, 15 bp, Homo sapiens
caagagatccacatg

SEQ ID NO: 262199 - DNA, 15 bp, Homo sapiens
acaagagatccacat

SEQ ID NO: 262200 - DNA, 15 bp, Homo sapiens
tacaagagatccaca

SEQ ID NO: 262201 - DNA, 15 bp, Homo sapiens
atacaagagatccac

SEQ ID NO: 262202 - DNA, 15 bp, Homo sapiens
aatacaagagatcca

SEQ ID NO: 262203 - DNA, 15 bp, Homo sapiens
aaatacaagagatcc

SEQ ID NO: 262204 - DNA, 15 bp, Homo sapiens
aaaatacaagagatc

SEQ ID NO: 262205 - DNA, 15 bp, Homo sapiens
taaaatacaagagat

SEQ ID NO: 262206 - DNA, 15 bp, Homo sapiens
ataaaatacaagaga

SEQ ID NO: 262207 - DNA, 15 bp, Homo sapiens
gataaaatacaagag

SEQ ID NO: 262208 - DNA, 15 bp, Homo sapiens
ggataaaatacaaga

SEQ ID NO: 262209 - DNA, 15 bp, Homo sapiens
tggataaaatacaag

SEQ ID NO: 262210 - DNA, 15 bp, Homo sapiens
atggataaaatacaa

SEQ ID NO: 262211 - DNA, 15 bp, Homo sapiens
aatggataaaataca

SEQ ID NO: 262212 - DNA, 15 bp, Homo sapiens
aaatggataaaatac

SEQ ID NO: 262213 - DNA, 15 bp, Homo sapiens
aaaatggataaaata

SEQ ID NO: 262214 - DNA, 15 bp, Homo sapiens
aaaaatggataaaat

SEQ ID NO: 262215 - DNA, 15 bp, Homo sapiens
gaaaaatggataaaa

SEQ ID NO: 262216 - DNA, 15 bp, Homo sapiens
tgaaaaatggataaa

SEQ ID NO: 262217 - DNA, 15 bp, Homo sapiens
ttgaaaaatggataa

SEQ ID NO: 262218 - DNA, 15 bp, Homo sapiens
tttgaaaaatggata

SEQ ID NO: 262219 - DNA, 15 bp, Homo sapiens
ctttgaaaaatggat

SEQ ID NO: 262220 - DNA, 15 bp, Homo sapiens
gctttgaaaaatgga

SEQ ID NO: 262221 - DNA, 15 bp, Homo sapiens
ggctttgaaaaatgg

SEQ ID NO: 262222 - DNA, 15 bp, Homo sapiens
gggctttgaaaaatg

SEQ ID NO: 262223 - DNA, 15 bp, Homo sapiens
tgggctttgaaaaat

SEQ ID NO: 262224 - DNA, 15 bp, Homo sapiens
atgggctttgaaaaa

SEQ ID NO: 262225 - DNA, 15 bp, Homo sapiens
aatgggctttgaaaa

SEQ ID NO: 262226 - DNA, 15 bp, Homo sapiens
aaatgggctttgaaa

SEQ ID NO: 262227 - DNA, 15 bp, Homo sapiens
gaaatgggctttgaa

SEQ ID NO: 262228 - DNA, 15 bp, Homo sapiens
tgaaatgggctttga

SEQ ID NO: 262229 - DNA, 15 bp, Homo sapiens
ttgaaatgggctttg

SEQ ID NO: 262230 - DNA, 15 bp, Homo sapiens
tttgaaatgggcttt

SEQ ID NO: 262231 - DNA, 15 bp, Homo sapiens
atttgaaatgggctt

SEQ ID NO: 262232 - DNA, 15 bp, Homo sapiens
gatttgaaatgggct

SEQ ID NO: 262233 - DNA, 15 bp, Homo sapiens
cgatttgaaatgggc

SEQ ID NO: 262234 - DNA, 15 bp, Homo sapiens
gcgatttgaaatggg

SEQ ID NO: 262235 - DNA, 15 bp, Homo sapiens
tgcgatttgaaatgg

SEQ ID NO: 262236 - DNA, 15 bp, Homo sapiens
gtgcgatttgaaatg

SEQ ID NO: 262237 - DNA, 15 bp, Homo sapiens
ggtgcgatttgaaat

SEQ ID NO: 262238 - DNA, 15 bp, Homo sapiens
aggtgcgatttgaaa

SEQ ID NO: 262239 - DNA, 15 bp, Homo sapiens
gaggtgcgatttgaa

SEQ ID NO: 262240 - DNA, 15 bp, Homo sapiens
agaggtgcgatttga

SEQ ID NO: 262241 - DNA, 15 bp, Homo sapiens
gagaggtgcgatttg

SEQ ID NO: 262242 - DNA, 15 bp, Homo sapiens
ggagaggtgcgattt

SEQ ID NO: 262243 - DNA, 15 bp, Homo sapiens
tggagaggtgcgatt

SEQ ID NO: 262244 - DNA, 15 bp, Homo sapiens
ctggagaggtgcgat

SEQ ID NO: 262245 - DNA, 15 bp, Homo sapiens
cctggagaggtgcga

SEQ ID NO: 262246 - DNA, 15 bp, Homo sapiens
ccctggagaggtgcg

SEQ ID NO: 262247 - DNA, 15 bp, Homo sapiens
tccctggagaggtgc

SEQ ID NO: 262248 - DNA, 15 bp, Homo sapiens
ctccctggagaggtg

SEQ ID NO: 262249 - DNA, 15 bp, Homo sapiens
gctccctggagaggt

SEQ ID NO: 262250 - DNA, 15 bp, Homo sapiens
ggctccctggagagg

SEQ ID NO: 262251 - DNA, 15 bp, Homo sapiens
aggctccctggagag

SEQ ID NO: 262252 - DNA, 15 bp, Homo sapiens
aaggctccctggaga

SEQ ID NO: 262253 - DNA, 15 bp, Homo sapiens
aaaggctccctggag

SEQ ID NO: 262254 - DNA, 15 bp, Homo sapiens
aaaaggctccctgga

SEQ ID NO: 262255 - DNA, 15 bp, Homo sapiens
gaaaaggctccctgg

SEQ ID NO: 262256 - DNA, 15 bp, Homo sapiens
ggaaaaggctccctg

SEQ ID NO: 262257 - DNA, 15 bp, Homo sapiens
tggaaaaggctccct

SEQ ID NO: 262258 - DNA, 15 bp, Homo sapiens
ctggaaaaggctccc

SEQ ID NO: 262259 - DNA, 15 bp, Homo sapiens
actggaaaaggctcc

SEQ ID NO: 262260 - DNA, 15 bp, Homo sapiens
aactggaaaaggctc

SEQ ID NO: 262261 - DNA, 15 bp, Homo sapiens
caactggaaaaggct

SEQ ID NO: 262262 - DNA, 15 bp, Homo sapiens
acaactggaaaaggc

SEQ ID NO: 262263 - DNA, 15 bp, Homo sapiens
gacaactggaaaagg

SEQ ID NO: 262264 - DNA, 15 bp, Homo sapiens
agacaactggaaaag

SEQ ID NO: 262265 - DNA, 15 bp, Homo sapiens
aagacaactggaaaa

SEQ ID NO: 262266 - DNA, 15 bp, Homo sapiens
aaagacaactggaaa

SEQ ID NO: 262267 - DNA, 15 bp, Homo sapiens
gaaagacaactggaa

SEQ ID NO: 262268 - DNA, 15 bp, Homo sapiens
ggaaagacaactgga

SEQ ID NO: 262269 - DNA, 15 bp, Homo sapiens
aggaaagacaactgg

SEQ ID NO: 262270 - DNA, 15 bp, Homo sapiens
gaggaaagacaactg

SEQ ID NO: 262271 - DNA, 15 bp, Homo sapiens
agaggaaagacaact

SEQ ID NO: 262272 - DNA, 15 bp, Homo sapiens
gagaggaaagacaac

SEQ ID NO: 262273 - DNA, 15 bp, Homo sapiens
ggagaggaaagacaa

SEQ ID NO: 262274 - DNA, 15 bp, Homo sapiens
aggagaggaaagaca

SEQ ID NO: 262275 - DNA, 15 bp, Homo sapiens
taggagaggaaagac

SEQ ID NO: 262276 - DNA, 15 bp, Homo sapiens
ctaggagaggaaaga

SEQ ID NO: 262277 - DNA, 15 bp, Homo sapiens
tctaggagaggaaag

SEQ ID NO: 262278 - DNA, 15 bp, Homo sapiens
ttctaggagaggaaa

SEQ ID NO: 262279 - DNA, 15 bp, Homo sapiens
cttctaggagaggaa

SEQ ID NO: 262280 - DNA, 15 bp, Homo sapiens
acttctaggagagga

SEQ ID NO: 262281 - DNA, 15 bp, Homo sapiens
tacttctaggagagg

SEQ ID NO: 262282 - DNA, 15 bp, Homo sapiens
ctacttctaggagag

SEQ ID NO: 262283 - DNA, 15 bp, Homo sapiens
actacttctaggaga

SEQ ID NO: 262284 - DNA, 15 bp, Homo sapiens
tactacttctaggag

SEQ ID NO: 262285 - DNA, 15 bp, Homo sapiens
ctactacttctagga

SEQ ID NO: 262286 - DNA, 15 bp, Homo sapiens
gctactacttctagg

SEQ ID NO: 262287 - DNA, 15 bp, Homo sapiens
agctactacttctag

SEQ ID NO: 262288 - DNA, 15 bp, Homo sapiens
gagctactacttcta

SEQ ID NO: 262289 - DNA, 15 bp, Homo sapiens
agagctactacttct

SEQ ID NO: 262290 - DNA, 15 bp, Homo sapiens
tagagctactacttc

SEQ ID NO: 262291 - DNA, 15 bp, Homo sapiens
ctagagctactactt

SEQ ID NO: 262292 - DNA, 15 bp, Homo sapiens
gctagagctactact

SEQ ID NO: 262293 - DNA, 15 bp, Homo sapiens
tgctagagctactac

SEQ ID NO: 262294 - DNA, 15 bp, Homo sapiens
ctgctagagctacta

SEQ ID NO: 262295 - DNA, 15 bp, Homo sapiens
tctgctagagctact

SEQ ID NO: 262296 - DNA, 15 bp, Homo sapiens
ttctgctagagctac

SEQ ID NO: 262297 - DNA, 15 bp, Homo sapiens
tttctgctagagcta

SEQ ID NO: 262298 - DNA, 15 bp, Homo sapiens
atttctgctagagct

SEQ ID NO: 262299 - DNA, 15 bp, Homo sapiens
aatttctgctagagc

SEQ ID NO: 262300 - DNA, 15 bp, Homo sapiens
aaatttctgctagag

SEQ ID NO: 262301 - DNA, 15 bp, Homo sapiens
caaatttctgctaga

SEQ ID NO: 262302 - DNA, 15 bp, Homo sapiens
gcaaatttctgctag

SEQ ID NO: 262303 - DNA, 15 bp, Homo sapiens
cgcaaatttctgcta

SEQ ID NO: 262304 - DNA, 15 bp, Homo sapiens
acgcaaatttctgct

SEQ ID NO: 262305 - DNA, 15 bp, Homo sapiens
tacgcaaatttctgc

SEQ ID NO: 262306 - DNA, 15 bp, Homo sapiens
atacgcaaatttctg

SEQ ID NO: 262307 - DNA, 15 bp, Homo sapiens
aatacgcaaatttct

SEQ ID NO: 262308 - DNA, 15 bp, Homo sapiens
gaatacgcaaatttc

SEQ ID NO: 262309 - DNA, 15 bp, Homo sapiens
ggaatacgcaaattt

SEQ ID NO: 262310 - DNA, 15 bp, Homo sapiens
aggaatacgcaaatt

SEQ ID NO: 262311 - DNA, 15 bp, Homo sapiens
gaggaatacgcaaat

SEQ ID NO: 262312 - DNA, 15 bp, Homo sapiens
agaggaatacgcaaa

SEQ ID NO: 262313 - DNA, 15 bp, Homo sapiens
gagaggaatacgcaa

SEQ ID NO: 262314 - DNA, 15 bp, Homo sapiens
tgagaggaatacgca

SEQ ID NO: 262315 - DNA, 15 bp, Homo sapiens
atgagaggaatacgc

SEQ ID NO: 262316 - DNA, 15 bp, Homo sapiens
tatgagaggaatacg

SEQ ID NO: 262317 - DNA, 15 bp, Homo sapiens
ctatgagaggaatac

SEQ ID NO: 262318 - DNA, 15 bp, Homo sapiens
cctatgagaggaata

SEQ ID NO: 262319 - DNA, 15 bp, Homo sapiens
ccctatgagaggaat

SEQ ID NO: 262320 - DNA, 15 bp, Homo sapiens
gccctatgagaggaa

SEQ ID NO: 262321 - DNA, 15 bp, Homo sapiens
tgccctatgagagga

SEQ ID NO: 262322 - DNA, 15 bp, Homo sapiens
atgccctatgagagg

SEQ ID NO: 262323 - DNA, 15 bp, Homo sapiens
catgccctatgagag

SEQ ID NO: 262324 - DNA, 15 bp, Homo sapiens
acatgccctatgaga

SEQ ID NO: 262325 - DNA, 15 bp, Homo sapiens
aacatgccctatgag

SEQ ID NO: 262326 - DNA, 15 bp, Homo sapiens
aaacatgccctatga

SEQ ID NO: 262327 - DNA, 15 bp, Homo sapiens
taaacatgccctatg

SEQ ID NO: 262328 - DNA, 15 bp, Homo sapiens
gtaaacatgccctat

SEQ ID NO: 262329 - DNA, 15 bp, Homo sapiens
agtaaacatgcccta

SEQ ID NO: 262330 - DNA, 15 bp, Homo sapiens
gagtaaacatgccct

SEQ ID NO: 262331 - DNA, 15 bp, Homo sapiens
ggagtaaacatgccc

SEQ ID NO: 262332 - DNA, 15 bp, Homo sapiens
aggagtaaacatgcc

SEQ ID NO: 262333 - DNA, 15 bp, Homo sapiens
gaggagtaaacatgc

SEQ ID NO: 262334 - DNA, 15 bp, Homo sapiens
ggaggagtaaacatg

SEQ ID NO: 262335 - DNA, 15 bp, Homo sapiens
aggaggagtaaacat

SEQ ID NO: 262336 - DNA, 15 bp, Homo sapiens
aaggaggagtaaaca

SEQ ID NO: 262337 - DNA, 15 bp, Homo sapiens
aaaggaggagtaaac

SEQ ID NO: 262338 - DNA, 15 bp, Homo sapiens
aaaaggaggagtaaa

SEQ ID NO: 262339 - DNA, 15 bp, Homo sapiens
taaaaggaggagtaa

SEQ ID NO: 262340 - DNA, 15 bp, Homo sapiens
ctaaaaggaggagta

SEQ ID NO: 262341 - DNA, 15 bp, Homo sapiens
actaaaaggaggagt

SEQ ID NO: 262342 - DNA, 15 bp, Homo sapiens
tactaaaaggaggag

SEQ ID NO: 262343 - DNA, 15 bp, Homo sapiens
ttactaaaaggagga

SEQ ID NO: 262344 - DNA, 15 bp, Homo sapiens
tttactaaaaggagg

SEQ ID NO: 262345 - DNA, 15 bp, Homo sapiens
ctttactaaaaggag

SEQ ID NO: 262346 - DNA, 15 bp, Homo sapiens
gctttactaaaagga

SEQ ID NO: 262347 - DNA, 15 bp, Homo sapiens
ggctttactaaaagg

SEQ ID NO: 262348 - DNA, 15 bp, Homo sapiens
tggctttactaaaag

SEQ ID NO: 262349 - DNA, 15 bp, Homo sapiens
atggctttactaaaa

SEQ ID NO: 262350 - DNA, 15 bp, Homo sapiens
gatggctttactaaa

SEQ ID NO: 262351 - DNA, 15 bp, Homo sapiens
tgatggctttactaa

SEQ ID NO: 262352 - DNA, 15 bp, Homo sapiens
ctgatggctttacta

SEQ ID NO: 262353 - DNA, 15 bp, Homo sapiens
actgatggctttact

SEQ ID NO: 262354 - DNA, 15 bp, Homo sapiens
tactgatggctttac

SEQ ID NO: 262355 - DNA, 15 bp, Homo sapiens
atactgatggcttta

SEQ ID NO: 262356 - DNA, 15 bp, Homo sapiens
catactgatggcttt

SEQ ID NO: 262357 - DNA, 15 bp, Homo sapiens
acatactgatggctt

SEQ ID NO: 262358 - DNA, 15 bp, Homo sapiens
gacatactgatggct

SEQ ID NO: 262359 - DNA, 15 bp, Homo sapiens
agacatactgatggc

SEQ ID NO: 262360 - DNA, 15 bp, Homo sapiens
aagacatactgatgg

SEQ ID NO: 262361 - DNA, 15 bp, Homo sapiens
aaagacatactgatg

SEQ ID NO: 262362 - DNA, 15 bp, Homo sapiens
caaagacatactgat

SEQ ID NO: 262363 - DNA, 15 bp, Homo sapiens
tcaaagacatactga

SEQ ID NO: 262364 - DNA, 15 bp, Homo sapiens
ctcaaagacatactg

SEQ ID NO: 262365 - DNA, 15 bp, Homo sapiens
tctcaaagacatact

SEQ ID NO: 262366 - DNA, 15 bp, Homo sapiens
ctctcaaagacatac

SEQ ID NO: 262367 - DNA, 15 bp, Homo sapiens
gctctcaaagacata

SEQ ID NO: 262368 - DNA, 15 bp, Homo sapiens
tgctctcaaagacat

SEQ ID NO: 262369 - DNA, 15 bp, Homo sapiens
ctgctctcaaagaca

SEQ ID NO: 262370 - DNA, 15 bp, Homo sapiens
cctgctctcaaagac

SEQ ID NO: 262371 - DNA, 15 bp, Homo sapiens
ccctgctctcaaaga

SEQ ID NO: 262372 - DNA, 15 bp, Homo sapiens
cccctgctctcaaag

SEQ ID NO: 262373 - DNA, 15 bp, Homo sapiens
gcccctgctctcaaa

SEQ ID NO: 262374 - DNA, 15 bp, Homo sapiens
agcccctgctctcaa

SEQ ID NO: 262375 - DNA, 15 bp, Homo sapiens
gagcccctgctctca

SEQ ID NO: 262376 - DNA, 15 bp, Homo sapiens
agagcccctgctctc

SEQ ID NO: 262377 - DNA, 15 bp, Homo sapiens
cagagcccctgctct

SEQ ID NO: 262378 - DNA, 15 bp, Homo sapiens
gcagagcccctgctc

SEQ ID NO: 262379 - DNA, 15 bp, Homo sapiens
ggcagagcccctgct

SEQ ID NO: 262380 - DNA, 15 bp, Homo sapiens
aggcagagcccctgc

SEQ ID NO: 262381 - DNA, 15 bp, Homo sapiens
aaggcagagcccctg

SEQ ID NO: 262382 - DNA, 15 bp, Homo sapiens
gaaggcagagcccct

SEQ ID NO: 262383 - DNA, 15 bp, Homo sapiens
tgaaggcagagcccc

SEQ ID NO: 262384 - DNA, 15 bp, Homo sapiens
gtgaaggcagagccc

SEQ ID NO: 262385 - DNA, 15 bp, Homo sapiens
ggtgaaggcagagcc

SEQ ID NO: 262386 - DNA, 15 bp, Homo sapiens
aggtgaaggcagagc

SEQ ID NO: 262387 - DNA, 15 bp, Homo sapiens
gaggtgaaggcagag

SEQ ID NO: 262388 - DNA, 15 bp, Homo sapiens
ggaggtgaaggcaga

SEQ ID NO: 262389 - DNA, 15 bp, Homo sapiens
aggaggtgaaggcag

SEQ ID NO: 262390 - DNA, 15 bp, Homo sapiens
caggaggtgaaggca

SEQ ID NO: 262391 - DNA, 15 bp, Homo sapiens
acaggaggtgaaggc

SEQ ID NO: 262392 - DNA, 15 bp, Homo sapiens
cacaggaggtgaagg

SEQ ID NO: 262393 - DNA, 15 bp, Homo sapiens
gcacaggaggtgaag

SEQ ID NO: 262394 - DNA, 15 bp, Homo sapiens
tgcacaggaggtgaa

SEQ ID NO: 262395 - DNA, 15 bp, Homo sapiens
gtgcacaggaggtga

SEQ ID NO: 262396 - DNA, 15 bp, Homo sapiens
tgtgcacaggaggtg

SEQ ID NO: 262397 - DNA, 15 bp, Homo sapiens
gtgtgcacaggaggt

SEQ ID NO: 262398 - DNA, 15 bp, Homo sapiens
ggtgtgcacaggagg

SEQ ID NO: 262399 - DNA, 15 bp, Homo sapiens
gggtgtgcacaggag

SEQ ID NO: 262400 - DNA, 15 bp, Homo sapiens
agggtgtgcacagga

SEQ ID NO: 262401 - DNA, 15 bp, Homo sapiens
gagggtgtgcacagg

SEQ ID NO: 262402 - DNA, 15 bp, Homo sapiens
ggagggtgtgcacag

SEQ ID NO: 262403 - DNA, 15 bp, Homo sapiens
aggagggtgtgcaca

SEQ ID NO: 262404 - DNA, 15 bp, Homo sapiens
caggagggtgtgcac

SEQ ID NO: 262405 - DNA, 15 bp, Homo sapiens
ccaggagggtgtgca

SEQ ID NO: 262406 - DNA, 15 bp, Homo sapiens
gccaggagggtgtgc

SEQ ID NO: 262407 - DNA, 15 bp, Homo sapiens
agccaggagggtgtg

SEQ ID NO: 262408 - DNA, 15 bp, Homo sapiens
gagccaggagggtgt

SEQ ID NO: 262409 - DNA, 15 bp, Homo sapiens
agagccaggagggtg

SEQ ID NO: 262410 - DNA, 15 bp, Homo sapiens
tagagccaggagggt

SEQ ID NO: 262411 - DNA, 15 bp, Homo sapiens
ctagagccaggaggg

SEQ ID NO: 262412 - DNA, 15 bp, Homo sapiens
gctagagccaggagg

SEQ ID NO: 262413 - DNA, 15 bp, Homo sapiens
ggctagagccaggag

SEQ ID NO: 262414 - DNA, 15 bp, Homo sapiens
gggctagagccagga

SEQ ID NO: 262415 - DNA, 15 bp, Homo sapiens
ggggctagagccagg

SEQ ID NO: 262416 - DNA, 15 bp, Homo sapiens
tggggctagagccag

SEQ ID NO: 262417 - DNA, 15 bp, Homo sapiens
ctggggctagagcca

SEQ ID NO: 262418 - DNA, 15 bp, Homo sapiens
gctggggctagagcc

SEQ ID NO: 262419 - DNA, 15 bp, Homo sapiens
ggctggggctagagc

SEQ ID NO: 262420 - DNA, 15 bp, Homo sapiens
tggctggggctagag

SEQ ID NO: 262421 - DNA, 15 bp, Homo sapiens
atggctggggctaga

SEQ ID NO: 262422 - DNA, 15 bp, Homo sapiens
catggctggggctag

SEQ ID NO: 262423 - DNA, 15 bp, Homo sapiens
gcatggctggggcta

SEQ ID NO: 262424 - DNA, 15 bp, Homo sapiens
ggcatggctggggct

SEQ ID NO: 262425 - DNA, 15 bp, Homo sapiens
aggcatggctggggc

SEQ ID NO: 262426 - DNA, 15 bp, Homo sapiens
taggcatggctgggg

SEQ ID NO: 262427 - DNA, 15 bp, Homo sapiens
gtaggcatggctggg

SEQ ID NO: 262428 - DNA, 15 bp, Homo sapiens
ggtaggcatggctgg

SEQ ID NO: 262429 - DNA, 15 bp, Homo sapiens
tggtaggcatggctg

SEQ ID NO: 262430 - DNA, 15 bp, Homo sapiens
atggtaggcatggct

SEQ ID NO: 262431 - DNA, 15 bp, Homo sapiens
tatggtaggcatggc

SEQ ID NO: 262432 - DNA, 15 bp, Homo sapiens
ctatggtaggcatgg

SEQ ID NO: 262433 - DNA, 15 bp, Homo sapiens
tctatggtaggcatg

SEQ ID NO: 262434 - DNA, 15 bp, Homo sapiens
atctatggtaggcat

SEQ ID NO: 262435 - DNA, 15 bp, Homo sapiens
catctatggtaggca

SEQ ID NO: 262436 - DNA, 15 bp, Homo sapiens
acatctatggtaggc

SEQ ID NO: 262437 - DNA, 15 bp, Homo sapiens
aacatctatggtagg

SEQ ID NO: 262438 - DNA, 15 bp, Homo sapiens
caacatctatggtag

SEQ ID NO: 262439 - DNA, 15 bp, Homo sapiens
acaacatctatggta

SEQ ID NO: 262440 - DNA, 15 bp, Homo sapiens
tacaacatctatggt

SEQ ID NO: 262441 - DNA, 15 bp, Homo sapiens
gtacaacatctatgg

SEQ ID NO: 262442 - DNA, 15 bp, Homo sapiens
tgtacaacatctatg

SEQ ID NO: 262443 - DNA, 15 bp, Homo sapiens
gtgtacaacatctat

SEQ ID NO: 262444 - DNA, 15 bp, Homo sapiens
tgtgtacaacatcta

SEQ ID NO: 262445 - DNA, 15 bp, Homo sapiens
atgtgtacaacatct

SEQ ID NO: 262446 - DNA, 15 bp, Homo sapiens
catgtgtacaacatc

SEQ ID NO: 262447 - DNA, 15 bp, Homo sapiens
tcatgtgtacaacat

SEQ ID NO: 262448 - DNA, 15 bp, Homo sapiens
ttcatgtgtacaaca

SEQ ID NO: 262449 - DNA, 15 bp, Homo sapiens
cttcatgtgtacaac

SEQ ID NO: 262450 - DNA, 15 bp, Homo sapiens
tcttcatgtgtacaa

SEQ ID NO: 262451 - DNA, 15 bp, Homo sapiens
ctcttcatgtgtaca

SEQ ID NO: 262452 - DNA, 15 bp, Homo sapiens
actcttcatgtgtac

SEQ ID NO: 262453 - DNA, 15 bp, Homo sapiens
tactcttcatgtgta

SEQ ID NO: 262454 - DNA, 15 bp, Homo sapiens
ttactcttcatgtgt

SEQ ID NO: 262455 - DNA, 15 bp, Homo sapiens
cttactcttcatgtg

SEQ ID NO: 262456 - DNA, 15 bp, Homo sapiens
ccttactcttcatgt

SEQ ID NO: 262457 - DNA, 15 bp, Homo sapiens
tccttactcttcatg

SEQ ID NO: 262458 - DNA, 15 bp, Homo sapiens
atccttactcttcat

SEQ ID NO: 262459 - DNA, 15 bp, Homo sapiens
catccttactcttca

SEQ ID NO: 262460 - DNA, 15 bp, Homo sapiens
ccatccttactcttc

SEQ ID NO: 262461 - DNA, 15 bp, Homo sapiens
cccatccttactctt

SEQ ID NO: 262462 - DNA, 15 bp, Homo sapiens
tcccatccttactct

SEQ ID NO: 262463 - DNA, 15 bp, Homo sapiens
ttcccatccttactc

SEQ ID NO: 262464 - DNA, 15 bp, Homo sapiens
gttcccatccttact

SEQ ID NO: 262465 - DNA, 15 bp, Homo sapiens
tgttcccatccttac

SEQ ID NO: 262466 - DNA, 15 bp, Homo sapiens
ttgttcccatcctta

SEQ ID NO: 262467 - DNA, 15 bp, Homo sapiens
tttgttcccatcctt

SEQ ID NO: 262468 - DNA, 15 bp, Homo sapiens
atttgttcccatcct

SEQ ID NO: 262469 - DNA, 15 bp, Homo sapiens
aatttgttcccatcc

SEQ ID NO: 262470 - DNA, 15 bp, Homo sapiens
aaatttgttcccatc

SEQ ID NO: 262471 - DNA, 15 bp, Homo sapiens
caaatttgttcccat

SEQ ID NO: 262472 - DNA, 15 bp, Homo sapiens
acaaatttgttccca

SEQ ID NO: 262473 - DNA, 15 bp, Homo sapiens
cacaaatttgttccc

SEQ ID NO: 262474 - DNA, 15 bp, Homo sapiens
tcacaaatttgttcc

SEQ ID NO: 262475 - DNA, 15 bp, Homo sapiens
ttcacaaatttgttc

SEQ ID NO: 262476 - DNA, 15 bp, Homo sapiens
cttcacaaatttgtt

SEQ ID NO: 262477 - DNA, 15 bp, Homo sapiens
tcttcacaaatttgt

SEQ ID NO: 262478 - DNA, 15 bp, Homo sapiens
gtcttcacaaatttg

SEQ ID NO: 262479 - DNA, 15 bp, Homo sapiens
ggtcttcacaaattt

SEQ ID NO: 262480 - DNA, 15 bp, Homo sapiens
tggtcttcacaaatt

SEQ ID NO: 262481 - DNA, 15 bp, Homo sapiens
ttggtcttcacaaat

SEQ ID NO: 262482 - DNA, 15 bp, Homo sapiens
attggtcttcacaaa

SEQ ID NO: 262483 - DNA, 15 bp, Homo sapiens
cattggtcttcacaa

SEQ ID NO: 262484 - DNA, 15 bp, Homo sapiens
ccattggtcttcaca

SEQ ID NO: 262485 - DNA, 15 bp, Homo sapiens
tccattggtcttcac

SEQ ID NO: 262486 - DNA, 15 bp, Homo sapiens
atccattggtcttca

SEQ ID NO: 262487 - DNA, 15 bp, Homo sapiens
catccattggtcttc

SEQ ID NO: 262488 - DNA, 15 bp, Homo sapiens
acatccattggtctt

SEQ ID NO: 262489 - DNA, 15 bp, Homo sapiens
cacatccattggtct

SEQ ID NO: 262490 - DNA, 15 bp, Homo sapiens
ccacatccattggtc

SEQ ID NO: 262491 - DNA, 15 bp, Homo sapiens
cccacatccattggt

SEQ ID NO: 262492 - DNA, 15 bp, Homo sapiens
ccccacatccattgg

SEQ ID NO: 262493 - DNA, 15 bp, Homo sapiens
cccccacatccattg

SEQ ID NO: 262494 - DNA, 15 bp, Homo sapiens
gcccccacatccatt

SEQ ID NO: 262495 - DNA, 15 bp, Homo sapiens
agcccccacatccat

SEQ ID NO: 262496 - DNA, 15 bp, Homo sapiens
cagcccccacatcca

SEQ ID NO: 262497 - DNA, 15 bp, Homo sapiens
acagcccccacatcc

SEQ ID NO: 262498 - DNA, 15 bp, Homo sapiens
gacagcccccacatc

SEQ ID NO: 262499 - DNA, 15 bp, Homo sapiens
agacagcccccacat

SEQ ID NO: 262500 - DNA, 15 bp, Homo sapiens
tagacagcccccaca

SEQ ID NO: 262501 - DNA, 15 bp, Homo sapiens
ctagacagcccccac

SEQ ID NO: 262502 - DNA, 15 bp, Homo sapiens
actagacagccccca

SEQ ID NO: 262503 - DNA, 15 bp, Homo sapiens
tactagacagccccc

SEQ ID NO: 262504 - DNA, 15 bp, Homo sapiens
gtactagacagcccc

SEQ ID NO: 262505 - DNA, 15 bp, Homo sapiens
agtactagacagccc

SEQ ID NO: 262506 - DNA, 15 bp, Homo sapiens
aagtactagacagcc

SEQ ID NO: 262507 - DNA, 15 bp, Homo sapiens
gaagtactagacagc

SEQ ID NO: 262508 - DNA, 15 bp, Homo sapiens
agaagtactagacag

SEQ ID NO: 262509 - DNA, 15 bp, Homo sapiens
aagaagtactagaca

SEQ ID NO: 262510 - DNA, 15 bp, Homo sapiens
gaagaagtactagac

SEQ ID NO: 262511 - DNA, 15 bp, Homo sapiens
agaagaagtactaga

SEQ ID NO: 262512 - DNA, 15 bp, Homo sapiens
aagaagaagtactag

SEQ ID NO: 262513 - DNA, 15 bp, Homo sapiens
taagaagaagtacta

SEQ ID NO: 262514 - DNA, 15 bp, Homo sapiens
ctaagaagaagtact

SEQ ID NO: 262515 - DNA, 15 bp, Homo sapiens
gctaagaagaagtac

SEQ ID NO: 262516 - DNA, 15 bp, Homo sapiens
agctaagaagaagta

SEQ ID NO: 262517 - DNA, 15 bp, Homo sapiens
tagctaagaagaagt

SEQ ID NO: 262518 - DNA, 15 bp, Homo sapiens
gtagctaagaagaag

SEQ ID NO: 262519 - DNA, 15 bp, Homo sapiens
tgtagctaagaagaa

SEQ ID NO: 262520 - DNA, 15 bp, Homo sapiens
ctgtagctaagaaga

SEQ ID NO: 262521 - DNA, 15 bp, Homo sapiens
cctgtagctaagaag

SEQ ID NO: 262522 - DNA, 15 bp, Homo sapiens
acctgtagctaagaa

SEQ ID NO: 262523 - DNA, 15 bp, Homo sapiens
gacctgtagctaaga

SEQ ID NO: 262524 - DNA, 15 bp, Homo sapiens
tgacctgtagctaag

SEQ ID NO: 262525 - DNA, 15 bp, Homo sapiens
gtgacctgtagctaa

SEQ ID NO: 262526 - DNA, 15 bp, Homo sapiens
ggtgacctgtagcta

SEQ ID NO: 262527 - DNA, 15 bp, Homo sapiens
aggtgacctgtagct

SEQ ID NO: 262528 - DNA, 15 bp, Homo sapiens
gaggtgacctgtagc

SEQ ID NO: 262529 - DNA, 15 bp, Homo sapiens
agaggtgacctgtag

SEQ ID NO: 262530 - DNA, 15 bp, Homo sapiens
cagaggtgacctgta

SEQ ID NO: 262531 - DNA, 15 bp, Homo sapiens
acagaggtgacctgt

SEQ ID NO: 262532 - DNA, 15 bp, Homo sapiens
cacagaggtgacctg

SEQ ID NO: 262533 - DNA, 15 bp, Homo sapiens
acacagaggtgacct

SEQ ID NO: 262534 - DNA, 15 bp, Homo sapiens
gacacagaggtgacc

SEQ ID NO: 262535 - DNA, 15 bp, Homo sapiens
agacacagaggtgac

SEQ ID NO: 262536 - DNA, 15 bp, Homo sapiens
tagacacagaggtga

SEQ ID NO: 262537 - DNA, 15 bp, Homo sapiens
ctagacacagaggtg

SEQ ID NO: 262538 - DNA, 15 bp, Homo sapiens
tctagacacagaggt

SEQ ID NO: 262539 - DNA, 15 bp, Homo sapiens
ctctagacacagagg

SEQ ID NO: 262540 - DNA, 15 bp, Homo sapiens
actctagacacagag

SEQ ID NO: 262541 - DNA, 15 bp, Homo sapiens
tactctagacacaga

SEQ ID NO: 262542 - DNA, 15 bp, Homo sapiens
gtactctagacacag

SEQ ID NO: 262543 - DNA, 15 bp, Homo sapiens
agtactctagacaca

SEQ ID NO: 262544 - DNA, 15 bp, Homo sapiens
cagtactctagacac

SEQ ID NO: 262545 - DNA, 15 bp, Homo sapiens
tcagtactctagaca

SEQ ID NO: 262546 - DNA, 15 bp, Homo sapiens
gtcagtactctagac

SEQ ID NO: 262547 - DNA, 15 bp, Homo sapiens
agtcagtactctaga

SEQ ID NO: 262548 - DNA, 15 bp, Homo sapiens
cagtcagtactctag

SEQ ID NO: 262549 - DNA, 15 bp, Homo sapiens
gcagtcagtactcta

SEQ ID NO: 262550 - DNA, 15 bp, Homo sapiens
agcagtcagtactct

SEQ ID NO: 262551 - DNA, 15 bp, Homo sapiens
gagcagtcagtactc

SEQ ID NO: 262552 - DNA, 15 bp, Homo sapiens
agagcagtcagtact

SEQ ID NO: 262553 - DNA, 15 bp, Homo sapiens
tagagcagtcagtac

SEQ ID NO: 262554 - DNA, 15 bp, Homo sapiens
ctagagcagtcagta

SEQ ID NO: 262555 - DNA, 15 bp, Homo sapiens
actagagcagtcagt

SEQ ID NO: 262556 - DNA, 15 bp, Homo sapiens
tactagagcagtcag

SEQ ID NO: 262557 - DNA, 15 bp, Homo sapiens
gtactagagcagtca

SEQ ID NO: 262558 - DNA, 15 bp, Homo sapiens
agtactagagcagtc

SEQ ID NO: 262559 - DNA, 15 bp, Homo sapiens
aagtactagagcagt

SEQ ID NO: 262560 - DNA, 15 bp, Homo sapiens
gaagtactagagcag

SEQ ID NO: 262561 - DNA, 15 bp, Homo sapiens
agaagtactagagca

SEQ ID NO: 262562 - DNA, 15 bp, Homo sapiens
aagaagtactagagc

SEQ ID NO: 262563 - DNA, 15 bp, Homo sapiens
gaagaagtactagag

SEQ ID NO: 262564 - DNA, 15 bp, Homo sapiens
tgacacagaggtgac

SEQ ID NO: 262565 - DNA, 15 bp, Homo sapiens
ctgacacagaggtga

SEQ ID NO: 262566 - DNA, 15 bp, Homo sapiens
tctgacacagaggtg

SEQ ID NO: 262567 - DNA, 15 bp, Homo sapiens
ctctgacacagaggt

SEQ ID NO: 262568 - DNA, 15 bp, Homo sapiens
gctctgacacagagg

SEQ ID NO: 262569 - DNA, 15 bp, Homo sapiens
tgctctgacacagag

SEQ ID NO: 262570 - DNA, 15 bp, Homo sapiens
atgctctgacacaga

SEQ ID NO: 262571 - DNA, 15 bp, Homo sapiens
gatgctctgacacag

SEQ ID NO: 262572 - DNA, 15 bp, Homo sapiens
tgatgctctgacaca

SEQ ID NO: 262573 - DNA, 15 bp, Homo sapiens
atgatgctctgacac

SEQ ID NO: 262574 - DNA, 15 bp, Homo sapiens
gatgatgctctgaca

SEQ ID NO: 262575 - DNA, 15 bp, Homo sapiens
cgatgatgctctgac

SEQ ID NO: 262576 - DNA, 15 bp, Homo sapiens
ccgatgatgctctga

SEQ ID NO: 262577 - DNA, 15 bp, Homo sapiens
tccgatgatgctctg

SEQ ID NO: 262578 - DNA, 15 bp, Homo sapiens
ttccgatgatgctct

SEQ ID NO: 262579 - DNA, 15 bp, Homo sapiens
cttccgatgatgctc

SEQ ID NO: 262580 - DNA, 15 bp, Homo sapiens
acttccgatgatgct

SEQ ID NO: 262581 - DNA, 15 bp, Homo sapiens
tacttccgatgatgc

SEQ ID NO: 262582 - DNA, 15 bp, Homo sapiens
ttacttccgatgatg

SEQ ID NO: 262583 - DNA, 15 bp, Homo sapiens
tttacttccgatgat

SEQ ID NO: 262584 - DNA, 15 bp, Homo sapiens
gtttacttccgatga

SEQ ID NO: 262585 - DNA, 15 bp, Homo sapiens
ggtttacttccgatg

SEQ ID NO: 262586 - DNA, 15 bp, Homo sapiens
tggtttacttccgat

SEQ ID NO: 262587 - DNA, 15 bp, Homo sapiens
ctggtttacttccga

SEQ ID NO: 262588 - DNA, 15 bp, Homo sapiens
cctggtttacttccg

SEQ ID NO: 262589 - DNA, 15 bp, Homo sapiens
acctggtttacttcc

SEQ ID NO: 262590 - DNA, 15 bp, Homo sapiens
aacctggtttacttc

SEQ ID NO: 262591 - DNA, 15 bp, Homo sapiens
taacctggtttactt

SEQ ID NO: 262592 - DNA, 15 bp, Homo sapiens
ctaacctggtttact

SEQ ID NO: 262593 - DNA, 15 bp, Homo sapiens
cctaacctggtttac

SEQ ID NO: 262594 - DNA, 15 bp, Homo sapiens
ccctaacctggttta

SEQ ID NO: 262595 - DNA, 15 bp, Homo sapiens
gccctaacctggttt

SEQ ID NO: 262596 - DNA, 15 bp, Homo sapiens
ggccctaacctggtt

SEQ ID NO: 262597 - DNA, 15 bp, Homo sapiens
tggccctaacctggt

SEQ ID NO: 262598 - DNA, 15 bp, Homo sapiens
ctggccctaacctgg

SEQ ID NO: 262599 - DNA, 15 bp, Homo sapiens
actggccctaacctg

SEQ ID NO: 262600 - DNA, 15 bp, Homo sapiens
aactggccctaacct

SEQ ID NO: 262601 - DNA, 15 bp, Homo sapiens
aaactggccctaacc

SEQ ID NO: 262602 - DNA, 15 bp, Homo sapiens
caaactggccctaac

SEQ ID NO: 262603 - DNA, 15 bp, Homo sapiens
acaaactggccctaa

SEQ ID NO: 262604 - DNA, 15 bp, Homo sapiens
cacaaactggcccta

SEQ ID NO: 262605 - DNA, 15 bp, Homo sapiens
tcacaaactggccct

SEQ ID NO: 262606 - DNA, 15 bp, Homo sapiens
gtcacaaactggccc

SEQ ID NO: 262607 - DNA, 15 bp, Homo sapiens
tgtcacaaactggcc

SEQ ID NO: 262608 - DNA, 15 bp, Homo sapiens
ttgtcacaaactggc

SEQ ID NO: 262609 - DNA, 15 bp, Homo sapiens
attgtcacaaactgg

SEQ ID NO: 262610 - DNA, 15 bp, Homo sapiens
gattgtcacaaactg

SEQ ID NO: 262611 - DNA, 15 bp, Homo sapiens
agattgtcacaaact

SEQ ID NO: 262612 - DNA, 15 bp, Homo sapiens
aagattgtcacaaac

SEQ ID NO: 262613 - DNA, 15 bp, Homo sapiens
taagattgtcacaaa

SEQ ID NO: 262614 - DNA, 15 bp, Homo sapiens
ataagattgtcacaa

SEQ ID NO: 262615 - DNA, 15 bp, Homo sapiens
tataagattgtcaca

SEQ ID NO: 262616 - DNA, 15 bp, Homo sapiens
ctataagattgtcac

SEQ ID NO: 262617 - DNA, 15 bp, Homo sapiens
tctataagattgtca

SEQ ID NO: 262618 - DNA, 15 bp, Homo sapiens
atctataagattgtc

SEQ ID NO: 262619 - DNA, 15 bp, Homo sapiens
gatctataagattgt

SEQ ID NO: 262620 - DNA, 15 bp, Homo sapiens
cgatctataagattg

SEQ ID NO: 262621 - DNA, 15 bp, Homo sapiens
ccgatctataagatt

SEQ ID NO: 262622 - DNA, 15 bp, Homo sapiens
cccgatctataagat

SEQ ID NO: 262623 - DNA, 15 bp, Homo sapiens
gcccgatctataaga

SEQ ID NO: 262624 - DNA, 15 bp, Homo sapiens
agcccgatctataag

SEQ ID NO: 262625 - DNA, 15 bp, Homo sapiens
aagcccgatctataa

SEQ ID NO: 262626 - DNA, 15 bp, Homo sapiens
caagcccgatctata

SEQ ID NO: 262627 - DNA, 15 bp, Homo sapiens
tcaagcccgatctat

SEQ ID NO: 262628 - DNA, 15 bp, Homo sapiens
atcaagcccgatcta

SEQ ID NO: 262629 - DNA, 15 bp, Homo sapiens
aatcaagcccgatct

SEQ ID NO: 262630 - DNA, 15 bp, Homo sapiens
gaatcaagcccgatc

SEQ ID NO: 262631 - DNA, 15 bp, Homo sapiens
tgaatcaagcccgat

SEQ ID NO: 262632 - DNA, 15 bp, Homo sapiens
ctgaatcaagcccga

SEQ ID NO: 262633 - DNA, 15 bp, Homo sapiens
gctgaatcaagcccg

SEQ ID NO: 262634 - DNA, 15 bp, Homo sapiens
tgctgaatcaagccc

SEQ ID NO: 262635 - DNA, 15 bp, Homo sapiens
ctgctgaatcaagcc

SEQ ID NO: 262636 - DNA, 15 bp, Homo sapiens
cctgctgaatcaagc

SEQ ID NO: 262637 - DNA, 15 bp, Homo sapiens
gcctgctgaatcaag

SEQ ID NO: 262638 - DNA, 15 bp, Homo sapiens
tgcctgctgaatcaa

SEQ ID NO: 262639 - DNA, 15 bp, Homo sapiens
ctgcctgctgaatca

SEQ ID NO: 262640 - DNA, 15 bp, Homo sapiens
actgcctgctgaatc

SEQ ID NO: 262641 - DNA, 15 bp, Homo sapiens
cactgcctgctgaat

SEQ ID NO: 262642 - DNA, 15 bp, Homo sapiens
ccactgcctgctgaa

SEQ ID NO: 262643 - DNA, 15 bp, Homo sapiens
tccactgcctgctga

SEQ ID NO: 262644 - DNA, 15 bp, Homo sapiens
ctccactgcctgctg

SEQ ID NO: 262645 - DNA, 15 bp, Homo sapiens
tctccactgcctgct

SEQ ID NO: 262646 - DNA, 15 bp, Homo sapiens
ctctccactgcctgc

SEQ ID NO: 262647 - DNA, 15 bp, Homo sapiens
gctctccactgcctg

SEQ ID NO: 262648 - DNA, 15 bp, Homo sapiens
agctctccactgcct

SEQ ID NO: 262649 - DNA, 15 bp, Homo sapiens
cagctctccactgcc

SEQ ID NO: 262650 - DNA, 15 bp, Homo sapiens
acagctctccactgc

SEQ ID NO: 262651 - DNA, 15 bp, Homo sapiens
aacagctctccactg

SEQ ID NO: 262652 - DNA, 15 bp, Homo sapiens
taacagctctccact

SEQ ID NO: 262653 - DNA, 15 bp, Homo sapiens
ataacagctctccac

SEQ ID NO: 262654 - DNA, 15 bp, Homo sapiens
aataacagctctcca

SEQ ID NO: 262655 - DNA, 15 bp, Homo sapiens
aaataacagctctcc

SEQ ID NO: 262656 - DNA, 15 bp, Homo sapiens
aaaataacagctctc

SEQ ID NO: 262657 - DNA, 15 bp, Homo sapiens
aaaaataacagctct

SEQ ID NO: 262658 - DNA, 15 bp, Homo sapiens
gaaaaataacagctc

SEQ ID NO: 262659 - DNA, 15 bp, Homo sapiens
agaaaaataacagct

SEQ ID NO: 262660 - DNA, 15 bp, Homo sapiens
tagaaaaataacagc

SEQ ID NO: 262661 - DNA, 15 bp, Homo sapiens
atagaaaaataacag

SEQ ID NO: 262662 - DNA, 15 bp, Homo sapiens
tatagaaaaataaca

SEQ ID NO: 262663 - DNA, 15 bp, Homo sapiens
ttatagaaaaataac

SEQ ID NO: 262664 - DNA, 15 bp, Homo sapiens
tttatagaaaaataa

SEQ ID NO: 262665 - DNA, 15 bp, Homo sapiens
ttttatagaaaaata

SEQ ID NO: 262666 - DNA, 15 bp, Homo sapiens
gttttatagaaaaat

SEQ ID NO: 262667 - DNA, 15 bp, Homo sapiens
ggttttatagaaaaa

SEQ ID NO: 262668 - DNA, 15 bp, Homo sapiens
aggttttatagaaaa

SEQ ID NO: 262669 - DNA, 15 bp, Homo sapiens
caggttttatagaaa

SEQ ID NO: 262670 - DNA, 15 bp, Homo sapiens
acaggttttatagaa

SEQ ID NO: 262671 - DNA, 15 bp, Homo sapiens
aacaggttttataga

SEQ ID NO: 262672 - DNA, 15 bp, Homo sapiens
aaacaggttttatag

SEQ ID NO: 262673 - DNA, 15 bp, Homo sapiens
aaaacaggttttata

SEQ ID NO: 262674 - DNA, 15 bp, Homo sapiens
aaaaacaggttttat

SEQ ID NO: 262675 - DNA, 15 bp, Homo sapiens
aaaaaacaggtttta

SEQ ID NO: 262676 - DNA, 15 bp, Homo sapiens
taaaaaacaggtttt

SEQ ID NO: 262677 - DNA, 15 bp, Homo sapiens
ttaaaaaacaggttt

SEQ ID NO: 262678 - DNA, 15 bp, Homo sapiens
attaaaaaacaggtt

SEQ ID NO: 262679 - DNA, 15 bp, Homo sapiens
tattaaaaaacaggt

SEQ ID NO: 262680 - DNA, 15 bp, Homo sapiens
atattaaaaaacagg

SEQ ID NO: 262681 - DNA, 15 bp, Homo sapiens
catattaaaaaacag

SEQ ID NO: 262682 - DNA, 15 bp, Homo sapiens
ccatattaaaaaaca

SEQ ID NO: 262683 - DNA, 15 bp, Homo sapiens
tccatattaaaaaac

SEQ ID NO: 262684 - DNA, 15 bp, Homo sapiens
ctccatattaaaaaa

SEQ ID NO: 262685 - DNA, 15 bp, Homo sapiens
gctccatattaaaaa

SEQ ID NO: 262686 - DNA, 15 bp, Homo sapiens
tgctccatattaaaa

SEQ ID NO: 262687 - DNA, 15 bp, Homo sapiens
atgctccatattaaa

SEQ ID NO: 262688 - DNA, 15 bp, Homo sapiens
gatgctccatattaa

SEQ ID NO: 262689 - DNA, 15 bp, Homo sapiens
agatgctccatatta

SEQ ID NO: 262690 - DNA, 15 bp, Homo sapiens
aagatgctccatatt

SEQ ID NO: 262691 - DNA, 15 bp, Homo sapiens
gaagatgctccatat

SEQ ID NO: 262692 - DNA, 15 bp, Homo sapiens
tgaagatgctccata

SEQ ID NO: 262693 - DNA, 15 bp, Homo sapiens
ctgaagatgctccat

SEQ ID NO: 262694 - DNA, 15 bp, Homo sapiens
actgaagatgctcca

SEQ ID NO: 262695 - DNA, 15 bp, Homo sapiens
tactgaagatgctcc

SEQ ID NO: 262696 - DNA, 15 bp, Homo sapiens
ttactgaagatgctc

SEQ ID NO: 262697 - DNA, 15 bp, Homo sapiens
tttactgaagatgct

SEQ ID NO: 262698 - DNA, 15 bp, Homo sapiens
atttactgaagatgc

SEQ ID NO: 262699 - DNA, 15 bp, Homo sapiens
aatttactgaagatg

SEQ ID NO: 262700 - DNA, 15 bp, Homo sapiens
aaatttactgaagat

SEQ ID NO: 262701 - DNA, 15 bp, Homo sapiens
aaaatttactgaaga

SEQ ID NO: 262702 - DNA, 15 bp, Homo sapiens
caaaatttactgaag

SEQ ID NO: 262703 - DNA, 15 bp, Homo sapiens
acaaaatttactgaa

SEQ ID NO: 262704 - DNA, 15 bp, Homo sapiens
tacaaaatttactga

SEQ ID NO: 262705 - DNA, 15 bp, Homo sapiens
atacaaaatttactg

SEQ ID NO: 262706 - DNA, 15 bp, Homo sapiens
catacaaaatttact

SEQ ID NO: 262707 - DNA, 15 bp, Homo sapiens
acatacaaaatttac

SEQ ID NO: 262708 - DNA, 15 bp, Homo sapiens
tacatacaaaattta

SEQ ID NO: 262709 - DNA, 15 bp, Homo sapiens
ttacatacaaaattt

SEQ ID NO: 262710 - DNA, 15 bp, Homo sapiens
attacatacaaaatt

SEQ ID NO: 262711 - DNA, 15 bp, Homo sapiens
cattacatacaaaat

SEQ ID NO: 262712 - DNA, 15 bp, Homo sapiens
tcattacatacaaaa

SEQ ID NO: 262713 - DNA, 15 bp, Homo sapiens
atcattacatacaaa

SEQ ID NO: 262714 - DNA, 15 bp, Homo sapiens
catcattacatacaa

SEQ ID NO: 262715 - DNA, 15 bp, Homo sapiens
acatcattacataca

SEQ ID NO: 262716 - DNA, 15 bp, Homo sapiens
tacatcattacatac

SEQ ID NO: 262717 - DNA, 15 bp, Homo sapiens
gtacatcattacata

SEQ ID NO: 262718 - DNA, 15 bp, Homo sapiens
tgtacatcattacat

SEQ ID NO: 262719 - DNA, 15 bp, Homo sapiens
atgtacatcattaca

SEQ ID NO: 262720 - DNA, 15 bp, Homo sapiens
catgtacatcattac

SEQ ID NO: 262721 - DNA, 15 bp, Homo sapiens
tcatgtacatcatta

SEQ ID NO: 262722 - DNA, 15 bp, Homo sapiens
atcatgtacatcatt

SEQ ID NO: 262723 - DNA, 15 bp, Homo sapiens
tatcatgtacatcat

SEQ ID NO: 262724 - DNA, 15 bp, Homo sapiens
ttatcatgtacatca

SEQ ID NO: 262725 - DNA, 15 bp, Homo sapiens
tttatcatgtacatc

SEQ ID NO: 262726 - DNA, 15 bp, Homo sapiens
ttttatcatgtacat

SEQ ID NO: 262727 - DNA, 15 bp, Homo sapiens
cttttatcatgtaca

SEQ ID NO: 262728 - DNA, 15 bp, Homo sapiens
tcttttatcatgtac

SEQ ID NO: 262729 - DNA, 15 bp, Homo sapiens
gtcttttatcatgta

SEQ ID NO: 262730 - DNA, 15 bp, Homo sapiens
agtcttttatcatgt

SEQ ID NO: 262731 - DNA, 15 bp, Homo sapiens
cagtcttttatcatg

SEQ ID NO: 262732 - DNA, 15 bp, Homo sapiens
acagtcttttatcat

SEQ ID NO: 262733 - DNA, 15 bp, Homo sapiens
aacagtcttttatca

SEQ ID NO: 262734 - DNA, 15 bp, Homo sapiens
aaacagtcttttatc

SEQ ID NO: 262735 - DNA, 15 bp, Homo sapiens
taaacagtcttttat

SEQ ID NO: 262736 - DNA, 15 bp, Homo sapiens
ttaaacagtctttta

SEQ ID NO: 262737 - DNA, 15 bp, Homo sapiens
cttaaacagtctttt

SEQ ID NO: 262738 - DNA, 15 bp, Homo sapiens
tcttaaacagtcttt

SEQ ID NO: 262739 - DNA, 15 bp, Homo sapiens
ttcttaaacagtctt

SEQ ID NO: 262740 - DNA, 15 bp, Homo sapiens
gttcttaaacagtct

SEQ ID NO: 262741 - DNA, 15 bp, Homo sapiens
tgttcttaaacagtc

SEQ ID NO: 262742 - DNA, 15 bp, Homo sapiens
ttgttcttaaacagt

SEQ ID NO: 262743 - DNA, 15 bp, Homo sapiens
attgttcttaaacag

SEQ ID NO: 262744 - DNA, 15 bp, Homo sapiens
aattgttcttaaaca

SEQ ID NO: 262745 - DNA, 15 bp, Homo sapiens
taattgttcttaaac

SEQ ID NO: 262746 - DNA, 15 bp, Homo sapiens
ctaattgttcttaaa

SEQ ID NO: 262747 - DNA, 15 bp, Homo sapiens
actaattgttcttaa

SEQ ID NO: 262748 - DNA, 15 bp, Homo sapiens
aactaattgttctta

SEQ ID NO: 262749 - DNA, 15 bp, Homo sapiens
aaactaattgttctt

SEQ ID NO: 262750 - DNA, 15 bp, Homo sapiens
caaactaattgttct

SEQ ID NO: 262751 - DNA, 15 bp, Homo sapiens
ccaaactaattgttc

SEQ ID NO: 262752 - DNA, 15 bp, Homo sapiens
gccaaactaattgtt

SEQ ID NO: 262753 - DNA, 15 bp, Homo sapiens
agccaaactaattgt

SEQ ID NO: 262754 - DNA, 15 bp, Homo sapiens
cagccaaactaattg

SEQ ID NO: 262755 - DNA, 15 bp, Homo sapiens
acagccaaactaatt

SEQ ID NO: 262756 - DNA, 15 bp, Homo sapiens
cacagccaaactaat

SEQ ID NO: 262757 - DNA, 15 bp, Homo sapiens
tcacagccaaactaa

SEQ ID NO: 262758 - DNA, 15 bp, Homo sapiens
atcacagccaaacta

SEQ ID NO: 262759 - DNA, 15 bp, Homo sapiens
tatcacagccaaact

SEQ ID NO: 262760 - DNA, 15 bp, Homo sapiens
gtatcacagccaaac

SEQ ID NO: 262761 - DNA, 15 bp, Homo sapiens
tgtatcacagccaaa

SEQ ID NO: 262762 - DNA, 15 bp, Homo sapiens
ttgtatcacagccaa

SEQ ID NO: 262763 - DNA, 15 bp, Homo sapiens
tttgtatcacagcca

SEQ ID NO: 262764 - DNA, 15 bp, Homo sapiens
ctttgtatcacagcc

SEQ ID NO: 262765 - DNA, 15 bp, Homo sapiens
tctttgtatcacagc

SEQ ID NO: 262766 - DNA, 15 bp, Homo sapiens
ttctttgtatcacag

SEQ ID NO: 262767 - DNA, 15 bp, Homo sapiens
attctttgtatcaca

SEQ ID NO: 262768 - DNA, 15 bp, Homo sapiens
cattctttgtatcac

SEQ ID NO: 262769 - DNA, 15 bp, Homo sapiens
tcattctttgtatca

SEQ ID NO: 262770 - DNA, 15 bp, Homo sapiens
ttcattctttgtatc

SEQ ID NO: 262771 - DNA, 15 bp, Homo sapiens
cttcattctttgtat

SEQ ID NO: 262772 - DNA, 15 bp, Homo sapiens
tcttcattctttgta

SEQ ID NO: 262773 - DNA, 15 bp, Homo sapiens
ctcttcattctttgt

SEQ ID NO: 262774 - DNA, 15 bp, Homo sapiens
tctcttcattctttg

SEQ ID NO: 262775 - DNA, 15 bp, Homo sapiens
ctctcttcattcttt

SEQ ID NO: 262776 - DNA, 15 bp, Homo sapiens
gctctcttcattctt

SEQ ID NO: 262777 - DNA, 15 bp, Homo sapiens
tgctctcttcattct

SEQ ID NO: 262778 - DNA, 15 bp, Homo sapiens
ctgctctcttcattc

SEQ ID NO: 262779 - DNA, 15 bp, Homo sapiens
actgctctcttcatt

SEQ ID NO: 262780 - DNA, 15 bp, Homo sapiens
cactgctctcttcat

SEQ ID NO: 262781 - DNA, 15 bp, Homo sapiens
gcactgctctcttca

SEQ ID NO: 262782 - DNA, 15 bp, Homo sapiens
tgcactgctctcttc

SEQ ID NO: 262783 - DNA, 15 bp, Homo sapiens
gtgcactgctctctt

SEQ ID NO: 262784 - DNA, 15 bp, Homo sapiens
tgtgcactgctctct

SEQ ID NO: 262785 - DNA, 15 bp, Homo sapiens
ctgtgcactgctctc

SEQ ID NO: 262786 - DNA, 15 bp, Homo sapiens
cctgtgcactgctct

SEQ ID NO: 262787 - DNA, 15 bp, Homo sapiens
gcctgtgcactgctc

SEQ ID NO: 262788 - DNA, 15 bp, Homo sapiens
agcctgtgcactgct

SEQ ID NO: 262789 - DNA, 15 bp, Homo sapiens
cagcctgtgcactgc

SEQ ID NO: 262790 - DNA, 15 bp, Homo sapiens
gcagcctgtgcactg

SEQ ID NO: 262791 - DNA, 15 bp, Homo sapiens
agcagcctgtgcact

SEQ ID NO: 262792 - DNA, 15 bp, Homo sapiens
aagcagcctgtgcac

SEQ ID NO: 262793 - DNA, 15 bp, Homo sapiens
caagcagcctgtgca

SEQ ID NO: 262794 - DNA, 15 bp, Homo sapiens
gcaagcagcctgtgc

SEQ ID NO: 262795 - DNA, 15 bp, Homo sapiens
tgcaagcagcctgtg

SEQ ID NO: 262796 - DNA, 15 bp, Homo sapiens
ctgcaagcagcctgt

SEQ ID NO: 262797 - DNA, 15 bp, Homo sapiens
cctgcaagcagcctg

SEQ ID NO: 262798 - DNA, 15 bp, Homo sapiens
tcctgcaagcagcct

SEQ ID NO: 262799 - DNA, 15 bp, Homo sapiens
ctcctgcaagcagcc

SEQ ID NO: 262800 - DNA, 15 bp, Homo sapiens
actcctgcaagcagc

SEQ ID NO: 262801 - DNA, 15 bp, Homo sapiens
aactcctgcaagcag

SEQ ID NO: 262802 - DNA, 15 bp, Homo sapiens
taactcctgcaagca

SEQ ID NO: 262803 - DNA, 15 bp, Homo sapiens
ttaactcctgcaagc

SEQ ID NO: 262804 - DNA, 15 bp, Homo sapiens
cttaactcctgcaag

SEQ ID NO: 262805 - DNA, 15 bp, Homo sapiens
tcttaactcctgcaa

SEQ ID NO: 262806 - DNA, 15 bp, Homo sapiens
atcttaactcctgca

SEQ ID NO: 262807 - DNA, 15 bp, Homo sapiens
catcttaactcctgc

SEQ ID NO: 262808 - DNA, 15 bp, Homo sapiens
tcatcttaactcctg

SEQ ID NO: 262809 - DNA, 15 bp, Homo sapiens
ctcatcttaactcct

SEQ ID NO: 262810 - DNA, 15 bp, Homo sapiens
cctcatcttaactcc

SEQ ID NO: 262811 - DNA, 15 bp, Homo sapiens
tcctcatcttaactc

SEQ ID NO: 262812 - DNA, 15 bp, Homo sapiens
ctcctcatcttaact

SEQ ID NO: 262813 - DNA, 15 bp, Homo sapiens
tctcctcatcttaac

SEQ ID NO: 262814 - DNA, 15 bp, Homo sapiens
ctctcctcatcttaa

SEQ ID NO: 262815 - DNA, 15 bp, Homo sapiens
gctctcctcatctta

SEQ ID NO: 262816 - DNA, 15 bp, Homo sapiens
tgctctcctcatctt

SEQ ID NO: 262817 - DNA, 15 bp, Homo sapiens
ctgctctcctcatct

SEQ ID NO: 262818 - DNA, 15 bp, Homo sapiens
actgctctcctcatc

SEQ ID NO: 262819 - DNA, 15 bp, Homo sapiens
cactgctctcctcat

SEQ ID NO: 262820 - DNA, 15 bp, Homo sapiens
acactgctctcctca

SEQ ID NO: 262821 - DNA, 15 bp, Homo sapiens
tacactgctctcctc

SEQ ID NO: 262822 - DNA, 15 bp, Homo sapiens
ttacactgctctcct

SEQ ID NO: 262823 - DNA, 15 bp, Homo sapiens
attacactgctctcc

SEQ ID NO: 262824 - DNA, 15 bp, Homo sapiens
tattacactgctctc

SEQ ID NO: 262825 - DNA, 15 bp, Homo sapiens
atattacactgctct

SEQ ID NO: 262826 - DNA, 15 bp, Homo sapiens
aatattacactgctc

SEQ ID NO: 262827 - DNA, 15 bp, Homo sapiens
aaatattacactgct

SEQ ID NO: 262828 - DNA, 15 bp, Homo sapiens
caaatattacactgc

SEQ ID NO: 262829 - DNA, 15 bp, Homo sapiens
tcaaatattacactg

SEQ ID NO: 262830 - DNA, 15 bp, Homo sapiens
ctcaaatattacact

SEQ ID NO: 262831 - DNA, 15 bp, Homo sapiens
tctcaaatattacac

SEQ ID NO: 262832 - DNA, 15 bp, Homo sapiens
atctcaaatattaca

SEQ ID NO: 262833 - DNA, 15 bp, Homo sapiens
catctcaaatattac

SEQ ID NO: 262834 - DNA, 15 bp, Homo sapiens
gcatctcaaatatta

SEQ ID NO: 262835 - DNA, 15 bp, Homo sapiens
cgcatctcaaatatt

SEQ ID NO: 262836 - DNA, 15 bp, Homo sapiens
gcgcatctcaaatat

SEQ ID NO: 262837 - DNA, 15 bp, Homo sapiens
agcgcatctcaaata

SEQ ID NO: 262838 - DNA, 15 bp, Homo sapiens
cagcgcatctcaaat

SEQ ID NO: 262839 - DNA, 15 bp, Homo sapiens
gcagcgcatctcaaa

SEQ ID NO: 262840 - DNA, 15 bp, Homo sapiens
ggcagcgcatctcaa

SEQ ID NO: 262841 - DNA, 15 bp, Homo sapiens
tggcagcgcatctca

SEQ ID NO: 262842 - DNA, 15 bp, Homo sapiens
atggcagcgcatctc

SEQ ID NO: 262843 - DNA, 15 bp, Homo sapiens
aatggcagcgcatct

SEQ ID NO: 262844 - DNA, 15 bp, Homo sapiens
aaatggcagcgcatc

SEQ ID NO: 262845 - DNA, 15 bp, Homo sapiens
caaatggcagcgcat

SEQ ID NO: 262846 - DNA, 15 bp, Homo sapiens
ccaaatggcagcgca

SEQ ID NO: 262847 - DNA, 15 bp, Homo sapiens
tccaaatggcagcgc

SEQ ID NO: 262848 - DNA, 15 bp, Homo sapiens
ctccaaatggcagcg

SEQ ID NO: 262849 - DNA, 15 bp, Homo sapiens
actccaaatggcagc

SEQ ID NO: 262850 - DNA, 15 bp, Homo sapiens
tactccaaatggcag

SEQ ID NO: 262851 - DNA, 15 bp, Homo sapiens
ctactccaaatggca

SEQ ID NO: 262852 - DNA, 15 bp, Homo sapiens
tctactccaaatggc

SEQ ID NO: 262853 - DNA, 15 bp, Homo sapiens
atctactccaaatgg

SEQ ID NO: 262854 - DNA, 15 bp, Homo sapiens
aatctactccaaatg

SEQ ID NO: 262855 - DNA, 15 bp, Homo sapiens
caatctactccaaat

SEQ ID NO: 262856 - DNA, 15 bp, Homo sapiens
tcaatctactccaaa

SEQ ID NO: 262857 - DNA, 15 bp, Homo sapiens
ctcaatctactccaa

SEQ ID NO: 262858 - DNA, 15 bp, Homo sapiens
tctcaatctactcca

SEQ ID NO: 262859 - DNA, 15 bp, Homo sapiens
ctctcaatctactcc

SEQ ID NO: 262860 - DNA, 15 bp, Homo sapiens
tctctcaatctactc

SEQ ID NO: 262861 - DNA, 15 bp, Homo sapiens
atctctcaatctact

SEQ ID NO: 262862 - DNA, 15 bp, Homo sapiens
aatctctcaatctac

SEQ ID NO: 262863 - DNA, 15 bp, Homo sapiens
aaatctctcaatcta

SEQ ID NO: 262864 - DNA, 15 bp, Homo sapiens
taaatctctcaatct

SEQ ID NO: 262865 - DNA, 15 bp, Homo sapiens
ataaatctctcaatc

SEQ ID NO: 262866 - DNA, 15 bp, Homo sapiens
cataaatctctcaat

SEQ ID NO: 262867 - DNA, 15 bp, Homo sapiens
gcataaatctctcaa

SEQ ID NO: 262868 - DNA, 15 bp, Homo sapiens
ggcataaatctctca

SEQ ID NO: 262869 - DNA, 15 bp, Homo sapiens
aggcataaatctctc

SEQ ID NO: 262870 - DNA, 15 bp, Homo sapiens
aaggcataaatctct

SEQ ID NO: 262871 - DNA, 15 bp, Homo sapiens
caaggcataaatctc

SEQ ID NO: 262872 - DNA, 15 bp, Homo sapiens
gcaaggcataaatct

SEQ ID NO: 262873 - DNA, 15 bp, Homo sapiens
agcaaggcataaatc

SEQ ID NO: 262874 - DNA, 15 bp, Homo sapiens
tagcaaggcataaat

SEQ ID NO: 262875 - DNA, 15 bp, Homo sapiens
gtagcaaggcataaa

SEQ ID NO: 262876 - DNA, 15 bp, Homo sapiens
tgtagcaaggcataa

SEQ ID NO: 262877 - DNA, 15 bp, Homo sapiens
atgtagcaaggcata

SEQ ID NO: 262878 - DNA, 15 bp, Homo sapiens
aatgtagcaaggcat

SEQ ID NO: 262879 - DNA, 15 bp, Homo sapiens
aaatgtagcaaggca

SEQ ID NO: 262880 - DNA, 15 bp, Homo sapiens
taaatgtagcaaggc

SEQ ID NO: 262881 - DNA, 15 bp, Homo sapiens
ttaaatgtagcaagg

SEQ ID NO: 262882 - DNA, 15 bp, Homo sapiens
tttaaatgtagcaag

SEQ ID NO: 262883 - DNA, 15 bp, Homo sapiens
ttttaaatgtagcaa

SEQ ID NO: 262884 - DNA, 15 bp, Homo sapiens
cttttaaatgtagca

SEQ ID NO: 262885 - DNA, 15 bp, Homo sapiens
gcttttaaatgtagc

SEQ ID NO: 262886 - DNA, 15 bp, Homo sapiens
tgcttttaaatgtag

SEQ ID NO: 262887 - DNA, 15 bp, Homo sapiens
ttgcttttaaatgta

SEQ ID NO: 262888 - DNA, 15 bp, Homo sapiens
tttgcttttaaatgt

SEQ ID NO: 262889 - DNA, 15 bp, Homo sapiens
ttttgcttttaaatg

SEQ ID NO: 262890 - DNA, 15 bp, Homo sapiens
tttttgcttttaaat

SEQ ID NO: 262891 - DNA, 15 bp, Homo sapiens
ctttttgcttttaaa

SEQ ID NO: 262892 - DNA, 15 bp, Homo sapiens
tctttttgcttttaa

SEQ ID NO: 262893 - DNA, 15 bp, Homo sapiens
ctctttttgctttta

SEQ ID NO: 262894 - DNA, 15 bp, Homo sapiens
gctctttttgctttt

SEQ ID NO: 262895 - DNA, 15 bp, Homo sapiens
ggctctttttgcttt

SEQ ID NO: 262896 - DNA, 15 bp, Homo sapiens
aggctctttttgctt

SEQ ID NO: 262897 - DNA, 15 bp, Homo sapiens
caggctctttttgct

SEQ ID NO: 262898 - DNA, 15 bp, Homo sapiens
ccaggctctttttgc

SEQ ID NO: 262899 - DNA, 15 bp, Homo sapiens
gccaggctctttttg

SEQ ID NO: 262900 - DNA, 15 bp, Homo sapiens
tgccaggctcttttt

SEQ ID NO: 262901 - DNA, 15 bp, Homo sapiens
ttgccaggctctttt

SEQ ID NO: 262902 - DNA, 15 bp, Homo sapiens
tttgccaggctcttt

SEQ ID NO: 262903 - DNA, 15 bp, Homo sapiens
ctttgccaggctctt

SEQ ID NO: 262904 - DNA, 15 bp, Homo sapiens
cctttgccaggctct

SEQ ID NO: 262905 - DNA, 15 bp, Homo sapiens
ccctttgccaggctc

SEQ ID NO: 262906 - DNA, 15 bp, Homo sapiens
tccctttgccaggct

SEQ ID NO: 262907 - DNA, 15 bp, Homo sapiens
ttccctttgccaggc

SEQ ID NO: 262908 - DNA, 15 bp, Homo sapiens
tttccctttgccagg

SEQ ID NO: 262909 - DNA, 15 bp, Homo sapiens
ctttccctttgccag

SEQ ID NO: 262910 - DNA, 15 bp, Homo sapiens
gctttccctttgcca

SEQ ID NO: 262911 - DNA, 15 bp, Homo sapiens
ggctttccctttgcc

SEQ ID NO: 262912 - DNA, 15 bp, Homo sapiens
tggctttccctttgc

SEQ ID NO: 262913 - DNA, 15 bp, Homo sapiens
ctggctttccctttg

SEQ ID NO: 262914 - DNA, 15 bp, Homo sapiens
tctggctttcccttt

SEQ ID NO: 262915 - DNA, 15 bp, Homo sapiens
ttctggctttccctt

SEQ ID NO: 262916 - DNA, 15 bp, Homo sapiens
tttctggctttccct

SEQ ID NO: 262917 - DNA, 15 bp, Homo sapiens
ttttctggctttccc

SEQ ID NO: 262918 - DNA, 15 bp, Homo sapiens
tttttctggctttcc

SEQ ID NO: 262919 - DNA, 15 bp, Homo sapiens
ctttttctggctttc

SEQ ID NO: 262920 - DNA, 15 bp, Homo sapiens
tctttttctggcttt

SEQ ID NO: 262921 - DNA, 15 bp, Homo sapiens
ttctttttctggctt

SEQ ID NO: 262922 - DNA, 15 bp, Homo sapiens
tttctttttctggct

SEQ ID NO: 262923 - DNA, 15 bp, Homo sapiens
ctttctttttctggc

SEQ ID NO: 262924 - DNA, 15 bp, Homo sapiens
actttctttttctgg

SEQ ID NO: 262925 - DNA, 15 bp, Homo sapiens
tactttctttttctg

SEQ ID NO: 262926 - DNA, 15 bp, Homo sapiens
ctactttctttttct

SEQ ID NO: 262927 - DNA, 15 bp, Homo sapiens
cctactttctttttc

SEQ ID NO: 262928 - DNA, 15 bp, Homo sapiens
tcctactttcttttt

SEQ ID NO: 262929 - DNA, 15 bp, Homo sapiens
ttcctactttctttt

SEQ ID NO: 262930 - DNA, 15 bp, Homo sapiens
attcctactttcttt

SEQ ID NO: 262931 - DNA, 15 bp, Homo sapiens
tattcctactttctt

SEQ ID NO: 262932 - DNA, 15 bp, Homo sapiens
ttattcctactttct

SEQ ID NO: 262933 - DNA, 15 bp, Homo sapiens
attattcctactttc

SEQ ID NO: 262934 - DNA, 15 bp, Homo sapiens
aattattcctacttt

SEQ ID NO: 262935 - DNA, 15 bp, Homo sapiens
taattattcctactt

SEQ ID NO: 262936 - DNA, 15 bp, Homo sapiens
ttaattattcctact

SEQ ID NO: 262937 - DNA, 15 bp, Homo sapiens
attaattattcctac

SEQ ID NO: 262938 - DNA, 15 bp, Homo sapiens
tattaattattccta

SEQ ID NO: 262939 - DNA, 15 bp, Homo sapiens
atattaattattcct

SEQ ID NO: 262940 - DNA, 15 bp, Homo sapiens
aatattaattattcc

SEQ ID NO: 262941 - DNA, 15 bp, Homo sapiens
gaatattaattattc

SEQ ID NO: 262942 - DNA, 15 bp, Homo sapiens
ggaatattaattatt

SEQ ID NO: 262943 - DNA, 15 bp, Homo sapiens
tggaatattaattat

SEQ ID NO: 262944 - DNA, 15 bp, Homo sapiens
ttggaatattaatta

SEQ ID NO: 262945 - DNA, 15 bp, Homo sapiens
tttggaatattaatt

SEQ ID NO: 262946 - DNA, 15 bp, Homo sapiens
ctttggaatattaat

SEQ ID NO: 262947 - DNA, 15 bp, Homo sapiens
tctttggaatattaa

SEQ ID NO: 262948 - DNA, 15 bp, Homo sapiens
ctctttggaatatta

SEQ ID NO: 262949 - DNA, 15 bp, Homo sapiens
gctctttggaatatt

SEQ ID NO: 262950 - DNA, 15 bp, Homo sapiens
tgctctttggaatat

SEQ ID NO: 262951 - DNA, 15 bp, Homo sapiens
ttgctctttggaata

SEQ ID NO: 262952 - DNA, 15 bp, Homo sapiens
tttgctctttggaat

SEQ ID NO: 262953 - DNA, 15 bp, Homo sapiens
ttttgctctttggaa

SEQ ID NO: 262954 - DNA, 15 bp, Homo sapiens
tttttgctctttgga

SEQ ID NO: 262955 - DNA, 15 bp, Homo sapiens
ttttttgctctttgg

SEQ ID NO: 262956 - DNA, 15 bp, Homo sapiens
attttttgctctttg

SEQ ID NO: 262957 - DNA, 15 bp, Homo sapiens
cattttttgctcttt

SEQ ID NO: 262958 - DNA, 15 bp, Homo sapiens
tcattttttgctctt

SEQ ID NO: 262959 - DNA, 15 bp, Homo sapiens
ctcattttttgctct

SEQ ID NO: 262960 - DNA, 15 bp, Homo sapiens
tctcattttttgctc

SEQ ID NO: 262961 - DNA, 15 bp, Homo sapiens
atctcattttttgct

SEQ ID NO: 262962 - DNA, 15 bp, Homo sapiens
tatctcattttttgc

SEQ ID NO: 262963 - DNA, 15 bp, Homo sapiens
ttatctcattttttg

SEQ ID NO: 262964 - DNA, 15 bp, Homo sapiens
cttatctcatttttt

SEQ ID NO: 262965 - DNA, 15 bp, Homo sapiens
tcttatctcattttt

SEQ ID NO: 262966 - DNA, 15 bp, Homo sapiens
atcttatctcatttt

SEQ ID NO: 262967 - DNA, 15 bp, Homo sapiens
aatcttatctcattt

SEQ ID NO: 262968 - DNA, 15 bp, Homo sapiens
caatcttatctcatt

SEQ ID NO: 262969 - DNA, 15 bp, Homo sapiens
ccaatcttatctcat

SEQ ID NO: 262970 - DNA, 15 bp, Homo sapiens
cccaatcttatctca

SEQ ID NO: 262971 - DNA, 15 bp, Homo sapiens
tcccaatcttatctc

SEQ ID NO: 262972 - DNA, 15 bp, Homo sapiens
ttcccaatcttatct

SEQ ID NO: 262973 - DNA, 15 bp, Homo sapiens
cttcccaatcttatc

SEQ ID NO: 262974 - DNA, 15 bp, Homo sapiens
gcttcccaatcttat

SEQ ID NO: 262975 - DNA, 15 bp, Homo sapiens
tgcttcccaatctta

SEQ ID NO: 262976 - DNA, 15 bp, Homo sapiens
ttgcttcccaatctt

SEQ ID NO: 262977 - DNA, 15 bp, Homo sapiens
gttgcttcccaatct

SEQ ID NO: 262978 - DNA, 15 bp, Homo sapiens
tgttgcttcccaatc

SEQ ID NO: 262979 - DNA, 15 bp, Homo sapiens
ctgttgcttcccaat

SEQ ID NO: 262980 - DNA, 15 bp, Homo sapiens
tctgttgcttcccaa

SEQ ID NO: 262981 - DNA, 15 bp, Homo sapiens
ctctgttgcttccca

SEQ ID NO: 262982 - DNA, 15 bp, Homo sapiens
actctgttgcttccc

SEQ ID NO: 262983 - DNA, 15 bp, Homo sapiens
aactctgttgcttcc

SEQ ID NO: 262984 - DNA, 15 bp, Homo sapiens
gaactctgttgcttc

SEQ ID NO: 262985 - DNA, 15 bp, Homo sapiens
tgaactctgttgctt

SEQ ID NO: 262986 - DNA, 15 bp, Homo sapiens
ctgaactctgttgct

SEQ ID NO: 262987 - DNA, 15 bp, Homo sapiens
tctgaactctgttgc

SEQ ID NO: 262988 - DNA, 15 bp, Homo sapiens
atctgaactctgttg

SEQ ID NO: 262989 - DNA, 15 bp, Homo sapiens
aatctgaactctgtt

SEQ ID NO: 262990 - DNA, 15 bp, Homo sapiens
gaatctgaactctgt

SEQ ID NO: 262991 - DNA, 15 bp, Homo sapiens
tgaatctgaactctg

SEQ ID NO: 262992 - DNA, 15 bp, Homo sapiens
ttgaatctgaactct

SEQ ID NO: 262993 - DNA, 15 bp, Homo sapiens
tttgaatctgaactc

SEQ ID NO: 262994 - DNA, 15 bp, Homo sapiens
ttttgaatctgaact

SEQ ID NO: 262995 - DNA, 15 bp, Homo sapiens
cttttgaatctgaac

SEQ ID NO: 262996 - DNA, 15 bp, Homo sapiens
acttttgaatctgaa

SEQ ID NO: 262997 - DNA, 15 bp, Homo sapiens
tacttttgaatctga

SEQ ID NO: 262998 - DNA, 15 bp, Homo sapiens
atacttttgaatctg

SEQ ID NO: 262999 - DNA, 15 bp, Homo sapiens
catacttttgaatct

SEQ ID NO: 263000 - DNA, 15 bp, Homo sapiens
tcatacttttgaatc

SEQ ID NO: 263001 - DNA, 15 bp, Homo sapiens
ttcatacttttgaat

SEQ ID NO: 263002 - DNA, 15 bp, Homo sapiens
tttcatacttttgaa

SEQ ID NO: 263003 - DNA, 15 bp, Homo sapiens
ctttcatacttttga

SEQ ID NO: 263004 - DNA, 15 bp, Homo sapiens
actttcatacttttg

SEQ ID NO: 263005 - DNA, 15 bp, Homo sapiens
cactttcatactttt

SEQ ID NO: 263006 - DNA, 15 bp, Homo sapiens
acactttcatacttt

SEQ ID NO: 263007 - DNA, 15 bp, Homo sapiens
cacactttcatactt

SEQ ID NO: 263008 - DNA, 15 bp, Homo sapiens
ccacactttcatact

SEQ ID NO: 263009 - DNA, 15 bp, Homo sapiens
accacactttcatac

SEQ ID NO: 263010 - DNA, 15 bp, Homo sapiens
taccacactttcata

SEQ ID NO: 263011 - DNA, 15 bp, Homo sapiens
ttaccacactttcat

SEQ ID NO: 263012 - DNA, 15 bp, Homo sapiens
tttaccacactttca

SEQ ID NO: 263013 - DNA, 15 bp, Homo sapiens
ttttaccacactttc

SEQ ID NO: 263014 - DNA, 15 bp, Homo sapiens
attttaccacacttt

SEQ ID NO: 263015 - DNA, 15 bp, Homo sapiens
cattttaccacactt

SEQ ID NO: 263016 - DNA, 15 bp, Homo sapiens
acattttaccacact

SEQ ID NO: 263017 - DNA, 15 bp, Homo sapiens
tacattttaccacac

SEQ ID NO: 263018 - DNA, 15 bp, Homo sapiens
ttacattttaccaca

SEQ ID NO: 263019 - DNA, 15 bp, Homo sapiens
cttacattttaccac

SEQ ID NO: 263020 - DNA, 15 bp, Homo sapiens
tcttacattttacca

SEQ ID NO: 263021 - DNA, 15 bp, Homo sapiens
ttcttacattttacc

SEQ ID NO: 263022 - DNA, 15 bp, Homo sapiens
attcttacattttac

SEQ ID NO: 263023 - DNA, 15 bp, Homo sapiens
tattcttacatttta

SEQ ID NO: 263024 - DNA, 15 bp, Homo sapiens
ctattcttacatttt

SEQ ID NO: 263025 - DNA, 15 bp, Homo sapiens
tctattcttacattt

SEQ ID NO: 263026 - DNA, 15 bp, Homo sapiens
ttctattcttacatt

SEQ ID NO: 263027 - DNA, 15 bp, Homo sapiens
tttctattcttacat

SEQ ID NO: 263028 - DNA, 15 bp, Homo sapiens
atttctattcttaca

SEQ ID NO: 263029 - DNA, 15 bp, Homo sapiens
catttctattcttac

SEQ ID NO: 263030 - DNA, 15 bp, Homo sapiens
acatttctattctta

SEQ ID NO: 263031 - DNA, 15 bp, Homo sapiens
cacatttctattctt

SEQ ID NO: 263032 - DNA, 15 bp, Homo sapiens
acacatttctattct

SEQ ID NO: 263033 - DNA, 15 bp, Homo sapiens
aacacatttctattc

SEQ ID NO: 263034 - DNA, 15 bp, Homo sapiens
aaacacatttctatt

SEQ ID NO: 263035 - DNA, 15 bp, Homo sapiens
caaacacatttctat

SEQ ID NO: 263036 - DNA, 15 bp, Homo sapiens
acaaacacatttcta

SEQ ID NO: 263037 - DNA, 15 bp, Homo sapiens
aacaaacacatttct

SEQ ID NO: 263038 - DNA, 15 bp, Homo sapiens
aaacaaacacatttc

SEQ ID NO: 263039 - DNA, 15 bp, Homo sapiens
gaaacaaacacattt

SEQ ID NO: 263040 - DNA, 15 bp, Homo sapiens
agaaacaaacacatt

SEQ ID NO: 263041 - DNA, 15 bp, Homo sapiens
aagaaacaaacacat

SEQ ID NO: 263042 - DNA, 15 bp, Homo sapiens
aaagaaacaaacaca

SEQ ID NO: 263043 - DNA, 15 bp, Homo sapiens
taaagaaacaaacac

SEQ ID NO: 263044 - DNA, 15 bp, Homo sapiens
ttaaagaaacaaaca

SEQ ID NO: 263045 - DNA, 15 bp, Homo sapiens
tttaaagaaacaaac

SEQ ID NO: 263046 - DNA, 15 bp, Homo sapiens
ttttaaagaaacaaa

SEQ ID NO: 263047 - DNA, 15 bp, Homo sapiens
cttttaaagaaacaa

SEQ ID NO: 263048 - DNA, 15 bp, Homo sapiens
gcttttaaagaaaca

SEQ ID NO: 263049 - DNA, 15 bp, Homo sapiens
agcttttaaagaaac

SEQ ID NO: 263050 - DNA, 15 bp, Homo sapiens
cagcttttaaagaaa

SEQ ID NO: 263051 - DNA, 15 bp, Homo sapiens
tcagcttttaaagaa

SEQ ID NO: 263052 - DNA, 15 bp, Homo sapiens
ttcagcttttaaaga

SEQ ID NO: 263053 - DNA, 15 bp, Homo sapiens
tttcagcttttaaag

SEQ ID NO: 263054 - DNA, 15 bp, Homo sapiens
atttcagcttttaaa

SEQ ID NO: 263055 - DNA, 15 bp, Homo sapiens
aatttcagcttttaa

SEQ ID NO: 263056 - DNA, 15 bp, Homo sapiens
aaatttcagctttta

SEQ ID NO: 263057 - DNA, 15 bp, Homo sapiens
taaatttcagctttt

SEQ ID NO: 263058 - DNA, 15 bp, Homo sapiens
ctaaatttcagcttt

SEQ ID NO: 263059 - DNA, 15 bp, Homo sapiens
gctaaatttcagctt

SEQ ID NO: 263060 - DNA, 15 bp, Homo sapiens
agctaaatttcagct

SEQ ID NO: 263061 - DNA, 15 bp, Homo sapiens
tagctaaatttcagc

SEQ ID NO: 263062 - DNA, 15 bp, Homo sapiens
ttagctaaatttcag

SEQ ID NO: 263063 - DNA, 15 bp, Homo sapiens
tttagctaaatttca

SEQ ID NO: 263064 - DNA, 15 bp, Homo sapiens
ttttagctaaatttc

SEQ ID NO: 263065 - DNA, 15 bp, Homo sapiens
tttttagctaaattt

SEQ ID NO: 263066 - DNA, 15 bp, Homo sapiens
ctttttagctaaatt

SEQ ID NO: 263067 - DNA, 15 bp, Homo sapiens
cctttttagctaaat

SEQ ID NO: 263068 - DNA, 15 bp, Homo sapiens
tcctttttagctaaa

SEQ ID NO: 263069 - DNA, 15 bp, Homo sapiens
atcctttttagctaa

SEQ ID NO: 263070 - DNA, 15 bp, Homo sapiens
tatcctttttagcta

SEQ ID NO: 263071 - DNA, 15 bp, Homo sapiens
ctatcctttttagct

SEQ ID NO: 263072 - DNA, 15 bp, Homo sapiens
tctatcctttttagc

SEQ ID NO: 263073 - DNA, 15 bp, Homo sapiens
atctatcctttttag

SEQ ID NO: 263074 - DNA, 15 bp, Homo sapiens
aatctatccttttta

SEQ ID NO: 263075 - DNA, 15 bp, Homo sapiens
gaatctatccttttt

SEQ ID NO: 263076 - DNA, 15 bp, Homo sapiens
agaatctatcctttt

SEQ ID NO: 263077 - DNA, 15 bp, Homo sapiens
aagaatctatccttt

SEQ ID NO: 263078 - DNA, 15 bp, Homo sapiens
taagaatctatcctt

SEQ ID NO: 263079 - DNA, 15 bp, Homo sapiens
ttaagaatctatcct

SEQ ID NO: 263080 - DNA, 15 bp, Homo sapiens
tttaagaatctatcc

SEQ ID NO: 263081 - DNA, 15 bp, Homo sapiens
atttaagaatctatc

SEQ ID NO: 263082 - DNA, 15 bp, Homo sapiens
aatttaagaatctat

SEQ ID NO: 263083 - DNA, 15 bp, Homo sapiens
caatttaagaatcta

SEQ ID NO: 263084 - DNA, 15 bp, Homo sapiens
tcaatttaagaatct

SEQ ID NO: 263085 - DNA, 15 bp, Homo sapiens
ttcaatttaagaatc

SEQ ID NO: 263086 - DNA, 15 bp, Homo sapiens
cttcaatttaagaat

SEQ ID NO: 263087 - DNA, 15 bp, Homo sapiens
tcttcaatttaagaa

SEQ ID NO: 263088 - DNA, 15 bp, Homo sapiens
ttcttcaatttaaga

SEQ ID NO: 263089 - DNA, 15 bp, Homo sapiens
attcttcaatttaag

SEQ ID NO: 263090 - DNA, 15 bp, Homo sapiens
gattcttcaatttaa

SEQ ID NO: 263091 - DNA, 15 bp, Homo sapiens
tgattcttcaattta

SEQ ID NO: 263092 - DNA, 15 bp, Homo sapiens
ttgattcttcaattt

SEQ ID NO: 263093 - DNA, 15 bp, Homo sapiens
cttgattcttcaatt

SEQ ID NO: 263094 - DNA, 15 bp, Homo sapiens
gcttgattcttcaat

SEQ ID NO: 263095 - DNA, 15 bp, Homo sapiens
agcttgattcttcaa

SEQ ID NO: 263096 - DNA, 15 bp, Homo sapiens
tagcttgattcttca

SEQ ID NO: 263097 - DNA, 15 bp, Homo sapiens
ttagcttgattcttc

SEQ ID NO: 263098 - DNA, 15 bp, Homo sapiens
tttagcttgattctt

SEQ ID NO: 263099 - DNA, 15 bp, Homo sapiens
atttagcttgattct

SEQ ID NO: 263100 - DNA, 15 bp, Homo sapiens
tatttagcttgattc

SEQ ID NO: 263101 - DNA, 15 bp, Homo sapiens
gtatttagcttgatt

SEQ ID NO: 263102 - DNA, 15 bp, Homo sapiens
agtatttagcttgat

SEQ ID NO: 263103 - DNA, 15 bp, Homo sapiens
aagtatttagcttga

SEQ ID NO: 263104 - DNA, 15 bp, Homo sapiens
caagtatttagcttg

SEQ ID NO: 263105 - DNA, 15 bp, Homo sapiens
tcaagtatttagctt

SEQ ID NO: 263106 - DNA, 15 bp, Homo sapiens
ctcaagtatttagct

SEQ ID NO: 263107 - DNA, 15 bp, Homo sapiens
tctcaagtatttagc

SEQ ID NO: 263108 - DNA, 15 bp, Homo sapiens
gtctcaagtatttag

SEQ ID NO: 263109 - DNA, 15 bp, Homo sapiens
agtctcaagtattta

SEQ ID NO: 263110 - DNA, 15 bp, Homo sapiens
tagtctcaagtattt

SEQ ID NO: 263111 - DNA, 15 bp, Homo sapiens
ctagtctcaagtatt

SEQ ID NO: 263112 - DNA, 15 bp, Homo sapiens
tctagtctcaagtat

SEQ ID NO: 263113 - DNA, 15 bp, Homo sapiens
ttctagtctcaagta

SEQ ID NO: 263114 - DNA, 15 bp, Homo sapiens
tttctagtctcaagt

SEQ ID NO: 263115 - DNA, 15 bp, Homo sapiens
atttctagtctcaag

SEQ ID NO: 263116 - DNA, 15 bp, Homo sapiens
catttctagtctcaa

SEQ ID NO: 263117 - DNA, 15 bp, Homo sapiens
gcatttctagtctca

SEQ ID NO: 263118 - DNA, 15 bp, Homo sapiens
ggcatttctagtctc

SEQ ID NO: 263119 - DNA, 15 bp, Homo sapiens
aggcatttctagtct

SEQ ID NO: 263120 - DNA, 15 bp, Homo sapiens
aaggcatttctagtc

SEQ ID NO: 263121 - DNA, 15 bp, Homo sapiens
aaaggcatttctagt

SEQ ID NO: 263122 - DNA, 15 bp, Homo sapiens
caaaggcatttctag

SEQ ID NO: 263123 - DNA, 15 bp, Homo sapiens
acaaaggcatttcta

SEQ ID NO: 263124 - DNA, 15 bp, Homo sapiens
aacaaaggcatttct

SEQ ID NO: 263125 - DNA, 15 bp, Homo sapiens
caacaaaggcatttc

SEQ ID NO: 263126 - DNA, 15 bp, Homo sapiens
acaacaaaggcattt

SEQ ID NO: 263127 - DNA, 15 bp, Homo sapiens
cacaacaaaggcatt

SEQ ID NO: 263128 - DNA, 15 bp, Homo sapiens
tcacaacaaaggcat

SEQ ID NO: 263129 - DNA, 15 bp, Homo sapiens
atcacaacaaaggca

SEQ ID NO: 263130 - DNA, 15 bp, Homo sapiens
catcacaacaaaggc

SEQ ID NO: 263131 - DNA, 15 bp, Homo sapiens
acatcacaacaaagg

SEQ ID NO: 263132 - DNA, 15 bp, Homo sapiens
aacatcacaacaaag

SEQ ID NO: 263133 - DNA, 15 bp, Homo sapiens
caacatcacaacaaa

SEQ ID NO: 263134 - DNA, 15 bp, Homo sapiens
acaacatcacaacaa

SEQ ID NO: 263135 - DNA, 15 bp, Homo sapiens
aacaacatcacaaca

SEQ ID NO: 263136 - DNA, 15 bp, Homo sapiens
taacaacatcacaac

SEQ ID NO: 263137 - DNA, 15 bp, Homo sapiens
ataacaacatcacaa

SEQ ID NO: 263138 - DNA, 15 bp, Homo sapiens
cataacaacatcaca

SEQ ID NO: 263139 - DNA, 15 bp, Homo sapiens
acataacaacatcac

SEQ ID NO: 263140 - DNA, 15 bp, Homo sapiens
tacataacaacatca

SEQ ID NO: 263141 - DNA, 15 bp, Homo sapiens
ttacataacaacatc

SEQ ID NO: 263142 - DNA, 15 bp, Homo sapiens
attacataacaacat

SEQ ID NO: 263143 - DNA, 15 bp, Homo sapiens
cattacataacaaca

SEQ ID NO: 263144 - DNA, 15 bp, Homo sapiens
acattacataacaac

SEQ ID NO: 263145 - DNA, 15 bp, Homo sapiens
tacattacataacaa

SEQ ID NO: 263146 - DNA, 15 bp, Homo sapiens
ttacattacataaca

SEQ ID NO: 263147 - DNA, 15 bp, Homo sapiens
attacattacataac

SEQ ID NO: 263148 - DNA, 15 bp, Homo sapiens
cattacattacataa

SEQ ID NO: 263149 - DNA, 15 bp, Homo sapiens
acattacattacata

SEQ ID NO: 263150 - DNA, 15 bp, Homo sapiens
tacattacattacat

SEQ ID NO: 263151 - DNA, 15 bp, Homo sapiens
ttacattacattaca

SEQ ID NO: 263152 - DNA, 15 bp, Homo sapiens
attacattacattac

SEQ ID NO: 263153 - DNA, 15 bp, Homo sapiens
cattacattacatta

SEQ ID NO: 263154 - DNA, 15 bp, Homo sapiens
acattacattacatt

SEQ ID NO: 263155 - DNA, 15 bp, Homo sapiens
tcattacattacatt

SEQ ID NO: 263156 - DNA, 15 bp, Homo sapiens
gtcattacattacat

SEQ ID NO: 263157 - DNA, 15 bp, Homo sapiens
agtcattacattaca

SEQ ID NO: 263158 - DNA, 15 bp, Homo sapiens
cagtcattacattac

SEQ ID NO: 263159 - DNA, 15 bp, Homo sapiens
acagtcattacatta

SEQ ID NO: 263160 - DNA, 15 bp, Homo sapiens
tacagtcattacatt

SEQ ID NO: 263161 - DNA, 15 bp, Homo sapiens
ttacagtcattacat

SEQ ID NO: 263162 - DNA, 15 bp, Homo sapiens
tttacagtcattaca

SEQ ID NO: 263163 - DNA, 15 bp, Homo sapiens
gtttacagtcattac

SEQ ID NO: 263164 - DNA, 15 bp, Homo sapiens
tgtttacagtcatta

SEQ ID NO: 263165 - DNA, 15 bp, Homo sapiens
atgtttacagtcatt

SEQ ID NO: 263166 - DNA, 15 bp, Homo sapiens
aatgtttacagtcat

SEQ ID NO: 263167 - DNA, 15 bp, Homo sapiens
gaatgtttacagtca

SEQ ID NO: 263168 - DNA, 15 bp, Homo sapiens
ggaatgtttacagtc

SEQ ID NO: 263169 - DNA, 15 bp, Homo sapiens
aggaatgtttacagt

SEQ ID NO: 263170 - DNA, 15 bp, Homo sapiens
aaggaatgtttacag

SEQ ID NO: 263171 - DNA, 15 bp, Homo sapiens
gaaggaatgtttaca

SEQ ID NO: 263172 - DNA, 15 bp, Homo sapiens
agaaggaatgtttac

SEQ ID NO: 263173 - DNA, 15 bp, Homo sapiens
aagaaggaatgttta

SEQ ID NO: 263174 - DNA, 15 bp, Homo sapiens
gaagaaggaatgttt

SEQ ID NO: 263175 - DNA, 15 bp, Homo sapiens
agaagaaggaatgtt

SEQ ID NO: 263176 - DNA, 15 bp, Homo sapiens
gagaagaaggaatgt

SEQ ID NO: 263177 - DNA, 15 bp, Homo sapiens
agagaagaaggaatg

SEQ ID NO: 263178 - DNA, 15 bp, Homo sapiens
gagagaagaaggaat

SEQ ID NO: 263179 - DNA, 15 bp, Homo sapiens
ggagagaagaaggaa

SEQ ID NO: 263180 - DNA, 15 bp, Homo sapiens
aggagagaagaagga

SEQ ID NO: 263181 - DNA, 15 bp, Homo sapiens
caggagagaagaagg

SEQ ID NO: 263182 - DNA, 15 bp, Homo sapiens
ccaggagagaagaag

SEQ ID NO: 263183 - DNA, 15 bp, Homo sapiens
accaggagagaagaa

SEQ ID NO: 263184 - DNA, 15 bp, Homo sapiens
aaccaggagagaaga

SEQ ID NO: 263185 - DNA, 15 bp, Homo sapiens
taaccaggagagaag

SEQ ID NO: 263186 - DNA, 15 bp, Homo sapiens
ctaaccaggagagaa

SEQ ID NO: 263187 - DNA, 15 bp, Homo sapiens
actaaccaggagaga

SEQ ID NO: 263188 - DNA, 15 bp, Homo sapiens
cactaaccaggagag

SEQ ID NO: 263189 - DNA, 15 bp, Homo sapiens
ccactaaccaggaga

SEQ ID NO: 263190 - DNA, 15 bp, Homo sapiens
tccactaaccaggag

SEQ ID NO: 263191 - DNA, 15 bp, Homo sapiens
atccactaaccagga

SEQ ID NO: 263192 - DNA, 15 bp, Homo sapiens
gatccactaaccagg

SEQ ID NO: 263193 - DNA, 15 bp, Homo sapiens
agatccactaaccag

SEQ ID NO: 263194 - DNA, 15 bp, Homo sapiens
gagatccactaacca

SEQ ID NO: 263195 - DNA, 15 bp, Homo sapiens
agagatccactaacc

SEQ ID NO: 263196 - DNA, 15 bp, Homo sapiens
aagagatccactaac

SEQ ID NO: 263197 - DNA, 15 bp, Homo sapiens
taagagatccactaa

SEQ ID NO: 263198 - DNA, 15 bp, Homo sapiens
ctaagagatccacta

SEQ ID NO: 263199 - DNA, 15 bp, Homo sapiens
tctaagagatccact

SEQ ID NO: 263200 - DNA, 15 bp, Homo sapiens
ctctaagagatccac

SEQ ID NO: 263201 - DNA, 15 bp, Homo sapiens
actctaagagatcca

SEQ ID NO: 263202 - DNA, 15 bp, Homo sapiens
aactctaagagatcc

SEQ ID NO: 263203 - DNA, 15 bp, Homo sapiens
caactctaagagatc

SEQ ID NO: 263204 - DNA, 15 bp, Homo sapiens
tcaactctaagagat

SEQ ID NO: 263205 - DNA, 15 bp, Homo sapiens
ctcaactctaagaga

SEQ ID NO: 263206 - DNA, 15 bp, Homo sapiens
actcaactctaagag

SEQ ID NO: 263207 - DNA, 15 bp, Homo sapiens
tactcaactctaaga

SEQ ID NO: 263208 - DNA, 15 bp, Homo sapiens
gtactcaactctaag

SEQ ID NO: 263209 - DNA, 15 bp, Homo sapiens
tgtactcaactctaa

SEQ ID NO: 263210 - DNA, 15 bp, Homo sapiens
ttgtactcaactcta

SEQ ID NO: 263211 - DNA, 15 bp, Homo sapiens
gttgtactcaactct

SEQ ID NO: 263212 - DNA, 15 bp, Homo sapiens
tgttgtactcaactc

SEQ ID NO: 263213 - DNA, 15 bp, Homo sapiens
ttgttgtactcaact

SEQ ID NO: 263214 - DNA, 15 bp, Homo sapiens
tttgttgtactcaac

SEQ ID NO: 263215 - DNA, 15 bp, Homo sapiens
atttgttgtactcaa

SEQ ID NO: 263216 - DNA, 15 bp, Homo sapiens
catttgttgtactca

SEQ ID NO: 263217 - DNA, 15 bp, Homo sapiens
tcatttgttgtactc

SEQ ID NO: 263218 - DNA, 15 bp, Homo sapiens
ttcatttgttgtact

SEQ ID NO: 263219 - DNA, 15 bp, Homo sapiens
tttcatttgttgtac

SEQ ID NO: 263220 - DNA, 15 bp, Homo sapiens
atttcatttgttgta

SEQ ID NO: 263221 - DNA, 15 bp, Homo sapiens
aatttcatttgttgt

SEQ ID NO: 263222 - DNA, 15 bp, Homo sapiens
aaatttcatttgttg

SEQ ID NO: 263223 - DNA, 15 bp, Homo sapiens
aaaatttcatttgtt

SEQ ID NO: 263224 - DNA, 15 bp, Homo sapiens
gaaaatttcatttgt

SEQ ID NO: 263225 - DNA, 15 bp, Homo sapiens
tgaaaatttcatttg

SEQ ID NO: 263226 - DNA, 15 bp, Homo sapiens
ttgaaaatttcattt

SEQ ID NO: 263227 - DNA, 15 bp, Homo sapiens
tttgaaaatttcatt

SEQ ID NO: 263228 - DNA, 15 bp, Homo sapiens
gtttgaaaatttcat

SEQ ID NO: 263229 - DNA, 15 bp, Homo sapiens
tgtttgaaaatttca

SEQ ID NO: 263230 - DNA, 15 bp, Homo sapiens
ctgtttgaaaatttc

SEQ ID NO: 263231 - DNA, 15 bp, Homo sapiens
gctgtttgaaaattt

SEQ ID NO: 263232 - DNA, 15 bp, Homo sapiens
tgctgtttgaaaatt

SEQ ID NO: 263233 - DNA, 15 bp, Homo sapiens
gtgctgtttgaaaat

SEQ ID NO: 263234 - DNA, 15 bp, Homo sapiens
tgtgctgtttgaaaa

SEQ ID NO: 263235 - DNA, 15 bp, Homo sapiens
ttgtgctgtttgaaa

SEQ ID NO: 263236 - DNA, 15 bp, Homo sapiens
cttgtgctgtttgaa

SEQ ID NO: 263237 - DNA, 15 bp, Homo sapiens
acttgtgctgtttga

SEQ ID NO: 263238 - DNA, 15 bp, Homo sapiens
aacttgtgctgtttg

SEQ ID NO: 263239 - DNA, 15 bp, Homo sapiens
caacttgtgctgttt

SEQ ID NO: 263240 - DNA, 15 bp, Homo sapiens
tcaacttgtgctgtt

SEQ ID NO: 263241 - DNA, 15 bp, Homo sapiens
ttcaacttgtgctgt

SEQ ID NO: 263242 - DNA, 15 bp, Homo sapiens
gttcaacttgtgctg

SEQ ID NO: 263243 - DNA, 15 bp, Homo sapiens
ggttcaacttgtgct

SEQ ID NO: 263244 - DNA, 15 bp, Homo sapiens
tggttcaacttgtgc

SEQ ID NO: 263245 - DNA, 15 bp, Homo sapiens
ttggttcaacttgtg

SEQ ID NO: 263246 - DNA, 15 bp, Homo sapiens
tttggttcaacttgt

SEQ ID NO: 263247 - DNA, 15 bp, Homo sapiens
ttttggttcaacttg

SEQ ID NO: 263248 - DNA, 15 bp, Homo sapiens
attttggttcaactt

SEQ ID NO: 263249 - DNA, 15 bp, Homo sapiens
cattttggttcaact

SEQ ID NO: 263250 - DNA, 15 bp, Homo sapiens
tcattttggttcaac

SEQ ID NO: 263251 - DNA, 15 bp, Homo sapiens
gtcattttggttcaa

SEQ ID NO: 263252 - DNA, 15 bp, Homo sapiens
ggtcattttggttca

SEQ ID NO: 263253 - DNA, 15 bp, Homo sapiens
tggtcattttggttc

SEQ ID NO: 263254 - DNA, 15 bp, Homo sapiens
ctggtcattttggtt

SEQ ID NO: 263255 - DNA, 15 bp, Homo sapiens
gctggtcattttggt

SEQ ID NO: 263256 - DNA, 15 bp, Homo sapiens
agctggtcattttgg

SEQ ID NO: 263257 - DNA, 15 bp, Homo sapiens
gagctggtcattttg

SEQ ID NO: 263258 - DNA, 15 bp, Homo sapiens
ggagctggtcatttt

SEQ ID NO: 263259 - DNA, 15 bp, Homo sapiens
aggagctggtcattt

SEQ ID NO: 263260 - DNA, 15 bp, Homo sapiens
gaggagctggtcatt

SEQ ID NO: 263261 - DNA, 15 bp, Homo sapiens
tgaggagctggtcat

SEQ ID NO: 263262 - DNA, 15 bp, Homo sapiens
ctgaggagctggtca

SEQ ID NO: 263263 - DNA, 15 bp, Homo sapiens
actgaggagctggtc

SEQ ID NO: 263264 - DNA, 15 bp, Homo sapiens
cactgaggagctggt

SEQ ID NO: 263265 - DNA, 15 bp, Homo sapiens
acactgaggagctgg

SEQ ID NO: 263266 - DNA, 15 bp, Homo sapiens
aacactgaggagctg

SEQ ID NO: 263267 - DNA, 15 bp, Homo sapiens
gaacactgaggagct

SEQ ID NO: 263268 - DNA, 15 bp, Homo sapiens
ggaacactgaggagc

SEQ ID NO: 263269 - DNA, 15 bp, Homo sapiens
tggaacactgaggag

SEQ ID NO: 263270 - DNA, 15 bp, Homo sapiens
ctggaacactgagga

SEQ ID NO: 263271 - DNA, 15 bp, Homo sapiens
tctggaacactgagg

SEQ ID NO: 263272 - DNA, 15 bp, Homo sapiens
atctggaacactgag

SEQ ID NO: 263273 - DNA, 15 bp, Homo sapiens
catctggaacactga

SEQ ID NO: 263274 - DNA, 15 bp, Homo sapiens
acatctggaacactg

SEQ ID NO: 263275 - DNA, 15 bp, Homo sapiens
gacatctggaacact

SEQ ID NO: 263276 - DNA, 15 bp, Homo sapiens
tgacatctggaacac

SEQ ID NO: 263277 - DNA, 15 bp, Homo sapiens
atgacatctggaaca

SEQ ID NO: 263278 - DNA, 15 bp, Homo sapiens
gatgacatctggaac

SEQ ID NO: 263279 - DNA, 15 bp, Homo sapiens
tgatgacatctggaa

SEQ ID NO: 263280 - DNA, 15 bp, Homo sapiens
ttgatgacatctgga

SEQ ID NO: 263281 - DNA, 15 bp, Homo sapiens
gttgatgacatctgg

SEQ ID NO: 263282 - DNA, 15 bp, Homo sapiens
agttgatgacatctg

SEQ ID NO: 263283 - DNA, 15 bp, Homo sapiens
cagttgatgacatct

SEQ ID NO: 263284 - DNA, 15 bp, Homo sapiens
acagttgatgacatc

SEQ ID NO: 263285 - DNA, 15 bp, Homo sapiens
gacagttgatgacat

SEQ ID NO: 263286 - DNA, 15 bp, Homo sapiens
agacagttgatgaca

SEQ ID NO: 263287 - DNA, 15 bp, Homo sapiens
cagacagttgatgac

SEQ ID NO: 263288 - DNA, 15 bp, Homo sapiens
tcagacagttgatga

SEQ ID NO: 263289 - DNA, 15 bp, Homo sapiens
gtcagacagttgatg

SEQ ID NO: 263290 - DNA, 15 bp, Homo sapiens
tgtcagacagttgat

SEQ ID NO: 263291 - DNA, 15 bp, Homo sapiens
ttgtcagacagttga

SEQ ID NO: 263292 - DNA, 15 bp, Homo sapiens
gttgtcagacagttg

SEQ ID NO: 263293 - DNA, 15 bp, Homo sapiens
tgttgtcagacagtt

SEQ ID NO: 263294 - DNA, 15 bp, Homo sapiens
ttgttgtcagacagt

SEQ ID NO: 263295 - DNA, 15 bp, Homo sapiens
gttgttgtcagacag

SEQ ID NO: 263296 - DNA, 15 bp, Homo sapiens
agttgttgtcagaca

SEQ ID NO: 263297 - DNA, 15 bp, Homo sapiens
aagttgttgtcagac

SEQ ID NO: 263298 - DNA, 15 bp, Homo sapiens
taagttgttgtcaga

SEQ ID NO: 263299 - DNA, 15 bp, Homo sapiens
ataagttgttgtcag

SEQ ID NO: 263300 - DNA, 15 bp, Homo sapiens
cataagttgttgtca

SEQ ID NO: 263301 - DNA, 15 bp, Homo sapiens
tcataagttgttgtc

SEQ ID NO: 263302 - DNA, 15 bp, Homo sapiens
atcataagttgttgt

SEQ ID NO: 263303 - DNA, 15 bp, Homo sapiens
catcataagttgttg

SEQ ID NO: 263304 - DNA, 15 bp, Homo sapiens
ccatcataagttgtt

SEQ ID NO: 263305 - DNA, 15 bp, Homo sapiens
tccatcataagttgt

SEQ ID NO: 263306 - DNA, 15 bp, Homo sapiens
gtccatcataagttg

SEQ ID NO: 263307 - DNA, 15 bp, Homo sapiens
agtccatcataagtt

SEQ ID NO: 263308 - DNA, 15 bp, Homo sapiens
aagtccatcataagt

SEQ ID NO: 263309 - DNA, 15 bp, Homo sapiens
caagtccatcataag

SEQ ID NO: 263310 - DNA, 15 bp, Homo sapiens
tcaagtccatcataa

SEQ ID NO: 263311 - DNA, 15 bp, Homo sapiens
ctcaagtccatcata

SEQ ID NO: 263312 - DNA, 15 bp, Homo sapiens
gctcaagtccatcat

SEQ ID NO: 263313 - DNA, 15 bp, Homo sapiens
tgctcaagtccatca

SEQ ID NO: 263314 - DNA, 15 bp, Homo sapiens
ttgctcaagtccatc

SEQ ID NO: 263315 - DNA, 15 bp, Homo sapiens
tttgctcaagtccat

SEQ ID NO: 263316 - DNA, 15 bp, Homo sapiens
atttgctcaagtcca

SEQ ID NO: 263317 - DNA, 15 bp, Homo sapiens
catttgctcaagtcc

SEQ ID NO: 263318 - DNA, 15 bp, Homo sapiens
gcatttgctcaagtc

SEQ ID NO: 263319 - DNA, 15 bp, Homo sapiens
tgcatttgctcaagt

SEQ ID NO: 263320 - DNA, 15 bp, Homo sapiens
atgcatttgctcaag

SEQ ID NO: 263321 - DNA, 15 bp, Homo sapiens
tatgcatttgctcaa

SEQ ID NO: 263322 - DNA, 15 bp, Homo sapiens
ttatgcatttgctca

SEQ ID NO: 263323 - DNA, 15 bp, Homo sapiens
cttatgcatttgctc

SEQ ID NO: 263324 - DNA, 15 bp, Homo sapiens
ccttatgcatttgct

SEQ ID NO: 263325 - DNA, 15 bp, Homo sapiens
tccttatgcatttgc

SEQ ID NO: 263326 - DNA, 15 bp, Homo sapiens
gtccttatgcatttg

SEQ ID NO: 263327 - DNA, 15 bp, Homo sapiens
ggtccttatgcattt

SEQ ID NO: 263328 - DNA, 15 bp, Homo sapiens
aggtccttatgcatt

SEQ ID NO: 263329 - DNA, 15 bp, Homo sapiens
caggtccttatgcat

SEQ ID NO: 263330 - DNA, 15 bp, Homo sapiens
ccaggtccttatgca

SEQ ID NO: 263331 - DNA, 15 bp, Homo sapiens
accaggtccttatgc

SEQ ID NO: 263332 - DNA, 15 bp, Homo sapiens
gaccaggtccttatg

SEQ ID NO: 263333 - DNA, 15 bp, Homo sapiens
tgaccaggtccttat

SEQ ID NO: 263334 - DNA, 15 bp, Homo sapiens
ttgaccaggtcctta

SEQ ID NO: 263335 - DNA, 15 bp, Homo sapiens
gttgaccaggtcctt

SEQ ID NO: 263336 - DNA, 15 bp, Homo sapiens
cgttgaccaggtcct

SEQ ID NO: 263337 - DNA, 15 bp, Homo sapiens
acgttgaccaggtcc

SEQ ID NO: 263338 - DNA, 15 bp, Homo sapiens
aacgttgaccaggtc

SEQ ID NO: 263339 - DNA, 15 bp, Homo sapiens
gaacgttgaccaggt

SEQ ID NO: 263340 - DNA, 15 bp, Homo sapiens
ggaacgttgaccagg

SEQ ID NO: 263341 - DNA, 15 bp, Homo sapiens
tggaacgttgaccag

SEQ ID NO: 263342 - DNA, 15 bp, Homo sapiens
gtggaacgttgacca

SEQ ID NO: 263343 - DNA, 15 bp, Homo sapiens
agtggaacgttgacc

SEQ ID NO: 263344 - DNA, 15 bp, Homo sapiens
gagtggaacgttgac

SEQ ID NO: 263345 - DNA, 15 bp, Homo sapiens
agagtggaacgttga

SEQ ID NO: 263346 - DNA, 15 bp, Homo sapiens
cagagtggaacgttg

SEQ ID NO: 263347 - DNA, 15 bp, Homo sapiens
acagagtggaacgtt

SEQ ID NO: 263348 - DNA, 15 bp, Homo sapiens
cacagagtggaacgt

SEQ ID NO: 263349 - DNA, 15 bp, Homo sapiens
acacagagtggaacg

SEQ ID NO: 263350 - DNA, 15 bp, Homo sapiens
aacacagagtggaac

SEQ ID NO: 263351 - DNA, 15 bp, Homo sapiens
caacacagagtggaa

SEQ ID NO: 263352 - DNA, 15 bp, Homo sapiens
tcaacacagagtgga

SEQ ID NO: 263353 - DNA, 15 bp, Homo sapiens
atcaacacagagtgg

SEQ ID NO: 263354 - DNA, 15 bp, Homo sapiens
tatcaacacagagtg

SEQ ID NO: 263355 - DNA, 15 bp, Homo sapiens
atatcaacacagagt

SEQ ID NO: 263356 - DNA, 15 bp, Homo sapiens
catatcaacacagag

SEQ ID NO: 263357 - DNA, 15 bp, Homo sapiens
acatatcaacacaga

SEQ ID NO: 263358 - DNA, 15 bp, Homo sapiens
cacatatcaacacag

SEQ ID NO: 263359 - DNA, 15 bp, Homo sapiens
acacatatcaacaca

SEQ ID NO: 263360 - DNA, 15 bp, Homo sapiens
gacacatatcaacac

SEQ ID NO: 263361 - DNA, 15 bp, Homo sapiens
agacacatatcaaca

SEQ ID NO: 263362 - DNA, 15 bp, Homo sapiens
gagacacatatcaac

SEQ ID NO: 263363 - DNA, 15 bp, Homo sapiens
tgagacacatatcaa

SEQ ID NO: 263364 - DNA, 15 bp, Homo sapiens
ttgagacacatatca

SEQ ID NO: 263365 - DNA, 15 bp, Homo sapiens
attgagacacatatc

SEQ ID NO: 263366 - DNA, 15 bp, Homo sapiens
aattgagacacatat

SEQ ID NO: 263367 - DNA, 15 bp, Homo sapiens
caattgagacacata

SEQ ID NO: 263368 - DNA, 15 bp, Homo sapiens
ccaattgagacacat

SEQ ID NO: 263369 - DNA, 15 bp, Homo sapiens
accaattgagacaca

SEQ ID NO: 263370 - DNA, 15 bp, Homo sapiens
aaccaattgagacac

SEQ ID NO: 263371 - DNA, 15 bp, Homo sapiens
caaccaattgagaca

SEQ ID NO: 263372 - DNA, 15 bp, Homo sapiens
gcaaccaattgagac

SEQ ID NO: 263373 - DNA, 15 bp, Homo sapiens
agcaaccaattgaga

SEQ ID NO: 263374 - DNA, 15 bp, Homo sapiens
gagcaaccaattgag

SEQ ID NO: 263375 - DNA, 15 bp, Homo sapiens
tgagcaaccaattga

SEQ ID NO: 263376 - DNA, 15 bp, Homo sapiens
ttgagcaaccaattg

SEQ ID NO: 263377 - DNA, 15 bp, Homo sapiens
attgagcaaccaatt

SEQ ID NO: 263378 - DNA, 15 bp, Homo sapiens
cattgagcaaccaat

SEQ ID NO: 263379 - DNA, 15 bp, Homo sapiens
acattgagcaaccaa

SEQ ID NO: 263380 - DNA, 15 bp, Homo sapiens
gacattgagcaacca

SEQ ID NO: 263381 - DNA, 15 bp, Homo sapiens
agacattgagcaacc

SEQ ID NO: 263382 - DNA, 15 bp, Homo sapiens
tagacattgagcaac

SEQ ID NO: 263383 - DNA, 15 bp, Homo sapiens
atagacattgagcaa

SEQ ID NO: 263384 - DNA, 15 bp, Homo sapiens
catagacattgagca

SEQ ID NO: 263385 - DNA, 15 bp, Homo sapiens
tcatagacattgagc

SEQ ID NO: 263386 - DNA, 15 bp, Homo sapiens
gtcatagacattgag

SEQ ID NO: 263387 - DNA, 15 bp, Homo sapiens
tgtcatagacattga

SEQ ID NO: 263388 - DNA, 15 bp, Homo sapiens
gtgtcatagacattg

SEQ ID NO: 263389 - DNA, 15 bp, Homo sapiens
cgtgtcatagacatt

SEQ ID NO: 263390 - DNA, 15 bp, Homo sapiens
acgtgtcatagacat

SEQ ID NO: 263391 - DNA, 15 bp, Homo sapiens
tacgtgtcatagaca

SEQ ID NO: 263392 - DNA, 15 bp, Homo sapiens
ttacgtgtcatagac

SEQ ID NO: 263393 - DNA, 15 bp, Homo sapiens
cttacgtgtcataga

SEQ ID NO: 263394 - DNA, 15 bp, Homo sapiens
acttacgtgtcatag

SEQ ID NO: 263395 - DNA, 15 bp, Homo sapiens
aacttacgtgtcata

SEQ ID NO: 263396 - DNA, 15 bp, Homo sapiens
aaacttacgtgtcat

SEQ ID NO: 263397 - DNA, 15 bp, Homo sapiens
taaacttacgtgtca

SEQ ID NO: 263398 - DNA, 15 bp, Homo sapiens
ataaacttacgtgtc

SEQ ID NO: 263399 - DNA, 15 bp, Homo sapiens
tataaacttacgtgt

SEQ ID NO: 263400 - DNA, 15 bp, Homo sapiens
atataaacttacgtg

SEQ ID NO: 263401 - DNA, 15 bp, Homo sapiens
aatataaacttacgt

SEQ ID NO: 263402 - DNA, 15 bp, Homo sapiens
aaatataaacttacg

SEQ ID NO: 263403 - DNA, 15 bp, Homo sapiens
aaaatataaacttac

SEQ ID NO: 263404 - DNA, 15 bp, Homo sapiens
aaaaatataaactta

SEQ ID NO: 263405 - DNA, 15 bp, Homo sapiens
aaaaaatataaactt

SEQ ID NO: 263406 - DNA, 15 bp, Homo sapiens
gaaaaaatataaact

SEQ ID NO: 263407 - DNA, 15 bp, Homo sapiens
agaaaaaatataaac

SEQ ID NO: 263408 - DNA, 15 bp, Homo sapiens
gagaaaaaatataaa

SEQ ID NO: 263409 - DNA, 15 bp, Homo sapiens
tgagaaaaaatataa

SEQ ID NO: 263410 - DNA, 15 bp, Homo sapiens
atgagaaaaaatata

SEQ ID NO: 263411 - DNA, 15 bp, Homo sapiens
aatgagaaaaaatat

SEQ ID NO: 263412 - DNA, 15 bp, Homo sapiens
taatgagaaaaaata

SEQ ID NO: 263413 - DNA, 15 bp, Homo sapiens
ttaatgagaaaaaat

SEQ ID NO: 263414 - DNA, 15 bp, Homo sapiens
tttaatgagaaaaaa

SEQ ID NO: 263415 - DNA, 15 bp, Homo sapiens
ttttaatgagaaaaa

SEQ ID NO: 263416 - DNA, 15 bp, Homo sapiens
attttaatgagaaaa

SEQ ID NO: 263417 - DNA, 15 bp, Homo sapiens
tattttaatgagaaa

SEQ ID NO: 263418 - DNA, 15 bp, Homo sapiens
gtattttaatgagaa

SEQ ID NO: 263419 - DNA, 15 bp, Homo sapiens
cgtattttaatgaga

SEQ ID NO: 263420 - DNA, 15 bp, Homo sapiens
tcgtattttaatgag

SEQ ID NO: 263421 - DNA, 15 bp, Homo sapiens
atcgtattttaatga

SEQ ID NO: 263422 - DNA, 15 bp, Homo sapiens
gatcgtattttaatg

SEQ ID NO: 263423 - DNA, 15 bp, Homo sapiens
tgatcgtattttaat

SEQ ID NO: 263424 - DNA, 15 bp, Homo sapiens
gtgatcgtattttaa

SEQ ID NO: 263425 - DNA, 15 bp, Homo sapiens
agtgatcgtatttta

SEQ ID NO: 263426 - DNA, 15 bp, Homo sapiens
cagtgatcgtatttt

SEQ ID NO: 263427 - DNA, 15 bp, Homo sapiens
tcagtgatcgtattt

SEQ ID NO: 263428 - DNA, 15 bp, Homo sapiens
ttcagtgatcgtatt

SEQ ID NO: 263429 - DNA, 15 bp, Homo sapiens
attcagtgatcgtat

SEQ ID NO: 263430 - DNA, 15 bp, Homo sapiens
cattcagtgatcgta

SEQ ID NO: 263431 - DNA, 15 bp, Homo sapiens
tcattcagtgatcgt

SEQ ID NO: 263432 - DNA, 15 bp, Homo sapiens
ttcattcagtgatcg

SEQ ID NO: 263433 - DNA, 15 bp, Homo sapiens
tttcattcagtgatc

SEQ ID NO: 263434 - DNA, 15 bp, Homo sapiens
atttcattcagtgat

SEQ ID NO: 263435 - DNA, 15 bp, Homo sapiens
tatttcattcagtga

SEQ ID NO: 263436 - DNA, 15 bp, Homo sapiens
atatttcattcagtg

SEQ ID NO: 263437 - DNA, 15 bp, Homo sapiens
catatttcattcagt

SEQ ID NO: 263438 - DNA, 15 bp, Homo sapiens
acatatttcattcag

SEQ ID NO: 263439 - DNA, 15 bp, Homo sapiens
aacatatttcattca

SEQ ID NO: 263440 - DNA, 15 bp, Homo sapiens
taacatatttcattc

SEQ ID NO: 263441 - DNA, 15 bp, Homo sapiens
ttaacatatttcatt

SEQ ID NO: 263442 - DNA, 15 bp, Homo sapiens
attaacatatttcat

SEQ ID NO: 263443 - DNA, 15 bp, Homo sapiens
tattaacatatttca

SEQ ID NO: 263444 - DNA, 15 bp, Homo sapiens
ctattaacatatttc

SEQ ID NO: 263445 - DNA, 15 bp, Homo sapiens
tctattaacatattt

SEQ ID NO: 263446 - DNA, 15 bp, Homo sapiens
ttctattaacatatt

SEQ ID NO: 263447 - DNA, 15 bp, Homo sapiens
tttctattaacatat

SEQ ID NO: 263448 - DNA, 15 bp, Homo sapiens
ttttctattaacata

SEQ ID NO: 263449 - DNA, 15 bp, Homo sapiens
attttctattaacat

SEQ ID NO: 263450 - DNA, 15 bp, Homo sapiens
cattttctattaaca

SEQ ID NO: 263451 - DNA, 15 bp, Homo sapiens
acattttctattaac

SEQ ID NO: 263452 - DNA, 15 bp, Homo sapiens
gacattttctattaa

SEQ ID NO: 263453 - DNA, 15 bp, Homo sapiens
agacattttctatta

SEQ ID NO: 263454 - DNA, 15 bp, Homo sapiens
cagacattttctatt

SEQ ID NO: 263455 - DNA, 15 bp, Homo sapiens
tcagacattttctat

SEQ ID NO: 263456 - DNA, 15 bp, Homo sapiens
atcagacattttcta

SEQ ID NO: 263457 - DNA, 15 bp, Homo sapiens
aatcagacattttct

SEQ ID NO: 263458 - DNA, 15 bp, Homo sapiens
aaatcagacattttc

SEQ ID NO: 263459 - DNA, 15 bp, Homo sapiens
aaaatcagacatttt

SEQ ID NO: 263460 - DNA, 15 bp, Homo sapiens
aaaaatcagacattt

SEQ ID NO: 263461 - DNA, 15 bp, Homo sapiens
taaaaatcagacatt

SEQ ID NO: 263462 - DNA, 15 bp, Homo sapiens
ttaaaaatcagacat

SEQ ID NO: 263463 - DNA, 15 bp, Homo sapiens
cttaaaaatcagaca

SEQ ID NO: 263464 - DNA, 15 bp, Homo sapiens
acttaaaaatcagac

SEQ ID NO: 263465 - DNA, 15 bp, Homo sapiens
cacttaaaaatcaga

SEQ ID NO: 263466 - DNA, 15 bp, Homo sapiens
tcacttaaaaatcag

SEQ ID NO: 263467 - DNA, 15 bp, Homo sapiens
ttcacttaaaaatca

SEQ ID NO: 263468 - DNA, 15 bp, Homo sapiens
attcacttaaaaatc

SEQ ID NO: 263469 - DNA, 15 bp, Homo sapiens
aattcacttaaaaat

SEQ ID NO: 263470 - DNA, 15 bp, Homo sapiens
aaattcacttaaaaa

SEQ ID NO: 263471 - DNA, 15 bp, Homo sapiens
aaaattcacttaaaa

SEQ ID NO: 263472 - DNA, 15 bp, Homo sapiens
aaaaattcacttaaa

SEQ ID NO: 263473 - DNA, 15 bp, Homo sapiens
aaaaaattcacttaa

SEQ ID NO: 263474 - DNA, 15 bp, Homo sapiens
taaaaaattcactta

SEQ ID NO: 263475 - DNA, 15 bp, Homo sapiens
ttaaaaaattcactt

SEQ ID NO: 263476 - DNA, 15 bp, Homo sapiens
attaaaaaattcact

SEQ ID NO: 263477 - DNA, 15 bp, Homo sapiens
tattaaaaaattcac

SEQ ID NO: 263478 - DNA, 15 bp, Homo sapiens
ttattaaaaaattca

SEQ ID NO: 263479 - DNA, 15 bp, Homo sapiens
cttattaaaaaattc

SEQ ID NO: 263480 - DNA, 15 bp, Homo sapiens
acttattaaaaaatt

SEQ ID NO: 263481 - DNA, 15 bp, Homo sapiens
cacttattaaaaaat

SEQ ID NO: 263482 - DNA, 15 bp, Homo sapiens
gcacttattaaaaaa

SEQ ID NO: 263483 - DNA, 15 bp, Homo sapiens
agcacttattaaaaa

SEQ ID NO: 263484 - DNA, 15 bp, Homo sapiens
aagcacttattaaaa

SEQ ID NO: 263485 - DNA, 15 bp, Homo sapiens
aaagcacttattaaa

SEQ ID NO: 263486 - DNA, 15 bp, Homo sapiens
gaaagcacttattaa

SEQ ID NO: 263487 - DNA, 15 bp, Homo sapiens
tgaaagcacttatta

SEQ ID NO: 263488 - DNA, 15 bp, Homo sapiens
ttgaaagcacttatt

SEQ ID NO: 263489 - DNA, 15 bp, Homo sapiens
tttgaaagcacttat

SEQ ID NO: 263490 - DNA, 15 bp, Homo sapiens
atttgaaagcactta

SEQ ID NO: 263491 - DNA, 15 bp, Homo sapiens
aatttgaaagcactt

SEQ ID NO: 263492 - DNA, 15 bp, Homo sapiens
taatttgaaagcact

SEQ ID NO: 263493 - DNA, 15 bp, Homo sapiens
gtaatttgaaagcac

SEQ ID NO: 263494 - DNA, 15 bp, Homo sapiens
agtaatttgaaagca

SEQ ID NO: 263495 - DNA, 15 bp, Homo sapiens
aagtaatttgaaagc

SEQ ID NO: 263496 - DNA, 15 bp, Homo sapiens
aaagtaatttgaaag

SEQ ID NO: 263497 - DNA, 15 bp, Homo sapiens
gaaagtaatttgaaa

SEQ ID NO: 263498 - DNA, 15 bp, Homo sapiens
ggaaagtaatttgaa

SEQ ID NO: 263499 - DNA, 15 bp, Homo sapiens
gggaaagtaatttga

SEQ ID NO: 263500 - DNA, 15 bp, Homo sapiens
tgggaaagtaatttg

SEQ ID NO: 263501 - DNA, 15 bp, Homo sapiens
ctgggaaagtaattt

SEQ ID NO: 263502 - DNA, 15 bp, Homo sapiens
actgggaaagtaatt

SEQ ID NO: 263503 - DNA, 15 bp, Homo sapiens
cactgggaaagtaat

SEQ ID NO: 263504 - DNA, 15 bp, Homo sapiens
ccactgggaaagtaa

SEQ ID NO: 263505 - DNA, 15 bp, Homo sapiens
tccactgggaaagta

SEQ ID NO: 263506 - DNA, 15 bp, Homo sapiens
ttccactgggaaagt

SEQ ID NO: 263507 - DNA, 15 bp, Homo sapiens
tttccactgggaaag

SEQ ID NO: 263508 - DNA, 15 bp, Homo sapiens
atttccactgggaaa

SEQ ID NO: 263509 - DNA, 15 bp, Homo sapiens
tatttccactgggaa

SEQ ID NO: 263510 - DNA, 15 bp, Homo sapiens
atatttccactggga

SEQ ID NO: 263511 - DNA, 15 bp, Homo sapiens
aatatttccactggg

SEQ ID NO: 263512 - DNA, 15 bp, Homo sapiens
aaatatttccactgg

SEQ ID NO: 263513 - DNA, 15 bp, Homo sapiens
taaatatttccactg

SEQ ID NO: 263514 - DNA, 15 bp, Homo sapiens
ataaatatttccact

SEQ ID NO: 263515 - DNA, 15 bp, Homo sapiens
cataaatatttccac

SEQ ID NO: 263516 - DNA, 15 bp, Homo sapiens
acataaatatttcca

SEQ ID NO: 263517 - DNA, 15 bp, Homo sapiens
aacataaatatttcc

SEQ ID NO: 263518 - DNA, 15 bp, Homo sapiens
aaacataaatatttc

SEQ ID NO: 263519 - DNA, 15 bp, Homo sapiens
caaacataaatattt

SEQ ID NO: 263520 - DNA, 15 bp, Homo sapiens
acaaacataaatatt

SEQ ID NO: 263521 - DNA, 15 bp, Homo sapiens
aacaaacataaatat

SEQ ID NO: 263522 - DNA, 15 bp, Homo sapiens
caacaaacataaata

SEQ ID NO: 263523 - DNA, 15 bp, Homo sapiens
acaacaaacataaat

SEQ ID NO: 263524 - DNA, 15 bp, Homo sapiens
aacaacaaacataaa

SEQ ID NO: 263525 - DNA, 15 bp, Homo sapiens
caacaacaaacataa

SEQ ID NO: 263526 - DNA, 15 bp, Homo sapiens
tcaacaacaaacata

SEQ ID NO: 263527 - DNA, 15 bp, Homo sapiens
ttcaacaacaaacat

SEQ ID NO: 263528 - DNA, 15 bp, Homo sapiens
tttcaacaacaaaca

SEQ ID NO: 263529 - DNA, 15 bp, Homo sapiens
gtttcaacaacaaac

SEQ ID NO: 263530 - DNA, 15 bp, Homo sapiens
agtttcaacaacaaa

SEQ ID NO: 263531 - DNA, 15 bp, Homo sapiens
cagtttcaacaacaa

SEQ ID NO: 263532 - DNA, 15 bp, Homo sapiens
tcagtttcaacaaca

SEQ ID NO: 263533 - DNA, 15 bp, Homo sapiens
ttcagtttcaacaac

SEQ ID NO: 263534 - DNA, 15 bp, Homo sapiens
attcagtttcaacaa

SEQ ID NO: 263535 - DNA, 15 bp, Homo sapiens
cattcagtttcaaca

SEQ ID NO: 263536 - DNA, 15 bp, Homo sapiens
tcattcagtttcaac

SEQ ID NO: 263537 - DNA, 15 bp, Homo sapiens
atcattcagtttcaa

SEQ ID NO: 263538 - DNA, 15 bp, Homo sapiens
aatcattcagtttca

SEQ ID NO: 263539 - DNA, 15 bp, Homo sapiens
aaatcattcagtttc

SEQ ID NO: 263540 - DNA, 15 bp, Homo sapiens
aaaatcattcagttt

SEQ ID NO: 263541 - DNA, 15 bp, Homo sapiens
taaaatcattcagtt

SEQ ID NO: 263542 - DNA, 15 bp, Homo sapiens
gtaaaatcattcagt

SEQ ID NO: 263543 - DNA, 15 bp, Homo sapiens
tgtaaaatcattcag

SEQ ID NO: 263544 - DNA, 15 bp, Homo sapiens
ttgtaaaatcattca

SEQ ID NO: 263545 - DNA, 15 bp, Homo sapiens
tttgtaaaatcattc

SEQ ID NO: 263546 - DNA, 15 bp, Homo sapiens
atttgtaaaatcatt

SEQ ID NO: 263547 - DNA, 15 bp, Homo sapiens
gatttgtaaaatcat

SEQ ID NO: 263548 - DNA, 15 bp, Homo sapiens
tgatttgtaaaatca

SEQ ID NO: 263549 - DNA, 15 bp, Homo sapiens
atgatttgtaaaatc

SEQ ID NO: 263550 - DNA, 15 bp, Homo sapiens
aatgatttgtaaaat

SEQ ID NO: 263551 - DNA, 15 bp, Homo sapiens
caatgatttgtaaaa

SEQ ID NO: 263552 - DNA, 15 bp, Homo sapiens
tcaatgatttgtaaa

SEQ ID NO: 263553 - DNA, 15 bp, Homo sapiens
ctcaatgatttgtaa

SEQ ID NO: 263554 - DNA, 15 bp, Homo sapiens
gctcaatgatttgta

SEQ ID NO: 263555 - DNA, 15 bp, Homo sapiens
agctcaatgatttgt

SEQ ID NO: 263556 - DNA, 15 bp, Homo sapiens
aagctcaatgatttg

SEQ ID NO: 263557 - DNA, 15 bp, Homo sapiens
gaagctcaatgattt

SEQ ID NO: 263558 - DNA, 15 bp, Homo sapiens
agaagctcaatgatt

SEQ ID NO: 263559 - DNA, 15 bp, Homo sapiens
aagaagctcaatgat

SEQ ID NO: 263560 - DNA, 15 bp, Homo sapiens
taagaagctcaatga

SEQ ID NO: 263561 - DNA, 15 bp, Homo sapiens
ttaagaagctcaatg

SEQ ID NO: 263562 - DNA, 15 bp, Homo sapiens
gttaagaagctcaat

SEQ ID NO: 263563 - DNA, 15 bp, Homo sapiens
tgttaagaagctcaa

SEQ ID NO: 263564 - DNA, 15 bp, Homo sapiens
ttgttaagaagctca

SEQ ID NO: 263565 - DNA, 15 bp, Homo sapiens
tttgttaagaagctc

SEQ ID NO: 263566 - DNA, 15 bp, Homo sapiens
gtttgttaagaagct

SEQ ID NO: 263567 - DNA, 15 bp, Homo sapiens
tgtttgttaagaagc

SEQ ID NO: 263568 - DNA, 15 bp, Homo sapiens
ttgtttgttaagaag

SEQ ID NO: 263569 - DNA, 15 bp, Homo sapiens
attgtttgttaagaa

SEQ ID NO: 263570 - DNA, 15 bp, Homo sapiens
tattgtttgttaaga

SEQ ID NO: 263571 - DNA, 15 bp, Homo sapiens
ctattgtttgttaag

SEQ ID NO: 263572 - DNA, 15 bp, Homo sapiens
tctattgtttgttaa

SEQ ID NO: 263573 - DNA, 15 bp, Homo sapiens
ttctattgtttgtta

SEQ ID NO: 263574 - DNA, 15 bp, Homo sapiens
gttctattgtttgtt

SEQ ID NO: 263575 - DNA, 15 bp, Homo sapiens
tgttctattgtttgt

SEQ ID NO: 263576 - DNA, 15 bp, Homo sapiens
ctgttctattgtttg

SEQ ID NO: 263577 - DNA, 15 bp, Homo sapiens
tctgttctattgttt

SEQ ID NO: 263578 - DNA, 15 bp, Homo sapiens
ttctgttctattgtt

SEQ ID NO: 263579 - DNA, 15 bp, Homo sapiens
tttctgttctattgt

SEQ ID NO: 263580 - DNA, 15 bp, Homo sapiens
ttttctgttctattg

SEQ ID NO: 263581 - DNA, 15 bp, Homo sapiens
cttttctgttctatt

SEQ ID NO: 263582 - DNA, 15 bp, Homo sapiens
tcttttctgttctat

SEQ ID NO: 263583 - DNA, 15 bp, Homo sapiens
ttcttttctgttcta

SEQ ID NO: 263584 - DNA, 15 bp, Homo sapiens
attcttttctgttct

SEQ ID NO: 263585 - DNA, 15 bp, Homo sapiens
cattcttttctgttc

SEQ ID NO: 263586 - DNA, 15 bp, Homo sapiens
acattcttttctgtt

SEQ ID NO: 263587 - DNA, 15 bp, Homo sapiens
tacattcttttctgt

SEQ ID NO: 263588 - DNA, 15 bp, Homo sapiens
gtacattcttttctg

SEQ ID NO: 263589 - DNA, 15 bp, Homo sapiens
tgtacattcttttct

SEQ ID NO: 263590 - DNA, 15 bp, Homo sapiens
atgtacattcttttc

SEQ ID NO: 263591 - DNA, 15 bp, Homo sapiens
gatgtacattctttt

SEQ ID NO: 263592 - DNA, 15 bp, Homo sapiens
agatgtacattcttt

SEQ ID NO: 263593 - DNA, 15 bp, Homo sapiens
aagatgtacattctt

SEQ ID NO: 263594 - DNA, 15 bp, Homo sapiens
aaagatgtacattct

SEQ ID NO: 263595 - DNA, 15 bp, Homo sapiens
gaaagatgtacattc

SEQ ID NO: 263596 - DNA, 15 bp, Homo sapiens
tgaaagatgtacatt

SEQ ID NO: 263597 - DNA, 15 bp, Homo sapiens
atgaaagatgtacat

SEQ ID NO: 263598 - DNA, 15 bp, Homo sapiens
aatgaaagatgtaca

SEQ ID NO: 263599 - DNA, 15 bp, Homo sapiens
aaatgaaagatgtac

SEQ ID NO: 263600 - DNA, 15 bp, Homo sapiens
aaaatgaaagatgta

SEQ ID NO: 263601 - DNA, 15 bp, Homo sapiens
taaaatgaaagatgt

SEQ ID NO: 263602 - DNA, 15 bp, Homo sapiens
ttaaaatgaaagatg

SEQ ID NO: 263603 - DNA, 15 bp, Homo sapiens
tttaaaatgaaagat

SEQ ID NO: 263604 - DNA, 15 bp, Homo sapiens
ttttaaaatgaaaga

SEQ ID NO: 263605 - DNA, 15 bp, Homo sapiens
attttaaaatgaaag

SEQ ID NO: 263606 - DNA, 15 bp, Homo sapiens
cattttaaaatgaaa

SEQ ID NO: 263607 - DNA, 15 bp, Homo sapiens
acattttaaaatgaa

SEQ ID NO: 263608 - DNA, 15 bp, Homo sapiens
aacattttaaaatga

SEQ ID NO: 263609 - DNA, 15 bp, Homo sapiens
caacattttaaaatg

SEQ ID NO: 263610 - DNA, 15 bp, Homo sapiens
gcaacattttaaaat

SEQ ID NO: 263611 - DNA, 15 bp, Homo sapiens
agcaacattttaaaa

SEQ ID NO: 263612 - DNA, 15 bp, Homo sapiens
aagcaacattttaaa

SEQ ID NO: 263613 - DNA, 15 bp, Homo sapiens
gaagcaacattttaa

SEQ ID NO: 263614 - DNA, 15 bp, Homo sapiens
tgaagcaacatttta

SEQ ID NO: 263615 - DNA, 15 bp, Homo sapiens
ttgaagcaacatttt

SEQ ID NO: 263616 - DNA, 15 bp, Homo sapiens
attgaagcaacattt

SEQ ID NO: 263617 - DNA, 15 bp, Homo sapiens
aattgaagcaacatt

SEQ ID NO: 263618 - DNA, 15 bp, Homo sapiens
aaattgaagcaacat

SEQ ID NO: 263619 - DNA, 15 bp, Homo sapiens
taaattgaagcaaca

SEQ ID NO: 263620 - DNA, 15 bp, Homo sapiens
gtaaattgaagcaac

SEQ ID NO: 263621 - DNA, 15 bp, Homo sapiens
tgtaaattgaagcaa

SEQ ID NO: 263622 - DNA, 15 bp, Homo sapiens
ttgtaaattgaagca

SEQ ID NO: 263623 - DNA, 15 bp, Homo sapiens
tttgtaaattgaagc

SEQ ID NO: 263624 - DNA, 15 bp, Homo sapiens
ctttgtaaattgaag

SEQ ID NO: 263625 - DNA, 15 bp, Homo sapiens
tctttgtaaattgaa

SEQ ID NO: 263626 - DNA, 15 bp, Homo sapiens
gtctttgtaaattga

SEQ ID NO: 263627 - DNA, 15 bp, Homo sapiens
agtctttgtaaattg

SEQ ID NO: 263628 - DNA, 15 bp, Homo sapiens
cagtctttgtaaatt

SEQ ID NO: 263629 - DNA, 15 bp, Homo sapiens
acagtctttgtaaat

SEQ ID NO: 263630 - DNA, 15 bp, Homo sapiens
gacagtctttgtaaa

SEQ ID NO: 263631 - DNA, 15 bp, Homo sapiens
tgacagtctttgtaa

SEQ ID NO: 263632 - DNA, 15 bp, Homo sapiens
ttgacagtctttgta

SEQ ID NO: 263633 - DNA, 15 bp, Homo sapiens
tttgacagtctttgt

SEQ ID NO: 263634 - DNA, 15 bp, Homo sapiens
atttgacagtctttg

SEQ ID NO: 263635 - DNA, 15 bp, Homo sapiens
aatttgacagtcttt

SEQ ID NO: 263636 - DNA, 15 bp, Homo sapiens
aaatttgacagtctt

SEQ ID NO: 263637 - DNA, 15 bp, Homo sapiens
taaatttgacagtct

SEQ ID NO: 263638 - DNA, 15 bp, Homo sapiens
ataaatttgacagtc

SEQ ID NO: 263639 - DNA, 15 bp, Homo sapiens
tataaatttgacagt

SEQ ID NO: 263640 - DNA, 15 bp, Homo sapiens
ctataaatttgacag

SEQ ID NO: 263641 - DNA, 15 bp, Homo sapiens
actataaatttgaca

SEQ ID NO: 263642 - DNA, 15 bp, Homo sapiens
tactataaatttgac

SEQ ID NO: 263643 - DNA, 15 bp, Homo sapiens
atactataaatttga

SEQ ID NO: 263644 - DNA, 15 bp, Homo sapiens
aatactataaatttg

SEQ ID NO: 263645 - DNA, 15 bp, Homo sapiens
gaatactataaattt

SEQ ID NO: 263646 - DNA, 15 bp, Homo sapiens
agaatactataaatt

SEQ ID NO: 263647 - DNA, 15 bp, Homo sapiens
aagaatactataaat

SEQ ID NO: 263648 - DNA, 15 bp, Homo sapiens
aaagaatactataaa

SEQ ID NO: 263649 - DNA, 15 bp, Homo sapiens
caaagaatactataa

SEQ ID NO: 263650 - DNA, 15 bp, Homo sapiens
gcaaagaatactata

SEQ ID NO: 263651 - DNA, 15 bp, Homo sapiens
ggcaaagaatactat

SEQ ID NO: 263652 - DNA, 15 bp, Homo sapiens
tggcaaagaatacta

SEQ ID NO: 263653 - DNA, 15 bp, Homo sapiens
ttggcaaagaatact

SEQ ID NO: 263654 - DNA, 15 bp, Homo sapiens
tttggcaaagaatac

SEQ ID NO: 263655 - DNA, 15 bp, Homo sapiens
ttttggcaaagaata

SEQ ID NO: 263656 - DNA, 15 bp, Homo sapiens
attttggcaaagaat

SEQ ID NO: 263657 - DNA, 15 bp, Homo sapiens
cattttggcaaagaa

SEQ ID NO: 263658 - DNA, 15 bp, Homo sapiens
gcattttggcaaaga

SEQ ID NO: 263659 - DNA, 15 bp, Homo sapiens
agcattttggcaaag

SEQ ID NO: 263660 - DNA, 15 bp, Homo sapiens
tagcattttggcaaa

SEQ ID NO: 263661 - DNA, 15 bp, Homo sapiens
ctagcattttggcaa

SEQ ID NO: 263662 - DNA, 15 bp, Homo sapiens
cctagcattttggca

SEQ ID NO: 263663 - DNA, 15 bp, Homo sapiens
ccctagcattttggc

SEQ ID NO: 263664 - DNA, 15 bp, Homo sapiens
cccctagcattttgg

SEQ ID NO: 263665 - DNA, 15 bp, Homo sapiens
tcccctagcattttg

SEQ ID NO: 263666 - DNA, 15 bp, Homo sapiens
ttcccctagcatttt

SEQ ID NO: 263667 - DNA, 15 bp, Homo sapiens
tttcccctagcattt

SEQ ID NO: 263668 - DNA, 15 bp, Homo sapiens
gtttcccctagcatt

SEQ ID NO: 263669 - DNA, 15 bp, Homo sapiens
tgtttcccctagcat

SEQ ID NO: 263670 - DNA, 15 bp, Homo sapiens
ttgtttcccctagca

SEQ ID NO: 263671 - DNA, 15 bp, Homo sapiens
attgtttcccctagc

SEQ ID NO: 263672 - DNA, 15 bp, Homo sapiens
tattgtttcccctag

SEQ ID NO: 263673 - DNA, 15 bp, Homo sapiens
atattgtttccccta

SEQ ID NO: 263674 - DNA, 15 bp, Homo sapiens
tatattgtttcccct

SEQ ID NO: 263675 - DNA, 15 bp, Homo sapiens
ctatattgtttcccc

SEQ ID NO: 263676 - DNA, 15 bp, Homo sapiens
gctatattgtttccc

SEQ ID NO: 263677 - DNA, 15 bp, Homo sapiens
agctatattgtttcc

SEQ ID NO: 263678 - DNA, 15 bp, Homo sapiens
tagctatattgtttc

SEQ ID NO: 263679 - DNA, 15 bp, Homo sapiens
ttagctatattgttt

SEQ ID NO: 263680 - DNA, 15 bp, Homo sapiens
cttagctatattgtt

SEQ ID NO: 263681 - DNA, 15 bp, Homo sapiens
acttagctatattgt

SEQ ID NO: 263682 - DNA, 15 bp, Homo sapiens
gacttagctatattg

SEQ ID NO: 263683 - DNA, 15 bp, Homo sapiens
ggacttagctatatt

SEQ ID NO: 263684 - DNA, 15 bp, Homo sapiens
aggacttagctatat

SEQ ID NO: 263685 - DNA, 15 bp, Homo sapiens
taggacttagctata

SEQ ID NO: 263686 - DNA, 15 bp, Homo sapiens
gtaggacttagctat

SEQ ID NO: 263687 - DNA, 15 bp, Homo sapiens
agtaggacttagcta

SEQ ID NO: 263688 - DNA, 15 bp, Homo sapiens
aagtaggacttagct

SEQ ID NO: 263689 - DNA, 15 bp, Homo sapiens
aaagtaggacttagc

SEQ ID NO: 263690 - DNA, 15 bp, Homo sapiens
gaaagtaggacttag

SEQ ID NO: 263691 - DNA, 15 bp, Homo sapiens
agaaagtaggactta

SEQ ID NO: 263692 - DNA, 15 bp, Homo sapiens
aagaaagtaggactt

SEQ ID NO: 263693 - DNA, 15 bp, Homo sapiens
gaagaaagtaggact

SEQ ID NO: 263694 - DNA, 15 bp, Homo sapiens
agaagaaagtaggac

SEQ ID NO: 263695 - DNA, 15 bp, Homo sapiens
aagaagaaagtagga

SEQ ID NO: 263696 - DNA, 15 bp, Homo sapiens
caagaagaaagtagg

SEQ ID NO: 263697 - DNA, 15 bp, Homo sapiens
acaagaagaaagtag

SEQ ID NO: 263698 - DNA, 15 bp, Homo sapiens
aacaagaagaaagta

SEQ ID NO: 263699 - DNA, 15 bp, Homo sapiens
aaacaagaagaaagt

SEQ ID NO: 263700 - DNA, 15 bp, Homo sapiens
gaaacaagaagaaag

SEQ ID NO: 263701 - DNA, 15 bp, Homo sapiens
tgaaacaagaagaaa

SEQ ID NO: 263702 - DNA, 15 bp, Homo sapiens
atgaaacaagaagaa

SEQ ID NO: 263703 - DNA, 15 bp, Homo sapiens
tatgaaacaagaaga

SEQ ID NO: 263704 - DNA, 15 bp, Homo sapiens
ttatgaaacaagaag

SEQ ID NO: 263705 - DNA, 15 bp, Homo sapiens
attatgaaacaagaa

SEQ ID NO: 263706 - DNA, 15 bp, Homo sapiens
cattatgaaacaaga

SEQ ID NO: 263707 - DNA, 15 bp, Homo sapiens
acattatgaaacaag

SEQ ID NO: 263708 - DNA, 15 bp, Homo sapiens
gacattatgaaacaa

SEQ ID NO: 263709 - DNA, 15 bp, Homo sapiens
agacattatgaaaca

SEQ ID NO: 263710 - DNA, 15 bp, Homo sapiens
gagacattatgaaac

SEQ ID NO: 263711 - DNA, 15 bp, Homo sapiens
tgagacattatgaaa

SEQ ID NO: 263712 - DNA, 15 bp, Homo sapiens
gtgagacattatgaa

SEQ ID NO: 263713 - DNA, 15 bp, Homo sapiens
tgtgagacattatga

SEQ ID NO: 263714 - DNA, 15 bp, Homo sapiens
ctgtgagacattatg

SEQ ID NO: 263715 - DNA, 15 bp, Homo sapiens
actgtgagacattat

SEQ ID NO: 263716 - DNA, 15 bp, Homo sapiens
tactgtgagacatta

SEQ ID NO: 263717 - DNA, 15 bp, Homo sapiens
atactgtgagacatt

SEQ ID NO: 263718 - DNA, 15 bp, Homo sapiens
aatactgtgagacat

SEQ ID NO: 263719 - DNA, 15 bp, Homo sapiens
aaatactgtgagaca

SEQ ID NO: 263720 - DNA, 15 bp, Homo sapiens
gaaatactgtgagac

SEQ ID NO: 263721 - DNA, 15 bp, Homo sapiens
agaaatactgtgaga

SEQ ID NO: 263722 - DNA, 15 bp, Homo sapiens
aagaaatactgtgag

SEQ ID NO: 263723 - DNA, 15 bp, Homo sapiens
aaagaaatactgtga

SEQ ID NO: 263724 - DNA, 15 bp, Homo sapiens
aaaagaaatactgtg

SEQ ID NO: 263725 - DNA, 15 bp, Homo sapiens
aaaaagaaatactgt

SEQ ID NO: 263726 - DNA, 15 bp, Homo sapiens
aaaaaagaaatactg

SEQ ID NO: 263727 - DNA, 15 bp, Homo sapiens
gaaaaaagaaatact

SEQ ID NO: 263728 - DNA, 15 bp, Homo sapiens
tgaaaaaagaaatac

SEQ ID NO: 263729 - DNA, 15 bp, Homo sapiens
ttgaaaaaagaaata

SEQ ID NO: 263730 - DNA, 15 bp, Homo sapiens
tttgaaaaaagaaat

SEQ ID NO: 263731 - DNA, 15 bp, Homo sapiens
ttttgaaaaaagaaa

SEQ ID NO: 263732 - DNA, 15 bp, Homo sapiens
attttgaaaaaagaa

SEQ ID NO: 263733 - DNA, 15 bp, Homo sapiens
tattttgaaaaaaga

SEQ ID NO: 263734 - DNA, 15 bp, Homo sapiens
ttattttgaaaaaag

SEQ ID NO: 263735 - DNA, 15 bp, Homo sapiens
tttattttgaaaaaa

SEQ ID NO: 263736 - DNA, 15 bp, Homo sapiens
ttttattttgaaaaa

SEQ ID NO: 263737 - DNA, 15 bp, Homo sapiens
tttttattttgaaaa

SEQ ID NO: 263738 - DNA, 15 bp, Homo sapiens
ttttttattttgaaa

SEQ ID NO: 263739 - DNA, 15 bp, Homo sapiens
attttttattttgaa

SEQ ID NO: 263740 - DNA, 15 bp, Homo sapiens
gattttttattttga

SEQ ID NO: 263741 - DNA, 15 bp, Homo sapiens
agattttttattttg

SEQ ID NO: 263742 - DNA, 15 bp, Homo sapiens
aagattttttatttt

SEQ ID NO: 263743 - DNA, 15 bp, Homo sapiens
gaagattttttattt

SEQ ID NO: 263744 - DNA, 15 bp, Homo sapiens
agaagattttttatt

SEQ ID NO: 263745 - DNA, 15 bp, Homo sapiens
cagaagattttttat

SEQ ID NO: 263746 - DNA, 15 bp, Homo sapiens
acagaagatttttta

SEQ ID NO: 263747 - DNA, 15 bp, Homo sapiens
aacagaagatttttt

SEQ ID NO: 263748 - DNA, 15 bp, Homo sapiens
aaacagaagattttt

SEQ ID NO: 263749 - DNA, 15 bp, Homo sapiens
taaacagaagatttt

SEQ ID NO: 263750 - DNA, 15 bp, Homo sapiens
ataaacagaagattt

SEQ ID NO: 263751 - DNA, 15 bp, Homo sapiens
aataaacagaagatt

SEQ ID NO: 263752 - DNA, 15 bp, Homo sapiens
caataaacagaagat

SEQ ID NO: 263753 - DNA, 15 bp, Homo sapiens
acaataaacagaaga

SEQ ID NO: 263754 - DNA, 15 bp, Homo sapiens
aacaataaacagaag

SEQ ID NO: 263755 - DNA, 15 bp, Homo sapiens
taacaataaacagaa

SEQ ID NO: 263756 - DNA, 15 bp, Homo sapiens
ataacaataaacaga

SEQ ID NO: 263757 - DNA, 15 bp, Homo sapiens
cataacaataaacag

SEQ ID NO: 263758 - DNA, 15 bp, Homo sapiens
tcataacaataaaca

SEQ ID NO: 263759 - DNA, 15 bp, Homo sapiens
ttcataacaataaac

SEQ ID NO: 263760 - DNA, 15 bp, Homo sapiens
attcataacaataaa

SEQ ID NO: 263761 - DNA, 15 bp, Homo sapiens
aattcataacaataa

SEQ ID NO: 263762 - DNA, 15 bp, Homo sapiens
taattcataacaata

SEQ ID NO: 263763 - DNA, 15 bp, Homo sapiens
gtaattcataacaat

SEQ ID NO: 263764 - DNA, 15 bp, Homo sapiens
tgtaattcataacaa

SEQ ID NO: 263765 - DNA, 15 bp, Homo sapiens
ctgtaattcataaca

SEQ ID NO: 263766 - DNA, 15 bp, Homo sapiens
actgtaattcataac

SEQ ID NO: 263767 - DNA, 15 bp, Homo sapiens
tactgtaattcataa

SEQ ID NO: 263768 - DNA, 15 bp, Homo sapiens
ttactgtaattcata

SEQ ID NO: 263769 - DNA, 15 bp, Homo sapiens
attactgtaattcat

SEQ ID NO: 263770 - DNA, 15 bp, Homo sapiens
aattactgtaattca

SEQ ID NO: 263771 - DNA, 15 bp, Homo sapiens
aaattactgtaattc

SEQ ID NO: 263772 - DNA, 15 bp, Homo sapiens
taaattactgtaatt

SEQ ID NO: 263773 - DNA, 15 bp, Homo sapiens
ataaattactgtaat

SEQ ID NO: 263774 - DNA, 15 bp, Homo sapiens
aataaattactgtaa

SEQ ID NO: 263775 - DNA, 15 bp, Homo sapiens
taataaattactgta

SEQ ID NO: 263776 - DNA, 15 bp, Homo sapiens
ctaataaattactgt

SEQ ID NO: 263777 - DNA, 15 bp, Homo sapiens
gctaataaattactg

SEQ ID NO: 263778 - DNA, 15 bp, Homo sapiens
agctaataaattact

SEQ ID NO: 263779 - DNA, 15 bp, Homo sapiens
gagctaataaattac

SEQ ID NO: 263780 - DNA, 15 bp, Homo sapiens
tgagctaataaatta

SEQ ID NO: 263781 - DNA, 15 bp, Homo sapiens
atgagctaataaatt

SEQ ID NO: 263782 - DNA, 15 bp, Homo sapiens
tatgagctaataaat

SEQ ID NO: 263783 - DNA, 15 bp, Homo sapiens
ttatgagctaataaa

SEQ ID NO: 263784 - DNA, 15 bp, Homo sapiens
attatgagctaataa

SEQ ID NO: 263785 - DNA, 15 bp, Homo sapiens
tattatgagctaata

SEQ ID NO: 263786 - DNA, 15 bp, Homo sapiens
gaaaaacaagaactt

SEQ ID NO: 263787 - DNA, 15 bp, Homo sapiens
ggaaaaacaagaact

SEQ ID NO: 263788 - DNA, 15 bp, Homo sapiens
aggaaaaacaagaac

SEQ ID NO: 263789 - DNA, 15 bp, Homo sapiens
aaggaaaaacaagaa

SEQ ID NO: 263790 - DNA, 15 bp, Homo sapiens
aaaggaaaaacaaga

SEQ ID NO: 263791 - DNA, 15 bp, Homo sapiens
caaaggaaaaacaag

SEQ ID NO: 263792 - DNA, 15 bp, Homo sapiens
tcaaaggaaaaacaa

SEQ ID NO: 263793 - DNA, 15 bp, Homo sapiens
atcaaaggaaaaaca

SEQ ID NO: 263794 - DNA, 15 bp, Homo sapiens
aatcaaaggaaaaac

SEQ ID NO: 263795 - DNA, 15 bp, Homo sapiens
aaatcaaaggaaaaa

SEQ ID NO: 263796 - DNA, 15 bp, Homo sapiens
taaatcaaaggaaaa

SEQ ID NO: 263797 - DNA, 15 bp, Homo sapiens
gtaaatcaaaggaaa

SEQ ID NO: 263798 - DNA, 15 bp, Homo sapiens
tgtaaatcaaaggaa

SEQ ID NO: 263799 - DNA, 15 bp, Homo sapiens
ctgtaaatcaaagga

SEQ ID NO: 263800 - DNA, 15 bp, Homo sapiens
gctgtaaatcaaagg

SEQ ID NO: 263801 - DNA, 15 bp, Homo sapiens
agctgtaaatcaaag

SEQ ID NO: 263802 - DNA, 15 bp, Homo sapiens
tagctgtaaatcaaa

SEQ ID NO: 263803 - DNA, 15 bp, Homo sapiens
atagctgtaaatcaa

SEQ ID NO: 263804 - DNA, 15 bp, Homo sapiens
aatagctgtaaatca

SEQ ID NO: 263805 - DNA, 15 bp, Homo sapiens
aaatagctgtaaatc

SEQ ID NO: 263806 - DNA, 15 bp, Homo sapiens
aaaatagctgtaaat

SEQ ID NO: 263807 - DNA, 15 bp, Homo sapiens
aaaaatagctgtaaa

SEQ ID NO: 263808 - DNA, 15 bp, Homo sapiens
aaaaaatagctgtaa

SEQ ID NO: 263809 - DNA, 15 bp, Homo sapiens
gaaaaaatagctgta

SEQ ID NO: 263810 - DNA, 15 bp, Homo sapiens
ggaaaaaatagctgt

SEQ ID NO: 263811 - DNA, 15 bp, Homo sapiens
aggaaaaaatagctg

SEQ ID NO: 263812 - DNA, 15 bp, Homo sapiens
caggaaaaaatagct

SEQ ID NO: 263813 - DNA, 15 bp, Homo sapiens
tcaggaaaaaatagc

SEQ ID NO: 263814 - DNA, 15 bp, Homo sapiens
ttcaggaaaaaatag

SEQ ID NO: 263815 - DNA, 15 bp, Homo sapiens
cttcaggaaaaaata

SEQ ID NO: 263816 - DNA, 15 bp, Homo sapiens
acttcaggaaaaaat

SEQ ID NO: 263817 - DNA, 15 bp, Homo sapiens
aacttcaggaaaaaa

SEQ ID NO: 263818 - DNA, 15 bp, Homo sapiens
taacttcaggaaaaa

SEQ ID NO: 263819 - DNA, 15 bp, Homo sapiens
ataacttcaggaaaa

SEQ ID NO: 263820 - DNA, 15 bp, Homo sapiens
gataacttcaggaaa

SEQ ID NO: 263821 - DNA, 15 bp, Homo sapiens
ggataacttcaggaa

SEQ ID NO: 263822 - DNA, 15 bp, Homo sapiens
aggataacttcagga

SEQ ID NO: 263823 - DNA, 15 bp, Homo sapiens
gaggataacttcagg

SEQ ID NO: 263824 - DNA, 15 bp, Homo sapiens
tgaggataacttcag

SEQ ID NO: 263825 - DNA, 15 bp, Homo sapiens
atgaggataacttca

SEQ ID NO: 263826 - DNA, 15 bp, Homo sapiens
catgaggataacttc

SEQ ID NO: 263827 - DNA, 15 bp, Homo sapiens
acatgaggataactt

SEQ ID NO: 263828 - DNA, 15 bp, Homo sapiens
aacatgaggataact

SEQ ID NO: 263829 - DNA, 15 bp, Homo sapiens
gaacatgaggataac

SEQ ID NO: 263830 - DNA, 15 bp, Homo sapiens
agaacatgaggataa

SEQ ID NO: 263831 - DNA, 15 bp, Homo sapiens
tagaacatgaggata

SEQ ID NO: 263832 - DNA, 15 bp, Homo sapiens
atagaacatgaggat

SEQ ID NO: 263833 - DNA, 15 bp, Homo sapiens
aatagaacatgagga

SEQ ID NO: 263834 - DNA, 15 bp, Homo sapiens
taatagaacatgagg

SEQ ID NO: 263835 - DNA, 15 bp, Homo sapiens
ttaatagaacatgag

SEQ ID NO: 263836 - DNA, 15 bp, Homo sapiens
attaatagaacatga

SEQ ID NO: 263837 - DNA, 15 bp, Homo sapiens
tattaatagaacatg

SEQ ID NO: 263838 - DNA, 15 bp, Homo sapiens
ctattaatagaacat

SEQ ID NO: 263839 - DNA, 15 bp, Homo sapiens
gctattaatagaaca

SEQ ID NO: 263840 - DNA, 15 bp, Homo sapiens
agctattaatagaac

SEQ ID NO: 263841 - DNA, 15 bp, Homo sapiens
tagctattaatagaa

SEQ ID NO: 263842 - DNA, 15 bp, Homo sapiens
atagctattaataga

SEQ ID NO: 263843 - DNA, 15 bp, Homo sapiens
aatagctattaatag

SEQ ID NO: 263844 - DNA, 15 bp, Homo sapiens
gaatagctattaata

SEQ ID NO: 263845 - DNA, 15 bp, Homo sapiens
agaatagctattaat

SEQ ID NO: 263846 - DNA, 15 bp, Homo sapiens
aagaatagctattaa

SEQ ID NO: 263847 - DNA, 15 bp, Homo sapiens
aaagaatagctatta

SEQ ID NO: 263848 - DNA, 15 bp, Homo sapiens
aaaagaatagctatt

SEQ ID NO: 263849 - DNA, 15 bp, Homo sapiens
taaaagaatagctat

SEQ ID NO: 263850 - DNA, 15 bp, Homo sapiens
gtaaaagaatagcta

SEQ ID NO: 263851 - DNA, 15 bp, Homo sapiens
agtaaaagaatagct

SEQ ID NO: 263852 - DNA, 15 bp, Homo sapiens
aagtaaaagaatagc

SEQ ID NO: 263853 - DNA, 15 bp, Homo sapiens
gaagtaaaagaatag

SEQ ID NO: 263854 - DNA, 15 bp, Homo sapiens
ggaagtaaaagaata

SEQ ID NO: 263855 - DNA, 15 bp, Homo sapiens
aggaagtaaaagaat

SEQ ID NO: 263856 - DNA, 15 bp, Homo sapiens
aaggaagtaaaagaa

SEQ ID NO: 263857 - DNA, 15 bp, Homo sapiens
gaaggaagtaaaaga

SEQ ID NO: 263858 - DNA, 15 bp, Homo sapiens
ggaaggaagtaaaag

SEQ ID NO: 263859 - DNA, 15 bp, Homo sapiens
tggaaggaagtaaaa

SEQ ID NO: 263860 - DNA, 15 bp, Homo sapiens
ttggaaggaagtaaa

SEQ ID NO: 263861 - DNA, 15 bp, Homo sapiens
tttggaaggaagtaa

SEQ ID NO: 263862 - DNA, 15 bp, Homo sapiens
atttggaaggaagta

SEQ ID NO: 263863 - DNA, 15 bp, Homo sapiens
tatttggaaggaagt

SEQ ID NO: 263864 - DNA, 15 bp, Homo sapiens
ttatttggaaggaag

SEQ ID NO: 263865 - DNA, 15 bp, Homo sapiens
attatttggaaggaa

SEQ ID NO: 263866 - DNA, 15 bp, Homo sapiens
cattatttggaagga

SEQ ID NO: 263867 - DNA, 15 bp, Homo sapiens
gcattatttggaagg

SEQ ID NO: 263868 - DNA, 15 bp, Homo sapiens
ggcattatttggaag

SEQ ID NO: 263869 - DNA, 15 bp, Homo sapiens
gggcattatttggaa

SEQ ID NO: 263870 - DNA, 15 bp, Homo sapiens
tgggcattatttgga

SEQ ID NO: 263871 - DNA, 15 bp, Homo sapiens
ttgggcattatttgg

SEQ ID NO: 263872 - DNA, 15 bp, Homo sapiens
tttgggcattatttg

SEQ ID NO: 263873 - DNA, 15 bp, Homo sapiens
atttgggcattattt

SEQ ID NO: 263874 - DNA, 15 bp, Homo sapiens
catttgggcattatt

SEQ ID NO: 263875 - DNA, 15 bp, Homo sapiens
acatttgggcattat

SEQ ID NO: 263876 - DNA, 15 bp, Homo sapiens
tacatttgggcatta

SEQ ID NO: 263877 - DNA, 15 bp, Homo sapiens
atacatttgggcatt

SEQ ID NO: 263878 - DNA, 15 bp, Homo sapiens
aatacatttgggcat

SEQ ID NO: 263879 - DNA, 15 bp, Homo sapiens
gaatacatttgggca

SEQ ID NO: 263880 - DNA, 15 bp, Homo sapiens
tgaatacatttgggc

SEQ ID NO: 263881 - DNA, 15 bp, Homo sapiens
atgaatacatttggg

SEQ ID NO: 263882 - DNA, 15 bp, Homo sapiens
gatgaatacatttgg

SEQ ID NO: 263883 - DNA, 15 bp, Homo sapiens
tgatgaatacatttg

SEQ ID NO: 263884 - DNA, 15 bp, Homo sapiens
ttgatgaatacattt

SEQ ID NO: 263885 - DNA, 15 bp, Homo sapiens
cttgatgaatacatt

SEQ ID NO: 263886 - DNA, 15 bp, Homo sapiens
gcttgatgaatacat

SEQ ID NO: 263887 - DNA, 15 bp, Homo sapiens
agcttgatgaataca

SEQ ID NO: 263888 - DNA, 15 bp, Homo sapiens
cagcttgatgaatac

SEQ ID NO: 263889 - DNA, 15 bp, Homo sapiens
acagcttgatgaata

SEQ ID NO: 263890 - DNA, 15 bp, Homo sapiens
gacagcttgatgaat

SEQ ID NO: 263891 - DNA, 15 bp, Homo sapiens
agacagcttgatgaa

SEQ ID NO: 263892 - DNA, 15 bp, Homo sapiens
tagacagcttgatga

SEQ ID NO: 263893 - DNA, 15 bp, Homo sapiens
atagacagcttgatg

SEQ ID NO: 263894 - DNA, 15 bp, Homo sapiens
aatagacagcttgat

SEQ ID NO: 263895 - DNA, 15 bp, Homo sapiens
aaatagacagcttga

SEQ ID NO: 263896 - DNA, 15 bp, Homo sapiens
aaaatagacagcttg

SEQ ID NO: 263897 - DNA, 15 bp, Homo sapiens
gaaaatagacagctt

SEQ ID NO: 263898 - DNA, 15 bp, Homo sapiens
agaaaatagacagct

SEQ ID NO: 263899 - DNA, 15 bp, Homo sapiens
aagaaaatagacagc

SEQ ID NO: 263900 - DNA, 15 bp, Homo sapiens
aaagaaaatagacag

SEQ ID NO: 263901 - DNA, 15 bp, Homo sapiens
caaagaaaatagaca

SEQ ID NO: 263902 - DNA, 15 bp, Homo sapiens
ccaaagaaaatagac

SEQ ID NO: 263903 - DNA, 15 bp, Homo sapiens
accaaagaaaataga

SEQ ID NO: 263904 - DNA, 15 bp, Homo sapiens
aaccaaagaaaatag

SEQ ID NO: 263905 - DNA, 15 bp, Homo sapiens
aaaccaaagaaaata

SEQ ID NO: 263906 - DNA, 15 bp, Homo sapiens
taaaccaaagaaaat

SEQ ID NO: 263907 - DNA, 15 bp, Homo sapiens
ctaaaccaaagaaaa

SEQ ID NO: 263908 - DNA, 15 bp, Homo sapiens
cctaaaccaaagaaa

SEQ ID NO: 263909 - DNA, 15 bp, Homo sapiens
ccctaaaccaaagaa

SEQ ID NO: 263910 - DNA, 15 bp, Homo sapiens
tccctaaaccaaaga

SEQ ID NO: 263911 - DNA, 15 bp, Homo sapiens
ttccctaaaccaaag

SEQ ID NO: 263912 - DNA, 15 bp, Homo sapiens
attccctaaaccaaa

SEQ ID NO: 263913 - DNA, 15 bp, Homo sapiens
aattccctaaaccaa

SEQ ID NO: 263914 - DNA, 15 bp, Homo sapiens
caattccctaaacca

SEQ ID NO: 263915 - DNA, 15 bp, Homo sapiens
tcaattccctaaacc

SEQ ID NO: 263916 - DNA, 15 bp, Homo sapiens
ctcaattccctaaac

SEQ ID NO: 263917 - DNA, 15 bp, Homo sapiens
actcaattccctaaa

SEQ ID NO: 263918 - DNA, 15 bp, Homo sapiens
aactcaattccctaa

SEQ ID NO: 263919 - DNA, 15 bp, Homo sapiens
taactcaattcccta

SEQ ID NO: 263920 - DNA, 15 bp, Homo sapiens
gtaactcaattccct

SEQ ID NO: 263921 - DNA, 15 bp, Homo sapiens
agtaactcaattccc

SEQ ID NO: 263922 - DNA, 15 bp, Homo sapiens
aagtaactcaattcc

SEQ ID NO: 263923 - DNA, 15 bp, Homo sapiens
aaagtaactcaattc

SEQ ID NO: 263924 - DNA, 15 bp, Homo sapiens
aaaagtaactcaatt

SEQ ID NO: 263925 - DNA, 15 bp, Homo sapiens
aaaaagtaactcaat

SEQ ID NO: 263926 - DNA, 15 bp, Homo sapiens
aaaaaagtaactcaa

SEQ ID NO: 263927 - DNA, 15 bp, Homo sapiens
caaaaaagtaactca

SEQ ID NO: 263928 - DNA, 15 bp, Homo sapiens
ccaaaaaagtaactc

SEQ ID NO: 263929 - DNA, 15 bp, Homo sapiens
tccaaaaaagtaact

SEQ ID NO: 263930 - DNA, 15 bp, Homo sapiens
atccaaaaaagtaac

SEQ ID NO: 263931 - DNA, 15 bp, Homo sapiens
gatccaaaaaagtaa

SEQ ID NO: 263932 - DNA, 15 bp, Homo sapiens
tgatccaaaaaagta

SEQ ID NO: 263933 - DNA, 15 bp, Homo sapiens
atgatccaaaaaagt

SEQ ID NO: 263934 - DNA, 15 bp, Homo sapiens
tatgatccaaaaaag

SEQ ID NO: 263935 - DNA, 15 bp, Homo sapiens
ttatgatccaaaaaa

SEQ ID NO: 263936 - DNA, 15 bp, Homo sapiens
tttatgatccaaaaa

SEQ ID NO: 263937 - DNA, 15 bp, Homo sapiens
atttatgatccaaaa

SEQ ID NO: 263938 - DNA, 15 bp, Homo sapiens
aatttatgatccaaa

SEQ ID NO: 263939 - DNA, 15 bp, Homo sapiens
caatttatgatccaa

SEQ ID NO: 263940 - DNA, 15 bp, Homo sapiens
tcaatttatgatcca

SEQ ID NO: 263941 - DNA, 15 bp, Homo sapiens
gtcaatttatgatcc

SEQ ID NO: 263942 - DNA, 15 bp, Homo sapiens
tgtcaatttatgatc

SEQ ID NO: 263943 - DNA, 15 bp, Homo sapiens
ctgtcaatttatgat

SEQ ID NO: 263944 - DNA, 15 bp, Homo sapiens
tctgtcaatttatga

SEQ ID NO: 263945 - DNA, 15 bp, Homo sapiens
ttctgtcaatttatg

SEQ ID NO: 263946 - DNA, 15 bp, Homo sapiens
tttctgtcaatttat

SEQ ID NO: 263947 - DNA, 15 bp, Homo sapiens
ctttctgtcaattta

SEQ ID NO: 263948 - DNA, 15 bp, Homo sapiens
cctttctgtcaattt

SEQ ID NO: 263949 - DNA, 15 bp, Homo sapiens
gcctttctgtcaatt

SEQ ID NO: 263950 - DNA, 15 bp, Homo sapiens
agcctttctgtcaat

SEQ ID NO: 263951 - DNA, 15 bp, Homo sapiens
cagcctttctgtcaa

SEQ ID NO: 263952 - DNA, 15 bp, Homo sapiens
acagcctttctgtca

SEQ ID NO: 263953 - DNA, 15 bp, Homo sapiens
tacagcctttctgtc

SEQ ID NO: 263954 - DNA, 15 bp, Homo sapiens
ttacagcctttctgt

SEQ ID NO: 263955 - DNA, 15 bp, Homo sapiens
attacagcctttctg

SEQ ID NO: 263956 - DNA, 15 bp, Homo sapiens
tattacagcctttct

SEQ ID NO: 263957 - DNA, 15 bp, Homo sapiens
gtattacagcctttc

SEQ ID NO: 263958 - DNA, 15 bp, Homo sapiens
agtattacagccttt

SEQ ID NO: 263959 - DNA, 15 bp, Homo sapiens
aagtattacagcctt

SEQ ID NO: 263960 - DNA, 15 bp, Homo sapiens
taagtattacagcct

SEQ ID NO: 263961 - DNA, 15 bp, Homo sapiens
ataagtattacagcc

SEQ ID NO: 263962 - DNA, 15 bp, Homo sapiens
tataagtattacagc

SEQ ID NO: 263963 - DNA, 15 bp, Homo sapiens
ttataagtattacag

SEQ ID NO: 263964 - DNA, 15 bp, Homo sapiens
tttataagtattaca

SEQ ID NO: 263965 - DNA, 15 bp, Homo sapiens
ttttataagtattac

SEQ ID NO: 263966 - DNA, 15 bp, Homo sapiens
attttataagtatta

SEQ ID NO: 263967 - DNA, 15 bp, Homo sapiens
tattttataagtatt

SEQ ID NO: 263968 - DNA, 15 bp, Homo sapiens
atattttataagtat

SEQ ID NO: 263969 - DNA, 15 bp, Homo sapiens
tatattttataagta

SEQ ID NO: 263970 - DNA, 15 bp, Homo sapiens
gtatattttataagt

SEQ ID NO: 263971 - DNA, 15 bp, Homo sapiens
tgtatattttataag

SEQ ID NO: 263972 - DNA, 15 bp, Homo sapiens
gtgtatattttataa

SEQ ID NO: 263973 - DNA, 15 bp, Homo sapiens
tgtgtatattttata

SEQ ID NO: 263974 - DNA, 15 bp, Homo sapiens
atgtgtatattttat

SEQ ID NO: 263975 - DNA, 15 bp, Homo sapiens
tatgtgtatatttta

SEQ ID NO: 263976 - DNA, 15 bp, Homo sapiens
atatgtgtatatttt

SEQ ID NO: 263977 - DNA, 15 bp, Homo sapiens
tatatgtgtatattt

SEQ ID NO: 263978 - DNA, 15 bp, Homo sapiens
ttatatgtgtatatt

SEQ ID NO: 263979 - DNA, 15 bp, Homo sapiens
tttatatgtgtatat

SEQ ID NO: 263980 - DNA, 15 bp, Homo sapiens
atttatatgtgtata

SEQ ID NO: 263981 - DNA, 15 bp, Homo sapiens
gatttatatgtgtat

SEQ ID NO: 263982 - DNA, 15 bp, Homo sapiens
agatttatatgtgta

SEQ ID NO: 263983 - DNA, 15 bp, Homo sapiens
gagatttatatgtgt

SEQ ID NO: 263984 - DNA, 15 bp, Homo sapiens
tgagatttatatgtg

SEQ ID NO: 263985 - DNA, 15 bp, Homo sapiens
gtgagatttatatgt

SEQ ID NO: 263986 - DNA, 15 bp, Homo sapiens
tgtgagatttatatg

SEQ ID NO: 263987 - DNA, 15 bp, Homo sapiens
gtgtgagatttatat

SEQ ID NO: 263988 - DNA, 15 bp, Homo sapiens
agtgtgagatttata

SEQ ID NO: 263989 - DNA, 15 bp, Homo sapiens
gagtgtgagatttat

SEQ ID NO: 263990 - DNA, 15 bp, Homo sapiens
tgagtgtgagattta

SEQ ID NO: 263991 - DNA, 15 bp, Homo sapiens
atgagtgtgagattt

SEQ ID NO: 263992 - DNA, 15 bp, Homo sapiens
tatgagtgtgagatt

SEQ ID NO: 263993 - DNA, 15 bp, Homo sapiens
ctatgagtgtgagat

SEQ ID NO: 263994 - DNA, 15 bp, Homo sapiens
cctatgagtgtgaga

SEQ ID NO: 263995 - DNA, 15 bp, Homo sapiens
acctatgagtgtgag

SEQ ID NO: 263996 - DNA, 15 bp, Homo sapiens
tacctatgagtgtga

SEQ ID NO: 263997 - DNA, 15 bp, Homo sapiens
atacctatgagtgtg

SEQ ID NO: 263998 - DNA, 15 bp, Homo sapiens
gatacctatgagtgt

SEQ ID NO: 263999 - DNA, 15 bp, Homo sapiens
agatacctatgagtg

SEQ ID NO: 264000 - DNA, 15 bp, Homo sapiens
aagatacctatgagt

SEQ ID NO: 264001 - DNA, 15 bp, Homo sapiens
taagatacctatgag

SEQ ID NO: 264002 - DNA, 15 bp, Homo sapiens
ataagatacctatga

SEQ ID NO: 264003 - DNA, 15 bp, Homo sapiens
gataagatacctatg

SEQ ID NO: 264004 - DNA, 15 bp, Homo sapiens
agataagatacctat

SEQ ID NO: 264005 - DNA, 15 bp, Homo sapiens
gagataagataccta

SEQ ID NO: 264006 - DNA, 15 bp, Homo sapiens
tgagataagatacct

SEQ ID NO: 264007 - DNA, 15 bp, Homo sapiens
ttgagataagatacc

SEQ ID NO: 264008 - DNA, 15 bp, Homo sapiens
tttgagataagatac

SEQ ID NO: 264009 - DNA, 15 bp, Homo sapiens
atttgagataagata

SEQ ID NO: 264010 - DNA, 15 bp, Homo sapiens
tatttgagataagat

SEQ ID NO: 264011 - DNA, 15 bp, Homo sapiens
ttatttgagataaga

SEQ ID NO: 264012 - DNA, 15 bp, Homo sapiens
tttatttgagataag

SEQ ID NO: 264013 - DNA, 15 bp, Homo sapiens
atttatttgagataa

SEQ ID NO: 264014 - DNA, 15 bp, Homo sapiens
tatttatttgagata

SEQ ID NO: 264015 - DNA, 15 bp, Homo sapiens
ttatttatttgagat

SEQ ID NO: 264016 - DNA, 15 bp, Homo sapiens
cttatttatttgaga

SEQ ID NO: 264017 - DNA, 15 bp, Homo sapiens
acttatttatttgag

SEQ ID NO: 264018 - DNA, 15 bp, Homo sapiens
cacttatttatttga

SEQ ID NO: 264019 - DNA, 15 bp, Homo sapiens
gcacttatttatttg

SEQ ID NO: 264020 - DNA, 15 bp, Homo sapiens
ggcacttatttattt

SEQ ID NO: 264021 - DNA, 15 bp, Homo sapiens
gggcacttatttatt

SEQ ID NO: 264022 - DNA, 15 bp, Homo sapiens
agggcacttatttat

SEQ ID NO: 264023 - DNA, 15 bp, Homo sapiens
cagggcacttattta

SEQ ID NO: 264024 - DNA, 15 bp, Homo sapiens
acagggcacttattt

SEQ ID NO: 264025 - DNA, 15 bp, Homo sapiens
cacagggcacttatt

SEQ ID NO: 264026 - DNA, 15 bp, Homo sapiens
acacagggcacttat

SEQ ID NO: 264027 - DNA, 15 bp, Homo sapiens
tacacagggcactta

SEQ ID NO: 264028 - DNA, 15 bp, Homo sapiens
atacacagggcactt

SEQ ID NO: 264029 - DNA, 15 bp, Homo sapiens
catacacagggcact

SEQ ID NO: 264030 - DNA, 15 bp, Homo sapiens
ccatacacagggcac

SEQ ID NO: 264031 - DNA, 15 bp, Homo sapiens
tccatacacagggca

SEQ ID NO: 264032 - DNA, 15 bp, Homo sapiens
ctccatacacagggc

SEQ ID NO: 264033 - DNA, 15 bp, Homo sapiens
tctccatacacaggg

SEQ ID NO: 264034 - DNA, 15 bp, Homo sapiens
ctctccatacacagg

SEQ ID NO: 264035 - DNA, 15 bp, Homo sapiens
cctctccatacacag

SEQ ID NO: 264036 - DNA, 15 bp, Homo sapiens
tcctctccatacaca

SEQ ID NO: 264037 - DNA, 15 bp, Homo sapiens
ttcctctccatacac

SEQ ID NO: 264038 - DNA, 15 bp, Homo sapiens
tttcctctccataca

SEQ ID NO: 264039 - DNA, 15 bp, Homo sapiens
atttcctctccatac

SEQ ID NO: 264040 - DNA, 15 bp, Homo sapiens
gatttcctctccata

SEQ ID NO: 264041 - DNA, 15 bp, Homo sapiens
agatttcctctccat

SEQ ID NO: 264042 - DNA, 15 bp, Homo sapiens
cagatttcctctcca

SEQ ID NO: 264043 - DNA, 15 bp, Homo sapiens
acagatttcctctcc

SEQ ID NO: 264044 - DNA, 15 bp, Homo sapiens
tacagatttcctctc

SEQ ID NO: 264045 - DNA, 15 bp, Homo sapiens
ctacagatttcctct

SEQ ID NO: 264046 - DNA, 15 bp, Homo sapiens
tctacagatttcctc

SEQ ID NO: 264047 - DNA, 15 bp, Homo sapiens
ttctacagatttcct

SEQ ID NO: 264048 - DNA, 15 bp, Homo sapiens
tttctacagatttcc

SEQ ID NO: 264049 - DNA, 15 bp, Homo sapiens
ttttctacagatttc

SEQ ID NO: 264050 - DNA, 15 bp, Homo sapiens
attttctacagattt

SEQ ID NO: 264051 - DNA, 15 bp, Homo sapiens
tattttctacagatt

SEQ ID NO: 264052 - DNA, 15 bp, Homo sapiens
atattttctacagat

SEQ ID NO: 264053 - DNA, 15 bp, Homo sapiens
aatattttctacaga

SEQ ID NO: 264054 - DNA, 15 bp, Homo sapiens
caatattttctacag

SEQ ID NO: 264055 - DNA, 15 bp, Homo sapiens
gcaatattttctaca

SEQ ID NO: 264056 - DNA, 15 bp, Homo sapiens
agcaatattttctac

SEQ ID NO: 264057 - DNA, 15 bp, Homo sapiens
cagcaatattttcta

SEQ ID NO: 264058 - DNA, 15 bp, Homo sapiens
tcagcaatattttct

SEQ ID NO: 264059 - DNA, 15 bp, Homo sapiens
ttcagcaatattttc

SEQ ID NO: 264060 - DNA, 15 bp, Homo sapiens
attcagcaatatttt

SEQ ID NO: 264061 - DNA, 15 bp, Homo sapiens
aattcagcaatattt

SEQ ID NO: 264062 - DNA, 15 bp, Homo sapiens
taattcagcaatatt

SEQ ID NO: 264063 - DNA, 15 bp, Homo sapiens
ataattcagcaatat

SEQ ID NO: 264064 - DNA, 15 bp, Homo sapiens
tataattcagcaata

SEQ ID NO: 264065 - DNA, 15 bp, Homo sapiens
ttataattcagcaat

SEQ ID NO: 264066 - DNA, 15 bp, Homo sapiens
attataattcagcaa

SEQ ID NO: 264067 - DNA, 15 bp, Homo sapiens
cattataattcagca

SEQ ID NO: 264068 - DNA, 15 bp, Homo sapiens
ccattataattcagc

SEQ ID NO: 264069 - DNA, 15 bp, Homo sapiens
tccattataattcag

SEQ ID NO: 264070 - DNA, 15 bp, Homo sapiens
ctccattataattca

SEQ ID NO: 264071 - DNA, 15 bp, Homo sapiens
cctccattataattc

SEQ ID NO: 264072 - DNA, 15 bp, Homo sapiens
tcctccattataatt

SEQ ID NO: 264073 - DNA, 15 bp, Homo sapiens
ttcctccattataat

SEQ ID NO: 264074 - DNA, 15 bp, Homo sapiens
cttcctccattataa

SEQ ID NO: 264075 - DNA, 15 bp, Homo sapiens
acttcctccattata

SEQ ID NO: 264076 - DNA, 15 bp, Homo sapiens
cacttcctccattat

SEQ ID NO: 264077 - DNA, 15 bp, Homo sapiens
gcacttcctccatta

SEQ ID NO: 264078 - DNA, 15 bp, Homo sapiens
ggcacttcctccatt

SEQ ID NO: 264079 - DNA, 15 bp, Homo sapiens
gggcacttcctccat

SEQ ID NO: 264080 - DNA, 15 bp, Homo sapiens
tgggcacttcctcca

SEQ ID NO: 264081 - DNA, 15 bp, Homo sapiens
gtgggcacttcctcc

SEQ ID NO: 264082 - DNA, 15 bp, Homo sapiens
tgtgggcacttcctc

SEQ ID NO: 264083 - DNA, 15 bp, Homo sapiens
atgtgggcacttcct

SEQ ID NO: 264084 - DNA, 15 bp, Homo sapiens
gatgtgggcacttcc

SEQ ID NO: 264085 - DNA, 15 bp, Homo sapiens
tgatgtgggcacttc

SEQ ID NO: 264086 - DNA, 15 bp, Homo sapiens
gtgatgtgggcactt

SEQ ID NO: 264087 - DNA, 15 bp, Homo sapiens
tgtgatgtgggcact

SEQ ID NO: 264088 - DNA, 15 bp, Homo sapiens
atgtgatgtgggcac

SEQ ID NO: 264089 - DNA, 15 bp, Homo sapiens
aatgtgatgtgggca

SEQ ID NO: 264090 - DNA, 15 bp, Homo sapiens
taatgtgatgtgggc

SEQ ID NO: 264091 - DNA, 15 bp, Homo sapiens
ataatgtgatgtggg

SEQ ID NO: 264092 - DNA, 15 bp, Homo sapiens
tataatgtgatgtgg

SEQ ID NO: 264093 - DNA, 15 bp, Homo sapiens
ctataatgtgatgtg

SEQ ID NO: 264094 - DNA, 15 bp, Homo sapiens
gctataatgtgatgt

SEQ ID NO: 264095 - DNA, 15 bp, Homo sapiens
agctataatgtgatg

SEQ ID NO: 264096 - DNA, 15 bp, Homo sapiens
aagctataatgtgat

SEQ ID NO: 264097 - DNA, 15 bp, Homo sapiens
aaagctataatgtga

SEQ ID NO: 264098 - DNA, 15 bp, Homo sapiens
taaagctataatgtg

SEQ ID NO: 264099 - DNA, 15 bp, Homo sapiens
ttaaagctataatgt

SEQ ID NO: 264100 - DNA, 15 bp, Homo sapiens
gttaaagctataatg

SEQ ID NO: 264101 - DNA, 15 bp, Homo sapiens
ggttaaagctataat

SEQ ID NO: 264102 - DNA, 15 bp, Homo sapiens
tggttaaagctataa

SEQ ID NO: 264103 - DNA, 15 bp, Homo sapiens
ctggttaaagctata

SEQ ID NO: 264104 - DNA, 15 bp, Homo sapiens
cctggttaaagctat

SEQ ID NO: 264105 - DNA, 15 bp, Homo sapiens
tcctggttaaagcta

SEQ ID NO: 264106 - DNA, 15 bp, Homo sapiens
ttcctggttaaagct

SEQ ID NO: 264107 - DNA, 15 bp, Homo sapiens
tttcctggttaaagc

SEQ ID NO: 264108 - DNA, 15 bp, Homo sapiens
ttttcctggttaaag

SEQ ID NO: 264109 - DNA, 15 bp, Homo sapiens
tttttcctggttaaa

SEQ ID NO: 264110 - DNA, 15 bp, Homo sapiens
ctttttcctggttaa

SEQ ID NO: 264111 - DNA, 15 bp, Homo sapiens
tctttttcctggtta

SEQ ID NO: 264112 - DNA, 15 bp, Homo sapiens
ttctttttcctggtt

SEQ ID NO: 264113 - DNA, 15 bp, Homo sapiens
tttctttttcctggt

SEQ ID NO: 264114 - DNA, 15 bp, Homo sapiens
atttctttttcctgg

SEQ ID NO: 264115 - DNA, 15 bp, Homo sapiens
gatttctttttcctg

SEQ ID NO: 264116 - DNA, 15 bp, Homo sapiens
agatttctttttcct

SEQ ID NO: 264117 - DNA, 15 bp, Homo sapiens
gagatttctttttcc

SEQ ID NO: 264118 - DNA, 15 bp, Homo sapiens
ggagatttctttttc

SEQ ID NO: 264119 - DNA, 15 bp, Homo sapiens
gggagatttcttttt

SEQ ID NO: 264120 - DNA, 15 bp, Homo sapiens
ggggagatttctttt

SEQ ID NO: 264121 - DNA, 15 bp, Homo sapiens
tggggagatttcttt

SEQ ID NO: 264122 - DNA, 15 bp, Homo sapiens
ttggggagatttctt

SEQ ID NO: 264123 - DNA, 15 bp, Homo sapiens
cttggggagatttct

SEQ ID NO: 264124 - DNA, 15 bp, Homo sapiens
tcttggggagatttc

SEQ ID NO: 264125 - DNA, 15 bp, Homo sapiens
ttcttggggagattt

SEQ ID NO: 264126 - DNA, 15 bp, Homo sapiens
tttcttggggagatt

SEQ ID NO: 264127 - DNA, 15 bp, Homo sapiens
ttttcttggggagat

SEQ ID NO: 264128 - DNA, 15 bp, Homo sapiens
attttcttggggaga

SEQ ID NO: 264129 - DNA, 15 bp, Homo sapiens
aattttcttggggag

SEQ ID NO: 264130 - DNA, 15 bp, Homo sapiens
aaattttcttgggga

SEQ ID NO: 264131 - DNA, 15 bp, Homo sapiens
caaattttcttgggg

SEQ ID NO: 264132 - DNA, 15 bp, Homo sapiens
acaaattttcttggg

SEQ ID NO: 264133 - DNA, 15 bp, Homo sapiens
cacaaattttcttgg

SEQ ID NO: 264134 - DNA, 15 bp, Homo sapiens
tcacaaattttcttg

SEQ ID NO: 264135 - DNA, 15 bp, Homo sapiens
ctcacaaattttctt

SEQ ID NO: 264136 - DNA, 15 bp, Homo sapiens
tctcacaaattttct

SEQ ID NO: 264137 - DNA, 15 bp, Homo sapiens
gtctcacaaattttc

SEQ ID NO: 264138 - DNA, 15 bp, Homo sapiens
tgtctcacaaatttt

SEQ ID NO: 264139 - DNA, 15 bp, Homo sapiens
atgtctcacaaattt

SEQ ID NO: 264140 - DNA, 15 bp, Homo sapiens
gatgtctcacaaatt

SEQ ID NO: 264141 - DNA, 15 bp, Homo sapiens
tgatgtctcacaaat

SEQ ID NO: 264142 - DNA, 15 bp, Homo sapiens
atgatgtctcacaaa

SEQ ID NO: 264143 - DNA, 15 bp, Homo sapiens
aatgatgtctcacaa

SEQ ID NO: 264144 - DNA, 15 bp, Homo sapiens
aaatgatgtctcaca

SEQ ID NO: 264145 - DNA, 15 bp, Homo sapiens
taaatgatgtctcac

SEQ ID NO: 264146 - DNA, 15 bp, Homo sapiens
ataaatgatgtctca

SEQ ID NO: 264147 - DNA, 15 bp, Homo sapiens
aataaatgatgtctc

SEQ ID NO: 264148 - DNA, 15 bp, Homo sapiens
taataaatgatgtct

SEQ ID NO: 264149 - DNA, 15 bp, Homo sapiens
gtaataaatgatgtc

SEQ ID NO: 264150 - DNA, 15 bp, Homo sapiens
agtaataaatgatgt

SEQ ID NO: 264151 - DNA, 15 bp, Homo sapiens
tagtaataaatgatg

SEQ ID NO: 264152 - DNA, 15 bp, Homo sapiens
atagtaataaatgat

SEQ ID NO: 264153 - DNA, 15 bp, Homo sapiens
aatagtaataaatga

SEQ ID NO: 264154 - DNA, 15 bp, Homo sapiens
taatagtaataaatg

SEQ ID NO: 264155 - DNA, 15 bp, Homo sapiens
ataatagtaataaat

SEQ ID NO: 264156 - DNA, 15 bp, Homo sapiens
gataatagtaataaa

SEQ ID NO: 264157 - DNA, 15 bp, Homo sapiens
tgataatagtaataa

SEQ ID NO: 264158 - DNA, 15 bp, Homo sapiens
ttgataatagtaata

SEQ ID NO: 264159 - DNA, 15 bp, Homo sapiens
gttgataatagtaat

SEQ ID NO: 264160 - DNA, 15 bp, Homo sapiens
agttgataatagtaa

SEQ ID NO: 264161 - DNA, 15 bp, Homo sapiens
aagttgataatagta

SEQ ID NO: 264162 - DNA, 15 bp, Homo sapiens
taagttgataatagt

SEQ ID NO: 264163 - DNA, 15 bp, Homo sapiens
ataagttgataatag

SEQ ID NO: 264164 - DNA, 15 bp, Homo sapiens
aataagttgataata

SEQ ID NO: 264165 - DNA, 15 bp, Homo sapiens
gaataagttgataat

SEQ ID NO: 264166 - DNA, 15 bp, Homo sapiens
tgaataagttgataa

SEQ ID NO: 264167 - DNA, 15 bp, Homo sapiens
gtgaataagttgata

SEQ ID NO: 264168 - DNA, 15 bp, Homo sapiens
agtgaataagttgat

SEQ ID NO: 264169 - DNA, 15 bp, Homo sapiens
gagtgaataagttga

SEQ ID NO: 264170 - DNA, 15 bp, Homo sapiens
tgagtgaataagttg

SEQ ID NO: 264171 - DNA, 15 bp, Homo sapiens
ttgagtgaataagtt

SEQ ID NO: 264172 - DNA, 15 bp, Homo sapiens
gttgagtgaataagt

SEQ ID NO: 264173 - DNA, 15 bp, Homo sapiens
tgttgagtgaataag

SEQ ID NO: 264174 - DNA, 15 bp, Homo sapiens
ttgttgagtgaataa

SEQ ID NO: 264175 - DNA, 15 bp, Homo sapiens
tttgttgagtgaata

SEQ ID NO: 264176 - DNA, 15 bp, Homo sapiens
atttgttgagtgaat

SEQ ID NO: 264177 - DNA, 15 bp, Homo sapiens
aatttgttgagtgaa

SEQ ID NO: 264178 - DNA, 15 bp, Homo sapiens
taatttgttgagtga

SEQ ID NO: 264179 - DNA, 15 bp, Homo sapiens
ttaatttgttgagtg

SEQ ID NO: 264180 - DNA, 15 bp, Homo sapiens
attaatttgttgagt

SEQ ID NO: 264181 - DNA, 15 bp, Homo sapiens
tattaatttgttgag

SEQ ID NO: 264182 - DNA, 15 bp, Homo sapiens
atattaatttgttga

SEQ ID NO: 264183 - DNA, 15 bp, Homo sapiens
aatattaatttgttg

SEQ ID NO: 264184 - DNA, 15 bp, Homo sapiens
caatattaatttgtt

SEQ ID NO: 264185 - DNA, 15 bp, Homo sapiens
tcaatattaatttgt

SEQ ID NO: 264186 - DNA, 15 bp, Homo sapiens
ttcaatattaatttg

SEQ ID NO: 264187 - DNA, 15 bp, Homo sapiens
gttcaatattaattt

SEQ ID NO: 264188 - DNA, 15 bp, Homo sapiens
tgttcaatattaatt

SEQ ID NO: 264189 - DNA, 15 bp, Homo sapiens
atgttcaatattaat

SEQ ID NO: 264190 - DNA, 15 bp, Homo sapiens
aatgttcaatattaa

SEQ ID NO: 264191 - DNA, 15 bp, Homo sapiens
aaatgttcaatatta

SEQ ID NO: 264192 - DNA, 15 bp, Homo sapiens
aaaatgttcaatatt

SEQ ID NO: 264193 - DNA, 15 bp, Homo sapiens
caaaatgttcaatat

SEQ ID NO: 264194 - DNA, 15 bp, Homo sapiens
gcaaaatgttcaata

SEQ ID NO: 264195 - DNA, 15 bp, Homo sapiens
tgcaaaatgttcaat

SEQ ID NO: 264196 - DNA, 15 bp, Homo sapiens
ctgcaaaatgttcaa

SEQ ID NO: 264197 - DNA, 15 bp, Homo sapiens
cctgcaaaatgttca

SEQ ID NO: 264198 - DNA, 15 bp, Homo sapiens
acctgcaaaatgttc

SEQ ID NO: 264199 - DNA, 15 bp, Homo sapiens
cacctgcaaaatgtt

SEQ ID NO: 264200 - DNA, 15 bp, Homo sapiens
acacctgcaaaatgt

SEQ ID NO: 264201 - DNA, 15 bp, Homo sapiens
gacacctgcaaaatg

SEQ ID NO: 264202 - DNA, 15 bp, Homo sapiens
tgacacctgcaaaat

SEQ ID NO: 264203 - DNA, 15 bp, Homo sapiens
ctgacacctgcaaaa

SEQ ID NO: 264204 - DNA, 15 bp, Homo sapiens
cctgacacctgcaaa

SEQ ID NO: 264205 - DNA, 15 bp, Homo sapiens
gcctgacacctgcaa

SEQ ID NO: 264206 - DNA, 15 bp, Homo sapiens
ggcctgacacctgca

SEQ ID NO: 264207 - DNA, 15 bp, Homo sapiens
gggcctgacacctgc

SEQ ID NO: 264208 - DNA, 15 bp, Homo sapiens
agggcctgacacctg

SEQ ID NO: 264209 - DNA, 15 bp, Homo sapiens
gagggcctgacacct

SEQ ID NO: 264210 - DNA, 15 bp, Homo sapiens
agagggcctgacacc

SEQ ID NO: 264211 - DNA, 15 bp, Homo sapiens
aagagggcctgacac

SEQ ID NO: 264212 - DNA, 15 bp, Homo sapiens
caagagggcctgaca

SEQ ID NO: 264213 - DNA, 15 bp, Homo sapiens
acaagagggcctgac

SEQ ID NO: 264214 - DNA, 15 bp, Homo sapiens
gacaagagggcctga

SEQ ID NO: 264215 - DNA, 15 bp, Homo sapiens
tgacaagagggcctg

SEQ ID NO: 264216 - DNA, 15 bp, Homo sapiens
ttgacaagagggcct

SEQ ID NO: 264217 - DNA, 15 bp, Homo sapiens
tttgacaagagggcc

SEQ ID NO: 264218 - DNA, 15 bp, Homo sapiens
ctttgacaagagggc

SEQ ID NO: 264219 - DNA, 15 bp, Homo sapiens
tctttgacaagaggg

SEQ ID NO: 264220 - DNA, 15 bp, Homo sapiens
atctttgacaagagg

SEQ ID NO: 264221 - DNA, 15 bp, Homo sapiens
tatctttgacaagag

SEQ ID NO: 264222 - DNA, 15 bp, Homo sapiens
ttatctttgacaaga

SEQ ID NO: 264223 - DNA, 15 bp, Homo sapiens
cttatctttgacaag

SEQ ID NO: 264224 - DNA, 15 bp, Homo sapiens
gcttatctttgacaa

SEQ ID NO: 264225 - DNA, 15 bp, Homo sapiens
tgcttatctttgaca

SEQ ID NO: 264226 - DNA, 15 bp, Homo sapiens
ttgcttatctttgac

SEQ ID NO: 264227 - DNA, 15 bp, Homo sapiens
tttgcttatctttga

SEQ ID NO: 264228 - DNA, 15 bp, Homo sapiens
ttttgcttatctttg

SEQ ID NO: 264229 - DNA, 15 bp, Homo sapiens
gttttgcttatcttt

SEQ ID NO: 264230 - DNA, 15 bp, Homo sapiens
ggttttgcttatctt

SEQ ID NO: 264231 - DNA, 15 bp, Homo sapiens
tggttttgcttatct

SEQ ID NO: 264232 - DNA, 15 bp, Homo sapiens
ctggttttgcttatc

SEQ ID NO: 264233 - DNA, 15 bp, Homo sapiens
tctggttttgcttat

SEQ ID NO: 264234 - DNA, 15 bp, Homo sapiens
gtctggttttgctta

SEQ ID NO: 264235 - DNA, 15 bp, Homo sapiens
tgtctggttttgctt

SEQ ID NO: 264236 - DNA, 15 bp, Homo sapiens
gtgtctggttttgct

SEQ ID NO: 264237 - DNA, 15 bp, Homo sapiens
agtgtctggttttgc

SEQ ID NO: 264238 - DNA, 15 bp, Homo sapiens
tagtgtctggttttg

SEQ ID NO: 264239 - DNA, 15 bp, Homo sapiens
ctagtgtctggtttt

SEQ ID NO: 264240 - DNA, 15 bp, Homo sapiens
actagtgtctggttt

SEQ ID NO: 264241 - DNA, 15 bp, Homo sapiens
aactagtgtctggtt

SEQ ID NO: 264242 - DNA, 15 bp, Homo sapiens
taactagtgtctggt

SEQ ID NO: 264243 - DNA, 15 bp, Homo sapiens
ttaactagtgtctgg

SEQ ID NO: 264244 - DNA, 15 bp, Homo sapiens
tttaactagtgtctg

SEQ ID NO: 264245 - DNA, 15 bp, Homo sapiens
ctttaactagtgtct

SEQ ID NO: 264246 - DNA, 15 bp, Homo sapiens
actttaactagtgtc

SEQ ID NO: 264247 - DNA, 15 bp, Homo sapiens
cactttaactagtgt

SEQ ID NO: 264248 - DNA, 15 bp, Homo sapiens
ccactttaactagtg

SEQ ID NO: 264249 - DNA, 15 bp, Homo sapiens
accactttaactagt

SEQ ID NO: 264250 - DNA, 15 bp, Homo sapiens
taccactttaactag

SEQ ID NO: 264251 - DNA, 15 bp, Homo sapiens
ttaccactttaacta

SEQ ID NO: 264252 - DNA, 15 bp, Homo sapiens
cttaccactttaact

SEQ ID NO: 264253 - DNA, 15 bp, Homo sapiens
ccttaccactttaac

SEQ ID NO: 264254 - DNA, 15 bp, Homo sapiens
tccttaccactttaa

SEQ ID NO: 264255 - DNA, 15 bp, Homo sapiens
gtccttaccacttta

SEQ ID NO: 264256 - DNA, 15 bp, Homo sapiens
tgtccttaccacttt

SEQ ID NO: 264257 - DNA, 15 bp, Homo sapiens
ctgtccttaccactt

SEQ ID NO: 264258 - DNA, 15 bp, Homo sapiens
tctgtccttaccact

SEQ ID NO: 264259 - DNA, 15 bp, Homo sapiens
atctgtccttaccac

SEQ ID NO: 264260 - DNA, 15 bp, Homo sapiens
aatctgtccttacca

SEQ ID NO: 264261 - DNA, 15 bp, Homo sapiens
aaatctgtccttacc

SEQ ID NO: 264262 - DNA, 15 bp, Homo sapiens
aaaatctgtccttac

SEQ ID NO: 264263 - DNA, 15 bp, Homo sapiens
taaaatctgtcctta

SEQ ID NO: 264264 - DNA, 15 bp, Homo sapiens
ttaaaatctgtcctt

SEQ ID NO: 264265 - DNA, 15 bp, Homo sapiens
attaaaatctgtcct

SEQ ID NO: 264266 - DNA, 15 bp, Homo sapiens
gattaaaatctgtcc

SEQ ID NO: 264267 - DNA, 15 bp, Homo sapiens
tgattaaaatctgtc

SEQ ID NO: 264268 - DNA, 15 bp, Homo sapiens
ttgattaaaatctgt

SEQ ID NO: 264269 - DNA, 15 bp, Homo sapiens
attgattaaaatctg

SEQ ID NO: 264270 - DNA, 15 bp, Homo sapiens
tattgattaaaatct

SEQ ID NO: 264271 - DNA, 15 bp, Homo sapiens
ttattgattaaaatc

SEQ ID NO: 264272 - DNA, 15 bp, Homo sapiens
attattgattaaaat

SEQ ID NO: 264273 - DNA, 15 bp, Homo sapiens
tattattgattaaaa

SEQ ID NO: 264274 - DNA, 15 bp, Homo sapiens
atattattgattaaa

SEQ ID NO: 264275 - DNA, 15 bp, Homo sapiens
tatattattgattaa

SEQ ID NO: 264276 - DNA, 15 bp, Homo sapiens
gtatattattgatta

SEQ ID NO: 264277 - DNA, 15 bp, Homo sapiens
agtatattattgatt

SEQ ID NO: 264278 - DNA, 15 bp, Homo sapiens
cagtatattattgat

SEQ ID NO: 264279 - DNA, 15 bp, Homo sapiens
tcagtatattattga

SEQ ID NO: 264280 - DNA, 15 bp, Homo sapiens
atcagtatattattg

SEQ ID NO: 264281 - DNA, 15 bp, Homo sapiens
aatcagtatattatt

SEQ ID NO: 264282 - DNA, 15 bp, Homo sapiens
taatcagtatattat

SEQ ID NO: 264283 - DNA, 15 bp, Homo sapiens
ataatcagtatatta

SEQ ID NO: 264284 - DNA, 15 bp, Homo sapiens
cataatcagtatatt

SEQ ID NO: 264285 - DNA, 15 bp, Homo sapiens
gcataatcagtatat

SEQ ID NO: 264286 - DNA, 15 bp, Homo sapiens
tgcataatcagtata

SEQ ID NO: 264287 - DNA, 15 bp, Homo sapiens
gtgcataatcagtat

SEQ ID NO: 264288 - DNA, 15 bp, Homo sapiens
tgtgcataatcagta

SEQ ID NO: 264289 - DNA, 15 bp, Homo sapiens
atgtgcataatcagt

SEQ ID NO: 264290 - DNA, 15 bp, Homo sapiens
catgtgcataatcag

SEQ ID NO: 264291 - DNA, 15 bp, Homo sapiens
acatgtgcataatca

SEQ ID NO: 264292 - DNA, 15 bp, Homo sapiens
tacatgtgcataatc

SEQ ID NO: 264293 - DNA, 15 bp, Homo sapiens
atacatgtgcataat

SEQ ID NO: 264294 - DNA, 15 bp, Homo sapiens
aatacatgtgcataa

SEQ ID NO: 264295 - DNA, 15 bp, Homo sapiens
aaatacatgtgcata

SEQ ID NO: 264296 - DNA, 15 bp, Homo sapiens
gaaatacatgtgcat

SEQ ID NO: 264297 - DNA, 15 bp, Homo sapiens
agaaatacatgtgca

SEQ ID NO: 264298 - DNA, 15 bp, Homo sapiens
cagaaatacatgtgc

SEQ ID NO: 264299 - DNA, 15 bp, Homo sapiens
acagaaatacatgtg

SEQ ID NO: 264300 - DNA, 15 bp, Homo sapiens
aacagaaatacatgt

SEQ ID NO: 264301 - DNA, 15 bp, Homo sapiens
aaacagaaatacatg

SEQ ID NO: 264302 - DNA, 15 bp, Homo sapiens
caaacagaaatacat

SEQ ID NO: 264303 - DNA, 15 bp, Homo sapiens
acaaacagaaataca

SEQ ID NO: 264304 - DNA, 15 bp, Homo sapiens
tacaaacagaaatac

SEQ ID NO: 264305 - DNA, 15 bp, Homo sapiens
gtacaaacagaaata

SEQ ID NO: 264306 - DNA, 15 bp, Homo sapiens
tgtacaaacagaaat

SEQ ID NO: 264307 - DNA, 15 bp, Homo sapiens
ctgtacaaacagaaa

SEQ ID NO: 264308 - DNA, 15 bp, Homo sapiens
tctgtacaaacagaa

SEQ ID NO: 264309 - DNA, 15 bp, Homo sapiens
ctctgtacaaacaga

SEQ ID NO: 264310 - DNA, 15 bp, Homo sapiens
cctctgtacaaacag

SEQ ID NO: 264311 - DNA, 15 bp, Homo sapiens
acctctgtacaaaca

SEQ ID NO: 264312 - DNA, 15 bp, Homo sapiens
cacctctgtacaaac

SEQ ID NO: 264313 - DNA, 15 bp, Homo sapiens
tcacctctgtacaaa

SEQ ID NO: 264314 - DNA, 15 bp, Homo sapiens
gtcacctctgtacaa

SEQ ID NO: 264315 - DNA, 15 bp, Homo sapiens
agtcacctctgtaca

SEQ ID NO: 264316 - DNA, 15 bp, Homo sapiens
cagtcacctctgtac

SEQ ID NO: 264317 - DNA, 15 bp, Homo sapiens
ccagtcacctctgta

SEQ ID NO: 264318 - DNA, 15 bp, Homo sapiens
cccagtcacctctgt

SEQ ID NO: 264319 - DNA, 15 bp, Homo sapiens
acccagtcacctctg

SEQ ID NO: 264320 - DNA, 15 bp, Homo sapiens
cacccagtcacctct

SEQ ID NO: 264321 - DNA, 15 bp, Homo sapiens
acacccagtcacctc

SEQ ID NO: 264322 - DNA, 15 bp, Homo sapiens
aacacccagtcacct

SEQ ID NO: 264323 - DNA, 15 bp, Homo sapiens
aaacacccagtcacc

SEQ ID NO: 264324 - DNA, 15 bp, Homo sapiens
aaaacacccagtcac

SEQ ID NO: 264325 - DNA, 15 bp, Homo sapiens
gaaaacacccagtca

SEQ ID NO: 264326 - DNA, 15 bp, Homo sapiens
tgaaaacacccagtc

SEQ ID NO: 264327 - DNA, 15 bp, Homo sapiens
ctgaaaacacccagt

SEQ ID NO: 264328 - DNA, 15 bp, Homo sapiens
tctgaaaacacccag

SEQ ID NO: 264329 - DNA, 15 bp, Homo sapiens
ttctgaaaacaccca

SEQ ID NO: 264330 - DNA, 15 bp, Homo sapiens
cttctgaaaacaccc

SEQ ID NO: 264331 - DNA, 15 bp, Homo sapiens
ccttctgaaaacacc

SEQ ID NO: 264332 - DNA, 15 bp, Homo sapiens
cccttctgaaaacac

SEQ ID NO: 264333 - DNA, 15 bp, Homo sapiens
tcccttctgaaaaca

SEQ ID NO: 264334 - DNA, 15 bp, Homo sapiens
ttcccttctgaaaac

SEQ ID NO: 264335 - DNA, 15 bp, Homo sapiens
attcccttctgaaaa

SEQ ID NO: 264336 - DNA, 15 bp, Homo sapiens
tattcccttctgaaa

SEQ ID NO: 264337 - DNA, 15 bp, Homo sapiens
ctattcccttctgaa

SEQ ID NO: 264338 - DNA, 15 bp, Homo sapiens
tctattcccttctga

SEQ ID NO: 264339 - DNA, 15 bp, Homo sapiens
gtctattcccttctg

SEQ ID NO: 264340 - DNA, 15 bp, Homo sapiens
agtctattcccttct

SEQ ID NO: 264341 - DNA, 15 bp, Homo sapiens
cagtctattcccttc

SEQ ID NO: 264342 - DNA, 15 bp, Homo sapiens
ccagtctattccctt

SEQ ID NO: 264343 - DNA, 15 bp, Homo sapiens
cccagtctattccct

SEQ ID NO: 264344 - DNA, 15 bp, Homo sapiens
ccccagtctattccc

SEQ ID NO: 264345 - DNA, 15 bp, Homo sapiens
tccccagtctattcc

SEQ ID NO: 264346 - DNA, 15 bp, Homo sapiens
ttccccagtctattc

SEQ ID NO: 264347 - DNA, 15 bp, Homo sapiens
tttccccagtctatt

SEQ ID NO: 264348 - DNA, 15 bp, Homo sapiens
gtttccccagtctat

SEQ ID NO: 264349 - DNA, 15 bp, Homo sapiens
tgtttccccagtcta

SEQ ID NO: 264350 - DNA, 15 bp, Homo sapiens
ttgtttccccagtct

SEQ ID NO: 264351 - DNA, 15 bp, Homo sapiens
tttgtttccccagtc

SEQ ID NO: 264352 - DNA, 15 bp, Homo sapiens
ttttgtttccccagt

SEQ ID NO: 264353 - DNA, 15 bp, Homo sapiens
cttttgtttccccag

SEQ ID NO: 264354 - DNA, 15 bp, Homo sapiens
tcttttgtttcccca

SEQ ID NO: 264355 - DNA, 15 bp, Homo sapiens
ctcttttgtttcccc

SEQ ID NO: 264356 - DNA, 15 bp, Homo sapiens
cctcttttgtttccc

SEQ ID NO: 264357 - DNA, 15 bp, Homo sapiens
ccctcttttgtttcc

SEQ ID NO: 264358 - DNA, 15 bp, Homo sapiens
tccctcttttgtttc

SEQ ID NO: 264359 - DNA, 15 bp, Homo sapiens
gtccctcttttgttt

SEQ ID NO: 264360 - DNA, 15 bp, Homo sapiens
agtccctcttttgtt

SEQ ID NO: 264361 - DNA, 15 bp, Homo sapiens
aagtccctcttttgt

SEQ ID NO: 264362 - DNA, 15 bp, Homo sapiens
caagtccctcttttg

SEQ ID NO: 264363 - DNA, 15 bp, Homo sapiens
tcaagtccctctttt

SEQ ID NO: 264364 - DNA, 15 bp, Homo sapiens
ctcaagtccctcttt

SEQ ID NO: 264365 - DNA, 15 bp, Homo sapiens
gctcaagtccctctt

SEQ ID NO: 264366 - DNA, 15 bp, Homo sapiens
tgctcaagtccctct

SEQ ID NO: 264367 - DNA, 15 bp, Homo sapiens
ctgctcaagtccctc

SEQ ID NO: 264368 - DNA, 15 bp, Homo sapiens
tctgctcaagtccct

SEQ ID NO: 264369 - DNA, 15 bp, Homo sapiens
ctctgctcaagtccc

SEQ ID NO: 264370 - DNA, 15 bp, Homo sapiens
cctctgctcaagtcc

SEQ ID NO: 264371 - DNA, 15 bp, Homo sapiens
gcctctgctcaagtc

SEQ ID NO: 264372 - DNA, 15 bp, Homo sapiens
tgcctctgctcaagt

SEQ ID NO: 264373 - DNA, 15 bp, Homo sapiens
ttgcctctgctcaag

SEQ ID NO: 264374 - DNA, 15 bp, Homo sapiens
cttgcctctgctcaa

SEQ ID NO: 264375 - DNA, 15 bp, Homo sapiens
ccttgcctctgctca

SEQ ID NO: 264376 - DNA, 15 bp, Homo sapiens
tccttgcctctgctc

SEQ ID NO: 264377 - DNA, 15 bp, Homo sapiens
ttccttgcctctgct

SEQ ID NO: 264378 - DNA, 15 bp, Homo sapiens
cttccttgcctctgc

SEQ ID NO: 264379 - DNA, 15 bp, Homo sapiens
acttccttgcctctg

SEQ ID NO: 264380 - DNA, 15 bp, Homo sapiens
cacttccttgcctct

SEQ ID NO: 264381 - DNA, 15 bp, Homo sapiens
tcacttccttgcctc

SEQ ID NO: 264382 - DNA, 15 bp, Homo sapiens
ttcacttccttgcct

SEQ ID NO: 264383 - DNA, 15 bp, Homo sapiens
tttcacttccttgcc

SEQ ID NO: 264384 - DNA, 15 bp, Homo sapiens
ttttcacttccttgc

SEQ ID NO: 264385 - DNA, 15 bp, Homo sapiens
tttttcacttccttg

SEQ ID NO: 264386 - DNA, 15 bp, Homo sapiens
atttttcacttcctt

SEQ ID NO: 264387 - DNA, 15 bp, Homo sapiens
catttttcacttcct

SEQ ID NO: 264388 - DNA, 15 bp, Homo sapiens
tcatttttcacttcc

SEQ ID NO: 264389 - DNA, 15 bp, Homo sapiens
gtcatttttcacttc

SEQ ID NO: 264390 - DNA, 15 bp, Homo sapiens
tgtcatttttcactt

SEQ ID NO: 264391 - DNA, 15 bp, Homo sapiens
ttgtcatttttcact

SEQ ID NO: 264392 - DNA, 15 bp, Homo sapiens
tttgtcatttttcac

SEQ ID NO: 264393 - DNA, 15 bp, Homo sapiens
ctttgtcatttttca

SEQ ID NO: 264394 - DNA, 15 bp, Homo sapiens
gctttgtcatttttc

SEQ ID NO: 264395 - DNA, 15 bp, Homo sapiens
tgctttgtcattttt

SEQ ID NO: 264396 - DNA, 15 bp, Homo sapiens
atgctttgtcatttt

SEQ ID NO: 264397 - DNA, 15 bp, Homo sapiens
aatgctttgtcattt

SEQ ID NO: 264398 - DNA, 15 bp, Homo sapiens
caatgctttgtcatt

SEQ ID NO: 264399 - DNA, 15 bp, Homo sapiens
ccaatgctttgtcat

SEQ ID NO: 264400 - DNA, 15 bp, Homo sapiens
accaatgctttgtca

SEQ ID NO: 264401 - DNA, 15 bp, Homo sapiens
gaccaatgctttgtc

SEQ ID NO: 264402 - DNA, 15 bp, Homo sapiens
tgaccaatgctttgt

SEQ ID NO: 264403 - DNA, 15 bp, Homo sapiens
ctgaccaatgctttg

SEQ ID NO: 264404 - DNA, 15 bp, Homo sapiens
gctgaccaatgcttt

SEQ ID NO: 264405 - DNA, 15 bp, Homo sapiens
tgctgaccaatgctt

SEQ ID NO: 264406 - DNA, 15 bp, Homo sapiens
atgctgaccaatgct

SEQ ID NO: 264407 - DNA, 15 bp, Homo sapiens
gatgctgaccaatgc

SEQ ID NO: 264408 - DNA, 15 bp, Homo sapiens
tgatgctgaccaatg

SEQ ID NO: 264409 - DNA, 15 bp, Homo sapiens
ctgatgctgaccaat

SEQ ID NO: 264410 - DNA, 15 bp, Homo sapiens
actgatgctgaccaa

SEQ ID NO: 264411 - DNA, 15 bp, Homo sapiens
aactgatgctgacca

SEQ ID NO: 264412 - DNA, 15 bp, Homo sapiens
gaactgatgctgacc

SEQ ID NO: 264413 - DNA, 15 bp, Homo sapiens
ggaactgatgctgac

SEQ ID NO: 264414 - DNA, 15 bp, Homo sapiens
tggaactgatgctga

SEQ ID NO: 264415 - DNA, 15 bp, Homo sapiens
atggaactgatgctg

SEQ ID NO: 264416 - DNA, 15 bp, Homo sapiens
gatggaactgatgct

SEQ ID NO: 264417 - DNA, 15 bp, Homo sapiens
tgatggaactgatgc

SEQ ID NO: 264418 - DNA, 15 bp, Homo sapiens
ctgatggaactgatg

SEQ ID NO: 264419 - DNA, 15 bp, Homo sapiens
tctgatggaactgat

SEQ ID NO: 264420 - DNA, 15 bp, Homo sapiens
gtctgatggaactga

SEQ ID NO: 264421 - DNA, 15 bp, Homo sapiens
ggtctgatggaactg

SEQ ID NO: 264422 - DNA, 15 bp, Homo sapiens
tggtctgatggaact

SEQ ID NO: 264423 - DNA, 15 bp, Homo sapiens
ctggtctgatggaac

SEQ ID NO: 264424 - DNA, 15 bp, Homo sapiens
gctggtctgatggaa

SEQ ID NO: 264425 - DNA, 15 bp, Homo sapiens
agctggtctgatgga

SEQ ID NO: 264426 - DNA, 15 bp, Homo sapiens
cagctggtctgatgg

SEQ ID NO: 264427 - DNA, 15 bp, Homo sapiens
acagctggtctgatg

SEQ ID NO: 264428 - DNA, 15 bp, Homo sapiens
cacagctggtctgat

SEQ ID NO: 264429 - DNA, 15 bp, Homo sapiens
acacagctggtctga

SEQ ID NO: 264430 - DNA, 15 bp, Homo sapiens
gacacagctggtctg

SEQ ID NO: 264431 - DNA, 15 bp, Homo sapiens
agacacagctggtct

SEQ ID NO: 264432 - DNA, 15 bp, Homo sapiens
cagacacagctggtc

SEQ ID NO: 264433 - DNA, 15 bp, Homo sapiens
acagacacagctggt

SEQ ID NO: 264434 - DNA, 15 bp, Homo sapiens
cacagacacagctgg

SEQ ID NO: 264435 - DNA, 15 bp, Homo sapiens
tcacagacacagctg

SEQ ID NO: 264436 - DNA, 15 bp, Homo sapiens
ctcacagacacagct

SEQ ID NO: 264437 - DNA, 15 bp, Homo sapiens
gctcacagacacagc

SEQ ID NO: 264438 - DNA, 15 bp, Homo sapiens
agctcacagacacag

SEQ ID NO: 264439 - DNA, 15 bp, Homo sapiens
cagctcacagacaca

SEQ ID NO: 264440 - DNA, 15 bp, Homo sapiens
ccagctcacagacac

SEQ ID NO: 264441 - DNA, 15 bp, Homo sapiens
gccagctcacagaca

SEQ ID NO: 264442 - DNA, 15 bp, Homo sapiens
tgccagctcacagac

SEQ ID NO: 264443 - DNA, 15 bp, Homo sapiens
ttgccagctcacaga

SEQ ID NO: 264444 - DNA, 15 bp, Homo sapiens
attgccagctcacag

SEQ ID NO: 264445 - DNA, 15 bp, Homo sapiens
aattgccagctcaca

SEQ ID NO: 264446 - DNA, 15 bp, Homo sapiens
caattgccagctcac

SEQ ID NO: 264447 - DNA, 15 bp, Homo sapiens
acaattgccagctca

SEQ ID NO: 264448 - DNA, 15 bp, Homo sapiens
gacaattgccagctc

SEQ ID NO: 264449 - DNA, 15 bp, Homo sapiens
tgacaattgccagct

SEQ ID NO: 264450 - DNA, 15 bp, Homo sapiens
ctgacaattgccagc

SEQ ID NO: 264451 - DNA, 15 bp, Homo sapiens
tctgacaattgccag

SEQ ID NO: 264452 - DNA, 15 bp, Homo sapiens
ctctgacaattgcca

SEQ ID NO: 264453 - DNA, 15 bp, Homo sapiens
actctgacaattgcc

SEQ ID NO: 264454 - DNA, 15 bp, Homo sapiens
aactctgacaattgc

SEQ ID NO: 264455 - DNA, 15 bp, Homo sapiens
taactctgacaattg

SEQ ID NO: 264456 - DNA, 15 bp, Homo sapiens
ctaactctgacaatt

SEQ ID NO: 264457 - DNA, 15 bp, Homo sapiens
cctaactctgacaat

SEQ ID NO: 264458 - DNA, 15 bp, Homo sapiens
tcctaactctgacaa

SEQ ID NO: 264459 - DNA, 15 bp, Homo sapiens
atcctaactctgaca

SEQ ID NO: 264460 - DNA, 15 bp, Homo sapiens
aatcctaactctgac

SEQ ID NO: 264461 - DNA, 15 bp, Homo sapiens
gaatcctaactctga

SEQ ID NO: 264462 - DNA, 15 bp, Homo sapiens
agaatcctaactctg

SEQ ID NO: 264463 - DNA, 15 bp, Homo sapiens
tagaatcctaactct

SEQ ID NO: 264464 - DNA, 15 bp, Homo sapiens
gtagaatcctaactc

SEQ ID NO: 264465 - DNA, 15 bp, Homo sapiens
ggtagaatcctaact

SEQ ID NO: 264466 - DNA, 15 bp, Homo sapiens
tggtagaatcctaac

SEQ ID NO: 264467 - DNA, 15 bp, Homo sapiens
atggtagaatcctaa

SEQ ID NO: 264468 - DNA, 15 bp, Homo sapiens
aatggtagaatccta

SEQ ID NO: 264469 - DNA, 15 bp, Homo sapiens
gaatggtagaatcct

SEQ ID NO: 264470 - DNA, 15 bp, Homo sapiens
ggaatggtagaatcc

SEQ ID NO: 264471 - DNA, 15 bp, Homo sapiens
tggaatggtagaatc

SEQ ID NO: 264472 - DNA, 15 bp, Homo sapiens
ctggaatggtagaat

SEQ ID NO: 264473 - DNA, 15 bp, Homo sapiens
tctggaatggtagaa

SEQ ID NO: 264474 - DNA, 15 bp, Homo sapiens
ctctggaatggtaga

SEQ ID NO: 264475 - DNA, 15 bp, Homo sapiens
tctctggaatggtag

SEQ ID NO: 264476 - DNA, 15 bp, Homo sapiens
ctctctggaatggta

SEQ ID NO: 264477 - DNA, 15 bp, Homo sapiens
tctctctggaatggt

SEQ ID NO: 264478 - DNA, 15 bp, Homo sapiens
ctctctctggaatgg

SEQ ID NO: 264479 - DNA, 15 bp, Homo sapiens
tctctctctggaatg

SEQ ID NO: 264480 - DNA, 15 bp, Homo sapiens
gtctctctctggaat

SEQ ID NO: 264481 - DNA, 15 bp, Homo sapiens
agtctctctctggaa

SEQ ID NO: 264482 - DNA, 15 bp, Homo sapiens
cagtctctctctgga

SEQ ID NO: 264483 - DNA, 15 bp, Homo sapiens
ccagtctctctctgg

SEQ ID NO: 264484 - DNA, 15 bp, Homo sapiens
cccagtctctctctg

SEQ ID NO: 264485 - DNA, 15 bp, Homo sapiens
tcccagtctctctct

SEQ ID NO: 264486 - DNA, 15 bp, Homo sapiens
ctcccagtctctctc

SEQ ID NO: 264487 - DNA, 15 bp, Homo sapiens
tctcccagtctctct

SEQ ID NO: 264488 - DNA, 15 bp, Homo sapiens
gtctcccagtctctc

SEQ ID NO: 264489 - DNA, 15 bp, Homo sapiens
tgtctcccagtctct

SEQ ID NO: 264490 - DNA, 15 bp, Homo sapiens
ctgtctcccagtctc

SEQ ID NO: 264491 - DNA, 15 bp, Homo sapiens
cctgtctcccagtct

SEQ ID NO: 264492 - DNA, 15 bp, Homo sapiens
ccctgtctcccagtc

SEQ ID NO: 264493 - DNA, 15 bp, Homo sapiens
cccctgtctcccagt

SEQ ID NO: 264494 - DNA, 15 bp, Homo sapiens
acccctgtctcccag

SEQ ID NO: 264495 - DNA, 15 bp, Homo sapiens
gacccctgtctccca

SEQ ID NO: 264496 - DNA, 15 bp, Homo sapiens
ggacccctgtctccc

SEQ ID NO: 264497 - DNA, 15 bp, Homo sapiens
aggacccctgtctcc

SEQ ID NO: 264498 - DNA, 15 bp, Homo sapiens
taggacccctgtctc

SEQ ID NO: 264499 - DNA, 15 bp, Homo sapiens
ataggacccctgtct

SEQ ID NO: 264500 - DNA, 15 bp, Homo sapiens
gataggacccctgtc

SEQ ID NO: 264501 - DNA, 15 bp, Homo sapiens
ggataggacccctgt

SEQ ID NO: 264502 - DNA, 15 bp, Homo sapiens
aggataggacccctg

SEQ ID NO: 264503 - DNA, 15 bp, Homo sapiens
aaggataggacccct

SEQ ID NO: 264504 - DNA, 15 bp, Homo sapiens
gaaggataggacccc

SEQ ID NO: 264505 - DNA, 15 bp, Homo sapiens
ggaaggataggaccc

SEQ ID NO: 264506 - DNA, 15 bp, Homo sapiens
aggaaggataggacc

SEQ ID NO: 264507 - DNA, 15 bp, Homo sapiens
caggaaggataggac

SEQ ID NO: 264508 - DNA, 15 bp, Homo sapiens
tcaggaaggatagga

SEQ ID NO: 264509 - DNA, 15 bp, Homo sapiens
atcaggaaggatagg

SEQ ID NO: 264510 - DNA, 15 bp, Homo sapiens
catcaggaaggatag

SEQ ID NO: 264511 - DNA, 15 bp, Homo sapiens
tcatcaggaaggata

SEQ ID NO: 264512 - DNA, 15 bp, Homo sapiens
atcatcaggaaggat

SEQ ID NO: 264513 - DNA, 15 bp, Homo sapiens
aatcatcaggaagga

SEQ ID NO: 264514 - DNA, 15 bp, Homo sapiens
taatcatcaggaagg

SEQ ID NO: 264515 - DNA, 15 bp, Homo sapiens
gtaatcatcaggaag

SEQ ID NO: 264516 - DNA, 15 bp, Homo sapiens
tgtaatcatcaggaa

SEQ ID NO: 264517 - DNA, 15 bp, Homo sapiens
atgtaatcatcagga

SEQ ID NO: 264518 - DNA, 15 bp, Homo sapiens
aatgtaatcatcagg

SEQ ID NO: 264519 - DNA, 15 bp, Homo sapiens
aaatgtaatcatcag

SEQ ID NO: 264520 - DNA, 15 bp, Homo sapiens
gaaatgtaatcatca

SEQ ID NO: 264521 - DNA, 15 bp, Homo sapiens
tgaaatgtaatcatc

SEQ ID NO: 264522 - DNA, 15 bp, Homo sapiens
ttgaaatgtaatcat

SEQ ID NO: 264523 - DNA, 15 bp, Homo sapiens
tttgaaatgtaatca

SEQ ID NO: 264524 - DNA, 15 bp, Homo sapiens
ctttgaaatgtaatc

SEQ ID NO: 264525 - DNA, 15 bp, Homo sapiens
tctttgaaatgtaat

SEQ ID NO: 264526 - DNA, 15 bp, Homo sapiens
ttctttgaaatgtaa

SEQ ID NO: 264527 - DNA, 15 bp, Homo sapiens
tttctttgaaatgta

SEQ ID NO: 264528 - DNA, 15 bp, Homo sapiens
atttctttgaaatgt

SEQ ID NO: 264529 - DNA, 15 bp, Homo sapiens
catttctttgaaatg

SEQ ID NO: 264530 - DNA, 15 bp, Homo sapiens
ccatttctttgaaat

SEQ ID NO: 264531 - DNA, 15 bp, Homo sapiens
accatttctttgaaa

SEQ ID NO: 264532 - DNA, 15 bp, Homo sapiens
aaccatttctttgaa

SEQ ID NO: 264533 - DNA, 15 bp, Homo sapiens
aaaccatttctttga

SEQ ID NO: 264534 - DNA, 15 bp, Homo sapiens
aaaaccatttctttg

SEQ ID NO: 264535 - DNA, 15 bp, Homo sapiens
gaaaaccatttcttt

SEQ ID NO: 264536 - DNA, 15 bp, Homo sapiens
tgaaaaccatttctt

SEQ ID NO: 264537 - DNA, 15 bp, Homo sapiens
ctgaaaaccatttct

SEQ ID NO: 264538 - DNA, 15 bp, Homo sapiens
tctgaaaaccatttc

SEQ ID NO: 264539 - DNA, 15 bp, Homo sapiens
atctgaaaaccattt

SEQ ID NO: 264540 - DNA, 15 bp, Homo sapiens
gatctgaaaaccatt

SEQ ID NO: 264541 - DNA, 15 bp, Homo sapiens
ggatctgaaaaccat

SEQ ID NO: 264542 - DNA, 15 bp, Homo sapiens
aggatctgaaaacca

SEQ ID NO: 264543 - DNA, 15 bp, Homo sapiens
aaggatctgaaaacc

SEQ ID NO: 264544 - DNA, 15 bp, Homo sapiens
caaggatctgaaaac

SEQ ID NO: 264545 - DNA, 15 bp, Homo sapiens
tcaaggatctgaaaa

SEQ ID NO: 264546 - DNA, 15 bp, Homo sapiens
ctcaaggatctgaaa

SEQ ID NO: 264547 - DNA, 15 bp, Homo sapiens
tctcaaggatctgaa

SEQ ID NO: 264548 - DNA, 15 bp, Homo sapiens
ttctcaaggatctga

SEQ ID NO: 264549 - DNA, 15 bp, Homo sapiens
tttctcaaggatctg

SEQ ID NO: 264550 - DNA, 15 bp, Homo sapiens
ctttctcaaggatct

SEQ ID NO: 264551 - DNA, 15 bp, Homo sapiens
tctttctcaaggatc

SEQ ID NO: 264552 - DNA, 15 bp, Homo sapiens
gtctttctcaaggat

SEQ ID NO: 264553 - DNA, 15 bp, Homo sapiens
tgtctttctcaagga

SEQ ID NO: 264554 - DNA, 15 bp, Homo sapiens
gtgtctttctcaagg

SEQ ID NO: 264555 - DNA, 15 bp, Homo sapiens
agtgtctttctcaag

SEQ ID NO: 264556 - DNA, 15 bp, Homo sapiens
gagtgtctttctcaa

SEQ ID NO: 264557 - DNA, 15 bp, Homo sapiens
ggagtgtctttctca

SEQ ID NO: 264558 - DNA, 15 bp, Homo sapiens
aggagtgtctttctc

SEQ ID NO: 264559 - DNA, 15 bp, Homo sapiens
caggagtgtctttct

SEQ ID NO: 264560 - DNA, 15 bp, Homo sapiens
tcaggagtgtctttc

SEQ ID NO: 264561 - DNA, 15 bp, Homo sapiens
ctcaggagtgtcttt

SEQ ID NO: 264562 - DNA, 15 bp, Homo sapiens
actcaggagtgtctt

SEQ ID NO: 264563 - DNA, 15 bp, Homo sapiens
aactcaggagtgtct

SEQ ID NO: 264564 - DNA, 15 bp, Homo sapiens
caactcaggagtgtc

SEQ ID NO: 264565 - DNA, 15 bp, Homo sapiens
acaactcaggagtgt

SEQ ID NO: 264566 - DNA, 15 bp, Homo sapiens
aacaactcaggagtg

SEQ ID NO: 264567 - DNA, 15 bp, Homo sapiens
caacaactcaggagt

SEQ ID NO: 264568 - DNA, 15 bp, Homo sapiens
ccaacaactcaggag

SEQ ID NO: 264569 - DNA, 15 bp, Homo sapiens
tccaacaactcagga

SEQ ID NO: 264570 - DNA, 15 bp, Homo sapiens
ctccaacaactcagg

SEQ ID NO: 264571 - DNA, 15 bp, Homo sapiens
tctccaacaactcag

SEQ ID NO: 264572 - DNA, 15 bp, Homo sapiens
atctccaacaactca

SEQ ID NO: 264573 - DNA, 15 bp, Homo sapiens
tatctccaacaactc

SEQ ID NO: 264574 - DNA, 15 bp, Homo sapiens
gtatctccaacaact

SEQ ID NO: 264575 - DNA, 15 bp, Homo sapiens
tgtatctccaacaac

SEQ ID NO: 264576 - DNA, 15 bp, Homo sapiens
atgtatctccaacaa

SEQ ID NO: 264577 - DNA, 15 bp, Homo sapiens
gatgtatctccaaca

SEQ ID NO: 264578 - DNA, 15 bp, Homo sapiens
ggatgtatctccaac

SEQ ID NO: 264579 - DNA, 15 bp, Homo sapiens
tggatgtatctccaa

SEQ ID NO: 264580 - DNA, 15 bp, Homo sapiens
gtggatgtatctcca

SEQ ID NO: 264581 - DNA, 15 bp, Homo sapiens
tgtggatgtatctcc

SEQ ID NO: 264582 - DNA, 15 bp, Homo sapiens
atgtggatgtatctc

SEQ ID NO: 264583 - DNA, 15 bp, Homo sapiens
gatgtggatgtatct

SEQ ID NO: 264584 - DNA, 15 bp, Homo sapiens
agatgtggatgtatc

SEQ ID NO: 264585 - DNA, 15 bp, Homo sapiens
gagatgtggatgtat

SEQ ID NO: 264586 - DNA, 15 bp, Homo sapiens
tgagatgtggatgta

SEQ ID NO: 264587 - DNA, 15 bp, Homo sapiens
ttgagatgtggatgt

SEQ ID NO: 264588 - DNA, 15 bp, Homo sapiens
tttgagatgtggatg

SEQ ID NO: 264589 - DNA, 15 bp, Homo sapiens
ctttgagatgtggat

SEQ ID NO: 264590 - DNA, 15 bp, Homo sapiens
cctttgagatgtgga

SEQ ID NO: 264591 - DNA, 15 bp, Homo sapiens
ccctttgagatgtgg

SEQ ID NO: 264592 - DNA, 15 bp, Homo sapiens
tccctttgagatgtg

SEQ ID NO: 264593 - DNA, 15 bp, Homo sapiens
gtccctttgagatgt

SEQ ID NO: 264594 - DNA, 15 bp, Homo sapiens
tgtccctttgagatg

SEQ ID NO: 264595 - DNA, 15 bp, Homo sapiens
ctgtccctttgagat

SEQ ID NO: 264596 - DNA, 15 bp, Homo sapiens
tctgtccctttgaga

SEQ ID NO: 264597 - DNA, 15 bp, Homo sapiens
ctctgtccctttgag

SEQ ID NO: 264598 - DNA, 15 bp, Homo sapiens
cctctgtccctttga

SEQ ID NO: 264599 - DNA, 15 bp, Homo sapiens
tcctctgtccctttg

SEQ ID NO: 264600 - DNA, 15 bp, Homo sapiens
ttcctctgtcccttt

SEQ ID NO: 264601 - DNA, 15 bp, Homo sapiens
cttcctctgtccctt

SEQ ID NO: 264602 - DNA, 15 bp, Homo sapiens
ccttcctctgtccct

SEQ ID NO: 264603 - DNA, 15 bp, Homo sapiens
tccttcctctgtccc

SEQ ID NO: 264604 - DNA, 15 bp, Homo sapiens
atccttcctctgtcc

SEQ ID NO: 264605 - DNA, 15 bp, Homo sapiens
aatccttcctctgtc

SEQ ID NO: 264606 - DNA, 15 bp, Homo sapiens
gaatccttcctctgt

SEQ ID NO: 264607 - DNA, 15 bp, Homo sapiens
ggaatccttcctctg

SEQ ID NO: 264608 - DNA, 15 bp, Homo sapiens
gggaatccttcctct

SEQ ID NO: 264609 - DNA, 15 bp, Homo sapiens
ggggaatccttcctc

SEQ ID NO: 264610 - DNA, 15 bp, Homo sapiens
tggggaatccttcct

SEQ ID NO: 264611 - DNA, 15 bp, Homo sapiens
atggggaatccttcc

SEQ ID NO: 264612 - DNA, 15 bp, Homo sapiens
aatggggaatccttc

SEQ ID NO: 264613 - DNA, 15 bp, Homo sapiens
caatggggaatcctt

SEQ ID NO: 264614 - DNA, 15 bp, Homo sapiens
acaatggggaatcct

SEQ ID NO: 264615 - DNA, 15 bp, Homo sapiens
tacaatggggaatcc

SEQ ID NO: 264616 - DNA, 15 bp, Homo sapiens
ttacaatggggaatc

SEQ ID NO: 264617 - DNA, 15 bp, Homo sapiens
tttacaatggggaat

SEQ ID NO: 264618 - DNA, 15 bp, Homo sapiens
gtttacaatggggaa

SEQ ID NO: 264619 - DNA, 15 bp, Homo sapiens
ggtttacaatgggga

SEQ ID NO: 264620 - DNA, 15 bp, Homo sapiens
gggtttacaatgggg

SEQ ID NO: 264621 - DNA, 15 bp, Homo sapiens
agggtttacaatggg

SEQ ID NO: 264622 - DNA, 15 bp, Homo sapiens
aagggtttacaatgg

SEQ ID NO: 264623 - DNA, 15 bp, Homo sapiens
aaagggtttacaatg

SEQ ID NO: 264624 - DNA, 15 bp, Homo sapiens
gaaagggtttacaat

SEQ ID NO: 264625 - DNA, 15 bp, Homo sapiens
ggaaagggtttacaa

SEQ ID NO: 264626 - DNA, 15 bp, Homo sapiens
tggaaagggtttaca

SEQ ID NO: 264627 - DNA, 15 bp, Homo sapiens
ctggaaagggtttac

SEQ ID NO: 264628 - DNA, 15 bp, Homo sapiens
actggaaagggttta

SEQ ID NO: 264629 - DNA, 15 bp, Homo sapiens
tactggaaagggttt

SEQ ID NO: 264630 - DNA, 15 bp, Homo sapiens
ttactggaaagggtt

SEQ ID NO: 264631 - DNA, 15 bp, Homo sapiens
tttactggaaagggt

SEQ ID NO: 264632 - DNA, 15 bp, Homo sapiens
atttactggaaaggg

SEQ ID NO: 264633 - DNA, 15 bp, Homo sapiens
catttactggaaagg

SEQ ID NO: 264634 - DNA, 15 bp, Homo sapiens
gcatttactggaaag

SEQ ID NO: 264635 - DNA, 15 bp, Homo sapiens
ggcatttactggaaa

SEQ ID NO: 264636 - DNA, 15 bp, Homo sapiens
gggcatttactggaa

SEQ ID NO: 264637 - DNA, 15 bp, Homo sapiens
agggcatttactgga

SEQ ID NO: 264638 - DNA, 15 bp, Homo sapiens
tagggcatttactgg

SEQ ID NO: 264639 - DNA, 15 bp, Homo sapiens
ttagggcatttactg

SEQ ID NO: 264640 - DNA, 15 bp, Homo sapiens
cttagggcatttact

SEQ ID NO: 264641 - DNA, 15 bp, Homo sapiens
tcttagggcatttac

SEQ ID NO: 264642 - DNA, 15 bp, Homo sapiens
ttcttagggcattta

SEQ ID NO: 264643 - DNA, 15 bp, Homo sapiens
tttcttagggcattt

SEQ ID NO: 264644 - DNA, 15 bp, Homo sapiens
ctttcttagggcatt

SEQ ID NO: 264645 - DNA, 15 bp, Homo sapiens
tctttcttagggcat

SEQ ID NO: 264646 - DNA, 15 bp, Homo sapiens
ctctttcttagggca

SEQ ID NO: 264647 - DNA, 15 bp, Homo sapiens
actctttcttagggc

SEQ ID NO: 264648 - DNA, 15 bp, Homo sapiens
cactctttcttaggg

SEQ ID NO: 264649 - DNA, 15 bp, Homo sapiens
tcactctttcttagg

SEQ ID NO: 264650 - DNA, 15 bp, Homo sapiens
ctcactctttcttag

SEQ ID NO: 264651 - DNA, 15 bp, Homo sapiens
gctcactctttctta

SEQ ID NO: 264652 - DNA, 15 bp, Homo sapiens
tgctcactctttctt

SEQ ID NO: 264653 - DNA, 15 bp, Homo sapiens
ctgctcactctttct

SEQ ID NO: 264654 - DNA, 15 bp, Homo sapiens
cctgctcactctttc

SEQ ID NO: 264655 - DNA, 15 bp, Homo sapiens
ccctgctcactcttt

SEQ ID NO: 264656 - DNA, 15 bp, Homo sapiens
tccctgctcactctt

SEQ ID NO: 264657 - DNA, 15 bp, Homo sapiens
gtccctgctcactct

SEQ ID NO: 264658 - DNA, 15 bp, Homo sapiens
ggtccctgctcactc

SEQ ID NO: 264659 - DNA, 15 bp, Homo sapiens
aggtccctgctcact

SEQ ID NO: 264660 - DNA, 15 bp, Homo sapiens
caggtccctgctcac

SEQ ID NO: 264661 - DNA, 15 bp, Homo sapiens
acaggtccctgctca

SEQ ID NO: 264662 - DNA, 15 bp, Homo sapiens
gacaggtccctgctc

SEQ ID NO: 264663 - DNA, 15 bp, Homo sapiens
agacaggtccctgct

SEQ ID NO: 264664 - DNA, 15 bp, Homo sapiens
aagacaggtccctgc

SEQ ID NO: 264665 - DNA, 15 bp, Homo sapiens
gaagacaggtccctg

SEQ ID NO: 264666 - DNA, 15 bp, Homo sapiens
tgaagacaggtccct

SEQ ID NO: 264667 - DNA, 15 bp, Homo sapiens
ctgaagacaggtccc

SEQ ID NO: 264668 - DNA, 15 bp, Homo sapiens
cctgaagacaggtcc

SEQ ID NO: 264669 - DNA, 15 bp, Homo sapiens
acctgaagacaggtc

SEQ ID NO: 264670 - DNA, 15 bp, Homo sapiens
cacctgaagacaggt

SEQ ID NO: 264671 - DNA, 15 bp, Homo sapiens
acacctgaagacagg

SEQ ID NO: 264672 - DNA, 15 bp, Homo sapiens
aacacctgaagacag

SEQ ID NO: 264673 - DNA, 15 bp, Homo sapiens
caacacctgaagaca

SEQ ID NO: 264674 - DNA, 15 bp, Homo sapiens
ccaacacctgaagac

SEQ ID NO: 264675 - DNA, 15 bp, Homo sapiens
gccaacacctgaaga

SEQ ID NO: 264676 - DNA, 15 bp, Homo sapiens
agccaacacctgaag

SEQ ID NO: 264677 - DNA, 15 bp, Homo sapiens
tagccaacacctgaa

SEQ ID NO: 264678 - DNA, 15 bp, Homo sapiens
ctagccaacacctga

SEQ ID NO: 264679 - DNA, 15 bp, Homo sapiens
tctagccaacacctg

SEQ ID NO: 264680 - DNA, 15 bp, Homo sapiens
ctctagccaacacct

SEQ ID NO: 264681 - DNA, 15 bp, Homo sapiens
actctagccaacacc

SEQ ID NO: 264682 - DNA, 15 bp, Homo sapiens
cactctagccaacac

SEQ ID NO: 264683 - DNA, 15 bp, Homo sapiens
tcactctagccaaca

SEQ ID NO: 264684 - DNA, 15 bp, Homo sapiens
ttcactctagccaac

SEQ ID NO: 264685 - DNA, 15 bp, Homo sapiens
gttcactctagccaa

SEQ ID NO: 264686 - DNA, 15 bp, Homo sapiens
tgttcactctagcca

SEQ ID NO: 264687 - DNA, 15 bp, Homo sapiens
ctgttcactctagcc

SEQ ID NO: 264688 - DNA, 15 bp, Homo sapiens
actgttcactctagc

SEQ ID NO: 264689 - DNA, 15 bp, Homo sapiens
tactgttcactctag

SEQ ID NO: 264690 - DNA, 15 bp, Homo sapiens
ttactgttcactcta

SEQ ID NO: 264691 - DNA, 15 bp, Homo sapiens
tttactgttcactct

SEQ ID NO: 264692 - DNA, 15 bp, Homo sapiens
atttactgttcactc

SEQ ID NO: 264693 - DNA, 15 bp, Homo sapiens
aatttactgttcact

SEQ ID NO: 264694 - DNA, 15 bp, Homo sapiens
gaatttactgttcac

SEQ ID NO: 264695 - DNA, 15 bp, Homo sapiens
aaagaatttactgtt

SEQ ID NO: 264696 - DNA, 15 bp, Homo sapiens
aaaagaatttactgt

SEQ ID NO: 264697 - DNA, 15 bp, Homo sapiens
caaaagaatttactg

SEQ ID NO: 264698 - DNA, 15 bp, Homo sapiens
ccaaaagaatttact

SEQ ID NO: 264699 - DNA, 15 bp, Homo sapiens
gccaaaagaatttac

SEQ ID NO: 264700 - DNA, 15 bp, Homo sapiens
tgccaaaagaattta

SEQ ID NO: 264701 - DNA, 15 bp, Homo sapiens
ctgccaaaagaattt

SEQ ID NO: 264702 - DNA, 15 bp, Homo sapiens
actgccaaaagaatt

SEQ ID NO: 264703 - DNA, 15 bp, Homo sapiens
gactgccaaaagaat

SEQ ID NO: 264704 - DNA, 15 bp, Homo sapiens
agactgccaaaagaa

SEQ ID NO: 264705 - DNA, 15 bp, Homo sapiens
cagactgccaaaaga

SEQ ID NO: 264706 - DNA, 15 bp, Homo sapiens
ccagactgccaaaag

SEQ ID NO: 264707 - DNA, 15 bp, Homo sapiens
tccagactgccaaaa

SEQ ID NO: 264708 - DNA, 15 bp, Homo sapiens
ctccagactgccaaa

SEQ ID NO: 264709 - DNA, 15 bp, Homo sapiens
actccagactgccaa

SEQ ID NO: 264710 - DNA, 15 bp, Homo sapiens
aactccagactgcca

SEQ ID NO: 264711 - DNA, 15 bp, Homo sapiens
aaactccagactgcc

SEQ ID NO: 264712 - DNA, 15 bp, Homo sapiens
caaactccagactgc

SEQ ID NO: 264713 - DNA, 15 bp, Homo sapiens
acaaactccagactg

SEQ ID NO: 264714 - DNA, 15 bp, Homo sapiens
aacaaactccagact

SEQ ID NO: 264715 - DNA, 15 bp, Homo sapiens
aaacaaactccagac

SEQ ID NO: 264716 - DNA, 15 bp, Homo sapiens
aaaacaaactccaga

SEQ ID NO: 264717 - DNA, 15 bp, Homo sapiens
aaaaacaaactccag

SEQ ID NO: 264718 - DNA, 15 bp, Homo sapiens
gaaaaacaaactcca

SEQ ID NO: 264719 - DNA, 15 bp, Homo sapiens
tgaaaaacaaactcc

SEQ ID NO: 264720 - DNA, 15 bp, Homo sapiens
ctgaaaaacaaactc

SEQ ID NO: 264721 - DNA, 15 bp, Homo sapiens
cctgaaaaacaaact

SEQ ID NO: 264722 - DNA, 15 bp, Homo sapiens
gcctgaaaaacaaac

SEQ ID NO: 264723 - DNA, 15 bp, Homo sapiens
tgcctgaaaaacaaa

SEQ ID NO: 264724 - DNA, 15 bp, Homo sapiens
ctgcctgaaaaacaa

SEQ ID NO: 264725 - DNA, 15 bp, Homo sapiens
tctgcctgaaaaaca

SEQ ID NO: 264726 - DNA, 15 bp, Homo sapiens
gtctgcctgaaaaac

SEQ ID NO: 264727 - DNA, 15 bp, Homo sapiens
cgtctgcctgaaaaa

SEQ ID NO: 264728 - DNA, 15 bp, Homo sapiens
gcgtctgcctgaaaa

SEQ ID NO: 264729 - DNA, 15 bp, Homo sapiens
agcgtctgcctgaaa

SEQ ID NO: 264730 - DNA, 15 bp, Homo sapiens
aagcgtctgcctgaa

SEQ ID NO: 264731 - DNA, 15 bp, Homo sapiens
aaagcgtctgcctga

SEQ ID NO: 264732 - DNA, 15 bp, Homo sapiens
taaagcgtctgcctg

SEQ ID NO: 264733 - DNA, 15 bp, Homo sapiens
ttaaagcgtctgcct

SEQ ID NO: 264734 - DNA, 15 bp, Homo sapiens
cttaaagcgtctgcc

SEQ ID NO: 264735 - DNA, 15 bp, Homo sapiens
ccttaaagcgtctgc

SEQ ID NO: 264736 - DNA, 15 bp, Homo sapiens
cccttaaagcgtctg

SEQ ID NO: 264737 - DNA, 15 bp, Homo sapiens
ccccttaaagcgtct

SEQ ID NO: 264738 - DNA, 15 bp, Homo sapiens
accccttaaagcgtc

SEQ ID NO: 264739 - DNA, 15 bp, Homo sapiens
gaccccttaaagcgt

SEQ ID NO: 264740 - DNA, 15 bp, Homo sapiens
tgaccccttaaagcg

SEQ ID NO: 264741 - DNA, 15 bp, Homo sapiens
ctgaccccttaaagc

SEQ ID NO: 264742 - DNA, 15 bp, Homo sapiens
tctgaccccttaaag

SEQ ID NO: 264743 - DNA, 15 bp, Homo sapiens
gtctgaccccttaaa

SEQ ID NO: 264744 - DNA, 15 bp, Homo sapiens
cgtctgaccccttaa

SEQ ID NO: 264745 - DNA, 15 bp, Homo sapiens
gcgtctgacccctta

SEQ ID NO: 264746 - DNA, 15 bp, Homo sapiens
ggcgtctgacccctt

SEQ ID NO: 264747 - DNA, 15 bp, Homo sapiens
aggcgtctgacccct

SEQ ID NO: 264748 - DNA, 15 bp, Homo sapiens
aaggcgtctgacccc

SEQ ID NO: 264749 - DNA, 15 bp, Homo sapiens
taaggcgtctgaccc

SEQ ID NO: 264750 - DNA, 15 bp, Homo sapiens
ttaaggcgtctgacc

SEQ ID NO: 264751 - DNA, 15 bp, Homo sapiens
attaaggcgtctgac

SEQ ID NO: 264752 - DNA, 15 bp, Homo sapiens
tattaaggcgtctga

SEQ ID NO: 264753 - DNA, 15 bp, Homo sapiens
ttattaaggcgtctg

SEQ ID NO: 264754 - DNA, 15 bp, Homo sapiens
attattaaggcgtct

SEQ ID NO: 264755 - DNA, 15 bp, Homo sapiens
gattattaaggcgtc

SEQ ID NO: 264756 - DNA, 15 bp, Homo sapiens
ggattattaaggcgt

SEQ ID NO: 264757 - DNA, 15 bp, Homo sapiens
gggattattaaggcg

SEQ ID NO: 264758 - DNA, 15 bp, Homo sapiens
agggattattaaggc

SEQ ID NO: 264759 - DNA, 15 bp, Homo sapiens
aagggattattaagg

SEQ ID NO: 264760 - DNA, 15 bp, Homo sapiens
aaagggattattaag

SEQ ID NO: 264761 - DNA, 15 bp, Homo sapiens
aaaagggattattaa

SEQ ID NO: 264762 - DNA, 15 bp, Homo sapiens
aaaaagggattatta

SEQ ID NO: 264763 - DNA, 15 bp, Homo sapiens
aaaaaagggattatt

SEQ ID NO: 264764 - DNA, 15 bp, Homo sapiens
taaaaaagggattat

SEQ ID NO: 264765 - DNA, 15 bp, Homo sapiens
ttaaaaaagggatta

SEQ ID NO: 264766 - DNA, 15 bp, Homo sapiens
cttaaaaaagggatt

SEQ ID NO: 264767 - DNA, 15 bp, Homo sapiens
ccttaaaaaagggat

SEQ ID NO: 264768 - DNA, 15 bp, Homo sapiens
cccttaaaaaaggga

SEQ ID NO: 264769 - DNA, 15 bp, Homo sapiens
acccttaaaaaaggg

SEQ ID NO: 264770 - DNA, 15 bp, Homo sapiens
gacccttaaaaaagg

SEQ ID NO: 264771 - DNA, 15 bp, Homo sapiens
tgacccttaaaaaag

SEQ ID NO: 264772 - DNA, 15 bp, Homo sapiens
atgacccttaaaaaa

SEQ ID NO: 264773 - DNA, 15 bp, Homo sapiens
gatgacccttaaaaa

SEQ ID NO: 264774 - DNA, 15 bp, Homo sapiens
ggatgacccttaaaa

SEQ ID NO: 264775 - DNA, 15 bp, Homo sapiens
aggatgacccttaaa

SEQ ID NO: 264776 - DNA, 15 bp, Homo sapiens
taggatgacccttaa

SEQ ID NO: 264777 - DNA, 15 bp, Homo sapiens
ctaggatgaccctta

SEQ ID NO: 264778 - DNA, 15 bp, Homo sapiens
cctaggatgaccctt

SEQ ID NO: 264779 - DNA, 15 bp, Homo sapiens
ccctaggatgaccct

SEQ ID NO: 264780 - DNA, 15 bp, Homo sapiens
tccctaggatgaccc

SEQ ID NO: 264781 - DNA, 15 bp, Homo sapiens
atccctaggatgacc

SEQ ID NO: 264782 - DNA, 15 bp, Homo sapiens
catccctaggatgac

SEQ ID NO: 264783 - DNA, 15 bp, Homo sapiens
acatccctaggatga

SEQ ID NO: 264784 - DNA, 15 bp, Homo sapiens
cacatccctaggatg

SEQ ID NO: 264785 - DNA, 15 bp, Homo sapiens
ccacatccctaggat

SEQ ID NO: 264786 - DNA, 15 bp, Homo sapiens
accacatccctagga

SEQ ID NO: 264787 - DNA, 15 bp, Homo sapiens
gaccacatccctagg

SEQ ID NO: 264788 - DNA, 15 bp, Homo sapiens
agaccacatccctag

SEQ ID NO: 264789 - DNA, 15 bp, Homo sapiens
aagaccacatcccta

SEQ ID NO: 264790 - DNA, 15 bp, Homo sapiens
caagaccacatccct

SEQ ID NO: 264791 - DNA, 15 bp, Homo sapiens
tcaagaccacatccc

SEQ ID NO: 264792 - DNA, 15 bp, Homo sapiens
ttcaagaccacatcc

SEQ ID NO: 264793 - DNA, 15 bp, Homo sapiens
gttcaagaccacatc

SEQ ID NO: 264794 - DNA, 15 bp, Homo sapiens
agttcaagaccacat

SEQ ID NO: 264795 - DNA, 15 bp, Homo sapiens
cagttcaagaccaca

SEQ ID NO: 264796 - DNA, 15 bp, Homo sapiens
acagttcaagaccac

SEQ ID NO: 264797 - DNA, 15 bp, Homo sapiens
aacagttcaagacca

SEQ ID NO: 264798 - DNA, 15 bp, Homo sapiens
taacagttcaagacc

SEQ ID NO: 264799 - DNA, 15 bp, Homo sapiens
ataacagttcaagac

SEQ ID NO: 264800 - DNA, 15 bp, Homo sapiens
tataacagttcaaga

SEQ ID NO: 264801 - DNA, 15 bp, Homo sapiens
ttataacagttcaag

SEQ ID NO: 264802 - DNA, 15 bp, Homo sapiens
tttataacagttcaa

SEQ ID NO: 264803 - DNA, 15 bp, Homo sapiens
atttataacagttca

SEQ ID NO: 264804 - DNA, 15 bp, Homo sapiens
aatttataacagttc

SEQ ID NO: 264805 - DNA, 15 bp, Homo sapiens
taatttataacagtt

SEQ ID NO: 264806 - DNA, 15 bp, Homo sapiens
ataatttataacagt

SEQ ID NO: 264807 - DNA, 15 bp, Homo sapiens
cataatttataacag

SEQ ID NO: 264808 - DNA, 15 bp, Homo sapiens
acataatttataaca

SEQ ID NO: 264809 - DNA, 15 bp, Homo sapiens
aacataatttataac

SEQ ID NO: 264810 - DNA, 15 bp, Homo sapiens
gaacataatttataa

SEQ ID NO: 264811 - DNA, 15 bp, Homo sapiens
tgaacataatttata

SEQ ID NO: 264812 - DNA, 15 bp, Homo sapiens
atgaacataatttat

SEQ ID NO: 264813 - DNA, 15 bp, Homo sapiens
catgaacataattta

SEQ ID NO: 264814 - DNA, 15 bp, Homo sapiens
acatgaacataattt

SEQ ID NO: 264815 - DNA, 15 bp, Homo sapiens
aacatgaacataatt

SEQ ID NO: 264816 - DNA, 15 bp, Homo sapiens
aaacatgaacataat

SEQ ID NO: 264817 - DNA, 15 bp, Homo sapiens
caaacatgaacataa

SEQ ID NO: 264818 - DNA, 15 bp, Homo sapiens
acaaacatgaacata

SEQ ID NO: 264819 - DNA, 15 bp, Homo sapiens
aacaaacatgaacat

SEQ ID NO: 264820 - DNA, 15 bp, Homo sapiens
aaacaaacatgaaca

SEQ ID NO: 264821 - DNA, 15 bp, Homo sapiens
taaacaaacatgaac

SEQ ID NO: 264822 - DNA, 15 bp, Homo sapiens
ttaaacaaacatgaa

SEQ ID NO: 264823 - DNA, 15 bp, Homo sapiens
cttaaacaaacatga

SEQ ID NO: 264824 - DNA, 15 bp, Homo sapiens
acttaaacaaacatg

SEQ ID NO: 264825 - DNA, 15 bp, Homo sapiens
gacttaaacaaacat

SEQ ID NO: 264826 - DNA, 15 bp, Homo sapiens
agacttaaacaaaca

SEQ ID NO: 264827 - DNA, 15 bp, Homo sapiens
aagacttaaacaaac

SEQ ID NO: 264828 - DNA, 15 bp, Homo sapiens
aaagacttaaacaaa

SEQ ID NO: 264829 - DNA, 15 bp, Homo sapiens
aaaagacttaaacaa

SEQ ID NO: 264830 - DNA, 15 bp, Homo sapiens
taaaagacttaaaca

SEQ ID NO: 264831 - DNA, 15 bp, Homo sapiens
ttaaaagacttaaac

SEQ ID NO: 264832 - DNA, 15 bp, Homo sapiens
attaaaagacttaaa

SEQ ID NO: 264833 - DNA, 15 bp, Homo sapiens
cattaaaagacttaa

SEQ ID NO: 264834 - DNA, 15 bp, Homo sapiens
ccattaaaagactta

SEQ ID NO: 264835 - DNA, 15 bp, Homo sapiens
tccattaaaagactt

SEQ ID NO: 264836 - DNA, 15 bp, Homo sapiens
ctccattaaaagact

SEQ ID NO: 264837 - DNA, 15 bp, Homo sapiens
tctccattaaaagac

SEQ ID NO: 264838 - DNA, 15 bp, Homo sapiens
ttctccattaaaaga

SEQ ID NO: 264839 - DNA, 15 bp, Homo sapiens
cttctccattaaaag

SEQ ID NO: 264840 - DNA, 15 bp, Homo sapiens
acttctccattaaaa

SEQ ID NO: 264841 - DNA, 15 bp, Homo sapiens
cacttctccattaaa

SEQ ID NO: 264842 - DNA, 15 bp, Homo sapiens
ccacttctccattaa

SEQ ID NO: 264843 - DNA, 15 bp, Homo sapiens
cccacttctccatta

SEQ ID NO: 264844 - DNA, 15 bp, Homo sapiens
acccacttctccatt

SEQ ID NO: 264845 - DNA, 15 bp, Homo sapiens
cacccacttctccat

SEQ ID NO: 264846 - DNA, 15 bp, Homo sapiens
ccacccacttctcca

SEQ ID NO: 264847 - DNA, 15 bp, Homo sapiens
tccacccacttctcc

SEQ ID NO: 264848 - DNA, 15 bp, Homo sapiens
gtccacccacttctc

SEQ ID NO: 264849 - DNA, 15 bp, Homo sapiens
tgtccacccacttct

SEQ ID NO: 264850 - DNA, 15 bp, Homo sapiens
ctgtccacccacttc

SEQ ID NO: 264851 - DNA, 15 bp, Homo sapiens
cctgtccacccactt

SEQ ID NO: 264852 - DNA, 15 bp, Homo sapiens
ccctgtccacccact

SEQ ID NO: 264853 - DNA, 15 bp, Homo sapiens
tccctgtccacccac

SEQ ID NO: 264854 - DNA, 15 bp, Homo sapiens
atccctgtccaccca

SEQ ID NO: 264855 - DNA, 15 bp, Homo sapiens
catccctgtccaccc

SEQ ID NO: 264856 - DNA, 15 bp, Homo sapiens
ccatccctgtccacc

SEQ ID NO: 264857 - DNA, 15 bp, Homo sapiens
tccatccctgtccac

SEQ ID NO: 264858 - DNA, 15 bp, Homo sapiens
gtccatccctgtcca

SEQ ID NO: 264859 - DNA, 15 bp, Homo sapiens
tgtccatccctgtcc

SEQ ID NO: 264860 - DNA, 15 bp, Homo sapiens
ttgtccatccctgtc

SEQ ID NO: 264861 - DNA, 15 bp, Homo sapiens
tttgtccatccctgt

SEQ ID NO: 264862 - DNA, 15 bp, Homo sapiens
ttttgtccatccctg

SEQ ID NO: 264863 - DNA, 15 bp, Homo sapiens
attttgtccatccct

SEQ ID NO: 264864 - DNA, 15 bp, Homo sapiens
cattttgtccatccc

SEQ ID NO: 264865 - DNA, 15 bp, Homo sapiens
tcattttgtccatcc

SEQ ID NO: 264866 - DNA, 15 bp, Homo sapiens
atcattttgtccatc

SEQ ID NO: 264867 - DNA, 15 bp, Homo sapiens
aatcattttgtccat

SEQ ID NO: 264868 - DNA, 15 bp, Homo sapiens
aaatcattttgtcca

SEQ ID NO: 264869 - DNA, 15 bp, Homo sapiens
caaatcattttgtcc

SEQ ID NO: 264870 - DNA, 15 bp, Homo sapiens
acaaatcattttgtc

SEQ ID NO: 264871 - DNA, 15 bp, Homo sapiens
cacaaatcattttgt

SEQ ID NO: 264872 - DNA, 15 bp, Homo sapiens
gcacaaatcattttg

SEQ ID NO: 264873 - DNA, 15 bp, Homo sapiens
agcacaaatcatttt

SEQ ID NO: 264874 - DNA, 15 bp, Homo sapiens
cagcacaaatcattt

SEQ ID NO: 264875 - DNA, 15 bp, Homo sapiens
tcagcacaaatcatt

SEQ ID NO: 264876 - DNA, 15 bp, Homo sapiens
ttcagcacaaatcat

SEQ ID NO: 264877 - DNA, 15 bp, Homo sapiens
tttcagcacaaatca

SEQ ID NO: 264878 - DNA, 15 bp, Homo sapiens
ttttcagcacaaatc

SEQ ID NO: 264879 - DNA, 15 bp, Homo sapiens
attttcagcacaaat

SEQ ID NO: 264880 - DNA, 15 bp, Homo sapiens
aattttcagcacaaa

SEQ ID NO: 264881 - DNA, 15 bp, Homo sapiens
aaattttcagcacaa

SEQ ID NO: 264882 - DNA, 15 bp, Homo sapiens
caaattttcagcaca

SEQ ID NO: 264883 - DNA, 15 bp, Homo sapiens
gcaaattttcagcac

SEQ ID NO: 264884 - DNA, 15 bp, Homo sapiens
tgcaaattttcagca

SEQ ID NO: 264885 - DNA, 15 bp, Homo sapiens
ctgcaaattttcagc

SEQ ID NO: 264886 - DNA, 15 bp, Homo sapiens
gctgcaaattttcag

SEQ ID NO: 264887 - DNA, 15 bp, Homo sapiens
agctgcaaattttca

SEQ ID NO: 264888 - DNA, 15 bp, Homo sapiens
aagctgcaaattttc

SEQ ID NO: 264889 - DNA, 15 bp, Homo sapiens
aaagctgcaaatttt

SEQ ID NO: 264890 - DNA, 15 bp, Homo sapiens
aaaagctgcaaattt

SEQ ID NO: 264891 - DNA, 15 bp, Homo sapiens
taaaagctgcaaatt

SEQ ID NO: 264892 - DNA, 15 bp, Homo sapiens
ataaaagctgcaaat

SEQ ID NO: 264893 - DNA, 15 bp, Homo sapiens
tataaaagctgcaaa

SEQ ID NO: 264894 - DNA, 15 bp, Homo sapiens
ctataaaagctgcaa

SEQ ID NO: 264895 - DNA, 15 bp, Homo sapiens
cctataaaagctgca

SEQ ID NO: 264896 - DNA, 15 bp, Homo sapiens
gcctataaaagctgc

SEQ ID NO: 264897 - DNA, 15 bp, Homo sapiens
ggcctataaaagctg

SEQ ID NO: 264898 - DNA, 15 bp, Homo sapiens
tggcctataaaagct

SEQ ID NO: 264899 - DNA, 15 bp, Homo sapiens
ttggcctataaaagc

SEQ ID NO: 264900 - DNA, 15 bp, Homo sapiens
cttggcctataaaag

SEQ ID NO: 264901 - DNA, 15 bp, Homo sapiens
ccttggcctataaaa

SEQ ID NO: 264902 - DNA, 15 bp, Homo sapiens
gccttggcctataaa

SEQ ID NO: 264903 - DNA, 15 bp, Homo sapiens
agccttggcctataa

SEQ ID NO: 264904 - DNA, 15 bp, Homo sapiens
aagccttggcctata

SEQ ID NO: 264905 - DNA, 15 bp, Homo sapiens
gaagccttggcctat

SEQ ID NO: 264906 - DNA, 15 bp, Homo sapiens
tgaagccttggccta

SEQ ID NO: 264907 - DNA, 15 bp, Homo sapiens
ctgaagccttggcct

SEQ ID NO: 264908 - DNA, 15 bp, Homo sapiens
actgaagccttggcc

SEQ ID NO: 264909 - DNA, 15 bp, Homo sapiens
tactgaagccttggc

SEQ ID NO: 264910 - DNA, 15 bp, Homo sapiens
ctactgaagccttgg

SEQ ID NO: 264911 - DNA, 15 bp, Homo sapiens
tctactgaagccttg

SEQ ID NO: 264912 - DNA, 15 bp, Homo sapiens
gtctactgaagcctt

SEQ ID NO: 264913 - DNA, 15 bp, Homo sapiens
tgtctactgaagcct

SEQ ID NO: 264914 - DNA, 15 bp, Homo sapiens
ttgtctactgaagcc

SEQ ID NO: 264915 - DNA, 15 bp, Homo sapiens
gttgtctactgaagc

SEQ ID NO: 264916 - DNA, 15 bp, Homo sapiens
tgttgtctactgaag

SEQ ID NO: 264917 - DNA, 15 bp, Homo sapiens
ctgttgtctactgaa

SEQ ID NO: 264918 - DNA, 15 bp, Homo sapiens
tctgttgtctactga

SEQ ID NO: 264919 - DNA, 15 bp, Homo sapiens
ctctgttgtctactg

SEQ ID NO: 264920 - DNA, 15 bp, Homo sapiens
gctctgttgtctact

SEQ ID NO: 264921 - DNA, 15 bp, Homo sapiens
agctctgttgtctac

SEQ ID NO: 264922 - DNA, 15 bp, Homo sapiens
aagctctgttgtcta

SEQ ID NO: 264923 - DNA, 15 bp, Homo sapiens
taagctctgttgtct

SEQ ID NO: 264924 - DNA, 15 bp, Homo sapiens
gtaagctctgttgtc

SEQ ID NO: 264925 - DNA, 15 bp, Homo sapiens
tgtaagctctgttgt

SEQ ID NO: 264926 - DNA, 15 bp, Homo sapiens
ctgtaagctctgttg

SEQ ID NO: 264927 - DNA, 15 bp, Homo sapiens
cctgtaagctctgtt

SEQ ID NO: 264928 - DNA, 15 bp, Homo sapiens
tcctgtaagctctgt

SEQ ID NO: 264929 - DNA, 15 bp, Homo sapiens
ctcctgtaagctctg

SEQ ID NO: 264930 - DNA, 15 bp, Homo sapiens
cctcctgtaagctct

SEQ ID NO: 264931 - DNA, 15 bp, Homo sapiens
gcctcctgtaagctc

SEQ ID NO: 264932 - DNA, 15 bp, Homo sapiens
ggcctcctgtaagct

SEQ ID NO: 264933 - DNA, 15 bp, Homo sapiens
tggcctcctgtaagc

SEQ ID NO: 264934 - DNA, 15 bp, Homo sapiens
ttggcctcctgtaag

SEQ ID NO: 264935 - DNA, 15 bp, Homo sapiens
gttggcctcctgtaa

SEQ ID NO: 264936 - DNA, 15 bp, Homo sapiens
agttggcctcctgta

SEQ ID NO: 264937 - DNA, 15 bp, Homo sapiens
gagttggcctcctgt

SEQ ID NO: 264938 - DNA, 15 bp, Homo sapiens
tgagttggcctcctg

SEQ ID NO: 264939 - DNA, 15 bp, Homo sapiens
ttgagttggcctcct

SEQ ID NO: 264940 - DNA, 15 bp, Homo sapiens
tttgagttggcctcc

SEQ ID NO: 264941 - DNA, 15 bp, Homo sapiens
atttgagttggcctc

SEQ ID NO: 264942 - DNA, 15 bp, Homo sapiens
aatttgagttggcct

SEQ ID NO: 264943 - DNA, 15 bp, Homo sapiens
aaatttgagttggcc

SEQ ID NO: 264944 - DNA, 15 bp, Homo sapiens
caaatttgagttggc

SEQ ID NO: 264945 - DNA, 15 bp, Homo sapiens
ccaaatttgagttgg

SEQ ID NO: 264946 - DNA, 15 bp, Homo sapiens
accaaatttgagttg

SEQ ID NO: 264947 - DNA, 15 bp, Homo sapiens
gaccaaatttgagtt

SEQ ID NO: 264948 - DNA, 15 bp, Homo sapiens
tgaccaaatttgagt

SEQ ID NO: 264949 - DNA, 15 bp, Homo sapiens
ttgaccaaatttgag

SEQ ID NO: 264950 - DNA, 15 bp, Homo sapiens
cttgaccaaatttga

SEQ ID NO: 264951 - DNA, 15 bp, Homo sapiens
ccttgaccaaatttg

SEQ ID NO: 264952 - DNA, 15 bp, Homo sapiens
tccttgaccaaattt

SEQ ID NO: 264953 - DNA, 15 bp, Homo sapiens
ctccttgaccaaatt

SEQ ID NO: 264954 - DNA, 15 bp, Homo sapiens
tctccttgaccaaat

SEQ ID NO: 264955 - DNA, 15 bp, Homo sapiens
ctctccttgaccaaa

SEQ ID NO: 264956 - DNA, 15 bp, Homo sapiens
tctctccttgaccaa

SEQ ID NO: 264957 - DNA, 15 bp, Homo sapiens
ttctctccttgacca

SEQ ID NO: 264958 - DNA, 15 bp, Homo sapiens
attctctccttgacc

SEQ ID NO: 264959 - DNA, 15 bp, Homo sapiens
gattctctccttgac

SEQ ID NO: 264960 - DNA, 15 bp, Homo sapiens
ggattctctccttga

SEQ ID NO: 264961 - DNA, 15 bp, Homo sapiens
aggattctctccttg

SEQ ID NO: 264962 - DNA, 15 bp, Homo sapiens
aaggattctctcctt

SEQ ID NO: 264963 - DNA, 15 bp, Homo sapiens
caaggattctctcct

SEQ ID NO: 264964 - DNA, 15 bp, Homo sapiens
acaaggattctctcc

SEQ ID NO: 264965 - DNA, 15 bp, Homo sapiens
gacaaggattctctc

SEQ ID NO: 264966 - DNA, 15 bp, Homo sapiens
tgacaaggattctct

SEQ ID NO: 264967 - DNA, 15 bp, Homo sapiens
ctgacaaggattctc

SEQ ID NO: 264968 - DNA, 15 bp, Homo sapiens
actgacaaggattct

SEQ ID NO: 264969 - DNA, 15 bp, Homo sapiens
tactgacaaggattc

SEQ ID NO: 264970 - DNA, 15 bp, Homo sapiens
ttactgacaaggatt

SEQ ID NO: 264971 - DNA, 15 bp, Homo sapiens
attactgacaaggat

SEQ ID NO: 264972 - DNA, 15 bp, Homo sapiens
aattactgacaagga

SEQ ID NO: 264973 - DNA, 15 bp, Homo sapiens
aaattactgacaagg

SEQ ID NO: 264974 - DNA, 15 bp, Homo sapiens
gaaattactgacaag

SEQ ID NO: 264975 - DNA, 15 bp, Homo sapiens
tgaaattactgacaa

SEQ ID NO: 264976 - DNA, 15 bp, Homo sapiens
ctgaaattactgaca

SEQ ID NO: 264977 - DNA, 15 bp, Homo sapiens
gctgaaattactgac

SEQ ID NO: 264978 - DNA, 15 bp, Homo sapiens
agctgaaattactga

SEQ ID NO: 264979 - DNA, 15 bp, Homo sapiens
gagctgaaattactg

SEQ ID NO: 264980 - DNA, 15 bp, Homo sapiens
agagctgaaattact

SEQ ID NO: 264981 - DNA, 15 bp, Homo sapiens
cagagctgaaattac

SEQ ID NO: 264982 - DNA, 15 bp, Homo sapiens
tcagagctgaaatta

SEQ ID NO: 264983 - DNA, 15 bp, Homo sapiens
atcagagctgaaatt

SEQ ID NO: 264984 - DNA, 15 bp, Homo sapiens
tatcagagctgaaat

SEQ ID NO: 264985 - DNA, 15 bp, Homo sapiens
ctatcagagctgaaa

SEQ ID NO: 264986 - DNA, 15 bp, Homo sapiens
actatcagagctgaa

SEQ ID NO: 264987 - DNA, 15 bp, Homo sapiens
cactatcagagctga

SEQ ID NO: 264988 - DNA, 15 bp, Homo sapiens
acactatcagagctg

SEQ ID NO: 264989 - DNA, 15 bp, Homo sapiens
tacactatcagagct

SEQ ID NO: 264990 - DNA, 15 bp, Homo sapiens
atacactatcagagc

SEQ ID NO: 264991 - DNA, 15 bp, Homo sapiens
gatacactatcagag

SEQ ID NO: 264992 - DNA, 15 bp, Homo sapiens
tgatacactatcaga

SEQ ID NO: 264993 - DNA, 15 bp, Homo sapiens
ctgatacactatcag

SEQ ID NO: 264994 - DNA, 15 bp, Homo sapiens
tctgatacactatca

SEQ ID NO: 264995 - DNA, 15 bp, Homo sapiens
ctctgatacactatc

SEQ ID NO: 264996 - DNA, 15 bp, Homo sapiens
actctgatacactat

SEQ ID NO: 264997 - DNA, 15 bp, Homo sapiens
tactctgatacacta

SEQ ID NO: 264998 - DNA, 15 bp, Homo sapiens
atactctgatacact

SEQ ID NO: 264999 - DNA, 15 bp, Homo sapiens
tatactctgatacac

SEQ ID NO: 265000 - DNA, 15 bp, Homo sapiens
gtatactctgataca

SEQ ID NO: 265001 - DNA, 15 bp, Homo sapiens
ggtatactctgatac

SEQ ID NO: 265002 - DNA, 15 bp, Homo sapiens
gggtatactctgata

SEQ ID NO: 265003 - DNA, 15 bp, Homo sapiens
tgggtatactctgat

SEQ ID NO: 265004 - DNA, 15 bp, Homo sapiens
ctgggtatactctga

SEQ ID NO: 265005 - DNA, 15 bp, Homo sapiens
tctgggtatactctg

SEQ ID NO: 265006 - DNA, 15 bp, Homo sapiens
ttctgggtatactct

SEQ ID NO: 265007 - DNA, 15 bp, Homo sapiens
tttctgggtatactc

SEQ ID NO: 265008 - DNA, 15 bp, Homo sapiens
ctttctgggtatact

SEQ ID NO: 265009 - DNA, 15 bp, Homo sapiens
tctttctgggtatac

SEQ ID NO: 265010 - DNA, 15 bp, Homo sapiens
atctttctgggtata

SEQ ID NO: 265011 - DNA, 15 bp, Homo sapiens
tatctttctgggtat

SEQ ID NO: 265012 - DNA, 15 bp, Homo sapiens
ttatctttctgggta

SEQ ID NO: 265013 - DNA, 15 bp, Homo sapiens
cttatctttctgggt

SEQ ID NO: 265014 - DNA, 15 bp, Homo sapiens
tcttatctttctggg

SEQ ID NO: 265015 - DNA, 15 bp, Homo sapiens
atcttatctttctgg

SEQ ID NO: 265016 - DNA, 15 bp, Homo sapiens
aatcttatctttctg

SEQ ID NO: 265017 - DNA, 15 bp, Homo sapiens
caatcttatctttct

SEQ ID NO: 265018 - DNA, 15 bp, Homo sapiens
acaatcttatctttc

SEQ ID NO: 265019 - DNA, 15 bp, Homo sapiens
cacaatcttatcttt

SEQ ID NO: 265020 - DNA, 15 bp, Homo sapiens
ccacaatcttatctt

SEQ ID NO: 265021 - DNA, 15 bp, Homo sapiens
tccacaatcttatct

SEQ ID NO: 265022 - DNA, 15 bp, Homo sapiens
gtccacaatcttatc

SEQ ID NO: 265023 - DNA, 15 bp, Homo sapiens
agtccacaatcttat

SEQ ID NO: 265024 - DNA, 15 bp, Homo sapiens
aagtccacaatctta

SEQ ID NO: 265025 - DNA, 15 bp, Homo sapiens
gaagtccacaatctt

SEQ ID NO: 265026 - DNA, 15 bp, Homo sapiens
ggaagtccacaatct

SEQ ID NO: 265027 - DNA, 15 bp, Homo sapiens
aggaagtccacaatc

SEQ ID NO: 265028 - DNA, 15 bp, Homo sapiens
caggaagtccacaat

SEQ ID NO: 265029 - DNA, 15 bp, Homo sapiens
gcaggaagtccacaa

SEQ ID NO: 265030 - DNA, 15 bp, Homo sapiens
agcaggaagtccaca

SEQ ID NO: 265031 - DNA, 15 bp, Homo sapiens
tagcaggaagtccac

SEQ ID NO: 265032 - DNA, 15 bp, Homo sapiens
gtagcaggaagtcca

SEQ ID NO: 265033 - DNA, 15 bp, Homo sapiens
agtagcaggaagtcc

SEQ ID NO: 265034 - DNA, 15 bp, Homo sapiens
gagtagcaggaagtc

SEQ ID NO: 265035 - DNA, 15 bp, Homo sapiens
agagtagcaggaagt

SEQ ID NO: 265036 - DNA, 15 bp, Homo sapiens
gagagtagcaggaag

SEQ ID NO: 265037 - DNA, 15 bp, Homo sapiens
ggagagtagcaggaa

SEQ ID NO: 265038 - DNA, 15 bp, Homo sapiens
gggagagtagcagga

SEQ ID NO: 265039 - DNA, 15 bp, Homo sapiens
agggagagtagcagg

SEQ ID NO: 265040 - DNA, 15 bp, Homo sapiens
aagggagagtagcag

SEQ ID NO: 265041 - DNA, 15 bp, Homo sapiens
aaagggagagtagca

SEQ ID NO: 265042 - DNA, 15 bp, Homo sapiens
taaagggagagtagc

SEQ ID NO: 265043 - DNA, 15 bp, Homo sapiens
ctaaagggagagtag

SEQ ID NO: 265044 - DNA, 15 bp, Homo sapiens
cctaaagggagagta

SEQ ID NO: 265045 - DNA, 15 bp, Homo sapiens
tcctaaagggagagt

SEQ ID NO: 265046 - DNA, 15 bp, Homo sapiens
ctcctaaagggagag

SEQ ID NO: 265047 - DNA, 15 bp, Homo sapiens
cctcctaaagggaga

SEQ ID NO: 265048 - DNA, 15 bp, Homo sapiens
tcctcctaaagggag

SEQ ID NO: 265049 - DNA, 15 bp, Homo sapiens
ttcctcctaaaggga

SEQ ID NO: 265050 - DNA, 15 bp, Homo sapiens
cttcctcctaaaggg

SEQ ID NO: 265051 - DNA, 15 bp, Homo sapiens
tcttcctcctaaagg

SEQ ID NO: 265052 - DNA, 15 bp, Homo sapiens
ttcttcctcctaaag

SEQ ID NO: 265053 - DNA, 15 bp, Homo sapiens
attcttcctcctaaa

SEQ ID NO: 265054 - DNA, 15 bp, Homo sapiens
cattcttcctcctaa

SEQ ID NO: 265055 - DNA, 15 bp, Homo sapiens
acattcttcctccta

SEQ ID NO: 265056 - DNA, 15 bp, Homo sapiens
cacattcttcctcct

SEQ ID NO: 265057 - DNA, 15 bp, Homo sapiens
acacattcttcctcc

SEQ ID NO: 265058 - DNA, 15 bp, Homo sapiens
cacacattcttcctc

SEQ ID NO: 265059 - DNA, 15 bp, Homo sapiens
tcacacattcttcct

SEQ ID NO: 265060 - DNA, 15 bp, Homo sapiens
ctcacacattcttcc

SEQ ID NO: 265061 - DNA, 15 bp, Homo sapiens
tctcacacattcttc

SEQ ID NO: 265062 - DNA, 15 bp, Homo sapiens
ttctcacacattctt

SEQ ID NO: 265063 - DNA, 15 bp, Homo sapiens
attctcacacattct

SEQ ID NO: 265064 - DNA, 15 bp, Homo sapiens
cattctcacacattc

SEQ ID NO: 265065 - DNA, 15 bp, Homo sapiens
tcattctcacacatt

SEQ ID NO: 265066 - DNA, 15 bp, Homo sapiens
ttcattctcacacat

SEQ ID NO: 265067 - DNA, 15 bp, Homo sapiens
gttcattctcacaca

SEQ ID NO: 265068 - DNA, 15 bp, Homo sapiens
tgttcattctcacac

SEQ ID NO: 265069 - DNA, 15 bp, Homo sapiens
ttgttcattctcaca

SEQ ID NO: 265070 - DNA, 15 bp, Homo sapiens
cttgttcattctcac

SEQ ID NO: 265071 - DNA, 15 bp, Homo sapiens
ccttgttcattctca

SEQ ID NO: 265072 - DNA, 15 bp, Homo sapiens
tccttgttcattctc

SEQ ID NO: 265073 - DNA, 15 bp, Homo sapiens
ttccttgttcattct

SEQ ID NO: 265074 - DNA, 15 bp, Homo sapiens
tttccttgttcattc

SEQ ID NO: 265075 - DNA, 15 bp, Homo sapiens
gtttccttgttcatt

SEQ ID NO: 265076 - DNA, 15 bp, Homo sapiens
cgtttccttgttcat

SEQ ID NO: 265077 - DNA, 15 bp, Homo sapiens
tcgtttccttgttca

SEQ ID NO: 265078 - DNA, 15 bp, Homo sapiens
ttcgtttccttgttc

SEQ ID NO: 265079 - DNA, 15 bp, Homo sapiens
attcgtttccttgtt

SEQ ID NO: 265080 - DNA, 15 bp, Homo sapiens
tattcgtttccttgt

SEQ ID NO: 265081 - DNA, 15 bp, Homo sapiens
ttattcgtttccttg

SEQ ID NO: 265082 - DNA, 15 bp, Homo sapiens
tttattcgtttcctt

SEQ ID NO: 265083 - DNA, 15 bp, Homo sapiens
atttattcgtttcct

SEQ ID NO: 265084 - DNA, 15 bp, Homo sapiens
catttattcgtttcc

SEQ ID NO: 265085 - DNA, 15 bp, Homo sapiens
ccatttattcgtttc

SEQ ID NO: 265086 - DNA, 15 bp, Homo sapiens
cccatttattcgttt

SEQ ID NO: 265087 - DNA, 15 bp, Homo sapiens
ccccatttattcgtt

SEQ ID NO: 265088 - DNA, 15 bp, Homo sapiens
accccatttattcgt

SEQ ID NO: 265089 - DNA, 15 bp, Homo sapiens
aaccccatttattcg

SEQ ID NO: 265090 - DNA, 15 bp, Homo sapiens
caaccccatttattc

SEQ ID NO: 265091 - DNA, 15 bp, Homo sapiens
acaaccccatttatt

SEQ ID NO: 265092 - DNA, 15 bp, Homo sapiens
aacaaccccatttat

SEQ ID NO: 265093 - DNA, 15 bp, Homo sapiens
taacaaccccattta

SEQ ID NO: 265094 - DNA, 15 bp, Homo sapiens
ataacaaccccattt

SEQ ID NO: 265095 - DNA, 15 bp, Homo sapiens
tataacaaccccatt

SEQ ID NO: 265096 - DNA, 15 bp, Homo sapiens
gtataacaaccccat

SEQ ID NO: 265097 - DNA, 15 bp, Homo sapiens
tgtataacaacccca

SEQ ID NO: 265098 - DNA, 15 bp, Homo sapiens
atgtataacaacccc

SEQ ID NO: 265099 - DNA, 15 bp, Homo sapiens
aatgtataacaaccc

SEQ ID NO: 265100 - DNA, 15 bp, Homo sapiens
caatgtataacaacc

SEQ ID NO: 265101 - DNA, 15 bp, Homo sapiens
gcaatgtataacaac

SEQ ID NO: 265102 - DNA, 15 bp, Homo sapiens
tgcaatgtataacaa

SEQ ID NO: 265103 - DNA, 15 bp, Homo sapiens
ctgcaatgtataaca

SEQ ID NO: 265104 - DNA, 15 bp, Homo sapiens
actgcaatgtataac

SEQ ID NO: 265105 - DNA, 15 bp, Homo sapiens
tactgcaatgtataa

SEQ ID NO: 265106 - DNA, 15 bp, Homo sapiens
ttactgcaatgtata

SEQ ID NO: 265107 - DNA, 15 bp, Homo sapiens
cttactgcaatgtat

SEQ ID NO: 265108 - DNA, 15 bp, Homo sapiens
acttactgcaatgta

SEQ ID NO: 265109 - DNA, 15 bp, Homo sapiens
cacttactgcaatgt

SEQ ID NO: 265110 - DNA, 15 bp, Homo sapiens
gcacttactgcaatg

SEQ ID NO: 265111 - DNA, 15 bp, Homo sapiens
ggcacttactgcaat

SEQ ID NO: 265112 - DNA, 15 bp, Homo sapiens
aggcacttactgcaa

SEQ ID NO: 265113 - DNA, 15 bp, Homo sapiens
aaggcacttactgca

SEQ ID NO: 265114 - DNA, 15 bp, Homo sapiens
aaaggcacttactgc

SEQ ID NO: 265115 - DNA, 15 bp, Homo sapiens
taaaggcacttactg

SEQ ID NO: 265116 - DNA, 15 bp, Homo sapiens
ttaaaggcacttact

SEQ ID NO: 265117 - DNA, 15 bp, Homo sapiens
cttaaaggcacttac

SEQ ID NO: 265118 - DNA, 15 bp, Homo sapiens
ccttaaaggcactta

SEQ ID NO: 265119 - DNA, 15 bp, Homo sapiens
tccttaaaggcactt

SEQ ID NO: 265120 - DNA, 15 bp, Homo sapiens
ttccttaaaggcact

SEQ ID NO: 265121 - DNA, 15 bp, Homo sapiens
tttccttaaaggcac

SEQ ID NO: 265122 - DNA, 15 bp, Homo sapiens
atttccttaaaggca

SEQ ID NO: 265123 - DNA, 15 bp, Homo sapiens
catttccttaaaggc

SEQ ID NO: 265124 - DNA, 15 bp, Homo sapiens
tcatttccttaaagg

SEQ ID NO: 265125 - DNA, 15 bp, Homo sapiens
ttcatttccttaaag

SEQ ID NO: 265126 - DNA, 15 bp, Homo sapiens
attcatttccttaaa

SEQ ID NO: 265127 - DNA, 15 bp, Homo sapiens
cattcatttccttaa

SEQ ID NO: 265128 - DNA, 15 bp, Homo sapiens
ccattcatttcctta

SEQ ID NO: 265129 - DNA, 15 bp, Homo sapiens
tccattcatttcctt

SEQ ID NO: 265130 - DNA, 15 bp, Homo sapiens
atccattcatttcct

SEQ ID NO: 265131 - DNA, 15 bp, Homo sapiens
tatccattcatttcc

SEQ ID NO: 265132 - DNA, 15 bp, Homo sapiens
ttatccattcatttc

SEQ ID NO: 265133 - DNA, 15 bp, Homo sapiens
attatccattcattt

SEQ ID NO: 265134 - DNA, 15 bp, Homo sapiens
cattatccattcatt

SEQ ID NO: 265135 - DNA, 15 bp, Homo sapiens
tcattatccattcat

SEQ ID NO: 265136 - DNA, 15 bp, Homo sapiens
ctcattatccattca

SEQ ID NO: 265137 - DNA, 15 bp, Homo sapiens
tctcattatccattc

SEQ ID NO: 265138 - DNA, 15 bp, Homo sapiens
atctcattatccatt

SEQ ID NO: 265139 - DNA, 15 bp, Homo sapiens
tatctcattatccat

SEQ ID NO: 265140 - DNA, 15 bp, Homo sapiens
ctatctcattatcca

SEQ ID NO: 265141 - DNA, 15 bp, Homo sapiens
tctatctcattatcc

SEQ ID NO: 265142 - DNA, 15 bp, Homo sapiens
ttctatctcattatc

SEQ ID NO: 265143 - DNA, 15 bp, Homo sapiens
attctatctcattat

SEQ ID NO: 265144 - DNA, 15 bp, Homo sapiens
cattctatctcatta

SEQ ID NO: 265145 - DNA, 15 bp, Homo sapiens
tcattctatctcatt

SEQ ID NO: 265146 - DNA, 15 bp, Homo sapiens
atcattctatctcat

SEQ ID NO: 265147 - DNA, 15 bp, Homo sapiens
aatcattctatctca

SEQ ID NO: 265148 - DNA, 15 bp, Homo sapiens
taatcattctatctc

SEQ ID NO: 265149 - DNA, 15 bp, Homo sapiens
ctaatcattctatct

SEQ ID NO: 265150 - DNA, 15 bp, Homo sapiens
tctaatcattctatc

SEQ ID NO: 265151 - DNA, 15 bp, Homo sapiens
ttctaatcattctat

SEQ ID NO: 265152 - DNA, 15 bp, Homo sapiens
cttctaatcattcta

SEQ ID NO: 265153 - DNA, 15 bp, Homo sapiens
tcttctaatcattct

SEQ ID NO: 265154 - DNA, 15 bp, Homo sapiens
ctcttctaatcattc

SEQ ID NO: 265155 - DNA, 15 bp, Homo sapiens
tctcttctaatcatt

SEQ ID NO: 265156 - DNA, 15 bp, Homo sapiens
gtctcttctaatcat

SEQ ID NO: 265157 - DNA, 15 bp, Homo sapiens
tgtctcttctaatca

SEQ ID NO: 265158 - DNA, 15 bp, Homo sapiens
atgtctcttctaatc

SEQ ID NO: 265159 - DNA, 15 bp, Homo sapiens
aatgtctcttctaat

SEQ ID NO: 265160 - DNA, 15 bp, Homo sapiens
aaatgtctcttctaa

SEQ ID NO: 265161 - DNA, 15 bp, Homo sapiens
aaaatgtctcttcta

SEQ ID NO: 265162 - DNA, 15 bp, Homo sapiens
taaaatgtctcttct

SEQ ID NO: 265163 - DNA, 15 bp, Homo sapiens
ctaaaatgtctcttc

SEQ ID NO: 265164 - DNA, 15 bp, Homo sapiens
tctaaaatgtctctt

SEQ ID NO: 265165 - DNA, 15 bp, Homo sapiens
atctaaaatgtctct

SEQ ID NO: 265166 - DNA, 15 bp, Homo sapiens
tatctaaaatgtctc

SEQ ID NO: 265167 - DNA, 15 bp, Homo sapiens
ttatctaaaatgtct

SEQ ID NO: 265168 - DNA, 15 bp, Homo sapiens
tttatctaaaatgtc

SEQ ID NO: 265169 - DNA, 15 bp, Homo sapiens
ctttatctaaaatgt

SEQ ID NO: 265170 - DNA, 15 bp, Homo sapiens
tctttatctaaaatg

SEQ ID NO: 265171 - DNA, 15 bp, Homo sapiens
ttctttatctaaaat

SEQ ID NO: 265172 - DNA, 15 bp, Homo sapiens
tttctttatctaaaa

SEQ ID NO: 265173 - DNA, 15 bp, Homo sapiens
atttctttatctaaa

SEQ ID NO: 265174 - DNA, 15 bp, Homo sapiens
gatttctttatctaa

SEQ ID NO: 265175 - DNA, 15 bp, Homo sapiens
tgatttctttatcta

SEQ ID NO: 265176 - DNA, 15 bp, Homo sapiens
ctgatttctttatct

SEQ ID NO: 265177 - DNA, 15 bp, Homo sapiens
actgatttctttatc

SEQ ID NO: 265178 - DNA, 15 bp, Homo sapiens
tactgatttctttat

SEQ ID NO: 265179 - DNA, 15 bp, Homo sapiens
ttactgatttcttta

SEQ ID NO: 265180 - DNA, 15 bp, Homo sapiens
cttactgatttcttt

SEQ ID NO: 265181 - DNA, 15 bp, Homo sapiens
ccttactgatttctt

SEQ ID NO: 265182 - DNA, 15 bp, Homo sapiens
accttactgatttct

SEQ ID NO: 265183 - DNA, 15 bp, Homo sapiens
aaccttactgatttc

SEQ ID NO: 265184 - DNA, 15 bp, Homo sapiens
aaaccttactgattt

SEQ ID NO: 265185 - DNA, 15 bp, Homo sapiens
caaaccttactgatt

SEQ ID NO: 265186 - DNA, 15 bp, Homo sapiens
acaaaccttactgat

SEQ ID NO: 265187 - DNA, 15 bp, Homo sapiens
gacaaaccttactga

SEQ ID NO: 265188 - DNA, 15 bp, Homo sapiens
agacaaaccttactg

SEQ ID NO: 265189 - DNA, 15 bp, Homo sapiens
cagacaaaccttact

SEQ ID NO: 265190 - DNA, 15 bp, Homo sapiens
tcagacaaaccttac

SEQ ID NO: 265191 - DNA, 15 bp, Homo sapiens
ctcagacaaacctta

SEQ ID NO: 265192 - DNA, 15 bp, Homo sapiens
actcagacaaacctt

SEQ ID NO: 265193 - DNA, 15 bp, Homo sapiens
aactcagacaaacct

SEQ ID NO: 265194 - DNA, 15 bp, Homo sapiens
caactcagacaaacc

SEQ ID NO: 265195 - DNA, 15 bp, Homo sapiens
tcaactcagacaaac

SEQ ID NO: 265196 - DNA, 15 bp, Homo sapiens
gtcaactcagacaaa

SEQ ID NO: 265197 - DNA, 15 bp, Homo sapiens
tgtcaactcagacaa

SEQ ID NO: 265198 - DNA, 15 bp, Homo sapiens
atgtcaactcagaca

SEQ ID NO: 265199 - DNA, 15 bp, Homo sapiens
aatgtcaactcagac

SEQ ID NO: 265200 - DNA, 15 bp, Homo sapiens
aaatgtcaactcaga

SEQ ID NO: 265201 - DNA, 15 bp, Homo sapiens
caaatgtcaactcag

SEQ ID NO: 265202 - DNA, 15 bp, Homo sapiens
tcaaatgtcaactca

SEQ ID NO: 265203 - DNA, 15 bp, Homo sapiens
ctcaaatgtcaactc

SEQ ID NO: 265204 - DNA, 15 bp, Homo sapiens
actcaaatgtcaact

SEQ ID NO: 265205 - DNA, 15 bp, Homo sapiens
aactcaaatgtcaac

SEQ ID NO: 265206 - DNA, 15 bp, Homo sapiens
caactcaaatgtcaa

SEQ ID NO: 265207 - DNA, 15 bp, Homo sapiens
tcaactcaaatgtca

SEQ ID NO: 265208 - DNA, 15 bp, Homo sapiens
ctcaactcaaatgtc

SEQ ID NO: 265209 - DNA, 15 bp, Homo sapiens
tctcaactcaaatgt

SEQ ID NO: 265210 - DNA, 15 bp, Homo sapiens
gtctcaactcaaatg

SEQ ID NO: 265211 - DNA, 15 bp, Homo sapiens
ggtctcaactcaaat

SEQ ID NO: 265212 - DNA, 15 bp, Homo sapiens
tggtctcaactcaaa

SEQ ID NO: 265213 - DNA, 15 bp, Homo sapiens
ttggtctcaactcaa

SEQ ID NO: 265214 - DNA, 15 bp, Homo sapiens
tttggtctcaactca

SEQ ID NO: 265215 - DNA, 15 bp, Homo sapiens
ctttggtctcaactc

SEQ ID NO: 265216 - DNA, 15 bp, Homo sapiens
actttggtctcaact

SEQ ID NO: 265217 - DNA, 15 bp, Homo sapiens
aactttggtctcaac

SEQ ID NO: 265218 - DNA, 15 bp, Homo sapiens
aaactttggtctcaa

SEQ ID NO: 265219 - DNA, 15 bp, Homo sapiens
caaactttggtctca

SEQ ID NO: 265220 - DNA, 15 bp, Homo sapiens
tcaaactttggtctc

SEQ ID NO: 265221 - DNA, 15 bp, Homo sapiens
ctcaaactttggtct

SEQ ID NO: 265222 - DNA, 15 bp, Homo sapiens
tctcaaactttggtc

SEQ ID NO: 265223 - DNA, 15 bp, Homo sapiens
ttctcaaactttggt

SEQ ID NO: 265224 - DNA, 15 bp, Homo sapiens
tttctcaaactttgg

SEQ ID NO: 265225 - DNA, 15 bp, Homo sapiens
ctttctcaaactttg

SEQ ID NO: 265226 - DNA, 15 bp, Homo sapiens
tctttctcaaacttt

SEQ ID NO: 265227 - DNA, 15 bp, Homo sapiens
atctttctcaaactt

SEQ ID NO: 265228 - DNA, 15 bp, Homo sapiens
aatctttctcaaact

SEQ ID NO: 265229 - DNA, 15 bp, Homo sapiens
gaatctttctcaaac

SEQ ID NO: 265230 - DNA, 15 bp, Homo sapiens
tgaatctttctcaaa

SEQ ID NO: 265231 - DNA, 15 bp, Homo sapiens
ctgaatctttctcaa

SEQ ID NO: 265232 - DNA, 15 bp, Homo sapiens
gctgaatctttctca

SEQ ID NO: 265233 - DNA, 15 bp, Homo sapiens
ggctgaatctttctc

SEQ ID NO: 265234 - DNA, 15 bp, Homo sapiens
gggctgaatctttct

SEQ ID NO: 265235 - DNA, 15 bp, Homo sapiens
agggctgaatctttc

SEQ ID NO: 265236 - DNA, 15 bp, Homo sapiens
cagggctgaatcttt

SEQ ID NO: 265237 - DNA, 15 bp, Homo sapiens
acagggctgaatctt

SEQ ID NO: 265238 - DNA, 15 bp, Homo sapiens
tacagggctgaatct

SEQ ID NO: 265239 - DNA, 15 bp, Homo sapiens
ttacagggctgaatc

SEQ ID NO: 265240 - DNA, 15 bp, Homo sapiens
tttacagggctgaat

SEQ ID NO: 265241 - DNA, 15 bp, Homo sapiens
ctttacagggctgaa

SEQ ID NO: 265242 - DNA, 15 bp, Homo sapiens
tctttacagggctga

SEQ ID NO: 265243 - DNA, 15 bp, Homo sapiens
ttctttacagggctg

SEQ ID NO: 265244 - DNA, 15 bp, Homo sapiens
gttctttacagggct

SEQ ID NO: 265245 - DNA, 15 bp, Homo sapiens
agttctttacagggc

SEQ ID NO: 265246 - DNA, 15 bp, Homo sapiens
tagttctttacaggg

SEQ ID NO: 265247 - DNA, 15 bp, Homo sapiens
ctagttctttacagg

SEQ ID NO: 265248 - DNA, 15 bp, Homo sapiens
actagttctttacag

SEQ ID NO: 265249 - DNA, 15 bp, Homo sapiens
tactagttctttaca

SEQ ID NO: 265250 - DNA, 15 bp, Homo sapiens
ctactagttctttac

SEQ ID NO: 265251 - DNA, 15 bp, Homo sapiens
tctactagttcttta

SEQ ID NO: 265252 - DNA, 15 bp, Homo sapiens
ttctactagttcttt

SEQ ID NO: 265253 - DNA, 15 bp, Homo sapiens
cttctactagttctt

SEQ ID NO: 265254 - DNA, 15 bp, Homo sapiens
gcttctactagttct

SEQ ID NO: 265255 - DNA, 15 bp, Homo sapiens
tgcttctactagttc

SEQ ID NO: 265256 - DNA, 15 bp, Homo sapiens
atgcttctactagtt

SEQ ID NO: 265257 - DNA, 15 bp, Homo sapiens
catgcttctactagt

SEQ ID NO: 265258 - DNA, 15 bp, Homo sapiens
acatgcttctactag

SEQ ID NO: 265259 - DNA, 15 bp, Homo sapiens
aacatgcttctacta

SEQ ID NO: 265260 - DNA, 15 bp, Homo sapiens
aaacatgcttctact

SEQ ID NO: 265261 - DNA, 15 bp, Homo sapiens
gaaacatgcttctac

SEQ ID NO: 265262 - DNA, 15 bp, Homo sapiens
ttctgaaacatgctt

SEQ ID NO: 265263 - DNA, 15 bp, Homo sapiens
tttctgaaacatgct

SEQ ID NO: 265264 - DNA, 15 bp, Homo sapiens
ctttctgaaacatgc

SEQ ID NO: 265265 - DNA, 15 bp, Homo sapiens
tctttctgaaacatg

SEQ ID NO: 265266 - DNA, 15 bp, Homo sapiens
ttctttctgaaacat

SEQ ID NO: 265267 - DNA, 15 bp, Homo sapiens
cttctttctgaaaca

SEQ ID NO: 265268 - DNA, 15 bp, Homo sapiens
tcttctttctgaaac

SEQ ID NO: 265269 - DNA, 15 bp, Homo sapiens
ttcttctttctgaaa

SEQ ID NO: 265270 - DNA, 15 bp, Homo sapiens
tttcttctttctgaa

SEQ ID NO: 265271 - DNA, 15 bp, Homo sapiens
gtttcttctttctga

SEQ ID NO: 265272 - DNA, 15 bp, Homo sapiens
tgtttcttctttctg

SEQ ID NO: 265273 - DNA, 15 bp, Homo sapiens
tctgtttcttctttc

SEQ ID NO: 265274 - DNA, 15 bp, Homo sapiens
ttctgtttcttcttt

SEQ ID NO: 265275 - DNA, 15 bp, Homo sapiens
gttctgtttcttctt

SEQ ID NO: 265276 - DNA, 15 bp, Homo sapiens
tgttctgtttcttct

SEQ ID NO: 265277 - DNA, 15 bp, Homo sapiens
atgttctgtttcttc

SEQ ID NO: 265278 - DNA, 15 bp, Homo sapiens
tatgttctgtttctt

SEQ ID NO: 265279 - DNA, 15 bp, Homo sapiens
atatgttctgtttct

SEQ ID NO: 265280 - DNA, 15 bp, Homo sapiens
tatatgttctgtttc

SEQ ID NO: 265281 - DNA, 15 bp, Homo sapiens
ctatatgttctgttt

SEQ ID NO: 265282 - DNA, 15 bp, Homo sapiens
actatatgttctgtt

SEQ ID NO: 265283 - DNA, 15 bp, Homo sapiens
cactatatgttctgt

SEQ ID NO: 265284 - DNA, 15 bp, Homo sapiens
ccactatatgttctg

SEQ ID NO: 265285 - DNA, 15 bp, Homo sapiens
accactatatgttct

SEQ ID NO: 265286 - DNA, 15 bp, Homo sapiens
gaccactatatgttc

SEQ ID NO: 265287 - DNA, 15 bp, Homo sapiens
agaccactatatgtt

SEQ ID NO: 265288 - DNA, 15 bp, Homo sapiens
cagaccactatatgt

SEQ ID NO: 265289 - DNA, 15 bp, Homo sapiens
tcagaccactatatg

SEQ ID NO: 265290 - DNA, 15 bp, Homo sapiens
ctcagaccactatat

SEQ ID NO: 265291 - DNA, 15 bp, Homo sapiens
actcagaccactata

SEQ ID NO: 265292 - DNA, 15 bp, Homo sapiens
aactcagaccactat

SEQ ID NO: 265293 - DNA, 15 bp, Homo sapiens
caactcagaccacta

SEQ ID NO: 265294 - DNA, 15 bp, Homo sapiens
ccaactcagaccact

SEQ ID NO: 265295 - DNA, 15 bp, Homo sapiens
cccaactcagaccac

SEQ ID NO: 265296 - DNA, 15 bp, Homo sapiens
tcccaactcagacca

SEQ ID NO: 265297 - DNA, 15 bp, Homo sapiens
ttcccaactcagacc

SEQ ID NO: 265298 - DNA, 15 bp, Homo sapiens
tttcccaactcagac

SEQ ID NO: 265299 - DNA, 15 bp, Homo sapiens
ttttcccaactcaga

SEQ ID NO: 265300 - DNA, 15 bp, Homo sapiens
tttttcccaactcag

SEQ ID NO: 265301 - DNA, 15 bp, Homo sapiens
ctttttcccaactca

SEQ ID NO: 265302 - DNA, 15 bp, Homo sapiens
cctttttcccaactc

SEQ ID NO: 265303 - DNA, 15 bp, Homo sapiens
acctttttcccaact

SEQ ID NO: 265304 - DNA, 15 bp, Homo sapiens
aacctttttcccaac

SEQ ID NO: 265305 - DNA, 15 bp, Homo sapiens
taacctttttcccaa

SEQ ID NO: 265306 - DNA, 15 bp, Homo sapiens
ctaacctttttccca

SEQ ID NO: 265307 - DNA, 15 bp, Homo sapiens
gctaacctttttccc

SEQ ID NO: 265308 - DNA, 15 bp, Homo sapiens
cgctaacctttttcc

SEQ ID NO: 265309 - DNA, 15 bp, Homo sapiens
acgctaacctttttc

SEQ ID NO: 265310 - DNA, 15 bp, Homo sapiens
cacgctaaccttttt

SEQ ID NO: 265311 - DNA, 15 bp, Homo sapiens
tcacgctaacctttt

SEQ ID NO: 265312 - DNA, 15 bp, Homo sapiens
atcacgctaaccttt

SEQ ID NO: 265313 - DNA, 15 bp, Homo sapiens
aatcacgctaacctt

SEQ ID NO: 265314 - DNA, 15 bp, Homo sapiens
caatcacgctaacct

SEQ ID NO: 265315 - DNA, 15 bp, Homo sapiens
ccaatcacgctaacc

SEQ ID NO: 265316 - DNA, 15 bp, Homo sapiens
cccaatcacgctaac

SEQ ID NO: 265317 - DNA, 15 bp, Homo sapiens
gcccaatcacgctaa

SEQ ID NO: 265318 - DNA, 15 bp, Homo sapiens
agcccaatcacgcta

SEQ ID NO: 265319 - DNA, 15 bp, Homo sapiens
cagcccaatcacgct

SEQ ID NO: 265320 - DNA, 15 bp, Homo sapiens
gcagcccaatcacgc

SEQ ID NO: 265321 - DNA, 15 bp, Homo sapiens
tgcagcccaatcacg

SEQ ID NO: 265322 - DNA, 15 bp, Homo sapiens
ctgcagcccaatcac

SEQ ID NO: 265323 - DNA, 15 bp, Homo sapiens
tctgcagcccaatca

SEQ ID NO: 265324 - DNA, 15 bp, Homo sapiens
ttctgcagcccaatc

SEQ ID NO: 265325 - DNA, 15 bp, Homo sapiens
tttctgcagcccaat

SEQ ID NO: 265326 - DNA, 15 bp, Homo sapiens
ctttctgcagcccaa

SEQ ID NO: 265327 - DNA, 15 bp, Homo sapiens
actttctgcagccca

SEQ ID NO: 265328 - DNA, 15 bp, Homo sapiens
cactttctgcagccc

SEQ ID NO: 265329 - DNA, 15 bp, Homo sapiens
tcactttctgcagcc

SEQ ID NO: 265330 - DNA, 15 bp, Homo sapiens
ttcactttctgcagc

SEQ ID NO: 265331 - DNA, 15 bp, Homo sapiens
cttcactttctgcag

SEQ ID NO: 265332 - DNA, 15 bp, Homo sapiens
gcttcactttctgca

SEQ ID NO: 265333 - DNA, 15 bp, Homo sapiens
ggcttcactttctgc

SEQ ID NO: 265334 - DNA, 15 bp, Homo sapiens
aggcttcactttctg

SEQ ID NO: 265335 - DNA, 15 bp, Homo sapiens
caggcttcactttct

SEQ ID NO: 265336 - DNA, 15 bp, Homo sapiens
acaggcttcactttc

SEQ ID NO: 265337 - DNA, 15 bp, Homo sapiens
aacaggcttcacttt

SEQ ID NO: 265338 - DNA, 15 bp, Homo sapiens
gaacaggcttcactt

SEQ ID NO: 265339 - DNA, 15 bp, Homo sapiens
ggaacaggcttcact

SEQ ID NO: 265340 - DNA, 15 bp, Homo sapiens
gggaacaggcttcac

SEQ ID NO: 265341 - DNA, 15 bp, Homo sapiens
ggggaacaggcttca

SEQ ID NO: 265342 - DNA, 15 bp, Homo sapiens
tggggaacaggcttc

SEQ ID NO: 265343 - DNA, 15 bp, Homo sapiens
ttggggaacaggctt

SEQ ID NO: 265344 - DNA, 15 bp, Homo sapiens
cttggggaacaggct

SEQ ID NO: 265345 - DNA, 15 bp, Homo sapiens
ccttggggaacaggc

SEQ ID NO: 265346 - DNA, 15 bp, Homo sapiens
cccttggggaacagg

SEQ ID NO: 265347 - DNA, 15 bp, Homo sapiens
ccccttggggaacag

SEQ ID NO: 265348 - DNA, 15 bp, Homo sapiens
gccccttggggaaca

SEQ ID NO: 265349 - DNA, 15 bp, Homo sapiens
cgccccttggggaac

SEQ ID NO: 265350 - DNA, 15 bp, Homo sapiens
gcgccccttggggaa

SEQ ID NO: 265351 - DNA, 15 bp, Homo sapiens
tgcgccccttgggga

SEQ ID NO: 265352 - DNA, 15 bp, Homo sapiens
atgcgccccttgggg

SEQ ID NO: 265353 - DNA, 15 bp, Homo sapiens
catgcgccccttggg

SEQ ID NO: 265354 - DNA, 15 bp, Homo sapiens
ccatgcgccccttgg

SEQ ID NO: 265355 - DNA, 15 bp, Homo sapiens
tccatgcgccccttg

SEQ ID NO: 265356 - DNA, 15 bp, Homo sapiens
ttccatgcgcccctt

SEQ ID NO: 265357 - DNA, 15 bp, Homo sapiens
tttccatgcgcccct

SEQ ID NO: 265358 - DNA, 15 bp, Homo sapiens
ctttccatgcgcccc

SEQ ID NO: 265359 - DNA, 15 bp, Homo sapiens
cctttccatgcgccc

SEQ ID NO: 265360 - DNA, 15 bp, Homo sapiens
tcctttccatgcgcc

SEQ ID NO: 265361 - DNA, 15 bp, Homo sapiens
ctcctttccatgcgc

SEQ ID NO: 265362 - DNA, 15 bp, Homo sapiens
gctcctttccatgcg

SEQ ID NO: 265363 - DNA, 15 bp, Homo sapiens
tgctcctttccatgc

SEQ ID NO: 265364 - DNA, 15 bp, Homo sapiens
gtgctcctttccatg

SEQ ID NO: 265365 - DNA, 15 bp, Homo sapiens
agtgctcctttccat

SEQ ID NO: 265366 - DNA, 15 bp, Homo sapiens
cagtgctcctttcca

SEQ ID NO: 265367 - DNA, 15 bp, Homo sapiens
ccagtgctcctttcc

SEQ ID NO: 265368 - DNA, 15 bp, Homo sapiens
accagtgctcctttc

SEQ ID NO: 265369 - DNA, 15 bp, Homo sapiens
aaccagtgctccttt

SEQ ID NO: 265370 - DNA, 15 bp, Homo sapiens
taaccagtgctcctt

SEQ ID NO: 265371 - DNA, 15 bp, Homo sapiens
gtaaccagtgctcct

SEQ ID NO: 265372 - DNA, 15 bp, Homo sapiens
tgtaaccagtgctcc

SEQ ID NO: 265373 - DNA, 15 bp, Homo sapiens
gtgtaaccagtgctc

SEQ ID NO: 265374 - DNA, 15 bp, Homo sapiens
tgtgtaaccagtgct

SEQ ID NO: 265375 - DNA, 15 bp, Homo sapiens
ttgtgtaaccagtgc

SEQ ID NO: 265376 - DNA, 15 bp, Homo sapiens
gttgtgtaaccagtg

SEQ ID NO: 265377 - DNA, 15 bp, Homo sapiens
agttgtgtaaccagt

SEQ ID NO: 265378 - DNA, 15 bp, Homo sapiens
cagttgtgtaaccag

SEQ ID NO: 265379 - DNA, 15 bp, Homo sapiens
ccagttgtgtaacca

SEQ ID NO: 265380 - DNA, 15 bp, Homo sapiens
tccagttgtgtaacc

SEQ ID NO: 265381 - DNA, 15 bp, Homo sapiens
ttccagttgtgtaac

SEQ ID NO: 265382 - DNA, 15 bp, Homo sapiens
cttccagttgtgtaa

SEQ ID NO: 265383 - DNA, 15 bp, Homo sapiens
acttccagttgtgta

SEQ ID NO: 265384 - DNA, 15 bp, Homo sapiens
cacttccagttgtgt

SEQ ID NO: 265385 - DNA, 15 bp, Homo sapiens
gcacttccagttgtg

SEQ ID NO: 265386 - DNA, 15 bp, Homo sapiens
ggcacttccagttgt

SEQ ID NO: 265387 - DNA, 15 bp, Homo sapiens
gggcacttccagttg

SEQ ID NO: 265388 - DNA, 15 bp, Homo sapiens
tgggcacttccagtt

SEQ ID NO: 265389 - DNA, 15 bp, Homo sapiens
ctgggcacttccagt

SEQ ID NO: 265390 - DNA, 15 bp, Homo sapiens
actgggcacttccag

SEQ ID NO: 265391 - DNA, 15 bp, Homo sapiens
cactgggcacttcca

SEQ ID NO: 265392 - DNA, 15 bp, Homo sapiens
gcactgggcacttcc

SEQ ID NO: 265393 - DNA, 15 bp, Homo sapiens
tgcactgggcacttc

SEQ ID NO: 265394 - DNA, 15 bp, Homo sapiens
ttgcactgggcactt

SEQ ID NO: 265395 - DNA, 15 bp, Homo sapiens
tttgcactgggcact

SEQ ID NO: 265396 - DNA, 15 bp, Homo sapiens
ttttgcactgggcac

SEQ ID NO: 265397 - DNA, 15 bp, Homo sapiens
attttgcactgggca

SEQ ID NO: 265398 - DNA, 15 bp, Homo sapiens
cattttgcactgggc

SEQ ID NO: 265399 - DNA, 15 bp, Homo sapiens
tcattttgcactggg

SEQ ID NO: 265400 - DNA, 15 bp, Homo sapiens
ttcattttgcactgg

SEQ ID NO: 265401 - DNA, 15 bp, Homo sapiens
tttcattttgcactg

SEQ ID NO: 265402 - DNA, 15 bp, Homo sapiens
gtttcattttgcact

SEQ ID NO: 265403 - DNA, 15 bp, Homo sapiens
agtttcattttgcac

SEQ ID NO: 265404 - DNA, 15 bp, Homo sapiens
cagtttcattttgca

SEQ ID NO: 265405 - DNA, 15 bp, Homo sapiens
ccagtttcattttgc

SEQ ID NO: 265406 - DNA, 15 bp, Homo sapiens
cccagtttcattttg

SEQ ID NO: 265407 - DNA, 15 bp, Homo sapiens
ccccagtttcatttt

SEQ ID NO: 265408 - DNA, 15 bp, Homo sapiens
cccccagtttcattt

SEQ ID NO: 265409 - DNA, 15 bp, Homo sapiens
ccccccagtttcatt

SEQ ID NO: 265410 - DNA, 15 bp, Homo sapiens
gccccccagtttcat

SEQ ID NO: 265411 - DNA, 15 bp, Homo sapiens
ggccccccagtttca

SEQ ID NO: 265412 - DNA, 15 bp, Homo sapiens
gggccccccagtttc

SEQ ID NO: 265413 - DNA, 15 bp, Homo sapiens
ggggccccccagttt

SEQ ID NO: 265414 - DNA, 15 bp, Homo sapiens
aggggccccccagtt

SEQ ID NO: 265415 - DNA, 15 bp, Homo sapiens
aaggggccccccagt

SEQ ID NO: 265416 - DNA, 15 bp, Homo sapiens
caaggggccccccag

SEQ ID NO: 265417 - DNA, 15 bp, Homo sapiens
acaaggggcccccca

SEQ ID NO: 265418 - DNA, 15 bp, Homo sapiens
aacaaggggcccccc

SEQ ID NO: 265419 - DNA, 15 bp, Homo sapiens
aaacaaggggccccc

SEQ ID NO: 265420 - DNA, 15 bp, Homo sapiens
taaacaaggggcccc

SEQ ID NO: 265421 - DNA, 15 bp, Homo sapiens
ttaaacaaggggccc

SEQ ID NO: 265422 - DNA, 15 bp, Homo sapiens
gttaaacaaggggcc

SEQ ID NO: 265423 - DNA, 15 bp, Homo sapiens
tgttaaacaaggggc

SEQ ID NO: 265424 - DNA, 15 bp, Homo sapiens
ttgttaaacaagggg

SEQ ID NO: 265425 - DNA, 15 bp, Homo sapiens
attgttaaacaaggg

SEQ ID NO: 265426 - DNA, 15 bp, Homo sapiens
aattgttaaacaagg

SEQ ID NO: 265427 - DNA, 15 bp, Homo sapiens
taattgttaaacaag

SEQ ID NO: 265428 - DNA, 15 bp, Homo sapiens
ataattgttaaacaa

SEQ ID NO: 265429 - DNA, 15 bp, Homo sapiens
aataattgttaaaca

SEQ ID NO: 265430 - DNA, 15 bp, Homo sapiens
taataattgttaaac

SEQ ID NO: 265431 - DNA, 15 bp, Homo sapiens
ttaataattgttaaa

SEQ ID NO: 265432 - DNA, 15 bp, Homo sapiens
cttaataattgttaa

SEQ ID NO: 265433 - DNA, 15 bp, Homo sapiens
tcttaataattgtta

SEQ ID NO: 265434 - DNA, 15 bp, Homo sapiens
gtcttaataattgtt

SEQ ID NO: 265435 - DNA, 15 bp, Homo sapiens
agtcttaataattgt

SEQ ID NO: 265436 - DNA, 15 bp, Homo sapiens
aagtcttaataattg

SEQ ID NO: 265437 - DNA, 15 bp, Homo sapiens
gaagtcttaataatt

SEQ ID NO: 265438 - DNA, 15 bp, Homo sapiens
ggaagtcttaataat

SEQ ID NO: 265439 - DNA, 15 bp, Homo sapiens
cggaagtcttaataa

SEQ ID NO: 265440 - DNA, 15 bp, Homo sapiens
tcggaagtcttaata

SEQ ID NO: 265441 - DNA, 15 bp, Homo sapiens
ctcggaagtcttaat

SEQ ID NO: 265442 - DNA, 15 bp, Homo sapiens
actcggaagtcttaa

SEQ ID NO: 265443 - DNA, 15 bp, Homo sapiens
aactcggaagtctta

SEQ ID NO: 265444 - DNA, 15 bp, Homo sapiens
caactcggaagtctt

SEQ ID NO: 265445 - DNA, 15 bp, Homo sapiens
ccaactcggaagtct

SEQ ID NO: 265446 - DNA, 15 bp, Homo sapiens
gccaactcggaagtc

SEQ ID NO: 265447 - DNA, 15 bp, Homo sapiens
tgccaactcggaagt

SEQ ID NO: 265448 - DNA, 15 bp, Homo sapiens
ttgccaactcggaag

SEQ ID NO: 265449 - DNA, 15 bp, Homo sapiens
gttgccaactcggaa

SEQ ID NO: 265450 - DNA, 15 bp, Homo sapiens
tgttgccaactcgga

SEQ ID NO: 265451 - DNA, 15 bp, Homo sapiens
atgttgccaactcgg

SEQ ID NO: 265452 - DNA, 15 bp, Homo sapiens
gatgttgccaactcg

SEQ ID NO: 265453 - DNA, 15 bp, Homo sapiens
tgatgttgccaactc

SEQ ID NO: 265454 - DNA, 15 bp, Homo sapiens
ctgatgttgccaact

SEQ ID NO: 265455 - DNA, 15 bp, Homo sapiens
tctgatgttgccaac

SEQ ID NO: 265456 - DNA, 15 bp, Homo sapiens
ctctgatgttgccaa

SEQ ID NO: 265457 - DNA, 15 bp, Homo sapiens
cctctgatgttgcca

SEQ ID NO: 265458 - DNA, 15 bp, Homo sapiens
tcctctgatgttgcc

SEQ ID NO: 265459 - DNA, 15 bp, Homo sapiens
ctcctctgatgttgc

SEQ ID NO: 265460 - DNA, 15 bp, Homo sapiens
actcctctgatgttg

SEQ ID NO: 265461 - DNA, 15 bp, Homo sapiens
tactcctctgatgtt

SEQ ID NO: 265462 - DNA, 15 bp, Homo sapiens
ttactcctctgatgt

SEQ ID NO: 265463 - DNA, 15 bp, Homo sapiens
tttactcctctgatg

SEQ ID NO: 265464 - DNA, 15 bp, Homo sapiens
atttactcctctgat

SEQ ID NO: 265465 - DNA, 15 bp, Homo sapiens
catttactcctctga

SEQ ID NO: 265466 - DNA, 15 bp, Homo sapiens
tcatttactcctctg

SEQ ID NO: 265467 - DNA, 15 bp, Homo sapiens
ttcatttactcctct

SEQ ID NO: 265468 - DNA, 15 bp, Homo sapiens
cttcatttactcctc

SEQ ID NO: 265469 - DNA, 15 bp, Homo sapiens
acttcatttactcct

SEQ ID NO: 265470 - DNA, 15 bp, Homo sapiens
aacttcatttactcc

SEQ ID NO: 265471 - DNA, 15 bp, Homo sapiens
gaacttcatttactc

SEQ ID NO: 265472 - DNA, 15 bp, Homo sapiens
tgaacttcatttact

SEQ ID NO: 265473 - DNA, 15 bp, Homo sapiens
ttgaacttcatttac

SEQ ID NO: 265474 - DNA, 15 bp, Homo sapiens
tttgaacttcattta

SEQ ID NO: 265475 - DNA, 15 bp, Homo sapiens
ctttgaacttcattt

SEQ ID NO: 265476 - DNA, 15 bp, Homo sapiens
gctttgaacttcatt

SEQ ID NO: 265477 - DNA, 15 bp, Homo sapiens
ggctttgaacttcat

SEQ ID NO: 265478 - DNA, 15 bp, Homo sapiens
gggctttgaacttca

SEQ ID NO: 265479 - DNA, 15 bp, Homo sapiens
agggctttgaacttc

SEQ ID NO: 265480 - DNA, 15 bp, Homo sapiens
aagggctttgaactt

SEQ ID NO: 265481 - DNA, 15 bp, Homo sapiens
gaagggctttgaact

SEQ ID NO: 265482 - DNA, 15 bp, Homo sapiens
agaagggctttgaac

SEQ ID NO: 265483 - DNA, 15 bp, Homo sapiens
cagaagggctttgaa

SEQ ID NO: 265484 - DNA, 15 bp, Homo sapiens
tcagaagggctttga

SEQ ID NO: 265485 - DNA, 15 bp, Homo sapiens
atcagaagggctttg

SEQ ID NO: 265486 - DNA, 15 bp, Homo sapiens
aatcagaagggcttt

SEQ ID NO: 265487 - DNA, 15 bp, Homo sapiens
caatcagaagggctt

SEQ ID NO: 265488 - DNA, 15 bp, Homo sapiens
acaatcagaagggct

SEQ ID NO: 265489 - DNA, 15 bp, Homo sapiens
tacaatcagaagggc

SEQ ID NO: 265490 - DNA, 15 bp, Homo sapiens
ctacaatcagaaggg

SEQ ID NO: 265491 - DNA, 15 bp, Homo sapiens
cctacaatcagaagg

SEQ ID NO: 265492 - DNA, 15 bp, Homo sapiens
ccctacaatcagaag

SEQ ID NO: 265493 - DNA, 15 bp, Homo sapiens
gccctacaatcagaa

SEQ ID NO: 265494 - DNA, 15 bp, Homo sapiens
ggccctacaatcaga

SEQ ID NO: 265495 - DNA, 15 bp, Homo sapiens
gggccctacaatcag

SEQ ID NO: 265496 - DNA, 15 bp, Homo sapiens
agggccctacaatca

SEQ ID NO: 265497 - DNA, 15 bp, Homo sapiens
cagggccctacaatc

SEQ ID NO: 265498 - DNA, 15 bp, Homo sapiens
acagggccctacaat

SEQ ID NO: 265499 - DNA, 15 bp, Homo sapiens
tacagggccctacaa

SEQ ID NO: 265500 - DNA, 15 bp, Homo sapiens
gtacagggccctaca

SEQ ID NO: 265501 - DNA, 15 bp, Homo sapiens
tgtacagggccctac

SEQ ID NO: 265502 - DNA, 15 bp, Homo sapiens
ttgtacagggcccta

SEQ ID NO: 265503 - DNA, 15 bp, Homo sapiens
gttgtacagggccct

SEQ ID NO: 265504 - DNA, 15 bp, Homo sapiens
agttgtacagggccc

SEQ ID NO: 265505 - DNA, 15 bp, Homo sapiens
cagttgtacagggcc

SEQ ID NO: 265506 - DNA, 15 bp, Homo sapiens
gcagttgtacagggc

SEQ ID NO: 265507 - DNA, 15 bp, Homo sapiens
tgcagttgtacaggg

SEQ ID NO: 265508 - DNA, 15 bp, Homo sapiens
atgcagttgtacagg

SEQ ID NO: 265509 - DNA, 15 bp, Homo sapiens
tatgcagttgtacag

SEQ ID NO: 265510 - DNA, 15 bp, Homo sapiens
ttatgcagttgtaca

SEQ ID NO: 265511 - DNA, 15 bp, Homo sapiens
cttatgcagttgtac

SEQ ID NO: 265512 - DNA, 15 bp, Homo sapiens
acttatgcagttgta

SEQ ID NO: 265513 - DNA, 15 bp, Homo sapiens
cacttatgcagttgt

SEQ ID NO: 265514 - DNA, 15 bp, Homo sapiens
gcacttatgcagttg

SEQ ID NO: 265515 - DNA, 15 bp, Homo sapiens
tgcacttatgcagtt

SEQ ID NO: 265516 - DNA, 15 bp, Homo sapiens
ttgcacttatgcagt

SEQ ID NO: 265517 - DNA, 15 bp, Homo sapiens
attgcacttatgcag

SEQ ID NO: 265518 - DNA, 15 bp, Homo sapiens
tattgcacttatgca

SEQ ID NO: 265519 - DNA, 15 bp, Homo sapiens
ctattgcacttatgc

SEQ ID NO: 265520 - DNA, 15 bp, Homo sapiens
actattgcacttatg

SEQ ID NO: 265521 - DNA, 15 bp, Homo sapiens
aactattgcacttat

SEQ ID NO: 265522 - DNA, 15 bp, Homo sapiens
gaactattgcactta

SEQ ID NO: 265523 - DNA, 15 bp, Homo sapiens
tgaactattgcactt

SEQ ID NO: 265524 - DNA, 15 bp, Homo sapiens
ttgaactattgcact

SEQ ID NO: 265525 - DNA, 15 bp, Homo sapiens
tttgaactattgcac

SEQ ID NO: 265526 - DNA, 15 bp, Homo sapiens
ctttgaactattgca

SEQ ID NO: 265527 - DNA, 15 bp, Homo sapiens
gctttgaactattgc

SEQ ID NO: 265528 - DNA, 15 bp, Homo sapiens
ggctttgaactattg

SEQ ID NO: 265529 - DNA, 15 bp, Homo sapiens
gggctttgaactatt

SEQ ID NO: 265530 - DNA, 15 bp, Homo sapiens
agggctttgaactat

SEQ ID NO: 265531 - DNA, 15 bp, Homo sapiens
aagggctttgaacta

SEQ ID NO: 265532 - DNA, 15 bp, Homo sapiens
atattgcacttatgc

SEQ ID NO: 265533 - DNA, 15 bp, Homo sapiens
gatattgcacttatg

SEQ ID NO: 265534 - DNA, 15 bp, Homo sapiens
agatattgcacttat

SEQ ID NO: 265535 - DNA, 15 bp, Homo sapiens
aagatattgcactta

SEQ ID NO: 265536 - DNA, 15 bp, Homo sapiens
aaagatattgcactt

SEQ ID NO: 265537 - DNA, 15 bp, Homo sapiens
caaagatattgcact

SEQ ID NO: 265538 - DNA, 15 bp, Homo sapiens
tcaaagatattgcac

SEQ ID NO: 265539 - DNA, 15 bp, Homo sapiens
ttcaaagatattgca

SEQ ID NO: 265540 - DNA, 15 bp, Homo sapiens
cttcaaagatattgc

SEQ ID NO: 265541 - DNA, 15 bp, Homo sapiens
gcttcaaagatattg

SEQ ID NO: 265542 - DNA, 15 bp, Homo sapiens
agcttcaaagatatt

SEQ ID NO: 265543 - DNA, 15 bp, Homo sapiens
gagcttcaaagatat

SEQ ID NO: 265544 - DNA, 15 bp, Homo sapiens
tgagcttcaaagata

SEQ ID NO: 265545 - DNA, 15 bp, Homo sapiens
gtgagcttcaaagat

SEQ ID NO: 265546 - DNA, 15 bp, Homo sapiens
ggtgagcttcaaaga

SEQ ID NO: 265547 - DNA, 15 bp, Homo sapiens
gggtgagcttcaaag

SEQ ID NO: 265548 - DNA, 15 bp, Homo sapiens
agggtgagcttcaaa

SEQ ID NO: 265549 - DNA, 15 bp, Homo sapiens
cagggtgagcttcaa

SEQ ID NO: 265550 - DNA, 15 bp, Homo sapiens
tcagggtgagcttca

SEQ ID NO: 265551 - DNA, 15 bp, Homo sapiens
ctcagggtgagcttc

SEQ ID NO: 265552 - DNA, 15 bp, Homo sapiens
cctcagggtgagctt

SEQ ID NO: 265553 - DNA, 15 bp, Homo sapiens
gcctcagggtgagct

SEQ ID NO: 265554 - DNA, 15 bp, Homo sapiens
agcctcagggtgagc

SEQ ID NO: 265555 - DNA, 15 bp, Homo sapiens
cagcctcagggtgag

SEQ ID NO: 265556 - DNA, 15 bp, Homo sapiens
ccagcctcagggtga

SEQ ID NO: 265557 - DNA, 15 bp, Homo sapiens
cccagcctcagggtg

SEQ ID NO: 265558 - DNA, 15 bp, Homo sapiens
tcccagcctcagggt

SEQ ID NO: 265559 - DNA, 15 bp, Homo sapiens
ttcccagcctcaggg

SEQ ID NO: 265560 - DNA, 15 bp, Homo sapiens
tttcccagcctcagg

SEQ ID NO: 265561 - DNA, 15 bp, Homo sapiens
ctttcccagcctcag

SEQ ID NO: 265562 - DNA, 15 bp, Homo sapiens
tctttcccagcctca

SEQ ID NO: 265563 - DNA, 15 bp, Homo sapiens
ctctttcccagcctc

SEQ ID NO: 265564 - DNA, 15 bp, Homo sapiens
acctctttcccagcc

SEQ ID NO: 265565 - DNA, 15 bp, Homo sapiens
cacctctttcccagc

SEQ ID NO: 265566 - DNA, 15 bp, Homo sapiens
ccacctctttcccag

SEQ ID NO: 265567 - DNA, 15 bp, Homo sapiens
cccacctctttccca

SEQ ID NO: 265568 - DNA, 15 bp, Homo sapiens
acccacctctttccc

SEQ ID NO: 265569 - DNA, 15 bp, Homo sapiens
cacccacctctttcc

SEQ ID NO: 265570 - DNA, 15 bp, Homo sapiens
acacccacctctttc

SEQ ID NO: 265571 - DNA, 15 bp, Homo sapiens
tacacccacctcttt

SEQ ID NO: 265572 - DNA, 15 bp, Homo sapiens
ttacacccacctctt

SEQ ID NO: 265573 - DNA, 15 bp, Homo sapiens
gttacacccacctct

SEQ ID NO: 265574 - DNA, 15 bp, Homo sapiens
ggttacacccacctc

SEQ ID NO: 265575 - DNA, 15 bp, Homo sapiens
tggttacacccacct

SEQ ID NO: 265576 - DNA, 15 bp, Homo sapiens
ctggttacacccacc

SEQ ID NO: 265577 - DNA, 15 bp, Homo sapiens
cctggttacacccac

SEQ ID NO: 265578 - DNA, 15 bp, Homo sapiens
ccctggttacaccca

SEQ ID NO: 265579 - DNA, 15 bp, Homo sapiens
tccctggttacaccc

SEQ ID NO: 265580 - DNA, 15 bp, Homo sapiens
ttccctggttacacc

SEQ ID NO: 265581 - DNA, 15 bp, Homo sapiens
gttccctggttacac

SEQ ID NO: 265582 - DNA, 15 bp, Homo sapiens
tgttccctggttaca

SEQ ID NO: 265583 - DNA, 15 bp, Homo sapiens
ctgttccctggttac

SEQ ID NO: 265584 - DNA, 15 bp, Homo sapiens
tctgttccctggtta

SEQ ID NO: 265585 - DNA, 15 bp, Homo sapiens
ttctgttccctggtt

SEQ ID NO: 265586 - DNA, 15 bp, Homo sapiens
tttctgttccctggt

SEQ ID NO: 265587 - DNA, 15 bp, Homo sapiens
ctttctgttccctgg

SEQ ID NO: 265588 - DNA, 15 bp, Homo sapiens
tctttctgttccctg

SEQ ID NO: 265589 - DNA, 15 bp, Homo sapiens
ttctttctgttccct

SEQ ID NO: 265590 - DNA, 15 bp, Homo sapiens
tttctttctgttccc

SEQ ID NO: 265591 - DNA, 15 bp, Homo sapiens
gtttctttctgttcc

SEQ ID NO: 265592 - DNA, 15 bp, Homo sapiens
ggtttctttctgttc

SEQ ID NO: 265593 - DNA, 15 bp, Homo sapiens
tggtttctttctgtt

SEQ ID NO: 265594 - DNA, 15 bp, Homo sapiens
ctggtttctttctgt

SEQ ID NO: 265595 - DNA, 15 bp, Homo sapiens
cctggtttctttctg

SEQ ID NO: 265596 - DNA, 15 bp, Homo sapiens
tcctggtttctttct

SEQ ID NO: 265597 - DNA, 15 bp, Homo sapiens
gtcctggtttctttc

SEQ ID NO: 265598 - DNA, 15 bp, Homo sapiens
tgtcctggtttcttt

SEQ ID NO: 265599 - DNA, 15 bp, Homo sapiens
ttgtcctggtttctt

SEQ ID NO: 265600 - DNA, 15 bp, Homo sapiens
tttgtcctggtttct

SEQ ID NO: 265601 - DNA, 15 bp, Homo sapiens
atttgtcctggtttc

SEQ ID NO: 265602 - DNA, 15 bp, Homo sapiens
aatttgtcctggttt

SEQ ID NO: 265603 - DNA, 15 bp, Homo sapiens
aaatttgtcctggtt

SEQ ID NO: 265604 - DNA, 15 bp, Homo sapiens
caaatttgtcctggt

SEQ ID NO: 265605 - DNA, 15 bp, Homo sapiens
tcaaatttgtcctgg

SEQ ID NO: 265606 - DNA, 15 bp, Homo sapiens
gtcaaatttgtcctg

SEQ ID NO: 265607 - DNA, 15 bp, Homo sapiens
tgtcaaatttgtcct

SEQ ID NO: 265608 - DNA, 15 bp, Homo sapiens
ttgtcaaatttgtcc

SEQ ID NO: 265609 - DNA, 15 bp, Homo sapiens
tttgtcaaatttgtc

SEQ ID NO: 265610 - DNA, 15 bp, Homo sapiens
ttttgtcaaatttgt

SEQ ID NO: 265611 - DNA, 15 bp, Homo sapiens
cttttgtcaaatttg

SEQ ID NO: 265612 - DNA, 15 bp, Homo sapiens
tcttttgtcaaattt

SEQ ID NO: 265613 - DNA, 15 bp, Homo sapiens
ctcttttgtcaaatt

SEQ ID NO: 265614 - DNA, 15 bp, Homo sapiens
tctcttttgtcaaat

SEQ ID NO: 265615 - DNA, 15 bp, Homo sapiens
ctctcttttgtcaaa

SEQ ID NO: 265616 - DNA, 15 bp, Homo sapiens
tctctcttttgtcaa

SEQ ID NO: 265617 - DNA, 15 bp, Homo sapiens
gtctctcttttgtca

SEQ ID NO: 265618 - DNA, 15 bp, Homo sapiens
tgtctctcttttgtc

SEQ ID NO: 265619 - DNA, 15 bp, Homo sapiens
ttgtctctcttttgt

SEQ ID NO: 265620 - DNA, 15 bp, Homo sapiens
attgtctctcttttg

SEQ ID NO: 265621 - DNA, 15 bp, Homo sapiens
tattgtctctctttt

SEQ ID NO: 265622 - DNA, 15 bp, Homo sapiens
ctattgtctctcttt

SEQ ID NO: 265623 - DNA, 15 bp, Homo sapiens
actattgtctctctt

SEQ ID NO: 265624 - DNA, 15 bp, Homo sapiens
tactattgtctctct

SEQ ID NO: 265625 - DNA, 15 bp, Homo sapiens
ctactattgtctctc

SEQ ID NO: 265626 - DNA, 15 bp, Homo sapiens
cctactattgtctct

SEQ ID NO: 265627 - DNA, 15 bp, Homo sapiens
tcctactattgtctc

SEQ ID NO: 265628 - DNA, 15 bp, Homo sapiens
ctcctactattgtct

SEQ ID NO: 265629 - DNA, 15 bp, Homo sapiens
tctcctactattgtc

SEQ ID NO: 265630 - DNA, 15 bp, Homo sapiens
atctcctactattgt

SEQ ID NO: 265631 - DNA, 15 bp, Homo sapiens
catctcctactattg

SEQ ID NO: 265632 - DNA, 15 bp, Homo sapiens
ccatctcctactatt

SEQ ID NO: 265633 - DNA, 15 bp, Homo sapiens
tccatctcctactat

SEQ ID NO: 265634 - DNA, 15 bp, Homo sapiens
ttccatctcctacta

SEQ ID NO: 265635 - DNA, 15 bp, Homo sapiens
attccatctcctact

SEQ ID NO: 265636 - DNA, 15 bp, Homo sapiens
aattccatctcctac

SEQ ID NO: 265637 - DNA, 15 bp, Homo sapiens
taattccatctccta

SEQ ID NO: 265638 - DNA, 15 bp, Homo sapiens
ttaattccatctcct

SEQ ID NO: 265639 - DNA, 15 bp, Homo sapiens
tttaattccatctcc

SEQ ID NO: 265640 - DNA, 15 bp, Homo sapiens
ttttaattccatctc

SEQ ID NO: 265641 - DNA, 15 bp, Homo sapiens
tttttaattccatct

SEQ ID NO: 265642 - DNA, 15 bp, Homo sapiens
ctttttaattccatc

SEQ ID NO: 265643 - DNA, 15 bp, Homo sapiens
tctttttaattccat

SEQ ID NO: 265644 - DNA, 15 bp, Homo sapiens
ttctttttaattcca

SEQ ID NO: 265645 - DNA, 15 bp, Homo sapiens
tttctttttaattcc

SEQ ID NO: 265646 - DNA, 15 bp, Homo sapiens
ctttctttttaattc

SEQ ID NO: 265647 - DNA, 15 bp, Homo sapiens
cctttctttttaatt

SEQ ID NO: 265648 - DNA, 15 bp, Homo sapiens
gcctttctttttaat

SEQ ID NO: 265649 - DNA, 15 bp, Homo sapiens
tgcctttctttttaa

SEQ ID NO: 265650 - DNA, 15 bp, Homo sapiens
ttgcctttcttttta

SEQ ID NO: 265651 - DNA, 15 bp, Homo sapiens
gttgcctttcttttt

SEQ ID NO: 265652 - DNA, 15 bp, Homo sapiens
agttgcctttctttt

SEQ ID NO: 265653 - DNA, 15 bp, Homo sapiens
tagttgcctttcttt

SEQ ID NO: 265654 - DNA, 15 bp, Homo sapiens
atagttgcctttctt

SEQ ID NO: 265655 - DNA, 15 bp, Homo sapiens
gatagttgcctttct

SEQ ID NO: 265656 - DNA, 15 bp, Homo sapiens
tgatagttgcctttc

SEQ ID NO: 265657 - DNA, 15 bp, Homo sapiens
ctgatagttgccttt

SEQ ID NO: 265658 - DNA, 15 bp, Homo sapiens
tctgatagttgcctt

SEQ ID NO: 265659 - DNA, 15 bp, Homo sapiens
atctgatagttgcct

SEQ ID NO: 265660 - DNA, 15 bp, Homo sapiens
aatctgatagttgcc

SEQ ID NO: 265661 - DNA, 15 bp, Homo sapiens
caatctgatagttgc

SEQ ID NO: 265662 - DNA, 15 bp, Homo sapiens
acaatctgatagttg

SEQ ID NO: 265663 - DNA, 15 bp, Homo sapiens
tacaatctgatagtt

SEQ ID NO: 265664 - DNA, 15 bp, Homo sapiens
atacaatctgatagt

SEQ ID NO: 265665 - DNA, 15 bp, Homo sapiens
tatacaatctgatag

SEQ ID NO: 265666 - DNA, 15 bp, Homo sapiens
ctatacaatctgata

SEQ ID NO: 265667 - DNA, 15 bp, Homo sapiens
tctatacaatctgat

SEQ ID NO: 265668 - DNA, 15 bp, Homo sapiens
ttctatacaatctga

SEQ ID NO: 265669 - DNA, 15 bp, Homo sapiens
gttctatacaatctg

SEQ ID NO: 265670 - DNA, 15 bp, Homo sapiens
ggttctatacaatct

SEQ ID NO: 265671 - DNA, 15 bp, Homo sapiens
gggttctatacaatc

SEQ ID NO: 265672 - DNA, 15 bp, Homo sapiens
agggttctatacaat

SEQ ID NO: 265673 - DNA, 15 bp, Homo sapiens
cagggttctatacaa

SEQ ID NO: 265674 - DNA, 15 bp, Homo sapiens
ccagggttctataca

SEQ ID NO: 265675 - DNA, 15 bp, Homo sapiens
cccagggttctatac

SEQ ID NO: 265676 - DNA, 15 bp, Homo sapiens
ccccagggttctata

SEQ ID NO: 265677 - DNA, 15 bp, Homo sapiens
tccccagggttctat

SEQ ID NO: 265678 - DNA, 15 bp, Homo sapiens
atccccagggttcta

SEQ ID NO: 265679 - DNA, 15 bp, Homo sapiens
gatccccagggttct

SEQ ID NO: 265680 - DNA, 15 bp, Homo sapiens
tgatccccagggttc

SEQ ID NO: 265681 - DNA, 15 bp, Homo sapiens
atgatccccagggtt

SEQ ID NO: 265682 - DNA, 15 bp, Homo sapiens
aatgatccccagggt

SEQ ID NO: 265683 - DNA, 15 bp, Homo sapiens
caatgatccccaggg

SEQ ID NO: 265684 - DNA, 15 bp, Homo sapiens
acaatgatccccagg

SEQ ID NO: 265685 - DNA, 15 bp, Homo sapiens
tacaatgatccccag

SEQ ID NO: 265686 - DNA, 15 bp, Homo sapiens
ttacaatgatcccca

SEQ ID NO: 265687 - DNA, 15 bp, Homo sapiens
cttacaatgatcccc

SEQ ID NO: 265688 - DNA, 15 bp, Homo sapiens
ccttacaatgatccc

SEQ ID NO: 265689 - DNA, 15 bp, Homo sapiens
tccttacaatgatcc

SEQ ID NO: 265690 - DNA, 15 bp, Homo sapiens
ttccttacaatgatc

SEQ ID NO: 265691 - DNA, 15 bp, Homo sapiens
attccttacaatgat

SEQ ID NO: 265692 - DNA, 15 bp, Homo sapiens
aattccttacaatga

SEQ ID NO: 265693 - DNA, 15 bp, Homo sapiens
aaattccttacaatg

SEQ ID NO: 265694 - DNA, 15 bp, Homo sapiens
caaattccttacaat

SEQ ID NO: 265695 - DNA, 15 bp, Homo sapiens
ccaaattccttacaa

SEQ ID NO: 265696 - DNA, 15 bp, Homo sapiens
tccaaattccttaca

SEQ ID NO: 265697 - DNA, 15 bp, Homo sapiens
atccaaattccttac

SEQ ID NO: 265698 - DNA, 15 bp, Homo sapiens
aatccaaattcctta

SEQ ID NO: 265699 - DNA, 15 bp, Homo sapiens
caatccaaattcctt

SEQ ID NO: 265700 - DNA, 15 bp, Homo sapiens
ccaatccaaattcct

SEQ ID NO: 265701 - DNA, 15 bp, Homo sapiens
cccaatccaaattcc

SEQ ID NO: 265702 - DNA, 15 bp, Homo sapiens
ccccaatccaaattc

SEQ ID NO: 265703 - DNA, 15 bp, Homo sapiens
cccccaatccaaatt

SEQ ID NO: 265704 - DNA, 15 bp, Homo sapiens
tcccccaatccaaat

SEQ ID NO: 265705 - DNA, 15 bp, Homo sapiens
ttcccccaatccaaa

SEQ ID NO: 265706 - DNA, 15 bp, Homo sapiens
tttcccccaatccaa

SEQ ID NO: 265707 - DNA, 15 bp, Homo sapiens
ttttcccccaatcca

SEQ ID NO: 265708 - DNA, 15 bp, Homo sapiens
attttcccccaatcc

SEQ ID NO: 265709 - DNA, 15 bp, Homo sapiens
tattttcccccaatc

SEQ ID NO: 265710 - DNA, 15 bp, Homo sapiens
atattttcccccaat

SEQ ID NO: 265711 - DNA, 15 bp, Homo sapiens
gatattttcccccaa

SEQ ID NO: 265712 - DNA, 15 bp, Homo sapiens
tgatattttccccca

SEQ ID NO: 265713 - DNA, 15 bp, Homo sapiens
atgatattttccccc

SEQ ID NO: 265714 - DNA, 15 bp, Homo sapiens
tatgatattttcccc

SEQ ID NO: 265715 - DNA, 15 bp, Homo sapiens
ctatgatattttccc

SEQ ID NO: 265716 - DNA, 15 bp, Homo sapiens
actatgatattttcc

SEQ ID NO: 265717 - DNA, 15 bp, Homo sapiens
tactatgatattttc

SEQ ID NO: 265718 - DNA, 15 bp, Homo sapiens
ttactatgatatttt

SEQ ID NO: 265719 - DNA, 15 bp, Homo sapiens
attactatgatattt

SEQ ID NO: 265720 - DNA, 15 bp, Homo sapiens
tattactatgatatt

SEQ ID NO: 265721 - DNA, 15 bp, Homo sapiens
atattactatgatat

SEQ ID NO: 265722 - DNA, 15 bp, Homo sapiens
aatattactatgata

SEQ ID NO: 265723 - DNA, 15 bp, Homo sapiens
aaatattactatgat

SEQ ID NO: 265724 - DNA, 15 bp, Homo sapiens
taaatattactatga

SEQ ID NO: 265725 - DNA, 15 bp, Homo sapiens
gtaaatattactatg

SEQ ID NO: 265726 - DNA, 15 bp, Homo sapiens
tgtaaatattactat

SEQ ID NO: 265727 - DNA, 15 bp, Homo sapiens
atgtaaatattacta

SEQ ID NO: 265728 - DNA, 15 bp, Homo sapiens
catgtaaatattact

SEQ ID NO: 265729 - DNA, 15 bp, Homo sapiens
tcatgtaaatattac

SEQ ID NO: 265730 - DNA, 15 bp, Homo sapiens
ttcatgtaaatatta

SEQ ID NO: 265731 - DNA, 15 bp, Homo sapiens
attcatgtaaatatt

SEQ ID NO: 265732 - DNA, 15 bp, Homo sapiens
ctattcatgtaaata

SEQ ID NO: 265733 - DNA, 15 bp, Homo sapiens
gctattcatgtaaat

SEQ ID NO: 265734 - DNA, 15 bp, Homo sapiens
agctattcatgtaaa

SEQ ID NO: 265735 - DNA, 15 bp, Homo sapiens
tagctattcatgtaa

SEQ ID NO: 265736 - DNA, 15 bp, Homo sapiens
atagctattcatgta

SEQ ID NO: 265737 - DNA, 15 bp, Homo sapiens
aatagctattcatgt

SEQ ID NO: 265738 - DNA, 15 bp, Homo sapiens
taatagctattcatg

SEQ ID NO: 265739 - DNA, 15 bp, Homo sapiens
ataatagctattcat

SEQ ID NO: 265740 - DNA, 15 bp, Homo sapiens
tataatagctattca

SEQ ID NO: 265741 - DNA, 15 bp, Homo sapiens
ctataatagctattc

SEQ ID NO: 265742 - DNA, 15 bp, Homo sapiens
tctataatagctatt

SEQ ID NO: 265743 - DNA, 15 bp, Homo sapiens
ttctataatagctat

SEQ ID NO: 265744 - DNA, 15 bp, Homo sapiens
cttctataatagcta

SEQ ID NO: 265745 - DNA, 15 bp, Homo sapiens
acttctataatagct

SEQ ID NO: 265746 - DNA, 15 bp, Homo sapiens
aacttctataatagc

SEQ ID NO: 265747 - DNA, 15 bp, Homo sapiens
aaacttctataatag

SEQ ID NO: 265748 - DNA, 15 bp, Homo sapiens
taaacttctataata

SEQ ID NO: 265749 - DNA, 15 bp, Homo sapiens
ctaaacttctataat

SEQ ID NO: 265750 - DNA, 15 bp, Homo sapiens
tctaaacttctataa

SEQ ID NO: 265751 - DNA, 15 bp, Homo sapiens
ttctaaacttctata

SEQ ID NO: 265752 - DNA, 15 bp, Homo sapiens
tttctaaacttctat

SEQ ID NO: 265753 - DNA, 15 bp, Homo sapiens
ttttctaaacttcta

SEQ ID NO: 265754 - DNA, 15 bp, Homo sapiens
gttttctaaacttct

SEQ ID NO: 265755 - DNA, 15 bp, Homo sapiens
agttttctaaacttc

SEQ ID NO: 265756 - DNA, 15 bp, Homo sapiens
cagttttctaaactt

SEQ ID NO: 265757 - DNA, 15 bp, Homo sapiens
tcagttttctaaact

SEQ ID NO: 265758 - DNA, 15 bp, Homo sapiens
atcagttttctaaac

SEQ ID NO: 265759 - DNA, 15 bp, Homo sapiens
aatcagttttctaaa

SEQ ID NO: 265760 - DNA, 15 bp, Homo sapiens
taatcagttttctaa

SEQ ID NO: 265761 - DNA, 15 bp, Homo sapiens
ataatcagttttcta

SEQ ID NO: 265762 - DNA, 15 bp, Homo sapiens
tataatcagttttct

SEQ ID NO: 265763 - DNA, 15 bp, Homo sapiens
ttataatcagttttc

SEQ ID NO: 265764 - DNA, 15 bp, Homo sapiens
tttataatcagtttt

SEQ ID NO: 265765 - DNA, 15 bp, Homo sapiens
ttttataatcagttt

SEQ ID NO: 265766 - DNA, 15 bp, Homo sapiens
attttataatcagtt

SEQ ID NO: 265767 - DNA, 15 bp, Homo sapiens
cattttataatcagt

SEQ ID NO: 265768 - DNA, 15 bp, Homo sapiens
gcattttataatcag

SEQ ID NO: 265769 - DNA, 15 bp, Homo sapiens
agcattttataatca

SEQ ID NO: 265770 - DNA, 15 bp, Homo sapiens
tagcattttataatc

SEQ ID NO: 265771 - DNA, 15 bp, Homo sapiens
ctagcattttataat

SEQ ID NO: 265772 - DNA, 15 bp, Homo sapiens
actagcattttataa

SEQ ID NO: 265773 - DNA, 15 bp, Homo sapiens
tactagcattttata

SEQ ID NO: 265774 - DNA, 15 bp, Homo sapiens
atactagcattttat

SEQ ID NO: 265775 - DNA, 15 bp, Homo sapiens
gatactagcatttta

SEQ ID NO: 265776 - DNA, 15 bp, Homo sapiens
tgatactagcatttt

SEQ ID NO: 265777 - DNA, 15 bp, Homo sapiens
ttgatactagcattt

SEQ ID NO: 265778 - DNA, 15 bp, Homo sapiens
tttgatactagcatt

SEQ ID NO: 265779 - DNA, 15 bp, Homo sapiens
ttttgatactagcat

SEQ ID NO: 265780 - DNA, 15 bp, Homo sapiens
attttgatactagca

SEQ ID NO: 265781 - DNA, 15 bp, Homo sapiens
tattttgatactagc

SEQ ID NO: 265782 - DNA, 15 bp, Homo sapiens
atattttgatactag

SEQ ID NO: 265783 - DNA, 15 bp, Homo sapiens
gatattttgatacta

SEQ ID NO: 265784 - DNA, 15 bp, Homo sapiens
tgatattttgatact

SEQ ID NO: 265785 - DNA, 15 bp, Homo sapiens
atgatattttgatac

SEQ ID NO: 265786 - DNA, 15 bp, Homo sapiens
tatgatattttgata

SEQ ID NO: 265787 - DNA, 15 bp, Homo sapiens
ttatgatattttgat

SEQ ID NO: 265788 - DNA, 15 bp, Homo sapiens
tttatgatattttga

SEQ ID NO: 265789 - DNA, 15 bp, Homo sapiens
ctttatgatattttg

SEQ ID NO: 265790 - DNA, 15 bp, Homo sapiens
actttatgatatttt

SEQ ID NO: 265791 - DNA, 15 bp, Homo sapiens
tactttatgatattt

SEQ ID NO: 265792 - DNA, 15 bp, Homo sapiens
ttactttatgatatt

SEQ ID NO: 265793 - DNA, 15 bp, Homo sapiens
tttactttatgatat

SEQ ID NO: 265794 - DNA, 15 bp, Homo sapiens
tatttactttatgat

SEQ ID NO: 265795 - DNA, 15 bp, Homo sapiens
atatttactttatga

SEQ ID NO: 265796 - DNA, 15 bp, Homo sapiens
tatatttactttatg

SEQ ID NO: 265797 - DNA, 15 bp, Homo sapiens
atatatttactttat

SEQ ID NO: 265798 - DNA, 15 bp, Homo sapiens
catatatttacttta

SEQ ID NO: 265799 - DNA, 15 bp, Homo sapiens
acatatatttacttt

SEQ ID NO: 265800 - DNA, 15 bp, Homo sapiens
aacatatatttactt

SEQ ID NO: 265801 - DNA, 15 bp, Homo sapiens
caacatatatttact

SEQ ID NO: 265802 - DNA, 15 bp, Homo sapiens
acaacatatatttac

SEQ ID NO: 265803 - DNA, 15 bp, Homo sapiens
aacaacatatattta

SEQ ID NO: 265804 - DNA, 15 bp, Homo sapiens
taacaacatatattt

SEQ ID NO: 265805 - DNA, 15 bp, Homo sapiens
ataacaacatatatt

SEQ ID NO: 265806 - DNA, 15 bp, Homo sapiens
tataacaacatatat

SEQ ID NO: 265807 - DNA, 15 bp, Homo sapiens
ctataacaacatata

SEQ ID NO: 265808 - DNA, 15 bp, Homo sapiens
actataacaacatat

SEQ ID NO: 265809 - DNA, 15 bp, Homo sapiens
tactataacaacata

SEQ ID NO: 265810 - DNA, 15 bp, Homo sapiens
ttactataacaacat

SEQ ID NO: 265811 - DNA, 15 bp, Homo sapiens
tttactataacaaca

SEQ ID NO: 265812 - DNA, 15 bp, Homo sapiens
ctttactataacaac

SEQ ID NO: 265813 - DNA, 15 bp, Homo sapiens
tctttactataacaa

SEQ ID NO: 265814 - DNA, 15 bp, Homo sapiens
atctttactataaca

SEQ ID NO: 265815 - DNA, 15 bp, Homo sapiens
tatctttactataac

SEQ ID NO: 265816 - DNA, 15 bp, Homo sapiens
atatctttactataa

SEQ ID NO: 265817 - DNA, 15 bp, Homo sapiens
tatatctttactata

SEQ ID NO: 265818 - DNA, 15 bp, Homo sapiens
atatatctttactat

SEQ ID NO: 265819 - DNA, 15 bp, Homo sapiens
tatatatctttacta

SEQ ID NO: 265820 - DNA, 15 bp, Homo sapiens
ttatatatctttact

SEQ ID NO: 265821 - DNA, 15 bp, Homo sapiens
tttatatatctttac

SEQ ID NO: 265822 - DNA, 15 bp, Homo sapiens
ttttatatatcttta

SEQ ID NO: 265823 - DNA, 15 bp, Homo sapiens
attttatatatcttt

SEQ ID NO: 265824 - DNA, 15 bp, Homo sapiens
aattttatatatctt

SEQ ID NO: 265825 - DNA, 15 bp, Homo sapiens
taattttatatatct

SEQ ID NO: 265826 - DNA, 15 bp, Homo sapiens
gtaattttatatatc

SEQ ID NO: 265827 - DNA, 15 bp, Homo sapiens
agtaattttatatat

SEQ ID NO: 265828 - DNA, 15 bp, Homo sapiens
tagtaattttatata

SEQ ID NO: 265829 - DNA, 15 bp, Homo sapiens
atagtaattttatat

SEQ ID NO: 265830 - DNA, 15 bp, Homo sapiens
aatagtaattttata

SEQ ID NO: 265831 - DNA, 15 bp, Homo sapiens
aaatagtaattttat

SEQ ID NO: 265832 - DNA, 15 bp, Homo sapiens
aaaatagtaatttta

SEQ ID NO: 265833 - DNA, 15 bp, Homo sapiens
aaaaatagtaatttt

SEQ ID NO: 265834 - DNA, 15 bp, Homo sapiens
gaaaaatagtaattt

SEQ ID NO: 265835 - DNA, 15 bp, Homo sapiens
agaaaaatagtaatt

SEQ ID NO: 265836 - DNA, 15 bp, Homo sapiens
aagaaaaatagtaat

SEQ ID NO: 265837 - DNA, 15 bp, Homo sapiens
caagaaaaatagtaa

SEQ ID NO: 265838 - DNA, 15 bp, Homo sapiens
ccaagaaaaatagta

SEQ ID NO: 265839 - DNA, 15 bp, Homo sapiens
accaagaaaaatagt

SEQ ID NO: 265840 - DNA, 15 bp, Homo sapiens
gaccaagaaaaatag

SEQ ID NO: 265841 - DNA, 15 bp, Homo sapiens
agaccaagaaaaata

SEQ ID NO: 265842 - DNA, 15 bp, Homo sapiens
aagaccaagaaaaat

SEQ ID NO: 265843 - DNA, 15 bp, Homo sapiens
caagaccaagaaaaa

SEQ ID NO: 265844 - DNA, 15 bp, Homo sapiens
tcaagaccaagaaaa

SEQ ID NO: 265845 - DNA, 15 bp, Homo sapiens
ttcaagaccaagaaa

SEQ ID NO: 265846 - DNA, 15 bp, Homo sapiens
gttcaagaccaagaa

SEQ ID NO: 265847 - DNA, 15 bp, Homo sapiens
tgttcaagaccaaga

SEQ ID NO: 265848 - DNA, 15 bp, Homo sapiens
atgttcaagaccaag

SEQ ID NO: 265849 - DNA, 15 bp, Homo sapiens
tatgttcaagaccaa

SEQ ID NO: 265850 - DNA, 15 bp, Homo sapiens
atatgttcaagacca

SEQ ID NO: 265851 - DNA, 15 bp, Homo sapiens
tatatgttcaagacc

SEQ ID NO: 265852 - DNA, 15 bp, Homo sapiens
ttatatgttcaagac

SEQ ID NO: 265853 - DNA, 15 bp, Homo sapiens
attatatgttcaaga

SEQ ID NO: 265854 - DNA, 15 bp, Homo sapiens
tattatatgttcaag

SEQ ID NO: 265855 - DNA, 15 bp, Homo sapiens
ttattatatgttcaa

SEQ ID NO: 265856 - DNA, 15 bp, Homo sapiens
attattatatgttca

SEQ ID NO: 265857 - DNA, 15 bp, Homo sapiens
aattattatatgttc

SEQ ID NO: 265858 - DNA, 15 bp, Homo sapiens
gaattattatatgtt

SEQ ID NO: 265859 - DNA, 15 bp, Homo sapiens
agaattattatatgt

SEQ ID NO: 265860 - DNA, 15 bp, Homo sapiens
aagaattattatatg

SEQ ID NO: 265861 - DNA, 15 bp, Homo sapiens
taagaattattatat

SEQ ID NO: 265862 - DNA, 15 bp, Homo sapiens
ttaagaattattata

SEQ ID NO: 265863 - DNA, 15 bp, Homo sapiens
attaagaattattat

SEQ ID NO: 265864 - DNA, 15 bp, Homo sapiens
cattaagaattatta

SEQ ID NO: 265865 - DNA, 15 bp, Homo sapiens
ccattaagaattatt

SEQ ID NO: 265866 - DNA, 15 bp, Homo sapiens
gccattaagaattat

SEQ ID NO: 265867 - DNA, 15 bp, Homo sapiens
agccattaagaatta

SEQ ID NO: 265868 - DNA, 15 bp, Homo sapiens
aagccattaagaatt

SEQ ID NO: 265869 - DNA, 15 bp, Homo sapiens
aaagccattaagaat

SEQ ID NO: 265870 - DNA, 15 bp, Homo sapiens
taaagccattaagaa

SEQ ID NO: 265871 - DNA, 15 bp, Homo sapiens
gtaaagccattaaga

SEQ ID NO: 265872 - DNA, 15 bp, Homo sapiens
tgtaaagccattaag

SEQ ID NO: 265873 - DNA, 15 bp, Homo sapiens
ttgtaaagccattaa

SEQ ID NO: 265874 - DNA, 15 bp, Homo sapiens
tttgtaaagccatta

SEQ ID NO: 265875 - DNA, 15 bp, Homo sapiens
ttttgtaaagccatt

SEQ ID NO: 265876 - DNA, 15 bp, Homo sapiens
attttgtaaagccat

SEQ ID NO: 265877 - DNA, 15 bp, Homo sapiens
tattttgtaaagcca

SEQ ID NO: 265878 - DNA, 15 bp, Homo sapiens
gtattttgtaaagcc

SEQ ID NO: 265879 - DNA, 15 bp, Homo sapiens
ggtattttgtaaagc

SEQ ID NO: 265880 - DNA, 15 bp, Homo sapiens
aggtattttgtaaag

SEQ ID NO: 265881 - DNA, 15 bp, Homo sapiens
taggtattttgtaaa

SEQ ID NO: 265882 - DNA, 15 bp, Homo sapiens
ttaggtattttgtaa

SEQ ID NO: 265883 - DNA, 15 bp, Homo sapiens
tttaggtattttgta

SEQ ID NO: 265884 - DNA, 15 bp, Homo sapiens
gtttaggtattttgt

SEQ ID NO: 265885 - DNA, 15 bp, Homo sapiens
tgtttaggtattttg

SEQ ID NO: 265886 - DNA, 15 bp, Homo sapiens
ttgtttaggtatttt

SEQ ID NO: 265887 - DNA, 15 bp, Homo sapiens
attgtttaggtattt

SEQ ID NO: 265888 - DNA, 15 bp, Homo sapiens
aattgtttaggtatt

SEQ ID NO: 265889 - DNA, 15 bp, Homo sapiens
aaattgtttaggtat

SEQ ID NO: 265890 - DNA, 15 bp, Homo sapiens
caaattgtttaggta

SEQ ID NO: 265891 - DNA, 15 bp, Homo sapiens
tcaaattgtttaggt

SEQ ID NO: 265892 - DNA, 15 bp, Homo sapiens
ttcaaattgtttagg

SEQ ID NO: 265893 - DNA, 15 bp, Homo sapiens
tttcaaattgtttag

SEQ ID NO: 265894 - DNA, 15 bp, Homo sapiens
gtttcaaattgttta

SEQ ID NO: 265895 - DNA, 15 bp, Homo sapiens
ggtttcaaattgttt

SEQ ID NO: 265896 - DNA, 15 bp, Homo sapiens
gggtttcaaattgtt

SEQ ID NO: 265897 - DNA, 15 bp, Homo sapiens
tgggtttcaaattgt

SEQ ID NO: 265898 - DNA, 15 bp, Homo sapiens
gtgggtttcaaattg

SEQ ID NO: 265899 - DNA, 15 bp, Homo sapiens
tgtgggtttcaaatt

SEQ ID NO: 265900 - DNA, 15 bp, Homo sapiens
atgtgggtttcaaat

SEQ ID NO: 265901 - DNA, 15 bp, Homo sapiens
tatgtgggtttcaaa

SEQ ID NO: 265902 - DNA, 15 bp, Homo sapiens
atatgtgggtttcaa

SEQ ID NO: 265903 - DNA, 15 bp, Homo sapiens
gatatgtgggtttca

SEQ ID NO: 265904 - DNA, 15 bp, Homo sapiens
agatatgtgggtttc

SEQ ID NO: 265905 - DNA, 15 bp, Homo sapiens
aagatatgtgggttt

SEQ ID NO: 265906 - DNA, 15 bp, Homo sapiens
gaagatatgtgggtt

SEQ ID NO: 265907 - DNA, 15 bp, Homo sapiens
tgaagatatgtgggt

SEQ ID NO: 265908 - DNA, 15 bp, Homo sapiens
ttgaagatatgtggg

SEQ ID NO: 265909 - DNA, 15 bp, Homo sapiens
gttgaagatatgtgg

SEQ ID NO: 265910 - DNA, 15 bp, Homo sapiens
tgttgaagatatgtg

SEQ ID NO: 265911 - DNA, 15 bp, Homo sapiens
ctgttgaagatatgt

SEQ ID NO: 265912 - DNA, 15 bp, Homo sapiens
actgttgaagatatg

SEQ ID NO: 265913 - DNA, 15 bp, Homo sapiens
aactgttgaagatat

SEQ ID NO: 265914 - DNA, 15 bp, Homo sapiens
caactgttgaagata

SEQ ID NO: 265915 - DNA, 15 bp, Homo sapiens
acaactgttgaagat

SEQ ID NO: 265916 - DNA, 15 bp, Homo sapiens
gacaactgttgaaga

SEQ ID NO: 265917 - DNA, 15 bp, Homo sapiens
tgacaactgttgaag

SEQ ID NO: 265918 - DNA, 15 bp, Homo sapiens
atgacaactgttgaa

SEQ ID NO: 265919 - DNA, 15 bp, Homo sapiens
catgacaactgttga

SEQ ID NO: 265920 - DNA, 15 bp, Homo sapiens
gcatgacaactgttg

SEQ ID NO: 265921 - DNA, 15 bp, Homo sapiens
tgcatgacaactgtt

SEQ ID NO: 265922 - DNA, 15 bp, Homo sapiens
ctgcatgacaactgt

SEQ ID NO: 265923 - DNA, 15 bp, Homo sapiens
actgcatgacaactg

SEQ ID NO: 265924 - DNA, 15 bp, Homo sapiens
tactgcatgacaact

SEQ ID NO: 265925 - DNA, 15 bp, Homo sapiens
ctactgcatgacaac

SEQ ID NO: 265926 - DNA, 15 bp, Homo sapiens
cctactgcatgacaa

SEQ ID NO: 265927 - DNA, 15 bp, Homo sapiens
acctactgcatgaca

SEQ ID NO: 265928 - DNA, 15 bp, Homo sapiens
cacctactgcatgac

SEQ ID NO: 265929 - DNA, 15 bp, Homo sapiens
gcacctactgcatga

SEQ ID NO: 265930 - DNA, 15 bp, Homo sapiens
tgcacctactgcatg

SEQ ID NO: 265931 - DNA, 15 bp, Homo sapiens
atgcacctactgcat

SEQ ID NO: 265932 - DNA, 15 bp, Homo sapiens
tatgcacctactgca

SEQ ID NO: 265933 - DNA, 15 bp, Homo sapiens
gtatgcacctactgc

SEQ ID NO: 265934 - DNA, 15 bp, Homo sapiens
agtatgcacctactg

SEQ ID NO: 265935 - DNA, 15 bp, Homo sapiens
aagtatgcacctact

SEQ ID NO: 265936 - DNA, 15 bp, Homo sapiens
taagtatgcacctac

SEQ ID NO: 265937 - DNA, 15 bp, Homo sapiens
ttaagtatgcaccta

SEQ ID NO: 265938 - DNA, 15 bp, Homo sapiens
cttaagtatgcacct

SEQ ID NO: 265939 - DNA, 15 bp, Homo sapiens
tcttaagtatgcacc

SEQ ID NO: 265940 - DNA, 15 bp, Homo sapiens
ttcttaagtatgcac

SEQ ID NO: 265941 - DNA, 15 bp, Homo sapiens
attcttaagtatgca

SEQ ID NO: 265942 - DNA, 15 bp, Homo sapiens
gattcttaagtatgc

SEQ ID NO: 265943 - DNA, 15 bp, Homo sapiens
tgattcttaagtatg

SEQ ID NO: 265944 - DNA, 15 bp, Homo sapiens
gtgattcttaagtat

SEQ ID NO: 265945 - DNA, 15 bp, Homo sapiens
agtgattcttaagta

SEQ ID NO: 265946 - DNA, 15 bp, Homo sapiens
cagtgattcttaagt

SEQ ID NO: 265947 - DNA, 15 bp, Homo sapiens
tcagtgattcttaag

SEQ ID NO: 265948 - DNA, 15 bp, Homo sapiens
atcagtgattcttaa

SEQ ID NO: 265949 - DNA, 15 bp, Homo sapiens
tatcagtgattctta

SEQ ID NO: 265950 - DNA, 15 bp, Homo sapiens
gtatcagtgattctt

SEQ ID NO: 265951 - DNA, 15 bp, Homo sapiens
tgtatcagtgattct

SEQ ID NO: 265952 - DNA, 15 bp, Homo sapiens
gtgtatcagtgattc

SEQ ID NO: 265953 - DNA, 15 bp, Homo sapiens
tgtgtatcagtgatt

SEQ ID NO: 265954 - DNA, 15 bp, Homo sapiens
atgtgtatcagtgat

SEQ ID NO: 265955 - DNA, 15 bp, Homo sapiens
tatgtgtatcagtga

SEQ ID NO: 265956 - DNA, 15 bp, Homo sapiens
atatgtgtatcagtg

SEQ ID NO: 265957 - DNA, 15 bp, Homo sapiens
catatgtgtatcagt

SEQ ID NO: 265958 - DNA, 15 bp, Homo sapiens
tcatatgtgtatcag

SEQ ID NO: 265959 - DNA, 15 bp, Homo sapiens
ttcatatgtgtatca

SEQ ID NO: 265960 - DNA, 15 bp, Homo sapiens
attcatatgtgtatc

SEQ ID NO: 265961 - DNA, 15 bp, Homo sapiens
aattcatatgtgtat

SEQ ID NO: 265962 - DNA, 15 bp, Homo sapiens
gaattcatatgtgta

SEQ ID NO: 265963 - DNA, 15 bp, Homo sapiens
ggaattcatatgtgt

SEQ ID NO: 265964 - DNA, 15 bp, Homo sapiens
tggaattcatatgtg

SEQ ID NO: 265965 - DNA, 15 bp, Homo sapiens
gtggaattcatatgt

SEQ ID NO: 265966 - DNA, 15 bp, Homo sapiens
agtggaattcatatg

SEQ ID NO: 265967 - DNA, 15 bp, Homo sapiens
gagtggaattcatat

SEQ ID NO: 265968 - DNA, 15 bp, Homo sapiens
agagtggaattcata

SEQ ID NO: 265969 - DNA, 15 bp, Homo sapiens
gagagtggaattcat

SEQ ID NO: 265970 - DNA, 15 bp, Homo sapiens
ggagagtggaattca

SEQ ID NO: 265971 - DNA, 15 bp, Homo sapiens
tggagagtggaattc

SEQ ID NO: 265972 - DNA, 15 bp, Homo sapiens
ttggagagtggaatt

SEQ ID NO: 265973 - DNA, 15 bp, Homo sapiens
gttggagagtggaat

SEQ ID NO: 265974 - DNA, 15 bp, Homo sapiens
agttggagagtggaa

SEQ ID NO: 265975 - DNA, 15 bp, Homo sapiens
tagttggagagtgga

SEQ ID NO: 265976 - DNA, 15 bp, Homo sapiens
gtagttggagagtgg

SEQ ID NO: 265977 - DNA, 15 bp, Homo sapiens
ggtagttggagagtg

SEQ ID NO: 265978 - DNA, 15 bp, Homo sapiens
tggtagttggagagt

SEQ ID NO: 265979 - DNA, 15 bp, Homo sapiens
ttggtagttggagag

SEQ ID NO: 265980 - DNA, 15 bp, Homo sapiens
attggtagttggaga

SEQ ID NO: 265981 - DNA, 15 bp, Homo sapiens
aattggtagttggag

SEQ ID NO: 265982 - DNA, 15 bp, Homo sapiens
aaattggtagttgga

SEQ ID NO: 265983 - DNA, 15 bp, Homo sapiens
aaaattggtagttgg

SEQ ID NO: 265984 - DNA, 15 bp, Homo sapiens
taaaattggtagttg

SEQ ID NO: 265985 - DNA, 15 bp, Homo sapiens
ttaaaattggtagtt

SEQ ID NO: 265986 - DNA, 15 bp, Homo sapiens
tttaaaattggtagt

SEQ ID NO: 265987 - DNA, 15 bp, Homo sapiens
atttaaaattggtag

SEQ ID NO: 265988 - DNA, 15 bp, Homo sapiens
catttaaaattggta

SEQ ID NO: 265989 - DNA, 15 bp, Homo sapiens
tcatttaaaattggt

SEQ ID NO: 265990 - DNA, 15 bp, Homo sapiens
ttcatttaaaattgg

SEQ ID NO: 265991 - DNA, 15 bp, Homo sapiens
tttcatttaaaattg

SEQ ID NO: 265992 - DNA, 15 bp, Homo sapiens
atttcatttaaaatt

SEQ ID NO: 265993 - DNA, 15 bp, Homo sapiens
gatttcatttaaaat

SEQ ID NO: 265994 - DNA, 15 bp, Homo sapiens
agatttcatttaaaa

SEQ ID NO: 265995 - DNA, 15 bp, Homo sapiens
cagatttcatttaaa

SEQ ID NO: 265996 - DNA, 15 bp, Homo sapiens
acagatttcatttaa

SEQ ID NO: 265997 - DNA, 15 bp, Homo sapiens
tacagatttcattta

SEQ ID NO: 265998 - DNA, 15 bp, Homo sapiens
ttacagatttcattt

SEQ ID NO: 265999 - DNA, 15 bp, Homo sapiens
cttacagatttcatt

SEQ ID NO: 266000 - DNA, 15 bp, Homo sapiens
acttacagatttcat

SEQ ID NO: 266001 - DNA, 15 bp, Homo sapiens
aacttacagatttca

SEQ ID NO: 266002 - DNA, 15 bp, Homo sapiens
taacttacagatttc

SEQ ID NO: 266003 - DNA, 15 bp, Homo sapiens
gtaacttacagattt

SEQ ID NO: 266004 - DNA, 15 bp, Homo sapiens
ggtaacttacagatt

SEQ ID NO: 266005 - DNA, 15 bp, Homo sapiens
gggtaacttacagat

SEQ ID NO: 266006 - DNA, 15 bp, Homo sapiens
tgggtaacttacaga

SEQ ID NO: 266007 - DNA, 15 bp, Homo sapiens
ttgggtaacttacag

SEQ ID NO: 266008 - DNA, 15 bp, Homo sapiens
tttgggtaacttaca

SEQ ID NO: 266009 - DNA, 15 bp, Homo sapiens
ttttgggtaacttac

SEQ ID NO: 266010 - DNA, 15 bp, Homo sapiens
gttttgggtaactta

SEQ ID NO: 266011 - DNA, 15 bp, Homo sapiens
agttttgggtaactt

SEQ ID NO: 266012 - DNA, 15 bp, Homo sapiens
cagttttgggtaact

SEQ ID NO: 266013 - DNA, 15 bp, Homo sapiens
acagttttgggtaac

SEQ ID NO: 266014 - DNA, 15 bp, Homo sapiens
aacagttttgggtaa

SEQ ID NO: 266015 - DNA, 15 bp, Homo sapiens
gaacagttttgggta

SEQ ID NO: 266016 - DNA, 15 bp, Homo sapiens
agaacagttttgggt

SEQ ID NO: 266017 - DNA, 15 bp, Homo sapiens
aagaacagttttggg

SEQ ID NO: 266018 - DNA, 15 bp, Homo sapiens
caagaacagttttgg

SEQ ID NO: 266019 - DNA, 15 bp, Homo sapiens
acaagaacagttttg

SEQ ID NO: 266020 - DNA, 15 bp, Homo sapiens
aacaagaacagtttt

SEQ ID NO: 266021 - DNA, 15 bp, Homo sapiens
caacaagaacagttt

SEQ ID NO: 266022 - DNA, 15 bp, Homo sapiens
gcaacaagaacagtt

SEQ ID NO: 266023 - DNA, 15 bp, Homo sapiens
tgcaacaagaacagt

SEQ ID NO: 266024 - DNA, 15 bp, Homo sapiens
atgcaacaagaacag

SEQ ID NO: 266025 - DNA, 15 bp, Homo sapiens
tatgcaacaagaaca

SEQ ID NO: 266026 - DNA, 15 bp, Homo sapiens
ctatgcaacaagaac

SEQ ID NO: 266027 - DNA, 15 bp, Homo sapiens
actatgcaacaagaa

SEQ ID NO: 266028 - DNA, 15 bp, Homo sapiens
gactatgcaacaaga

SEQ ID NO: 266029 - DNA, 15 bp, Homo sapiens
agactatgcaacaag

SEQ ID NO: 266030 - DNA, 15 bp, Homo sapiens
aagactatgcaacaa

SEQ ID NO: 266031 - DNA, 15 bp, Homo sapiens
aaagactatgcaaca

SEQ ID NO: 266032 - DNA, 15 bp, Homo sapiens
gaaagactatgcaac

SEQ ID NO: 266033 - DNA, 15 bp, Homo sapiens
tgaaagactatgcaa

SEQ ID NO: 266034 - DNA, 15 bp, Homo sapiens
ttgaaagactatgca

SEQ ID NO: 266035 - DNA, 15 bp, Homo sapiens
tttgaaagactatgc

SEQ ID NO: 266036 - DNA, 15 bp, Homo sapiens
ttttgaaagactatg

SEQ ID NO: 266037 - DNA, 15 bp, Homo sapiens
cttttgaaagactat

SEQ ID NO: 266038 - DNA, 15 bp, Homo sapiens
acttttgaaagacta

SEQ ID NO: 266039 - DNA, 15 bp, Homo sapiens
gacttttgaaagact

SEQ ID NO: 266040 - DNA, 15 bp, Homo sapiens
tgacttttgaaagac

SEQ ID NO: 266041 - DNA, 15 bp, Homo sapiens
gtgacttttgaaaga

SEQ ID NO: 266042 - DNA, 15 bp, Homo sapiens
agtgacttttgaaag

SEQ ID NO: 266043 - DNA, 15 bp, Homo sapiens
cagtgacttttgaaa

SEQ ID NO: 266044 - DNA, 15 bp, Homo sapiens
acagtgacttttgaa

SEQ ID NO: 266045 - DNA, 15 bp, Homo sapiens
aacagtgacttttga

SEQ ID NO: 266046 - DNA, 15 bp, Homo sapiens
aaacagtgacttttg

SEQ ID NO: 266047 - DNA, 15 bp, Homo sapiens
taaacagtgactttt

SEQ ID NO: 266048 - DNA, 15 bp, Homo sapiens
ataaacagtgacttt

SEQ ID NO: 266049 - DNA, 15 bp, Homo sapiens
gataaacagtgactt

SEQ ID NO: 266050 - DNA, 15 bp, Homo sapiens
tgataaacagtgact

SEQ ID NO: 266051 - DNA, 15 bp, Homo sapiens
atgataaacagtgac

SEQ ID NO: 266052 - DNA, 15 bp, Homo sapiens
aatgataaacagtga

SEQ ID NO: 266053 - DNA, 15 bp, Homo sapiens
aaatgataaacagtg

SEQ ID NO: 266054 - DNA, 15 bp, Homo sapiens
gaaatgataaacagt

SEQ ID NO: 266055 - DNA, 15 bp, Homo sapiens
ggaaatgataaacag

SEQ ID NO: 266056 - DNA, 15 bp, Homo sapiens
tggaaatgataaaca

SEQ ID NO: 266057 - DNA, 15 bp, Homo sapiens
ttggaaatgataaac

SEQ ID NO: 266058 - DNA, 15 bp, Homo sapiens
cttggaaatgataaa

SEQ ID NO: 266059 - DNA, 15 bp, Homo sapiens
tcttggaaatgataa

SEQ ID NO: 266060 - DNA, 15 bp, Homo sapiens
atcttggaaatgata

SEQ ID NO: 266061 - DNA, 15 bp, Homo sapiens
aatcttggaaatgat

SEQ ID NO: 266062 - DNA, 15 bp, Homo sapiens
caatcttggaaatga

SEQ ID NO: 266063 - DNA, 15 bp, Homo sapiens
gcaatcttggaaatg

SEQ ID NO: 266064 - DNA, 15 bp, Homo sapiens
tgcaatcttggaaat

SEQ ID NO: 266065 - DNA, 15 bp, Homo sapiens
ctgcaatcttggaaa

SEQ ID NO: 266066 - DNA, 15 bp, Homo sapiens
gctgcaatcttggaa

SEQ ID NO: 266067 - DNA, 15 bp, Homo sapiens
agctgcaatcttgga

SEQ ID NO: 266068 - DNA, 15 bp, Homo sapiens
aagctgcaatcttgg

SEQ ID NO: 266069 - DNA, 15 bp, Homo sapiens
taagctgcaatcttg

SEQ ID NO: 266070 - DNA, 15 bp, Homo sapiens
ataagctgcaatctt

SEQ ID NO: 266071 - DNA, 15 bp, Homo sapiens
gataagctgcaatct

SEQ ID NO: 266072 - DNA, 15 bp, Homo sapiens
ggataagctgcaatc

SEQ ID NO: 266073 - DNA, 15 bp, Homo sapiens
aggataagctgcaat

SEQ ID NO: 266074 - DNA, 15 bp, Homo sapiens
caggataagctgcaa

SEQ ID NO: 266075 - DNA, 15 bp, Homo sapiens
gcaggataagctgca

SEQ ID NO: 266076 - DNA, 15 bp, Homo sapiens
tgcaggataagctgc

SEQ ID NO: 266077 - DNA, 15 bp, Homo sapiens
atgcaggataagctg

SEQ ID NO: 266078 - DNA, 15 bp, Homo sapiens
aatgcaggataagct

SEQ ID NO: 266079 - DNA, 15 bp, Homo sapiens
taatgcaggataagc

SEQ ID NO: 266080 - DNA, 15 bp, Homo sapiens
ataatgcaggataag

SEQ ID NO: 266081 - DNA, 15 bp, Homo sapiens
tataatgcaggataa

SEQ ID NO: 266082 - DNA, 15 bp, Homo sapiens
gtataatgcaggata

SEQ ID NO: 266083 - DNA, 15 bp, Homo sapiens
tgtataatgcaggat

SEQ ID NO: 266084 - DNA, 15 bp, Homo sapiens
ttgtataatgcagga

SEQ ID NO: 266085 - DNA, 15 bp, Homo sapiens
cttgtataatgcagg

SEQ ID NO: 266086 - DNA, 15 bp, Homo sapiens
ccttgtataatgcag

SEQ ID NO: 266087 - DNA, 15 bp, Homo sapiens
tccttgtataatgca

SEQ ID NO: 266088 - DNA, 15 bp, Homo sapiens
atccttgtataatgc

SEQ ID NO: 266089 - DNA, 15 bp, Homo sapiens
tatccttgtataatg

SEQ ID NO: 266090 - DNA, 15 bp, Homo sapiens
ctatccttgtataat

SEQ ID NO: 266091 - DNA, 15 bp, Homo sapiens
gctatccttgtataa

SEQ ID NO: 266092 - DNA, 15 bp, Homo sapiens
agctatccttgtata

SEQ ID NO: 266093 - DNA, 15 bp, Homo sapiens
aagctatccttgtat

SEQ ID NO: 266094 - DNA, 15 bp, Homo sapiens
gaagctatccttgta

SEQ ID NO: 266095 - DNA, 15 bp, Homo sapiens
tgaagctatccttgt

SEQ ID NO: 266096 - DNA, 15 bp, Homo sapiens
atgaagctatccttg

SEQ ID NO: 266097 - DNA, 15 bp, Homo sapiens
aatgaagctatcctt

SEQ ID NO: 266098 - DNA, 15 bp, Homo sapiens
aaatgaagctatcct

SEQ ID NO: 266099 - DNA, 15 bp, Homo sapiens
aaaatgaagctatcc

SEQ ID NO: 266100 - DNA, 15 bp, Homo sapiens
aaaaatgaagctatc

SEQ ID NO: 266101 - DNA, 15 bp, Homo sapiens
gaaaaatgaagctat

SEQ ID NO: 266102 - DNA, 15 bp, Homo sapiens
tgaaaaatgaagcta

SEQ ID NO: 266103 - DNA, 15 bp, Homo sapiens
ttgaaaaatgaagct

SEQ ID NO: 266104 - DNA, 15 bp, Homo sapiens
cttgaaaaatgaagc

SEQ ID NO: 266105 - DNA, 15 bp, Homo sapiens
tcttgaaaaatgaag

SEQ ID NO: 266106 - DNA, 15 bp, Homo sapiens
gtcttgaaaaatgaa

SEQ ID NO: 266107 - DNA, 15 bp, Homo sapiens
tgtcttgaaaaatga

SEQ ID NO: 266108 - DNA, 15 bp, Homo sapiens
atgtcttgaaaaatg

SEQ ID NO: 266109 - DNA, 15 bp, Homo sapiens
gatgtcttgaaaaat

SEQ ID NO: 266110 - DNA, 15 bp, Homo sapiens
ggatgtcttgaaaaa

SEQ ID NO: 266111 - DNA, 15 bp, Homo sapiens
aggatgtcttgaaaa

SEQ ID NO: 266112 - DNA, 15 bp, Homo sapiens
aaggatgtcttgaaa

SEQ ID NO: 266113 - DNA, 15 bp, Homo sapiens
aaaggatgtcttgaa

SEQ ID NO: 266114 - DNA, 15 bp, Homo sapiens
caaaggatgtcttga

SEQ ID NO: 266115 - DNA, 15 bp, Homo sapiens
gcaaaggatgtcttg

SEQ ID NO: 266116 - DNA, 15 bp, Homo sapiens
ggcaaaggatgtctt

SEQ ID NO: 266117 - DNA, 15 bp, Homo sapiens
gggcaaaggatgtct

SEQ ID NO: 266118 - DNA, 15 bp, Homo sapiens
tgggcaaaggatgtc

SEQ ID NO: 266119 - DNA, 15 bp, Homo sapiens
atgggcaaaggatgt

SEQ ID NO: 266120 - DNA, 15 bp, Homo sapiens
aatgggcaaaggatg

SEQ ID NO: 266121 - DNA, 15 bp, Homo sapiens
aaatgggcaaaggat

SEQ ID NO: 266122 - DNA, 15 bp, Homo sapiens
gaaatgggcaaagga

SEQ ID NO: 266123 - DNA, 15 bp, Homo sapiens
agaaatgggcaaagg

SEQ ID NO: 266124 - DNA, 15 bp, Homo sapiens
cagaaatgggcaaag

SEQ ID NO: 266125 - DNA, 15 bp, Homo sapiens
tcagaaatgggcaaa

SEQ ID NO: 266126 - DNA, 15 bp, Homo sapiens
ctcagaaatgggcaa

SEQ ID NO: 266127 - DNA, 15 bp, Homo sapiens
cctcagaaatgggca

SEQ ID NO: 266128 - DNA, 15 bp, Homo sapiens
gcctcagaaatgggc

SEQ ID NO: 266129 - DNA, 15 bp, Homo sapiens
agcctcagaaatggg

SEQ ID NO: 266130 - DNA, 15 bp, Homo sapiens
aagcctcagaaatgg

SEQ ID NO: 266131 - DNA, 15 bp, Homo sapiens
aaagcctcagaaatg

SEQ ID NO: 266132 - DNA, 15 bp, Homo sapiens
caaagcctcagaaat

SEQ ID NO: 266133 - DNA, 15 bp, Homo sapiens
acaaagcctcagaaa

SEQ ID NO: 266134 - DNA, 15 bp, Homo sapiens
tacaaagcctcagaa

SEQ ID NO: 266135 - DNA, 15 bp, Homo sapiens
ctacaaagcctcaga

SEQ ID NO: 266136 - DNA, 15 bp, Homo sapiens
actacaaagcctcag

SEQ ID NO: 266137 - DNA, 15 bp, Homo sapiens
cactacaaagcctca

SEQ ID NO: 266138 - DNA, 15 bp, Homo sapiens
tcactacaaagcctc

SEQ ID NO: 266139 - DNA, 15 bp, Homo sapiens
atcactacaaagcct

SEQ ID NO: 266140 - DNA, 15 bp, Homo sapiens
gatcactacaaagcc

SEQ ID NO: 266141 - DNA, 15 bp, Homo sapiens
agatcactacaaagc

SEQ ID NO: 266142 - DNA, 15 bp, Homo sapiens
aagatcactacaaag

SEQ ID NO: 266143 - DNA, 15 bp, Homo sapiens
taagatcactacaaa

SEQ ID NO: 266144 - DNA, 15 bp, Homo sapiens
ataagatcactacaa

SEQ ID NO: 266145 - DNA, 15 bp, Homo sapiens
gataagatcactaca

SEQ ID NO: 266146 - DNA, 15 bp, Homo sapiens
tgataagatcactac

SEQ ID NO: 266147 - DNA, 15 bp, Homo sapiens
ttgataagatcacta

SEQ ID NO: 266148 - DNA, 15 bp, Homo sapiens
gttgataagatcact

SEQ ID NO: 266149 - DNA, 15 bp, Homo sapiens
tgttgataagatcac

SEQ ID NO: 266150 - DNA, 15 bp, Homo sapiens
ctgttgataagatca

SEQ ID NO: 266151 - DNA, 15 bp, Homo sapiens
gctgttgataagatc

SEQ ID NO: 266152 - DNA, 15 bp, Homo sapiens
ggctgttgataagat

SEQ ID NO: 266153 - DNA, 15 bp, Homo sapiens
aggctgttgataaga

SEQ ID NO: 266154 - DNA, 15 bp, Homo sapiens
taggctgttgataag

SEQ ID NO: 266155 - DNA, 15 bp, Homo sapiens
gtaggctgttgataa

SEQ ID NO: 266156 - DNA, 15 bp, Homo sapiens
agtaggctgttgata

SEQ ID NO: 266157 - DNA, 15 bp, Homo sapiens
aagtaggctgttgat

SEQ ID NO: 266158 - DNA, 15 bp, Homo sapiens
taagtaggctgttga

SEQ ID NO: 266159 - DNA, 15 bp, Homo sapiens
ataagtaggctgttg

SEQ ID NO: 266160 - DNA, 15 bp, Homo sapiens
tataagtaggctgtt

SEQ ID NO: 266161 - DNA, 15 bp, Homo sapiens
ttataagtaggctgt

SEQ ID NO: 266162 - DNA, 15 bp, Homo sapiens
tttataagtaggctg

SEQ ID NO: 266163 - DNA, 15 bp, Homo sapiens
atttataagtaggct

SEQ ID NO: 266164 - DNA, 15 bp, Homo sapiens
gatttataagtaggc

SEQ ID NO: 266165 - DNA, 15 bp, Homo sapiens
tgatttataagtagg

SEQ ID NO: 266166 - DNA, 15 bp, Homo sapiens
atgatttataagtag

SEQ ID NO: 266167 - DNA, 15 bp, Homo sapiens
gatgatttataagta

SEQ ID NO: 266168 - DNA, 15 bp, Homo sapiens
agatgatttataagt

SEQ ID NO: 266169 - DNA, 15 bp, Homo sapiens
cagatgatttataag

SEQ ID NO: 266170 - DNA, 15 bp, Homo sapiens
acagatgatttataa

SEQ ID NO: 266171 - DNA, 15 bp, Homo sapiens
tacagatgatttata

SEQ ID NO: 266172 - DNA, 15 bp, Homo sapiens
atacagatgatttat

SEQ ID NO: 266173 - DNA, 15 bp, Homo sapiens
catacagatgattta

SEQ ID NO: 266174 - DNA, 15 bp, Homo sapiens
tcatacagatgattt

SEQ ID NO: 266175 - DNA, 15 bp, Homo sapiens
gtcatacagatgatt

SEQ ID NO: 266176 - DNA, 15 bp, Homo sapiens
tgtcatacagatgat

SEQ ID NO: 266177 - DNA, 15 bp, Homo sapiens
ctgtcatacagatga

SEQ ID NO: 266178 - DNA, 15 bp, Homo sapiens
cctgtcatacagatg

SEQ ID NO: 266179 - DNA, 15 bp, Homo sapiens
acctgtcatacagat

SEQ ID NO: 266180 - DNA, 15 bp, Homo sapiens
gacctgtcatacaga

SEQ ID NO: 266181 - DNA, 15 bp, Homo sapiens
tgacctgtcatacag

SEQ ID NO: 266182 - DNA, 15 bp, Homo sapiens
gtgacctgtcataca

SEQ ID NO: 266183 - DNA, 15 bp, Homo sapiens
agtgacctgtcatac

SEQ ID NO: 266184 - DNA, 15 bp, Homo sapiens
aagtgacctgtcata

SEQ ID NO: 266185 - DNA, 15 bp, Homo sapiens
aaagtgacctgtcat

SEQ ID NO: 266186 - DNA, 15 bp, Homo sapiens
gaaagtgacctgtca

SEQ ID NO: 266187 - DNA, 15 bp, Homo sapiens
agaaagtgacctgtc

SEQ ID NO: 266188 - DNA, 15 bp, Homo sapiens
cagaaagtgacctgt

SEQ ID NO: 266189 - DNA, 15 bp, Homo sapiens
gcagaaagtgacctg

SEQ ID NO: 266190 - DNA, 15 bp, Homo sapiens
tgcagaaagtgacct

SEQ ID NO: 266191 - DNA, 15 bp, Homo sapiens
atgcagaaagtgacc

SEQ ID NO: 266192 - DNA, 15 bp, Homo sapiens
aatgcagaaagtgac

SEQ ID NO: 266193 - DNA, 15 bp, Homo sapiens
aaatgcagaaagtga

SEQ ID NO: 266194 - DNA, 15 bp, Homo sapiens
caaatgcagaaagtg

SEQ ID NO: 266195 - DNA, 15 bp, Homo sapiens
tcaaatgcagaaagt

SEQ ID NO: 266196 - DNA, 15 bp, Homo sapiens
gtcaaatgcagaaag

SEQ ID NO: 266197 - DNA, 15 bp, Homo sapiens
ggtcaaatgcagaaa

SEQ ID NO: 266198 - DNA, 15 bp, Homo sapiens
gggtcaaatgcagaa

SEQ ID NO: 266199 - DNA, 15 bp, Homo sapiens
agggtcaaatgcaga

SEQ ID NO: 266200 - DNA, 15 bp, Homo sapiens
tagggtcaaatgcag

SEQ ID NO: 266201 - DNA, 15 bp, Homo sapiens
gtagggtcaaatgca

SEQ ID NO: 266202 - DNA, 15 bp, Homo sapiens
tgtagggtcaaatgc

SEQ ID NO: 266203 - DNA, 15 bp, Homo sapiens
ttgtagggtcaaatg

SEQ ID NO: 266204 - DNA, 15 bp, Homo sapiens
gttgtagggtcaaat

SEQ ID NO: 266205 - DNA, 15 bp, Homo sapiens
agttgtagggtcaaa

SEQ ID NO: 266206 - DNA, 15 bp, Homo sapiens
aagttgtagggtcaa

SEQ ID NO: 266207 - DNA, 15 bp, Homo sapiens
aaagttgtagggtca

SEQ ID NO: 266208 - DNA, 15 bp, Homo sapiens
aaaagttgtagggtc

SEQ ID NO: 266209 - DNA, 15 bp, Homo sapiens
aaaaagttgtagggt

SEQ ID NO: 266210 - DNA, 15 bp, Homo sapiens
caaaaagttgtaggg

SEQ ID NO: 266211 - DNA, 15 bp, Homo sapiens
acaaaaagttgtagg

SEQ ID NO: 266212 - DNA, 15 bp, Homo sapiens
tacaaaaagttgtag

SEQ ID NO: 266213 - DNA, 15 bp, Homo sapiens
ttacaaaaagttgta

SEQ ID NO: 266214 - DNA, 15 bp, Homo sapiens
tttacaaaaagttgt

SEQ ID NO: 266215 - DNA, 15 bp, Homo sapiens
ttttacaaaaagttg

SEQ ID NO: 266216 - DNA, 15 bp, Homo sapiens
attttacaaaaagtt

SEQ ID NO: 266217 - DNA, 15 bp, Homo sapiens
tattttacaaaaagt

SEQ ID NO: 266218 - DNA, 15 bp, Homo sapiens
ttattttacaaaaag

SEQ ID NO: 266219 - DNA, 15 bp, Homo sapiens
gttattttacaaaaa

SEQ ID NO: 266220 - DNA, 15 bp, Homo sapiens
agttattttacaaaa

SEQ ID NO: 266221 - DNA, 15 bp, Homo sapiens
tagttattttacaaa

SEQ ID NO: 266222 - DNA, 15 bp, Homo sapiens
ctagttattttacaa

SEQ ID NO: 266223 - DNA, 15 bp, Homo sapiens
tctagttattttaca

SEQ ID NO: 266224 - DNA, 15 bp, Homo sapiens
ttctagttattttac

SEQ ID NO: 266225 - DNA, 15 bp, Homo sapiens
tttctagttatttta

SEQ ID NO: 266226 - DNA, 15 bp, Homo sapiens
atttctagttatttt

SEQ ID NO: 266227 - DNA, 15 bp, Homo sapiens
tatttctagttattt

SEQ ID NO: 266228 - DNA, 15 bp, Homo sapiens
atatttctagttatt

SEQ ID NO: 266229 - DNA, 15 bp, Homo sapiens
tatatttctagttat

SEQ ID NO: 266230 - DNA, 15 bp, Homo sapiens
atatatttctagtta

SEQ ID NO: 266231 - DNA, 15 bp, Homo sapiens
catatatttctagtt

SEQ ID NO: 266232 - DNA, 15 bp, Homo sapiens
acatatatttctagt

SEQ ID NO: 266233 - DNA, 15 bp, Homo sapiens
tacatatatttctag

SEQ ID NO: 266234 - DNA, 15 bp, Homo sapiens
ttacatatatttcta

SEQ ID NO: 266235 - DNA, 15 bp, Homo sapiens
tttacatatatttct

SEQ ID NO: 266236 - DNA, 15 bp, Homo sapiens
atttacatatatttc

SEQ ID NO: 266237 - DNA, 15 bp, Homo sapiens
aatttacatatattt

SEQ ID NO: 266238 - DNA, 15 bp, Homo sapiens
caatttacatatatt

SEQ ID NO: 266239 - DNA, 15 bp, Homo sapiens
tcaatttacatatat

SEQ ID NO: 266240 - DNA, 15 bp, Homo sapiens
ttcaatttacatata

SEQ ID NO: 266241 - DNA, 15 bp, Homo sapiens
attcaatttacatat

SEQ ID NO: 266242 - DNA, 15 bp, Homo sapiens
gattcaatttacata

SEQ ID NO: 266243 - DNA, 15 bp, Homo sapiens
agattcaatttacat

SEQ ID NO: 266244 - DNA, 15 bp, Homo sapiens
aagattcaatttaca

SEQ ID NO: 266245 - DNA, 15 bp, Homo sapiens
aaagattcaatttac

SEQ ID NO: 266246 - DNA, 15 bp, Homo sapiens
taaagattcaattta

SEQ ID NO: 266247 - DNA, 15 bp, Homo sapiens
ttaaagattcaattt

SEQ ID NO: 266248 - DNA, 15 bp, Homo sapiens
tttaaagattcaatt

SEQ ID NO: 266249 - DNA, 15 bp, Homo sapiens
ttttaaagattcaat

SEQ ID NO: 266250 - DNA, 15 bp, Homo sapiens
tttttaaagattcaa

SEQ ID NO: 266251 - DNA, 15 bp, Homo sapiens
ctttttaaagattca

SEQ ID NO: 266252 - DNA, 15 bp, Homo sapiens
tctttttaaagattc

SEQ ID NO: 266253 - DNA, 15 bp, Homo sapiens
atctttttaaagatt

SEQ ID NO: 266254 - DNA, 15 bp, Homo sapiens
tatctttttaaagat

SEQ ID NO: 266255 - DNA, 15 bp, Homo sapiens
gtatctttttaaaga

SEQ ID NO: 266256 - DNA, 15 bp, Homo sapiens
agtatctttttaaag

SEQ ID NO: 266257 - DNA, 15 bp, Homo sapiens
aagtatctttttaaa

SEQ ID NO: 266258 - DNA, 15 bp, Homo sapiens
caagtatctttttaa

SEQ ID NO: 266259 - DNA, 15 bp, Homo sapiens
gcaagtatcttttta

SEQ ID NO: 266260 - DNA, 15 bp, Homo sapiens
tgcaagtatcttttt

SEQ ID NO: 266261 - DNA, 15 bp, Homo sapiens
atgcaagtatctttt

SEQ ID NO: 266262 - DNA, 15 bp, Homo sapiens
aatgcaagtatcttt

SEQ ID NO: 266263 - DNA, 15 bp, Homo sapiens
aaatgcaagtatctt

SEQ ID NO: 266264 - DNA, 15 bp, Homo sapiens
taaatgcaagtatct

SEQ ID NO: 266265 - DNA, 15 bp, Homo sapiens
ttaaatgcaagtatc

SEQ ID NO: 266266 - DNA, 15 bp, Homo sapiens
attaaatgcaagtat

SEQ ID NO: 266267 - DNA, 15 bp, Homo sapiens
tattaaatgcaagta

SEQ ID NO: 266268 - DNA, 15 bp, Homo sapiens
ctattaaatgcaagt

SEQ ID NO: 266269 - DNA, 15 bp, Homo sapiens
gctattaaatgcaag

SEQ ID NO: 266270 - DNA, 15 bp, Homo sapiens
tgctattaaatgcaa

SEQ ID NO: 266271 - DNA, 15 bp, Homo sapiens
ttgctattaaatgca

SEQ ID NO: 266272 - DNA, 15 bp, Homo sapiens
attgctattaaatgc

SEQ ID NO: 266273 - DNA, 15 bp, Homo sapiens
cattgctattaaatg

SEQ ID NO: 266274 - DNA, 15 bp, Homo sapiens
tcattgctattaaat

SEQ ID NO: 266275 - DNA, 15 bp, Homo sapiens
ttcattgctattaaa

SEQ ID NO: 266276 - DNA, 15 bp, Homo sapiens
attcattgctattaa

SEQ ID NO: 266277 - DNA, 15 bp, Homo sapiens
cattcattgctatta

SEQ ID NO: 266278 - DNA, 15 bp, Homo sapiens
tcattcattgctatt

SEQ ID NO: 266279 - DNA, 15 bp, Homo sapiens
atcattcattgctat

SEQ ID NO: 266280 - DNA, 15 bp, Homo sapiens
gatcattcattgcta

SEQ ID NO: 266281 - DNA, 15 bp, Homo sapiens
agatcattcattgct

SEQ ID NO: 266282 - DNA, 15 bp, Homo sapiens
cagatcattcattgc

SEQ ID NO: 266283 - DNA, 15 bp, Homo sapiens
tcagatcattcattg

SEQ ID NO: 266284 - DNA, 15 bp, Homo sapiens
atcagatcattcatt

SEQ ID NO: 266285 - DNA, 15 bp, Homo sapiens
aatcagatcattcat

SEQ ID NO: 266286 - DNA, 15 bp, Homo sapiens
caatcagatcattca

SEQ ID NO: 266287 - DNA, 15 bp, Homo sapiens
gcaatcagatcattc

SEQ ID NO: 266288 - DNA, 15 bp, Homo sapiens
agcaatcagatcatt

SEQ ID NO: 266289 - DNA, 15 bp, Homo sapiens
tagcaatcagatcat

SEQ ID NO: 266290 - DNA, 15 bp, Homo sapiens
atagcaatcagatca

SEQ ID NO: 266291 - DNA, 15 bp, Homo sapiens
aatagcaatcagatc

SEQ ID NO: 266292 - DNA, 15 bp, Homo sapiens
taatagcaatcagat

SEQ ID NO: 266293 - DNA, 15 bp, Homo sapiens
ataatagcaatcaga

SEQ ID NO: 266294 - DNA, 15 bp, Homo sapiens
aataatagcaatcag

SEQ ID NO: 266295 - DNA, 15 bp, Homo sapiens
caataatagcaatca

SEQ ID NO: 266296 - DNA, 15 bp, Homo sapiens
acaataatagcaatc

SEQ ID NO: 266297 - DNA, 15 bp, Homo sapiens
tacaataatagcaat

SEQ ID NO: 266298 - DNA, 15 bp, Homo sapiens
ctacaataatagcaa

SEQ ID NO: 266299 - DNA, 15 bp, Homo sapiens
gctacaataatagca

SEQ ID NO: 266300 - DNA, 15 bp, Homo sapiens
tgctacaataatagc

SEQ ID NO: 266301 - DNA, 15 bp, Homo sapiens
atgctacaataatag

SEQ ID NO: 266302 - DNA, 15 bp, Homo sapiens
aatgctacaataata

SEQ ID NO: 266303 - DNA, 15 bp, Homo sapiens
taatgctacaataat

SEQ ID NO: 266304 - DNA, 15 bp, Homo sapiens
ttaatgctacaataa

SEQ ID NO: 266305 - DNA, 15 bp, Homo sapiens
attaatgctacaata

SEQ ID NO: 266306 - DNA, 15 bp, Homo sapiens
cattaatgctacaat

SEQ ID NO: 266307 - DNA, 15 bp, Homo sapiens
acattaatgctacaa

SEQ ID NO: 266308 - DNA, 15 bp, Homo sapiens
gacattaatgctaca

SEQ ID NO: 266309 - DNA, 15 bp, Homo sapiens
agacattaatgctac

SEQ ID NO: 266310 - DNA, 15 bp, Homo sapiens
aagacattaatgcta

SEQ ID NO: 266311 - DNA, 15 bp, Homo sapiens
aaagacattaatgct

SEQ ID NO: 266312 - DNA, 15 bp, Homo sapiens
gaaagacattaatgc

SEQ ID NO: 266313 - DNA, 15 bp, Homo sapiens
ggaaagacattaatg

SEQ ID NO: 266314 - DNA, 15 bp, Homo sapiens
tggaaagacattaat

SEQ ID NO: 266315 - DNA, 15 bp, Homo sapiens
atggaaagacattaa

SEQ ID NO: 266316 - DNA, 15 bp, Homo sapiens
aatggaaagacatta

SEQ ID NO: 266317 - DNA, 15 bp, Homo sapiens
gaatggaaagacatt

SEQ ID NO: 266318 - DNA, 15 bp, Homo sapiens
tgaatggaaagacat

SEQ ID NO: 266319 - DNA, 15 bp, Homo sapiens
atacttgcatttata

SEQ ID NO: 266320 - DNA, 15 bp, Homo sapiens
aatacttgcatttat

SEQ ID NO: 266321 - DNA, 15 bp, Homo sapiens
gaatacttgcattta

SEQ ID NO: 266322 - DNA, 15 bp, Homo sapiens
tgaatacttgcattt

SEQ ID NO: 266323 - DNA, 15 bp, Homo sapiens
ctgaatacttgcatt

SEQ ID NO: 266324 - DNA, 15 bp, Homo sapiens
tctgaatacttgcat

SEQ ID NO: 266325 - DNA, 15 bp, Homo sapiens
ttctgaatacttgca

SEQ ID NO: 266326 - DNA, 15 bp, Homo sapiens
tttctgaatacttgc

SEQ ID NO: 266327 - DNA, 15 bp, Homo sapiens
atttctgaatacttg

SEQ ID NO: 266328 - DNA, 15 bp, Homo sapiens
gatttctgaatactt

SEQ ID NO: 266329 - DNA, 15 bp, Homo sapiens
tgatttctgaatact

SEQ ID NO: 266330 - DNA, 15 bp, Homo sapiens
atgatttctgaatac

SEQ ID NO: 266331 - DNA, 15 bp, Homo sapiens
aatgatttctgaata

SEQ ID NO: 266332 - DNA, 15 bp, Homo sapiens
caatgatttctgaat

SEQ ID NO: 266333 - DNA, 15 bp, Homo sapiens
gcaatgatttctgaa

SEQ ID NO: 266334 - DNA, 15 bp, Homo sapiens
agcaatgatttctga

SEQ ID NO: 266335 - DNA, 15 bp, Homo sapiens
aagcaatgatttctg

SEQ ID NO: 266336 - DNA, 15 bp, Homo sapiens
gaaagcaatgatttc

SEQ ID NO: 266337 - DNA, 15 bp, Homo sapiens
agaaagcaatgattt

SEQ ID NO: 266338 - DNA, 15 bp, Homo sapiens
cagaaagcaatgatt

SEQ ID NO: 266339 - DNA, 15 bp, Homo sapiens
tcagaaagcaatgat

SEQ ID NO: 266340 - DNA, 15 bp, Homo sapiens
ttcagaaagcaatga

SEQ ID NO: 266341 - DNA, 15 bp, Homo sapiens
tttcagaaagcaatg

SEQ ID NO: 266342 - DNA, 15 bp, Homo sapiens
atttcagaaagcaat

SEQ ID NO: 266343 - DNA, 15 bp, Homo sapiens
aatttcagaaagcaa

SEQ ID NO: 266344 - DNA, 15 bp, Homo sapiens
aaatttcagaaagca

SEQ ID NO: 266345 - DNA, 15 bp, Homo sapiens
gaaatttcagaaagc

SEQ ID NO: 266346 - DNA, 15 bp, Homo sapiens
agaaatttcagaaag

SEQ ID NO: 266347 - DNA, 15 bp, Homo sapiens
aagaaatttcagaaa

SEQ ID NO: 266348 - DNA, 15 bp, Homo sapiens
aaagaaatttcagaa

SEQ ID NO: 266349 - DNA, 15 bp, Homo sapiens
gaaagaaatttcaga

SEQ ID NO: 266350 - DNA, 15 bp, Homo sapiens
agaaagaaatttcag

SEQ ID NO: 266351 - DNA, 15 bp, Homo sapiens
cagaaagaaatttca

SEQ ID NO: 266352 - DNA, 15 bp, Homo sapiens
acagaaagaaatttc

SEQ ID NO: 266353 - DNA, 15 bp, Homo sapiens
aacagaaagaaattt

SEQ ID NO: 266354 - DNA, 15 bp, Homo sapiens
gaacagaaagaaatt

SEQ ID NO: 266355 - DNA, 15 bp, Homo sapiens
tgaacagaaagaaat

SEQ ID NO: 266356 - DNA, 15 bp, Homo sapiens
gtgaacagaaagaaa

SEQ ID NO: 266357 - DNA, 15 bp, Homo sapiens
ggtgaacagaaagaa

SEQ ID NO: 266358 - DNA, 15 bp, Homo sapiens
gggtgaacagaaaga

SEQ ID NO: 266359 - DNA, 15 bp, Homo sapiens
tgggtgaacagaaag

SEQ ID NO: 266360 - DNA, 15 bp, Homo sapiens
gtgggtgaacagaaa

SEQ ID NO: 266361 - DNA, 15 bp, Homo sapiens
tgtgggtgaacagaa

SEQ ID NO: 266362 - DNA, 15 bp, Homo sapiens
atgtgggtgaacaga

SEQ ID NO: 266363 - DNA, 15 bp, Homo sapiens
aatgtgggtgaacag

SEQ ID NO: 266364 - DNA, 15 bp, Homo sapiens
gaatgtgggtgaaca

SEQ ID NO: 266365 - DNA, 15 bp, Homo sapiens
agaatgtgggtgaac

SEQ ID NO: 266366 - DNA, 15 bp, Homo sapiens
aagaatgtgggtgaa

SEQ ID NO: 266367 - DNA, 15 bp, Homo sapiens
aaagaatgtgggtga

SEQ ID NO: 266368 - DNA, 15 bp, Homo sapiens
taaagaatgtgggtg

SEQ ID NO: 266369 - DNA, 15 bp, Homo sapiens
gtaaagaatgtgggt

SEQ ID NO: 266370 - DNA, 15 bp, Homo sapiens
tgtaaagaatgtggg

SEQ ID NO: 266371 - DNA, 15 bp, Homo sapiens
atgtaaagaatgtgg

SEQ ID NO: 266372 - DNA, 15 bp, Homo sapiens
aatgtaaagaatgtg

SEQ ID NO: 266373 - DNA, 15 bp, Homo sapiens
aaatgtaaagaatgt

SEQ ID NO: 266374 - DNA, 15 bp, Homo sapiens
caaatgtaaagaatg

SEQ ID NO: 266375 - DNA, 15 bp, Homo sapiens
gcaaatgtaaagaat

SEQ ID NO: 266376 - DNA, 15 bp, Homo sapiens
agcaaatgtaaagaa

SEQ ID NO: 266377 - DNA, 15 bp, Homo sapiens
gagcaaatgtaaaga

SEQ ID NO: 266378 - DNA, 15 bp, Homo sapiens
agagcaaatgtaaag

SEQ ID NO: 266379 - DNA, 15 bp, Homo sapiens
tagagcaaatgtaaa

SEQ ID NO: 266380 - DNA, 15 bp, Homo sapiens
gtagagcaaatgtaa

SEQ ID NO: 266381 - DNA, 15 bp, Homo sapiens
agtagagcaaatgta

SEQ ID NO: 266382 - DNA, 15 bp, Homo sapiens
gagtagagcaaatgt

SEQ ID NO: 266383 - DNA, 15 bp, Homo sapiens
agagtagagcaaatg

SEQ ID NO: 266384 - DNA, 15 bp, Homo sapiens
aagagtagagcaaat

SEQ ID NO: 266385 - DNA, 15 bp, Homo sapiens
aaagagtagagcaaa

SEQ ID NO: 266386 - DNA, 15 bp, Homo sapiens
aaaagagtagagcaa

SEQ ID NO: 266387 - DNA, 15 bp, Homo sapiens
taaaagagtagagca

SEQ ID NO: 266388 - DNA, 15 bp, Homo sapiens
ttaaaagagtagagc

SEQ ID NO: 266389 - DNA, 15 bp, Homo sapiens
cttaaaagagtagag

SEQ ID NO: 266390 - DNA, 15 bp, Homo sapiens
acttaaaagagtaga

SEQ ID NO: 266391 - DNA, 15 bp, Homo sapiens
aacttaaaagagtag

SEQ ID NO: 266392 - DNA, 15 bp, Homo sapiens
aaacttaaaagagta

SEQ ID NO: 266393 - DNA, 15 bp, Homo sapiens
aaaacttaaaagagt

SEQ ID NO: 266394 - DNA, 15 bp, Homo sapiens
taaaacttaaaagag

SEQ ID NO: 266395 - DNA, 15 bp, Homo sapiens
ataaaacttaaaaga

SEQ ID NO: 266396 - DNA, 15 bp, Homo sapiens
aataaaacttaaaag

SEQ ID NO: 266397 - DNA, 15 bp, Homo sapiens
taaataaaacttaaa

SEQ ID NO: 266398 - DNA, 15 bp, Homo sapiens
ataaataaaacttaa

SEQ ID NO: 266399 - DNA, 15 bp, Homo sapiens
cataaataaaactta

SEQ ID NO: 266400 - DNA, 15 bp, Homo sapiens
ccataaataaaactt

SEQ ID NO: 266401 - DNA, 15 bp, Homo sapiens
accataaataaaact

SEQ ID NO: 266402 - DNA, 15 bp, Homo sapiens
aaccataaataaaac

SEQ ID NO: 266403 - DNA, 15 bp, Homo sapiens
gaaccataaataaaa

SEQ ID NO: 266404 - DNA, 15 bp, Homo sapiens
tgaaccataaataaa

SEQ ID NO: 266405 - DNA, 15 bp, Homo sapiens
atgaaccataaataa

SEQ ID NO: 266406 - DNA, 15 bp, Homo sapiens
gatgaaccataaata

SEQ ID NO: 266407 - DNA, 15 bp, Homo sapiens
ggatgaaccataaat

SEQ ID NO: 266408 - DNA, 15 bp, Homo sapiens
tggatgaaccataaa

SEQ ID NO: 266409 - DNA, 15 bp, Homo sapiens
atggatgaaccataa

SEQ ID NO: 266410 - DNA, 15 bp, Homo sapiens
gatggatgaaccata

SEQ ID NO: 266411 - DNA, 15 bp, Homo sapiens
agatggatgaaccat

SEQ ID NO: 266412 - DNA, 15 bp, Homo sapiens
aagatggatgaacca

SEQ ID NO: 266413 - DNA, 15 bp, Homo sapiens
aaagatggatgaacc

SEQ ID NO: 266414 - DNA, 15 bp, Homo sapiens
aaaagatggatgaac

SEQ ID NO: 266415 - DNA, 15 bp, Homo sapiens
taaaagatggatgaa

SEQ ID NO: 266416 - DNA, 15 bp, Homo sapiens
gtaaaagatggatga

SEQ ID NO: 266417 - DNA, 15 bp, Homo sapiens
agtaaaagatggatg

SEQ ID NO: 266418 - DNA, 15 bp, Homo sapiens
gagtaaaagatggat

SEQ ID NO: 266419 - DNA, 15 bp, Homo sapiens
tgagtaaaagatgga

SEQ ID NO: 266420 - DNA, 15 bp, Homo sapiens
ttgagtaaaagatgg

SEQ ID NO: 266421 - DNA, 15 bp, Homo sapiens
gttgagtaaaagatg

SEQ ID NO: 266422 - DNA, 15 bp, Homo sapiens
tgttgagtaaaagat

SEQ ID NO: 266423 - DNA, 15 bp, Homo sapiens
atgttgagtaaaaga

SEQ ID NO: 266424 - DNA, 15 bp, Homo sapiens
aatgttgagtaaaag

SEQ ID NO: 266425 - DNA, 15 bp, Homo sapiens
aaatgttgagtaaaa

SEQ ID NO: 266426 - DNA, 15 bp, Homo sapiens
gaaatgttgagtaaa

SEQ ID NO: 266427 - DNA, 15 bp, Homo sapiens
ggaaatgttgagtaa

SEQ ID NO: 266428 - DNA, 15 bp, Homo sapiens
aggaaatgttgagta

SEQ ID NO: 266429 - DNA, 15 bp, Homo sapiens
taggaaatgttgagt

SEQ ID NO: 266430 - DNA, 15 bp, Homo sapiens
ttaggaaatgttgag

SEQ ID NO: 266431 - DNA, 15 bp, Homo sapiens
tttaggaaatgttga

SEQ ID NO: 266432 - DNA, 15 bp, Homo sapiens
ctttaggaaatgttg

SEQ ID NO: 266433 - DNA, 15 bp, Homo sapiens
actttaggaaatgtt

SEQ ID NO: 266434 - DNA, 15 bp, Homo sapiens
gactttaggaaatgt

SEQ ID NO: 266435 - DNA, 15 bp, Homo sapiens
cgactttaggaaatg

SEQ ID NO: 266436 - DNA, 15 bp, Homo sapiens
acgactttaggaaat

SEQ ID NO: 266437 - DNA, 15 bp, Homo sapiens
aacgactttaggaaa

SEQ ID NO: 266438 - DNA, 15 bp, Homo sapiens
aaacgactttaggaa

SEQ ID NO: 266439 - DNA, 15 bp, Homo sapiens
gaaacgactttagga

SEQ ID NO: 266440 - DNA, 15 bp, Homo sapiens
tgaaacgactttagg

SEQ ID NO: 266441 - DNA, 15 bp, Homo sapiens
atgaaacgactttag

SEQ ID NO: 266442 - DNA, 15 bp, Homo sapiens
catgaaacgacttta

SEQ ID NO: 266443 - DNA, 15 bp, Homo sapiens
acatgaaacgacttt

SEQ ID NO: 266444 - DNA, 15 bp, Homo sapiens
gacatgaaacgactt

SEQ ID NO: 266445 - DNA, 15 bp, Homo sapiens
agacatgaaacgact

SEQ ID NO: 266446 - DNA, 15 bp, Homo sapiens
cagacatgaaacgac

SEQ ID NO: 266447 - DNA, 15 bp, Homo sapiens
gcagacatgaaacga

SEQ ID NO: 266448 - DNA, 15 bp, Homo sapiens
ggcagacatgaaacg

SEQ ID NO: 266449 - DNA, 15 bp, Homo sapiens
aggcagacatgaaac

SEQ ID NO: 266450 - DNA, 15 bp, Homo sapiens
aaggcagacatgaaa

SEQ ID NO: 266451 - DNA, 15 bp, Homo sapiens
taaggcagacatgaa

SEQ ID NO: 266452 - DNA, 15 bp, Homo sapiens
ctaaggcagacatga

SEQ ID NO: 266453 - DNA, 15 bp, Homo sapiens
tctaaggcagacatg

SEQ ID NO: 266454 - DNA, 15 bp, Homo sapiens
ttctaaggcagacat

SEQ ID NO: 266455 - DNA, 15 bp, Homo sapiens
tttctaaggcagaca

SEQ ID NO: 266456 - DNA, 15 bp, Homo sapiens
ttttctaaggcagac

SEQ ID NO: 266457 - DNA, 15 bp, Homo sapiens
attttctaaggcaga

SEQ ID NO: 266458 - DNA, 15 bp, Homo sapiens
cattttctaaggcag

SEQ ID NO: 266459 - DNA, 15 bp, Homo sapiens
tcattttctaaggca

SEQ ID NO: 266460 - DNA, 15 bp, Homo sapiens
ttcattttctaaggc

SEQ ID NO: 266461 - DNA, 15 bp, Homo sapiens
gttcattttctaagg

SEQ ID NO: 266462 - DNA, 15 bp, Homo sapiens
agttcattttctaag

SEQ ID NO: 266463 - DNA, 15 bp, Homo sapiens
gagttcattttctaa

SEQ ID NO: 266464 - DNA, 15 bp, Homo sapiens
tgagttcattttcta

SEQ ID NO: 266465 - DNA, 15 bp, Homo sapiens
ttgagttcattttct

SEQ ID NO: 266466 - DNA, 15 bp, Homo sapiens
cttgagttcattttc

SEQ ID NO: 266467 - DNA, 15 bp, Homo sapiens
acttgagttcatttt

SEQ ID NO: 266468 - DNA, 15 bp, Homo sapiens
cacttgagttcattt

SEQ ID NO: 266469 - DNA, 15 bp, Homo sapiens
acacttgagttcatt

SEQ ID NO: 266470 - DNA, 15 bp, Homo sapiens
cacacttgagttcat

SEQ ID NO: 266471 - DNA, 15 bp, Homo sapiens
tcacacttgagttca

SEQ ID NO: 266472 - DNA, 15 bp, Homo sapiens
ttcacacttgagttc

SEQ ID NO: 266473 - DNA, 15 bp, Homo sapiens
attcacacttgagtt

SEQ ID NO: 266474 - DNA, 15 bp, Homo sapiens
aattcacacttgagt

SEQ ID NO: 266475 - DNA, 15 bp, Homo sapiens
aaattcacacttgag

SEQ ID NO: 266476 - DNA, 15 bp, Homo sapiens
caaattcacacttga

SEQ ID NO: 266477 - DNA, 15 bp, Homo sapiens
acaaattcacacttg

SEQ ID NO: 266478 - DNA, 15 bp, Homo sapiens
aacaaattcacactt

SEQ ID NO: 266479 - DNA, 15 bp, Homo sapiens
aaacaaattcacact

SEQ ID NO: 266480 - DNA, 15 bp, Homo sapiens
caaacaaattcacac

SEQ ID NO: 266481 - DNA, 15 bp, Homo sapiens
ccaaacaaattcaca

SEQ ID NO: 266482 - DNA, 15 bp, Homo sapiens
accaaacaaattcac

SEQ ID NO: 266483 - DNA, 15 bp, Homo sapiens
taccaaacaaattca

SEQ ID NO: 266484 - DNA, 15 bp, Homo sapiens
gtaccaaacaaattc

SEQ ID NO: 266485 - DNA, 15 bp, Homo sapiens
tgtaccaaacaaatt

SEQ ID NO: 266486 - DNA, 15 bp, Homo sapiens
ctgtaccaaacaaat

SEQ ID NO: 266487 - DNA, 15 bp, Homo sapiens
actgtaccaaacaaa

SEQ ID NO: 266488 - DNA, 15 bp, Homo sapiens
cactgtaccaaacaa

SEQ ID NO: 266489 - DNA, 15 bp, Homo sapiens
tcactgtaccaaaca

SEQ ID NO: 266490 - DNA, 15 bp, Homo sapiens
atcactgtaccaaac

SEQ ID NO: 266491 - DNA, 15 bp, Homo sapiens
tatcactgtaccaaa

SEQ ID NO: 266492 - DNA, 15 bp, Homo sapiens
ttatcactgtaccaa

SEQ ID NO: 266493 - DNA, 15 bp, Homo sapiens
attatcactgtacca

SEQ ID NO: 266494 - DNA, 15 bp, Homo sapiens
tattatcactgtacc

SEQ ID NO: 266495 - DNA, 15 bp, Homo sapiens
ttattatcactgtac

SEQ ID NO: 266496 - DNA, 15 bp, Homo sapiens
cttattatcactgta

SEQ ID NO: 266497 - DNA, 15 bp, Homo sapiens
gcttattatcactgt

SEQ ID NO: 266498 - DNA, 15 bp, Homo sapiens
tgcttattatcactg

SEQ ID NO: 266499 - DNA, 15 bp, Homo sapiens
ttgcttattatcact

SEQ ID NO: 266500 - DNA, 15 bp, Homo sapiens
gttgcttattatcac

SEQ ID NO: 266501 - DNA, 15 bp, Homo sapiens
tgttgcttattatca

SEQ ID NO: 266502 - DNA, 15 bp, Homo sapiens
gtgttgcttattatc

SEQ ID NO: 266503 - DNA, 15 bp, Homo sapiens
agtgttgcttattat

SEQ ID NO: 266504 - DNA, 15 bp, Homo sapiens
aagtgttgcttatta

SEQ ID NO: 266505 - DNA, 15 bp, Homo sapiens
caagtgttgcttatt

SEQ ID NO: 266506 - DNA, 15 bp, Homo sapiens
tcaagtgttgcttat

SEQ ID NO: 266507 - DNA, 15 bp, Homo sapiens
ctcaagtgttgctta

SEQ ID NO: 266508 - DNA, 15 bp, Homo sapiens
actcaagtgttgctt

SEQ ID NO: 266509 - DNA, 15 bp, Homo sapiens
cactcaagtgttgct

SEQ ID NO: 266510 - DNA, 15 bp, Homo sapiens
acactcaagtgttgc

SEQ ID NO: 266511 - DNA, 15 bp, Homo sapiens
aacactcaagtgttg

SEQ ID NO: 266512 - DNA, 15 bp, Homo sapiens
taacactcaagtgtt

SEQ ID NO: 266513 - DNA, 15 bp, Homo sapiens
ttaacactcaagtgt

SEQ ID NO: 266514 - DNA, 15 bp, Homo sapiens
tttaacactcaagtg

SEQ ID NO: 266515 - DNA, 15 bp, Homo sapiens
atttaacactcaagt

SEQ ID NO: 266516 - DNA, 15 bp, Homo sapiens
catttaacactcaag

SEQ ID NO: 266517 - DNA, 15 bp, Homo sapiens
ccatttaacactcaa

SEQ ID NO: 266518 - DNA, 15 bp, Homo sapiens
tccatttaacactca

SEQ ID NO: 266519 - DNA, 15 bp, Homo sapiens
atccatttaacactc

SEQ ID NO: 266520 - DNA, 15 bp, Homo sapiens
gatccatttaacact

SEQ ID NO: 266521 - DNA, 15 bp, Homo sapiens
tgatccatttaacac

SEQ ID NO: 266522 - DNA, 15 bp, Homo sapiens
ctgatccatttaaca

SEQ ID NO: 266523 - DNA, 15 bp, Homo sapiens
tctgatccatttaac

SEQ ID NO: 266524 - DNA, 15 bp, Homo sapiens
gtctgatccatttaa

SEQ ID NO: 266525 - DNA, 15 bp, Homo sapiens
ggtctgatccattta

SEQ ID NO: 266526 - DNA, 15 bp, Homo sapiens
aggtctgatccattt

SEQ ID NO: 266527 - DNA, 15 bp, Homo sapiens
aaggtctgatccatt

SEQ ID NO: 266528 - DNA, 15 bp, Homo sapiens
gaaggtctgatccat

SEQ ID NO: 266529 - DNA, 15 bp, Homo sapiens
ggaaggtctgatcca

SEQ ID NO: 266530 - DNA, 15 bp, Homo sapiens
gggaaggtctgatcc

SEQ ID NO: 266531 - DNA, 15 bp, Homo sapiens
tgggaaggtctgatc

SEQ ID NO: 266532 - DNA, 15 bp, Homo sapiens
atgggaaggtctgat

SEQ ID NO: 266533 - DNA, 15 bp, Homo sapiens
tatgggaaggtctga

SEQ ID NO: 266534 - DNA, 15 bp, Homo sapiens
atatgggaaggtctg

SEQ ID NO: 266535 - DNA, 15 bp, Homo sapiens
catatgggaaggtct

SEQ ID NO: 266536 - DNA, 15 bp, Homo sapiens
ccatatgggaaggtc

SEQ ID NO: 266537 - DNA, 15 bp, Homo sapiens
tccatatgggaaggt

SEQ ID NO: 266538 - DNA, 15 bp, Homo sapiens
gtccatatgggaagg

SEQ ID NO: 266539 - DNA, 15 bp, Homo sapiens
ggtccatatgggaag

SEQ ID NO: 266540 - DNA, 15 bp, Homo sapiens
aggtccatatgggaa

SEQ ID NO: 266541 - DNA, 15 bp, Homo sapiens
aaggtccatatggga

SEQ ID NO: 266542 - DNA, 15 bp, Homo sapiens
caaggtccatatggg

SEQ ID NO: 266543 - DNA, 15 bp, Homo sapiens
tcaaggtccatatgg

SEQ ID NO: 266544 - DNA, 15 bp, Homo sapiens
atcaaggtccatatg

SEQ ID NO: 266545 - DNA, 15 bp, Homo sapiens
catcaaggtccatat

SEQ ID NO: 266546 - DNA, 15 bp, Homo sapiens
acatcaaggtccata

SEQ ID NO: 266547 - DNA, 15 bp, Homo sapiens
aacatcaaggtccat

SEQ ID NO: 266548 - DNA, 15 bp, Homo sapiens
aaacatcaaggtcca

SEQ ID NO: 266549 - DNA, 15 bp, Homo sapiens
caaacatcaaggtcc

SEQ ID NO: 266550 - DNA, 15 bp, Homo sapiens
gcaaacatcaaggtc

SEQ ID NO: 266551 - DNA, 15 bp, Homo sapiens
tgcaaacatcaaggt

SEQ ID NO: 266552 - DNA, 15 bp, Homo sapiens
atgcaaacatcaagg

SEQ ID NO: 266553 - DNA, 15 bp, Homo sapiens
aatgcaaacatcaag

SEQ ID NO: 266554 - DNA, 15 bp, Homo sapiens
gaatgcaaacatcaa

SEQ ID NO: 266555 - DNA, 15 bp, Homo sapiens
ggaatgcaaacatca

SEQ ID NO: 266556 - DNA, 15 bp, Homo sapiens
aggaatgcaaacatc

SEQ ID NO: 266557 - DNA, 15 bp, Homo sapiens
gaggaatgcaaacat

SEQ ID NO: 266558 - DNA, 15 bp, Homo sapiens
tgaggaatgcaaaca

SEQ ID NO: 266559 - DNA, 15 bp, Homo sapiens
ctgaggaatgcaaac

SEQ ID NO: 266560 - DNA, 15 bp, Homo sapiens
tctgaggaatgcaaa

SEQ ID NO: 266561 - DNA, 15 bp, Homo sapiens
gtctgaggaatgcaa

SEQ ID NO: 266562 - DNA, 15 bp, Homo sapiens
agtctgaggaatgca

SEQ ID NO: 266563 - DNA, 15 bp, Homo sapiens
cagtctgaggaatgc

SEQ ID NO: 266564 - DNA, 15 bp, Homo sapiens
gcagtctgaggaatg

SEQ ID NO: 266565 - DNA, 15 bp, Homo sapiens
tgcagtctgaggaat

SEQ ID NO: 266566 - DNA, 15 bp, Homo sapiens
atgcagtctgaggaa

SEQ ID NO: 266567 - DNA, 15 bp, Homo sapiens
gatgcagtctgagga

SEQ ID NO: 266568 - DNA, 15 bp, Homo sapiens
agatgcagtctgagg

SEQ ID NO: 266569 - DNA, 15 bp, Homo sapiens
gagatgcagtctgag

SEQ ID NO: 266570 - DNA, 15 bp, Homo sapiens
ggagatgcagtctga

SEQ ID NO: 266571 - DNA, 15 bp, Homo sapiens
gggagatgcagtctg

SEQ ID NO: 266572 - DNA, 15 bp, Homo sapiens
agggagatgcagtct

SEQ ID NO: 266573 - DNA, 15 bp, Homo sapiens
aagggagatgcagtc

SEQ ID NO: 266574 - DNA, 15 bp, Homo sapiens
aaagggagatgcagt

SEQ ID NO: 266575 - DNA, 15 bp, Homo sapiens
aaaagggagatgcag

SEQ ID NO: 266576 - DNA, 15 bp, Homo sapiens
aaaaagggagatgca

SEQ ID NO: 266577 - DNA, 15 bp, Homo sapiens
taaaaagggagatgc

SEQ ID NO: 266578 - DNA, 15 bp, Homo sapiens
ctaaaaagggagatg

SEQ ID NO: 266579 - DNA, 15 bp, Homo sapiens
actaaaaagggagat

SEQ ID NO: 266580 - DNA, 15 bp, Homo sapiens
aactaaaaagggaga

SEQ ID NO: 266581 - DNA, 15 bp, Homo sapiens
taactaaaaagggag

SEQ ID NO: 266582 - DNA, 15 bp, Homo sapiens
ttaactaaaaaggga

SEQ ID NO: 266583 - DNA, 15 bp, Homo sapiens
cttaactaaaaaggg

SEQ ID NO: 266584 - DNA, 15 bp, Homo sapiens
tcttaactaaaaagg

SEQ ID NO: 266585 - DNA, 15 bp, Homo sapiens
ttcttaactaaaaag

SEQ ID NO: 266586 - DNA, 15 bp, Homo sapiens
cttcttaactaaaaa

SEQ ID NO: 266587 - DNA, 15 bp, Homo sapiens
tcttcttaactaaaa

SEQ ID NO: 266588 - DNA, 15 bp, Homo sapiens
atcttcttaactaaa

SEQ ID NO: 266589 - DNA, 15 bp, Homo sapiens
catcttcttaactaa

SEQ ID NO: 266590 - DNA, 15 bp, Homo sapiens
gcatcttcttaacta

SEQ ID NO: 266591 - DNA, 15 bp, Homo sapiens
agcatcttcttaact

SEQ ID NO: 266592 - DNA, 15 bp, Homo sapiens
gagcatcttcttaac

SEQ ID NO: 266593 - DNA, 15 bp, Homo sapiens
ggagcatcttcttaa

SEQ ID NO: 266594 - DNA, 15 bp, Homo sapiens
tggagcatcttctta

SEQ ID NO: 266595 - DNA, 15 bp, Homo sapiens
ctggagcatcttctt

SEQ ID NO: 266596 - DNA, 15 bp, Homo sapiens
actggagcatcttct

SEQ ID NO: 266597 - DNA, 15 bp, Homo sapiens
gactggagcatcttc

SEQ ID NO: 266598 - DNA, 15 bp, Homo sapiens
tgactggagcatctt

SEQ ID NO: 266599 - DNA, 15 bp, Homo sapiens
gtgactggagcatct

SEQ ID NO: 266600 - DNA, 15 bp, Homo sapiens
ggtgactggagcatc

SEQ ID NO: 266601 - DNA, 15 bp, Homo sapiens
aggtgactggagcat

SEQ ID NO: 266602 - DNA, 15 bp, Homo sapiens
aaggtgactggagca

SEQ ID NO: 266603 - DNA, 15 bp, Homo sapiens
taaggtgactggagc

SEQ ID NO: 266604 - DNA, 15 bp, Homo sapiens
gtaaggtgactggag

SEQ ID NO: 266605 - DNA, 15 bp, Homo sapiens
agtaaggtgactgga

SEQ ID NO: 266606 - DNA, 15 bp, Homo sapiens
cagtaaggtgactgg

SEQ ID NO: 266607 - DNA, 15 bp, Homo sapiens
tcagtaaggtgactg

SEQ ID NO: 266608 - DNA, 15 bp, Homo sapiens
gtcagtaaggtgact

SEQ ID NO: 266609 - DNA, 15 bp, Homo sapiens
agtcagtaaggtgac

SEQ ID NO: 266610 - DNA, 15 bp, Homo sapiens
aagtcagtaaggtga

SEQ ID NO: 266611 - DNA, 15 bp, Homo sapiens
gaagtcagtaaggtg

SEQ ID NO: 266612 - DNA, 15 bp, Homo sapiens
tgaagtcagtaaggt

SEQ ID NO: 266613 - DNA, 15 bp, Homo sapiens
atgaagtcagtaagg

SEQ ID NO: 266614 - DNA, 15 bp, Homo sapiens
gatgaagtcagtaag

SEQ ID NO: 266615 - DNA, 15 bp, Homo sapiens
agatgaagtcagtaa

SEQ ID NO: 266616 - DNA, 15 bp, Homo sapiens
gagatgaagtcagta

SEQ ID NO: 266617 - DNA, 15 bp, Homo sapiens
agagatgaagtcagt

SEQ ID NO: 266618 - DNA, 15 bp, Homo sapiens
aagagatgaagtcag

SEQ ID NO: 266619 - DNA, 15 bp, Homo sapiens
aaagagatgaagtca

SEQ ID NO: 266620 - DNA, 15 bp, Homo sapiens
gaaagagatgaagtc

SEQ ID NO: 266621 - DNA, 15 bp, Homo sapiens
ggaaagagatgaagt

SEQ ID NO: 266622 - DNA, 15 bp, Homo sapiens
aggaaagagatgaag

SEQ ID NO: 266623 - DNA, 15 bp, Homo sapiens
aaggaaagagatgaa

SEQ ID NO: 266624 - DNA, 15 bp, Homo sapiens
aaaggaaagagatga

SEQ ID NO: 266625 - DNA, 15 bp, Homo sapiens
aaaaggaaagagatg

SEQ ID NO: 266626 - DNA, 15 bp, Homo sapiens
gaaaaggaaagagat

SEQ ID NO: 266627 - DNA, 15 bp, Homo sapiens
tgaaaaggaaagaga

SEQ ID NO: 266628 - DNA, 15 bp, Homo sapiens
ttgaaaaggaaagag

SEQ ID NO: 266629 - DNA, 15 bp, Homo sapiens
tttgaaaaggaaaga

SEQ ID NO: 266630 - DNA, 15 bp, Homo sapiens
ctttgaaaaggaaag

SEQ ID NO: 266631 - DNA, 15 bp, Homo sapiens
actttgaaaaggaaa

SEQ ID NO: 266632 - DNA, 15 bp, Homo sapiens
gactttgaaaaggaa

SEQ ID NO: 266633 - DNA, 15 bp, Homo sapiens
ggactttgaaaagga

SEQ ID NO: 266634 - DNA, 15 bp, Homo sapiens
aggactttgaaaagg

SEQ ID NO: 266635 - DNA, 15 bp, Homo sapiens
aaggactttgaaaag

SEQ ID NO: 266636 - DNA, 15 bp, Homo sapiens
aaaggactttgaaaa

SEQ ID NO: 266637 - DNA, 15 bp, Homo sapiens
taaaggactttgaaa

SEQ ID NO: 266638 - DNA, 15 bp, Homo sapiens
gtaaaggactttgaa

SEQ ID NO: 266639 - DNA, 15 bp, Homo sapiens
tgtaaaggactttga

SEQ ID NO: 266640 - DNA, 15 bp, Homo sapiens
ctgtaaaggactttg

SEQ ID NO: 266641 - DNA, 15 bp, Homo sapiens
gctgtaaaggacttt

SEQ ID NO: 266642 - DNA, 15 bp, Homo sapiens
agctgtaaaggactt

SEQ ID NO: 266643 - DNA, 15 bp, Homo sapiens
cagctgtaaaggact

SEQ ID NO: 266644 - DNA, 15 bp, Homo sapiens
tcagctgtaaaggac

SEQ ID NO: 266645 - DNA, 15 bp, Homo sapiens
gtcagctgtaaagga

SEQ ID NO: 266646 - DNA, 15 bp, Homo sapiens
agtcagctgtaaagg

SEQ ID NO: 266647 - DNA, 15 bp, Homo sapiens
gagtcagctgtaaag

SEQ ID NO: 266648 - DNA, 15 bp, Homo sapiens
agagtcagctgtaaa

SEQ ID NO: 266649 - DNA, 15 bp, Homo sapiens
cagagtcagctgtaa

SEQ ID NO: 266650 - DNA, 15 bp, Homo sapiens
tcagagtcagctgta

SEQ ID NO: 266651 - DNA, 15 bp, Homo sapiens
ttcagagtcagctgt

SEQ ID NO: 266652 - DNA, 15 bp, Homo sapiens
attcagagtcagctg

SEQ ID NO: 266653 - DNA, 15 bp, Homo sapiens
cattcagagtcagct

SEQ ID NO: 266654 - DNA, 15 bp, Homo sapiens
acattcagagtcagc

SEQ ID NO: 266655 - DNA, 15 bp, Homo sapiens
aacattcagagtcag

SEQ ID NO: 266656 - DNA, 15 bp, Homo sapiens
aaacattcagagtca

SEQ ID NO: 266657 - DNA, 15 bp, Homo sapiens
gaaacattcagagtc

SEQ ID NO: 266658 - DNA, 15 bp, Homo sapiens
agaaacattcagagt

SEQ ID NO: 266659 - DNA, 15 bp, Homo sapiens
tagaaacattcagag

SEQ ID NO: 266660 - DNA, 15 bp, Homo sapiens
atagaaacattcaga

SEQ ID NO: 266661 - DNA, 15 bp, Homo sapiens
aatagaaacattcag

SEQ ID NO: 266662 - DNA, 15 bp, Homo sapiens
aaatagaaacattca

SEQ ID NO: 266663 - DNA, 15 bp, Homo sapiens
aaaatagaaacattc

SEQ ID NO: 266664 - DNA, 15 bp, Homo sapiens
aaaaatagaaacatt

SEQ ID NO: 266665 - DNA, 15 bp, Homo sapiens
taaaaatagaaacat

SEQ ID NO: 266666 - DNA, 15 bp, Homo sapiens
ttaaaaatagaaaca

SEQ ID NO: 266667 - DNA, 15 bp, Homo sapiens
cttaaaaatagaaac

SEQ ID NO: 266668 - DNA, 15 bp, Homo sapiens
tcttaaaaatagaaa

SEQ ID NO: 266669 - DNA, 15 bp, Homo sapiens
ctcttaaaaatagaa

SEQ ID NO: 266670 - DNA, 15 bp, Homo sapiens
gctcttaaaaataga

SEQ ID NO: 266671 - DNA, 15 bp, Homo sapiens
agctcttaaaaatag

SEQ ID NO: 266672 - DNA, 15 bp, Homo sapiens
aagctcttaaaaata

SEQ ID NO: 266673 - DNA, 15 bp, Homo sapiens
aaagctcttaaaaat

SEQ ID NO: 266674 - DNA, 15 bp, Homo sapiens
gaaagctcttaaaaa

SEQ ID NO: 266675 - DNA, 15 bp, Homo sapiens
agaaagctcttaaaa

SEQ ID NO: 266676 - DNA, 15 bp, Homo sapiens
cagaaagctcttaaa

SEQ ID NO: 266677 - DNA, 15 bp, Homo sapiens
gcagaaagctcttaa

SEQ ID NO: 266678 - DNA, 15 bp, Homo sapiens
tgcagaaagctctta

SEQ ID NO: 266679 - DNA, 15 bp, Homo sapiens
ttgcagaaagctctt

SEQ ID NO: 266680 - DNA, 15 bp, Homo sapiens
attgcagaaagctct

SEQ ID NO: 266681 - DNA, 15 bp, Homo sapiens
aattgcagaaagctc

SEQ ID NO: 266682 - DNA, 15 bp, Homo sapiens
aaattgcagaaagct

SEQ ID NO: 266683 - DNA, 15 bp, Homo sapiens
taaattgcagaaagc

SEQ ID NO: 266684 - DNA, 15 bp, Homo sapiens
ctaaattgcagaaag

SEQ ID NO: 266685 - DNA, 15 bp, Homo sapiens
tctaaattgcagaaa

SEQ ID NO: 266686 - DNA, 15 bp, Homo sapiens
ttctaaattgcagaa

SEQ ID NO: 266687 - DNA, 15 bp, Homo sapiens
tttctaaattgcaga

SEQ ID NO: 266688 - DNA, 15 bp, Homo sapiens
gtttctaaattgcag

SEQ ID NO: 266689 - DNA, 15 bp, Homo sapiens
ggtttctaaattgca

SEQ ID NO: 266690 - DNA, 15 bp, Homo sapiens
aggtttctaaattgc

SEQ ID NO: 266691 - DNA, 15 bp, Homo sapiens
aaggtttctaaattg

SEQ ID NO: 266692 - DNA, 15 bp, Homo sapiens
taaggtttctaaatt

SEQ ID NO: 266693 - DNA, 15 bp, Homo sapiens
ataaggtttctaaat

SEQ ID NO: 266694 - DNA, 15 bp, Homo sapiens
aataaggtttctaaa

SEQ ID NO: 266695 - DNA, 15 bp, Homo sapiens
aaataaggtttctaa

SEQ ID NO: 266696 - DNA, 15 bp, Homo sapiens
aaaataaggtttcta

SEQ ID NO: 266697 - DNA, 15 bp, Homo sapiens
taaaataaggtttct

SEQ ID NO: 266698 - DNA, 15 bp, Homo sapiens
ttaaaataaggtttc

SEQ ID NO: 266699 - DNA, 15 bp, Homo sapiens
tttaaaataaggttt

SEQ ID NO: 266700 - DNA, 15 bp, Homo sapiens
atttaaaataaggtt

SEQ ID NO: 266701 - DNA, 15 bp, Homo sapiens
gatttaaaataaggt

SEQ ID NO: 266702 - DNA, 15 bp, Homo sapiens
ggatttaaaataagg

SEQ ID NO: 266703 - DNA, 15 bp, Homo sapiens
tggatttaaaataag

SEQ ID NO: 266704 - DNA, 15 bp, Homo sapiens
gtggatttaaaataa

SEQ ID NO: 266705 - DNA, 15 bp, Homo sapiens
tgtggatttaaaata

SEQ ID NO: 266706 - DNA, 15 bp, Homo sapiens
ttgtggatttaaaat

SEQ ID NO: 266707 - DNA, 15 bp, Homo sapiens
tttgtggatttaaaa

SEQ ID NO: 266708 - DNA, 15 bp, Homo sapiens
ctttgtggatttaaa

SEQ ID NO: 266709 - DNA, 15 bp, Homo sapiens
gctttgtggatttaa

SEQ ID NO: 266710 - DNA, 15 bp, Homo sapiens
tgctttgtggattta

SEQ ID NO: 266711 - DNA, 15 bp, Homo sapiens
gtgctttgtggattt

SEQ ID NO: 266712 - DNA, 15 bp, Homo sapiens
ggtgctttgtggatt

SEQ ID NO: 266713 - DNA, 15 bp, Homo sapiens
gggtgctttgtggat

SEQ ID NO: 266714 - DNA, 15 bp, Homo sapiens
agggtgctttgtgga

SEQ ID NO: 266715 - DNA, 15 bp, Homo sapiens
tagggtgctttgtgg

SEQ ID NO: 266716 - DNA, 15 bp, Homo sapiens
ttagggtgctttgtg

SEQ ID NO: 266717 - DNA, 15 bp, Homo sapiens
tttagggtgctttgt

SEQ ID NO: 266718 - DNA, 15 bp, Homo sapiens
atttagggtgctttg

SEQ ID NO: 266719 - DNA, 15 bp, Homo sapiens
tatttagggtgcttt

SEQ ID NO: 266720 - DNA, 15 bp, Homo sapiens
atatttagggtgctt

SEQ ID NO: 266721 - DNA, 15 bp, Homo sapiens
aatatttagggtgct

SEQ ID NO: 266722 - DNA, 15 bp, Homo sapiens
aaatatttagggtgc

SEQ ID NO: 266723 - DNA, 15 bp, Homo sapiens
aaaatatttagggtg

SEQ ID NO: 266724 - DNA, 15 bp, Homo sapiens
caaaatatttagggt

SEQ ID NO: 266725 - DNA, 15 bp, Homo sapiens
gcaaaatatttaggg

SEQ ID NO: 266726 - DNA, 15 bp, Homo sapiens
ggcaaaatatttagg

SEQ ID NO: 266727 - DNA, 15 bp, Homo sapiens
tggcaaaatatttag

SEQ ID NO: 266728 - DNA, 15 bp, Homo sapiens
ttggcaaaatattta

SEQ ID NO: 266729 - DNA, 15 bp, Homo sapiens
attggcaaaatattt

SEQ ID NO: 266730 - DNA, 15 bp, Homo sapiens
tattggcaaaatatt

SEQ ID NO: 266731 - DNA, 15 bp, Homo sapiens
atattggcaaaatat

SEQ ID NO: 266732 - DNA, 15 bp, Homo sapiens
tatattggcaaaata

SEQ ID NO: 266733 - DNA, 15 bp, Homo sapiens
atatattggcaaaat

SEQ ID NO: 266734 - DNA, 15 bp, Homo sapiens
gatatattggcaaaa

SEQ ID NO: 266735 - DNA, 15 bp, Homo sapiens
agatatattggcaaa

SEQ ID NO: 266736 - DNA, 15 bp, Homo sapiens
cagatatattggcaa

SEQ ID NO: 266737 - DNA, 15 bp, Homo sapiens
gcagatatattggca

SEQ ID NO: 266738 - DNA, 15 bp, Homo sapiens
agcagatatattggc

SEQ ID NO: 266739 - DNA, 15 bp, Homo sapiens
aagcagatatattgg

SEQ ID NO: 266740 - DNA, 15 bp, Homo sapiens
taagcagatatattg

SEQ ID NO: 266741 - DNA, 15 bp, Homo sapiens
ataagcagatatatt

SEQ ID NO: 266742 - DNA, 15 bp, Homo sapiens
cataagcagatatat

SEQ ID NO: 266743 - DNA, 15 bp, Homo sapiens
tcataagcagatata

SEQ ID NO: 266744 - DNA, 15 bp, Homo sapiens
atcataagcagatat

SEQ ID NO: 266745 - DNA, 15 bp, Homo sapiens
aatcataagcagata

SEQ ID NO: 266746 - DNA, 15 bp, Homo sapiens
aaatcataagcagat

SEQ ID NO: 266747 - DNA, 15 bp, Homo sapiens
taaatcataagcaga

SEQ ID NO: 266748 - DNA, 15 bp, Homo sapiens
ataaatcataagcag

SEQ ID NO: 266749 - DNA, 15 bp, Homo sapiens
cataaatcataagca

SEQ ID NO: 266750 - DNA, 15 bp, Homo sapiens
ccataaatcataagc

SEQ ID NO: 266751 - DNA, 15 bp, Homo sapiens
accataaatcataag

SEQ ID NO: 266752 - DNA, 15 bp, Homo sapiens
taccataaatcataa

SEQ ID NO: 266753 - DNA, 15 bp, Homo sapiens
ttaccataaatcata

SEQ ID NO: 266754 - DNA, 15 bp, Homo sapiens
attaccataaatcat

SEQ ID NO: 266755 - DNA, 15 bp, Homo sapiens
cattaccataaatca

SEQ ID NO: 266756 - DNA, 15 bp, Homo sapiens
acattaccataaatc

SEQ ID NO: 266757 - DNA, 15 bp, Homo sapiens
aacattaccataaat

SEQ ID NO: 266758 - DNA, 15 bp, Homo sapiens
aaacattaccataaa

SEQ ID NO: 266759 - DNA, 15 bp, Homo sapiens
aaaacattaccataa

SEQ ID NO: 266760 - DNA, 15 bp, Homo sapiens
gaaaacattaccata

SEQ ID NO: 266761 - DNA, 15 bp, Homo sapiens
ggaaaacattaccat

SEQ ID NO: 266762 - DNA, 15 bp, Homo sapiens
aggaaaacattacca

SEQ ID NO: 266763 - DNA, 15 bp, Homo sapiens
aaggaaaacattacc

SEQ ID NO: 266764 - DNA, 15 bp, Homo sapiens
aaaggaaaacattac

SEQ ID NO: 266765 - DNA, 15 bp, Homo sapiens
taaaggaaaacatta

SEQ ID NO: 266766 - DNA, 15 bp, Homo sapiens
ctaaaggaaaacatt

SEQ ID NO: 266767 - DNA, 15 bp, Homo sapiens
gctaaaggaaaacat

SEQ ID NO: 266768 - DNA, 15 bp, Homo sapiens
agctaaaggaaaaca

SEQ ID NO: 266769 - DNA, 15 bp, Homo sapiens
cagctaaaggaaaac

SEQ ID NO: 266770 - DNA, 15 bp, Homo sapiens
acagctaaaggaaaa

SEQ ID NO: 266771 - DNA, 15 bp, Homo sapiens
tacagctaaaggaaa

SEQ ID NO: 266772 - DNA, 15 bp, Homo sapiens
ttacagctaaaggaa

SEQ ID NO: 266773 - DNA, 15 bp, Homo sapiens
cttacagctaaagga

SEQ ID NO: 266774 - DNA, 15 bp, Homo sapiens
tcttacagctaaagg

SEQ ID NO: 266775 - DNA, 15 bp, Homo sapiens
ttcttacagctaaag

SEQ ID NO: 266776 - DNA, 15 bp, Homo sapiens
cttcttacagctaaa

SEQ ID NO: 266777 - DNA, 15 bp, Homo sapiens
tcttcttacagctaa

SEQ ID NO: 266778 - DNA, 15 bp, Homo sapiens
gtcttcttacagcta

SEQ ID NO: 266779 - DNA, 15 bp, Homo sapiens
agtcttcttacagct

SEQ ID NO: 266780 - DNA, 15 bp, Homo sapiens
tagtcttcttacagc

SEQ ID NO: 266781 - DNA, 15 bp, Homo sapiens
ttagtcttcttacag

SEQ ID NO: 266782 - DNA, 15 bp, Homo sapiens
attagtcttcttaca

SEQ ID NO: 266783 - DNA, 15 bp, Homo sapiens
cattagtcttcttac

SEQ ID NO: 266784 - DNA, 15 bp, Homo sapiens
ccattagtcttctta

SEQ ID NO: 266785 - DNA, 15 bp, Homo sapiens
accattagtcttctt

SEQ ID NO: 266786 - DNA, 15 bp, Homo sapiens
taccattagtcttct

SEQ ID NO: 266787 - DNA, 15 bp, Homo sapiens
ataccattagtcttc

SEQ ID NO: 266788 - DNA, 15 bp, Homo sapiens
tataccattagtctt

SEQ ID NO: 266789 - DNA, 15 bp, Homo sapiens
atataccattagtct

SEQ ID NO: 266790 - DNA, 15 bp, Homo sapiens
catataccattagtc

SEQ ID NO: 266791 - DNA, 15 bp, Homo sapiens
tcatataccattagt

SEQ ID NO: 266792 - DNA, 15 bp, Homo sapiens
ttcatataccattag

SEQ ID NO: 266793 - DNA, 15 bp, Homo sapiens
attcatataccatta

SEQ ID NO: 266794 - DNA, 15 bp, Homo sapiens
cattcatataccatt

SEQ ID NO: 266795 - DNA, 15 bp, Homo sapiens
tcattcatataccat

SEQ ID NO: 266796 - DNA, 15 bp, Homo sapiens
ttcattcatatacca

SEQ ID NO: 266797 - DNA, 15 bp, Homo sapiens
gttcattcatatacc

SEQ ID NO: 266798 - DNA, 15 bp, Homo sapiens
agttcattcatatac

SEQ ID NO: 266799 - DNA, 15 bp, Homo sapiens
tagttcattcatata

SEQ ID NO: 266800 - DNA, 15 bp, Homo sapiens
atagttcattcatat

SEQ ID NO: 266801 - DNA, 15 bp, Homo sapiens
gatagttcattcata

SEQ ID NO: 266802 - DNA, 15 bp, Homo sapiens
tgatagttcattcat

SEQ ID NO: 266803 - DNA, 15 bp, Homo sapiens
atgatagttcattca

SEQ ID NO: 266804 - DNA, 15 bp, Homo sapiens
catgatagttcattc

SEQ ID NO: 266805 - DNA, 15 bp, Homo sapiens
tcatgatagttcatt

SEQ ID NO: 266806 - DNA, 15 bp, Homo sapiens
gtcatgatagttcat

SEQ ID NO: 266807 - DNA, 15 bp, Homo sapiens
agtcatgatagttca

SEQ ID NO: 266808 - DNA, 15 bp, Homo sapiens
gagtcatgatagttc

SEQ ID NO: 266809 - DNA, 15 bp, Homo sapiens
tgagtcatgatagtt

SEQ ID NO: 266810 - DNA, 15 bp, Homo sapiens
atgagtcatgatagt

SEQ ID NO: 266811 - DNA, 15 bp, Homo sapiens
catgagtcatgatag

SEQ ID NO: 266812 - DNA, 15 bp, Homo sapiens
tcatgagtcatgata

SEQ ID NO: 266813 - DNA, 15 bp, Homo sapiens
ttcatgagtcatgat

SEQ ID NO: 266814 - DNA, 15 bp, Homo sapiens
tttcatgagtcatga

SEQ ID NO: 266815 - DNA, 15 bp, Homo sapiens
ctttcatgagtcatg

SEQ ID NO: 266816 - DNA, 15 bp, Homo sapiens
actttcatgagtcat

SEQ ID NO: 266817 - DNA, 15 bp, Homo sapiens
tactttcatgagtca

SEQ ID NO: 266818 - DNA, 15 bp, Homo sapiens
atactttcatgagtc

SEQ ID NO: 266819 - DNA, 15 bp, Homo sapiens
aatactttcatgagt

SEQ ID NO: 266820 - DNA, 15 bp, Homo sapiens
aaatactttcatgag

SEQ ID NO: 266821 - DNA, 15 bp, Homo sapiens
aaaatactttcatga

SEQ ID NO: 266822 - DNA, 15 bp, Homo sapiens
taaaatactttcatg

SEQ ID NO: 266823 - DNA, 15 bp, Homo sapiens
ataaaatactttcat

SEQ ID NO: 266824 - DNA, 15 bp, Homo sapiens
cataaaatactttca

SEQ ID NO: 266825 - DNA, 15 bp, Homo sapiens
tcataaaatactttc

SEQ ID NO: 266826 - DNA, 15 bp, Homo sapiens
atcataaaatacttt

SEQ ID NO: 266827 - DNA, 15 bp, Homo sapiens
tatcataaaatactt

SEQ ID NO: 266828 - DNA, 15 bp, Homo sapiens
atatcataaaatact

SEQ ID NO: 266829 - DNA, 15 bp, Homo sapiens
aatatcataaaatac

SEQ ID NO: 266830 - DNA, 15 bp, Homo sapiens
caatatcataaaata

SEQ ID NO: 266831 - DNA, 15 bp, Homo sapiens
tcaatatcataaaat

SEQ ID NO: 266832 - DNA, 15 bp, Homo sapiens
atcaatatcataaaa

SEQ ID NO: 266833 - DNA, 15 bp, Homo sapiens
tatcaatatcataaa

SEQ ID NO: 266834 - DNA, 15 bp, Homo sapiens
ttatcaatatcataa

SEQ ID NO: 266835 - DNA, 15 bp, Homo sapiens
attatcaatatcata

SEQ ID NO: 266836 - DNA, 15 bp, Homo sapiens
aattatcaatatcat

SEQ ID NO: 266837 - DNA, 15 bp, Homo sapiens
aaattatcaatatca

SEQ ID NO: 266838 - DNA, 15 bp, Homo sapiens
taaattatcaatatc

SEQ ID NO: 266839 - DNA, 15 bp, Homo sapiens
ataaattatcaatat

SEQ ID NO: 266840 - DNA, 15 bp, Homo sapiens
tataaattatcaata

SEQ ID NO: 266841 - DNA, 15 bp, Homo sapiens
atataaattatcaat

SEQ ID NO: 266842 - DNA, 15 bp, Homo sapiens
tatataaattatcaa

SEQ ID NO: 266843 - DNA, 15 bp, Homo sapiens
atatataaattatca

SEQ ID NO: 266844 - DNA, 15 bp, Homo sapiens
catatataaattatc

SEQ ID NO: 266845 - DNA, 15 bp, Homo sapiens
acatatataaattat

SEQ ID NO: 266846 - DNA, 15 bp, Homo sapiens
tacatatataaatta

SEQ ID NO: 266847 - DNA, 15 bp, Homo sapiens
atacatatataaatt

SEQ ID NO: 266848 - DNA, 15 bp, Homo sapiens
tatacatatataaat

SEQ ID NO: 266849 - DNA, 15 bp, Homo sapiens
atatacatatataaa

SEQ ID NO: 266850 - DNA, 15 bp, Homo sapiens
tatatacatatataa

SEQ ID NO: 266851 - DNA, 15 bp, Homo sapiens
ttatatatacatata

SEQ ID NO: 266852 - DNA, 15 bp, Homo sapiens
tttatatatacatat

SEQ ID NO: 266853 - DNA, 15 bp, Homo sapiens
atttatatatacata

SEQ ID NO: 266854 - DNA, 15 bp, Homo sapiens
aatttatatatacat

SEQ ID NO: 266855 - DNA, 15 bp, Homo sapiens
taatttatatataca

SEQ ID NO: 266856 - DNA, 15 bp, Homo sapiens
ataatttatatatac

SEQ ID NO: 266857 - DNA, 15 bp, Homo sapiens
gataatttatatata

SEQ ID NO: 266858 - DNA, 15 bp, Homo sapiens
agataatttatatat

SEQ ID NO: 266859 - DNA, 15 bp, Homo sapiens
cagataatttatata

SEQ ID NO: 266860 - DNA, 15 bp, Homo sapiens
tcagataatttatat

SEQ ID NO: 266861 - DNA, 15 bp, Homo sapiens
ttcagataatttata

SEQ ID NO: 266862 - DNA, 15 bp, Homo sapiens
cttcagataatttat

SEQ ID NO: 266863 - DNA, 15 bp, Homo sapiens
tcttcagataattta

SEQ ID NO: 266864 - DNA, 15 bp, Homo sapiens
ttcttcagataattt

SEQ ID NO: 266865 - DNA, 15 bp, Homo sapiens
tttcttcagataatt

SEQ ID NO: 266866 - DNA, 15 bp, Homo sapiens
atttcttcagataat

SEQ ID NO: 266867 - DNA, 15 bp, Homo sapiens
catttcttcagataa

SEQ ID NO: 266868 - DNA, 15 bp, Homo sapiens
acatttcttcagata

SEQ ID NO: 266869 - DNA, 15 bp, Homo sapiens
tacatttcttcagat

SEQ ID NO: 266870 - DNA, 15 bp, Homo sapiens
ctacatttcttcaga

SEQ ID NO: 266871 - DNA, 15 bp, Homo sapiens
gctacatttcttcag

SEQ ID NO: 266872 - DNA, 15 bp, Homo sapiens
tgctacatttcttca

SEQ ID NO: 266873 - DNA, 15 bp, Homo sapiens
ctgctacatttcttc

SEQ ID NO: 266874 - DNA, 15 bp, Homo sapiens
tctgctacatttctt

SEQ ID NO: 266875 - DNA, 15 bp, Homo sapiens
ttctgctacatttct

SEQ ID NO: 266876 - DNA, 15 bp, Homo sapiens
attctgctacatttc

SEQ ID NO: 266877 - DNA, 15 bp, Homo sapiens
aattctgctacattt

SEQ ID NO: 266878 - DNA, 15 bp, Homo sapiens
aaattctgctacatt

SEQ ID NO: 266879 - DNA, 15 bp, Homo sapiens
aaaattctgctacat

SEQ ID NO: 266880 - DNA, 15 bp, Homo sapiens
aaaaattctgctaca

SEQ ID NO: 266881 - DNA, 15 bp, Homo sapiens
taaaaattctgctac

SEQ ID NO: 266882 - DNA, 15 bp, Homo sapiens
ataaaaattctgcta

SEQ ID NO: 266883 - DNA, 15 bp, Homo sapiens
aataaaaattctgct

SEQ ID NO: 266884 - DNA, 15 bp, Homo sapiens
aaataaaaattctgc

SEQ ID NO: 266885 - DNA, 15 bp, Homo sapiens
gaaataaaaattctg

SEQ ID NO: 266886 - DNA, 15 bp, Homo sapiens
agaaataaaaattct

SEQ ID NO: 266887 - DNA, 15 bp, Homo sapiens
gagaaataaaaattc

SEQ ID NO: 266888 - DNA, 15 bp, Homo sapiens
agagaaataaaaatt

SEQ ID NO: 266889 - DNA, 15 bp, Homo sapiens
tagagaaataaaaat

SEQ ID NO: 266890 - DNA, 15 bp, Homo sapiens
ctagagaaataaaaa

SEQ ID NO: 266891 - DNA, 15 bp, Homo sapiens
cctagagaaataaaa

SEQ ID NO: 266892 - DNA, 15 bp, Homo sapiens
tcctagagaaataaa

SEQ ID NO: 266893 - DNA, 15 bp, Homo sapiens
ttcctagagaaataa

SEQ ID NO: 266894 - DNA, 15 bp, Homo sapiens
tttcctagagaaata

SEQ ID NO: 266895 - DNA, 15 bp, Homo sapiens
atttcctagagaaat

SEQ ID NO: 266896 - DNA, 15 bp, Homo sapiens
catttcctagagaaa

SEQ ID NO: 266897 - DNA, 15 bp, Homo sapiens
tcatttcctagagaa

SEQ ID NO: 266898 - DNA, 15 bp, Homo sapiens
atcatttcctagaga

SEQ ID NO: 266899 - DNA, 15 bp, Homo sapiens
aatcatttcctagag

SEQ ID NO: 266900 - DNA, 15 bp, Homo sapiens
aaatcatttcctaga

SEQ ID NO: 266901 - DNA, 15 bp, Homo sapiens
aaaatcatttcctag

SEQ ID NO: 266902 - DNA, 15 bp, Homo sapiens
aaaaatcatttccta

SEQ ID NO: 266903 - DNA, 15 bp, Homo sapiens
aaaaaatcatttcct

SEQ ID NO: 266904 - DNA, 15 bp, Homo sapiens
caaaaaatcatttcc

SEQ ID NO: 266905 - DNA, 15 bp, Homo sapiens
acaaaaaatcatttc

SEQ ID NO: 266906 - DNA, 15 bp, Homo sapiens
gacaaaaaatcattt

SEQ ID NO: 266907 - DNA, 15 bp, Homo sapiens
agacaaaaaatcatt

SEQ ID NO: 266908 - DNA, 15 bp, Homo sapiens
aagacaaaaaatcat

SEQ ID NO: 266909 - DNA, 15 bp, Homo sapiens
taagacaaaaaatca

SEQ ID NO: 266910 - DNA, 15 bp, Homo sapiens
ataagacaaaaaatc

SEQ ID NO: 266911 - DNA, 15 bp, Homo sapiens
aataagacaaaaaat

SEQ ID NO: 266912 - DNA, 15 bp, Homo sapiens
aaataagacaaaaaa

SEQ ID NO: 266913 - DNA, 15 bp, Homo sapiens
gaaataagacaaaaa

SEQ ID NO: 266914 - DNA, 15 bp, Homo sapiens
ggaaataagacaaaa

SEQ ID NO: 266915 - DNA, 15 bp, Homo sapiens
gggaaataagacaaa

SEQ ID NO: 266916 - DNA, 15 bp, Homo sapiens
ggggaaataagacaa

SEQ ID NO: 266917 - DNA, 15 bp, Homo sapiens
gggggaaataagaca

SEQ ID NO: 266918 - DNA, 15 bp, Homo sapiens
agggggaaataagac

SEQ ID NO: 266919 - DNA, 15 bp, Homo sapiens
tagggggaaataaga

SEQ ID NO: 266920 - DNA, 15 bp, Homo sapiens
gtagggggaaataag

SEQ ID NO: 266921 - DNA, 15 bp, Homo sapiens
agtagggggaaataa

SEQ ID NO: 266922 - DNA, 15 bp, Homo sapiens
tagtagggggaaata

SEQ ID NO: 266923 - DNA, 15 bp, Homo sapiens
atagtagggggaaat

SEQ ID NO: 266924 - DNA, 15 bp, Homo sapiens
aatagtagggggaaa

SEQ ID NO: 266925 - DNA, 15 bp, Homo sapiens
gaatagtagggggaa

SEQ ID NO: 266926 - DNA, 15 bp, Homo sapiens
agaatagtaggggga

SEQ ID NO: 266927 - DNA, 15 bp, Homo sapiens
tagaatagtaggggg

SEQ ID NO: 266928 - DNA, 15 bp, Homo sapiens
atagaatagtagggg

SEQ ID NO: 266929 - DNA, 15 bp, Homo sapiens
tatagaatagtaggg

SEQ ID NO: 266930 - DNA, 15 bp, Homo sapiens
ttatagaatagtagg

SEQ ID NO: 266931 - DNA, 15 bp, Homo sapiens
attatagaatagtag

SEQ ID NO: 266932 - DNA, 15 bp, Homo sapiens
gattatagaatagta

SEQ ID NO: 266933 - DNA, 15 bp, Homo sapiens
ggattatagaatagt

SEQ ID NO: 266934 - DNA, 15 bp, Homo sapiens
tggattatagaatag

SEQ ID NO: 266935 - DNA, 15 bp, Homo sapiens
ttggattatagaata

SEQ ID NO: 266936 - DNA, 15 bp, Homo sapiens
tttggattatagaat

SEQ ID NO: 266937 - DNA, 15 bp, Homo sapiens
atttggattatagaa

SEQ ID NO: 266938 - DNA, 15 bp, Homo sapiens
aatttggattataga

SEQ ID NO: 266939 - DNA, 15 bp, Homo sapiens
aaatttggattatag

SEQ ID NO: 266940 - DNA, 15 bp, Homo sapiens
caaatttggattata

SEQ ID NO: 266941 - DNA, 15 bp, Homo sapiens
acaaatttggattat

SEQ ID NO: 266942 - DNA, 15 bp, Homo sapiens
tacaaatttggatta

SEQ ID NO: 266943 - DNA, 15 bp, Homo sapiens
gtacaaatttggatt

SEQ ID NO: 266944 - DNA, 15 bp, Homo sapiens
tgtacaaatttggat

SEQ ID NO: 266945 - DNA, 15 bp, Homo sapiens
atgtacaaatttgga

SEQ ID NO: 266946 - DNA, 15 bp, Homo sapiens
aatgtacaaatttgg

SEQ ID NO: 266947 - DNA, 15 bp, Homo sapiens
aaatgtacaaatttg

SEQ ID NO: 266948 - DNA, 15 bp, Homo sapiens
taaatgtacaaattt

SEQ ID NO: 266949 - DNA, 15 bp, Homo sapiens
ttaaatgtacaaatt

SEQ ID NO: 266950 - DNA, 15 bp, Homo sapiens
cttaaatgtacaaat

SEQ ID NO: 266951 - DNA, 15 bp, Homo sapiens
tcttaaatgtacaaa

SEQ ID NO: 266952 - DNA, 15 bp, Homo sapiens
ttcttaaatgtacaa

SEQ ID NO: 266953 - DNA, 15 bp, Homo sapiens
attcttaaatgtaca

SEQ ID NO: 266954 - DNA, 15 bp, Homo sapiens
aattcttaaatgtac

SEQ ID NO: 266955 - DNA, 15 bp, Homo sapiens
gaattcttaaatgta

SEQ ID NO: 266956 - DNA, 15 bp, Homo sapiens
agaattcttaaatgt

SEQ ID NO: 266957 - DNA, 15 bp, Homo sapiens
aagaattcttaaatg

SEQ ID NO: 266958 - DNA, 15 bp, Homo sapiens
aaagaattcttaaat

SEQ ID NO: 266959 - DNA, 15 bp, Homo sapiens
gaaagaattcttaaa

SEQ ID NO: 266960 - DNA, 15 bp, Homo sapiens
tgaaagaattcttaa

SEQ ID NO: 266961 - DNA, 15 bp, Homo sapiens
atgaaagaattctta

SEQ ID NO: 266962 - DNA, 15 bp, Homo sapiens
aatgaaagaattctt

SEQ ID NO: 266963 - DNA, 15 bp, Homo sapiens
taatgaaagaattct

SEQ ID NO: 266964 - DNA, 15 bp, Homo sapiens
ctaatgaaagaattc

SEQ ID NO: 266965 - DNA, 15 bp, Homo sapiens
cctaatgaaagaatt

SEQ ID NO: 266966 - DNA, 15 bp, Homo sapiens
gcctaatgaaagaat

SEQ ID NO: 266967 - DNA, 15 bp, Homo sapiens
agcctaatgaaagaa

SEQ ID NO: 266968 - DNA, 15 bp, Homo sapiens
aagcctaatgaaaga

SEQ ID NO: 266969 - DNA, 15 bp, Homo sapiens
taagcctaatgaaag

SEQ ID NO: 266970 - DNA, 15 bp, Homo sapiens
ttaagcctaatgaaa

SEQ ID NO: 266971 - DNA, 15 bp, Homo sapiens
attaagcctaatgaa

SEQ ID NO: 266972 - DNA, 15 bp, Homo sapiens
tattaagcctaatga

SEQ ID NO: 266973 - DNA, 15 bp, Homo sapiens
ttattaagcctaatg

SEQ ID NO: 266974 - DNA, 15 bp, Homo sapiens
cttattaagcctaat

SEQ ID NO: 266975 - DNA, 15 bp, Homo sapiens
tcttattaagcctaa

SEQ ID NO: 266976 - DNA, 15 bp, Homo sapiens
ctcttattaagccta

SEQ ID NO: 266977 - DNA, 15 bp, Homo sapiens
actcttattaagcct

SEQ ID NO: 266978 - DNA, 15 bp, Homo sapiens
aactcttattaagcc

SEQ ID NO: 266979 - DNA, 15 bp, Homo sapiens
caactcttattaagc

SEQ ID NO: 266980 - DNA, 15 bp, Homo sapiens
tcaactcttattaag

SEQ ID NO: 266981 - DNA, 15 bp, Homo sapiens
atcaactcttattaa

SEQ ID NO: 266982 - DNA, 15 bp, Homo sapiens
gatcaactcttatta

SEQ ID NO: 266983 - DNA, 15 bp, Homo sapiens
agatcaactcttatt

SEQ ID NO: 266984 - DNA, 15 bp, Homo sapiens
aagatcaactcttat

SEQ ID NO: 266985 - DNA, 15 bp, Homo sapiens
gaagatcaactctta

SEQ ID NO: 266986 - DNA, 15 bp, Homo sapiens
tgaagatcaactctt

SEQ ID NO: 266987 - DNA, 15 bp, Homo sapiens
ttgaagatcaactct

SEQ ID NO: 266988 - DNA, 15 bp, Homo sapiens
cttgaagatcaactc

SEQ ID NO: 266989 - DNA, 15 bp, Homo sapiens
tcttgaagatcaact

SEQ ID NO: 266990 - DNA, 15 bp, Homo sapiens
ctcttgaagatcaac

SEQ ID NO: 266991 - DNA, 15 bp, Homo sapiens
tctcttgaagatcaa

SEQ ID NO: 266992 - DNA, 15 bp, Homo sapiens
gtctcttgaagatca

SEQ ID NO: 266993 - DNA, 15 bp, Homo sapiens
tgtctcttgaagatc

SEQ ID NO: 266994 - DNA, 15 bp, Homo sapiens
ctgtctcttgaagat

SEQ ID NO: 266995 - DNA, 15 bp, Homo sapiens
gctgtctcttgaaga

SEQ ID NO: 266996 - DNA, 15 bp, Homo sapiens
tgctgtctcttgaag

SEQ ID NO: 266997 - DNA, 15 bp, Homo sapiens
atgctgtctcttgaa

SEQ ID NO: 266998 - DNA, 15 bp, Homo sapiens
catgctgtctcttga

SEQ ID NO: 266999 - DNA, 15 bp, Homo sapiens
tcatgctgtctcttg

SEQ ID NO: 267000 - DNA, 15 bp, Homo sapiens
gtcatgctgtctctt

SEQ ID NO: 267001 - DNA, 15 bp, Homo sapiens
tgtcatgctgtctct

SEQ ID NO: 267002 - DNA, 15 bp, Homo sapiens
gtgtcatgctgtctc

SEQ ID NO: 267003 - DNA, 15 bp, Homo sapiens
tgtgtcatgctgtct

SEQ ID NO: 267004 - DNA, 15 bp, Homo sapiens
ctgtgtcatgctgtc

SEQ ID NO: 267005 - DNA, 15 bp, Homo sapiens
tctgtgtcatgctgt

SEQ ID NO: 267006 - DNA, 15 bp, Homo sapiens
atctgtgtcatgctg

SEQ ID NO: 267007 - DNA, 15 bp, Homo sapiens
catctgtgtcatgct

SEQ ID NO: 267008 - DNA, 15 bp, Homo sapiens
tcatctgtgtcatgc

SEQ ID NO: 267009 - DNA, 15 bp, Homo sapiens
atcatctgtgtcatg

SEQ ID NO: 267010 - DNA, 15 bp, Homo sapiens
tatcatctgtgtcat

SEQ ID NO: 267011 - DNA, 15 bp, Homo sapiens
atatcatctgtgtca

SEQ ID NO: 267012 - DNA, 15 bp, Homo sapiens
aatatcatctgtgtc

SEQ ID NO: 267013 - DNA, 15 bp, Homo sapiens
aaatatcatctgtgt

SEQ ID NO: 267014 - DNA, 15 bp, Homo sapiens
taaatatcatctgtg

SEQ ID NO: 267015 - DNA, 15 bp, Homo sapiens
ttaaatatcatctgt

SEQ ID NO: 267016 - DNA, 15 bp, Homo sapiens
attaaatatcatctg

SEQ ID NO: 267017 - DNA, 15 bp, Homo sapiens
cattaaatatcatct

SEQ ID NO: 267018 - DNA, 15 bp, Homo sapiens
gcattaaatatcatc

SEQ ID NO: 267019 - DNA, 15 bp, Homo sapiens
ggcattaaatatcat

SEQ ID NO: 267020 - DNA, 15 bp, Homo sapiens
aggcattaaatatca

SEQ ID NO: 267021 - DNA, 15 bp, Homo sapiens
caggcattaaatatc

SEQ ID NO: 267022 - DNA, 15 bp, Homo sapiens
acaggcattaaatat

SEQ ID NO: 267023 - DNA, 15 bp, Homo sapiens
gacaggcattaaata

SEQ ID NO: 267024 - DNA, 15 bp, Homo sapiens
tgacaggcattaaat

SEQ ID NO: 267025 - DNA, 15 bp, Homo sapiens
atgacaggcattaaa

SEQ ID NO: 267026 - DNA, 15 bp, Homo sapiens
gatgacaggcattaa

SEQ ID NO: 267027 - DNA, 15 bp, Homo sapiens
tgatgacaggcatta

SEQ ID NO: 267028 - DNA, 15 bp, Homo sapiens
atgatgacaggcatt

SEQ ID NO: 267029 - DNA, 15 bp, Homo sapiens
aatgatgacaggcat

SEQ ID NO: 267030 - DNA, 15 bp, Homo sapiens
gaatgatgacaggca

SEQ ID NO: 267031 - DNA, 15 bp, Homo sapiens
agaatgatgacaggc

SEQ ID NO: 267032 - DNA, 15 bp, Homo sapiens
cagaatgatgacagg

SEQ ID NO: 267033 - DNA, 15 bp, Homo sapiens
acagaatgatgacag

SEQ ID NO: 267034 - DNA, 15 bp, Homo sapiens
gacagaatgatgaca

SEQ ID NO: 267035 - DNA, 15 bp, Homo sapiens
agacagaatgatgac

SEQ ID NO: 267036 - DNA, 15 bp, Homo sapiens
gagacagaatgatga

SEQ ID NO: 267037 - DNA, 15 bp, Homo sapiens
ggagacagaatgatg

SEQ ID NO: 267038 - DNA, 15 bp, Homo sapiens
tggagacagaatgat

SEQ ID NO: 267039 - DNA, 15 bp, Homo sapiens
atggagacagaatga

SEQ ID NO: 267040 - DNA, 15 bp, Homo sapiens
tatggagacagaatg

SEQ ID NO: 267041 - DNA, 15 bp, Homo sapiens
atatggagacagaat

SEQ ID NO: 267042 - DNA, 15 bp, Homo sapiens
catatggagacagaa

SEQ ID NO: 267043 - DNA, 15 bp, Homo sapiens
acatatggagacaga

SEQ ID NO: 267044 - DNA, 15 bp, Homo sapiens
gacatatggagacag

SEQ ID NO: 267045 - DNA, 15 bp, Homo sapiens
ggacatatggagaca

SEQ ID NO: 267046 - DNA, 15 bp, Homo sapiens
tggacatatggagac

SEQ ID NO: 267047 - DNA, 15 bp, Homo sapiens
ttggacatatggaga

SEQ ID NO: 267048 - DNA, 15 bp, Homo sapiens
tttggacatatggag

SEQ ID NO: 267049 - DNA, 15 bp, Homo sapiens
atttggacatatgga

SEQ ID NO: 267050 - DNA, 15 bp, Homo sapiens
gatttggacatatgg

SEQ ID NO: 267051 - DNA, 15 bp, Homo sapiens
ggatttggacatatg

SEQ ID NO: 267052 - DNA, 15 bp, Homo sapiens
gggatttggacatat

SEQ ID NO: 267053 - DNA, 15 bp, Homo sapiens
tgggatttggacata

SEQ ID NO: 267054 - DNA, 15 bp, Homo sapiens
gtgggatttggacat

SEQ ID NO: 267055 - DNA, 15 bp, Homo sapiens
ggtgggatttggaca

SEQ ID NO: 267056 - DNA, 15 bp, Homo sapiens
aggtgggatttggac

SEQ ID NO: 267057 - DNA, 15 bp, Homo sapiens
aaggtgggatttgga

SEQ ID NO: 267058 - DNA, 15 bp, Homo sapiens
gaaggtgggatttgg

SEQ ID NO: 267059 - DNA, 15 bp, Homo sapiens
agaaggtgggatttg

SEQ ID NO: 267060 - DNA, 15 bp, Homo sapiens
gagaaggtgggattt

SEQ ID NO: 267061 - DNA, 15 bp, Homo sapiens
tgagaaggtgggatt

SEQ ID NO: 267062 - DNA, 15 bp, Homo sapiens
gtgagaaggtgggat

SEQ ID NO: 267063 - DNA, 15 bp, Homo sapiens
tgtgagaaggtggga

SEQ ID NO: 267064 - DNA, 15 bp, Homo sapiens
ttgtgagaaggtggg

SEQ ID NO: 267065 - DNA, 15 bp, Homo sapiens
tttgtgagaaggtgg

SEQ ID NO: 267066 - DNA, 15 bp, Homo sapiens
ttttgtgagaaggtg

SEQ ID NO: 267067 - DNA, 15 bp, Homo sapiens
tttttgtgagaaggt

SEQ ID NO: 267068 - DNA, 15 bp, Homo sapiens
gtttttgtgagaagg

SEQ ID NO: 267069 - DNA, 15 bp, Homo sapiens
tgtttttgtgagaag

SEQ ID NO: 267070 - DNA, 15 bp, Homo sapiens
ctgtttttgtgagaa

SEQ ID NO: 267071 - DNA, 15 bp, Homo sapiens
gctgtttttgtgaga

SEQ ID NO: 267072 - DNA, 15 bp, Homo sapiens
agctgtttttgtgag

SEQ ID NO: 267073 - DNA, 15 bp, Homo sapiens
gagctgtttttgtga

SEQ ID NO: 267074 - DNA, 15 bp, Homo sapiens
tgagctgtttttgtg

SEQ ID NO: 267075 - DNA, 15 bp, Homo sapiens
ttgagctgtttttgt

SEQ ID NO: 267076 - DNA, 15 bp, Homo sapiens
gttgagctgtttttg

SEQ ID NO: 267077 - DNA, 15 bp, Homo sapiens
agttgagctgttttt

SEQ ID NO: 267078 - DNA, 15 bp, Homo sapiens
gagttgagctgtttt

SEQ ID NO: 267079 - DNA, 15 bp, Homo sapiens
ggagttgagctgttt

SEQ ID NO: 267080 - DNA, 15 bp, Homo sapiens
gggagttgagctgtt

SEQ ID NO: 267081 - DNA, 15 bp, Homo sapiens
tgggagttgagctgt

SEQ ID NO: 267082 - DNA, 15 bp, Homo sapiens
gtgggagttgagctg

SEQ ID NO: 267083 - DNA, 15 bp, Homo sapiens
agtgggagttgagct

SEQ ID NO: 267084 - DNA, 15 bp, Homo sapiens
aagtgggagttgagc

SEQ ID NO: 267085 - DNA, 15 bp, Homo sapiens
aaagtgggagttgag

SEQ ID NO: 267086 - DNA, 15 bp, Homo sapiens
caaagtgggagttga

SEQ ID NO: 267087 - DNA, 15 bp, Homo sapiens
acaaagtgggagttg

SEQ ID NO: 267088 - DNA, 15 bp, Homo sapiens
cacaaagtgggagtt

SEQ ID NO: 267089 - DNA, 15 bp, Homo sapiens
acacaaagtgggagt

SEQ ID NO: 267090 - DNA, 15 bp, Homo sapiens
cacacaaagtgggag

SEQ ID NO: 267091 - DNA, 15 bp, Homo sapiens
acacacaaagtggga

SEQ ID NO: 267092 - DNA, 15 bp, Homo sapiens
cacacacaaagtggg

SEQ ID NO: 267093 - DNA, 15 bp, Homo sapiens
tcacacacaaagtgg

SEQ ID NO: 267094 - DNA, 15 bp, Homo sapiens
ttcacacacaaagtg

SEQ ID NO: 267095 - DNA, 15 bp, Homo sapiens
tttcacacacaaagt

SEQ ID NO: 267096 - DNA, 15 bp, Homo sapiens
atttcacacacaaag

SEQ ID NO: 267097 - DNA, 15 bp, Homo sapiens
gatttcacacacaaa

SEQ ID NO: 267098 - DNA, 15 bp, Homo sapiens
agatttcacacacaa

SEQ ID NO: 267099 - DNA, 15 bp, Homo sapiens
gagatttcacacaca

SEQ ID NO: 267100 - DNA, 15 bp, Homo sapiens
agagatttcacacac

SEQ ID NO: 267101 - DNA, 15 bp, Homo sapiens
gagagatttcacaca

SEQ ID NO: 267102 - DNA, 15 bp, Homo sapiens
ggagagatttcacac

SEQ ID NO: 267103 - DNA, 15 bp, Homo sapiens
gggagagatttcaca

SEQ ID NO: 267104 - DNA, 15 bp, Homo sapiens
tgggagagatttcac

SEQ ID NO: 267105 - DNA, 15 bp, Homo sapiens
ctgggagagatttca

SEQ ID NO: 267106 - DNA, 15 bp, Homo sapiens
gctgggagagatttc

SEQ ID NO: 267107 - DNA, 15 bp, Homo sapiens
agctgggagagattt

SEQ ID NO: 267108 - DNA, 15 bp, Homo sapiens
gagctgggagagatt

SEQ ID NO: 267109 - DNA, 15 bp, Homo sapiens
ggagctgggagagat

SEQ ID NO: 267110 - DNA, 15 bp, Homo sapiens
aggagctgggagaga

SEQ ID NO: 267111 - DNA, 15 bp, Homo sapiens
gaggagctgggagag

SEQ ID NO: 267112 - DNA, 15 bp, Homo sapiens
ggaggagctgggaga

SEQ ID NO: 267113 - DNA, 15 bp, Homo sapiens
tggaggagctgggag

SEQ ID NO: 267114 - DNA, 15 bp, Homo sapiens
ctggaggagctggga

SEQ ID NO: 267115 - DNA, 15 bp, Homo sapiens
actggaggagctggg

SEQ ID NO: 267116 - DNA, 15 bp, Homo sapiens
aactggaggagctgg

SEQ ID NO: 267117 - DNA, 15 bp, Homo sapiens
aaactggaggagctg

SEQ ID NO: 267118 - DNA, 15 bp, Homo sapiens
aaaactggaggagct

SEQ ID NO: 267119 - DNA, 15 bp, Homo sapiens
taaaactggaggagc

SEQ ID NO: 267120 - DNA, 15 bp, Homo sapiens
gtaaaactggaggag

SEQ ID NO: 267121 - DNA, 15 bp, Homo sapiens
ggtaaaactggagga

SEQ ID NO: 267122 - DNA, 15 bp, Homo sapiens
gggtaaaactggagg

SEQ ID NO: 267123 - DNA, 15 bp, Homo sapiens
agggtaaaactggag

SEQ ID NO: 267124 - DNA, 15 bp, Homo sapiens
gagggtaaaactgga

SEQ ID NO: 267125 - DNA, 15 bp, Homo sapiens
tgagggtaaaactgg

SEQ ID NO: 267126 - DNA, 15 bp, Homo sapiens
atgagggtaaaactg

SEQ ID NO: 267127 - DNA, 15 bp, Homo sapiens
gatgagggtaaaact

SEQ ID NO: 267128 - DNA, 15 bp, Homo sapiens
tgatgagggtaaaac

SEQ ID NO: 267129 - DNA, 15 bp, Homo sapiens
ttgatgagggtaaaa

SEQ ID NO: 267130 - DNA, 15 bp, Homo sapiens
tttgatgagggtaaa

SEQ ID NO: 267131 - DNA, 15 bp, Homo sapiens
ctttgatgagggtaa

SEQ ID NO: 267132 - DNA, 15 bp, Homo sapiens
gctttgatgagggta

SEQ ID NO: 267133 - DNA, 15 bp, Homo sapiens
tgctttgatgagggt

SEQ ID NO: 267134 - DNA, 15 bp, Homo sapiens
gtgctttgatgaggg

SEQ ID NO: 267135 - DNA, 15 bp, Homo sapiens
agtgctttgatgagg

SEQ ID NO: 267136 - DNA, 15 bp, Homo sapiens
aagtgctttgatgag

SEQ ID NO: 267137 - DNA, 15 bp, Homo sapiens
taagtgctttgatga

SEQ ID NO: 267138 - DNA, 15 bp, Homo sapiens
ctaagtgctttgatg

SEQ ID NO: 267139 - DNA, 15 bp, Homo sapiens
actaagtgctttgat

SEQ ID NO: 267140 - DNA, 15 bp, Homo sapiens
aactaagtgctttga

SEQ ID NO: 267141 - DNA, 15 bp, Homo sapiens
gaactaagtgctttg

SEQ ID NO: 267142 - DNA, 15 bp, Homo sapiens
tgaactaagtgcttt

SEQ ID NO: 267143 - DNA, 15 bp, Homo sapiens
ctgaactaagtgctt

SEQ ID NO: 267144 - DNA, 15 bp, Homo sapiens
cctgaactaagtgct

SEQ ID NO: 267145 - DNA, 15 bp, Homo sapiens
ccctgaactaagtgc

SEQ ID NO: 267146 - DNA, 15 bp, Homo sapiens
cccctgaactaagtg

SEQ ID NO: 267147 - DNA, 15 bp, Homo sapiens
gcccctgaactaagt

SEQ ID NO: 267148 - DNA, 15 bp, Homo sapiens
ggcccctgaactaag

SEQ ID NO: 267149 - DNA, 15 bp, Homo sapiens
aggcccctgaactaa

SEQ ID NO: 267150 - DNA, 15 bp, Homo sapiens
gaggcccctgaacta

SEQ ID NO: 267151 - DNA, 15 bp, Homo sapiens
agaggcccctgaact

SEQ ID NO: 267152 - DNA, 15 bp, Homo sapiens
cagaggcccctgaac

SEQ ID NO: 267153 - DNA, 15 bp, Homo sapiens
gcagaggcccctgaa

SEQ ID NO: 267154 - DNA, 15 bp, Homo sapiens
ggcagaggcccctga

SEQ ID NO: 267155 - DNA, 15 bp, Homo sapiens
tggcagaggcccctg

SEQ ID NO: 267156 - DNA, 15 bp, Homo sapiens
ttggcagaggcccct

SEQ ID NO: 267157 - DNA, 15 bp, Homo sapiens
attggcagaggcccc

SEQ ID NO: 267158 - DNA, 15 bp, Homo sapiens
tattggcagaggccc

SEQ ID NO: 267159 - DNA, 15 bp, Homo sapiens
ctattggcagaggcc

SEQ ID NO: 267160 - DNA, 15 bp, Homo sapiens
gctattggcagaggc

SEQ ID NO: 267161 - DNA, 15 bp, Homo sapiens
ggctattggcagagg

SEQ ID NO: 267162 - DNA, 15 bp, Homo sapiens
aggctattggcagag

SEQ ID NO: 267163 - DNA, 15 bp, Homo sapiens
gaggctattggcaga

SEQ ID NO: 267164 - DNA, 15 bp, Homo sapiens
agaggctattggcag

SEQ ID NO: 267165 - DNA, 15 bp, Homo sapiens
tagaggctattggca

SEQ ID NO: 267166 - DNA, 15 bp, Homo sapiens
gtagaggctattggc

SEQ ID NO: 267167 - DNA, 15 bp, Homo sapiens
agtagaggctattgg

SEQ ID NO: 267168 - DNA, 15 bp, Homo sapiens
aagtagaggctattg

SEQ ID NO: 267169 - DNA, 15 bp, Homo sapiens
aaagtagaggctatt

SEQ ID NO: 267170 - DNA, 15 bp, Homo sapiens
taaagtagaggctat

SEQ ID NO: 267171 - DNA, 15 bp, Homo sapiens
gtaaagtagaggcta

SEQ ID NO: 267172 - DNA, 15 bp, Homo sapiens
ggtaaagtagaggct

SEQ ID NO: 267173 - DNA, 15 bp, Homo sapiens
tggtaaagtagaggc

SEQ ID NO: 267174 - DNA, 15 bp, Homo sapiens
ttggtaaagtagagg

SEQ ID NO: 267175 - DNA, 15 bp, Homo sapiens
attggtaaagtagag

SEQ ID NO: 267176 - DNA, 15 bp, Homo sapiens
aattggtaaagtaga

SEQ ID NO: 267177 - DNA, 15 bp, Homo sapiens
taattggtaaagtag

SEQ ID NO: 267178 - DNA, 15 bp, Homo sapiens
ctaattggtaaagta

SEQ ID NO: 267179 - DNA, 15 bp, Homo sapiens
cctaattggtaaagt

SEQ ID NO: 267180 - DNA, 15 bp, Homo sapiens
tcctaattggtaaag

SEQ ID NO: 267181 - DNA, 15 bp, Homo sapiens
atcctaattggtaaa

SEQ ID NO: 267182 - DNA, 15 bp, Homo sapiens
aatcctaattggtaa

SEQ ID NO: 267183 - DNA, 15 bp, Homo sapiens
aaatcctaattggta

SEQ ID NO: 267184 - DNA, 15 bp, Homo sapiens
caaatcctaattggt

SEQ ID NO: 267185 - DNA, 15 bp, Homo sapiens
tcaaatcctaattgg

SEQ ID NO: 267186 - DNA, 15 bp, Homo sapiens
atcaaatcctaattg

SEQ ID NO: 267187 - DNA, 15 bp, Homo sapiens
aatcaaatcctaatt

SEQ ID NO: 267188 - DNA, 15 bp, Homo sapiens
gaatcaaatcctaat

SEQ ID NO: 267189 - DNA, 15 bp, Homo sapiens
agaatcaaatcctaa

SEQ ID NO: 267190 - DNA, 15 bp, Homo sapiens
tagaatcaaatccta

SEQ ID NO: 267191 - DNA, 15 bp, Homo sapiens
atagaatcaaatcct

SEQ ID NO: 267192 - DNA, 15 bp, Homo sapiens
catagaatcaaatcc

SEQ ID NO: 267193 - DNA, 15 bp, Homo sapiens
acatagaatcaaatc

SEQ ID NO: 267194 - DNA, 15 bp, Homo sapiens
aacatagaatcaaat

SEQ ID NO: 267195 - DNA, 15 bp, Homo sapiens
gaacatagaatcaaa

SEQ ID NO: 267196 - DNA, 15 bp, Homo sapiens
ggaacatagaatcaa

SEQ ID NO: 267197 - DNA, 15 bp, Homo sapiens
gggaacatagaatca

SEQ ID NO: 267198 - DNA, 15 bp, Homo sapiens
agggaacatagaatc

SEQ ID NO: 267199 - DNA, 15 bp, Homo sapiens
aagggaacatagaat

SEQ ID NO: 267200 - DNA, 15 bp, Homo sapiens
caagggaacatagaa

SEQ ID NO: 267201 - DNA, 15 bp, Homo sapiens
acaagggaacataga

SEQ ID NO: 267202 - DNA, 15 bp, Homo sapiens
tacaagggaacatag

SEQ ID NO: 267203 - DNA, 15 bp, Homo sapiens
atacaagggaacata

SEQ ID NO: 267204 - DNA, 15 bp, Homo sapiens
gatacaagggaacat

SEQ ID NO: 267205 - DNA, 15 bp, Homo sapiens
tgatacaagggaaca

SEQ ID NO: 267206 - DNA, 15 bp, Homo sapiens
atgatacaagggaac

SEQ ID NO: 267207 - DNA, 15 bp, Homo sapiens
aatgatacaagggaa

SEQ ID NO: 267208 - DNA, 15 bp, Homo sapiens
aaatgatacaaggga

SEQ ID NO: 267209 - DNA, 15 bp, Homo sapiens
aaaatgatacaaggg

SEQ ID NO: 267210 - DNA, 15 bp, Homo sapiens
gaaaatgatacaagg

SEQ ID NO: 267211 - DNA, 15 bp, Homo sapiens
agaaaatgatacaag

SEQ ID NO: 267212 - DNA, 15 bp, Homo sapiens
tagaaaatgatacaa

SEQ ID NO: 267213 - DNA, 15 bp, Homo sapiens
ttagaaaatgataca

SEQ ID NO: 267214 - DNA, 15 bp, Homo sapiens
gttagaaaatgatac

SEQ ID NO: 267215 - DNA, 15 bp, Homo sapiens
agttagaaaatgata

SEQ ID NO: 267216 - DNA, 15 bp, Homo sapiens
cagttagaaaatgat

SEQ ID NO: 267217 - DNA, 15 bp, Homo sapiens
acagttagaaaatga

SEQ ID NO: 267218 - DNA, 15 bp, Homo sapiens
cacagttagaaaatg

SEQ ID NO: 267219 - DNA, 15 bp, Homo sapiens
ccacagttagaaaat

SEQ ID NO: 267220 - DNA, 15 bp, Homo sapiens
accacagttagaaaa

SEQ ID NO: 267221 - DNA, 15 bp, Homo sapiens
caccacagttagaaa

SEQ ID NO: 267222 - DNA, 15 bp, Homo sapiens
acaccacagttagaa

SEQ ID NO: 267223 - DNA, 15 bp, Homo sapiens
aacaccacagttaga

SEQ ID NO: 267224 - DNA, 15 bp, Homo sapiens
aaacaccacagttag

SEQ ID NO: 267225 - DNA, 15 bp, Homo sapiens
aaaacaccacagtta

SEQ ID NO: 267226 - DNA, 15 bp, Homo sapiens
aaaaacaccacagtt

SEQ ID NO: 267227 - DNA, 15 bp, Homo sapiens
caaaaacaccacagt

SEQ ID NO: 267228 - DNA, 15 bp, Homo sapiens
acaaaaacaccacag

SEQ ID NO: 267229 - DNA, 15 bp, Homo sapiens
gacaaaaacaccaca

SEQ ID NO: 267230 - DNA, 15 bp, Homo sapiens
agacaaaaacaccac

SEQ ID NO: 267231 - DNA, 15 bp, Homo sapiens
aagacaaaaacacca

SEQ ID NO: 267232 - DNA, 15 bp, Homo sapiens
gaagacaaaaacacc

SEQ ID NO: 267233 - DNA, 15 bp, Homo sapiens
agaagacaaaaacac

SEQ ID NO: 267234 - DNA, 15 bp, Homo sapiens
gagaagacaaaaaca

SEQ ID NO: 267235 - DNA, 15 bp, Homo sapiens
tgagaagacaaaaac

SEQ ID NO: 267236 - DNA, 15 bp, Homo sapiens
ttgagaagacaaaaa

SEQ ID NO: 267237 - DNA, 15 bp, Homo sapiens
attgagaagacaaaa

SEQ ID NO: 267238 - DNA, 15 bp, Homo sapiens
aattgagaagacaaa

SEQ ID NO: 267239 - DNA, 15 bp, Homo sapiens
taattgagaagacaa

SEQ ID NO: 267240 - DNA, 15 bp, Homo sapiens
ataattgagaagaca

SEQ ID NO: 267241 - DNA, 15 bp, Homo sapiens
gataattgagaagac

SEQ ID NO: 267242 - DNA, 15 bp, Homo sapiens
agataattgagaaga

SEQ ID NO: 267243 - DNA, 15 bp, Homo sapiens
aagataattgagaag

SEQ ID NO: 267244 - DNA, 15 bp, Homo sapiens
aaagataattgagaa

SEQ ID NO: 267245 - DNA, 15 bp, Homo sapiens
aaaagataattgaga

SEQ ID NO: 267246 - DNA, 15 bp, Homo sapiens
aaaaagataattgag

SEQ ID NO: 267247 - DNA, 15 bp, Homo sapiens
taaaaagataattga

SEQ ID NO: 267248 - DNA, 15 bp, Homo sapiens
gtaaaaagataattg

SEQ ID NO: 267249 - DNA, 15 bp, Homo sapiens
ggtaaaaagataatt

SEQ ID NO: 267250 - DNA, 15 bp, Homo sapiens
aggtaaaaagataat

SEQ ID NO: 267251 - DNA, 15 bp, Homo sapiens
gaggtaaaaagataa

SEQ ID NO: 267252 - DNA, 15 bp, Homo sapiens
ggaggtaaaaagata

SEQ ID NO: 267253 - DNA, 15 bp, Homo sapiens
aggaggtaaaaagat

SEQ ID NO: 267254 - DNA, 15 bp, Homo sapiens
aaggaggtaaaaaga

SEQ ID NO: 267255 - DNA, 15 bp, Homo sapiens
caaggaggtaaaaag

SEQ ID NO: 267256 - DNA, 15 bp, Homo sapiens
tcaaggaggtaaaaa

SEQ ID NO: 267257 - DNA, 15 bp, Homo sapiens
ctcaaggaggtaaaa

SEQ ID NO: 267258 - DNA, 15 bp, Homo sapiens
cctcaaggaggtaaa

SEQ ID NO: 267259 - DNA, 15 bp, Homo sapiens
tcctcaaggaggtaa

SEQ ID NO: 267260 - DNA, 15 bp, Homo sapiens
gtcctcaaggaggta

SEQ ID NO: 267261 - DNA, 15 bp, Homo sapiens
agtcctcaaggaggt

SEQ ID NO: 267262 - DNA, 15 bp, Homo sapiens
cagtcctcaaggagg

SEQ ID NO: 267263 - DNA, 15 bp, Homo sapiens
ccagtcctcaaggag

SEQ ID NO: 267264 - DNA, 15 bp, Homo sapiens
cccagtcctcaagga

SEQ ID NO: 267265 - DNA, 15 bp, Homo sapiens
tcccagtcctcaagg

SEQ ID NO: 267266 - DNA, 15 bp, Homo sapiens
atcccagtcctcaag

SEQ ID NO: 267267 - DNA, 15 bp, Homo sapiens
catcccagtcctcaa

SEQ ID NO: 267268 - DNA, 15 bp, Homo sapiens
tcatcccagtcctca

SEQ ID NO: 267269 - DNA, 15 bp, Homo sapiens
gtcatcccagtcctc

SEQ ID NO: 267270 - DNA, 15 bp, Homo sapiens
agtcatcccagtcct

SEQ ID NO: 267271 - DNA, 15 bp, Homo sapiens
aagtcatcccagtcc

SEQ ID NO: 267272 - DNA, 15 bp, Homo sapiens
aaagtcatcccagtc

SEQ ID NO: 267273 - DNA, 15 bp, Homo sapiens
aaaagtcatcccagt

SEQ ID NO: 267274 - DNA, 15 bp, Homo sapiens
taaaagtcatcccag

SEQ ID NO: 267275 - DNA, 15 bp, Homo sapiens
ataaaagtcatccca

SEQ ID NO: 267276 - DNA, 15 bp, Homo sapiens
tataaaagtcatccc

SEQ ID NO: 267277 - DNA, 15 bp, Homo sapiens
gtataaaagtcatcc

SEQ ID NO: 267278 - DNA, 15 bp, Homo sapiens
agtataaaagtcatc

SEQ ID NO: 267279 - DNA, 15 bp, Homo sapiens
aagtataaaagtcat

SEQ ID NO: 267280 - DNA, 15 bp, Homo sapiens
aaagtataaaagtca

SEQ ID NO: 267281 - DNA, 15 bp, Homo sapiens
aaaagtataaaagtc

SEQ ID NO: 267282 - DNA, 15 bp, Homo sapiens
gaaaagtataaaagt

SEQ ID NO: 267283 - DNA, 15 bp, Homo sapiens
agaaaagtataaaag

SEQ ID NO: 267284 - DNA, 15 bp, Homo sapiens
gagaaaagtataaaa

SEQ ID NO: 267285 - DNA, 15 bp, Homo sapiens
ggagaaaagtataaa

SEQ ID NO: 267286 - DNA, 15 bp, Homo sapiens
gggagaaaagtataa

SEQ ID NO: 267287 - DNA, 15 bp, Homo sapiens
agggagaaaagtata

SEQ ID NO: 267288 - DNA, 15 bp, Homo sapiens
cagggagaaaagtat

SEQ ID NO: 267289 - DNA, 15 bp, Homo sapiens
acagggagaaaagta

SEQ ID NO: 267290 - DNA, 15 bp, Homo sapiens
cacagggagaaaagt

SEQ ID NO: 267291 - DNA, 15 bp, Homo sapiens
acacagggagaaaag

SEQ ID NO: 267292 - DNA, 15 bp, Homo sapiens
aacacagggagaaaa

SEQ ID NO: 267293 - DNA, 15 bp, Homo sapiens
taacacagggagaaa

SEQ ID NO: 267294 - DNA, 15 bp, Homo sapiens
ctaacacagggagaa

SEQ ID NO: 267295 - DNA, 15 bp, Homo sapiens
actaacacagggaga

SEQ ID NO: 267296 - DNA, 15 bp, Homo sapiens
aactaacacagggag

SEQ ID NO: 267297 - DNA, 15 bp, Homo sapiens
taactaacacaggga

SEQ ID NO: 267298 - DNA, 15 bp, Homo sapiens
ttaactaacacaggg

SEQ ID NO: 267299 - DNA, 15 bp, Homo sapiens
tttaactaacacagg

SEQ ID NO: 267300 - DNA, 15 bp, Homo sapiens
atttaactaacacag

SEQ ID NO: 267301 - DNA, 15 bp, Homo sapiens
aatttaactaacaca

SEQ ID NO: 267302 - DNA, 15 bp, Homo sapiens
aaatttaactaacac

SEQ ID NO: 267303 - DNA, 15 bp, Homo sapiens
caaatttaactaaca

SEQ ID NO: 267304 - DNA, 15 bp, Homo sapiens
gcaaatttaactaac

SEQ ID NO: 267305 - DNA, 15 bp, Homo sapiens
ggcaaatttaactaa

SEQ ID NO: 267306 - DNA, 15 bp, Homo sapiens
aggcaaatttaacta

SEQ ID NO: 267307 - DNA, 15 bp, Homo sapiens
gaggcaaatttaact

SEQ ID NO: 267308 - DNA, 15 bp, Homo sapiens
tgaggcaaatttaac

SEQ ID NO: 267309 - DNA, 15 bp, Homo sapiens
atgaggcaaatttaa

SEQ ID NO: 267310 - DNA, 15 bp, Homo sapiens
tatgaggcaaattta

SEQ ID NO: 267311 - DNA, 15 bp, Homo sapiens
ttatgaggcaaattt

SEQ ID NO: 267312 - DNA, 15 bp, Homo sapiens
tttatgaggcaaatt

SEQ ID NO: 267313 - DNA, 15 bp, Homo sapiens
cttttatgaggcaaa

SEQ ID NO: 267314 - DNA, 15 bp, Homo sapiens
gcttttatgaggcaa

SEQ ID NO: 267315 - DNA, 15 bp, Homo sapiens
ggcttttatgaggca

SEQ ID NO: 267316 - DNA, 15 bp, Homo sapiens
tggcttttatgaggc

SEQ ID NO: 267317 - DNA, 15 bp, Homo sapiens
ctggcttttatgagg

SEQ ID NO: 267318 - DNA, 15 bp, Homo sapiens
tctggcttttatgag

SEQ ID NO: 267319 - DNA, 15 bp, Homo sapiens
atctggcttttatga

SEQ ID NO: 267320 - DNA, 15 bp, Homo sapiens
catctggcttttatg

SEQ ID NO: 267321 - DNA, 15 bp, Homo sapiens
tcatctggcttttat

SEQ ID NO: 267322 - DNA, 15 bp, Homo sapiens
ctcatctggctttta

SEQ ID NO: 267323 - DNA, 15 bp, Homo sapiens
gctcatctggctttt

SEQ ID NO: 267324 - DNA, 15 bp, Homo sapiens
agctcatctggcttt

SEQ ID NO: 267325 - DNA, 15 bp, Homo sapiens
gagctcatctggctt

SEQ ID NO: 267326 - DNA, 15 bp, Homo sapiens
cgagctcatctggct

SEQ ID NO: 267327 - DNA, 15 bp, Homo sapiens
acgagctcatctggc

SEQ ID NO: 267328 - DNA, 15 bp, Homo sapiens
tacgagctcatctgg

SEQ ID NO: 267329 - DNA, 15 bp, Homo sapiens
atacgagctcatctg

SEQ ID NO: 267330 - DNA, 15 bp, Homo sapiens
gatacgagctcatct

SEQ ID NO: 267331 - DNA, 15 bp, Homo sapiens
agatacgagctcatc

SEQ ID NO: 267332 - DNA, 15 bp, Homo sapiens
cagatacgagctcat

SEQ ID NO: 267333 - DNA, 15 bp, Homo sapiens
tcagatacgagctca

SEQ ID NO: 267334 - DNA, 15 bp, Homo sapiens
gtcagatacgagctc

SEQ ID NO: 267335 - DNA, 15 bp, Homo sapiens
agtcagatacgagct

SEQ ID NO: 267336 - DNA, 15 bp, Homo sapiens
aagtcagatacgagc

SEQ ID NO: 267337 - DNA, 15 bp, Homo sapiens
aaagtcagatacgag

SEQ ID NO: 267338 - DNA, 15 bp, Homo sapiens
taaagtcagatacga

SEQ ID NO: 267339 - DNA, 15 bp, Homo sapiens
ataaagtcagatacg

SEQ ID NO: 267340 - DNA, 15 bp, Homo sapiens
tataaagtcagatac

SEQ ID NO: 267341 - DNA, 15 bp, Homo sapiens
ttataaagtcagata

SEQ ID NO: 267342 - DNA, 15 bp, Homo sapiens
tttataaagtcagat

SEQ ID NO: 267343 - DNA, 15 bp, Homo sapiens
atttataaagtcaga

SEQ ID NO: 267344 - DNA, 15 bp, Homo sapiens
tatttataaagtcag

SEQ ID NO: 267345 - DNA, 15 bp, Homo sapiens
gtatttataaagtca

SEQ ID NO: 267346 - DNA, 15 bp, Homo sapiens
agtatttataaagtc

SEQ ID NO: 267347 - DNA, 15 bp, Homo sapiens
tagtatttataaagt

SEQ ID NO: 267348 - DNA, 15 bp, Homo sapiens
ctagtatttataaag

SEQ ID NO: 267349 - DNA, 15 bp, Homo sapiens
actagtatttataaa

SEQ ID NO: 267350 - DNA, 15 bp, Homo sapiens
aactagtatttataa

SEQ ID NO: 267351 - DNA, 15 bp, Homo sapiens
taactagtatttata

SEQ ID NO: 267352 - DNA, 15 bp, Homo sapiens
ataactagtatttat

SEQ ID NO: 267353 - DNA, 15 bp, Homo sapiens
tataactagtattta

SEQ ID NO: 267354 - DNA, 15 bp, Homo sapiens
ctataactagtattt

SEQ ID NO: 267355 - DNA, 15 bp, Homo sapiens
tctataactagtatt

SEQ ID NO: 267356 - DNA, 15 bp, Homo sapiens
ttctataactagtat

SEQ ID NO: 267357 - DNA, 15 bp, Homo sapiens
attctataactagta

SEQ ID NO: 267358 - DNA, 15 bp, Homo sapiens
tattctataactagt

SEQ ID NO: 267359 - DNA, 15 bp, Homo sapiens
atattctataactag

SEQ ID NO: 267360 - DNA, 15 bp, Homo sapiens
aatattctataacta

SEQ ID NO: 267361 - DNA, 15 bp, Homo sapiens
taatattctataact

SEQ ID NO: 267362 - DNA, 15 bp, Homo sapiens
ttaatattctataac

SEQ ID NO: 267363 - DNA, 15 bp, Homo sapiens
tttaatattctataa

SEQ ID NO: 267364 - DNA, 15 bp, Homo sapiens
ctttaatattctata

SEQ ID NO: 267365 - DNA, 15 bp, Homo sapiens
gctttaatattctat

SEQ ID NO: 267366 - DNA, 15 bp, Homo sapiens
agctttaatattcta

SEQ ID NO: 267367 - DNA, 15 bp, Homo sapiens
cagctttaatattct

SEQ ID NO: 267368 - DNA, 15 bp, Homo sapiens
ccagctttaatattc

SEQ ID NO: 267369 - DNA, 15 bp, Homo sapiens
tccagctttaatatt

SEQ ID NO: 267370 - DNA, 15 bp, Homo sapiens
ttccagctttaatat

SEQ ID NO: 267371 - DNA, 15 bp, Homo sapiens
attccagctttaata

SEQ ID NO: 267372 - DNA, 15 bp, Homo sapiens
aattccagctttaat

SEQ ID NO: 267373 - DNA, 15 bp, Homo sapiens
taattccagctttaa

SEQ ID NO: 267374 - DNA, 15 bp, Homo sapiens
ttaattccagcttta

SEQ ID NO: 267375 - DNA, 15 bp, Homo sapiens
tttaattccagcttt

SEQ ID NO: 267376 - DNA, 15 bp, Homo sapiens
ctttaattccagctt

SEQ ID NO: 267377 - DNA, 15 bp, Homo sapiens
gctttaattccagct

SEQ ID NO: 267378 - DNA, 15 bp, Homo sapiens
agctttaattccagc

SEQ ID NO: 267379 - DNA, 15 bp, Homo sapiens
gagctttaattccag

SEQ ID NO: 267380 - DNA, 15 bp, Homo sapiens
agagctttaattcca

SEQ ID NO: 267381 - DNA, 15 bp, Homo sapiens
tagagctttaattcc

SEQ ID NO: 267382 - DNA, 15 bp, Homo sapiens
ttagagctttaattc

SEQ ID NO: 267383 - DNA, 15 bp, Homo sapiens
cttagagctttaatt

SEQ ID NO: 267384 - DNA, 15 bp, Homo sapiens
tcttagagctttaat

SEQ ID NO: 267385 - DNA, 15 bp, Homo sapiens
ctcttagagctttaa

SEQ ID NO: 267386 - DNA, 15 bp, Homo sapiens
tctcttagagcttta

SEQ ID NO: 267387 - DNA, 15 bp, Homo sapiens
atctcttagagcttt

SEQ ID NO: 267388 - DNA, 15 bp, Homo sapiens
gatctcttagagctt

SEQ ID NO: 267389 - DNA, 15 bp, Homo sapiens
tgatctcttagagct

SEQ ID NO: 267390 - DNA, 15 bp, Homo sapiens
atgatctcttagagc

SEQ ID NO: 267391 - DNA, 15 bp, Homo sapiens
gatgatctcttagag

SEQ ID NO: 267392 - DNA, 15 bp, Homo sapiens
agatgatctcttaga

SEQ ID NO: 267393 - DNA, 15 bp, Homo sapiens
tagatgatctcttag

SEQ ID NO: 267394 - DNA, 15 bp, Homo sapiens
ttagatgatctctta

SEQ ID NO: 267395 - DNA, 15 bp, Homo sapiens
gttagatgatctctt

SEQ ID NO: 267396 - DNA, 15 bp, Homo sapiens
agttagatgatctct

SEQ ID NO: 267397 - DNA, 15 bp, Homo sapiens
aagttagatgatctc

SEQ ID NO: 267398 - DNA, 15 bp, Homo sapiens
taagttagatgatct

SEQ ID NO: 267399 - DNA, 15 bp, Homo sapiens
ataagttagatgatc

SEQ ID NO: 267400 - DNA, 15 bp, Homo sapiens
gataagttagatgat

SEQ ID NO: 267401 - DNA, 15 bp, Homo sapiens
agataagttagatga

SEQ ID NO: 267402 - DNA, 15 bp, Homo sapiens
aagataagttagatg

SEQ ID NO: 267403 - DNA, 15 bp, Homo sapiens
aaagataagttagat

SEQ ID NO: 267404 - DNA, 15 bp, Homo sapiens
taaagataagttaga

SEQ ID NO: 267405 - DNA, 15 bp, Homo sapiens
ataaagataagttag

SEQ ID NO: 267406 - DNA, 15 bp, Homo sapiens
aataaagataagtta

SEQ ID NO: 267407 - DNA, 15 bp, Homo sapiens
aaataaagataagtt

SEQ ID NO: 267408 - DNA, 15 bp, Homo sapiens
aaaataaagataagt

SEQ ID NO: 267409 - DNA, 15 bp, Homo sapiens
caaaataaagataag

SEQ ID NO: 267410 - DNA, 15 bp, Homo sapiens
tcaaaataaagataa

SEQ ID NO: 267411 - DNA, 15 bp, Homo sapiens
ttcaaaataaagata

SEQ ID NO: 267412 - DNA, 15 bp, Homo sapiens
cttcaaaataaagat

SEQ ID NO: 267413 - DNA, 15 bp, Homo sapiens
tcttcaaaataaaga

SEQ ID NO: 267414 - DNA, 15 bp, Homo sapiens
ttcttcaaaataaag

SEQ ID NO: 267415 - DNA, 15 bp, Homo sapiens
tttcttcaaaataaa

SEQ ID NO: 267416 - DNA, 15 bp, Homo sapiens
ttttcttcaaaataa

SEQ ID NO: 267417 - DNA, 15 bp, Homo sapiens
tttttcttcaaaata

SEQ ID NO: 267418 - DNA, 15 bp, Homo sapiens
ttttttcttcaaaat

SEQ ID NO: 267419 - DNA, 15 bp, Homo sapiens
gttttttcttcaaaa

SEQ ID NO: 267420 - DNA, 15 bp, Homo sapiens
agttttttcttcaaa

SEQ ID NO: 267421 - DNA, 15 bp, Homo sapiens
tagttttttcttcaa

SEQ ID NO: 267422 - DNA, 15 bp, Homo sapiens
ttagttttttcttca

SEQ ID NO: 267423 - DNA, 15 bp, Homo sapiens
cttagttttttcttc

SEQ ID NO: 267424 - DNA, 15 bp, Homo sapiens
acttagttttttctt

SEQ ID NO: 267425 - DNA, 15 bp, Homo sapiens
gacttagttttttct

SEQ ID NO: 267426 - DNA, 15 bp, Homo sapiens
agacttagttttttc

SEQ ID NO: 267427 - DNA, 15 bp, Homo sapiens
aagacttagtttttt

SEQ ID NO: 267428 - DNA, 15 bp, Homo sapiens
taagacttagttttt

SEQ ID NO: 267429 - DNA, 15 bp, Homo sapiens
ctaagacttagtttt

SEQ ID NO: 267430 - DNA, 15 bp, Homo sapiens
tctaagacttagttt

SEQ ID NO: 267431 - DNA, 15 bp, Homo sapiens
ctctaagacttagtt

SEQ ID NO: 267432 - DNA, 15 bp, Homo sapiens
tctctaagacttagt

SEQ ID NO: 267433 - DNA, 15 bp, Homo sapiens
ttctctaagacttag

SEQ ID NO: 267434 - DNA, 15 bp, Homo sapiens
cttctctaagactta

SEQ ID NO: 267435 - DNA, 15 bp, Homo sapiens
ccttctctaagactt

SEQ ID NO: 267436 - DNA, 15 bp, Homo sapiens
accttctctaagact

SEQ ID NO: 267437 - DNA, 15 bp, Homo sapiens
taccttctctaagac

SEQ ID NO: 267438 - DNA, 15 bp, Homo sapiens
ttaccttctctaaga

SEQ ID NO: 267439 - DNA, 15 bp, Homo sapiens
cttaccttctctaag

SEQ ID NO: 267440 - DNA, 15 bp, Homo sapiens
acttaccttctctaa

SEQ ID NO: 267441 - DNA, 15 bp, Homo sapiens
cacttaccttctcta

SEQ ID NO: 267442 - DNA, 15 bp, Homo sapiens
tcacttaccttctct

SEQ ID NO: 267443 - DNA, 15 bp, Homo sapiens
atcacttaccttctc

SEQ ID NO: 267444 - DNA, 15 bp, Homo sapiens
aatcacttaccttct

SEQ ID NO: 267445 - DNA, 15 bp, Homo sapiens
aaatcacttaccttc

SEQ ID NO: 267446 - DNA, 15 bp, Homo sapiens
caaatcacttacctt

SEQ ID NO: 267447 - DNA, 15 bp, Homo sapiens
acaaatcacttacct

SEQ ID NO: 267448 - DNA, 15 bp, Homo sapiens
cacaaatcacttacc

SEQ ID NO: 267449 - DNA, 15 bp, Homo sapiens
gcacaaatcacttac

SEQ ID NO: 267450 - DNA, 15 bp, Homo sapiens
tgcacaaatcactta

SEQ ID NO: 267451 - DNA, 15 bp, Homo sapiens
ttgcacaaatcactt

SEQ ID NO: 267452 - DNA, 15 bp, Homo sapiens
tttgcacaaatcact

SEQ ID NO: 267453 - DNA, 15 bp, Homo sapiens
ctttgcacaaatcac

SEQ ID NO: 267454 - DNA, 15 bp, Homo sapiens
actttgcacaaatca

SEQ ID NO: 267455 - DNA, 15 bp, Homo sapiens
aactttgcacaaatc

SEQ ID NO: 267456 - DNA, 15 bp, Homo sapiens
taactttgcacaaat

SEQ ID NO: 267457 - DNA, 15 bp, Homo sapiens
ttaactttgcacaaa

SEQ ID NO: 267458 - DNA, 15 bp, Homo sapiens
attaactttgcacaa

SEQ ID NO: 267459 - DNA, 15 bp, Homo sapiens
cattaactttgcaca

SEQ ID NO: 267460 - DNA, 15 bp, Homo sapiens
ccattaactttgcac

SEQ ID NO: 267461 - DNA, 15 bp, Homo sapiens
accattaactttgca

SEQ ID NO: 267462 - DNA, 15 bp, Homo sapiens
taccattaactttgc

SEQ ID NO: 267463 - DNA, 15 bp, Homo sapiens
ataccattaactttg

SEQ ID NO: 267464 - DNA, 15 bp, Homo sapiens
cataccattaacttt

SEQ ID NO: 267465 - DNA, 15 bp, Homo sapiens
ccataccattaactt

SEQ ID NO: 267466 - DNA, 15 bp, Homo sapiens
tccataccattaact

SEQ ID NO: 267467 - DNA, 15 bp, Homo sapiens
atccataccattaac

SEQ ID NO: 267468 - DNA, 15 bp, Homo sapiens
aatccataccattaa

SEQ ID NO: 267469 - DNA, 15 bp, Homo sapiens
aaatccataccatta

SEQ ID NO: 267470 - DNA, 15 bp, Homo sapiens
taaatccataccatt

SEQ ID NO: 267471 - DNA, 15 bp, Homo sapiens
ctaaatccataccat

SEQ ID NO: 267472 - DNA, 15 bp, Homo sapiens
actaaatccatacca

SEQ ID NO: 267473 - DNA, 15 bp, Homo sapiens
cactaaatccatacc

SEQ ID NO: 267474 - DNA, 15 bp, Homo sapiens
tcactaaatccatac

SEQ ID NO: 267475 - DNA, 15 bp, Homo sapiens
gtcactaaatccata

SEQ ID NO: 267476 - DNA, 15 bp, Homo sapiens
agtcactaaatccat

SEQ ID NO: 267477 - DNA, 15 bp, Homo sapiens
aagtcactaaatcca

SEQ ID NO: 267478 - DNA, 15 bp, Homo sapiens
taagtcactaaatcc

SEQ ID NO: 267479 - DNA, 15 bp, Homo sapiens
ttaagtcactaaatc

SEQ ID NO: 267480 - DNA, 15 bp, Homo sapiens
gttaagtcactaaat

SEQ ID NO: 267481 - DNA, 15 bp, Homo sapiens
agttaagtcactaaa

SEQ ID NO: 267482 - DNA, 15 bp, Homo sapiens
gagttaagtcactaa

SEQ ID NO: 267483 - DNA, 15 bp, Homo sapiens
ggagttaagtcacta

SEQ ID NO: 267484 - DNA, 15 bp, Homo sapiens
tggagttaagtcact

SEQ ID NO: 267485 - DNA, 15 bp, Homo sapiens
atggagttaagtcac

SEQ ID NO: 267486 - DNA, 15 bp, Homo sapiens
aatggagttaagtca

SEQ ID NO: 267487 - DNA, 15 bp, Homo sapiens
taatggagttaagtc

SEQ ID NO: 267488 - DNA, 15 bp, Homo sapiens
ctaatggagttaagt

SEQ ID NO: 267489 - DNA, 15 bp, Homo sapiens
cctaatggagttaag

SEQ ID NO: 267490 - DNA, 15 bp, Homo sapiens
ccctaatggagttaa

SEQ ID NO: 267491 - DNA, 15 bp, Homo sapiens
tccctaatggagtta

SEQ ID NO: 267492 - DNA, 15 bp, Homo sapiens
ttccctaatggagtt

SEQ ID NO: 267493 - DNA, 15 bp, Homo sapiens
tttccctaatggagt

SEQ ID NO: 267494 - DNA, 15 bp, Homo sapiens
atttccctaatggag

SEQ ID NO: 267495 - DNA, 15 bp, Homo sapiens
tatttccctaatgga

SEQ ID NO: 267496 - DNA, 15 bp, Homo sapiens
gtatttccctaatgg

SEQ ID NO: 267497 - DNA, 15 bp, Homo sapiens
tgtatttccctaatg

SEQ ID NO: 267498 - DNA, 15 bp, Homo sapiens
gtgtatttccctaat

SEQ ID NO: 267499 - DNA, 15 bp, Homo sapiens
tgtgtatttccctaa

SEQ ID NO: 267500 - DNA, 15 bp, Homo sapiens
gtgtgtatttcccta

SEQ ID NO: 267501 - DNA, 15 bp, Homo sapiens
tgtgtgtatttccct

SEQ ID NO: 267502 - DNA, 15 bp, Homo sapiens
gtgtgtgtatttccc

SEQ ID NO: 267503 - DNA, 15 bp, Homo sapiens
tgtgtgtgtatttcc

SEQ ID NO: 267504 - DNA, 15 bp, Homo sapiens
gtgtgtgtgtatttc

SEQ ID NO: 267505 - DNA, 15 bp, Homo sapiens
tgtgtgtgtgtattt

SEQ ID NO: 267506 - DNA, 15 bp, Homo sapiens
gtgtgtgtgtgtatt

SEQ ID NO: 267507 - DNA, 15 bp, Homo sapiens
ctgcgtgtgtgtgtg

SEQ ID NO: 267508 - DNA, 15 bp, Homo sapiens
actgcgtgtgtgtgt

SEQ ID NO: 267509 - DNA, 15 bp, Homo sapiens
aactgcgtgtgtgtg

SEQ ID NO: 267510 - DNA, 15 bp, Homo sapiens
taactgcgtgtgtgt

SEQ ID NO: 267511 - DNA, 15 bp, Homo sapiens
ctaactgcgtgtgtg

SEQ ID NO: 267512 - DNA, 15 bp, Homo sapiens
gctaactgcgtgtgt

SEQ ID NO: 267513 - DNA, 15 bp, Homo sapiens
tgctaactgcgtgtg

SEQ ID NO: 267514 - DNA, 15 bp, Homo sapiens
gtgctaactgcgtgt

SEQ ID NO: 267515 - DNA, 15 bp, Homo sapiens
tgtgctaactgcgtg

SEQ ID NO: 267516 - DNA, 15 bp, Homo sapiens
atgtgctaactgcgt

SEQ ID NO: 267517 - DNA, 15 bp, Homo sapiens
aatgtgctaactgcg

SEQ ID NO: 267518 - DNA, 15 bp, Homo sapiens
caatgtgctaactgc

SEQ ID NO: 267519 - DNA, 15 bp, Homo sapiens
ccaatgtgctaactg

SEQ ID NO: 267520 - DNA, 15 bp, Homo sapiens
tccaatgtgctaact

SEQ ID NO: 267521 - DNA, 15 bp, Homo sapiens
ttccaatgtgctaac

SEQ ID NO: 267522 - DNA, 15 bp, Homo sapiens
tttccaatgtgctaa

SEQ ID NO: 267523 - DNA, 15 bp, Homo sapiens
ttttccaatgtgcta

SEQ ID NO: 267524 - DNA, 15 bp, Homo sapiens
attttccaatgtgct

SEQ ID NO: 267525 - DNA, 15 bp, Homo sapiens
tattttccaatgtgc

SEQ ID NO: 267526 - DNA, 15 bp, Homo sapiens
ctattttccaatgtg

SEQ ID NO: 267527 - DNA, 15 bp, Homo sapiens
cctattttccaatgt

SEQ ID NO: 267528 - DNA, 15 bp, Homo sapiens
ccctattttccaatg

SEQ ID NO: 267529 - DNA, 15 bp, Homo sapiens
cccctattttccaat

SEQ ID NO: 267530 - DNA, 15 bp, Homo sapiens
acccctattttccaa

SEQ ID NO: 267531 - DNA, 15 bp, Homo sapiens
aacccctattttcca

SEQ ID NO: 267532 - DNA, 15 bp, Homo sapiens
aaacccctattttcc

SEQ ID NO: 267533 - DNA, 15 bp, Homo sapiens
caaacccctattttc

SEQ ID NO: 267534 - DNA, 15 bp, Homo sapiens
acaaacccctatttt

SEQ ID NO: 267535 - DNA, 15 bp, Homo sapiens
cacaaacccctattt

SEQ ID NO: 267536 - DNA, 15 bp, Homo sapiens
acacaaacccctatt

SEQ ID NO: 267537 - DNA, 15 bp, Homo sapiens
tacacaaacccctat

SEQ ID NO: 267538 - DNA, 15 bp, Homo sapiens
atacacaaaccccta

SEQ ID NO: 267539 - DNA, 15 bp, Homo sapiens
tatacacaaacccct

SEQ ID NO: 267540 - DNA, 15 bp, Homo sapiens
atatacacaaacccc

SEQ ID NO: 267541 - DNA, 15 bp, Homo sapiens
gatatacacaaaccc

SEQ ID NO: 267542 - DNA, 15 bp, Homo sapiens
ggatatacacaaacc

SEQ ID NO: 267543 - DNA, 15 bp, Homo sapiens
aggatatacacaaac

SEQ ID NO: 267544 - DNA, 15 bp, Homo sapiens
aaggatatacacaaa

SEQ ID NO: 267545 - DNA, 15 bp, Homo sapiens
caaggatatacacaa

SEQ ID NO: 267546 - DNA, 15 bp, Homo sapiens
gcaaggatatacaca

SEQ ID NO: 267547 - DNA, 15 bp, Homo sapiens
agcaaggatatacac

SEQ ID NO: 267548 - DNA, 15 bp, Homo sapiens
cagcaaggatataca

SEQ ID NO: 267549 - DNA, 15 bp, Homo sapiens
ccagcaaggatatac

SEQ ID NO: 267550 - DNA, 15 bp, Homo sapiens
tccagcaaggatata

SEQ ID NO: 267551 - DNA, 15 bp, Homo sapiens
ttccagcaaggatat

SEQ ID NO: 267552 - DNA, 15 bp, Homo sapiens
attccagcaaggata

SEQ ID NO: 267553 - DNA, 15 bp, Homo sapiens
tattccagcaaggat

SEQ ID NO: 267554 - DNA, 15 bp, Homo sapiens
atattccagcaagga

SEQ ID NO: 267555 - DNA, 15 bp, Homo sapiens
aatattccagcaagg

SEQ ID NO: 267556 - DNA, 15 bp, Homo sapiens
taatattccagcaag

SEQ ID NO: 267557 - DNA, 15 bp, Homo sapiens
ataatattccagcaa

SEQ ID NO: 267558 - DNA, 15 bp, Homo sapiens
cataatattccagca

SEQ ID NO: 267559 - DNA, 15 bp, Homo sapiens
acataatattccagc

SEQ ID NO: 267560 - DNA, 15 bp, Homo sapiens
aacataatattccag

SEQ ID NO: 267561 - DNA, 15 bp, Homo sapiens
aaacataatattcca

SEQ ID NO: 267562 - DNA, 15 bp, Homo sapiens
caaacataatattcc

SEQ ID NO: 267563 - DNA, 15 bp, Homo sapiens
acaaacataatattc

SEQ ID NO: 267564 - DNA, 15 bp, Homo sapiens
aacaaacataatatt

SEQ ID NO: 267565 - DNA, 15 bp, Homo sapiens
caacaaacataatat

SEQ ID NO: 267566 - DNA, 15 bp, Homo sapiens
tcaacaaacataata

SEQ ID NO: 267567 - DNA, 15 bp, Homo sapiens
ttcaacaaacataat

SEQ ID NO: 267568 - DNA, 15 bp, Homo sapiens
attcaacaaacataa

SEQ ID NO: 267569 - DNA, 15 bp, Homo sapiens
tattcaacaaacata

SEQ ID NO: 267570 - DNA, 15 bp, Homo sapiens
gtattcaacaaacat

SEQ ID NO: 267571 - DNA, 15 bp, Homo sapiens
ggtattcaacaaaca

SEQ ID NO: 267572 - DNA, 15 bp, Homo sapiens
gggtattcaacaaac

SEQ ID NO: 267573 - DNA, 15 bp, Homo sapiens
agggtattcaacaaa

SEQ ID NO: 267574 - DNA, 15 bp, Homo sapiens
aagggtattcaacaa

SEQ ID NO: 267575 - DNA, 15 bp, Homo sapiens
aaagggtattcaaca

SEQ ID NO: 267576 - DNA, 15 bp, Homo sapiens
aaaagggtattcaac

SEQ ID NO: 267577 - DNA, 15 bp, Homo sapiens
taaaagggtattcaa

SEQ ID NO: 267578 - DNA, 15 bp, Homo sapiens
gtaaaagggtattca

SEQ ID NO: 267579 - DNA, 15 bp, Homo sapiens
tgtaaaagggtattc

SEQ ID NO: 267580 - DNA, 15 bp, Homo sapiens
atgtaaaagggtatt

SEQ ID NO: 267581 - DNA, 15 bp, Homo sapiens
tatgtaaaagggtat

SEQ ID NO: 267582 - DNA, 15 bp, Homo sapiens
gtatgtaaaagggta

SEQ ID NO: 267583 - DNA, 15 bp, Homo sapiens
ggtatgtaaaagggt

SEQ ID NO: 267584 - DNA, 15 bp, Homo sapiens
tggtatgtaaaaggg

SEQ ID NO: 267585 - DNA, 15 bp, Homo sapiens
ctggtatgtaaaagg

SEQ ID NO: 267586 - DNA, 15 bp, Homo sapiens
cctggtatgtaaaag

SEQ ID NO: 267587 - DNA, 15 bp, Homo sapiens
gcctggtatgtaaaa

SEQ ID NO: 267588 - DNA, 15 bp, Homo sapiens
tgcctggtatgtaaa

SEQ ID NO: 267589 - DNA, 15 bp, Homo sapiens
atgcctggtatgtaa

SEQ ID NO: 267590 - DNA, 15 bp, Homo sapiens
aatgcctggtatgta

SEQ ID NO: 267591 - DNA, 15 bp, Homo sapiens
aaatgcctggtatgt

SEQ ID NO: 267592 - DNA, 15 bp, Homo sapiens
aaaatgcctggtatg

SEQ ID NO: 267593 - DNA, 15 bp, Homo sapiens
caaaatgcctggtat

SEQ ID NO: 267594 - DNA, 15 bp, Homo sapiens
gcaaaatgcctggta

SEQ ID NO: 267595 - DNA, 15 bp, Homo sapiens
agcaaaatgcctggt

SEQ ID NO: 267596 - DNA, 15 bp, Homo sapiens
tagcaaaatgcctgg

SEQ ID NO: 267597 - DNA, 15 bp, Homo sapiens
ctagcaaaatgcctg

SEQ ID NO: 267598 - DNA, 15 bp, Homo sapiens
cctagcaaaatgcct

SEQ ID NO: 267599 - DNA, 15 bp, Homo sapiens
tcctagcaaaatgcc

SEQ ID NO: 267600 - DNA, 15 bp, Homo sapiens
ctcctagcaaaatgc

SEQ ID NO: 267601 - DNA, 15 bp, Homo sapiens
actcctagcaaaatg

SEQ ID NO: 267602 - DNA, 15 bp, Homo sapiens
aactcctagcaaaat

SEQ ID NO: 267603 - DNA, 15 bp, Homo sapiens
caactcctagcaaaa

SEQ ID NO: 267604 - DNA, 15 bp, Homo sapiens
ccaactcctagcaaa

SEQ ID NO: 267605 - DNA, 15 bp, Homo sapiens
tccaactcctagcaa

SEQ ID NO: 267606 - DNA, 15 bp, Homo sapiens
ttccaactcctagca

SEQ ID NO: 267607 - DNA, 15 bp, Homo sapiens
tttccaactcctagc

SEQ ID NO: 267608 - DNA, 15 bp, Homo sapiens
atttccaactcctag

SEQ ID NO: 267609 - DNA, 15 bp, Homo sapiens
tatttccaactccta

SEQ ID NO: 267610 - DNA, 15 bp, Homo sapiens
ctatttccaactcct

SEQ ID NO: 267611 - DNA, 15 bp, Homo sapiens
tctatttccaactcc

SEQ ID NO: 267612 - DNA, 15 bp, Homo sapiens
ctctatttccaactc

SEQ ID NO: 267613 - DNA, 15 bp, Homo sapiens
tctctatttccaact

SEQ ID NO: 267614 - DNA, 15 bp, Homo sapiens
ctctctatttccaac

SEQ ID NO: 267615 - DNA, 15 bp, Homo sapiens
tctctctatttccaa

SEQ ID NO: 267616 - DNA, 15 bp, Homo sapiens
ttctctctatttcca

SEQ ID NO: 267617 - DNA, 15 bp, Homo sapiens
tttctctctatttcc

SEQ ID NO: 267618 - DNA, 15 bp, Homo sapiens
ttttctctctatttc

SEQ ID NO: 267619 - DNA, 15 bp, Homo sapiens
attttctctctattt

SEQ ID NO: 267620 - DNA, 15 bp, Homo sapiens
aattttctctctatt

SEQ ID NO: 267621 - DNA, 15 bp, Homo sapiens
aaattttctctctat

SEQ ID NO: 267622 - DNA, 15 bp, Homo sapiens
gaaattttctctcta

SEQ ID NO: 267623 - DNA, 15 bp, Homo sapiens
tgaaattttctctct

SEQ ID NO: 267624 - DNA, 15 bp, Homo sapiens
atgaaattttctctc

SEQ ID NO: 267625 - DNA, 15 bp, Homo sapiens
catgaaattttctct

SEQ ID NO: 267626 - DNA, 15 bp, Homo sapiens
tcatgaaattttctc

SEQ ID NO: 267627 - DNA, 15 bp, Homo sapiens
ttcatgaaattttct

SEQ ID NO: 267628 - DNA, 15 bp, Homo sapiens
cttcatgaaattttc

SEQ ID NO: 267629 - DNA, 15 bp, Homo sapiens
ccttcatgaaatttt

SEQ ID NO: 267630 - DNA, 15 bp, Homo sapiens
tccttcatgaaattt

SEQ ID NO: 267631 - DNA, 15 bp, Homo sapiens
ctccttcatgaaatt

SEQ ID NO: 267632 - DNA, 15 bp, Homo sapiens
tctccttcatgaaat

SEQ ID NO: 267633 - DNA, 15 bp, Homo sapiens
ttctccttcatgaaa

SEQ ID NO: 267634 - DNA, 15 bp, Homo sapiens
tttctccttcatgaa

SEQ ID NO: 267635 - DNA, 15 bp, Homo sapiens
ttttctccttcatga

SEQ ID NO: 267636 - DNA, 15 bp, Homo sapiens
tttttctccttcatg

SEQ ID NO: 267637 - DNA, 15 bp, Homo sapiens
ttttttctccttcat

SEQ ID NO: 267638 - DNA, 15 bp, Homo sapiens
attttttctccttca

SEQ ID NO: 267639 - DNA, 15 bp, Homo sapiens
tattttttctccttc

SEQ ID NO: 267640 - DNA, 15 bp, Homo sapiens
gtattttttctcctt

SEQ ID NO: 267641 - DNA, 15 bp, Homo sapiens
ggtattttttctcct

SEQ ID NO: 267642 - DNA, 15 bp, Homo sapiens
aggtattttttctcc

SEQ ID NO: 267643 - DNA, 15 bp, Homo sapiens
gaggtattttttctc

SEQ ID NO: 267644 - DNA, 15 bp, Homo sapiens
agaggtattttttct

SEQ ID NO: 267645 - DNA, 15 bp, Homo sapiens
tagaggtattttttc

SEQ ID NO: 267646 - DNA, 15 bp, Homo sapiens
atagaggtatttttt

SEQ ID NO: 267647 - DNA, 15 bp, Homo sapiens
catagaggtattttt

SEQ ID NO: 267648 - DNA, 15 bp, Homo sapiens
acatagaggtatttt

SEQ ID NO: 267649 - DNA, 15 bp, Homo sapiens
cacatagaggtattt

SEQ ID NO: 267650 - DNA, 15 bp, Homo sapiens
ccacatagaggtatt

SEQ ID NO: 267651 - DNA, 15 bp, Homo sapiens
tccacatagaggtat

SEQ ID NO: 267652 - DNA, 15 bp, Homo sapiens
ctccacatagaggta

SEQ ID NO: 267653 - DNA, 15 bp, Homo sapiens
tctccacatagaggt

SEQ ID NO: 267654 - DNA, 15 bp, Homo sapiens
ttctccacatagagg

SEQ ID NO: 267655 - DNA, 15 bp, Homo sapiens
tttctccacatagag

SEQ ID NO: 267656 - DNA, 15 bp, Homo sapiens
atttctccacataga

SEQ ID NO: 267657 - DNA, 15 bp, Homo sapiens
aatttctccacatag

SEQ ID NO: 267658 - DNA, 15 bp, Homo sapiens
gaatttctccacata

SEQ ID NO: 267659 - DNA, 15 bp, Homo sapiens
tgaatttctccacat

SEQ ID NO: 267660 - DNA, 15 bp, Homo sapiens
ttgaatttctccaca

SEQ ID NO: 267661 - DNA, 15 bp, Homo sapiens
gttgaatttctccac

SEQ ID NO: 267662 - DNA, 15 bp, Homo sapiens
tgttgaatttctcca

SEQ ID NO: 267663 - DNA, 15 bp, Homo sapiens
ttgttgaatttctcc

SEQ ID NO: 267664 - DNA, 15 bp, Homo sapiens
cttgttgaatttctc

SEQ ID NO: 267665 - DNA, 15 bp, Homo sapiens
tcttgttgaatttct

SEQ ID NO: 267666 - DNA, 15 bp, Homo sapiens
gtcttgttgaatttc

SEQ ID NO: 267667 - DNA, 15 bp, Homo sapiens
agtcttgttgaattt

SEQ ID NO: 267668 - DNA, 15 bp, Homo sapiens
cagtcttgttgaatt

SEQ ID NO: 267669 - DNA, 15 bp, Homo sapiens
acagtcttgttgaat

SEQ ID NO: 267670 - DNA, 15 bp, Homo sapiens
tacagtcttgttgaa

SEQ ID NO: 267671 - DNA, 15 bp, Homo sapiens
ttacagtcttgttga

SEQ ID NO: 267672 - DNA, 15 bp, Homo sapiens
attacagtcttgttg

SEQ ID NO: 267673 - DNA, 15 bp, Homo sapiens
tattacagtcttgtt

SEQ ID NO: 267674 - DNA, 15 bp, Homo sapiens
atattacagtcttgt

SEQ ID NO: 267675 - DNA, 15 bp, Homo sapiens
aatattacagtcttg

SEQ ID NO: 267676 - DNA, 15 bp, Homo sapiens
aaatattacagtctt

SEQ ID NO: 267677 - DNA, 15 bp, Homo sapiens
aaaatattacagtct

SEQ ID NO: 267678 - DNA, 15 bp, Homo sapiens
aaaaatattacagtc

SEQ ID NO: 267679 - DNA, 15 bp, Homo sapiens
aaaaaatattacagt

SEQ ID NO: 267680 - DNA, 15 bp, Homo sapiens
taaaaaatattacag

SEQ ID NO: 267681 - DNA, 15 bp, Homo sapiens
tctaaaaaatattac

SEQ ID NO: 267682 - DNA, 15 bp, Homo sapiens
ttctaaaaaatatta

SEQ ID NO: 267683 - DNA, 15 bp, Homo sapiens
attctaaaaaatatt

SEQ ID NO: 267684 - DNA, 15 bp, Homo sapiens
cattctaaaaaatat

SEQ ID NO: 267685 - DNA, 15 bp, Homo sapiens
tcattctaaaaaata

SEQ ID NO: 267686 - DNA, 15 bp, Homo sapiens
atcattctaaaaaat

SEQ ID NO: 267687 - DNA, 15 bp, Homo sapiens
aatcattctaaaaaa

SEQ ID NO: 267688 - DNA, 15 bp, Homo sapiens
taatcattctaaaaa

SEQ ID NO: 267689 - DNA, 15 bp, Homo sapiens
ttaatcattctaaaa

SEQ ID NO: 267690 - DNA, 15 bp, Homo sapiens
cttaatcattctaaa

SEQ ID NO: 267691 - DNA, 15 bp, Homo sapiens
gcttaatcattctaa

SEQ ID NO: 267692 - DNA, 15 bp, Homo sapiens
agcttaatcattcta

SEQ ID NO: 267693 - DNA, 15 bp, Homo sapiens
aagcttaatcattct

SEQ ID NO: 267694 - DNA, 15 bp, Homo sapiens
taagcttaatcattc

SEQ ID NO: 267695 - DNA, 15 bp, Homo sapiens
ataagcttaatcatt

SEQ ID NO: 267696 - DNA, 15 bp, Homo sapiens
cataagcttaatcat

SEQ ID NO: 267697 - DNA, 15 bp, Homo sapiens
tcataagcttaatca

SEQ ID NO: 267698 - DNA, 15 bp, Homo sapiens
ttcataagcttaatc

SEQ ID NO: 267699 - DNA, 15 bp, Homo sapiens
attcataagcttaat

SEQ ID NO: 267700 - DNA, 15 bp, Homo sapiens
gattcataagcttaa

SEQ ID NO: 267701 - DNA, 15 bp, Homo sapiens
tgattcataagctta

SEQ ID NO: 267702 - DNA, 15 bp, Homo sapiens
ttgattcataagctt

SEQ ID NO: 267703 - DNA, 15 bp, Homo sapiens
cttgattcataagct

SEQ ID NO: 267704 - DNA, 15 bp, Homo sapiens
tcttgattcataagc

SEQ ID NO: 267705 - DNA, 15 bp, Homo sapiens
ctcttgattcataag

SEQ ID NO: 267706 - DNA, 15 bp, Homo sapiens
tctcttgattcataa

SEQ ID NO: 267707 - DNA, 15 bp, Homo sapiens
ctctcttgattcata

SEQ ID NO: 267708 - DNA, 15 bp, Homo sapiens
actctcttgattcat

SEQ ID NO: 267709 - DNA, 15 bp, Homo sapiens
tactctcttgattca

SEQ ID NO: 267710 - DNA, 15 bp, Homo sapiens
ctactctcttgattc

SEQ ID NO: 267711 - DNA, 15 bp, Homo sapiens
actactctcttgatt

SEQ ID NO: 267712 - DNA, 15 bp, Homo sapiens
gactactctcttgat

SEQ ID NO: 267713 - DNA, 15 bp, Homo sapiens
tgactactctcttga

SEQ ID NO: 267714 - DNA, 15 bp, Homo sapiens
ttgactactctcttg

SEQ ID NO: 267715 - DNA, 15 bp, Homo sapiens
attgactactctctt

SEQ ID NO: 267716 - DNA, 15 bp, Homo sapiens
aattgactactctct

SEQ ID NO: 267717 - DNA, 15 bp, Homo sapiens
aaattgactactctc

SEQ ID NO: 267718 - DNA, 15 bp, Homo sapiens
aaaattgactactct

SEQ ID NO: 267719 - DNA, 15 bp, Homo sapiens
aaaaattgactactc

SEQ ID NO: 267720 - DNA, 15 bp, Homo sapiens
aaaaaattgactact

SEQ ID NO: 267721 - DNA, 15 bp, Homo sapiens
aaaaaaattgactac

SEQ ID NO: 267722 - DNA, 15 bp, Homo sapiens
aaaaaaaattgacta

SEQ ID NO: 267723 - DNA, 15 bp, Homo sapiens
aaaaaaaaattgact

SEQ ID NO: 267724 - DNA, 15 bp, Homo sapiens
caaaaaaaaattgac

SEQ ID NO: 267725 - DNA, 15 bp, Homo sapiens
acaaaaaaaaattga

SEQ ID NO: 267726 - DNA, 15 bp, Homo sapiens
tacaaaaaaaaattg

SEQ ID NO: 267727 - DNA, 15 bp, Homo sapiens
taatacaaaaaaaaa

SEQ ID NO: 267728 - DNA, 15 bp, Homo sapiens
ataatacaaaaaaaa

SEQ ID NO: 267729 - DNA, 15 bp, Homo sapiens
gataatacaaaaaaa

SEQ ID NO: 267730 - DNA, 15 bp, Homo sapiens
ggataatacaaaaaa

SEQ ID NO: 267731 - DNA, 15 bp, Homo sapiens
tggataatacaaaaa

SEQ ID NO: 267732 - DNA, 15 bp, Homo sapiens
atggataatacaaaa

SEQ ID NO: 267733 - DNA, 15 bp, Homo sapiens
catggataatacaaa

SEQ ID NO: 267734 - DNA, 15 bp, Homo sapiens
gcatggataatacaa

SEQ ID NO: 267735 - DNA, 15 bp, Homo sapiens
tgcatggataataca

SEQ ID NO: 267736 - DNA, 15 bp, Homo sapiens
atgcatggataatac

SEQ ID NO: 267737 - DNA, 15 bp, Homo sapiens
aatgcatggataata

SEQ ID NO: 267738 - DNA, 15 bp, Homo sapiens
taatgcatggataat

SEQ ID NO: 267739 - DNA, 15 bp, Homo sapiens
ttaatgcatggataa

SEQ ID NO: 267740 - DNA, 15 bp, Homo sapiens
tttaatgcatggata

SEQ ID NO: 267741 - DNA, 15 bp, Homo sapiens
gtttaatgcatggat

SEQ ID NO: 267742 - DNA, 15 bp, Homo sapiens
ggtttaatgcatgga

SEQ ID NO: 267743 - DNA, 15 bp, Homo sapiens
aggtttaatgcatgg

SEQ ID NO: 267744 - DNA, 15 bp, Homo sapiens
aaggtttaatgcatg

SEQ ID NO: 267745 - DNA, 15 bp, Homo sapiens
aaaggtttaatgcat

SEQ ID NO: 267746 - DNA, 15 bp, Homo sapiens
caaaggtttaatgca

SEQ ID NO: 267747 - DNA, 15 bp, Homo sapiens
tcaaaggtttaatgc

SEQ ID NO: 267748 - DNA, 15 bp, Homo sapiens
ttcaaaggtttaatg

SEQ ID NO: 267749 - DNA, 15 bp, Homo sapiens
attcaaaggtttaat

SEQ ID NO: 267750 - DNA, 15 bp, Homo sapiens
aattcaaaggtttaa

SEQ ID NO: 267751 - DNA, 15 bp, Homo sapiens
gaattcaaaggttta

SEQ ID NO: 267752 - DNA, 15 bp, Homo sapiens
tgaattcaaaggttt

SEQ ID NO: 267753 - DNA, 15 bp, Homo sapiens
ctgaattcaaaggtt

SEQ ID NO: 267754 - DNA, 15 bp, Homo sapiens
cctgaattcaaaggt

SEQ ID NO: 267755 - DNA, 15 bp, Homo sapiens
ccctgaattcaaagg

SEQ ID NO: 267756 - DNA, 15 bp, Homo sapiens
tccctgaattcaaag

SEQ ID NO: 267757 - DNA, 15 bp, Homo sapiens
atccctgaattcaaa

SEQ ID NO: 267758 - DNA, 15 bp, Homo sapiens
aatccctgaattcaa

SEQ ID NO: 267759 - DNA, 15 bp, Homo sapiens
taatccctgaattca

SEQ ID NO: 267760 - DNA, 15 bp, Homo sapiens
ataatccctgaattc

SEQ ID NO: 267761 - DNA, 15 bp, Homo sapiens
gataatccctgaatt

SEQ ID NO: 267762 - DNA, 15 bp, Homo sapiens
tgataatccctgaat

SEQ ID NO: 267763 - DNA, 15 bp, Homo sapiens
atgataatccctgaa

SEQ ID NO: 267764 - DNA, 15 bp, Homo sapiens
aatgataatccctga

SEQ ID NO: 267765 - DNA, 15 bp, Homo sapiens
aaatgataatccctg

SEQ ID NO: 267766 - DNA, 15 bp, Homo sapiens
aaaatgataatccct

SEQ ID NO: 267767 - DNA, 15 bp, Homo sapiens
aaaaatgataatccc

SEQ ID NO: 267768 - DNA, 15 bp, Homo sapiens
aaaaaatgataatcc

SEQ ID NO: 267769 - DNA, 15 bp, Homo sapiens
ttaaaaaatgataat

SEQ ID NO: 267770 - DNA, 15 bp, Homo sapiens
tttaaaaaatgataa

SEQ ID NO: 267771 - DNA, 15 bp, Homo sapiens
atttaaaaaatgata

SEQ ID NO: 267772 - DNA, 15 bp, Homo sapiens
tatttaaaaaatgat

SEQ ID NO: 267773 - DNA, 15 bp, Homo sapiens
ttatttaaaaaatga

SEQ ID NO: 267774 - DNA, 15 bp, Homo sapiens
tttatttaaaaaatg

SEQ ID NO: 267775 - DNA, 15 bp, Homo sapiens
atttatttaaaaaat

SEQ ID NO: 267776 - DNA, 15 bp, Homo sapiens
ctatttatttaaaaa

SEQ ID NO: 267777 - DNA, 15 bp, Homo sapiens
actatttatttaaaa

SEQ ID NO: 267778 - DNA, 15 bp, Homo sapiens
aactatttatttaaa

SEQ ID NO: 267779 - DNA, 15 bp, Homo sapiens
taactatttatttaa

SEQ ID NO: 267780 - DNA, 15 bp, Homo sapiens
ataactatttattta

SEQ ID NO: 267781 - DNA, 15 bp, Homo sapiens
tataactatttattt

SEQ ID NO: 267782 - DNA, 15 bp, Homo sapiens
atataactatttatt

SEQ ID NO: 267783 - DNA, 15 bp, Homo sapiens
gatataactatttat

SEQ ID NO: 267784 - DNA, 15 bp, Homo sapiens
agatataactattta

SEQ ID NO: 267785 - DNA, 15 bp, Homo sapiens
aagatataactattt

SEQ ID NO: 267786 - DNA, 15 bp, Homo sapiens
taagatataactatt

SEQ ID NO: 267787 - DNA, 15 bp, Homo sapiens
ataagatataactat

SEQ ID NO: 267788 - DNA, 15 bp, Homo sapiens
tataagatataacta

SEQ ID NO: 267789 - DNA, 15 bp, Homo sapiens
atataagatataact

SEQ ID NO: 267790 - DNA, 15 bp, Homo sapiens
aatataagatataac

SEQ ID NO: 267791 - DNA, 15 bp, Homo sapiens
taatataagatataa

SEQ ID NO: 267792 - DNA, 15 bp, Homo sapiens
ttaatataagatata

SEQ ID NO: 267793 - DNA, 15 bp, Homo sapiens
tttaatataagatat

SEQ ID NO: 267794 - DNA, 15 bp, Homo sapiens
ctttaatataagata

SEQ ID NO: 267795 - DNA, 15 bp, Homo sapiens
tctttaatataagat

SEQ ID NO: 267796 - DNA, 15 bp, Homo sapiens
atctttaatataaga

SEQ ID NO: 267797 - DNA, 15 bp, Homo sapiens
catctttaatataag

SEQ ID NO: 267798 - DNA, 15 bp, Homo sapiens
acatctttaatataa

SEQ ID NO: 267799 - DNA, 15 bp, Homo sapiens
aacatctttaatata

SEQ ID NO: 267800 - DNA, 15 bp, Homo sapiens
gaacatctttaatat

SEQ ID NO: 267801 - DNA, 15 bp, Homo sapiens
tgaacatctttaata

SEQ ID NO: 267802 - DNA, 15 bp, Homo sapiens
ctgaacatctttaat

SEQ ID NO: 267803 - DNA, 15 bp, Homo sapiens
tctgaacatctttaa

SEQ ID NO: 267804 - DNA, 15 bp, Homo sapiens
atctgaacatcttta

SEQ ID NO: 267805 - DNA, 15 bp, Homo sapiens
aatctgaacatcttt

SEQ ID NO: 267806 - DNA, 15 bp, Homo sapiens
aaatctgaacatctt

SEQ ID NO: 267807 - DNA, 15 bp, Homo sapiens
taaatctgaacatct

SEQ ID NO: 267808 - DNA, 15 bp, Homo sapiens
ttaaatctgaacatc

SEQ ID NO: 267809 - DNA, 15 bp, Homo sapiens
tttaaatctgaacat

SEQ ID NO: 267810 - DNA, 15 bp, Homo sapiens
atttaaatctgaaca

SEQ ID NO: 267811 - DNA, 15 bp, Homo sapiens
aatttaaatctgaac

SEQ ID NO: 267812 - DNA, 15 bp, Homo sapiens
aaatttaaatctgaa

SEQ ID NO: 267813 - DNA, 15 bp, Homo sapiens
gaaatttaaatctga

SEQ ID NO: 267814 - DNA, 15 bp, Homo sapiens
agaaatttaaatctg

SEQ ID NO: 267815 - DNA, 15 bp, Homo sapiens
aagaaatttaaatct

SEQ ID NO: 267816 - DNA, 15 bp, Homo sapiens
aaagaaatttaaatc

SEQ ID NO: 267817 - DNA, 15 bp, Homo sapiens
aaaagaaatttaaat

SEQ ID NO: 267818 - DNA, 15 bp, Homo sapiens
aaaaaagaaatttaa

SEQ ID NO: 267819 - DNA, 15 bp, Homo sapiens
taaaaaagaaattta

SEQ ID NO: 267820 - DNA, 15 bp, Homo sapiens
ataaaaaagaaattt

SEQ ID NO: 267821 - DNA, 15 bp, Homo sapiens
aataaaaaagaaatt

SEQ ID NO: 267822 - DNA, 15 bp, Homo sapiens
aaataaaaaagaaat

SEQ ID NO: 267823 - DNA, 15 bp, Homo sapiens
taaataaaaaagaaa

SEQ ID NO: 267824 - DNA, 15 bp, Homo sapiens
ataaataaaaaagaa

SEQ ID NO: 267825 - DNA, 15 bp, Homo sapiens
cataaataaaaaaga

SEQ ID NO: 267826 - DNA, 15 bp, Homo sapiens
tcataaataaaaaag

SEQ ID NO: 267827 - DNA, 15 bp, Homo sapiens
atcataaataaaaaa

SEQ ID NO: 267828 - DNA, 15 bp, Homo sapiens
catcataaataaaaa

SEQ ID NO: 267829 - DNA, 15 bp, Homo sapiens
tcatcataaataaaa

SEQ ID NO: 267830 - DNA, 15 bp, Homo sapiens
atcatcataaataaa

SEQ ID NO: 267831 - DNA, 15 bp, Homo sapiens
aatcatcataaataa

SEQ ID NO: 267832 - DNA, 15 bp, Homo sapiens
aaatcatcataaata

SEQ ID NO: 267833 - DNA, 15 bp, Homo sapiens
taaatcatcataaat

SEQ ID NO: 267834 - DNA, 15 bp, Homo sapiens
ttaaatcatcataaa

SEQ ID NO: 267835 - DNA, 15 bp, Homo sapiens
attaaatcatcataa

SEQ ID NO: 267836 - DNA, 15 bp, Homo sapiens
aattaaatcatcata

SEQ ID NO: 267837 - DNA, 15 bp, Homo sapiens
aaattaaatcatcat

SEQ ID NO: 267838 - DNA, 15 bp, Homo sapiens
gaaattaaatcatca

SEQ ID NO: 267839 - DNA, 15 bp, Homo sapiens
tgaaattaaatcatc

SEQ ID NO: 267840 - DNA, 15 bp, Homo sapiens
atgaaattaaatcat

SEQ ID NO: 267841 - DNA, 15 bp, Homo sapiens
gatgaaattaaatca

SEQ ID NO: 267842 - DNA, 15 bp, Homo sapiens
cgatgaaattaaatc

SEQ ID NO: 267843 - DNA, 15 bp, Homo sapiens
acgatgaaattaaat

SEQ ID NO: 267844 - DNA, 15 bp, Homo sapiens
cacgatgaaattaaa

SEQ ID NO: 267845 - DNA, 15 bp, Homo sapiens
tcacgatgaaattaa

SEQ ID NO: 267846 - DNA, 15 bp, Homo sapiens
ttcacgatgaaatta

SEQ ID NO: 267847 - DNA, 15 bp, Homo sapiens
tttcacgatgaaatt

SEQ ID NO: 267848 - DNA, 15 bp, Homo sapiens
ttttcacgatgaaat

SEQ ID NO: 267849 - DNA, 15 bp, Homo sapiens
attttcacgatgaaa

SEQ ID NO: 267850 - DNA, 15 bp, Homo sapiens
aattttcacgatgaa

SEQ ID NO: 267851 - DNA, 15 bp, Homo sapiens
taattttcacgatga

SEQ ID NO: 267852 - DNA, 15 bp, Homo sapiens
gtaattttcacgatg

SEQ ID NO: 267853 - DNA, 15 bp, Homo sapiens
ggtaattttcacgat

SEQ ID NO: 267854 - DNA, 15 bp, Homo sapiens
gggtaattttcacga

SEQ ID NO: 267855 - DNA, 15 bp, Homo sapiens
agggtaattttcacg

SEQ ID NO: 267856 - DNA, 15 bp, Homo sapiens
tagggtaattttcac

SEQ ID NO: 267857 - DNA, 15 bp, Homo sapiens
gtagggtaattttca

SEQ ID NO: 267858 - DNA, 15 bp, Homo sapiens
agtagggtaattttc

SEQ ID NO: 267859 - DNA, 15 bp, Homo sapiens
gagtagggtaatttt

SEQ ID NO: 267860 - DNA, 15 bp, Homo sapiens
tgagtagggtaattt

SEQ ID NO: 267861 - DNA, 15 bp, Homo sapiens
ctgagtagggtaatt

SEQ ID NO: 267862 - DNA, 15 bp, Homo sapiens
tctgagtagggtaat

SEQ ID NO: 267863 - DNA, 15 bp, Homo sapiens
atctgagtagggtaa

SEQ ID NO: 267864 - DNA, 15 bp, Homo sapiens
gatctgagtagggta

SEQ ID NO: 267865 - DNA, 15 bp, Homo sapiens
agatctgagtagggt

SEQ ID NO: 267866 - DNA, 15 bp, Homo sapiens
aagatctgagtaggg

SEQ ID NO: 267867 - DNA, 15 bp, Homo sapiens
gaagatctgagtagg

SEQ ID NO: 267868 - DNA, 15 bp, Homo sapiens
agaagatctgagtag

SEQ ID NO: 267869 - DNA, 15 bp, Homo sapiens
aagaagatctgagta

SEQ ID NO: 267870 - DNA, 15 bp, Homo sapiens
aaagaagatctgagt

SEQ ID NO: 267871 - DNA, 15 bp, Homo sapiens
taaagaagatctgag

SEQ ID NO: 267872 - DNA, 15 bp, Homo sapiens
ttaaagaagatctga

SEQ ID NO: 267873 - DNA, 15 bp, Homo sapiens
tttaaagaagatctg

SEQ ID NO: 267874 - DNA, 15 bp, Homo sapiens
ttttaaagaagatct

SEQ ID NO: 267875 - DNA, 15 bp, Homo sapiens
attttaaagaagatc

SEQ ID NO: 267876 - DNA, 15 bp, Homo sapiens
gattttaaagaagat

SEQ ID NO: 267877 - DNA, 15 bp, Homo sapiens
tgattttaaagaaga

SEQ ID NO: 267878 - DNA, 15 bp, Homo sapiens
atgattttaaagaag

SEQ ID NO: 267879 - DNA, 15 bp, Homo sapiens
gatgattttaaagaa

SEQ ID NO: 267880 - DNA, 15 bp, Homo sapiens
agatgattttaaaga

SEQ ID NO: 267881 - DNA, 15 bp, Homo sapiens
aagatgattttaaag

SEQ ID NO: 267882 - DNA, 15 bp, Homo sapiens
aaagatgattttaaa

SEQ ID NO: 267883 - DNA, 15 bp, Homo sapiens
caaagatgattttaa

SEQ ID NO: 267884 - DNA, 15 bp, Homo sapiens
acaaagatgatttta

SEQ ID NO: 267885 - DNA, 15 bp, Homo sapiens
aacaaagatgatttt

SEQ ID NO: 267886 - DNA, 15 bp, Homo sapiens
caacaaagatgattt

SEQ ID NO: 267887 - DNA, 15 bp, Homo sapiens
acaacaaagatgatt

SEQ ID NO: 267888 - DNA, 15 bp, Homo sapiens
tacaacaaagatgat

SEQ ID NO: 267889 - DNA, 15 bp, Homo sapiens
ttacaacaaagatga

SEQ ID NO: 267890 - DNA, 15 bp, Homo sapiens
cttacaacaaagatg

SEQ ID NO: 267891 - DNA, 15 bp, Homo sapiens
acttacaacaaagat

SEQ ID NO: 267892 - DNA, 15 bp, Homo sapiens
tacttacaacaaaga

SEQ ID NO: 267893 - DNA, 15 bp, Homo sapiens
ttacttacaacaaag

SEQ ID NO: 267894 - DNA, 15 bp, Homo sapiens
gttacttacaacaaa

SEQ ID NO: 267895 - DNA, 15 bp, Homo sapiens
ggttacttacaacaa

SEQ ID NO: 267896 - DNA, 15 bp, Homo sapiens
tggttacttacaaca

SEQ ID NO: 267897 - DNA, 15 bp, Homo sapiens
ttggttacttacaac

SEQ ID NO: 267898 - DNA, 15 bp, Homo sapiens
tttggttacttacaa

SEQ ID NO: 267899 - DNA, 15 bp, Homo sapiens
ttttggttacttaca

SEQ ID NO: 267900 - DNA, 15 bp, Homo sapiens
attttggttacttac

SEQ ID NO: 267901 - DNA, 15 bp, Homo sapiens
aattttggttactta

SEQ ID NO: 267902 - DNA, 15 bp, Homo sapiens
aaattttggttactt

SEQ ID NO: 267903 - DNA, 15 bp, Homo sapiens
taaattttggttact

SEQ ID NO: 267904 - DNA, 15 bp, Homo sapiens
ttaaattttggttac

SEQ ID NO: 267905 - DNA, 15 bp, Homo sapiens
attaaattttggtta

SEQ ID NO: 267906 - DNA, 15 bp, Homo sapiens
aattaaattttggtt

SEQ ID NO: 267907 - DNA, 15 bp, Homo sapiens
gaattaaattttggt

SEQ ID NO: 267908 - DNA, 15 bp, Homo sapiens
tgaattaaattttgg

SEQ ID NO: 267909 - DNA, 15 bp, Homo sapiens
ttgaattaaattttg

SEQ ID NO: 267910 - DNA, 15 bp, Homo sapiens
atttgaattaaattt

SEQ ID NO: 267911 - DNA, 15 bp, Homo sapiens
aatttgaattaaatt

SEQ ID NO: 267912 - DNA, 15 bp, Homo sapiens
taatttgaattaaat

SEQ ID NO: 267913 - DNA, 15 bp, Homo sapiens
ctaatttgaattaaa

SEQ ID NO: 267914 - DNA, 15 bp, Homo sapiens
tctaatttgaattaa

SEQ ID NO: 267915 - DNA, 15 bp, Homo sapiens
ttctaatttgaatta

SEQ ID NO: 267916 - DNA, 15 bp, Homo sapiens
tttctaatttgaatt

SEQ ID NO: 267917 - DNA, 15 bp, Homo sapiens
gtttctaatttgaat

SEQ ID NO: 267918 - DNA, 15 bp, Homo sapiens
tgtttctaatttgaa

SEQ ID NO: 267919 - DNA, 15 bp, Homo sapiens
atgtttctaatttga

SEQ ID NO: 267920 - DNA, 15 bp, Homo sapiens
aatgtttctaatttg

SEQ ID NO: 267921 - DNA, 15 bp, Homo sapiens
aaatgtttctaattt

SEQ ID NO: 267922 - DNA, 15 bp, Homo sapiens
aaaatgtttctaatt

SEQ ID NO: 267923 - DNA, 15 bp, Homo sapiens
gaaaatgtttctaat

SEQ ID NO: 267924 - DNA, 15 bp, Homo sapiens
tgaaaatgtttctaa

SEQ ID NO: 267925 - DNA, 15 bp, Homo sapiens
atgaaaatgtttcta

SEQ ID NO: 267926 - DNA, 15 bp, Homo sapiens
tatgaaaatgtttct

SEQ ID NO: 267927 - DNA, 15 bp, Homo sapiens
atatgaaaatgtttc

SEQ ID NO: 267928 - DNA, 15 bp, Homo sapiens
catatgaaaatgttt

SEQ ID NO: 267929 - DNA, 15 bp, Homo sapiens
acatatgaaaatgtt

SEQ ID NO: 267930 - DNA, 15 bp, Homo sapiens
aacatatgaaaatgt

SEQ ID NO: 267931 - DNA, 15 bp, Homo sapiens
caacatatgaaaatg

SEQ ID NO: 267932 - DNA, 15 bp, Homo sapiens
acaacatatgaaaat

SEQ ID NO: 267933 - DNA, 15 bp, Homo sapiens
aacaacatatgaaaa

SEQ ID NO: 267934 - DNA, 15 bp, Homo sapiens
taacaacatatgaaa

SEQ ID NO: 267935 - DNA, 15 bp, Homo sapiens
ctaacaacatatgaa

SEQ ID NO: 267936 - DNA, 15 bp, Homo sapiens
tctaacaacatatga

SEQ ID NO: 267937 - DNA, 15 bp, Homo sapiens
ctctaacaacatatg

SEQ ID NO: 267938 - DNA, 15 bp, Homo sapiens
gctctaacaacatat

SEQ ID NO: 267939 - DNA, 15 bp, Homo sapiens
tgctctaacaacata

SEQ ID NO: 267940 - DNA, 15 bp, Homo sapiens
atgctctaacaacat

SEQ ID NO: 267941 - DNA, 15 bp, Homo sapiens
tatgctctaacaaca

SEQ ID NO: 267942 - DNA, 15 bp, Homo sapiens
atatgctctaacaac

SEQ ID NO: 267943 - DNA, 15 bp, Homo sapiens
tatatgctctaacaa

SEQ ID NO: 267944 - DNA, 15 bp, Homo sapiens
ttatatgctctaaca

SEQ ID NO: 267945 - DNA, 15 bp, Homo sapiens
tttatatgctctaac

SEQ ID NO: 267946 - DNA, 15 bp, Homo sapiens
ttttatatgctctaa

SEQ ID NO: 267947 - DNA, 15 bp, Homo sapiens
cttttatatgctcta

SEQ ID NO: 267948 - DNA, 15 bp, Homo sapiens
tcttttatatgctct

SEQ ID NO: 267949 - DNA, 15 bp, Homo sapiens
atcttttatatgctc

SEQ ID NO: 267950 - DNA, 15 bp, Homo sapiens
tatcttttatatgct

SEQ ID NO: 267951 - DNA, 15 bp, Homo sapiens
ctatcttttatatgc

SEQ ID NO: 267952 - DNA, 15 bp, Homo sapiens
actatcttttatatg

SEQ ID NO: 267953 - DNA, 15 bp, Homo sapiens
cactatcttttatat

SEQ ID NO: 267954 - DNA, 15 bp, Homo sapiens
acactatcttttata

SEQ ID NO: 267955 - DNA, 15 bp, Homo sapiens
cacactatcttttat

SEQ ID NO: 267956 - DNA, 15 bp, Homo sapiens
acacactatctttta

SEQ ID NO: 267957 - DNA, 15 bp, Homo sapiens
cacacactatctttt

SEQ ID NO: 267958 - DNA, 15 bp, Homo sapiens
ccacacactatcttt

SEQ ID NO: 267959 - DNA, 15 bp, Homo sapiens
accacacactatctt

SEQ ID NO: 267960 - DNA, 15 bp, Homo sapiens
aaccacacactatct

SEQ ID NO: 267961 - DNA, 15 bp, Homo sapiens
aaaccacacactatc

SEQ ID NO: 267962 - DNA, 15 bp, Homo sapiens
aaaaccacacactat

SEQ ID NO: 267963 - DNA, 15 bp, Homo sapiens
caaaaccacacacta

SEQ ID NO: 267964 - DNA, 15 bp, Homo sapiens
acaaaaccacacact

SEQ ID NO: 267965 - DNA, 15 bp, Homo sapiens
aacaaaaccacacac

SEQ ID NO: 267966 - DNA, 15 bp, Homo sapiens
aaacaaaaccacaca

SEQ ID NO: 267967 - DNA, 15 bp, Homo sapiens
aaaacaaaaccacac

SEQ ID NO: 267968 - DNA, 15 bp, Homo sapiens
aaaaacaaaaccaca

SEQ ID NO: 267969 - DNA, 15 bp, Homo sapiens
aaaaaacaaaaccac

SEQ ID NO: 267970 - DNA, 15 bp, Homo sapiens
caaaaaacaaaacca

SEQ ID NO: 267971 - DNA, 15 bp, Homo sapiens
tcaaaaaacaaaacc

SEQ ID NO: 267972 - DNA, 15 bp, Homo sapiens
ctcaaaaaacaaaac

SEQ ID NO: 267973 - DNA, 15 bp, Homo sapiens
tcatctcaaaaaaca

SEQ ID NO: 267974 - DNA, 15 bp, Homo sapiens
ctcatctcaaaaaac

SEQ ID NO: 267975 - DNA, 15 bp, Homo sapiens
tctcatctcaaaaaa

SEQ ID NO: 267976 - DNA, 15 bp, Homo sapiens
atctcatctcaaaaa

SEQ ID NO: 267977 - DNA, 15 bp, Homo sapiens
gatctcatctcaaaa

SEQ ID NO: 267978 - DNA, 15 bp, Homo sapiens
agatctcatctcaaa

SEQ ID NO: 267979 - DNA, 15 bp, Homo sapiens
tagatctcatctcaa

SEQ ID NO: 267980 - DNA, 15 bp, Homo sapiens
ctagatctcatctca

SEQ ID NO: 267981 - DNA, 15 bp, Homo sapiens
actagatctcatctc

SEQ ID NO: 267982 - DNA, 15 bp, Homo sapiens
gactagatctcatct

SEQ ID NO: 267983 - DNA, 15 bp, Homo sapiens
agactagatctcatc

SEQ ID NO: 267984 - DNA, 15 bp, Homo sapiens
cagactagatctcat

SEQ ID NO: 267985 - DNA, 15 bp, Homo sapiens
acagactagatctca

SEQ ID NO: 267986 - DNA, 15 bp, Homo sapiens
aacagactagatctc

SEQ ID NO: 267987 - DNA, 15 bp, Homo sapiens
taacagactagatct

SEQ ID NO: 267988 - DNA, 15 bp, Homo sapiens
ctaacagactagatc

SEQ ID NO: 267989 - DNA, 15 bp, Homo sapiens
actaacagactagat

SEQ ID NO: 267990 - DNA, 15 bp, Homo sapiens
cactaacagactaga

SEQ ID NO: 267991 - DNA, 15 bp, Homo sapiens
tcactaacagactag

SEQ ID NO: 267992 - DNA, 15 bp, Homo sapiens
ttcactaacagacta

SEQ ID NO: 267993 - DNA, 15 bp, Homo sapiens
attcactaacagact

SEQ ID NO: 267994 - DNA, 15 bp, Homo sapiens
aattcactaacagac

SEQ ID NO: 267995 - DNA, 15 bp, Homo sapiens
aaattcactaacaga

SEQ ID NO: 267996 - DNA, 15 bp, Homo sapiens
gaaattcactaacag

SEQ ID NO: 267997 - DNA, 15 bp, Homo sapiens
tgaaattcactaaca

SEQ ID NO: 267998 - DNA, 15 bp, Homo sapiens
ttgaaattcactaac

SEQ ID NO: 267999 - DNA, 15 bp, Homo sapiens
cttgaaattcactaa

SEQ ID NO: 268000 - DNA, 15 bp, Homo sapiens
acttgaaattcacta

SEQ ID NO: 268001 - DNA, 15 bp, Homo sapiens
cacttgaaattcact

SEQ ID NO: 268002 - DNA, 15 bp, Homo sapiens
acacttgaaattcac

SEQ ID NO: 268003 - DNA, 15 bp, Homo sapiens
tacacttgaaattca

SEQ ID NO: 268004 - DNA, 15 bp, Homo sapiens
atacacttgaaattc

SEQ ID NO: 268005 - DNA, 15 bp, Homo sapiens
aatacacttgaaatt

SEQ ID NO: 268006 - DNA, 15 bp, Homo sapiens
taatacacttgaaat

SEQ ID NO: 268007 - DNA, 15 bp, Homo sapiens
ataatacacttgaaa

SEQ ID NO: 268008 - DNA, 15 bp, Homo sapiens
gataatacacttgaa

SEQ ID NO: 268009 - DNA, 15 bp, Homo sapiens
agataatacacttga

SEQ ID NO: 268010 - DNA, 15 bp, Homo sapiens
cagataatacacttg

SEQ ID NO: 268011 - DNA, 15 bp, Homo sapiens
acagataatacactt

SEQ ID NO: 268012 - DNA, 15 bp, Homo sapiens
tacagataatacact

SEQ ID NO: 268013 - DNA, 15 bp, Homo sapiens
ctacagataatacac

SEQ ID NO: 268014 - DNA, 15 bp, Homo sapiens
gctacagataataca

SEQ ID NO: 268015 - DNA, 15 bp, Homo sapiens
ggctacagataatac

SEQ ID NO: 268016 - DNA, 15 bp, Homo sapiens
tggctacagataata

SEQ ID NO: 268017 - DNA, 15 bp, Homo sapiens
gtggctacagataat

SEQ ID NO: 268018 - DNA, 15 bp, Homo sapiens
tgtggctacagataa

SEQ ID NO: 268019 - DNA, 15 bp, Homo sapiens
ttgtggctacagata

SEQ ID NO: 268020 - DNA, 15 bp, Homo sapiens
cttgtggctacagat

SEQ ID NO: 268021 - DNA, 15 bp, Homo sapiens
gcttgtggctacaga

SEQ ID NO: 268022 - DNA, 15 bp, Homo sapiens
agcttgtggctacag

SEQ ID NO: 268023 - DNA, 15 bp, Homo sapiens
cagcttgtggctaca

SEQ ID NO: 268024 - DNA, 15 bp, Homo sapiens
acagcttgtggctac

SEQ ID NO: 268025 - DNA, 15 bp, Homo sapiens
tacagcttgtggcta

SEQ ID NO: 268026 - DNA, 15 bp, Homo sapiens
gtacagcttgtggct

SEQ ID NO: 268027 - DNA, 15 bp, Homo sapiens
tgtacagcttgtggc

SEQ ID NO: 268028 - DNA, 15 bp, Homo sapiens
atgtacagcttgtgg

SEQ ID NO: 268029 - DNA, 15 bp, Homo sapiens
aatgtacagcttgtg

SEQ ID NO: 268030 - DNA, 15 bp, Homo sapiens
taatgtacagcttgt

SEQ ID NO: 268031 - DNA, 15 bp, Homo sapiens
ctaatgtacagcttg

SEQ ID NO: 268032 - DNA, 15 bp, Homo sapiens
cctaatgtacagctt

SEQ ID NO: 268033 - DNA, 15 bp, Homo sapiens
acctaatgtacagct

SEQ ID NO: 268034 - DNA, 15 bp, Homo sapiens
gacctaatgtacagc

SEQ ID NO: 268035 - DNA, 15 bp, Homo sapiens
agacctaatgtacag

SEQ ID NO: 268036 - DNA, 15 bp, Homo sapiens
gagacctaatgtaca

SEQ ID NO: 268037 - DNA, 15 bp, Homo sapiens
ggagacctaatgtac

SEQ ID NO: 268038 - DNA, 15 bp, Homo sapiens
tggagacctaatgta

SEQ ID NO: 268039 - DNA, 15 bp, Homo sapiens
ctggagacctaatgt

SEQ ID NO: 268040 - DNA, 15 bp, Homo sapiens
tctggagacctaatg

SEQ ID NO: 268041 - DNA, 15 bp, Homo sapiens
ttctggagacctaat

SEQ ID NO: 268042 - DNA, 15 bp, Homo sapiens
attctggagacctaa

SEQ ID NO: 268043 - DNA, 15 bp, Homo sapiens
aattctggagaccta

SEQ ID NO: 268044 - DNA, 15 bp, Homo sapiens
aaattctggagacct

SEQ ID NO: 268045 - DNA, 15 bp, Homo sapiens
taaattctggagacc

SEQ ID NO: 268046 - DNA, 15 bp, Homo sapiens
ataaattctggagac

SEQ ID NO: 268047 - DNA, 15 bp, Homo sapiens
aataaattctggaga

SEQ ID NO: 268048 - DNA, 15 bp, Homo sapiens
gaataaattctggag

SEQ ID NO: 268049 - DNA, 15 bp, Homo sapiens
tgaataaattctgga

SEQ ID NO: 268050 - DNA, 15 bp, Homo sapiens
atgaataaattctgg

SEQ ID NO: 268051 - DNA, 15 bp, Homo sapiens
gatgaataaattctg

SEQ ID NO: 268052 - DNA, 15 bp, Homo sapiens
tgatgaataaattct

SEQ ID NO: 268053 - DNA, 15 bp, Homo sapiens
atgatgaataaattc

SEQ ID NO: 268054 - DNA, 15 bp, Homo sapiens
tatgatgaataaatt

SEQ ID NO: 268055 - DNA, 15 bp, Homo sapiens
atatgatgaataaat

SEQ ID NO: 268056 - DNA, 15 bp, Homo sapiens
tatatgatgaataaa

SEQ ID NO: 268057 - DNA, 15 bp, Homo sapiens
ttatatgatgaataa

SEQ ID NO: 268058 - DNA, 15 bp, Homo sapiens
gttatatgatgaata

SEQ ID NO: 268059 - DNA, 15 bp, Homo sapiens
agttatatgatgaat

SEQ ID NO: 268060 - DNA, 15 bp, Homo sapiens
cagttatatgatgaa

SEQ ID NO: 268061 - DNA, 15 bp, Homo sapiens
tcagttatatgatga

SEQ ID NO: 268062 - DNA, 15 bp, Homo sapiens
ttcagttatatgatg

SEQ ID NO: 268063 - DNA, 15 bp, Homo sapiens
tttcagttatatgat

SEQ ID NO: 268064 - DNA, 15 bp, Homo sapiens
ctttcagttatatga

SEQ ID NO: 268065 - DNA, 15 bp, Homo sapiens
actttcagttatatg

SEQ ID NO: 268066 - DNA, 15 bp, Homo sapiens
aactttcagttatat

SEQ ID NO: 268067 - DNA, 15 bp, Homo sapiens
aaactttcagttata

SEQ ID NO: 268068 - DNA, 15 bp, Homo sapiens
taaactttcagttat

SEQ ID NO: 268069 - DNA, 15 bp, Homo sapiens
ataaactttcagtta

SEQ ID NO: 268070 - DNA, 15 bp, Homo sapiens
tataaactttcagtt

SEQ ID NO: 268071 - DNA, 15 bp, Homo sapiens
gtataaactttcagt

SEQ ID NO: 268072 - DNA, 15 bp, Homo sapiens
ggtataaactttcag

SEQ ID NO: 268073 - DNA, 15 bp, Homo sapiens
gggtataaactttca

SEQ ID NO: 268074 - DNA, 15 bp, Homo sapiens
agggtataaactttc

SEQ ID NO: 268075 - DNA, 15 bp, Homo sapiens
aagggtataaacttt

SEQ ID NO: 268076 - DNA, 15 bp, Homo sapiens
aaagggtataaactt

SEQ ID NO: 268077 - DNA, 15 bp, Homo sapiens
caaagggtataaact

SEQ ID NO: 268078 - DNA, 15 bp, Homo sapiens
tcaaagggtataaac

SEQ ID NO: 268079 - DNA, 15 bp, Homo sapiens
gtcaaagggtataaa

SEQ ID NO: 268080 - DNA, 15 bp, Homo sapiens
ggtcaaagggtataa

SEQ ID NO: 268081 - DNA, 15 bp, Homo sapiens
tggtcaaagggtata

SEQ ID NO: 268082 - DNA, 15 bp, Homo sapiens
ctggtcaaagggtat

SEQ ID NO: 268083 - DNA, 15 bp, Homo sapiens
actggtcaaagggta

SEQ ID NO: 268084 - DNA, 15 bp, Homo sapiens
gactggtcaaagggt

SEQ ID NO: 268085 - DNA, 15 bp, Homo sapiens
agactggtcaaaggg

SEQ ID NO: 268086 - DNA, 15 bp, Homo sapiens
gagactggtcaaagg

SEQ ID NO: 268087 - DNA, 15 bp, Homo sapiens
agagactggtcaaag

SEQ ID NO: 268088 - DNA, 15 bp, Homo sapiens
aagagactggtcaaa

SEQ ID NO: 268089 - DNA, 15 bp, Homo sapiens
gaagagactggtcaa

SEQ ID NO: 268090 - DNA, 15 bp, Homo sapiens
agaagagactggtca

SEQ ID NO: 268091 - DNA, 15 bp, Homo sapiens
gagaagagactggtc

SEQ ID NO: 268092 - DNA, 15 bp, Homo sapiens
agagaagagactggt

SEQ ID NO: 268093 - DNA, 15 bp, Homo sapiens
aagagaagagactgg

SEQ ID NO: 268094 - DNA, 15 bp, Homo sapiens
aaagagaagagactg

SEQ ID NO: 268095 - DNA, 15 bp, Homo sapiens
aaaagagaagagact

SEQ ID NO: 268096 - DNA, 15 bp, Homo sapiens
gaaaagagaagagac

SEQ ID NO: 268097 - DNA, 15 bp, Homo sapiens
ggaaaagagaagaga

SEQ ID NO: 268098 - DNA, 15 bp, Homo sapiens
aggaaaagagaagag

SEQ ID NO: 268099 - DNA, 15 bp, Homo sapiens
gaggaaaagagaaga

SEQ ID NO: 268100 - DNA, 15 bp, Homo sapiens
ggaggaaaagagaag

SEQ ID NO: 268101 - DNA, 15 bp, Homo sapiens
tggaggaaaagagaa

SEQ ID NO: 268102 - DNA, 15 bp, Homo sapiens
gtggaggaaaagaga

SEQ ID NO: 268103 - DNA, 15 bp, Homo sapiens
ggtggaggaaaagag

SEQ ID NO: 268104 - DNA, 15 bp, Homo sapiens
gggtggaggaaaaga

SEQ ID NO: 268105 - DNA, 15 bp, Homo sapiens
ggggtggaggaaaag

SEQ ID NO: 268106 - DNA, 15 bp, Homo sapiens
gggggtggaggaaaa

SEQ ID NO: 268107 - DNA, 15 bp, Homo sapiens
ggggggtggaggaaa

SEQ ID NO: 268108 - DNA, 15 bp, Homo sapiens
tggggggtggaggaa

SEQ ID NO: 268109 - DNA, 15 bp, Homo sapiens
ctggggggtggagga

SEQ ID NO: 268110 - DNA, 15 bp, Homo sapiens
gctggggggtggagg

SEQ ID NO: 268111 - DNA, 15 bp, Homo sapiens
ggctggggggtggag

SEQ ID NO: 268112 - DNA, 15 bp, Homo sapiens
gggctggggggtgga

SEQ ID NO: 268113 - DNA, 15 bp, Homo sapiens
ggggctggggggtgg

SEQ ID NO: 268114 - DNA, 15 bp, Homo sapiens
aggggctggggggtg

SEQ ID NO: 268115 - DNA, 15 bp, Homo sapiens
caggggctggggggt

SEQ ID NO: 268116 - DNA, 15 bp, Homo sapiens
ccaggggctgggggg

SEQ ID NO: 268117 - DNA, 15 bp, Homo sapiens
accaggggctggggg

SEQ ID NO: 268118 - DNA, 15 bp, Homo sapiens
taccaggggctgggg

SEQ ID NO: 268119 - DNA, 15 bp, Homo sapiens
ttaccaggggctggg

SEQ ID NO: 268120 - DNA, 15 bp, Homo sapiens
gttaccaggggctgg

SEQ ID NO: 268121 - DNA, 15 bp, Homo sapiens
agttaccaggggctg

SEQ ID NO: 268122 - DNA, 15 bp, Homo sapiens
tagttaccaggggct

SEQ ID NO: 268123 - DNA, 15 bp, Homo sapiens
gtagttaccaggggc

SEQ ID NO: 268124 - DNA, 15 bp, Homo sapiens
ggtagttaccagggg

SEQ ID NO: 268125 - DNA, 15 bp, Homo sapiens
tggtagttaccaggg

SEQ ID NO: 268126 - DNA, 15 bp, Homo sapiens
atggtagttaccagg

SEQ ID NO: 268127 - DNA, 15 bp, Homo sapiens
aatggtagttaccag

SEQ ID NO: 268128 - DNA, 15 bp, Homo sapiens
gaatggtagttacca

SEQ ID NO: 268129 - DNA, 15 bp, Homo sapiens
agaatggtagttacc

SEQ ID NO: 268130 - DNA, 15 bp, Homo sapiens
tagaatggtagttac

SEQ ID NO: 268131 - DNA, 15 bp, Homo sapiens
gtagaatggtagtta

SEQ ID NO: 268132 - DNA, 15 bp, Homo sapiens
agtagaatggtagtt

SEQ ID NO: 268133 - DNA, 15 bp, Homo sapiens
gagtagaatggtagt

SEQ ID NO: 268134 - DNA, 15 bp, Homo sapiens
agagtagaatggtag

SEQ ID NO: 268135 - DNA, 15 bp, Homo sapiens
cagagtagaatggta

SEQ ID NO: 268136 - DNA, 15 bp, Homo sapiens
acagagtagaatggt

SEQ ID NO: 268137 - DNA, 15 bp, Homo sapiens
cacagagtagaatgg

SEQ ID NO: 268138 - DNA, 15 bp, Homo sapiens
gcacagagtagaatg

SEQ ID NO: 268139 - DNA, 15 bp, Homo sapiens
agcacagagtagaat

SEQ ID NO: 268140 - DNA, 15 bp, Homo sapiens
tagcacagagtagaa

SEQ ID NO: 268141 - DNA, 15 bp, Homo sapiens
gtagcacagagtaga

SEQ ID NO: 268142 - DNA, 15 bp, Homo sapiens
agtagcacagagtag

SEQ ID NO: 268143 - DNA, 15 bp, Homo sapiens
tagtagcacagagta

SEQ ID NO: 268144 - DNA, 15 bp, Homo sapiens
atagtagcacagagt

SEQ ID NO: 268145 - DNA, 15 bp, Homo sapiens
catagtagcacagag

SEQ ID NO: 268146 - DNA, 15 bp, Homo sapiens
tcatagtagcacaga

SEQ ID NO: 268147 - DNA, 15 bp, Homo sapiens
ctcatagtagcacag

SEQ ID NO: 268148 - DNA, 15 bp, Homo sapiens
gctcatagtagcaca

SEQ ID NO: 268149 - DNA, 15 bp, Homo sapiens
agctcatagtagcac

SEQ ID NO: 268150 - DNA, 15 bp, Homo sapiens
aagctcatagtagca

SEQ ID NO: 268151 - DNA, 15 bp, Homo sapiens
caagctcatagtagc

SEQ ID NO: 268152 - DNA, 15 bp, Homo sapiens
tcaagctcatagtag

SEQ ID NO: 268153 - DNA, 15 bp, Homo sapiens
gtcaagctcatagta

SEQ ID NO: 268154 - DNA, 15 bp, Homo sapiens
agtcaagctcatagt

SEQ ID NO: 268155 - DNA, 15 bp, Homo sapiens
aagtcaagctcatag

SEQ ID NO: 268156 - DNA, 15 bp, Homo sapiens
aaagtcaagctcata

SEQ ID NO: 268157 - DNA, 15 bp, Homo sapiens
aaaagtcaagctcat

SEQ ID NO: 268158 - DNA, 15 bp, Homo sapiens
aaaaagtcaagctca

SEQ ID NO: 268159 - DNA, 15 bp, Homo sapiens
aaaaaagtcaagctc

SEQ ID NO: 268160 - DNA, 15 bp, Homo sapiens
aaaaaaagtcaagct

SEQ ID NO: 268161 - DNA, 15 bp, Homo sapiens
aaaaaaaagtcaagc

SEQ ID NO: 268162 - DNA, 15 bp, Homo sapiens
aaaaaaaaagtcaag

SEQ ID NO: 268163 - DNA, 15 bp, Homo sapiens
taaaaaaaaaagtca

SEQ ID NO: 268164 - DNA, 15 bp, Homo sapiens
ttaaaaaaaaaagtc

SEQ ID NO: 268165 - DNA, 15 bp, Homo sapiens
tttaaaaaaaaaagt

SEQ ID NO: 268166 - DNA, 15 bp, Homo sapiens
cctttaaaaaaaaaa

SEQ ID NO: 268167 - DNA, 15 bp, Homo sapiens
acctttaaaaaaaaa

SEQ ID NO: 268168 - DNA, 15 bp, Homo sapiens
gacctttaaaaaaaa

SEQ ID NO: 268169 - DNA, 15 bp, Homo sapiens
ggacctttaaaaaaa

SEQ ID NO: 268170 - DNA, 15 bp, Homo sapiens
gggacctttaaaaaa

SEQ ID NO: 268171 - DNA, 15 bp, Homo sapiens
tgggacctttaaaaa

SEQ ID NO: 268172 - DNA, 15 bp, Homo sapiens
gtgggacctttaaaa

SEQ ID NO: 268173 - DNA, 15 bp, Homo sapiens
tgtgggacctttaaa

SEQ ID NO: 268174 - DNA, 15 bp, Homo sapiens
atgtgggacctttaa

SEQ ID NO: 268175 - DNA, 15 bp, Homo sapiens
tatgtgggaccttta

SEQ ID NO: 268176 - DNA, 15 bp, Homo sapiens
atatgtgggaccttt

SEQ ID NO: 268177 - DNA, 15 bp, Homo sapiens
tatatgtgggacctt

SEQ ID NO: 268178 - DNA, 15 bp, Homo sapiens
ttatatgtgggacct

SEQ ID NO: 268179 - DNA, 15 bp, Homo sapiens
cttatatgtgggacc

SEQ ID NO: 268180 - DNA, 15 bp, Homo sapiens
acttatatgtgggac

SEQ ID NO: 268181 - DNA, 15 bp, Homo sapiens
cacttatatgtggga

SEQ ID NO: 268182 - DNA, 15 bp, Homo sapiens
tcacttatatgtggg

SEQ ID NO: 268183 - DNA, 15 bp, Homo sapiens
ctcacttatatgtgg

SEQ ID NO: 268184 - DNA, 15 bp, Homo sapiens
tctcacttatatgtg

SEQ ID NO: 268185 - DNA, 15 bp, Homo sapiens
atctcacttatatgt

SEQ ID NO: 268186 - DNA, 15 bp, Homo sapiens
gatctcacttatatg

SEQ ID NO: 268187 - DNA, 15 bp, Homo sapiens
tgatctcacttatat

SEQ ID NO: 268188 - DNA, 15 bp, Homo sapiens
atgatctcacttata

SEQ ID NO: 268189 - DNA, 15 bp, Homo sapiens
catgatctcacttat

SEQ ID NO: 268190 - DNA, 15 bp, Homo sapiens
gcatgatctcactta

SEQ ID NO: 268191 - DNA, 15 bp, Homo sapiens
tgcatgatctcactt

SEQ ID NO: 268192 - DNA, 15 bp, Homo sapiens
ctgcatgatctcact

SEQ ID NO: 268193 - DNA, 15 bp, Homo sapiens
actgcatgatctcac

SEQ ID NO: 268194 - DNA, 15 bp, Homo sapiens
tactgcatgatctca

SEQ ID NO: 268195 - DNA, 15 bp, Homo sapiens
atactgcatgatctc

SEQ ID NO: 268196 - DNA, 15 bp, Homo sapiens
aatactgcatgatct

SEQ ID NO: 268197 - DNA, 15 bp, Homo sapiens
aaatactgcatgatc

SEQ ID NO: 268198 - DNA, 15 bp, Homo sapiens
caaatactgcatgat

SEQ ID NO: 268199 - DNA, 15 bp, Homo sapiens
acaaatactgcatga

SEQ ID NO: 268200 - DNA, 15 bp, Homo sapiens
gacaaatactgcatg

SEQ ID NO: 268201 - DNA, 15 bp, Homo sapiens
agacaaatactgcat

SEQ ID NO: 268202 - DNA, 15 bp, Homo sapiens
aagacaaatactgca

SEQ ID NO: 268203 - DNA, 15 bp, Homo sapiens
aaagacaaatactgc

SEQ ID NO: 268204 - DNA, 15 bp, Homo sapiens
gaaagacaaatactg

SEQ ID NO: 268205 - DNA, 15 bp, Homo sapiens
agaaagacaaatact

SEQ ID NO: 268206 - DNA, 15 bp, Homo sapiens
cagaaagacaaatac

SEQ ID NO: 268207 - DNA, 15 bp, Homo sapiens
acagaaagacaaata

SEQ ID NO: 268208 - DNA, 15 bp, Homo sapiens
tacagaaagacaaat

SEQ ID NO: 268209 - DNA, 15 bp, Homo sapiens
atacagaaagacaaa

SEQ ID NO: 268210 - DNA, 15 bp, Homo sapiens
gatacagaaagacaa

SEQ ID NO: 268211 - DNA, 15 bp, Homo sapiens
agatacagaaagaca

SEQ ID NO: 268212 - DNA, 15 bp, Homo sapiens
cagatacagaaagac

SEQ ID NO: 268213 - DNA, 15 bp, Homo sapiens
ccagatacagaaaga

SEQ ID NO: 268214 - DNA, 15 bp, Homo sapiens
cccagatacagaaag

SEQ ID NO: 268215 - DNA, 15 bp, Homo sapiens
acccagatacagaaa

SEQ ID NO: 268216 - DNA, 15 bp, Homo sapiens
aacccagatacagaa

SEQ ID NO: 268217 - DNA, 15 bp, Homo sapiens
taacccagatacaga

SEQ ID NO: 268218 - DNA, 15 bp, Homo sapiens
ataacccagatacag

SEQ ID NO: 268219 - DNA, 15 bp, Homo sapiens
aataacccagataca

SEQ ID NO: 268220 - DNA, 15 bp, Homo sapiens
aaataacccagatac

SEQ ID NO: 268221 - DNA, 15 bp, Homo sapiens
gaaataacccagata

SEQ ID NO: 268222 - DNA, 15 bp, Homo sapiens
tgaaataacccagat

SEQ ID NO: 268223 - DNA, 15 bp, Homo sapiens
gtgaaataacccaga

SEQ ID NO: 268224 - DNA, 15 bp, Homo sapiens
agtgaaataacccag

SEQ ID NO: 268225 - DNA, 15 bp, Homo sapiens
aagtgaaataaccca

SEQ ID NO: 268226 - DNA, 15 bp, Homo sapiens
taagtgaaataaccc

SEQ ID NO: 268227 - DNA, 15 bp, Homo sapiens
ctaagtgaaataacc

SEQ ID NO: 268228 - DNA, 15 bp, Homo sapiens
actaagtgaaataac

SEQ ID NO: 268229 - DNA, 15 bp, Homo sapiens
tactaagtgaaataa

SEQ ID NO: 268230 - DNA, 15 bp, Homo sapiens
atactaagtgaaata

SEQ ID NO: 268231 - DNA, 15 bp, Homo sapiens
tatactaagtgaaat

SEQ ID NO: 268232 - DNA, 15 bp, Homo sapiens
ttatactaagtgaaa

SEQ ID NO: 268233 - DNA, 15 bp, Homo sapiens
attatactaagtgaa

SEQ ID NO: 268234 - DNA, 15 bp, Homo sapiens
cattatactaagtga

SEQ ID NO: 268235 - DNA, 15 bp, Homo sapiens
acattatactaagtg

SEQ ID NO: 268236 - DNA, 15 bp, Homo sapiens
gacattatactaagt

SEQ ID NO: 268237 - DNA, 15 bp, Homo sapiens
ggacattatactaag

SEQ ID NO: 268238 - DNA, 15 bp, Homo sapiens
aggacattatactaa

SEQ ID NO: 268239 - DNA, 15 bp, Homo sapiens
gaggacattatacta

SEQ ID NO: 268240 - DNA, 15 bp, Homo sapiens
ggaggacattatact

SEQ ID NO: 268241 - DNA, 15 bp, Homo sapiens
tggaggacattatac

SEQ ID NO: 268242 - DNA, 15 bp, Homo sapiens
ctggaggacattata

SEQ ID NO: 268243 - DNA, 15 bp, Homo sapiens
cctggaggacattat

SEQ ID NO: 268244 - DNA, 15 bp, Homo sapiens
gcctggaggacatta

SEQ ID NO: 268245 - DNA, 15 bp, Homo sapiens
agcctggaggacatt

SEQ ID NO: 268246 - DNA, 15 bp, Homo sapiens
gagcctggaggacat

SEQ ID NO: 268247 - DNA, 15 bp, Homo sapiens
tgagcctggaggaca

SEQ ID NO: 268248 - DNA, 15 bp, Homo sapiens
atgagcctggaggac

SEQ ID NO: 268249 - DNA, 15 bp, Homo sapiens
gatgagcctggagga

SEQ ID NO: 268250 - DNA, 15 bp, Homo sapiens
agatgagcctggagg

SEQ ID NO: 268251 - DNA, 15 bp, Homo sapiens
tagatgagcctggag

SEQ ID NO: 268252 - DNA, 15 bp, Homo sapiens
ttagatgagcctgga

SEQ ID NO: 268253 - DNA, 15 bp, Homo sapiens
cttagatgagcctgg

SEQ ID NO: 268254 - DNA, 15 bp, Homo sapiens
acttagatgagcctg

SEQ ID NO: 268255 - DNA, 15 bp, Homo sapiens
aacttagatgagcct

SEQ ID NO: 268256 - DNA, 15 bp, Homo sapiens
taacttagatgagcc

SEQ ID NO: 268257 - DNA, 15 bp, Homo sapiens
ataacttagatgagc

SEQ ID NO: 268258 - DNA, 15 bp, Homo sapiens
aataacttagatgag

SEQ ID NO: 268259 - DNA, 15 bp, Homo sapiens
caataacttagatga

SEQ ID NO: 268260 - DNA, 15 bp, Homo sapiens
gcaataacttagatg

SEQ ID NO: 268261 - DNA, 15 bp, Homo sapiens
tgcaataacttagat

SEQ ID NO: 268262 - DNA, 15 bp, Homo sapiens
ttgcaataacttaga

SEQ ID NO: 268263 - DNA, 15 bp, Homo sapiens
tttgcaataacttag

SEQ ID NO: 268264 - DNA, 15 bp, Homo sapiens
atttgcaataactta

SEQ ID NO: 268265 - DNA, 15 bp, Homo sapiens
catttgcaataactt

SEQ ID NO: 268266 - DNA, 15 bp, Homo sapiens
tcatttgcaataact

SEQ ID NO: 268267 - DNA, 15 bp, Homo sapiens
gtcatttgcaataac

SEQ ID NO: 268268 - DNA, 15 bp, Homo sapiens
tgtcatttgcaataa

SEQ ID NO: 268269 - DNA, 15 bp, Homo sapiens
ctgtcatttgcaata

SEQ ID NO: 268270 - DNA, 15 bp, Homo sapiens
tctgtcatttgcaat

SEQ ID NO: 268271 - DNA, 15 bp, Homo sapiens
aattctgtcatttgc

SEQ ID NO: 268272 - DNA, 15 bp, Homo sapiens
gaattctgtcatttg

SEQ ID NO: 268273 - DNA, 15 bp, Homo sapiens
ggaattctgtcattt

SEQ ID NO: 268274 - DNA, 15 bp, Homo sapiens
gggaattctgtcatt

SEQ ID NO: 268275 - DNA, 15 bp, Homo sapiens
agggaattctgtcat

SEQ ID NO: 268276 - DNA, 15 bp, Homo sapiens
aagggaattctgtca

SEQ ID NO: 268277 - DNA, 15 bp, Homo sapiens
gaagggaattctgtc

SEQ ID NO: 268278 - DNA, 15 bp, Homo sapiens
agaagggaattctgt

SEQ ID NO: 268279 - DNA, 15 bp, Homo sapiens
aagaagggaattctg

SEQ ID NO: 268280 - DNA, 15 bp, Homo sapiens
aaagaagggaattct

SEQ ID NO: 268281 - DNA, 15 bp, Homo sapiens
aaaagaagggaattc

SEQ ID NO: 268282 - DNA, 15 bp, Homo sapiens
aaaaagaagggaatt

SEQ ID NO: 268283 - DNA, 15 bp, Homo sapiens
aaaaaagaagggaat

SEQ ID NO: 268284 - DNA, 15 bp, Homo sapiens
aaaaaaagaagggaa

SEQ ID NO: 268285 - DNA, 15 bp, Homo sapiens
taaaaaaagaaggga

SEQ ID NO: 268286 - DNA, 15 bp, Homo sapiens
ataaaaaaagaaggg

SEQ ID NO: 268287 - DNA, 15 bp, Homo sapiens
cataaaaaaagaagg

SEQ ID NO: 268288 - DNA, 15 bp, Homo sapiens
tcataaaaaaagaag

SEQ ID NO: 268289 - DNA, 15 bp, Homo sapiens
gtcataaaaaaagaa

SEQ ID NO: 268290 - DNA, 15 bp, Homo sapiens
agtcataaaaaaaga

SEQ ID NO: 268291 - DNA, 15 bp, Homo sapiens
cagtcataaaaaaag

SEQ ID NO: 268292 - DNA, 15 bp, Homo sapiens
ccagtcataaaaaaa

SEQ ID NO: 268293 - DNA, 15 bp, Homo sapiens
tccagtcataaaaaa

SEQ ID NO: 268294 - DNA, 15 bp, Homo sapiens
atccagtcataaaaa

SEQ ID NO: 268295 - DNA, 15 bp, Homo sapiens
tatccagtcataaaa

SEQ ID NO: 268296 - DNA, 15 bp, Homo sapiens
atatccagtcataaa

SEQ ID NO: 268297 - DNA, 15 bp, Homo sapiens
tatatccagtcataa

SEQ ID NO: 268298 - DNA, 15 bp, Homo sapiens
atatatccagtcata

SEQ ID NO: 268299 - DNA, 15 bp, Homo sapiens
aatatatccagtcat

SEQ ID NO: 268300 - DNA, 15 bp, Homo sapiens
aaatatatccagtca

SEQ ID NO: 268301 - DNA, 15 bp, Homo sapiens
gaaatatatccagtc

SEQ ID NO: 268302 - DNA, 15 bp, Homo sapiens
tgaaatatatccagt

SEQ ID NO: 268303 - DNA, 15 bp, Homo sapiens
gtgaaatatatccag

SEQ ID NO: 268304 - DNA, 15 bp, Homo sapiens
agtgaaatatatcca

SEQ ID NO: 268305 - DNA, 15 bp, Homo sapiens
cagtgaaatatatcc

SEQ ID NO: 268306 - DNA, 15 bp, Homo sapiens
acagtgaaatatatc

SEQ ID NO: 268307 - DNA, 15 bp, Homo sapiens
cacagtgaaatatat

SEQ ID NO: 268308 - DNA, 15 bp, Homo sapiens
acacagtgaaatata

SEQ ID NO: 268309 - DNA, 15 bp, Homo sapiens
aacacagtgaaatat

SEQ ID NO: 268310 - DNA, 15 bp, Homo sapiens
aaacacagtgaaata

SEQ ID NO: 268311 - DNA, 15 bp, Homo sapiens
aaaacacagtgaaat

SEQ ID NO: 268312 - DNA, 15 bp, Homo sapiens
gaaaacacagtgaaa

SEQ ID NO: 268313 - DNA, 15 bp, Homo sapiens
agaaaacacagtgaa

SEQ ID NO: 268314 - DNA, 15 bp, Homo sapiens
aagaaaacacagtga

SEQ ID NO: 268315 - DNA, 15 bp, Homo sapiens
aaagaaaacacagtg

SEQ ID NO: 268316 - DNA, 15 bp, Homo sapiens
taaagaaaacacagt

SEQ ID NO: 268317 - DNA, 15 bp, Homo sapiens
ataaagaaaacacag

SEQ ID NO: 268318 - DNA, 15 bp, Homo sapiens
gataaagaaaacaca

SEQ ID NO: 268319 - DNA, 15 bp, Homo sapiens
ggataaagaaaacac

SEQ ID NO: 268320 - DNA, 15 bp, Homo sapiens
tggataaagaaaaca

SEQ ID NO: 268321 - DNA, 15 bp, Homo sapiens
aaaatggataaagaa

SEQ ID NO: 268322 - DNA, 15 bp, Homo sapiens
aaaaatggataaaga

SEQ ID NO: 268323 - DNA, 15 bp, Homo sapiens
gaaaaatggataaag

SEQ ID NO: 268324 - DNA, 15 bp, Homo sapiens
agaaaaatggataaa

SEQ ID NO: 268325 - DNA, 15 bp, Homo sapiens
cagaaaaatggataa

SEQ ID NO: 268326 - DNA, 15 bp, Homo sapiens
acagaaaaatggata

SEQ ID NO: 268327 - DNA, 15 bp, Homo sapiens
aacagaaaaatggat

SEQ ID NO: 268328 - DNA, 15 bp, Homo sapiens
caacagaaaaatgga

SEQ ID NO: 268329 - DNA, 15 bp, Homo sapiens
acaacagaaaaatgg

SEQ ID NO: 268330 - DNA, 15 bp, Homo sapiens
tacaacagaaaaatg

SEQ ID NO: 268331 - DNA, 15 bp, Homo sapiens
ctacaacagaaaaat

SEQ ID NO: 268332 - DNA, 15 bp, Homo sapiens
cctacaacagaaaaa

SEQ ID NO: 268333 - DNA, 15 bp, Homo sapiens
tcctacaacagaaaa

SEQ ID NO: 268334 - DNA, 15 bp, Homo sapiens
atcctacaacagaaa

SEQ ID NO: 268335 - DNA, 15 bp, Homo sapiens
tatcctacaacagaa

SEQ ID NO: 268336 - DNA, 15 bp, Homo sapiens
gtatcctacaacaga

SEQ ID NO: 268337 - DNA, 15 bp, Homo sapiens
agtatcctacaacag

SEQ ID NO: 268338 - DNA, 15 bp, Homo sapiens
aagtatcctacaaca

SEQ ID NO: 268339 - DNA, 15 bp, Homo sapiens
taagtatcctacaac

SEQ ID NO: 268340 - DNA, 15 bp, Homo sapiens
ctaagtatcctacaa

SEQ ID NO: 268341 - DNA, 15 bp, Homo sapiens
actaagtatcctaca

SEQ ID NO: 268342 - DNA, 15 bp, Homo sapiens
aactaagtatcctac

SEQ ID NO: 268343 - DNA, 15 bp, Homo sapiens
aaactaagtatccta

SEQ ID NO: 268344 - DNA, 15 bp, Homo sapiens
caaactaagtatcct

SEQ ID NO: 268345 - DNA, 15 bp, Homo sapiens
tcaaactaagtatcc

SEQ ID NO: 268346 - DNA, 15 bp, Homo sapiens
atcaaactaagtatc

SEQ ID NO: 268347 - DNA, 15 bp, Homo sapiens
aatcaaactaagtat

SEQ ID NO: 268348 - DNA, 15 bp, Homo sapiens
gaatcaaactaagta

SEQ ID NO: 268349 - DNA, 15 bp, Homo sapiens
ggaatcaaactaagt

SEQ ID NO: 268350 - DNA, 15 bp, Homo sapiens
tggaatcaaactaag

SEQ ID NO: 268351 - DNA, 15 bp, Homo sapiens
atggaatcaaactaa

SEQ ID NO: 268352 - DNA, 15 bp, Homo sapiens
tatggaatcaaacta

SEQ ID NO: 268353 - DNA, 15 bp, Homo sapiens
atatggaatcaaact

SEQ ID NO: 268354 - DNA, 15 bp, Homo sapiens
gatatggaatcaaac

SEQ ID NO: 268355 - DNA, 15 bp, Homo sapiens
agatatggaatcaaa

SEQ ID NO: 268356 - DNA, 15 bp, Homo sapiens
aagatatggaatcaa

SEQ ID NO: 268357 - DNA, 15 bp, Homo sapiens
caagatatggaatca

SEQ ID NO: 268358 - DNA, 15 bp, Homo sapiens
ccaagatatggaatc

SEQ ID NO: 268359 - DNA, 15 bp, Homo sapiens
gccaagatatggaat

SEQ ID NO: 268360 - DNA, 15 bp, Homo sapiens
agccaagatatggaa

SEQ ID NO: 268361 - DNA, 15 bp, Homo sapiens
tagccaagatatgga

SEQ ID NO: 268362 - DNA, 15 bp, Homo sapiens
atagccaagatatgg

SEQ ID NO: 268363 - DNA, 15 bp, Homo sapiens
aatagccaagatatg

SEQ ID NO: 268364 - DNA, 15 bp, Homo sapiens
caatagccaagatat

SEQ ID NO: 268365 - DNA, 15 bp, Homo sapiens
acaatagccaagata

SEQ ID NO: 268366 - DNA, 15 bp, Homo sapiens
tagcattattcacaa

SEQ ID NO: 268367 - DNA, 15 bp, Homo sapiens
gtagcattattcaca

SEQ ID NO: 268368 - DNA, 15 bp, Homo sapiens
tgtagcattattcac

SEQ ID NO: 268369 - DNA, 15 bp, Homo sapiens
ctgtagcattattca

SEQ ID NO: 268370 - DNA, 15 bp, Homo sapiens
actgtagcattattc

SEQ ID NO: 268371 - DNA, 15 bp, Homo sapiens
cactgtagcattatt

SEQ ID NO: 268372 - DNA, 15 bp, Homo sapiens
gcactgtagcattat

SEQ ID NO: 268373 - DNA, 15 bp, Homo sapiens
tgcactgtagcatta

SEQ ID NO: 268374 - DNA, 15 bp, Homo sapiens
gtgcactgtagcatt

SEQ ID NO: 268375 - DNA, 15 bp, Homo sapiens
tgtgcactgtagcat

SEQ ID NO: 268376 - DNA, 15 bp, Homo sapiens
atgtgcactgtagca

SEQ ID NO: 268377 - DNA, 15 bp, Homo sapiens
tatgtgcactgtagc

SEQ ID NO: 268378 - DNA, 15 bp, Homo sapiens
ctatgtgcactgtag

SEQ ID NO: 268379 - DNA, 15 bp, Homo sapiens
cctatgtgcactgta

SEQ ID NO: 268380 - DNA, 15 bp, Homo sapiens
tcctatgtgcactgt

SEQ ID NO: 268381 - DNA, 15 bp, Homo sapiens
ctcctatgtgcactg

SEQ ID NO: 268382 - DNA, 15 bp, Homo sapiens
actcctatgtgcact

SEQ ID NO: 268383 - DNA, 15 bp, Homo sapiens
tactcctatgtgcac

SEQ ID NO: 268384 - DNA, 15 bp, Homo sapiens
atactcctatgtgca

SEQ ID NO: 268385 - DNA, 15 bp, Homo sapiens
tatactcctatgtgc

SEQ ID NO: 268386 - DNA, 15 bp, Homo sapiens
ttatactcctatgtg

SEQ ID NO: 268387 - DNA, 15 bp, Homo sapiens
tttatactcctatgt

SEQ ID NO: 268388 - DNA, 15 bp, Homo sapiens
atttatactcctatg

SEQ ID NO: 268389 - DNA, 15 bp, Homo sapiens
tatttatactcctat

SEQ ID NO: 268390 - DNA, 15 bp, Homo sapiens
gtatttatactccta

SEQ ID NO: 268391 - DNA, 15 bp, Homo sapiens
ggtatttatactcct

SEQ ID NO: 268392 - DNA, 15 bp, Homo sapiens
aggtatttatactcc

SEQ ID NO: 268393 - DNA, 15 bp, Homo sapiens
aaggtatttatactc

SEQ ID NO: 268394 - DNA, 15 bp, Homo sapiens
aaaggtatttatact

SEQ ID NO: 268395 - DNA, 15 bp, Homo sapiens
aaaaggtatttatac

SEQ ID NO: 268396 - DNA, 15 bp, Homo sapiens
caaaaggtatttata

SEQ ID NO: 268397 - DNA, 15 bp, Homo sapiens
ccaaaaggtatttat

SEQ ID NO: 268398 - DNA, 15 bp, Homo sapiens
tccaaaaggtattta

SEQ ID NO: 268399 - DNA, 15 bp, Homo sapiens
ctccaaaaggtattt

SEQ ID NO: 268400 - DNA, 15 bp, Homo sapiens
tctccaaaaggtatt

SEQ ID NO: 268401 - DNA, 15 bp, Homo sapiens
atctccaaaaggtat

SEQ ID NO: 268402 - DNA, 15 bp, Homo sapiens
tatctccaaaaggta

SEQ ID NO: 268403 - DNA, 15 bp, Homo sapiens
ttatctccaaaaggt

SEQ ID NO: 268404 - DNA, 15 bp, Homo sapiens
attatctccaaaagg

SEQ ID NO: 268405 - DNA, 15 bp, Homo sapiens
cattatctccaaaag

SEQ ID NO: 268406 - DNA, 15 bp, Homo sapiens
tcattatctccaaaa

SEQ ID NO: 268407 - DNA, 15 bp, Homo sapiens
atcattatctccaaa

SEQ ID NO: 268408 - DNA, 15 bp, Homo sapiens
aatcattatctccaa

SEQ ID NO: 268409 - DNA, 15 bp, Homo sapiens
aaatcattatctcca

SEQ ID NO: 268410 - DNA, 15 bp, Homo sapiens
aaaatcattatctcc

SEQ ID NO: 268411 - DNA, 15 bp, Homo sapiens
taaaatcattatctc

SEQ ID NO: 268412 - DNA, 15 bp, Homo sapiens
ataaaatcattatct

SEQ ID NO: 268413 - DNA, 15 bp, Homo sapiens
aataaaatcattatc

SEQ ID NO: 268414 - DNA, 15 bp, Homo sapiens
aaataaaatcattat

SEQ ID NO: 268415 - DNA, 15 bp, Homo sapiens
aaaataaaatcatta

SEQ ID NO: 268416 - DNA, 15 bp, Homo sapiens
gaaaataaaatcatt

SEQ ID NO: 268417 - DNA, 15 bp, Homo sapiens
agaaaataaaatcat

SEQ ID NO: 268418 - DNA, 15 bp, Homo sapiens
aagaaaataaaatca

SEQ ID NO: 268419 - DNA, 15 bp, Homo sapiens
aaagaaaataaaatc

SEQ ID NO: 268420 - DNA, 15 bp, Homo sapiens
caaagaaaataaaat

SEQ ID NO: 268421 - DNA, 15 bp, Homo sapiens
ccaaagaaaataaaa

SEQ ID NO: 268422 - DNA, 15 bp, Homo sapiens
tccaaagaaaataaa

SEQ ID NO: 268423 - DNA, 15 bp, Homo sapiens
atccaaagaaaataa

SEQ ID NO: 268424 - DNA, 15 bp, Homo sapiens
tatccaaagaaaata

SEQ ID NO: 268425 - DNA, 15 bp, Homo sapiens
atatccaaagaaaat

SEQ ID NO: 268426 - DNA, 15 bp, Homo sapiens
catatccaaagaaaa

SEQ ID NO: 268427 - DNA, 15 bp, Homo sapiens
acatatccaaagaaa

SEQ ID NO: 268428 - DNA, 15 bp, Homo sapiens
tacatatccaaagaa

SEQ ID NO: 268429 - DNA, 15 bp, Homo sapiens
gtacatatccaaaga

SEQ ID NO: 268430 - DNA, 15 bp, Homo sapiens
ggtacatatccaaag

SEQ ID NO: 268431 - DNA, 15 bp, Homo sapiens
gggtacatatccaaa

SEQ ID NO: 268432 - DNA, 15 bp, Homo sapiens
tgggtacatatccaa

SEQ ID NO: 268433 - DNA, 15 bp, Homo sapiens
ctgggtacatatcca

SEQ ID NO: 268434 - DNA, 15 bp, Homo sapiens
tctgggtacatatcc

SEQ ID NO: 268435 - DNA, 15 bp, Homo sapiens
ttctgggtacatatc

SEQ ID NO: 268436 - DNA, 15 bp, Homo sapiens
cttctgggtacatat

SEQ ID NO: 268437 - DNA, 15 bp, Homo sapiens
acttctgggtacata

SEQ ID NO: 268438 - DNA, 15 bp, Homo sapiens
cacttctgggtacat

SEQ ID NO: 268439 - DNA, 15 bp, Homo sapiens
ccacttctgggtaca

SEQ ID NO: 268440 - DNA, 15 bp, Homo sapiens
cccacttctgggtac

SEQ ID NO: 268441 - DNA, 15 bp, Homo sapiens
tcccacttctgggta

SEQ ID NO: 268442 - DNA, 15 bp, Homo sapiens
atcccacttctgggt

SEQ ID NO: 268443 - DNA, 15 bp, Homo sapiens
aatcccacttctggg

SEQ ID NO: 268444 - DNA, 15 bp, Homo sapiens
taatcccacttctgg

SEQ ID NO: 268445 - DNA, 15 bp, Homo sapiens
gtaatcccacttctg

SEQ ID NO: 268446 - DNA, 15 bp, Homo sapiens
agtaatcccacttct

SEQ ID NO: 268447 - DNA, 15 bp, Homo sapiens
cagtaatcccacttc

SEQ ID NO: 268448 - DNA, 15 bp, Homo sapiens
ccagtaatcccactt

SEQ ID NO: 268449 - DNA, 15 bp, Homo sapiens
tccagtaatcccact

SEQ ID NO: 268450 - DNA, 15 bp, Homo sapiens
atccagtaatcccac

SEQ ID NO: 268451 - DNA, 15 bp, Homo sapiens
catccagtaatccca

SEQ ID NO: 268452 - DNA, 15 bp, Homo sapiens
tcatccagtaatccc

SEQ ID NO: 268453 - DNA, 15 bp, Homo sapiens
atcatccagtaatcc

SEQ ID NO: 268454 - DNA, 15 bp, Homo sapiens
tatcatccagtaatc

SEQ ID NO: 268455 - DNA, 15 bp, Homo sapiens
atatcatccagtaat

SEQ ID NO: 268456 - DNA, 15 bp, Homo sapiens
catatcatccagtaa

SEQ ID NO: 268457 - DNA, 15 bp, Homo sapiens
tcatatcatccagta

SEQ ID NO: 268458 - DNA, 15 bp, Homo sapiens
atcatatcatccagt

SEQ ID NO: 268459 - DNA, 15 bp, Homo sapiens
tatcatatcatccag

SEQ ID NO: 268460 - DNA, 15 bp, Homo sapiens
ctatcatatcatcca

SEQ ID NO: 268461 - DNA, 15 bp, Homo sapiens
actatcatatcatcc

SEQ ID NO: 268462 - DNA, 15 bp, Homo sapiens
aactatcatatcatc

SEQ ID NO: 268463 - DNA, 15 bp, Homo sapiens
gaactatcatatcat

SEQ ID NO: 268464 - DNA, 15 bp, Homo sapiens
agaactatcatatca

SEQ ID NO: 268465 - DNA, 15 bp, Homo sapiens
tagaactatcatatc

SEQ ID NO: 268466 - DNA, 15 bp, Homo sapiens
atagaactatcatat

SEQ ID NO: 268467 - DNA, 15 bp, Homo sapiens
aatagaactatcata

SEQ ID NO: 268468 - DNA, 15 bp, Homo sapiens
aaatagaactatcat

SEQ ID NO: 268469 - DNA, 15 bp, Homo sapiens
aaaatagaactatca

SEQ ID NO: 268470 - DNA, 15 bp, Homo sapiens
aaaaatagaactatc

SEQ ID NO: 268471 - DNA, 15 bp, Homo sapiens
taaaaatagaactat

SEQ ID NO: 268472 - DNA, 15 bp, Homo sapiens
ttaaaaatagaacta

SEQ ID NO: 268473 - DNA, 15 bp, Homo sapiens
attaaaaatagaact

SEQ ID NO: 268474 - DNA, 15 bp, Homo sapiens
aattaaaaatagaac

SEQ ID NO: 268475 - DNA, 15 bp, Homo sapiens
aaattaaaaatagaa

SEQ ID NO: 268476 - DNA, 15 bp, Homo sapiens
aaaattaaaaataga

SEQ ID NO: 268477 - DNA, 15 bp, Homo sapiens
aaaaattaaaaatag

SEQ ID NO: 268478 - DNA, 15 bp, Homo sapiens
taaaaaattaaaaat

SEQ ID NO: 268479 - DNA, 15 bp, Homo sapiens
ttaaaaaattaaaaa

SEQ ID NO: 268480 - DNA, 15 bp, Homo sapiens
ctttaaaaaattaaa

SEQ ID NO: 268481 - DNA, 15 bp, Homo sapiens
tctttaaaaaattaa

SEQ ID NO: 268482 - DNA, 15 bp, Homo sapiens
ttctttaaaaaatta

SEQ ID NO: 268483 - DNA, 15 bp, Homo sapiens
gttctttaaaaaatt

SEQ ID NO: 268484 - DNA, 15 bp, Homo sapiens
ggttctttaaaaaat

SEQ ID NO: 268485 - DNA, 15 bp, Homo sapiens
aggttctttaaaaaa

SEQ ID NO: 268486 - DNA, 15 bp, Homo sapiens
aaggttctttaaaaa

SEQ ID NO: 268487 - DNA, 15 bp, Homo sapiens
aaaggttctttaaaa

SEQ ID NO: 268488 - DNA, 15 bp, Homo sapiens
taaaggttctttaaa

SEQ ID NO: 268489 - DNA, 15 bp, Homo sapiens
ctaaaggttctttaa

SEQ ID NO: 268490 - DNA, 15 bp, Homo sapiens
tctaaaggttcttta

SEQ ID NO: 268491 - DNA, 15 bp, Homo sapiens
atctaaaggttcttt

SEQ ID NO: 268492 - DNA, 15 bp, Homo sapiens
aatctaaaggttctt

SEQ ID NO: 268493 - DNA, 15 bp, Homo sapiens
caatctaaaggttct

SEQ ID NO: 268494 - DNA, 15 bp, Homo sapiens
acaatctaaaggttc

SEQ ID NO: 268495 - DNA, 15 bp, Homo sapiens
aacaatctaaaggtt

SEQ ID NO: 268496 - DNA, 15 bp, Homo sapiens
aaacaatctaaaggt

SEQ ID NO: 268497 - DNA, 15 bp, Homo sapiens
aaaacaatctaaagg

SEQ ID NO: 268498 - DNA, 15 bp, Homo sapiens
aaaaacaatctaaag

SEQ ID NO: 268499 - DNA, 15 bp, Homo sapiens
gaaaaacaatctaaa

SEQ ID NO: 268500 - DNA, 15 bp, Homo sapiens
tgaaaaacaatctaa

SEQ ID NO: 268501 - DNA, 15 bp, Homo sapiens
atgaaaaacaatcta

SEQ ID NO: 268502 - DNA, 15 bp, Homo sapiens
tatgaaaaacaatct

SEQ ID NO: 268503 - DNA, 15 bp, Homo sapiens
ttatgaaaaacaatc

SEQ ID NO: 268504 - DNA, 15 bp, Homo sapiens
attatgaaaaacaat

SEQ ID NO: 268505 - DNA, 15 bp, Homo sapiens
cattatgaaaaacaa

SEQ ID NO: 268506 - DNA, 15 bp, Homo sapiens
tcattatgaaaaaca

SEQ ID NO: 268507 - DNA, 15 bp, Homo sapiens
gtcattatgaaaaac

SEQ ID NO: 268508 - DNA, 15 bp, Homo sapiens
agtcattatgaaaaa

SEQ ID NO: 268509 - DNA, 15 bp, Homo sapiens
cagtcattatgaaaa

SEQ ID NO: 268510 - DNA, 15 bp, Homo sapiens
tcagtcattatgaaa

SEQ ID NO: 268511 - DNA, 15 bp, Homo sapiens
ttcagtcattatgaa

SEQ ID NO: 268512 - DNA, 15 bp, Homo sapiens
gttcagtcattatga

SEQ ID NO: 268513 - DNA, 15 bp, Homo sapiens
ggttcagtcattatg

SEQ ID NO: 268514 - DNA, 15 bp, Homo sapiens
tggttcagtcattat

SEQ ID NO: 268515 - DNA, 15 bp, Homo sapiens
ttggttcagtcatta

SEQ ID NO: 268516 - DNA, 15 bp, Homo sapiens
tttggttcagtcatt

SEQ ID NO: 268517 - DNA, 15 bp, Homo sapiens
ctttggttcagtcat

SEQ ID NO: 268518 - DNA, 15 bp, Homo sapiens
tctttggttcagtca

SEQ ID NO: 268519 - DNA, 15 bp, Homo sapiens
atctttggttcagtc

SEQ ID NO: 268520 - DNA, 15 bp, Homo sapiens
tatctttggttcagt

SEQ ID NO: 268521 - DNA, 15 bp, Homo sapiens
ctatctttggttcag

SEQ ID NO: 268522 - DNA, 15 bp, Homo sapiens
actatctttggttca

SEQ ID NO: 268523 - DNA, 15 bp, Homo sapiens
aactatctttggttc

SEQ ID NO: 268524 - DNA, 15 bp, Homo sapiens
gaactatctttggtt

SEQ ID NO: 268525 - DNA, 15 bp, Homo sapiens
agaactatctttggt

SEQ ID NO: 268526 - DNA, 15 bp, Homo sapiens
aagaactatctttgg

SEQ ID NO: 268527 - DNA, 15 bp, Homo sapiens
aaagaactatctttg

SEQ ID NO: 268528 - DNA, 15 bp, Homo sapiens
taaagaactatcttt

SEQ ID NO: 268529 - DNA, 15 bp, Homo sapiens
ttaaagaactatctt

SEQ ID NO: 268530 - DNA, 15 bp, Homo sapiens
cttaaagaactatct

SEQ ID NO: 268531 - DNA, 15 bp, Homo sapiens
acttaaagaactatc

SEQ ID NO: 268532 - DNA, 15 bp, Homo sapiens
aacttaaagaactat

SEQ ID NO: 268533 - DNA, 15 bp, Homo sapiens
caacttaaagaacta

SEQ ID NO: 268534 - DNA, 15 bp, Homo sapiens
ccaacttaaagaact

SEQ ID NO: 268535 - DNA, 15 bp, Homo sapiens
tccaacttaaagaac

SEQ ID NO: 268536 - DNA, 15 bp, Homo sapiens
ctccaacttaaagaa

SEQ ID NO: 268537 - DNA, 15 bp, Homo sapiens
tctccaacttaaaga

SEQ ID NO: 268538 - DNA, 15 bp, Homo sapiens
ctctccaacttaaag

SEQ ID NO: 268539 - DNA, 15 bp, Homo sapiens
actctccaacttaaa

SEQ ID NO: 268540 - DNA, 15 bp, Homo sapiens
aactctccaacttaa

SEQ ID NO: 268541 - DNA, 15 bp, Homo sapiens
gaactctccaactta

SEQ ID NO: 268542 - DNA, 15 bp, Homo sapiens
agaactctccaactt

SEQ ID NO: 268543 - DNA, 15 bp, Homo sapiens
aagaactctccaact

SEQ ID NO: 268544 - DNA, 15 bp, Homo sapiens
gaagaactctccaac

SEQ ID NO: 268545 - DNA, 15 bp, Homo sapiens
agaagaactctccaa

SEQ ID NO: 268546 - DNA, 15 bp, Homo sapiens
aagaagaactctcca

SEQ ID NO: 268547 - DNA, 15 bp, Homo sapiens
aaagaagaactctcc

SEQ ID NO: 268548 - DNA, 15 bp, Homo sapiens
taaagaagaactctc

SEQ ID NO: 268549 - DNA, 15 bp, Homo sapiens
ttaaagaagaactct

SEQ ID NO: 268550 - DNA, 15 bp, Homo sapiens
tttaaagaagaactc

SEQ ID NO: 268551 - DNA, 15 bp, Homo sapiens
atttaaagaagaact

SEQ ID NO: 268552 - DNA, 15 bp, Homo sapiens
aatttaaagaagaac

SEQ ID NO: 268553 - DNA, 15 bp, Homo sapiens
aaatttaaagaagaa

SEQ ID NO: 268554 - DNA, 15 bp, Homo sapiens
gaaatttaaagaaga

SEQ ID NO: 268555 - DNA, 15 bp, Homo sapiens
tgaaatttaaagaag

SEQ ID NO: 268556 - DNA, 15 bp, Homo sapiens
gtgaaatttaaagaa

SEQ ID NO: 268557 - DNA, 15 bp, Homo sapiens
tgtgaaatttaaaga

SEQ ID NO: 268558 - DNA, 15 bp, Homo sapiens
atgtgaaatttaaag

SEQ ID NO: 268559 - DNA, 15 bp, Homo sapiens
catgtgaaatttaaa

SEQ ID NO: 268560 - DNA, 15 bp, Homo sapiens
tcatgtgaaatttaa

SEQ ID NO: 268561 - DNA, 15 bp, Homo sapiens
atcatgtgaaattta

SEQ ID NO: 268562 - DNA, 15 bp, Homo sapiens
aatcatgtgaaattt

SEQ ID NO: 268563 - DNA, 15 bp, Homo sapiens
aaatcatgtgaaatt

SEQ ID NO: 268564 - DNA, 15 bp, Homo sapiens
taaatcatgtgaaat

SEQ ID NO: 268565 - DNA, 15 bp, Homo sapiens
ataaatcatgtgaaa

SEQ ID NO: 268566 - DNA, 15 bp, Homo sapiens
tataaatcatgtgaa

SEQ ID NO: 268567 - DNA, 15 bp, Homo sapiens
ttataaatcatgtga

SEQ ID NO: 268568 - DNA, 15 bp, Homo sapiens
tttataaatcatgtg

SEQ ID NO: 268569 - DNA, 15 bp, Homo sapiens
ttttataaatcatgt

SEQ ID NO: 268570 - DNA, 15 bp, Homo sapiens
cttttataaatcatg

SEQ ID NO: 268571 - DNA, 15 bp, Homo sapiens
acttttataaatcat

SEQ ID NO: 268572 - DNA, 15 bp, Homo sapiens
aacttttataaatca

SEQ ID NO: 268573 - DNA, 15 bp, Homo sapiens
gaacttttataaatc

SEQ ID NO: 268574 - DNA, 15 bp, Homo sapiens
tgaacttttataaat

SEQ ID NO: 268575 - DNA, 15 bp, Homo sapiens
atgaacttttataaa

SEQ ID NO: 268576 - DNA, 15 bp, Homo sapiens
tatgaacttttataa

SEQ ID NO: 268577 - DNA, 15 bp, Homo sapiens
gtatgaacttttata

SEQ ID NO: 268578 - DNA, 15 bp, Homo sapiens
tgtatgaacttttat

SEQ ID NO: 268579 - DNA, 15 bp, Homo sapiens
ttgtatgaactttta

SEQ ID NO: 268580 - DNA, 15 bp, Homo sapiens
attgtatgaactttt

SEQ ID NO: 268581 - DNA, 15 bp, Homo sapiens
aattgtatgaacttt

SEQ ID NO: 268582 - DNA, 15 bp, Homo sapiens
caattgtatgaactt

SEQ ID NO: 268583 - DNA, 15 bp, Homo sapiens
gcaattgtatgaact

SEQ ID NO: 268584 - DNA, 15 bp, Homo sapiens
agcaattgtatgaac

SEQ ID NO: 268585 - DNA, 15 bp, Homo sapiens
cagcaattgtatgaa

SEQ ID NO: 268586 - DNA, 15 bp, Homo sapiens
tcagcaattgtatga

SEQ ID NO: 268587 - DNA, 15 bp, Homo sapiens
gtcagcaattgtatg

SEQ ID NO: 268588 - DNA, 15 bp, Homo sapiens
tgtcagcaattgtat

SEQ ID NO: 268589 - DNA, 15 bp, Homo sapiens
ctgtcagcaattgta

SEQ ID NO: 268590 - DNA, 15 bp, Homo sapiens
actgtcagcaattgt

SEQ ID NO: 268591 - DNA, 15 bp, Homo sapiens
cactgtcagcaattg

SEQ ID NO: 268592 - DNA, 15 bp, Homo sapiens
tcactgtcagcaatt

SEQ ID NO: 268593 - DNA, 15 bp, Homo sapiens
ctcactgtcagcaat

SEQ ID NO: 268594 - DNA, 15 bp, Homo sapiens
tctcactgtcagcaa

SEQ ID NO: 268595 - DNA, 15 bp, Homo sapiens
ctctcactgtcagca

SEQ ID NO: 268596 - DNA, 15 bp, Homo sapiens
tctctcactgtcagc

SEQ ID NO: 268597 - DNA, 15 bp, Homo sapiens
ctctctcactgtcag

SEQ ID NO: 268598 - DNA, 15 bp, Homo sapiens
tctctctcactgtca

SEQ ID NO: 268599 - DNA, 15 bp, Homo sapiens
ttctctctcactgtc

SEQ ID NO: 268600 - DNA, 15 bp, Homo sapiens
cttctctctcactgt

SEQ ID NO: 268601 - DNA, 15 bp, Homo sapiens
acttctctctcactg

SEQ ID NO: 268602 - DNA, 15 bp, Homo sapiens
cacttctctctcact

SEQ ID NO: 268603 - DNA, 15 bp, Homo sapiens
ccacttctctctcac

SEQ ID NO: 268604 - DNA, 15 bp, Homo sapiens
tccacttctctctca

SEQ ID NO: 268605 - DNA, 15 bp, Homo sapiens
atccacttctctctc

SEQ ID NO: 268606 - DNA, 15 bp, Homo sapiens
tatccacttctctct

SEQ ID NO: 268607 - DNA, 15 bp, Homo sapiens
ctatccacttctctc

SEQ ID NO: 268608 - DNA, 15 bp, Homo sapiens
cctatccacttctct

SEQ ID NO: 268609 - DNA, 15 bp, Homo sapiens
ccctatccacttctc

SEQ ID NO: 268610 - DNA, 15 bp, Homo sapiens
accctatccacttct

SEQ ID NO: 268611 - DNA, 15 bp, Homo sapiens
aaccctatccacttc

SEQ ID NO: 268612 - DNA, 15 bp, Homo sapiens
taaccctatccactt

SEQ ID NO: 268613 - DNA, 15 bp, Homo sapiens
ttaaccctatccact

SEQ ID NO: 268614 - DNA, 15 bp, Homo sapiens
tttaaccctatccac

SEQ ID NO: 268615 - DNA, 15 bp, Homo sapiens
atttaaccctatcca

SEQ ID NO: 268616 - DNA, 15 bp, Homo sapiens
tatttaaccctatcc

SEQ ID NO: 268617 - DNA, 15 bp, Homo sapiens
gtatttaaccctatc

SEQ ID NO: 268618 - DNA, 15 bp, Homo sapiens
agtatttaaccctat

SEQ ID NO: 268619 - DNA, 15 bp, Homo sapiens
tagtatttaacccta

SEQ ID NO: 268620 - DNA, 15 bp, Homo sapiens
ttagtatttaaccct

SEQ ID NO: 268621 - DNA, 15 bp, Homo sapiens
cttagtatttaaccc

SEQ ID NO: 268622 - DNA, 15 bp, Homo sapiens
ccttagtatttaacc

SEQ ID NO: 268623 - DNA, 15 bp, Homo sapiens
tccttagtatttaac

SEQ ID NO: 268624 - DNA, 15 bp, Homo sapiens
atccttagtatttaa

SEQ ID NO: 268625 - DNA, 15 bp, Homo sapiens
tatccttagtattta

SEQ ID NO: 268626 - DNA, 15 bp, Homo sapiens
ttatccttagtattt

SEQ ID NO: 268627 - DNA, 15 bp, Homo sapiens
attatccttagtatt

SEQ ID NO: 268628 - DNA, 15 bp, Homo sapiens
cattatccttagtat

SEQ ID NO: 268629 - DNA, 15 bp, Homo sapiens
ccattatccttagta

SEQ ID NO: 268630 - DNA, 15 bp, Homo sapiens
tccattatccttagt

SEQ ID NO: 268631 - DNA, 15 bp, Homo sapiens
ttccattatccttag

SEQ ID NO: 268632 - DNA, 15 bp, Homo sapiens
tttccattatcctta

SEQ ID NO: 268633 - DNA, 15 bp, Homo sapiens
ttttccattatcctt

SEQ ID NO: 268634 - DNA, 15 bp, Homo sapiens
attttccattatcct

SEQ ID NO: 268635 - DNA, 15 bp, Homo sapiens
cattttccattatcc

SEQ ID NO: 268636 - DNA, 15 bp, Homo sapiens
acattttccattatc

SEQ ID NO: 268637 - DNA, 15 bp, Homo sapiens
aacattttccattat

SEQ ID NO: 268638 - DNA, 15 bp, Homo sapiens
aaacattttccatta

SEQ ID NO: 268639 - DNA, 15 bp, Homo sapiens
taaacattttccatt

SEQ ID NO: 268640 - DNA, 15 bp, Homo sapiens
ctaaacattttccat

SEQ ID NO: 268641 - DNA, 15 bp, Homo sapiens
tctaaacattttcca

SEQ ID NO: 268642 - DNA, 15 bp, Homo sapiens
ttctaaacattttcc

SEQ ID NO: 268643 - DNA, 15 bp, Homo sapiens
attctaaacattttc

SEQ ID NO: 268644 - DNA, 15 bp, Homo sapiens
tattctaaacatttt

SEQ ID NO: 268645 - DNA, 15 bp, Homo sapiens
ctattctaaacattt

SEQ ID NO: 268646 - DNA, 15 bp, Homo sapiens
gctattctaaacatt

SEQ ID NO: 268647 - DNA, 15 bp, Homo sapiens
agctattctaaacat

SEQ ID NO: 268648 - DNA, 15 bp, Homo sapiens
tagctattctaaaca

SEQ ID NO: 268649 - DNA, 15 bp, Homo sapiens
gtagctattctaaac

SEQ ID NO: 268650 - DNA, 15 bp, Homo sapiens
agtagctattctaaa

SEQ ID NO: 268651 - DNA, 15 bp, Homo sapiens
tagtagctattctaa

SEQ ID NO: 268652 - DNA, 15 bp, Homo sapiens
ctagtagctattcta

SEQ ID NO: 268653 - DNA, 15 bp, Homo sapiens
cctagtagctattct

SEQ ID NO: 268654 - DNA, 15 bp, Homo sapiens
ccctagtagctattc

SEQ ID NO: 268655 - DNA, 15 bp, Homo sapiens
accctagtagctatt

SEQ ID NO: 268656 - DNA, 15 bp, Homo sapiens
gaccctagtagctat

SEQ ID NO: 268657 - DNA, 15 bp, Homo sapiens
tgaccctagtagcta

SEQ ID NO: 268658 - DNA, 15 bp, Homo sapiens
ttgaccctagtagct

SEQ ID NO: 268659 - DNA, 15 bp, Homo sapiens
attgaccctagtagc

SEQ ID NO: 268660 - DNA, 15 bp, Homo sapiens
gattgaccctagtag

SEQ ID NO: 268661 - DNA, 15 bp, Homo sapiens
agattgaccctagta

SEQ ID NO: 268662 - DNA, 15 bp, Homo sapiens
aagattgaccctagt

SEQ ID NO: 268663 - DNA, 15 bp, Homo sapiens
caagattgaccctag

SEQ ID NO: 268664 - DNA, 15 bp, Homo sapiens
tcaagattgacccta

SEQ ID NO: 268665 - DNA, 15 bp, Homo sapiens
ctcaagattgaccct

SEQ ID NO: 268666 - DNA, 15 bp, Homo sapiens
actcaagattgaccc

SEQ ID NO: 268667 - DNA, 15 bp, Homo sapiens
gactcaagattgacc

SEQ ID NO: 268668 - DNA, 15 bp, Homo sapiens
tgactcaagattgac

SEQ ID NO: 268669 - DNA, 15 bp, Homo sapiens
gtgactcaagattga

SEQ ID NO: 268670 - DNA, 15 bp, Homo sapiens
tgtgactcaagattg

SEQ ID NO: 268671 - DNA, 15 bp, Homo sapiens
gtgtgactcaagatt

SEQ ID NO: 268672 - DNA, 15 bp, Homo sapiens
tgtgtgactcaagat

SEQ ID NO: 268673 - DNA, 15 bp, Homo sapiens
ctgtgtgactcaaga

SEQ ID NO: 268674 - DNA, 15 bp, Homo sapiens
tctgtgtgactcaag

SEQ ID NO: 268675 - DNA, 15 bp, Homo sapiens
ctctgtgtgactcaa

SEQ ID NO: 268676 - DNA, 15 bp, Homo sapiens
tctctgtgtgactca

SEQ ID NO: 268677 - DNA, 15 bp, Homo sapiens
atctctgtgtgactc

SEQ ID NO: 268678 - DNA, 15 bp, Homo sapiens
catctctgtgtgact

SEQ ID NO: 268679 - DNA, 15 bp, Homo sapiens
tcatctctgtgtgac

SEQ ID NO: 268680 - DNA, 15 bp, Homo sapiens
ctcatctctgtgtga

SEQ ID NO: 268681 - DNA, 15 bp, Homo sapiens
actcatctctgtgtg

SEQ ID NO: 268682 - DNA, 15 bp, Homo sapiens
tactcatctctgtgt

SEQ ID NO: 268683 - DNA, 15 bp, Homo sapiens
ttactcatctctgtg

SEQ ID NO: 268684 - DNA, 15 bp, Homo sapiens
tttactcatctctgt

SEQ ID NO: 268685 - DNA, 15 bp, Homo sapiens
gtttactcatctctg

SEQ ID NO: 268686 - DNA, 15 bp, Homo sapiens
agtttactcatctct

SEQ ID NO: 268687 - DNA, 15 bp, Homo sapiens
cagtttactcatctc

SEQ ID NO: 268688 - DNA, 15 bp, Homo sapiens
tcagtttactcatct

SEQ ID NO: 268689 - DNA, 15 bp, Homo sapiens
atcagtttactcatc

SEQ ID NO: 268690 - DNA, 15 bp, Homo sapiens
aatcagtttactcat

SEQ ID NO: 268691 - DNA, 15 bp, Homo sapiens
caatcagtttactca

SEQ ID NO: 268692 - DNA, 15 bp, Homo sapiens
gcaatcagtttactc

SEQ ID NO: 268693 - DNA, 15 bp, Homo sapiens
agcaatcagtttact

SEQ ID NO: 268694 - DNA, 15 bp, Homo sapiens
tagcaatcagtttac

SEQ ID NO: 268695 - DNA, 15 bp, Homo sapiens
gtagcaatcagttta

SEQ ID NO: 268696 - DNA, 15 bp, Homo sapiens
ggtagcaatcagttt

SEQ ID NO: 268697 - DNA, 15 bp, Homo sapiens
aggtagcaatcagtt

SEQ ID NO: 268698 - DNA, 15 bp, Homo sapiens
aaggtagcaatcagt

SEQ ID NO: 268699 - DNA, 15 bp, Homo sapiens
caaggtagcaatcag

SEQ ID NO: 268700 - DNA, 15 bp, Homo sapiens
gcaaggtagcaatca

SEQ ID NO: 268701 - DNA, 15 bp, Homo sapiens
ggcaaggtagcaatc

SEQ ID NO: 268702 - DNA, 15 bp, Homo sapiens
tggcaaggtagcaat

SEQ ID NO: 268703 - DNA, 15 bp, Homo sapiens
gtggcaaggtagcaa

SEQ ID NO: 268704 - DNA, 15 bp, Homo sapiens
agtggcaaggtagca

SEQ ID NO: 268705 - DNA, 15 bp, Homo sapiens
tagtggcaaggtagc

SEQ ID NO: 268706 - DNA, 15 bp, Homo sapiens
ctagtggcaaggtag

SEQ ID NO: 268707 - DNA, 15 bp, Homo sapiens
tctagtggcaaggta

SEQ ID NO: 268708 - DNA, 15 bp, Homo sapiens
ctctagtggcaaggt

SEQ ID NO: 268709 - DNA, 15 bp, Homo sapiens
actctagtggcaagg

SEQ ID NO: 268710 - DNA, 15 bp, Homo sapiens
cactctagtggcaag

SEQ ID NO: 268711 - DNA, 15 bp, Homo sapiens
gcactctagtggcaa

SEQ ID NO: 268712 - DNA, 15 bp, Homo sapiens
tgcactctagtggca

SEQ ID NO: 268713 - DNA, 15 bp, Homo sapiens
ctgcactctagtggc

SEQ ID NO: 268714 - DNA, 15 bp, Homo sapiens
gctgcactctagtgg

SEQ ID NO: 268715 - DNA, 15 bp, Homo sapiens
agctgcactctagtg

SEQ ID NO: 268716 - DNA, 15 bp, Homo sapiens
cagctgcactctagt

SEQ ID NO: 268717 - DNA, 15 bp, Homo sapiens
tcagctgcactctag

SEQ ID NO: 268718 - DNA, 15 bp, Homo sapiens
ctcagctgcactcta

SEQ ID NO: 268719 - DNA, 15 bp, Homo sapiens
cctcagctgcactct

SEQ ID NO: 268720 - DNA, 15 bp, Homo sapiens
acctcagctgcactc

SEQ ID NO: 268721 - DNA, 15 bp, Homo sapiens
aacctcagctgcact

SEQ ID NO: 268722 - DNA, 15 bp, Homo sapiens
taacctcagctgcac

SEQ ID NO: 268723 - DNA, 15 bp, Homo sapiens
ttaacctcagctgca

SEQ ID NO: 268724 - DNA, 15 bp, Homo sapiens
attaacctcagctgc

SEQ ID NO: 268725 - DNA, 15 bp, Homo sapiens
aattaacctcagctg

SEQ ID NO: 268726 - DNA, 15 bp, Homo sapiens
caattaacctcagct

SEQ ID NO: 268727 - DNA, 15 bp, Homo sapiens
tcaattaacctcagc

SEQ ID NO: 268728 - DNA, 15 bp, Homo sapiens
gtcaattaacctcag

SEQ ID NO: 268729 - DNA, 15 bp, Homo sapiens
tgtcaattaacctca

SEQ ID NO: 268730 - DNA, 15 bp, Homo sapiens
ttgtcaattaacctc

SEQ ID NO: 268731 - DNA, 15 bp, Homo sapiens
cttgtcaattaacct

SEQ ID NO: 268732 - DNA, 15 bp, Homo sapiens
ccttgtcaattaacc

SEQ ID NO: 268733 - DNA, 15 bp, Homo sapiens
tccttgtcaattaac

SEQ ID NO: 268734 - DNA, 15 bp, Homo sapiens
atccttgtcaattaa

SEQ ID NO: 268735 - DNA, 15 bp, Homo sapiens
aatccttgtcaatta

SEQ ID NO: 268736 - DNA, 15 bp, Homo sapiens
aaatccttgtcaatt

SEQ ID NO: 268737 - DNA, 15 bp, Homo sapiens
caaatccttgtcaat

SEQ ID NO: 268738 - DNA, 15 bp, Homo sapiens
acaaatccttgtcaa

SEQ ID NO: 268739 - DNA, 15 bp, Homo sapiens
tacaaatccttgtca

SEQ ID NO: 268740 - DNA, 15 bp, Homo sapiens
ctacaaatccttgtc

SEQ ID NO: 268741 - DNA, 15 bp, Homo sapiens
actacaaatccttgt

SEQ ID NO: 268742 - DNA, 15 bp, Homo sapiens
aactacaaatccttg

SEQ ID NO: 268743 - DNA, 15 bp, Homo sapiens
aaactacaaatcctt

SEQ ID NO: 268744 - DNA, 15 bp, Homo sapiens
caaactacaaatcct

SEQ ID NO: 268745 - DNA, 15 bp, Homo sapiens
acaaactacaaatcc

SEQ ID NO: 268746 - DNA, 15 bp, Homo sapiens
cacaaactacaaatc

SEQ ID NO: 268747 - DNA, 15 bp, Homo sapiens
tcacaaactacaaat

SEQ ID NO: 268748 - DNA, 15 bp, Homo sapiens
gtcacaaactacaaa

SEQ ID NO: 268749 - DNA, 15 bp, Homo sapiens
agtcacaaactacaa

SEQ ID NO: 268750 - DNA, 15 bp, Homo sapiens
gagtcacaaactaca

SEQ ID NO: 268751 - DNA, 15 bp, Homo sapiens
ggagtcacaaactac

SEQ ID NO: 268752 - DNA, 15 bp, Homo sapiens
tggagtcacaaacta

SEQ ID NO: 268753 - DNA, 15 bp, Homo sapiens
atggagtcacaaact

SEQ ID NO: 268754 - DNA, 15 bp, Homo sapiens
gatggagtcacaaac

SEQ ID NO: 268755 - DNA, 15 bp, Homo sapiens
tgatggagtcacaaa

SEQ ID NO: 268756 - DNA, 15 bp, Homo sapiens
atgatggagtcacaa

SEQ ID NO: 268757 - DNA, 15 bp, Homo sapiens
aatgatggagtcaca

SEQ ID NO: 268758 - DNA, 15 bp, Homo sapiens
caatgatggagtcac

SEQ ID NO: 268759 - DNA, 15 bp, Homo sapiens
gcaatgatggagtca

SEQ ID NO: 268760 - DNA, 15 bp, Homo sapiens
agcaatgatggagtc

SEQ ID NO: 268761 - DNA, 15 bp, Homo sapiens
gagcaatgatggagt

SEQ ID NO: 268762 - DNA, 15 bp, Homo sapiens
tgagcaatgatggag

SEQ ID NO: 268763 - DNA, 15 bp, Homo sapiens
ctgagcaatgatgga

SEQ ID NO: 268764 - DNA, 15 bp, Homo sapiens
gctgagcaatgatgg

SEQ ID NO: 268765 - DNA, 15 bp, Homo sapiens
tgctgagcaatgatg

SEQ ID NO: 268766 - DNA, 15 bp, Homo sapiens
ctgctgagcaatgat

SEQ ID NO: 268767 - DNA, 15 bp, Homo sapiens
gctgctgagcaatga

SEQ ID NO: 268768 - DNA, 15 bp, Homo sapiens
agctgctgagcaatg

SEQ ID NO: 268769 - DNA, 15 bp, Homo sapiens
aagctgctgagcaat

SEQ ID NO: 268770 - DNA, 15 bp, Homo sapiens
aaagctgctgagcaa

SEQ ID NO: 268771 - DNA, 15 bp, Homo sapiens
caaagctgctgagca

SEQ ID NO: 268772 - DNA, 15 bp, Homo sapiens
ccaaagctgctgagc

SEQ ID NO: 268773 - DNA, 15 bp, Homo sapiens
tccaaagctgctgag

SEQ ID NO: 268774 - DNA, 15 bp, Homo sapiens
ttccaaagctgctga

SEQ ID NO: 268775 - DNA, 15 bp, Homo sapiens
attccaaagctgctg

SEQ ID NO: 268776 - DNA, 15 bp, Homo sapiens
aattccaaagctgct

SEQ ID NO: 268777 - DNA, 15 bp, Homo sapiens
taattccaaagctgc

SEQ ID NO: 268778 - DNA, 15 bp, Homo sapiens
ttaattccaaagctg

SEQ ID NO: 268779 - DNA, 15 bp, Homo sapiens
tttaattccaaagct

SEQ ID NO: 268780 - DNA, 15 bp, Homo sapiens
ttttaattccaaagc

SEQ ID NO: 268781 - DNA, 15 bp, Homo sapiens
cttttaattccaaag

SEQ ID NO: 268782 - DNA, 15 bp, Homo sapiens
tcttttaattccaaa

SEQ ID NO: 268783 - DNA, 15 bp, Homo sapiens
atcttttaattccaa

SEQ ID NO: 268784 - DNA, 15 bp, Homo sapiens
catcttttaattcca

SEQ ID NO: 268785 - DNA, 15 bp, Homo sapiens
tcatcttttaattcc

SEQ ID NO: 268786 - DNA, 15 bp, Homo sapiens
ttcatcttttaattc

SEQ ID NO: 268787 - DNA, 15 bp, Homo sapiens
tttcatcttttaatt

SEQ ID NO: 268788 - DNA, 15 bp, Homo sapiens
ttttcatcttttaat

SEQ ID NO: 268789 - DNA, 15 bp, Homo sapiens
cttttcatcttttaa

SEQ ID NO: 268790 - DNA, 15 bp, Homo sapiens
acttttcatctttta

SEQ ID NO: 268791 - DNA, 15 bp, Homo sapiens
tacttttcatctttt

SEQ ID NO: 268792 - DNA, 15 bp, Homo sapiens
atacttttcatcttt

SEQ ID NO: 268793 - DNA, 15 bp, Homo sapiens
tatacttttcatctt

SEQ ID NO: 268794 - DNA, 15 bp, Homo sapiens
atatacttttcatct

SEQ ID NO: 268795 - DNA, 15 bp, Homo sapiens
aatatacttttcatc

SEQ ID NO: 268796 - DNA, 15 bp, Homo sapiens
aaatatacttttcat

SEQ ID NO: 268797 - DNA, 15 bp, Homo sapiens
caaatatacttttca

SEQ ID NO: 268798 - DNA, 15 bp, Homo sapiens
tcaaatatacttttc

SEQ ID NO: 268799 - DNA, 15 bp, Homo sapiens
ttcaaatatactttt

SEQ ID NO: 268800 - DNA, 15 bp, Homo sapiens
cttcaaatatacttt

SEQ ID NO: 268801 - DNA, 15 bp, Homo sapiens
ccttcaaatatactt

SEQ ID NO: 268802 - DNA, 15 bp, Homo sapiens
gccttcaaatatact

SEQ ID NO: 268803 - DNA, 15 bp, Homo sapiens
ggccttcaaatatac

SEQ ID NO: 268804 - DNA, 15 bp, Homo sapiens
tggccttcaaatata

SEQ ID NO: 268805 - DNA, 15 bp, Homo sapiens
ttggccttcaaatat

SEQ ID NO: 268806 - DNA, 15 bp, Homo sapiens
cttggccttcaaata

SEQ ID NO: 268807 - DNA, 15 bp, Homo sapiens
ccttggccttcaaat

SEQ ID NO: 268808 - DNA, 15 bp, Homo sapiens
cccttggccttcaaa

SEQ ID NO: 268809 - DNA, 15 bp, Homo sapiens
tcccttggccttcaa

SEQ ID NO: 268810 - DNA, 15 bp, Homo sapiens
ctcccttggccttca

SEQ ID NO: 268811 - DNA, 15 bp, Homo sapiens
actcccttggccttc

SEQ ID NO: 268812 - DNA, 15 bp, Homo sapiens
cactcccttggcctt

SEQ ID NO: 268813 - DNA, 15 bp, Homo sapiens
tcactcccttggcct

SEQ ID NO: 268814 - DNA, 15 bp, Homo sapiens
ttcactcccttggcc

SEQ ID NO: 268815 - DNA, 15 bp, Homo sapiens
tttcactcccttggc

SEQ ID NO: 268816 - DNA, 15 bp, Homo sapiens
ttttcactcccttgg

SEQ ID NO: 268817 - DNA, 15 bp, Homo sapiens
aatttttcactccct

SEQ ID NO: 268818 - DNA, 15 bp, Homo sapiens
gaatttttcactccc

SEQ ID NO: 268819 - DNA, 15 bp, Homo sapiens
ggaatttttcactcc

SEQ ID NO: 268820 - DNA, 15 bp, Homo sapiens
tggaatttttcactc

SEQ ID NO: 268821 - DNA, 15 bp, Homo sapiens
ttggaatttttcact

SEQ ID NO: 268822 - DNA, 15 bp, Homo sapiens
cttggaatttttcac

SEQ ID NO: 268823 - DNA, 15 bp, Homo sapiens
ccttggaatttttca

SEQ ID NO: 268824 - DNA, 15 bp, Homo sapiens
accttggaatttttc

SEQ ID NO: 268825 - DNA, 15 bp, Homo sapiens
caccttggaattttt

SEQ ID NO: 268826 - DNA, 15 bp, Homo sapiens
acaccttggaatttt

SEQ ID NO: 268827 - DNA, 15 bp, Homo sapiens
aacaccttggaattt

SEQ ID NO: 268828 - DNA, 15 bp, Homo sapiens
taacaccttggaatt

SEQ ID NO: 268829 - DNA, 15 bp, Homo sapiens
ttaacaccttggaat

SEQ ID NO: 268830 - DNA, 15 bp, Homo sapiens
attaacaccttggaa

SEQ ID NO: 268831 - DNA, 15 bp, Homo sapiens
cattaacaccttgga

SEQ ID NO: 268832 - DNA, 15 bp, Homo sapiens
tcattaacaccttgg

SEQ ID NO: 268833 - DNA, 15 bp, Homo sapiens
atcattaacaccttg

SEQ ID NO: 268834 - DNA, 15 bp, Homo sapiens
tatcattaacacctt

SEQ ID NO: 268835 - DNA, 15 bp, Homo sapiens
gtatcattaacacct

SEQ ID NO: 268836 - DNA, 15 bp, Homo sapiens
agtatcattaacacc

SEQ ID NO: 268837 - DNA, 15 bp, Homo sapiens
cagtatcattaacac

SEQ ID NO: 268838 - DNA, 15 bp, Homo sapiens
acagtatcattaaca

SEQ ID NO: 268839 - DNA, 15 bp, Homo sapiens
cacagtatcattaac

SEQ ID NO: 268840 - DNA, 15 bp, Homo sapiens
ccacagtatcattaa

SEQ ID NO: 268841 - DNA, 15 bp, Homo sapiens
accacagtatcatta

SEQ ID NO: 268842 - DNA, 15 bp, Homo sapiens
aaccacagtatcatt

SEQ ID NO: 268843 - DNA, 15 bp, Homo sapiens
caaccacagtatcat

SEQ ID NO: 268844 - DNA, 15 bp, Homo sapiens
tcaaccacagtatca

SEQ ID NO: 268845 - DNA, 15 bp, Homo sapiens
atcaaccacagtatc

SEQ ID NO: 268846 - DNA, 15 bp, Homo sapiens
aatcaaccacagtat

SEQ ID NO: 268847 - DNA, 15 bp, Homo sapiens
aaatcaaccacagta

SEQ ID NO: 268848 - DNA, 15 bp, Homo sapiens
caaatcaaccacagt

SEQ ID NO: 268849 - DNA, 15 bp, Homo sapiens
tcaaatcaaccacag

SEQ ID NO: 268850 - DNA, 15 bp, Homo sapiens
ctcaaatcaaccaca

SEQ ID NO: 268851 - DNA, 15 bp, Homo sapiens
cctcaaatcaaccac

SEQ ID NO: 268852 - DNA, 15 bp, Homo sapiens
acctcaaatcaacca

SEQ ID NO: 268853 - DNA, 15 bp, Homo sapiens
tacctcaaatcaacc

SEQ ID NO: 268854 - DNA, 15 bp, Homo sapiens
atacctcaaatcaac

SEQ ID NO: 268855 - DNA, 15 bp, Homo sapiens
gatacctcaaatcaa

SEQ ID NO: 268856 - DNA, 15 bp, Homo sapiens
ggatacctcaaatca

SEQ ID NO: 268857 - DNA, 15 bp, Homo sapiens
aggatacctcaaatc

SEQ ID NO: 268858 - DNA, 15 bp, Homo sapiens
gaggatacctcaaat

SEQ ID NO: 268859 - DNA, 15 bp, Homo sapiens
tgaggatacctcaaa

SEQ ID NO: 268860 - DNA, 15 bp, Homo sapiens
atgaggatacctcaa

SEQ ID NO: 268861 - DNA, 15 bp, Homo sapiens
catgaggatacctca

SEQ ID NO: 268862 - DNA, 15 bp, Homo sapiens
gcatgaggatacctc

SEQ ID NO: 268863 - DNA, 15 bp, Homo sapiens
agcatgaggatacct

SEQ ID NO: 268864 - DNA, 15 bp, Homo sapiens
cagcatgaggatacc

SEQ ID NO: 268865 - DNA, 15 bp, Homo sapiens
tcagcatgaggatac

SEQ ID NO: 268866 - DNA, 15 bp, Homo sapiens
ttcagcatgaggata

SEQ ID NO: 268867 - DNA, 15 bp, Homo sapiens
cttcagcatgaggat

SEQ ID NO: 268868 - DNA, 15 bp, Homo sapiens
tcttcagcatgagga

SEQ ID NO: 268869 - DNA, 15 bp, Homo sapiens
ttcttcagcatgagg

SEQ ID NO: 268870 - DNA, 15 bp, Homo sapiens
tttcttcagcatgag

SEQ ID NO: 268871 - DNA, 15 bp, Homo sapiens
atttcttcagcatga

SEQ ID NO: 268872 - DNA, 15 bp, Homo sapiens
gatttcttcagcatg

SEQ ID NO: 268873 - DNA, 15 bp, Homo sapiens
ggatttcttcagcat

SEQ ID NO: 268874 - DNA, 15 bp, Homo sapiens
gggatttcttcagca

SEQ ID NO: 268875 - DNA, 15 bp, Homo sapiens
tgggatttcttcagc

SEQ ID NO: 268876 - DNA, 15 bp, Homo sapiens
ttgggatttcttcag

SEQ ID NO: 268877 - DNA, 15 bp, Homo sapiens
cttgggatttcttca

SEQ ID NO: 268878 - DNA, 15 bp, Homo sapiens
ccttgggatttcttc

SEQ ID NO: 268879 - DNA, 15 bp, Homo sapiens
accttgggatttctt

SEQ ID NO: 268880 - DNA, 15 bp, Homo sapiens
caccttgggatttct

SEQ ID NO: 268881 - DNA, 15 bp, Homo sapiens
ccaccttgggatttc

SEQ ID NO: 268882 - DNA, 15 bp, Homo sapiens
cccaccttgggattt

SEQ ID NO: 268883 - DNA, 15 bp, Homo sapiens
tcccaccttgggatt

SEQ ID NO: 268884 - DNA, 15 bp, Homo sapiens
atcccaccttgggat

SEQ ID NO: 268885 - DNA, 15 bp, Homo sapiens
tatcccaccttggga

SEQ ID NO: 268886 - DNA, 15 bp, Homo sapiens
ttatcccaccttggg

SEQ ID NO: 268887 - DNA, 15 bp, Homo sapiens
tttatcccaccttgg

SEQ ID NO: 268888 - DNA, 15 bp, Homo sapiens
ctttatcccaccttg

SEQ ID NO: 268889 - DNA, 15 bp, Homo sapiens
cctttatcccacctt

SEQ ID NO: 268890 - DNA, 15 bp, Homo sapiens
ccctttatcccacct

SEQ ID NO: 268891 - DNA, 15 bp, Homo sapiens
gccctttatcccacc

SEQ ID NO: 268892 - DNA, 15 bp, Homo sapiens
agccctttatcccac

SEQ ID NO: 268893 - DNA, 15 bp, Homo sapiens
tagccctttatccca

SEQ ID NO: 268894 - DNA, 15 bp, Homo sapiens
ctagccctttatccc

SEQ ID NO: 268895 - DNA, 15 bp, Homo sapiens
tctagccctttatcc

SEQ ID NO: 268896 - DNA, 15 bp, Homo sapiens
gtctagccctttatc

SEQ ID NO: 268897 - DNA, 15 bp, Homo sapiens
cgtctagccctttat

SEQ ID NO: 268898 - DNA, 15 bp, Homo sapiens
acgtctagcccttta

SEQ ID NO: 268899 - DNA, 15 bp, Homo sapiens
gacgtctagcccttt

SEQ ID NO: 268900 - DNA, 15 bp, Homo sapiens
tgacgtctagccctt

SEQ ID NO: 268901 - DNA, 15 bp, Homo sapiens
ttgacgtctagccct

SEQ ID NO: 268902 - DNA, 15 bp, Homo sapiens
cttgacgtctagccc

SEQ ID NO: 268903 - DNA, 15 bp, Homo sapiens
tcttgacgtctagcc

SEQ ID NO: 268904 - DNA, 15 bp, Homo sapiens
atcttgacgtctagc

SEQ ID NO: 268905 - DNA, 15 bp, Homo sapiens
catcttgacgtctag

SEQ ID NO: 268906 - DNA, 15 bp, Homo sapiens
tcatcttgacgtcta

SEQ ID NO: 268907 - DNA, 15 bp, Homo sapiens
atcatcttgacgtct

SEQ ID NO: 268908 - DNA, 15 bp, Homo sapiens
catcatcttgacgtc

SEQ ID NO: 268909 - DNA, 15 bp, Homo sapiens
ccatcatcttgacgt

SEQ ID NO: 268910 - DNA, 15 bp, Homo sapiens
cccatcatcttgacg

SEQ ID NO: 268911 - DNA, 15 bp, Homo sapiens
ccccatcatcttgac

SEQ ID NO: 268912 - DNA, 15 bp, Homo sapiens
tccccatcatcttga

SEQ ID NO: 268913 - DNA, 15 bp, Homo sapiens
ttccccatcatcttg

SEQ ID NO: 268914 - DNA, 15 bp, Homo sapiens
tttccccatcatctt

SEQ ID NO: 268915 - DNA, 15 bp, Homo sapiens
ctttccccatcatct

SEQ ID NO: 268916 - DNA, 15 bp, Homo sapiens
tctttccccatcatc

SEQ ID NO: 268917 - DNA, 15 bp, Homo sapiens
ttctttccccatcat

SEQ ID NO: 268918 - DNA, 15 bp, Homo sapiens
cttctttccccatca

SEQ ID NO: 268919 - DNA, 15 bp, Homo sapiens
tcttctttccccatc

SEQ ID NO: 268920 - DNA, 15 bp, Homo sapiens
ctcttctttccccat

SEQ ID NO: 268921 - DNA, 15 bp, Homo sapiens
cctcttctttcccca

SEQ ID NO: 268922 - DNA, 15 bp, Homo sapiens
acctcttctttcccc

SEQ ID NO: 268923 - DNA, 15 bp, Homo sapiens
aacctcttctttccc

SEQ ID NO: 268924 - DNA, 15 bp, Homo sapiens
aaacctcttctttcc

SEQ ID NO: 268925 - DNA, 15 bp, Homo sapiens
taaacctcttctttc

SEQ ID NO: 268926 - DNA, 15 bp, Homo sapiens
ataaacctcttcttt

SEQ ID NO: 268927 - DNA, 15 bp, Homo sapiens
aataaacctcttctt

SEQ ID NO: 268928 - DNA, 15 bp, Homo sapiens
aaataaacctcttct

SEQ ID NO: 268929 - DNA, 15 bp, Homo sapiens
taaataaacctcttc

SEQ ID NO: 268930 - DNA, 15 bp, Homo sapiens
ataaataaacctctt

SEQ ID NO: 268931 - DNA, 15 bp, Homo sapiens
tataaataaacctct

SEQ ID NO: 268932 - DNA, 15 bp, Homo sapiens
ttataaataaacctc

SEQ ID NO: 268933 - DNA, 15 bp, Homo sapiens
attataaataaacct

SEQ ID NO: 268934 - DNA, 15 bp, Homo sapiens
tattataaataaacc

SEQ ID NO: 268935 - DNA, 15 bp, Homo sapiens
atattataaataaac

SEQ ID NO: 268936 - DNA, 15 bp, Homo sapiens
tatattataaataaa

SEQ ID NO: 268937 - DNA, 15 bp, Homo sapiens
ttatattataaataa

SEQ ID NO: 268938 - DNA, 15 bp, Homo sapiens
cttatattataaata

SEQ ID NO: 268939 - DNA, 15 bp, Homo sapiens
tcttatattataaat

SEQ ID NO: 268940 - DNA, 15 bp, Homo sapiens
ttcttatattataaa

SEQ ID NO: 268941 - DNA, 15 bp, Homo sapiens
cttcttatattataa

SEQ ID NO: 268942 - DNA, 15 bp, Homo sapiens
acttcttatattata

SEQ ID NO: 268943 - DNA, 15 bp, Homo sapiens
cacttcttatattat

SEQ ID NO: 268944 - DNA, 15 bp, Homo sapiens
tcacttcttatatta

SEQ ID NO: 268945 - DNA, 15 bp, Homo sapiens
ctcacttcttatatt

SEQ ID NO: 268946 - DNA, 15 bp, Homo sapiens
tctcacttcttatat

SEQ ID NO: 268947 - DNA, 15 bp, Homo sapiens
ttctcacttcttata

SEQ ID NO: 268948 - DNA, 15 bp, Homo sapiens
cttctcacttcttat

SEQ ID NO: 268949 - DNA, 15 bp, Homo sapiens
tcttctcacttctta

SEQ ID NO: 268950 - DNA, 15 bp, Homo sapiens
ttcttctcacttctt

SEQ ID NO: 268951 - DNA, 15 bp, Homo sapiens
cttcttctcacttct

SEQ ID NO: 268952 - DNA, 15 bp, Homo sapiens
tcttcttctcacttc

SEQ ID NO: 268953 - DNA, 15 bp, Homo sapiens
ctcttcttctcactt

SEQ ID NO: 268954 - DNA, 15 bp, Homo sapiens
actcttcttctcact

SEQ ID NO: 268955 - DNA, 15 bp, Homo sapiens
gactcttcttctcac

SEQ ID NO: 268956 - DNA, 15 bp, Homo sapiens
tgactcttcttctca

SEQ ID NO: 268957 - DNA, 15 bp, Homo sapiens
ctgactcttcttctc

SEQ ID NO: 268958 - DNA, 15 bp, Homo sapiens
tctgactcttcttct

SEQ ID NO: 268959 - DNA, 15 bp, Homo sapiens
ttctgactcttcttc

SEQ ID NO: 268960 - DNA, 15 bp, Homo sapiens
cttctgactcttctt

SEQ ID NO: 268961 - DNA, 15 bp, Homo sapiens
tcttctgactcttct

SEQ ID NO: 268962 - DNA, 15 bp, Homo sapiens
atcttctgactcttc

SEQ ID NO: 268963 - DNA, 15 bp, Homo sapiens
aatcttctgactctt

SEQ ID NO: 268964 - DNA, 15 bp, Homo sapiens
gaatcttctgactct

SEQ ID NO: 268965 - DNA, 15 bp, Homo sapiens
ggaatcttctgactc

SEQ ID NO: 268966 - DNA, 15 bp, Homo sapiens
tggaatcttctgact

SEQ ID NO: 268967 - DNA, 15 bp, Homo sapiens
ctggaatcttctgac

SEQ ID NO: 268968 - DNA, 15 bp, Homo sapiens
actggaatcttctga

SEQ ID NO: 268969 - DNA, 15 bp, Homo sapiens
gactggaatcttctg

SEQ ID NO: 268970 - DNA, 15 bp, Homo sapiens
tgactggaatcttct

SEQ ID NO: 268971 - DNA, 15 bp, Homo sapiens
ctgactggaatcttc

SEQ ID NO: 268972 - DNA, 15 bp, Homo sapiens
actgactggaatctt

SEQ ID NO: 268973 - DNA, 15 bp, Homo sapiens
cactgactggaatct

SEQ ID NO: 268974 - DNA, 15 bp, Homo sapiens
tcactgactggaatc

SEQ ID NO: 268975 - DNA, 15 bp, Homo sapiens
ttcactgactggaat

SEQ ID NO: 268976 - DNA, 15 bp, Homo sapiens
tttcactgactggaa

SEQ ID NO: 268977 - DNA, 15 bp, Homo sapiens
ctttcactgactgga

SEQ ID NO: 268978 - DNA, 15 bp, Homo sapiens
tctttcactgactgg

SEQ ID NO: 268979 - DNA, 15 bp, Homo sapiens
atctttcactgactg

SEQ ID NO: 268980 - DNA, 15 bp, Homo sapiens
aatctttcactgact

SEQ ID NO: 268981 - DNA, 15 bp, Homo sapiens
aaatctttcactgac

SEQ ID NO: 268982 - DNA, 15 bp, Homo sapiens
aaaatctttcactga

SEQ ID NO: 268983 - DNA, 15 bp, Homo sapiens
aaaaatctttcactg

SEQ ID NO: 268984 - DNA, 15 bp, Homo sapiens
aaaaaatctttcact

SEQ ID NO: 268985 - DNA, 15 bp, Homo sapiens
gaaaaaatctttcac

SEQ ID NO: 268986 - DNA, 15 bp, Homo sapiens
tgaaaaaatctttca

SEQ ID NO: 268987 - DNA, 15 bp, Homo sapiens
ttgaaaaaatctttc

SEQ ID NO: 268988 - DNA, 15 bp, Homo sapiens
cttgaaaaaatcttt

SEQ ID NO: 268989 - DNA, 15 bp, Homo sapiens
acttgaaaaaatctt

SEQ ID NO: 268990 - DNA, 15 bp, Homo sapiens
aacttgaaaaaatct

SEQ ID NO: 268991 - DNA, 15 bp, Homo sapiens
taacttgaaaaaatc

SEQ ID NO: 268992 - DNA, 15 bp, Homo sapiens
ctaacttgaaaaaat

SEQ ID NO: 268993 - DNA, 15 bp, Homo sapiens
tctaacttgaaaaaa

SEQ ID NO: 268994 - DNA, 15 bp, Homo sapiens
ctctaacttgaaaaa

SEQ ID NO: 268995 - DNA, 15 bp, Homo sapiens
tctctaacttgaaaa

SEQ ID NO: 268996 - DNA, 15 bp, Homo sapiens
atctctaacttgaaa

SEQ ID NO: 268997 - DNA, 15 bp, Homo sapiens
aatctctaacttgaa

SEQ ID NO: 268998 - DNA, 15 bp, Homo sapiens
aaatctctaacttga

SEQ ID NO: 268999 - DNA, 15 bp, Homo sapiens
aaaatctctaacttg

SEQ ID NO: 269000 - DNA, 15 bp, Homo sapiens
caaaatctctaactt

SEQ ID NO: 269001 - DNA, 15 bp, Homo sapiens
ccaaaatctctaact

SEQ ID NO: 269002 - DNA, 15 bp, Homo sapiens
tccaaaatctctaac

SEQ ID NO: 269003 - DNA, 15 bp, Homo sapiens
gtccaaaatctctaa

SEQ ID NO: 269004 - DNA, 15 bp, Homo sapiens
agtccaaaatctcta

SEQ ID NO: 269005 - DNA, 15 bp, Homo sapiens
tagtccaaaatctct

SEQ ID NO: 269006 - DNA, 15 bp, Homo sapiens
ttagtccaaaatctc

SEQ ID NO: 269007 - DNA, 15 bp, Homo sapiens
tttagtccaaaatct

SEQ ID NO: 269008 - DNA, 15 bp, Homo sapiens
ttttagtccaaaatc

SEQ ID NO: 269009 - DNA, 15 bp, Homo sapiens
cttttagtccaaaat

SEQ ID NO: 269010 - DNA, 15 bp, Homo sapiens
acttttagtccaaaa

SEQ ID NO: 269011 - DNA, 15 bp, Homo sapiens
cacttttagtccaaa

SEQ ID NO: 269012 - DNA, 15 bp, Homo sapiens
ccacttttagtccaa

SEQ ID NO: 269013 - DNA, 15 bp, Homo sapiens
accacttttagtcca

SEQ ID NO: 269014 - DNA, 15 bp, Homo sapiens
aaccacttttagtcc

SEQ ID NO: 269015 - DNA, 15 bp, Homo sapiens
aaaccacttttagtc

SEQ ID NO: 269016 - DNA, 15 bp, Homo sapiens
aaaaccacttttagt

SEQ ID NO: 269017 - DNA, 15 bp, Homo sapiens
taaaaccacttttag

SEQ ID NO: 269018 - DNA, 15 bp, Homo sapiens
ttaaaaccactttta

SEQ ID NO: 269019 - DNA, 15 bp, Homo sapiens
cttaaaaccactttt

SEQ ID NO: 269020 - DNA, 15 bp, Homo sapiens
acttaaaaccacttt

SEQ ID NO: 269021 - DNA, 15 bp, Homo sapiens
aacttaaaaccactt

SEQ ID NO: 269022 - DNA, 15 bp, Homo sapiens
taacttaaaaccact

SEQ ID NO: 269023 - DNA, 15 bp, Homo sapiens
ataacttaaaaccac

SEQ ID NO: 269024 - DNA, 15 bp, Homo sapiens
cataacttaaaacca

SEQ ID NO: 269025 - DNA, 15 bp, Homo sapiens
tcataacttaaaacc

SEQ ID NO: 269026 - DNA, 15 bp, Homo sapiens
atcataacttaaaac

SEQ ID NO: 269027 - DNA, 15 bp, Homo sapiens
catcataacttaaaa

SEQ ID NO: 269028 - DNA, 15 bp, Homo sapiens
tcatcataacttaaa

SEQ ID NO: 269029 - DNA, 15 bp, Homo sapiens
ctcatcataacttaa

SEQ ID NO: 269030 - DNA, 15 bp, Homo sapiens
cctcatcataactta

SEQ ID NO: 269031 - DNA, 15 bp, Homo sapiens
gcctcatcataactt

SEQ ID NO: 269032 - DNA, 15 bp, Homo sapiens
ggcctcatcataact

SEQ ID NO: 269033 - DNA, 15 bp, Homo sapiens
aggcctcatcataac

SEQ ID NO: 269034 - DNA, 15 bp, Homo sapiens
caggcctcatcataa

SEQ ID NO: 269035 - DNA, 15 bp, Homo sapiens
ccaggcctcatcata

SEQ ID NO: 269036 - DNA, 15 bp, Homo sapiens
cccaggcctcatcat

SEQ ID NO: 269037 - DNA, 15 bp, Homo sapiens
ccccaggcctcatca

SEQ ID NO: 269038 - DNA, 15 bp, Homo sapiens
accccaggcctcatc

SEQ ID NO: 269039 - DNA, 15 bp, Homo sapiens
taccccaggcctcat

SEQ ID NO: 269040 - DNA, 15 bp, Homo sapiens
ataccccaggcctca

SEQ ID NO: 269041 - DNA, 15 bp, Homo sapiens
cataccccaggcctc

SEQ ID NO: 269042 - DNA, 15 bp, Homo sapiens
ccataccccaggcct

SEQ ID NO: 269043 - DNA, 15 bp, Homo sapiens
gccataccccaggcc

SEQ ID NO: 269044 - DNA, 15 bp, Homo sapiens
ggccataccccaggc

SEQ ID NO: 269045 - DNA, 15 bp, Homo sapiens
tggccataccccagg

SEQ ID NO: 269046 - DNA, 15 bp, Homo sapiens
atggccataccccag

SEQ ID NO: 269047 - DNA, 15 bp, Homo sapiens
tatggccatacccca

SEQ ID NO: 269048 - DNA, 15 bp, Homo sapiens
gtatggccatacccc

SEQ ID NO: 269049 - DNA, 15 bp, Homo sapiens
ggtatggccataccc

SEQ ID NO: 269050 - DNA, 15 bp, Homo sapiens
gggtatggccatacc

SEQ ID NO: 269051 - DNA, 15 bp, Homo sapiens
ggggtatggccatac

SEQ ID NO: 269052 - DNA, 15 bp, Homo sapiens
tggggtatggccata

SEQ ID NO: 269053 - DNA, 15 bp, Homo sapiens
ttggggtatggccat

SEQ ID NO: 269054 - DNA, 15 bp, Homo sapiens
attggggtatggcca

SEQ ID NO: 269055 - DNA, 15 bp, Homo sapiens
cattggggtatggcc

SEQ ID NO: 269056 - DNA, 15 bp, Homo sapiens
acattggggtatggc

SEQ ID NO: 269057 - DNA, 15 bp, Homo sapiens
cacattggggtatgg

SEQ ID NO: 269058 - DNA, 15 bp, Homo sapiens
acacattggggtatg

SEQ ID NO: 269059 - DNA, 15 bp, Homo sapiens
cacacattggggtat

SEQ ID NO: 269060 - DNA, 15 bp, Homo sapiens
tcacacattggggta

SEQ ID NO: 269061 - DNA, 15 bp, Homo sapiens
gtcacacattggggt

SEQ ID NO: 269062 - DNA, 15 bp, Homo sapiens
agtcacacattgggg

SEQ ID NO: 269063 - DNA, 15 bp, Homo sapiens
cagtcacacattggg

SEQ ID NO: 269064 - DNA, 15 bp, Homo sapiens
tcagtcacacattgg

SEQ ID NO: 269065 - DNA, 15 bp, Homo sapiens
ttcagtcacacattg

SEQ ID NO: 269066 - DNA, 15 bp, Homo sapiens
cttcagtcacacatt

SEQ ID NO: 269067 - DNA, 15 bp, Homo sapiens
acttcagtcacacat

SEQ ID NO: 269068 - DNA, 15 bp, Homo sapiens
cacttcagtcacaca

SEQ ID NO: 269069 - DNA, 15 bp, Homo sapiens
ccacttcagtcacac

SEQ ID NO: 269070 - DNA, 15 bp, Homo sapiens
cccacttcagtcaca

SEQ ID NO: 269071 - DNA, 15 bp, Homo sapiens
tcccacttcagtcac

SEQ ID NO: 269072 - DNA, 15 bp, Homo sapiens
gtcccacttcagtca

SEQ ID NO: 269073 - DNA, 15 bp, Homo sapiens
tgtcccacttcagtc

SEQ ID NO: 269074 - DNA, 15 bp, Homo sapiens
atgtcccacttcagt

SEQ ID NO: 269075 - DNA, 15 bp, Homo sapiens
tatgtcccacttcag

SEQ ID NO: 269076 - DNA, 15 bp, Homo sapiens
ctatgtcccacttca

SEQ ID NO: 269077 - DNA, 15 bp, Homo sapiens
tctatgtcccacttc

SEQ ID NO: 269078 - DNA, 15 bp, Homo sapiens
ttctatgtcccactt

SEQ ID NO: 269079 - DNA, 15 bp, Homo sapiens
cttctatgtcccact

SEQ ID NO: 269080 - DNA, 15 bp, Homo sapiens
ccttctatgtcccac

SEQ ID NO: 269081 - DNA, 15 bp, Homo sapiens
accttctatgtccca

SEQ ID NO: 269082 - DNA, 15 bp, Homo sapiens
aaccttctatgtccc

SEQ ID NO: 269083 - DNA, 15 bp, Homo sapiens
gaaccttctatgtcc

SEQ ID NO: 269084 - DNA, 15 bp, Homo sapiens
agaaccttctatgtc

SEQ ID NO: 269085 - DNA, 15 bp, Homo sapiens
tagaaccttctatgt

SEQ ID NO: 269086 - DNA, 15 bp, Homo sapiens
ctagaaccttctatg

SEQ ID NO: 269087 - DNA, 15 bp, Homo sapiens
tctagaaccttctat

SEQ ID NO: 269088 - DNA, 15 bp, Homo sapiens
ttctagaaccttcta

SEQ ID NO: 269089 - DNA, 15 bp, Homo sapiens
tttctagaaccttct

SEQ ID NO: 269090 - DNA, 15 bp, Homo sapiens
atttctagaaccttc

SEQ ID NO: 269091 - DNA, 15 bp, Homo sapiens
catttctagaacctt

SEQ ID NO: 269092 - DNA, 15 bp, Homo sapiens
tcatttctagaacct

SEQ ID NO: 269093 - DNA, 15 bp, Homo sapiens
ctcatttctagaacc

SEQ ID NO: 269094 - DNA, 15 bp, Homo sapiens
tctcatttctagaac

SEQ ID NO: 269095 - DNA, 15 bp, Homo sapiens
atctcatttctagaa

SEQ ID NO: 269096 - DNA, 15 bp, Homo sapiens
catctcatttctaga

SEQ ID NO: 269097 - DNA, 15 bp, Homo sapiens
ccatctcatttctag

SEQ ID NO: 269098 - DNA, 15 bp, Homo sapiens
gccatctcatttcta

SEQ ID NO: 269099 - DNA, 15 bp, Homo sapiens
agccatctcatttct

SEQ ID NO: 269100 - DNA, 15 bp, Homo sapiens
aagccatctcatttc

SEQ ID NO: 269101 - DNA, 15 bp, Homo sapiens
aaagccatctcattt

SEQ ID NO: 269102 - DNA, 15 bp, Homo sapiens
aaaagccatctcatt

SEQ ID NO: 269103 - DNA, 15 bp, Homo sapiens
taaaagccatctcat

SEQ ID NO: 269104 - DNA, 15 bp, Homo sapiens
ctaaaagccatctca

SEQ ID NO: 269105 - DNA, 15 bp, Homo sapiens
tctaaaagccatctc

SEQ ID NO: 269106 - DNA, 15 bp, Homo sapiens
ttctaaaagccatct

SEQ ID NO: 269107 - DNA, 15 bp, Homo sapiens
cttctaaaagccatc

SEQ ID NO: 269108 - DNA, 15 bp, Homo sapiens
ccttctaaaagccat

SEQ ID NO: 269109 - DNA, 15 bp, Homo sapiens
accttctaaaagcca

SEQ ID NO: 269110 - DNA, 15 bp, Homo sapiens
gaccttctaaaagcc

SEQ ID NO: 269111 - DNA, 15 bp, Homo sapiens
tgaccttctaaaagc

SEQ ID NO: 269112 - DNA, 15 bp, Homo sapiens
atgaccttctaaaag

SEQ ID NO: 269113 - DNA, 15 bp, Homo sapiens
gatgaccttctaaaa

SEQ ID NO: 269114 - DNA, 15 bp, Homo sapiens
tgatgaccttctaaa

SEQ ID NO: 269115 - DNA, 15 bp, Homo sapiens
gtgatgaccttctaa

SEQ ID NO: 269116 - DNA, 15 bp, Homo sapiens
agtgatgaccttcta

SEQ ID NO: 269117 - DNA, 15 bp, Homo sapiens
cagtgatgaccttct

SEQ ID NO: 269118 - DNA, 15 bp, Homo sapiens
gcagtgatgaccttc

SEQ ID NO: 269119 - DNA, 15 bp, Homo sapiens
tgcagtgatgacctt

SEQ ID NO: 269120 - DNA, 15 bp, Homo sapiens
atgcagtgatgacct

SEQ ID NO: 269121 - DNA, 15 bp, Homo sapiens
aatgcagtgatgacc

SEQ ID NO: 269122 - DNA, 15 bp, Homo sapiens
aaatgcagtgatgac

SEQ ID NO: 269123 - DNA, 15 bp, Homo sapiens
gaaatgcagtgatga

SEQ ID NO: 269124 - DNA, 15 bp, Homo sapiens
agaaatgcagtgatg

SEQ ID NO: 269125 - DNA, 15 bp, Homo sapiens
tagaaatgcagtgat

SEQ ID NO: 269126 - DNA, 15 bp, Homo sapiens
ctagaaatgcagtga

SEQ ID NO: 269127 - DNA, 15 bp, Homo sapiens
tctagaaatgcagtg

SEQ ID NO: 269128 - DNA, 15 bp, Homo sapiens
ttctagaaatgcagt

SEQ ID NO: 269129 - DNA, 15 bp, Homo sapiens
cttctagaaatgcag

SEQ ID NO: 269130 - DNA, 15 bp, Homo sapiens
acttctagaaatgca

SEQ ID NO: 269131 - DNA, 15 bp, Homo sapiens
cacttctagaaatgc

SEQ ID NO: 269132 - DNA, 15 bp, Homo sapiens
tcacttctagaaatg

SEQ ID NO: 269133 - DNA, 15 bp, Homo sapiens
ttcacttctagaaat

SEQ ID NO: 269134 - DNA, 15 bp, Homo sapiens
cttcacttctagaaa

SEQ ID NO: 269135 - DNA, 15 bp, Homo sapiens
acttcacttctagaa

SEQ ID NO: 269136 - DNA, 15 bp, Homo sapiens
cacttcacttctaga

SEQ ID NO: 269137 - DNA, 15 bp, Homo sapiens
tcacttcacttctag

SEQ ID NO: 269138 - DNA, 15 bp, Homo sapiens
gtcacttcacttcta

SEQ ID NO: 269139 - DNA, 15 bp, Homo sapiens
tgtcacttcacttct

SEQ ID NO: 269140 - DNA, 15 bp, Homo sapiens
ctgtcacttcacttc

SEQ ID NO: 269141 - DNA, 15 bp, Homo sapiens
tctgtcacttcactt

SEQ ID NO: 269142 - DNA, 15 bp, Homo sapiens
atctgtcacttcact

SEQ ID NO: 269143 - DNA, 15 bp, Homo sapiens
catctgtcacttcac

SEQ ID NO: 269144 - DNA, 15 bp, Homo sapiens
tcatctgtcacttca

SEQ ID NO: 269145 - DNA, 15 bp, Homo sapiens
atcatctgtcacttc

SEQ ID NO: 269146 - DNA, 15 bp, Homo sapiens
tatcatctgtcactt

SEQ ID NO: 269147 - DNA, 15 bp, Homo sapiens
ctatcatctgtcact

SEQ ID NO: 269148 - DNA, 15 bp, Homo sapiens
gctatcatctgtcac

SEQ ID NO: 269149 - DNA, 15 bp, Homo sapiens
ggctatcatctgtca

SEQ ID NO: 269150 - DNA, 15 bp, Homo sapiens
gggctatcatctgtc

SEQ ID NO: 269151 - DNA, 15 bp, Homo sapiens
agggctatcatctgt

SEQ ID NO: 269152 - DNA, 15 bp, Homo sapiens
cagggctatcatctg

SEQ ID NO: 269153 - DNA, 15 bp, Homo sapiens
acagggctatcatct

SEQ ID NO: 269154 - DNA, 15 bp, Homo sapiens
gacagggctatcatc

SEQ ID NO: 269155 - DNA, 15 bp, Homo sapiens
agacagggctatcat

SEQ ID NO: 269156 - DNA, 15 bp, Homo sapiens
cagacagggctatca

SEQ ID NO: 269157 - DNA, 15 bp, Homo sapiens
ccagacagggctatc

SEQ ID NO: 269158 - DNA, 15 bp, Homo sapiens
gccagacagggctat

SEQ ID NO: 269159 - DNA, 15 bp, Homo sapiens
cgccagacagggcta

SEQ ID NO: 269160 - DNA, 15 bp, Homo sapiens
acgccagacagggct

SEQ ID NO: 269161 - DNA, 15 bp, Homo sapiens
aacgccagacagggc

SEQ ID NO: 269162 - DNA, 15 bp, Homo sapiens
caacgccagacaggg

SEQ ID NO: 269163 - DNA, 15 bp, Homo sapiens
acaacgccagacagg

SEQ ID NO: 269164 - DNA, 15 bp, Homo sapiens
cacaacgccagacag

SEQ ID NO: 269165 - DNA, 15 bp, Homo sapiens
gcacaacgccagaca

SEQ ID NO: 269166 - DNA, 15 bp, Homo sapiens
ggcacaacgccagac

SEQ ID NO: 269167 - DNA, 15 bp, Homo sapiens
tggcacaacgccaga

SEQ ID NO: 269168 - DNA, 15 bp, Homo sapiens
atggcacaacgccag

SEQ ID NO: 269169 - DNA, 15 bp, Homo sapiens
gatggcacaacgcca

SEQ ID NO: 269170 - DNA, 15 bp, Homo sapiens
tgatggcacaacgcc

SEQ ID NO: 269171 - DNA, 15 bp, Homo sapiens
ttgatggcacaacgc

SEQ ID NO: 269172 - DNA, 15 bp, Homo sapiens
tttgatggcacaacg

SEQ ID NO: 269173 - DNA, 15 bp, Homo sapiens
ctttgatggcacaac

SEQ ID NO: 269174 - DNA, 15 bp, Homo sapiens
cctttgatggcacaa

SEQ ID NO: 269175 - DNA, 15 bp, Homo sapiens
tcctttgatggcaca

SEQ ID NO: 269176 - DNA, 15 bp, Homo sapiens
ctcctttgatggcac

SEQ ID NO: 269177 - DNA, 15 bp, Homo sapiens
tctcctttgatggca

SEQ ID NO: 269178 - DNA, 15 bp, Homo sapiens
ctctcctttgatggc

SEQ ID NO: 269179 - DNA, 15 bp, Homo sapiens
cctctcctttgatgg

SEQ ID NO: 269180 - DNA, 15 bp, Homo sapiens
ccctctcctttgatg

SEQ ID NO: 269181 - DNA, 15 bp, Homo sapiens
cccctctcctttgat

SEQ ID NO: 269182 - DNA, 15 bp, Homo sapiens
tcccctctcctttga

SEQ ID NO: 269183 - DNA, 15 bp, Homo sapiens
ttcccctctcctttg

SEQ ID NO: 269184 - DNA, 15 bp, Homo sapiens
cttcccctctccttt

SEQ ID NO: 269185 - DNA, 15 bp, Homo sapiens
ccttcccctctcctt

SEQ ID NO: 269186 - DNA, 15 bp, Homo sapiens
cccttcccctctcct

SEQ ID NO: 269187 - DNA, 15 bp, Homo sapiens
gcccttcccctctcc

SEQ ID NO: 269188 - DNA, 15 bp, Homo sapiens
tgcccttcccctctc

SEQ ID NO: 269189 - DNA, 15 bp, Homo sapiens
gtgcccttcccctct

SEQ ID NO: 269190 - DNA, 15 bp, Homo sapiens
tgtgcccttcccctc

SEQ ID NO: 269191 - DNA, 15 bp, Homo sapiens
atgtgcccttcccct

SEQ ID NO: 269192 - DNA, 15 bp, Homo sapiens
aatgtgcccttcccc

SEQ ID NO: 269193 - DNA, 15 bp, Homo sapiens
caatgtgcccttccc

SEQ ID NO: 269194 - DNA, 15 bp, Homo sapiens
ccaatgtgcccttcc

SEQ ID NO: 269195 - DNA, 15 bp, Homo sapiens
gccaatgtgcccttc

SEQ ID NO: 269196 - DNA, 15 bp, Homo sapiens
agccaatgtgccctt

SEQ ID NO: 269197 - DNA, 15 bp, Homo sapiens
aagccaatgtgccct

SEQ ID NO: 269198 - DNA, 15 bp, Homo sapiens
aaagccaatgtgccc

SEQ ID NO: 269199 - DNA, 15 bp, Homo sapiens
taaagccaatgtgcc

SEQ ID NO: 269200 - DNA, 15 bp, Homo sapiens
ctaaagccaatgtgc

SEQ ID NO: 269201 - DNA, 15 bp, Homo sapiens
actaaagccaatgtg

SEQ ID NO: 269202 - DNA, 15 bp, Homo sapiens
tactaaagccaatgt

SEQ ID NO: 269203 - DNA, 15 bp, Homo sapiens
ctactaaagccaatg

SEQ ID NO: 269204 - DNA, 15 bp, Homo sapiens
tctactaaagccaat

SEQ ID NO: 269205 - DNA, 15 bp, Homo sapiens
atctactaaagccaa

SEQ ID NO: 269206 - DNA, 15 bp, Homo sapiens
catctactaaagcca

SEQ ID NO: 269207 - DNA, 15 bp, Homo sapiens
tcatctactaaagcc

SEQ ID NO: 269208 - DNA, 15 bp, Homo sapiens
ttcatctactaaagc

SEQ ID NO: 269209 - DNA, 15 bp, Homo sapiens
cttcatctactaaag

SEQ ID NO: 269210 - DNA, 15 bp, Homo sapiens
gcttcatctactaaa

SEQ ID NO: 269211 - DNA, 15 bp, Homo sapiens
agcttcatctactaa

SEQ ID NO: 269212 - DNA, 15 bp, Homo sapiens
tagcttcatctacta

SEQ ID NO: 269213 - DNA, 15 bp, Homo sapiens
ttagcttcatctact

SEQ ID NO: 269214 - DNA, 15 bp, Homo sapiens
cttagcttcatctac

SEQ ID NO: 269215 - DNA, 15 bp, Homo sapiens
ccttagcttcatcta

SEQ ID NO: 269216 - DNA, 15 bp, Homo sapiens
cccttagcttcatct

SEQ ID NO: 269217 - DNA, 15 bp, Homo sapiens
ccccttagcttcatc

SEQ ID NO: 269218 - DNA, 15 bp, Homo sapiens
tccccttagcttcat

SEQ ID NO: 269219 - DNA, 15 bp, Homo sapiens
ttccccttagcttca

SEQ ID NO: 269220 - DNA, 15 bp, Homo sapiens
tttccccttagcttc

SEQ ID NO: 269221 - DNA, 15 bp, Homo sapiens
ttttccccttagctt

SEQ ID NO: 269222 - DNA, 15 bp, Homo sapiens
cttttccccttagct

SEQ ID NO: 269223 - DNA, 15 bp, Homo sapiens
ccttttccccttagc

SEQ ID NO: 269224 - DNA, 15 bp, Homo sapiens
cccttttccccttag

SEQ ID NO: 269225 - DNA, 15 bp, Homo sapiens
acccttttcccctta

SEQ ID NO: 269226 - DNA, 15 bp, Homo sapiens
cacccttttcccctt

SEQ ID NO: 269227 - DNA, 15 bp, Homo sapiens
acacccttttcccct

SEQ ID NO: 269228 - DNA, 15 bp, Homo sapiens
cacacccttttcccc

SEQ ID NO: 269229 - DNA, 15 bp, Homo sapiens
acacacccttttccc

SEQ ID NO: 269230 - DNA, 15 bp, Homo sapiens
tacacacccttttcc

SEQ ID NO: 269231 - DNA, 15 bp, Homo sapiens
ctacacacccttttc

SEQ ID NO: 269232 - DNA, 15 bp, Homo sapiens
cctacacaccctttt

SEQ ID NO: 269233 - DNA, 15 bp, Homo sapiens
tcctacacacccttt

SEQ ID NO: 269234 - DNA, 15 bp, Homo sapiens
ctcctacacaccctt

SEQ ID NO: 269235 - DNA, 15 bp, Homo sapiens
tctcctacacaccct

SEQ ID NO: 269236 - DNA, 15 bp, Homo sapiens
ctctcctacacaccc

SEQ ID NO: 269237 - DNA, 15 bp, Homo sapiens
cctctcctacacacc

SEQ ID NO: 269238 - DNA, 15 bp, Homo sapiens
tcctctcctacacac

SEQ ID NO: 269239 - DNA, 15 bp, Homo sapiens
ttcctctcctacaca

SEQ ID NO: 269240 - DNA, 15 bp, Homo sapiens
tttcctctcctacac

SEQ ID NO: 269241 - DNA, 15 bp, Homo sapiens
ttttcctctcctaca

SEQ ID NO: 269242 - DNA, 15 bp, Homo sapiens
tttttcctctcctac

SEQ ID NO: 269243 - DNA, 15 bp, Homo sapiens
ttttttcctctccta

SEQ ID NO: 269244 - DNA, 15 bp, Homo sapiens
tttttttcctctcct

SEQ ID NO: 269245 - DNA, 15 bp, Homo sapiens
atttttttcctctcc

SEQ ID NO: 269246 - DNA, 15 bp, Homo sapiens
tatttttttcctctc

SEQ ID NO: 269247 - DNA, 15 bp, Homo sapiens
atatttttttcctct

SEQ ID NO: 269248 - DNA, 15 bp, Homo sapiens
gatatttttttcctc

SEQ ID NO: 269249 - DNA, 15 bp, Homo sapiens
agatatttttttcct

SEQ ID NO: 269250 - DNA, 15 bp, Homo sapiens
aagatatttttttcc

SEQ ID NO: 269251 - DNA, 15 bp, Homo sapiens
gaagatatttttttc

SEQ ID NO: 269252 - DNA, 15 bp, Homo sapiens
agaagatattttttt

SEQ ID NO: 269253 - DNA, 15 bp, Homo sapiens
aagaagatatttttt

SEQ ID NO: 269254 - DNA, 15 bp, Homo sapiens
gaagaagatattttt

SEQ ID NO: 269255 - DNA, 15 bp, Homo sapiens
ggaagaagatatttt

SEQ ID NO: 269256 - DNA, 15 bp, Homo sapiens
gggaagaagatattt

SEQ ID NO: 269257 - DNA, 15 bp, Homo sapiens
tgggaagaagatatt

SEQ ID NO: 269258 - DNA, 15 bp, Homo sapiens
atgggaagaagatat

SEQ ID NO: 269259 - DNA, 15 bp, Homo sapiens
gatgggaagaagata

SEQ ID NO: 269260 - DNA, 15 bp, Homo sapiens
agatgggaagaagat

SEQ ID NO: 269261 - DNA, 15 bp, Homo sapiens
aagatgggaagaaga

SEQ ID NO: 269262 - DNA, 15 bp, Homo sapiens
taagatgggaagaag

SEQ ID NO: 269263 - DNA, 15 bp, Homo sapiens
ctaagatgggaagaa

SEQ ID NO: 269264 - DNA, 15 bp, Homo sapiens
actaagatgggaaga

SEQ ID NO: 269265 - DNA, 15 bp, Homo sapiens
aactaagatgggaag

SEQ ID NO: 269266 - DNA, 15 bp, Homo sapiens
aaactaagatgggaa

SEQ ID NO: 269267 - DNA, 15 bp, Homo sapiens
gaaactaagatggga

SEQ ID NO: 269268 - DNA, 15 bp, Homo sapiens
tgaaactaagatggg

SEQ ID NO: 269269 - DNA, 15 bp, Homo sapiens
atgaaactaagatgg

SEQ ID NO: 269270 - DNA, 15 bp, Homo sapiens
tatgaaactaagatg

SEQ ID NO: 269271 - DNA, 15 bp, Homo sapiens
ctatgaaactaagat

SEQ ID NO: 269272 - DNA, 15 bp, Homo sapiens
actatgaaactaaga

SEQ ID NO: 269273 - DNA, 15 bp, Homo sapiens
aactatgaaactaag

SEQ ID NO: 269274 - DNA, 15 bp, Homo sapiens
caactatgaaactaa

SEQ ID NO: 269275 - DNA, 15 bp, Homo sapiens
tcaactatgaaacta

SEQ ID NO: 269276 - DNA, 15 bp, Homo sapiens
ctcaactatgaaact

SEQ ID NO: 269277 - DNA, 15 bp, Homo sapiens
cctcaactatgaaac

SEQ ID NO: 269278 - DNA, 15 bp, Homo sapiens
gcctcaactatgaaa

SEQ ID NO: 269279 - DNA, 15 bp, Homo sapiens
agcctcaactatgaa

SEQ ID NO: 269280 - DNA, 15 bp, Homo sapiens
gagcctcaactatga

SEQ ID NO: 269281 - DNA, 15 bp, Homo sapiens
ggagcctcaactatg

SEQ ID NO: 269282 - DNA, 15 bp, Homo sapiens
aggagcctcaactat

SEQ ID NO: 269283 - DNA, 15 bp, Homo sapiens
caggagcctcaacta

SEQ ID NO: 269284 - DNA, 15 bp, Homo sapiens
acaggagcctcaact

SEQ ID NO: 269285 - DNA, 15 bp, Homo sapiens
tacaggagcctcaac

SEQ ID NO: 269286 - DNA, 15 bp, Homo sapiens
ttacaggagcctcaa

SEQ ID NO: 269287 - DNA, 15 bp, Homo sapiens
gttacaggagcctca

SEQ ID NO: 269288 - DNA, 15 bp, Homo sapiens
tgttacaggagcctc

SEQ ID NO: 269289 - DNA, 15 bp, Homo sapiens
ttgttacaggagcct

SEQ ID NO: 269290 - DNA, 15 bp, Homo sapiens
tttgttacaggagcc

SEQ ID NO: 269291 - DNA, 15 bp, Homo sapiens
ttttgttacaggagc

SEQ ID NO: 269292 - DNA, 15 bp, Homo sapiens
cttttgttacaggag

SEQ ID NO: 269293 - DNA, 15 bp, Homo sapiens
tcttttgttacagga

SEQ ID NO: 269294 - DNA, 15 bp, Homo sapiens
gtcttttgttacagg

SEQ ID NO: 269295 - DNA, 15 bp, Homo sapiens
tgtcttttgttacag

SEQ ID NO: 269296 - DNA, 15 bp, Homo sapiens
ctgtcttttgttaca

SEQ ID NO: 269297 - DNA, 15 bp, Homo sapiens
tctgtcttttgttac

SEQ ID NO: 269298 - DNA, 15 bp, Homo sapiens
atctgtcttttgtta

SEQ ID NO: 269299 - DNA, 15 bp, Homo sapiens
aatctgtcttttgtt

SEQ ID NO: 269300 - DNA, 15 bp, Homo sapiens
taatctgtcttttgt

SEQ ID NO: 269301 - DNA, 15 bp, Homo sapiens
ttaatctgtcttttg

SEQ ID NO: 269302 - DNA, 15 bp, Homo sapiens
gttaatctgtctttt

SEQ ID NO: 269303 - DNA, 15 bp, Homo sapiens
tgttaatctgtcttt

SEQ ID NO: 269304 - DNA, 15 bp, Homo sapiens
ttgttaatctgtctt

SEQ ID NO: 269305 - DNA, 15 bp, Homo sapiens
cttgttaatctgtct

SEQ ID NO: 269306 - DNA, 15 bp, Homo sapiens
tcttgttaatctgtc

SEQ ID NO: 269307 - DNA, 15 bp, Homo sapiens
ctcttgttaatctgt

SEQ ID NO: 269308 - DNA, 15 bp, Homo sapiens
tctcttgttaatctg

SEQ ID NO: 269309 - DNA, 15 bp, Homo sapiens
ttctcttgttaatct

SEQ ID NO: 269310 - DNA, 15 bp, Homo sapiens
tttctcttgttaatc

SEQ ID NO: 269311 - DNA, 15 bp, Homo sapiens
ttttctcttgttaat

SEQ ID NO: 269312 - DNA, 15 bp, Homo sapiens
cttttctcttgttaa

SEQ ID NO: 269313 - DNA, 15 bp, Homo sapiens
gcttttctcttgtta

SEQ ID NO: 269314 - DNA, 15 bp, Homo sapiens
tgcttttctcttgtt

SEQ ID NO: 269315 - DNA, 15 bp, Homo sapiens
atgcttttctcttgt

SEQ ID NO: 269316 - DNA, 15 bp, Homo sapiens
tatgcttttctcttg

SEQ ID NO: 269317 - DNA, 15 bp, Homo sapiens
gtatgcttttctctt

SEQ ID NO: 269318 - DNA, 15 bp, Homo sapiens
cgtatgcttttctct

SEQ ID NO: 269319 - DNA, 15 bp, Homo sapiens
tcgtatgcttttctc

SEQ ID NO: 269320 - DNA, 15 bp, Homo sapiens
ttcgtatgcttttct

SEQ ID NO: 269321 - DNA, 15 bp, Homo sapiens
attcgtatgcttttc

SEQ ID NO: 269322 - DNA, 15 bp, Homo sapiens
aattcgtatgctttt

SEQ ID NO: 269323 - DNA, 15 bp, Homo sapiens
caattcgtatgcttt

SEQ ID NO: 269324 - DNA, 15 bp, Homo sapiens
tcaattcgtatgctt

SEQ ID NO: 269325 - DNA, 15 bp, Homo sapiens
atcaattcgtatgct

SEQ ID NO: 269326 - DNA, 15 bp, Homo sapiens
aatcaattcgtatgc

SEQ ID NO: 269327 - DNA, 15 bp, Homo sapiens
aaatcaattcgtatg

SEQ ID NO: 269328 - DNA, 15 bp, Homo sapiens
taaatcaattcgtat

SEQ ID NO: 269329 - DNA, 15 bp, Homo sapiens
ttaaatcaattcgta

SEQ ID NO: 269330 - DNA, 15 bp, Homo sapiens
attaaatcaattcgt

SEQ ID NO: 269331 - DNA, 15 bp, Homo sapiens
tattaaatcaattcg

SEQ ID NO: 269332 - DNA, 15 bp, Homo sapiens
atattaaatcaattc

SEQ ID NO: 269333 - DNA, 15 bp, Homo sapiens
tatattaaatcaatt

SEQ ID NO: 269334 - DNA, 15 bp, Homo sapiens
ttatattaaatcaat

SEQ ID NO: 269335 - DNA, 15 bp, Homo sapiens
tttatattaaatcaa

SEQ ID NO: 269336 - DNA, 15 bp, Homo sapiens
aaatttatattaaat

SEQ ID NO: 269337 - DNA, 15 bp, Homo sapiens
aaaatttatattaaa

SEQ ID NO: 269338 - DNA, 15 bp, Homo sapiens
taaaatttatattaa

SEQ ID NO: 269339 - DNA, 15 bp, Homo sapiens
gtaaaatttatatta

SEQ ID NO: 269340 - DNA, 15 bp, Homo sapiens
tgtaaaatttatatt

SEQ ID NO: 269341 - DNA, 15 bp, Homo sapiens
atgtaaaatttatat

SEQ ID NO: 269342 - DNA, 15 bp, Homo sapiens
aatgtaaaatttata

SEQ ID NO: 269343 - DNA, 15 bp, Homo sapiens
taatgtaaaatttat

SEQ ID NO: 269344 - DNA, 15 bp, Homo sapiens
ataatgtaaaattta

SEQ ID NO: 269345 - DNA, 15 bp, Homo sapiens
tataatgtaaaattt

SEQ ID NO: 269346 - DNA, 15 bp, Homo sapiens
atataatgtaaaatt

SEQ ID NO: 269347 - DNA, 15 bp, Homo sapiens
catataatgtaaaat

SEQ ID NO: 269348 - DNA, 15 bp, Homo sapiens
ccatataatgtaaaa

SEQ ID NO: 269349 - DNA, 15 bp, Homo sapiens
tccatataatgtaaa

SEQ ID NO: 269350 - DNA, 15 bp, Homo sapiens
ttccatataatgtaa

SEQ ID NO: 269351 - DNA, 15 bp, Homo sapiens
cttccatataatgta

SEQ ID NO: 269352 - DNA, 15 bp, Homo sapiens
gcttccatataatgt

SEQ ID NO: 269353 - DNA, 15 bp, Homo sapiens
ggcttccatataatg

SEQ ID NO: 269354 - DNA, 15 bp, Homo sapiens
aggcttccatataat

SEQ ID NO: 269355 - DNA, 15 bp, Homo sapiens
aaggcttccatataa

SEQ ID NO: 269356 - DNA, 15 bp, Homo sapiens
gaaggcttccatata

SEQ ID NO: 269357 - DNA, 15 bp, Homo sapiens
tgaaggcttccatat

SEQ ID NO: 269358 - DNA, 15 bp, Homo sapiens
atgaaggcttccata

SEQ ID NO: 269359 - DNA, 15 bp, Homo sapiens
gatgaaggcttccat

SEQ ID NO: 269360 - DNA, 15 bp, Homo sapiens
tgatgaaggcttcca

SEQ ID NO: 269361 - DNA, 15 bp, Homo sapiens
ctgatgaaggcttcc

SEQ ID NO: 269362 - DNA, 15 bp, Homo sapiens
cctgatgaaggcttc

SEQ ID NO: 269363 - DNA, 15 bp, Homo sapiens
tcctgatgaaggctt

SEQ ID NO: 269364 - DNA, 15 bp, Homo sapiens
ttcctgatgaaggct

SEQ ID NO: 269365 - DNA, 15 bp, Homo sapiens
cttcctgatgaaggc

SEQ ID NO: 269366 - DNA, 15 bp, Homo sapiens
tcttcctgatgaagg

SEQ ID NO: 269367 - DNA, 15 bp, Homo sapiens
ctcttcctgatgaag

SEQ ID NO: 269368 - DNA, 15 bp, Homo sapiens
tctcttcctgatgaa

SEQ ID NO: 269369 - DNA, 15 bp, Homo sapiens
ttctcttcctgatga

SEQ ID NO: 269370 - DNA, 15 bp, Homo sapiens
cttctcttcctgatg

SEQ ID NO: 269371 - DNA, 15 bp, Homo sapiens
tcttctcttcctgat

SEQ ID NO: 269372 - DNA, 15 bp, Homo sapiens
gtcttctcttcctga

SEQ ID NO: 269373 - DNA, 15 bp, Homo sapiens
ggtcttctcttcctg

SEQ ID NO: 269374 - DNA, 15 bp, Homo sapiens
gggtcttctcttcct

SEQ ID NO: 269375 - DNA, 15 bp, Homo sapiens
tgggtcttctcttcc

SEQ ID NO: 269376 - DNA, 15 bp, Homo sapiens
ttgggtcttctcttc

SEQ ID NO: 269377 - DNA, 15 bp, Homo sapiens
tttgggtcttctctt

SEQ ID NO: 269378 - DNA, 15 bp, Homo sapiens
ctttgggtcttctct

SEQ ID NO: 269379 - DNA, 15 bp, Homo sapiens
tctttgggtcttctc

SEQ ID NO: 269380 - DNA, 15 bp, Homo sapiens
ttctttgggtcttct

SEQ ID NO: 269381 - DNA, 15 bp, Homo sapiens
tttctttgggtcttc

SEQ ID NO: 269382 - DNA, 15 bp, Homo sapiens
gtttctttgggtctt

SEQ ID NO: 269383 - DNA, 15 bp, Homo sapiens
cgtttctttgggtct

SEQ ID NO: 269384 - DNA, 15 bp, Homo sapiens
ccgtttctttgggtc

SEQ ID NO: 269385 - DNA, 15 bp, Homo sapiens
tccgtttctttgggt

SEQ ID NO: 269386 - DNA, 15 bp, Homo sapiens
ttccgtttctttggg

SEQ ID NO: 269387 - DNA, 15 bp, Homo sapiens
cttccgtttctttgg

SEQ ID NO: 269388 - DNA, 15 bp, Homo sapiens
gcttccgtttctttg

SEQ ID NO: 269389 - DNA, 15 bp, Homo sapiens
ggcttccgtttcttt

SEQ ID NO: 269390 - DNA, 15 bp, Homo sapiens
aggcttccgtttctt

SEQ ID NO: 269391 - DNA, 15 bp, Homo sapiens
caggcttccgtttct

SEQ ID NO: 269392 - DNA, 15 bp, Homo sapiens
acaggcttccgtttc

SEQ ID NO: 269393 - DNA, 15 bp, Homo sapiens
cacaggcttccgttt

SEQ ID NO: 269394 - DNA, 15 bp, Homo sapiens
acacaggcttccgtt

SEQ ID NO: 269395 - DNA, 15 bp, Homo sapiens
tacacaggcttccgt

SEQ ID NO: 269396 - DNA, 15 bp, Homo sapiens
atacacaggcttccg

SEQ ID NO: 269397 - DNA, 15 bp, Homo sapiens
aatacacaggcttcc

SEQ ID NO: 269398 - DNA, 15 bp, Homo sapiens
aaatacacaggcttc

SEQ ID NO: 269399 - DNA, 15 bp, Homo sapiens
aaaatacacaggctt

SEQ ID NO: 269400 - DNA, 15 bp, Homo sapiens
aaaaatacacaggct

SEQ ID NO: 269401 - DNA, 15 bp, Homo sapiens
taaaaatacacaggc

SEQ ID NO: 269402 - DNA, 15 bp, Homo sapiens
ataaaaatacacagg

SEQ ID NO: 269403 - DNA, 15 bp, Homo sapiens
cataaaaatacacag

SEQ ID NO: 269404 - DNA, 15 bp, Homo sapiens
gcataaaaatacaca

SEQ ID NO: 269405 - DNA, 15 bp, Homo sapiens
agcataaaaatacac

SEQ ID NO: 269406 - DNA, 15 bp, Homo sapiens
aagcataaaaataca

SEQ ID NO: 269407 - DNA, 15 bp, Homo sapiens
taagcataaaaatac

SEQ ID NO: 269408 - DNA, 15 bp, Homo sapiens
ctaagcataaaaata

SEQ ID NO: 269409 - DNA, 15 bp, Homo sapiens
cctaagcataaaaat

SEQ ID NO: 269410 - DNA, 15 bp, Homo sapiens
acctaagcataaaaa

SEQ ID NO: 269411 - DNA, 15 bp, Homo sapiens
aacctaagcataaaa

SEQ ID NO: 269412 - DNA, 15 bp, Homo sapiens
aaacctaagcataaa

SEQ ID NO: 269413 - DNA, 15 bp, Homo sapiens
caaacctaagcataa

SEQ ID NO: 269414 - DNA, 15 bp, Homo sapiens
tcaaacctaagcata

SEQ ID NO: 269415 - DNA, 15 bp, Homo sapiens
atcaaacctaagcat

SEQ ID NO: 269416 - DNA, 15 bp, Homo sapiens
catcaaacctaagca

SEQ ID NO: 269417 - DNA, 15 bp, Homo sapiens
tcatcaaacctaagc

SEQ ID NO: 269418 - DNA, 15 bp, Homo sapiens
ttcatcaaacctaag

SEQ ID NO: 269419 - DNA, 15 bp, Homo sapiens
cttcatcaaacctaa

SEQ ID NO: 269420 - DNA, 15 bp, Homo sapiens
tcttcatcaaaccta

SEQ ID NO: 269421 - DNA, 15 bp, Homo sapiens
ctcttcatcaaacct

SEQ ID NO: 269422 - DNA, 15 bp, Homo sapiens
actcttcatcaaacc

SEQ ID NO: 269423 - DNA, 15 bp, Homo sapiens
cactcttcatcaaac

SEQ ID NO: 269424 - DNA, 15 bp, Homo sapiens
ccactcttcatcaaa

SEQ ID NO: 269425 - DNA, 15 bp, Homo sapiens
tccactcttcatcaa

SEQ ID NO: 269426 - DNA, 15 bp, Homo sapiens
gtccactcttcatca

SEQ ID NO: 269427 - DNA, 15 bp, Homo sapiens
tgtccactcttcatc

SEQ ID NO: 269428 - DNA, 15 bp, Homo sapiens
ctgtccactcttcat

SEQ ID NO: 269429 - DNA, 15 bp, Homo sapiens
actgtccactcttca

SEQ ID NO: 269430 - DNA, 15 bp, Homo sapiens
aactgtccactcttc

SEQ ID NO: 269431 - DNA, 15 bp, Homo sapiens
caactgtccactctt

SEQ ID NO: 269432 - DNA, 15 bp, Homo sapiens
gcaactgtccactct

SEQ ID NO: 269433 - DNA, 15 bp, Homo sapiens
cgcaactgtccactc

SEQ ID NO: 269434 - DNA, 15 bp, Homo sapiens
acgcaactgtccact

SEQ ID NO: 269435 - DNA, 15 bp, Homo sapiens
tacgcaactgtccac

SEQ ID NO: 269436 - DNA, 15 bp, Homo sapiens
ctacgcaactgtcca

SEQ ID NO: 269437 - DNA, 15 bp, Homo sapiens
tctacgcaactgtcc

SEQ ID NO: 269438 - DNA, 15 bp, Homo sapiens
ttctacgcaactgtc

SEQ ID NO: 269439 - DNA, 15 bp, Homo sapiens
cttctacgcaactgt

SEQ ID NO: 269440 - DNA, 15 bp, Homo sapiens
acttctacgcaactg

SEQ ID NO: 269441 - DNA, 15 bp, Homo sapiens
tacttctacgcaact

SEQ ID NO: 269442 - DNA, 15 bp, Homo sapiens
atacttctacgcaac

SEQ ID NO: 269443 - DNA, 15 bp, Homo sapiens
catacttctacgcaa

SEQ ID NO: 269444 - DNA, 15 bp, Homo sapiens
tcatacttctacgca

SEQ ID NO: 269445 - DNA, 15 bp, Homo sapiens
atcatacttctacgc

SEQ ID NO: 269446 - DNA, 15 bp, Homo sapiens
aatcatacttctacg

SEQ ID NO: 269447 - DNA, 15 bp, Homo sapiens
caatcatacttctac

SEQ ID NO: 269448 - DNA, 15 bp, Homo sapiens
tcaatcatacttcta

SEQ ID NO: 269449 - DNA, 15 bp, Homo sapiens
ttcaatcatacttct

SEQ ID NO: 269450 - DNA, 15 bp, Homo sapiens
attcaatcatacttc

SEQ ID NO: 269451 - DNA, 15 bp, Homo sapiens
tattcaatcatactt

SEQ ID NO: 269452 - DNA, 15 bp, Homo sapiens
ttattcaatcatact

SEQ ID NO: 269453 - DNA, 15 bp, Homo sapiens
cttattcaatcatac

SEQ ID NO: 269454 - DNA, 15 bp, Homo sapiens
tcttattcaatcata

SEQ ID NO: 269455 - DNA, 15 bp, Homo sapiens
ttcttattcaatcat

SEQ ID NO: 269456 - DNA, 15 bp, Homo sapiens
cttcttattcaatca

SEQ ID NO: 269457 - DNA, 15 bp, Homo sapiens
tcttcttattcaatc

SEQ ID NO: 269458 - DNA, 15 bp, Homo sapiens
atcttcttattcaat

SEQ ID NO: 269459 - DNA, 15 bp, Homo sapiens
tatcttcttattcaa

SEQ ID NO: 269460 - DNA, 15 bp, Homo sapiens
gtatcttcttattca

SEQ ID NO: 269461 - DNA, 15 bp, Homo sapiens
cgtatcttcttattc

SEQ ID NO: 269462 - DNA, 15 bp, Homo sapiens
tcgtatcttcttatt

SEQ ID NO: 269463 - DNA, 15 bp, Homo sapiens
gtcgtatcttcttat

SEQ ID NO: 269464 - DNA, 15 bp, Homo sapiens
ggtcgtatcttctta

SEQ ID NO: 269465 - DNA, 15 bp, Homo sapiens
aggtcgtatcttctt

SEQ ID NO: 269466 - DNA, 15 bp, Homo sapiens
taggtcgtatcttct

SEQ ID NO: 269467 - DNA, 15 bp, Homo sapiens
ttaggtcgtatcttc

SEQ ID NO: 269468 - DNA, 15 bp, Homo sapiens
attaggtcgtatctt

SEQ ID NO: 269469 - DNA, 15 bp, Homo sapiens
cattaggtcgtatct

SEQ ID NO: 269470 - DNA, 15 bp, Homo sapiens
gcattaggtcgtatc

SEQ ID NO: 269471 - DNA, 15 bp, Homo sapiens
agcattaggtcgtat

SEQ ID NO: 269472 - DNA, 15 bp, Homo sapiens
tagcattaggtcgta

SEQ ID NO: 269473 - DNA, 15 bp, Homo sapiens
ttagcattaggtcgt

SEQ ID NO: 269474 - DNA, 15 bp, Homo sapiens
attagcattaggtcg

SEQ ID NO: 269475 - DNA, 15 bp, Homo sapiens
cattagcattaggtc

SEQ ID NO: 269476 - DNA, 15 bp, Homo sapiens
tcattagcattaggt

SEQ ID NO: 269477 - DNA, 15 bp, Homo sapiens
ttcattagcattagg

SEQ ID NO: 269478 - DNA, 15 bp, Homo sapiens
gttcattagcattag

SEQ ID NO: 269479 - DNA, 15 bp, Homo sapiens
agttcattagcatta

SEQ ID NO: 269480 - DNA, 15 bp, Homo sapiens
tagttcattagcatt

SEQ ID NO: 269481 - DNA, 15 bp, Homo sapiens
ctagttcattagcat

SEQ ID NO: 269482 - DNA, 15 bp, Homo sapiens
cctagttcattagca

SEQ ID NO: 269483 - DNA, 15 bp, Homo sapiens
gcctagttcattagc

SEQ ID NO: 269484 - DNA, 15 bp, Homo sapiens
cgcctagttcattag

SEQ ID NO: 269485 - DNA, 15 bp, Homo sapiens
tcgcctagttcatta

SEQ ID NO: 269486 - DNA, 15 bp, Homo sapiens
ttcgcctagttcatt

SEQ ID NO: 269487 - DNA, 15 bp, Homo sapiens
gttcgcctagttcat

SEQ ID NO: 269488 - DNA, 15 bp, Homo sapiens
agttcgcctagttca

SEQ ID NO: 269489 - DNA, 15 bp, Homo sapiens
aagttcgcctagttc

SEQ ID NO: 269490 - DNA, 15 bp, Homo sapiens
taagttcgcctagtt

SEQ ID NO: 269491 - DNA, 15 bp, Homo sapiens
ctaagttcgcctagt

SEQ ID NO: 269492 - DNA, 15 bp, Homo sapiens
gctaagttcgcctag

SEQ ID NO: 269493 - DNA, 15 bp, Homo sapiens
tgctaagttcgccta

SEQ ID NO: 269494 - DNA, 15 bp, Homo sapiens
ttgctaagttcgcct

SEQ ID NO: 269495 - DNA, 15 bp, Homo sapiens
cttgctaagttcgcc

SEQ ID NO: 269496 - DNA, 15 bp, Homo sapiens
ccttgctaagttcgc

SEQ ID NO: 269497 - DNA, 15 bp, Homo sapiens
gccttgctaagttcg

SEQ ID NO: 269498 - DNA, 15 bp, Homo sapiens
ggccttgctaagttc

SEQ ID NO: 269499 - DNA, 15 bp, Homo sapiens
aggccttgctaagtt

SEQ ID NO: 269500 - DNA, 15 bp, Homo sapiens
caggccttgctaagt

SEQ ID NO: 269501 - DNA, 15 bp, Homo sapiens
acaggccttgctaag

SEQ ID NO: 269502 - DNA, 15 bp, Homo sapiens
aacaggccttgctaa

SEQ ID NO: 269503 - DNA, 15 bp, Homo sapiens
aaacaggccttgcta

SEQ ID NO: 269504 - DNA, 15 bp, Homo sapiens
caaacaggccttgct

SEQ ID NO: 269505 - DNA, 15 bp, Homo sapiens
acaaacaggccttgc

SEQ ID NO: 269506 - DNA, 15 bp, Homo sapiens
aacaaacaggccttg

SEQ ID NO: 269507 - DNA, 15 bp, Homo sapiens
gaacaaacaggcctt

SEQ ID NO: 269508 - DNA, 15 bp, Homo sapiens
tgaacaaacaggcct

SEQ ID NO: 269509 - DNA, 15 bp, Homo sapiens
ctgaacaaacaggcc

SEQ ID NO: 269510 - DNA, 15 bp, Homo sapiens
tctgaacaaacaggc

SEQ ID NO: 269511 - DNA, 15 bp, Homo sapiens
atctgaacaaacagg

SEQ ID NO: 269512 - DNA, 15 bp, Homo sapiens
aatctgaacaaacag

SEQ ID NO: 269513 - DNA, 15 bp, Homo sapiens
gaatctgaacaaaca

SEQ ID NO: 269514 - DNA, 15 bp, Homo sapiens
agaatctgaacaaac

SEQ ID NO: 269515 - DNA, 15 bp, Homo sapiens
aagaatctgaacaaa

SEQ ID NO: 269516 - DNA, 15 bp, Homo sapiens
aaagaatctgaacaa

SEQ ID NO: 269517 - DNA, 15 bp, Homo sapiens
gaaaagaatctgaac

SEQ ID NO: 269518 - DNA, 15 bp, Homo sapiens
agaaaagaatctgaa

SEQ ID NO: 269519 - DNA, 15 bp, Homo sapiens
cagaaaagaatctga

SEQ ID NO: 269520 - DNA, 15 bp, Homo sapiens
acagaaaagaatctg

SEQ ID NO: 269521 - DNA, 15 bp, Homo sapiens
cacagaaaagaatct

SEQ ID NO: 269522 - DNA, 15 bp, Homo sapiens
acacagaaaagaatc

SEQ ID NO: 269523 - DNA, 15 bp, Homo sapiens
gacacagaaaagaat

SEQ ID NO: 269524 - DNA, 15 bp, Homo sapiens
ggacacagaaaagaa

SEQ ID NO: 269525 - DNA, 15 bp, Homo sapiens
aggacacagaaaaga

SEQ ID NO: 269526 - DNA, 15 bp, Homo sapiens
aaggacacagaaaag

SEQ ID NO: 269527 - DNA, 15 bp, Homo sapiens
gaaggacacagaaaa

SEQ ID NO: 269528 - DNA, 15 bp, Homo sapiens
agaaggacacagaaa

SEQ ID NO: 269529 - DNA, 15 bp, Homo sapiens
cagaaggacacagaa

SEQ ID NO: 269530 - DNA, 15 bp, Homo sapiens
acagaaggacacaga

SEQ ID NO: 269531 - DNA, 15 bp, Homo sapiens
aacagaaggacacag

SEQ ID NO: 269532 - DNA, 15 bp, Homo sapiens
aaacagaaggacaca

SEQ ID NO: 269533 - DNA, 15 bp, Homo sapiens
aaaacagaaggacac

SEQ ID NO: 269534 - DNA, 15 bp, Homo sapiens
gaaaacagaaggaca

SEQ ID NO: 269535 - DNA, 15 bp, Homo sapiens
tgaaaacagaaggac

SEQ ID NO: 269536 - DNA, 15 bp, Homo sapiens
ctgaaaacagaagga

SEQ ID NO: 269537 - DNA, 15 bp, Homo sapiens
actgaaaacagaagg

SEQ ID NO: 269538 - DNA, 15 bp, Homo sapiens
cactgaaaacagaag

SEQ ID NO: 269539 - DNA, 15 bp, Homo sapiens
tcactgaaaacagaa

SEQ ID NO: 269540 - DNA, 15 bp, Homo sapiens
atcactgaaaacaga

SEQ ID NO: 269541 - DNA, 15 bp, Homo sapiens
tatcactgaaaacag

SEQ ID NO: 269542 - DNA, 15 bp, Homo sapiens
ttatcactgaaaaca

SEQ ID NO: 269543 - DNA, 15 bp, Homo sapiens
cttatcactgaaaac

SEQ ID NO: 269544 - DNA, 15 bp, Homo sapiens
ccttatcactgaaaa

SEQ ID NO: 269545 - DNA, 15 bp, Homo sapiens
tccttatcactgaaa

SEQ ID NO: 269546 - DNA, 15 bp, Homo sapiens
atccttatcactgaa

SEQ ID NO: 269547 - DNA, 15 bp, Homo sapiens
catccttatcactga

SEQ ID NO: 269548 - DNA, 15 bp, Homo sapiens
acatccttatcactg

SEQ ID NO: 269549 - DNA, 15 bp, Homo sapiens
aacatccttatcact

SEQ ID NO: 269550 - DNA, 15 bp, Homo sapiens
aaacatccttatcac

SEQ ID NO: 269551 - DNA, 15 bp, Homo sapiens
gaaacatccttatca

SEQ ID NO: 269552 - DNA, 15 bp, Homo sapiens
agaaacatccttatc

SEQ ID NO: 269553 - DNA, 15 bp, Homo sapiens
aagaaacatccttat

SEQ ID NO: 269554 - DNA, 15 bp, Homo sapiens
gaagaaacatcctta

SEQ ID NO: 269555 - DNA, 15 bp, Homo sapiens
ggaagaaacatcctt

SEQ ID NO: 269556 - DNA, 15 bp, Homo sapiens
gggaagaaacatcct

SEQ ID NO: 269557 - DNA, 15 bp, Homo sapiens
agggaagaaacatcc

SEQ ID NO: 269558 - DNA, 15 bp, Homo sapiens
gagggaagaaacatc

SEQ ID NO: 269559 - DNA, 15 bp, Homo sapiens
ggagggaagaaacat

SEQ ID NO: 269560 - DNA, 15 bp, Homo sapiens
tggagggaagaaaca

SEQ ID NO: 269561 - DNA, 15 bp, Homo sapiens
ctggagggaagaaac

SEQ ID NO: 269562 - DNA, 15 bp, Homo sapiens
cctggagggaagaaa

SEQ ID NO: 269563 - DNA, 15 bp, Homo sapiens
tcctggagggaagaa

SEQ ID NO: 269564 - DNA, 15 bp, Homo sapiens
ttcctggagggaaga

SEQ ID NO: 269565 - DNA, 15 bp, Homo sapiens
attcctggagggaag

SEQ ID NO: 269566 - DNA, 15 bp, Homo sapiens
tattcctggagggaa

SEQ ID NO: 269567 - DNA, 15 bp, Homo sapiens
ttattcctggaggga

SEQ ID NO: 269568 - DNA, 15 bp, Homo sapiens
cttattcctggaggg

SEQ ID NO: 269569 - DNA, 15 bp, Homo sapiens
ccttattcctggagg

SEQ ID NO: 269570 - DNA, 15 bp, Homo sapiens
tccttattcctggag

SEQ ID NO: 269571 - DNA, 15 bp, Homo sapiens
ctccttattcctgga

SEQ ID NO: 269572 - DNA, 15 bp, Homo sapiens
cctccttattcctgg

SEQ ID NO: 269573 - DNA, 15 bp, Homo sapiens
ccctccttattcctg

SEQ ID NO: 269574 - DNA, 15 bp, Homo sapiens
gccctccttattcct

SEQ ID NO: 269575 - DNA, 15 bp, Homo sapiens
tgccctccttattcc

SEQ ID NO: 269576 - DNA, 15 bp, Homo sapiens
gtgccctccttattc

SEQ ID NO: 269577 - DNA, 15 bp, Homo sapiens
ggtgccctccttatt

SEQ ID NO: 269578 - DNA, 15 bp, Homo sapiens
aggtgccctccttat

SEQ ID NO: 269579 - DNA, 15 bp, Homo sapiens
gaggtgccctcctta

SEQ ID NO: 269580 - DNA, 15 bp, Homo sapiens
agaggtgccctcctt

SEQ ID NO: 269581 - DNA, 15 bp, Homo sapiens
gagaggtgccctcct

SEQ ID NO: 269582 - DNA, 15 bp, Homo sapiens
tgagaggtgccctcc

SEQ ID NO: 269583 - DNA, 15 bp, Homo sapiens
ttgagaggtgccctc

SEQ ID NO: 269584 - DNA, 15 bp, Homo sapiens
tttgagaggtgccct

SEQ ID NO: 269585 - DNA, 15 bp, Homo sapiens
atttgagaggtgccc

SEQ ID NO: 269586 - DNA, 15 bp, Homo sapiens
tatttgagaggtgcc

SEQ ID NO: 269587 - DNA, 15 bp, Homo sapiens
ttatttgagaggtgc

SEQ ID NO: 269588 - DNA, 15 bp, Homo sapiens
cttatttgagaggtg

SEQ ID NO: 269589 - DNA, 15 bp, Homo sapiens
ccttatttgagaggt

SEQ ID NO: 269590 - DNA, 15 bp, Homo sapiens
cccttatttgagagg

SEQ ID NO: 269591 - DNA, 15 bp, Homo sapiens
acccttatttgagag

SEQ ID NO: 269592 - DNA, 15 bp, Homo sapiens
gacccttatttgaga

SEQ ID NO: 269593 - DNA, 15 bp, Homo sapiens
agacccttatttgag

SEQ ID NO: 269594 - DNA, 15 bp, Homo sapiens
aagacccttatttga

SEQ ID NO: 269595 - DNA, 15 bp, Homo sapiens
taagacccttatttg

SEQ ID NO: 269596 - DNA, 15 bp, Homo sapiens
ataagacccttattt

SEQ ID NO: 269597 - DNA, 15 bp, Homo sapiens
cataagacccttatt

SEQ ID NO: 269598 - DNA, 15 bp, Homo sapiens
tcataagacccttat

SEQ ID NO: 269599 - DNA, 15 bp, Homo sapiens
gtcataagaccctta

SEQ ID NO: 269600 - DNA, 15 bp, Homo sapiens
ggtcataagaccctt

SEQ ID NO: 269601 - DNA, 15 bp, Homo sapiens
gggtcataagaccct

SEQ ID NO: 269602 - DNA, 15 bp, Homo sapiens
agggtcataagaccc

SEQ ID NO: 269603 - DNA, 15 bp, Homo sapiens
aagggtcataagacc

SEQ ID NO: 269604 - DNA, 15 bp, Homo sapiens
aaagggtcataagac

SEQ ID NO: 269605 - DNA, 15 bp, Homo sapiens
taaagggtcataaga

SEQ ID NO: 269606 - DNA, 15 bp, Homo sapiens
ctaaagggtcataag

SEQ ID NO: 269607 - DNA, 15 bp, Homo sapiens
cctaaagggtcataa

SEQ ID NO: 269608 - DNA, 15 bp, Homo sapiens
ccctaaagggtcata

SEQ ID NO: 269609 - DNA, 15 bp, Homo sapiens
tccctaaagggtcat

SEQ ID NO: 269610 - DNA, 15 bp, Homo sapiens
ttccctaaagggtca

SEQ ID NO: 269611 - DNA, 15 bp, Homo sapiens
cttccctaaagggtc

SEQ ID NO: 269612 - DNA, 15 bp, Homo sapiens
tcttccctaaagggt

SEQ ID NO: 269613 - DNA, 15 bp, Homo sapiens
ttcttccctaaaggg

SEQ ID NO: 269614 - DNA, 15 bp, Homo sapiens
cttcttccctaaagg

SEQ ID NO: 269615 - DNA, 15 bp, Homo sapiens
ccttcttccctaaag

SEQ ID NO: 269616 - DNA, 15 bp, Homo sapiens
tccttcttccctaaa

SEQ ID NO: 269617 - DNA, 15 bp, Homo sapiens
atccttcttccctaa

SEQ ID NO: 269618 - DNA, 15 bp, Homo sapiens
catccttcttcccta

SEQ ID NO: 269619 - DNA, 15 bp, Homo sapiens
ccatccttcttccct

SEQ ID NO: 269620 - DNA, 15 bp, Homo sapiens
cccatccttcttccc

SEQ ID NO: 269621 - DNA, 15 bp, Homo sapiens
tcccatccttcttcc

SEQ ID NO: 269622 - DNA, 15 bp, Homo sapiens
ctcccatccttcttc

SEQ ID NO: 269623 - DNA, 15 bp, Homo sapiens
tctcccatccttctt

SEQ ID NO: 269624 - DNA, 15 bp, Homo sapiens
ttctcccatccttct

SEQ ID NO: 269625 - DNA, 15 bp, Homo sapiens
cttctcccatccttc

SEQ ID NO: 269626 - DNA, 15 bp, Homo sapiens
ccttctcccatcctt

SEQ ID NO: 269627 - DNA, 15 bp, Homo sapiens
accttctcccatcct

SEQ ID NO: 269628 - DNA, 15 bp, Homo sapiens
gaccttctcccatcc

SEQ ID NO: 269629 - DNA, 15 bp, Homo sapiens
tgaccttctcccatc

SEQ ID NO: 269630 - DNA, 15 bp, Homo sapiens
ctgaccttctcccat

SEQ ID NO: 269631 - DNA, 15 bp, Homo sapiens
tctgaccttctccca

SEQ ID NO: 269632 - DNA, 15 bp, Homo sapiens
ctctgaccttctccc

SEQ ID NO: 269633 - DNA, 15 bp, Homo sapiens
tctctgaccttctcc

SEQ ID NO: 269634 - DNA, 15 bp, Homo sapiens
ctctctgaccttctc

SEQ ID NO: 269635 - DNA, 15 bp, Homo sapiens
tctctctgaccttct

SEQ ID NO: 269636 - DNA, 15 bp, Homo sapiens
atctctctgaccttc

SEQ ID NO: 269637 - DNA, 15 bp, Homo sapiens
gatctctctgacctt

SEQ ID NO: 269638 - DNA, 15 bp, Homo sapiens
agatctctctgacct

SEQ ID NO: 269639 - DNA, 15 bp, Homo sapiens
aagatctctctgacc

SEQ ID NO: 269640 - DNA, 15 bp, Homo sapiens
caagatctctctgac

SEQ ID NO: 269641 - DNA, 15 bp, Homo sapiens
gcaagatctctctga

SEQ ID NO: 269642 - DNA, 15 bp, Homo sapiens
agcaagatctctctg

SEQ ID NO: 269643 - DNA, 15 bp, Homo sapiens
tagcaagatctctct

SEQ ID NO: 269644 - DNA, 15 bp, Homo sapiens
gtagcaagatctctc

SEQ ID NO: 269645 - DNA, 15 bp, Homo sapiens
cgtagcaagatctct

SEQ ID NO: 269646 - DNA, 15 bp, Homo sapiens
acgtagcaagatctc

SEQ ID NO: 269647 - DNA, 15 bp, Homo sapiens
gacgtagcaagatct

SEQ ID NO: 269648 - DNA, 15 bp, Homo sapiens
agacgtagcaagatc

SEQ ID NO: 269649 - DNA, 15 bp, Homo sapiens
cagacgtagcaagat

SEQ ID NO: 269650 - DNA, 15 bp, Homo sapiens
gcagacgtagcaaga

SEQ ID NO: 269651 - DNA, 15 bp, Homo sapiens
agcagacgtagcaag

SEQ ID NO: 269652 - DNA, 15 bp, Homo sapiens
cagcagacgtagcaa

SEQ ID NO: 269653 - DNA, 15 bp, Homo sapiens
acagcagacgtagca

SEQ ID NO: 269654 - DNA, 15 bp, Homo sapiens
aacagcagacgtagc

SEQ ID NO: 269655 - DNA, 15 bp, Homo sapiens
aaacagcagacgtag

SEQ ID NO: 269656 - DNA, 15 bp, Homo sapiens
aaaacagcagacgta

SEQ ID NO: 269657 - DNA, 15 bp, Homo sapiens
gaaaacagcagacgt

SEQ ID NO: 269658 - DNA, 15 bp, Homo sapiens
agaaaacagcagacg

SEQ ID NO: 269659 - DNA, 15 bp, Homo sapiens
gagaaaacagcagac

SEQ ID NO: 269660 - DNA, 15 bp, Homo sapiens
tgagaaaacagcaga

SEQ ID NO: 269661 - DNA, 15 bp, Homo sapiens
ttgagaaaacagcag

SEQ ID NO: 269662 - DNA, 15 bp, Homo sapiens
gttgagaaaacagca

SEQ ID NO: 269663 - DNA, 15 bp, Homo sapiens
agttgagaaaacagc

SEQ ID NO: 269664 - DNA, 15 bp, Homo sapiens
cagttgagaaaacag

SEQ ID NO: 269665 - DNA, 15 bp, Homo sapiens
gcagttgagaaaaca

SEQ ID NO: 269666 - DNA, 15 bp, Homo sapiens
ggcagttgagaaaac

SEQ ID NO: 269667 - DNA, 15 bp, Homo sapiens
tggcagttgagaaaa

SEQ ID NO: 269668 - DNA, 15 bp, Homo sapiens
ttggcagttgagaaa

SEQ ID NO: 269669 - DNA, 15 bp, Homo sapiens
attggcagttgagaa

SEQ ID NO: 269670 - DNA, 15 bp, Homo sapiens
cattggcagttgaga

SEQ ID NO: 269671 - DNA, 15 bp, Homo sapiens
acattggcagttgag

SEQ ID NO: 269672 - DNA, 15 bp, Homo sapiens
cacattggcagttga

SEQ ID NO: 269673 - DNA, 15 bp, Homo sapiens
gcacattggcagttg

SEQ ID NO: 269674 - DNA, 15 bp, Homo sapiens
ggcacattggcagtt

SEQ ID NO: 269675 - DNA, 15 bp, Homo sapiens
tggcacattggcagt

SEQ ID NO: 269676 - DNA, 15 bp, Homo sapiens
atggcacattggcag

SEQ ID NO: 269677 - DNA, 15 bp, Homo sapiens
tatggcacattggca

SEQ ID NO: 269678 - DNA, 15 bp, Homo sapiens
atatggcacattggc

SEQ ID NO: 269679 - DNA, 15 bp, Homo sapiens
aatatggcacattgg

SEQ ID NO: 269680 - DNA, 15 bp, Homo sapiens
aaatatggcacattg

SEQ ID NO: 269681 - DNA, 15 bp, Homo sapiens
caaatatggcacatt

SEQ ID NO: 269682 - DNA, 15 bp, Homo sapiens
ccaaatatggcacat

SEQ ID NO: 269683 - DNA, 15 bp, Homo sapiens
tccaaatatggcaca

SEQ ID NO: 269684 - DNA, 15 bp, Homo sapiens
ctccaaatatggcac

SEQ ID NO: 269685 - DNA, 15 bp, Homo sapiens
cctccaaatatggca

SEQ ID NO: 269686 - DNA, 15 bp, Homo sapiens
acctccaaatatggc

SEQ ID NO: 269687 - DNA, 15 bp, Homo sapiens
tacctccaaatatgg

SEQ ID NO: 269688 - DNA, 15 bp, Homo sapiens
ctacctccaaatatg

SEQ ID NO: 269689 - DNA, 15 bp, Homo sapiens
actacctccaaatat

SEQ ID NO: 269690 - DNA, 15 bp, Homo sapiens
cactacctccaaata

SEQ ID NO: 269691 - DNA, 15 bp, Homo sapiens
acactacctccaaat

SEQ ID NO: 269692 - DNA, 15 bp, Homo sapiens
cacactacctccaaa

SEQ ID NO: 269693 - DNA, 15 bp, Homo sapiens
acacactacctccaa

SEQ ID NO: 269694 - DNA, 15 bp, Homo sapiens
gacacactacctcca

SEQ ID NO: 269695 - DNA, 15 bp, Homo sapiens
ggacacactacctcc

SEQ ID NO: 269696 - DNA, 15 bp, Homo sapiens
aggacacactacctc

SEQ ID NO: 269697 - DNA, 15 bp, Homo sapiens
caggacacactacct

SEQ ID NO: 269698 - DNA, 15 bp, Homo sapiens
tcaggacacactacc

SEQ ID NO: 269699 - DNA, 15 bp, Homo sapiens
ttcaggacacactac

SEQ ID NO: 269700 - DNA, 15 bp, Homo sapiens
gttcaggacacacta

SEQ ID NO: 269701 - DNA, 15 bp, Homo sapiens
ggttcaggacacact

SEQ ID NO: 269702 - DNA, 15 bp, Homo sapiens
gggttcaggacacac

SEQ ID NO: 269703 - DNA, 15 bp, Homo sapiens
agggttcaggacaca

SEQ ID NO: 269704 - DNA, 15 bp, Homo sapiens
aagggttcaggacac

SEQ ID NO: 269705 - DNA, 15 bp, Homo sapiens
caagggttcaggaca

SEQ ID NO: 269706 - DNA, 15 bp, Homo sapiens
gcaagggttcaggac

SEQ ID NO: 269707 - DNA, 15 bp, Homo sapiens
ggcaagggttcagga

SEQ ID NO: 269708 - DNA, 15 bp, Homo sapiens
tggcaagggttcagg

SEQ ID NO: 269709 - DNA, 15 bp, Homo sapiens
ttggcaagggttcag

SEQ ID NO: 269710 - DNA, 15 bp, Homo sapiens
cttggcaagggttca

SEQ ID NO: 269711 - DNA, 15 bp, Homo sapiens
acttggcaagggttc

SEQ ID NO: 269712 - DNA, 15 bp, Homo sapiens
cacttggcaagggtt

SEQ ID NO: 269713 - DNA, 15 bp, Homo sapiens
acacttggcaagggt

SEQ ID NO: 269714 - DNA, 15 bp, Homo sapiens
tacacttggcaaggg

SEQ ID NO: 269715 - DNA, 15 bp, Homo sapiens
ttacacttggcaagg

SEQ ID NO: 269716 - DNA, 15 bp, Homo sapiens
tttacacttggcaag

SEQ ID NO: 269717 - DNA, 15 bp, Homo sapiens
gtttacacttggcaa

SEQ ID NO: 269718 - DNA, 15 bp, Homo sapiens
tgtttacacttggca

SEQ ID NO: 269719 - DNA, 15 bp, Homo sapiens
atgtttacacttggc

SEQ ID NO: 269720 - DNA, 15 bp, Homo sapiens
gatgtttacacttgg

SEQ ID NO: 269721 - DNA, 15 bp, Homo sapiens
ggatgtttacacttg

SEQ ID NO: 269722 - DNA, 15 bp, Homo sapiens
aggatgtttacactt

SEQ ID NO: 269723 - DNA, 15 bp, Homo sapiens
aaggatgtttacact

SEQ ID NO: 269724 - DNA, 15 bp, Homo sapiens
aaaggatgtttacac

SEQ ID NO: 269725 - DNA, 15 bp, Homo sapiens
aaaaggatgtttaca

SEQ ID NO: 269726 - DNA, 15 bp, Homo sapiens
gaaaaggatgtttac

SEQ ID NO: 269727 - DNA, 15 bp, Homo sapiens
agaaaaggatgttta

SEQ ID NO: 269728 - DNA, 15 bp, Homo sapiens
gagaaaaggatgttt

SEQ ID NO: 269729 - DNA, 15 bp, Homo sapiens
agagaaaaggatgtt

SEQ ID NO: 269730 - DNA, 15 bp, Homo sapiens
aagagaaaaggatgt

SEQ ID NO: 269731 - DNA, 15 bp, Homo sapiens
caagagaaaaggatg

SEQ ID NO: 269732 - DNA, 15 bp, Homo sapiens
ccaagagaaaaggat

SEQ ID NO: 269733 - DNA, 15 bp, Homo sapiens
accaagagaaaagga

SEQ ID NO: 269734 - DNA, 15 bp, Homo sapiens
aaccaagagaaaagg

SEQ ID NO: 269735 - DNA, 15 bp, Homo sapiens
caaccaagagaaaag

SEQ ID NO: 269736 - DNA, 15 bp, Homo sapiens
acaaccaagagaaaa

SEQ ID NO: 269737 - DNA, 15 bp, Homo sapiens
aacaaccaagagaaa

SEQ ID NO: 269738 - DNA, 15 bp, Homo sapiens
taacaaccaagagaa

SEQ ID NO: 269739 - DNA, 15 bp, Homo sapiens
ataacaaccaagaga

SEQ ID NO: 269740 - DNA, 15 bp, Homo sapiens
cataacaaccaagag

SEQ ID NO: 269741 - DNA, 15 bp, Homo sapiens
tcataacaaccaaga

SEQ ID NO: 269742 - DNA, 15 bp, Homo sapiens
ttcataacaaccaag

SEQ ID NO: 269743 - DNA, 15 bp, Homo sapiens
tttcataacaaccaa

SEQ ID NO: 269744 - DNA, 15 bp, Homo sapiens
ttttcataacaacca

SEQ ID NO: 269745 - DNA, 15 bp, Homo sapiens
tttttcataacaacc

SEQ ID NO: 269746 - DNA, 15 bp, Homo sapiens
ctttttcataacaac

SEQ ID NO: 269747 - DNA, 15 bp, Homo sapiens
tctttttcataacaa

SEQ ID NO: 269748 - DNA, 15 bp, Homo sapiens
ctctttttcataaca

SEQ ID NO: 269749 - DNA, 15 bp, Homo sapiens
tctctttttcataac

SEQ ID NO: 269750 - DNA, 15 bp, Homo sapiens
atctctttttcataa

SEQ ID NO: 269751 - DNA, 15 bp, Homo sapiens
aatctctttttcata

SEQ ID NO: 269752 - DNA, 15 bp, Homo sapiens
taatctctttttcat

SEQ ID NO: 269753 - DNA, 15 bp, Homo sapiens
ataatctctttttca

SEQ ID NO: 269754 - DNA, 15 bp, Homo sapiens
tataatctctttttc

SEQ ID NO: 269755 - DNA, 15 bp, Homo sapiens
gtataatctcttttt

SEQ ID NO: 269756 - DNA, 15 bp, Homo sapiens
tgtataatctctttt

SEQ ID NO: 269757 - DNA, 15 bp, Homo sapiens
ctgtataatctcttt

SEQ ID NO: 269758 - DNA, 15 bp, Homo sapiens
gctgtataatctctt

SEQ ID NO: 269759 - DNA, 15 bp, Homo sapiens
ggctgtataatctct

SEQ ID NO: 269760 - DNA, 15 bp, Homo sapiens
tggctgtataatctc

SEQ ID NO: 269761 - DNA, 15 bp, Homo sapiens
gtggctgtataatct

SEQ ID NO: 269762 - DNA, 15 bp, Homo sapiens
tgtggctgtataatc

SEQ ID NO: 269763 - DNA, 15 bp, Homo sapiens
ttgtggctgtataat

SEQ ID NO: 269764 - DNA, 15 bp, Homo sapiens
tttgtggctgtataa

SEQ ID NO: 269765 - DNA, 15 bp, Homo sapiens
atttgtggctgtata

SEQ ID NO: 269766 - DNA, 15 bp, Homo sapiens
catttgtggctgtat

SEQ ID NO: 269767 - DNA, 15 bp, Homo sapiens
tcatttgtggctgta

SEQ ID NO: 269768 - DNA, 15 bp, Homo sapiens
ttcatttgtggctgt

SEQ ID NO: 269769 - DNA, 15 bp, Homo sapiens
tttcatttgtggctg

SEQ ID NO: 269770 - DNA, 15 bp, Homo sapiens
ttttcatttgtggct

SEQ ID NO: 269771 - DNA, 15 bp, Homo sapiens
tttttcatttgtggc

SEQ ID NO: 269772 - DNA, 15 bp, Homo sapiens
ctttttcatttgtgg

SEQ ID NO: 269773 - DNA, 15 bp, Homo sapiens
tctttttcatttgtg

SEQ ID NO: 269774 - DNA, 15 bp, Homo sapiens
atctttttcatttgt

SEQ ID NO: 269775 - DNA, 15 bp, Homo sapiens
catctttttcatttg

SEQ ID NO: 269776 - DNA, 15 bp, Homo sapiens
acatctttttcattt

SEQ ID NO: 269777 - DNA, 15 bp, Homo sapiens
aacatctttttcatt

SEQ ID NO: 269778 - DNA, 15 bp, Homo sapiens
taacatctttttcat

SEQ ID NO: 269779 - DNA, 15 bp, Homo sapiens
ataacatctttttca

SEQ ID NO: 269780 - DNA, 15 bp, Homo sapiens
tataacatctttttc

SEQ ID NO: 269781 - DNA, 15 bp, Homo sapiens
ctataacatcttttt

SEQ ID NO: 269782 - DNA, 15 bp, Homo sapiens
cctataacatctttt

SEQ ID NO: 269783 - DNA, 15 bp, Homo sapiens
tcctataacatcttt

SEQ ID NO: 269784 - DNA, 15 bp, Homo sapiens
ttcctataacatctt

SEQ ID NO: 269785 - DNA, 15 bp, Homo sapiens
tttcctataacatct

SEQ ID NO: 269786 - DNA, 15 bp, Homo sapiens
atttcctataacatc

SEQ ID NO: 269787 - DNA, 15 bp, Homo sapiens
catttcctataacat

SEQ ID NO: 269788 - DNA, 15 bp, Homo sapiens
ccatttcctataaca

SEQ ID NO: 269789 - DNA, 15 bp, Homo sapiens
gccatttcctataac

SEQ ID NO: 269790 - DNA, 15 bp, Homo sapiens
tgccatttcctataa

SEQ ID NO: 269791 - DNA, 15 bp, Homo sapiens
atgccatttcctata

SEQ ID NO: 269792 - DNA, 15 bp, Homo sapiens
aatgccatttcctat

SEQ ID NO: 269793 - DNA, 15 bp, Homo sapiens
taatgccatttccta

SEQ ID NO: 269794 - DNA, 15 bp, Homo sapiens
ataatgccatttcct

SEQ ID NO: 269795 - DNA, 15 bp, Homo sapiens
gataatgccatttcc

SEQ ID NO: 269796 - DNA, 15 bp, Homo sapiens
tgataatgccatttc

SEQ ID NO: 269797 - DNA, 15 bp, Homo sapiens
atgataatgccattt

SEQ ID NO: 269798 - DNA, 15 bp, Homo sapiens
catgataatgccatt

SEQ ID NO: 269799 - DNA, 15 bp, Homo sapiens
ccatgataatgccat

SEQ ID NO: 269800 - DNA, 15 bp, Homo sapiens
cccatgataatgcca

SEQ ID NO: 269801 - DNA, 15 bp, Homo sapiens
tcccatgataatgcc

SEQ ID NO: 269802 - DNA, 15 bp, Homo sapiens
ctcccatgataatgc

SEQ ID NO: 269803 - DNA, 15 bp, Homo sapiens
gctcccatgataatg

SEQ ID NO: 269804 - DNA, 15 bp, Homo sapiens
agctcccatgataat

SEQ ID NO: 269805 - DNA, 15 bp, Homo sapiens
aagctcccatgataa

SEQ ID NO: 269806 - DNA, 15 bp, Homo sapiens
gaagctcccatgata

SEQ ID NO: 269807 - DNA, 15 bp, Homo sapiens
cgaagctcccatgat

SEQ ID NO: 269808 - DNA, 15 bp, Homo sapiens
ccgaagctcccatga

SEQ ID NO: 269809 - DNA, 15 bp, Homo sapiens
cccgaagctcccatg

SEQ ID NO: 269810 - DNA, 15 bp, Homo sapiens
tcccgaagctcccat

SEQ ID NO: 269811 - DNA, 15 bp, Homo sapiens
atcccgaagctccca

SEQ ID NO: 269812 - DNA, 15 bp, Homo sapiens
aatcccgaagctccc

SEQ ID NO: 269813 - DNA, 15 bp, Homo sapiens
caatcccgaagctcc

SEQ ID NO: 269814 - DNA, 15 bp, Homo sapiens
tcaatcccgaagctc

SEQ ID NO: 269815 - DNA, 15 bp, Homo sapiens
atcaatcccgaagct

SEQ ID NO: 269816 - DNA, 15 bp, Homo sapiens
aatcaatcccgaagc

SEQ ID NO: 269817 - DNA, 15 bp, Homo sapiens
gaatcaatcccgaag

SEQ ID NO: 269818 - DNA, 15 bp, Homo sapiens
tgaatcaatcccgaa

SEQ ID NO: 269819 - DNA, 15 bp, Homo sapiens
ttgaatcaatcccga

SEQ ID NO: 269820 - DNA, 15 bp, Homo sapiens
cttgaatcaatcccg

SEQ ID NO: 269821 - DNA, 15 bp, Homo sapiens
ccttgaatcaatccc

SEQ ID NO: 269822 - DNA, 15 bp, Homo sapiens
tccttgaatcaatcc

SEQ ID NO: 269823 - DNA, 15 bp, Homo sapiens
ctccttgaatcaatc

SEQ ID NO: 269824 - DNA, 15 bp, Homo sapiens
tctccttgaatcaat

SEQ ID NO: 269825 - DNA, 15 bp, Homo sapiens
atctccttgaatcaa

SEQ ID NO: 269826 - DNA, 15 bp, Homo sapiens
tatctccttgaatca

SEQ ID NO: 269827 - DNA, 15 bp, Homo sapiens
ctatctccttgaatc

SEQ ID NO: 269828 - DNA, 15 bp, Homo sapiens
cctatctccttgaat

SEQ ID NO: 269829 - DNA, 15 bp, Homo sapiens
acctatctccttgaa

SEQ ID NO: 269830 - DNA, 15 bp, Homo sapiens
aacctatctccttga

SEQ ID NO: 269831 - DNA, 15 bp, Homo sapiens
caacctatctccttg

SEQ ID NO: 269832 - DNA, 15 bp, Homo sapiens
tcaacctatctcctt

SEQ ID NO: 269833 - DNA, 15 bp, Homo sapiens
ttcaacctatctcct

SEQ ID NO: 269834 - DNA, 15 bp, Homo sapiens
tttcaacctatctcc

SEQ ID NO: 269835 - DNA, 15 bp, Homo sapiens
atttcaacctatctc

SEQ ID NO: 269836 - DNA, 15 bp, Homo sapiens
tatttcaacctatct

SEQ ID NO: 269837 - DNA, 15 bp, Homo sapiens
gtatttcaacctatc

SEQ ID NO: 269838 - DNA, 15 bp, Homo sapiens
agtatttcaacctat

SEQ ID NO: 269839 - DNA, 15 bp, Homo sapiens
tagtatttcaaccta

SEQ ID NO: 269840 - DNA, 15 bp, Homo sapiens
ttagtatttcaacct

SEQ ID NO: 269841 - DNA, 15 bp, Homo sapiens
attagtatttcaacc

SEQ ID NO: 269842 - DNA, 15 bp, Homo sapiens
aattagtatttcaac

SEQ ID NO: 269843 - DNA, 15 bp, Homo sapiens
taattagtatttcaa

SEQ ID NO: 269844 - DNA, 15 bp, Homo sapiens
ataattagtatttca

SEQ ID NO: 269845 - DNA, 15 bp, Homo sapiens
cataattagtatttc

SEQ ID NO: 269846 - DNA, 15 bp, Homo sapiens
tcataattagtattt

SEQ ID NO: 269847 - DNA, 15 bp, Homo sapiens
ttcataattagtatt

SEQ ID NO: 269848 - DNA, 15 bp, Homo sapiens
gttcataattagtat

SEQ ID NO: 269849 - DNA, 15 bp, Homo sapiens
tgttcataattagta

SEQ ID NO: 269850 - DNA, 15 bp, Homo sapiens
ttgttcataattagt

SEQ ID NO: 269851 - DNA, 15 bp, Homo sapiens
tttgttcataattag

SEQ ID NO: 269852 - DNA, 15 bp, Homo sapiens
ttttgttcataatta

SEQ ID NO: 269853 - DNA, 15 bp, Homo sapiens
attttgttcataatt

SEQ ID NO: 269854 - DNA, 15 bp, Homo sapiens
cattttgttcataat

SEQ ID NO: 269855 - DNA, 15 bp, Homo sapiens
acattttgttcataa

SEQ ID NO: 269856 - DNA, 15 bp, Homo sapiens
tacattttgttcata

SEQ ID NO: 269857 - DNA, 15 bp, Homo sapiens
ttacattttgttcat

SEQ ID NO: 269858 - DNA, 15 bp, Homo sapiens
cttacattttgttca

SEQ ID NO: 269859 - DNA, 15 bp, Homo sapiens
ccttacattttgttc

SEQ ID NO: 269860 - DNA, 15 bp, Homo sapiens
accttacattttgtt

SEQ ID NO: 269861 - DNA, 15 bp, Homo sapiens
taccttacattttgt

SEQ ID NO: 269862 - DNA, 15 bp, Homo sapiens
ttaccttacattttg

SEQ ID NO: 269863 - DNA, 15 bp, Homo sapiens
attaccttacatttt

SEQ ID NO: 269864 - DNA, 15 bp, Homo sapiens
cattaccttacattt

SEQ ID NO: 269865 - DNA, 15 bp, Homo sapiens
acattaccttacatt

SEQ ID NO: 269866 - DNA, 15 bp, Homo sapiens
cacattaccttacat

SEQ ID NO: 269867 - DNA, 15 bp, Homo sapiens
acacattaccttaca

SEQ ID NO: 269868 - DNA, 15 bp, Homo sapiens
tacacattaccttac

SEQ ID NO: 269869 - DNA, 15 bp, Homo sapiens
ttacacattacctta

SEQ ID NO: 269870 - DNA, 15 bp, Homo sapiens
tttacacattacctt

SEQ ID NO: 269871 - DNA, 15 bp, Homo sapiens
ttttacacattacct

SEQ ID NO: 269872 - DNA, 15 bp, Homo sapiens
cttttacacattacc

SEQ ID NO: 269873 - DNA, 15 bp, Homo sapiens
tcttttacacattac

SEQ ID NO: 269874 - DNA, 15 bp, Homo sapiens
ttcttttacacatta

SEQ ID NO: 269875 - DNA, 15 bp, Homo sapiens
gttcttttacacatt

SEQ ID NO: 269876 - DNA, 15 bp, Homo sapiens
tgttcttttacacat

SEQ ID NO: 269877 - DNA, 15 bp, Homo sapiens
gtgttcttttacaca

SEQ ID NO: 269878 - DNA, 15 bp, Homo sapiens
tgtgttcttttacac

SEQ ID NO: 269879 - DNA, 15 bp, Homo sapiens
ctgtgttcttttaca

SEQ ID NO: 269880 - DNA, 15 bp, Homo sapiens
tctgtgttcttttac

SEQ ID NO: 269881 - DNA, 15 bp, Homo sapiens
ttctgtgttctttta

SEQ ID NO: 269882 - DNA, 15 bp, Homo sapiens
attctgtgttctttt

SEQ ID NO: 269883 - DNA, 15 bp, Homo sapiens
gattctgtgttcttt

SEQ ID NO: 269884 - DNA, 15 bp, Homo sapiens
ggattctgtgttctt

SEQ ID NO: 269885 - DNA, 15 bp, Homo sapiens
tggattctgtgttct

SEQ ID NO: 269886 - DNA, 15 bp, Homo sapiens
gtggattctgtgttc

SEQ ID NO: 269887 - DNA, 15 bp, Homo sapiens
agtggattctgtgtt

SEQ ID NO: 269888 - DNA, 15 bp, Homo sapiens
cagtggattctgtgt

SEQ ID NO: 269889 - DNA, 15 bp, Homo sapiens
acagtggattctgtg

SEQ ID NO: 269890 - DNA, 15 bp, Homo sapiens
tacagtggattctgt

SEQ ID NO: 269891 - DNA, 15 bp, Homo sapiens
ttacagtggattctg

SEQ ID NO: 269892 - DNA, 15 bp, Homo sapiens
attacagtggattct

SEQ ID NO: 269893 - DNA, 15 bp, Homo sapiens
cattacagtggattc

SEQ ID NO: 269894 - DNA, 15 bp, Homo sapiens
ccattacagtggatt

SEQ ID NO: 269895 - DNA, 15 bp, Homo sapiens
tccattacagtggat

SEQ ID NO: 269896 - DNA, 15 bp, Homo sapiens
ctccattacagtgga

SEQ ID NO: 269897 - DNA, 15 bp, Homo sapiens
tctccattacagtgg

SEQ ID NO: 269898 - DNA, 15 bp, Homo sapiens
ttctccattacagtg

SEQ ID NO: 269899 - DNA, 15 bp, Homo sapiens
tttctccattacagt

SEQ ID NO: 269900 - DNA, 15 bp, Homo sapiens
ctttctccattacag

SEQ ID NO: 269901 - DNA, 15 bp, Homo sapiens
tctttctccattaca

SEQ ID NO: 269902 - DNA, 15 bp, Homo sapiens
ttctttctccattac

SEQ ID NO: 269903 - DNA, 15 bp, Homo sapiens
tttctttctccatta

SEQ ID NO: 269904 - DNA, 15 bp, Homo sapiens
ctttctttctccatt

SEQ ID NO: 269905 - DNA, 15 bp, Homo sapiens
cctttctttctccat

SEQ ID NO: 269906 - DNA, 15 bp, Homo sapiens
acctttctttctcca

SEQ ID NO: 269907 - DNA, 15 bp, Homo sapiens
tacctttctttctcc

SEQ ID NO: 269908 - DNA, 15 bp, Homo sapiens
ctacctttctttctc

SEQ ID NO: 269909 - DNA, 15 bp, Homo sapiens
tctacctttctttct

SEQ ID NO: 269910 - DNA, 15 bp, Homo sapiens
atctacctttctttc

SEQ ID NO: 269911 - DNA, 15 bp, Homo sapiens
tatctacctttcttt

SEQ ID NO: 269912 - DNA, 15 bp, Homo sapiens
ctatctacctttctt

SEQ ID NO: 269913 - DNA, 15 bp, Homo sapiens
tctatctacctttct

SEQ ID NO: 269914 - DNA, 15 bp, Homo sapiens
atctatctacctttc

SEQ ID NO: 269915 - DNA, 15 bp, Homo sapiens
tatctatctaccttt

SEQ ID NO: 269916 - DNA, 15 bp, Homo sapiens
ctatctatctacctt

SEQ ID NO: 269917 - DNA, 15 bp, Homo sapiens
cctatctatctacct

SEQ ID NO: 269918 - DNA, 15 bp, Homo sapiens
gcctatctatctacc

SEQ ID NO: 269919 - DNA, 15 bp, Homo sapiens
agcctatctatctac

SEQ ID NO: 269920 - DNA, 15 bp, Homo sapiens
cagcctatctatcta

SEQ ID NO: 269921 - DNA, 15 bp, Homo sapiens
acagcctatctatct

SEQ ID NO: 269922 - DNA, 15 bp, Homo sapiens
tacagcctatctatc

SEQ ID NO: 269923 - DNA, 15 bp, Homo sapiens
atacagcctatctat

SEQ ID NO: 269924 - DNA, 15 bp, Homo sapiens
catacagcctatcta

SEQ ID NO: 269925 - DNA, 15 bp, Homo sapiens
gcatacagcctatct

SEQ ID NO: 269926 - DNA, 15 bp, Homo sapiens
tgcatacagcctatc

SEQ ID NO: 269927 - DNA, 15 bp, Homo sapiens
atgcatacagcctat

SEQ ID NO: 269928 - DNA, 15 bp, Homo sapiens
tatgcatacagccta

SEQ ID NO: 269929 - DNA, 15 bp, Homo sapiens
atatgcatacagcct

SEQ ID NO: 269930 - DNA, 15 bp, Homo sapiens
tatatgcatacagcc

SEQ ID NO: 269931 - DNA, 15 bp, Homo sapiens
ctatatgcatacagc

SEQ ID NO: 269932 - DNA, 15 bp, Homo sapiens
actatatgcatacag

SEQ ID NO: 269933 - DNA, 15 bp, Homo sapiens
cactatatgcataca

SEQ ID NO: 269934 - DNA, 15 bp, Homo sapiens
tcactatatgcatac

SEQ ID NO: 269935 - DNA, 15 bp, Homo sapiens
ctcactatatgcata

SEQ ID NO: 269936 - DNA, 15 bp, Homo sapiens
cctcactatatgcat

SEQ ID NO: 269937 - DNA, 15 bp, Homo sapiens
acctcactatatgca

SEQ ID NO: 269938 - DNA, 15 bp, Homo sapiens
tacctcactatatgc

SEQ ID NO: 269939 - DNA, 15 bp, Homo sapiens
gtacctcactatatg

SEQ ID NO: 269940 - DNA, 15 bp, Homo sapiens
tgtacctcactatat

SEQ ID NO: 269941 - DNA, 15 bp, Homo sapiens
ctgtacctcactata

SEQ ID NO: 269942 - DNA, 15 bp, Homo sapiens
actgtacctcactat

SEQ ID NO: 269943 - DNA, 15 bp, Homo sapiens
tactgtacctcacta

SEQ ID NO: 269944 - DNA, 15 bp, Homo sapiens
ttactgtacctcact

SEQ ID NO: 269945 - DNA, 15 bp, Homo sapiens
gttactgtacctcac

SEQ ID NO: 269946 - DNA, 15 bp, Homo sapiens
ggttactgtacctca

SEQ ID NO: 269947 - DNA, 15 bp, Homo sapiens
gggttactgtacctc

SEQ ID NO: 269948 - DNA, 15 bp, Homo sapiens
ggggttactgtacct

SEQ ID NO: 269949 - DNA, 15 bp, Homo sapiens
tggggttactgtacc

SEQ ID NO: 269950 - DNA, 15 bp, Homo sapiens
atggggttactgtac

SEQ ID NO: 269951 - DNA, 15 bp, Homo sapiens
gatggggttactgta

SEQ ID NO: 269952 - DNA, 15 bp, Homo sapiens
ggatggggttactgt

SEQ ID NO: 269953 - DNA, 15 bp, Homo sapiens
tggatggggttactg

SEQ ID NO: 269954 - DNA, 15 bp, Homo sapiens
atggatggggttact

SEQ ID NO: 269955 - DNA, 15 bp, Homo sapiens
catggatggggttac

SEQ ID NO: 269956 - DNA, 15 bp, Homo sapiens
ccatggatggggtta

SEQ ID NO: 269957 - DNA, 15 bp, Homo sapiens
tccatggatggggtt

SEQ ID NO: 269958 - DNA, 15 bp, Homo sapiens
ctccatggatggggt

SEQ ID NO: 269959 - DNA, 15 bp, Homo sapiens
tctccatggatgggg

SEQ ID NO: 269960 - DNA, 15 bp, Homo sapiens
ctctccatggatggg

SEQ ID NO: 269961 - DNA, 15 bp, Homo sapiens
tctctccatggatgg

SEQ ID NO: 269962 - DNA, 15 bp, Homo sapiens
ttctctccatggatg

SEQ ID NO: 269963 - DNA, 15 bp, Homo sapiens
tttctctccatggat

SEQ ID NO: 269964 - DNA, 15 bp, Homo sapiens
ttttctctccatgga

SEQ ID NO: 269965 - DNA, 15 bp, Homo sapiens
attttctctccatgg

SEQ ID NO: 269966 - DNA, 15 bp, Homo sapiens
cattttctctccatg

SEQ ID NO: 269967 - DNA, 15 bp, Homo sapiens
acattttctctccat

SEQ ID NO: 269968 - DNA, 15 bp, Homo sapiens
cacattttctctcca

SEQ ID NO: 269969 - DNA, 15 bp, Homo sapiens
tcacattttctctcc

SEQ ID NO: 269970 - DNA, 15 bp, Homo sapiens
ttcacattttctctc

SEQ ID NO: 269971 - DNA, 15 bp, Homo sapiens
tttcacattttctct

SEQ ID NO: 269972 - DNA, 15 bp, Homo sapiens
atttcacattttctc

SEQ ID NO: 269973 - DNA, 15 bp, Homo sapiens
tatttcacattttct

SEQ ID NO: 269974 - DNA, 15 bp, Homo sapiens
ctatttcacattttc

SEQ ID NO: 269975 - DNA, 15 bp, Homo sapiens
tctatttcacatttt

SEQ ID NO: 269976 - DNA, 15 bp, Homo sapiens
ctctatttcacattt

SEQ ID NO: 269977 - DNA, 15 bp, Homo sapiens
gctctatttcacatt

SEQ ID NO: 269978 - DNA, 15 bp, Homo sapiens
tgctctatttcacat

SEQ ID NO: 269979 - DNA, 15 bp, Homo sapiens
ttgctctatttcaca

SEQ ID NO: 269980 - DNA, 15 bp, Homo sapiens
cttgctctatttcac

SEQ ID NO: 269981 - DNA, 15 bp, Homo sapiens
ccttgctctatttca

SEQ ID NO: 269982 - DNA, 15 bp, Homo sapiens
accttgctctatttc

SEQ ID NO: 269983 - DNA, 15 bp, Homo sapiens
taccttgctctattt

SEQ ID NO: 269984 - DNA, 15 bp, Homo sapiens
ttaccttgctctatt

SEQ ID NO: 269985 - DNA, 15 bp, Homo sapiens
attaccttgctctat

SEQ ID NO: 269986 - DNA, 15 bp, Homo sapiens
cattaccttgctcta

SEQ ID NO: 269987 - DNA, 15 bp, Homo sapiens
ccattaccttgctct

SEQ ID NO: 269988 - DNA, 15 bp, Homo sapiens
tccattaccttgctc

SEQ ID NO: 269989 - DNA, 15 bp, Homo sapiens
ctccattaccttgct

SEQ ID NO: 269990 - DNA, 15 bp, Homo sapiens
cctccattaccttgc

SEQ ID NO: 269991 - DNA, 15 bp, Homo sapiens
tcctccattaccttg

SEQ ID NO: 269992 - DNA, 15 bp, Homo sapiens
ttcctccattacctt

SEQ ID NO: 269993 - DNA, 15 bp, Homo sapiens
tttcctccattacct

SEQ ID NO: 269994 - DNA, 15 bp, Homo sapiens
atttcctccattacc

SEQ ID NO: 269995 - DNA, 15 bp, Homo sapiens
tatttcctccattac

SEQ ID NO: 269996 - DNA, 15 bp, Homo sapiens
ctatttcctccatta

SEQ ID NO: 269997 - DNA, 15 bp, Homo sapiens
actatttcctccatt

SEQ ID NO: 269998 - DNA, 15 bp, Homo sapiens
tactatttcctccat

SEQ ID NO: 269999 - DNA, 15 bp, Homo sapiens
ttactatttcctcca

SEQ ID NO: 270000 - DNA, 15 bp, Homo sapiens
tttactatttcctcc

SEQ ID NO: 270001 - DNA, 15 bp, Homo sapiens
ttttactatttcctc

SEQ ID NO: 270002 - DNA, 15 bp, Homo sapiens
cttttactatttcct

SEQ ID NO: 270003 - DNA, 15 bp, Homo sapiens
ccttttactatttcc

SEQ ID NO: 270004 - DNA, 15 bp, Homo sapiens
tccttttactatttc

SEQ ID NO: 270005 - DNA, 15 bp, Homo sapiens
ttccttttactattt

SEQ ID NO: 270006 - DNA, 15 bp, Homo sapiens
tttccttttactatt

SEQ ID NO: 270007 - DNA, 15 bp, Homo sapiens
ctttccttttactat

SEQ ID NO: 270008 - DNA, 15 bp, Homo sapiens
tctttccttttacta

SEQ ID NO: 270009 - DNA, 15 bp, Homo sapiens
ttctttccttttact

SEQ ID NO: 270010 - DNA, 15 bp, Homo sapiens
cttctttccttttac

SEQ ID NO: 270011 - DNA, 15 bp, Homo sapiens
ccttctttcctttta

SEQ ID NO: 270012 - DNA, 15 bp, Homo sapiens
tccttctttcctttt

SEQ ID NO: 270013 - DNA, 15 bp, Homo sapiens
ctccttctttccttt

SEQ ID NO: 270014 - DNA, 15 bp, Homo sapiens
cctccttctttcctt

SEQ ID NO: 270015 - DNA, 15 bp, Homo sapiens
tcctccttctttcct

SEQ ID NO: 270016 - DNA, 15 bp, Homo sapiens
ttcctccttctttcc

SEQ ID NO: 270017 - DNA, 15 bp, Homo sapiens
tttcctccttctttc

SEQ ID NO: 270018 - DNA, 15 bp, Homo sapiens
atttcctccttcttt

SEQ ID NO: 270019 - DNA, 15 bp, Homo sapiens
tatttcctccttctt

SEQ ID NO: 270020 - DNA, 15 bp, Homo sapiens
ttatttcctccttct

SEQ ID NO: 270021 - DNA, 15 bp, Homo sapiens
cttatttcctccttc

SEQ ID NO: 270022 - DNA, 15 bp, Homo sapiens
gcttatttcctcctt

SEQ ID NO: 270023 - DNA, 15 bp, Homo sapiens
tgcttatttcctcct

SEQ ID NO: 270024 - DNA, 15 bp, Homo sapiens
ttgcttatttcctcc

SEQ ID NO: 270025 - DNA, 15 bp, Homo sapiens
cttgcttatttcctc

SEQ ID NO: 270026 - DNA, 15 bp, Homo sapiens
ccttgcttatttcct

SEQ ID NO: 270027 - DNA, 15 bp, Homo sapiens
tccttgcttatttcc

SEQ ID NO: 270028 - DNA, 15 bp, Homo sapiens
ttccttgcttatttc

SEQ ID NO: 270029 - DNA, 15 bp, Homo sapiens
tttccttgcttattt

SEQ ID NO: 270030 - DNA, 15 bp, Homo sapiens
ctttccttgcttatt

SEQ ID NO: 270031 - DNA, 15 bp, Homo sapiens
cctttccttgcttat

SEQ ID NO: 270032 - DNA, 15 bp, Homo sapiens
acctttccttgctta

SEQ ID NO: 270033 - DNA, 15 bp, Homo sapiens
aacctttccttgctt

SEQ ID NO: 270034 - DNA, 15 bp, Homo sapiens
taacctttccttgct

SEQ ID NO: 270035 - DNA, 15 bp, Homo sapiens
ctaacctttccttgc

SEQ ID NO: 270036 - DNA, 15 bp, Homo sapiens
gctaacctttccttg

SEQ ID NO: 270037 - DNA, 15 bp, Homo sapiens
ggctaacctttcctt

SEQ ID NO: 270038 - DNA, 15 bp, Homo sapiens
tggctaacctttcct

SEQ ID NO: 270039 - DNA, 15 bp, Homo sapiens
ctggctaacctttcc

SEQ ID NO: 270040 - DNA, 15 bp, Homo sapiens
cctggctaacctttc

SEQ ID NO: 270041 - DNA, 15 bp, Homo sapiens
tcctggctaaccttt

SEQ ID NO: 270042 - DNA, 15 bp, Homo sapiens
atcctggctaacctt

SEQ ID NO: 270043 - DNA, 15 bp, Homo sapiens
tatcctggctaacct

SEQ ID NO: 270044 - DNA, 15 bp, Homo sapiens
ctatcctggctaacc

SEQ ID NO: 270045 - DNA, 15 bp, Homo sapiens
tctatcctggctaac

SEQ ID NO: 270046 - DNA, 15 bp, Homo sapiens
ttctatcctggctaa

SEQ ID NO: 270047 - DNA, 15 bp, Homo sapiens
tttctatcctggcta

SEQ ID NO: 270048 - DNA, 15 bp, Homo sapiens
ctttctatcctggct

SEQ ID NO: 270049 - DNA, 15 bp, Homo sapiens
cctttctatcctggc

SEQ ID NO: 270050 - DNA, 15 bp, Homo sapiens
acctttctatcctgg

SEQ ID NO: 270051 - DNA, 15 bp, Homo sapiens
tacctttctatcctg

SEQ ID NO: 270052 - DNA, 15 bp, Homo sapiens
ctacctttctatcct

SEQ ID NO: 270053 - DNA, 15 bp, Homo sapiens
actacctttctatcc

SEQ ID NO: 270054 - DNA, 15 bp, Homo sapiens
aactacctttctatc

SEQ ID NO: 270055 - DNA, 15 bp, Homo sapiens
aaactacctttctat

SEQ ID NO: 270056 - DNA, 15 bp, Homo sapiens
caaactacctttcta

SEQ ID NO: 270057 - DNA, 15 bp, Homo sapiens
tcaaactacctttct

SEQ ID NO: 270058 - DNA, 15 bp, Homo sapiens
ctcaaactacctttc

SEQ ID NO: 270059 - DNA, 15 bp, Homo sapiens
tctcaaactaccttt

SEQ ID NO: 270060 - DNA, 15 bp, Homo sapiens
ctctcaaactacctt

SEQ ID NO: 270061 - DNA, 15 bp, Homo sapiens
tctctcaaactacct

SEQ ID NO: 270062 - DNA, 15 bp, Homo sapiens
gtctctcaaactacc

SEQ ID NO: 270063 - DNA, 15 bp, Homo sapiens
tgtctctcaaactac

SEQ ID NO: 270064 - DNA, 15 bp, Homo sapiens
atgtctctcaaacta

SEQ ID NO: 270065 - DNA, 15 bp, Homo sapiens
catgtctctcaaact

SEQ ID NO: 270066 - DNA, 15 bp, Homo sapiens
acatgtctctcaaac

SEQ ID NO: 270067 - DNA, 15 bp, Homo sapiens
aacatgtctctcaaa

SEQ ID NO: 270068 - DNA, 15 bp, Homo sapiens
taacatgtctctcaa

SEQ ID NO: 270069 - DNA, 15 bp, Homo sapiens
ctaacatgtctctca

SEQ ID NO: 270070 - DNA, 15 bp, Homo sapiens
gctaacatgtctctc

SEQ ID NO: 270071 - DNA, 15 bp, Homo sapiens
agctaacatgtctct

SEQ ID NO: 270072 - DNA, 15 bp, Homo sapiens
cagctaacatgtctc

SEQ ID NO: 270073 - DNA, 15 bp, Homo sapiens
tcagctaacatgtct

SEQ ID NO: 270074 - DNA, 15 bp, Homo sapiens
ctcagctaacatgtc

SEQ ID NO: 270075 - DNA, 15 bp, Homo sapiens
cctcagctaacatgt

SEQ ID NO: 270076 - DNA, 15 bp, Homo sapiens
ccctcagctaacatg

SEQ ID NO: 270077 - DNA, 15 bp, Homo sapiens
tccctcagctaacat

SEQ ID NO: 270078 - DNA, 15 bp, Homo sapiens
ctccctcagctaaca

SEQ ID NO: 270079 - DNA, 15 bp, Homo sapiens
tctccctcagctaac

SEQ ID NO: 270080 - DNA, 15 bp, Homo sapiens
ttctccctcagctaa

SEQ ID NO: 270081 - DNA, 15 bp, Homo sapiens
cttctccctcagcta

SEQ ID NO: 270082 - DNA, 15 bp, Homo sapiens
tcttctccctcagct

SEQ ID NO: 270083 - DNA, 15 bp, Homo sapiens
ctcttctccctcagc

SEQ ID NO: 270084 - DNA, 15 bp, Homo sapiens
tctcttctccctcag

SEQ ID NO: 270085 - DNA, 15 bp, Homo sapiens
gtctcttctccctca

SEQ ID NO: 270086 - DNA, 15 bp, Homo sapiens
tgtctcttctccctc

SEQ ID NO: 270087 - DNA, 15 bp, Homo sapiens
ctgtctcttctccct

SEQ ID NO: 270088 - DNA, 15 bp, Homo sapiens
cctgtctcttctccc

SEQ ID NO: 270089 - DNA, 15 bp, Homo sapiens
tcctgtctcttctcc

SEQ ID NO: 270090 - DNA, 15 bp, Homo sapiens
atcctgtctcttctc

SEQ ID NO: 270091 - DNA, 15 bp, Homo sapiens
tatcctgtctcttct

SEQ ID NO: 270092 - DNA, 15 bp, Homo sapiens
atatcctgtctcttc

SEQ ID NO: 270093 - DNA, 15 bp, Homo sapiens
aatatcctgtctctt

SEQ ID NO: 270094 - DNA, 15 bp, Homo sapiens
aaatatcctgtctct

SEQ ID NO: 270095 - DNA, 15 bp, Homo sapiens
caaatatcctgtctc

SEQ ID NO: 270096 - DNA, 15 bp, Homo sapiens
gcaaatatcctgtct

SEQ ID NO: 270097 - DNA, 15 bp, Homo sapiens
tgcaaatatcctgtc

SEQ ID NO: 270098 - DNA, 15 bp, Homo sapiens
ttgcaaatatcctgt

SEQ ID NO: 270099 - DNA, 15 bp, Homo sapiens
tttgcaaatatcctg

SEQ ID NO: 270100 - DNA, 15 bp, Homo sapiens
ttttgcaaatatcct

SEQ ID NO: 270101 - DNA, 15 bp, Homo sapiens
attttgcaaatatcc

SEQ ID NO: 270102 - DNA, 15 bp, Homo sapiens
aattttgcaaatatc

SEQ ID NO: 270103 - DNA, 15 bp, Homo sapiens
aaattttgcaaatat

SEQ ID NO: 270104 - DNA, 15 bp, Homo sapiens
aaaattttgcaaata

SEQ ID NO: 270105 - DNA, 15 bp, Homo sapiens
caaaattttgcaaat

SEQ ID NO: 270106 - DNA, 15 bp, Homo sapiens
acaaaattttgcaaa

SEQ ID NO: 270107 - DNA, 15 bp, Homo sapiens
tacaaaattttgcaa

SEQ ID NO: 270108 - DNA, 15 bp, Homo sapiens
ctacaaaattttgca

SEQ ID NO: 270109 - DNA, 15 bp, Homo sapiens
gctacaaaattttgc

SEQ ID NO: 270110 - DNA, 15 bp, Homo sapiens
agctacaaaattttg

SEQ ID NO: 270111 - DNA, 15 bp, Homo sapiens
aagctacaaaatttt

SEQ ID NO: 270112 - DNA, 15 bp, Homo sapiens
caagctacaaaattt

SEQ ID NO: 270113 - DNA, 15 bp, Homo sapiens
tcaagctacaaaatt

SEQ ID NO: 270114 - DNA, 15 bp, Homo sapiens
ttcaagctacaaaat

SEQ ID NO: 270115 - DNA, 15 bp, Homo sapiens
tttcaagctacaaaa

SEQ ID NO: 270116 - DNA, 15 bp, Homo sapiens
ctttcaagctacaaa

SEQ ID NO: 270117 - DNA, 15 bp, Homo sapiens
cctttcaagctacaa

SEQ ID NO: 270118 - DNA, 15 bp, Homo sapiens
acctttcaagctaca

SEQ ID NO: 270119 - DNA, 15 bp, Homo sapiens
gacctttcaagctac

SEQ ID NO: 270120 - DNA, 15 bp, Homo sapiens
tgacctttcaagcta

SEQ ID NO: 270121 - DNA, 15 bp, Homo sapiens
ttgacctttcaagct

SEQ ID NO: 270122 - DNA, 15 bp, Homo sapiens
gttgacctttcaagc

SEQ ID NO: 270123 - DNA, 15 bp, Homo sapiens
tgttgacctttcaag

SEQ ID NO: 270124 - DNA, 15 bp, Homo sapiens
ctgttgacctttcaa

SEQ ID NO: 270125 - DNA, 15 bp, Homo sapiens
gctgttgacctttca

SEQ ID NO: 270126 - DNA, 15 bp, Homo sapiens
tgctgttgacctttc

SEQ ID NO: 270127 - DNA, 15 bp, Homo sapiens
atgctgttgaccttt

SEQ ID NO: 270128 - DNA, 15 bp, Homo sapiens
gatgctgttgacctt

SEQ ID NO: 270129 - DNA, 15 bp, Homo sapiens
tgatgctgttgacct

SEQ ID NO: 270130 - DNA, 15 bp, Homo sapiens
ctgatgctgttgacc

SEQ ID NO: 270131 - DNA, 15 bp, Homo sapiens
gctgatgctgttgac

SEQ ID NO: 270132 - DNA, 15 bp, Homo sapiens
agctgatgctgttga

SEQ ID NO: 270133 - DNA, 15 bp, Homo sapiens
tagctgatgctgttg

SEQ ID NO: 270134 - DNA, 15 bp, Homo sapiens
gtagctgatgctgtt

SEQ ID NO: 270135 - DNA, 15 bp, Homo sapiens
agtagctgatgctgt

SEQ ID NO: 270136 - DNA, 15 bp, Homo sapiens
aagtagctgatgctg

SEQ ID NO: 270137 - DNA, 15 bp, Homo sapiens
gaagtagctgatgct

SEQ ID NO: 270138 - DNA, 15 bp, Homo sapiens
ggaagtagctgatgc

SEQ ID NO: 270139 - DNA, 15 bp, Homo sapiens
tggaagtagctgatg

SEQ ID NO: 270140 - DNA, 15 bp, Homo sapiens
ctggaagtagctgat

SEQ ID NO: 270141 - DNA, 15 bp, Homo sapiens
gctggaagtagctga

SEQ ID NO: 270142 - DNA, 15 bp, Homo sapiens
tgctggaagtagctg

SEQ ID NO: 270143 - DNA, 15 bp, Homo sapiens
atgctggaagtagct

SEQ ID NO: 270144 - DNA, 15 bp, Homo sapiens
aatgctggaagtagc

SEQ ID NO: 270145 - DNA, 15 bp, Homo sapiens
aaatgctggaagtag

SEQ ID NO: 270146 - DNA, 15 bp, Homo sapiens
gaaatgctggaagta

SEQ ID NO: 270147 - DNA, 15 bp, Homo sapiens
tgaaatgctggaagt

SEQ ID NO: 270148 - DNA, 15 bp, Homo sapiens
ttgaaatgctggaag

SEQ ID NO: 270149 - DNA, 15 bp, Homo sapiens
attgaaatgctggaa

SEQ ID NO: 270150 - DNA, 15 bp, Homo sapiens
aattgaaatgctgga

SEQ ID NO: 270151 - DNA, 15 bp, Homo sapiens
caattgaaatgctgg

SEQ ID NO: 270152 - DNA, 15 bp, Homo sapiens
gcaattgaaatgctg

SEQ ID NO: 270153 - DNA, 15 bp, Homo sapiens
tgcaattgaaatgct

SEQ ID NO: 270154 - DNA, 15 bp, Homo sapiens
ttgcaattgaaatgc

SEQ ID NO: 270155 - DNA, 15 bp, Homo sapiens
cttgcaattgaaatg

SEQ ID NO: 270156 - DNA, 15 bp, Homo sapiens
ccttgcaattgaaat

SEQ ID NO: 270157 - DNA, 15 bp, Homo sapiens
cccttgcaattgaaa

SEQ ID NO: 270158 - DNA, 15 bp, Homo sapiens
acccttgcaattgaa

SEQ ID NO: 270159 - DNA, 15 bp, Homo sapiens
tacccttgcaattga

SEQ ID NO: 270160 - DNA, 15 bp, Homo sapiens
ctacccttgcaattg

SEQ ID NO: 270161 - DNA, 15 bp, Homo sapiens
tctacccttgcaatt

SEQ ID NO: 270162 - DNA, 15 bp, Homo sapiens
atctacccttgcaat

SEQ ID NO: 270163 - DNA, 15 bp, Homo sapiens
aatctacccttgcaa

SEQ ID NO: 270164 - DNA, 15 bp, Homo sapiens
gaatctacccttgca

SEQ ID NO: 270165 - DNA, 15 bp, Homo sapiens
tgaatctacccttgc

SEQ ID NO: 270166 - DNA, 15 bp, Homo sapiens
atgaatctacccttg

SEQ ID NO: 270167 - DNA, 15 bp, Homo sapiens
aatgaatctaccctt

SEQ ID NO: 270168 - DNA, 15 bp, Homo sapiens
caatgaatctaccct

SEQ ID NO: 270169 - DNA, 15 bp, Homo sapiens
acaatgaatctaccc

SEQ ID NO: 270170 - DNA, 15 bp, Homo sapiens
gacaatgaatctacc

SEQ ID NO: 270171 - DNA, 15 bp, Homo sapiens
tgacaatgaatctac

SEQ ID NO: 270172 - DNA, 15 bp, Homo sapiens
ttgacaatgaatcta

SEQ ID NO: 270173 - DNA, 15 bp, Homo sapiens
attgacaatgaatct

SEQ ID NO: 270174 - DNA, 15 bp, Homo sapiens
cattgacaatgaatc

SEQ ID NO: 270175 - DNA, 15 bp, Homo sapiens
acattgacaatgaat

SEQ ID NO: 270176 - DNA, 15 bp, Homo sapiens
gacattgacaatgaa

SEQ ID NO: 270177 - DNA, 15 bp, Homo sapiens
tgacattgacaatga

SEQ ID NO: 270178 - DNA, 15 bp, Homo sapiens
atgacattgacaatg

SEQ ID NO: 270179 - DNA, 15 bp, Homo sapiens
tatgacattgacaat

SEQ ID NO: 270180 - DNA, 15 bp, Homo sapiens
ctatgacattgacaa

SEQ ID NO: 270181 - DNA, 15 bp, Homo sapiens
actatgacattgaca

SEQ ID NO: 270182 - DNA, 15 bp, Homo sapiens
aactatgacattgac

SEQ ID NO: 270183 - DNA, 15 bp, Homo sapiens
aaactatgacattga

SEQ ID NO: 270184 - DNA, 15 bp, Homo sapiens
taaactatgacattg

SEQ ID NO: 270185 - DNA, 15 bp, Homo sapiens
ctaaactatgacatt

SEQ ID NO: 270186 - DNA, 15 bp, Homo sapiens
actaaactatgacat

SEQ ID NO: 270187 - DNA, 15 bp, Homo sapiens
aactaaactatgaca

SEQ ID NO: 270188 - DNA, 15 bp, Homo sapiens
caactaaactatgac

SEQ ID NO: 270189 - DNA, 15 bp, Homo sapiens
gcaactaaactatga

SEQ ID NO: 270190 - DNA, 15 bp, Homo sapiens
agcaactaaactatg

SEQ ID NO: 270191 - DNA, 15 bp, Homo sapiens
cagcaactaaactat

SEQ ID NO: 270192 - DNA, 15 bp, Homo sapiens
tcagcaactaaacta

SEQ ID NO: 270193 - DNA, 15 bp, Homo sapiens
ctcagcaactaaact

SEQ ID NO: 270194 - DNA, 15 bp, Homo sapiens
gctcagcaactaaac

SEQ ID NO: 270195 - DNA, 15 bp, Homo sapiens
agctcagcaactaaa

SEQ ID NO: 270196 - DNA, 15 bp, Homo sapiens
aagctcagcaactaa

SEQ ID NO: 270197 - DNA, 15 bp, Homo sapiens
aaagctcagcaacta

SEQ ID NO: 270198 - DNA, 15 bp, Homo sapiens
taaagctcagcaact

SEQ ID NO: 270199 - DNA, 15 bp, Homo sapiens
gtaaagctcagcaac

SEQ ID NO: 270200 - DNA, 15 bp, Homo sapiens
tgtaaagctcagcaa

SEQ ID NO: 270201 - DNA, 15 bp, Homo sapiens
atgtaaagctcagca

SEQ ID NO: 270202 - DNA, 15 bp, Homo sapiens
tatgtaaagctcagc

SEQ ID NO: 270203 - DNA, 15 bp, Homo sapiens
ctatgtaaagctcag

SEQ ID NO: 270204 - DNA, 15 bp, Homo sapiens
cctatgtaaagctca

SEQ ID NO: 270205 - DNA, 15 bp, Homo sapiens
tcctatgtaaagctc

SEQ ID NO: 270206 - DNA, 15 bp, Homo sapiens
gtcctatgtaaagct

SEQ ID NO: 270207 - DNA, 15 bp, Homo sapiens
agtcctatgtaaagc

SEQ ID NO: 270208 - DNA, 15 bp, Homo sapiens
tagtcctatgtaaag

SEQ ID NO: 270209 - DNA, 15 bp, Homo sapiens
ctagtcctatgtaaa

SEQ ID NO: 270210 - DNA, 15 bp, Homo sapiens
actagtcctatgtaa

SEQ ID NO: 270211 - DNA, 15 bp, Homo sapiens
aactagtcctatgta

SEQ ID NO: 270212 - DNA, 15 bp, Homo sapiens
aaactagtcctatgt

SEQ ID NO: 270213 - DNA, 15 bp, Homo sapiens
caaactagtcctatg

SEQ ID NO: 270214 - DNA, 15 bp, Homo sapiens
acaaactagtcctat

SEQ ID NO: 270215 - DNA, 15 bp, Homo sapiens
tacaaactagtccta

SEQ ID NO: 270216 - DNA, 15 bp, Homo sapiens
gtacaaactagtcct

SEQ ID NO: 270217 - DNA, 15 bp, Homo sapiens
agtacaaactagtcc

SEQ ID NO: 270218 - DNA, 15 bp, Homo sapiens
cagtacaaactagtc

SEQ ID NO: 270219 - DNA, 15 bp, Homo sapiens
ccagtacaaactagt

SEQ ID NO: 270220 - DNA, 15 bp, Homo sapiens
accagtacaaactag

SEQ ID NO: 270221 - DNA, 15 bp, Homo sapiens
taccagtacaaacta

SEQ ID NO: 270222 - DNA, 15 bp, Homo sapiens
ttaccagtacaaact

SEQ ID NO: 270223 - DNA, 15 bp, Homo sapiens
gttaccagtacaaac

SEQ ID NO: 270224 - DNA, 15 bp, Homo sapiens
agttaccagtacaaa

SEQ ID NO: 270225 - DNA, 15 bp, Homo sapiens
aagttaccagtacaa

SEQ ID NO: 270226 - DNA, 15 bp, Homo sapiens
aaagttaccagtaca

SEQ ID NO: 270227 - DNA, 15 bp, Homo sapiens
caaagttaccagtac

SEQ ID NO: 270228 - DNA, 15 bp, Homo sapiens
tcaaagttaccagta

SEQ ID NO: 270229 - DNA, 15 bp, Homo sapiens
atcaaagttaccagt

SEQ ID NO: 270230 - DNA, 15 bp, Homo sapiens
catcaaagttaccag

SEQ ID NO: 270231 - DNA, 15 bp, Homo sapiens
tcatcaaagttacca

SEQ ID NO: 270232 - DNA, 15 bp, Homo sapiens
ctcatcaaagttacc

SEQ ID NO: 270233 - DNA, 15 bp, Homo sapiens
actcatcaaagttac

SEQ ID NO: 270234 - DNA, 15 bp, Homo sapiens
aactcatcaaagtta

SEQ ID NO: 270235 - DNA, 15 bp, Homo sapiens
aaactcatcaaagtt

SEQ ID NO: 270236 - DNA, 15 bp, Homo sapiens
taaactcatcaaagt

SEQ ID NO: 270237 - DNA, 15 bp, Homo sapiens
ctaaactcatcaaag

SEQ ID NO: 270238 - DNA, 15 bp, Homo sapiens
actaaactcatcaaa

SEQ ID NO: 270239 - DNA, 15 bp, Homo sapiens
cactaaactcatcaa

SEQ ID NO: 270240 - DNA, 15 bp, Homo sapiens
tcactaaactcatca

SEQ ID NO: 270241 - DNA, 15 bp, Homo sapiens
ctcactaaactcatc

SEQ ID NO: 270242 - DNA, 15 bp, Homo sapiens
tctcactaaactcat

SEQ ID NO: 270243 - DNA, 15 bp, Homo sapiens
ttctcactaaactca

SEQ ID NO: 270244 - DNA, 15 bp, Homo sapiens
cttctcactaaactc

SEQ ID NO: 270245 - DNA, 15 bp, Homo sapiens
tcttctcactaaact

SEQ ID NO: 270246 - DNA, 15 bp, Homo sapiens
ctcttctcactaaac

SEQ ID NO: 270247 - DNA, 15 bp, Homo sapiens
cctcttctcactaaa

SEQ ID NO: 270248 - DNA, 15 bp, Homo sapiens
gcctcttctcactaa

SEQ ID NO: 270249 - DNA, 15 bp, Homo sapiens
tgcctcttctcacta

SEQ ID NO: 270250 - DNA, 15 bp, Homo sapiens
ttgcctcttctcact

SEQ ID NO: 270251 - DNA, 15 bp, Homo sapiens
gttgcctcttctcac

SEQ ID NO: 270252 - DNA, 15 bp, Homo sapiens
tgttgcctcttctca

SEQ ID NO: 270253 - DNA, 15 bp, Homo sapiens
ttgttgcctcttctc

SEQ ID NO: 270254 - DNA, 15 bp, Homo sapiens
gttgttgcctcttct

SEQ ID NO: 270255 - DNA, 15 bp, Homo sapiens
tgttgttgcctcttc

SEQ ID NO: 270256 - DNA, 15 bp, Homo sapiens
ctgttgttgcctctt

SEQ ID NO: 270257 - DNA, 15 bp, Homo sapiens
cctgttgttgcctct

SEQ ID NO: 270258 - DNA, 15 bp, Homo sapiens
tcctgttgttgcctc

SEQ ID NO: 270259 - DNA, 15 bp, Homo sapiens
ttcctgttgttgcct

SEQ ID NO: 270260 - DNA, 15 bp, Homo sapiens
tttcctgttgttgcc

SEQ ID NO: 270261 - DNA, 15 bp, Homo sapiens
ttttcctgttgttgc

SEQ ID NO: 270262 - DNA, 15 bp, Homo sapiens
tttttcctgttgttg

SEQ ID NO: 270263 - DNA, 15 bp, Homo sapiens
ttttttcctgttgtt

SEQ ID NO: 270264 - DNA, 15 bp, Homo sapiens
tttttttcctgttgt

SEQ ID NO: 270265 - DNA, 15 bp, Homo sapiens
atttttttcctgttg

SEQ ID NO: 270266 - DNA, 15 bp, Homo sapiens
tatttttttcctgtt

SEQ ID NO: 270267 - DNA, 15 bp, Homo sapiens
gtatttttttcctgt

SEQ ID NO: 270268 - DNA, 15 bp, Homo sapiens
ggtatttttttcctg

SEQ ID NO: 270269 - DNA, 15 bp, Homo sapiens
aggtatttttttcct

SEQ ID NO: 270270 - DNA, 15 bp, Homo sapiens
gaggtatttttttcc

SEQ ID NO: 270271 - DNA, 15 bp, Homo sapiens
tgaggtatttttttc

SEQ ID NO: 270272 - DNA, 15 bp, Homo sapiens
ttgaggtattttttt

SEQ ID NO: 270273 - DNA, 15 bp, Homo sapiens
attgaggtatttttt

SEQ ID NO: 270274 - DNA, 15 bp, Homo sapiens
cattgaggtattttt

SEQ ID NO: 270275 - DNA, 15 bp, Homo sapiens
tcattgaggtatttt

SEQ ID NO: 270276 - DNA, 15 bp, Homo sapiens
ctcattgaggtattt

SEQ ID NO: 270277 - DNA, 15 bp, Homo sapiens
tctcattgaggtatt

SEQ ID NO: 270278 - DNA, 15 bp, Homo sapiens
ttctcattgaggtat

SEQ ID NO: 270279 - DNA, 15 bp, Homo sapiens
tttctcattgaggta

SEQ ID NO: 270280 - DNA, 15 bp, Homo sapiens
gtttctcattgaggt

SEQ ID NO: 270281 - DNA, 15 bp, Homo sapiens
tgtttctcattgagg

SEQ ID NO: 270282 - DNA, 15 bp, Homo sapiens
ctgtttctcattgag

SEQ ID NO: 270283 - DNA, 15 bp, Homo sapiens
agctgtttctcattg

SEQ ID NO: 270284 - DNA, 15 bp, Homo sapiens
aagctgtttctcatt

SEQ ID NO: 270285 - DNA, 15 bp, Homo sapiens
taagctgtttctcat

SEQ ID NO: 270286 - DNA, 15 bp, Homo sapiens
ataagctgtttctca

SEQ ID NO: 270287 - DNA, 15 bp, Homo sapiens
aataagctgtttctc

SEQ ID NO: 270288 - DNA, 15 bp, Homo sapiens
taataagctgtttct

SEQ ID NO: 270289 - DNA, 15 bp, Homo sapiens
ttaataagctgtttc

SEQ ID NO: 270290 - DNA, 15 bp, Homo sapiens
tttaataagctgttt

SEQ ID NO: 270291 - DNA, 15 bp, Homo sapiens
atttaataagctgtt

SEQ ID NO: 270292 - DNA, 15 bp, Homo sapiens
aatttaataagctgt

SEQ ID NO: 270293 - DNA, 15 bp, Homo sapiens
taatttaataagctg

SEQ ID NO: 270294 - DNA, 15 bp, Homo sapiens
ttaatttaataagct

SEQ ID NO: 270295 - DNA, 15 bp, Homo sapiens
attaatttaataagc

SEQ ID NO: 270296 - DNA, 15 bp, Homo sapiens
tattaatttaataag

SEQ ID NO: 270297 - DNA, 15 bp, Homo sapiens
gtattaatttaataa

SEQ ID NO: 270298 - DNA, 15 bp, Homo sapiens
ggtattaatttaata

SEQ ID NO: 270299 - DNA, 15 bp, Homo sapiens
tggtattaatttaat

SEQ ID NO: 270300 - DNA, 15 bp, Homo sapiens
gtggtattaatttaa

SEQ ID NO: 270301 - DNA, 15 bp, Homo sapiens
agtggtattaattta

SEQ ID NO: 270302 - DNA, 15 bp, Homo sapiens
gagtggtattaattt

SEQ ID NO: 270303 - DNA, 15 bp, Homo sapiens
tgagtggtattaatt

SEQ ID NO: 270304 - DNA, 15 bp, Homo sapiens
ttgagtggtattaat

SEQ ID NO: 270305 - DNA, 15 bp, Homo sapiens
tttgagtggtattaa

SEQ ID NO: 270306 - DNA, 15 bp, Homo sapiens
ttttgagtggtatta

SEQ ID NO: 270307 - DNA, 15 bp, Homo sapiens
gttttgagtggtatt

SEQ ID NO: 270308 - DNA, 15 bp, Homo sapiens
tgttttgagtggtat

SEQ ID NO: 270309 - DNA, 15 bp, Homo sapiens
ctgttttgagtggta

SEQ ID NO: 270310 - DNA, 15 bp, Homo sapiens
tctgttttgagtggt

SEQ ID NO: 270311 - DNA, 15 bp, Homo sapiens
atctgttttgagtgg

SEQ ID NO: 270312 - DNA, 15 bp, Homo sapiens
aatctgttttgagtg

SEQ ID NO: 270313 - DNA, 15 bp, Homo sapiens
aaatctgttttgagt

SEQ ID NO: 270314 - DNA, 15 bp, Homo sapiens
taaatctgttttgag

SEQ ID NO: 270315 - DNA, 15 bp, Homo sapiens
ataaatctgttttga

SEQ ID NO: 270316 - DNA, 15 bp, Homo sapiens
tataaatctgttttg

SEQ ID NO: 270317 - DNA, 15 bp, Homo sapiens
atataaatctgtttt

SEQ ID NO: 270318 - DNA, 15 bp, Homo sapiens
aatataaatctgttt

SEQ ID NO: 270319 - DNA, 15 bp, Homo sapiens
caatataaatctgtt

SEQ ID NO: 270320 - DNA, 15 bp, Homo sapiens
gcaatataaatctgt

SEQ ID NO: 270321 - DNA, 15 bp, Homo sapiens
tgcaatataaatctg

SEQ ID NO: 270322 - DNA, 15 bp, Homo sapiens
ctgcaatataaatct

SEQ ID NO: 270323 - DNA, 15 bp, Homo sapiens
cctgcaatataaatc

SEQ ID NO: 270324 - DNA, 15 bp, Homo sapiens
acctgcaatataaat

SEQ ID NO: 270325 - DNA, 15 bp, Homo sapiens
aacctgcaatataaa

SEQ ID NO: 270326 - DNA, 15 bp, Homo sapiens
aaacctgcaatataa

SEQ ID NO: 270327 - DNA, 15 bp, Homo sapiens
aaaacctgcaatata

SEQ ID NO: 270328 - DNA, 15 bp, Homo sapiens
taaaacctgcaatat

SEQ ID NO: 270329 - DNA, 15 bp, Homo sapiens
ttaaaacctgcaata

SEQ ID NO: 270330 - DNA, 15 bp, Homo sapiens
cttaaaacctgcaat

SEQ ID NO: 270331 - DNA, 15 bp, Homo sapiens
gcttaaaacctgcaa

SEQ ID NO: 270332 - DNA, 15 bp, Homo sapiens
tgcttaaaacctgca

SEQ ID NO: 270333 - DNA, 15 bp, Homo sapiens
ttgcttaaaacctgc

SEQ ID NO: 270334 - DNA, 15 bp, Homo sapiens
tttgcttaaaacctg

SEQ ID NO: 270335 - DNA, 15 bp, Homo sapiens
atttgcttaaaacct

SEQ ID NO: 270336 - DNA, 15 bp, Homo sapiens
tatttgcttaaaacc

SEQ ID NO: 270337 - DNA, 15 bp, Homo sapiens
gtatttgcttaaaac

SEQ ID NO: 270338 - DNA, 15 bp, Homo sapiens
tgtatttgcttaaaa

SEQ ID NO: 270339 - DNA, 15 bp, Homo sapiens
ctgtatttgcttaaa

SEQ ID NO: 270340 - DNA, 15 bp, Homo sapiens
actgtatttgcttaa

SEQ ID NO: 270341 - DNA, 15 bp, Homo sapiens
aactgtatttgctta

SEQ ID NO: 270342 - DNA, 15 bp, Homo sapiens
caactgtatttgctt

SEQ ID NO: 270343 - DNA, 15 bp, Homo sapiens
acaactgtatttgct

SEQ ID NO: 270344 - DNA, 15 bp, Homo sapiens
aacaactgtatttgc

SEQ ID NO: 270345 - DNA, 15 bp, Homo sapiens
aaacaactgtatttg

SEQ ID NO: 270346 - DNA, 15 bp, Homo sapiens
aaaacaactgtattt

SEQ ID NO: 270347 - DNA, 15 bp, Homo sapiens
taaaacaactgtatt

SEQ ID NO: 270348 - DNA, 15 bp, Homo sapiens
ttaaaacaactgtat

SEQ ID NO: 270349 - DNA, 15 bp, Homo sapiens
tttaaaacaactgta

SEQ ID NO: 270350 - DNA, 15 bp, Homo sapiens
ttttaaaacaactgt

SEQ ID NO: 270351 - DNA, 15 bp, Homo sapiens
cttttaaaacaactg

SEQ ID NO: 270352 - DNA, 15 bp, Homo sapiens
gcttttaaaacaact

SEQ ID NO: 270353 - DNA, 15 bp, Homo sapiens
tgcttttaaaacaac

SEQ ID NO: 270354 - DNA, 15 bp, Homo sapiens
ttgcttttaaaacaa

SEQ ID NO: 270355 - DNA, 15 bp, Homo sapiens
cttgcttttaaaaca

SEQ ID NO: 270356 - DNA, 15 bp, Homo sapiens
tcttgcttttaaaac

SEQ ID NO: 270357 - DNA, 15 bp, Homo sapiens
ctcttgcttttaaaa

SEQ ID NO: 270358 - DNA, 15 bp, Homo sapiens
cctcttgcttttaaa

SEQ ID NO: 270359 - DNA, 15 bp, Homo sapiens
acctcttgcttttaa

SEQ ID NO: 270360 - DNA, 15 bp, Homo sapiens
aacctcttgctttta

SEQ ID NO: 270361 - DNA, 15 bp, Homo sapiens
gaacctcttgctttt

SEQ ID NO: 270362 - DNA, 15 bp, Homo sapiens
tgaacctcttgcttt

SEQ ID NO: 270363 - DNA, 15 bp, Homo sapiens
ttgaacctcttgctt

SEQ ID NO: 270364 - DNA, 15 bp, Homo sapiens
gttgaacctcttgct

SEQ ID NO: 270365 - DNA, 15 bp, Homo sapiens
agttgaacctcttgc

SEQ ID NO: 270366 - DNA, 15 bp, Homo sapiens
cagttgaacctcttg

SEQ ID NO: 270367 - DNA, 15 bp, Homo sapiens
acagttgaacctctt

SEQ ID NO: 270368 - DNA, 15 bp, Homo sapiens
tacagttgaacctct

SEQ ID NO: 270369 - DNA, 15 bp, Homo sapiens
atacagttgaacctc

SEQ ID NO: 270370 - DNA, 15 bp, Homo sapiens
aatacagttgaacct

SEQ ID NO: 270371 - DNA, 15 bp, Homo sapiens
gaatacagttgaacc

SEQ ID NO: 270372 - DNA, 15 bp, Homo sapiens
agaatacagttgaac

SEQ ID NO: 270373 - DNA, 15 bp, Homo sapiens
aagaatacagttgaa

SEQ ID NO: 270374 - DNA, 15 bp, Homo sapiens
caagaatacagttga

SEQ ID NO: 270375 - DNA, 15 bp, Homo sapiens
acaagaatacagttg

SEQ ID NO: 270376 - DNA, 15 bp, Homo sapiens
aacaagaatacagtt

SEQ ID NO: 270377 - DNA, 15 bp, Homo sapiens
caacaagaatacagt

SEQ ID NO: 270378 - DNA, 15 bp, Homo sapiens
tcaacaagaatacag

SEQ ID NO: 270379 - DNA, 15 bp, Homo sapiens
atcaacaagaataca

SEQ ID NO: 270380 - DNA, 15 bp, Homo sapiens
tatcaacaagaatac

SEQ ID NO: 270381 - DNA, 15 bp, Homo sapiens
atatcaacaagaata

SEQ ID NO: 270382 - DNA, 15 bp, Homo sapiens
aatatcaacaagaat

SEQ ID NO: 270383 - DNA, 15 bp, Homo sapiens
caatatcaacaagaa

SEQ ID NO: 270384 - DNA, 15 bp, Homo sapiens
tcaatatcaacaaga

SEQ ID NO: 270385 - DNA, 15 bp, Homo sapiens
atcaatatcaacaag

SEQ ID NO: 270386 - DNA, 15 bp, Homo sapiens
aatcaatatcaacaa

SEQ ID NO: 270387 - DNA, 15 bp, Homo sapiens
taatcaatatcaaca

SEQ ID NO: 270388 - DNA, 15 bp, Homo sapiens
ttaatcaatatcaac

SEQ ID NO: 270389 - DNA, 15 bp, Homo sapiens
attaatcaatatcaa

SEQ ID NO: 270390 - DNA, 15 bp, Homo sapiens
tattaatcaatatca

SEQ ID NO: 270391 - DNA, 15 bp, Homo sapiens
atattaatcaatatc

SEQ ID NO: 270392 - DNA, 15 bp, Homo sapiens
catattaatcaatat

SEQ ID NO: 270393 - DNA, 15 bp, Homo sapiens
acatattaatcaata

SEQ ID NO: 270394 - DNA, 15 bp, Homo sapiens
tacatattaatcaat

SEQ ID NO: 270395 - DNA, 15 bp, Homo sapiens
ctacatattaatcaa

SEQ ID NO: 270396 - DNA, 15 bp, Homo sapiens
cctacatattaatca

SEQ ID NO: 270397 - DNA, 15 bp, Homo sapiens
ccctacatattaatc

SEQ ID NO: 270398 - DNA, 15 bp, Homo sapiens
tccctacatattaat

SEQ ID NO: 270399 - DNA, 15 bp, Homo sapiens
ttccctacatattaa

SEQ ID NO: 270400 - DNA, 15 bp, Homo sapiens
tttccctacatatta

SEQ ID NO: 270401 - DNA, 15 bp, Homo sapiens
atttccctacatatt

SEQ ID NO: 270402 - DNA, 15 bp, Homo sapiens
tatttccctacatat

SEQ ID NO: 270403 - DNA, 15 bp, Homo sapiens
ttatttccctacata

SEQ ID NO: 270404 - DNA, 15 bp, Homo sapiens
tttatttccctacat

SEQ ID NO: 270405 - DNA, 15 bp, Homo sapiens
gtttatttccctaca

SEQ ID NO: 270406 - DNA, 15 bp, Homo sapiens
ggtttatttccctac

SEQ ID NO: 270407 - DNA, 15 bp, Homo sapiens
tggtttatttcccta

SEQ ID NO: 270408 - DNA, 15 bp, Homo sapiens
ttggtttatttccct

SEQ ID NO: 270409 - DNA, 15 bp, Homo sapiens
tttggtttatttccc

SEQ ID NO: 270410 - DNA, 15 bp, Homo sapiens
ttttggtttatttcc

SEQ ID NO: 270411 - DNA, 15 bp, Homo sapiens
attttggtttatttc

SEQ ID NO: 270412 - DNA, 15 bp, Homo sapiens
gtaattttggtttat

SEQ ID NO: 270413 - DNA, 15 bp, Homo sapiens
tgtaattttggttta

SEQ ID NO: 270414 - DNA, 15 bp, Homo sapiens
atgtaattttggttt

SEQ ID NO: 270415 - DNA, 15 bp, Homo sapiens
catgtaattttggtt

SEQ ID NO: 270416 - DNA, 15 bp, Homo sapiens
acatgtaattttggt

SEQ ID NO: 270417 - DNA, 15 bp, Homo sapiens
aacatgtaattttgg

SEQ ID NO: 270418 - DNA, 15 bp, Homo sapiens
aaacatgtaattttg

SEQ ID NO: 270419 - DNA, 15 bp, Homo sapiens
aaaacatgtaatttt

SEQ ID NO: 270420 - DNA, 15 bp, Homo sapiens
gaaaacatgtaattt

SEQ ID NO: 270421 - DNA, 15 bp, Homo sapiens
ggaaaacatgtaatt

SEQ ID NO: 270422 - DNA, 15 bp, Homo sapiens
tggaaaacatgtaat

SEQ ID NO: 270423 - DNA, 15 bp, Homo sapiens
atggaaaacatgtaa

SEQ ID NO: 270424 - DNA, 15 bp, Homo sapiens
catggaaaacatgta

SEQ ID NO: 270425 - DNA, 15 bp, Homo sapiens
tcatggaaaacatgt

SEQ ID NO: 270426 - DNA, 15 bp, Homo sapiens
ctcatggaaaacatg

SEQ ID NO: 270427 - DNA, 15 bp, Homo sapiens
tctcatggaaaacat

SEQ ID NO: 270428 - DNA, 15 bp, Homo sapiens
ttctcatggaaaaca

SEQ ID NO: 270429 - DNA, 15 bp, Homo sapiens
cttctcatggaaaac

SEQ ID NO: 270430 - DNA, 15 bp, Homo sapiens
tcttctcatggaaaa

SEQ ID NO: 270431 - DNA, 15 bp, Homo sapiens
ttcttctcatggaaa

SEQ ID NO: 270432 - DNA, 15 bp, Homo sapiens
attcttctcatggaa

SEQ ID NO: 270433 - DNA, 15 bp, Homo sapiens
gattcttctcatgga

SEQ ID NO: 270434 - DNA, 15 bp, Homo sapiens
tgattcttctcatgg

SEQ ID NO: 270435 - DNA, 15 bp, Homo sapiens
atgattcttctcatg

SEQ ID NO: 270436 - DNA, 15 bp, Homo sapiens
tatgattcttctcat

SEQ ID NO: 270437 - DNA, 15 bp, Homo sapiens
atatgattcttctca

SEQ ID NO: 270438 - DNA, 15 bp, Homo sapiens
aatatgattcttctc

SEQ ID NO: 270439 - DNA, 15 bp, Homo sapiens
aaatatgattcttct

SEQ ID NO: 270440 - DNA, 15 bp, Homo sapiens
aaaatatgattcttc

SEQ ID NO: 270441 - DNA, 15 bp, Homo sapiens
gaaaatatgattctt

SEQ ID NO: 270442 - DNA, 15 bp, Homo sapiens
tgaaaatatgattct

SEQ ID NO: 270443 - DNA, 15 bp, Homo sapiens
ctgaaaatatgattc

SEQ ID NO: 270444 - DNA, 15 bp, Homo sapiens
actgaaaatatgatt

SEQ ID NO: 270445 - DNA, 15 bp, Homo sapiens
cactgaaaatatgat

SEQ ID NO: 270446 - DNA, 15 bp, Homo sapiens
tcactgaaaatatga

SEQ ID NO: 270447 - DNA, 15 bp, Homo sapiens
ctcactgaaaatatg

SEQ ID NO: 270448 - DNA, 15 bp, Homo sapiens
tctcactgaaaatat

SEQ ID NO: 270449 - DNA, 15 bp, Homo sapiens
ttctcactgaaaata

SEQ ID NO: 270450 - DNA, 15 bp, Homo sapiens
cttctcactgaaaat

SEQ ID NO: 270451 - DNA, 15 bp, Homo sapiens
tcttctcactgaaaa

SEQ ID NO: 270452 - DNA, 15 bp, Homo sapiens
ttcttctcactgaaa

SEQ ID NO: 270453 - DNA, 15 bp, Homo sapiens
attcttctcactgaa

SEQ ID NO: 270454 - DNA, 15 bp, Homo sapiens
aattcttctcactga

SEQ ID NO: 270455 - DNA, 15 bp, Homo sapiens
taattcttctcactg

SEQ ID NO: 270456 - DNA, 15 bp, Homo sapiens
gtaattcttctcact

SEQ ID NO: 270457 - DNA, 15 bp, Homo sapiens
tgtaattcttctcac

SEQ ID NO: 270458 - DNA, 15 bp, Homo sapiens
ttgtaattcttctca

SEQ ID NO: 270459 - DNA, 15 bp, Homo sapiens
attgtaattcttctc

SEQ ID NO: 270460 - DNA, 15 bp, Homo sapiens
aattgtaattcttct

SEQ ID NO: 270461 - DNA, 15 bp, Homo sapiens
aaattgtaattcttc

SEQ ID NO: 270462 - DNA, 15 bp, Homo sapiens
aaaattgtaattctt

SEQ ID NO: 270463 - DNA, 15 bp, Homo sapiens
gaaaattgtaattct

SEQ ID NO: 270464 - DNA, 15 bp, Homo sapiens
agaaaattgtaattc

SEQ ID NO: 270465 - DNA, 15 bp, Homo sapiens
tagaaaattgtaatt

SEQ ID NO: 270466 - DNA, 15 bp, Homo sapiens
ctagaaaattgtaat

SEQ ID NO: 270467 - DNA, 15 bp, Homo sapiens
actagaaaattgtaa

SEQ ID NO: 270468 - DNA, 15 bp, Homo sapiens
tactagaaaattgta

SEQ ID NO: 270469 - DNA, 15 bp, Homo sapiens
ttactagaaaattgt

SEQ ID NO: 270470 - DNA, 15 bp, Homo sapiens
tttactagaaaattg

SEQ ID NO: 270471 - DNA, 15 bp, Homo sapiens
ttttactagaaaatt

SEQ ID NO: 270472 - DNA, 15 bp, Homo sapiens
tttttactagaaaat

SEQ ID NO: 270473 - DNA, 15 bp, Homo sapiens
ttttttactagaaaa

SEQ ID NO: 270474 - DNA, 15 bp, Homo sapiens
attttttactagaaa

SEQ ID NO: 270475 - DNA, 15 bp, Homo sapiens
tattttttactagaa

SEQ ID NO: 270476 - DNA, 15 bp, Homo sapiens
atattttttactaga

SEQ ID NO: 270477 - DNA, 15 bp, Homo sapiens
gatattttttactag

SEQ ID NO: 270478 - DNA, 15 bp, Homo sapiens
cgatattttttacta

SEQ ID NO: 270479 - DNA, 15 bp, Homo sapiens
tcgatattttttact

SEQ ID NO: 270480 - DNA, 15 bp, Homo sapiens
ttcgatattttttac

SEQ ID NO: 270481 - DNA, 15 bp, Homo sapiens
attcgatatttttta

SEQ ID NO: 270482 - DNA, 15 bp, Homo sapiens
aattcgatatttttt

SEQ ID NO: 270483 - DNA, 15 bp, Homo sapiens
aaattcgatattttt

SEQ ID NO: 270484 - DNA, 15 bp, Homo sapiens
gaaattcgatatttt

SEQ ID NO: 270485 - DNA, 15 bp, Homo sapiens
agaaattcgatattt

SEQ ID NO: 270486 - DNA, 15 bp, Homo sapiens
cagaaattcgatatt

SEQ ID NO: 270487 - DNA, 15 bp, Homo sapiens
acagaaattcgatat

SEQ ID NO: 270488 - DNA, 15 bp, Homo sapiens
aacagaaattcgata

SEQ ID NO: 270489 - DNA, 15 bp, Homo sapiens
aaacagaaattcgat

SEQ ID NO: 270490 - DNA, 15 bp, Homo sapiens
aaaacagaaattcga

SEQ ID NO: 270491 - DNA, 15 bp, Homo sapiens
taaaacagaaattcg

SEQ ID NO: 270492 - DNA, 15 bp, Homo sapiens
ttaaaacagaaattc

SEQ ID NO: 270493 - DNA, 15 bp, Homo sapiens
tttaaaacagaaatt

SEQ ID NO: 270494 - DNA, 15 bp, Homo sapiens
ttttaaaacagaaat

SEQ ID NO: 270495 - DNA, 15 bp, Homo sapiens
cttttaaaacagaaa

SEQ ID NO: 270496 - DNA, 15 bp, Homo sapiens
tcttttaaaacagaa

SEQ ID NO: 270497 - DNA, 15 bp, Homo sapiens
atcttttaaaacaga

SEQ ID NO: 270498 - DNA, 15 bp, Homo sapiens
tatcttttaaaacag

SEQ ID NO: 270499 - DNA, 15 bp, Homo sapiens
tttatcttttaaaac

SEQ ID NO: 270500 - DNA, 15 bp, Homo sapiens
atttatcttttaaaa

SEQ ID NO: 270501 - DNA, 15 bp, Homo sapiens
aatttatcttttaaa

SEQ ID NO: 270502 - DNA, 15 bp, Homo sapiens
caatttatcttttaa

SEQ ID NO: 270503 - DNA, 15 bp, Homo sapiens
acaatttatctttta

SEQ ID NO: 270504 - DNA, 15 bp, Homo sapiens
cacaatttatctttt

SEQ ID NO: 270505 - DNA, 15 bp, Homo sapiens
gcacaatttatcttt

SEQ ID NO: 270506 - DNA, 15 bp, Homo sapiens
ggcacaatttatctt

SEQ ID NO: 270507 - DNA, 15 bp, Homo sapiens
aggcacaatttatct

SEQ ID NO: 270508 - DNA, 15 bp, Homo sapiens
aaggcacaatttatc

SEQ ID NO: 270509 - DNA, 15 bp, Homo sapiens
aaaggcacaatttat

SEQ ID NO: 270510 - DNA, 15 bp, Homo sapiens
aaaaggcacaattta

SEQ ID NO: 270511 - DNA, 15 bp, Homo sapiens
aaaaaggcacaattt

SEQ ID NO: 270512 - DNA, 15 bp, Homo sapiens
aaaaaaggcacaatt

SEQ ID NO: 270513 - DNA, 15 bp, Homo sapiens
aaaaaaaggcacaat

SEQ ID NO: 270514 - DNA, 15 bp, Homo sapiens
aaaaaaaaggcacaa

SEQ ID NO: 270515 - DNA, 15 bp, Homo sapiens
taaaaaaaaggcaca

SEQ ID NO: 270516 - DNA, 15 bp, Homo sapiens
ataaaaaaaaggcac

SEQ ID NO: 270517 - DNA, 15 bp, Homo sapiens
cataaaaaaaaggca

SEQ ID NO: 270518 - DNA, 15 bp, Homo sapiens
tcataaaaaaaaggc

SEQ ID NO: 270519 - DNA, 15 bp, Homo sapiens
ttcataaaaaaaagg

SEQ ID NO: 270520 - DNA, 15 bp, Homo sapiens
gttcataaaaaaaag

SEQ ID NO: 270521 - DNA, 15 bp, Homo sapiens
agttcataaaaaaaa

SEQ ID NO: 270522 - DNA, 15 bp, Homo sapiens
tagttcataaaaaaa

SEQ ID NO: 270523 - DNA, 15 bp, Homo sapiens
atagttcataaaaaa

SEQ ID NO: 270524 - DNA, 15 bp, Homo sapiens
tatagttcataaaaa

SEQ ID NO: 270525 - DNA, 15 bp, Homo sapiens
atatagttcataaaa

SEQ ID NO: 270526 - DNA, 15 bp, Homo sapiens
catatagttcataaa

SEQ ID NO: 270527 - DNA, 15 bp, Homo sapiens
gcatatagttcataa

SEQ ID NO: 270528 - DNA, 15 bp, Homo sapiens
ggcatatagttcata

SEQ ID NO: 270529 - DNA, 15 bp, Homo sapiens
tggcatatagttcat

SEQ ID NO: 270530 - DNA, 15 bp, Homo sapiens
atggcatatagttca

SEQ ID NO: 270531 - DNA, 15 bp, Homo sapiens
aatggcatatagttc

SEQ ID NO: 270532 - DNA, 15 bp, Homo sapiens
caatggcatatagtt

SEQ ID NO: 270533 - DNA, 15 bp, Homo sapiens
ccaatggcatatagt

SEQ ID NO: 270534 - DNA, 15 bp, Homo sapiens
gccaatggcatatag

SEQ ID NO: 270535 - DNA, 15 bp, Homo sapiens
tgccaatggcatata

SEQ ID NO: 270536 - DNA, 15 bp, Homo sapiens
ttgccaatggcatat

SEQ ID NO: 270537 - DNA, 15 bp, Homo sapiens
tttgccaatggcata

SEQ ID NO: 270538 - DNA, 15 bp, Homo sapiens
ttttgccaatggcat

SEQ ID NO: 270539 - DNA, 15 bp, Homo sapiens
tttttgccaatggca

SEQ ID NO: 270540 - DNA, 15 bp, Homo sapiens
atttttgccaatggc

SEQ ID NO: 270541 - DNA, 15 bp, Homo sapiens
tatttttgccaatgg

SEQ ID NO: 270542 - DNA, 15 bp, Homo sapiens
ttatttttgccaatg

SEQ ID NO: 270543 - DNA, 15 bp, Homo sapiens
tttatttttgccaat

SEQ ID NO: 270544 - DNA, 15 bp, Homo sapiens
ttttatttttgccaa

SEQ ID NO: 270545 - DNA, 15 bp, Homo sapiens
gttttatttttgcca

SEQ ID NO: 270546 - DNA, 15 bp, Homo sapiens
tgttttatttttgcc

SEQ ID NO: 270547 - DNA, 15 bp, Homo sapiens
gtgttttatttttgc

SEQ ID NO: 270548 - DNA, 15 bp, Homo sapiens
tgtgttttatttttg

SEQ ID NO: 270549 - DNA, 15 bp, Homo sapiens
gtgtgttttattttt

SEQ ID NO: 270550 - DNA, 15 bp, Homo sapiens
tgtgtgttttatttt

SEQ ID NO: 270551 - DNA, 15 bp, Homo sapiens
gtgtgtgttttattt

SEQ ID NO: 270552 - DNA, 15 bp, Homo sapiens
tgtgtgtgttttatt

SEQ ID NO: 270553 - DNA, 15 bp, Homo sapiens
gtgtgtgtgttttat

SEQ ID NO: 270554 - DNA, 15 bp, Homo sapiens
tgtgtgtgtgtttta

SEQ ID NO: 270555 - DNA, 15 bp, Homo sapiens
gtgtgtgtgtgtttt

SEQ ID NO: 270556 - DNA, 15 bp, Homo sapiens
gttttgtgtgtgtgt

SEQ ID NO: 270557 - DNA, 15 bp, Homo sapiens
tgttttgtgtgtgtg

SEQ ID NO: 270558 - DNA, 15 bp, Homo sapiens
gtgttttgtgtgtgt

SEQ ID NO: 270559 - DNA, 15 bp, Homo sapiens
ggtgttttgtgtgtg

SEQ ID NO: 270560 - DNA, 15 bp, Homo sapiens
gggtgttttgtgtgt

SEQ ID NO: 270561 - DNA, 15 bp, Homo sapiens
cgggtgttttgtgtg

SEQ ID NO: 270562 - DNA, 15 bp, Homo sapiens
tcgggtgttttgtgt

SEQ ID NO: 270563 - DNA, 15 bp, Homo sapiens
ttcgggtgttttgtg

SEQ ID NO: 270564 - DNA, 15 bp, Homo sapiens
tttcgggtgttttgt

SEQ ID NO: 270565 - DNA, 15 bp, Homo sapiens
ttttcgggtgttttg

SEQ ID NO: 270566 - DNA, 15 bp, Homo sapiens
cttttcgggtgtttt

SEQ ID NO: 270567 - DNA, 15 bp, Homo sapiens
tcttttcgggtgttt

SEQ ID NO: 270568 - DNA, 15 bp, Homo sapiens
ttcttttcgggtgtt

SEQ ID NO: 270569 - DNA, 15 bp, Homo sapiens
gttcttttcgggtgt

SEQ ID NO: 270570 - DNA, 15 bp, Homo sapiens
tgttcttttcgggtg

SEQ ID NO: 270571 - DNA, 15 bp, Homo sapiens
ttgttcttttcgggt

SEQ ID NO: 270572 - DNA, 15 bp, Homo sapiens
tttgttcttttcggg

SEQ ID NO: 270573 - DNA, 15 bp, Homo sapiens
ctttgttcttttcgg

SEQ ID NO: 270574 - DNA, 15 bp, Homo sapiens
tctttgttcttttcg

SEQ ID NO: 270575 - DNA, 15 bp, Homo sapiens
ttctttgttcttttc

SEQ ID NO: 270576 - DNA, 15 bp, Homo sapiens
tttctttgttctttt

SEQ ID NO: 270577 - DNA, 15 bp, Homo sapiens
ttttctttgttcttt

SEQ ID NO: 270578 - DNA, 15 bp, Homo sapiens
tttttctttgttctt

SEQ ID NO: 270579 - DNA, 15 bp, Homo sapiens
ttttttctttgttct

SEQ ID NO: 270580 - DNA, 15 bp, Homo sapiens
atttttttctttgtt

SEQ ID NO: 270581 - DNA, 15 bp, Homo sapiens
gatttttttctttgt

SEQ ID NO: 270582 - DNA, 15 bp, Homo sapiens
agatttttttctttg

SEQ ID NO: 270583 - DNA, 15 bp, Homo sapiens
tagatttttttcttt

SEQ ID NO: 270584 - DNA, 15 bp, Homo sapiens
ctagatttttttctt

SEQ ID NO: 270585 - DNA, 15 bp, Homo sapiens
tctagatttttttct

SEQ ID NO: 270586 - DNA, 15 bp, Homo sapiens
ttctagatttttttc

SEQ ID NO: 270587 - DNA, 15 bp, Homo sapiens
cttctagattttttt

SEQ ID NO: 270588 - DNA, 15 bp, Homo sapiens
gcttctagatttttt

SEQ ID NO: 270589 - DNA, 15 bp, Homo sapiens
tgcttctagattttt

SEQ ID NO: 270590 - DNA, 15 bp, Homo sapiens
ctgcttctagatttt

SEQ ID NO: 270591 - DNA, 15 bp, Homo sapiens
actgcttctagattt

SEQ ID NO: 270592 - DNA, 15 bp, Homo sapiens
aactgcttctagatt

SEQ ID NO: 270593 - DNA, 15 bp, Homo sapiens
caactgcttctagat

SEQ ID NO: 270594 - DNA, 15 bp, Homo sapiens
acaactgcttctaga

SEQ ID NO: 270595 - DNA, 15 bp, Homo sapiens
aacaactgcttctag

SEQ ID NO: 270596 - DNA, 15 bp, Homo sapiens
aaacaactgcttcta

SEQ ID NO: 270597 - DNA, 15 bp, Homo sapiens
aaaacaactgcttct

SEQ ID NO: 270598 - DNA, 15 bp, Homo sapiens
caaaacaactgcttc

SEQ ID NO: 270599 - DNA, 15 bp, Homo sapiens
tcaaaacaactgctt

SEQ ID NO: 270600 - DNA, 15 bp, Homo sapiens
atcaaaacaactgct

SEQ ID NO: 270601 - DNA, 15 bp, Homo sapiens
gatcaaaacaactgc

SEQ ID NO: 270602 - DNA, 15 bp, Homo sapiens
tgatcaaaacaactg

SEQ ID NO: 270603 - DNA, 15 bp, Homo sapiens
ttgatcaaaacaact

SEQ ID NO: 270604 - DNA, 15 bp, Homo sapiens
attgatcaaaacaac

SEQ ID NO: 270605 - DNA, 15 bp, Homo sapiens
gattgatcaaaacaa

SEQ ID NO: 270606 - DNA, 15 bp, Homo sapiens
ggattgatcaaaaca

SEQ ID NO: 270607 - DNA, 15 bp, Homo sapiens
aggattgatcaaaac

SEQ ID NO: 270608 - DNA, 15 bp, Homo sapiens
aaggattgatcaaaa

SEQ ID NO: 270609 - DNA, 15 bp, Homo sapiens
aaaggattgatcaaa

SEQ ID NO: 270610 - DNA, 15 bp, Homo sapiens
gaaaggattgatcaa

SEQ ID NO: 270611 - DNA, 15 bp, Homo sapiens
ggaaaggattgatca

SEQ ID NO: 270612 - DNA, 15 bp, Homo sapiens
tggaaaggattgatc

SEQ ID NO: 270613 - DNA, 15 bp, Homo sapiens
gtggaaaggattgat

SEQ ID NO: 270614 - DNA, 15 bp, Homo sapiens
ggtggaaaggattga

SEQ ID NO: 270615 - DNA, 15 bp, Homo sapiens
gggtggaaaggattg

SEQ ID NO: 270616 - DNA, 15 bp, Homo sapiens
ggggtggaaaggatt

SEQ ID NO: 270617 - DNA, 15 bp, Homo sapiens
aggggtggaaaggat

SEQ ID NO: 270618 - DNA, 15 bp, Homo sapiens
caggggtggaaagga

SEQ ID NO: 270619 - DNA, 15 bp, Homo sapiens
gcaggggtggaaagg

SEQ ID NO: 270620 - DNA, 15 bp, Homo sapiens
ggcaggggtggaaag

SEQ ID NO: 270621 - DNA, 15 bp, Homo sapiens
tggcaggggtggaaa

SEQ ID NO: 270622 - DNA, 15 bp, Homo sapiens
ctggcaggggtggaa

SEQ ID NO: 270623 - DNA, 15 bp, Homo sapiens
gctggcaggggtgga

SEQ ID NO: 270624 - DNA, 15 bp, Homo sapiens
tgctggcaggggtgg

SEQ ID NO: 270625 - DNA, 15 bp, Homo sapiens
atgctggcaggggtg

SEQ ID NO: 270626 - DNA, 15 bp, Homo sapiens
gatgctggcaggggt

SEQ ID NO: 270627 - DNA, 15 bp, Homo sapiens
tgatgctggcagggg

SEQ ID NO: 270628 - DNA, 15 bp, Homo sapiens
ttgatgctggcaggg

SEQ ID NO: 270629 - DNA, 15 bp, Homo sapiens
attgatgctggcagg

SEQ ID NO: 270630 - DNA, 15 bp, Homo sapiens
cattgatgctggcag

SEQ ID NO: 270631 - DNA, 15 bp, Homo sapiens
acattgatgctggca

SEQ ID NO: 270632 - DNA, 15 bp, Homo sapiens
tacattgatgctggc

SEQ ID NO: 270633 - DNA, 15 bp, Homo sapiens
gtacattgatgctgg

SEQ ID NO: 270634 - DNA, 15 bp, Homo sapiens
agtacattgatgctg

SEQ ID NO: 270635 - DNA, 15 bp, Homo sapiens
aagtacattgatgct

SEQ ID NO: 270636 - DNA, 15 bp, Homo sapiens
gaagtacattgatgc

SEQ ID NO: 270637 - DNA, 15 bp, Homo sapiens
cgaagtacattgatg

SEQ ID NO: 270638 - DNA, 15 bp, Homo sapiens
acgaagtacattgat

SEQ ID NO: 270639 - DNA, 15 bp, Homo sapiens
tacgaagtacattga

SEQ ID NO: 270640 - DNA, 15 bp, Homo sapiens
ttacgaagtacattg

SEQ ID NO: 270641 - DNA, 15 bp, Homo sapiens
cttacgaagtacatt

SEQ ID NO: 270642 - DNA, 15 bp, Homo sapiens
tcttacgaagtacat

SEQ ID NO: 270643 - DNA, 15 bp, Homo sapiens
gtcttacgaagtaca

SEQ ID NO: 270644 - DNA, 15 bp, Homo sapiens
agtcttacgaagtac

SEQ ID NO: 270645 - DNA, 15 bp, Homo sapiens
tagtcttacgaagta

SEQ ID NO: 270646 - DNA, 15 bp, Homo sapiens
atagtcttacgaagt

SEQ ID NO: 270647 - DNA, 15 bp, Homo sapiens
tatagtcttacgaag

SEQ ID NO: 270648 - DNA, 15 bp, Homo sapiens
ttatagtcttacgaa

SEQ ID NO: 270649 - DNA, 15 bp, Homo sapiens
tttatagtcttacga

SEQ ID NO: 270650 - DNA, 15 bp, Homo sapiens
ttttatagtcttacg

SEQ ID NO: 270651 - DNA, 15 bp, Homo sapiens
tttttatagtcttac

SEQ ID NO: 270652 - DNA, 15 bp, Homo sapiens
atttttatagtctta

SEQ ID NO: 270653 - DNA, 15 bp, Homo sapiens
gatttttatagtctt

SEQ ID NO: 270654 - DNA, 15 bp, Homo sapiens
tgatttttatagtct

SEQ ID NO: 270655 - DNA, 15 bp, Homo sapiens
ttgatttttatagtc

SEQ ID NO: 270656 - DNA, 15 bp, Homo sapiens
tttgatttttatagt

SEQ ID NO: 270657 - DNA, 15 bp, Homo sapiens
atttgatttttatag

SEQ ID NO: 270658 - DNA, 15 bp, Homo sapiens
tatttgatttttata

SEQ ID NO: 270659 - DNA, 15 bp, Homo sapiens
atatttgatttttat

SEQ ID NO: 270660 - DNA, 15 bp, Homo sapiens
aatatttgattttta

SEQ ID NO: 270661 - DNA, 15 bp, Homo sapiens
aaatatttgattttt

SEQ ID NO: 270662 - DNA, 15 bp, Homo sapiens
aaaatatttgatttt

SEQ ID NO: 270663 - DNA, 15 bp, Homo sapiens
taaaatatttgattt

SEQ ID NO: 270664 - DNA, 15 bp, Homo sapiens
ttaaaatatttgatt

SEQ ID NO: 270665 - DNA, 15 bp, Homo sapiens
tttaaaatatttgat

SEQ ID NO: 270666 - DNA, 15 bp, Homo sapiens
ttttaaaatatttga

SEQ ID NO: 270667 - DNA, 15 bp, Homo sapiens
tttttaaaatatttg

SEQ ID NO: 270668 - DNA, 15 bp, Homo sapiens
catttttaaaatatt

SEQ ID NO: 270669 - DNA, 15 bp, Homo sapiens
gcatttttaaaatat

SEQ ID NO: 270670 - DNA, 15 bp, Homo sapiens
agcatttttaaaata

SEQ ID NO: 270671 - DNA, 15 bp, Homo sapiens
cagcatttttaaaat

SEQ ID NO: 270672 - DNA, 15 bp, Homo sapiens
tcagcatttttaaaa

SEQ ID NO: 270673 - DNA, 15 bp, Homo sapiens
atcagcatttttaaa

SEQ ID NO: 270674 - DNA, 15 bp, Homo sapiens
aatcagcatttttaa

SEQ ID NO: 270675 - DNA, 15 bp, Homo sapiens
gaatcagcattttta

SEQ ID NO: 270676 - DNA, 15 bp, Homo sapiens
tgaatcagcattttt

SEQ ID NO: 270677 - DNA, 15 bp, Homo sapiens
atgaatcagcatttt

SEQ ID NO: 270678 - DNA, 15 bp, Homo sapiens
aatgaatcagcattt

SEQ ID NO: 270679 - DNA, 15 bp, Homo sapiens
gaatgaatcagcatt

SEQ ID NO: 270680 - DNA, 15 bp, Homo sapiens
agaatgaatcagcat

SEQ ID NO: 270681 - DNA, 15 bp, Homo sapiens
aagaatgaatcagca

SEQ ID NO: 270682 - DNA, 15 bp, Homo sapiens
aaagaatgaatcagc

SEQ ID NO: 270683 - DNA, 15 bp, Homo sapiens
caaagaatgaatcag

SEQ ID NO: 270684 - DNA, 15 bp, Homo sapiens
ccaaagaatgaatca

SEQ ID NO: 270685 - DNA, 15 bp, Homo sapiens
tccaaagaatgaatc

SEQ ID NO: 270686 - DNA, 15 bp, Homo sapiens
ttccaaagaatgaat

SEQ ID NO: 270687 - DNA, 15 bp, Homo sapiens
tttccaaagaatgaa

SEQ ID NO: 270688 - DNA, 15 bp, Homo sapiens
ctttccaaagaatga

SEQ ID NO: 270689 - DNA, 15 bp, Homo sapiens
gctttccaaagaatg

SEQ ID NO: 270690 - DNA, 15 bp, Homo sapiens
agctttccaaagaat

SEQ ID NO: 270691 - DNA, 15 bp, Homo sapiens
gagctttccaaagaa

SEQ ID NO: 270692 - DNA, 15 bp, Homo sapiens
agagctttccaaaga

SEQ ID NO: 270693 - DNA, 15 bp, Homo sapiens
tagagctttccaaag

SEQ ID NO: 270694 - DNA, 15 bp, Homo sapiens
gtagagctttccaaa

SEQ ID NO: 270695 - DNA, 15 bp, Homo sapiens
ggtagagctttccaa

SEQ ID NO: 270696 - DNA, 15 bp, Homo sapiens
aggtagagctttcca

SEQ ID NO: 270697 - DNA, 15 bp, Homo sapiens
aaggtagagctttcc

SEQ ID NO: 270698 - DNA, 15 bp, Homo sapiens
caaggtagagctttc

SEQ ID NO: 270699 - DNA, 15 bp, Homo sapiens
tcaaggtagagcttt

SEQ ID NO: 270700 - DNA, 15 bp, Homo sapiens
ctcaaggtagagctt

SEQ ID NO: 270701 - DNA, 15 bp, Homo sapiens
actcaaggtagagct

SEQ ID NO: 270702 - DNA, 15 bp, Homo sapiens
aactcaaggtagagc

SEQ ID NO: 270703 - DNA, 15 bp, Homo sapiens
taactcaaggtagag

SEQ ID NO: 270704 - DNA, 15 bp, Homo sapiens
ctaactcaaggtaga

SEQ ID NO: 270705 - DNA, 15 bp, Homo sapiens
cctaactcaaggtag

SEQ ID NO: 270706 - DNA, 15 bp, Homo sapiens
ccctaactcaaggta

SEQ ID NO: 270707 - DNA, 15 bp, Homo sapiens
accctaactcaaggt

SEQ ID NO: 270708 - DNA, 15 bp, Homo sapiens
taccctaactcaagg

SEQ ID NO: 270709 - DNA, 15 bp, Homo sapiens
ctaccctaactcaag

SEQ ID NO: 270710 - DNA, 15 bp, Homo sapiens
actaccctaactcaa

SEQ ID NO: 270711 - DNA, 15 bp, Homo sapiens
aactaccctaactca

SEQ ID NO: 270712 - DNA, 15 bp, Homo sapiens
aaactaccctaactc

SEQ ID NO: 270713 - DNA, 15 bp, Homo sapiens
caaactaccctaact

SEQ ID NO: 270714 - DNA, 15 bp, Homo sapiens
acaaactaccctaac

SEQ ID NO: 270715 - DNA, 15 bp, Homo sapiens
aacaaactaccctaa

SEQ ID NO: 270716 - DNA, 15 bp, Homo sapiens
aaacaaactacccta

SEQ ID NO: 270717 - DNA, 15 bp, Homo sapiens
aaaacaaactaccct

SEQ ID NO: 270718 - DNA, 15 bp, Homo sapiens
aaaaacaaactaccc

SEQ ID NO: 270719 - DNA, 15 bp, Homo sapiens
aaaaaacaaactacc

SEQ ID NO: 270720 - DNA, 15 bp, Homo sapiens
caaaaaacaaactac

SEQ ID NO: 270721 - DNA, 15 bp, Homo sapiens
ccaaaaaacaaacta

SEQ ID NO: 270722 - DNA, 15 bp, Homo sapiens
gccaaaaaacaaact

SEQ ID NO: 270723 - DNA, 15 bp, Homo sapiens
tgccaaaaaacaaac

SEQ ID NO: 270724 - DNA, 15 bp, Homo sapiens
ctgccaaaaaacaaa

SEQ ID NO: 270725 - DNA, 15 bp, Homo sapiens
actgccaaaaaacaa

SEQ ID NO: 270726 - DNA, 15 bp, Homo sapiens
gactgccaaaaaaca

SEQ ID NO: 270727 - DNA, 15 bp, Homo sapiens
agactgccaaaaaac

SEQ ID NO: 270728 - DNA, 15 bp, Homo sapiens
aagactgccaaaaaa

SEQ ID NO: 270729 - DNA, 15 bp, Homo sapiens
caagactgccaaaaa

SEQ ID NO: 270730 - DNA, 15 bp, Homo sapiens
acaagactgccaaaa

SEQ ID NO: 270731 - DNA, 15 bp, Homo sapiens
gacaagactgccaaa

SEQ ID NO: 270732 - DNA, 15 bp, Homo sapiens
agacaagactgccaa

SEQ ID NO: 270733 - DNA, 15 bp, Homo sapiens
gagacaagactgcca

SEQ ID NO: 270734 - DNA, 15 bp, Homo sapiens
agagacaagactgcc

SEQ ID NO: 270735 - DNA, 15 bp, Homo sapiens
aagagacaagactgc

SEQ ID NO: 270736 - DNA, 15 bp, Homo sapiens
gaagagacaagactg

SEQ ID NO: 270737 - DNA, 15 bp, Homo sapiens
tgaagagacaagact

SEQ ID NO: 270738 - DNA, 15 bp, Homo sapiens
ctgaagagacaagac

SEQ ID NO: 270739 - DNA, 15 bp, Homo sapiens
tctgaagagacaaga

SEQ ID NO: 270740 - DNA, 15 bp, Homo sapiens
atctgaagagacaag

SEQ ID NO: 270741 - DNA, 15 bp, Homo sapiens
catctgaagagacaa

SEQ ID NO: 270742 - DNA, 15 bp, Homo sapiens
acatctgaagagaca

SEQ ID NO: 270743 - DNA, 15 bp, Homo sapiens
cacatctgaagagac

SEQ ID NO: 270744 - DNA, 15 bp, Homo sapiens
tcacatctgaagaga

SEQ ID NO: 270745 - DNA, 15 bp, Homo sapiens
atcacatctgaagag

SEQ ID NO: 270746 - DNA, 15 bp, Homo sapiens
catcacatctgaaga

SEQ ID NO: 270747 - DNA, 15 bp, Homo sapiens
acatcacatctgaag

SEQ ID NO: 270748 - DNA, 15 bp, Homo sapiens
cacatcacatctgaa

SEQ ID NO: 270749 - DNA, 15 bp, Homo sapiens
ccacatcacatctga

SEQ ID NO: 270750 - DNA, 15 bp, Homo sapiens
cccacatcacatctg

SEQ ID NO: 270751 - DNA, 15 bp, Homo sapiens
ccccacatcacatct

SEQ ID NO: 270752 - DNA, 15 bp, Homo sapiens
accccacatcacatc

SEQ ID NO: 270753 - DNA, 15 bp, Homo sapiens
caccccacatcacat

SEQ ID NO: 270754 - DNA, 15 bp, Homo sapiens
acaccccacatcaca

SEQ ID NO: 270755 - DNA, 15 bp, Homo sapiens
aacaccccacatcac

SEQ ID NO: 270756 - DNA, 15 bp, Homo sapiens
aaacaccccacatca

SEQ ID NO: 270757 - DNA, 15 bp, Homo sapiens
caaacaccccacatc

SEQ ID NO: 270758 - DNA, 15 bp, Homo sapiens
gcaaacaccccacat

SEQ ID NO: 270759 - DNA, 15 bp, Homo sapiens
ggcaaacaccccaca

SEQ ID NO: 270760 - DNA, 15 bp, Homo sapiens
tggcaaacaccccac

SEQ ID NO: 270761 - DNA, 15 bp, Homo sapiens
ttggcaaacacccca

SEQ ID NO: 270762 - DNA, 15 bp, Homo sapiens
attggcaaacacccc

SEQ ID NO: 270763 - DNA, 15 bp, Homo sapiens
tattggcaaacaccc

SEQ ID NO: 270764 - DNA, 15 bp, Homo sapiens
atattggcaaacacc

SEQ ID NO: 270765 - DNA, 15 bp, Homo sapiens
tatattggcaaacac

SEQ ID NO: 270766 - DNA, 15 bp, Homo sapiens
gtatattggcaaaca

SEQ ID NO: 270767 - DNA, 15 bp, Homo sapiens
agtatattggcaaac

SEQ ID NO: 270768 - DNA, 15 bp, Homo sapiens
cagtatattggcaaa

SEQ ID NO: 270769 - DNA, 15 bp, Homo sapiens
tcagtatattggcaa

SEQ ID NO: 270770 - DNA, 15 bp, Homo sapiens
ttcagtatattggca

SEQ ID NO: 270771 - DNA, 15 bp, Homo sapiens
tttcagtatattggc

SEQ ID NO: 270772 - DNA, 15 bp, Homo sapiens
ttttcagtatattgg

SEQ ID NO: 270773 - DNA, 15 bp, Homo sapiens
gttttcagtatattg

SEQ ID NO: 270774 - DNA, 15 bp, Homo sapiens
cgttttcagtatatt

SEQ ID NO: 270775 - DNA, 15 bp, Homo sapiens
gcgttttcagtatat

SEQ ID NO: 270776 - DNA, 15 bp, Homo sapiens
tgcgttttcagtata

SEQ ID NO: 270777 - DNA, 15 bp, Homo sapiens
ctgcgttttcagtat

SEQ ID NO: 270778 - DNA, 15 bp, Homo sapiens
gctgcgttttcagta

SEQ ID NO: 270779 - DNA, 15 bp, Homo sapiens
tgctgcgttttcagt

SEQ ID NO: 270780 - DNA, 15 bp, Homo sapiens
atgctgcgttttcag

SEQ ID NO: 270781 - DNA, 15 bp, Homo sapiens
gatgctgcgttttca

SEQ ID NO: 270782 - DNA, 15 bp, Homo sapiens
cgtgatgctgcgttt

SEQ ID NO: 270783 - DNA, 15 bp, Homo sapiens
ccgtgatgctgcgtt

SEQ ID NO: 270784 - DNA, 15 bp, Homo sapiens
gccgtgatgctgcgt

SEQ ID NO: 270785 - DNA, 15 bp, Homo sapiens
agccgtgatgctgcg

SEQ ID NO: 270786 - DNA, 15 bp, Homo sapiens
cagccgtgatgctgc

SEQ ID NO: 270787 - DNA, 15 bp, Homo sapiens
acagccgtgatgctg

SEQ ID NO: 270788 - DNA, 15 bp, Homo sapiens
aacagccgtgatgct

SEQ ID NO: 270789 - DNA, 15 bp, Homo sapiens
aaacagccgtgatgc

SEQ ID NO: 270790 - DNA, 15 bp, Homo sapiens
gaaacagccgtgatg

SEQ ID NO: 270791 - DNA, 15 bp, Homo sapiens
agaaacagccgtgat

SEQ ID NO: 270792 - DNA, 15 bp, Homo sapiens
gagaaacagccgtga

SEQ ID NO: 270793 - DNA, 15 bp, Homo sapiens
agagaaacagccgtg

SEQ ID NO: 270794 - DNA, 15 bp, Homo sapiens
cagagaaacagccgt

SEQ ID NO: 270795 - DNA, 15 bp, Homo sapiens
tcagagaaacagccg

SEQ ID NO: 270796 - DNA, 15 bp, Homo sapiens
gtcagagaaacagcc

SEQ ID NO: 270797 - DNA, 15 bp, Homo sapiens
ggtcagagaaacagc

SEQ ID NO: 270798 - DNA, 15 bp, Homo sapiens
aggtcagagaaacag

SEQ ID NO: 270799 - DNA, 15 bp, Homo sapiens
gaggtcagagaaaca

SEQ ID NO: 270800 - DNA, 15 bp, Homo sapiens
tgaggtcagagaaac

SEQ ID NO: 270801 - DNA, 15 bp, Homo sapiens
ctgaggtcagagaaa

SEQ ID NO: 270802 - DNA, 15 bp, Homo sapiens
gctgaggtcagagaa

SEQ ID NO: 270803 - DNA, 15 bp, Homo sapiens
tgctgaggtcagaga

SEQ ID NO: 270804 - DNA, 15 bp, Homo sapiens
atgctgaggtcagag

SEQ ID NO: 270805 - DNA, 15 bp, Homo sapiens
gatgctgaggtcaga

SEQ ID NO: 270806 - DNA, 15 bp, Homo sapiens
ggatgctgaggtcag

SEQ ID NO: 270807 - DNA, 15 bp, Homo sapiens
aggatgctgaggtca

SEQ ID NO: 270808 - DNA, 15 bp, Homo sapiens
caggatgctgaggtc

SEQ ID NO: 270809 - DNA, 15 bp, Homo sapiens
tcaggatgctgaggt

SEQ ID NO: 270810 - DNA, 15 bp, Homo sapiens
ttcaggatgctgagg

SEQ ID NO: 270811 - DNA, 15 bp, Homo sapiens
cttcaggatgctgag

SEQ ID NO: 270812 - DNA, 15 bp, Homo sapiens
acttcaggatgctga

SEQ ID NO: 270813 - DNA, 15 bp, Homo sapiens
cacttcaggatgctg

SEQ ID NO: 270814 - DNA, 15 bp, Homo sapiens
ccacttcaggatgct

SEQ ID NO: 270815 - DNA, 15 bp, Homo sapiens
accacttcaggatgc

SEQ ID NO: 270816 - DNA, 15 bp, Homo sapiens
caccacttcaggatg

SEQ ID NO: 270817 - DNA, 15 bp, Homo sapiens
acaccacttcaggat

SEQ ID NO: 270818 - DNA, 15 bp, Homo sapiens
aacaccacttcagga

SEQ ID NO: 270819 - DNA, 15 bp, Homo sapiens
aaacaccacttcagg

SEQ ID NO: 270820 - DNA, 15 bp, Homo sapiens
gaaacaccacttcag

SEQ ID NO: 270821 - DNA, 15 bp, Homo sapiens
tgaaacaccacttca

SEQ ID NO: 270822 - DNA, 15 bp, Homo sapiens
ctgaaacaccacttc

SEQ ID NO: 270823 - DNA, 15 bp, Homo sapiens
gctgaaacaccactt

SEQ ID NO: 270824 - DNA, 15 bp, Homo sapiens
agctgaaacaccact

SEQ ID NO: 270825 - DNA, 15 bp, Homo sapiens
gagctgaaacaccac

SEQ ID NO: 270826 - DNA, 15 bp, Homo sapiens
ggagctgaaacacca

SEQ ID NO: 270827 - DNA, 15 bp, Homo sapiens
aggagctgaaacacc

SEQ ID NO: 270828 - DNA, 15 bp, Homo sapiens
caggagctgaaacac

SEQ ID NO: 270829 - DNA, 15 bp, Homo sapiens
gcaggagctgaaaca

SEQ ID NO: 270830 - DNA, 15 bp, Homo sapiens
agcaggagctgaaac

SEQ ID NO: 270831 - DNA, 15 bp, Homo sapiens
gagcaggagctgaaa

SEQ ID NO: 270832 - DNA, 15 bp, Homo sapiens
agagcaggagctgaa

SEQ ID NO: 270833 - DNA, 15 bp, Homo sapiens
gagagcaggagctga

SEQ ID NO: 270834 - DNA, 15 bp, Homo sapiens
ggagagcaggagctg

SEQ ID NO: 270835 - DNA, 15 bp, Homo sapiens
aggagagcaggagct

SEQ ID NO: 270836 - DNA, 15 bp, Homo sapiens
aaggagagcaggagc

SEQ ID NO: 270837 - DNA, 15 bp, Homo sapiens
taaggagagcaggag

SEQ ID NO: 270838 - DNA, 15 bp, Homo sapiens
gtaaggagagcagga

SEQ ID NO: 270839 - DNA, 15 bp, Homo sapiens
tgtaaggagagcagg

SEQ ID NO: 270840 - DNA, 15 bp, Homo sapiens
atgtaaggagagcag

SEQ ID NO: 270841 - DNA, 15 bp, Homo sapiens
gatgtaaggagagca

SEQ ID NO: 270842 - DNA, 15 bp, Homo sapiens
cgatgtaaggagagc

SEQ ID NO: 270843 - DNA, 15 bp, Homo sapiens
acgatgtaaggagag

SEQ ID NO: 270844 - DNA, 15 bp, Homo sapiens
aacgatgtaaggaga

SEQ ID NO: 270845 - DNA, 15 bp, Homo sapiens
aaacgatgtaaggag

SEQ ID NO: 270846 - DNA, 15 bp, Homo sapiens
aaaacgatgtaagga

SEQ ID NO: 270847 - DNA, 15 bp, Homo sapiens
taaaacgatgtaagg

SEQ ID NO: 270848 - DNA, 15 bp, Homo sapiens
gtaaaacgatgtaag

SEQ ID NO: 270849 - DNA, 15 bp, Homo sapiens
ggtaaaacgatgtaa

SEQ ID NO: 270850 - DNA, 15 bp, Homo sapiens
tggtaaaacgatgta

SEQ ID NO: 270851 - DNA, 15 bp, Homo sapiens
ctggtaaaacgatgt

SEQ ID NO: 270852 - DNA, 15 bp, Homo sapiens
actggtaaaacgatg

SEQ ID NO: 270853 - DNA, 15 bp, Homo sapiens
tactggtaaaacgat

SEQ ID NO: 270854 - DNA, 15 bp, Homo sapiens
ctactggtaaaacga

SEQ ID NO: 270855 - DNA, 15 bp, Homo sapiens
cctactggtaaaacg

SEQ ID NO: 270856 - DNA, 15 bp, Homo sapiens
acctactggtaaaac

SEQ ID NO: 270857 - DNA, 15 bp, Homo sapiens
gacctactggtaaaa

SEQ ID NO: 270858 - DNA, 15 bp, Homo sapiens
ggacctactggtaaa

SEQ ID NO: 270859 - DNA, 15 bp, Homo sapiens
tggacctactggtaa

SEQ ID NO: 270860 - DNA, 15 bp, Homo sapiens
ctggacctactggta

SEQ ID NO: 270861 - DNA, 15 bp, Homo sapiens
actggacctactggt

SEQ ID NO: 270862 - DNA, 15 bp, Homo sapiens
cactggacctactgg

SEQ ID NO: 270863 - DNA, 15 bp, Homo sapiens
gcactggacctactg

SEQ ID NO: 270864 - DNA, 15 bp, Homo sapiens
tgcactggacctact

SEQ ID NO: 270865 - DNA, 15 bp, Homo sapiens
atgcactggacctac

SEQ ID NO: 270866 - DNA, 15 bp, Homo sapiens
aatgcactggaccta

SEQ ID NO: 270867 - DNA, 15 bp, Homo sapiens
aaatgcactggacct

SEQ ID NO: 270868 - DNA, 15 bp, Homo sapiens
taaatgcactggacc

SEQ ID NO: 270869 - DNA, 15 bp, Homo sapiens
ctaaatgcactggac

SEQ ID NO: 270870 - DNA, 15 bp, Homo sapiens
tctaaatgcactgga

SEQ ID NO: 270871 - DNA, 15 bp, Homo sapiens
atctaaatgcactgg

SEQ ID NO: 270872 - DNA, 15 bp, Homo sapiens
aatctaaatgcactg

SEQ ID NO: 270873 - DNA, 15 bp, Homo sapiens
aaatctaaatgcact

SEQ ID NO: 270874 - DNA, 15 bp, Homo sapiens
caaatctaaatgcac

SEQ ID NO: 270875 - DNA, 15 bp, Homo sapiens
acaaatctaaatgca

SEQ ID NO: 270876 - DNA, 15 bp, Homo sapiens
gacaaatctaaatgc

SEQ ID NO: 270877 - DNA, 15 bp, Homo sapiens
tgacaaatctaaatg

SEQ ID NO: 270878 - DNA, 15 bp, Homo sapiens
atgacaaatctaaat

SEQ ID NO: 270879 - DNA, 15 bp, Homo sapiens
aatgacaaatctaaa

SEQ ID NO: 270880 - DNA, 15 bp, Homo sapiens
taatgacaaatctaa

SEQ ID NO: 270881 - DNA, 15 bp, Homo sapiens
ctaatgacaaatcta

SEQ ID NO: 270882 - DNA, 15 bp, Homo sapiens
gctaatgacaaatct

SEQ ID NO: 270883 - DNA, 15 bp, Homo sapiens
agctaatgacaaatc

SEQ ID NO: 270884 - DNA, 15 bp, Homo sapiens
aagctaatgacaaat

SEQ ID NO: 270885 - DNA, 15 bp, Homo sapiens
aaagctaatgacaaa

SEQ ID NO: 270886 - DNA, 15 bp, Homo sapiens
aaaagctaatgacaa

SEQ ID NO: 270887 - DNA, 15 bp, Homo sapiens
taaaagctaatgaca

SEQ ID NO: 270888 - DNA, 15 bp, Homo sapiens
ttaaaagctaatgac

SEQ ID NO: 270889 - DNA, 15 bp, Homo sapiens
cttaaaagctaatga

SEQ ID NO: 270890 - DNA, 15 bp, Homo sapiens
ccttaaaagctaatg

SEQ ID NO: 270891 - DNA, 15 bp, Homo sapiens
accttaaaagctaat

SEQ ID NO: 270892 - DNA, 15 bp, Homo sapiens
caccttaaaagctaa

SEQ ID NO: 270893 - DNA, 15 bp, Homo sapiens
tcaccttaaaagcta

SEQ ID NO: 270894 - DNA, 15 bp, Homo sapiens
ctcaccttaaaagct

SEQ ID NO: 270895 - DNA, 15 bp, Homo sapiens
cctcaccttaaaagc

SEQ ID NO: 270896 - DNA, 15 bp, Homo sapiens
acctcaccttaaaag

SEQ ID NO: 270897 - DNA, 15 bp, Homo sapiens
aacctcaccttaaaa

SEQ ID NO: 270898 - DNA, 15 bp, Homo sapiens
aaacctcaccttaaa

SEQ ID NO: 270899 - DNA, 15 bp, Homo sapiens
caaacctcaccttaa

SEQ ID NO: 270900 - DNA, 15 bp, Homo sapiens
ccaaacctcacctta

SEQ ID NO: 270901 - DNA, 15 bp, Homo sapiens
cccaaacctcacctt

SEQ ID NO: 270902 - DNA, 15 bp, Homo sapiens
gcccaaacctcacct

SEQ ID NO: 270903 - DNA, 15 bp, Homo sapiens
tgcccaaacctcacc

SEQ ID NO: 270904 - DNA, 15 bp, Homo sapiens
ttgcccaaacctcac

SEQ ID NO: 270905 - DNA, 15 bp, Homo sapiens
tttgcccaaacctca

SEQ ID NO: 270906 - DNA, 15 bp, Homo sapiens
ttttgcccaaacctc

SEQ ID NO: 270907 - DNA, 15 bp, Homo sapiens
attttgcccaaacct

SEQ ID NO: 270908 - DNA, 15 bp, Homo sapiens
gattttgcccaaacc

SEQ ID NO: 270909 - DNA, 15 bp, Homo sapiens
ggattttgcccaaac

SEQ ID NO: 270910 - DNA, 15 bp, Homo sapiens
tggattttgcccaaa

SEQ ID NO: 270911 - DNA, 15 bp, Homo sapiens
atggattttgcccaa

SEQ ID NO: 270912 - DNA, 15 bp, Homo sapiens
aatggattttgccca

SEQ ID NO: 270913 - DNA, 15 bp, Homo sapiens
aaatggattttgccc

SEQ ID NO: 270914 - DNA, 15 bp, Homo sapiens
aaaatggattttgcc

SEQ ID NO: 270915 - DNA, 15 bp, Homo sapiens
taaaatggattttgc

SEQ ID NO: 270916 - DNA, 15 bp, Homo sapiens
ataaaatggattttg

SEQ ID NO: 270917 - DNA, 15 bp, Homo sapiens
aataaaatggatttt

SEQ ID NO: 270918 - DNA, 15 bp, Homo sapiens
aaataaaatggattt

SEQ ID NO: 270919 - DNA, 15 bp, Homo sapiens
aaaataaaatggatt

SEQ ID NO: 270920 - DNA, 15 bp, Homo sapiens
caaaataaaatggat

SEQ ID NO: 270921 - DNA, 15 bp, Homo sapiens
ccaaaataaaatgga

SEQ ID NO: 270922 - DNA, 15 bp, Homo sapiens
tccaaaataaaatgg

SEQ ID NO: 270923 - DNA, 15 bp, Homo sapiens
atccaaaataaaatg

SEQ ID NO: 270924 - DNA, 15 bp, Homo sapiens
catccaaaataaaat

SEQ ID NO: 270925 - DNA, 15 bp, Homo sapiens
tcatccaaaataaaa

SEQ ID NO: 270926 - DNA, 15 bp, Homo sapiens
gtcatccaaaataaa

SEQ ID NO: 270927 - DNA, 15 bp, Homo sapiens
agtcatccaaaataa

SEQ ID NO: 270928 - DNA, 15 bp, Homo sapiens
aagtcatccaaaata

SEQ ID NO: 270929 - DNA, 15 bp, Homo sapiens
taagtcatccaaaat

SEQ ID NO: 270930 - DNA, 15 bp, Homo sapiens
ataagtcatccaaaa

SEQ ID NO: 270931 - DNA, 15 bp, Homo sapiens
gataagtcatccaaa

SEQ ID NO: 270932 - DNA, 15 bp, Homo sapiens
tgataagtcatccaa

SEQ ID NO: 270933 - DNA, 15 bp, Homo sapiens
atgataagtcatcca

SEQ ID NO: 270934 - DNA, 15 bp, Homo sapiens
gatgataagtcatcc

SEQ ID NO: 270935 - DNA, 15 bp, Homo sapiens
ggatgataagtcatc

SEQ ID NO: 270936 - DNA, 15 bp, Homo sapiens
gggatgataagtcat

SEQ ID NO: 270937 - DNA, 15 bp, Homo sapiens
tgggatgataagtca

SEQ ID NO: 270938 - DNA, 15 bp, Homo sapiens
gtgggatgataagtc

SEQ ID NO: 270939 - DNA, 15 bp, Homo sapiens
agtgggatgataagt

SEQ ID NO: 270940 - DNA, 15 bp, Homo sapiens
cagtgggatgataag

SEQ ID NO: 270941 - DNA, 15 bp, Homo sapiens
tcagtgggatgataa

SEQ ID NO: 270942 - DNA, 15 bp, Homo sapiens
atcagtgggatgata

SEQ ID NO: 270943 - DNA, 15 bp, Homo sapiens
aatcagtgggatgat

SEQ ID NO: 270944 - DNA, 15 bp, Homo sapiens
gaatcagtgggatga

SEQ ID NO: 270945 - DNA, 15 bp, Homo sapiens
agaatcagtgggatg

SEQ ID NO: 270946 - DNA, 15 bp, Homo sapiens
aagaatcagtgggat

SEQ ID NO: 270947 - DNA, 15 bp, Homo sapiens
caagaatcagtggga

SEQ ID NO: 270948 - DNA, 15 bp, Homo sapiens
tcaagaatcagtggg

SEQ ID NO: 270949 - DNA, 15 bp, Homo sapiens
gtcaagaatcagtgg

SEQ ID NO: 270950 - DNA, 15 bp, Homo sapiens
agtcaagaatcagtg

SEQ ID NO: 270951 - DNA, 15 bp, Homo sapiens
gagtcaagaatcagt

SEQ ID NO: 270952 - DNA, 15 bp, Homo sapiens
ggagtcaagaatcag

SEQ ID NO: 270953 - DNA, 15 bp, Homo sapiens
aggagtcaagaatca

SEQ ID NO: 270954 - DNA, 15 bp, Homo sapiens
aaggagtcaagaatc

SEQ ID NO: 270955 - DNA, 15 bp, Homo sapiens
caaggagtcaagaat

SEQ ID NO: 270956 - DNA, 15 bp, Homo sapiens
ccaaggagtcaagaa

SEQ ID NO: 270957 - DNA, 15 bp, Homo sapiens
accaaggagtcaaga

SEQ ID NO: 270958 - DNA, 15 bp, Homo sapiens
taccaaggagtcaag

SEQ ID NO: 270959 - DNA, 15 bp, Homo sapiens
ttaccaaggagtcaa

SEQ ID NO: 270960 - DNA, 15 bp, Homo sapiens
attaccaaggagtca

SEQ ID NO: 270961 - DNA, 15 bp, Homo sapiens
aattaccaaggagtc

SEQ ID NO: 270962 - DNA, 15 bp, Homo sapiens
gaattaccaaggagt

SEQ ID NO: 270963 - DNA, 15 bp, Homo sapiens
agaattaccaaggag

SEQ ID NO: 270964 - DNA, 15 bp, Homo sapiens
cagaattaccaagga

SEQ ID NO: 270965 - DNA, 15 bp, Homo sapiens
gcagaattaccaagg

SEQ ID NO: 270966 - DNA, 15 bp, Homo sapiens
agcagaattaccaag

SEQ ID NO: 270967 - DNA, 15 bp, Homo sapiens
tagcagaattaccaa

SEQ ID NO: 270968 - DNA, 15 bp, Homo sapiens
ttagcagaattacca

SEQ ID NO: 270969 - DNA, 15 bp, Homo sapiens
attagcagaattacc

SEQ ID NO: 270970 - DNA, 15 bp, Homo sapiens
cattagcagaattac

SEQ ID NO: 270971 - DNA, 15 bp, Homo sapiens
gcattagcagaatta

SEQ ID NO: 270972 - DNA, 15 bp, Homo sapiens
agcattagcagaatt

SEQ ID NO: 270973 - DNA, 15 bp, Homo sapiens
tagcattagcagaat

SEQ ID NO: 270974 - DNA, 15 bp, Homo sapiens
ttagcattagcagaa

SEQ ID NO: 270975 - DNA, 15 bp, Homo sapiens
attagcattagcaga

SEQ ID NO: 270976 - DNA, 15 bp, Homo sapiens
aattagcattagcag

SEQ ID NO: 270977 - DNA, 15 bp, Homo sapiens
aaattagcattagca

SEQ ID NO: 270978 - DNA, 15 bp, Homo sapiens
aaaattagcattagc

SEQ ID NO: 270979 - DNA, 15 bp, Homo sapiens
aaaaattagcattag

SEQ ID NO: 270980 - DNA, 15 bp, Homo sapiens
aaaaaattagcatta

SEQ ID NO: 270981 - DNA, 15 bp, Homo sapiens
aaaaaaattagcatt

SEQ ID NO: 270982 - DNA, 15 bp, Homo sapiens
taaaaaaattagcat

SEQ ID NO: 270983 - DNA, 15 bp, Homo sapiens
ctaaaaaaattagca

SEQ ID NO: 270984 - DNA, 15 bp, Homo sapiens
gctaaaaaaattagc

SEQ ID NO: 270985 - DNA, 15 bp, Homo sapiens
agctaaaaaaattag

SEQ ID NO: 270986 - DNA, 15 bp, Homo sapiens
aagctaaaaaaatta

SEQ ID NO: 270987 - DNA, 15 bp, Homo sapiens
gaagctaaaaaaatt

SEQ ID NO: 270988 - DNA, 15 bp, Homo sapiens
tgaagctaaaaaaat

SEQ ID NO: 270989 - DNA, 15 bp, Homo sapiens
atgaagctaaaaaaa

SEQ ID NO: 270990 - DNA, 15 bp, Homo sapiens
tatgaagctaaaaaa

SEQ ID NO: 270991 - DNA, 15 bp, Homo sapiens
atatgaagctaaaaa

SEQ ID NO: 270992 - DNA, 15 bp, Homo sapiens
tatatgaagctaaaa

SEQ ID NO: 270993 - DNA, 15 bp, Homo sapiens
atatatgaagctaaa

SEQ ID NO: 270994 - DNA, 15 bp, Homo sapiens
aatatatgaagctaa

SEQ ID NO: 270995 - DNA, 15 bp, Homo sapiens
aaatatatgaagcta

SEQ ID NO: 270996 - DNA, 15 bp, Homo sapiens
aaaatatatgaagct

SEQ ID NO: 270997 - DNA, 15 bp, Homo sapiens
gaaaatatatgaagc

SEQ ID NO: 270998 - DNA, 15 bp, Homo sapiens
tgaaaatatatgaag

SEQ ID NO: 270999 - DNA, 15 bp, Homo sapiens
atgaaaatatatgaa

SEQ ID NO: 271000 - DNA, 15 bp, Homo sapiens
aatgaaaatatatga

SEQ ID NO: 271001 - DNA, 15 bp, Homo sapiens
taatgaaaatatatg

SEQ ID NO: 271002 - DNA, 15 bp, Homo sapiens
ctaatgaaaatatat

SEQ ID NO: 271003 - DNA, 15 bp, Homo sapiens
cctaatgaaaatata

SEQ ID NO: 271004 - DNA, 15 bp, Homo sapiens
ccctaatgaaaatat

SEQ ID NO: 271005 - DNA, 15 bp, Homo sapiens
gccctaatgaaaata

SEQ ID NO: 271006 - DNA, 15 bp, Homo sapiens
agccctaatgaaaat

SEQ ID NO: 271007 - DNA, 15 bp, Homo sapiens
aagccctaatgaaaa

SEQ ID NO: 271008 - DNA, 15 bp, Homo sapiens
caagccctaatgaaa

SEQ ID NO: 271009 - DNA, 15 bp, Homo sapiens
tcaagccctaatgaa

SEQ ID NO: 271010 - DNA, 15 bp, Homo sapiens
ttcaagccctaatga

SEQ ID NO: 271011 - DNA, 15 bp, Homo sapiens
tttcaagccctaatg

SEQ ID NO: 271012 - DNA, 15 bp, Homo sapiens
ctttcaagccctaat

SEQ ID NO: 271013 - DNA, 15 bp, Homo sapiens
actttcaagccctaa

SEQ ID NO: 271014 - DNA, 15 bp, Homo sapiens
gactttcaagcccta

SEQ ID NO: 271015 - DNA, 15 bp, Homo sapiens
agactttcaagccct

SEQ ID NO: 271016 - DNA, 15 bp, Homo sapiens
gagactttcaagccc

SEQ ID NO: 271017 - DNA, 15 bp, Homo sapiens
agagactttcaagcc

SEQ ID NO: 271018 - DNA, 15 bp, Homo sapiens
cagagactttcaagc

SEQ ID NO: 271019 - DNA, 15 bp, Homo sapiens
tcagagactttcaag

SEQ ID NO: 271020 - DNA, 15 bp, Homo sapiens
ctcagagactttcaa

SEQ ID NO: 271021 - DNA, 15 bp, Homo sapiens
gctcagagactttca

SEQ ID NO: 271022 - DNA, 15 bp, Homo sapiens
agctcagagactttc

SEQ ID NO: 271023 - DNA, 15 bp, Homo sapiens
aagctcagagacttt

SEQ ID NO: 271024 - DNA, 15 bp, Homo sapiens
aaagctcagagactt

SEQ ID NO: 271025 - DNA, 15 bp, Homo sapiens
aaaagctcagagact

SEQ ID NO: 271026 - DNA, 15 bp, Homo sapiens
gaaaagctcagagac

SEQ ID NO: 271027 - DNA, 15 bp, Homo sapiens
agaaaagctcagaga

SEQ ID NO: 271028 - DNA, 15 bp, Homo sapiens
aagaaaagctcagag

SEQ ID NO: 271029 - DNA, 15 bp, Homo sapiens
taagaaaagctcaga

SEQ ID NO: 271030 - DNA, 15 bp, Homo sapiens
gtaagaaaagctcag

SEQ ID NO: 271031 - DNA, 15 bp, Homo sapiens
agtaagaaaagctca

SEQ ID NO: 271032 - DNA, 15 bp, Homo sapiens
cagtaagaaaagctc

SEQ ID NO: 271033 - DNA, 15 bp, Homo sapiens
tcagtaagaaaagct

SEQ ID NO: 271034 - DNA, 15 bp, Homo sapiens
atcagtaagaaaagc

SEQ ID NO: 271035 - DNA, 15 bp, Homo sapiens
aatcagtaagaaaag

SEQ ID NO: 271036 - DNA, 15 bp, Homo sapiens
caatcagtaagaaaa

SEQ ID NO: 271037 - DNA, 15 bp, Homo sapiens
gcaatcagtaagaaa

SEQ ID NO: 271038 - DNA, 15 bp, Homo sapiens
tgcaatcagtaagaa

SEQ ID NO: 271039 - DNA, 15 bp, Homo sapiens
atgcaatcagtaaga

SEQ ID NO: 271040 - DNA, 15 bp, Homo sapiens
gatgcaatcagtaag

SEQ ID NO: 271041 - DNA, 15 bp, Homo sapiens
ggatgcaatcagtaa

SEQ ID NO: 271042 - DNA, 15 bp, Homo sapiens
aggatgcaatcagta

SEQ ID NO: 271043 - DNA, 15 bp, Homo sapiens
taggatgcaatcagt

SEQ ID NO: 271044 - DNA, 15 bp, Homo sapiens
ataggatgcaatcag

SEQ ID NO: 271045 - DNA, 15 bp, Homo sapiens
gataggatgcaatca

SEQ ID NO: 271046 - DNA, 15 bp, Homo sapiens
ggataggatgcaatc

SEQ ID NO: 271047 - DNA, 15 bp, Homo sapiens
tggataggatgcaat

SEQ ID NO: 271048 - DNA, 15 bp, Homo sapiens
atggataggatgcaa

SEQ ID NO: 271049 - DNA, 15 bp, Homo sapiens
catggataggatgca

SEQ ID NO: 271050 - DNA, 15 bp, Homo sapiens
ccatggataggatgc

SEQ ID NO: 271051 - DNA, 15 bp, Homo sapiens
gccatggataggatg

SEQ ID NO: 271052 - DNA, 15 bp, Homo sapiens
tgccatggataggat

SEQ ID NO: 271053 - DNA, 15 bp, Homo sapiens
atgccatggatagga

SEQ ID NO: 271054 - DNA, 15 bp, Homo sapiens
aatgccatggatagg

SEQ ID NO: 271055 - DNA, 15 bp, Homo sapiens
gaatgccatggatag

SEQ ID NO: 271056 - DNA, 15 bp, Homo sapiens
tgaatgccatggata

SEQ ID NO: 271057 - DNA, 15 bp, Homo sapiens
ttgaatgccatggat

SEQ ID NO: 271058 - DNA, 15 bp, Homo sapiens
tttgaatgccatgga

SEQ ID NO: 271059 - DNA, 15 bp, Homo sapiens
atttgaatgccatgg

SEQ ID NO: 271060 - DNA, 15 bp, Homo sapiens
catttgaatgccatg

SEQ ID NO: 271061 - DNA, 15 bp, Homo sapiens
acatttgaatgccat

SEQ ID NO: 271062 - DNA, 15 bp, Homo sapiens
cacatttgaatgcca

SEQ ID NO: 271063 - DNA, 15 bp, Homo sapiens
acacatttgaatgcc

SEQ ID NO: 271064 - DNA, 15 bp, Homo sapiens
gacacatttgaatgc

SEQ ID NO: 271065 - DNA, 15 bp, Homo sapiens
agacacatttgaatg

SEQ ID NO: 271066 - DNA, 15 bp, Homo sapiens
cagacacatttgaat

SEQ ID NO: 271067 - DNA, 15 bp, Homo sapiens
tcagacacatttgaa

SEQ ID NO: 271068 - DNA, 15 bp, Homo sapiens
ttcagacacatttga

SEQ ID NO: 271069 - DNA, 15 bp, Homo sapiens
attcagacacatttg

SEQ ID NO: 271070 - DNA, 15 bp, Homo sapiens
aattcagacacattt

SEQ ID NO: 271071 - DNA, 15 bp, Homo sapiens
aaattcagacacatt

SEQ ID NO: 271072 - DNA, 15 bp, Homo sapiens
tgaaattcagacaca

SEQ ID NO: 271073 - DNA, 15 bp, Homo sapiens
ttgaaattcagacac

SEQ ID NO: 271074 - DNA, 15 bp, Homo sapiens
gttgaaattcagaca

SEQ ID NO: 271075 - DNA, 15 bp, Homo sapiens
agttgaaattcagac

SEQ ID NO: 271076 - DNA, 15 bp, Homo sapiens
aagttgaaattcaga

SEQ ID NO: 271077 - DNA, 15 bp, Homo sapiens
caagttgaaattcag

SEQ ID NO: 271078 - DNA, 15 bp, Homo sapiens
acaagttgaaattca

SEQ ID NO: 271079 - DNA, 15 bp, Homo sapiens
aacaagttgaaattc

SEQ ID NO: 271080 - DNA, 15 bp, Homo sapiens
caacaagttgaaatt

SEQ ID NO: 271081 - DNA, 15 bp, Homo sapiens
tcaacaagttgaaat

SEQ ID NO: 271082 - DNA, 15 bp, Homo sapiens
ttcaacaagttgaaa

SEQ ID NO: 271083 - DNA, 15 bp, Homo sapiens
tttcaacaagttgaa

SEQ ID NO: 271084 - DNA, 15 bp, Homo sapiens
atttcaacaagttga

SEQ ID NO: 271085 - DNA, 15 bp, Homo sapiens
gatttcaacaagttg

SEQ ID NO: 271086 - DNA, 15 bp, Homo sapiens
tgatttcaacaagtt

SEQ ID NO: 271087 - DNA, 15 bp, Homo sapiens
atgatttcaacaagt

SEQ ID NO: 271088 - DNA, 15 bp, Homo sapiens
aatgatttcaacaag

SEQ ID NO: 271089 - DNA, 15 bp, Homo sapiens
caatgatttcaacaa

SEQ ID NO: 271090 - DNA, 15 bp, Homo sapiens
tcaatgatttcaaca

SEQ ID NO: 271091 - DNA, 15 bp, Homo sapiens
ttcaatgatttcaac

SEQ ID NO: 271092 - DNA, 15 bp, Homo sapiens
tttcaatgatttcaa

SEQ ID NO: 271093 - DNA, 15 bp, Homo sapiens
gtttcaatgatttca

SEQ ID NO: 271094 - DNA, 15 bp, Homo sapiens
agtttcaatgatttc

SEQ ID NO: 271095 - DNA, 15 bp, Homo sapiens
aagtttcaatgattt

SEQ ID NO: 271096 - DNA, 15 bp, Homo sapiens
taagtttcaatgatt

SEQ ID NO: 271097 - DNA, 15 bp, Homo sapiens
ttaagtttcaatgat

SEQ ID NO: 271098 - DNA, 15 bp, Homo sapiens
tttaagtttcaatga

SEQ ID NO: 271099 - DNA, 15 bp, Homo sapiens
atttaagtttcaatg

SEQ ID NO: 271100 - DNA, 15 bp, Homo sapiens
tatttaagtttcaat

SEQ ID NO: 271101 - DNA, 15 bp, Homo sapiens
ttatttaagtttcaa

SEQ ID NO: 271102 - DNA, 15 bp, Homo sapiens
tttatttaagtttca

SEQ ID NO: 271103 - DNA, 15 bp, Homo sapiens
ttttatttaagtttc

SEQ ID NO: 271104 - DNA, 15 bp, Homo sapiens
tttttatttaagttt

SEQ ID NO: 271105 - DNA, 15 bp, Homo sapiens
gtttttatttaagtt

SEQ ID NO: 271106 - DNA, 15 bp, Homo sapiens
agtttttatttaagt

SEQ ID NO: 271107 - DNA, 15 bp, Homo sapiens
cagtttttatttaag

SEQ ID NO: 271108 - DNA, 15 bp, Homo sapiens
tcagtttttatttaa

SEQ ID NO: 271109 - DNA, 15 bp, Homo sapiens
ctcagtttttattta

SEQ ID NO: 271110 - DNA, 15 bp, Homo sapiens
tctcagtttttattt

SEQ ID NO: 271111 - DNA, 15 bp, Homo sapiens
ctctcagtttttatt

SEQ ID NO: 271112 - DNA, 15 bp, Homo sapiens
cctctcagtttttat

SEQ ID NO: 271113 - DNA, 15 bp, Homo sapiens
acctctcagttttta

SEQ ID NO: 271114 - DNA, 15 bp, Homo sapiens
aacctctcagttttt

SEQ ID NO: 271115 - DNA, 15 bp, Homo sapiens
caacctctcagtttt

SEQ ID NO: 271116 - DNA, 15 bp, Homo sapiens
acaacctctcagttt

SEQ ID NO: 271117 - DNA, 15 bp, Homo sapiens
aacaacctctcagtt

SEQ ID NO: 271118 - DNA, 15 bp, Homo sapiens
aaacaacctctcagt

SEQ ID NO: 271119 - DNA, 15 bp, Homo sapiens
aaaacaacctctcag

SEQ ID NO: 271120 - DNA, 15 bp, Homo sapiens
taaaacaacctctca

SEQ ID NO: 271121 - DNA, 15 bp, Homo sapiens
ataaaacaacctctc

SEQ ID NO: 271122 - DNA, 15 bp, Homo sapiens
tataaaacaacctct

SEQ ID NO: 271123 - DNA, 15 bp, Homo sapiens
ctataaaacaacctc

SEQ ID NO: 271124 - DNA, 15 bp, Homo sapiens
actataaaacaacct

SEQ ID NO: 271125 - DNA, 15 bp, Homo sapiens
aactataaaacaacc

SEQ ID NO: 271126 - DNA, 15 bp, Homo sapiens
taactataaaacaac

SEQ ID NO: 271127 - DNA, 15 bp, Homo sapiens
ttaactataaaacaa

SEQ ID NO: 271128 - DNA, 15 bp, Homo sapiens
tttaactataaaaca

SEQ ID NO: 271129 - DNA, 15 bp, Homo sapiens
ttttaactataaaac

SEQ ID NO: 271130 - DNA, 15 bp, Homo sapiens
tttttaactataaaa

SEQ ID NO: 271131 - DNA, 15 bp, Homo sapiens
ttttttaactataaa

SEQ ID NO: 271132 - DNA, 15 bp, Homo sapiens
tttttttaactataa

SEQ ID NO: 271133 - DNA, 15 bp, Homo sapiens
ttttttttaactata

SEQ ID NO: 271134 - DNA, 15 bp, Homo sapiens
tttttttttaactat

SEQ ID NO: 271135 - DNA, 15 bp, Homo sapiens
ttttttttttaacta

SEQ ID NO: 271136 - DNA, 15 bp, Homo sapiens
ggtttttttttttta

SEQ ID NO: 271137 - DNA, 15 bp, Homo sapiens
aggtttttttttttt

SEQ ID NO: 271138 - DNA, 15 bp, Homo sapiens
caggttttttttttt

SEQ ID NO: 271139 - DNA, 15 bp, Homo sapiens
acaggtttttttttt

SEQ ID NO: 271140 - DNA, 15 bp, Homo sapiens
aacaggttttttttt

SEQ ID NO: 271141 - DNA, 15 bp, Homo sapiens
taacaggtttttttt

SEQ ID NO: 271142 - DNA, 15 bp, Homo sapiens
ttaacaggttttttt

SEQ ID NO: 271143 - DNA, 15 bp, Homo sapiens
cttaacaggtttttt

SEQ ID NO: 271144 - DNA, 15 bp, Homo sapiens
tcttaacaggttttt

SEQ ID NO: 271145 - DNA, 15 bp, Homo sapiens
ttcttaacaggtttt

SEQ ID NO: 271146 - DNA, 15 bp, Homo sapiens
attcttaacaggttt

SEQ ID NO: 271147 - DNA, 15 bp, Homo sapiens
tattcttaacaggtt

SEQ ID NO: 271148 - DNA, 15 bp, Homo sapiens
atattcttaacaggt

SEQ ID NO: 271149 - DNA, 15 bp, Homo sapiens
gatattcttaacagg

SEQ ID NO: 271150 - DNA, 15 bp, Homo sapiens
agatattcttaacag

SEQ ID NO: 271151 - DNA, 15 bp, Homo sapiens
aagatattcttaaca

SEQ ID NO: 271152 - DNA, 15 bp, Homo sapiens
aaagatattcttaac

SEQ ID NO: 271153 - DNA, 15 bp, Homo sapiens
taaagatattcttaa

SEQ ID NO: 271154 - DNA, 15 bp, Homo sapiens
ttaaagatattctta

SEQ ID NO: 271155 - DNA, 15 bp, Homo sapiens
tttaaagatattctt

SEQ ID NO: 271156 - DNA, 15 bp, Homo sapiens
ttttaaagatattct

SEQ ID NO: 271157 - DNA, 15 bp, Homo sapiens
attttaaagatattc

SEQ ID NO: 271158 - DNA, 15 bp, Homo sapiens
tattttaaagatatt

SEQ ID NO: 271159 - DNA, 15 bp, Homo sapiens
ttattttaaagatat

SEQ ID NO: 271160 - DNA, 15 bp, Homo sapiens
acttattttaaagat

SEQ ID NO: 271161 - DNA, 15 bp, Homo sapiens
gacttattttaaaga

SEQ ID NO: 271162 - DNA, 15 bp, Homo sapiens
agacttattttaaag

SEQ ID NO: 271163 - DNA, 15 bp, Homo sapiens
aagacttattttaaa

SEQ ID NO: 271164 - DNA, 15 bp, Homo sapiens
caagacttattttaa

SEQ ID NO: 271165 - DNA, 15 bp, Homo sapiens
acaagacttatttta

SEQ ID NO: 271166 - DNA, 15 bp, Homo sapiens
cacaagacttatttt

SEQ ID NO: 271167 - DNA, 15 bp, Homo sapiens
tcacaagacttattt

SEQ ID NO: 271168 - DNA, 15 bp, Homo sapiens
atcacaagacttatt

SEQ ID NO: 271169 - DNA, 15 bp, Homo sapiens
tatcacaagacttat

SEQ ID NO: 271170 - DNA, 15 bp, Homo sapiens
ttatcacaagactta

SEQ ID NO: 271171 - DNA, 15 bp, Homo sapiens
attatcacaagactt

SEQ ID NO: 271172 - DNA, 15 bp, Homo sapiens
cattatcacaagact

SEQ ID NO: 271173 - DNA, 15 bp, Homo sapiens
tcattatcacaagac

SEQ ID NO: 271174 - DNA, 15 bp, Homo sapiens
ttcattatcacaaga

SEQ ID NO: 271175 - DNA, 15 bp, Homo sapiens
tttcattatcacaag

SEQ ID NO: 271176 - DNA, 15 bp, Homo sapiens
atttcattatcacaa

SEQ ID NO: 271177 - DNA, 15 bp, Homo sapiens
catttcattatcaca

SEQ ID NO: 271178 - DNA, 15 bp, Homo sapiens
acatttcattatcac

SEQ ID NO: 271179 - DNA, 15 bp, Homo sapiens
tacatttcattatca

SEQ ID NO: 271180 - DNA, 15 bp, Homo sapiens
gtacatttcattatc

SEQ ID NO: 271181 - DNA, 15 bp, Homo sapiens
ggtacatttcattat

SEQ ID NO: 271182 - DNA, 15 bp, Homo sapiens
cggtacatttcatta

SEQ ID NO: 271183 - DNA, 15 bp, Homo sapiens
gcggtacatttcatt

SEQ ID NO: 271184 - DNA, 15 bp, Homo sapiens
agcggtacatttcat

SEQ ID NO: 271185 - DNA, 15 bp, Homo sapiens
aagcggtacatttca

SEQ ID NO: 271186 - DNA, 15 bp, Homo sapiens
taagcggtacatttc

SEQ ID NO: 271187 - DNA, 15 bp, Homo sapiens
ctaagcggtacattt

SEQ ID NO: 271188 - DNA, 15 bp, Homo sapiens
gctaagcggtacatt

SEQ ID NO: 271189 - DNA, 15 bp, Homo sapiens
tgctaagcggtacat

SEQ ID NO: 271190 - DNA, 15 bp, Homo sapiens
ctgctaagcggtaca

SEQ ID NO: 271191 - DNA, 15 bp, Homo sapiens
actgctaagcggtac

SEQ ID NO: 271192 - DNA, 15 bp, Homo sapiens
tactgctaagcggta

SEQ ID NO: 271193 - DNA, 15 bp, Homo sapiens
atactgctaagcggt

SEQ ID NO: 271194 - DNA, 15 bp, Homo sapiens
catactgctaagcgg

SEQ ID NO: 271195 - DNA, 15 bp, Homo sapiens
gcatactgctaagcg

SEQ ID NO: 271196 - DNA, 15 bp, Homo sapiens
tgcatactgctaagc

SEQ ID NO: 271197 - DNA, 15 bp, Homo sapiens
atgcatactgctaag

SEQ ID NO: 271198 - DNA, 15 bp, Homo sapiens
catgcatactgctaa

SEQ ID NO: 271199 - DNA, 15 bp, Homo sapiens
acatgcatactgcta

SEQ ID NO: 271200 - DNA, 15 bp, Homo sapiens
tacatgcatactgct

SEQ ID NO: 271201 - DNA, 15 bp, Homo sapiens
gtacatgcatactgc

SEQ ID NO: 271202 - DNA, 15 bp, Homo sapiens
ggtacatgcatactg

SEQ ID NO: 271203 - DNA, 15 bp, Homo sapiens
tggtacatgcatact

SEQ ID NO: 271204 - DNA, 15 bp, Homo sapiens
ctggtacatgcatac

SEQ ID NO: 271205 - DNA, 15 bp, Homo sapiens
actggtacatgcata

SEQ ID NO: 271206 - DNA, 15 bp, Homo sapiens
aactggtacatgcat

SEQ ID NO: 271207 - DNA, 15 bp, Homo sapiens
caactggtacatgca

SEQ ID NO: 271208 - DNA, 15 bp, Homo sapiens
ccaactggtacatgc

SEQ ID NO: 271209 - DNA, 15 bp, Homo sapiens
cccaactggtacatg

SEQ ID NO: 271210 - DNA, 15 bp, Homo sapiens
tcccaactggtacat

SEQ ID NO: 271211 - DNA, 15 bp, Homo sapiens
gtcccaactggtaca

SEQ ID NO: 271212 - DNA, 15 bp, Homo sapiens
agtcccaactggtac

SEQ ID NO: 271213 - DNA, 15 bp, Homo sapiens
tagtcccaactggta

SEQ ID NO: 271214 - DNA, 15 bp, Homo sapiens
gtagtcccaactggt

SEQ ID NO: 271215 - DNA, 15 bp, Homo sapiens
agtagtcccaactgg

SEQ ID NO: 271216 - DNA, 15 bp, Homo sapiens
cagtagtcccaactg

SEQ ID NO: 271217 - DNA, 15 bp, Homo sapiens
ccagtagtcccaact

SEQ ID NO: 271218 - DNA, 15 bp, Homo sapiens
accagtagtcccaac

SEQ ID NO: 271219 - DNA, 15 bp, Homo sapiens
aaccagtagtcccaa

SEQ ID NO: 271220 - DNA, 15 bp, Homo sapiens
aaaccagtagtccca

SEQ ID NO: 271221 - DNA, 15 bp, Homo sapiens
gaaaccagtagtccc

SEQ ID NO: 271222 - DNA, 15 bp, Homo sapiens
agaaaccagtagtcc

SEQ ID NO: 271223 - DNA, 15 bp, Homo sapiens
tagaaaccagtagtc

SEQ ID NO: 271224 - DNA, 15 bp, Homo sapiens
atagaaaccagtagt

SEQ ID NO: 271225 - DNA, 15 bp, Homo sapiens
tatagaaaccagtag

SEQ ID NO: 271226 - DNA, 15 bp, Homo sapiens
atatagaaaccagta

SEQ ID NO: 271227 - DNA, 15 bp, Homo sapiens
aatatagaaaccagt

SEQ ID NO: 271228 - DNA, 15 bp, Homo sapiens
aaatatagaaaccag

SEQ ID NO: 271229 - DNA, 15 bp, Homo sapiens
taaatatagaaacca

SEQ ID NO: 271230 - DNA, 15 bp, Homo sapiens
ttaaatatagaaacc

SEQ ID NO: 271231 - DNA, 15 bp, Homo sapiens
cttaaatatagaaac

SEQ ID NO: 271232 - DNA, 15 bp, Homo sapiens
tcttaaatatagaaa

SEQ ID NO: 271233 - DNA, 15 bp, Homo sapiens
ttcttaaatatagaa

SEQ ID NO: 271234 - DNA, 15 bp, Homo sapiens
cttcttaaatataga

SEQ ID NO: 271235 - DNA, 15 bp, Homo sapiens
acttcttaaatatag

SEQ ID NO: 271236 - DNA, 15 bp, Homo sapiens
tacttcttaaatata

SEQ ID NO: 271237 - DNA, 15 bp, Homo sapiens
ttacttcttaaatat

SEQ ID NO: 271238 - DNA, 15 bp, Homo sapiens
gttacttcttaaata

SEQ ID NO: 271239 - DNA, 15 bp, Homo sapiens
agttacttcttaaat

SEQ ID NO: 271240 - DNA, 15 bp, Homo sapiens
gagttacttcttaaa

SEQ ID NO: 271241 - DNA, 15 bp, Homo sapiens
agagttacttcttaa

SEQ ID NO: 271242 - DNA, 15 bp, Homo sapiens
aagagttacttctta

SEQ ID NO: 271243 - DNA, 15 bp, Homo sapiens
caagagttacttctt

SEQ ID NO: 271244 - DNA, 15 bp, Homo sapiens
gcaagagttacttct

SEQ ID NO: 271245 - DNA, 15 bp, Homo sapiens
agcaagagttacttc

SEQ ID NO: 271246 - DNA, 15 bp, Homo sapiens
tagcaagagttactt

SEQ ID NO: 271247 - DNA, 15 bp, Homo sapiens
ttagcaagagttact

SEQ ID NO: 271248 - DNA, 15 bp, Homo sapiens
attagcaagagttac

SEQ ID NO: 271249 - DNA, 15 bp, Homo sapiens
cattagcaagagtta

SEQ ID NO: 271250 - DNA, 15 bp, Homo sapiens
tcattagcaagagtt

SEQ ID NO: 271251 - DNA, 15 bp, Homo sapiens
ctcattagcaagagt

SEQ ID NO: 271252 - DNA, 15 bp, Homo sapiens
cctcattagcaagag

SEQ ID NO: 271253 - DNA, 15 bp, Homo sapiens
ccctcattagcaaga

SEQ ID NO: 271254 - DNA, 15 bp, Homo sapiens
accctcattagcaag

SEQ ID NO: 271255 - DNA, 15 bp, Homo sapiens
caccctcattagcaa

SEQ ID NO: 271256 - DNA, 15 bp, Homo sapiens
gcaccctcattagca

SEQ ID NO: 271257 - DNA, 15 bp, Homo sapiens
agcaccctcattagc

SEQ ID NO: 271258 - DNA, 15 bp, Homo sapiens
cagcaccctcattag

SEQ ID NO: 271259 - DNA, 15 bp, Homo sapiens
acagcaccctcatta

SEQ ID NO: 271260 - DNA, 15 bp, Homo sapiens
aacagcaccctcatt

SEQ ID NO: 271261 - DNA, 15 bp, Homo sapiens
gaacagcaccctcat

SEQ ID NO: 271262 - DNA, 15 bp, Homo sapiens
tgaacagcaccctca

SEQ ID NO: 271263 - DNA, 15 bp, Homo sapiens
ttgaacagcaccctc

SEQ ID NO: 271264 - DNA, 15 bp, Homo sapiens
gttgaacagcaccct

SEQ ID NO: 271265 - DNA, 15 bp, Homo sapiens
tgttgaacagcaccc

SEQ ID NO: 271266 - DNA, 15 bp, Homo sapiens
ttgttgaacagcacc

SEQ ID NO: 271267 - DNA, 15 bp, Homo sapiens
attgttgaacagcac

SEQ ID NO: 271268 - DNA, 15 bp, Homo sapiens
cattgttgaacagca

SEQ ID NO: 271269 - DNA, 15 bp, Homo sapiens
tcattgttgaacagc

SEQ ID NO: 271270 - DNA, 15 bp, Homo sapiens
atcattgttgaacag

SEQ ID NO: 271271 - DNA, 15 bp, Homo sapiens
aatcattgttgaaca

SEQ ID NO: 271272 - DNA, 15 bp, Homo sapiens
aaatcattgttgaac

SEQ ID NO: 271273 - DNA, 15 bp, Homo sapiens
aaaatcattgttgaa

SEQ ID NO: 271274 - DNA, 15 bp, Homo sapiens
taaaatcattgttga

SEQ ID NO: 271275 - DNA, 15 bp, Homo sapiens
ctaaaatcattgttg

SEQ ID NO: 271276 - DNA, 15 bp, Homo sapiens
gctaaaatcattgtt

SEQ ID NO: 271277 - DNA, 15 bp, Homo sapiens
tgctaaaatcattgt

SEQ ID NO: 271278 - DNA, 15 bp, Homo sapiens
gtgctaaaatcattg

SEQ ID NO: 271279 - DNA, 15 bp, Homo sapiens
agtgctaaaatcatt

SEQ ID NO: 271280 - DNA, 15 bp, Homo sapiens
aagtgctaaaatcat

SEQ ID NO: 271281 - DNA, 15 bp, Homo sapiens
caagtgctaaaatca

SEQ ID NO: 271282 - DNA, 15 bp, Homo sapiens
acaagtgctaaaatc

SEQ ID NO: 271283 - DNA, 15 bp, Homo sapiens
cacaagtgctaaaat

SEQ ID NO: 271284 - DNA, 15 bp, Homo sapiens
gcacaagtgctaaaa

SEQ ID NO: 271285 - DNA, 15 bp, Homo sapiens
tgcacaagtgctaaa

SEQ ID NO: 271286 - DNA, 15 bp, Homo sapiens
atgcacaagtgctaa

SEQ ID NO: 271287 - DNA, 15 bp, Homo sapiens
catgcacaagtgcta

SEQ ID NO: 271288 - DNA, 15 bp, Homo sapiens
tcatgcacaagtgct

SEQ ID NO: 271289 - DNA, 15 bp, Homo sapiens
atcatgcacaagtgc

SEQ ID NO: 271290 - DNA, 15 bp, Homo sapiens
gatcatgcacaagtg

SEQ ID NO: 271291 - DNA, 15 bp, Homo sapiens
ggatcatgcacaagt

SEQ ID NO: 271292 - DNA, 15 bp, Homo sapiens
tggatcatgcacaag

SEQ ID NO: 271293 - DNA, 15 bp, Homo sapiens
ttggatcatgcacaa

SEQ ID NO: 271294 - DNA, 15 bp, Homo sapiens
tttggatcatgcaca

SEQ ID NO: 271295 - DNA, 15 bp, Homo sapiens
atttggatcatgcac

SEQ ID NO: 271296 - DNA, 15 bp, Homo sapiens
catttggatcatgca

SEQ ID NO: 271297 - DNA, 15 bp, Homo sapiens
tcatttggatcatgc

SEQ ID NO: 271298 - DNA, 15 bp, Homo sapiens
atcatttggatcatg

SEQ ID NO: 271299 - DNA, 15 bp, Homo sapiens
tatcatttggatcat

SEQ ID NO: 271300 - DNA, 15 bp, Homo sapiens
ttatcatttggatca

SEQ ID NO: 271301 - DNA, 15 bp, Homo sapiens
attatcatttggatc

SEQ ID NO: 271302 - DNA, 15 bp, Homo sapiens
cattatcatttggat

SEQ ID NO: 271303 - DNA, 15 bp, Homo sapiens
acattatcatttgga

SEQ ID NO: 271304 - DNA, 15 bp, Homo sapiens
aacattatcatttgg

SEQ ID NO: 271305 - DNA, 15 bp, Homo sapiens
aaacattatcatttg

SEQ ID NO: 271306 - DNA, 15 bp, Homo sapiens
taaacattatcattt

SEQ ID NO: 271307 - DNA, 15 bp, Homo sapiens
ttaaacattatcatt

SEQ ID NO: 271308 - DNA, 15 bp, Homo sapiens
attaaacattatcat

SEQ ID NO: 271309 - DNA, 15 bp, Homo sapiens
aattaaacattatca

SEQ ID NO: 271310 - DNA, 15 bp, Homo sapiens
taattaaacattatc

SEQ ID NO: 271311 - DNA, 15 bp, Homo sapiens
ataattaaacattat

SEQ ID NO: 271312 - DNA, 15 bp, Homo sapiens
aataattaaacatta

SEQ ID NO: 271313 - DNA, 15 bp, Homo sapiens
gaataattaaacatt

SEQ ID NO: 271314 - DNA, 15 bp, Homo sapiens
agaataattaaacat

SEQ ID NO: 271315 - DNA, 15 bp, Homo sapiens
cagaataattaaaca

SEQ ID NO: 271316 - DNA, 15 bp, Homo sapiens
acagaataattaaac

SEQ ID NO: 271317 - DNA, 15 bp, Homo sapiens
aacagaataattaaa

SEQ ID NO: 271318 - DNA, 15 bp, Homo sapiens
aaacagaataattaa

SEQ ID NO: 271319 - DNA, 15 bp, Homo sapiens
caaacagaataatta

SEQ ID NO: 271320 - DNA, 15 bp, Homo sapiens
gcaaacagaataatt

SEQ ID NO: 271321 - DNA, 15 bp, Homo sapiens
cgcaaacagaataat

SEQ ID NO: 271322 - DNA, 15 bp, Homo sapiens
acgcaaacagaataa

SEQ ID NO: 271323 - DNA, 15 bp, Homo sapiens
cacgcaaacagaata

SEQ ID NO: 271324 - DNA, 15 bp, Homo sapiens
gcacgcaaacagaat

SEQ ID NO: 271325 - DNA, 15 bp, Homo sapiens
ggcacgcaaacagaa

SEQ ID NO: 271326 - DNA, 15 bp, Homo sapiens
tggcacgcaaacaga

SEQ ID NO: 271327 - DNA, 15 bp, Homo sapiens
ttggcacgcaaacag

SEQ ID NO: 271328 - DNA, 15 bp, Homo sapiens
cttggcacgcaaaca

SEQ ID NO: 271329 - DNA, 15 bp, Homo sapiens
acttggcacgcaaac

SEQ ID NO: 271330 - DNA, 15 bp, Homo sapiens
cacttggcacgcaaa

SEQ ID NO: 271331 - DNA, 15 bp, Homo sapiens
tcacttggcacgcaa

SEQ ID NO: 271332 - DNA, 15 bp, Homo sapiens
gtcacttggcacgca

SEQ ID NO: 271333 - DNA, 15 bp, Homo sapiens
agtcacttggcacgc

SEQ ID NO: 271334 - DNA, 15 bp, Homo sapiens
aagtcacttggcacg

SEQ ID NO: 271335 - DNA, 15 bp, Homo sapiens
aaagtcacttggcac

SEQ ID NO: 271336 - DNA, 15 bp, Homo sapiens
aaaagtcacttggca

SEQ ID NO: 271337 - DNA, 15 bp, Homo sapiens
aaaaagtcacttggc

SEQ ID NO: 271338 - DNA, 15 bp, Homo sapiens
aaaaaagtcacttgg

SEQ ID NO: 271339 - DNA, 15 bp, Homo sapiens
aaaaaaagtcacttg

SEQ ID NO: 271340 - DNA, 15 bp, Homo sapiens
taaaaaaagtcactt

SEQ ID NO: 271341 - DNA, 15 bp, Homo sapiens
ataaaaaaagtcact

SEQ ID NO: 271342 - DNA, 15 bp, Homo sapiens
tataaaaaaagtcac

SEQ ID NO: 271343 - DNA, 15 bp, Homo sapiens
atataaaaaaagtca

SEQ ID NO: 271344 - DNA, 15 bp, Homo sapiens
tatataaaaaaagtc

SEQ ID NO: 271345 - DNA, 15 bp, Homo sapiens
ttatataaaaaaagt

SEQ ID NO: 271346 - DNA, 15 bp, Homo sapiens
gttatataaaaaaag

SEQ ID NO: 271347 - DNA, 15 bp, Homo sapiens
ggttatataaaaaaa

SEQ ID NO: 271348 - DNA, 15 bp, Homo sapiens
aggttatataaaaaa

SEQ ID NO: 271349 - DNA, 15 bp, Homo sapiens
aaggttatataaaaa

SEQ ID NO: 271350 - DNA, 15 bp, Homo sapiens
caaggttatataaaa

SEQ ID NO: 271351 - DNA, 15 bp, Homo sapiens
tcaaggttatataaa

SEQ ID NO: 271352 - DNA, 15 bp, Homo sapiens
atcaaggttatataa

SEQ ID NO: 271353 - DNA, 15 bp, Homo sapiens
aatcaaggttatata

SEQ ID NO: 271354 - DNA, 15 bp, Homo sapiens
aaatcaaggttatat

SEQ ID NO: 271355 - DNA, 15 bp, Homo sapiens
caaatcaaggttata

SEQ ID NO: 271356 - DNA, 15 bp, Homo sapiens
gcaaatcaaggttat

SEQ ID NO: 271357 - DNA, 15 bp, Homo sapiens
ggcaaatcaaggtta

SEQ ID NO: 271358 - DNA, 15 bp, Homo sapiens
aggcaaatcaaggtt

SEQ ID NO: 271359 - DNA, 15 bp, Homo sapiens
gaggcaaatcaaggt

SEQ ID NO: 271360 - DNA, 15 bp, Homo sapiens
agaggcaaatcaagg

SEQ ID NO: 271361 - DNA, 15 bp, Homo sapiens
aagaggcaaatcaag

SEQ ID NO: 271362 - DNA, 15 bp, Homo sapiens
aaagaggcaaatcaa

SEQ ID NO: 271363 - DNA, 15 bp, Homo sapiens
caaagaggcaaatca

SEQ ID NO: 271364 - DNA, 15 bp, Homo sapiens
acaaagaggcaaatc

SEQ ID NO: 271365 - DNA, 15 bp, Homo sapiens
tacaaagaggcaaat

SEQ ID NO: 271366 - DNA, 15 bp, Homo sapiens
ttacaaagaggcaaa

SEQ ID NO: 271367 - DNA, 15 bp, Homo sapiens
cttacaaagaggcaa

SEQ ID NO: 271368 - DNA, 15 bp, Homo sapiens
gcttacaaagaggca

SEQ ID NO: 271369 - DNA, 15 bp, Homo sapiens
ggcttacaaagaggc

SEQ ID NO: 271370 - DNA, 15 bp, Homo sapiens
aggcttacaaagagg

SEQ ID NO: 271371 - DNA, 15 bp, Homo sapiens
aaggcttacaaagag

SEQ ID NO: 271372 - DNA, 15 bp, Homo sapiens
aaaggcttacaaaga

SEQ ID NO: 271373 - DNA, 15 bp, Homo sapiens
caaaggcttacaaag

SEQ ID NO: 271374 - DNA, 15 bp, Homo sapiens
acaaaggcttacaaa

SEQ ID NO: 271375 - DNA, 15 bp, Homo sapiens
aacaaaggcttacaa

SEQ ID NO: 271376 - DNA, 15 bp, Homo sapiens
aaacaaaggcttaca

SEQ ID NO: 271377 - DNA, 15 bp, Homo sapiens
aaaacaaaggcttac

SEQ ID NO: 271378 - DNA, 15 bp, Homo sapiens
gaaaacaaaggctta

SEQ ID NO: 271379 - DNA, 15 bp, Homo sapiens
ggaaaacaaaggctt

SEQ ID NO: 271380 - DNA, 15 bp, Homo sapiens
aggaaaacaaaggct

SEQ ID NO: 271381 - DNA, 15 bp, Homo sapiens
gaggaaaacaaaggc

SEQ ID NO: 271382 - DNA, 15 bp, Homo sapiens
agaggaaaacaaagg

SEQ ID NO: 271383 - DNA, 15 bp, Homo sapiens
cagaggaaaacaaag

SEQ ID NO: 271384 - DNA, 15 bp, Homo sapiens
acagaggaaaacaaa

SEQ ID NO: 271385 - DNA, 15 bp, Homo sapiens
tacagaggaaaacaa

SEQ ID NO: 271386 - DNA, 15 bp, Homo sapiens
atacagaggaaaaca

SEQ ID NO: 271387 - DNA, 15 bp, Homo sapiens
catacagaggaaaac

SEQ ID NO: 271388 - DNA, 15 bp, Homo sapiens
acatacagaggaaaa

SEQ ID NO: 271389 - DNA, 15 bp, Homo sapiens
tacatacagaggaaa

SEQ ID NO: 271390 - DNA, 15 bp, Homo sapiens
ttacatacagaggaa

SEQ ID NO: 271391 - DNA, 15 bp, Homo sapiens
gttacatacagagga

SEQ ID NO: 271392 - DNA, 15 bp, Homo sapiens
agttacatacagagg

SEQ ID NO: 271393 - DNA, 15 bp, Homo sapiens
aagttacatacagag

SEQ ID NO: 271394 - DNA, 15 bp, Homo sapiens
taagttacatacaga

SEQ ID NO: 271395 - DNA, 15 bp, Homo sapiens
ataagttacatacag

SEQ ID NO: 271396 - DNA, 15 bp, Homo sapiens
aataagttacataca

SEQ ID NO: 271397 - DNA, 15 bp, Homo sapiens
gaataagttacatac

SEQ ID NO: 271398 - DNA, 15 bp, Homo sapiens
tgaataagttacata

SEQ ID NO: 271399 - DNA, 15 bp, Homo sapiens
atgaataagttacat

SEQ ID NO: 271400 - DNA, 15 bp, Homo sapiens
tatgaataagttaca

SEQ ID NO: 271401 - DNA, 15 bp, Homo sapiens
atatgaataagttac

SEQ ID NO: 271402 - DNA, 15 bp, Homo sapiens
aatatgaataagtta

SEQ ID NO: 271403 - DNA, 15 bp, Homo sapiens
aaatatgaataagtt

SEQ ID NO: 271404 - DNA, 15 bp, Homo sapiens
caaatatgaataagt

SEQ ID NO: 271405 - DNA, 15 bp, Homo sapiens
acaaatatgaataag

SEQ ID NO: 271406 - DNA, 15 bp, Homo sapiens
tacaaatatgaataa

SEQ ID NO: 271407 - DNA, 15 bp, Homo sapiens
ttacaaatatgaata

SEQ ID NO: 271408 - DNA, 15 bp, Homo sapiens
attacaaatatgaat

SEQ ID NO: 271409 - DNA, 15 bp, Homo sapiens
aattacaaatatgaa

SEQ ID NO: 271410 - DNA, 15 bp, Homo sapiens
taattacaaatatga

SEQ ID NO: 271411 - DNA, 15 bp, Homo sapiens
ttaattacaaatatg

SEQ ID NO: 271412 - DNA, 15 bp, Homo sapiens
gttaattacaaatat

SEQ ID NO: 271413 - DNA, 15 bp, Homo sapiens
tgttaattacaaata

SEQ ID NO: 271414 - DNA, 15 bp, Homo sapiens
ttgttaattacaaat

SEQ ID NO: 271415 - DNA, 15 bp, Homo sapiens
attgttaattacaaa

SEQ ID NO: 271416 - DNA, 15 bp, Homo sapiens
aattgttaattacaa

SEQ ID NO: 271417 - DNA, 15 bp, Homo sapiens
aaattgttaattaca

SEQ ID NO: 271418 - DNA, 15 bp, Homo sapiens
taaattgttaattac

SEQ ID NO: 271419 - DNA, 15 bp, Homo sapiens
ttaaattgttaatta

SEQ ID NO: 271420 - DNA, 15 bp, Homo sapiens
tttaaattgttaatt

SEQ ID NO: 271421 - DNA, 15 bp, Homo sapiens
atttaaattgttaat

SEQ ID NO: 271422 - DNA, 15 bp, Homo sapiens
gatttaaattgttaa

SEQ ID NO: 271423 - DNA, 15 bp, Homo sapiens
ggatttaaattgtta

SEQ ID NO: 271424 - DNA, 15 bp, Homo sapiens
tggatttaaattgtt

SEQ ID NO: 271425 - DNA, 15 bp, Homo sapiens
gtggatttaaattgt

SEQ ID NO: 271426 - DNA, 15 bp, Homo sapiens
agtggatttaaattg

SEQ ID NO: 271427 - DNA, 15 bp, Homo sapiens
cagtggatttaaatt

SEQ ID NO: 271428 - DNA, 15 bp, Homo sapiens
acagtggatttaaat

SEQ ID NO: 271429 - DNA, 15 bp, Homo sapiens
aacagtggatttaaa

SEQ ID NO: 271430 - DNA, 15 bp, Homo sapiens
aaacagtggatttaa

SEQ ID NO: 271431 - DNA, 15 bp, Homo sapiens
caaacagtggattta

SEQ ID NO: 271432 - DNA, 15 bp, Homo sapiens
ccaaacagtggattt

SEQ ID NO: 271433 - DNA, 15 bp, Homo sapiens
tccaaacagtggatt

SEQ ID NO: 271434 - DNA, 15 bp, Homo sapiens
ctccaaacagtggat

SEQ ID NO: 271435 - DNA, 15 bp, Homo sapiens
gctccaaacagtgga

SEQ ID NO: 271436 - DNA, 15 bp, Homo sapiens
tgctccaaacagtgg

SEQ ID NO: 271437 - DNA, 15 bp, Homo sapiens
atgctccaaacagtg

SEQ ID NO: 271438 - DNA, 15 bp, Homo sapiens
aatgctccaaacagt

SEQ ID NO: 271439 - DNA, 15 bp, Homo sapiens
taatgctccaaacag

SEQ ID NO: 271440 - DNA, 15 bp, Homo sapiens
ttaatgctccaaaca

SEQ ID NO: 271441 - DNA, 15 bp, Homo sapiens
cttaatgctccaaac

SEQ ID NO: 271442 - DNA, 15 bp, Homo sapiens
ccttaatgctccaaa

SEQ ID NO: 271443 - DNA, 15 bp, Homo sapiens
tccttaatgctccaa

SEQ ID NO: 271444 - DNA, 15 bp, Homo sapiens
ttccttaatgctcca

SEQ ID NO: 271445 - DNA, 15 bp, Homo sapiens
attccttaatgctcc

SEQ ID NO: 271446 - DNA, 15 bp, Homo sapiens
aattccttaatgctc

SEQ ID NO: 271447 - DNA, 15 bp, Homo sapiens
taattccttaatgct

SEQ ID NO: 271448 - DNA, 15 bp, Homo sapiens
ctaattccttaatgc

SEQ ID NO: 271449 - DNA, 15 bp, Homo sapiens
actaattccttaatg

SEQ ID NO: 271450 - DNA, 15 bp, Homo sapiens
aactaattccttaat

SEQ ID NO: 271451 - DNA, 15 bp, Homo sapiens
taactaattccttaa

SEQ ID NO: 271452 - DNA, 15 bp, Homo sapiens
ttaactaattcctta

SEQ ID NO: 271453 - DNA, 15 bp, Homo sapiens
attaactaattcctt

SEQ ID NO: 271454 - DNA, 15 bp, Homo sapiens
tattaactaattcct

SEQ ID NO: 271455 - DNA, 15 bp, Homo sapiens
gtattaactaattcc

SEQ ID NO: 271456 - DNA, 15 bp, Homo sapiens
agtattaactaattc

SEQ ID NO: 271457 - DNA, 15 bp, Homo sapiens
cagtattaactaatt

SEQ ID NO: 271458 - DNA, 15 bp, Homo sapiens
tcagtattaactaat

SEQ ID NO: 271459 - DNA, 15 bp, Homo sapiens
atcagtattaactaa

SEQ ID NO: 271460 - DNA, 15 bp, Homo sapiens
tatcagtattaacta

SEQ ID NO: 271461 - DNA, 15 bp, Homo sapiens
atatcagtattaact

SEQ ID NO: 271462 - DNA, 15 bp, Homo sapiens
gatatcagtattaac

SEQ ID NO: 271463 - DNA, 15 bp, Homo sapiens
agatatcagtattaa

SEQ ID NO: 271464 - DNA, 15 bp, Homo sapiens
gagatatcagtatta

SEQ ID NO: 271465 - DNA, 15 bp, Homo sapiens
tgagatatcagtatt

SEQ ID NO: 271466 - DNA, 15 bp, Homo sapiens
ttgagatatcagtat

SEQ ID NO: 271467 - DNA, 15 bp, Homo sapiens
cttgagatatcagta

SEQ ID NO: 271468 - DNA, 15 bp, Homo sapiens
acttgagatatcagt

SEQ ID NO: 271469 - DNA, 15 bp, Homo sapiens
aacttgagatatcag

SEQ ID NO: 271470 - DNA, 15 bp, Homo sapiens
taacttgagatatca

SEQ ID NO: 271471 - DNA, 15 bp, Homo sapiens
ttaacttgagatatc

SEQ ID NO: 271472 - DNA, 15 bp, Homo sapiens
cttaacttgagatat

SEQ ID NO: 271473 - DNA, 15 bp, Homo sapiens
tcttaacttgagata

SEQ ID NO: 271474 - DNA, 15 bp, Homo sapiens
ttcttaacttgagat

SEQ ID NO: 271475 - DNA, 15 bp, Homo sapiens
cttcttaacttgaga

SEQ ID NO: 271476 - DNA, 15 bp, Homo sapiens
acttcttaacttgag

SEQ ID NO: 271477 - DNA, 15 bp, Homo sapiens
cacttcttaacttga

SEQ ID NO: 271478 - DNA, 15 bp, Homo sapiens
tcacttcttaacttg

SEQ ID NO: 271479 - DNA, 15 bp, Homo sapiens
gtcacttcttaactt

SEQ ID NO: 271480 - DNA, 15 bp, Homo sapiens
agtcacttcttaact

SEQ ID NO: 271481 - DNA, 15 bp, Homo sapiens
gagtcacttcttaac

SEQ ID NO: 271482 - DNA, 15 bp, Homo sapiens
ggagtcacttcttaa

SEQ ID NO: 271483 - DNA, 15 bp, Homo sapiens
gggagtcacttctta

SEQ ID NO: 271484 - DNA, 15 bp, Homo sapiens
ggggagtcacttctt

SEQ ID NO: 271485 - DNA, 15 bp, Homo sapiens
tggggagtcacttct

SEQ ID NO: 271486 - DNA, 15 bp, Homo sapiens
ttggggagtcacttc

SEQ ID NO: 271487 - DNA, 15 bp, Homo sapiens
tttggggagtcactt

SEQ ID NO: 271488 - DNA, 15 bp, Homo sapiens
ttttggggagtcact

SEQ ID NO: 271489 - DNA, 15 bp, Homo sapiens
tttttggggagtcac

SEQ ID NO: 271490 - DNA, 15 bp, Homo sapiens
ttttttggggagtca

SEQ ID NO: 271491 - DNA, 15 bp, Homo sapiens
tttttttggggagtc

SEQ ID NO: 271492 - DNA, 15 bp, Homo sapiens
ttttttttggggagt

SEQ ID NO: 271493 - DNA, 15 bp, Homo sapiens
cttttttttggggag

SEQ ID NO: 271494 - DNA, 15 bp, Homo sapiens
acttttttttgggga

SEQ ID NO: 271495 - DNA, 15 bp, Homo sapiens
aacttttttttgggg

SEQ ID NO: 271496 - DNA, 15 bp, Homo sapiens
caacttttttttggg

SEQ ID NO: 271497 - DNA, 15 bp, Homo sapiens
acaacttttttttgg

SEQ ID NO: 271498 - DNA, 15 bp, Homo sapiens
cacaacttttttttg

SEQ ID NO: 271499 - DNA, 15 bp, Homo sapiens
ccacaactttttttt

SEQ ID NO: 271500 - DNA, 15 bp, Homo sapiens
cccacaacttttttt

SEQ ID NO: 271501 - DNA, 15 bp, Homo sapiens
ccccacaactttttt

SEQ ID NO: 271502 - DNA, 15 bp, Homo sapiens
tccccacaacttttt

SEQ ID NO: 271503 - DNA, 15 bp, Homo sapiens
ctccccacaactttt

SEQ ID NO: 271504 - DNA, 15 bp, Homo sapiens
tctccccacaacttt

SEQ ID NO: 271505 - DNA, 15 bp, Homo sapiens
ttctccccacaactt

SEQ ID NO: 271506 - DNA, 15 bp, Homo sapiens
attctccccacaact

SEQ ID NO: 271507 - DNA, 15 bp, Homo sapiens
aattctccccacaac

SEQ ID NO: 271508 - DNA, 15 bp, Homo sapiens
taattctccccacaa

SEQ ID NO: 271509 - DNA, 15 bp, Homo sapiens
ttaattctccccaca

SEQ ID NO: 271510 - DNA, 15 bp, Homo sapiens
tttaattctccccac

SEQ ID NO: 271511 - DNA, 15 bp, Homo sapiens
ttttaattctcccca

SEQ ID NO: 271512 - DNA, 15 bp, Homo sapiens
gttttaattctcccc

SEQ ID NO: 271513 - DNA, 15 bp, Homo sapiens
tgttttaattctccc

SEQ ID NO: 271514 - DNA, 15 bp, Homo sapiens
ttgttttaattctcc

SEQ ID NO: 271515 - DNA, 15 bp, Homo sapiens
tttgttttaattctc

SEQ ID NO: 271516 - DNA, 15 bp, Homo sapiens
atttgttttaattct

SEQ ID NO: 271517 - DNA, 15 bp, Homo sapiens
tatttgttttaattc

SEQ ID NO: 271518 - DNA, 15 bp, Homo sapiens
atatttgttttaatt

SEQ ID NO: 271519 - DNA, 15 bp, Homo sapiens
aatatttgttttaat

SEQ ID NO: 271520 - DNA, 15 bp, Homo sapiens
aaatatttgttttaa

SEQ ID NO: 271521 - DNA, 15 bp, Homo sapiens
aaaatatttgtttta

SEQ ID NO: 271522 - DNA, 15 bp, Homo sapiens
gaaaatatttgtttt

SEQ ID NO: 271523 - DNA, 15 bp, Homo sapiens
agaaaatatttgttt

SEQ ID NO: 271524 - DNA, 15 bp, Homo sapiens
cagaaaatatttgtt

SEQ ID NO: 271525 - DNA, 15 bp, Homo sapiens
acagaaaatatttgt

SEQ ID NO: 271526 - DNA, 15 bp, Homo sapiens
aacagaaaatatttg

SEQ ID NO: 271527 - DNA, 15 bp, Homo sapiens
aaacagaaaatattt

SEQ ID NO: 271528 - DNA, 15 bp, Homo sapiens
aaaacagaaaatatt

SEQ ID NO: 271529 - DNA, 15 bp, Homo sapiens
caaaacagaaaatat

SEQ ID NO: 271530 - DNA, 15 bp, Homo sapiens
acaaaacagaaaata

SEQ ID NO: 271531 - DNA, 15 bp, Homo sapiens
aacaaaacagaaaat

SEQ ID NO: 271532 - DNA, 15 bp, Homo sapiens
aaacaaaacagaaaa

SEQ ID NO: 271533 - DNA, 15 bp, Homo sapiens
aaaacaaaacagaaa

SEQ ID NO: 271534 - DNA, 15 bp, Homo sapiens
caaaacaaaacagaa

SEQ ID NO: 271535 - DNA, 15 bp, Homo sapiens
acaaaacaaaacaga

SEQ ID NO: 271536 - DNA, 15 bp, Homo sapiens
aacaaaacaaaacag

SEQ ID NO: 271537 - DNA, 15 bp, Homo sapiens
gaaacaaaacaaaac

SEQ ID NO: 271538 - DNA, 15 bp, Homo sapiens
agaaacaaaacaaaa

SEQ ID NO: 271539 - DNA, 15 bp, Homo sapiens
aagaaacaaaacaaa

SEQ ID NO: 271540 - DNA, 15 bp, Homo sapiens
aaagaaacaaaacaa

SEQ ID NO: 271541 - DNA, 15 bp, Homo sapiens
taaagaaacaaaaca

SEQ ID NO: 271542 - DNA, 15 bp, Homo sapiens
ataaagaaacaaaac

SEQ ID NO: 271543 - DNA, 15 bp, Homo sapiens
aataaagaaacaaaa

SEQ ID NO: 271544 - DNA, 15 bp, Homo sapiens
aaataaagaaacaaa

SEQ ID NO: 271545 - DNA, 15 bp, Homo sapiens
caaataaagaaacaa

SEQ ID NO: 271546 - DNA, 15 bp, Homo sapiens
acaaataaagaaaca

SEQ ID NO: 271547 - DNA, 15 bp, Homo sapiens
cacaaataaagaaac

SEQ ID NO: 271548 - DNA, 15 bp, Homo sapiens
ccacaaataaagaaa

SEQ ID NO: 271549 - DNA, 15 bp, Homo sapiens
accacaaataaagaa

SEQ ID NO: 271550 - DNA, 15 bp, Homo sapiens
aaccacaaataaaga

SEQ ID NO: 271551 - DNA, 15 bp, Homo sapiens
gaaccacaaataaag

SEQ ID NO: 271552 - DNA, 15 bp, Homo sapiens
agaaccacaaataaa

SEQ ID NO: 271553 - DNA, 15 bp, Homo sapiens
aagaaccacaaataa

SEQ ID NO: 271554 - DNA, 15 bp, Homo sapiens
aaagaaccacaaata

SEQ ID NO: 271555 - DNA, 15 bp, Homo sapiens
taaagaaccacaaat

SEQ ID NO: 271556 - DNA, 15 bp, Homo sapiens
ataaagaaccacaaa

SEQ ID NO: 271557 - DNA, 15 bp, Homo sapiens
gataaagaaccacaa

SEQ ID NO: 271558 - DNA, 15 bp, Homo sapiens
agataaagaaccaca

SEQ ID NO: 271559 - DNA, 15 bp, Homo sapiens
aagataaagaaccac

SEQ ID NO: 271560 - DNA, 15 bp, Homo sapiens
caagataaagaacca

SEQ ID NO: 271561 - DNA, 15 bp, Homo sapiens
acaagataaagaacc

SEQ ID NO: 271562 - DNA, 15 bp, Homo sapiens
aacaagataaagaac

SEQ ID NO: 271563 - DNA, 15 bp, Homo sapiens
aaacaagataaagaa

SEQ ID NO: 271564 - DNA, 15 bp, Homo sapiens
aaaacaagataaaga

SEQ ID NO: 271565 - DNA, 15 bp, Homo sapiens
caaaacaagataaag

SEQ ID NO: 271566 - DNA, 15 bp, Homo sapiens
acaaaacaagataaa

SEQ ID NO: 271567 - DNA, 15 bp, Homo sapiens
aacaaaacaagataa

SEQ ID NO: 271568 - DNA, 15 bp, Homo sapiens
aaacaaaacaagata

SEQ ID NO: 271569 - DNA, 15 bp, Homo sapiens
taaacaaaacaagat

SEQ ID NO: 271570 - DNA, 15 bp, Homo sapiens
ttaaacaaaacaaga

SEQ ID NO: 271571 - DNA, 15 bp, Homo sapiens
tttaaacaaaacaag

SEQ ID NO: 271572 - DNA, 15 bp, Homo sapiens
atttaaacaaaacaa

SEQ ID NO: 271573 - DNA, 15 bp, Homo sapiens
aatttaaacaaaaca

SEQ ID NO: 271574 - DNA, 15 bp, Homo sapiens
caatttaaacaaaac

SEQ ID NO: 271575 - DNA, 15 bp, Homo sapiens
acaatttaaacaaaa

SEQ ID NO: 271576 - DNA, 15 bp, Homo sapiens
aacaatttaaacaaa

SEQ ID NO: 271577 - DNA, 15 bp, Homo sapiens
aaacaatttaaacaa

SEQ ID NO: 271578 - DNA, 15 bp, Homo sapiens
caaacaatttaaaca

SEQ ID NO: 271579 - DNA, 15 bp, Homo sapiens
ccaaacaatttaaac

SEQ ID NO: 271580 - DNA, 15 bp, Homo sapiens
accaaacaatttaaa

SEQ ID NO: 271581 - DNA, 15 bp, Homo sapiens
taccaaacaatttaa

SEQ ID NO: 271582 - DNA, 15 bp, Homo sapiens
ttaccaaacaattta

SEQ ID NO: 271583 - DNA, 15 bp, Homo sapiens
attaccaaacaattt

SEQ ID NO: 271584 - DNA, 15 bp, Homo sapiens
aattaccaaacaatt

SEQ ID NO: 271585 - DNA, 15 bp, Homo sapiens
taattaccaaacaat

SEQ ID NO: 271586 - DNA, 15 bp, Homo sapiens
ctaattaccaaacaa

SEQ ID NO: 271587 - DNA, 15 bp, Homo sapiens
tctaattaccaaaca

SEQ ID NO: 271588 - DNA, 15 bp, Homo sapiens
ttctaattaccaaac

SEQ ID NO: 271589 - DNA, 15 bp, Homo sapiens
cttctaattaccaaa

SEQ ID NO: 271590 - DNA, 15 bp, Homo sapiens
acttctaattaccaa

SEQ ID NO: 271591 - DNA, 15 bp, Homo sapiens
aacttctaattacca

SEQ ID NO: 271592 - DNA, 15 bp, Homo sapiens
taacttctaattacc

SEQ ID NO: 271593 - DNA, 15 bp, Homo sapiens
ataacttctaattac

SEQ ID NO: 271594 - DNA, 15 bp, Homo sapiens
aataacttctaatta

SEQ ID NO: 271595 - DNA, 15 bp, Homo sapiens
aaataacttctaatt

SEQ ID NO: 271596 - DNA, 15 bp, Homo sapiens
taaataacttctaat

SEQ ID NO: 271597 - DNA, 15 bp, Homo sapiens
gtaaataacttctaa

SEQ ID NO: 271598 - DNA, 15 bp, Homo sapiens
cgtaaataacttcta

SEQ ID NO: 271599 - DNA, 15 bp, Homo sapiens
ccgtaaataacttct

SEQ ID NO: 271600 - DNA, 15 bp, Homo sapiens
cccgtaaataacttc

SEQ ID NO: 271601 - DNA, 15 bp, Homo sapiens
tcccgtaaataactt

SEQ ID NO: 271602 - DNA, 15 bp, Homo sapiens
atcccgtaaataact

SEQ ID NO: 271603 - DNA, 15 bp, Homo sapiens
aatcccgtaaataac

SEQ ID NO: 271604 - DNA, 15 bp, Homo sapiens
aaatcccgtaaataa

SEQ ID NO: 271605 - DNA, 15 bp, Homo sapiens
taaatcccgtaaata

SEQ ID NO: 271606 - DNA, 15 bp, Homo sapiens
ctaaatcccgtaaat

SEQ ID NO: 271607 - DNA, 15 bp, Homo sapiens
cctaaatcccgtaaa

SEQ ID NO: 271608 - DNA, 15 bp, Homo sapiens
acctaaatcccgtaa

SEQ ID NO: 271609 - DNA, 15 bp, Homo sapiens
aacctaaatcccgta

SEQ ID NO: 271610 - DNA, 15 bp, Homo sapiens
taacctaaatcccgt

SEQ ID NO: 271611 - DNA, 15 bp, Homo sapiens
ataacctaaatcccg

SEQ ID NO: 271612 - DNA, 15 bp, Homo sapiens
aataacctaaatccc

SEQ ID NO: 271613 - DNA, 15 bp, Homo sapiens
aaataacctaaatcc

SEQ ID NO: 271614 - DNA, 15 bp, Homo sapiens
caaataacctaaatc

SEQ ID NO: 271615 - DNA, 15 bp, Homo sapiens
ccaaataacctaaat

SEQ ID NO: 271616 - DNA, 15 bp, Homo sapiens
accaaataacctaaa

SEQ ID NO: 271617 - DNA, 15 bp, Homo sapiens
taccaaataacctaa

SEQ ID NO: 271618 - DNA, 15 bp, Homo sapiens
ctaccaaataaccta

SEQ ID NO: 271619 - DNA, 15 bp, Homo sapiens
gctaccaaataacct

SEQ ID NO: 271620 - DNA, 15 bp, Homo sapiens
tgctaccaaataacc

SEQ ID NO: 271621 - DNA, 15 bp, Homo sapiens
atgctaccaaataac

SEQ ID NO: 271622 - DNA, 15 bp, Homo sapiens
aatgctaccaaataa

SEQ ID NO: 271623 - DNA, 15 bp, Homo sapiens
caatgctaccaaata

SEQ ID NO: 271624 - DNA, 15 bp, Homo sapiens
acaatgctaccaaat

SEQ ID NO: 271625 - DNA, 15 bp, Homo sapiens
tacaatgctaccaaa

SEQ ID NO: 271626 - DNA, 15 bp, Homo sapiens
ttacaatgctaccaa

SEQ ID NO: 271627 - DNA, 15 bp, Homo sapiens
tttacaatgctacca

SEQ ID NO: 271628 - DNA, 15 bp, Homo sapiens
atttacaatgctacc

SEQ ID NO: 271629 - DNA, 15 bp, Homo sapiens
tatttacaatgctac

SEQ ID NO: 271630 - DNA, 15 bp, Homo sapiens
ctatttacaatgcta

SEQ ID NO: 271631 - DNA, 15 bp, Homo sapiens
gctatttacaatgct

SEQ ID NO: 271632 - DNA, 15 bp, Homo sapiens
agctatttacaatgc

SEQ ID NO: 271633 - DNA, 15 bp, Homo sapiens
aagctatttacaatg

SEQ ID NO: 271634 - DNA, 15 bp, Homo sapiens
gaagctatttacaat

SEQ ID NO: 271635 - DNA, 15 bp, Homo sapiens
ggaagctatttacaa

SEQ ID NO: 271636 - DNA, 15 bp, Homo sapiens
aggaagctatttaca

SEQ ID NO: 271637 - DNA, 15 bp, Homo sapiens
aaggaagctatttac

SEQ ID NO: 271638 - DNA, 15 bp, Homo sapiens
aaaggaagctattta

SEQ ID NO: 271639 - DNA, 15 bp, Homo sapiens
gaaaggaagctattt

SEQ ID NO: 271640 - DNA, 15 bp, Homo sapiens
tgaaaggaagctatt

SEQ ID NO: 271641 - DNA, 15 bp, Homo sapiens
atgaaaggaagctat

SEQ ID NO: 271642 - DNA, 15 bp, Homo sapiens
catgaaaggaagcta

SEQ ID NO: 271643 - DNA, 15 bp, Homo sapiens
acatgaaaggaagct

SEQ ID NO: 271644 - DNA, 15 bp, Homo sapiens
cacatgaaaggaagc

SEQ ID NO: 271645 - DNA, 15 bp, Homo sapiens
acacatgaaaggaag

SEQ ID NO: 271646 - DNA, 15 bp, Homo sapiens
aacacatgaaaggaa

SEQ ID NO: 271647 - DNA, 15 bp, Homo sapiens
caacacatgaaagga

SEQ ID NO: 271648 - DNA, 15 bp, Homo sapiens
gcaacacatgaaagg

SEQ ID NO: 271649 - DNA, 15 bp, Homo sapiens
agcaacacatgaaag

SEQ ID NO: 271650 - DNA, 15 bp, Homo sapiens
aagcaacacatgaaa

SEQ ID NO: 271651 - DNA, 15 bp, Homo sapiens
aaagcaacacatgaa

SEQ ID NO: 271652 - DNA, 15 bp, Homo sapiens
caaagcaacacatga

SEQ ID NO: 271653 - DNA, 15 bp, Homo sapiens
gcaaagcaacacatg

SEQ ID NO: 271654 - DNA, 15 bp, Homo sapiens
ggcaaagcaacacat

SEQ ID NO: 271655 - DNA, 15 bp, Homo sapiens
cggcaaagcaacaca

SEQ ID NO: 271656 - DNA, 15 bp, Homo sapiens
ccggcaaagcaacac

SEQ ID NO: 271657 - DNA, 15 bp, Homo sapiens
accggcaaagcaaca

SEQ ID NO: 271658 - DNA, 15 bp, Homo sapiens
gaccggcaaagcaac

SEQ ID NO: 271659 - DNA, 15 bp, Homo sapiens
agaccggcaaagcaa

SEQ ID NO: 271660 - DNA, 15 bp, Homo sapiens
aagaccggcaaagca

SEQ ID NO: 271661 - DNA, 15 bp, Homo sapiens
aaagaccggcaaagc

SEQ ID NO: 271662 - DNA, 15 bp, Homo sapiens
caaagaccggcaaag

SEQ ID NO: 271663 - DNA, 15 bp, Homo sapiens
ccaaagaccggcaaa

SEQ ID NO: 271664 - DNA, 15 bp, Homo sapiens
cccaaagaccggcaa

SEQ ID NO: 271665 - DNA, 15 bp, Homo sapiens
ccccaaagaccggca

SEQ ID NO: 271666 - DNA, 15 bp, Homo sapiens
tccccaaagaccggc

SEQ ID NO: 271667 - DNA, 15 bp, Homo sapiens
atccccaaagaccgg

SEQ ID NO: 271668 - DNA, 15 bp, Homo sapiens
tatccccaaagaccg

SEQ ID NO: 271669 - DNA, 15 bp, Homo sapiens
ttatccccaaagacc

SEQ ID NO: 271670 - DNA, 15 bp, Homo sapiens
attatccccaaagac

SEQ ID NO: 271671 - DNA, 15 bp, Homo sapiens
tattatccccaaaga

SEQ ID NO: 271672 - DNA, 15 bp, Homo sapiens
ttattatccccaaag

SEQ ID NO: 271673 - DNA, 15 bp, Homo sapiens
attattatccccaaa

SEQ ID NO: 271674 - DNA, 15 bp, Homo sapiens
tattattatccccaa

SEQ ID NO: 271675 - DNA, 15 bp, Homo sapiens
ttattattatcccca

SEQ ID NO: 271676 - DNA, 15 bp, Homo sapiens
cttattattatcccc

SEQ ID NO: 271677 - DNA, 15 bp, Homo sapiens
tcttattattatccc

SEQ ID NO: 271678 - DNA, 15 bp, Homo sapiens
ctcttattattatcc

SEQ ID NO: 271679 - DNA, 15 bp, Homo sapiens
actcttattattatc

SEQ ID NO: 271680 - DNA, 15 bp, Homo sapiens
gactcttattattat

SEQ ID NO: 271681 - DNA, 15 bp, Homo sapiens
ggactcttattatta

SEQ ID NO: 271682 - DNA, 15 bp, Homo sapiens
aggactcttattatt

SEQ ID NO: 271683 - DNA, 15 bp, Homo sapiens
aaggactcttattat

SEQ ID NO: 271684 - DNA, 15 bp, Homo sapiens
aaaggactcttatta

SEQ ID NO: 271685 - DNA, 15 bp, Homo sapiens
caaaggactcttatt

SEQ ID NO: 271686 - DNA, 15 bp, Homo sapiens
tcaaaggactcttat

SEQ ID NO: 271687 - DNA, 15 bp, Homo sapiens
ctcaaaggactctta

SEQ ID NO: 271688 - DNA, 15 bp, Homo sapiens
gctcaaaggactctt

SEQ ID NO: 271689 - DNA, 15 bp, Homo sapiens
agctcaaaggactct

SEQ ID NO: 271690 - DNA, 15 bp, Homo sapiens
cagctcaaaggactc

SEQ ID NO: 271691 - DNA, 15 bp, Homo sapiens
tcagctcaaaggact

SEQ ID NO: 271692 - DNA, 15 bp, Homo sapiens
gtcagctcaaaggac

SEQ ID NO: 271693 - DNA, 15 bp, Homo sapiens
ggtcagctcaaagga

SEQ ID NO: 271694 - DNA, 15 bp, Homo sapiens
aggtcagctcaaagg

SEQ ID NO: 271695 - DNA, 15 bp, Homo sapiens
taggtcagctcaaag

SEQ ID NO: 271696 - DNA, 15 bp, Homo sapiens
ctaggtcagctcaaa

SEQ ID NO: 271697 - DNA, 15 bp, Homo sapiens
actaggtcagctcaa

SEQ ID NO: 271698 - DNA, 15 bp, Homo sapiens
tactaggtcagctca

SEQ ID NO: 271699 - DNA, 15 bp, Homo sapiens
ttactaggtcagctc

SEQ ID NO: 271700 - DNA, 15 bp, Homo sapiens
tttactaggtcagct

SEQ ID NO: 271701 - DNA, 15 bp, Homo sapiens
ctttactaggtcagc

SEQ ID NO: 271702 - DNA, 15 bp, Homo sapiens
gctttactaggtcag

SEQ ID NO: 271703 - DNA, 15 bp, Homo sapiens
ggctttactaggtca

SEQ ID NO: 271704 - DNA, 15 bp, Homo sapiens
cggctttactaggtc

SEQ ID NO: 271705 - DNA, 15 bp, Homo sapiens
acggctttactaggt

SEQ ID NO: 271706 - DNA, 15 bp, Homo sapiens
aacggctttactagg

SEQ ID NO: 271707 - DNA, 15 bp, Homo sapiens
aaacggctttactag

SEQ ID NO: 271708 - DNA, 15 bp, Homo sapiens
taaacggctttacta

SEQ ID NO: 271709 - DNA, 15 bp, Homo sapiens
ataaacggctttact

SEQ ID NO: 271710 - DNA, 15 bp, Homo sapiens
aataaacggctttac

SEQ ID NO: 271711 - DNA, 15 bp, Homo sapiens
gaataaacggcttta

SEQ ID NO: 271712 - DNA, 15 bp, Homo sapiens
tgaataaacggcttt

SEQ ID NO: 271713 - DNA, 15 bp, Homo sapiens
ttgaataaacggctt

SEQ ID NO: 271714 - DNA, 15 bp, Homo sapiens
cttgaataaacggct

SEQ ID NO: 271715 - DNA, 15 bp, Homo sapiens
ccttgaataaacggc

SEQ ID NO: 271716 - DNA, 15 bp, Homo sapiens
tccttgaataaacgg

SEQ ID NO: 271717 - DNA, 15 bp, Homo sapiens
atccttgaataaacg

SEQ ID NO: 271718 - DNA, 15 bp, Homo sapiens
gatccttgaataaac

SEQ ID NO: 271719 - DNA, 15 bp, Homo sapiens
tgatccttgaataaa

SEQ ID NO: 271720 - DNA, 15 bp, Homo sapiens
gtgatccttgaataa

SEQ ID NO: 271721 - DNA, 15 bp, Homo sapiens
agtgatccttgaata

SEQ ID NO: 271722 - DNA, 15 bp, Homo sapiens
aagtgatccttgaat

SEQ ID NO: 271723 - DNA, 15 bp, Homo sapiens
caagtgatccttgaa

SEQ ID NO: 271724 - DNA, 15 bp, Homo sapiens
tcaagtgatccttga

SEQ ID NO: 271725 - DNA, 15 bp, Homo sapiens
atcaagtgatccttg

SEQ ID NO: 271726 - DNA, 15 bp, Homo sapiens
aatcaagtgatcctt

SEQ ID NO: 271727 - DNA, 15 bp, Homo sapiens
taatcaagtgatcct

SEQ ID NO: 271728 - DNA, 15 bp, Homo sapiens
ataatcaagtgatcc

SEQ ID NO: 271729 - DNA, 15 bp, Homo sapiens
cataatcaagtgatc

SEQ ID NO: 271730 - DNA, 15 bp, Homo sapiens
tcataatcaagtgat

SEQ ID NO: 271731 - DNA, 15 bp, Homo sapiens
ttcataatcaagtga

SEQ ID NO: 271732 - DNA, 15 bp, Homo sapiens
attcataatcaagtg

SEQ ID NO: 271733 - DNA, 15 bp, Homo sapiens
tattcataatcaagt

SEQ ID NO: 271734 - DNA, 15 bp, Homo sapiens
gtattcataatcaag

SEQ ID NO: 271735 - DNA, 15 bp, Homo sapiens
agtattcataatcaa

SEQ ID NO: 271736 - DNA, 15 bp, Homo sapiens
cagtattcataatca

SEQ ID NO: 271737 - DNA, 15 bp, Homo sapiens
ccagtattcataatc

SEQ ID NO: 271738 - DNA, 15 bp, Homo sapiens
cccagtattcataat

SEQ ID NO: 271739 - DNA, 15 bp, Homo sapiens
ccccagtattcataa

SEQ ID NO: 271740 - DNA, 15 bp, Homo sapiens
cccccagtattcata

SEQ ID NO: 271741 - DNA, 15 bp, Homo sapiens
tcccccagtattcat

SEQ ID NO: 271742 - DNA, 15 bp, Homo sapiens
ttcccccagtattca

SEQ ID NO: 271743 - DNA, 15 bp, Homo sapiens
cttcccccagtattc

SEQ ID NO: 271744 - DNA, 15 bp, Homo sapiens
ccttcccccagtatt

SEQ ID NO: 271745 - DNA, 15 bp, Homo sapiens
cccttcccccagtat

SEQ ID NO: 271746 - DNA, 15 bp, Homo sapiens
ccccttcccccagta

SEQ ID NO: 271747 - DNA, 15 bp, Homo sapiens
cccccttcccccagt

SEQ ID NO: 271748 - DNA, 15 bp, Homo sapiens
acccccttcccccag

SEQ ID NO: 271749 - DNA, 15 bp, Homo sapiens
aacccccttccccca

SEQ ID NO: 271750 - DNA, 15 bp, Homo sapiens
taacccccttccccc

SEQ ID NO: 271751 - DNA, 15 bp, Homo sapiens
ctaacccccttcccc

SEQ ID NO: 271752 - DNA, 15 bp, Homo sapiens
gctaacccccttccc

SEQ ID NO: 271753 - DNA, 15 bp, Homo sapiens
agctaacccccttcc

SEQ ID NO: 271754 - DNA, 15 bp, Homo sapiens
aagctaacccccttc

SEQ ID NO: 271755 - DNA, 15 bp, Homo sapiens
aaagctaaccccctt

SEQ ID NO: 271756 - DNA, 15 bp, Homo sapiens
aaaagctaaccccct

SEQ ID NO: 271757 - DNA, 15 bp, Homo sapiens
gaaaagctaaccccc

SEQ ID NO: 271758 - DNA, 15 bp, Homo sapiens
agaaaagctaacccc

SEQ ID NO: 271759 - DNA, 15 bp, Homo sapiens
tagaaaagctaaccc

SEQ ID NO: 271760 - DNA, 15 bp, Homo sapiens
gtagaaaagctaacc

SEQ ID NO: 271761 - DNA, 15 bp, Homo sapiens
tgtagaaaagctaac

SEQ ID NO: 271762 - DNA, 15 bp, Homo sapiens
atgtagaaaagctaa

SEQ ID NO: 271763 - DNA, 15 bp, Homo sapiens
aatgtagaaaagcta

SEQ ID NO: 271764 - DNA, 15 bp, Homo sapiens
gaatgtagaaaagct

SEQ ID NO: 271765 - DNA, 15 bp, Homo sapiens
agaatgtagaaaagc

SEQ ID NO: 271766 - DNA, 15 bp, Homo sapiens
tagaatgtagaaaag

SEQ ID NO: 271767 - DNA, 15 bp, Homo sapiens
ctagaatgtagaaaa

SEQ ID NO: 271768 - DNA, 15 bp, Homo sapiens
tctagaatgtagaaa

SEQ ID NO: 271769 - DNA, 15 bp, Homo sapiens
atctagaatgtagaa

SEQ ID NO: 271770 - DNA, 15 bp, Homo sapiens
aatctagaatgtaga

SEQ ID NO: 271771 - DNA, 15 bp, Homo sapiens
gaatctagaatgtag

SEQ ID NO: 271772 - DNA, 15 bp, Homo sapiens
agaatctagaatgta

SEQ ID NO: 271773 - DNA, 15 bp, Homo sapiens
aagaatctagaatgt

SEQ ID NO: 271774 - DNA, 15 bp, Homo sapiens
gaagaatctagaatg

SEQ ID NO: 271775 - DNA, 15 bp, Homo sapiens
agaagaatctagaat

SEQ ID NO: 271776 - DNA, 15 bp, Homo sapiens
tagaagaatctagaa

SEQ ID NO: 271777 - DNA, 15 bp, Homo sapiens
atagaagaatctaga

SEQ ID NO: 271778 - DNA, 15 bp, Homo sapiens
tatagaagaatctag

SEQ ID NO: 271779 - DNA, 15 bp, Homo sapiens
gtatagaagaatcta

SEQ ID NO: 271780 - DNA, 15 bp, Homo sapiens
ggtatagaagaatct

SEQ ID NO: 271781 - DNA, 15 bp, Homo sapiens
aggtatagaagaatc

SEQ ID NO: 271782 - DNA, 15 bp, Homo sapiens
aaggtatagaagaat

SEQ ID NO: 271783 - DNA, 15 bp, Homo sapiens
taaggtatagaagaa

SEQ ID NO: 271784 - DNA, 15 bp, Homo sapiens
ataaggtatagaaga

SEQ ID NO: 271785 - DNA, 15 bp, Homo sapiens
gataaggtatagaag

SEQ ID NO: 271786 - DNA, 15 bp, Homo sapiens
ggataaggtatagaa

SEQ ID NO: 271787 - DNA, 15 bp, Homo sapiens
aggataaggtataga

SEQ ID NO: 271788 - DNA, 15 bp, Homo sapiens
aaggataaggtatag

SEQ ID NO: 271789 - DNA, 15 bp, Homo sapiens
caaggataaggtata

SEQ ID NO: 271790 - DNA, 15 bp, Homo sapiens
gcaaggataaggtat

SEQ ID NO: 271791 - DNA, 15 bp, Homo sapiens
agcaaggataaggta

SEQ ID NO: 271792 - DNA, 15 bp, Homo sapiens
cagcaaggataaggt

SEQ ID NO: 271793 - DNA, 15 bp, Homo sapiens
gcagcaaggataagg

SEQ ID NO: 271794 - DNA, 15 bp, Homo sapiens
agcagcaaggataag

SEQ ID NO: 271795 - DNA, 15 bp, Homo sapiens
aagcagcaaggataa

SEQ ID NO: 271796 - DNA, 15 bp, Homo sapiens
gaagcagcaaggata

SEQ ID NO: 271797 - DNA, 15 bp, Homo sapiens
agaagcagcaaggat

SEQ ID NO: 271798 - DNA, 15 bp, Homo sapiens
aagaagcagcaagga

SEQ ID NO: 271799 - DNA, 15 bp, Homo sapiens
caagaagcagcaagg

SEQ ID NO: 271800 - DNA, 15 bp, Homo sapiens
acaagaagcagcaag

SEQ ID NO: 271801 - DNA, 15 bp, Homo sapiens
cacaagaagcagcaa

SEQ ID NO: 271802 - DNA, 15 bp, Homo sapiens
tcacaagaagcagca

SEQ ID NO: 271803 - DNA, 15 bp, Homo sapiens
atcacaagaagcagc

SEQ ID NO: 271804 - DNA, 15 bp, Homo sapiens
tatcacaagaagcag

SEQ ID NO: 271805 - DNA, 15 bp, Homo sapiens
gtatcacaagaagca

SEQ ID NO: 271806 - DNA, 15 bp, Homo sapiens
tgtatcacaagaagc

SEQ ID NO: 271807 - DNA, 15 bp, Homo sapiens
atgtatcacaagaag

SEQ ID NO: 271808 - DNA, 15 bp, Homo sapiens
tatgtatcacaagaa

SEQ ID NO: 271809 - DNA, 15 bp, Homo sapiens
atatgtatcacaaga

SEQ ID NO: 271810 - DNA, 15 bp, Homo sapiens
aatatgtatcacaag

SEQ ID NO: 271811 - DNA, 15 bp, Homo sapiens
taatatgtatcacaa

SEQ ID NO: 271812 - DNA, 15 bp, Homo sapiens
ctaatatgtatcaca

SEQ ID NO: 271813 - DNA, 15 bp, Homo sapiens
actaatatgtatcac

SEQ ID NO: 271814 - DNA, 15 bp, Homo sapiens
cactaatatgtatca

SEQ ID NO: 271815 - DNA, 15 bp, Homo sapiens
tcactaatatgtatc

SEQ ID NO: 271816 - DNA, 15 bp, Homo sapiens
ttcactaatatgtat

SEQ ID NO: 271817 - DNA, 15 bp, Homo sapiens
tttcactaatatgta

SEQ ID NO: 271818 - DNA, 15 bp, Homo sapiens
ttttcactaatatgt

SEQ ID NO: 271819 - DNA, 15 bp, Homo sapiens
cttttcactaatatg

SEQ ID NO: 271820 - DNA, 15 bp, Homo sapiens
ccttttcactaatat

SEQ ID NO: 271821 - DNA, 15 bp, Homo sapiens
cccttttcactaata

SEQ ID NO: 271822 - DNA, 15 bp, Homo sapiens
tcccttttcactaat

SEQ ID NO: 271823 - DNA, 15 bp, Homo sapiens
ttcccttttcactaa

SEQ ID NO: 271824 - DNA, 15 bp, Homo sapiens
gttcccttttcacta

SEQ ID NO: 271825 - DNA, 15 bp, Homo sapiens
agttcccttttcact

SEQ ID NO: 271826 - DNA, 15 bp, Homo sapiens
aagttcccttttcac

SEQ ID NO: 271827 - DNA, 15 bp, Homo sapiens
aaagttcccttttca

SEQ ID NO: 271828 - DNA, 15 bp, Homo sapiens
gaaagttcccttttc

SEQ ID NO: 271829 - DNA, 15 bp, Homo sapiens
tgaaagttccctttt

SEQ ID NO: 271830 - DNA, 15 bp, Homo sapiens
ctgaaagttcccttt

SEQ ID NO: 271831 - DNA, 15 bp, Homo sapiens
gctgaaagttccctt

SEQ ID NO: 271832 - DNA, 15 bp, Homo sapiens
ggctgaaagttccct

SEQ ID NO: 271833 - DNA, 15 bp, Homo sapiens
tggctgaaagttccc

SEQ ID NO: 271834 - DNA, 15 bp, Homo sapiens
atggctgaaagttcc

SEQ ID NO: 271835 - DNA, 15 bp, Homo sapiens
catggctgaaagttc

SEQ ID NO: 271836 - DNA, 15 bp, Homo sapiens
acatggctgaaagtt

SEQ ID NO: 271837 - DNA, 15 bp, Homo sapiens
tacatggctgaaagt

SEQ ID NO: 271838 - DNA, 15 bp, Homo sapiens
atacatggctgaaag

SEQ ID NO: 271839 - DNA, 15 bp, Homo sapiens
aatacatggctgaaa

SEQ ID NO: 271840 - DNA, 15 bp, Homo sapiens
taatacatggctgaa

SEQ ID NO: 271841 - DNA, 15 bp, Homo sapiens
ttaatacatggctga

SEQ ID NO: 271842 - DNA, 15 bp, Homo sapiens
attaatacatggctg

SEQ ID NO: 271843 - DNA, 15 bp, Homo sapiens
cattaatacatggct

SEQ ID NO: 271844 - DNA, 15 bp, Homo sapiens
gcattaatacatggc

SEQ ID NO: 271845 - DNA, 15 bp, Homo sapiens
agcattaatacatgg

SEQ ID NO: 271846 - DNA, 15 bp, Homo sapiens
aagcattaatacatg

SEQ ID NO: 271847 - DNA, 15 bp, Homo sapiens
aaagcattaatacat

SEQ ID NO: 271848 - DNA, 15 bp, Homo sapiens
aaaagcattaataca

SEQ ID NO: 271849 - DNA, 15 bp, Homo sapiens
caaaagcattaatac

SEQ ID NO: 271850 - DNA, 15 bp, Homo sapiens
tcaaaagcattaata

SEQ ID NO: 271851 - DNA, 15 bp, Homo sapiens
ttcaaaagcattaat

SEQ ID NO: 271852 - DNA, 15 bp, Homo sapiens
cttcaaaagcattaa

SEQ ID NO: 271853 - DNA, 15 bp, Homo sapiens
acttcaaaagcatta

SEQ ID NO: 271854 - DNA, 15 bp, Homo sapiens
aacttcaaaagcatt

SEQ ID NO: 271855 - DNA, 15 bp, Homo sapiens
gaacttcaaaagcat

SEQ ID NO: 271856 - DNA, 15 bp, Homo sapiens
tgaacttcaaaagca

SEQ ID NO: 271857 - DNA, 15 bp, Homo sapiens
ctgaacttcaaaagc

SEQ ID NO: 271858 - DNA, 15 bp, Homo sapiens
actgaacttcaaaag

SEQ ID NO: 271859 - DNA, 15 bp, Homo sapiens
tactgaacttcaaaa

SEQ ID NO: 271860 - DNA, 15 bp, Homo sapiens
ctactgaacttcaaa

SEQ ID NO: 271861 - DNA, 15 bp, Homo sapiens
actactgaacttcaa

SEQ ID NO: 271862 - DNA, 15 bp, Homo sapiens
cactactgaacttca

SEQ ID NO: 271863 - DNA, 15 bp, Homo sapiens
gcactactgaacttc

SEQ ID NO: 271864 - DNA, 15 bp, Homo sapiens
tgcactactgaactt

SEQ ID NO: 271865 - DNA, 15 bp, Homo sapiens
atgcactactgaact

SEQ ID NO: 271866 - DNA, 15 bp, Homo sapiens
tatgcactactgaac

SEQ ID NO: 271867 - DNA, 15 bp, Homo sapiens
ctatgcactactgaa

SEQ ID NO: 271868 - DNA, 15 bp, Homo sapiens
tctatgcactactga

SEQ ID NO: 271869 - DNA, 15 bp, Homo sapiens
atctatgcactactg

SEQ ID NO: 271870 - DNA, 15 bp, Homo sapiens
aatctatgcactact

SEQ ID NO: 271871 - DNA, 15 bp, Homo sapiens
aaatctatgcactac

SEQ ID NO: 271872 - DNA, 15 bp, Homo sapiens
gaaatctatgcacta

SEQ ID NO: 271873 - DNA, 15 bp, Homo sapiens
tgaaatctatgcact

SEQ ID NO: 271874 - DNA, 15 bp, Homo sapiens
ctgaaatctatgcac

SEQ ID NO: 271875 - DNA, 15 bp, Homo sapiens
gctgaaatctatgca

SEQ ID NO: 271876 - DNA, 15 bp, Homo sapiens
tgctgaaatctatgc

SEQ ID NO: 271877 - DNA, 15 bp, Homo sapiens
atgctgaaatctatg

SEQ ID NO: 271878 - DNA, 15 bp, Homo sapiens
tatgctgaaatctat

SEQ ID NO: 271879 - DNA, 15 bp, Homo sapiens
ttatgctgaaatcta

SEQ ID NO: 271880 - DNA, 15 bp, Homo sapiens
tttatgctgaaatct

SEQ ID NO: 271881 - DNA, 15 bp, Homo sapiens
ctttatgctgaaatc

SEQ ID NO: 271882 - DNA, 15 bp, Homo sapiens
actttatgctgaaat

SEQ ID NO: 271883 - DNA, 15 bp, Homo sapiens
tactttatgctgaaa

SEQ ID NO: 271884 - DNA, 15 bp, Homo sapiens
ttactttatgctgaa

SEQ ID NO: 271885 - DNA, 15 bp, Homo sapiens
cttactttatgctga

SEQ ID NO: 271886 - DNA, 15 bp, Homo sapiens
tcttactttatgctg

SEQ ID NO: 271887 - DNA, 15 bp, Homo sapiens
atcttactttatgct

SEQ ID NO: 271888 - DNA, 15 bp, Homo sapiens
aatcttactttatgc

SEQ ID NO: 271889 - DNA, 15 bp, Homo sapiens
taatcttactttatg

SEQ ID NO: 271890 - DNA, 15 bp, Homo sapiens
ataatcttactttat

SEQ ID NO: 271891 - DNA, 15 bp, Homo sapiens
tataatcttacttta

SEQ ID NO: 271892 - DNA, 15 bp, Homo sapiens
gtataatcttacttt

SEQ ID NO: 271893 - DNA, 15 bp, Homo sapiens
tgtataatcttactt

SEQ ID NO: 271894 - DNA, 15 bp, Homo sapiens
ctgtataatcttact

SEQ ID NO: 271895 - DNA, 15 bp, Homo sapiens
actgtataatcttac

SEQ ID NO: 271896 - DNA, 15 bp, Homo sapiens
aactgtataatctta

SEQ ID NO: 271897 - DNA, 15 bp, Homo sapiens
aaactgtataatctt

SEQ ID NO: 271898 - DNA, 15 bp, Homo sapiens
caaactgtataatct

SEQ ID NO: 271899 - DNA, 15 bp, Homo sapiens
gcaaactgtataatc

SEQ ID NO: 271900 - DNA, 15 bp, Homo sapiens
tgcaaactgtataat

SEQ ID NO: 271901 - DNA, 15 bp, Homo sapiens
ttgcaaactgtataa

SEQ ID NO: 271902 - DNA, 15 bp, Homo sapiens
attgcaaactgtata

SEQ ID NO: 271903 - DNA, 15 bp, Homo sapiens
tattgcaaactgtat

SEQ ID NO: 271904 - DNA, 15 bp, Homo sapiens
atattgcaaactgta

SEQ ID NO: 271905 - DNA, 15 bp, Homo sapiens
catattgcaaactgt

SEQ ID NO: 271906 - DNA, 15 bp, Homo sapiens
tcatattgcaaactg

SEQ ID NO: 271907 - DNA, 15 bp, Homo sapiens
ttcatattgcaaact

SEQ ID NO: 271908 - DNA, 15 bp, Homo sapiens
gttcatattgcaaac

SEQ ID NO: 271909 - DNA, 15 bp, Homo sapiens
tgttcatattgcaaa

SEQ ID NO: 271910 - DNA, 15 bp, Homo sapiens
ctgttcatattgcaa

SEQ ID NO: 271911 - DNA, 15 bp, Homo sapiens
cctgttcatattgca

SEQ ID NO: 271912 - DNA, 15 bp, Homo sapiens
ccctgttcatattgc

SEQ ID NO: 271913 - DNA, 15 bp, Homo sapiens
tccctgttcatattg

SEQ ID NO: 271914 - DNA, 15 bp, Homo sapiens
gtccctgttcatatt

SEQ ID NO: 271915 - DNA, 15 bp, Homo sapiens
tgtccctgttcatat

SEQ ID NO: 271916 - DNA, 15 bp, Homo sapiens
atgtccctgttcata

SEQ ID NO: 271917 - DNA, 15 bp, Homo sapiens
tatgtccctgttcat

SEQ ID NO: 271918 - DNA, 15 bp, Homo sapiens
atatgtccctgttca

SEQ ID NO: 271919 - DNA, 15 bp, Homo sapiens
tatatgtccctgttc

SEQ ID NO: 271920 - DNA, 15 bp, Homo sapiens
ctatatgtccctgtt

SEQ ID NO: 271921 - DNA, 15 bp, Homo sapiens
tctatatgtccctgt

SEQ ID NO: 271922 - DNA, 15 bp, Homo sapiens
ttctatatgtccctg

SEQ ID NO: 271923 - DNA, 15 bp, Homo sapiens
cttctatatgtccct

SEQ ID NO: 271924 - DNA, 15 bp, Homo sapiens
ccttctatatgtccc

SEQ ID NO: 271925 - DNA, 15 bp, Homo sapiens
tccttctatatgtcc

SEQ ID NO: 271926 - DNA, 15 bp, Homo sapiens
atccttctatatgtc

SEQ ID NO: 271927 - DNA, 15 bp, Homo sapiens
tatccttctatatgt

SEQ ID NO: 271928 - DNA, 15 bp, Homo sapiens
gtatccttctatatg

SEQ ID NO: 271929 - DNA, 15 bp, Homo sapiens
tgtatccttctatat

SEQ ID NO: 271930 - DNA, 15 bp, Homo sapiens
gtgtatccttctata

SEQ ID NO: 271931 - DNA, 15 bp, Homo sapiens
tgtgtatccttctat

SEQ ID NO: 271932 - DNA, 15 bp, Homo sapiens
atgtgtatccttcta

SEQ ID NO: 271933 - DNA, 15 bp, Homo sapiens
catgtgtatccttct

SEQ ID NO: 271934 - DNA, 15 bp, Homo sapiens
gcatgtgtatccttc

SEQ ID NO: 271935 - DNA, 15 bp, Homo sapiens
tgcatgtgtatcctt

SEQ ID NO: 271936 - DNA, 15 bp, Homo sapiens
atgcatgtgtatcct

SEQ ID NO: 271937 - DNA, 15 bp, Homo sapiens
aatgcatgtgtatcc

SEQ ID NO: 271938 - DNA, 15 bp, Homo sapiens
gaatgcatgtgtatc

SEQ ID NO: 271939 - DNA, 15 bp, Homo sapiens
tgaatgcatgtgtat

SEQ ID NO: 271940 - DNA, 15 bp, Homo sapiens
atgaatgcatgtgta

SEQ ID NO: 271941 - DNA, 15 bp, Homo sapiens
tatgaatgcatgtgt

SEQ ID NO: 271942 - DNA, 15 bp, Homo sapiens
atatgaatgcatgtg

SEQ ID NO: 271943 - DNA, 15 bp, Homo sapiens
tatatgaatgcatgt

SEQ ID NO: 271944 - DNA, 15 bp, Homo sapiens
ctatatgaatgcatg

SEQ ID NO: 271945 - DNA, 15 bp, Homo sapiens
tctatatgaatgcat

SEQ ID NO: 271946 - DNA, 15 bp, Homo sapiens
ctctatatgaatgca

SEQ ID NO: 271947 - DNA, 15 bp, Homo sapiens
tctctatatgaatgc

SEQ ID NO: 271948 - DNA, 15 bp, Homo sapiens
atctctatatgaatg

SEQ ID NO: 271949 - DNA, 15 bp, Homo sapiens
tatctctatatgaat

SEQ ID NO: 271950 - DNA, 15 bp, Homo sapiens
atatctctatatgaa

SEQ ID NO: 271951 - DNA, 15 bp, Homo sapiens
tatatctctatatga

SEQ ID NO: 271952 - DNA, 15 bp, Homo sapiens
gtatatctctatatg

SEQ ID NO: 271953 - DNA, 15 bp, Homo sapiens
tgtatatctctatat

SEQ ID NO: 271954 - DNA, 15 bp, Homo sapiens
ttgtatatctctata

SEQ ID NO: 271955 - DNA, 15 bp, Homo sapiens
tttgtatatctctat

SEQ ID NO: 271956 - DNA, 15 bp, Homo sapiens
gtttgtatatctcta

SEQ ID NO: 271957 - DNA, 15 bp, Homo sapiens
agtttgtatatctct

SEQ ID NO: 271958 - DNA, 15 bp, Homo sapiens
gagtttgtatatctc

SEQ ID NO: 271959 - DNA, 15 bp, Homo sapiens
tgagtttgtatatct

SEQ ID NO: 271960 - DNA, 15 bp, Homo sapiens
ttgagtttgtatatc

SEQ ID NO: 271961 - DNA, 15 bp, Homo sapiens
cttgagtttgtatat

SEQ ID NO: 271962 - DNA, 15 bp, Homo sapiens
gcttgagtttgtata

SEQ ID NO: 271963 - DNA, 15 bp, Homo sapiens
tgcttgagtttgtat

SEQ ID NO: 271964 - DNA, 15 bp, Homo sapiens
ttgcttgagtttgta

SEQ ID NO: 271965 - DNA, 15 bp, Homo sapiens
tttgcttgagtttgt

SEQ ID NO: 271966 - DNA, 15 bp, Homo sapiens
ttttgcttgagtttg

SEQ ID NO: 271967 - DNA, 15 bp, Homo sapiens
cttttgcttgagttt

SEQ ID NO: 271968 - DNA, 15 bp, Homo sapiens
tcttttgcttgagtt

SEQ ID NO: 271969 - DNA, 15 bp, Homo sapiens
atcttttgcttgagt

SEQ ID NO: 271970 - DNA, 15 bp, Homo sapiens
tatcttttgcttgag

SEQ ID NO: 271971 - DNA, 15 bp, Homo sapiens
ctatcttttgcttga

SEQ ID NO: 271972 - DNA, 15 bp, Homo sapiens
tctatcttttgcttg

SEQ ID NO: 271973 - DNA, 15 bp, Homo sapiens
ctctatcttttgctt

SEQ ID NO: 271974 - DNA, 15 bp, Homo sapiens
actctatcttttgct

SEQ ID NO: 271975 - DNA, 15 bp, Homo sapiens
tactctatcttttgc

SEQ ID NO: 271976 - DNA, 15 bp, Homo sapiens
ttactctatcttttg

SEQ ID NO: 271977 - DNA, 15 bp, Homo sapiens
gttactctatctttt

SEQ ID NO: 271978 - DNA, 15 bp, Homo sapiens
agttactctatcttt

SEQ ID NO: 271979 - DNA, 15 bp, Homo sapiens
gagttactctatctt

SEQ ID NO: 271980 - DNA, 15 bp, Homo sapiens
agagttactctatct

SEQ ID NO: 271981 - DNA, 15 bp, Homo sapiens
tagagttactctatc

SEQ ID NO: 271982 - DNA, 15 bp, Homo sapiens
ttagagttactctat

SEQ ID NO: 271983 - DNA, 15 bp, Homo sapiens
tttagagttactcta

SEQ ID NO: 271984 - DNA, 15 bp, Homo sapiens
atttagagttactct

SEQ ID NO: 271985 - DNA, 15 bp, Homo sapiens
aatttagagttactc

SEQ ID NO: 271986 - DNA, 15 bp, Homo sapiens
taatttagagttact

SEQ ID NO: 271987 - DNA, 15 bp, Homo sapiens
ataatttagagttac

SEQ ID NO: 271988 - DNA, 15 bp, Homo sapiens
cataatttagagtta

SEQ ID NO: 271989 - DNA, 15 bp, Homo sapiens
acataatttagagtt

SEQ ID NO: 271990 - DNA, 15 bp, Homo sapiens
aacataatttagagt

SEQ ID NO: 271991 - DNA, 15 bp, Homo sapiens
gaacataatttagag

SEQ ID NO: 271992 - DNA, 15 bp, Homo sapiens
ggaacataatttaga

SEQ ID NO: 271993 - DNA, 15 bp, Homo sapiens
tggaacataatttag

SEQ ID NO: 271994 - DNA, 15 bp, Homo sapiens
atggaacataattta

SEQ ID NO: 271995 - DNA, 15 bp, Homo sapiens
catggaacataattt

SEQ ID NO: 271996 - DNA, 15 bp, Homo sapiens
acatggaacataatt

SEQ ID NO: 271997 - DNA, 15 bp, Homo sapiens
cacatggaacataat

SEQ ID NO: 271998 - DNA, 15 bp, Homo sapiens
tcacatggaacataa

SEQ ID NO: 271999 - DNA, 15 bp, Homo sapiens
atcacatggaacata

SEQ ID NO: 272000 - DNA, 15 bp, Homo sapiens
catcacatggaacat

SEQ ID NO: 272001 - DNA, 15 bp, Homo sapiens
acatcacatggaaca

SEQ ID NO: 272002 - DNA, 15 bp, Homo sapiens
tacatcacatggaac

SEQ ID NO: 272003 - DNA, 15 bp, Homo sapiens
atacatcacatggaa

SEQ ID NO: 272004 - DNA, 15 bp, Homo sapiens
gatacatcacatgga

SEQ ID NO: 272005 - DNA, 15 bp, Homo sapiens
agatacatcacatgg

SEQ ID NO: 272006 - DNA, 15 bp, Homo sapiens
tagatacatcacatg

SEQ ID NO: 272007 - DNA, 15 bp, Homo sapiens
atagatacatcacat

SEQ ID NO: 272008 - DNA, 15 bp, Homo sapiens
tatagatacatcaca

SEQ ID NO: 272009 - DNA, 15 bp, Homo sapiens
atatagatacatcac

SEQ ID NO: 272010 - DNA, 15 bp, Homo sapiens
aatatagatacatca

SEQ ID NO: 272011 - DNA, 15 bp, Homo sapiens
aaatatagatacatc

SEQ ID NO: 272012 - DNA, 15 bp, Homo sapiens
caaatatagatacat

SEQ ID NO: 272013 - DNA, 15 bp, Homo sapiens
acaaatatagataca

SEQ ID NO: 272014 - DNA, 15 bp, Homo sapiens
aacaaatatagatac

SEQ ID NO: 272015 - DNA, 15 bp, Homo sapiens
gaacaaatatagata

SEQ ID NO: 272016 - DNA, 15 bp, Homo sapiens
agaacaaatatagat

SEQ ID NO: 272017 - DNA, 15 bp, Homo sapiens
gagaacaaatataga

SEQ ID NO: 272018 - DNA, 15 bp, Homo sapiens
agagaacaaatatag

SEQ ID NO: 272019 - DNA, 15 bp, Homo sapiens
cagagaacaaatata

SEQ ID NO: 272020 - DNA, 15 bp, Homo sapiens
acagagaacaaatat

SEQ ID NO: 272021 - DNA, 15 bp, Homo sapiens
gacagagaacaaata

SEQ ID NO: 272022 - DNA, 15 bp, Homo sapiens
tgacagagaacaaat

SEQ ID NO: 272023 - DNA, 15 bp, Homo sapiens
ttgacagagaacaaa

SEQ ID NO: 272024 - DNA, 15 bp, Homo sapiens
cttgacagagaacaa

SEQ ID NO: 272025 - DNA, 15 bp, Homo sapiens
ccttgacagagaaca

SEQ ID NO: 272026 - DNA, 15 bp, Homo sapiens
tccttgacagagaac

SEQ ID NO: 272027 - DNA, 15 bp, Homo sapiens
atccttgacagagaa

SEQ ID NO: 272028 - DNA, 15 bp, Homo sapiens
tatccttgacagaga

SEQ ID NO: 272029 - DNA, 15 bp, Homo sapiens
ttatccttgacagag

SEQ ID NO: 272030 - DNA, 15 bp, Homo sapiens
tttatccttgacaga

SEQ ID NO: 272031 - DNA, 15 bp, Homo sapiens
ttttatccttgacag

SEQ ID NO: 272032 - DNA, 15 bp, Homo sapiens
attttatccttgaca

SEQ ID NO: 272033 - DNA, 15 bp, Homo sapiens
cattttatccttgac

SEQ ID NO: 272034 - DNA, 15 bp, Homo sapiens
ccattttatccttga

SEQ ID NO: 272035 - DNA, 15 bp, Homo sapiens
tccattttatccttg

SEQ ID NO: 272036 - DNA, 15 bp, Homo sapiens
ttccattttatcctt

SEQ ID NO: 272037 - DNA, 15 bp, Homo sapiens
cttccattttatcct

SEQ ID NO: 272038 - DNA, 15 bp, Homo sapiens
tcttccattttatcc

SEQ ID NO: 272039 - DNA, 15 bp, Homo sapiens
ttcttccattttatc

SEQ ID NO: 272040 - DNA, 15 bp, Homo sapiens
tttcttccattttat

SEQ ID NO: 272041 - DNA, 15 bp, Homo sapiens
ttttcttccatttta

SEQ ID NO: 272042 - DNA, 15 bp, Homo sapiens
attttcttccatttt

SEQ ID NO: 272043 - DNA, 15 bp, Homo sapiens
aattttcttccattt

SEQ ID NO: 272044 - DNA, 15 bp, Homo sapiens
caattttcttccatt

SEQ ID NO: 272045 - DNA, 15 bp, Homo sapiens
tcaattttcttccat

SEQ ID NO: 272046 - DNA, 15 bp, Homo sapiens
ttcaattttcttcca

SEQ ID NO: 272047 - DNA, 15 bp, Homo sapiens
tttcaattttcttcc

SEQ ID NO: 272048 - DNA, 15 bp, Homo sapiens
ttttcaattttcttc

SEQ ID NO: 272049 - DNA, 15 bp, Homo sapiens
attttcaattttctt

SEQ ID NO: 272050 - DNA, 15 bp, Homo sapiens
aattttcaattttct

SEQ ID NO: 272051 - DNA, 15 bp, Homo sapiens
aaattttcaattttc

SEQ ID NO: 272052 - DNA, 15 bp, Homo sapiens
gaaattttcaatttt

SEQ ID NO: 272053 - DNA, 15 bp, Homo sapiens
ggaaattttcaattt

SEQ ID NO: 272054 - DNA, 15 bp, Homo sapiens
aggaaattttcaatt

SEQ ID NO: 272055 - DNA, 15 bp, Homo sapiens
taggaaattttcaat

SEQ ID NO: 272056 - DNA, 15 bp, Homo sapiens
ttaggaaattttcaa

SEQ ID NO: 272057 - DNA, 15 bp, Homo sapiens
gttaggaaattttca

SEQ ID NO: 272058 - DNA, 15 bp, Homo sapiens
agttaggaaattttc

SEQ ID NO: 272059 - DNA, 15 bp, Homo sapiens
cagttaggaaatttt

SEQ ID NO: 272060 - DNA, 15 bp, Homo sapiens
acagttaggaaattt

SEQ ID NO: 272061 - DNA, 15 bp, Homo sapiens
tacagttaggaaatt

SEQ ID NO: 272062 - DNA, 15 bp, Homo sapiens
atacagttaggaaat

SEQ ID NO: 272063 - DNA, 15 bp, Homo sapiens
aatacagttaggaaa

SEQ ID NO: 272064 - DNA, 15 bp, Homo sapiens
aaatacagttaggaa

SEQ ID NO: 272065 - DNA, 15 bp, Homo sapiens
aaaatacagttagga

SEQ ID NO: 272066 - DNA, 15 bp, Homo sapiens
caaaatacagttagg

SEQ ID NO: 272067 - DNA, 15 bp, Homo sapiens
ccaaaatacagttag

SEQ ID NO: 272068 - DNA, 15 bp, Homo sapiens
accaaaatacagtta

SEQ ID NO: 272069 - DNA, 15 bp, Homo sapiens
aaccaaaatacagtt

SEQ ID NO: 272070 - DNA, 15 bp, Homo sapiens
caaccaaaatacagt

SEQ ID NO: 272071 - DNA, 15 bp, Homo sapiens
ccaaccaaaatacag

SEQ ID NO: 272072 - DNA, 15 bp, Homo sapiens
accaaccaaaataca

SEQ ID NO: 272073 - DNA, 15 bp, Homo sapiens
taccaaccaaaatac

SEQ ID NO: 272074 - DNA, 15 bp, Homo sapiens
ttaccaaccaaaata

SEQ ID NO: 272075 - DNA, 15 bp, Homo sapiens
tttaccaaccaaaat

SEQ ID NO: 272076 - DNA, 15 bp, Homo sapiens
ttttaccaaccaaaa

SEQ ID NO: 272077 - DNA, 15 bp, Homo sapiens
attttaccaaccaaa

SEQ ID NO: 272078 - DNA, 15 bp, Homo sapiens
tattttaccaaccaa

SEQ ID NO: 272079 - DNA, 15 bp, Homo sapiens
gtattttaccaacca

SEQ ID NO: 272080 - DNA, 15 bp, Homo sapiens
tgtattttaccaacc

SEQ ID NO: 272081 - DNA, 15 bp, Homo sapiens
ttgtattttaccaac

SEQ ID NO: 272082 - DNA, 15 bp, Homo sapiens
attgtattttaccaa

SEQ ID NO: 272083 - DNA, 15 bp, Homo sapiens
gattgtattttacca

SEQ ID NO: 272084 - DNA, 15 bp, Homo sapiens
agattgtattttacc

SEQ ID NO: 272085 - DNA, 15 bp, Homo sapiens
gagattgtattttac

SEQ ID NO: 272086 - DNA, 15 bp, Homo sapiens
tgagattgtatttta

SEQ ID NO: 272087 - DNA, 15 bp, Homo sapiens
ttgagattgtatttt

SEQ ID NO: 272088 - DNA, 15 bp, Homo sapiens
tttgagattgtattt

SEQ ID NO: 272089 - DNA, 15 bp, Homo sapiens
ttttgagattgtatt

SEQ ID NO: 272090 - DNA, 15 bp, Homo sapiens
cttttgagattgtat

SEQ ID NO: 272091 - DNA, 15 bp, Homo sapiens
acttttgagattgta

SEQ ID NO: 272092 - DNA, 15 bp, Homo sapiens
tacttttgagattgt

SEQ ID NO: 272093 - DNA, 15 bp, Homo sapiens
ttacttttgagattg

SEQ ID NO: 272094 - DNA, 15 bp, Homo sapiens
tttacttttgagatt

SEQ ID NO: 272095 - DNA, 15 bp, Homo sapiens
ttttacttttgagat

SEQ ID NO: 272096 - DNA, 15 bp, Homo sapiens
tttttacttttgaga

SEQ ID NO: 272097 - DNA, 15 bp, Homo sapiens
ttttttacttttgag

SEQ ID NO: 272098 - DNA, 15 bp, Homo sapiens
attttttacttttga

SEQ ID NO: 272099 - DNA, 15 bp, Homo sapiens
aattttttacttttg

SEQ ID NO: 272100 - DNA, 15 bp, Homo sapiens
taattttttactttt

SEQ ID NO: 272101 - DNA, 15 bp, Homo sapiens
ataattttttacttt

SEQ ID NO: 272102 - DNA, 15 bp, Homo sapiens
aataattttttactt

SEQ ID NO: 272103 - DNA, 15 bp, Homo sapiens
aaataattttttact

SEQ ID NO: 272104 - DNA, 15 bp, Homo sapiens
caaataattttttac

SEQ ID NO: 272105 - DNA, 15 bp, Homo sapiens
tcaaataatttttta

SEQ ID NO: 272106 - DNA, 15 bp, Homo sapiens
atcaaataatttttt

SEQ ID NO: 272107 - DNA, 15 bp, Homo sapiens
aatcaaataattttt

SEQ ID NO: 272108 - DNA, 15 bp, Homo sapiens
aaatcaaataatttt

SEQ ID NO: 272109 - DNA, 15 bp, Homo sapiens
gaaatcaaataattt

SEQ ID NO: 272110 - DNA, 15 bp, Homo sapiens
cgaaatcaaataatt

SEQ ID NO: 272111 - DNA, 15 bp, Homo sapiens
gcgaaatcaaataat

SEQ ID NO: 272112 - DNA, 15 bp, Homo sapiens
ggcgaaatcaaataa

SEQ ID NO: 272113 - DNA, 15 bp, Homo sapiens
aggcgaaatcaaata

SEQ ID NO: 272114 - DNA, 15 bp, Homo sapiens
aaggcgaaatcaaat

SEQ ID NO: 272115 - DNA, 15 bp, Homo sapiens
taaggcgaaatcaaa

SEQ ID NO: 272116 - DNA, 15 bp, Homo sapiens
ttaaggcgaaatcaa

SEQ ID NO: 272117 - DNA, 15 bp, Homo sapiens
tttaaggcgaaatca

SEQ ID NO: 272118 - DNA, 15 bp, Homo sapiens
ttttaaggcgaaatc

SEQ ID NO: 272119 - DNA, 15 bp, Homo sapiens
cttttaaggcgaaat

SEQ ID NO: 272120 - DNA, 15 bp, Homo sapiens
acttttaaggcgaaa

SEQ ID NO: 272121 - DNA, 15 bp, Homo sapiens
cacttttaaggcgaa

SEQ ID NO: 272122 - DNA, 15 bp, Homo sapiens
tcacttttaaggcga

SEQ ID NO: 272123 - DNA, 15 bp, Homo sapiens
atcacttttaaggcg

SEQ ID NO: 272124 - DNA, 15 bp, Homo sapiens
aatcacttttaaggc

SEQ ID NO: 272125 - DNA, 15 bp, Homo sapiens
aaatcacttttaagg

SEQ ID NO: 272126 - DNA, 15 bp, Homo sapiens
aaaatcacttttaag

SEQ ID NO: 272127 - DNA, 15 bp, Homo sapiens
caaaatcacttttaa

SEQ ID NO: 272128 - DNA, 15 bp, Homo sapiens
acaaaatcactttta

SEQ ID NO: 272129 - DNA, 15 bp, Homo sapiens
aacaaaatcactttt

SEQ ID NO: 272130 - DNA, 15 bp, Homo sapiens
aaacaaaatcacttt

SEQ ID NO: 272131 - DNA, 15 bp, Homo sapiens
taaacaaaatcactt

SEQ ID NO: 272132 - DNA, 15 bp, Homo sapiens
ctaaacaaaatcact

SEQ ID NO: 272133 - DNA, 15 bp, Homo sapiens
cctaaacaaaatcac

SEQ ID NO: 272134 - DNA, 15 bp, Homo sapiens
ccctaaacaaaatca

SEQ ID NO: 272135 - DNA, 15 bp, Homo sapiens
accctaaacaaaatc

SEQ ID NO: 272136 - DNA, 15 bp, Homo sapiens
aaccctaaacaaaat

SEQ ID NO: 272137 - DNA, 15 bp, Homo sapiens
aaaccctaaacaaaa

SEQ ID NO: 272138 - DNA, 15 bp, Homo sapiens
aaaaccctaaacaaa

SEQ ID NO: 272139 - DNA, 15 bp, Homo sapiens
aaaaaccctaaacaa

SEQ ID NO: 272140 - DNA, 15 bp, Homo sapiens
gaaaaaccctaaaca

SEQ ID NO: 272141 - DNA, 15 bp, Homo sapiens
agaaaaaccctaaac

SEQ ID NO: 272142 - DNA, 15 bp, Homo sapiens
aagaaaaaccctaaa

SEQ ID NO: 272143 - DNA, 15 bp, Homo sapiens
aaagaaaaaccctaa

SEQ ID NO: 272144 - DNA, 15 bp, Homo sapiens
taaagaaaaacccta

SEQ ID NO: 272145 - DNA, 15 bp, Homo sapiens
ctaaagaaaaaccct

SEQ ID NO: 272146 - DNA, 15 bp, Homo sapiens
cctaaagaaaaaccc

SEQ ID NO: 272147 - DNA, 15 bp, Homo sapiens
ccctaaagaaaaacc

SEQ ID NO: 272148 - DNA, 15 bp, Homo sapiens
accctaaagaaaaac

SEQ ID NO: 272149 - DNA, 15 bp, Homo sapiens
aaccctaaagaaaaa

SEQ ID NO: 272150 - DNA, 15 bp, Homo sapiens
aaaccctaaagaaaa

SEQ ID NO: 272151 - DNA, 15 bp, Homo sapiens
aaaaccctaaagaaa

SEQ ID NO: 272152 - DNA, 15 bp, Homo sapiens
caaaaccctaaagaa

SEQ ID NO: 272153 - DNA, 15 bp, Homo sapiens
gcaaaaccctaaaga

SEQ ID NO: 272154 - DNA, 15 bp, Homo sapiens
agcaaaaccctaaag

SEQ ID NO: 272155 - DNA, 15 bp, Homo sapiens
tagcaaaaccctaaa

SEQ ID NO: 272156 - DNA, 15 bp, Homo sapiens
gtagcaaaaccctaa

SEQ ID NO: 272157 - DNA, 15 bp, Homo sapiens
tgtagcaaaacccta

SEQ ID NO: 272158 - DNA, 15 bp, Homo sapiens
ctgtagcaaaaccct

SEQ ID NO: 272159 - DNA, 15 bp, Homo sapiens
tctgtagcaaaaccc

SEQ ID NO: 272160 - DNA, 15 bp, Homo sapiens
atctgtagcaaaacc

SEQ ID NO: 272161 - DNA, 15 bp, Homo sapiens
tatctgtagcaaaac

SEQ ID NO: 272162 - DNA, 15 bp, Homo sapiens
ctatctgtagcaaaa

SEQ ID NO: 272163 - DNA, 15 bp, Homo sapiens
tctatctgtagcaaa

SEQ ID NO: 272164 - DNA, 15 bp, Homo sapiens
atctatctgtagcaa

SEQ ID NO: 272165 - DNA, 15 bp, Homo sapiens
catctatctgtagca

SEQ ID NO: 272166 - DNA, 15 bp, Homo sapiens
acatctatctgtagc

SEQ ID NO: 272167 - DNA, 15 bp, Homo sapiens
tacatctatctgtag

SEQ ID NO: 272168 - DNA, 15 bp, Homo sapiens
atacatctatctgta

SEQ ID NO: 272169 - DNA, 15 bp, Homo sapiens
gatacatctatctgt

SEQ ID NO: 272170 - DNA, 15 bp, Homo sapiens
tgatacatctatctg

SEQ ID NO: 272171 - DNA, 15 bp, Homo sapiens
gtgatacatctatct

SEQ ID NO: 272172 - DNA, 15 bp, Homo sapiens
tgtgatacatctatc

SEQ ID NO: 272173 - DNA, 15 bp, Homo sapiens
ctgtgatacatctat

SEQ ID NO: 272174 - DNA, 15 bp, Homo sapiens
cctgtgatacatcta

SEQ ID NO: 272175 - DNA, 15 bp, Homo sapiens
ccctgtgatacatct

SEQ ID NO: 272176 - DNA, 15 bp, Homo sapiens
accctgtgatacatc

SEQ ID NO: 272177 - DNA, 15 bp, Homo sapiens
taccctgtgatacat

SEQ ID NO: 272178 - DNA, 15 bp, Homo sapiens
gtaccctgtgataca

SEQ ID NO: 272179 - DNA, 15 bp, Homo sapiens
tgtaccctgtgatac

SEQ ID NO: 272180 - DNA, 15 bp, Homo sapiens
atgtaccctgtgata

SEQ ID NO: 272181 - DNA, 15 bp, Homo sapiens
aatgtaccctgtgat

SEQ ID NO: 272182 - DNA, 15 bp, Homo sapiens
aaatgtaccctgtga

SEQ ID NO: 272183 - DNA, 15 bp, Homo sapiens
aaaatgtaccctgtg

SEQ ID NO: 272184 - DNA, 15 bp, Homo sapiens
taaaatgtaccctgt

SEQ ID NO: 272185 - DNA, 15 bp, Homo sapiens
ataaaatgtaccctg

SEQ ID NO: 272186 - DNA, 15 bp, Homo sapiens
tataaaatgtaccct

SEQ ID NO: 272187 - DNA, 15 bp, Homo sapiens
ttataaaatgtaccc

SEQ ID NO: 272188 - DNA, 15 bp, Homo sapiens
attataaaatgtacc

SEQ ID NO: 272189 - DNA, 15 bp, Homo sapiens
aattataaaatgtac

SEQ ID NO: 272190 - DNA, 15 bp, Homo sapiens
gaattataaaatgta

SEQ ID NO: 272191 - DNA, 15 bp, Homo sapiens
tgaattataaaatgt

SEQ ID NO: 272192 - DNA, 15 bp, Homo sapiens
ctgaattataaaatg

SEQ ID NO: 272193 - DNA, 15 bp, Homo sapiens
actgaattataaaat

SEQ ID NO: 272194 - DNA, 15 bp, Homo sapiens
cactgaattataaaa

SEQ ID NO: 272195 - DNA, 15 bp, Homo sapiens
tcactgaattataaa

SEQ ID NO: 272196 - DNA, 15 bp, Homo sapiens
atcactgaattataa

SEQ ID NO: 272197 - DNA, 15 bp, Homo sapiens
tatcactgaattata

SEQ ID NO: 272198 - DNA, 15 bp, Homo sapiens
gtatcactgaattat

SEQ ID NO: 272199 - DNA, 15 bp, Homo sapiens
agtatcactgaatta

SEQ ID NO: 272200 - DNA, 15 bp, Homo sapiens
aagtatcactgaatt

SEQ ID NO: 272201 - DNA, 15 bp, Homo sapiens
aaagtatcactgaat

SEQ ID NO: 272202 - DNA, 15 bp, Homo sapiens
gaaagtatcactgaa

SEQ ID NO: 272203 - DNA, 15 bp, Homo sapiens
ggaaagtatcactga

SEQ ID NO: 272204 - DNA, 15 bp, Homo sapiens
tggaaagtatcactg

SEQ ID NO: 272205 - DNA, 15 bp, Homo sapiens
atggaaagtatcact

SEQ ID NO: 272206 - DNA, 15 bp, Homo sapiens
tatggaaagtatcac

SEQ ID NO: 272207 - DNA, 15 bp, Homo sapiens
atatggaaagtatca

SEQ ID NO: 272208 - DNA, 15 bp, Homo sapiens
aatatggaaagtatc

SEQ ID NO: 272209 - DNA, 15 bp, Homo sapiens
aaatatggaaagtat

SEQ ID NO: 272210 - DNA, 15 bp, Homo sapiens
aaaatatggaaagta

SEQ ID NO: 272211 - DNA, 15 bp, Homo sapiens
taaaatatggaaagt

SEQ ID NO: 272212 - DNA, 15 bp, Homo sapiens
ataaaatatggaaag

SEQ ID NO: 272213 - DNA, 15 bp, Homo sapiens
aataaaatatggaaa

SEQ ID NO: 272214 - DNA, 15 bp, Homo sapiens
taaataaaatatgga

SEQ ID NO: 272215 - DNA, 15 bp, Homo sapiens
ataaataaaatatgg

SEQ ID NO: 272216 - DNA, 15 bp, Homo sapiens
aataaataaaatatg

SEQ ID NO: 272217 - DNA, 15 bp, Homo sapiens
gaataaataaaatat

SEQ ID NO: 272218 - DNA, 15 bp, Homo sapiens
tgaataaataaaata

SEQ ID NO: 272219 - DNA, 15 bp, Homo sapiens
atgaataaataaaat

SEQ ID NO: 272220 - DNA, 15 bp, Homo sapiens
tataaatgaataaat

SEQ ID NO: 272221 - DNA, 15 bp, Homo sapiens
atataaatgaataaa

SEQ ID NO: 272222 - DNA, 15 bp, Homo sapiens
aatataaatgaataa

SEQ ID NO: 272223 - DNA, 15 bp, Homo sapiens
taatataaatgaata

SEQ ID NO: 272224 - DNA, 15 bp, Homo sapiens
ctaatataaatgaat

SEQ ID NO: 272225 - DNA, 15 bp, Homo sapiens
actaatataaatgaa

SEQ ID NO: 272226 - DNA, 15 bp, Homo sapiens
aactaatataaatga

SEQ ID NO: 272227 - DNA, 15 bp, Homo sapiens
caactaatataaatg

SEQ ID NO: 272228 - DNA, 15 bp, Homo sapiens
ccaactaatataaat

SEQ ID NO: 272229 - DNA, 15 bp, Homo sapiens
accaactaatataaa

SEQ ID NO: 272230 - DNA, 15 bp, Homo sapiens
caccaactaatataa

SEQ ID NO: 272231 - DNA, 15 bp, Homo sapiens
ccaccaactaatata

SEQ ID NO: 272232 - DNA, 15 bp, Homo sapiens
cccaccaactaatat

SEQ ID NO: 272233 - DNA, 15 bp, Homo sapiens
ccccaccaactaata

SEQ ID NO: 272234 - DNA, 15 bp, Homo sapiens
tccccaccaactaat

SEQ ID NO: 272235 - DNA, 15 bp, Homo sapiens
ttccccaccaactaa

SEQ ID NO: 272236 - DNA, 15 bp, Homo sapiens
gttccccaccaacta

SEQ ID NO: 272237 - DNA, 15 bp, Homo sapiens
tgttccccaccaact

SEQ ID NO: 272238 - DNA, 15 bp, Homo sapiens
ttgttccccaccaac

SEQ ID NO: 272239 - DNA, 15 bp, Homo sapiens
cttgttccccaccaa

SEQ ID NO: 272240 - DNA, 15 bp, Homo sapiens
acttgttccccacca

SEQ ID NO: 272241 - DNA, 15 bp, Homo sapiens
tacttgttccccacc

SEQ ID NO: 272242 - DNA, 15 bp, Homo sapiens
ttacttgttccccac

SEQ ID NO: 272243 - DNA, 15 bp, Homo sapiens
tttacttgttcccca

SEQ ID NO: 272244 - DNA, 15 bp, Homo sapiens
ttttacttgttcccc

SEQ ID NO: 272245 - DNA, 15 bp, Homo sapiens
tttttacttgttccc

SEQ ID NO: 272246 - DNA, 15 bp, Homo sapiens
ttttttacttgttcc

SEQ ID NO: 272247 - DNA, 15 bp, Homo sapiens
attttttacttgttc

SEQ ID NO: 272248 - DNA, 15 bp, Homo sapiens
aattttttacttgtt

SEQ ID NO: 272249 - DNA, 15 bp, Homo sapiens
caattttttacttgt

SEQ ID NO: 272250 - DNA, 15 bp, Homo sapiens
tcaattttttacttg

SEQ ID NO: 272251 - DNA, 15 bp, Homo sapiens
atcaattttttactt

SEQ ID NO: 272252 - DNA, 15 bp, Homo sapiens
aatcaattttttact

SEQ ID NO: 272253 - DNA, 15 bp, Homo sapiens
taatcaattttttac

SEQ ID NO: 272254 - DNA, 15 bp, Homo sapiens
ttaatcaatttttta

SEQ ID NO: 272255 - DNA, 15 bp, Homo sapiens
attaatcaatttttt

SEQ ID NO: 272256 - DNA, 15 bp, Homo sapiens
aattaatcaattttt

SEQ ID NO: 272257 - DNA, 15 bp, Homo sapiens
gaattaatcaatttt

SEQ ID NO: 272258 - DNA, 15 bp, Homo sapiens
agaattaatcaattt

SEQ ID NO: 272259 - DNA, 15 bp, Homo sapiens
aagaattaatcaatt

SEQ ID NO: 272260 - DNA, 15 bp, Homo sapiens
taagaattaatcaat

SEQ ID NO: 272261 - DNA, 15 bp, Homo sapiens
ataagaattaatcaa

SEQ ID NO: 272262 - DNA, 15 bp, Homo sapiens
aataagaattaatca

SEQ ID NO: 272263 - DNA, 15 bp, Homo sapiens
taataagaattaatc

SEQ ID NO: 272264 - DNA, 15 bp, Homo sapiens
ataataagaattaat

SEQ ID NO: 272265 - DNA, 15 bp, Homo sapiens
tataataagaattaa

SEQ ID NO: 272266 - DNA, 15 bp, Homo sapiens
gtataataagaatta

SEQ ID NO: 272267 - DNA, 15 bp, Homo sapiens
tgtataataagaatt

SEQ ID NO: 272268 - DNA, 15 bp, Homo sapiens
ctgtataataagaat

SEQ ID NO: 272269 - DNA, 15 bp, Homo sapiens
cctgtataataagaa

SEQ ID NO: 272270 - DNA, 15 bp, Homo sapiens
acctgtataataaga

SEQ ID NO: 272271 - DNA, 15 bp, Homo sapiens
tacctgtataataag

SEQ ID NO: 272272 - DNA, 15 bp, Homo sapiens
ttacctgtataataa

SEQ ID NO: 272273 - DNA, 15 bp, Homo sapiens
cttacctgtataata

SEQ ID NO: 272274 - DNA, 15 bp, Homo sapiens
acttacctgtataat

SEQ ID NO: 272275 - DNA, 15 bp, Homo sapiens
aacttacctgtataa

SEQ ID NO: 272276 - DNA, 15 bp, Homo sapiens
aaacttacctgtata

SEQ ID NO: 272277 - DNA, 15 bp, Homo sapiens
aaaacttacctgtat

SEQ ID NO: 272278 - DNA, 15 bp, Homo sapiens
gaaaacttacctgta

SEQ ID NO: 272279 - DNA, 15 bp, Homo sapiens
tgaaaacttacctgt

SEQ ID NO: 272280 - DNA, 15 bp, Homo sapiens
atgaaaacttacctg

SEQ ID NO: 272281 - DNA, 15 bp, Homo sapiens
aatgaaaacttacct

SEQ ID NO: 272282 - DNA, 15 bp, Homo sapiens
caatgaaaacttacc

SEQ ID NO: 272283 - DNA, 15 bp, Homo sapiens
acaatgaaaacttac

SEQ ID NO: 272284 - DNA, 15 bp, Homo sapiens
aacaatgaaaactta

SEQ ID NO: 272285 - DNA, 15 bp, Homo sapiens
aaacaatgaaaactt

SEQ ID NO: 272286 - DNA, 15 bp, Homo sapiens
aaaacaatgaaaact

SEQ ID NO: 272287 - DNA, 15 bp, Homo sapiens
taaaacaatgaaaac

SEQ ID NO: 272288 - DNA, 15 bp, Homo sapiens
gtaaaacaatgaaaa

SEQ ID NO: 272289 - DNA, 15 bp, Homo sapiens
cgtaaaacaatgaaa

SEQ ID NO: 272290 - DNA, 15 bp, Homo sapiens
ccgtaaaacaatgaa

SEQ ID NO: 272291 - DNA, 15 bp, Homo sapiens
gccgtaaaacaatga

SEQ ID NO: 272292 - DNA, 15 bp, Homo sapiens
agccgtaaaacaatg

SEQ ID NO: 272293 - DNA, 15 bp, Homo sapiens
tagccgtaaaacaat

SEQ ID NO: 272294 - DNA, 15 bp, Homo sapiens
gtagccgtaaaacaa

SEQ ID NO: 272295 - DNA, 15 bp, Homo sapiens
agtagccgtaaaaca

SEQ ID NO: 272296 - DNA, 15 bp, Homo sapiens
aagtagccgtaaaac

SEQ ID NO: 272297 - DNA, 15 bp, Homo sapiens
taagtagccgtaaaa

SEQ ID NO: 272298 - DNA, 15 bp, Homo sapiens
ttaagtagccgtaaa

SEQ ID NO: 272299 - DNA, 15 bp, Homo sapiens
attaagtagccgtaa

SEQ ID NO: 272300 - DNA, 15 bp, Homo sapiens
tattaagtagccgta

SEQ ID NO: 272301 - DNA, 15 bp, Homo sapiens
ctattaagtagccgt

SEQ ID NO: 272302 - DNA, 15 bp, Homo sapiens
gctattaagtagccg

SEQ ID NO: 272303 - DNA, 15 bp, Homo sapiens
tgctattaagtagcc

SEQ ID NO: 272304 - DNA, 15 bp, Homo sapiens
ctgctattaagtagc

SEQ ID NO: 272305 - DNA, 15 bp, Homo sapiens
actgctattaagtag

SEQ ID NO: 272306 - DNA, 15 bp, Homo sapiens
tactgctattaagta

SEQ ID NO: 272307 - DNA, 15 bp, Homo sapiens
gtactgctattaagt

SEQ ID NO: 272308 - DNA, 15 bp, Homo sapiens
tgtactgctattaag

SEQ ID NO: 272309 - DNA, 15 bp, Homo sapiens
ctgtactgctattaa

SEQ ID NO: 272310 - DNA, 15 bp, Homo sapiens
actgtactgctatta

SEQ ID NO: 272311 - DNA, 15 bp, Homo sapiens
cactgtactgctatt

SEQ ID NO: 272312 - DNA, 15 bp, Homo sapiens
ccactgtactgctat

SEQ ID NO: 272313 - DNA, 15 bp, Homo sapiens
tccactgtactgcta

SEQ ID NO: 272314 - DNA, 15 bp, Homo sapiens
ctccactgtactgct

SEQ ID NO: 272315 - DNA, 15 bp, Homo sapiens
actccactgtactgc

SEQ ID NO: 272316 - DNA, 15 bp, Homo sapiens
tactccactgtactg

SEQ ID NO: 272317 - DNA, 15 bp, Homo sapiens
ttactccactgtact

SEQ ID NO: 272318 - DNA, 15 bp, Homo sapiens
tttactccactgtac

SEQ ID NO: 272319 - DNA, 15 bp, Homo sapiens
ctttactccactgta

SEQ ID NO: 272320 - DNA, 15 bp, Homo sapiens
gctttactccactgt

SEQ ID NO: 272321 - DNA, 15 bp, Homo sapiens
tgctttactccactg

SEQ ID NO: 272322 - DNA, 15 bp, Homo sapiens
gtgctttactccact

SEQ ID NO: 272323 - DNA, 15 bp, Homo sapiens
tgtgctttactccac

SEQ ID NO: 272324 - DNA, 15 bp, Homo sapiens
atgtgctttactcca

SEQ ID NO: 272325 - DNA, 15 bp, Homo sapiens
aatgtgctttactcc

SEQ ID NO: 272326 - DNA, 15 bp, Homo sapiens
aaatgtgctttactc

SEQ ID NO: 272327 - DNA, 15 bp, Homo sapiens
aaaatgtgctttact

SEQ ID NO: 272328 - DNA, 15 bp, Homo sapiens
gaaaatgtgctttac

SEQ ID NO: 272329 - DNA, 15 bp, Homo sapiens
tgaaaatgtgcttta

SEQ ID NO: 272330 - DNA, 15 bp, Homo sapiens
ctgaaaatgtgcttt

SEQ ID NO: 272331 - DNA, 15 bp, Homo sapiens
tctgaaaatgtgctt

SEQ ID NO: 272332 - DNA, 15 bp, Homo sapiens
ttctgaaaatgtgct

SEQ ID NO: 272333 - DNA, 15 bp, Homo sapiens
attctgaaaatgtgc

SEQ ID NO: 272334 - DNA, 15 bp, Homo sapiens
aattctgaaaatgtg

SEQ ID NO: 272335 - DNA, 15 bp, Homo sapiens
gaattctgaaaatgt

SEQ ID NO: 272336 - DNA, 15 bp, Homo sapiens
tgaattctgaaaatg

SEQ ID NO: 272337 - DNA, 15 bp, Homo sapiens
gtgaattctgaaaat

SEQ ID NO: 272338 - DNA, 15 bp, Homo sapiens
tgtgaattctgaaaa

SEQ ID NO: 272339 - DNA, 15 bp, Homo sapiens
atgtgaattctgaaa

SEQ ID NO: 272340 - DNA, 15 bp, Homo sapiens
catgtgaattctgaa

SEQ ID NO: 272341 - DNA, 15 bp, Homo sapiens
gcatgtgaattctga

SEQ ID NO: 272342 - DNA, 15 bp, Homo sapiens
ggcatgtgaattctg

SEQ ID NO: 272343 - DNA, 15 bp, Homo sapiens
gggcatgtgaattct

SEQ ID NO: 272344 - DNA, 15 bp, Homo sapiens
tgggcatgtgaattc

SEQ ID NO: 272345 - DNA, 15 bp, Homo sapiens
gtgggcatgtgaatt

SEQ ID NO: 272346 - DNA, 15 bp, Homo sapiens
agtgggcatgtgaat

SEQ ID NO: 272347 - DNA, 15 bp, Homo sapiens
aagtgggcatgtgaa

SEQ ID NO: 272348 - DNA, 15 bp, Homo sapiens
taagtgggcatgtga

SEQ ID NO: 272349 - DNA, 15 bp, Homo sapiens
ataagtgggcatgtg

SEQ ID NO: 272350 - DNA, 15 bp, Homo sapiens
gataagtgggcatgt

SEQ ID NO: 272351 - DNA, 15 bp, Homo sapiens
agataagtgggcatg

SEQ ID NO: 272352 - DNA, 15 bp, Homo sapiens
cagataagtgggcat

SEQ ID NO: 272353 - DNA, 15 bp, Homo sapiens
acagataagtgggca

SEQ ID NO: 272354 - DNA, 15 bp, Homo sapiens
cacagataagtgggc

SEQ ID NO: 272355 - DNA, 15 bp, Homo sapiens
acacagataagtggg

SEQ ID NO: 272356 - DNA, 15 bp, Homo sapiens
tacacagataagtgg

SEQ ID NO: 272357 - DNA, 15 bp, Homo sapiens
ctacacagataagtg

SEQ ID NO: 272358 - DNA, 15 bp, Homo sapiens
cctacacagataagt

SEQ ID NO: 272359 - DNA, 15 bp, Homo sapiens
acctacacagataag

SEQ ID NO: 272360 - DNA, 15 bp, Homo sapiens
aacctacacagataa

SEQ ID NO: 272361 - DNA, 15 bp, Homo sapiens
gaacctacacagata

SEQ ID NO: 272362 - DNA, 15 bp, Homo sapiens
tgaacctacacagat

SEQ ID NO: 272363 - DNA, 15 bp, Homo sapiens
ctgaacctacacaga

SEQ ID NO: 272364 - DNA, 15 bp, Homo sapiens
actgaacctacacag

SEQ ID NO: 272365 - DNA, 15 bp, Homo sapiens
aactgaacctacaca

SEQ ID NO: 272366 - DNA, 15 bp, Homo sapiens
gaactgaacctacac

SEQ ID NO: 272367 - DNA, 15 bp, Homo sapiens
agaactgaacctaca

SEQ ID NO: 272368 - DNA, 15 bp, Homo sapiens
tagaactgaacctac

SEQ ID NO: 272369 - DNA, 15 bp, Homo sapiens
ttagaactgaaccta

SEQ ID NO: 272370 - DNA, 15 bp, Homo sapiens
tttagaactgaacct

SEQ ID NO: 272371 - DNA, 15 bp, Homo sapiens
ttttagaactgaacc

SEQ ID NO: 272372 - DNA, 15 bp, Homo sapiens
attttagaactgaac

SEQ ID NO: 272373 - DNA, 15 bp, Homo sapiens
cattttagaactgaa

SEQ ID NO: 272374 - DNA, 15 bp, Homo sapiens
acattttagaactga

SEQ ID NO: 272375 - DNA, 15 bp, Homo sapiens
aacattttagaactg

SEQ ID NO: 272376 - DNA, 15 bp, Homo sapiens
aaacattttagaact

SEQ ID NO: 272377 - DNA, 15 bp, Homo sapiens
aaaacattttagaac

SEQ ID NO: 272378 - DNA, 15 bp, Homo sapiens
aaaaacattttagaa

SEQ ID NO: 272379 - DNA, 15 bp, Homo sapiens
gaaaaacattttaga

SEQ ID NO: 272380 - DNA, 15 bp, Homo sapiens
tgaaaaacattttag

SEQ ID NO: 272381 - DNA, 15 bp, Homo sapiens
gtgaaaaacatttta

SEQ ID NO: 272382 - DNA, 15 bp, Homo sapiens
tgtgaaaaacatttt

SEQ ID NO: 272383 - DNA, 15 bp, Homo sapiens
ctgtgaaaaacattt

SEQ ID NO: 272384 - DNA, 15 bp, Homo sapiens
actgtgaaaaacatt

SEQ ID NO: 272385 - DNA, 15 bp, Homo sapiens
cactgtgaaaaacat

SEQ ID NO: 272386 - DNA, 15 bp, Homo sapiens
tcactgtgaaaaaca

SEQ ID NO: 272387 - DNA, 15 bp, Homo sapiens
ctcactgtgaaaaac

SEQ ID NO: 272388 - DNA, 15 bp, Homo sapiens
actcactgtgaaaaa

SEQ ID NO: 272389 - DNA, 15 bp, Homo sapiens
gactcactgtgaaaa

SEQ ID NO: 272390 - DNA, 15 bp, Homo sapiens
tgactcactgtgaaa

SEQ ID NO: 272391 - DNA, 15 bp, Homo sapiens
gtgactcactgtgaa

SEQ ID NO: 272392 - DNA, 15 bp, Homo sapiens
agtgactcactgtga

SEQ ID NO: 272393 - DNA, 15 bp, Homo sapiens
cagtgactcactgtg

SEQ ID NO: 272394 - DNA, 15 bp, Homo sapiens
acagtgactcactgt

SEQ ID NO: 272395 - DNA, 15 bp, Homo sapiens
gacagtgactcactg

SEQ ID NO: 272396 - DNA, 15 bp, Homo sapiens
tgacagtgactcact

SEQ ID NO: 272397 - DNA, 15 bp, Homo sapiens
atgacagtgactcac

SEQ ID NO: 272398 - DNA, 15 bp, Homo sapiens
aatgacagtgactca

SEQ ID NO: 272399 - DNA, 15 bp, Homo sapiens
taatgacagtgactc

SEQ ID NO: 272400 - DNA, 15 bp, Homo sapiens
ctaatgacagtgact

SEQ ID NO: 272401 - DNA, 15 bp, Homo sapiens
gctaatgacagtgac

SEQ ID NO: 272402 - DNA, 15 bp, Homo sapiens
agctaatgacagtga

SEQ ID NO: 272403 - DNA, 15 bp, Homo sapiens
aagctaatgacagtg

SEQ ID NO: 272404 - DNA, 15 bp, Homo sapiens
aaagctaatgacagt

SEQ ID NO: 272405 - DNA, 15 bp, Homo sapiens
gaaagctaatgacag

SEQ ID NO: 272406 - DNA, 15 bp, Homo sapiens
ggaaagctaatgaca

SEQ ID NO: 272407 - DNA, 15 bp, Homo sapiens
tggaaagctaatgac

SEQ ID NO: 272408 - DNA, 15 bp, Homo sapiens
ttggaaagctaatga

SEQ ID NO: 272409 - DNA, 15 bp, Homo sapiens
tttggaaagctaatg

SEQ ID NO: 272410 - DNA, 15 bp, Homo sapiens
ttttggaaagctaat

SEQ ID NO: 272411 - DNA, 15 bp, Homo sapiens
tttttggaaagctaa

SEQ ID NO: 272412 - DNA, 15 bp, Homo sapiens
atttttggaaagcta

SEQ ID NO: 272413 - DNA, 15 bp, Homo sapiens
catttttggaaagct

SEQ ID NO: 272414 - DNA, 15 bp, Homo sapiens
tcatttttggaaagc

SEQ ID NO: 272415 - DNA, 15 bp, Homo sapiens
gtcatttttggaaag

SEQ ID NO: 272416 - DNA, 15 bp, Homo sapiens
tgtcatttttggaaa

SEQ ID NO: 272417 - DNA, 15 bp, Homo sapiens
ttgtcatttttggaa

SEQ ID NO: 272418 - DNA, 15 bp, Homo sapiens
attgtcatttttgga

SEQ ID NO: 272419 - DNA, 15 bp, Homo sapiens
aattgtcatttttgg

SEQ ID NO: 272420 - DNA, 15 bp, Homo sapiens
aaattgtcatttttg

SEQ ID NO: 272421 - DNA, 15 bp, Homo sapiens
gaaattgtcattttt

SEQ ID NO: 272422 - DNA, 15 bp, Homo sapiens
tgaaattgtcatttt

SEQ ID NO: 272423 - DNA, 15 bp, Homo sapiens
ttgaaattgtcattt

SEQ ID NO: 272424 - DNA, 15 bp, Homo sapiens
cttgaaattgtcatt

SEQ ID NO: 272425 - DNA, 15 bp, Homo sapiens
ccttgaaattgtcat

SEQ ID NO: 272426 - DNA, 15 bp, Homo sapiens
tccttgaaattgtca

SEQ ID NO: 272427 - DNA, 15 bp, Homo sapiens
gtccttgaaattgtc

SEQ ID NO: 272428 - DNA, 15 bp, Homo sapiens
tgtccttgaaattgt

SEQ ID NO: 272429 - DNA, 15 bp, Homo sapiens
ctgtccttgaaattg

SEQ ID NO: 272430 - DNA, 15 bp, Homo sapiens
gctgtccttgaaatt

SEQ ID NO: 272431 - DNA, 15 bp, Homo sapiens
ggctgtccttgaaat

SEQ ID NO: 272432 - DNA, 15 bp, Homo sapiens
gggctgtccttgaaa

SEQ ID NO: 272433 - DNA, 15 bp, Homo sapiens
agggctgtccttgaa

SEQ ID NO: 272434 - DNA, 15 bp, Homo sapiens
tagggctgtccttga

SEQ ID NO: 272435 - DNA, 15 bp, Homo sapiens
ttagggctgtccttg

SEQ ID NO: 272436 - DNA, 15 bp, Homo sapiens
attagggctgtcctt

SEQ ID NO: 272437 - DNA, 15 bp, Homo sapiens
aattagggctgtcct

SEQ ID NO: 272438 - DNA, 15 bp, Homo sapiens
aaattagggctgtcc

SEQ ID NO: 272439 - DNA, 15 bp, Homo sapiens
caaattagggctgtc

SEQ ID NO: 272440 - DNA, 15 bp, Homo sapiens
acaaattagggctgt

SEQ ID NO: 272441 - DNA, 15 bp, Homo sapiens
tacaaattagggctg

SEQ ID NO: 272442 - DNA, 15 bp, Homo sapiens
gtacaaattagggct

SEQ ID NO: 272443 - DNA, 15 bp, Homo sapiens
tgtacaaattagggc

SEQ ID NO: 272444 - DNA, 15 bp, Homo sapiens
atgtacaaattaggg

SEQ ID NO: 272445 - DNA, 15 bp, Homo sapiens
catgtacaaattagg

SEQ ID NO: 272446 - DNA, 15 bp, Homo sapiens
acatgtacaaattag

SEQ ID NO: 272447 - DNA, 15 bp, Homo sapiens
cacatgtacaaatta

SEQ ID NO: 272448 - DNA, 15 bp, Homo sapiens
tcacatgtacaaatt

SEQ ID NO: 272449 - DNA, 15 bp, Homo sapiens
ttcacatgtacaaat

SEQ ID NO: 272450 - DNA, 15 bp, Homo sapiens
attcacatgtacaaa

SEQ ID NO: 272451 - DNA, 15 bp, Homo sapiens
aattcacatgtacaa

SEQ ID NO: 272452 - DNA, 15 bp, Homo sapiens
aaattcacatgtaca

SEQ ID NO: 272453 - DNA, 15 bp, Homo sapiens
aaaattcacatgtac

SEQ ID NO: 272454 - DNA, 15 bp, Homo sapiens
aaaaattcacatgta

SEQ ID NO: 272455 - DNA, 15 bp, Homo sapiens
taaaaattcacatgt

SEQ ID NO: 272456 - DNA, 15 bp, Homo sapiens
ataaaaattcacatg

SEQ ID NO: 272457 - DNA, 15 bp, Homo sapiens
cataaaaattcacat

SEQ ID NO: 272458 - DNA, 15 bp, Homo sapiens
acataaaaattcaca

SEQ ID NO: 272459 - DNA, 15 bp, Homo sapiens
cacataaaaattcac

SEQ ID NO: 272460 - DNA, 15 bp, Homo sapiens
gcacataaaaattca

SEQ ID NO: 272461 - DNA, 15 bp, Homo sapiens
agcacataaaaattc

SEQ ID NO: 272462 - DNA, 15 bp, Homo sapiens
aagcacataaaaatt

SEQ ID NO: 272463 - DNA, 15 bp, Homo sapiens
caagcacataaaaat

SEQ ID NO: 272464 - DNA, 15 bp, Homo sapiens
acaagcacataaaaa

SEQ ID NO: 272465 - DNA, 15 bp, Homo sapiens
aacaagcacataaaa

SEQ ID NO: 272466 - DNA, 15 bp, Homo sapiens
caacaagcacataaa

SEQ ID NO: 272467 - DNA, 15 bp, Homo sapiens
tcaacaagcacataa

SEQ ID NO: 272468 - DNA, 15 bp, Homo sapiens
ttcaacaagcacata

SEQ ID NO: 272469 - DNA, 15 bp, Homo sapiens
tttcaacaagcacat

SEQ ID NO: 272470 - DNA, 15 bp, Homo sapiens
ttttcaacaagcaca

SEQ ID NO: 272471 - DNA, 15 bp, Homo sapiens
attttcaacaagcac

SEQ ID NO: 272472 - DNA, 15 bp, Homo sapiens
gattttcaacaagca

SEQ ID NO: 272473 - DNA, 15 bp, Homo sapiens
tgattttcaacaagc

SEQ ID NO: 272474 - DNA, 15 bp, Homo sapiens
ctgattttcaacaag

SEQ ID NO: 272475 - DNA, 15 bp, Homo sapiens
actgattttcaacaa

SEQ ID NO: 272476 - DNA, 15 bp, Homo sapiens
gactgattttcaaca

SEQ ID NO: 272477 - DNA, 15 bp, Homo sapiens
ggactgattttcaac

SEQ ID NO: 272478 - DNA, 15 bp, Homo sapiens
tggactgattttcaa

SEQ ID NO: 272479 - DNA, 15 bp, Homo sapiens
ctggactgattttca

SEQ ID NO: 272480 - DNA, 15 bp, Homo sapiens
tctggactgattttc

SEQ ID NO: 272481 - DNA, 15 bp, Homo sapiens
ctctggactgatttt

SEQ ID NO: 272482 - DNA, 15 bp, Homo sapiens
cctctggactgattt

SEQ ID NO: 272483 - DNA, 15 bp, Homo sapiens
gcctctggactgatt

SEQ ID NO: 272484 - DNA, 15 bp, Homo sapiens
tgcctctggactgat

SEQ ID NO: 272485 - DNA, 15 bp, Homo sapiens
atgcctctggactga

SEQ ID NO: 272486 - DNA, 15 bp, Homo sapiens
gatgcctctggactg

SEQ ID NO: 272487 - DNA, 15 bp, Homo sapiens
agatgcctctggact

SEQ ID NO: 272488 - DNA, 15 bp, Homo sapiens
cagatgcctctggac

SEQ ID NO: 272489 - DNA, 15 bp, Homo sapiens
ccagatgcctctgga

SEQ ID NO: 272490 - DNA, 15 bp, Homo sapiens
cccagatgcctctgg

SEQ ID NO: 272491 - DNA, 15 bp, Homo sapiens
ccccagatgcctctg

SEQ ID NO: 272492 - DNA, 15 bp, Homo sapiens
tccccagatgcctct

SEQ ID NO: 272493 - DNA, 15 bp, Homo sapiens
ttccccagatgcctc

SEQ ID NO: 272494 - DNA, 15 bp, Homo sapiens
cttccccagatgcct

SEQ ID NO: 272495 - DNA, 15 bp, Homo sapiens
tcttccccagatgcc

SEQ ID NO: 272496 - DNA, 15 bp, Homo sapiens
atcttccccagatgc

SEQ ID NO: 272497 - DNA, 15 bp, Homo sapiens
catcttccccagatg

SEQ ID NO: 272498 - DNA, 15 bp, Homo sapiens
ccatcttccccagat

SEQ ID NO: 272499 - DNA, 15 bp, Homo sapiens
accatcttccccaga

SEQ ID NO: 272500 - DNA, 15 bp, Homo sapiens
caccatcttccccag

SEQ ID NO: 272501 - DNA, 15 bp, Homo sapiens
ccaccatcttcccca

SEQ ID NO: 272502 - DNA, 15 bp, Homo sapiens
accaccatcttcccc

SEQ ID NO: 272503 - DNA, 15 bp, Homo sapiens
taccaccatcttccc

SEQ ID NO: 272504 - DNA, 15 bp, Homo sapiens
ctaccaccatcttcc

SEQ ID NO: 272505 - DNA, 15 bp, Homo sapiens
gctaccaccatcttc

SEQ ID NO: 272506 - DNA, 15 bp, Homo sapiens
tgctaccaccatctt

SEQ ID NO: 272507 - DNA, 15 bp, Homo sapiens
atgctaccaccatct

SEQ ID NO: 272508 - DNA, 15 bp, Homo sapiens
catgctaccaccatc

SEQ ID NO: 272509 - DNA, 15 bp, Homo sapiens
ccatgctaccaccat

SEQ ID NO: 272510 - DNA, 15 bp, Homo sapiens
gccatgctaccacca

SEQ ID NO: 272511 - DNA, 15 bp, Homo sapiens
tgccatgctaccacc

SEQ ID NO: 272512 - DNA, 15 bp, Homo sapiens
atgccatgctaccac

SEQ ID NO: 272513 - DNA, 15 bp, Homo sapiens
gatgccatgctacca

SEQ ID NO: 272514 - DNA, 15 bp, Homo sapiens
tgatgccatgctacc

SEQ ID NO: 272515 - DNA, 15 bp, Homo sapiens
ctgatgccatgctac

SEQ ID NO: 272516 - DNA, 15 bp, Homo sapiens
tctgatgccatgcta

SEQ ID NO: 272517 - DNA, 15 bp, Homo sapiens
ctctgatgccatgct

SEQ ID NO: 272518 - DNA, 15 bp, Homo sapiens
actctgatgccatgc

SEQ ID NO: 272519 - DNA, 15 bp, Homo sapiens
aactctgatgccatg

SEQ ID NO: 272520 - DNA, 15 bp, Homo sapiens
aaactctgatgccat

SEQ ID NO: 272521 - DNA, 15 bp, Homo sapiens
aaaactctgatgcca

SEQ ID NO: 272522 - DNA, 15 bp, Homo sapiens
aaaaactctgatgcc

SEQ ID NO: 272523 - DNA, 15 bp, Homo sapiens
aaaaaactctgatgc

SEQ ID NO: 272524 - DNA, 15 bp, Homo sapiens
aaaaaaactctgatg

SEQ ID NO: 272525 - DNA, 15 bp, Homo sapiens
caaaaaaactctgat

SEQ ID NO: 272526 - DNA, 15 bp, Homo sapiens
acaaaaaaactctga

SEQ ID NO: 272527 - DNA, 15 bp, Homo sapiens
aacaaaaaaactctg

SEQ ID NO: 272528 - DNA, 15 bp, Homo sapiens
caacaaaaaaactct

SEQ ID NO: 272529 - DNA, 15 bp, Homo sapiens
acaacaaaaaaactc

SEQ ID NO: 272530 - DNA, 15 bp, Homo sapiens
aacaacaaaaaaact

SEQ ID NO: 272531 - DNA, 15 bp, Homo sapiens
caacaacaaaaaaac

SEQ ID NO: 272532 - DNA, 15 bp, Homo sapiens
taaaacaacaacaac

SEQ ID NO: 272533 - DNA, 15 bp, Homo sapiens
ataaaacaacaacaa

SEQ ID NO: 272534 - DNA, 15 bp, Homo sapiens
aataaaacaacaaca

SEQ ID NO: 272535 - DNA, 15 bp, Homo sapiens
aaataaaacaacaac

SEQ ID NO: 272536 - DNA, 15 bp, Homo sapiens
aaaataaaacaacaa

SEQ ID NO: 272537 - DNA, 15 bp, Homo sapiens
aaaaataaaacaaca

SEQ ID NO: 272538 - DNA, 15 bp, Homo sapiens
aaaaaataaaacaac

SEQ ID NO: 272539 - DNA, 15 bp, Homo sapiens
aaaaaaataaaacaa

SEQ ID NO: 272540 - DNA, 15 bp, Homo sapiens
taaaaaaataaaaca

SEQ ID NO: 272541 - DNA, 15 bp, Homo sapiens
ataaaaaaataaaac

SEQ ID NO: 272542 - DNA, 15 bp, Homo sapiens
aataaaaaaataaaa

SEQ ID NO: 272543 - DNA, 15 bp, Homo sapiens
taaataaaaataaaa

SEQ ID NO: 272544 - DNA, 15 bp, Homo sapiens
ttcaaaaaaataaat

SEQ ID NO: 272545 - DNA, 15 bp, Homo sapiens
tttcaaaaaaataaa

SEQ ID NO: 272546 - DNA, 15 bp, Homo sapiens
atttcaaaaaaataa

SEQ ID NO: 272547 - DNA, 15 bp, Homo sapiens
catttcaaaaaaata

SEQ ID NO: 272548 - DNA, 15 bp, Homo sapiens
ccatttcaaaaaaat

SEQ ID NO: 272549 - DNA, 15 bp, Homo sapiens
cgaaactccatttca

SEQ ID NO: 272550 - DNA, 15 bp, Homo sapiens
gcgaaactccatttc

SEQ ID NO: 272551 - DNA, 15 bp, Homo sapiens
agcgaaactccattt

SEQ ID NO: 272552 - DNA, 15 bp, Homo sapiens
gagcgaaactccatt

SEQ ID NO: 272553 - DNA, 15 bp, Homo sapiens
agagcgaaactccat

SEQ ID NO: 272554 - DNA, 15 bp, Homo sapiens
aagagcgaaactcca

SEQ ID NO: 272555 - DNA, 15 bp, Homo sapiens
caagagcgaaactcc

SEQ ID NO: 272556 - DNA, 15 bp, Homo sapiens
acaagagcgaaactc

SEQ ID NO: 272557 - DNA, 15 bp, Homo sapiens
aacaagagcgaaact

SEQ ID NO: 272558 - DNA, 15 bp, Homo sapiens
caacaagagcgaaac

SEQ ID NO: 272559 - DNA, 15 bp, Homo sapiens
acaacaagagcgaaa

SEQ ID NO: 272560 - DNA, 15 bp, Homo sapiens
gacaacaagagcgaa

SEQ ID NO: 272561 - DNA, 15 bp, Homo sapiens
ggacaacaagagcga

SEQ ID NO: 272562 - DNA, 15 bp, Homo sapiens
tggacaacaagagcg

SEQ ID NO: 272563 - DNA, 15 bp, Homo sapiens
ttggacaacaagagc

SEQ ID NO: 272564 - DNA, 15 bp, Homo sapiens
cttggacaacaagag

SEQ ID NO: 272565 - DNA, 15 bp, Homo sapiens
gcttggacaacaaga

SEQ ID NO: 272566 - DNA, 15 bp, Homo sapiens
agcttggacaacaag

SEQ ID NO: 272567 - DNA, 15 bp, Homo sapiens
cagcttggacaacaa

SEQ ID NO: 272568 - DNA, 15 bp, Homo sapiens
ccagcttggacaaca

SEQ ID NO: 272569 - DNA, 15 bp, Homo sapiens
tccagcttggacaac

SEQ ID NO: 272570 - DNA, 15 bp, Homo sapiens
ttccagcttggacaa

SEQ ID NO: 272571 - DNA, 15 bp, Homo sapiens
cttccagcttggaca

SEQ ID NO: 272572 - DNA, 15 bp, Homo sapiens
gcttccagcttggac

SEQ ID NO: 272573 - DNA, 15 bp, Homo sapiens
tgcttccagcttgga

SEQ ID NO: 272574 - DNA, 15 bp, Homo sapiens
ttgcttccagcttgg

SEQ ID NO: 272575 - DNA, 15 bp, Homo sapiens
attgcttccagcttg

SEQ ID NO: 272576 - DNA, 15 bp, Homo sapiens
cattgcttccagctt

SEQ ID NO: 272577 - DNA, 15 bp, Homo sapiens
ccattgcttccagct

SEQ ID NO: 272578 - DNA, 15 bp, Homo sapiens
gccattgcttccagc

SEQ ID NO: 272579 - DNA, 15 bp, Homo sapiens
cgccattgcttccag

SEQ ID NO: 272580 - DNA, 15 bp, Homo sapiens
gcgccattgcttcca

SEQ ID NO: 272581 - DNA, 15 bp, Homo sapiens
tgcgccattgcttcc

SEQ ID NO: 272582 - DNA, 15 bp, Homo sapiens
ttgcgccattgcttc

SEQ ID NO: 272583 - DNA, 15 bp, Homo sapiens
attgcgccattgctt

SEQ ID NO: 272584 - DNA, 15 bp, Homo sapiens
gattgcgccattgct

SEQ ID NO: 272585 - DNA, 15 bp, Homo sapiens
aagattgcgccattg

SEQ ID NO: 272586 - DNA, 15 bp, Homo sapiens
caagattgcgccatt

SEQ ID NO: 272587 - DNA, 15 bp, Homo sapiens
ccaagattgcgccat

SEQ ID NO: 272588 - DNA, 15 bp, Homo sapiens
gccaagattgcgcca

SEQ ID NO: 272589 - DNA, 15 bp, Homo sapiens
agccaagattgcgcc

SEQ ID NO: 272590 - DNA, 15 bp, Homo sapiens
aaggcaggagaatca

SEQ ID NO: 272591 - DNA, 15 bp, Homo sapiens
taaggcaggagaatc

SEQ ID NO: 272592 - DNA, 15 bp, Homo sapiens
gctaaggcaggagaa

SEQ ID NO: 272593 - DNA, 15 bp, Homo sapiens
ggctaaggcaggaga

SEQ ID NO: 272594 - DNA, 15 bp, Homo sapiens
aggctaaggcaggag

SEQ ID NO: 272595 - DNA, 15 bp, Homo sapiens
gaggctaaggcagga

SEQ ID NO: 272596 - DNA, 15 bp, Homo sapiens
ggaggctaaggcagg

SEQ ID NO: 272597 - DNA, 15 bp, Homo sapiens
cctggaatcccagct

SEQ ID NO: 272598 - DNA, 15 bp, Homo sapiens
acatgcctggaatcc

SEQ ID NO: 272599 - DNA, 15 bp, Homo sapiens
cacatgcctggaatc

SEQ ID NO: 272600 - DNA, 15 bp, Homo sapiens
gcacatgcctggaat

SEQ ID NO: 272601 - DNA, 15 bp, Homo sapiens
ggcacatgcctggaa

SEQ ID NO: 272602 - DNA, 15 bp, Homo sapiens
tggcacatgcctgga

SEQ ID NO: 272603 - DNA, 15 bp, Homo sapiens
gtggcacatgcctgg

SEQ ID NO: 272604 - DNA, 15 bp, Homo sapiens
gcaaaaattagctgg

SEQ ID NO: 272605 - DNA, 15 bp, Homo sapiens
tgcaaaaattagctg

SEQ ID NO: 272606 - DNA, 15 bp, Homo sapiens
atgcaaaaattagct

SEQ ID NO: 272607 - DNA, 15 bp, Homo sapiens
aatgcaaaaattagc

SEQ ID NO: 272608 - DNA, 15 bp, Homo sapiens
aaatgcaaaaattag

SEQ ID NO: 272609 - DNA, 15 bp, Homo sapiens
aaaatgcaaaaatta

SEQ ID NO: 272610 - DNA, 15 bp, Homo sapiens
aaaaatgcaaaaatt

SEQ ID NO: 272611 - DNA, 15 bp, Homo sapiens
taacaaggtgaaacc

SEQ ID NO: 272612 - DNA, 15 bp, Homo sapiens
ctaacaaggtgaaac

SEQ ID NO: 272613 - DNA, 15 bp, Homo sapiens
gctaacaaggtgaaa

SEQ ID NO: 272614 - DNA, 15 bp, Homo sapiens
ggctaacaaggtgaa

SEQ ID NO: 272615 - DNA, 15 bp, Homo sapiens
tggctaacaaggtga

SEQ ID NO: 272616 - DNA, 15 bp, Homo sapiens
ctggctaacaaggtg

SEQ ID NO: 272617 - DNA, 15 bp, Homo sapiens
cctggctaacaaggt

SEQ ID NO: 272618 - DNA, 15 bp, Homo sapiens
tcctggctaacaagg

SEQ ID NO: 272619 - DNA, 15 bp, Homo sapiens
atcctggctaacaag

SEQ ID NO: 272620 - DNA, 15 bp, Homo sapiens
catcctggctaacaa

SEQ ID NO: 272621 - DNA, 15 bp, Homo sapiens
tcatcctggctaaca

SEQ ID NO: 272622 - DNA, 15 bp, Homo sapiens
atcatcctggctaac

SEQ ID NO: 272623 - DNA, 15 bp, Homo sapiens
gatcatcctggctaa

SEQ ID NO: 272624 - DNA, 15 bp, Homo sapiens
agatcatcctggcta

SEQ ID NO: 272625 - DNA, 15 bp, Homo sapiens
gagatcatcctggct

SEQ ID NO: 272626 - DNA, 15 bp, Homo sapiens
cgagatcatcctggc

SEQ ID NO: 272627 - DNA, 15 bp, Homo sapiens
tcgagatcatcctgg

SEQ ID NO: 272628 - DNA, 15 bp, Homo sapiens
atcgagatcatcctg

SEQ ID NO: 272629 - DNA, 15 bp, Homo sapiens
gatcgagatcatcct

SEQ ID NO: 272630 - DNA, 15 bp, Homo sapiens
agatcgagatcatcc

SEQ ID NO: 272631 - DNA, 15 bp, Homo sapiens
gagatcgagatcatc

SEQ ID NO: 272632 - DNA, 15 bp, Homo sapiens
ggggaggccgaggcg

SEQ ID NO: 272633 - DNA, 15 bp, Homo sapiens
tggggaggccgaggc

SEQ ID NO: 272634 - DNA, 15 bp, Homo sapiens
ttggggaggccgagg

SEQ ID NO: 272635 - DNA, 15 bp, Homo sapiens
tttggggaggccgag

SEQ ID NO: 272636 - DNA, 15 bp, Homo sapiens
ctttggggaggccga

SEQ ID NO: 272637 - DNA, 15 bp, Homo sapiens
actttggggaggccg

SEQ ID NO: 272638 - DNA, 15 bp, Homo sapiens
cactttggggaggcc

SEQ ID NO: 272639 - DNA, 15 bp, Homo sapiens
gcactttggggaggc

SEQ ID NO: 272640 - DNA, 15 bp, Homo sapiens
agcactttggggagg

SEQ ID NO: 272641 - DNA, 15 bp, Homo sapiens
cagcactttggggag

SEQ ID NO: 272642 - DNA, 15 bp, Homo sapiens
ccagcactttgggga

SEQ ID NO: 272643 - DNA, 15 bp, Homo sapiens
cccagcactttgggg

SEQ ID NO: 272644 - DNA, 15 bp, Homo sapiens
cccatgcctgtaatc

SEQ ID NO: 272645 - DNA, 15 bp, Homo sapiens
gcccatgcctgtaat

SEQ ID NO: 272646 - DNA, 15 bp, Homo sapiens
ggcccatgcctgtaa

SEQ ID NO: 272647 - DNA, 15 bp, Homo sapiens
tggcccatgcctgta

SEQ ID NO: 272648 - DNA, 15 bp, Homo sapiens
gtggcccatgcctgt

SEQ ID NO: 272649 - DNA, 15 bp, Homo sapiens
ggtggcccatgcctg

SEQ ID NO: 272650 - DNA, 15 bp, Homo sapiens
tggtggcccatgcct

SEQ ID NO: 272651 - DNA, 15 bp, Homo sapiens
gtggtggcccatgcc

SEQ ID NO: 272652 - DNA, 15 bp, Homo sapiens
tgtggtggcccatgc

SEQ ID NO: 272653 - DNA, 15 bp, Homo sapiens
gtgtggtggcccatg

SEQ ID NO: 272654 - DNA, 15 bp, Homo sapiens
ggtgtggtggcccat

SEQ ID NO: 272655 - DNA, 15 bp, Homo sapiens
aggtgtggtggccca

SEQ ID NO: 272656 - DNA, 15 bp, Homo sapiens
caggtgtggtggccc

SEQ ID NO: 272657 - DNA, 15 bp, Homo sapiens
ccaggtgtggtggcc

SEQ ID NO: 272658 - DNA, 15 bp, Homo sapiens
gggccaggtgtggtg

SEQ ID NO: 272659 - DNA, 15 bp, Homo sapiens
tgggccaggtgtggt

SEQ ID NO: 272660 - DNA, 15 bp, Homo sapiens
ctgggccaggtgtgg

SEQ ID NO: 272661 - DNA, 15 bp, Homo sapiens
tctgggccaggtgtg

SEQ ID NO: 272662 - DNA, 15 bp, Homo sapiens
ctctgggccaggtgt

SEQ ID NO: 272663 - DNA, 15 bp, Homo sapiens
actctgggccaggtg

SEQ ID NO: 272664 - DNA, 15 bp, Homo sapiens
aactctgggccaggt

SEQ ID NO: 272665 - DNA, 15 bp, Homo sapiens
aaactctgggccagg

SEQ ID NO: 272666 - DNA, 15 bp, Homo sapiens
aaaactctgggccag

SEQ ID NO: 272667 - DNA, 15 bp, Homo sapiens
aaaaactctgggcca

SEQ ID NO: 272668 - DNA, 15 bp, Homo sapiens
gaaaaactctgggcc

SEQ ID NO: 272669 - DNA, 15 bp, Homo sapiens
ggaaaaactctgggc

SEQ ID NO: 272670 - DNA, 15 bp, Homo sapiens
tggaaaaactctggg

SEQ ID NO: 272671 - DNA, 15 bp, Homo sapiens
atggaaaaactctgg

SEQ ID NO: 272672 - DNA, 15 bp, Homo sapiens
catggaaaaactctg

SEQ ID NO: 272673 - DNA, 15 bp, Homo sapiens
acatggaaaaactct

SEQ ID NO: 272674 - DNA, 15 bp, Homo sapiens
gacatggaaaaactc

SEQ ID NO: 272675 - DNA, 15 bp, Homo sapiens
agacatggaaaaact

SEQ ID NO: 272676 - DNA, 15 bp, Homo sapiens
aagacatggaaaaac

SEQ ID NO: 272677 - DNA, 15 bp, Homo sapiens
aaagacatggaaaaa

SEQ ID NO: 272678 - DNA, 15 bp, Homo sapiens
aaaagacatggaaaa

SEQ ID NO: 272679 - DNA, 15 bp, Homo sapiens
caaaagacatggaaa

SEQ ID NO: 272680 - DNA, 15 bp, Homo sapiens
gcaaaagacatggaa

SEQ ID NO: 272681 - DNA, 15 bp, Homo sapiens
ggcaaaagacatgga

SEQ ID NO: 272682 - DNA, 15 bp, Homo sapiens
aggcaaaagacatgg

SEQ ID NO: 272683 - DNA, 15 bp, Homo sapiens
aaggcaaaagacatg

SEQ ID NO: 272684 - DNA, 15 bp, Homo sapiens
aaaggcaaaagacat

SEQ ID NO: 272685 - DNA, 15 bp, Homo sapiens
caaaggcaaaagaca

SEQ ID NO: 272686 - DNA, 15 bp, Homo sapiens
gcaaaggcaaaagac

SEQ ID NO: 272687 - DNA, 15 bp, Homo sapiens
ggcaaaggcaaaaga

SEQ ID NO: 272688 - DNA, 15 bp, Homo sapiens
tggcaaaggcaaaag

SEQ ID NO: 272689 - DNA, 15 bp, Homo sapiens
atggcaaaggcaaaa

SEQ ID NO: 272690 - DNA, 15 bp, Homo sapiens
aatggcaaaggcaaa

SEQ ID NO: 272691 - DNA, 15 bp, Homo sapiens
aaatggcaaaggcaa

SEQ ID NO: 272692 - DNA, 15 bp, Homo sapiens
aaaatggcaaaggca

SEQ ID NO: 272693 - DNA, 15 bp, Homo sapiens
gaaaatggcaaaggc

SEQ ID NO: 272694 - DNA, 15 bp, Homo sapiens
ggaaaatggcaaagg

SEQ ID NO: 272695 - DNA, 15 bp, Homo sapiens
aggaaaatggcaaag

SEQ ID NO: 272696 - DNA, 15 bp, Homo sapiens
aaggaaaatggcaaa

SEQ ID NO: 272697 - DNA, 15 bp, Homo sapiens
gaaggaaaatggcaa

SEQ ID NO: 272698 - DNA, 15 bp, Homo sapiens
ggaaggaaaatggca

SEQ ID NO: 272699 - DNA, 15 bp, Homo sapiens
tggaaggaaaatggc

SEQ ID NO: 272700 - DNA, 15 bp, Homo sapiens
atggaaggaaaatgg

SEQ ID NO: 272701 - DNA, 15 bp, Homo sapiens
aatggaaggaaaatg

SEQ ID NO: 272702 - DNA, 15 bp, Homo sapiens
caatggaaggaaaat

SEQ ID NO: 272703 - DNA, 15 bp, Homo sapiens
ccaatggaaggaaaa

SEQ ID NO: 272704 - DNA, 15 bp, Homo sapiens
accaatggaaggaaa

SEQ ID NO: 272705 - DNA, 15 bp, Homo sapiens
taccaatggaaggaa

SEQ ID NO: 272706 - DNA, 15 bp, Homo sapiens
ttaccaatggaagga

SEQ ID NO: 272707 - DNA, 15 bp, Homo sapiens
tttaccaatggaagg

SEQ ID NO: 272708 - DNA, 15 bp, Homo sapiens
ctttaccaatggaag

SEQ ID NO: 272709 - DNA, 15 bp, Homo sapiens
gctttaccaatggaa

SEQ ID NO: 272710 - DNA, 15 bp, Homo sapiens
tgctttaccaatgga

SEQ ID NO: 272711 - DNA, 15 bp, Homo sapiens
ctgctttaccaatgg

SEQ ID NO: 272712 - DNA, 15 bp, Homo sapiens
actgctttaccaatg

SEQ ID NO: 272713 - DNA, 15 bp, Homo sapiens
aactgctttaccaat

SEQ ID NO: 272714 - DNA, 15 bp, Homo sapiens
taactgctttaccaa

SEQ ID NO: 272715 - DNA, 15 bp, Homo sapiens
gtaactgctttacca

SEQ ID NO: 272716 - DNA, 15 bp, Homo sapiens
tgtaactgctttacc

SEQ ID NO: 272717 - DNA, 15 bp, Homo sapiens
aatgtaactgcttta

SEQ ID NO: 272718 - DNA, 15 bp, Homo sapiens
aaatgtaactgcttt

SEQ ID NO: 272719 - DNA, 15 bp, Homo sapiens
taaatgtaactgctt

SEQ ID NO: 272720 - DNA, 15 bp, Homo sapiens
ataaatgtaactgct

SEQ ID NO: 272721 - DNA, 15 bp, Homo sapiens
tataaatgtaactgc

SEQ ID NO: 272722 - DNA, 15 bp, Homo sapiens
ttataaatgtaactg

SEQ ID NO: 272723 - DNA, 15 bp, Homo sapiens
tttataaatgtaact

SEQ ID NO: 272724 - DNA, 15 bp, Homo sapiens
ctttataaatgtaac

SEQ ID NO: 272725 - DNA, 15 bp, Homo sapiens
tctttataaatgtaa

SEQ ID NO: 272726 - DNA, 15 bp, Homo sapiens
ctctttataaatgta

SEQ ID NO: 272727 - DNA, 15 bp, Homo sapiens
tctctttataaatgt

SEQ ID NO: 272728 - DNA, 15 bp, Homo sapiens
gtctctttataaatg

SEQ ID NO: 272729 - DNA, 15 bp, Homo sapiens
tgtctctttataaat

SEQ ID NO: 272730 - DNA, 15 bp, Homo sapiens
atgtctctttataaa

SEQ ID NO: 272731 - DNA, 15 bp, Homo sapiens
aatgtctctttataa

SEQ ID NO: 272732 - DNA, 15 bp, Homo sapiens
aaatgtctctttata

SEQ ID NO: 272733 - DNA, 15 bp, Homo sapiens
caaatgtctctttat

SEQ ID NO: 272734 - DNA, 15 bp, Homo sapiens
acaaatgtctcttta

SEQ ID NO: 272735 - DNA, 15 bp, Homo sapiens
tacaaatgtctcttt

SEQ ID NO: 272736 - DNA, 15 bp, Homo sapiens
ttacaaatgtctctt

SEQ ID NO: 272737 - DNA, 15 bp, Homo sapiens
tttacaaatgtctct

SEQ ID NO: 272738 - DNA, 15 bp, Homo sapiens
ctttacaaatgtctc

SEQ ID NO: 272739 - DNA, 15 bp, Homo sapiens
tctttacaaatgtct

SEQ ID NO: 272740 - DNA, 15 bp, Homo sapiens
ctctttacaaatgtc

SEQ ID NO: 272741 - DNA, 15 bp, Homo sapiens
tctctttacaaatgt

SEQ ID NO: 272742 - DNA, 15 bp, Homo sapiens
ttctctttacaaatg

SEQ ID NO: 272743 - DNA, 15 bp, Homo sapiens
attctctttacaaat

SEQ ID NO: 272744 - DNA, 15 bp, Homo sapiens
tattctctttacaaa

SEQ ID NO: 272745 - DNA, 15 bp, Homo sapiens
ttattctctttacaa

SEQ ID NO: 272746 - DNA, 15 bp, Homo sapiens
gttattctctttaca

SEQ ID NO: 272747 - DNA, 15 bp, Homo sapiens
agttattctctttac

SEQ ID NO: 272748 - DNA, 15 bp, Homo sapiens
tagttattctcttta

SEQ ID NO: 272749 - DNA, 15 bp, Homo sapiens
ctagttattctcttt

SEQ ID NO: 272750 - DNA, 15 bp, Homo sapiens
tctagttattctctt

SEQ ID NO: 272751 - DNA, 15 bp, Homo sapiens
gtctagttattctct

SEQ ID NO: 272752 - DNA, 15 bp, Homo sapiens
tgtctagttattctc

SEQ ID NO: 272753 - DNA, 15 bp, Homo sapiens
ctgtctagttattct

SEQ ID NO: 272754 - DNA, 15 bp, Homo sapiens
gctgtctagttattc

SEQ ID NO: 272755 - DNA, 15 bp, Homo sapiens
tgctgtctagttatt

SEQ ID NO: 272756 - DNA, 15 bp, Homo sapiens
ttgctgtctagttat

SEQ ID NO: 272757 - DNA, 15 bp, Homo sapiens
tttgctgtctagtta

SEQ ID NO: 272758 - DNA, 15 bp, Homo sapiens
ttttgctgtctagtt

SEQ ID NO: 272759 - DNA, 15 bp, Homo sapiens
gttttgctgtctagt

SEQ ID NO: 272760 - DNA, 15 bp, Homo sapiens
agttttgctgtctag

SEQ ID NO: 272761 - DNA, 15 bp, Homo sapiens
tagttttgctgtcta

SEQ ID NO: 272762 - DNA, 15 bp, Homo sapiens
ttagttttgctgtct

SEQ ID NO: 272763 - DNA, 15 bp, Homo sapiens
tttagttttgctgtc

SEQ ID NO: 272764 - DNA, 15 bp, Homo sapiens
ttttagttttgctgt

SEQ ID NO: 272765 - DNA, 15 bp, Homo sapiens
gttttagttttgctg

SEQ ID NO: 272766 - DNA, 15 bp, Homo sapiens
cgttttagttttgct

SEQ ID NO: 272767 - DNA, 15 bp, Homo sapiens
acgttttagttttgc

SEQ ID NO: 272768 - DNA, 15 bp, Homo sapiens
tacgttttagttttg

SEQ ID NO: 272769 - DNA, 15 bp, Homo sapiens
gtacgttttagtttt

SEQ ID NO: 272770 - DNA, 15 bp, Homo sapiens
tgtacgttttagttt

SEQ ID NO: 272771 - DNA, 15 bp, Homo sapiens
ttgtacgttttagtt

SEQ ID NO: 272772 - DNA, 15 bp, Homo sapiens
attgtacgttttagt

SEQ ID NO: 272773 - DNA, 15 bp, Homo sapiens
cattgtacgttttag

SEQ ID NO: 272774 - DNA, 15 bp, Homo sapiens
acattgtacgtttta

SEQ ID NO: 272775 - DNA, 15 bp, Homo sapiens
aacattgtacgtttt

SEQ ID NO: 272776 - DNA, 15 bp, Homo sapiens
aaacattgtacgttt

SEQ ID NO: 272777 - DNA, 15 bp, Homo sapiens
caaacattgtacgtt

SEQ ID NO: 272778 - DNA, 15 bp, Homo sapiens
gcaaacattgtacgt

SEQ ID NO: 272779 - DNA, 15 bp, Homo sapiens
tgcaaacattgtacg

SEQ ID NO: 272780 - DNA, 15 bp, Homo sapiens
ttgcaaacattgtac

SEQ ID NO: 272781 - DNA, 15 bp, Homo sapiens
gttgcaaacattgta

SEQ ID NO: 272782 - DNA, 15 bp, Homo sapiens
ggttgcaaacattgt

SEQ ID NO: 272783 - DNA, 15 bp, Homo sapiens
tggttgcaaacattg

SEQ ID NO: 272784 - DNA, 15 bp, Homo sapiens
ttggttgcaaacatt

SEQ ID NO: 272785 - DNA, 15 bp, Homo sapiens
tttggttgcaaacat

SEQ ID NO: 272786 - DNA, 15 bp, Homo sapiens
gtttggttgcaaaca

SEQ ID NO: 272787 - DNA, 15 bp, Homo sapiens
agtttggttgcaaac

SEQ ID NO: 272788 - DNA, 15 bp, Homo sapiens
tagtttggttgcaaa

SEQ ID NO: 272789 - DNA, 15 bp, Homo sapiens
ctagtttggttgcaa

SEQ ID NO: 272790 - DNA, 15 bp, Homo sapiens
tctagtttggttgca

SEQ ID NO: 272791 - DNA, 15 bp, Homo sapiens
atctagtttggttgc

SEQ ID NO: 272792 - DNA, 15 bp, Homo sapiens
catctagtttggttg

SEQ ID NO: 272793 - DNA, 15 bp, Homo sapiens
tcatctagtttggtt

SEQ ID NO: 272794 - DNA, 15 bp, Homo sapiens
gtcatctagtttggt

SEQ ID NO: 272795 - DNA, 15 bp, Homo sapiens
tgtcatctagtttgg

SEQ ID NO: 272796 - DNA, 15 bp, Homo sapiens
ttgtcatctagtttg

SEQ ID NO: 272797 - DNA, 15 bp, Homo sapiens
cttgtcatctagttt

SEQ ID NO: 272798 - DNA, 15 bp, Homo sapiens
tcttgtcatctagtt

SEQ ID NO: 272799 - DNA, 15 bp, Homo sapiens
ctcttgtcatctagt

SEQ ID NO: 272800 - DNA, 15 bp, Homo sapiens
tctcttgtcatctag

SEQ ID NO: 272801 - DNA, 15 bp, Homo sapiens
ctctcttgtcatcta

SEQ ID NO: 272802 - DNA, 15 bp, Homo sapiens
tctctcttgtcatct

SEQ ID NO: 272803 - DNA, 15 bp, Homo sapiens
atctctcttgtcatc

SEQ ID NO: 272804 - DNA, 15 bp, Homo sapiens
gatctctcttgtcat

SEQ ID NO: 272805 - DNA, 15 bp, Homo sapiens
ggatctctcttgtca

SEQ ID NO: 272806 - DNA, 15 bp, Homo sapiens
tggatctctcttgtc

SEQ ID NO: 272807 - DNA, 15 bp, Homo sapiens
ttggatctctcttgt

SEQ ID NO: 272808 - DNA, 15 bp, Homo sapiens
tttggatctctcttg

SEQ ID NO: 272809 - DNA, 15 bp, Homo sapiens
ttttggatctctctt

SEQ ID NO: 272810 - DNA, 15 bp, Homo sapiens
attttggatctctct

SEQ ID NO: 272811 - DNA, 15 bp, Homo sapiens
tattttggatctctc

SEQ ID NO: 272812 - DNA, 15 bp, Homo sapiens
ttattttggatctct

SEQ ID NO: 272813 - DNA, 15 bp, Homo sapiens
tttattttggatctc

SEQ ID NO: 272814 - DNA, 15 bp, Homo sapiens
atttattttggatct

SEQ ID NO: 272815 - DNA, 15 bp, Homo sapiens
gatttattttggatc

SEQ ID NO: 272816 - DNA, 15 bp, Homo sapiens
ggatttattttggat

SEQ ID NO: 272817 - DNA, 15 bp, Homo sapiens
tggatttattttgga

SEQ ID NO: 272818 - DNA, 15 bp, Homo sapiens
ctggatttattttgg

SEQ ID NO: 272819 - DNA, 15 bp, Homo sapiens
cctggatttattttg

SEQ ID NO: 272820 - DNA, 15 bp, Homo sapiens
acctggatttatttt

SEQ ID NO: 272821 - DNA, 15 bp, Homo sapiens
cacctggatttattt

SEQ ID NO: 272822 - DNA, 15 bp, Homo sapiens
ccacctggatttatt

SEQ ID NO: 272823 - DNA, 15 bp, Homo sapiens
gccacctggatttat

SEQ ID NO: 272824 - DNA, 15 bp, Homo sapiens
cgccacctggattta

SEQ ID NO: 272825 - DNA, 15 bp, Homo sapiens
tcgccacctggattt

SEQ ID NO: 272826 - DNA, 15 bp, Homo sapiens
atcgccacctggatt

SEQ ID NO: 272827 - DNA, 15 bp, Homo sapiens
tatcgccacctggat

SEQ ID NO: 272828 - DNA, 15 bp, Homo sapiens
ttatcgccacctgga

SEQ ID NO: 272829 - DNA, 15 bp, Homo sapiens
cttatcgccacctgg

SEQ ID NO: 272830 - DNA, 15 bp, Homo sapiens
gcttatcgccacctg

SEQ ID NO: 272831 - DNA, 15 bp, Homo sapiens
ggcttatcgccacct

SEQ ID NO: 272832 - DNA, 15 bp, Homo sapiens
tggcttatcgccacc

SEQ ID NO: 272833 - DNA, 15 bp, Homo sapiens
gtggcttatcgccac

SEQ ID NO: 272834 - DNA, 15 bp, Homo sapiens
ggtggcttatcgcca

SEQ ID NO: 272835 - DNA, 15 bp, Homo sapiens
tggtggcttatcgcc

SEQ ID NO: 272836 - DNA, 15 bp, Homo sapiens
gtggtggcttatcgc

SEQ ID NO: 272837 - DNA, 15 bp, Homo sapiens
ggtggtggcttatcg

SEQ ID NO: 272838 - DNA, 15 bp, Homo sapiens
tggtggtggcttatc

SEQ ID NO: 272839 - DNA, 15 bp, Homo sapiens
ctggtggtggcttat

SEQ ID NO: 272840 - DNA, 15 bp, Homo sapiens
gctggtggtggctta

SEQ ID NO: 272841 - DNA, 15 bp, Homo sapiens
ggctggtggtggctt

SEQ ID NO: 272842 - DNA, 15 bp, Homo sapiens
tggctggtggtggct

SEQ ID NO: 272843 - DNA, 15 bp, Homo sapiens
gtggctggtggtggc

SEQ ID NO: 272844 - DNA, 15 bp, Homo sapiens
tgtggctggtggtgg

SEQ ID NO: 272845 - DNA, 15 bp, Homo sapiens
ttgtggctggtggtg

SEQ ID NO: 272846 - DNA, 15 bp, Homo sapiens
tttgtggctggtggt

SEQ ID NO: 272847 - DNA, 15 bp, Homo sapiens
ttttgtggctggtgg

SEQ ID NO: 272848 - DNA, 15 bp, Homo sapiens
gttttgtggctggtg

SEQ ID NO: 272849 - DNA, 15 bp, Homo sapiens
cgttttgtggctggt

SEQ ID NO: 272850 - DNA, 15 bp, Homo sapiens
acgttttgtggctgg

SEQ ID NO: 272851 - DNA, 15 bp, Homo sapiens
tacgttttgtggctg

SEQ ID NO: 272852 - DNA, 15 bp, Homo sapiens
gtacgttttgtggct

SEQ ID NO: 272853 - DNA, 15 bp, Homo sapiens
tgtacgttttgtggc

SEQ ID NO: 272854 - DNA, 15 bp, Homo sapiens
ttgtacgttttgtgg

SEQ ID NO: 272855 - DNA, 15 bp, Homo sapiens
cttgtacgttttgtg

SEQ ID NO: 272856 - DNA, 15 bp, Homo sapiens
tcttgtacgttttgt

SEQ ID NO: 272857 - DNA, 15 bp, Homo sapiens
gtcttgtacgttttg

SEQ ID NO: 272858 - DNA, 15 bp, Homo sapiens
tgtcttgtacgtttt

SEQ ID NO: 272859 - DNA, 15 bp, Homo sapiens
atgtcttgtacgttt

SEQ ID NO: 272860 - DNA, 15 bp, Homo sapiens
gatgtcttgtacgtt

SEQ ID NO: 272861 - DNA, 15 bp, Homo sapiens
tgatgtcttgtacgt

SEQ ID NO: 272862 - DNA, 15 bp, Homo sapiens
gtgatgtcttgtacg

SEQ ID NO: 272863 - DNA, 15 bp, Homo sapiens
agtgatgtcttgtac

SEQ ID NO: 272864 - DNA, 15 bp, Homo sapiens
cagtgatgtcttgta

SEQ ID NO: 272865 - DNA, 15 bp, Homo sapiens
gcagtgatgtcttgt

SEQ ID NO: 272866 - DNA, 15 bp, Homo sapiens
ggcagtgatgtcttg

SEQ ID NO: 272867 - DNA, 15 bp, Homo sapiens
aggcagtgatgtctt

SEQ ID NO: 272868 - DNA, 15 bp, Homo sapiens
caggcagtgatgtct

SEQ ID NO: 272869 - DNA, 15 bp, Homo sapiens
acaggcagtgatgtc

SEQ ID NO: 272870 - DNA, 15 bp, Homo sapiens
tacaggcagtgatgt

SEQ ID NO: 272871 - DNA, 15 bp, Homo sapiens
atacaggcagtgatg

SEQ ID NO: 272872 - DNA, 15 bp, Homo sapiens
catacaggcagtgat

SEQ ID NO: 272873 - DNA, 15 bp, Homo sapiens
tcatacaggcagtga

SEQ ID NO: 272874 - DNA, 15 bp, Homo sapiens
ctcatacaggcagtg

SEQ ID NO: 272875 - DNA, 15 bp, Homo sapiens
tctcatacaggcagt

SEQ ID NO: 272876 - DNA, 15 bp, Homo sapiens
ctctcatacaggcag

SEQ ID NO: 272877 - DNA, 15 bp, Homo sapiens
cctctcatacaggca

SEQ ID NO: 272878 - DNA, 15 bp, Homo sapiens
tcctctcatacaggc

SEQ ID NO: 272879 - DNA, 15 bp, Homo sapiens
ttcctctcatacagg

SEQ ID NO: 272880 - DNA, 15 bp, Homo sapiens
tttcctctcatacag

SEQ ID NO: 272881 - DNA, 15 bp, Homo sapiens
ctttcctctcataca

SEQ ID NO: 272882 - DNA, 15 bp, Homo sapiens
tctttcctctcatac

SEQ ID NO: 272883 - DNA, 15 bp, Homo sapiens
gtctttcctctcata

SEQ ID NO: 272884 - DNA, 15 bp, Homo sapiens
tgtctttcctctcat

SEQ ID NO: 272885 - DNA, 15 bp, Homo sapiens
ttgtctttcctctca

SEQ ID NO: 272886 - DNA, 15 bp, Homo sapiens
cttgtctttcctctc

SEQ ID NO: 272887 - DNA, 15 bp, Homo sapiens
ccttgtctttcctct

SEQ ID NO: 272888 - DNA, 15 bp, Homo sapiens
tccttgtctttcctc

SEQ ID NO: 272889 - DNA, 15 bp, Homo sapiens
ttccttgtctttcct

SEQ ID NO: 272890 - DNA, 15 bp, Homo sapiens
cttccttgtctttcc

SEQ ID NO: 272891 - DNA, 15 bp, Homo sapiens
acttccttgtctttc

SEQ ID NO: 272892 - DNA, 15 bp, Homo sapiens
cacttccttgtcttt

SEQ ID NO: 272893 - DNA, 15 bp, Homo sapiens
tcacttccttgtctt

SEQ ID NO: 272894 - DNA, 15 bp, Homo sapiens
ctcacttccttgtct

SEQ ID NO: 272895 - DNA, 15 bp, Homo sapiens
cctcacttccttgtc

SEQ ID NO: 272896 - DNA, 15 bp, Homo sapiens
ccctcacttccttgt

SEQ ID NO: 272897 - DNA, 15 bp, Homo sapiens
accctcacttccttg

SEQ ID NO: 272898 - DNA, 15 bp, Homo sapiens
caccctcacttcctt

SEQ ID NO: 272899 - DNA, 15 bp, Homo sapiens
gcaccctcacttcct

SEQ ID NO: 272900 - DNA, 15 bp, Homo sapiens
ggcaccctcacttcc

SEQ ID NO: 272901 - DNA, 15 bp, Homo sapiens
aggcaccctcacttc

SEQ ID NO: 272902 - DNA, 15 bp, Homo sapiens
taggcaccctcactt

SEQ ID NO: 272903 - DNA, 15 bp, Homo sapiens
ttaggcaccctcact

SEQ ID NO: 272904 - DNA, 15 bp, Homo sapiens
cttaggcaccctcac

SEQ ID NO: 272905 - DNA, 15 bp, Homo sapiens
tcttaggcaccctca

SEQ ID NO: 272906 - DNA, 15 bp, Homo sapiens
ttcttaggcaccctc

SEQ ID NO: 272907 - DNA, 15 bp, Homo sapiens
gttcttaggcaccct

SEQ ID NO: 272908 - DNA, 15 bp, Homo sapiens
ggttcttaggcaccc

SEQ ID NO: 272909 - DNA, 15 bp, Homo sapiens
tggttcttaggcacc

SEQ ID NO: 272910 - DNA, 15 bp, Homo sapiens
ctggttcttaggcac

SEQ ID NO: 272911 - DNA, 15 bp, Homo sapiens
tctggttcttaggca

SEQ ID NO: 272912 - DNA, 15 bp, Homo sapiens
atctggttcttaggc

SEQ ID NO: 272913 - DNA, 15 bp, Homo sapiens
tatctggttcttagg

SEQ ID NO: 272914 - DNA, 15 bp, Homo sapiens
ctatctggttcttag

SEQ ID NO: 272915 - DNA, 15 bp, Homo sapiens
gctatctggttctta

SEQ ID NO: 272916 - DNA, 15 bp, Homo sapiens
ggctatctggttctt

SEQ ID NO: 272917 - DNA, 15 bp, Homo sapiens
gggctatctggttct

SEQ ID NO: 272918 - DNA, 15 bp, Homo sapiens
ggggctatctggttc

SEQ ID NO: 272919 - DNA, 15 bp, Homo sapiens
gggggctatctggtt

SEQ ID NO: 272920 - DNA, 15 bp, Homo sapiens
tgggggctatctggt

SEQ ID NO: 272921 - DNA, 15 bp, Homo sapiens
ttgggggctatctgg

SEQ ID NO: 272922 - DNA, 15 bp, Homo sapiens
tttgggggctatctg

SEQ ID NO: 272923 - DNA, 15 bp, Homo sapiens
ttttgggggctatct

SEQ ID NO: 272924 - DNA, 15 bp, Homo sapiens
attttgggggctatc

SEQ ID NO: 272925 - DNA, 15 bp, Homo sapiens
tattttgggggctat

SEQ ID NO: 272926 - DNA, 15 bp, Homo sapiens
ctattttgggggcta

SEQ ID NO: 272927 - DNA, 15 bp, Homo sapiens
cctattttgggggct

SEQ ID NO: 272928 - DNA, 15 bp, Homo sapiens
gcctattttgggggc

SEQ ID NO: 272929 - DNA, 15 bp, Homo sapiens
tgcctattttggggg

SEQ ID NO: 272930 - DNA, 15 bp, Homo sapiens
ttgcctattttgggg

SEQ ID NO: 272931 - DNA, 15 bp, Homo sapiens
gttgcctattttggg

SEQ ID NO: 272932 - DNA, 15 bp, Homo sapiens
tgttgcctattttgg

SEQ ID NO: 272933 - DNA, 15 bp, Homo sapiens
ctgttgcctattttg

SEQ ID NO: 272934 - DNA, 15 bp, Homo sapiens
tctgttgcctatttt

SEQ ID NO: 272935 - DNA, 15 bp, Homo sapiens
atctgttgcctattt

SEQ ID NO: 272936 - DNA, 15 bp, Homo sapiens
tatctgttgcctatt

SEQ ID NO: 272937 - DNA, 15 bp, Homo sapiens
atatctgttgcctat

SEQ ID NO: 272938 - DNA, 15 bp, Homo sapiens
aatatctgttgccta

SEQ ID NO: 272939 - DNA, 15 bp, Homo sapiens
aaatatctgttgcct

SEQ ID NO: 272940 - DNA, 15 bp, Homo sapiens
taaatatctgttgcc

SEQ ID NO: 272941 - DNA, 15 bp, Homo sapiens
ttaaatatctgttgc

SEQ ID NO: 272942 - DNA, 15 bp, Homo sapiens
attaaatatctgttg

SEQ ID NO: 272943 - DNA, 15 bp, Homo sapiens
cattaaatatctgtt

SEQ ID NO: 272944 - DNA, 15 bp, Homo sapiens
ccattaaatatctgt

SEQ ID NO: 272945 - DNA, 15 bp, Homo sapiens
tccattaaatatctg

SEQ ID NO: 272946 - DNA, 15 bp, Homo sapiens
ttccattaaatatct

SEQ ID NO: 272947 - DNA, 15 bp, Homo sapiens
tttccattaaatatc

SEQ ID NO: 272948 - DNA, 15 bp, Homo sapiens
ctttccattaaatat

SEQ ID NO: 272949 - DNA, 15 bp, Homo sapiens
gctttccattaaata

SEQ ID NO: 272950 - DNA, 15 bp, Homo sapiens
agctttccattaaat

SEQ ID NO: 272951 - DNA, 15 bp, Homo sapiens
cagctttccattaaa

SEQ ID NO: 272952 - DNA, 15 bp, Homo sapiens
ccagctttccattaa

SEQ ID NO: 272953 - DNA, 15 bp, Homo sapiens
gccagctttccatta

SEQ ID NO: 272954 - DNA, 15 bp, Homo sapiens
agccagctttccatt

SEQ ID NO: 272955 - DNA, 15 bp, Homo sapiens
aagccagctttccat

SEQ ID NO: 272956 - DNA, 15 bp, Homo sapiens
caagccagctttcca

SEQ ID NO: 272957 - DNA, 15 bp, Homo sapiens
tcaagccagctttcc

SEQ ID NO: 272958 - DNA, 15 bp, Homo sapiens
ctcaagccagctttc

SEQ ID NO: 272959 - DNA, 15 bp, Homo sapiens
tctcaagccagcttt

SEQ ID NO: 272960 - DNA, 15 bp, Homo sapiens
ctctcaagccagctt

SEQ ID NO: 272961 - DNA, 15 bp, Homo sapiens
gctctcaagccagct

SEQ ID NO: 272962 - DNA, 15 bp, Homo sapiens
tgctctcaagccagc

SEQ ID NO: 272963 - DNA, 15 bp, Homo sapiens
ctgctctcaagccag

SEQ ID NO: 272964 - DNA, 15 bp, Homo sapiens
tctgctctcaagcca

SEQ ID NO: 272965 - DNA, 15 bp, Homo sapiens
ctctgctctcaagcc

SEQ ID NO: 272966 - DNA, 15 bp, Homo sapiens
gctctgctctcaagc

SEQ ID NO: 272967 - DNA, 15 bp, Homo sapiens
agctctgctctcaag

SEQ ID NO: 272968 - DNA, 15 bp, Homo sapiens
tagctctgctctcaa

SEQ ID NO: 272969 - DNA, 15 bp, Homo sapiens
ttagctctgctctca

SEQ ID NO: 272970 - DNA, 15 bp, Homo sapiens
tttagctctgctctc

SEQ ID NO: 272971 - DNA, 15 bp, Homo sapiens
gtttagctctgctct

SEQ ID NO: 272972 - DNA, 15 bp, Homo sapiens
ggtttagctctgctc

SEQ ID NO: 272973 - DNA, 15 bp, Homo sapiens
aggtttagctctgct

SEQ ID NO: 272974 - DNA, 15 bp, Homo sapiens
caggtttagctctgc

SEQ ID NO: 272975 - DNA, 15 bp, Homo sapiens
ccaggtttagctctg

SEQ ID NO: 272976 - DNA, 15 bp, Homo sapiens
tccaggtttagctct

SEQ ID NO: 272977 - DNA, 15 bp, Homo sapiens
ttccaggtttagctc

SEQ ID NO: 272978 - DNA, 15 bp, Homo sapiens
cttccaggtttagct

SEQ ID NO: 272979 - DNA, 15 bp, Homo sapiens
ccttccaggtttagc

SEQ ID NO: 272980 - DNA, 15 bp, Homo sapiens
cccttccaggtttag

SEQ ID NO: 272981 - DNA, 15 bp, Homo sapiens
acccttccaggttta

SEQ ID NO: 272982 - DNA, 15 bp, Homo sapiens
aacccttccaggttt

SEQ ID NO: 272983 - DNA, 15 bp, Homo sapiens
aaacccttccaggtt

SEQ ID NO: 272984 - DNA, 15 bp, Homo sapiens
aaaacccttccaggt

SEQ ID NO: 272985 - DNA, 15 bp, Homo sapiens
caaaacccttccagg

SEQ ID NO: 272986 - DNA, 15 bp, Homo sapiens
gcaaaacccttccag

SEQ ID NO: 272987 - DNA, 15 bp, Homo sapiens
ggcaaaacccttcca

SEQ ID NO: 272988 - DNA, 15 bp, Homo sapiens
tggcaaaacccttcc

SEQ ID NO: 272989 - DNA, 15 bp, Homo sapiens
atggcaaaacccttc

SEQ ID NO: 272990 - DNA, 15 bp, Homo sapiens
catggcaaaaccctt

SEQ ID NO: 272991 - DNA, 15 bp, Homo sapiens
gcatggcaaaaccct

SEQ ID NO: 272992 - DNA, 15 bp, Homo sapiens
cgcatggcaaaaccc

SEQ ID NO: 272993 - DNA, 15 bp, Homo sapiens
gcgcatggcaaaacc

SEQ ID NO: 272994 - DNA, 15 bp, Homo sapiens
tgcgcatggcaaaac

SEQ ID NO: 272995 - DNA, 15 bp, Homo sapiens
ctgcgcatggcaaaa

SEQ ID NO: 272996 - DNA, 15 bp, Homo sapiens
tctgcgcatggcaaa

SEQ ID NO: 272997 - DNA, 15 bp, Homo sapiens
ctctgcgcatggcaa

SEQ ID NO: 272998 - DNA, 15 bp, Homo sapiens
cctctgcgcatggca

SEQ ID NO: 272999 - DNA, 15 bp, Homo sapiens
gcctctgcgcatggc

SEQ ID NO: 273000 - DNA, 15 bp, Homo sapiens
agcctctgcgcatgg

SEQ ID NO: 273001 - DNA, 15 bp, Homo sapiens
tagcctctgcgcatg

SEQ ID NO: 273002 - DNA, 15 bp, Homo sapiens
ctagcctctgcgcat

SEQ ID NO: 273003 - DNA, 15 bp, Homo sapiens
cctagcctctgcgca

SEQ ID NO: 273004 - DNA, 15 bp, Homo sapiens
ccctagcctctgcgc

SEQ ID NO: 273005 - DNA, 15 bp, Homo sapiens
accctagcctctgcg

SEQ ID NO: 273006 - DNA, 15 bp, Homo sapiens
taccctagcctctgc

SEQ ID NO: 273007 - DNA, 15 bp, Homo sapiens
ttaccctagcctctg

SEQ ID NO: 273008 - DNA, 15 bp, Homo sapiens
tttaccctagcctct

SEQ ID NO: 273009 - DNA, 15 bp, Homo sapiens
ttttaccctagcctc

SEQ ID NO: 273010 - DNA, 15 bp, Homo sapiens
tttttaccctagcct

SEQ ID NO: 273011 - DNA, 15 bp, Homo sapiens
ttttttaccctagcc

SEQ ID NO: 273012 - DNA, 15 bp, Homo sapiens
cttttttaccctagc

SEQ ID NO: 273013 - DNA, 15 bp, Homo sapiens
ccttttttaccctag

SEQ ID NO: 273014 - DNA, 15 bp, Homo sapiens
accttttttacccta

SEQ ID NO: 273015 - DNA, 15 bp, Homo sapiens
caccttttttaccct

SEQ ID NO: 273016 - DNA, 15 bp, Homo sapiens
acaccttttttaccc

SEQ ID NO: 273017 - DNA, 15 bp, Homo sapiens
cacaccttttttacc

SEQ ID NO: 273018 - DNA, 15 bp, Homo sapiens
tcacaccttttttac

SEQ ID NO: 273019 - DNA, 15 bp, Homo sapiens
gtcacacctttttta

SEQ ID NO: 273020 - DNA, 15 bp, Homo sapiens
tgtcacacctttttt

SEQ ID NO: 273021 - DNA, 15 bp, Homo sapiens
atgtcacaccttttt

SEQ ID NO: 273022 - DNA, 15 bp, Homo sapiens
aatgtcacacctttt

SEQ ID NO: 273023 - DNA, 15 bp, Homo sapiens
aaatgtcacaccttt

SEQ ID NO: 273024 - DNA, 15 bp, Homo sapiens
gaaatgtcacacctt

SEQ ID NO: 273025 - DNA, 15 bp, Homo sapiens
agaaatgtcacacct

SEQ ID NO: 273026 - DNA, 15 bp, Homo sapiens
tagaaatgtcacacc

SEQ ID NO: 273027 - DNA, 15 bp, Homo sapiens
ctagaaatgtcacac

SEQ ID NO: 273028 - DNA, 15 bp, Homo sapiens
tctagaaatgtcaca

SEQ ID NO: 273029 - DNA, 15 bp, Homo sapiens
ttctagaaatgtcac

SEQ ID NO: 273030 - DNA, 15 bp, Homo sapiens
attctagaaatgtca

SEQ ID NO: 273031 - DNA, 15 bp, Homo sapiens
cattctagaaatgtc

SEQ ID NO: 273032 - DNA, 15 bp, Homo sapiens
gcattctagaaatgt

SEQ ID NO: 273033 - DNA, 15 bp, Homo sapiens
agcattctagaaatg

SEQ ID NO: 273034 - DNA, 15 bp, Homo sapiens
gagcattctagaaat

SEQ ID NO: 273035 - DNA, 15 bp, Homo sapiens
agagcattctagaaa

SEQ ID NO: 273036 - DNA, 15 bp, Homo sapiens
aagagcattctagaa

SEQ ID NO: 273037 - DNA, 15 bp, Homo sapiens
caagagcattctaga

SEQ ID NO: 273038 - DNA, 15 bp, Homo sapiens
gcaagagcattctag

SEQ ID NO: 273039 - DNA, 15 bp, Homo sapiens
ggcaagagcattcta

SEQ ID NO: 273040 - DNA, 15 bp, Homo sapiens
aggcaagagcattct

SEQ ID NO: 273041 - DNA, 15 bp, Homo sapiens
caggcaagagcattc

SEQ ID NO: 273042 - DNA, 15 bp, Homo sapiens
gcaggcaagagcatt

SEQ ID NO: 273043 - DNA, 15 bp, Homo sapiens
agcaggcaagagcat

SEQ ID NO: 273044 - DNA, 15 bp, Homo sapiens
cagcaggcaagagca

SEQ ID NO: 273045 - DNA, 15 bp, Homo sapiens
acagcaggcaagagc

SEQ ID NO: 273046 - DNA, 15 bp, Homo sapiens
cacagcaggcaagag

SEQ ID NO: 273047 - DNA, 15 bp, Homo sapiens
tcacagcaggcaaga

SEQ ID NO: 273048 - DNA, 15 bp, Homo sapiens
ctcacagcaggcaag

SEQ ID NO: 273049 - DNA, 15 bp, Homo sapiens
gctcacagcaggcaa

SEQ ID NO: 273050 - DNA, 15 bp, Homo sapiens
agctcacagcaggca

SEQ ID NO: 273051 - DNA, 15 bp, Homo sapiens
gagctcacagcaggc

SEQ ID NO: 273052 - DNA, 15 bp, Homo sapiens
agagctcacagcagg

SEQ ID NO: 273053 - DNA, 15 bp, Homo sapiens
gagagctcacagcag

SEQ ID NO: 273054 - DNA, 15 bp, Homo sapiens
tgagagctcacagca

SEQ ID NO: 273055 - DNA, 15 bp, Homo sapiens
ctgagagctcacagc

SEQ ID NO: 273056 - DNA, 15 bp, Homo sapiens
tctgagagctcacag

SEQ ID NO: 273057 - DNA, 15 bp, Homo sapiens
gtctgagagctcaca

SEQ ID NO: 273058 - DNA, 15 bp, Homo sapiens
agtctgagagctcac

SEQ ID NO: 273059 - DNA, 15 bp, Homo sapiens
cagtctgagagctca

SEQ ID NO: 273060 - DNA, 15 bp, Homo sapiens
ccagtctgagagctc

SEQ ID NO: 273061 - DNA, 15 bp, Homo sapiens
tccagtctgagagct

SEQ ID NO: 273062 - DNA, 15 bp, Homo sapiens
gtccagtctgagagc

SEQ ID NO: 273063 - DNA, 15 bp, Homo sapiens
ggtccagtctgagag

SEQ ID NO: 273064 - DNA, 15 bp, Homo sapiens
gggtccagtctgaga

SEQ ID NO: 273065 - DNA, 15 bp, Homo sapiens
tgggtccagtctgag

SEQ ID NO: 273066 - DNA, 15 bp, Homo sapiens
atgggtccagtctga

SEQ ID NO: 273067 - DNA, 15 bp, Homo sapiens
gatgggtccagtctg

SEQ ID NO: 273068 - DNA, 15 bp, Homo sapiens
tgatgggtccagtct

SEQ ID NO: 273069 - DNA, 15 bp, Homo sapiens
ctgatgggtccagtc

SEQ ID NO: 273070 - DNA, 15 bp, Homo sapiens
cctgatgggtccagt

SEQ ID NO: 273071 - DNA, 15 bp, Homo sapiens
ccctgatgggtccag

SEQ ID NO: 273072 - DNA, 15 bp, Homo sapiens
gccctgatgggtcca

SEQ ID NO: 273073 - DNA, 15 bp, Homo sapiens
agccctgatgggtcc

SEQ ID NO: 273074 - DNA, 15 bp, Homo sapiens
aagccctgatgggtc

SEQ ID NO: 273075 - DNA, 15 bp, Homo sapiens
gaagccctgatgggt

SEQ ID NO: 273076 - DNA, 15 bp, Homo sapiens
ggaagccctgatggg

SEQ ID NO: 273077 - DNA, 15 bp, Homo sapiens
aggaagccctgatgg

SEQ ID NO: 273078 - DNA, 15 bp, Homo sapiens
aaggaagccctgatg

SEQ ID NO: 273079 - DNA, 15 bp, Homo sapiens
gaaggaagccctgat

SEQ ID NO: 273080 - DNA, 15 bp, Homo sapiens
agaaggaagccctga

SEQ ID NO: 273081 - DNA, 15 bp, Homo sapiens
tagaaggaagccctg

SEQ ID NO: 273082 - DNA, 15 bp, Homo sapiens
ctagaaggaagccct

SEQ ID NO: 273083 - DNA, 15 bp, Homo sapiens
tctagaaggaagccc

SEQ ID NO: 273084 - DNA, 15 bp, Homo sapiens
ttctagaaggaagcc

SEQ ID NO: 273085 - DNA, 15 bp, Homo sapiens
tttctagaaggaagc

SEQ ID NO: 273086 - DNA, 15 bp, Homo sapiens
ctttctagaaggaag

SEQ ID NO: 273087 - DNA, 15 bp, Homo sapiens
tctttctagaaggaa

SEQ ID NO: 273088 - DNA, 15 bp, Homo sapiens
ttctttctagaagga

SEQ ID NO: 273089 - DNA, 15 bp, Homo sapiens
cttctttctagaagg

SEQ ID NO: 273090 - DNA, 15 bp, Homo sapiens
ccttctttctagaag

SEQ ID NO: 273091 - DNA, 15 bp, Homo sapiens
accttctttctagaa

SEQ ID NO: 273092 - DNA, 15 bp, Homo sapiens
gaccttctttctaga

SEQ ID NO: 273093 - DNA, 15 bp, Homo sapiens
agaccttctttctag

SEQ ID NO: 273094 - DNA, 15 bp, Homo sapiens
gagaccttctttcta

SEQ ID NO: 273095 - DNA, 15 bp, Homo sapiens
tgagaccttctttct

SEQ ID NO: 273096 - DNA, 15 bp, Homo sapiens
atgagaccttctttc

SEQ ID NO: 273097 - DNA, 15 bp, Homo sapiens
catgagaccttcttt

SEQ ID NO: 273098 - DNA, 15 bp, Homo sapiens
gcatgagaccttctt

SEQ ID NO: 273099 - DNA, 15 bp, Homo sapiens
agcatgagaccttct

SEQ ID NO: 273100 - DNA, 15 bp, Homo sapiens
cagcatgagaccttc

SEQ ID NO: 273101 - DNA, 15 bp, Homo sapiens
tcagcatgagacctt

SEQ ID NO: 273102 - DNA, 15 bp, Homo sapiens
ctcagcatgagacct

SEQ ID NO: 273103 - DNA, 15 bp, Homo sapiens
gctcagcatgagacc

SEQ ID NO: 273104 - DNA, 15 bp, Homo sapiens
tgctcagcatgagac

SEQ ID NO: 273105 - DNA, 15 bp, Homo sapiens
ttgctcagcatgaga

SEQ ID NO: 273106 - DNA, 15 bp, Homo sapiens
tttgctcagcatgag

SEQ ID NO: 273107 - DNA, 15 bp, Homo sapiens
ttttgctcagcatga

SEQ ID NO: 273108 - DNA, 15 bp, Homo sapiens
gttttgctcagcatg

SEQ ID NO: 273109 - DNA, 15 bp, Homo sapiens
agttttgctcagcat

SEQ ID NO: 273110 - DNA, 15 bp, Homo sapiens
aagttttgctcagca

SEQ ID NO: 273111 - DNA, 15 bp, Homo sapiens
gaagttttgctcagc

SEQ ID NO: 273112 - DNA, 15 bp, Homo sapiens
agaagttttgctcag

SEQ ID NO: 273113 - DNA, 15 bp, Homo sapiens
cagaagttttgctca

SEQ ID NO: 273114 - DNA, 15 bp, Homo sapiens
ccagaagttttgctc

SEQ ID NO: 273115 - DNA, 15 bp, Homo sapiens
cccagaagttttgct

SEQ ID NO: 273116 - DNA, 15 bp, Homo sapiens
tcccagaagttttgc

SEQ ID NO: 273117 - DNA, 15 bp, Homo sapiens
ttcccagaagttttg

SEQ ID NO: 273118 - DNA, 15 bp, Homo sapiens
attcccagaagtttt

SEQ ID NO: 273119 - DNA, 15 bp, Homo sapiens
tattcccagaagttt

SEQ ID NO: 273120 - DNA, 15 bp, Homo sapiens
ctattcccagaagtt

SEQ ID NO: 273121 - DNA, 15 bp, Homo sapiens
tctattcccagaagt

SEQ ID NO: 273122 - DNA, 15 bp, Homo sapiens
ttctattcccagaag

SEQ ID NO: 273123 - DNA, 15 bp, Homo sapiens
attctattcccagaa

SEQ ID NO: 273124 - DNA, 15 bp, Homo sapiens
gattctattcccaga

SEQ ID NO: 273125 - DNA, 15 bp, Homo sapiens
tgattctattcccag

SEQ ID NO: 273126 - DNA, 15 bp, Homo sapiens
ttgattctattccca

SEQ ID NO: 273127 - DNA, 15 bp, Homo sapiens
attgattctattccc

SEQ ID NO: 273128 - DNA, 15 bp, Homo sapiens
tattgattctattcc

SEQ ID NO: 273129 - DNA, 15 bp, Homo sapiens
atattgattctattc

SEQ ID NO: 273130 - DNA, 15 bp, Homo sapiens
catattgattctatt

SEQ ID NO: 273131 - DNA, 15 bp, Homo sapiens
ccatattgattctat

SEQ ID NO: 273132 - DNA, 15 bp, Homo sapiens
tccatattgattcta

SEQ ID NO: 273133 - DNA, 15 bp, Homo sapiens
ctccatattgattct

SEQ ID NO: 273134 - DNA, 15 bp, Homo sapiens
gctccatattgattc

SEQ ID NO: 273135 - DNA, 15 bp, Homo sapiens
tgctccatattgatt

SEQ ID NO: 273136 - DNA, 15 bp, Homo sapiens
atgctccatattgat

SEQ ID NO: 273137 - DNA, 15 bp, Homo sapiens
gatgctccatattga

SEQ ID NO: 273138 - DNA, 15 bp, Homo sapiens
agatgctccatattg

SEQ ID NO: 273139 - DNA, 15 bp, Homo sapiens
gagatgctccatatt

SEQ ID NO: 273140 - DNA, 15 bp, Homo sapiens
tgagatgctccatat

SEQ ID NO: 273141 - DNA, 15 bp, Homo sapiens
ttgagatgctccata

SEQ ID NO: 273142 - DNA, 15 bp, Homo sapiens
cttgagatgctccat

SEQ ID NO: 273143 - DNA, 15 bp, Homo sapiens
ccttgagatgctcca

SEQ ID NO: 273144 - DNA, 15 bp, Homo sapiens
gccttgagatgctcc

SEQ ID NO: 273145 - DNA, 15 bp, Homo sapiens
tgccttgagatgctc

SEQ ID NO: 273146 - DNA, 15 bp, Homo sapiens
ttgccttgagatgct

SEQ ID NO: 273147 - DNA, 15 bp, Homo sapiens
gttgccttgagatgc

SEQ ID NO: 273148 - DNA, 15 bp, Homo sapiens
tgttgccttgagatg

SEQ ID NO: 273149 - DNA, 15 bp, Homo sapiens
ctgttgccttgagat

SEQ ID NO: 273150 - DNA, 15 bp, Homo sapiens
tctgttgccttgaga

SEQ ID NO: 273151 - DNA, 15 bp, Homo sapiens
ttctgttgccttgag

SEQ ID NO: 273152 - DNA, 15 bp, Homo sapiens
tttctgttgccttga

SEQ ID NO: 273153 - DNA, 15 bp, Homo sapiens
atttctgttgccttg

SEQ ID NO: 273154 - DNA, 15 bp, Homo sapiens
catttctgttgcctt

SEQ ID NO: 273155 - DNA, 15 bp, Homo sapiens
tcatttctgttgcct

SEQ ID NO: 273156 - DNA, 15 bp, Homo sapiens
ttcatttctgttgcc

SEQ ID NO: 273157 - DNA, 15 bp, Homo sapiens
tttcatttctgttgc

SEQ ID NO: 273158 - DNA, 15 bp, Homo sapiens
ctttcatttctgttg

SEQ ID NO: 273159 - DNA, 15 bp, Homo sapiens
cctttcatttctgtt

SEQ ID NO: 273160 - DNA, 15 bp, Homo sapiens
tcctttcatttctgt

SEQ ID NO: 273161 - DNA, 15 bp, Homo sapiens
ctcctttcatttctg

SEQ ID NO: 273162 - DNA, 15 bp, Homo sapiens
tctcctttcatttct

SEQ ID NO: 273163 - DNA, 15 bp, Homo sapiens
ttctcctttcatttc

SEQ ID NO: 273164 - DNA, 15 bp, Homo sapiens
cttctcctttcattt

SEQ ID NO: 273165 - DNA, 15 bp, Homo sapiens
ccttctcctttcatt

SEQ ID NO: 273166 - DNA, 15 bp, Homo sapiens
gccttctcctttcat

SEQ ID NO: 273167 - DNA, 15 bp, Homo sapiens
ggccttctcctttca

SEQ ID NO: 273168 - DNA, 15 bp, Homo sapiens
aggccttctcctttc

SEQ ID NO: 273169 - DNA, 15 bp, Homo sapiens
taggccttctccttt

SEQ ID NO: 273170 - DNA, 15 bp, Homo sapiens
ctaggccttctcctt

SEQ ID NO: 273171 - DNA, 15 bp, Homo sapiens
actaggccttctcct

SEQ ID NO: 273172 - DNA, 15 bp, Homo sapiens
gactaggccttctcc

SEQ ID NO: 273173 - DNA, 15 bp, Homo sapiens
ggactaggccttctc

SEQ ID NO: 273174 - DNA, 15 bp, Homo sapiens
tggactaggccttct

SEQ ID NO: 273175 - DNA, 15 bp, Homo sapiens
ttggactaggccttc

SEQ ID NO: 273176 - DNA, 15 bp, Homo sapiens
tttggactaggcctt

SEQ ID NO: 273177 - DNA, 15 bp, Homo sapiens
gtttggactaggcct

SEQ ID NO: 273178 - DNA, 15 bp, Homo sapiens
agtttggactaggcc

SEQ ID NO: 273179 - DNA, 15 bp, Homo sapiens
cagtttggactaggc

SEQ ID NO: 273180 - DNA, 15 bp, Homo sapiens
acagtttggactagg

SEQ ID NO: 273181 - DNA, 15 bp, Homo sapiens
aacagtttggactag

SEQ ID NO: 273182 - DNA, 15 bp, Homo sapiens
gaacagtttggacta

SEQ ID NO: 273183 - DNA, 15 bp, Homo sapiens
ggaacagtttggact

SEQ ID NO: 273184 - DNA, 15 bp, Homo sapiens
aggaacagtttggac

SEQ ID NO: 273185 - DNA, 15 bp, Homo sapiens
taggaacagtttgga

SEQ ID NO: 273186 - DNA, 15 bp, Homo sapiens
gtaggaacagtttgg

SEQ ID NO: 273187 - DNA, 15 bp, Homo sapiens
cgtaggaacagtttg

SEQ ID NO: 273188 - DNA, 15 bp, Homo sapiens
acgtaggaacagttt

SEQ ID NO: 273189 - DNA, 15 bp, Homo sapiens
cacgtaggaacagtt

SEQ ID NO: 273190 - DNA, 15 bp, Homo sapiens
gcacgtaggaacagt

SEQ ID NO: 273191 - DNA, 15 bp, Homo sapiens
agcacgtaggaacag

SEQ ID NO: 273192 - DNA, 15 bp, Homo sapiens
cagcacgtaggaaca

SEQ ID NO: 273193 - DNA, 15 bp, Homo sapiens
ccagcacgtaggaac

SEQ ID NO: 273194 - DNA, 15 bp, Homo sapiens
accagcacgtaggaa

SEQ ID NO: 273195 - DNA, 15 bp, Homo sapiens
taccagcacgtagga

SEQ ID NO: 273196 - DNA, 15 bp, Homo sapiens
ctaccagcacgtagg

SEQ ID NO: 273197 - DNA, 15 bp, Homo sapiens
tctaccagcacgtag

SEQ ID NO: 273198 - DNA, 15 bp, Homo sapiens
ctctaccagcacgta

SEQ ID NO: 273199 - DNA, 15 bp, Homo sapiens
cctctaccagcacgt

SEQ ID NO: 273200 - DNA, 15 bp, Homo sapiens
ccctctaccagcacg

SEQ ID NO: 273201 - DNA, 15 bp, Homo sapiens
accctctaccagcac

SEQ ID NO: 273202 - DNA, 15 bp, Homo sapiens
taccctctaccagca

SEQ ID NO: 273203 - DNA, 15 bp, Homo sapiens
ataccctctaccagc

SEQ ID NO: 273204 - DNA, 15 bp, Homo sapiens
cataccctctaccag

SEQ ID NO: 273205 - DNA, 15 bp, Homo sapiens
ccataccctctacca

SEQ ID NO: 273206 - DNA, 15 bp, Homo sapiens
cccataccctctacc

SEQ ID NO: 273207 - DNA, 15 bp, Homo sapiens
ccccataccctctac

SEQ ID NO: 273208 - DNA, 15 bp, Homo sapiens
cccccataccctcta

SEQ ID NO: 273209 - DNA, 15 bp, Homo sapiens
tcccccataccctct

SEQ ID NO: 273210 - DNA, 15 bp, Homo sapiens
ttcccccataccctc

SEQ ID NO: 273211 - DNA, 15 bp, Homo sapiens
gttcccccataccct

SEQ ID NO: 273212 - DNA, 15 bp, Homo sapiens
tgttcccccataccc

SEQ ID NO: 273213 - DNA, 15 bp, Homo sapiens
ctgttcccccatacc

SEQ ID NO: 273214 - DNA, 15 bp, Homo sapiens
cctgttcccccatac

SEQ ID NO: 273215 - DNA, 15 bp, Homo sapiens
tcctgttcccccata

SEQ ID NO: 273216 - DNA, 15 bp, Homo sapiens
gtcctgttcccccat

SEQ ID NO: 273217 - DNA, 15 bp, Homo sapiens
ggtcctgttccccca

SEQ ID NO: 273218 - DNA, 15 bp, Homo sapiens
tggtcctgttccccc

SEQ ID NO: 273219 - DNA, 15 bp, Homo sapiens
ctggtcctgttcccc

SEQ ID NO: 273220 - DNA, 15 bp, Homo sapiens
cctggtcctgttccc

SEQ ID NO: 273221 - DNA, 15 bp, Homo sapiens
tcctggtcctgttcc

SEQ ID NO: 273222 - DNA, 15 bp, Homo sapiens
ttcctggtcctgttc

SEQ ID NO: 273223 - DNA, 15 bp, Homo sapiens
cttcctggtcctgtt

SEQ ID NO: 273224 - DNA, 15 bp, Homo sapiens
acttcctggtcctgt

SEQ ID NO: 273225 - DNA, 15 bp, Homo sapiens
gacttcctggtcctg

SEQ ID NO: 273226 - DNA, 15 bp, Homo sapiens
agacttcctggtcct

SEQ ID NO: 273227 - DNA, 15 bp, Homo sapiens
gagacttcctggtcc

SEQ ID NO: 273228 - DNA, 15 bp, Homo sapiens
tgagacttcctggtc

SEQ ID NO: 273229 - DNA, 15 bp, Homo sapiens
ttgagacttcctggt

SEQ ID NO: 273230 - DNA, 15 bp, Homo sapiens
tttgagacttcctgg

SEQ ID NO: 273231 - DNA, 15 bp, Homo sapiens
gtttgagacttcctg

SEQ ID NO: 273232 - DNA, 15 bp, Homo sapiens
agtttgagacttcct

SEQ ID NO: 273233 - DNA, 15 bp, Homo sapiens
gagtttgagacttcc

SEQ ID NO: 273234 - DNA, 15 bp, Homo sapiens
tgagtttgagacttc

SEQ ID NO: 273235 - DNA, 15 bp, Homo sapiens
ttgagtttgagactt

SEQ ID NO: 273236 - DNA, 15 bp, Homo sapiens
cttgagtttgagact

SEQ ID NO: 273237 - DNA, 15 bp, Homo sapiens
acttgagtttgagac

SEQ ID NO: 273238 - DNA, 15 bp, Homo sapiens
tacttgagtttgaga

SEQ ID NO: 273239 - DNA, 15 bp, Homo sapiens
gtacttgagtttgag

SEQ ID NO: 273240 - DNA, 15 bp, Homo sapiens
agtacttgagtttga

SEQ ID NO: 273241 - DNA, 15 bp, Homo sapiens
cagtacttgagtttg

SEQ ID NO: 273242 - DNA, 15 bp, Homo sapiens
gcagtacttgagttt

SEQ ID NO: 273243 - DNA, 15 bp, Homo sapiens
agcagtacttgagtt

SEQ ID NO: 273244 - DNA, 15 bp, Homo sapiens
tagcagtacttgagt

SEQ ID NO: 273245 - DNA, 15 bp, Homo sapiens
atagcagtacttgag

SEQ ID NO: 273246 - DNA, 15 bp, Homo sapiens
catagcagtacttga

SEQ ID NO: 273247 - DNA, 15 bp, Homo sapiens
tcatagcagtacttg

SEQ ID NO: 273248 - DNA, 15 bp, Homo sapiens
ttcatagcagtactt

SEQ ID NO: 273249 - DNA, 15 bp, Homo sapiens
attcatagcagtact

SEQ ID NO: 273250 - DNA, 15 bp, Homo sapiens
cattcatagcagtac

SEQ ID NO: 273251 - DNA, 15 bp, Homo sapiens
ccattcatagcagta

SEQ ID NO: 273252 - DNA, 15 bp, Homo sapiens
tccattcatagcagt

SEQ ID NO: 273253 - DNA, 15 bp, Homo sapiens
ttccattcatagcag

SEQ ID NO: 273254 - DNA, 15 bp, Homo sapiens
attccattcatagca

SEQ ID NO: 273255 - DNA, 15 bp, Homo sapiens
cattccattcatagc

SEQ ID NO: 273256 - DNA, 15 bp, Homo sapiens
acattccattcatag

SEQ ID NO: 273257 - DNA, 15 bp, Homo sapiens
aacattccattcata

SEQ ID NO: 273258 - DNA, 15 bp, Homo sapiens
aaacattccattcat

SEQ ID NO: 273259 - DNA, 15 bp, Homo sapiens
taaacattccattca

SEQ ID NO: 273260 - DNA, 15 bp, Homo sapiens
ataaacattccattc

SEQ ID NO: 273261 - DNA, 15 bp, Homo sapiens
cataaacattccatt

SEQ ID NO: 273262 - DNA, 15 bp, Homo sapiens
acataaacattccat

SEQ ID NO: 273263 - DNA, 15 bp, Homo sapiens
gacataaacattcca

SEQ ID NO: 273264 - DNA, 15 bp, Homo sapiens
ggacataaacattcc

SEQ ID NO: 273265 - DNA, 15 bp, Homo sapiens
gggacataaacattc

SEQ ID NO: 273266 - DNA, 15 bp, Homo sapiens
ggggacataaacatt

SEQ ID NO: 273267 - DNA, 15 bp, Homo sapiens
gggggacataaacat

SEQ ID NO: 273268 - DNA, 15 bp, Homo sapiens
tgggggacataaaca

SEQ ID NO: 273269 - DNA, 15 bp, Homo sapiens
ttgggggacataaac

SEQ ID NO: 273270 - DNA, 15 bp, Homo sapiens
tttgggggacataaa

SEQ ID NO: 273271 - DNA, 15 bp, Homo sapiens
ttttgggggacataa

SEQ ID NO: 273272 - DNA, 15 bp, Homo sapiens
tttttgggggacata

SEQ ID NO: 273273 - DNA, 15 bp, Homo sapiens
atttttgggggacat

SEQ ID NO: 273274 - DNA, 15 bp, Homo sapiens
aatttttgggggaca

SEQ ID NO: 273275 - DNA, 15 bp, Homo sapiens
gaatttttgggggac

SEQ ID NO: 273276 - DNA, 15 bp, Homo sapiens
tgaatttttggggga

SEQ ID NO: 273277 - DNA, 15 bp, Homo sapiens
atgaatttttggggg

SEQ ID NO: 273278 - DNA, 15 bp, Homo sapiens
catgaatttttgggg

SEQ ID NO: 273279 - DNA, 15 bp, Homo sapiens
ccatgaatttttggg

SEQ ID NO: 273280 - DNA, 15 bp, Homo sapiens
cccatgaatttttgg

SEQ ID NO: 273281 - DNA, 15 bp, Homo sapiens
acccatgaatttttg

SEQ ID NO: 273282 - DNA, 15 bp, Homo sapiens
aacccatgaattttt

SEQ ID NO: 273283 - DNA, 15 bp, Homo sapiens
caacccatgaatttt

SEQ ID NO: 273284 - DNA, 15 bp, Homo sapiens
tcaacccatgaattt

SEQ ID NO: 273285 - DNA, 15 bp, Homo sapiens
ttcaacccatgaatt

SEQ ID NO: 273286 - DNA, 15 bp, Homo sapiens
tttcaacccatgaat

SEQ ID NO: 273287 - DNA, 15 bp, Homo sapiens
atttcaacccatgaa

SEQ ID NO: 273288 - DNA, 15 bp, Homo sapiens
gatttcaacccatga

SEQ ID NO: 273289 - DNA, 15 bp, Homo sapiens
agatttcaacccatg

SEQ ID NO: 273290 - DNA, 15 bp, Homo sapiens
tagatttcaacccat

SEQ ID NO: 273291 - DNA, 15 bp, Homo sapiens
ttagatttcaaccca

SEQ ID NO: 273292 - DNA, 15 bp, Homo sapiens
attagatttcaaccc

SEQ ID NO: 273293 - DNA, 15 bp, Homo sapiens
gattagatttcaacc

SEQ ID NO: 273294 - DNA, 15 bp, Homo sapiens
ggattagatttcaac

SEQ ID NO: 273295 - DNA, 15 bp, Homo sapiens
gggattagatttcaa

SEQ ID NO: 273296 - DNA, 15 bp, Homo sapiens
agggattagatttca

SEQ ID NO: 273297 - DNA, 15 bp, Homo sapiens
tagggattagatttc

SEQ ID NO: 273298 - DNA, 15 bp, Homo sapiens
ctagggattagattt

SEQ ID NO: 273299 - DNA, 15 bp, Homo sapiens
actagggattagatt

SEQ ID NO: 273300 - DNA, 15 bp, Homo sapiens
cactagggattagat

SEQ ID NO: 273301 - DNA, 15 bp, Homo sapiens
acactagggattaga

SEQ ID NO: 273302 - DNA, 15 bp, Homo sapiens
cacactagggattag

SEQ ID NO: 273303 - DNA, 15 bp, Homo sapiens
tcacactagggatta

SEQ ID NO: 273304 - DNA, 15 bp, Homo sapiens
atcacactagggatt

SEQ ID NO: 273305 - DNA, 15 bp, Homo sapiens
tatcacactagggat

SEQ ID NO: 273306 - DNA, 15 bp, Homo sapiens
ctatcacactaggga

SEQ ID NO: 273307 - DNA, 15 bp, Homo sapiens
actatcacactaggg

SEQ ID NO: 273308 - DNA, 15 bp, Homo sapiens
cactatcacactagg

SEQ ID NO: 273309 - DNA, 15 bp, Homo sapiens
acactatcacactag

SEQ ID NO: 273310 - DNA, 15 bp, Homo sapiens
aacactatcacacta

SEQ ID NO: 273311 - DNA, 15 bp, Homo sapiens
taacactatcacact

SEQ ID NO: 273312 - DNA, 15 bp, Homo sapiens
ctaacactatcacac

SEQ ID NO: 273313 - DNA, 15 bp, Homo sapiens
cctaacactatcaca

SEQ ID NO: 273314 - DNA, 15 bp, Homo sapiens
tcctaacactatcac

SEQ ID NO: 273315 - DNA, 15 bp, Homo sapiens
ctcctaacactatca

SEQ ID NO: 273316 - DNA, 15 bp, Homo sapiens
tctcctaacactatc

SEQ ID NO: 273317 - DNA, 15 bp, Homo sapiens
atctcctaacactat

SEQ ID NO: 273318 - DNA, 15 bp, Homo sapiens
catctcctaacacta

SEQ ID NO: 273319 - DNA, 15 bp, Homo sapiens
ccatctcctaacact

SEQ ID NO: 273320 - DNA, 15 bp, Homo sapiens
cccatctcctaacac

SEQ ID NO: 273321 - DNA, 15 bp, Homo sapiens
ccccatctcctaaca

SEQ ID NO: 273322 - DNA, 15 bp, Homo sapiens
gccccatctcctaac

SEQ ID NO: 273323 - DNA, 15 bp, Homo sapiens
ggccccatctcctaa

SEQ ID NO: 273324 - DNA, 15 bp, Homo sapiens
aggccccatctccta

SEQ ID NO: 273325 - DNA, 15 bp, Homo sapiens
aaggccccatctcct

SEQ ID NO: 273326 - DNA, 15 bp, Homo sapiens
caaggccccatctcc

SEQ ID NO: 273327 - DNA, 15 bp, Homo sapiens
ccaaggccccatctc

SEQ ID NO: 273328 - DNA, 15 bp, Homo sapiens
tccaaggccccatct

SEQ ID NO: 273329 - DNA, 15 bp, Homo sapiens
ttccaaggccccatc

SEQ ID NO: 273330 - DNA, 15 bp, Homo sapiens
cttccaaggccccat

SEQ ID NO: 273331 - DNA, 15 bp, Homo sapiens
acttccaaggcccca

SEQ ID NO: 273332 - DNA, 15 bp, Homo sapiens
cacttccaaggcccc

SEQ ID NO: 273333 - DNA, 15 bp, Homo sapiens
tcacttccaaggccc

SEQ ID NO: 273334 - DNA, 15 bp, Homo sapiens
atcacttccaaggcc

SEQ ID NO: 273335 - DNA, 15 bp, Homo sapiens
aatcacttccaaggc

SEQ ID NO: 273336 - DNA, 15 bp, Homo sapiens
taatcacttccaagg

SEQ ID NO: 273337 - DNA, 15 bp, Homo sapiens
ctaatcacttccaag

SEQ ID NO: 273338 - DNA, 15 bp, Homo sapiens
cctaatcacttccaa

SEQ ID NO: 273339 - DNA, 15 bp, Homo sapiens
acctaatcacttcca

SEQ ID NO: 273340 - DNA, 15 bp, Homo sapiens
gacctaatcacttcc

SEQ ID NO: 273341 - DNA, 15 bp, Homo sapiens
tgacctaatcacttc

SEQ ID NO: 273342 - DNA, 15 bp, Homo sapiens
atgacctaatcactt

SEQ ID NO: 273343 - DNA, 15 bp, Homo sapiens
catgacctaatcact

SEQ ID NO: 273344 - DNA, 15 bp, Homo sapiens
cctcatgacctaatc

SEQ ID NO: 273345 - DNA, 15 bp, Homo sapiens
tcctcatgacctaat

SEQ ID NO: 273346 - DNA, 15 bp, Homo sapiens
atcctcatgacctaa

SEQ ID NO: 273347 - DNA, 15 bp, Homo sapiens
catcctcatgaccta

SEQ ID NO: 273348 - DNA, 15 bp, Homo sapiens
ccatcctcatgacct

SEQ ID NO: 273349 - DNA, 15 bp, Homo sapiens
tccatcctcatgacc

SEQ ID NO: 273350 - DNA, 15 bp, Homo sapiens
ctccatcctcatgac

SEQ ID NO: 273351 - DNA, 15 bp, Homo sapiens
gctccatcctcatga

SEQ ID NO: 273352 - DNA, 15 bp, Homo sapiens
agctccatcctcatg

SEQ ID NO: 273353 - DNA, 15 bp, Homo sapiens
cagctccatcctcat

SEQ ID NO: 273354 - DNA, 15 bp, Homo sapiens
acagctccatcctca

SEQ ID NO: 273355 - DNA, 15 bp, Homo sapiens
gacagctccatcctc

SEQ ID NO: 273356 - DNA, 15 bp, Homo sapiens
tgacagctccatcct

SEQ ID NO: 273357 - DNA, 15 bp, Homo sapiens
atgacagctccatcc

SEQ ID NO: 273358 - DNA, 15 bp, Homo sapiens
tatgacagctccatc

SEQ ID NO: 273359 - DNA, 15 bp, Homo sapiens
ttatgacagctccat

SEQ ID NO: 273360 - DNA, 15 bp, Homo sapiens
tttatgacagctcca

SEQ ID NO: 273361 - DNA, 15 bp, Homo sapiens
atttatgacagctcc

SEQ ID NO: 273362 - DNA, 15 bp, Homo sapiens
catttatgacagctc

SEQ ID NO: 273363 - DNA, 15 bp, Homo sapiens
tcatttatgacagct

SEQ ID NO: 273364 - DNA, 15 bp, Homo sapiens
ttcatttatgacagc

SEQ ID NO: 273365 - DNA, 15 bp, Homo sapiens
tttcatttatgacag

SEQ ID NO: 273366 - DNA, 15 bp, Homo sapiens
atttcatttatgaca

SEQ ID NO: 273367 - DNA, 15 bp, Homo sapiens
aatttcatttatgac

SEQ ID NO: 273368 - DNA, 15 bp, Homo sapiens
taatttcatttatga

SEQ ID NO: 273369 - DNA, 15 bp, Homo sapiens
ctaatttcatttatg

SEQ ID NO: 273370 - DNA, 15 bp, Homo sapiens
actaatttcatttat

SEQ ID NO: 273371 - DNA, 15 bp, Homo sapiens
tactaatttcattta

SEQ ID NO: 273372 - DNA, 15 bp, Homo sapiens
gtactaatttcattt

SEQ ID NO: 273373 - DNA, 15 bp, Homo sapiens
tgtactaatttcatt

SEQ ID NO: 273374 - DNA, 15 bp, Homo sapiens
atgtactaatttcat

SEQ ID NO: 273375 - DNA, 15 bp, Homo sapiens
aatgtactaatttca

SEQ ID NO: 273376 - DNA, 15 bp, Homo sapiens
gaatgtactaatttc

SEQ ID NO: 273377 - DNA, 15 bp, Homo sapiens
tgaatgtactaattt

SEQ ID NO: 273378 - DNA, 15 bp, Homo sapiens
atgaatgtactaatt

SEQ ID NO: 273379 - DNA, 15 bp, Homo sapiens
tatgaatgtactaat

SEQ ID NO: 273380 - DNA, 15 bp, Homo sapiens
ttatgaatgtactaa

SEQ ID NO: 273381 - DNA, 15 bp, Homo sapiens
tttatgaatgtacta

SEQ ID NO: 273382 - DNA, 15 bp, Homo sapiens
ttttatgaatgtact

SEQ ID NO: 273383 - DNA, 15 bp, Homo sapiens
cttttatgaatgtac

SEQ ID NO: 273384 - DNA, 15 bp, Homo sapiens
acttttatgaatgta

SEQ ID NO: 273385 - DNA, 15 bp, Homo sapiens
cacttttatgaatgt

SEQ ID NO: 273386 - DNA, 15 bp, Homo sapiens
tcacttttatgaatg

SEQ ID NO: 273387 - DNA, 15 bp, Homo sapiens
gtcacttttatgaat

SEQ ID NO: 273388 - DNA, 15 bp, Homo sapiens
ggtcacttttatgaa

SEQ ID NO: 273389 - DNA, 15 bp, Homo sapiens
gggtcacttttatga

SEQ ID NO: 273390 - DNA, 15 bp, Homo sapiens
ggggtcacttttatg

SEQ ID NO: 273391 - DNA, 15 bp, Homo sapiens
tggggtcacttttat

SEQ ID NO: 273392 - DNA, 15 bp, Homo sapiens
ctggggtcactttta

SEQ ID NO: 273393 - DNA, 15 bp, Homo sapiens
tctggggtcactttt

SEQ ID NO: 273394 - DNA, 15 bp, Homo sapiens
ctctggggtcacttt

SEQ ID NO: 273395 - DNA, 15 bp, Homo sapiens
tctctggggtcactt

SEQ ID NO: 273396 - DNA, 15 bp, Homo sapiens
ctctctggggtcact

SEQ ID NO: 273397 - DNA, 15 bp, Homo sapiens
gctctctggggtcac

SEQ ID NO: 273398 - DNA, 15 bp, Homo sapiens
agctctctggggtca

SEQ ID NO: 273399 - DNA, 15 bp, Homo sapiens
gagctctctggggtc

SEQ ID NO: 273400 - DNA, 15 bp, Homo sapiens
agagctctctggggt

SEQ ID NO: 273401 - DNA, 15 bp, Homo sapiens
gagagctctctgggg

SEQ ID NO: 273402 - DNA, 15 bp, Homo sapiens
agagagctctctggg

SEQ ID NO: 273403 - DNA, 15 bp, Homo sapiens
gagagagctctctgg

SEQ ID NO: 273404 - DNA, 15 bp, Homo sapiens
agagagagctctctg

SEQ ID NO: 273405 - DNA, 15 bp, Homo sapiens
aagagagagctctct

SEQ ID NO: 273406 - DNA, 15 bp, Homo sapiens
gaagagagagctctc

SEQ ID NO: 273407 - DNA, 15 bp, Homo sapiens
ggaagagagagctct

SEQ ID NO: 273408 - DNA, 15 bp, Homo sapiens
gggaagagagagctc

SEQ ID NO: 273409 - DNA, 15 bp, Homo sapiens
agggaagagagagct

SEQ ID NO: 273410 - DNA, 15 bp, Homo sapiens
aagggaagagagagc

SEQ ID NO: 273411 - DNA, 15 bp, Homo sapiens
gaagggaagagagag

SEQ ID NO: 273412 - DNA, 15 bp, Homo sapiens
ggaagggaagagaga

SEQ ID NO: 273413 - DNA, 15 bp, Homo sapiens
tggaagggaagagag

SEQ ID NO: 273414 - DNA, 15 bp, Homo sapiens
gtggaagggaagaga

SEQ ID NO: 273415 - DNA, 15 bp, Homo sapiens
ggtggaagggaagag

SEQ ID NO: 273416 - DNA, 15 bp, Homo sapiens
tggtggaagggaaga

SEQ ID NO: 273417 - DNA, 15 bp, Homo sapiens
atggtggaagggaag

SEQ ID NO: 273418 - DNA, 15 bp, Homo sapiens
catggtggaagggaa

SEQ ID NO: 273419 - DNA, 15 bp, Homo sapiens
ccatggtggaaggga

SEQ ID NO: 273420 - DNA, 15 bp, Homo sapiens
cccatggtggaaggg

SEQ ID NO: 273421 - DNA, 15 bp, Homo sapiens
tcccatggtggaagg

SEQ ID NO: 273422 - DNA, 15 bp, Homo sapiens
ctcccatggtggaag

SEQ ID NO: 273423 - DNA, 15 bp, Homo sapiens
cctcccatggtggaa

SEQ ID NO: 273424 - DNA, 15 bp, Homo sapiens
tcctcccatggtgga

SEQ ID NO: 273425 - DNA, 15 bp, Homo sapiens
gtcctcccatggtgg

SEQ ID NO: 273426 - DNA, 15 bp, Homo sapiens
cgtcctcccatggtg

SEQ ID NO: 273427 - DNA, 15 bp, Homo sapiens
gcgtcctcccatggt

SEQ ID NO: 273428 - DNA, 15 bp, Homo sapiens
tgcgtcctcccatgg

SEQ ID NO: 273429 - DNA, 15 bp, Homo sapiens
ctgcgtcctcccatg

SEQ ID NO: 273430 - DNA, 15 bp, Homo sapiens
actgcgtcctcccat

SEQ ID NO: 273431 - DNA, 15 bp, Homo sapiens
cactgcgtcctccca

SEQ ID NO: 273432 - DNA, 15 bp, Homo sapiens
tcactgcgtcctccc

SEQ ID NO: 273433 - DNA, 15 bp, Homo sapiens
ctcactgcgtcctcc

SEQ ID NO: 273434 - DNA, 15 bp, Homo sapiens
tctcactgcgtcctc

SEQ ID NO: 273435 - DNA, 15 bp, Homo sapiens
ttctcactgcgtcct

SEQ ID NO: 273436 - DNA, 15 bp, Homo sapiens
cttctcactgcgtcc

SEQ ID NO: 273437 - DNA, 15 bp, Homo sapiens
tcttctcactgcgtc

SEQ ID NO: 273438 - DNA, 15 bp, Homo sapiens
gtcttctcactgcgt

SEQ ID NO: 273439 - DNA, 15 bp, Homo sapiens
cgtcttctcactgcg

SEQ ID NO: 273440 - DNA, 15 bp, Homo sapiens
ccgtcttctcactgc

SEQ ID NO: 273441 - DNA, 15 bp, Homo sapiens
gccgtcttctcactg

SEQ ID NO: 273442 - DNA, 15 bp, Homo sapiens
agccgtcttctcact

SEQ ID NO: 273443 - DNA, 15 bp, Homo sapiens
cagccgtcttctcac

SEQ ID NO: 273444 - DNA, 15 bp, Homo sapiens
acagccgtcttctca

SEQ ID NO: 273445 - DNA, 15 bp, Homo sapiens
cacagccgtcttctc

SEQ ID NO: 273446 - DNA, 15 bp, Homo sapiens
acacagccgtcttct

SEQ ID NO: 273447 - DNA, 15 bp, Homo sapiens
tacacagccgtcttc

SEQ ID NO: 273448 - DNA, 15 bp, Homo sapiens
atacacagccgtctt

SEQ ID NO: 273449 - DNA, 15 bp, Homo sapiens
catacacagccgtct

SEQ ID NO: 273450 - DNA, 15 bp, Homo sapiens
tcatacacagccgtc

SEQ ID NO: 273451 - DNA, 15 bp, Homo sapiens
gtcatacacagccgt

SEQ ID NO: 273452 - DNA, 15 bp, Homo sapiens
ggtcatacacagccg

SEQ ID NO: 273453 - DNA, 15 bp, Homo sapiens
gggtcatacacagcc

SEQ ID NO: 273454 - DNA, 15 bp, Homo sapiens
tgggtcatacacagc

SEQ ID NO: 273455 - DNA, 15 bp, Homo sapiens
ctgggtcatacacag

SEQ ID NO: 273456 - DNA, 15 bp, Homo sapiens
cctgggtcatacaca

SEQ ID NO: 273457 - DNA, 15 bp, Homo sapiens
tcctgggtcatacac

SEQ ID NO: 273458 - DNA, 15 bp, Homo sapiens
ttcctgggtcataca

SEQ ID NO: 273459 - DNA, 15 bp, Homo sapiens
cttcctgggtcatac

SEQ ID NO: 273460 - DNA, 15 bp, Homo sapiens
gcttcctgggtcata

SEQ ID NO: 273461 - DNA, 15 bp, Homo sapiens
tgcttcctgggtcat

SEQ ID NO: 273462 - DNA, 15 bp, Homo sapiens
ctgcttcctgggtca

SEQ ID NO: 273463 - DNA, 15 bp, Homo sapiens
tctgcttcctgggtc

SEQ ID NO: 273464 - DNA, 15 bp, Homo sapiens
gtctgcttcctgggt

SEQ ID NO: 273465 - DNA, 15 bp, Homo sapiens
agtctgcttcctggg

SEQ ID NO: 273466 - DNA, 15 bp, Homo sapiens
gagtctgcttcctgg

SEQ ID NO: 273467 - DNA, 15 bp, Homo sapiens
tgagtctgcttcctg

SEQ ID NO: 273468 - DNA, 15 bp, Homo sapiens
gtgagtctgcttcct

SEQ ID NO: 273469 - DNA, 15 bp, Homo sapiens
agtgagtctgcttcc

SEQ ID NO: 273470 - DNA, 15 bp, Homo sapiens
cagtgagtctgcttc

SEQ ID NO: 273471 - DNA, 15 bp, Homo sapiens
ccagtgagtctgctt

SEQ ID NO: 273472 - DNA, 15 bp, Homo sapiens
tccagtgagtctgct

SEQ ID NO: 273473 - DNA, 15 bp, Homo sapiens
gtccagtgagtctgc

SEQ ID NO: 273474 - DNA, 15 bp, Homo sapiens
ggtccagtgagtctg

SEQ ID NO: 273475 - DNA, 15 bp, Homo sapiens
tggtccagtgagtct

SEQ ID NO: 273476 - DNA, 15 bp, Homo sapiens
gtggtccagtgagtc

SEQ ID NO: 273477 - DNA, 15 bp, Homo sapiens
tgtggtccagtgagt

SEQ ID NO: 273478 - DNA, 15 bp, Homo sapiens
ctgtggtccagtgag

SEQ ID NO: 273479 - DNA, 15 bp, Homo sapiens
tctgtggtccagtga

SEQ ID NO: 273480 - DNA, 15 bp, Homo sapiens
atctgtggtccagtg

SEQ ID NO: 273481 - DNA, 15 bp, Homo sapiens
gatctgtggtccagt

SEQ ID NO: 273482 - DNA, 15 bp, Homo sapiens
agatctgtggtccag

SEQ ID NO: 273483 - DNA, 15 bp, Homo sapiens
tagatctgtggtcca

SEQ ID NO: 273484 - DNA, 15 bp, Homo sapiens
gtagatctgtggtcc

SEQ ID NO: 273485 - DNA, 15 bp, Homo sapiens
ggtagatctgtggtc

SEQ ID NO: 273486 - DNA, 15 bp, Homo sapiens
tggtagatctgtggt

SEQ ID NO: 273487 - DNA, 15 bp, Homo sapiens
ttggtagatctgtgg

SEQ ID NO: 273488 - DNA, 15 bp, Homo sapiens
attggtagatctgtg

SEQ ID NO: 273489 - DNA, 15 bp, Homo sapiens
gattggtagatctgt

SEQ ID NO: 273490 - DNA, 15 bp, Homo sapiens
ggattggtagatctg

SEQ ID NO: 273491 - DNA, 15 bp, Homo sapiens
aggattggtagatct

SEQ ID NO: 273492 - DNA, 15 bp, Homo sapiens
aaggattggtagatc

SEQ ID NO: 273493 - DNA, 15 bp, Homo sapiens
aaaggattggtagat

SEQ ID NO: 273494 - DNA, 15 bp, Homo sapiens
caaaggattggtaga

SEQ ID NO: 273495 - DNA, 15 bp, Homo sapiens
tcaaaggattggtag

SEQ ID NO: 273496 - DNA, 15 bp, Homo sapiens
atcaaaggattggta

SEQ ID NO: 273497 - DNA, 15 bp, Homo sapiens
gatcaaaggattggt

SEQ ID NO: 273498 - DNA, 15 bp, Homo sapiens
agatcaaaggattgg

SEQ ID NO: 273499 - DNA, 15 bp, Homo sapiens
aagatcaaaggattg

SEQ ID NO: 273500 - DNA, 15 bp, Homo sapiens
caagatcaaaggatt

SEQ ID NO: 273501 - DNA, 15 bp, Homo sapiens
ccaagatcaaaggat

SEQ ID NO: 273502 - DNA, 15 bp, Homo sapiens
tccaagatcaaagga

SEQ ID NO: 273503 - DNA, 15 bp, Homo sapiens
gtccaagatcaaagg

SEQ ID NO: 273504 - DNA, 15 bp, Homo sapiens
agtccaagatcaaag

SEQ ID NO: 273505 - DNA, 15 bp, Homo sapiens
aagtccaagatcaaa

SEQ ID NO: 273506 - DNA, 15 bp, Homo sapiens
caagtccaagatcaa

SEQ ID NO: 273507 - DNA, 15 bp, Homo sapiens
gcaagtccaagatca

SEQ ID NO: 273508 - DNA, 15 bp, Homo sapiens
ggcaagtccaagatc

SEQ ID NO: 273509 - DNA, 15 bp, Homo sapiens
tggcaagtccaagat

SEQ ID NO: 273510 - DNA, 15 bp, Homo sapiens
ctggcaagtccaaga

SEQ ID NO: 273511 - DNA, 15 bp, Homo sapiens
actggcaagtccaag

SEQ ID NO: 273512 - DNA, 15 bp, Homo sapiens
gactggcaagtccaa

SEQ ID NO: 273513 - DNA, 15 bp, Homo sapiens
agactggcaagtcca

SEQ ID NO: 273514 - DNA, 15 bp, Homo sapiens
gagactggcaagtcc

SEQ ID NO: 273515 - DNA, 15 bp, Homo sapiens
ggagactggcaagtc

SEQ ID NO: 273516 - DNA, 15 bp, Homo sapiens
tggagactggcaagt

SEQ ID NO: 273517 - DNA, 15 bp, Homo sapiens
ctggagactggcaag

SEQ ID NO: 273518 - DNA, 15 bp, Homo sapiens
tctggagactggcaa

SEQ ID NO: 273519 - DNA, 15 bp, Homo sapiens
ttctggagactggca

SEQ ID NO: 273520 - DNA, 15 bp, Homo sapiens
gttctggagactggc

SEQ ID NO: 273521 - DNA, 15 bp, Homo sapiens
agttctggagactgg

SEQ ID NO: 273522 - DNA, 15 bp, Homo sapiens
cagttctggagactg

SEQ ID NO: 273523 - DNA, 15 bp, Homo sapiens
acagttctggagact

SEQ ID NO: 273524 - DNA, 15 bp, Homo sapiens
cacagttctggagac

SEQ ID NO: 273525 - DNA, 15 bp, Homo sapiens
tcacagttctggaga

SEQ ID NO: 273526 - DNA, 15 bp, Homo sapiens
ctcacagttctggag

SEQ ID NO: 273527 - DNA, 15 bp, Homo sapiens
tctcacagttctgga

SEQ ID NO: 273528 - DNA, 15 bp, Homo sapiens
ctctcacagttctgg

SEQ ID NO: 273529 - DNA, 15 bp, Homo sapiens
tctctcacagttctg

SEQ ID NO: 273530 - DNA, 15 bp, Homo sapiens
atctctcacagttct

SEQ ID NO: 273531 - DNA, 15 bp, Homo sapiens
tatctctcacagttc

SEQ ID NO: 273532 - DNA, 15 bp, Homo sapiens
ttatctctcacagtt

SEQ ID NO: 273533 - DNA, 15 bp, Homo sapiens
tttatctctcacagt

SEQ ID NO: 273534 - DNA, 15 bp, Homo sapiens
atttatctctcacag

SEQ ID NO: 273535 - DNA, 15 bp, Homo sapiens
gatttatctctcaca

SEQ ID NO: 273536 - DNA, 15 bp, Homo sapiens
agatttatctctcac

SEQ ID NO: 273537 - DNA, 15 bp, Homo sapiens
gagatttatctctca

SEQ ID NO: 273538 - DNA, 15 bp, Homo sapiens
agagatttatctctc

SEQ ID NO: 273539 - DNA, 15 bp, Homo sapiens
cagagatttatctct

SEQ ID NO: 273540 - DNA, 15 bp, Homo sapiens
gcagagatttatctc

SEQ ID NO: 273541 - DNA, 15 bp, Homo sapiens
agcagagatttatct

SEQ ID NO: 273542 - DNA, 15 bp, Homo sapiens
cagcagagatttatc

SEQ ID NO: 273543 - DNA, 15 bp, Homo sapiens
acagcagagatttat

SEQ ID NO: 273544 - DNA, 15 bp, Homo sapiens
aacagcagagattta

SEQ ID NO: 273545 - DNA, 15 bp, Homo sapiens
aaacagcagagattt

SEQ ID NO: 273546 - DNA, 15 bp, Homo sapiens
aaaacagcagagatt

SEQ ID NO: 273547 - DNA, 15 bp, Homo sapiens
taaaacagcagagat

SEQ ID NO: 273548 - DNA, 15 bp, Homo sapiens
ataaaacagcagaga

SEQ ID NO: 273549 - DNA, 15 bp, Homo sapiens
aataaaacagcagag

SEQ ID NO: 273550 - DNA, 15 bp, Homo sapiens
aaataaaacagcaga

SEQ ID NO: 273551 - DNA, 15 bp, Homo sapiens
taaataaaacagcag

SEQ ID NO: 273552 - DNA, 15 bp, Homo sapiens
ttaaataaaacagca

SEQ ID NO: 273553 - DNA, 15 bp, Homo sapiens
cttaaataaaacagc

SEQ ID NO: 273554 - DNA, 15 bp, Homo sapiens
gcttaaataaaacag

SEQ ID NO: 273555 - DNA, 15 bp, Homo sapiens
ggcttaaataaaaca

SEQ ID NO: 273556 - DNA, 15 bp, Homo sapiens
tggcttaaataaaac

SEQ ID NO: 273557 - DNA, 15 bp, Homo sapiens
gtggcttaaataaaa

SEQ ID NO: 273558 - DNA, 15 bp, Homo sapiens
agtggcttaaataaa

SEQ ID NO: 273559 - DNA, 15 bp, Homo sapiens
gagtggcttaaataa

SEQ ID NO: 273560 - DNA, 15 bp, Homo sapiens
tgagtggcttaaata

SEQ ID NO: 273561 - DNA, 15 bp, Homo sapiens
ctgagtggcttaaat

SEQ ID NO: 273562 - DNA, 15 bp, Homo sapiens
actgagtggcttaaa

SEQ ID NO: 273563 - DNA, 15 bp, Homo sapiens
gactgagtggcttaa

SEQ ID NO: 273564 - DNA, 15 bp, Homo sapiens
agactgagtggctta

SEQ ID NO: 273565 - DNA, 15 bp, Homo sapiens
tagactgagtggctt

SEQ ID NO: 273566 - DNA, 15 bp, Homo sapiens
atagactgagtggct

SEQ ID NO: 273567 - DNA, 15 bp, Homo sapiens
tatagactgagtggc

SEQ ID NO: 273568 - DNA, 15 bp, Homo sapiens
ctatagactgagtgg

SEQ ID NO: 273569 - DNA, 15 bp, Homo sapiens
actatagactgagtg

SEQ ID NO: 273570 - DNA, 15 bp, Homo sapiens
tactatagactgagt

SEQ ID NO: 273571 - DNA, 15 bp, Homo sapiens
atactatagactgag

SEQ ID NO: 273572 - DNA, 15 bp, Homo sapiens
aatactatagactga

SEQ ID NO: 273573 - DNA, 15 bp, Homo sapiens
gaatactatagactg

SEQ ID NO: 273574 - DNA, 15 bp, Homo sapiens
agaatactatagact

SEQ ID NO: 273575 - DNA, 15 bp, Homo sapiens
cagaatactatagac

SEQ ID NO: 273576 - DNA, 15 bp, Homo sapiens
acagaatactataga

SEQ ID NO: 273577 - DNA, 15 bp, Homo sapiens
aacagaatactatag

SEQ ID NO: 273578 - DNA, 15 bp, Homo sapiens
taacagaatactata

SEQ ID NO: 273579 - DNA, 15 bp, Homo sapiens
ataacagaatactat

SEQ ID NO: 273580 - DNA, 15 bp, Homo sapiens
tataacagaatacta

SEQ ID NO: 273581 - DNA, 15 bp, Homo sapiens
ctataacagaatact

SEQ ID NO: 273582 - DNA, 15 bp, Homo sapiens
gctataacagaatac

SEQ ID NO: 273583 - DNA, 15 bp, Homo sapiens
tgctataacagaata

SEQ ID NO: 273584 - DNA, 15 bp, Homo sapiens
ctgctataacagaat

SEQ ID NO: 273585 - DNA, 15 bp, Homo sapiens
tctgctataacagaa

SEQ ID NO: 273586 - DNA, 15 bp, Homo sapiens
gtctgctataacaga

SEQ ID NO: 273587 - DNA, 15 bp, Homo sapiens
agtctgctataacag

SEQ ID NO: 273588 - DNA, 15 bp, Homo sapiens
cagtctgctataaca

SEQ ID NO: 273589 - DNA, 15 bp, Homo sapiens
tcagtctgctataac

SEQ ID NO: 273590 - DNA, 15 bp, Homo sapiens
ttcagtctgctataa

SEQ ID NO: 273591 - DNA, 15 bp, Homo sapiens
attcagtctgctata

SEQ ID NO: 273592 - DNA, 15 bp, Homo sapiens
tattcagtctgctat

SEQ ID NO: 273593 - DNA, 15 bp, Homo sapiens
ctattcagtctgcta

SEQ ID NO: 273594 - DNA, 15 bp, Homo sapiens
tctattcagtctgct

SEQ ID NO: 273595 - DNA, 15 bp, Homo sapiens
atctattcagtctgc

SEQ ID NO: 273596 - DNA, 15 bp, Homo sapiens
aatctattcagtctg

SEQ ID NO: 273597 - DNA, 15 bp, Homo sapiens
caatctattcagtct

SEQ ID NO: 273598 - DNA, 15 bp, Homo sapiens
tcaatctattcagtc

SEQ ID NO: 273599 - DNA, 15 bp, Homo sapiens
ctcaatctattcagt

SEQ ID NO: 273600 - DNA, 15 bp, Homo sapiens
tctcaatctattcag

SEQ ID NO: 273601 - DNA, 15 bp, Homo sapiens
gtctcaatctattca

SEQ ID NO: 273602 - DNA, 15 bp, Homo sapiens
tgtctcaatctattc

SEQ ID NO: 273603 - DNA, 15 bp, Homo sapiens
gtgtctcaatctatt

SEQ ID NO: 273604 - DNA, 15 bp, Homo sapiens
tgtgtctcaatctat

SEQ ID NO: 273605 - DNA, 15 bp, Homo sapiens
atgtgtctcaatcta

SEQ ID NO: 273606 - DNA, 15 bp, Homo sapiens
catgtgtctcaatct

SEQ ID NO: 273607 - DNA, 15 bp, Homo sapiens
gcatgtgtctcaatc

SEQ ID NO: 273608 - DNA, 15 bp, Homo sapiens
agcatgtgtctcaat

SEQ ID NO: 273609 - DNA, 15 bp, Homo sapiens
cagcatgtgtctcaa

SEQ ID NO: 273610 - DNA, 15 bp, Homo sapiens
acagcatgtgtctca

SEQ ID NO: 273611 - DNA, 15 bp, Homo sapiens
tacagcatgtgtctc

SEQ ID NO: 273612 - DNA, 15 bp, Homo sapiens
ttacagcatgtgtct

SEQ ID NO: 273613 - DNA, 15 bp, Homo sapiens
attacagcatgtgtc

SEQ ID NO: 273614 - DNA, 15 bp, Homo sapiens
aattacagcatgtgt

SEQ ID NO: 273615 - DNA, 15 bp, Homo sapiens
caattacagcatgtg

SEQ ID NO: 273616 - DNA, 15 bp, Homo sapiens
acaattacagcatgt

SEQ ID NO: 273617 - DNA, 15 bp, Homo sapiens
tacaattacagcatg

SEQ ID NO: 273618 - DNA, 15 bp, Homo sapiens
ttacaattacagcat

SEQ ID NO: 273619 - DNA, 15 bp, Homo sapiens
tttacaattacagca

SEQ ID NO: 273620 - DNA, 15 bp, Homo sapiens
atttacaattacagc

SEQ ID NO: 273621 - DNA, 15 bp, Homo sapiens
tatttacaattacag

SEQ ID NO: 273622 - DNA, 15 bp, Homo sapiens
gtatttacaattaca

SEQ ID NO: 273623 - DNA, 15 bp, Homo sapiens
ggtatttacaattac

SEQ ID NO: 273624 - DNA, 15 bp, Homo sapiens
tggtatttacaatta

SEQ ID NO: 273625 - DNA, 15 bp, Homo sapiens
gtggtatttacaatt

SEQ ID NO: 273626 - DNA, 15 bp, Homo sapiens
tgtggtatttacaat

SEQ ID NO: 273627 - DNA, 15 bp, Homo sapiens
gtgtggtatttacaa

SEQ ID NO: 273628 - DNA, 15 bp, Homo sapiens
tgtgtggtatttaca

SEQ ID NO: 273629 - DNA, 15 bp, Homo sapiens
ttgtgtggtatttac

SEQ ID NO: 273630 - DNA, 15 bp, Homo sapiens
tttgtgtggtattta

SEQ ID NO: 273631 - DNA, 15 bp, Homo sapiens
ttttgtgtggtattt

SEQ ID NO: 273632 - DNA, 15 bp, Homo sapiens
cttttgtgtggtatt

SEQ ID NO: 273633 - DNA, 15 bp, Homo sapiens
gcttttgtgtggtat

SEQ ID NO: 273634 - DNA, 15 bp, Homo sapiens
tgcttttgtgtggta

SEQ ID NO: 273635 - DNA, 15 bp, Homo sapiens
ttgcttttgtgtggt

SEQ ID NO: 273636 - DNA, 15 bp, Homo sapiens
tttgcttttgtgtgg

SEQ ID NO: 273637 - DNA, 15 bp, Homo sapiens
ttttgcttttgtgtg

SEQ ID NO: 273638 - DNA, 15 bp, Homo sapiens
cttttgcttttgtgt

SEQ ID NO: 273639 - DNA, 15 bp, Homo sapiens
tcttttgcttttgtg

SEQ ID NO: 273640 - DNA, 15 bp, Homo sapiens
ttcttttgcttttgt

SEQ ID NO: 273641 - DNA, 15 bp, Homo sapiens
cttcttttgcttttg

SEQ ID NO: 273642 - DNA, 15 bp, Homo sapiens
tcttcttttgctttt

SEQ ID NO: 273643 - DNA, 15 bp, Homo sapiens
ctcttcttttgcttt

SEQ ID NO: 273644 - DNA, 15 bp, Homo sapiens
cctcttcttttgctt

SEQ ID NO: 273645 - DNA, 15 bp, Homo sapiens
tcctcttcttttgct

SEQ ID NO: 273646 - DNA, 15 bp, Homo sapiens
ttcctcttcttttgc

SEQ ID NO: 273647 - DNA, 15 bp, Homo sapiens
attcctcttcttttg

SEQ ID NO: 273648 - DNA, 15 bp, Homo sapiens
gattcctcttctttt

SEQ ID NO: 273649 - DNA, 15 bp, Homo sapiens
agattcctcttcttt

SEQ ID NO: 273650 - DNA, 15 bp, Homo sapiens
gagattcctcttctt

SEQ ID NO: 273651 - DNA, 15 bp, Homo sapiens
agagattcctcttct

SEQ ID NO: 273652 - DNA, 15 bp, Homo sapiens
cagagattcctcttc

SEQ ID NO: 273653 - DNA, 15 bp, Homo sapiens
acagagattcctctt

SEQ ID NO: 273654 - DNA, 15 bp, Homo sapiens
cacagagattcctct

SEQ ID NO: 273655 - DNA, 15 bp, Homo sapiens
tcacagagattcctc

SEQ ID NO: 273656 - DNA, 15 bp, Homo sapiens
ttcacagagattcct

SEQ ID NO: 273657 - DNA, 15 bp, Homo sapiens
cttcacagagattcc

SEQ ID NO: 273658 - DNA, 15 bp, Homo sapiens
acttcacagagattc

SEQ ID NO: 273659 - DNA, 15 bp, Homo sapiens
aacttcacagagatt

SEQ ID NO: 273660 - DNA, 15 bp, Homo sapiens
taacttcacagagat

SEQ ID NO: 273661 - DNA, 15 bp, Homo sapiens
ctaacttcacagaga

SEQ ID NO: 273662 - DNA, 15 bp, Homo sapiens
tctaacttcacagag

SEQ ID NO: 273663 - DNA, 15 bp, Homo sapiens
ttctaacttcacaga

SEQ ID NO: 273664 - DNA, 15 bp, Homo sapiens
tttctaacttcacag

SEQ ID NO: 273665 - DNA, 15 bp, Homo sapiens
ttttctaacttcaca

SEQ ID NO: 273666 - DNA, 15 bp, Homo sapiens
cttttctaacttcac

SEQ ID NO: 273667 - DNA, 15 bp, Homo sapiens
gcttttctaacttca

SEQ ID NO: 273668 - DNA, 15 bp, Homo sapiens
agcttttctaacttc

SEQ ID NO: 273669 - DNA, 15 bp, Homo sapiens
gagcttttctaactt

SEQ ID NO: 273670 - DNA, 15 bp, Homo sapiens
agagcttttctaact

SEQ ID NO: 273671 - DNA, 15 bp, Homo sapiens
gagagcttttctaac

SEQ ID NO: 273672 - DNA, 15 bp, Homo sapiens
ggagagcttttctaa

SEQ ID NO: 273673 - DNA, 15 bp, Homo sapiens
aggagagcttttcta

SEQ ID NO: 273674 - DNA, 15 bp, Homo sapiens
gaggagagcttttct

SEQ ID NO: 273675 - DNA, 15 bp, Homo sapiens
tgaggagagcttttc

SEQ ID NO: 273676 - DNA, 15 bp, Homo sapiens
ttgaggagagctttt

SEQ ID NO: 273677 - DNA, 15 bp, Homo sapiens
gttgaggagagcttt

SEQ ID NO: 273678 - DNA, 15 bp, Homo sapiens
ggttgaggagagctt

SEQ ID NO: 273679 - DNA, 15 bp, Homo sapiens
aggttgaggagagct

SEQ ID NO: 273680 - DNA, 15 bp, Homo sapiens
gaggttgaggagagc

SEQ ID NO: 273681 - DNA, 15 bp, Homo sapiens
tgaggttgaggagag

SEQ ID NO: 273682 - DNA, 15 bp, Homo sapiens
atgaggttgaggaga

SEQ ID NO: 273683 - DNA, 15 bp, Homo sapiens
aatgaggttgaggag

SEQ ID NO: 273684 - DNA, 15 bp, Homo sapiens
aaatgaggttgagga

SEQ ID NO: 273685 - DNA, 15 bp, Homo sapiens
aaaatgaggttgagg

SEQ ID NO: 273686 - DNA, 15 bp, Homo sapiens
caaaatgaggttgag

SEQ ID NO: 273687 - DNA, 15 bp, Homo sapiens
acaaaatgaggttga

SEQ ID NO: 273688 - DNA, 15 bp, Homo sapiens
aacaaaatgaggttg

SEQ ID NO: 273689 - DNA, 15 bp, Homo sapiens
taacaaaatgaggtt

SEQ ID NO: 273690 - DNA, 15 bp, Homo sapiens
ataacaaaatgaggt

SEQ ID NO: 273691 - DNA, 15 bp, Homo sapiens
tataacaaaatgagg

SEQ ID NO: 273692 - DNA, 15 bp, Homo sapiens
ttataacaaaatgag

SEQ ID NO: 273693 - DNA, 15 bp, Homo sapiens
tttataacaaaatga

SEQ ID NO: 273694 - DNA, 15 bp, Homo sapiens
ttttataacaaaatg

SEQ ID NO: 273695 - DNA, 15 bp, Homo sapiens
cttttataacaaaat

SEQ ID NO: 273696 - DNA, 15 bp, Homo sapiens
acttttataacaaaa

SEQ ID NO: 273697 - DNA, 15 bp, Homo sapiens
aacttttataacaaa

SEQ ID NO: 273698 - DNA, 15 bp, Homo sapiens
aaacttttataacaa

SEQ ID NO: 273699 - DNA, 15 bp, Homo sapiens
taaacttttataaca

SEQ ID NO: 273700 - DNA, 15 bp, Homo sapiens
ctaaacttttataac

SEQ ID NO: 273701 - DNA, 15 bp, Homo sapiens
cctaaacttttataa

SEQ ID NO: 273702 - DNA, 15 bp, Homo sapiens
tcctaaacttttata

SEQ ID NO: 273703 - DNA, 15 bp, Homo sapiens
ttcctaaacttttat

SEQ ID NO: 273704 - DNA, 15 bp, Homo sapiens
tttcctaaactttta

SEQ ID NO: 273705 - DNA, 15 bp, Homo sapiens
ttttcctaaactttt

SEQ ID NO: 273706 - DNA, 15 bp, Homo sapiens
attttcctaaacttt

SEQ ID NO: 273707 - DNA, 15 bp, Homo sapiens
aattttcctaaactt

SEQ ID NO: 273708 - DNA, 15 bp, Homo sapiens
taattttcctaaact

SEQ ID NO: 273709 - DNA, 15 bp, Homo sapiens
ttaattttcctaaac

SEQ ID NO: 273710 - DNA, 15 bp, Homo sapiens
attaattttcctaaa

SEQ ID NO: 273711 - DNA, 15 bp, Homo sapiens
aattaattttcctaa

SEQ ID NO: 273712 - DNA, 15 bp, Homo sapiens
taattaattttccta

SEQ ID NO: 273713 - DNA, 15 bp, Homo sapiens
ataattaattttcct

SEQ ID NO: 273714 - DNA, 15 bp, Homo sapiens
tataattaattttcc

SEQ ID NO: 273715 - DNA, 15 bp, Homo sapiens
gtataattaattttc

SEQ ID NO: 273716 - DNA, 15 bp, Homo sapiens
tgtataattaatttt

SEQ ID NO: 273717 - DNA, 15 bp, Homo sapiens
ttgtataattaattt

SEQ ID NO: 273718 - DNA, 15 bp, Homo sapiens
gttgtataattaatt

SEQ ID NO: 273719 - DNA, 15 bp, Homo sapiens
ggttgtataattaat

SEQ ID NO: 273720 - DNA, 15 bp, Homo sapiens
tggttgtataattaa

SEQ ID NO: 273721 - DNA, 15 bp, Homo sapiens
ttggttgtataatta

SEQ ID NO: 273722 - DNA, 15 bp, Homo sapiens
tttggttgtataatt

SEQ ID NO: 273723 - DNA, 15 bp, Homo sapiens
ttttggttgtataat

SEQ ID NO: 273724 - DNA, 15 bp, Homo sapiens
tttttggttgtataa

SEQ ID NO: 273725 - DNA, 15 bp, Homo sapiens
ttttttggttgtata

SEQ ID NO: 273726 - DNA, 15 bp, Homo sapiens
tttttttggttgtat

SEQ ID NO: 273727 - DNA, 15 bp, Homo sapiens
atttttttggttgta

SEQ ID NO: 273728 - DNA, 15 bp, Homo sapiens
catttttttggttgt

SEQ ID NO: 273729 - DNA, 15 bp, Homo sapiens
tcatttttttggttg

SEQ ID NO: 273730 - DNA, 15 bp, Homo sapiens
ctcatttttttggtt

SEQ ID NO: 273731 - DNA, 15 bp, Homo sapiens
gctcatttttttggt

SEQ ID NO: 273732 - DNA, 15 bp, Homo sapiens
tgctcatttttttgg

SEQ ID NO: 273733 - DNA, 15 bp, Homo sapiens
ttgctcatttttttg

SEQ ID NO: 273734 - DNA, 15 bp, Homo sapiens
gttgctcattttttt

SEQ ID NO: 273735 - DNA, 15 bp, Homo sapiens
tgttgctcatttttt

SEQ ID NO: 273736 - DNA, 15 bp, Homo sapiens
ttgttgctcattttt

SEQ ID NO: 273737 - DNA, 15 bp, Homo sapiens
tttgttgctcatttt

SEQ ID NO: 273738 - DNA, 15 bp, Homo sapiens
ttttgttgctcattt

SEQ ID NO: 273739 - DNA, 15 bp, Homo sapiens
cttttgttgctcatt

SEQ ID NO: 273740 - DNA, 15 bp, Homo sapiens
acttttgttgctcat

SEQ ID NO: 273741 - DNA, 15 bp, Homo sapiens
tacttttgttgctca

SEQ ID NO: 273742 - DNA, 15 bp, Homo sapiens
atacttttgttgctc

SEQ ID NO: 273743 - DNA, 15 bp, Homo sapiens
gatacttttgttgct

SEQ ID NO: 273744 - DNA, 15 bp, Homo sapiens
tgatacttttgttgc

SEQ ID NO: 273745 - DNA, 15 bp, Homo sapiens
ttgatacttttgttg

SEQ ID NO: 273746 - DNA, 15 bp, Homo sapiens
cttgatacttttgtt

SEQ ID NO: 273747 - DNA, 15 bp, Homo sapiens
tcttgatacttttgt

SEQ ID NO: 273748 - DNA, 15 bp, Homo sapiens
gtcttgatacttttg

SEQ ID NO: 273749 - DNA, 15 bp, Homo sapiens
ggtcttgatactttt

SEQ ID NO: 273750 - DNA, 15 bp, Homo sapiens
tggtcttgatacttt

SEQ ID NO: 273751 - DNA, 15 bp, Homo sapiens
ttggtcttgatactt

SEQ ID NO: 273752 - DNA, 15 bp, Homo sapiens
tttggtcttgatact

SEQ ID NO: 273753 - DNA, 15 bp, Homo sapiens
atttggtcttgatac

SEQ ID NO: 273754 - DNA, 15 bp, Homo sapiens
gatttggtcttgata

SEQ ID NO: 273755 - DNA, 15 bp, Homo sapiens
agatttggtcttgat

SEQ ID NO: 273756 - DNA, 15 bp, Homo sapiens
gagatttggtcttga

SEQ ID NO: 273757 - DNA, 15 bp, Homo sapiens
tgagatttggtcttg

SEQ ID NO: 273758 - DNA, 15 bp, Homo sapiens
atgagatttggtctt

SEQ ID NO: 273759 - DNA, 15 bp, Homo sapiens
tatgagatttggtct

SEQ ID NO: 273760 - DNA, 15 bp, Homo sapiens
atatgagatttggtc

SEQ ID NO: 273761 - DNA, 15 bp, Homo sapiens
tatatgagatttggt

SEQ ID NO: 273762 - DNA, 15 bp, Homo sapiens
ttatatgagatttgg

SEQ ID NO: 273763 - DNA, 15 bp, Homo sapiens
tttatatgagatttg

SEQ ID NO: 273764 - DNA, 15 bp, Homo sapiens
ctttatatgagattt

SEQ ID NO: 273765 - DNA, 15 bp, Homo sapiens
cctttatatgagatt

SEQ ID NO: 273766 - DNA, 15 bp, Homo sapiens
tcctttatatgagat

SEQ ID NO: 273767 - DNA, 15 bp, Homo sapiens
ttcctttatatgaga

SEQ ID NO: 273768 - DNA, 15 bp, Homo sapiens
attcctttatatgag

SEQ ID NO: 273769 - DNA, 15 bp, Homo sapiens
aattcctttatatga

SEQ ID NO: 273770 - DNA, 15 bp, Homo sapiens
aaattcctttatatg

SEQ ID NO: 273771 - DNA, 15 bp, Homo sapiens
aaaattcctttatat

SEQ ID NO: 273772 - DNA, 15 bp, Homo sapiens
taaaattcctttata

SEQ ID NO: 273773 - DNA, 15 bp, Homo sapiens
ttaaaattcctttat

SEQ ID NO: 273774 - DNA, 15 bp, Homo sapiens
cttaaaattccttta

SEQ ID NO: 273775 - DNA, 15 bp, Homo sapiens
tcttaaaattccttt

SEQ ID NO: 273776 - DNA, 15 bp, Homo sapiens
ttcttaaaattcctt

SEQ ID NO: 273777 - DNA, 15 bp, Homo sapiens
tttcttaaaattcct

SEQ ID NO: 273778 - DNA, 15 bp, Homo sapiens
ttttcttaaaattcc

SEQ ID NO: 273779 - DNA, 15 bp, Homo sapiens
tttttcttaaaattc

SEQ ID NO: 273780 - DNA, 15 bp, Homo sapiens
ctttttcttaaaatt

SEQ ID NO: 273781 - DNA, 15 bp, Homo sapiens
tctttttcttaaaat

SEQ ID NO: 273782 - DNA, 15 bp, Homo sapiens
ctctttttcttaaaa

SEQ ID NO: 273783 - DNA, 15 bp, Homo sapiens
tctctttttcttaaa

SEQ ID NO: 273784 - DNA, 15 bp, Homo sapiens
atctctttttcttaa

SEQ ID NO: 273785 - DNA, 15 bp, Homo sapiens
tatctctttttctta

SEQ ID NO: 273786 - DNA, 15 bp, Homo sapiens
ttatctctttttctt

SEQ ID NO: 273787 - DNA, 15 bp, Homo sapiens
cttatctctttttct

SEQ ID NO: 273788 - DNA, 15 bp, Homo sapiens
ccttatctctttttc

SEQ ID NO: 273789 - DNA, 15 bp, Homo sapiens
tccttatctcttttt

SEQ ID NO: 273790 - DNA, 15 bp, Homo sapiens
ttccttatctctttt

SEQ ID NO: 273791 - DNA, 15 bp, Homo sapiens
gttccttatctcttt

SEQ ID NO: 273792 - DNA, 15 bp, Homo sapiens
tgttccttatctctt

SEQ ID NO: 273793 - DNA, 15 bp, Homo sapiens
ttgttccttatctct

SEQ ID NO: 273794 - DNA, 15 bp, Homo sapiens
tttgttccttatctc

SEQ ID NO: 273795 - DNA, 15 bp, Homo sapiens
ttttgttccttatct

SEQ ID NO: 273796 - DNA, 15 bp, Homo sapiens
attttgttccttatc

SEQ ID NO: 273797 - DNA, 15 bp, Homo sapiens
aattttgttccttat

SEQ ID NO: 273798 - DNA, 15 bp, Homo sapiens
taattttgttcctta

SEQ ID NO: 273799 - DNA, 15 bp, Homo sapiens
ataattttgttcctt

SEQ ID NO: 273800 - DNA, 15 bp, Homo sapiens
tataattttgttcct

SEQ ID NO: 273801 - DNA, 15 bp, Homo sapiens
atataattttgttcc

SEQ ID NO: 273802 - DNA, 15 bp, Homo sapiens
gatataattttgttc

SEQ ID NO: 273803 - DNA, 15 bp, Homo sapiens
tgatataattttgtt

SEQ ID NO: 273804 - DNA, 15 bp, Homo sapiens
gtgatataattttgt

SEQ ID NO: 273805 - DNA, 15 bp, Homo sapiens
agtgatataattttg

SEQ ID NO: 273806 - DNA, 15 bp, Homo sapiens
tagtgatataatttt

SEQ ID NO: 273807 - DNA, 15 bp, Homo sapiens
gtagtgatataattt

SEQ ID NO: 273808 - DNA, 15 bp, Homo sapiens
tgtagtgatataatt

SEQ ID NO: 273809 - DNA, 15 bp, Homo sapiens
ttgtagtgatataat

SEQ ID NO: 273810 - DNA, 15 bp, Homo sapiens
tttgtagtgatataa

SEQ ID NO: 273811 - DNA, 15 bp, Homo sapiens
atttgtagtgatata

SEQ ID NO: 273812 - DNA, 15 bp, Homo sapiens
tatttgtagtgatat

SEQ ID NO: 273813 - DNA, 15 bp, Homo sapiens
ttatttgtagtgata

SEQ ID NO: 273814 - DNA, 15 bp, Homo sapiens
tttatttgtagtgat

SEQ ID NO: 273815 - DNA, 15 bp, Homo sapiens
ctttatttgtagtga

SEQ ID NO: 273816 - DNA, 15 bp, Homo sapiens
gctttatttgtagtg

SEQ ID NO: 273817 - DNA, 15 bp, Homo sapiens
tgctttatttgtagt

SEQ ID NO: 273818 - DNA, 15 bp, Homo sapiens
atgctttatttgtag

SEQ ID NO: 273819 - DNA, 15 bp, Homo sapiens
catgctttatttgta

SEQ ID NO: 273820 - DNA, 15 bp, Homo sapiens
gcatgctttatttgt

SEQ ID NO: 273821 - DNA, 15 bp, Homo sapiens
ggcatgctttatttg

SEQ ID NO: 273822 - DNA, 15 bp, Homo sapiens
tggcatgctttattt

SEQ ID NO: 273823 - DNA, 15 bp, Homo sapiens
ctggcatgctttatt

SEQ ID NO: 273824 - DNA, 15 bp, Homo sapiens
actggcatgctttat

SEQ ID NO: 273825 - DNA, 15 bp, Homo sapiens
cactggcatgcttta

SEQ ID NO: 273826 - DNA, 15 bp, Homo sapiens
acactggcatgcttt

SEQ ID NO: 273827 - DNA, 15 bp, Homo sapiens
tacactggcatgctt

SEQ ID NO: 273828 - DNA, 15 bp, Homo sapiens
ttacactggcatgct

SEQ ID NO: 273829 - DNA, 15 bp, Homo sapiens
gttacactggcatgc

SEQ ID NO: 273830 - DNA, 15 bp, Homo sapiens
agttacactggcatg

SEQ ID NO: 273831 - DNA, 15 bp, Homo sapiens
tagttacactggcat

SEQ ID NO: 273832 - DNA, 15 bp, Homo sapiens
gtagttacactggca

SEQ ID NO: 273833 - DNA, 15 bp, Homo sapiens
agtagttacactggc

SEQ ID NO: 273834 - DNA, 15 bp, Homo sapiens
aagtagttacactgg

SEQ ID NO: 273835 - DNA, 15 bp, Homo sapiens
aaagtagttacactg

SEQ ID NO: 273836 - DNA, 15 bp, Homo sapiens
taaagtagttacact

SEQ ID NO: 273837 - DNA, 15 bp, Homo sapiens
ataaagtagttacac

SEQ ID NO: 273838 - DNA, 15 bp, Homo sapiens
cataaagtagttaca

SEQ ID NO: 273839 - DNA, 15 bp, Homo sapiens
tcataaagtagttac

SEQ ID NO: 273840 - DNA, 15 bp, Homo sapiens
ttcataaagtagtta

SEQ ID NO: 273841 - DNA, 15 bp, Homo sapiens
attcataaagtagtt

SEQ ID NO: 273842 - DNA, 15 bp, Homo sapiens
cattcataaagtagt

SEQ ID NO: 273843 - DNA, 15 bp, Homo sapiens
ccattcataaagtag

SEQ ID NO: 273844 - DNA, 15 bp, Homo sapiens
cccattcataaagta

SEQ ID NO: 273845 - DNA, 15 bp, Homo sapiens
tcccattcataaagt

SEQ ID NO: 273846 - DNA, 15 bp, Homo sapiens
ctcccattcataaag

SEQ ID NO: 273847 - DNA, 15 bp, Homo sapiens
cctcccattcataaa

SEQ ID NO: 273848 - DNA, 15 bp, Homo sapiens
tcctcccattcataa

SEQ ID NO: 273849 - DNA, 15 bp, Homo sapiens
ttcctcccattcata

SEQ ID NO: 273850 - DNA, 15 bp, Homo sapiens
tttcctcccattcat

SEQ ID NO: 273851 - DNA, 15 bp, Homo sapiens
ttttcctcccattca

SEQ ID NO: 273852 - DNA, 15 bp, Homo sapiens
attttcctcccattc

SEQ ID NO: 273853 - DNA, 15 bp, Homo sapiens
cattttcctcccatt

SEQ ID NO: 273854 - DNA, 15 bp, Homo sapiens
ccattttcctcccat

SEQ ID NO: 273855 - DNA, 15 bp, Homo sapiens
tccattttcctccca

SEQ ID NO: 273856 - DNA, 15 bp, Homo sapiens
ttccattttcctccc

SEQ ID NO: 273857 - DNA, 15 bp, Homo sapiens
tttccattttcctcc

SEQ ID NO: 273858 - DNA, 15 bp, Homo sapiens
ttttccattttcctc

SEQ ID NO: 273859 - DNA, 15 bp, Homo sapiens
cttttccattttcct

SEQ ID NO: 273860 - DNA, 15 bp, Homo sapiens
acttttccattttcc

SEQ ID NO: 273861 - DNA, 15 bp, Homo sapiens
tacttttccattttc

SEQ ID NO: 273862 - DNA, 15 bp, Homo sapiens
ttacttttccatttt

SEQ ID NO: 273863 - DNA, 15 bp, Homo sapiens
tttacttttccattt

SEQ ID NO: 273864 - DNA, 15 bp, Homo sapiens
atttacttttccatt

SEQ ID NO: 273865 - DNA, 15 bp, Homo sapiens
gatttacttttccat

SEQ ID NO: 273866 - DNA, 15 bp, Homo sapiens
agatttacttttcca

SEQ ID NO: 273867 - DNA, 15 bp, Homo sapiens
tagatttacttttcc

SEQ ID NO: 273868 - DNA, 15 bp, Homo sapiens
atagatttacttttc

SEQ ID NO: 273869 - DNA, 15 bp, Homo sapiens
tatagatttactttt

SEQ ID NO: 273870 - DNA, 15 bp, Homo sapiens
atatagatttacttt

SEQ ID NO: 273871 - DNA, 15 bp, Homo sapiens
aatatagatttactt

SEQ ID NO: 273872 - DNA, 15 bp, Homo sapiens
aaatatagatttact

SEQ ID NO: 273873 - DNA, 15 bp, Homo sapiens
aaaatatagatttac

SEQ ID NO: 273874 - DNA, 15 bp, Homo sapiens
taaaatatagattta

SEQ ID NO: 273875 - DNA, 15 bp, Homo sapiens
ttaaaatatagattt

SEQ ID NO: 273876 - DNA, 15 bp, Homo sapiens
attaaaatatagatt

SEQ ID NO: 273877 - DNA, 15 bp, Homo sapiens
cattaaaatatagat

SEQ ID NO: 273878 - DNA, 15 bp, Homo sapiens
acattaaaatataga

SEQ ID NO: 273879 - DNA, 15 bp, Homo sapiens
aacattaaaatatag

SEQ ID NO: 273880 - DNA, 15 bp, Homo sapiens
aaacattaaaatata

SEQ ID NO: 273881 - DNA, 15 bp, Homo sapiens
aaaacattaaaatat

SEQ ID NO: 273882 - DNA, 15 bp, Homo sapiens
gaaaacattaaaata

SEQ ID NO: 273883 - DNA, 15 bp, Homo sapiens
tgaaaacattaaaat

SEQ ID NO: 273884 - DNA, 15 bp, Homo sapiens
gtgaaaacattaaaa

SEQ ID NO: 273885 - DNA, 15 bp, Homo sapiens
agtgaaaacattaaa

SEQ ID NO: 273886 - DNA, 15 bp, Homo sapiens
tagtgaaaacattaa

SEQ ID NO: 273887 - DNA, 15 bp, Homo sapiens
ttagtgaaaacatta

SEQ ID NO: 273888 - DNA, 15 bp, Homo sapiens
attagtgaaaacatt

SEQ ID NO: 273889 - DNA, 15 bp, Homo sapiens
gattagtgaaaacat

SEQ ID NO: 273890 - DNA, 15 bp, Homo sapiens
tgattagtgaaaaca

SEQ ID NO: 273891 - DNA, 15 bp, Homo sapiens
atgattagtgaaaac

SEQ ID NO: 273892 - DNA, 15 bp, Homo sapiens
catgattagtgaaaa

SEQ ID NO: 273893 - DNA, 15 bp, Homo sapiens
acatgattagtgaaa

SEQ ID NO: 273894 - DNA, 15 bp, Homo sapiens
cacatgattagtgaa

SEQ ID NO: 273895 - DNA, 15 bp, Homo sapiens
ccacatgattagtga

SEQ ID NO: 273896 - DNA, 15 bp, Homo sapiens
cccacatgattagtg

SEQ ID NO: 273897 - DNA, 15 bp, Homo sapiens
acccacatgattagt

SEQ ID NO: 273898 - DNA, 15 bp, Homo sapiens
cacccacatgattag

SEQ ID NO: 273899 - DNA, 15 bp, Homo sapiens
ccacccacatgatta

SEQ ID NO: 273900 - DNA, 15 bp, Homo sapiens
accacccacatgatt

SEQ ID NO: 273901 - DNA, 15 bp, Homo sapiens
taccacccacatgat

SEQ ID NO: 273902 - DNA, 15 bp, Homo sapiens
ctaccacccacatga

SEQ ID NO: 273903 - DNA, 15 bp, Homo sapiens
actaccacccacatg

SEQ ID NO: 273904 - DNA, 15 bp, Homo sapiens
tactaccacccacat

SEQ ID NO: 273905 - DNA, 15 bp, Homo sapiens
atactaccacccaca

SEQ ID NO: 273906 - DNA, 15 bp, Homo sapiens
aatactaccacccac

SEQ ID NO: 273907 - DNA, 15 bp, Homo sapiens
caatactaccaccca

SEQ ID NO: 273908 - DNA, 15 bp, Homo sapiens
ccaatactaccaccc

SEQ ID NO: 273909 - DNA, 15 bp, Homo sapiens
accaatactaccacc

SEQ ID NO: 273910 - DNA, 15 bp, Homo sapiens
taccaatactaccac

SEQ ID NO: 273911 - DNA, 15 bp, Homo sapiens
ataccaatactacca

SEQ ID NO: 273912 - DNA, 15 bp, Homo sapiens
aataccaatactacc

SEQ ID NO: 273913 - DNA, 15 bp, Homo sapiens
taataccaatactac

SEQ ID NO: 273914 - DNA, 15 bp, Homo sapiens
ctaataccaatacta

SEQ ID NO: 273915 - DNA, 15 bp, Homo sapiens
actaataccaatact

SEQ ID NO: 273916 - DNA, 15 bp, Homo sapiens
cactaataccaatac

SEQ ID NO: 273917 - DNA, 15 bp, Homo sapiens
acactaataccaata

SEQ ID NO: 273918 - DNA, 15 bp, Homo sapiens
aacactaataccaat

SEQ ID NO: 273919 - DNA, 15 bp, Homo sapiens
gaacactaataccaa

SEQ ID NO: 273920 - DNA, 15 bp, Homo sapiens
agaacactaatacca

SEQ ID NO: 273921 - DNA, 15 bp, Homo sapiens
tagaacactaatacc

SEQ ID NO: 273922 - DNA, 15 bp, Homo sapiens
ttagaacactaatac

SEQ ID NO: 273923 - DNA, 15 bp, Homo sapiens
cttagaacactaata

SEQ ID NO: 273924 - DNA, 15 bp, Homo sapiens
tcttagaacactaat

SEQ ID NO: 273925 - DNA, 15 bp, Homo sapiens
gtcttagaacactaa

SEQ ID NO: 273926 - DNA, 15 bp, Homo sapiens
agtcttagaacacta

SEQ ID NO: 273927 - DNA, 15 bp, Homo sapiens
tagtcttagaacact

SEQ ID NO: 273928 - DNA, 15 bp, Homo sapiens
atagtcttagaacac

SEQ ID NO: 273929 - DNA, 15 bp, Homo sapiens
aatagtcttagaaca

SEQ ID NO: 273930 - DNA, 15 bp, Homo sapiens
caatagtcttagaac

SEQ ID NO: 273931 - DNA, 15 bp, Homo sapiens
acaatagtcttagaa

SEQ ID NO: 273932 - DNA, 15 bp, Homo sapiens
cacaatagtcttaga

SEQ ID NO: 273933 - DNA, 15 bp, Homo sapiens
acacaatagtcttag

SEQ ID NO: 273934 - DNA, 15 bp, Homo sapiens
tacacaatagtctta

SEQ ID NO: 273935 - DNA, 15 bp, Homo sapiens
gtacacaatagtctt

SEQ ID NO: 273936 - DNA, 15 bp, Homo sapiens
cgtacacaatagtct

SEQ ID NO: 273937 - DNA, 15 bp, Homo sapiens
acgtacacaatagtc

SEQ ID NO: 273938 - DNA, 15 bp, Homo sapiens
tacgtacacaatagt

SEQ ID NO: 273939 - DNA, 15 bp, Homo sapiens
ttacgtacacaatag

SEQ ID NO: 273940 - DNA, 15 bp, Homo sapiens
attacgtacacaata

SEQ ID NO: 273941 - DNA, 15 bp, Homo sapiens
tattacgtacacaat

SEQ ID NO: 273942 - DNA, 15 bp, Homo sapiens
atattacgtacacaa

SEQ ID NO: 273943 - DNA, 15 bp, Homo sapiens
catattacgtacaca

SEQ ID NO: 273944 - DNA, 15 bp, Homo sapiens
tcatattacgtacac

SEQ ID NO: 273945 - DNA, 15 bp, Homo sapiens
atcatattacgtaca

SEQ ID NO: 273946 - DNA, 15 bp, Homo sapiens
tatcatattacgtac

SEQ ID NO: 273947 - DNA, 15 bp, Homo sapiens
ttatcatattacgta

SEQ ID NO: 273948 - DNA, 15 bp, Homo sapiens
tttatcatattacgt

SEQ ID NO: 273949 - DNA, 15 bp, Homo sapiens
ttttatcatattacg

SEQ ID NO: 273950 - DNA, 15 bp, Homo sapiens
tttttatcatattac

SEQ ID NO: 273951 - DNA, 15 bp, Homo sapiens
ctttttatcatatta

SEQ ID NO: 273952 - DNA, 15 bp, Homo sapiens
gctttttatcatatt

SEQ ID NO: 273953 - DNA, 15 bp, Homo sapiens
tgctttttatcatat

SEQ ID NO: 273954 - DNA, 15 bp, Homo sapiens
ttgctttttatcata

SEQ ID NO: 273955 - DNA, 15 bp, Homo sapiens
tttgctttttatcat

SEQ ID NO: 273956 - DNA, 15 bp, Homo sapiens
atttgctttttatca

SEQ ID NO: 273957 - DNA, 15 bp, Homo sapiens
catttgctttttatc

SEQ ID NO: 273958 - DNA, 15 bp, Homo sapiens
tcatttgctttttat

SEQ ID NO: 273959 - DNA, 15 bp, Homo sapiens
ttcatttgcttttta

SEQ ID NO: 273960 - DNA, 15 bp, Homo sapiens
attcatttgcttttt

SEQ ID NO: 273961 - DNA, 15 bp, Homo sapiens
tattcatttgctttt

SEQ ID NO: 273962 - DNA, 15 bp, Homo sapiens
ttattcatttgcttt

SEQ ID NO: 273963 - DNA, 15 bp, Homo sapiens
attattcatttgctt

SEQ ID NO: 273964 - DNA, 15 bp, Homo sapiens
aattattcatttgct

SEQ ID NO: 273965 - DNA, 15 bp, Homo sapiens
taattattcatttgc

SEQ ID NO: 273966 - DNA, 15 bp, Homo sapiens
ataattattcatttg

SEQ ID NO: 273967 - DNA, 15 bp, Homo sapiens
cataattattcattt

SEQ ID NO: 273968 - DNA, 15 bp, Homo sapiens
ccataattattcatt

SEQ ID NO: 273969 - DNA, 15 bp, Homo sapiens
cccataattattcat

SEQ ID NO: 273970 - DNA, 15 bp, Homo sapiens
tcccataattattca

SEQ ID NO: 273971 - DNA, 15 bp, Homo sapiens
atcccataattattc

SEQ ID NO: 273972 - DNA, 15 bp, Homo sapiens
aatcccataattatt

SEQ ID NO: 273973 - DNA, 15 bp, Homo sapiens
caatcccataattat

SEQ ID NO: 273974 - DNA, 15 bp, Homo sapiens
acaatcccataatta

SEQ ID NO: 273975 - DNA, 15 bp, Homo sapiens
gacaatcccataatt

SEQ ID NO: 273976 - DNA, 15 bp, Homo sapiens
agacaatcccataat

SEQ ID NO: 273977 - DNA, 15 bp, Homo sapiens
tagacaatcccataa

SEQ ID NO: 273978 - DNA, 15 bp, Homo sapiens
ctagacaatcccata

SEQ ID NO: 273979 - DNA, 15 bp, Homo sapiens
cctagacaatcccat

SEQ ID NO: 273980 - DNA, 15 bp, Homo sapiens
acctagacaatccca

SEQ ID NO: 273981 - DNA, 15 bp, Homo sapiens
gacctagacaatccc

SEQ ID NO: 273982 - DNA, 15 bp, Homo sapiens
agacctagacaatcc

SEQ ID NO: 273983 - DNA, 15 bp, Homo sapiens
tagacctagacaatc

SEQ ID NO: 273984 - DNA, 15 bp, Homo sapiens
atagacctagacaat

SEQ ID NO: 273985 - DNA, 15 bp, Homo sapiens
gatagacctagacaa

SEQ ID NO: 273986 - DNA, 15 bp, Homo sapiens
tgatagacctagaca

SEQ ID NO: 273987 - DNA, 15 bp, Homo sapiens
atgatagacctagac

SEQ ID NO: 273988 - DNA, 15 bp, Homo sapiens
gatgatagacctaga

SEQ ID NO: 273989 - DNA, 15 bp, Homo sapiens
agatgatagacctag

SEQ ID NO: 273990 - DNA, 15 bp, Homo sapiens
gagatgatagaccta

SEQ ID NO: 273991 - DNA, 15 bp, Homo sapiens
agagatgatagacct

SEQ ID NO: 273992 - DNA, 15 bp, Homo sapiens
aagagatgatagacc

SEQ ID NO: 273993 - DNA, 15 bp, Homo sapiens
caagagatgatagac

SEQ ID NO: 273994 - DNA, 15 bp, Homo sapiens
acaagagatgataga

SEQ ID NO: 273995 - DNA, 15 bp, Homo sapiens
cacaagagatgatag

SEQ ID NO: 273996 - DNA, 15 bp, Homo sapiens
acacaagagatgata

SEQ ID NO: 273997 - DNA, 15 bp, Homo sapiens
gacacaagagatgat

SEQ ID NO: 273998 - DNA, 15 bp, Homo sapiens
ggacacaagagatga

SEQ ID NO: 273999 - DNA, 15 bp, Homo sapiens
aggacacaagagatg

SEQ ID NO: 274000 - DNA, 15 bp, Homo sapiens
aaggacacaagagat

SEQ ID NO: 274001 - DNA, 15 bp, Homo sapiens
caaggacacaagaga

SEQ ID NO: 274002 - DNA, 15 bp, Homo sapiens
tcaaggacacaagag

SEQ ID NO: 274003 - DNA, 15 bp, Homo sapiens
ctcaaggacacaaga

SEQ ID NO: 274004 - DNA, 15 bp, Homo sapiens
tctcaaggacacaag

SEQ ID NO: 274005 - DNA, 15 bp, Homo sapiens
ttctcaaggacacaa

SEQ ID NO: 274006 - DNA, 15 bp, Homo sapiens
gttctcaaggacaca

SEQ ID NO: 274007 - DNA, 15 bp, Homo sapiens
ggttctcaaggacac

SEQ ID NO: 274008 - DNA, 15 bp, Homo sapiens
tggttctcaaggaca

SEQ ID NO: 274009 - DNA, 15 bp, Homo sapiens
ctggttctcaaggac

SEQ ID NO: 274010 - DNA, 15 bp, Homo sapiens
tctggttctcaagga

SEQ ID NO: 274011 - DNA, 15 bp, Homo sapiens
atctggttctcaagg

SEQ ID NO: 274012 - DNA, 15 bp, Homo sapiens
aatctggttctcaag

SEQ ID NO: 274013 - DNA, 15 bp, Homo sapiens
aaatctggttctcaa

SEQ ID NO: 274014 - DNA, 15 bp, Homo sapiens
aaaatctggttctca

SEQ ID NO: 274015 - DNA, 15 bp, Homo sapiens
aaaaatctggttctc

SEQ ID NO: 274016 - DNA, 15 bp, Homo sapiens
caaaaatctggttct

SEQ ID NO: 274017 - DNA, 15 bp, Homo sapiens
ccaaaaatctggttc

SEQ ID NO: 274018 - DNA, 15 bp, Homo sapiens
accaaaaatctggtt

SEQ ID NO: 274019 - DNA, 15 bp, Homo sapiens
aaccaaaaatctggt

SEQ ID NO: 274020 - DNA, 15 bp, Homo sapiens
aaaccaaaaatctgg

SEQ ID NO: 274021 - DNA, 15 bp, Homo sapiens
aaaaccaaaaatctg

SEQ ID NO: 274022 - DNA, 15 bp, Homo sapiens
caaaaccaaaaatct

SEQ ID NO: 274023 - DNA, 15 bp, Homo sapiens
tcaaaaccaaaaatc

SEQ ID NO: 274024 - DNA, 15 bp, Homo sapiens
ttcaaaaccaaaaat

SEQ ID NO: 274025 - DNA, 15 bp, Homo sapiens
tttcaaaaccaaaaa

SEQ ID NO: 274026 - DNA, 15 bp, Homo sapiens
ttttcaaaaccaaaa

SEQ ID NO: 274027 - DNA, 15 bp, Homo sapiens
tttttcaaaaccaaa

SEQ ID NO: 274028 - DNA, 15 bp, Homo sapiens
ttttttcaaaaccaa

SEQ ID NO: 274029 - DNA, 15 bp, Homo sapiens
cttttttcaaaacca

SEQ ID NO: 274030 - DNA, 15 bp, Homo sapiens
ccttttttcaaaacc

SEQ ID NO: 274031 - DNA, 15 bp, Homo sapiens
tccttttttcaaaac

SEQ ID NO: 274032 - DNA, 15 bp, Homo sapiens
ctccttttttcaaaa

SEQ ID NO: 274033 - DNA, 15 bp, Homo sapiens
tctccttttttcaaa

SEQ ID NO: 274034 - DNA, 15 bp, Homo sapiens
atctccttttttcaa

SEQ ID NO: 274035 - DNA, 15 bp, Homo sapiens
tatctccttttttca

SEQ ID NO: 274036 - DNA, 15 bp, Homo sapiens
ctatctccttttttc

SEQ ID NO: 274037 - DNA, 15 bp, Homo sapiens
tctatctcctttttt

SEQ ID NO: 274038 - DNA, 15 bp, Homo sapiens
ctctatctccttttt

SEQ ID NO: 274039 - DNA, 15 bp, Homo sapiens
cctctatctcctttt

SEQ ID NO: 274040 - DNA, 15 bp, Homo sapiens
acctctatctccttt

SEQ ID NO: 274041 - DNA, 15 bp, Homo sapiens
cacctctatctcctt

SEQ ID NO: 274042 - DNA, 15 bp, Homo sapiens
acacctctatctcct

SEQ ID NO: 274043 - DNA, 15 bp, Homo sapiens
tacacctctatctcc

SEQ ID NO: 274044 - DNA, 15 bp, Homo sapiens
atacacctctatctc

SEQ ID NO: 274045 - DNA, 15 bp, Homo sapiens
aatacacctctatct

SEQ ID NO: 274046 - DNA, 15 bp, Homo sapiens
taatacacctctatc

SEQ ID NO: 274047 - DNA, 15 bp, Homo sapiens
ctaatacacctctat

SEQ ID NO: 274048 - DNA, 15 bp, Homo sapiens
tctaatacacctcta

SEQ ID NO: 274049 - DNA, 15 bp, Homo sapiens
ttctaatacacctct

SEQ ID NO: 274050 - DNA, 15 bp, Homo sapiens
tttctaatacacctc

SEQ ID NO: 274051 - DNA, 15 bp, Homo sapiens
ttttctaatacacct

SEQ ID NO: 274052 - DNA, 15 bp, Homo sapiens
gttttctaatacacc

SEQ ID NO: 274053 - DNA, 15 bp, Homo sapiens
tgttttctaatacac

SEQ ID NO: 274054 - DNA, 15 bp, Homo sapiens
ttgttttctaataca

SEQ ID NO: 274055 - DNA, 15 bp, Homo sapiens
cttgttttctaatac

SEQ ID NO: 274056 - DNA, 15 bp, Homo sapiens
acttgttttctaata

SEQ ID NO: 274057 - DNA, 15 bp, Homo sapiens
aacttgttttctaat

SEQ ID NO: 274058 - DNA, 15 bp, Homo sapiens
taacttgttttctaa

SEQ ID NO: 274059 - DNA, 15 bp, Homo sapiens
ttaacttgttttcta

SEQ ID NO: 274060 - DNA, 15 bp, Homo sapiens
cttaacttgttttct

SEQ ID NO: 274061 - DNA, 15 bp, Homo sapiens
acttaacttgttttc

SEQ ID NO: 274062 - DNA, 15 bp, Homo sapiens
aacttaacttgtttt

SEQ ID NO: 274063 - DNA, 15 bp, Homo sapiens
taacttaacttgttt

SEQ ID NO: 274064 - DNA, 15 bp, Homo sapiens
ttaacttaacttgtt

SEQ ID NO: 274065 - DNA, 15 bp, Homo sapiens
tttaacttaacttgt

SEQ ID NO: 274066 - DNA, 15 bp, Homo sapiens
atttaacttaacttg

SEQ ID NO: 274067 - DNA, 15 bp, Homo sapiens
gatttaacttaactt

SEQ ID NO: 274068 - DNA, 15 bp, Homo sapiens
tgatttaacttaact

SEQ ID NO: 274069 - DNA, 15 bp, Homo sapiens
ctgatttaacttaac

SEQ ID NO: 274070 - DNA, 15 bp, Homo sapiens
tctgatttaacttaa

SEQ ID NO: 274071 - DNA, 15 bp, Homo sapiens
ttctgatttaactta

SEQ ID NO: 274072 - DNA, 15 bp, Homo sapiens
tttctgatttaactt

SEQ ID NO: 274073 - DNA, 15 bp, Homo sapiens
atttctgatttaact

SEQ ID NO: 274074 - DNA, 15 bp, Homo sapiens
aatttctgatttaac

SEQ ID NO: 274075 - DNA, 15 bp, Homo sapiens
aaatttctgatttaa

SEQ ID NO: 274076 - DNA, 15 bp, Homo sapiens
caaatttctgattta

SEQ ID NO: 274077 - DNA, 15 bp, Homo sapiens
tcaaatttctgattt

SEQ ID NO: 274078 - DNA, 15 bp, Homo sapiens
ttcaaatttctgatt

SEQ ID NO: 274079 - DNA, 15 bp, Homo sapiens
attcaaatttctgat

SEQ ID NO: 274080 - DNA, 15 bp, Homo sapiens
aattcaaatttctga

SEQ ID NO: 274081 - DNA, 15 bp, Homo sapiens
caattcaaatttctg

SEQ ID NO: 274082 - DNA, 15 bp, Homo sapiens
ccaattcaaatttct

SEQ ID NO: 274083 - DNA, 15 bp, Homo sapiens
tccaattcaaatttc

SEQ ID NO: 274084 - DNA, 15 bp, Homo sapiens
ttccaattcaaattt

SEQ ID NO: 274085 - DNA, 15 bp, Homo sapiens
attccaattcaaatt

SEQ ID NO: 274086 - DNA, 15 bp, Homo sapiens
gattccaattcaaat

SEQ ID NO: 274087 - DNA, 15 bp, Homo sapiens
tgattccaattcaaa

SEQ ID NO: 274088 - DNA, 15 bp, Homo sapiens
atgattccaattcaa

SEQ ID NO: 274089 - DNA, 15 bp, Homo sapiens
gatgattccaattca

SEQ ID NO: 274090 - DNA, 15 bp, Homo sapiens
tgatgattccaattc

SEQ ID NO: 274091 - DNA, 15 bp, Homo sapiens
ttgatgattccaatt

SEQ ID NO: 274092 - DNA, 15 bp, Homo sapiens
attgatgattccaat

SEQ ID NO: 274093 - DNA, 15 bp, Homo sapiens
cattgatgattccaa

SEQ ID NO: 274094 - DNA, 15 bp, Homo sapiens
acattgatgattcca

SEQ ID NO: 274095 - DNA, 15 bp, Homo sapiens
tacattgatgattcc

SEQ ID NO: 274096 - DNA, 15 bp, Homo sapiens
ttacattgatgattc

SEQ ID NO: 274097 - DNA, 15 bp, Homo sapiens
gttacattgatgatt

SEQ ID NO: 274098 - DNA, 15 bp, Homo sapiens
agttacattgatgat

SEQ ID NO: 274099 - DNA, 15 bp, Homo sapiens
aagttacattgatga

SEQ ID NO: 274100 - DNA, 15 bp, Homo sapiens
gaagttacattgatg

SEQ ID NO: 274101 - DNA, 15 bp, Homo sapiens
tgaagttacattgat

SEQ ID NO: 274102 - DNA, 15 bp, Homo sapiens
ttgaagttacattga

SEQ ID NO: 274103 - DNA, 15 bp, Homo sapiens
cttgaagttacattg

SEQ ID NO: 274104 - DNA, 15 bp, Homo sapiens
tcttgaagttacatt

SEQ ID NO: 274105 - DNA, 15 bp, Homo sapiens
ctcttgaagttacat

SEQ ID NO: 274106 - DNA, 15 bp, Homo sapiens
tctcttgaagttaca

SEQ ID NO: 274107 - DNA, 15 bp, Homo sapiens
ttctcttgaagttac

SEQ ID NO: 274108 - DNA, 15 bp, Homo sapiens
tttctcttgaagtta

SEQ ID NO: 274109 - DNA, 15 bp, Homo sapiens
atttctcttgaagtt

SEQ ID NO: 274110 - DNA, 15 bp, Homo sapiens
aatttctcttgaagt

SEQ ID NO: 274111 - DNA, 15 bp, Homo sapiens
aaatttctcttgaag

SEQ ID NO: 274112 - DNA, 15 bp, Homo sapiens
aaaatttctcttgaa

SEQ ID NO: 274113 - DNA, 15 bp, Homo sapiens
taaaatttctcttga

SEQ ID NO: 274114 - DNA, 15 bp, Homo sapiens
gtaaaatttctcttg

SEQ ID NO: 274115 - DNA, 15 bp, Homo sapiens
ggtaaaatttctctt

SEQ ID NO: 274116 - DNA, 15 bp, Homo sapiens
aggtaaaatttctct

SEQ ID NO: 274117 - DNA, 15 bp, Homo sapiens
aaggtaaaatttctc

SEQ ID NO: 274118 - DNA, 15 bp, Homo sapiens
gaaggtaaaatttct

SEQ ID NO: 274119 - DNA, 15 bp, Homo sapiens
tgaaggtaaaatttc

SEQ ID NO: 274120 - DNA, 15 bp, Homo sapiens
ttgaaggtaaaattt

SEQ ID NO: 274121 - DNA, 15 bp, Homo sapiens
tttgaaggtaaaatt

SEQ ID NO: 274122 - DNA, 15 bp, Homo sapiens
atttgaaggtaaaat

SEQ ID NO: 274123 - DNA, 15 bp, Homo sapiens
catttgaaggtaaaa

SEQ ID NO: 274124 - DNA, 15 bp, Homo sapiens
gcatttgaaggtaaa

SEQ ID NO: 274125 - DNA, 15 bp, Homo sapiens
tgcatttgaaggtaa

SEQ ID NO: 274126 - DNA, 15 bp, Homo sapiens
atgcatttgaaggta

SEQ ID NO: 274127 - DNA, 15 bp, Homo sapiens
tatgcatttgaaggt

SEQ ID NO: 274128 - DNA, 15 bp, Homo sapiens
atatgcatttgaagg

SEQ ID NO: 274129 - DNA, 15 bp, Homo sapiens
aatatgcatttgaag

SEQ ID NO: 274130 - DNA, 15 bp, Homo sapiens
aaatatgcatttgaa

SEQ ID NO: 274131 - DNA, 15 bp, Homo sapiens
gaaatatgcatttga

SEQ ID NO: 274132 - DNA, 15 bp, Homo sapiens
ggaaatatgcatttg

SEQ ID NO: 274133 - DNA, 15 bp, Homo sapiens
gggaaatatgcattt

SEQ ID NO: 274134 - DNA, 15 bp, Homo sapiens
tgggaaatatgcatt

SEQ ID NO: 274135 - DNA, 15 bp, Homo sapiens
ctgggaaatatgcat

SEQ ID NO: 274136 - DNA, 15 bp, Homo sapiens
gctgggaaatatgca

SEQ ID NO: 274137 - DNA, 15 bp, Homo sapiens
agctgggaaatatgc

SEQ ID NO: 274138 - DNA, 15 bp, Homo sapiens
gagctgggaaatatg

SEQ ID NO: 274139 - DNA, 15 bp, Homo sapiens
agagctgggaaatat

SEQ ID NO: 274140 - DNA, 15 bp, Homo sapiens
cagagctgggaaata

SEQ ID NO: 274141 - DNA, 15 bp, Homo sapiens
acagagctgggaaat

SEQ ID NO: 274142 - DNA, 15 bp, Homo sapiens
cacagagctgggaaa

SEQ ID NO: 274143 - DNA, 15 bp, Homo sapiens
gcacagagctgggaa

SEQ ID NO: 274144 - DNA, 15 bp, Homo sapiens
tgcacagagctggga

SEQ ID NO: 274145 - DNA, 15 bp, Homo sapiens
ttgcacagagctggg

SEQ ID NO: 274146 - DNA, 15 bp, Homo sapiens
tttgcacagagctgg

SEQ ID NO: 274147 - DNA, 15 bp, Homo sapiens
ctttgcacagagctg

SEQ ID NO: 274148 - DNA, 15 bp, Homo sapiens
tctttgcacagagct

SEQ ID NO: 274149 - DNA, 15 bp, Homo sapiens
ttctttgcacagagc

SEQ ID NO: 274150 - DNA, 15 bp, Homo sapiens
tttctttgcacagag

SEQ ID NO: 274151 - DNA, 15 bp, Homo sapiens
ttttctttgcacaga

SEQ ID NO: 274152 - DNA, 15 bp, Homo sapiens
tttttctttgcacag

SEQ ID NO: 274153 - DNA, 15 bp, Homo sapiens
ctttttctttgcaca

SEQ ID NO: 274154 - DNA, 15 bp, Homo sapiens
gctttttctttgcac

SEQ ID NO: 274155 - DNA, 15 bp, Homo sapiens
ggctttttctttgca

SEQ ID NO: 274156 - DNA, 15 bp, Homo sapiens
aggctttttctttgc

SEQ ID NO: 274157 - DNA, 15 bp, Homo sapiens
caggctttttctttg

SEQ ID NO: 274158 - DNA, 15 bp, Homo sapiens
acaggctttttcttt

SEQ ID NO: 274159 - DNA, 15 bp, Homo sapiens
aacaggctttttctt

SEQ ID NO: 274160 - DNA, 15 bp, Homo sapiens
taacaggctttttct

SEQ ID NO: 274161 - DNA, 15 bp, Homo sapiens
ttaacaggctttttc

SEQ ID NO: 274162 - DNA, 15 bp, Homo sapiens
gttaacaggcttttt

SEQ ID NO: 274163 - DNA, 15 bp, Homo sapiens
tgttaacaggctttt

SEQ ID NO: 274164 - DNA, 15 bp, Homo sapiens
gtgttaacaggcttt

SEQ ID NO: 274165 - DNA, 15 bp, Homo sapiens
agtgttaacaggctt

SEQ ID NO: 274166 - DNA, 15 bp, Homo sapiens
cagtgttaacaggct

SEQ ID NO: 274167 - DNA, 15 bp, Homo sapiens
tcagtgttaacaggc

SEQ ID NO: 274168 - DNA, 15 bp, Homo sapiens
ttcagtgttaacagg

SEQ ID NO: 274169 - DNA, 15 bp, Homo sapiens
tttcagtgttaacag

SEQ ID NO: 274170 - DNA, 15 bp, Homo sapiens
ttttcagtgttaaca

SEQ ID NO: 274171 - DNA, 15 bp, Homo sapiens
cttttcagtgttaac

SEQ ID NO: 274172 - DNA, 15 bp, Homo sapiens
ccttttcagtgttaa

SEQ ID NO: 274173 - DNA, 15 bp, Homo sapiens
gccttttcagtgtta

SEQ ID NO: 274174 - DNA, 15 bp, Homo sapiens
ggccttttcagtgtt

SEQ ID NO: 274175 - DNA, 15 bp, Homo sapiens
aggccttttcagtgt

SEQ ID NO: 274176 - DNA, 15 bp, Homo sapiens
taggccttttcagtg

SEQ ID NO: 274177 - DNA, 15 bp, Homo sapiens
ttaggccttttcagt

SEQ ID NO: 274178 - DNA, 15 bp, Homo sapiens
tttaggccttttcag

SEQ ID NO: 274179 - DNA, 15 bp, Homo sapiens
ttttaggccttttca

SEQ ID NO: 274180 - DNA, 15 bp, Homo sapiens
cttttaggccttttc

SEQ ID NO: 274181 - DNA, 15 bp, Homo sapiens
ccttttaggcctttt

SEQ ID NO: 274182 - DNA, 15 bp, Homo sapiens
accttttaggccttt

SEQ ID NO: 274183 - DNA, 15 bp, Homo sapiens
caccttttaggcctt

SEQ ID NO: 274184 - DNA, 15 bp, Homo sapiens
acaccttttaggcct

SEQ ID NO: 274185 - DNA, 15 bp, Homo sapiens
cacaccttttaggcc

SEQ ID NO: 274186 - DNA, 15 bp, Homo sapiens
gcacaccttttaggc

SEQ ID NO: 274187 - DNA, 15 bp, Homo sapiens
agcacaccttttagg

SEQ ID NO: 274188 - DNA, 15 bp, Homo sapiens
aagcacaccttttag

SEQ ID NO: 274189 - DNA, 15 bp, Homo sapiens
caagcacacctttta

SEQ ID NO: 274190 - DNA, 15 bp, Homo sapiens
ccaagcacacctttt

SEQ ID NO: 274191 - DNA, 15 bp, Homo sapiens
tccaagcacaccttt

SEQ ID NO: 274192 - DNA, 15 bp, Homo sapiens
ttccaagcacacctt

SEQ ID NO: 274193 - DNA, 15 bp, Homo sapiens
gttccaagcacacct

SEQ ID NO: 274194 - DNA, 15 bp, Homo sapiens
tgttccaagcacacc

SEQ ID NO: 274195 - DNA, 15 bp, Homo sapiens
atgttccaagcacac

SEQ ID NO: 274196 - DNA, 15 bp, Homo sapiens
gatgttccaagcaca

SEQ ID NO: 274197 - DNA, 15 bp, Homo sapiens
agatgttccaagcac

SEQ ID NO: 274198 - DNA, 15 bp, Homo sapiens
aagatgttccaagca

SEQ ID NO: 274199 - DNA, 15 bp, Homo sapiens
caagatgttccaagc

SEQ ID NO: 274200 - DNA, 15 bp, Homo sapiens
acaagatgttccaag

SEQ ID NO: 274201 - DNA, 15 bp, Homo sapiens
tacaagatgttccaa

SEQ ID NO: 274202 - DNA, 15 bp, Homo sapiens
ttacaagatgttcca

SEQ ID NO: 274203 - DNA, 15 bp, Homo sapiens
attacaagatgttcc

SEQ ID NO: 274204 - DNA, 15 bp, Homo sapiens
tattacaagatgttc

SEQ ID NO: 274205 - DNA, 15 bp, Homo sapiens
ctattacaagatgtt

SEQ ID NO: 274206 - DNA, 15 bp, Homo sapiens
actattacaagatgt

SEQ ID NO: 274207 - DNA, 15 bp, Homo sapiens
tactattacaagatg

SEQ ID NO: 274208 - DNA, 15 bp, Homo sapiens
ctactattacaagat

SEQ ID NO: 274209 - DNA, 15 bp, Homo sapiens
gctactattacaaga

SEQ ID NO: 274210 - DNA, 15 bp, Homo sapiens
agctactattacaag

SEQ ID NO: 274211 - DNA, 15 bp, Homo sapiens
tagctactattacaa

SEQ ID NO: 274212 - DNA, 15 bp, Homo sapiens
ttagctactattaca

SEQ ID NO: 274213 - DNA, 15 bp, Homo sapiens
attagctactattac

SEQ ID NO: 274214 - DNA, 15 bp, Homo sapiens
tattagctactatta

SEQ ID NO: 274215 - DNA, 15 bp, Homo sapiens
ttattagctactatt

SEQ ID NO: 274216 - DNA, 15 bp, Homo sapiens
cttattagctactat

SEQ ID NO: 274217 - DNA, 15 bp, Homo sapiens
ccttattagctacta

SEQ ID NO: 274218 - DNA, 15 bp, Homo sapiens
tccttattagctact

SEQ ID NO: 274219 - DNA, 15 bp, Homo sapiens
ttccttattagctac

SEQ ID NO: 274220 - DNA, 15 bp, Homo sapiens
cttccttattagcta

SEQ ID NO: 274221 - DNA, 15 bp, Homo sapiens
gcttccttattagct

SEQ ID NO: 274222 - DNA, 15 bp, Homo sapiens
agcttccttattagc

SEQ ID NO: 274223 - DNA, 15 bp, Homo sapiens
cagcttccttattag

SEQ ID NO: 274224 - DNA, 15 bp, Homo sapiens
acagcttccttatta

SEQ ID NO: 274225 - DNA, 15 bp, Homo sapiens
aacagcttccttatt

SEQ ID NO: 274226 - DNA, 15 bp, Homo sapiens
caacagcttccttat

SEQ ID NO: 274227 - DNA, 15 bp, Homo sapiens
tcaacagcttcctta

SEQ ID NO: 274228 - DNA, 15 bp, Homo sapiens
ttcaacagcttcctt

SEQ ID NO: 274229 - DNA, 15 bp, Homo sapiens
cttcaacagcttcct

SEQ ID NO: 274230 - DNA, 15 bp, Homo sapiens
tcttcaacagcttcc

SEQ ID NO: 274231 - DNA, 15 bp, Homo sapiens
gtcttcaacagcttc

SEQ ID NO: 274232 - DNA, 15 bp, Homo sapiens
agtcttcaacagctt

SEQ ID NO: 274233 - DNA, 15 bp, Homo sapiens
cagtcttcaacagct

SEQ ID NO: 274234 - DNA, 15 bp, Homo sapiens
acagtcttcaacagc

SEQ ID NO: 274235 - DNA, 15 bp, Homo sapiens
aacagtcttcaacag

SEQ ID NO: 274236 - DNA, 15 bp, Homo sapiens
taacagtcttcaaca

SEQ ID NO: 274237 - DNA, 15 bp, Homo sapiens
ctaacagtcttcaac

SEQ ID NO: 274238 - DNA, 15 bp, Homo sapiens
tctaacagtcttcaa

SEQ ID NO: 274239 - DNA, 15 bp, Homo sapiens
ctctaacagtcttca

SEQ ID NO: 274240 - DNA, 15 bp, Homo sapiens
actctaacagtcttc

SEQ ID NO: 274241 - DNA, 15 bp, Homo sapiens
gactctaacagtctt

SEQ ID NO: 274242 - DNA, 15 bp, Homo sapiens
tgactctaacagtct

SEQ ID NO: 274243 - DNA, 15 bp, Homo sapiens
gtgactctaacagtc

SEQ ID NO: 274244 - DNA, 15 bp, Homo sapiens
tgtgactctaacagt

SEQ ID NO: 274245 - DNA, 15 bp, Homo sapiens
atgtgactctaacag

SEQ ID NO: 274246 - DNA, 15 bp, Homo sapiens
aatgtgactctaaca

SEQ ID NO: 274247 - DNA, 15 bp, Homo sapiens
taatgtgactctaac

SEQ ID NO: 274248 - DNA, 15 bp, Homo sapiens
ttaatgtgactctaa

SEQ ID NO: 274249 - DNA, 15 bp, Homo sapiens
tttaatgtgactcta

SEQ ID NO: 274250 - DNA, 15 bp, Homo sapiens
ttttaatgtgactct

SEQ ID NO: 274251 - DNA, 15 bp, Homo sapiens
cttttaatgtgactc

SEQ ID NO: 274252 - DNA, 15 bp, Homo sapiens
acttttaatgtgact

SEQ ID NO: 274253 - DNA, 15 bp, Homo sapiens
aacttttaatgtgac

SEQ ID NO: 274254 - DNA, 15 bp, Homo sapiens
caacttttaatgtga

SEQ ID NO: 274255 - DNA, 15 bp, Homo sapiens
gcaacttttaatgtg

SEQ ID NO: 274256 - DNA, 15 bp, Homo sapiens
ggcaacttttaatgt

SEQ ID NO: 274257 - DNA, 15 bp, Homo sapiens
tggcaacttttaatg

SEQ ID NO: 274258 - DNA, 15 bp, Homo sapiens
ttggcaacttttaat

SEQ ID NO: 274259 - DNA, 15 bp, Homo sapiens
gttggcaacttttaa

SEQ ID NO: 274260 - DNA, 15 bp, Homo sapiens
agttggcaactttta

SEQ ID NO: 274261 - DNA, 15 bp, Homo sapiens
cagttggcaactttt

SEQ ID NO: 274262 - DNA, 15 bp, Homo sapiens
tcagttggcaacttt

SEQ ID NO: 274263 - DNA, 15 bp, Homo sapiens
ttcagttggcaactt

SEQ ID NO: 274264 - DNA, 15 bp, Homo sapiens
gttcagttggcaact

SEQ ID NO: 274265 - DNA, 15 bp, Homo sapiens
agttcagttggcaac

SEQ ID NO: 274266 - DNA, 15 bp, Homo sapiens
aagttcagttggcaa

SEQ ID NO: 274267 - DNA, 15 bp, Homo sapiens
caagttcagttggca

SEQ ID NO: 274268 - DNA, 15 bp, Homo sapiens
tcaagttcagttggc

SEQ ID NO: 274269 - DNA, 15 bp, Homo sapiens
gtcaagttcagttgg

SEQ ID NO: 274270 - DNA, 15 bp, Homo sapiens
ggtcaagttcagttg

SEQ ID NO: 274271 - DNA, 15 bp, Homo sapiens
aggtcaagttcagtt

SEQ ID NO: 274272 - DNA, 15 bp, Homo sapiens
aaggtcaagttcagt

SEQ ID NO: 274273 - DNA, 15 bp, Homo sapiens
gaaggtcaagttcag

SEQ ID NO: 274274 - DNA, 15 bp, Homo sapiens
tgaaggtcaagttca

SEQ ID NO: 274275 - DNA, 15 bp, Homo sapiens
ttgaaggtcaagttc

SEQ ID NO: 274276 - DNA, 15 bp, Homo sapiens
attgaaggtcaagtt

SEQ ID NO: 274277 - DNA, 15 bp, Homo sapiens
tattgaaggtcaagt

SEQ ID NO: 274278 - DNA, 15 bp, Homo sapiens
ttattgaaggtcaag

SEQ ID NO: 274279 - DNA, 15 bp, Homo sapiens
attattgaaggtcaa

SEQ ID NO: 274280 - DNA, 15 bp, Homo sapiens
cattattgaaggtca

SEQ ID NO: 274281 - DNA, 15 bp, Homo sapiens
tcattattgaaggtc

SEQ ID NO: 274282 - DNA, 15 bp, Homo sapiens
ctcattattgaaggt

SEQ ID NO: 274283 - DNA, 15 bp, Homo sapiens
tctcattattgaagg

SEQ ID NO: 274284 - DNA, 15 bp, Homo sapiens
ttctcattattgaag

SEQ ID NO: 274285 - DNA, 15 bp, Homo sapiens
attctcattattgaa

SEQ ID NO: 274286 - DNA, 15 bp, Homo sapiens
aattctcattattga

SEQ ID NO: 274287 - DNA, 15 bp, Homo sapiens
caattctcattattg

SEQ ID NO: 274288 - DNA, 15 bp, Homo sapiens
gcaattctcattatt

SEQ ID NO: 274289 - DNA, 15 bp, Homo sapiens
tgcaattctcattat

SEQ ID NO: 274290 - DNA, 15 bp, Homo sapiens
ttgcaattctcatta

SEQ ID NO: 274291 - DNA, 15 bp, Homo sapiens
attgcaattctcatt

SEQ ID NO: 274292 - DNA, 15 bp, Homo sapiens
tattgcaattctcat

SEQ ID NO: 274293 - DNA, 15 bp, Homo sapiens
ctattgcaattctca

SEQ ID NO: 274294 - DNA, 15 bp, Homo sapiens
tctattgcaattctc

SEQ ID NO: 274295 - DNA, 15 bp, Homo sapiens
atctattgcaattct

SEQ ID NO: 274296 - DNA, 15 bp, Homo sapiens
aatctattgcaattc

SEQ ID NO: 274297 - DNA, 15 bp, Homo sapiens
caatctattgcaatt

SEQ ID NO: 274298 - DNA, 15 bp, Homo sapiens
tcaatctattgcaat

SEQ ID NO: 274299 - DNA, 15 bp, Homo sapiens
ttcaatctattgcaa

SEQ ID NO: 274300 - DNA, 15 bp, Homo sapiens
tttcaatctattgca

SEQ ID NO: 274301 - DNA, 15 bp, Homo sapiens
gtttcaatctattgc

SEQ ID NO: 274302 - DNA, 15 bp, Homo sapiens
ggtttcaatctattg

SEQ ID NO: 274303 - DNA, 15 bp, Homo sapiens
gggtttcaatctatt

SEQ ID NO: 274304 - DNA, 15 bp, Homo sapiens
tgggtttcaatctat

SEQ ID NO: 274305 - DNA, 15 bp, Homo sapiens
atgggtttcaatcta

SEQ ID NO: 274306 - DNA, 15 bp, Homo sapiens
gatgggtttcaatct

SEQ ID NO: 274307 - DNA, 15 bp, Homo sapiens
tgatgggtttcaatc

SEQ ID NO: 274308 - DNA, 15 bp, Homo sapiens
ttgatgggtttcaat

SEQ ID NO: 274309 - DNA, 15 bp, Homo sapiens
tttgatgggtttcaa

SEQ ID NO: 274310 - DNA, 15 bp, Homo sapiens
atttgatgggtttca

SEQ ID NO: 274311 - DNA, 15 bp, Homo sapiens
tatttgatgggtttc

SEQ ID NO: 274312 - DNA, 15 bp, Homo sapiens
gtatttgatgggttt

SEQ ID NO: 274313 - DNA, 15 bp, Homo sapiens
tgtatttgatgggtt

SEQ ID NO: 274314 - DNA, 15 bp, Homo sapiens
atgtatttgatgggt

SEQ ID NO: 274315 - DNA, 15 bp, Homo sapiens
aatgtatttgatggg

SEQ ID NO: 274316 - DNA, 15 bp, Homo sapiens
taatgtatttgatgg

SEQ ID NO: 274317 - DNA, 15 bp, Homo sapiens
ttaatgtatttgatg

SEQ ID NO: 274318 - DNA, 15 bp, Homo sapiens
tttaatgtatttgat

SEQ ID NO: 274319 - DNA, 15 bp, Homo sapiens
ttttaatgtatttga

SEQ ID NO: 274320 - DNA, 15 bp, Homo sapiens
attttaatgtatttg

SEQ ID NO: 274321 - DNA, 15 bp, Homo sapiens
gattttaatgtattt

SEQ ID NO: 274322 - DNA, 15 bp, Homo sapiens
agattttaatgtatt

SEQ ID NO: 274323 - DNA, 15 bp, Homo sapiens
gagattttaatgtat

SEQ ID NO: 274324 - DNA, 15 bp, Homo sapiens
tgagattttaatgta

SEQ ID NO: 274325 - DNA, 15 bp, Homo sapiens
atgagattttaatgt

SEQ ID NO: 274326 - DNA, 15 bp, Homo sapiens
catgagattttaatg

SEQ ID NO: 274327 - DNA, 15 bp, Homo sapiens
tcatgagattttaat

SEQ ID NO: 274328 - DNA, 15 bp, Homo sapiens
atcatgagattttaa

SEQ ID NO: 274329 - DNA, 15 bp, Homo sapiens
tatcatgagatttta

SEQ ID NO: 274330 - DNA, 15 bp, Homo sapiens
atatcatgagatttt

SEQ ID NO: 274331 - DNA, 15 bp, Homo sapiens
aatatcatgagattt

SEQ ID NO: 274332 - DNA, 15 bp, Homo sapiens
aaatatcatgagatt

SEQ ID NO: 274333 - DNA, 15 bp, Homo sapiens
taaatatcatgagat

SEQ ID NO: 274334 - DNA, 15 bp, Homo sapiens
ttaaatatcatgaga

SEQ ID NO: 274335 - DNA, 15 bp, Homo sapiens
tttaaatatcatgag

SEQ ID NO: 274336 - DNA, 15 bp, Homo sapiens
ttttaaatatcatga

SEQ ID NO: 274337 - DNA, 15 bp, Homo sapiens
attttaaatatcatg

SEQ ID NO: 274338 - DNA, 15 bp, Homo sapiens
cattttaaatatcat

SEQ ID NO: 274339 - DNA, 15 bp, Homo sapiens
tcattttaaatatca

SEQ ID NO: 274340 - DNA, 15 bp, Homo sapiens
ttcattttaaatatc

SEQ ID NO: 274341 - DNA, 15 bp, Homo sapiens
gttcattttaaatat

SEQ ID NO: 274342 - DNA, 15 bp, Homo sapiens
tgttcattttaaata

SEQ ID NO: 274343 - DNA, 15 bp, Homo sapiens
ttgttcattttaaat

SEQ ID NO: 274344 - DNA, 15 bp, Homo sapiens
tttgttcattttaaa

SEQ ID NO: 274345 - DNA, 15 bp, Homo sapiens
ttttgttcattttaa

SEQ ID NO: 274346 - DNA, 15 bp, Homo sapiens
cttttgttcatttta

SEQ ID NO: 274347 - DNA, 15 bp, Homo sapiens
gcttttgttcatttt

SEQ ID NO: 274348 - DNA, 15 bp, Homo sapiens
tgcttttgttcattt

SEQ ID NO: 274349 - DNA, 15 bp, Homo sapiens
atgcttttgttcatt

SEQ ID NO: 274350 - DNA, 15 bp, Homo sapiens
aatgcttttgttcat

SEQ ID NO: 274351 - DNA, 15 bp, Homo sapiens
caatgcttttgttca

SEQ ID NO: 274352 - DNA, 15 bp, Homo sapiens
tcaatgcttttgttc

SEQ ID NO: 274353 - DNA, 15 bp, Homo sapiens
atcaatgcttttgtt

SEQ ID NO: 274354 - DNA, 15 bp, Homo sapiens
gatcaatgcttttgt

SEQ ID NO: 274355 - DNA, 15 bp, Homo sapiens
tgatcaatgcttttg

SEQ ID NO: 274356 - DNA, 15 bp, Homo sapiens
atgatcaatgctttt

SEQ ID NO: 274357 - DNA, 15 bp, Homo sapiens
gatgatcaatgcttt

SEQ ID NO: 274358 - DNA, 15 bp, Homo sapiens
agatgatcaatgctt

SEQ ID NO: 274359 - DNA, 15 bp, Homo sapiens
aagatgatcaatgct

SEQ ID NO: 274360 - DNA, 15 bp, Homo sapiens
aaagatgatcaatgc

SEQ ID NO: 274361 - DNA, 15 bp, Homo sapiens
caaagatgatcaatg

SEQ ID NO: 274362 - DNA, 15 bp, Homo sapiens
ccaaagatgatcaat

SEQ ID NO: 274363 - DNA, 15 bp, Homo sapiens
tccaaagatgatcaa

SEQ ID NO: 274364 - DNA, 15 bp, Homo sapiens
ttccaaagatgatca

SEQ ID NO: 274365 - DNA, 15 bp, Homo sapiens
tttccaaagatgatc

SEQ ID NO: 274366 - DNA, 15 bp, Homo sapiens
ttttccaaagatgat

SEQ ID NO: 274367 - DNA, 15 bp, Homo sapiens
attttccaaagatga

SEQ ID NO: 274368 - DNA, 15 bp, Homo sapiens
tattttccaaagatg

SEQ ID NO: 274369 - DNA, 15 bp, Homo sapiens
ttattttccaaagat

SEQ ID NO: 274370 - DNA, 15 bp, Homo sapiens
attattttccaaaga

SEQ ID NO: 274371 - DNA, 15 bp, Homo sapiens
tattattttccaaag

SEQ ID NO: 274372 - DNA, 15 bp, Homo sapiens
ctattattttccaaa

SEQ ID NO: 274373 - DNA, 15 bp, Homo sapiens
cctattattttccaa

SEQ ID NO: 274374 - DNA, 15 bp, Homo sapiens
tcctattattttcca

SEQ ID NO: 274375 - DNA, 15 bp, Homo sapiens
ttcctattattttcc

SEQ ID NO: 274376 - DNA, 15 bp, Homo sapiens
tttcctattattttc

SEQ ID NO: 274377 - DNA, 15 bp, Homo sapiens
gtttcctattatttt

SEQ ID NO: 274378 - DNA, 15 bp, Homo sapiens
ggtttcctattattt

SEQ ID NO: 274379 - DNA, 15 bp, Homo sapiens
tggtttcctattatt

SEQ ID NO: 274380 - DNA, 15 bp, Homo sapiens
atggtttcctattat

SEQ ID NO: 274381 - DNA, 15 bp, Homo sapiens
aatggtttcctatta

SEQ ID NO: 274382 - DNA, 15 bp, Homo sapiens
aaatggtttcctatt

SEQ ID NO: 274383 - DNA, 15 bp, Homo sapiens
gaaatggtttcctat

SEQ ID NO: 274384 - DNA, 15 bp, Homo sapiens
tgaaatggtttccta

SEQ ID NO: 274385 - DNA, 15 bp, Homo sapiens
atgaaatggtttcct

SEQ ID NO: 274386 - DNA, 15 bp, Homo sapiens
catgaaatggtttcc

SEQ ID NO: 274387 - DNA, 15 bp, Homo sapiens
tcatgaaatggtttc

SEQ ID NO: 274388 - DNA, 15 bp, Homo sapiens
atcatgaaatggttt

SEQ ID NO: 274389 - DNA, 15 bp, Homo sapiens
tatcatgaaatggtt

SEQ ID NO: 274390 - DNA, 15 bp, Homo sapiens
gtatcatgaaatggt

SEQ ID NO: 274391 - DNA, 15 bp, Homo sapiens
agtatcatgaaatgg

SEQ ID NO: 274392 - DNA, 15 bp, Homo sapiens
cagtatcatgaaatg

SEQ ID NO: 274393 - DNA, 15 bp, Homo sapiens
tcagtatcatgaaat

SEQ ID NO: 274394 - DNA, 15 bp, Homo sapiens
ttcagtatcatgaaa

SEQ ID NO: 274395 - DNA, 15 bp, Homo sapiens
tttcagtatcatgaa

SEQ ID NO: 274396 - DNA, 15 bp, Homo sapiens
ttttcagtatcatga

SEQ ID NO: 274397 - DNA, 15 bp, Homo sapiens
attttcagtatcatg

SEQ ID NO: 274398 - DNA, 15 bp, Homo sapiens
aattttcagtatcat

SEQ ID NO: 274399 - DNA, 15 bp, Homo sapiens
taattttcagtatca

SEQ ID NO: 274400 - DNA, 15 bp, Homo sapiens
ctaattttcagtatc

SEQ ID NO: 274401 - DNA, 15 bp, Homo sapiens
actaattttcagtat

SEQ ID NO: 274402 - DNA, 15 bp, Homo sapiens
gactaattttcagta

SEQ ID NO: 274403 - DNA, 15 bp, Homo sapiens
tgactaattttcagt

SEQ ID NO: 274404 - DNA, 15 bp, Homo sapiens
ttgactaattttcag

SEQ ID NO: 274405 - DNA, 15 bp, Homo sapiens
gttgactaattttca

SEQ ID NO: 274406 - DNA, 15 bp, Homo sapiens
tgttgactaattttc

SEQ ID NO: 274407 - DNA, 15 bp, Homo sapiens
gtgttgactaatttt

SEQ ID NO: 274408 - DNA, 15 bp, Homo sapiens
tgtgttgactaattt

SEQ ID NO: 274409 - DNA, 15 bp, Homo sapiens
ctgtgttgactaatt

SEQ ID NO: 274410 - DNA, 15 bp, Homo sapiens
actgtgttgactaat

SEQ ID NO: 274411 - DNA, 15 bp, Homo sapiens
tactgtgttgactaa

SEQ ID NO: 274412 - DNA, 15 bp, Homo sapiens
ttactgtgttgacta

SEQ ID NO: 274413 - DNA, 15 bp, Homo sapiens
tttactgtgttgact

SEQ ID NO: 274414 - DNA, 15 bp, Homo sapiens
ttttactgtgttgac

SEQ ID NO: 274415 - DNA, 15 bp, Homo sapiens
attttactgtgttga

SEQ ID NO: 274416 - DNA, 15 bp, Homo sapiens
tattttactgtgttg

SEQ ID NO: 274417 - DNA, 15 bp, Homo sapiens
atattttactgtgtt

SEQ ID NO: 274418 - DNA, 15 bp, Homo sapiens
aatattttactgtgt

SEQ ID NO: 274419 - DNA, 15 bp, Homo sapiens
aaatattttactgtg

SEQ ID NO: 274420 - DNA, 15 bp, Homo sapiens
taaatattttactgt

SEQ ID NO: 274421 - DNA, 15 bp, Homo sapiens
ataaatattttactg

SEQ ID NO: 274422 - DNA, 15 bp, Homo sapiens
gataaatattttact

SEQ ID NO: 274423 - DNA, 15 bp, Homo sapiens
ggataaatattttac

SEQ ID NO: 274424 - DNA, 15 bp, Homo sapiens
aggataaatatttta

SEQ ID NO: 274425 - DNA, 15 bp, Homo sapiens
caggataaatatttt

SEQ ID NO: 274426 - DNA, 15 bp, Homo sapiens
tcaggataaatattt

SEQ ID NO: 274427 - DNA, 15 bp, Homo sapiens
agtcaggataaatat

SEQ ID NO: 274428 - DNA, 15 bp, Homo sapiens
aagtcaggataaata

SEQ ID NO: 274429 - DNA, 15 bp, Homo sapiens
aaagtcaggataaat

SEQ ID NO: 274430 - DNA, 15 bp, Homo sapiens
aaaagtcaggataaa

SEQ ID NO: 274431 - DNA, 15 bp, Homo sapiens
gaaaagtcaggataa

SEQ ID NO: 274432 - DNA, 15 bp, Homo sapiens
agaaaagtcaggata

SEQ ID NO: 274433 - DNA, 15 bp, Homo sapiens
tagaaaagtcaggat

SEQ ID NO: 274434 - DNA, 15 bp, Homo sapiens
ttagaaaagtcagga

SEQ ID NO: 274435 - DNA, 15 bp, Homo sapiens
tttagaaaagtcagg

SEQ ID NO: 274436 - DNA, 15 bp, Homo sapiens
atttagaaaagtcag

SEQ ID NO: 274437 - DNA, 15 bp, Homo sapiens
catttagaaaagtca

SEQ ID NO: 274438 - DNA, 15 bp, Homo sapiens
tcatttagaaaagtc

SEQ ID NO: 274439 - DNA, 15 bp, Homo sapiens
ttcatttagaaaagt

SEQ ID NO: 274440 - DNA, 15 bp, Homo sapiens
gttcatttagaaaag

SEQ ID NO: 274441 - DNA, 15 bp, Homo sapiens
agttcatttagaaaa

SEQ ID NO: 274442 - DNA, 15 bp, Homo sapiens
cagttcatttagaaa

SEQ ID NO: 274443 - DNA, 15 bp, Homo sapiens
acagttcatttagaa

SEQ ID NO: 274444 - DNA, 15 bp, Homo sapiens
tacagttcatttaga

SEQ ID NO: 274445 - DNA, 15 bp, Homo sapiens
gtacagttcatttag

SEQ ID NO: 274446 - DNA, 15 bp, Homo sapiens
ggtacagttcattta

SEQ ID NO: 274447 - DNA, 15 bp, Homo sapiens
tggtacagttcattt

SEQ ID NO: 274448 - DNA, 15 bp, Homo sapiens
gtggtacagttcatt

SEQ ID NO: 274449 - DNA, 15 bp, Homo sapiens
tgtggtacagttcat

SEQ ID NO: 274450 - DNA, 15 bp, Homo sapiens
ctgtggtacagttca

SEQ ID NO: 274451 - DNA, 15 bp, Homo sapiens
tctgtggtacagttc

SEQ ID NO: 274452 - DNA, 15 bp, Homo sapiens
ctctgtggtacagtt

SEQ ID NO: 274453 - DNA, 15 bp, Homo sapiens
actctgtggtacagt

SEQ ID NO: 274454 - DNA, 15 bp, Homo sapiens
tactctgtggtacag

SEQ ID NO: 274455 - DNA, 15 bp, Homo sapiens
gtactctgtggtaca

SEQ ID NO: 274456 - DNA, 15 bp, Homo sapiens
ggtactctgtggtac

SEQ ID NO: 274457 - DNA, 15 bp, Homo sapiens
aggtactctgtggta

SEQ ID NO: 274458 - DNA, 15 bp, Homo sapiens
taggtactctgtggt

SEQ ID NO: 274459 - DNA, 15 bp, Homo sapiens
ttaggtactctgtgg

SEQ ID NO: 274460 - DNA, 15 bp, Homo sapiens
tttaggtactctgtg

SEQ ID NO: 274461 - DNA, 15 bp, Homo sapiens
atttaggtactctgt

SEQ ID NO: 274462 - DNA, 15 bp, Homo sapiens
catttaggtactctg

SEQ ID NO: 274463 - DNA, 15 bp, Homo sapiens
acatttaggtactct

SEQ ID NO: 274464 - DNA, 15 bp, Homo sapiens
aacatttaggtactc

SEQ ID NO: 274465 - DNA, 15 bp, Homo sapiens
taacatttaggtact

SEQ ID NO: 274466 - DNA, 15 bp, Homo sapiens
ctaacatttaggtac

SEQ ID NO: 274467 - DNA, 15 bp, Homo sapiens
tctaacatttaggta

SEQ ID NO: 274468 - DNA, 15 bp, Homo sapiens
gtctaacatttaggt

SEQ ID NO: 274469 - DNA, 15 bp, Homo sapiens
tgtctaacatttagg

SEQ ID NO: 274470 - DNA, 15 bp, Homo sapiens
atgtctaacatttag

SEQ ID NO: 274471 - DNA, 15 bp, Homo sapiens
catgtctaacattta

SEQ ID NO: 274472 - DNA, 15 bp, Homo sapiens
ccatgtctaacattt

SEQ ID NO: 274473 - DNA, 15 bp, Homo sapiens
accatgtctaacatt

SEQ ID NO: 274474 - DNA, 15 bp, Homo sapiens
caccatgtctaacat

SEQ ID NO: 274475 - DNA, 15 bp, Homo sapiens
tcaccatgtctaaca

SEQ ID NO: 274476 - DNA, 15 bp, Homo sapiens
atcaccatgtctaac

SEQ ID NO: 274477 - DNA, 15 bp, Homo sapiens
catcaccatgtctaa

SEQ ID NO: 274478 - DNA, 15 bp, Homo sapiens
acatcaccatgtcta

SEQ ID NO: 274479 - DNA, 15 bp, Homo sapiens
aacatcaccatgtct

SEQ ID NO: 274480 - DNA, 15 bp, Homo sapiens
aaacatcaccatgtc

SEQ ID NO: 274481 - DNA, 15 bp, Homo sapiens
gaaacatcaccatgt

SEQ ID NO: 274482 - DNA, 15 bp, Homo sapiens
agaaacatcaccatg

SEQ ID NO: 274483 - DNA, 15 bp, Homo sapiens
aagaaacatcaccat

SEQ ID NO: 274484 - DNA, 15 bp, Homo sapiens
aaagaaacatcacca

SEQ ID NO: 274485 - DNA, 15 bp, Homo sapiens
taaagaaacatcacc

SEQ ID NO: 274486 - DNA, 15 bp, Homo sapiens
ataaagaaacatcac

SEQ ID NO: 274487 - DNA, 15 bp, Homo sapiens
tataaagaaacatca

SEQ ID NO: 274488 - DNA, 15 bp, Homo sapiens
ttataaagaaacatc

SEQ ID NO: 274489 - DNA, 15 bp, Homo sapiens
tttataaagaaacat

SEQ ID NO: 274490 - DNA, 15 bp, Homo sapiens
ttttataaagaaaca

SEQ ID NO: 274491 - DNA, 15 bp, Homo sapiens
cttttataaagaaac

SEQ ID NO: 274492 - DNA, 15 bp, Homo sapiens
acttttataaagaaa

SEQ ID NO: 274493 - DNA, 15 bp, Homo sapiens
tacttttataaagaa

SEQ ID NO: 274494 - DNA, 15 bp, Homo sapiens
atacttttataaaga

SEQ ID NO: 274495 - DNA, 15 bp, Homo sapiens
catacttttataaag

SEQ ID NO: 274496 - DNA, 15 bp, Homo sapiens
acatacttttataaa

SEQ ID NO: 274497 - DNA, 15 bp, Homo sapiens
tacatacttttataa

SEQ ID NO: 274498 - DNA, 15 bp, Homo sapiens
atacatacttttata

SEQ ID NO: 274499 - DNA, 15 bp, Homo sapiens
aatacatacttttat

SEQ ID NO: 274500 - DNA, 15 bp, Homo sapiens
taatacatactttta

SEQ ID NO: 274501 - DNA, 15 bp, Homo sapiens
ctaatacatactttt

SEQ ID NO: 274502 - DNA, 15 bp, Homo sapiens
cctaatacatacttt

SEQ ID NO: 274503 - DNA, 15 bp, Homo sapiens
gcctaatacatactt

SEQ ID NO: 274504 - DNA, 15 bp, Homo sapiens
tgcctaatacatact

SEQ ID NO: 274505 - DNA, 15 bp, Homo sapiens
ctgcctaatacatac

SEQ ID NO: 274506 - DNA, 15 bp, Homo sapiens
cctgcctaatacata

SEQ ID NO: 274507 - DNA, 15 bp, Homo sapiens
ccctgcctaatacat

SEQ ID NO: 274508 - DNA, 15 bp, Homo sapiens
gccctgcctaataca

SEQ ID NO: 274509 - DNA, 15 bp, Homo sapiens
agccctgcctaatac

SEQ ID NO: 274510 - DNA, 15 bp, Homo sapiens
cagccctgcctaata

SEQ ID NO: 274511 - DNA, 15 bp, Homo sapiens
acagccctgcctaat

SEQ ID NO: 274512 - DNA, 15 bp, Homo sapiens
gacagccctgcctaa

SEQ ID NO: 274513 - DNA, 15 bp, Homo sapiens
agacagccctgccta

SEQ ID NO: 274514 - DNA, 15 bp, Homo sapiens
tagacagccctgcct

SEQ ID NO: 274515 - DNA, 15 bp, Homo sapiens
ctagacagccctgcc

SEQ ID NO: 274516 - DNA, 15 bp, Homo sapiens
tctagacagccctgc

SEQ ID NO: 274517 - DNA, 15 bp, Homo sapiens
ctctagacagccctg

SEQ ID NO: 274518 - DNA, 15 bp, Homo sapiens
cctctagacagccct

SEQ ID NO: 274519 - DNA, 15 bp, Homo sapiens
ccctctagacagccc

SEQ ID NO: 274520 - DNA, 15 bp, Homo sapiens
accctctagacagcc

SEQ ID NO: 274521 - DNA, 15 bp, Homo sapiens
gaccctctagacagc

SEQ ID NO: 274522 - DNA, 15 bp, Homo sapiens
tgaccctctagacag

SEQ ID NO: 274523 - DNA, 15 bp, Homo sapiens
ctgaccctctagaca

SEQ ID NO: 274524 - DNA, 15 bp, Homo sapiens
tctgaccctctagac

SEQ ID NO: 274525 - DNA, 15 bp, Homo sapiens
ttctgaccctctaga

SEQ ID NO: 274526 - DNA, 15 bp, Homo sapiens
gttctgaccctctag

SEQ ID NO: 274527 - DNA, 15 bp, Homo sapiens
agttctgaccctcta

SEQ ID NO: 274528 - DNA, 15 bp, Homo sapiens
tagttctgaccctct

SEQ ID NO: 274529 - DNA, 15 bp, Homo sapiens
ttagttctgaccctc

SEQ ID NO: 274530 - DNA, 15 bp, Homo sapiens
attagttctgaccct

SEQ ID NO: 274531 - DNA, 15 bp, Homo sapiens
tattagttctgaccc

SEQ ID NO: 274532 - DNA, 15 bp, Homo sapiens
ctattagttctgacc

SEQ ID NO: 274533 - DNA, 15 bp, Homo sapiens
cctattagttctgac

SEQ ID NO: 274534 - DNA, 15 bp, Homo sapiens
tcctattagttctga

SEQ ID NO: 274535 - DNA, 15 bp, Homo sapiens
atcctattagttctg

SEQ ID NO: 274536 - DNA, 15 bp, Homo sapiens
tatcctattagttct

SEQ ID NO: 274537 - DNA, 15 bp, Homo sapiens
ctatcctattagttc

SEQ ID NO: 274538 - DNA, 15 bp, Homo sapiens
tctatcctattagtt

SEQ ID NO: 274539 - DNA, 15 bp, Homo sapiens
atctatcctattagt

SEQ ID NO: 274540 - DNA, 15 bp, Homo sapiens
catctatcctattag

SEQ ID NO: 274541 - DNA, 15 bp, Homo sapiens
acatctatcctatta

SEQ ID NO: 274542 - DNA, 15 bp, Homo sapiens
tacatctatcctatt

SEQ ID NO: 274543 - DNA, 15 bp, Homo sapiens
atacatctatcctat

SEQ ID NO: 274544 - DNA, 15 bp, Homo sapiens
tatacatctatccta

SEQ ID NO: 274545 - DNA, 15 bp, Homo sapiens
atatacatctatcct

SEQ ID NO: 274546 - DNA, 15 bp, Homo sapiens
tatatacatctatcc

SEQ ID NO: 274547 - DNA, 15 bp, Homo sapiens
atatatacatctatc

SEQ ID NO: 274548 - DNA, 15 bp, Homo sapiens
catatatacatctat

SEQ ID NO: 274549 - DNA, 15 bp, Homo sapiens
tcatatatacatcta

SEQ ID NO: 274550 - DNA, 15 bp, Homo sapiens
ttcatatatacatct

SEQ ID NO: 274551 - DNA, 15 bp, Homo sapiens
attcatatatacatc

SEQ ID NO: 274552 - DNA, 15 bp, Homo sapiens
cattcatatatacat

SEQ ID NO: 274553 - DNA, 15 bp, Homo sapiens
ccattcatatataca

SEQ ID NO: 274554 - DNA, 15 bp, Homo sapiens
cccattcatatatac

SEQ ID NO: 274555 - DNA, 15 bp, Homo sapiens
tcccattcatatata

SEQ ID NO: 274556 - DNA, 15 bp, Homo sapiens
ctcccattcatatat

SEQ ID NO: 274557 - DNA, 15 bp, Homo sapiens
actcccattcatata

SEQ ID NO: 274558 - DNA, 15 bp, Homo sapiens
aactcccattcatat

SEQ ID NO: 274559 - DNA, 15 bp, Homo sapiens
aaactcccattcata

SEQ ID NO: 274560 - DNA, 15 bp, Homo sapiens
taaactcccattcat

SEQ ID NO: 274561 - DNA, 15 bp, Homo sapiens
ataaactcccattca

SEQ ID NO: 274562 - DNA, 15 bp, Homo sapiens
aataaactcccattc

SEQ ID NO: 274563 - DNA, 15 bp, Homo sapiens
taataaactcccatt

SEQ ID NO: 274564 - DNA, 15 bp, Homo sapiens
ttaataaactcccat

SEQ ID NO: 274565 - DNA, 15 bp, Homo sapiens
cttaataaactccca

SEQ ID NO: 274566 - DNA, 15 bp, Homo sapiens
ccttaataaactccc

SEQ ID NO: 274567 - DNA, 15 bp, Homo sapiens
tccttaataaactcc

SEQ ID NO: 274568 - DNA, 15 bp, Homo sapiens
ctccttaataaactc

SEQ ID NO: 274569 - DNA, 15 bp, Homo sapiens
actccttaataaact

SEQ ID NO: 274570 - DNA, 15 bp, Homo sapiens
tactccttaataaac

SEQ ID NO: 274571 - DNA, 15 bp, Homo sapiens
atactccttaataaa

SEQ ID NO: 274572 - DNA, 15 bp, Homo sapiens
aatactccttaataa

SEQ ID NO: 274573 - DNA, 15 bp, Homo sapiens
caatactccttaata

SEQ ID NO: 274574 - DNA, 15 bp, Homo sapiens
tcaatactccttaat

SEQ ID NO: 274575 - DNA, 15 bp, Homo sapiens
gtcaatactccttaa

SEQ ID NO: 274576 - DNA, 15 bp, Homo sapiens
agtcaatactcctta

SEQ ID NO: 274577 - DNA, 15 bp, Homo sapiens
gagtcaatactcctt

SEQ ID NO: 274578 - DNA, 15 bp, Homo sapiens
tgagtcaatactcct

SEQ ID NO: 274579 - DNA, 15 bp, Homo sapiens
gtgagtcaatactcc

SEQ ID NO: 274580 - DNA, 15 bp, Homo sapiens
tgtgagtcaatactc

SEQ ID NO: 274581 - DNA, 15 bp, Homo sapiens
atgtgagtcaatact

SEQ ID NO: 274582 - DNA, 15 bp, Homo sapiens
catgtgagtcaatac

SEQ ID NO: 274583 - DNA, 15 bp, Homo sapiens
tcatgtgagtcaata

SEQ ID NO: 274584 - DNA, 15 bp, Homo sapiens
atcatgtgagtcaat

SEQ ID NO: 274585 - DNA, 15 bp, Homo sapiens
gatcatgtgagtcaa

SEQ ID NO: 274586 - DNA, 15 bp, Homo sapiens
tgatcatgtgagtca

SEQ ID NO: 274587 - DNA, 15 bp, Homo sapiens
gtgatcatgtgagtc

SEQ ID NO: 274588 - DNA, 15 bp, Homo sapiens
tgtgatcatgtgagt

SEQ ID NO: 274589 - DNA, 15 bp, Homo sapiens
ttgtgatcatgtgag

SEQ ID NO: 274590 - DNA, 15 bp, Homo sapiens
cttgtgatcatgtga

SEQ ID NO: 274591 - DNA, 15 bp, Homo sapiens
ccttgtgatcatgtg

SEQ ID NO: 274592 - DNA, 15 bp, Homo sapiens
accttgtgatcatgt

SEQ ID NO: 274593 - DNA, 15 bp, Homo sapiens
caccttgtgatcatg

SEQ ID NO: 274594 - DNA, 15 bp, Homo sapiens
tcaccttgtgatcat

SEQ ID NO: 274595 - DNA, 15 bp, Homo sapiens
ttcaccttgtgatca

SEQ ID NO: 274596 - DNA, 15 bp, Homo sapiens
cttcaccttgtgatc

SEQ ID NO: 274597 - DNA, 15 bp, Homo sapiens
acttcaccttgtgat

SEQ ID NO: 274598 - DNA, 15 bp, Homo sapiens
gacttcaccttgtga

SEQ ID NO: 274599 - DNA, 15 bp, Homo sapiens
ggacttcaccttgtg

SEQ ID NO: 274600 - DNA, 15 bp, Homo sapiens
gggacttcaccttgt

SEQ ID NO: 274601 - DNA, 15 bp, Homo sapiens
tgggacttcaccttg

SEQ ID NO: 274602 - DNA, 15 bp, Homo sapiens
gtgggacttcacctt

SEQ ID NO: 274603 - DNA, 15 bp, Homo sapiens
tgtgggacttcacct

SEQ ID NO: 274604 - DNA, 15 bp, Homo sapiens
ctgtgggacttcacc

SEQ ID NO: 274605 - DNA, 15 bp, Homo sapiens
actgtgggacttcac

SEQ ID NO: 274606 - DNA, 15 bp, Homo sapiens
tactgtgggacttca

SEQ ID NO: 274607 - DNA, 15 bp, Homo sapiens
ctactgtgggacttc

SEQ ID NO: 274608 - DNA, 15 bp, Homo sapiens
cctactgtgggactt

SEQ ID NO: 274609 - DNA, 15 bp, Homo sapiens
gcctactgtgggact

SEQ ID NO: 274610 - DNA, 15 bp, Homo sapiens
agcctactgtgggac

SEQ ID NO: 274611 - DNA, 15 bp, Homo sapiens
cagcctactgtggga

SEQ ID NO: 274612 - DNA, 15 bp, Homo sapiens
acagcctactgtggg

SEQ ID NO: 274613 - DNA, 15 bp, Homo sapiens
gacagcctactgtgg

SEQ ID NO: 274614 - DNA, 15 bp, Homo sapiens
agacagcctactgtg

SEQ ID NO: 274615 - DNA, 15 bp, Homo sapiens
cagacagcctactgt

SEQ ID NO: 274616 - DNA, 15 bp, Homo sapiens
gcagacagcctactg

SEQ ID NO: 274617 - DNA, 15 bp, Homo sapiens
tgcagacagcctact

SEQ ID NO: 274618 - DNA, 15 bp, Homo sapiens
ttgcagacagcctac

SEQ ID NO: 274619 - DNA, 15 bp, Homo sapiens
cttgcagacagccta

SEQ ID NO: 274620 - DNA, 15 bp, Homo sapiens
gcttgcagacagcct

SEQ ID NO: 274621 - DNA, 15 bp, Homo sapiens
agcttgcagacagcc

SEQ ID NO: 274622 - DNA, 15 bp, Homo sapiens
cagcttgcagacagc

SEQ ID NO: 274623 - DNA, 15 bp, Homo sapiens
tcagcttgcagacag

SEQ ID NO: 274624 - DNA, 15 bp, Homo sapiens
ttcagcttgcagaca

SEQ ID NO: 274625 - DNA, 15 bp, Homo sapiens
cttcagcttgcagac

SEQ ID NO: 274626 - DNA, 15 bp, Homo sapiens
tcttcagcttgcaga

SEQ ID NO: 274627 - DNA, 15 bp, Homo sapiens
ctcttcagcttgcag

SEQ ID NO: 274628 - DNA, 15 bp, Homo sapiens
gctcttcagcttgca

SEQ ID NO: 274629 - DNA, 15 bp, Homo sapiens
tgctcttcagcttgc

SEQ ID NO: 274630 - DNA, 15 bp, Homo sapiens
ttgctcttcagcttg

SEQ ID NO: 274631 - DNA, 15 bp, Homo sapiens
cttgctcttcagctt

SEQ ID NO: 274632 - DNA, 15 bp, Homo sapiens
ccttgctcttcagct

SEQ ID NO: 274633 - DNA, 15 bp, Homo sapiens
tccttgctcttcagc

SEQ ID NO: 274634 - DNA, 15 bp, Homo sapiens
ttccttgctcttcag

SEQ ID NO: 274635 - DNA, 15 bp, Homo sapiens
cttccttgctcttca

SEQ ID NO: 274636 - DNA, 15 bp, Homo sapiens
gcttccttgctcttc

SEQ ID NO: 274637 - DNA, 15 bp, Homo sapiens
ggcttccttgctctt

SEQ ID NO: 274638 - DNA, 15 bp, Homo sapiens
tggcttccttgctct

SEQ ID NO: 274639 - DNA, 15 bp, Homo sapiens
ctggcttccttgctc

SEQ ID NO: 274640 - DNA, 15 bp, Homo sapiens
actggcttccttgct

SEQ ID NO: 274641 - DNA, 15 bp, Homo sapiens
aactggcttccttgc

SEQ ID NO: 274642 - DNA, 15 bp, Homo sapiens
aaactggcttccttg

SEQ ID NO: 274643 - DNA, 15 bp, Homo sapiens
caaactggcttcctt

SEQ ID NO: 274644 - DNA, 15 bp, Homo sapiens
tcaaactggcttcct

SEQ ID NO: 274645 - DNA, 15 bp, Homo sapiens
ctcaaactggcttcc

SEQ ID NO: 274646 - DNA, 15 bp, Homo sapiens
actcaaactggcttc

SEQ ID NO: 274647 - DNA, 15 bp, Homo sapiens
tactcaaactggctt

SEQ ID NO: 274648 - DNA, 15 bp, Homo sapiens
gtactcaaactggct

SEQ ID NO: 274649 - DNA, 15 bp, Homo sapiens
ggtactcaaactggc

SEQ ID NO: 274650 - DNA, 15 bp, Homo sapiens
gggtactcaaactgg

SEQ ID NO: 274651 - DNA, 15 bp, Homo sapiens
tgggtactcaaactg

SEQ ID NO: 274652 - DNA, 15 bp, Homo sapiens
ttgggtactcaaact

SEQ ID NO: 274653 - DNA, 15 bp, Homo sapiens
tttgggtactcaaac

SEQ ID NO: 274654 - DNA, 15 bp, Homo sapiens
gtttgggtactcaaa

SEQ ID NO: 274655 - DNA, 15 bp, Homo sapiens
ggtttgggtactcaa

SEQ ID NO: 274656 - DNA, 15 bp, Homo sapiens
aggtttgggtactca

SEQ ID NO: 274657 - DNA, 15 bp, Homo sapiens
gaggtttgggtactc

SEQ ID NO: 274658 - DNA, 15 bp, Homo sapiens
tgaggtttgggtact

SEQ ID NO: 274659 - DNA, 15 bp, Homo sapiens
ttgaggtttgggtac

SEQ ID NO: 274660 - DNA, 15 bp, Homo sapiens
tttgaggtttgggta

SEQ ID NO: 274661 - DNA, 15 bp, Homo sapiens
ttttgaggtttgggt

SEQ ID NO: 274662 - DNA, 15 bp, Homo sapiens
cttttgaggtttggg

SEQ ID NO: 274663 - DNA, 15 bp, Homo sapiens
acttttgaggtttgg

SEQ ID NO: 274664 - DNA, 15 bp, Homo sapiens
tacttttgaggtttg

SEQ ID NO: 274665 - DNA, 15 bp, Homo sapiens
ctacttttgaggttt

SEQ ID NO: 274666 - DNA, 15 bp, Homo sapiens
tctacttttgaggtt

SEQ ID NO: 274667 - DNA, 15 bp, Homo sapiens
ctctacttttgaggt

SEQ ID NO: 274668 - DNA, 15 bp, Homo sapiens
tctctacttttgagg

SEQ ID NO: 274669 - DNA, 15 bp, Homo sapiens
ttctctacttttgag

SEQ ID NO: 274670 - DNA, 15 bp, Homo sapiens
cttctctacttttga

SEQ ID NO: 274671 - DNA, 15 bp, Homo sapiens
gcttctctacttttg

SEQ ID NO: 274672 - DNA, 15 bp, Homo sapiens
ggcttctctactttt

SEQ ID NO: 274673 - DNA, 15 bp, Homo sapiens
cggcttctctacttt

SEQ ID NO: 274674 - DNA, 15 bp, Homo sapiens
tcggcttctctactt

SEQ ID NO: 274675 - DNA, 15 bp, Homo sapiens
gtcggcttctctact

SEQ ID NO: 274676 - DNA, 15 bp, Homo sapiens
tgtcggcttctctac

SEQ ID NO: 274677 - DNA, 15 bp, Homo sapiens
ctgtcggcttctcta

SEQ ID NO: 274678 - DNA, 15 bp, Homo sapiens
actgtcggcttctct

SEQ ID NO: 274679 - DNA, 15 bp, Homo sapiens
cactgtcggcttctc

SEQ ID NO: 274680 - DNA, 15 bp, Homo sapiens
gcactgtcggcttct

SEQ ID NO: 274681 - DNA, 15 bp, Homo sapiens
tgcactgtcggcttc

SEQ ID NO: 274682 - DNA, 15 bp, Homo sapiens
gctgcactgtcggct

SEQ ID NO: 274683 - DNA, 15 bp, Homo sapiens
ggctgcactgtcggc

SEQ ID NO: 274684 - DNA, 15 bp, Homo sapiens
aggctgcactgtcgg

SEQ ID NO: 274685 - DNA, 15 bp, Homo sapiens
aaggctgcactgtcg

SEQ ID NO: 274686 - DNA, 15 bp, Homo sapiens
gaaggctgcactgtc

SEQ ID NO: 274687 - DNA, 15 bp, Homo sapiens
tgaaggctgcactgt

SEQ ID NO: 274688 - DNA, 15 bp, Homo sapiens
ctgaaggctgcactg

SEQ ID NO: 274689 - DNA, 15 bp, Homo sapiens
actgaaggctgcact

SEQ ID NO: 274690 - DNA, 15 bp, Homo sapiens
gactgaaggctgcac

SEQ ID NO: 274691 - DNA, 15 bp, Homo sapiens
agactgaaggctgca

SEQ ID NO: 274692 - DNA, 15 bp, Homo sapiens
cagactgaaggctgc

SEQ ID NO: 274693 - DNA, 15 bp, Homo sapiens
acagactgaaggctg

SEQ ID NO: 274694 - DNA, 15 bp, Homo sapiens
cacagactgaaggct

SEQ ID NO: 274695 - DNA, 15 bp, Homo sapiens
ccacagactgaaggc

SEQ ID NO: 274696 - DNA, 15 bp, Homo sapiens
gccacagactgaagg

SEQ ID NO: 274697 - DNA, 15 bp, Homo sapiens
ggccacagactgaag

SEQ ID NO: 274698 - DNA, 15 bp, Homo sapiens
cggccacagactgaa

SEQ ID NO: 274699 - DNA, 15 bp, Homo sapiens
tcggccacagactga

SEQ ID NO: 274700 - DNA, 15 bp, Homo sapiens
ttcggccacagactg

SEQ ID NO: 274701 - DNA, 15 bp, Homo sapiens
cttcggccacagact

SEQ ID NO: 274702 - DNA, 15 bp, Homo sapiens
ccttcggccacagac

SEQ ID NO: 274703 - DNA, 15 bp, Homo sapiens
gccttcggccacaga

SEQ ID NO: 274704 - DNA, 15 bp, Homo sapiens
ggccttcggccacag

SEQ ID NO: 274705 - DNA, 15 bp, Homo sapiens
gggccttcggccaca

SEQ ID NO: 274706 - DNA, 15 bp, Homo sapiens
tgggccttcggccac

SEQ ID NO: 274707 - DNA, 15 bp, Homo sapiens
ttgggccttcggcca

SEQ ID NO: 274708 - DNA, 15 bp, Homo sapiens
cttgggccttcggcc

SEQ ID NO: 274709 - DNA, 15 bp, Homo sapiens
tcttgggccttcggc

SEQ ID NO: 274710 - DNA, 15 bp, Homo sapiens
ctcttgggccttcgg

SEQ ID NO: 274711 - DNA, 15 bp, Homo sapiens
gctcttgggccttcg

SEQ ID NO: 274712 - DNA, 15 bp, Homo sapiens
ggctcttgggccttc

SEQ ID NO: 274713 - DNA, 15 bp, Homo sapiens
gggctcttgggcctt

SEQ ID NO: 274714 - DNA, 15 bp, Homo sapiens
ggggctcttgggcct

SEQ ID NO: 274715 - DNA, 15 bp, Homo sapiens
aggggctcttgggcc

SEQ ID NO: 274716 - DNA, 15 bp, Homo sapiens
caggggctcttgggc

SEQ ID NO: 274717 - DNA, 15 bp, Homo sapiens
ccaggggctcttggg

SEQ ID NO: 274718 - DNA, 15 bp, Homo sapiens
gccaggggctcttgg

SEQ ID NO: 274719 - DNA, 15 bp, Homo sapiens
tgccaggggctcttg

SEQ ID NO: 274720 - DNA, 15 bp, Homo sapiens
ttgccaggggctctt

SEQ ID NO: 274721 - DNA, 15 bp, Homo sapiens
tttgccaggggctct

SEQ ID NO: 274722 - DNA, 15 bp, Homo sapiens
gtttgccaggggctc

SEQ ID NO: 274723 - DNA, 15 bp, Homo sapiens
ggtttgccaggggct

SEQ ID NO: 274724 - DNA, 15 bp, Homo sapiens
tggtttgccaggggc

SEQ ID NO: 274725 - DNA, 15 bp, Homo sapiens
gtggtttgccagggg

SEQ ID NO: 274726 - DNA, 15 bp, Homo sapiens
agtggtttgccaggg

SEQ ID NO: 274727 - DNA, 15 bp, Homo sapiens
cagtggtttgccagg

SEQ ID NO: 274728 - DNA, 15 bp, Homo sapiens
ccagtggtttgccag

SEQ ID NO: 274729 - DNA, 15 bp, Homo sapiens
accagtggtttgcca

SEQ ID NO: 274730 - DNA, 15 bp, Homo sapiens
gaccagtggtttgcc

SEQ ID NO: 274731 - DNA, 15 bp, Homo sapiens
agaccagtggtttgc

SEQ ID NO: 274732 - DNA, 15 bp, Homo sapiens
tagaccagtggtttg

SEQ ID NO: 274733 - DNA, 15 bp, Homo sapiens
ttagaccagtggttt

SEQ ID NO: 274734 - DNA, 15 bp, Homo sapiens
gttagaccagtggtt

SEQ ID NO: 274735 - DNA, 15 bp, Homo sapiens
tgttagaccagtggt

SEQ ID NO: 274736 - DNA, 15 bp, Homo sapiens
ctgttagaccagtgg

SEQ ID NO: 274737 - DNA, 15 bp, Homo sapiens
actgttagaccagtg

SEQ ID NO: 274738 - DNA, 15 bp, Homo sapiens
gactgttagaccagt

SEQ ID NO: 274739 - DNA, 15 bp, Homo sapiens
ggactgttagaccag

SEQ ID NO: 274740 - DNA, 15 bp, Homo sapiens
tggactgttagacca

SEQ ID NO: 274741 - DNA, 15 bp, Homo sapiens
ttggactgttagacc

SEQ ID NO: 274742 - DNA, 15 bp, Homo sapiens
tttggactgttagac

SEQ ID NO: 274743 - DNA, 15 bp, Homo sapiens
ttttggactgttaga

SEQ ID NO: 274744 - DNA, 15 bp, Homo sapiens
cttttggactgttag

SEQ ID NO: 274745 - DNA, 15 bp, Homo sapiens
acttttggactgtta

SEQ ID NO: 274746 - DNA, 15 bp, Homo sapiens
aacttttggactgtt

SEQ ID NO: 274747 - DNA, 15 bp, Homo sapiens
caacttttggactgt

SEQ ID NO: 274748 - DNA, 15 bp, Homo sapiens
tcaacttttggactg

SEQ ID NO: 274749 - DNA, 15 bp, Homo sapiens
ttcaacttttggact

SEQ ID NO: 274750 - DNA, 15 bp, Homo sapiens
cttcaacttttggac

SEQ ID NO: 274751 - DNA, 15 bp, Homo sapiens
tcttcaacttttgga

SEQ ID NO: 274752 - DNA, 15 bp, Homo sapiens
ttcttcaacttttgg

SEQ ID NO: 274753 - DNA, 15 bp, Homo sapiens
gttcttcaacttttg

SEQ ID NO: 274754 - DNA, 15 bp, Homo sapiens
agttcttcaactttt

SEQ ID NO: 274755 - DNA, 15 bp, Homo sapiens
aagttcttcaacttt

SEQ ID NO: 274756 - DNA, 15 bp, Homo sapiens
caagttcttcaactt

SEQ ID NO: 274757 - DNA, 15 bp, Homo sapiens
ccaagttcttcaact

SEQ ID NO: 274758 - DNA, 15 bp, Homo sapiens
tccaagttcttcaac

SEQ ID NO: 274759 - DNA, 15 bp, Homo sapiens
actccaagttcttca

SEQ ID NO: 274760 - DNA, 15 bp, Homo sapiens
aactccaagttcttc

SEQ ID NO: 274761 - DNA, 15 bp, Homo sapiens
aaactccaagttctt

SEQ ID NO: 274762 - DNA, 15 bp, Homo sapiens
taaactccaagttct

SEQ ID NO: 274763 - DNA, 15 bp, Homo sapiens
ataaactccaagttc

SEQ ID NO: 274764 - DNA, 15 bp, Homo sapiens
cataaactccaagtt

SEQ ID NO: 274765 - DNA, 15 bp, Homo sapiens
acataaactccaagt

SEQ ID NO: 274766 - DNA, 15 bp, Homo sapiens
aacataaactccaag

SEQ ID NO: 274767 - DNA, 15 bp, Homo sapiens
gaacataaactccaa

SEQ ID NO: 274768 - DNA, 15 bp, Homo sapiens
cgaacataaactcca

SEQ ID NO: 274769 - DNA, 15 bp, Homo sapiens
tcgaacataaactcc

SEQ ID NO: 274770 - DNA, 15 bp, Homo sapiens
ctcgaacataaactc

SEQ ID NO: 274771 - DNA, 15 bp, Homo sapiens
cctcgaacataaact

SEQ ID NO: 274772 - DNA, 15 bp, Homo sapiens
ccctcgaacataaac

SEQ ID NO: 274773 - DNA, 15 bp, Homo sapiens
gccctcgaacataaa

SEQ ID NO: 274774 - DNA, 15 bp, Homo sapiens
tgccctcgaacataa

SEQ ID NO: 274775 - DNA, 15 bp, Homo sapiens
ctgccctcgaacata

SEQ ID NO: 274776 - DNA, 15 bp, Homo sapiens
cctgccctcgaacat

SEQ ID NO: 274777 - DNA, 15 bp, Homo sapiens
tcctgccctcgaaca

SEQ ID NO: 274778 - DNA, 15 bp, Homo sapiens
ttcctgccctcgaac

SEQ ID NO: 274779 - DNA, 15 bp, Homo sapiens
cttcctgccctcgaa

SEQ ID NO: 274780 - DNA, 15 bp, Homo sapiens
gcttcctgccctcga

SEQ ID NO: 274781 - DNA, 15 bp, Homo sapiens
agcttcctgccctcg

SEQ ID NO: 274782 - DNA, 15 bp, Homo sapiens
aagcttcctgccctc

SEQ ID NO: 274783 - DNA, 15 bp, Homo sapiens
gaagcttcctgccct

SEQ ID NO: 274784 - DNA, 15 bp, Homo sapiens
ggaagcttcctgccc

SEQ ID NO: 274785 - DNA, 15 bp, Homo sapiens
tggaagcttcctgcc

SEQ ID NO: 274786 - DNA, 15 bp, Homo sapiens
ctggaagcttcctgc

SEQ ID NO: 274787 - DNA, 15 bp, Homo sapiens
gctggaagcttcctg

SEQ ID NO: 274788 - DNA, 15 bp, Homo sapiens
tgctggaagcttcct

SEQ ID NO: 274789 - DNA, 15 bp, Homo sapiens
gtgctggaagcttcc

SEQ ID NO: 274790 - DNA, 15 bp, Homo sapiens
cgtgctggaagcttc

SEQ ID NO: 274791 - DNA, 15 bp, Homo sapiens
ccgtgctggaagctt

SEQ ID NO: 274792 - DNA, 15 bp, Homo sapiens
tccgtgctggaagct

SEQ ID NO: 274793 - DNA, 15 bp, Homo sapiens
ttccgtgctggaagc

SEQ ID NO: 274794 - DNA, 15 bp, Homo sapiens
tttccgtgctggaag

SEQ ID NO: 274795 - DNA, 15 bp, Homo sapiens
ttttccgtgctggaa

SEQ ID NO: 274796 - DNA, 15 bp, Homo sapiens
tttttccgtgctgga

SEQ ID NO: 274797 - DNA, 15 bp, Homo sapiens
ctttttccgtgctgg

SEQ ID NO: 274798 - DNA, 15 bp, Homo sapiens
tctttttccgtgctg

SEQ ID NO: 274799 - DNA, 15 bp, Homo sapiens
atctttttccgtgct

SEQ ID NO: 274800 - DNA, 15 bp, Homo sapiens
catctttttccgtgc

SEQ ID NO: 274801 - DNA, 15 bp, Homo sapiens
tcatctttttccgtg

SEQ ID NO: 274802 - DNA, 15 bp, Homo sapiens
ttcatctttttccgt

SEQ ID NO: 274803 - DNA, 15 bp, Homo sapiens
cttcatctttttccg

SEQ ID NO: 274804 - DNA, 15 bp, Homo sapiens
ccttcatctttttcc

SEQ ID NO: 274805 - DNA, 15 bp, Homo sapiens
gccttcatctttttc

SEQ ID NO: 274806 - DNA, 15 bp, Homo sapiens
ggccttcatcttttt

SEQ ID NO: 274807 - DNA, 15 bp, Homo sapiens
tggccttcatctttt

SEQ ID NO: 274808 - DNA, 15 bp, Homo sapiens
ctggccttcatcttt

SEQ ID NO: 274809 - DNA, 15 bp, Homo sapiens
tctggccttcatctt

SEQ ID NO: 274810 - DNA, 15 bp, Homo sapiens
ttctggccttcatct

SEQ ID NO: 274811 - DNA, 15 bp, Homo sapiens
cttctggccttcatc

SEQ ID NO: 274812 - DNA, 15 bp, Homo sapiens
tcttctggccttcat

SEQ ID NO: 274813 - DNA, 15 bp, Homo sapiens
gtcttctggccttca

SEQ ID NO: 274814 - DNA, 15 bp, Homo sapiens
agtcttctggccttc

SEQ ID NO: 274815 - DNA, 15 bp, Homo sapiens
gagtcttctggcctt

SEQ ID NO: 274816 - DNA, 15 bp, Homo sapiens
tgagtcttctggcct

SEQ ID NO: 274817 - DNA, 15 bp, Homo sapiens
ctgagtcttctggcc

SEQ ID NO: 274818 - DNA, 15 bp, Homo sapiens
gctgagtcttctggc

SEQ ID NO: 274819 - DNA, 15 bp, Homo sapiens
tgctgagtcttctgg

SEQ ID NO: 274820 - DNA, 15 bp, Homo sapiens
ttgctgagtcttctg

SEQ ID NO: 274821 - DNA, 15 bp, Homo sapiens
cttgctgagtcttct

SEQ ID NO: 274822 - DNA, 15 bp, Homo sapiens
acttgctgagtcttc

SEQ ID NO: 274823 - DNA, 15 bp, Homo sapiens
gacttgctgagtctt

SEQ ID NO: 274824 - DNA, 15 bp, Homo sapiens
agacttgctgagtct

SEQ ID NO: 274825 - DNA, 15 bp, Homo sapiens
cagacttgctgagtc

SEQ ID NO: 274826 - DNA, 15 bp, Homo sapiens
gcagacttgctgagt

SEQ ID NO: 274827 - DNA, 15 bp, Homo sapiens
agcagacttgctgag

SEQ ID NO: 274828 - DNA, 15 bp, Homo sapiens
gagcagacttgctga

SEQ ID NO: 274829 - DNA, 15 bp, Homo sapiens
agagcagacttgctg

SEQ ID NO: 274830 - DNA, 15 bp, Homo sapiens
aagagcagacttgct

SEQ ID NO: 274831 - DNA, 15 bp, Homo sapiens
gaagagcagacttgc

SEQ ID NO: 274832 - DNA, 15 bp, Homo sapiens
ggaagagcagacttg

SEQ ID NO: 274833 - DNA, 15 bp, Homo sapiens
tggaagagcagactt

SEQ ID NO: 274834 - DNA, 15 bp, Homo sapiens
atggaagagcagact

SEQ ID NO: 274835 - DNA, 15 bp, Homo sapiens
gatggaagagcagac

SEQ ID NO: 274836 - DNA, 15 bp, Homo sapiens
agatggaagagcaga

SEQ ID NO: 274837 - DNA, 15 bp, Homo sapiens
aagatggaagagcag

SEQ ID NO: 274838 - DNA, 15 bp, Homo sapiens
gaagatggaagagca

SEQ ID NO: 274839 - DNA, 15 bp, Homo sapiens
agaagatggaagagc

SEQ ID NO: 274840 - DNA, 15 bp, Homo sapiens
gagaagatggaagag

SEQ ID NO: 274841 - DNA, 15 bp, Homo sapiens
ggagaagatggaaga

SEQ ID NO: 274842 - DNA, 15 bp, Homo sapiens
aggagaagatggaag

SEQ ID NO: 274843 - DNA, 15 bp, Homo sapiens
caggagaagatggaa

SEQ ID NO: 274844 - DNA, 15 bp, Homo sapiens
gcaggagaagatgga

SEQ ID NO: 274845 - DNA, 15 bp, Homo sapiens
ggcaggagaagatgg

SEQ ID NO: 274846 - DNA, 15 bp, Homo sapiens
aggcaggagaagatg

SEQ ID NO: 274847 - DNA, 15 bp, Homo sapiens
caggcaggagaagat

SEQ ID NO: 274848 - DNA, 15 bp, Homo sapiens
gcaggcaggagaaga

SEQ ID NO: 274849 - DNA, 15 bp, Homo sapiens
agcaggcaggagaag

SEQ ID NO: 274850 - DNA, 15 bp, Homo sapiens
aagcaggcaggagaa

SEQ ID NO: 274851 - DNA, 15 bp, Homo sapiens
aaagcaggcaggaga

SEQ ID NO: 274852 - DNA, 15 bp, Homo sapiens
caaagcaggcaggag

SEQ ID NO: 274853 - DNA, 15 bp, Homo sapiens
acaaagcaggcagga

SEQ ID NO: 274854 - DNA, 15 bp, Homo sapiens
aacaaagcaggcagg

SEQ ID NO: 274855 - DNA, 15 bp, Homo sapiens
gaacaaagcaggcag

SEQ ID NO: 274856 - DNA, 15 bp, Homo sapiens
agaacaaagcaggca

SEQ ID NO: 274857 - DNA, 15 bp, Homo sapiens
tagaacaaagcaggc

SEQ ID NO: 274858 - DNA, 15 bp, Homo sapiens
ctagaacaaagcagg

SEQ ID NO: 274859 - DNA, 15 bp, Homo sapiens
gctagaacaaagcag

SEQ ID NO: 274860 - DNA, 15 bp, Homo sapiens
ggctagaacaaagca

SEQ ID NO: 274861 - DNA, 15 bp, Homo sapiens
tggctagaacaaagc

SEQ ID NO: 274862 - DNA, 15 bp, Homo sapiens
atggctagaacaaag

SEQ ID NO: 274863 - DNA, 15 bp, Homo sapiens
tatggctagaacaaa

SEQ ID NO: 274864 - DNA, 15 bp, Homo sapiens
gtatggctagaacaa

SEQ ID NO: 274865 - DNA, 15 bp, Homo sapiens
agtatggctagaaca

SEQ ID NO: 274866 - DNA, 15 bp, Homo sapiens
cagtatggctagaac

SEQ ID NO: 274867 - DNA, 15 bp, Homo sapiens
ccagtatggctagaa

SEQ ID NO: 274868 - DNA, 15 bp, Homo sapiens
gccagtatggctaga

SEQ ID NO: 274869 - DNA, 15 bp, Homo sapiens
tgccagtatggctag

SEQ ID NO: 274870 - DNA, 15 bp, Homo sapiens
ttgccagtatggcta

SEQ ID NO: 274871 - DNA, 15 bp, Homo sapiens
cttgccagtatggct

SEQ ID NO: 274872 - DNA, 15 bp, Homo sapiens
acttgccagtatggc

SEQ ID NO: 274873 - DNA, 15 bp, Homo sapiens
cacttgccagtatgg

SEQ ID NO: 274874 - DNA, 15 bp, Homo sapiens
tcacttgccagtatg

SEQ ID NO: 274875 - DNA, 15 bp, Homo sapiens
atcacttgccagtat

SEQ ID NO: 274876 - DNA, 15 bp, Homo sapiens
aatcacttgccagta

SEQ ID NO: 274877 - DNA, 15 bp, Homo sapiens
taatcacttgccagt

SEQ ID NO: 274878 - DNA, 15 bp, Homo sapiens
ctaatcacttgccag

SEQ ID NO: 274879 - DNA, 15 bp, Homo sapiens
tctaatcacttgcca

SEQ ID NO: 274880 - DNA, 15 bp, Homo sapiens
atctaatcacttgcc

SEQ ID NO: 274881 - DNA, 15 bp, Homo sapiens
catctaatcacttgc

SEQ ID NO: 274882 - DNA, 15 bp, Homo sapiens
ccatctaatcacttg

SEQ ID NO: 274883 - DNA, 15 bp, Homo sapiens
accatctaatcactt

SEQ ID NO: 274884 - DNA, 15 bp, Homo sapiens
caccatctaatcact

SEQ ID NO: 274885 - DNA, 15 bp, Homo sapiens
gcaccatctaatcac

SEQ ID NO: 274886 - DNA, 15 bp, Homo sapiens
ggcaccatctaatca

SEQ ID NO: 274887 - DNA, 15 bp, Homo sapiens
gggcaccatctaatc

SEQ ID NO: 274888 - DNA, 15 bp, Homo sapiens
tgggcaccatctaat

SEQ ID NO: 274889 - DNA, 15 bp, Homo sapiens
gtgggcaccatctaa

SEQ ID NO: 274890 - DNA, 15 bp, Homo sapiens
agtgggcaccatcta

SEQ ID NO: 274891 - DNA, 15 bp, Homo sapiens
cagtgggcaccatct

SEQ ID NO: 274892 - DNA, 15 bp, Homo sapiens
tcagtgggcaccatc

SEQ ID NO: 274893 - DNA, 15 bp, Homo sapiens
atcagtgggcaccat

SEQ ID NO: 274894 - DNA, 15 bp, Homo sapiens
aatcagtgggcacca

SEQ ID NO: 274895 - DNA, 15 bp, Homo sapiens
taatcagtgggcacc

SEQ ID NO: 274896 - DNA, 15 bp, Homo sapiens
ctaatcagtgggcac

SEQ ID NO: 274897 - DNA, 15 bp, Homo sapiens
tctaatcagtgggca

SEQ ID NO: 274898 - DNA, 15 bp, Homo sapiens
atctaatcagtgggc

SEQ ID NO: 274899 - DNA, 15 bp, Homo sapiens
catctaatcagtggg

SEQ ID NO: 274900 - DNA, 15 bp, Homo sapiens
ccatctaatcagtgg

SEQ ID NO: 274901 - DNA, 15 bp, Homo sapiens
accatctaatcagtg

SEQ ID NO: 274902 - DNA, 15 bp, Homo sapiens
taccatctaatcagt

SEQ ID NO: 274903 - DNA, 15 bp, Homo sapiens
gtaccatctaatcag

SEQ ID NO: 274904 - DNA, 15 bp, Homo sapiens
ggtaccatctaatca

SEQ ID NO: 274905 - DNA, 15 bp, Homo sapiens
gggtaccatctaatc

SEQ ID NO: 274906 - DNA, 15 bp, Homo sapiens
tgggtaccatctaat

SEQ ID NO: 274907 - DNA, 15 bp, Homo sapiens
gtgggtaccatctaa

SEQ ID NO: 274908 - DNA, 15 bp, Homo sapiens
ggtgggtaccatcta

SEQ ID NO: 274909 - DNA, 15 bp, Homo sapiens
cggtgggtaccatct

SEQ ID NO: 274910 - DNA, 15 bp, Homo sapiens
ccggtgggtaccatc

SEQ ID NO: 274911 - DNA, 15 bp, Homo sapiens
cccggtgggtaccat

SEQ ID NO: 274912 - DNA, 15 bp, Homo sapiens
acccggtgggtacca

SEQ ID NO: 274913 - DNA, 15 bp, Homo sapiens
aacccggtgggtacc

SEQ ID NO: 274914 - DNA, 15 bp, Homo sapiens
aaacccggtgggtac

SEQ ID NO: 274915 - DNA, 15 bp, Homo sapiens
caaacccggtgggta

SEQ ID NO: 274916 - DNA, 15 bp, Homo sapiens
tcaaacccggtgggt

SEQ ID NO: 274917 - DNA, 15 bp, Homo sapiens
ctcaaacccggtggg

SEQ ID NO: 274918 - DNA, 15 bp, Homo sapiens
cctcaaacccggtgg

SEQ ID NO: 274919 - DNA, 15 bp, Homo sapiens
ccctcaaacccggtg

SEQ ID NO: 274920 - DNA, 15 bp, Homo sapiens
accctcaaacccggt

SEQ ID NO: 274921 - DNA, 15 bp, Homo sapiens
caccctcaaacccgg

SEQ ID NO: 274922 - DNA, 15 bp, Homo sapiens
acaccctcaaacccg

SEQ ID NO: 274923 - DNA, 15 bp, Homo sapiens
tacaccctcaaaccc

SEQ ID NO: 274924 - DNA, 15 bp, Homo sapiens
aaaaaacaacagatt

SEQ ID NO: 274925 - DNA, 15 bp, Homo sapiens
aaaaaaacaacagat

SEQ ID NO: 274926 - DNA, 15 bp, Homo sapiens
aaaaaaaacaacaga

SEQ ID NO: 274927 - DNA, 15 bp, Homo sapiens
aaaaaaaaacaacag

SEQ ID NO: 274928 - DNA, 15 bp, Homo sapiens
gaaaaaaaaaaaaac

SEQ ID NO: 274929 - DNA, 15 bp, Homo sapiens
aaggaaaaaaaaaaa

SEQ ID NO: 274930 - DNA, 15 bp, Homo sapiens
gcagaaaaggaaaaa

SEQ ID NO: 274931 - DNA, 15 bp, Homo sapiens
ggcagaaaaggaaaa

SEQ ID NO: 274932 - DNA, 15 bp, Homo sapiens
aggcagaaaaggaaa

SEQ ID NO: 274933 - DNA, 15 bp, Homo sapiens
caggcagaaaaggaa

SEQ ID NO: 274934 - DNA, 15 bp, Homo sapiens
ccaggcagaaaagga

SEQ ID NO: 274935 - DNA, 15 bp, Homo sapiens
accaggcagaaaagg

SEQ ID NO: 274936 - DNA, 15 bp, Homo sapiens
taccaggcagaaaag

SEQ ID NO: 274937 - DNA, 15 bp, Homo sapiens
ttaccaggcagaaaa

SEQ ID NO: 274938 - DNA, 15 bp, Homo sapiens
cttaccaggcagaaa

SEQ ID NO: 274939 - DNA, 15 bp, Homo sapiens
tcttaccaggcagaa

SEQ ID NO: 274940 - DNA, 15 bp, Homo sapiens
ctcttaccaggcaga

SEQ ID NO: 274941 - DNA, 15 bp, Homo sapiens
gctcttaccaggcag

SEQ ID NO: 274942 - DNA, 15 bp, Homo sapiens
agctcttaccaggca

SEQ ID NO: 274943 - DNA, 15 bp, Homo sapiens
cagctcttaccaggc

SEQ ID NO: 274944 - DNA, 15 bp, Homo sapiens
tcagctcttaccagg

SEQ ID NO: 274945 - DNA, 15 bp, Homo sapiens
ttcagctcttaccag

SEQ ID NO: 274946 - DNA, 15 bp, Homo sapiens
attcagctcttacca

SEQ ID NO: 274947 - DNA, 15 bp, Homo sapiens
tattcagctcttacc

SEQ ID NO: 274948 - DNA, 15 bp, Homo sapiens
gtattcagctcttac

SEQ ID NO: 274949 - DNA, 15 bp, Homo sapiens
agtattcagctctta

SEQ ID NO: 274950 - DNA, 15 bp, Homo sapiens
gagtattcagctctt

SEQ ID NO: 274951 - DNA, 15 bp, Homo sapiens
agagtattcagctct

SEQ ID NO: 274952 - DNA, 15 bp, Homo sapiens
gagagtattcagctc

SEQ ID NO: 274953 - DNA, 15 bp, Homo sapiens
tgagagtattcagct

SEQ ID NO: 274954 - DNA, 15 bp, Homo sapiens
ttgagagtattcagc

SEQ ID NO: 274955 - DNA, 15 bp, Homo sapiens
tttgagagtattcag

SEQ ID NO: 274956 - DNA, 15 bp, Homo sapiens
gtttgagagtattca

SEQ ID NO: 274957 - DNA, 15 bp, Homo sapiens
ggtttgagagtattc

SEQ ID NO: 274958 - DNA, 15 bp, Homo sapiens
cggtttgagagtatt

SEQ ID NO: 274959 - DNA, 15 bp, Homo sapiens
acggtttgagagtat

SEQ ID NO: 274960 - DNA, 15 bp, Homo sapiens
gacggtttgagagta

SEQ ID NO: 274961 - DNA, 15 bp, Homo sapiens
tgacggtttgagagt

SEQ ID NO: 274962 - DNA, 15 bp, Homo sapiens
ctgacggtttgagag

SEQ ID NO: 274963 - DNA, 15 bp, Homo sapiens
tctgacggtttgaga

SEQ ID NO: 274964 - DNA, 15 bp, Homo sapiens
atctgacggtttgag

SEQ ID NO: 274965 - DNA, 15 bp, Homo sapiens
gatctgacggtttga

SEQ ID NO: 274966 - DNA, 15 bp, Homo sapiens
agatctgacggtttg

SEQ ID NO: 274967 - DNA, 15 bp, Homo sapiens
aagatctgacggttt

SEQ ID NO: 274968 - DNA, 15 bp, Homo sapiens
taagatctgacggtt

SEQ ID NO: 274969 - DNA, 15 bp, Homo sapiens
ataagatctgacggt

SEQ ID NO: 274970 - DNA, 15 bp, Homo sapiens
tataagatctgacgg

SEQ ID NO: 274971 - DNA, 15 bp, Homo sapiens
ttataagatctgacg

SEQ ID NO: 274972 - DNA, 15 bp, Homo sapiens
gttataagatctgac

SEQ ID NO: 274973 - DNA, 15 bp, Homo sapiens
tgttataagatctga

SEQ ID NO: 274974 - DNA, 15 bp, Homo sapiens
ttgttataagatctg

SEQ ID NO: 274975 - DNA, 15 bp, Homo sapiens
gttgttataagatct

SEQ ID NO: 274976 - DNA, 15 bp, Homo sapiens
ggttgttataagatc

SEQ ID NO: 274977 - DNA, 15 bp, Homo sapiens
gggttgttataagat

SEQ ID NO: 274978 - DNA, 15 bp, Homo sapiens
agggttgttataaga

SEQ ID NO: 274979 - DNA, 15 bp, Homo sapiens
aagggttgttataag

SEQ ID NO: 274980 - DNA, 15 bp, Homo sapiens
aaagggttgttataa

SEQ ID NO: 274981 - DNA, 15 bp, Homo sapiens
aaaagggttgttata

SEQ ID NO: 274982 - DNA, 15 bp, Homo sapiens
aaaaagggttgttat

SEQ ID NO: 274983 - DNA, 15 bp, Homo sapiens
aaaaaagggttgtta

SEQ ID NO: 274984 - DNA, 15 bp, Homo sapiens
gaaaaaagggttgtt

SEQ ID NO: 274985 - DNA, 15 bp, Homo sapiens
agaaaaaagggttgt

SEQ ID NO: 274986 - DNA, 15 bp, Homo sapiens
gagaaaaaagggttg

SEQ ID NO: 274987 - DNA, 15 bp, Homo sapiens
ggagaaaaaagggtt

SEQ ID NO: 274988 - DNA, 15 bp, Homo sapiens
tggagaaaaaagggt

SEQ ID NO: 274989 - DNA, 15 bp, Homo sapiens
gtggagaaaaaaggg

SEQ ID NO: 274990 - DNA, 15 bp, Homo sapiens
tgtggagaaaaaagg

SEQ ID NO: 274991 - DNA, 15 bp, Homo sapiens
ctgtggagaaaaaag

SEQ ID NO: 274992 - DNA, 15 bp, Homo sapiens
cctgtggagaaaaaa

SEQ ID NO: 274993 - DNA, 15 bp, Homo sapiens
ccctgtggagaaaaa

SEQ ID NO: 274994 - DNA, 15 bp, Homo sapiens
accctgtggagaaaa

SEQ ID NO: 274995 - DNA, 15 bp, Homo sapiens
aaccctgtggagaaa

SEQ ID NO: 274996 - DNA, 15 bp, Homo sapiens
aaaccctgtggagaa

SEQ ID NO: 274997 - DNA, 15 bp, Homo sapiens
gaaaccctgtggaga

SEQ ID NO: 274998 - DNA, 15 bp, Homo sapiens
ggaaaccctgtggag

SEQ ID NO: 274999 - DNA, 15 bp, Homo sapiens
aggaaaccctgtgga

SEQ ID NO: 275000 - DNA, 15 bp, Homo sapiens
aaggaaaccctgtgg

SEQ ID NO: 275001 - DNA, 15 bp, Homo sapiens
caaggaaaccctgtg

SEQ ID NO: 275002 - DNA, 15 bp, Homo sapiens
tcaaggaaaccctgt

SEQ ID NO: 275003 - DNA, 15 bp, Homo sapiens
ttcaaggaaaccctg

SEQ ID NO: 275004 - DNA, 15 bp, Homo sapiens
attcaaggaaaccct

SEQ ID NO: 275005 - DNA, 15 bp, Homo sapiens
aattcaaggaaaccc

SEQ ID NO: 275006 - DNA, 15 bp, Homo sapiens
gaattcaaggaaacc

SEQ ID NO: 275007 - DNA, 15 bp, Homo sapiens
agaattcaaggaaac

SEQ ID NO: 275008 - DNA, 15 bp, Homo sapiens
aagaattcaaggaaa

SEQ ID NO: 275009 - DNA, 15 bp, Homo sapiens
aaagaattcaaggaa

SEQ ID NO: 275010 - DNA, 15 bp, Homo sapiens
aaaagaattcaagga

SEQ ID NO: 275011 - DNA, 15 bp, Homo sapiens
aaaaagaattcaagg

SEQ ID NO: 275012 - DNA, 15 bp, Homo sapiens
gaaaaagaattcaag

SEQ ID NO: 275013 - DNA, 15 bp, Homo sapiens
agaaaaagaattcaa

SEQ ID NO: 275014 - DNA, 15 bp, Homo sapiens
aagaaaaagaattca

SEQ ID NO: 275015 - DNA, 15 bp, Homo sapiens
aaagaaaaagaattc

SEQ ID NO: 275016 - DNA, 15 bp, Homo sapiens
aaaagaaaaagaatt

SEQ ID NO: 275017 - DNA, 15 bp, Homo sapiens
gaaaagaaaaagaat

SEQ ID NO: 275018 - DNA, 15 bp, Homo sapiens
tgaaaagaaaaagaa

SEQ ID NO: 275019 - DNA, 15 bp, Homo sapiens
atgaaaagaaaaaga

SEQ ID NO: 275020 - DNA, 15 bp, Homo sapiens
catgaaaagaaaaag

SEQ ID NO: 275021 - DNA, 15 bp, Homo sapiens
tcatgaaaagaaaaa

SEQ ID NO: 275022 - DNA, 15 bp, Homo sapiens
ttcatgaaaagaaaa

SEQ ID NO: 275023 - DNA, 15 bp, Homo sapiens
attcatgaaaagaaa

SEQ ID NO: 275024 - DNA, 15 bp, Homo sapiens
tattcatgaaaagaa

SEQ ID NO: 275025 - DNA, 15 bp, Homo sapiens
gtattcatgaaaaga

SEQ ID NO: 275026 - DNA, 15 bp, Homo sapiens
ggtattcatgaaaag

SEQ ID NO: 275027 - DNA, 15 bp, Homo sapiens
aggtattcatgaaaa

SEQ ID NO: 275028 - DNA, 15 bp, Homo sapiens
aaggtattcatgaaa

SEQ ID NO: 275029 - DNA, 15 bp, Homo sapiens
aaaggtattcatgaa

SEQ ID NO: 275030 - DNA, 15 bp, Homo sapiens
aaaaggtattcatga

SEQ ID NO: 275031 - DNA, 15 bp, Homo sapiens
aaaaaggtattcatg

SEQ ID NO: 275032 - DNA, 15 bp, Homo sapiens
gaaaaaggtattcat

SEQ ID NO: 275033 - DNA, 15 bp, Homo sapiens
aagaaaaaggtattc

SEQ ID NO: 275034 - DNA, 15 bp, Homo sapiens
gaagaaaaaggtatt

SEQ ID NO: 275035 - DNA, 15 bp, Homo sapiens
agaagaaaaaggtat

SEQ ID NO: 275036 - DNA, 15 bp, Homo sapiens
cagaagaaaaaggta

SEQ ID NO: 275037 - DNA, 15 bp, Homo sapiens
gcagaagaaaaaggt

SEQ ID NO: 275038 - DNA, 15 bp, Homo sapiens
tgcagaagaaaaagg

SEQ ID NO: 275039 - DNA, 15 bp, Homo sapiens
gtgcagaagaaaaag

SEQ ID NO: 275040 - DNA, 15 bp, Homo sapiens
agtgcagaagaaaaa

SEQ ID NO: 275041 - DNA, 15 bp, Homo sapiens
aagtgcagaagaaaa

SEQ ID NO: 275042 - DNA, 15 bp, Homo sapiens
aaagtgcagaagaaa

SEQ ID NO: 275043 - DNA, 15 bp, Homo sapiens
aaaagtgcagaagaa

SEQ ID NO: 275044 - DNA, 15 bp, Homo sapiens
caaaagtgcagaaga

SEQ ID NO: 275045 - DNA, 15 bp, Homo sapiens
gcaaaagtgcagaag

SEQ ID NO: 275046 - DNA, 15 bp, Homo sapiens
agcaaaagtgcagaa

SEQ ID NO: 275047 - DNA, 15 bp, Homo sapiens
aagcaaaagtgcaga

SEQ ID NO: 275048 - DNA, 15 bp, Homo sapiens
aaagcaaaagtgcag

SEQ ID NO: 275049 - DNA, 15 bp, Homo sapiens
caaagcaaaagtgca

SEQ ID NO: 275050 - DNA, 15 bp, Homo sapiens
gcaaagcaaaagtgc

SEQ ID NO: 275051 - DNA, 15 bp, Homo sapiens
tgcaaagcaaaagtg

SEQ ID NO: 275052 - DNA, 15 bp, Homo sapiens
atgcaaagcaaaagt

SEQ ID NO: 275053 - DNA, 15 bp, Homo sapiens
aatgcaaagcaaaag

SEQ ID NO: 275054 - DNA, 15 bp, Homo sapiens
aaatgcaaagcaaaa

SEQ ID NO: 275055 - DNA, 15 bp, Homo sapiens
caaatgcaaagcaaa

SEQ ID NO: 275056 - DNA, 15 bp, Homo sapiens
ccaaatgcaaagcaa

SEQ ID NO: 275057 - DNA, 15 bp, Homo sapiens
cccaaatgcaaagca

SEQ ID NO: 275058 - DNA, 15 bp, Homo sapiens
tcccaaatgcaaagc

SEQ ID NO: 275059 - DNA, 15 bp, Homo sapiens
ttcccaaatgcaaag

SEQ ID NO: 275060 - DNA, 15 bp, Homo sapiens
cttcccaaatgcaaa

SEQ ID NO: 275061 - DNA, 15 bp, Homo sapiens
gcttcccaaatgcaa

SEQ ID NO: 275062 - DNA, 15 bp, Homo sapiens
ggcttcccaaatgca

SEQ ID NO: 275063 - DNA, 15 bp, Homo sapiens
gggcttcccaaatgc

SEQ ID NO: 275064 - DNA, 15 bp, Homo sapiens
agggcttcccaaatg

SEQ ID NO: 275065 - DNA, 15 bp, Homo sapiens
tagggcttcccaaat

SEQ ID NO: 275066 - DNA, 15 bp, Homo sapiens
atagggcttcccaaa

SEQ ID NO: 275067 - DNA, 15 bp, Homo sapiens
tatagggcttcccaa

SEQ ID NO: 275068 - DNA, 15 bp, Homo sapiens
atatagggcttccca

SEQ ID NO: 275069 - DNA, 15 bp, Homo sapiens
gatatagggcttccc

SEQ ID NO: 275070 - DNA, 15 bp, Homo sapiens
ggatatagggcttcc

SEQ ID NO: 275071 - DNA, 15 bp, Homo sapiens
tggatatagggcttc

SEQ ID NO: 275072 - DNA, 15 bp, Homo sapiens
atggatatagggctt

SEQ ID NO: 275073 - DNA, 15 bp, Homo sapiens
tatggatatagggct

SEQ ID NO: 275074 - DNA, 15 bp, Homo sapiens
atatggatatagggc

SEQ ID NO: 275075 - DNA, 15 bp, Homo sapiens
tatatggatataggg

SEQ ID NO: 275076 - DNA, 15 bp, Homo sapiens
ttatatggatatagg

SEQ ID NO: 275077 - DNA, 15 bp, Homo sapiens
gttatatggatatag

SEQ ID NO: 275078 - DNA, 15 bp, Homo sapiens
agttatatggatata

SEQ ID NO: 275079 - DNA, 15 bp, Homo sapiens
cagttatatggatat

SEQ ID NO: 275080 - DNA, 15 bp, Homo sapiens
gcagttatatggata

SEQ ID NO: 275081 - DNA, 15 bp, Homo sapiens
tgcagttatatggat

SEQ ID NO: 275082 - DNA, 15 bp, Homo sapiens
ctgcagttatatgga

SEQ ID NO: 275083 - DNA, 15 bp, Homo sapiens
tctgcagttatatgg

SEQ ID NO: 275084 - DNA, 15 bp, Homo sapiens
atctgcagttatatg

SEQ ID NO: 275085 - DNA, 15 bp, Homo sapiens
gatctgcagttatat

SEQ ID NO: 275086 - DNA, 15 bp, Homo sapiens
tgatctgcagttata

SEQ ID NO: 275087 - DNA, 15 bp, Homo sapiens
atgatctgcagttat

SEQ ID NO: 275088 - DNA, 15 bp, Homo sapiens
aatgatctgcagtta

SEQ ID NO: 275089 - DNA, 15 bp, Homo sapiens
taatgatctgcagtt

SEQ ID NO: 275090 - DNA, 15 bp, Homo sapiens
ataatgatctgcagt

SEQ ID NO: 275091 - DNA, 15 bp, Homo sapiens
cataatgatctgcag

SEQ ID NO: 275092 - DNA, 15 bp, Homo sapiens
acataatgatctgca

SEQ ID NO: 275093 - DNA, 15 bp, Homo sapiens
tacataatgatctgc

SEQ ID NO: 275094 - DNA, 15 bp, Homo sapiens
ctacataatgatctg

SEQ ID NO: 275095 - DNA, 15 bp, Homo sapiens
actacataatgatct

SEQ ID NO: 275096 - DNA, 15 bp, Homo sapiens
aactacataatgatc

SEQ ID NO: 275097 - DNA, 15 bp, Homo sapiens
taactacataatgat

SEQ ID NO: 275098 - DNA, 15 bp, Homo sapiens
ttaactacataatga

SEQ ID NO: 275099 - DNA, 15 bp, Homo sapiens
attaactacataatg

SEQ ID NO: 275100 - DNA, 15 bp, Homo sapiens
tattaactacataat

SEQ ID NO: 275101 - DNA, 15 bp, Homo sapiens
atattaactacataa

SEQ ID NO: 275102 - DNA, 15 bp, Homo sapiens
aatattaactacata

SEQ ID NO: 275103 - DNA, 15 bp, Homo sapiens
gaatattaactacat

SEQ ID NO: 275104 - DNA, 15 bp, Homo sapiens
tgaatattaactaca

SEQ ID NO: 275105 - DNA, 15 bp, Homo sapiens
ctgaatattaactac

SEQ ID NO: 275106 - DNA, 15 bp, Homo sapiens
actgaatattaacta

SEQ ID NO: 275107 - DNA, 15 bp, Homo sapiens
aactgaatattaact

SEQ ID NO: 275108 - DNA, 15 bp, Homo sapiens
taactgaatattaac

SEQ ID NO: 275109 - DNA, 15 bp, Homo sapiens
ataactgaatattaa

SEQ ID NO: 275110 - DNA, 15 bp, Homo sapiens
aataactgaatatta

SEQ ID NO: 275111 - DNA, 15 bp, Homo sapiens
gaataactgaatatt

SEQ ID NO: 275112 - DNA, 15 bp, Homo sapiens
tgaataactgaatat

SEQ ID NO: 275113 - DNA, 15 bp, Homo sapiens
ctgaataactgaata

SEQ ID NO: 275114 - DNA, 15 bp, Homo sapiens
cctgaataactgaat

SEQ ID NO: 275115 - DNA, 15 bp, Homo sapiens
tcctgaataactgaa

SEQ ID NO: 275116 - DNA, 15 bp, Homo sapiens
ttcctgaataactga

SEQ ID NO: 275117 - DNA, 15 bp, Homo sapiens
tttcctgaataactg

SEQ ID NO: 275118 - DNA, 15 bp, Homo sapiens
ttttcctgaataact

SEQ ID NO: 275119 - DNA, 15 bp, Homo sapiens
cttttcctgaataac

SEQ ID NO: 275120 - DNA, 15 bp, Homo sapiens
tcttttcctgaataa

SEQ ID NO: 275121 - DNA, 15 bp, Homo sapiens
atcttttcctgaata

SEQ ID NO: 275122 - DNA, 15 bp, Homo sapiens
catcttttcctgaat

SEQ ID NO: 275123 - DNA, 15 bp, Homo sapiens
ccatcttttcctgaa

SEQ ID NO: 275124 - DNA, 15 bp, Homo sapiens
cccatcttttcctga

SEQ ID NO: 275125 - DNA, 15 bp, Homo sapiens
acccatcttttcctg

SEQ ID NO: 275126 - DNA, 15 bp, Homo sapiens
gacccatcttttcct

SEQ ID NO: 275127 - DNA, 15 bp, Homo sapiens
tgacccatcttttcc

SEQ ID NO: 275128 - DNA, 15 bp, Homo sapiens
atgacccatcttttc

SEQ ID NO: 275129 - DNA, 15 bp, Homo sapiens
aatgacccatctttt

SEQ ID NO: 275130 - DNA, 15 bp, Homo sapiens
caatgacccatcttt

SEQ ID NO: 275131 - DNA, 15 bp, Homo sapiens
acaatgacccatctt

SEQ ID NO: 275132 - DNA, 15 bp, Homo sapiens
cacaatgacccatct

SEQ ID NO: 275133 - DNA, 15 bp, Homo sapiens
tcacaatgacccatc

SEQ ID NO: 275134 - DNA, 15 bp, Homo sapiens
ttcacaatgacccat

SEQ ID NO: 275135 - DNA, 15 bp, Homo sapiens
attcacaatgaccca

SEQ ID NO: 275136 - DNA, 15 bp, Homo sapiens
gattcacaatgaccc

SEQ ID NO: 275137 - DNA, 15 bp, Homo sapiens
agattcacaatgacc

SEQ ID NO: 275138 - DNA, 15 bp, Homo sapiens
cagattcacaatgac

SEQ ID NO: 275139 - DNA, 15 bp, Homo sapiens
tcagattcacaatga

SEQ ID NO: 275140 - DNA, 15 bp, Homo sapiens
atcagattcacaatg

SEQ ID NO: 275141 - DNA, 15 bp, Homo sapiens
catcagattcacaat

SEQ ID NO: 275142 - DNA, 15 bp, Homo sapiens
ccatcagattcacaa

SEQ ID NO: 275143 - DNA, 15 bp, Homo sapiens
gccatcagattcaca

SEQ ID NO: 275144 - DNA, 15 bp, Homo sapiens
tgccatcagattcac

SEQ ID NO: 275145 - DNA, 15 bp, Homo sapiens
ttgccatcagattca

SEQ ID NO: 275146 - DNA, 15 bp, Homo sapiens
tttgccatcagattc

SEQ ID NO: 275147 - DNA, 15 bp, Homo sapiens
ctttgccatcagatt

SEQ ID NO: 275148 - DNA, 15 bp, Homo sapiens
gctttgccatcagat

SEQ ID NO: 275149 - DNA, 15 bp, Homo sapiens
ggctttgccatcaga

SEQ ID NO: 275150 - DNA, 15 bp, Homo sapiens
aggctttgccatcag

SEQ ID NO: 275151 - DNA, 15 bp, Homo sapiens
caggctttgccatca

SEQ ID NO: 275152 - DNA, 15 bp, Homo sapiens
ccaggctttgccatc

SEQ ID NO: 275153 - DNA, 15 bp, Homo sapiens
accaggctttgccat

SEQ ID NO: 275154 - DNA, 15 bp, Homo sapiens
caccaggctttgcca

SEQ ID NO: 275155 - DNA, 15 bp, Homo sapiens
tcaccaggctttgcc

SEQ ID NO: 275156 - DNA, 15 bp, Homo sapiens
atcaccaggctttgc

SEQ ID NO: 275157 - DNA, 15 bp, Homo sapiens
tatcaccaggctttg

SEQ ID NO: 275158 - DNA, 15 bp, Homo sapiens
ctatcaccaggcttt

SEQ ID NO: 275159 - DNA, 15 bp, Homo sapiens
gctatcaccaggctt

SEQ ID NO: 275160 - DNA, 15 bp, Homo sapiens
tgctatcaccaggct

SEQ ID NO: 275161 - DNA, 15 bp, Homo sapiens
atgctatcaccaggc

SEQ ID NO: 275162 - DNA, 15 bp, Homo sapiens
catgctatcaccagg

SEQ ID NO: 275163 - DNA, 15 bp, Homo sapiens
ccatgctatcaccag

SEQ ID NO: 275164 - DNA, 15 bp, Homo sapiens
cccatgctatcacca

SEQ ID NO: 275165 - DNA, 15 bp, Homo sapiens
ccccatgctatcacc

SEQ ID NO: 275166 - DNA, 15 bp, Homo sapiens
gccccatgctatcac

SEQ ID NO: 275167 - DNA, 15 bp, Homo sapiens
agccccatgctatca

SEQ ID NO: 275168 - DNA, 15 bp, Homo sapiens
cagccccatgctatc

SEQ ID NO: 275169 - DNA, 15 bp, Homo sapiens
ccagccccatgctat

SEQ ID NO: 275170 - DNA, 15 bp, Homo sapiens
gccagccccatgcta

SEQ ID NO: 275171 - DNA, 15 bp, Homo sapiens
tgccagccccatgct

SEQ ID NO: 275172 - DNA, 15 bp, Homo sapiens
gtgccagccccatgc

SEQ ID NO: 275173 - DNA, 15 bp, Homo sapiens
ggtgccagccccatg

SEQ ID NO: 275174 - DNA, 15 bp, Homo sapiens
aggtgccagccccat

SEQ ID NO: 275175 - DNA, 15 bp, Homo sapiens
aaggtgccagcccca

SEQ ID NO: 275176 - DNA, 15 bp, Homo sapiens
caaggtgccagcccc

SEQ ID NO: 275177 - DNA, 15 bp, Homo sapiens
acaaggtgccagccc

SEQ ID NO: 275178 - DNA, 15 bp, Homo sapiens
aacaaggtgccagcc

SEQ ID NO: 275179 - DNA, 15 bp, Homo sapiens
caacaaggtgccagc

SEQ ID NO: 275180 - DNA, 15 bp, Homo sapiens
gcaacaaggtgccag

SEQ ID NO: 275181 - DNA, 15 bp, Homo sapiens
tgcaacaaggtgcca

SEQ ID NO: 275182 - DNA, 15 bp, Homo sapiens
ctgcaacaaggtgcc

SEQ ID NO: 275183 - DNA, 15 bp, Homo sapiens
cctgcaacaaggtgc

SEQ ID NO: 275184 - DNA, 15 bp, Homo sapiens
acctgcaacaaggtg

SEQ ID NO: 275185 - DNA, 15 bp, Homo sapiens
aacctgcaacaaggt

SEQ ID NO: 275186 - DNA, 15 bp, Homo sapiens
caacctgcaacaagg

SEQ ID NO: 275187 - DNA, 15 bp, Homo sapiens
acaacctgcaacaag

SEQ ID NO: 275188 - DNA, 15 bp, Homo sapiens
aacaacctgcaacaa

SEQ ID NO: 275189 - DNA, 15 bp, Homo sapiens
aaacaacctgcaaca

SEQ ID NO: 275190 - DNA, 15 bp, Homo sapiens
caaacaacctgcaac

SEQ ID NO: 275191 - DNA, 15 bp, Homo sapiens
acaaacaacctgcaa

SEQ ID NO: 275192 - DNA, 15 bp, Homo sapiens
aacaaacaacctgca

SEQ ID NO: 275193 - DNA, 15 bp, Homo sapiens
aaacaaacaacctgc

SEQ ID NO: 275194 - DNA, 15 bp, Homo sapiens
aaaacaaacaacctg

SEQ ID NO: 275195 - DNA, 15 bp, Homo sapiens
caaaacaaacaacct

SEQ ID NO: 275196 - DNA, 15 bp, Homo sapiens
acaaaacaaacaacc

SEQ ID NO: 275197 - DNA, 15 bp, Homo sapiens
gacaaaacaaacaac

SEQ ID NO: 275198 - DNA, 15 bp, Homo sapiens
tgacaaaacaaacaa

SEQ ID NO: 275199 - DNA, 15 bp, Homo sapiens
ctgacaaaacaaaca

SEQ ID NO: 275200 - DNA, 15 bp, Homo sapiens
actgacaaaacaaac

SEQ ID NO: 275201 - DNA, 15 bp, Homo sapiens
cactgacaaaacaaa

SEQ ID NO: 275202 - DNA, 15 bp, Homo sapiens
acactgacaaaacaa

SEQ ID NO: 275203 - DNA, 15 bp, Homo sapiens
tacactgacaaaaca

SEQ ID NO: 275204 - DNA, 15 bp, Homo sapiens
ttacactgacaaaac

SEQ ID NO: 275205 - DNA, 15 bp, Homo sapiens
tttacactgacaaaa

SEQ ID NO: 275206 - DNA, 15 bp, Homo sapiens
ttttacactgacaaa

SEQ ID NO: 275207 - DNA, 15 bp, Homo sapiens
tttttacactgacaa

SEQ ID NO: 275208 - DNA, 15 bp, Homo sapiens
gtttttacactgaca

SEQ ID NO: 275209 - DNA, 15 bp, Homo sapiens
agtttttacactgac

SEQ ID NO: 275210 - DNA, 15 bp, Homo sapiens
cagtttttacactga

SEQ ID NO: 275211 - DNA, 15 bp, Homo sapiens
tcagtttttacactg

SEQ ID NO: 275212 - DNA, 15 bp, Homo sapiens
atcagtttttacact

SEQ ID NO: 275213 - DNA, 15 bp, Homo sapiens
catcagtttttacac

SEQ ID NO: 275214 - DNA, 15 bp, Homo sapiens
tcatcagtttttaca

SEQ ID NO: 275215 - DNA, 15 bp, Homo sapiens
ttcatcagtttttac

SEQ ID NO: 275216 - DNA, 15 bp, Homo sapiens
attcatcagttttta

SEQ ID NO: 275217 - DNA, 15 bp, Homo sapiens
aattcatcagttttt

SEQ ID NO: 275218 - DNA, 15 bp, Homo sapiens
aaattcatcagtttt

SEQ ID NO: 275219 - DNA, 15 bp, Homo sapiens
aaaattcatcagttt

SEQ ID NO: 275220 - DNA, 15 bp, Homo sapiens
taaaattcatcagtt

SEQ ID NO: 275221 - DNA, 15 bp, Homo sapiens
ttaaaattcatcagt

SEQ ID NO: 275222 - DNA, 15 bp, Homo sapiens
tttaaaattcatcag

SEQ ID NO: 275223 - DNA, 15 bp, Homo sapiens
atttaaaattcatca

SEQ ID NO: 275224 - DNA, 15 bp, Homo sapiens
catttaaaattcatc

SEQ ID NO: 275225 - DNA, 15 bp, Homo sapiens
tcatttaaaattcat

SEQ ID NO: 275226 - DNA, 15 bp, Homo sapiens
atcatttaaaattca

SEQ ID NO: 275227 - DNA, 15 bp, Homo sapiens
tatcatttaaaattc

SEQ ID NO: 275228 - DNA, 15 bp, Homo sapiens
ttatcatttaaaatt

SEQ ID NO: 275229 - DNA, 15 bp, Homo sapiens
cttatcatttaaaat

SEQ ID NO: 275230 - DNA, 15 bp, Homo sapiens
acttatcatttaaaa

SEQ ID NO: 275231 - DNA, 15 bp, Homo sapiens
tacttatcatttaaa

SEQ ID NO: 275232 - DNA, 15 bp, Homo sapiens
ctacttatcatttaa

SEQ ID NO: 275233 - DNA, 15 bp, Homo sapiens
gctacttatcattta

SEQ ID NO: 275234 - DNA, 15 bp, Homo sapiens
agctacttatcattt

SEQ ID NO: 275235 - DNA, 15 bp, Homo sapiens
cagctacttatcatt

SEQ ID NO: 275236 - DNA, 15 bp, Homo sapiens
gcagctacttatcat

SEQ ID NO: 275237 - DNA, 15 bp, Homo sapiens
cgcagctacttatca

SEQ ID NO: 275238 - DNA, 15 bp, Homo sapiens
ccgcagctacttatc

SEQ ID NO: 275239 - DNA, 15 bp, Homo sapiens
gccgcagctacttat

SEQ ID NO: 275240 - DNA, 15 bp, Homo sapiens
agccgcagctactta

SEQ ID NO: 275241 - DNA, 15 bp, Homo sapiens
aagccgcagctactt

SEQ ID NO: 275242 - DNA, 15 bp, Homo sapiens
taagccgcagctact

SEQ ID NO: 275243 - DNA, 15 bp, Homo sapiens
ttaagccgcagctac

SEQ ID NO: 275244 - DNA, 15 bp, Homo sapiens
attaagccgcagcta

SEQ ID NO: 275245 - DNA, 15 bp, Homo sapiens
gattaagccgcagct

SEQ ID NO: 275246 - DNA, 15 bp, Homo sapiens
tgattaagccgcagc

SEQ ID NO: 275247 - DNA, 15 bp, Homo sapiens
atgattaagccgcag

SEQ ID NO: 275248 - DNA, 15 bp, Homo sapiens
catgattaagccgca

SEQ ID NO: 275249 - DNA, 15 bp, Homo sapiens
acatgattaagccgc

SEQ ID NO: 275250 - DNA, 15 bp, Homo sapiens
gacatgattaagccg

SEQ ID NO: 275251 - DNA, 15 bp, Homo sapiens
agacatgattaagcc

SEQ ID NO: 275252 - DNA, 15 bp, Homo sapiens
gagacatgattaagc

SEQ ID NO: 275253 - DNA, 15 bp, Homo sapiens
tgagacatgattaag

SEQ ID NO: 275254 - DNA, 15 bp, Homo sapiens
atgagacatgattaa

SEQ ID NO: 275255 - DNA, 15 bp, Homo sapiens
gatgagacatgatta

SEQ ID NO: 275256 - DNA, 15 bp, Homo sapiens
agatgagacatgatt

SEQ ID NO: 275257 - DNA, 15 bp, Homo sapiens
gagatgagacatgat

SEQ ID NO: 275258 - DNA, 15 bp, Homo sapiens
agagatgagacatga

SEQ ID NO: 275259 - DNA, 15 bp, Homo sapiens
cagagatgagacatg

SEQ ID NO: 275260 - DNA, 15 bp, Homo sapiens
gcagagatgagacat

SEQ ID NO: 275261 - DNA, 15 bp, Homo sapiens
agcagagatgagaca

SEQ ID NO: 275262 - DNA, 15 bp, Homo sapiens
aagcagagatgagac

SEQ ID NO: 275263 - DNA, 15 bp, Homo sapiens
aaagcagagatgaga

SEQ ID NO: 275264 - DNA, 15 bp, Homo sapiens
caaagcagagatgag

SEQ ID NO: 275265 - DNA, 15 bp, Homo sapiens
gcaaagcagagatga

SEQ ID NO: 275266 - DNA, 15 bp, Homo sapiens
tgcaaagcagagatg

SEQ ID NO: 275267 - DNA, 15 bp, Homo sapiens
ttgcaaagcagagat

SEQ ID NO: 275268 - DNA, 15 bp, Homo sapiens
cttgcaaagcagaga

SEQ ID NO: 275269 - DNA, 15 bp, Homo sapiens
gcttgcaaagcagag

SEQ ID NO: 275270 - DNA, 15 bp, Homo sapiens
ggcttgcaaagcaga

SEQ ID NO: 275271 - DNA, 15 bp, Homo sapiens
tggcttgcaaagcag

SEQ ID NO: 275272 - DNA, 15 bp, Homo sapiens
ttggcttgcaaagca

SEQ ID NO: 275273 - DNA, 15 bp, Homo sapiens
cttggcttgcaaagc

SEQ ID NO: 275274 - DNA, 15 bp, Homo sapiens
tcttggcttgcaaag

SEQ ID NO: 275275 - DNA, 15 bp, Homo sapiens
ctcttggcttgcaaa

SEQ ID NO: 275276 - DNA, 15 bp, Homo sapiens
tctcttggcttgcaa

SEQ ID NO: 275277 - DNA, 15 bp, Homo sapiens
ttctcttggcttgca

SEQ ID NO: 275278 - DNA, 15 bp, Homo sapiens
attctcttggcttgc

SEQ ID NO: 275279 - DNA, 15 bp, Homo sapiens
gattctcttggcttg

SEQ ID NO: 275280 - DNA, 15 bp, Homo sapiens
tgattctcttggctt

SEQ ID NO: 275281 - DNA, 15 bp, Homo sapiens
ttgattctcttggct

SEQ ID NO: 275282 - DNA, 15 bp, Homo sapiens
tttgattctcttggc

SEQ ID NO: 275283 - DNA, 15 bp, Homo sapiens
ttttgattctcttgg

SEQ ID NO: 275284 - DNA, 15 bp, Homo sapiens
cttttgattctcttg

SEQ ID NO: 275285 - DNA, 15 bp, Homo sapiens
acttttgattctctt

SEQ ID NO: 275286 - DNA, 15 bp, Homo sapiens
aacttttgattctct

SEQ ID NO: 275287 - DNA, 15 bp, Homo sapiens
gaacttttgattctc

SEQ ID NO: 275288 - DNA, 15 bp, Homo sapiens
ggaacttttgattct

SEQ ID NO: 275289 - DNA, 15 bp, Homo sapiens
gggaacttttgattc

SEQ ID NO: 275290 - DNA, 15 bp, Homo sapiens
agggaacttttgatt

SEQ ID NO: 275291 - DNA, 15 bp, Homo sapiens
aagggaacttttgat

SEQ ID NO: 275292 - DNA, 15 bp, Homo sapiens
taagggaacttttga

SEQ ID NO: 275293 - DNA, 15 bp, Homo sapiens
ttaagggaacttttg

SEQ ID NO: 275294 - DNA, 15 bp, Homo sapiens
attaagggaactttt

SEQ ID NO: 275295 - DNA, 15 bp, Homo sapiens
aattaagggaacttt

SEQ ID NO: 275296 - DNA, 15 bp, Homo sapiens
taattaagggaactt

SEQ ID NO: 275297 - DNA, 15 bp, Homo sapiens
ataattaagggaact

SEQ ID NO: 275298 - DNA, 15 bp, Homo sapiens
aataattaagggaac

SEQ ID NO: 275299 - DNA, 15 bp, Homo sapiens
caataattaagggaa

SEQ ID NO: 275300 - DNA, 15 bp, Homo sapiens
tcaataattaaggga

SEQ ID NO: 275301 - DNA, 15 bp, Homo sapiens
gtcaataattaaggg

SEQ ID NO: 275302 - DNA, 15 bp, Homo sapiens
agtcaataattaagg

SEQ ID NO: 275303 - DNA, 15 bp, Homo sapiens
tagtcaataattaag

SEQ ID NO: 275304 - DNA, 15 bp, Homo sapiens
ctagtcaataattaa

SEQ ID NO: 275305 - DNA, 15 bp, Homo sapiens
tctagtcaataatta

SEQ ID NO: 275306 - DNA, 15 bp, Homo sapiens
ttctagtcaataatt

SEQ ID NO: 275307 - DNA, 15 bp, Homo sapiens
cttctagtcaataat

SEQ ID NO: 275308 - DNA, 15 bp, Homo sapiens
gcttctagtcaataa

SEQ ID NO: 275309 - DNA, 15 bp, Homo sapiens
tgcttctagtcaata

SEQ ID NO: 275310 - DNA, 15 bp, Homo sapiens
ctgcttctagtcaat

SEQ ID NO: 275311 - DNA, 15 bp, Homo sapiens
tctgcttctagtcaa

SEQ ID NO: 275312 - DNA, 15 bp, Homo sapiens
gtctgcttctagtca

SEQ ID NO: 275313 - DNA, 15 bp, Homo sapiens
tgtctgcttctagtc

SEQ ID NO: 275314 - DNA, 15 bp, Homo sapiens
atgtctgcttctagt

SEQ ID NO: 275315 - DNA, 15 bp, Homo sapiens
catgtctgcttctag

SEQ ID NO: 275316 - DNA, 15 bp, Homo sapiens
acatgtctgcttcta

SEQ ID NO: 275317 - DNA, 15 bp, Homo sapiens
aacatgtctgcttct

SEQ ID NO: 275318 - DNA, 15 bp, Homo sapiens
aaacatgtctgcttc

SEQ ID NO: 275319 - DNA, 15 bp, Homo sapiens
aaaacatgtctgctt

SEQ ID NO: 275320 - DNA, 15 bp, Homo sapiens
caaaacatgtctgct

SEQ ID NO: 275321 - DNA, 15 bp, Homo sapiens
tcaaaacatgtctgc

SEQ ID NO: 275322 - DNA, 15 bp, Homo sapiens
atcaaaacatgtctg

SEQ ID NO: 275323 - DNA, 15 bp, Homo sapiens
tatcaaaacatgtct

SEQ ID NO: 275324 - DNA, 15 bp, Homo sapiens
ctatcaaaacatgtc

SEQ ID NO: 275325 - DNA, 15 bp, Homo sapiens
tctatcaaaacatgt

SEQ ID NO: 275326 - DNA, 15 bp, Homo sapiens
ttctatcaaaacatg

SEQ ID NO: 275327 - DNA, 15 bp, Homo sapiens
cttctatcaaaacat

SEQ ID NO: 275328 - DNA, 15 bp, Homo sapiens
ccttctatcaaaaca

SEQ ID NO: 275329 - DNA, 15 bp, Homo sapiens
cccttctatcaaaac

SEQ ID NO: 275330 - DNA, 15 bp, Homo sapiens
ccccttctatcaaaa

SEQ ID NO: 275331 - DNA, 15 bp, Homo sapiens
tccccttctatcaaa

SEQ ID NO: 275332 - DNA, 15 bp, Homo sapiens
ttccccttctatcaa

SEQ ID NO: 275333 - DNA, 15 bp, Homo sapiens
attccccttctatca

SEQ ID NO: 275334 - DNA, 15 bp, Homo sapiens
cattccccttctatc

SEQ ID NO: 275335 - DNA, 15 bp, Homo sapiens
ccattccccttctat

SEQ ID NO: 275336 - DNA, 15 bp, Homo sapiens
tccattccccttcta

SEQ ID NO: 275337 - DNA, 15 bp, Homo sapiens
atccattccccttct

SEQ ID NO: 275338 - DNA, 15 bp, Homo sapiens
tatccattccccttc

SEQ ID NO: 275339 - DNA, 15 bp, Homo sapiens
ctatccattcccctt

SEQ ID NO: 275340 - DNA, 15 bp, Homo sapiens
tctatccattcccct

SEQ ID NO: 275341 - DNA, 15 bp, Homo sapiens
ttctatccattcccc

SEQ ID NO: 275342 - DNA, 15 bp, Homo sapiens
tttctatccattccc

SEQ ID NO: 275343 - DNA, 15 bp, Homo sapiens
ctttctatccattcc

SEQ ID NO: 275344 - DNA, 15 bp, Homo sapiens
actttctatccattc

SEQ ID NO: 275345 - DNA, 15 bp, Homo sapiens
cactttctatccatt

SEQ ID NO: 275346 - DNA, 15 bp, Homo sapiens
ccactttctatccat

SEQ ID NO: 275347 - DNA, 15 bp, Homo sapiens
gccactttctatcca

SEQ ID NO: 275348 - DNA, 15 bp, Homo sapiens
tgccactttctatcc

SEQ ID NO: 275349 - DNA, 15 bp, Homo sapiens
ttgccactttctatc

SEQ ID NO: 275350 - DNA, 15 bp, Homo sapiens
tttgccactttctat

SEQ ID NO: 275351 - DNA, 15 bp, Homo sapiens
ttttgccactttcta

SEQ ID NO: 275352 - DNA, 15 bp, Homo sapiens
gttttgccactttct

SEQ ID NO: 275353 - DNA, 15 bp, Homo sapiens
agttttgccactttc

SEQ ID NO: 275354 - DNA, 15 bp, Homo sapiens
tagttttgccacttt

SEQ ID NO: 275355 - DNA, 15 bp, Homo sapiens
atagttttgccactt

SEQ ID NO: 275356 - DNA, 15 bp, Homo sapiens
tatagttttgccact

SEQ ID NO: 275357 - DNA, 15 bp, Homo sapiens
atatagttttgccac

SEQ ID NO: 275358 - DNA, 15 bp, Homo sapiens
tatatagttttgcca

SEQ ID NO: 275359 - DNA, 15 bp, Homo sapiens
ttatatagttttgcc

SEQ ID NO: 275360 - DNA, 15 bp, Homo sapiens
cttatatagttttgc

SEQ ID NO: 275361 - DNA, 15 bp, Homo sapiens
ccttatatagttttg

SEQ ID NO: 275362 - DNA, 15 bp, Homo sapiens
cccttatatagtttt

SEQ ID NO: 275363 - DNA, 15 bp, Homo sapiens
acccttatatagttt

SEQ ID NO: 275364 - DNA, 15 bp, Homo sapiens
aacccttatatagtt

SEQ ID NO: 275365 - DNA, 15 bp, Homo sapiens
taacccttatatagt

SEQ ID NO: 275366 - DNA, 15 bp, Homo sapiens
ttaacccttatatag

SEQ ID NO: 275367 - DNA, 15 bp, Homo sapiens
gttaacccttatata

SEQ ID NO: 275368 - DNA, 15 bp, Homo sapiens
agttaacccttatat

SEQ ID NO: 275369 - DNA, 15 bp, Homo sapiens
gagttaacccttata

SEQ ID NO: 275370 - DNA, 15 bp, Homo sapiens
tgagttaacccttat

SEQ ID NO: 275371 - DNA, 15 bp, Homo sapiens
ctgagttaaccctta

SEQ ID NO: 275372 - DNA, 15 bp, Homo sapiens
tctgagttaaccctt

SEQ ID NO: 275373 - DNA, 15 bp, Homo sapiens
ttctgagttaaccct

SEQ ID NO: 275374 - DNA, 15 bp, Homo sapiens
gttctgagttaaccc

SEQ ID NO: 275375 - DNA, 15 bp, Homo sapiens
agttctgagttaacc

SEQ ID NO: 275376 - DNA, 15 bp, Homo sapiens
aagttctgagttaac

SEQ ID NO: 275377 - DNA, 15 bp, Homo sapiens
taagttctgagttaa

SEQ ID NO: 275378 - DNA, 15 bp, Homo sapiens
ctaagttctgagtta

SEQ ID NO: 275379 - DNA, 15 bp, Homo sapiens
actaagttctgagtt

SEQ ID NO: 275380 - DNA, 15 bp, Homo sapiens
aactaagttctgagt

SEQ ID NO: 275381 - DNA, 15 bp, Homo sapiens
caactaagttctgag

SEQ ID NO: 275382 - DNA, 15 bp, Homo sapiens
acaactaagttctga

SEQ ID NO: 275383 - DNA, 15 bp, Homo sapiens
aacaactaagttctg

SEQ ID NO: 275384 - DNA, 15 bp, Homo sapiens
aaacaactaagttct

SEQ ID NO: 275385 - DNA, 15 bp, Homo sapiens
aaaacaactaagttc

SEQ ID NO: 275386 - DNA, 15 bp, Homo sapiens
gaaaacaactaagtt

SEQ ID NO: 275387 - DNA, 15 bp, Homo sapiens
tgaaaacaactaagt

SEQ ID NO: 275388 - DNA, 15 bp, Homo sapiens
ttgaaaacaactaag

SEQ ID NO: 275389 - DNA, 15 bp, Homo sapiens
tttgaaaacaactaa

SEQ ID NO: 275390 - DNA, 15 bp, Homo sapiens
ttttgaaaacaacta

SEQ ID NO: 275391 - DNA, 15 bp, Homo sapiens
tttttgaaaacaact

SEQ ID NO: 275392 - DNA, 15 bp, Homo sapiens
atttttgaaaacaac

SEQ ID NO: 275393 - DNA, 15 bp, Homo sapiens
tatttttgaaaacaa

SEQ ID NO: 275394 - DNA, 15 bp, Homo sapiens
ctatttttgaaaaca

SEQ ID NO: 275395 - DNA, 15 bp, Homo sapiens
actatttttgaaaac

SEQ ID NO: 275396 - DNA, 15 bp, Homo sapiens
aactatttttgaaaa

SEQ ID NO: 275397 - DNA, 15 bp, Homo sapiens
aaactatttttgaaa

SEQ ID NO: 275398 - DNA, 15 bp, Homo sapiens
caaactatttttgaa

SEQ ID NO: 275399 - DNA, 15 bp, Homo sapiens
ccaaactatttttga

SEQ ID NO: 275400 - DNA, 15 bp, Homo sapiens
accaaactatttttg

SEQ ID NO: 275401 - DNA, 15 bp, Homo sapiens
aaccaaactattttt

SEQ ID NO: 275402 - DNA, 15 bp, Homo sapiens
aaaccaaactatttt

SEQ ID NO: 275403 - DNA, 15 bp, Homo sapiens
aaaaccaaactattt

SEQ ID NO: 275404 - DNA, 15 bp, Homo sapiens
aaaaaccaaactatt

SEQ ID NO: 275405 - DNA, 15 bp, Homo sapiens
caaaaaccaaactat

SEQ ID NO: 275406 - DNA, 15 bp, Homo sapiens
acaaaaaccaaacta

SEQ ID NO: 275407 - DNA, 15 bp, Homo sapiens
aacaaaaaccaaact

SEQ ID NO: 275408 - DNA, 15 bp, Homo sapiens
aaacaaaaaccaaac

SEQ ID NO: 275409 - DNA, 15 bp, Homo sapiens
caaaaacaaaaacca

SEQ ID NO: 275410 - DNA, 15 bp, Homo sapiens
acaaaaacaaaaacc

SEQ ID NO: 275411 - DNA, 15 bp, Homo sapiens
aaaaaaacaaaaaca

SEQ ID NO: 275412 - DNA, 15 bp, Homo sapiens
gaaaaaaacaaaaac

SEQ ID NO: 275413 - DNA, 15 bp, Homo sapiens
tgaaaaaaacaaaaa

SEQ ID NO: 275414 - DNA, 15 bp, Homo sapiens
ttgaaaaaaacaaaa

SEQ ID NO: 275415 - DNA, 15 bp, Homo sapiens
attgaaaaaaacaaa

SEQ ID NO: 275416 - DNA, 15 bp, Homo sapiens
aattgaaaaaaacaa

SEQ ID NO: 275417 - DNA, 15 bp, Homo sapiens
aaattgaaaaaaaca

SEQ ID NO: 275418 - DNA, 15 bp, Homo sapiens
aaaattgaaaaaaac

SEQ ID NO: 275419 - DNA, 15 bp, Homo sapiens
aaaaattgaaaaaaa

SEQ ID NO: 275420 - DNA, 15 bp, Homo sapiens
caaaaattgaaaaaa

SEQ ID NO: 275421 - DNA, 15 bp, Homo sapiens
ccaaaaattgaaaaa

SEQ ID NO: 275422 - DNA, 15 bp, Homo sapiens
accaaaaattgaaaa

SEQ ID NO: 275423 - DNA, 15 bp, Homo sapiens
aaccaaaaattgaaa

SEQ ID NO: 275424 - DNA, 15 bp, Homo sapiens
caaccaaaaattgaa

SEQ ID NO: 275425 - DNA, 15 bp, Homo sapiens
ccaaccaaaaattga

SEQ ID NO: 275426 - DNA, 15 bp, Homo sapiens
cccaaccaaaaattg

SEQ ID NO: 275427 - DNA, 15 bp, Homo sapiens
acccaaccaaaaatt

SEQ ID NO: 275428 - DNA, 15 bp, Homo sapiens
cacccaaccaaaaat

SEQ ID NO: 275429 - DNA, 15 bp, Homo sapiens
gcacccaaccaaaaa

SEQ ID NO: 275430 - DNA, 15 bp, Homo sapiens
tgcacccaaccaaaa

SEQ ID NO: 275431 - DNA, 15 bp, Homo sapiens
ctgcacccaaccaaa

SEQ ID NO: 275432 - DNA, 15 bp, Homo sapiens
actgcacccaaccaa

SEQ ID NO: 275433 - DNA, 15 bp, Homo sapiens
cactgcacccaacca

SEQ ID NO: 275434 - DNA, 15 bp, Homo sapiens
ccactgcacccaacc

SEQ ID NO: 275435 - DNA, 15 bp, Homo sapiens
gccactgcacccaac

SEQ ID NO: 275436 - DNA, 15 bp, Homo sapiens
agccactgcacccaa

SEQ ID NO: 275437 - DNA, 15 bp, Homo sapiens
tgtgagccactgcac

SEQ ID NO: 275438 - DNA, 15 bp, Homo sapiens
gtgtgagccactgca

SEQ ID NO: 275439 - DNA, 15 bp, Homo sapiens
attcccaaagtgctg

SEQ ID NO: 275440 - DNA, 15 bp, Homo sapiens
gattcccaaagtgct

SEQ ID NO: 275441 - DNA, 15 bp, Homo sapiens
agattcccaaagtgc

SEQ ID NO: 275442 - DNA, 15 bp, Homo sapiens
cagattcccaaagtg

SEQ ID NO: 275443 - DNA, 15 bp, Homo sapiens
tcagattcccaaagt

SEQ ID NO: 275444 - DNA, 15 bp, Homo sapiens
ctcagattcccaaag

SEQ ID NO: 275445 - DNA, 15 bp, Homo sapiens
cctcagattcccaaa

SEQ ID NO: 275446 - DNA, 15 bp, Homo sapiens
gcctcagattcccaa

SEQ ID NO: 275447 - DNA, 15 bp, Homo sapiens
tgcctcagattccca

SEQ ID NO: 275448 - DNA, 15 bp, Homo sapiens
ctgcctcagattccc

SEQ ID NO: 275449 - DNA, 15 bp, Homo sapiens
cctgcctcagattcc

SEQ ID NO: 275450 - DNA, 15 bp, Homo sapiens
acctgcctcagattc

SEQ ID NO: 275451 - DNA, 15 bp, Homo sapiens
cacctgcctcagatt

SEQ ID NO: 275452 - DNA, 15 bp, Homo sapiens
tcacctgcctcagat

SEQ ID NO: 275453 - DNA, 15 bp, Homo sapiens
ttcacctgcctcaga

SEQ ID NO: 275454 - DNA, 15 bp, Homo sapiens
tgattcacctgcctc

SEQ ID NO: 275455 - DNA, 15 bp, Homo sapiens
gtgattcacctgcct

SEQ ID NO: 275456 - DNA, 15 bp, Homo sapiens
agtgattcacctgcc

SEQ ID NO: 275457 - DNA, 15 bp, Homo sapiens
aagtgattcacctgc

SEQ ID NO: 275458 - DNA, 15 bp, Homo sapiens
caagtgattcacctg

SEQ ID NO: 275459 - DNA, 15 bp, Homo sapiens
tcaagtgattcacct

SEQ ID NO: 275460 - DNA, 15 bp, Homo sapiens
ctcaagtgattcacc

SEQ ID NO: 275461 - DNA, 15 bp, Homo sapiens
cctcaagtgattcac

SEQ ID NO: 275462 - DNA, 15 bp, Homo sapiens
acctcaagtgattca

SEQ ID NO: 275463 - DNA, 15 bp, Homo sapiens
gacctcaagtgattc

SEQ ID NO: 275464 - DNA, 15 bp, Homo sapiens
tgacctcaagtgatt

SEQ ID NO: 275465 - DNA, 15 bp, Homo sapiens
tagacggggtttcac

SEQ ID NO: 275466 - DNA, 15 bp, Homo sapiens
gtagacggggtttca

SEQ ID NO: 275467 - DNA, 15 bp, Homo sapiens
agtagacggggtttc

SEQ ID NO: 275468 - DNA, 15 bp, Homo sapiens
tagtagacggggttt

SEQ ID NO: 275469 - DNA, 15 bp, Homo sapiens
ttagtagacggggtt

SEQ ID NO: 275470 - DNA, 15 bp, Homo sapiens
tttagtagacggggt

SEQ ID NO: 275471 - DNA, 15 bp, Homo sapiens
ttttagtagacgggg

SEQ ID NO: 275472 - DNA, 15 bp, Homo sapiens
tttttagtagacggg

SEQ ID NO: 275473 - DNA, 15 bp, Homo sapiens
atttttagtagacgg

SEQ ID NO: 275474 - DNA, 15 bp, Homo sapiens
tatttttagtagacg

SEQ ID NO: 275475 - DNA, 15 bp, Homo sapiens
gtatttttagtagac

SEQ ID NO: 275476 - DNA, 15 bp, Homo sapiens
cgcaccaccacaccc

SEQ ID NO: 275477 - DNA, 15 bp, Homo sapiens
gcgcaccaccacacc

SEQ ID NO: 275478 - DNA, 15 bp, Homo sapiens
tgcgcaccaccacac

SEQ ID NO: 275479 - DNA, 15 bp, Homo sapiens
gtgcgcaccaccaca

SEQ ID NO: 275480 - DNA, 15 bp, Homo sapiens
gtgcctcagcctcct

SEQ ID NO: 275481 - DNA, 15 bp, Homo sapiens
cgattctcgtgcctc

SEQ ID NO: 275482 - DNA, 15 bp, Homo sapiens
ccgattctcgtgcct

SEQ ID NO: 275483 - DNA, 15 bp, Homo sapiens
gccgattctcgtgcc

SEQ ID NO: 275484 - DNA, 15 bp, Homo sapiens
agccgattctcgtgc

SEQ ID NO: 275485 - DNA, 15 bp, Homo sapiens
cagccgattctcgtg

SEQ ID NO: 275486 - DNA, 15 bp, Homo sapiens
tcagccgattctcgt

SEQ ID NO: 275487 - DNA, 15 bp, Homo sapiens
ttcagccgattctcg

SEQ ID NO: 275488 - DNA, 15 bp, Homo sapiens
gttcagccgattctc

SEQ ID NO: 275489 - DNA, 15 bp, Homo sapiens
agttcagccgattct

SEQ ID NO: 275490 - DNA, 15 bp, Homo sapiens
aagttcagccgattc

SEQ ID NO: 275491 - DNA, 15 bp, Homo sapiens
caagttcagccgatt

SEQ ID NO: 275492 - DNA, 15 bp, Homo sapiens
ccaagttcagccgat

SEQ ID NO: 275493 - DNA, 15 bp, Homo sapiens
cccaagttcagccga

SEQ ID NO: 275494 - DNA, 15 bp, Homo sapiens
tcccaagttcagccg

SEQ ID NO: 275495 - DNA, 15 bp, Homo sapiens
ctcccaagttcagcc

SEQ ID NO: 275496 - DNA, 15 bp, Homo sapiens
cctcccaagttcagc

SEQ ID NO: 275497 - DNA, 15 bp, Homo sapiens
gcctcccaagttcag

SEQ ID NO: 275498 - DNA, 15 bp, Homo sapiens
tgcctcccaagttca

SEQ ID NO: 275499 - DNA, 15 bp, Homo sapiens
ctgcctcccaagttc

SEQ ID NO: 275500 - DNA, 15 bp, Homo sapiens
tctgcctcccaagtt

SEQ ID NO: 275501 - DNA, 15 bp, Homo sapiens
ctctgcctcccaagt

SEQ ID NO: 275502 - DNA, 15 bp, Homo sapiens
cctctgcctcccaag

SEQ ID NO: 275503 - DNA, 15 bp, Homo sapiens
acctctgcctcccaa

SEQ ID NO: 275504 - DNA, 15 bp, Homo sapiens
atgcaatggcacgat

SEQ ID NO: 275505 - DNA, 15 bp, Homo sapiens
catgcaatggcacga

SEQ ID NO: 275506 - DNA, 15 bp, Homo sapiens
gcatgcaatggcacg

SEQ ID NO: 275507 - DNA, 15 bp, Homo sapiens
ggcatgcaatggcac

SEQ ID NO: 275508 - DNA, 15 bp, Homo sapiens
tggcatgcaatggca

SEQ ID NO: 275509 - DNA, 15 bp, Homo sapiens
ctggcatgcaatggc

SEQ ID NO: 275510 - DNA, 15 bp, Homo sapiens
gctggcatgcaatgg

SEQ ID NO: 275511 - DNA, 15 bp, Homo sapiens
agctggcatgcaatg

SEQ ID NO: 275512 - DNA, 15 bp, Homo sapiens
aagctggcatgcaat

SEQ ID NO: 275513 - DNA, 15 bp, Homo sapiens
caagctggcatgcaa

SEQ ID NO: 275514 - DNA, 15 bp, Homo sapiens
ccaagctggcatgca

SEQ ID NO: 275515 - DNA, 15 bp, Homo sapiens
cccaagctggcatgc

SEQ ID NO: 275516 - DNA, 15 bp, Homo sapiens
gcccaagctggcatg

SEQ ID NO: 275517 - DNA, 15 bp, Homo sapiens
tgcccaagctggcat

SEQ ID NO: 275518 - DNA, 15 bp, Homo sapiens
ttgcccaagctggca

SEQ ID NO: 275519 - DNA, 15 bp, Homo sapiens
gttgcccaagctggc

SEQ ID NO: 275520 - DNA, 15 bp, Homo sapiens
gctctgttgcccaag

SEQ ID NO: 275521 - DNA, 15 bp, Homo sapiens
cgctctgttgcccaa

SEQ ID NO: 275522 - DNA, 15 bp, Homo sapiens
atttttttgagacag

SEQ ID NO: 275523 - DNA, 15 bp, Homo sapiens
tatttttttgagaca

SEQ ID NO: 275524 - DNA, 15 bp, Homo sapiens
ttatttttttgagac

SEQ ID NO: 275525 - DNA, 15 bp, Homo sapiens
tttatttttttgaga

SEQ ID NO: 275526 - DNA, 15 bp, Homo sapiens
ttttatttttttgag

SEQ ID NO: 275527 - DNA, 15 bp, Homo sapiens
tttttatttttttga

SEQ ID NO: 275528 - DNA, 15 bp, Homo sapiens
ttttttatttttttg

SEQ ID NO: 275529 - DNA, 15 bp, Homo sapiens
tttttttattttttt

SEQ ID NO: 275530 - DNA, 15 bp, Homo sapiens
ctttttttatttttt

SEQ ID NO: 275531 - DNA, 15 bp, Homo sapiens
actttttttattttt

SEQ ID NO: 275532 - DNA, 15 bp, Homo sapiens
aactttttttatttt

SEQ ID NO: 275533 - DNA, 15 bp, Homo sapiens
aaactttttttattt

SEQ ID NO: 275534 - DNA, 15 bp, Homo sapiens
gaaactttttttatt

SEQ ID NO: 275535 - DNA, 15 bp, Homo sapiens
agaaactttttttat

SEQ ID NO: 275536 - DNA, 15 bp, Homo sapiens
cagaaacttttttta

SEQ ID NO: 275537 - DNA, 15 bp, Homo sapiens
acagaaacttttttt

SEQ ID NO: 275538 - DNA, 15 bp, Homo sapiens
gacagaaactttttt

SEQ ID NO: 275539 - DNA, 15 bp, Homo sapiens
agacagaaacttttt

SEQ ID NO: 275540 - DNA, 15 bp, Homo sapiens
cagacagaaactttt

SEQ ID NO: 275541 - DNA, 15 bp, Homo sapiens
gcagacagaaacttt

SEQ ID NO: 275542 - DNA, 15 bp, Homo sapiens
tgcagacagaaactt

SEQ ID NO: 275543 - DNA, 15 bp, Homo sapiens
ttgcagacagaaact

SEQ ID NO: 275544 - DNA, 15 bp, Homo sapiens
tttgcagacagaaac

SEQ ID NO: 275545 - DNA, 15 bp, Homo sapiens
ttttgcagacagaaa

SEQ ID NO: 275546 - DNA, 15 bp, Homo sapiens
gttttgcagacagaa

SEQ ID NO: 275547 - DNA, 15 bp, Homo sapiens
tgttttgcagacaga

SEQ ID NO: 275548 - DNA, 15 bp, Homo sapiens
ttgttttgcagacag

SEQ ID NO: 275549 - DNA, 15 bp, Homo sapiens
cttgttttgcagaca

SEQ ID NO: 275550 - DNA, 15 bp, Homo sapiens
acttgttttgcagac

SEQ ID NO: 275551 - DNA, 15 bp, Homo sapiens
aacttgttttgcaga

SEQ ID NO: 275552 - DNA, 15 bp, Homo sapiens
aaacttgttttgcag

SEQ ID NO: 275553 - DNA, 15 bp, Homo sapiens
gaaacttgttttgca

SEQ ID NO: 275554 - DNA, 15 bp, Homo sapiens
agaaacttgttttgc

SEQ ID NO: 275555 - DNA, 15 bp, Homo sapiens
cagaaacttgttttg

SEQ ID NO: 275556 - DNA, 15 bp, Homo sapiens
acagaaacttgtttt

SEQ ID NO: 275557 - DNA, 15 bp, Homo sapiens
cacagaaacttgttt

SEQ ID NO: 275558 - DNA, 15 bp, Homo sapiens
tcacagaaacttgtt

SEQ ID NO: 275559 - DNA, 15 bp, Homo sapiens
ctcacagaaacttgt

SEQ ID NO: 275560 - DNA, 15 bp, Homo sapiens
actcacagaaacttg

SEQ ID NO: 275561 - DNA, 15 bp, Homo sapiens
gactcacagaaactt

SEQ ID NO: 275562 - DNA, 15 bp, Homo sapiens
ggactcacagaaact

SEQ ID NO: 275563 - DNA, 15 bp, Homo sapiens
aggactcacagaaac

SEQ ID NO: 275564 - DNA, 15 bp, Homo sapiens
caggactcacagaaa

SEQ ID NO: 275565 - DNA, 15 bp, Homo sapiens
ccaggactcacagaa

SEQ ID NO: 275566 - DNA, 15 bp, Homo sapiens
cccaggactcacaga

SEQ ID NO: 275567 - DNA, 15 bp, Homo sapiens
gcccaggactcacag

SEQ ID NO: 275568 - DNA, 15 bp, Homo sapiens
tgcccaggactcaca

SEQ ID NO: 275569 - DNA, 15 bp, Homo sapiens
atgcccaggactcac

SEQ ID NO: 275570 - DNA, 15 bp, Homo sapiens
catgcccaggactca

SEQ ID NO: 275571 - DNA, 15 bp, Homo sapiens
gcatgcccaggactc

SEQ ID NO: 275572 - DNA, 15 bp, Homo sapiens
tgcatgcccaggact

SEQ ID NO: 275573 - DNA, 15 bp, Homo sapiens
atgcatgcccaggac

SEQ ID NO: 275574 - DNA, 15 bp, Homo sapiens
catgcatgcccagga

SEQ ID NO: 275575 - DNA, 15 bp, Homo sapiens
acatgcatgcccagg

SEQ ID NO: 275576 - DNA, 15 bp, Homo sapiens
aacatgcatgcccag

SEQ ID NO: 275577 - DNA, 15 bp, Homo sapiens
caacatgcatgccca

SEQ ID NO: 275578 - DNA, 15 bp, Homo sapiens
acaacatgcatgccc

SEQ ID NO: 275579 - DNA, 15 bp, Homo sapiens
cacaacatgcatgcc

SEQ ID NO: 275580 - DNA, 15 bp, Homo sapiens
tcacaacatgcatgc

SEQ ID NO: 275581 - DNA, 15 bp, Homo sapiens
ttcacaacatgcatg

SEQ ID NO: 275582 - DNA, 15 bp, Homo sapiens
cttcacaacatgcat

SEQ ID NO: 275583 - DNA, 15 bp, Homo sapiens
ccttcacaacatgca

SEQ ID NO: 275584 - DNA, 15 bp, Homo sapiens
tccttcacaacatgc

SEQ ID NO: 275585 - DNA, 15 bp, Homo sapiens
ttccttcacaacatg

SEQ ID NO: 275586 - DNA, 15 bp, Homo sapiens
tttccttcacaacat

SEQ ID NO: 275587 - DNA, 15 bp, Homo sapiens
ttttccttcacaaca

SEQ ID NO: 275588 - DNA, 15 bp, Homo sapiens
cttttccttcacaac

SEQ ID NO: 275589 - DNA, 15 bp, Homo sapiens
gcttttccttcacaa

SEQ ID NO: 275590 - DNA, 15 bp, Homo sapiens
agcttttccttcaca

SEQ ID NO: 275591 - DNA, 15 bp, Homo sapiens
cagcttttccttcac

SEQ ID NO: 275592 - DNA, 15 bp, Homo sapiens
tcagcttttccttca

SEQ ID NO: 275593 - DNA, 15 bp, Homo sapiens
ttcagcttttccttc

SEQ ID NO: 275594 - DNA, 15 bp, Homo sapiens
cttcagcttttcctt

SEQ ID NO: 275595 - DNA, 15 bp, Homo sapiens
ccttcagcttttcct

SEQ ID NO: 275596 - DNA, 15 bp, Homo sapiens
cccttcagcttttcc

SEQ ID NO: 275597 - DNA, 15 bp, Homo sapiens
gcccttcagcttttc

SEQ ID NO: 275598 - DNA, 15 bp, Homo sapiens
tgcccttcagctttt

SEQ ID NO: 275599 - DNA, 15 bp, Homo sapiens
ctgcccttcagcttt

SEQ ID NO: 275600 - DNA, 15 bp, Homo sapiens
cctgcccttcagctt

SEQ ID NO: 275601 - DNA, 15 bp, Homo sapiens
ccctgcccttcagct

SEQ ID NO: 275602 - DNA, 15 bp, Homo sapiens
tccctgcccttcagc

SEQ ID NO: 275603 - DNA, 15 bp, Homo sapiens
gtccctgcccttcag

SEQ ID NO: 275604 - DNA, 15 bp, Homo sapiens
tgtccctgcccttca

SEQ ID NO: 275605 - DNA, 15 bp, Homo sapiens
ctgtccctgcccttc

SEQ ID NO: 275606 - DNA, 15 bp, Homo sapiens
cctgtccctgccctt

SEQ ID NO: 275607 - DNA, 15 bp, Homo sapiens
ccctgtccctgccct

SEQ ID NO: 275608 - DNA, 15 bp, Homo sapiens
tccctgtccctgccc

SEQ ID NO: 275609 - DNA, 15 bp, Homo sapiens
ctccctgtccctgcc

SEQ ID NO: 275610 - DNA, 15 bp, Homo sapiens
gctccctgtccctgc

SEQ ID NO: 275611 - DNA, 15 bp, Homo sapiens
tgctccctgtccctg

SEQ ID NO: 275612 - DNA, 15 bp, Homo sapiens
ctgctccctgtccct

SEQ ID NO: 275613 - DNA, 15 bp, Homo sapiens
cctgctccctgtccc

SEQ ID NO: 275614 - DNA, 15 bp, Homo sapiens
gcctgctccctgtcc

SEQ ID NO: 275615 - DNA, 15 bp, Homo sapiens
tgcctgctccctgtc

SEQ ID NO: 275616 - DNA, 15 bp, Homo sapiens
ctgcctgctccctgt

SEQ ID NO: 275617 - DNA, 15 bp, Homo sapiens
gctgcctgctccctg

SEQ ID NO: 275618 - DNA, 15 bp, Homo sapiens
tgctgcctgctccct

SEQ ID NO: 275619 - DNA, 15 bp, Homo sapiens
ctgctgcctgctccc

SEQ ID NO: 275620 - DNA, 15 bp, Homo sapiens
cctgctgcctgctcc

SEQ ID NO: 275621 - DNA, 15 bp, Homo sapiens
acctgctgcctgctc

SEQ ID NO: 275622 - DNA, 15 bp, Homo sapiens
tacctgctgcctgct

SEQ ID NO: 275623 - DNA, 15 bp, Homo sapiens
ttacctgctgcctgc

SEQ ID NO: 275624 - DNA, 15 bp, Homo sapiens
cttacctgctgcctg

SEQ ID NO: 275625 - DNA, 15 bp, Homo sapiens
gcttacctgctgcct

SEQ ID NO: 275626 - DNA, 15 bp, Homo sapiens
tgcttacctgctgcc

SEQ ID NO: 275627 - DNA, 15 bp, Homo sapiens
ttgcttacctgctgc

SEQ ID NO: 275628 - DNA, 15 bp, Homo sapiens
tttgcttacctgctg

SEQ ID NO: 275629 - DNA, 15 bp, Homo sapiens
atttgcttacctgct

SEQ ID NO: 275630 - DNA, 15 bp, Homo sapiens
tatttgcttacctgc

SEQ ID NO: 275631 - DNA, 15 bp, Homo sapiens
atatttgcttacctg

SEQ ID NO: 275632 - DNA, 15 bp, Homo sapiens
tatatttgcttacct

SEQ ID NO: 275633 - DNA, 15 bp, Homo sapiens
gtatatttgcttacc

SEQ ID NO: 275634 - DNA, 15 bp, Homo sapiens
agtatatttgcttac

SEQ ID NO: 275635 - DNA, 15 bp, Homo sapiens
aagtatatttgctta

SEQ ID NO: 275636 - DNA, 15 bp, Homo sapiens
taagtatatttgctt

SEQ ID NO: 275637 - DNA, 15 bp, Homo sapiens
ataagtatatttgct

SEQ ID NO: 275638 - DNA, 15 bp, Homo sapiens
gataagtatatttgc

SEQ ID NO: 275639 - DNA, 15 bp, Homo sapiens
tgataagtatatttg

SEQ ID NO: 275640 - DNA, 15 bp, Homo sapiens
atgataagtatattt

SEQ ID NO: 275641 - DNA, 15 bp, Homo sapiens
aatgataagtatatt

SEQ ID NO: 275642 - DNA, 15 bp, Homo sapiens
gaatgataagtatat

SEQ ID NO: 275643 - DNA, 15 bp, Homo sapiens
tgaatgataagtata

SEQ ID NO: 275644 - DNA, 15 bp, Homo sapiens
ctgaatgataagtat

SEQ ID NO: 275645 - DNA, 15 bp, Homo sapiens
actgaatgataagta

SEQ ID NO: 275646 - DNA, 15 bp, Homo sapiens
cactgaatgataagt

SEQ ID NO: 275647 - DNA, 15 bp, Homo sapiens
acactgaatgataag

SEQ ID NO: 275648 - DNA, 15 bp, Homo sapiens
gacactgaatgataa

SEQ ID NO: 275649 - DNA, 15 bp, Homo sapiens
agacactgaatgata

SEQ ID NO: 275650 - DNA, 15 bp, Homo sapiens
cagacactgaatgat

SEQ ID NO: 275651 - DNA, 15 bp, Homo sapiens
acagacactgaatga

SEQ ID NO: 275652 - DNA, 15 bp, Homo sapiens
cacagacactgaatg

SEQ ID NO: 275653 - DNA, 15 bp, Homo sapiens
tcacagacactgaat

SEQ ID NO: 275654 - DNA, 15 bp, Homo sapiens
atcacagacactgaa

SEQ ID NO: 275655 - DNA, 15 bp, Homo sapiens
aatcacagacactga

SEQ ID NO: 275656 - DNA, 15 bp, Homo sapiens
taatcacagacactg

SEQ ID NO: 275657 - DNA, 15 bp, Homo sapiens
gtaatcacagacact

SEQ ID NO: 275658 - DNA, 15 bp, Homo sapiens
tgtaatcacagacac

SEQ ID NO: 275659 - DNA, 15 bp, Homo sapiens
ttgtaatcacagaca

SEQ ID NO: 275660 - DNA, 15 bp, Homo sapiens
cttgtaatcacagac

SEQ ID NO: 275661 - DNA, 15 bp, Homo sapiens
tcttgtaatcacaga

SEQ ID NO: 275662 - DNA, 15 bp, Homo sapiens
ttcttgtaatcacag

SEQ ID NO: 275663 - DNA, 15 bp, Homo sapiens
tttcttgtaatcaca

SEQ ID NO: 275664 - DNA, 15 bp, Homo sapiens
ctttcttgtaatcac

SEQ ID NO: 275665 - DNA, 15 bp, Homo sapiens
actttcttgtaatca

SEQ ID NO: 275666 - DNA, 15 bp, Homo sapiens
aactttcttgtaatc

SEQ ID NO: 275667 - DNA, 15 bp, Homo sapiens
aaactttcttgtaat

SEQ ID NO: 275668 - DNA, 15 bp, Homo sapiens
gaaactttcttgtaa

SEQ ID NO: 275669 - DNA, 15 bp, Homo sapiens
agaaactttcttgta

SEQ ID NO: 275670 - DNA, 15 bp, Homo sapiens
gagaaactttcttgt

SEQ ID NO: 275671 - DNA, 15 bp, Homo sapiens
agagaaactttcttg

SEQ ID NO: 275672 - DNA, 15 bp, Homo sapiens
gagagaaactttctt

SEQ ID NO: 275673 - DNA, 15 bp, Homo sapiens
agagagaaactttct

SEQ ID NO: 275674 - DNA, 15 bp, Homo sapiens
gagagagaaactttc

SEQ ID NO: 275675 - DNA, 15 bp, Homo sapiens
ggagagagaaacttt

SEQ ID NO: 275676 - DNA, 15 bp, Homo sapiens
aggagagagaaactt

SEQ ID NO: 275677 - DNA, 15 bp, Homo sapiens
aaggagagagaaact

SEQ ID NO: 275678 - DNA, 15 bp, Homo sapiens
gaaggagagagaaac

SEQ ID NO: 275679 - DNA, 15 bp, Homo sapiens
agaaggagagagaaa

SEQ ID NO: 275680 - DNA, 15 bp, Homo sapiens
gagaaggagagagaa

SEQ ID NO: 275681 - DNA, 15 bp, Homo sapiens
ggagaaggagagaga

SEQ ID NO: 275682 - DNA, 15 bp, Homo sapiens
gggagaaggagagag

SEQ ID NO: 275683 - DNA, 15 bp, Homo sapiens
ggggagaaggagaga

SEQ ID NO: 275684 - DNA, 15 bp, Homo sapiens
aggggagaaggagag

SEQ ID NO: 275685 - DNA, 15 bp, Homo sapiens
aaggggagaaggaga

SEQ ID NO: 275686 - DNA, 15 bp, Homo sapiens
gaaggggagaaggag

SEQ ID NO: 275687 - DNA, 15 bp, Homo sapiens
agaaggggagaagga

SEQ ID NO: 275688 - DNA, 15 bp, Homo sapiens
gagaaggggagaagg

SEQ ID NO: 275689 - DNA, 15 bp, Homo sapiens
ggagaaggggagaag

SEQ ID NO: 275690 - DNA, 15 bp, Homo sapiens
aggagaaggggagaa

SEQ ID NO: 275691 - DNA, 15 bp, Homo sapiens
gaggagaaggggaga

SEQ ID NO: 275692 - DNA, 15 bp, Homo sapiens
ggaggagaaggggag

SEQ ID NO: 275693 - DNA, 15 bp, Homo sapiens
aggaggagaagggga

SEQ ID NO: 275694 - DNA, 15 bp, Homo sapiens
gaggaggagaagggg

SEQ ID NO: 275695 - DNA, 15 bp, Homo sapiens
ggaggaggagaaggg

SEQ ID NO: 275696 - DNA, 15 bp, Homo sapiens
cggaggaggagaagg

SEQ ID NO: 275697 - DNA, 15 bp, Homo sapiens
gcggaggaggagaag

SEQ ID NO: 275698 - DNA, 15 bp, Homo sapiens
ggcggaggaggagaa

SEQ ID NO: 275699 - DNA, 15 bp, Homo sapiens
cggcggaggaggaga

SEQ ID NO: 275700 - DNA, 15 bp, Homo sapiens
gcggcggaggaggag

SEQ ID NO: 275701 - DNA, 15 bp, Homo sapiens
ggcggcggaggagga

SEQ ID NO: 275702 - DNA, 15 bp, Homo sapiens
aggcggcggaggagg

SEQ ID NO: 275703 - DNA, 15 bp, Homo sapiens
gaggcggcggaggag

SEQ ID NO: 275704 - DNA, 15 bp, Homo sapiens
ggaggcggcggagga

SEQ ID NO: 275705 - DNA, 15 bp, Homo sapiens
aggaggcggcggagg

SEQ ID NO: 275706 - DNA, 15 bp, Homo sapiens
gaggaggcggcggag

SEQ ID NO: 275707 - DNA, 15 bp, Homo sapiens
ggaggaggcggcgga

SEQ ID NO: 275708 - DNA, 15 bp, Homo sapiens
aggaggaggcggcgg

SEQ ID NO: 275709 - DNA, 15 bp, Homo sapiens
gaggaggaggcggcg

SEQ ID NO: 275710 - DNA, 15 bp, Homo sapiens
ggaggaggaggcggc

SEQ ID NO: 275711 - DNA, 15 bp, Homo sapiens
aggaggaggaggcgg

SEQ ID NO: 275712 - DNA, 15 bp, Homo sapiens
gaggaggaggaggcg

SEQ ID NO: 275713 - DNA, 15 bp, Homo sapiens
agaggaggaggagga

SEQ ID NO: 275714 - DNA, 15 bp, Homo sapiens
gagaggaggaggagg

SEQ ID NO: 275715 - DNA, 15 bp, Homo sapiens
agagaggaggaggag

SEQ ID NO: 275716 - DNA, 15 bp, Homo sapiens
gagagaggaggagga

SEQ ID NO: 275717 - DNA, 15 bp, Homo sapiens
agagagaggaggagg

SEQ ID NO: 275718 - DNA, 15 bp, Homo sapiens
gagagagaggaggag

SEQ ID NO: 275719 - DNA, 15 bp, Homo sapiens
agagagagaggagga

SEQ ID NO: 275720 - DNA, 15 bp, Homo sapiens
gagagagagaggagg

SEQ ID NO: 275721 - DNA, 15 bp, Homo sapiens
agagagagagaggag

SEQ ID NO: 275722 - DNA, 15 bp, Homo sapiens
agagagagagagagg

SEQ ID NO: 275723 - DNA, 15 bp, Homo sapiens
agacagaaagagaga

SEQ ID NO: 275724 - DNA, 15 bp, Homo sapiens
gagacagaaagagag

SEQ ID NO: 275725 - DNA, 15 bp, Homo sapiens
agagacagaaagaga

SEQ ID NO: 275726 - DNA, 15 bp, Homo sapiens
tagagacagaaagag

SEQ ID NO: 275727 - DNA, 15 bp, Homo sapiens
ttagagacagaaaga

SEQ ID NO: 275728 - DNA, 15 bp, Homo sapiens
cttagagacagaaag

SEQ ID NO: 275729 - DNA, 15 bp, Homo sapiens
tcttagagacagaaa

SEQ ID NO: 275730 - DNA, 15 bp, Homo sapiens
ctcttagagacagaa

SEQ ID NO: 275731 - DNA, 15 bp, Homo sapiens
cctcttagagacaga

SEQ ID NO: 275732 - DNA, 15 bp, Homo sapiens
tcctcttagagacag

SEQ ID NO: 275733 - DNA, 15 bp, Homo sapiens
ctcctcttagagaca

SEQ ID NO: 275734 - DNA, 15 bp, Homo sapiens
cctcctcttagagac

SEQ ID NO: 275735 - DNA, 15 bp, Homo sapiens
ccctcctcttagaga

SEQ ID NO: 275736 - DNA, 15 bp, Homo sapiens
tccctcctcttagag

SEQ ID NO: 275737 - DNA, 15 bp, Homo sapiens
ctccctcctcttaga

SEQ ID NO: 275738 - DNA, 15 bp, Homo sapiens
actccctcctcttag

SEQ ID NO: 275739 - DNA, 15 bp, Homo sapiens
cactccctcctctta

SEQ ID NO: 275740 - DNA, 15 bp, Homo sapiens
tcactccctcctctt

SEQ ID NO: 275741 - DNA, 15 bp, Homo sapiens
ctcactccctcctct

SEQ ID NO: 275742 - DNA, 15 bp, Homo sapiens
cctcactccctcctc

SEQ ID NO: 275743 - DNA, 15 bp, Homo sapiens
acctcactccctcct

SEQ ID NO: 275744 - DNA, 15 bp, Homo sapiens
tacctcactccctcc

SEQ ID NO: 275745 - DNA, 15 bp, Homo sapiens
atacctcactccctc

SEQ ID NO: 275746 - DNA, 15 bp, Homo sapiens
tatacctcactccct

SEQ ID NO: 275747 - DNA, 15 bp, Homo sapiens
ttatacctcactccc

SEQ ID NO: 275748 - DNA, 15 bp, Homo sapiens
attatacctcactcc

SEQ ID NO: 275749 - DNA, 15 bp, Homo sapiens
cattatacctcactc

SEQ ID NO: 275750 - DNA, 15 bp, Homo sapiens
tcattatacctcact

SEQ ID NO: 275751 - DNA, 15 bp, Homo sapiens
ctcattatacctcac

SEQ ID NO: 275752 - DNA, 15 bp, Homo sapiens
actcattatacctca

SEQ ID NO: 275753 - DNA, 15 bp, Homo sapiens
cactcattatacctc

SEQ ID NO: 275754 - DNA, 15 bp, Homo sapiens
ccactcattatacct

SEQ ID NO: 275755 - DNA, 15 bp, Homo sapiens
accactcattatacc

SEQ ID NO: 275756 - DNA, 15 bp, Homo sapiens
taccactcattatac

SEQ ID NO: 275757 - DNA, 15 bp, Homo sapiens
ctaccactcattata

SEQ ID NO: 275758 - DNA, 15 bp, Homo sapiens
cctaccactcattat

SEQ ID NO: 275759 - DNA, 15 bp, Homo sapiens
acctaccactcatta

SEQ ID NO: 275760 - DNA, 15 bp, Homo sapiens
aacctaccactcatt

SEQ ID NO: 275761 - DNA, 15 bp, Homo sapiens
caacctaccactcat

SEQ ID NO: 275762 - DNA, 15 bp, Homo sapiens
tcaacctaccactca

SEQ ID NO: 275763 - DNA, 15 bp, Homo sapiens
ctcaacctaccactc

SEQ ID NO: 275764 - DNA, 15 bp, Homo sapiens
gctcaacctaccact

SEQ ID NO: 275765 - DNA, 15 bp, Homo sapiens
tgctcaacctaccac

SEQ ID NO: 275766 - DNA, 15 bp, Homo sapiens
ctgctcaacctacca

SEQ ID NO: 275767 - DNA, 15 bp, Homo sapiens
gctgctcaacctacc

SEQ ID NO: 275768 - DNA, 15 bp, Homo sapiens
ggctgctcaacctac

SEQ ID NO: 275769 - DNA, 15 bp, Homo sapiens
tggctgctcaaccta

SEQ ID NO: 275770 - DNA, 15 bp, Homo sapiens
ttggctgctcaacct

SEQ ID NO: 275771 - DNA, 15 bp, Homo sapiens
cttggctgctcaacc

SEQ ID NO: 275772 - DNA, 15 bp, Homo sapiens
acttggctgctcaac

SEQ ID NO: 275773 - DNA, 15 bp, Homo sapiens
aacttggctgctcaa

SEQ ID NO: 275774 - DNA, 15 bp, Homo sapiens
caacttggctgctca

SEQ ID NO: 275775 - DNA, 15 bp, Homo sapiens
ccaacttggctgctc

SEQ ID NO: 275776 - DNA, 15 bp, Homo sapiens
tccaacttggctgct

SEQ ID NO: 275777 - DNA, 15 bp, Homo sapiens
ctccaacttggctgc

SEQ ID NO: 275778 - DNA, 15 bp, Homo sapiens
gctccaacttggctg

SEQ ID NO: 275779 - DNA, 15 bp, Homo sapiens
ggctccaacttggct

SEQ ID NO: 275780 - DNA, 15 bp, Homo sapiens
tggctccaacttggc

SEQ ID NO: 275781 - DNA, 15 bp, Homo sapiens
ctggctccaacttgg

SEQ ID NO: 275782 - DNA, 15 bp, Homo sapiens
tctggctccaacttg

SEQ ID NO: 275783 - DNA, 15 bp, Homo sapiens
ctctggctccaactt

SEQ ID NO: 275784 - DNA, 15 bp, Homo sapiens
cctctggctccaact

SEQ ID NO: 275785 - DNA, 15 bp, Homo sapiens
tcctctggctccaac

SEQ ID NO: 275786 - DNA, 15 bp, Homo sapiens
atcctctggctccaa

SEQ ID NO: 275787 - DNA, 15 bp, Homo sapiens
gatcctctggctcca

SEQ ID NO: 275788 - DNA, 15 bp, Homo sapiens
tgatcctctggctcc

SEQ ID NO: 275789 - DNA, 15 bp, Homo sapiens
atgatcctctggctc

SEQ ID NO: 275790 - DNA, 15 bp, Homo sapiens
catgatcctctggct

SEQ ID NO: 275791 - DNA, 15 bp, Homo sapiens
ccatgatcctctggc

SEQ ID NO: 275792 - DNA, 15 bp, Homo sapiens
cccatgatcctctgg

SEQ ID NO: 275793 - DNA, 15 bp, Homo sapiens
gcccatgatcctctg

SEQ ID NO: 275794 - DNA, 15 bp, Homo sapiens
agcccatgatcctct

SEQ ID NO: 275795 - DNA, 15 bp, Homo sapiens
aagcccatgatcctc

SEQ ID NO: 275796 - DNA, 15 bp, Homo sapiens
gaagcccatgatcct

SEQ ID NO: 275797 - DNA, 15 bp, Homo sapiens
tgaagcccatgatcc

SEQ ID NO: 275798 - DNA, 15 bp, Homo sapiens
atgaagcccatgatc

SEQ ID NO: 275799 - DNA, 15 bp, Homo sapiens
aatgaagcccatgat

SEQ ID NO: 275800 - DNA, 15 bp, Homo sapiens
taatgaagcccatga

SEQ ID NO: 275801 - DNA, 15 bp, Homo sapiens
ttaatgaagcccatg

SEQ ID NO: 275802 - DNA, 15 bp, Homo sapiens
cttaatgaagcccat

SEQ ID NO: 275803 - DNA, 15 bp, Homo sapiens
acttaatgaagccca

SEQ ID NO: 275804 - DNA, 15 bp, Homo sapiens
aacttaatgaagccc

SEQ ID NO: 275805 - DNA, 15 bp, Homo sapiens
gaacttaatgaagcc

SEQ ID NO: 275806 - DNA, 15 bp, Homo sapiens
agaacttaatgaagc

SEQ ID NO: 275807 - DNA, 15 bp, Homo sapiens
cagaacttaatgaag

SEQ ID NO: 275808 - DNA, 15 bp, Homo sapiens
acagaacttaatgaa

SEQ ID NO: 275809 - DNA, 15 bp, Homo sapiens
cacagaacttaatga

SEQ ID NO: 275810 - DNA, 15 bp, Homo sapiens
gcacagaacttaatg

SEQ ID NO: 275811 - DNA, 15 bp, Homo sapiens
tgcacagaacttaat

SEQ ID NO: 275812 - DNA, 15 bp, Homo sapiens
ctgcacagaacttaa

SEQ ID NO: 275813 - DNA, 15 bp, Homo sapiens
cctgcacagaactta

SEQ ID NO: 275814 - DNA, 15 bp, Homo sapiens
acctgcacagaactt

SEQ ID NO: 275815 - DNA, 15 bp, Homo sapiens
tacctgcacagaact

SEQ ID NO: 275816 - DNA, 15 bp, Homo sapiens
ttacctgcacagaac

SEQ ID NO: 275817 - DNA, 15 bp, Homo sapiens
attacctgcacagaa

SEQ ID NO: 275818 - DNA, 15 bp, Homo sapiens
cattacctgcacaga

SEQ ID NO: 275819 - DNA, 15 bp, Homo sapiens
acattacctgcacag

SEQ ID NO: 275820 - DNA, 15 bp, Homo sapiens
tacattacctgcaca

SEQ ID NO: 275821 - DNA, 15 bp, Homo sapiens
ttacattacctgcac

SEQ ID NO: 275822 - DNA, 15 bp, Homo sapiens
tttacattacctgca

SEQ ID NO: 275823 - DNA, 15 bp, Homo sapiens
atttacattacctgc

SEQ ID NO: 275824 - DNA, 15 bp, Homo sapiens
tatttacattacctg

SEQ ID NO: 275825 - DNA, 15 bp, Homo sapiens
atatttacattacct

SEQ ID NO: 275826 - DNA, 15 bp, Homo sapiens
aatatttacattacc

SEQ ID NO: 275827 - DNA, 15 bp, Homo sapiens
aaatatttacattac

SEQ ID NO: 275828 - DNA, 15 bp, Homo sapiens
aaaatatttacatta

SEQ ID NO: 275829 - DNA, 15 bp, Homo sapiens
taaaatatttacatt

SEQ ID NO: 275830 - DNA, 15 bp, Homo sapiens
ttaaaatatttacat

SEQ ID NO: 275831 - DNA, 15 bp, Homo sapiens
tttaaaatatttaca

SEQ ID NO: 275832 - DNA, 15 bp, Homo sapiens
atttaaaatatttac

SEQ ID NO: 275833 - DNA, 15 bp, Homo sapiens
catttaaaatattta

SEQ ID NO: 275834 - DNA, 15 bp, Homo sapiens
gcatttaaaatattt

SEQ ID NO: 275835 - DNA, 15 bp, Homo sapiens
tgcatttaaaatatt

SEQ ID NO: 275836 - DNA, 15 bp, Homo sapiens
atgcatttaaaatat

SEQ ID NO: 275837 - DNA, 15 bp, Homo sapiens
gatgcatttaaaata

SEQ ID NO: 275838 - DNA, 15 bp, Homo sapiens
agatgcatttaaaat

SEQ ID NO: 275839 - DNA, 15 bp, Homo sapiens
aagatgcatttaaaa

SEQ ID NO: 275840 - DNA, 15 bp, Homo sapiens
gaagatgcatttaaa

SEQ ID NO: 275841 - DNA, 15 bp, Homo sapiens
cgaagatgcatttaa

SEQ ID NO: 275842 - DNA, 15 bp, Homo sapiens
ccgaagatgcattta

SEQ ID NO: 275843 - DNA, 15 bp, Homo sapiens
tccgaagatgcattt

SEQ ID NO: 275844 - DNA, 15 bp, Homo sapiens
ttccgaagatgcatt

SEQ ID NO: 275845 - DNA, 15 bp, Homo sapiens
cttccgaagatgcat

SEQ ID NO: 275846 - DNA, 15 bp, Homo sapiens
ccttccgaagatgca

SEQ ID NO: 275847 - DNA, 15 bp, Homo sapiens
tccttccgaagatgc

SEQ ID NO: 275848 - DNA, 15 bp, Homo sapiens
atccttccgaagatg

SEQ ID NO: 275849 - DNA, 15 bp, Homo sapiens
gatccttccgaagat

SEQ ID NO: 275850 - DNA, 15 bp, Homo sapiens
tgatccttccgaaga

SEQ ID NO: 275851 - DNA, 15 bp, Homo sapiens
gtgatccttccgaag

SEQ ID NO: 275852 - DNA, 15 bp, Homo sapiens
tgtgatccttccgaa

SEQ ID NO: 275853 - DNA, 15 bp, Homo sapiens
ctgtgatccttccga

SEQ ID NO: 275854 - DNA, 15 bp, Homo sapiens
actgtgatccttccg

SEQ ID NO: 275855 - DNA, 15 bp, Homo sapiens
aactgtgatccttcc

SEQ ID NO: 275856 - DNA, 15 bp, Homo sapiens
caactgtgatccttc

SEQ ID NO: 275857 - DNA, 15 bp, Homo sapiens
tcaactgtgatcctt

SEQ ID NO: 275858 - DNA, 15 bp, Homo sapiens
atcaactgtgatcct

SEQ ID NO: 275859 - DNA, 15 bp, Homo sapiens
tatcaactgtgatcc

SEQ ID NO: 275860 - DNA, 15 bp, Homo sapiens
atatcaactgtgatc

SEQ ID NO: 275861 - DNA, 15 bp, Homo sapiens
gatatcaactgtgat

SEQ ID NO: 275862 - DNA, 15 bp, Homo sapiens
agatatcaactgtga

SEQ ID NO: 275863 - DNA, 15 bp, Homo sapiens
cagatatcaactgtg

SEQ ID NO: 275864 - DNA, 15 bp, Homo sapiens
acagatatcaactgt

SEQ ID NO: 275865 - DNA, 15 bp, Homo sapiens
tacagatatcaactg

SEQ ID NO: 275866 - DNA, 15 bp, Homo sapiens
atacagatatcaact

SEQ ID NO: 275867 - DNA, 15 bp, Homo sapiens
aatacagatatcaac

SEQ ID NO: 275868 - DNA, 15 bp, Homo sapiens
caatacagatatcaa

SEQ ID NO: 275869 - DNA, 15 bp, Homo sapiens
acaatacagatatca

SEQ ID NO: 275870 - DNA, 15 bp, Homo sapiens
tacaatacagatatc

SEQ ID NO: 275871 - DNA, 15 bp, Homo sapiens
ttacaatacagatat

SEQ ID NO: 275872 - DNA, 15 bp, Homo sapiens
tttacaatacagata

SEQ ID NO: 275873 - DNA, 15 bp, Homo sapiens
atttacaatacagat

SEQ ID NO: 275874 - DNA, 15 bp, Homo sapiens
tatttacaatacaga

SEQ ID NO: 275875 - DNA, 15 bp, Homo sapiens
ctatttacaatacag

SEQ ID NO: 275876 - DNA, 15 bp, Homo sapiens
tctatttacaataca

SEQ ID NO: 275877 - DNA, 15 bp, Homo sapiens
ttctatttacaatac

SEQ ID NO: 275878 - DNA, 15 bp, Homo sapiens
tttctatttacaata

SEQ ID NO: 275879 - DNA, 15 bp, Homo sapiens
gtttctatttacaat

SEQ ID NO: 275880 - DNA, 15 bp, Homo sapiens
agtttctatttacaa

SEQ ID NO: 275881 - DNA, 15 bp, Homo sapiens
tagtttctatttaca

SEQ ID NO: 275882 - DNA, 15 bp, Homo sapiens
ctagtttctatttac

SEQ ID NO: 275883 - DNA, 15 bp, Homo sapiens
tctagtttctattta

SEQ ID NO: 275884 - DNA, 15 bp, Homo sapiens
ttctagtttctattt

SEQ ID NO: 275885 - DNA, 15 bp, Homo sapiens
attctagtttctatt

SEQ ID NO: 275886 - DNA, 15 bp, Homo sapiens
aattctagtttctat

SEQ ID NO: 275887 - DNA, 15 bp, Homo sapiens
caattctagtttcta

SEQ ID NO: 275888 - DNA, 15 bp, Homo sapiens
acaattctagtttct

SEQ ID NO: 275889 - DNA, 15 bp, Homo sapiens
cacaattctagtttc

SEQ ID NO: 275890 - DNA, 15 bp, Homo sapiens
tcacaattctagttt

SEQ ID NO: 275891 - DNA, 15 bp, Homo sapiens
atcacaattctagtt

SEQ ID NO: 275892 - DNA, 15 bp, Homo sapiens
tatcacaattctagt

SEQ ID NO: 275893 - DNA, 15 bp, Homo sapiens
atatcacaattctag

SEQ ID NO: 275894 - DNA, 15 bp, Homo sapiens
tatatcacaattcta

SEQ ID NO: 275895 - DNA, 15 bp, Homo sapiens
gtatatcacaattct

SEQ ID NO: 275896 - DNA, 15 bp, Homo sapiens
tgtatatcacaattc

SEQ ID NO: 275897 - DNA, 15 bp, Homo sapiens
ctgtatatcacaatt

SEQ ID NO: 275898 - DNA, 15 bp, Homo sapiens
actgtatatcacaat

SEQ ID NO: 275899 - DNA, 15 bp, Homo sapiens
tactgtatatcacaa

SEQ ID NO: 275900 - DNA, 15 bp, Homo sapiens
ctactgtatatcaca

SEQ ID NO: 275901 - DNA, 15 bp, Homo sapiens
tctactgtatatcac

SEQ ID NO: 275902 - DNA, 15 bp, Homo sapiens
ttctactgtatatca

SEQ ID NO: 275903 - DNA, 15 bp, Homo sapiens
tttctactgtatatc

SEQ ID NO: 275904 - DNA, 15 bp, Homo sapiens
ttttctactgtatat

SEQ ID NO: 275905 - DNA, 15 bp, Homo sapiens
gttttctactgtata

SEQ ID NO: 275906 - DNA, 15 bp, Homo sapiens
agttttctactgtat

SEQ ID NO: 275907 - DNA, 15 bp, Homo sapiens
cagttttctactgta

SEQ ID NO: 275908 - DNA, 15 bp, Homo sapiens
ccagttttctactgt

SEQ ID NO: 275909 - DNA, 15 bp, Homo sapiens
cccagttttctactg

SEQ ID NO: 275910 - DNA, 15 bp, Homo sapiens
ccccagttttctact

SEQ ID NO: 275911 - DNA, 15 bp, Homo sapiens
gccccagttttctac

SEQ ID NO: 275912 - DNA, 15 bp, Homo sapiens
agccccagttttcta

SEQ ID NO: 275913 - DNA, 15 bp, Homo sapiens
aagccccagttttct

SEQ ID NO: 275914 - DNA, 15 bp, Homo sapiens
caagccccagttttc

SEQ ID NO: 275915 - DNA, 15 bp, Homo sapiens
ccaagccccagtttt

SEQ ID NO: 275916 - DNA, 15 bp, Homo sapiens
tccaagccccagttt

SEQ ID NO: 275917 - DNA, 15 bp, Homo sapiens
ctccaagccccagtt

SEQ ID NO: 275918 - DNA, 15 bp, Homo sapiens
tctccaagccccagt

SEQ ID NO: 275919 - DNA, 15 bp, Homo sapiens
ttctccaagccccag

SEQ ID NO: 275920 - DNA, 15 bp, Homo sapiens
gttctccaagcccca

SEQ ID NO: 275921 - DNA, 15 bp, Homo sapiens
tgttctccaagcccc

SEQ ID NO: 275922 - DNA, 15 bp, Homo sapiens
ttgttctccaagccc

SEQ ID NO: 275923 - DNA, 15 bp, Homo sapiens
attgttctccaagcc

SEQ ID NO: 275924 - DNA, 15 bp, Homo sapiens
tattgttctccaagc

SEQ ID NO: 275925 - DNA, 15 bp, Homo sapiens
ctattgttctccaag

SEQ ID NO: 275926 - DNA, 15 bp, Homo sapiens
actattgttctccaa

SEQ ID NO: 275927 - DNA, 15 bp, Homo sapiens
aactattgttctcca

SEQ ID NO: 275928 - DNA, 15 bp, Homo sapiens
gaactattgttctcc

SEQ ID NO: 275929 - DNA, 15 bp, Homo sapiens
tgaactattgttctc

SEQ ID NO: 275930 - DNA, 15 bp, Homo sapiens
atgaactattgttct

SEQ ID NO: 275931 - DNA, 15 bp, Homo sapiens
catgaactattgttc

SEQ ID NO: 275932 - DNA, 15 bp, Homo sapiens
ccatgaactattgtt

SEQ ID NO: 275933 - DNA, 15 bp, Homo sapiens
cccatgaactattgt

SEQ ID NO: 275934 - DNA, 15 bp, Homo sapiens
tcccatgaactattg

SEQ ID NO: 275935 - DNA, 15 bp, Homo sapiens
atcccatgaactatt

SEQ ID NO: 275936 - DNA, 15 bp, Homo sapiens
tatcccatgaactat

SEQ ID NO: 275937 - DNA, 15 bp, Homo sapiens
ctatcccatgaacta

SEQ ID NO: 275938 - DNA, 15 bp, Homo sapiens
cctatcccatgaact

SEQ ID NO: 275939 - DNA, 15 bp, Homo sapiens
tcctatcccatgaac

SEQ ID NO: 275940 - DNA, 15 bp, Homo sapiens
atcctatcccatgaa

SEQ ID NO: 275941 - DNA, 15 bp, Homo sapiens
catcctatcccatga

SEQ ID NO: 275942 - DNA, 15 bp, Homo sapiens
tcatcctatcccatg

SEQ ID NO: 275943 - DNA, 15 bp, Homo sapiens
atcatcctatcccat

SEQ ID NO: 275944 - DNA, 15 bp, Homo sapiens
catcatcctatccca

SEQ ID NO: 275945 - DNA, 15 bp, Homo sapiens
ccatcatcctatccc

SEQ ID NO: 275946 - DNA, 15 bp, Homo sapiens
cccatcatcctatcc

SEQ ID NO: 275947 - DNA, 15 bp, Homo sapiens
ccccatcatcctatc

SEQ ID NO: 275948 - DNA, 15 bp, Homo sapiens
accccatcatcctat

SEQ ID NO: 275949 - DNA, 15 bp, Homo sapiens
caccccatcatccta

SEQ ID NO: 275950 - DNA, 15 bp, Homo sapiens
ccaccccatcatcct

SEQ ID NO: 275951 - DNA, 15 bp, Homo sapiens
cccaccccatcatcc

SEQ ID NO: 275952 - DNA, 15 bp, Homo sapiens
acccaccccatcatc

SEQ ID NO: 275953 - DNA, 15 bp, Homo sapiens
cacccaccccatcat

SEQ ID NO: 275954 - DNA, 15 bp, Homo sapiens
ccacccaccccatca

SEQ ID NO: 275955 - DNA, 15 bp, Homo sapiens
cccacccaccccatc

SEQ ID NO: 275956 - DNA, 15 bp, Homo sapiens
ccccacccaccccat

SEQ ID NO: 275957 - DNA, 15 bp, Homo sapiens
accccacccacccca

SEQ ID NO: 275958 - DNA, 15 bp, Homo sapiens
aaccccacccacccc

SEQ ID NO: 275959 - DNA, 15 bp, Homo sapiens
caaccccacccaccc

SEQ ID NO: 275960 - DNA, 15 bp, Homo sapiens
ccaaccccacccacc

SEQ ID NO: 275961 - DNA, 15 bp, Homo sapiens
cccaaccccacccac

SEQ ID NO: 275962 - DNA, 15 bp, Homo sapiens
tcccaaccccaccca

SEQ ID NO: 275963 - DNA, 15 bp, Homo sapiens
atcccaaccccaccc

SEQ ID NO: 275964 - DNA, 15 bp, Homo sapiens
tatcccaaccccacc

SEQ ID NO: 275965 - DNA, 15 bp, Homo sapiens
ctatcccaaccccac

SEQ ID NO: 275966 - DNA, 15 bp, Homo sapiens
actatcccaacccca

SEQ ID NO: 275967 - DNA, 15 bp, Homo sapiens
cactatcccaacccc

SEQ ID NO: 275968 - DNA, 15 bp, Homo sapiens
acactatcccaaccc

SEQ ID NO: 275969 - DNA, 15 bp, Homo sapiens
aacactatcccaacc

SEQ ID NO: 275970 - DNA, 15 bp, Homo sapiens
taacactatcccaac

SEQ ID NO: 275971 - DNA, 15 bp, Homo sapiens
ctaacactatcccaa

SEQ ID NO: 275972 - DNA, 15 bp, Homo sapiens
actaacactatccca

SEQ ID NO: 275973 - DNA, 15 bp, Homo sapiens
gactaacactatccc

SEQ ID NO: 275974 - DNA, 15 bp, Homo sapiens
ggactaacactatcc

SEQ ID NO: 275975 - DNA, 15 bp, Homo sapiens
tggactaacactatc

SEQ ID NO: 275976 - DNA, 15 bp, Homo sapiens
atggactaacactat

SEQ ID NO: 275977 - DNA, 15 bp, Homo sapiens
tatggactaacacta

SEQ ID NO: 275978 - DNA, 15 bp, Homo sapiens
atatggactaacact

SEQ ID NO: 275979 - DNA, 15 bp, Homo sapiens
gatatggactaacac

SEQ ID NO: 275980 - DNA, 15 bp, Homo sapiens
tgatatggactaaca

SEQ ID NO: 275981 - DNA, 15 bp, Homo sapiens
gtgatatggactaac

SEQ ID NO: 275982 - DNA, 15 bp, Homo sapiens
ggtgatatggactaa

SEQ ID NO: 275983 - DNA, 15 bp, Homo sapiens
gggtgatatggacta

SEQ ID NO: 275984 - DNA, 15 bp, Homo sapiens
agggtgatatggact

SEQ ID NO: 275985 - DNA, 15 bp, Homo sapiens
tagggtgatatggac

SEQ ID NO: 275986 - DNA, 15 bp, Homo sapiens
ttagggtgatatgga

SEQ ID NO: 275987 - DNA, 15 bp, Homo sapiens
tttagggtgatatgg

SEQ ID NO: 275988 - DNA, 15 bp, Homo sapiens
atttagggtgatatg

SEQ ID NO: 275989 - DNA, 15 bp, Homo sapiens
catttagggtgatat

SEQ ID NO: 275990 - DNA, 15 bp, Homo sapiens
tcatttagggtgata

SEQ ID NO: 275991 - DNA, 15 bp, Homo sapiens
atcatttagggtgat

SEQ ID NO: 275992 - DNA, 15 bp, Homo sapiens
aatcatttagggtga

SEQ ID NO: 275993 - DNA, 15 bp, Homo sapiens
taatcatttagggtg

SEQ ID NO: 275994 - DNA, 15 bp, Homo sapiens
ataatcatttagggt

SEQ ID NO: 275995 - DNA, 15 bp, Homo sapiens
gataatcatttaggg

SEQ ID NO: 275996 - DNA, 15 bp, Homo sapiens
tgataatcatttagg

SEQ ID NO: 275997 - DNA, 15 bp, Homo sapiens
ttgataatcatttag

SEQ ID NO: 275998 - DNA, 15 bp, Homo sapiens
tttgataatcattta

SEQ ID NO: 275999 - DNA, 15 bp, Homo sapiens
gtttgataatcattt

SEQ ID NO: 276000 - DNA, 15 bp, Homo sapiens
agtttgataatcatt

SEQ ID NO: 276001 - DNA, 15 bp, Homo sapiens
tagtttgataatcat

SEQ ID NO: 276002 - DNA, 15 bp, Homo sapiens
ttagtttgataatca

SEQ ID NO: 276003 - DNA, 15 bp, Homo sapiens
attagtttgataatc

SEQ ID NO: 276004 - DNA, 15 bp, Homo sapiens
gattagtttgataat

SEQ ID NO: 276005 - DNA, 15 bp, Homo sapiens
tgattagtttgataa

SEQ ID NO: 276006 - DNA, 15 bp, Homo sapiens
atgattagtttgata

SEQ ID NO: 276007 - DNA, 15 bp, Homo sapiens
aatgattagtttgat

SEQ ID NO: 276008 - DNA, 15 bp, Homo sapiens
aaatgattagtttga

SEQ ID NO: 276009 - DNA, 15 bp, Homo sapiens
taaatgattagtttg

SEQ ID NO: 276010 - DNA, 15 bp, Homo sapiens
ctaaatgattagttt

SEQ ID NO: 276011 - DNA, 15 bp, Homo sapiens
tctaaatgattagtt

SEQ ID NO: 276012 - DNA, 15 bp, Homo sapiens
ttctaaatgattagt

SEQ ID NO: 276013 - DNA, 15 bp, Homo sapiens
tttctaaatgattag

SEQ ID NO: 276014 - DNA, 15 bp, Homo sapiens
atttctaaatgatta

SEQ ID NO: 276015 - DNA, 15 bp, Homo sapiens
tatttctaaatgatt

SEQ ID NO: 276016 - DNA, 15 bp, Homo sapiens
gtatttctaaatgat

SEQ ID NO: 276017 - DNA, 15 bp, Homo sapiens
ggtatttctaaatga

SEQ ID NO: 276018 - DNA, 15 bp, Homo sapiens
aggtatttctaaatg

SEQ ID NO: 276019 - DNA, 15 bp, Homo sapiens
taggtatttctaaat

SEQ ID NO: 276020 - DNA, 15 bp, Homo sapiens
ttaggtatttctaaa

SEQ ID NO: 276021 - DNA, 15 bp, Homo sapiens
cttaggtatttctaa

SEQ ID NO: 276022 - DNA, 15 bp, Homo sapiens
ccttaggtatttcta

SEQ ID NO: 276023 - DNA, 15 bp, Homo sapiens
cccttaggtatttct

SEQ ID NO: 276024 - DNA, 15 bp, Homo sapiens
tcccttaggtatttc

SEQ ID NO: 276025 - DNA, 15 bp, Homo sapiens
ttcccttaggtattt

SEQ ID NO: 276026 - DNA, 15 bp, Homo sapiens
gttcccttaggtatt

SEQ ID NO: 276027 - DNA, 15 bp, Homo sapiens
tgttcccttaggtat

SEQ ID NO: 276028 - DNA, 15 bp, Homo sapiens
ctgttcccttaggta

SEQ ID NO: 276029 - DNA, 15 bp, Homo sapiens
actgttcccttaggt

SEQ ID NO: 276030 - DNA, 15 bp, Homo sapiens
cactgttcccttagg

SEQ ID NO: 276031 - DNA, 15 bp, Homo sapiens
tcactgttcccttag

SEQ ID NO: 276032 - DNA, 15 bp, Homo sapiens
gtcactgttccctta

SEQ ID NO: 276033 - DNA, 15 bp, Homo sapiens
tgtcactgttccctt

SEQ ID NO: 276034 - DNA, 15 bp, Homo sapiens
atgtcactgttccct

SEQ ID NO: 276035 - DNA, 15 bp, Homo sapiens
aatgtcactgttccc

SEQ ID NO: 276036 - DNA, 15 bp, Homo sapiens
aaatgtcactgttcc

SEQ ID NO: 276037 - DNA, 15 bp, Homo sapiens
aaaatgtcactgttc

SEQ ID NO: 276038 - DNA, 15 bp, Homo sapiens
taaaatgtcactgtt

SEQ ID NO: 276039 - DNA, 15 bp, Homo sapiens
ataaaatgtcactgt

SEQ ID NO: 276040 - DNA, 15 bp, Homo sapiens
tataaaatgtcactg

SEQ ID NO: 276041 - DNA, 15 bp, Homo sapiens
gtataaaatgtcact

SEQ ID NO: 276042 - DNA, 15 bp, Homo sapiens
ggtataaaatgtcac

SEQ ID NO: 276043 - DNA, 15 bp, Homo sapiens
tggtataaaatgtca

SEQ ID NO: 276044 - DNA, 15 bp, Homo sapiens
gtggtataaaatgtc

SEQ ID NO: 276045 - DNA, 15 bp, Homo sapiens
agtggtataaaatgt

SEQ ID NO: 276046 - DNA, 15 bp, Homo sapiens
tagtggtataaaatg

SEQ ID NO: 276047 - DNA, 15 bp, Homo sapiens
atagtggtataaaat

SEQ ID NO: 276048 - DNA, 15 bp, Homo sapiens
aatagtggtataaaa

SEQ ID NO: 276049 - DNA, 15 bp, Homo sapiens
taatagtggtataaa

SEQ ID NO: 276050 - DNA, 15 bp, Homo sapiens
ttaatagtggtataa

SEQ ID NO: 276051 - DNA, 15 bp, Homo sapiens
tttaatagtggtata

SEQ ID NO: 276052 - DNA, 15 bp, Homo sapiens
ttttaatagtggtat

SEQ ID NO: 276053 - DNA, 15 bp, Homo sapiens
tttttaatagtggta

SEQ ID NO: 276054 - DNA, 15 bp, Homo sapiens
atttttaatagtggt

SEQ ID NO: 276055 - DNA, 15 bp, Homo sapiens
catttttaatagtgg

SEQ ID NO: 276056 - DNA, 15 bp, Homo sapiens
acatttttaatagtg

SEQ ID NO: 276057 - DNA, 15 bp, Homo sapiens
tacatttttaatagt

SEQ ID NO: 276058 - DNA, 15 bp, Homo sapiens
ctacatttttaatag

SEQ ID NO: 276059 - DNA, 15 bp, Homo sapiens
actacatttttaata

SEQ ID NO: 276060 - DNA, 15 bp, Homo sapiens
aactacatttttaat

SEQ ID NO: 276061 - DNA, 15 bp, Homo sapiens
gaactacatttttaa

SEQ ID NO: 276062 - DNA, 15 bp, Homo sapiens
tgaactacattttta

SEQ ID NO: 276063 - DNA, 15 bp, Homo sapiens
ctgaactacattttt

SEQ ID NO: 276064 - DNA, 15 bp, Homo sapiens
cctgaactacatttt

SEQ ID NO: 276065 - DNA, 15 bp, Homo sapiens
acctgaactacattt

SEQ ID NO: 276066 - DNA, 15 bp, Homo sapiens
tacctgaactacatt

SEQ ID NO: 276067 - DNA, 15 bp, Homo sapiens
ttacctgaactacat

SEQ ID NO: 276068 - DNA, 15 bp, Homo sapiens
tttacctgaactaca

SEQ ID NO: 276069 - DNA, 15 bp, Homo sapiens
ttttacctgaactac

SEQ ID NO: 276070 - DNA, 15 bp, Homo sapiens
attttacctgaacta

SEQ ID NO: 276071 - DNA, 15 bp, Homo sapiens
tattttacctgaact

SEQ ID NO: 276072 - DNA, 15 bp, Homo sapiens
ttattttacctgaac

SEQ ID NO: 276073 - DNA, 15 bp, Homo sapiens
attattttacctgaa

SEQ ID NO: 276074 - DNA, 15 bp, Homo sapiens
aattattttacctga

SEQ ID NO: 276075 - DNA, 15 bp, Homo sapiens
taattattttacctg

SEQ ID NO: 276076 - DNA, 15 bp, Homo sapiens
atataattattttac

SEQ ID NO: 276077 - DNA, 15 bp, Homo sapiens
catataattatttta

SEQ ID NO: 276078 - DNA, 15 bp, Homo sapiens
acatataattatttt

SEQ ID NO: 276079 - DNA, 15 bp, Homo sapiens
gacatataattattt

SEQ ID NO: 276080 - DNA, 15 bp, Homo sapiens
agacatataattatt

SEQ ID NO: 276081 - DNA, 15 bp, Homo sapiens
cagacatataattat

SEQ ID NO: 276082 - DNA, 15 bp, Homo sapiens
gcagacatataatta

SEQ ID NO: 276083 - DNA, 15 bp, Homo sapiens
tgcagacatataatt

SEQ ID NO: 276084 - DNA, 15 bp, Homo sapiens
atgcagacatataat

SEQ ID NO: 276085 - DNA, 15 bp, Homo sapiens
tatgcagacatataa

SEQ ID NO: 276086 - DNA, 15 bp, Homo sapiens
ctatgcagacatata

SEQ ID NO: 276087 - DNA, 15 bp, Homo sapiens
actatgcagacatat

SEQ ID NO: 276088 - DNA, 15 bp, Homo sapiens
aactatgcagacata

SEQ ID NO: 276089 - DNA, 15 bp, Homo sapiens
caactatgcagacat

SEQ ID NO: 276090 - DNA, 15 bp, Homo sapiens
ccaactatgcagaca

SEQ ID NO: 276091 - DNA, 15 bp, Homo sapiens
cccaactatgcagac

SEQ ID NO: 276092 - DNA, 15 bp, Homo sapiens
tcccaactatgcaga

SEQ ID NO: 276093 - DNA, 15 bp, Homo sapiens
ttcccaactatgcag

SEQ ID NO: 276094 - DNA, 15 bp, Homo sapiens
tttcccaactatgca

SEQ ID NO: 276095 - DNA, 15 bp, Homo sapiens
ctttcccaactatgc

SEQ ID NO: 276096 - DNA, 15 bp, Homo sapiens
cctttcccaactatg

SEQ ID NO: 276097 - DNA, 15 bp, Homo sapiens
tcctttcccaactat

SEQ ID NO: 276098 - DNA, 15 bp, Homo sapiens
gtcctttcccaacta

SEQ ID NO: 276099 - DNA, 15 bp, Homo sapiens
tgtcctttcccaact

SEQ ID NO: 276100 - DNA, 15 bp, Homo sapiens
ttgtcctttcccaac

SEQ ID NO: 276101 - DNA, 15 bp, Homo sapiens
tttgtcctttcccaa

SEQ ID NO: 276102 - DNA, 15 bp, Homo sapiens
ctttgtcctttccca

SEQ ID NO: 276103 - DNA, 15 bp, Homo sapiens
tctttgtcctttccc

SEQ ID NO: 276104 - DNA, 15 bp, Homo sapiens
ttctttgtcctttcc

SEQ ID NO: 276105 - DNA, 15 bp, Homo sapiens
tttctttgtcctttc

SEQ ID NO: 276106 - DNA, 15 bp, Homo sapiens
atttctttgtccttt

SEQ ID NO: 276107 - DNA, 15 bp, Homo sapiens
aatttctttgtcctt

SEQ ID NO: 276108 - DNA, 15 bp, Homo sapiens
caatttctttgtcct

SEQ ID NO: 276109 - DNA, 15 bp, Homo sapiens
tcaatttctttgtcc

SEQ ID NO: 276110 - DNA, 15 bp, Homo sapiens
gtcaatttctttgtc

SEQ ID NO: 276111 - DNA, 15 bp, Homo sapiens
tgtcaatttctttgt

SEQ ID NO: 276112 - DNA, 15 bp, Homo sapiens
ctgtcaatttctttg

SEQ ID NO: 276113 - DNA, 15 bp, Homo sapiens
actgtcaatttcttt

SEQ ID NO: 276114 - DNA, 15 bp, Homo sapiens
tactgtcaatttctt

SEQ ID NO: 276115 - DNA, 15 bp, Homo sapiens
atactgtcaatttct

SEQ ID NO: 276116 - DNA, 15 bp, Homo sapiens
aatactgtcaatttc

SEQ ID NO: 276117 - DNA, 15 bp, Homo sapiens
gaatactgtcaattt

SEQ ID NO: 276118 - DNA, 15 bp, Homo sapiens
ggaatactgtcaatt

SEQ ID NO: 276119 - DNA, 15 bp, Homo sapiens
aggaatactgtcaat

SEQ ID NO: 276120 - DNA, 15 bp, Homo sapiens
aaggaatactgtcaa

SEQ ID NO: 276121 - DNA, 15 bp, Homo sapiens
gaaggaatactgtca

SEQ ID NO: 276122 - DNA, 15 bp, Homo sapiens
ggaaggaatactgtc

SEQ ID NO: 276123 - DNA, 15 bp, Homo sapiens
gggaaggaatactgt

SEQ ID NO: 276124 - DNA, 15 bp, Homo sapiens
tgggaaggaatactg

SEQ ID NO: 276125 - DNA, 15 bp, Homo sapiens
ttgggaaggaatact

SEQ ID NO: 276126 - DNA, 15 bp, Homo sapiens
tttgggaaggaatac

SEQ ID NO: 276127 - DNA, 15 bp, Homo sapiens
gtttgggaaggaata

SEQ ID NO: 276128 - DNA, 15 bp, Homo sapiens
tgtttgggaaggaat

SEQ ID NO: 276129 - DNA, 15 bp, Homo sapiens
ctgtttgggaaggaa

SEQ ID NO: 276130 - DNA, 15 bp, Homo sapiens
tctgtttgggaagga

SEQ ID NO: 276131 - DNA, 15 bp, Homo sapiens
ctctgtttgggaagg

SEQ ID NO: 276132 - DNA, 15 bp, Homo sapiens
gctctgtttgggaag

SEQ ID NO: 276133 - DNA, 15 bp, Homo sapiens
tgctctgtttgggaa

SEQ ID NO: 276134 - DNA, 15 bp, Homo sapiens
gtgctctgtttggga

SEQ ID NO: 276135 - DNA, 15 bp, Homo sapiens
ggtgctctgtttggg

SEQ ID NO: 276136 - DNA, 15 bp, Homo sapiens
tggtgctctgtttgg

SEQ ID NO: 276137 - DNA, 15 bp, Homo sapiens
ttggtgctctgtttg

SEQ ID NO: 276138 - DNA, 15 bp, Homo sapiens
attggtgctctgttt

SEQ ID NO: 276139 - DNA, 15 bp, Homo sapiens
cattggtgctctgtt

SEQ ID NO: 276140 - DNA, 15 bp, Homo sapiens
acattggtgctctgt

SEQ ID NO: 276141 - DNA, 15 bp, Homo sapiens
cacattggtgctctg

SEQ ID NO: 276142 - DNA, 15 bp, Homo sapiens
ccacattggtgctct

SEQ ID NO: 276143 - DNA, 15 bp, Homo sapiens
gccacattggtgctc

SEQ ID NO: 276144 - DNA, 15 bp, Homo sapiens
ggccacattggtgct

SEQ ID NO: 276145 - DNA, 15 bp, Homo sapiens
gggccacattggtgc

SEQ ID NO: 276146 - DNA, 15 bp, Homo sapiens
agggccacattggtg

SEQ ID NO: 276147 - DNA, 15 bp, Homo sapiens
cagggccacattggt

SEQ ID NO: 276148 - DNA, 15 bp, Homo sapiens
gcagggccacattgg

SEQ ID NO: 276149 - DNA, 15 bp, Homo sapiens
agcagggccacattg

SEQ ID NO: 276150 - DNA, 15 bp, Homo sapiens
gagcagggccacatt

SEQ ID NO: 276151 - DNA, 15 bp, Homo sapiens
agagcagggccacat

SEQ ID NO: 276152 - DNA, 15 bp, Homo sapiens
aagagcagggccaca

SEQ ID NO: 276153 - DNA, 15 bp, Homo sapiens
aaagagcagggccac

SEQ ID NO: 276154 - DNA, 15 bp, Homo sapiens
gaaagagcagggcca

SEQ ID NO: 276155 - DNA, 15 bp, Homo sapiens
agaaagagcagggcc

SEQ ID NO: 276156 - DNA, 15 bp, Homo sapiens
gagaaagagcagggc

SEQ ID NO: 276157 - DNA, 15 bp, Homo sapiens
agagaaagagcaggg

SEQ ID NO: 276158 - DNA, 15 bp, Homo sapiens
gagagaaagagcagg

SEQ ID NO: 276159 - DNA, 15 bp, Homo sapiens
agagagaaagagcag

SEQ ID NO: 276160 - DNA, 15 bp, Homo sapiens
aagagagaaagagca

SEQ ID NO: 276161 - DNA, 15 bp, Homo sapiens
taagagagaaagagc

SEQ ID NO: 276162 - DNA, 15 bp, Homo sapiens
ataagagagaaagag

SEQ ID NO: 276163 - DNA, 15 bp, Homo sapiens
aataagagagaaaga

SEQ ID NO: 276164 - DNA, 15 bp, Homo sapiens
aaataagagagaaag

SEQ ID NO: 276165 - DNA, 15 bp, Homo sapiens
taaataagagagaaa

SEQ ID NO: 276166 - DNA, 15 bp, Homo sapiens
ataaataagagagaa

SEQ ID NO: 276167 - DNA, 15 bp, Homo sapiens
aataaataagagaga

SEQ ID NO: 276168 - DNA, 15 bp, Homo sapiens
caataaataagagag

SEQ ID NO: 276169 - DNA, 15 bp, Homo sapiens
acaataaataagaga

SEQ ID NO: 276170 - DNA, 15 bp, Homo sapiens
gacaataaataagag

SEQ ID NO: 276171 - DNA, 15 bp, Homo sapiens
agacaataaataaga

SEQ ID NO: 276172 - DNA, 15 bp, Homo sapiens
aagacaataaataag

SEQ ID NO: 276173 - DNA, 15 bp, Homo sapiens
taagacaataaataa

SEQ ID NO: 276174 - DNA, 15 bp, Homo sapiens
gtaagacaataaata

SEQ ID NO: 276175 - DNA, 15 bp, Homo sapiens
ggtaagacaataaat

SEQ ID NO: 276176 - DNA, 15 bp, Homo sapiens
aggtaagacaataaa

SEQ ID NO: 276177 - DNA, 15 bp, Homo sapiens
aaggtaagacaataa

SEQ ID NO: 276178 - DNA, 15 bp, Homo sapiens
aaaggtaagacaata

SEQ ID NO: 276179 - DNA, 15 bp, Homo sapiens
aaaaggtaagacaat

SEQ ID NO: 276180 - DNA, 15 bp, Homo sapiens
aaaaaggtaagacaa

SEQ ID NO: 276181 - DNA, 15 bp, Homo sapiens
gaaaaaggtaagaca

SEQ ID NO: 276182 - DNA, 15 bp, Homo sapiens
ggaaaaaggtaagac

SEQ ID NO: 276183 - DNA, 15 bp, Homo sapiens
gggaaaaaggtaaga

SEQ ID NO: 276184 - DNA, 15 bp, Homo sapiens
ggggaaaaaggtaag

SEQ ID NO: 276185 - DNA, 15 bp, Homo sapiens
tggggaaaaaggtaa

SEQ ID NO: 276186 - DNA, 15 bp, Homo sapiens
gtggggaaaaaggta

SEQ ID NO: 276187 - DNA, 15 bp, Homo sapiens
agtggggaaaaaggt

SEQ ID NO: 276188 - DNA, 15 bp, Homo sapiens
tagtggggaaaaagg

SEQ ID NO: 276189 - DNA, 15 bp, Homo sapiens
ctagtggggaaaaag

SEQ ID NO: 276190 - DNA, 15 bp, Homo sapiens
tctagtggggaaaaa

SEQ ID NO: 276191 - DNA, 15 bp, Homo sapiens
ttctagtggggaaaa

SEQ ID NO: 276192 - DNA, 15 bp, Homo sapiens
attctagtggggaaa

SEQ ID NO: 276193 - DNA, 15 bp, Homo sapiens
tattctagtggggaa

SEQ ID NO: 276194 - DNA, 15 bp, Homo sapiens
atattctagtgggga

SEQ ID NO: 276195 - DNA, 15 bp, Homo sapiens
tatattctagtgggg

SEQ ID NO: 276196 - DNA, 15 bp, Homo sapiens
atatattctagtggg

SEQ ID NO: 276197 - DNA, 15 bp, Homo sapiens
catatattctagtgg

SEQ ID NO: 276198 - DNA, 15 bp, Homo sapiens
gcatatattctagtg

SEQ ID NO: 276199 - DNA, 15 bp, Homo sapiens
agcatatattctagt

SEQ ID NO: 276200 - DNA, 15 bp, Homo sapiens
cagcatatattctag

SEQ ID NO: 276201 - DNA, 15 bp, Homo sapiens
ccagcatatattcta

SEQ ID NO: 276202 - DNA, 15 bp, Homo sapiens
gccagcatatattct

SEQ ID NO: 276203 - DNA, 15 bp, Homo sapiens
agccagcatatattc

SEQ ID NO: 276204 - DNA, 15 bp, Homo sapiens
aagccagcatatatt

SEQ ID NO: 276205 - DNA, 15 bp, Homo sapiens
caagccagcatatat

SEQ ID NO: 276206 - DNA, 15 bp, Homo sapiens
acaagccagcatata

SEQ ID NO: 276207 - DNA, 15 bp, Homo sapiens
cacaagccagcatat

SEQ ID NO: 276208 - DNA, 15 bp, Homo sapiens
acacaagccagcata

SEQ ID NO: 276209 - DNA, 15 bp, Homo sapiens
cacacaagccagcat

SEQ ID NO: 276210 - DNA, 15 bp, Homo sapiens
acacacaagccagca

SEQ ID NO: 276211 - DNA, 15 bp, Homo sapiens
tacacacaagccagc

SEQ ID NO: 276212 - DNA, 15 bp, Homo sapiens
ctacacacaagccag

SEQ ID NO: 276213 - DNA, 15 bp, Homo sapiens
gctacacacaagcca

SEQ ID NO: 276214 - DNA, 15 bp, Homo sapiens
ggctacacacaagcc

SEQ ID NO: 276215 - DNA, 15 bp, Homo sapiens
tggctacacacaagc

SEQ ID NO: 276216 - DNA, 15 bp, Homo sapiens
ctggctacacacaag

SEQ ID NO: 276217 - DNA, 15 bp, Homo sapiens
gctggctacacacaa

SEQ ID NO: 276218 - DNA, 15 bp, Homo sapiens
tgctggctacacaca

SEQ ID NO: 276219 - DNA, 15 bp, Homo sapiens
atgctggctacacac

SEQ ID NO: 276220 - DNA, 15 bp, Homo sapiens
gatgctggctacaca

SEQ ID NO: 276221 - DNA, 15 bp, Homo sapiens
cgatgctggctacac

SEQ ID NO: 276222 - DNA, 15 bp, Homo sapiens
ccgatgctggctaca

SEQ ID NO: 276223 - DNA, 15 bp, Homo sapiens
gccgatgctggctac

SEQ ID NO: 276224 - DNA, 15 bp, Homo sapiens
agccgatgctggcta

SEQ ID NO: 276225 - DNA, 15 bp, Homo sapiens
gagccgatgctggct

SEQ ID NO: 276226 - DNA, 15 bp, Homo sapiens
agagccgatgctggc

SEQ ID NO: 276227 - DNA, 15 bp, Homo sapiens
tagagccgatgctgg

SEQ ID NO: 276228 - DNA, 15 bp, Homo sapiens
atagagccgatgctg

SEQ ID NO: 276229 - DNA, 15 bp, Homo sapiens
catagagccgatgct

SEQ ID NO: 276230 - DNA, 15 bp, Homo sapiens
tcatagagccgatgc

SEQ ID NO: 276231 - DNA, 15 bp, Homo sapiens
gtcatagagccgatg

SEQ ID NO: 276232 - DNA, 15 bp, Homo sapiens
agtcatagagccgat

SEQ ID NO: 276233 - DNA, 15 bp, Homo sapiens
tagtcatagagccga

SEQ ID NO: 276234 - DNA, 15 bp, Homo sapiens
ttagtcatagagccg

SEQ ID NO: 276235 - DNA, 15 bp, Homo sapiens
attagtcatagagcc

SEQ ID NO: 276236 - DNA, 15 bp, Homo sapiens
aattagtcatagagc

SEQ ID NO: 276237 - DNA, 15 bp, Homo sapiens
aaattagtcatagag

SEQ ID NO: 276238 - DNA, 15 bp, Homo sapiens
gaaattagtcataga

SEQ ID NO: 276239 - DNA, 15 bp, Homo sapiens
ggaaattagtcatag

SEQ ID NO: 276240 - DNA, 15 bp, Homo sapiens
tggaaattagtcata

SEQ ID NO: 276241 - DNA, 15 bp, Homo sapiens
atggaaattagtcat

SEQ ID NO: 276242 - DNA, 15 bp, Homo sapiens
aatggaaattagtca

SEQ ID NO: 276243 - DNA, 15 bp, Homo sapiens
taatggaaattagtc

SEQ ID NO: 276244 - DNA, 15 bp, Homo sapiens
ttaatggaaattagt

SEQ ID NO: 276245 - DNA, 15 bp, Homo sapiens
gttaatggaaattag

SEQ ID NO: 276246 - DNA, 15 bp, Homo sapiens
tgttaatggaaatta

SEQ ID NO: 276247 - DNA, 15 bp, Homo sapiens
gtgttaatggaaatt

SEQ ID NO: 276248 - DNA, 15 bp, Homo sapiens
tgtgttaatggaaat

SEQ ID NO: 276249 - DNA, 15 bp, Homo sapiens
ctgtgttaatggaaa

SEQ ID NO: 276250 - DNA, 15 bp, Homo sapiens
gctgtgttaatggaa

SEQ ID NO: 276251 - DNA, 15 bp, Homo sapiens
agctgtgttaatgga

SEQ ID NO: 276252 - DNA, 15 bp, Homo sapiens
aagctgtgttaatgg

SEQ ID NO: 276253 - DNA, 15 bp, Homo sapiens
caagctgtgttaatg

SEQ ID NO: 276254 - DNA, 15 bp, Homo sapiens
ccaagctgtgttaat

SEQ ID NO: 276255 - DNA, 15 bp, Homo sapiens
accaagctgtgttaa

SEQ ID NO: 276256 - DNA, 15 bp, Homo sapiens
aaccaagctgtgtta

SEQ ID NO: 276257 - DNA, 15 bp, Homo sapiens
taaccaagctgtgtt

SEQ ID NO: 276258 - DNA, 15 bp, Homo sapiens
ttaaccaagctgtgt

SEQ ID NO: 276259 - DNA, 15 bp, Homo sapiens
tttaaccaagctgtg

SEQ ID NO: 276260 - DNA, 15 bp, Homo sapiens
ttttaaccaagctgt

SEQ ID NO: 276261 - DNA, 15 bp, Homo sapiens
gttttaaccaagctg

SEQ ID NO: 276262 - DNA, 15 bp, Homo sapiens
ggttttaaccaagct

SEQ ID NO: 276263 - DNA, 15 bp, Homo sapiens
tggttttaaccaagc

SEQ ID NO: 276264 - DNA, 15 bp, Homo sapiens
atggttttaaccaag

SEQ ID NO: 276265 - DNA, 15 bp, Homo sapiens
aatggttttaaccaa

SEQ ID NO: 276266 - DNA, 15 bp, Homo sapiens
caatggttttaacca

SEQ ID NO: 276267 - DNA, 15 bp, Homo sapiens
acaatggttttaacc

SEQ ID NO: 276268 - DNA, 15 bp, Homo sapiens
cacaatggttttaac

SEQ ID NO: 276269 - DNA, 15 bp, Homo sapiens
ccacaatggttttaa

SEQ ID NO: 276270 - DNA, 15 bp, Homo sapiens
accacaatggtttta

SEQ ID NO: 276271 - DNA, 15 bp, Homo sapiens
aaccacaatggtttt

SEQ ID NO: 276272 - DNA, 15 bp, Homo sapiens
taaccacaatggttt

SEQ ID NO: 276273 - DNA, 15 bp, Homo sapiens
ttaaccacaatggtt

SEQ ID NO: 276274 - DNA, 15 bp, Homo sapiens
tttaaccacaatggt

SEQ ID NO: 276275 - DNA, 15 bp, Homo sapiens
ttttaaccacaatgg

SEQ ID NO: 276276 - DNA, 15 bp, Homo sapiens
gttttaaccacaatg

SEQ ID NO: 276277 - DNA, 15 bp, Homo sapiens
ggttttaaccacaat

SEQ ID NO: 276278 - DNA, 15 bp, Homo sapiens
tggttttaaccacaa

SEQ ID NO: 276279 - DNA, 15 bp, Homo sapiens
tgtggttttaaccac

SEQ ID NO: 276280 - DNA, 15 bp, Homo sapiens
ttgtggttttaacca

SEQ ID NO: 276281 - DNA, 15 bp, Homo sapiens
attgtggttttaacc

SEQ ID NO: 276282 - DNA, 15 bp, Homo sapiens
tattgtggttttaac

SEQ ID NO: 276283 - DNA, 15 bp, Homo sapiens
gtattgtggttttaa

SEQ ID NO: 276284 - DNA, 15 bp, Homo sapiens
agtattgtggtttta

SEQ ID NO: 276285 - DNA, 15 bp, Homo sapiens
gagtattgtggtttt

SEQ ID NO: 276286 - DNA, 15 bp, Homo sapiens
agagtattgtggttt

SEQ ID NO: 276287 - DNA, 15 bp, Homo sapiens
cagagtattgtggtt

SEQ ID NO: 276288 - DNA, 15 bp, Homo sapiens
acagagtattgtggt

SEQ ID NO: 276289 - DNA, 15 bp, Homo sapiens
gacagagtattgtgg

SEQ ID NO: 276290 - DNA, 15 bp, Homo sapiens
tgacagagtattgtg

SEQ ID NO: 276291 - DNA, 15 bp, Homo sapiens
atgacagagtattgt

SEQ ID NO: 276292 - DNA, 15 bp, Homo sapiens
gatgacagagtattg

SEQ ID NO: 276293 - DNA, 15 bp, Homo sapiens
tgatgacagagtatt

SEQ ID NO: 276294 - DNA, 15 bp, Homo sapiens
gtgatgacagagtat

SEQ ID NO: 276295 - DNA, 15 bp, Homo sapiens
agtgatgacagagta

SEQ ID NO: 276296 - DNA, 15 bp, Homo sapiens
tagtgatgacagagt

SEQ ID NO: 276297 - DNA, 15 bp, Homo sapiens
atagtgatgacagag

SEQ ID NO: 276298 - DNA, 15 bp, Homo sapiens
tatagtgatgacaga

SEQ ID NO: 276299 - DNA, 15 bp, Homo sapiens
atatagtgatgacag

SEQ ID NO: 276300 - DNA, 15 bp, Homo sapiens
aatatagtgatgaca

SEQ ID NO: 276301 - DNA, 15 bp, Homo sapiens
taatatagtgatgac

SEQ ID NO: 276302 - DNA, 15 bp, Homo sapiens
ttaatatagtgatga

SEQ ID NO: 276303 - DNA, 15 bp, Homo sapiens
attaatatagtgatg

SEQ ID NO: 276304 - DNA, 15 bp, Homo sapiens
tattaatatagtgat

SEQ ID NO: 276305 - DNA, 15 bp, Homo sapiens
ctattaatatagtga

SEQ ID NO: 276306 - DNA, 15 bp, Homo sapiens
gctattaatatagtg

SEQ ID NO: 276307 - DNA, 15 bp, Homo sapiens
tgctattaatatagt

SEQ ID NO: 276308 - DNA, 15 bp, Homo sapiens
ttgctattaatatag

SEQ ID NO: 276309 - DNA, 15 bp, Homo sapiens
tttgctattaatata

SEQ ID NO: 276310 - DNA, 15 bp, Homo sapiens
atttgctattaatat

SEQ ID NO: 276311 - DNA, 15 bp, Homo sapiens
aatttgctattaata

SEQ ID NO: 276312 - DNA, 15 bp, Homo sapiens
caatttgctattaat

SEQ ID NO: 276313 - DNA, 15 bp, Homo sapiens
tcaatttgctattaa

SEQ ID NO: 276314 - DNA, 15 bp, Homo sapiens
ttcaatttgctatta

SEQ ID NO: 276315 - DNA, 15 bp, Homo sapiens
tttcaatttgctatt

SEQ ID NO: 276316 - DNA, 15 bp, Homo sapiens
ttttcaatttgctat

SEQ ID NO: 276317 - DNA, 15 bp, Homo sapiens
attttcaatttgcta

SEQ ID NO: 276318 - DNA, 15 bp, Homo sapiens
aattttcaatttgct

SEQ ID NO: 276319 - DNA, 15 bp, Homo sapiens
aaattttcaatttgc

SEQ ID NO: 276320 - DNA, 15 bp, Homo sapiens
aaaattttcaatttg

SEQ ID NO: 276321 - DNA, 15 bp, Homo sapiens
aaaaattttcaattt

SEQ ID NO: 276322 - DNA, 15 bp, Homo sapiens
aaaaaattttcaatt

SEQ ID NO: 276323 - DNA, 15 bp, Homo sapiens
aaaaaaattttcaat

SEQ ID NO: 276324 - DNA, 15 bp, Homo sapiens
taaaaaaattttcaa

SEQ ID NO: 276325 - DNA, 15 bp, Homo sapiens
ctaaaaaaattttca

SEQ ID NO: 276326 - DNA, 15 bp, Homo sapiens
actaaaaaaattttc

SEQ ID NO: 276327 - DNA, 15 bp, Homo sapiens
cactaaaaaaatttt

SEQ ID NO: 276328 - DNA, 15 bp, Homo sapiens
tcactaaaaaaattt

SEQ ID NO: 276329 - DNA, 15 bp, Homo sapiens
atcactaaaaaaatt

SEQ ID NO: 276330 - DNA, 15 bp, Homo sapiens
tatcactaaaaaaat

SEQ ID NO: 276331 - DNA, 15 bp, Homo sapiens
ttatcactaaaaaaa

SEQ ID NO: 276332 - DNA, 15 bp, Homo sapiens
cttatcactaaaaaa

SEQ ID NO: 276333 - DNA, 15 bp, Homo sapiens
tcttatcactaaaaa

SEQ ID NO: 276334 - DNA, 15 bp, Homo sapiens
ttcttatcactaaaa

SEQ ID NO: 276335 - DNA, 15 bp, Homo sapiens
gttcttatcactaaa

SEQ ID NO: 276336 - DNA, 15 bp, Homo sapiens
ggttcttatcactaa

SEQ ID NO: 276337 - DNA, 15 bp, Homo sapiens
tggttcttatcacta

SEQ ID NO: 276338 - DNA, 15 bp, Homo sapiens
ctggttcttatcact

SEQ ID NO: 276339 - DNA, 15 bp, Homo sapiens
gctggttcttatcac

SEQ ID NO: 276340 - DNA, 15 bp, Homo sapiens
ggctggttcttatca

SEQ ID NO: 276341 - DNA, 15 bp, Homo sapiens
tggctggttcttatc

SEQ ID NO: 276342 - DNA, 15 bp, Homo sapiens
ttggctggttcttat

SEQ ID NO: 276343 - DNA, 15 bp, Homo sapiens
attggctggttctta

SEQ ID NO: 276344 - DNA, 15 bp, Homo sapiens
tattggctggttctt

SEQ ID NO: 276345 - DNA, 15 bp, Homo sapiens
ctattggctggttct

SEQ ID NO: 276346 - DNA, 15 bp, Homo sapiens
actattggctggttc

SEQ ID NO: 276347 - DNA, 15 bp, Homo sapiens
aactattggctggtt

SEQ ID NO: 276348 - DNA, 15 bp, Homo sapiens
aaactattggctggt

SEQ ID NO: 276349 - DNA, 15 bp, Homo sapiens
caaactattggctgg

SEQ ID NO: 276350 - DNA, 15 bp, Homo sapiens
ccaaactattggctg

SEQ ID NO: 276351 - DNA, 15 bp, Homo sapiens
tccaaactattggct

SEQ ID NO: 276352 - DNA, 15 bp, Homo sapiens
ttccaaactattggc

SEQ ID NO: 276353 - DNA, 15 bp, Homo sapiens
tttccaaactattgg

SEQ ID NO: 276354 - DNA, 15 bp, Homo sapiens
ttttccaaactattg

SEQ ID NO: 276355 - DNA, 15 bp, Homo sapiens
tttttccaaactatt

SEQ ID NO: 276356 - DNA, 15 bp, Homo sapiens
atttttccaaactat

SEQ ID NO: 276357 - DNA, 15 bp, Homo sapiens
aatttttccaaacta

SEQ ID NO: 276358 - DNA, 15 bp, Homo sapiens
taatttttccaaact

SEQ ID NO: 276359 - DNA, 15 bp, Homo sapiens
ctaatttttccaaac

SEQ ID NO: 276360 - DNA, 15 bp, Homo sapiens
actaatttttccaaa

SEQ ID NO: 276361 - DNA, 15 bp, Homo sapiens
aactaatttttccaa

SEQ ID NO: 276362 - DNA, 15 bp, Homo sapiens
aaactaatttttcca

SEQ ID NO: 276363 - DNA, 15 bp, Homo sapiens
caaactaatttttcc

SEQ ID NO: 276364 - DNA, 15 bp, Homo sapiens
ccaaactaatttttc

SEQ ID NO: 276365 - DNA, 15 bp, Homo sapiens
tccaaactaattttt

SEQ ID NO: 276366 - DNA, 15 bp, Homo sapiens
ttccaaactaatttt

SEQ ID NO: 276367 - DNA, 15 bp, Homo sapiens
tttccaaactaattt

SEQ ID NO: 276368 - DNA, 15 bp, Homo sapiens
ttttccaaactaatt

SEQ ID NO: 276369 - DNA, 15 bp, Homo sapiens
tttttccaaactaat

SEQ ID NO: 276370 - DNA, 15 bp, Homo sapiens
atttttccaaactaa

SEQ ID NO: 276371 - DNA, 15 bp, Homo sapiens
aaatttttccaaact

SEQ ID NO: 276372 - DNA, 15 bp, Homo sapiens
gaaatttttccaaac

SEQ ID NO: 276373 - DNA, 15 bp, Homo sapiens
tgaaatttttccaaa

SEQ ID NO: 276374 - DNA, 15 bp, Homo sapiens
ttgaaatttttccaa

SEQ ID NO: 276375 - DNA, 15 bp, Homo sapiens
tttgaaatttttcca

SEQ ID NO: 276376 - DNA, 15 bp, Homo sapiens
ttttgaaatttttcc

SEQ ID NO: 276377 - DNA, 15 bp, Homo sapiens
gttttgaaatttttc

SEQ ID NO: 276378 - DNA, 15 bp, Homo sapiens
agttttgaaattttt

SEQ ID NO: 276379 - DNA, 15 bp, Homo sapiens
tagttttgaaatttt

SEQ ID NO: 276380 - DNA, 15 bp, Homo sapiens
taattagttttgaaa

SEQ ID NO: 276381 - DNA, 15 bp, Homo sapiens
ataattagttttgaa

SEQ ID NO: 276382 - DNA, 15 bp, Homo sapiens
tataattagttttga

SEQ ID NO: 276383 - DNA, 15 bp, Homo sapiens
gtataattagttttg

SEQ ID NO: 276384 - DNA, 15 bp, Homo sapiens
agtataattagtttt

SEQ ID NO: 276385 - DNA, 15 bp, Homo sapiens
aagtataattagttt

SEQ ID NO: 276386 - DNA, 15 bp, Homo sapiens
aaagtataattagtt

SEQ ID NO: 276387 - DNA, 15 bp, Homo sapiens
aaaagtataattagt

SEQ ID NO: 276388 - DNA, 15 bp, Homo sapiens
aaaaagtataattag

SEQ ID NO: 276389 - DNA, 15 bp, Homo sapiens
caaaaagtataatta

SEQ ID NO: 276390 - DNA, 15 bp, Homo sapiens
ccaaaaagtataatt

SEQ ID NO: 276391 - DNA, 15 bp, Homo sapiens
gccaaaaagtataat

SEQ ID NO: 276392 - DNA, 15 bp, Homo sapiens
ggccaaaaagtataa

SEQ ID NO: 276393 - DNA, 15 bp, Homo sapiens
gggccaaaaagtata

SEQ ID NO: 276394 - DNA, 15 bp, Homo sapiens
tgggccaaaaagtat

SEQ ID NO: 276395 - DNA, 15 bp, Homo sapiens
ttgggccaaaaagta

SEQ ID NO: 276396 - DNA, 15 bp, Homo sapiens
cttgggccaaaaagt

SEQ ID NO: 276397 - DNA, 15 bp, Homo sapiens
acttgggccaaaaag

SEQ ID NO: 276398 - DNA, 15 bp, Homo sapiens
aacttgggccaaaaa

SEQ ID NO: 276399 - DNA, 15 bp, Homo sapiens
aaacttgggccaaaa

SEQ ID NO: 276400 - DNA, 15 bp, Homo sapiens
aaaacttgggccaaa

SEQ ID NO: 276401 - DNA, 15 bp, Homo sapiens
taaaacttgggccaa

SEQ ID NO: 276402 - DNA, 15 bp, Homo sapiens
ttaaaacttgggcca

SEQ ID NO: 276403 - DNA, 15 bp, Homo sapiens
tttaaaacttgggcc

SEQ ID NO: 276404 - DNA, 15 bp, Homo sapiens
ttttaaaacttgggc

SEQ ID NO: 276405 - DNA, 15 bp, Homo sapiens
attttaaaacttggg

SEQ ID NO: 276406 - DNA, 15 bp, Homo sapiens
tattttaaaacttgg

SEQ ID NO: 276407 - DNA, 15 bp, Homo sapiens
atattttaaaacttg

SEQ ID NO: 276408 - DNA, 15 bp, Homo sapiens
aatattttaaaactt

SEQ ID NO: 276409 - DNA, 15 bp, Homo sapiens
caatattttaaaact

SEQ ID NO: 276410 - DNA, 15 bp, Homo sapiens
ccaatattttaaaac

SEQ ID NO: 276411 - DNA, 15 bp, Homo sapiens
cccaatattttaaaa

SEQ ID NO: 276412 - DNA, 15 bp, Homo sapiens
ccccaatattttaaa

SEQ ID NO: 276413 - DNA, 15 bp, Homo sapiens
tccccaatattttaa

SEQ ID NO: 276414 - DNA, 15 bp, Homo sapiens
ttccccaatatttta

SEQ ID NO: 276415 - DNA, 15 bp, Homo sapiens
tttccccaatatttt

SEQ ID NO: 276416 - DNA, 15 bp, Homo sapiens
atttccccaatattt

SEQ ID NO: 276417 - DNA, 15 bp, Homo sapiens
catttccccaatatt

SEQ ID NO: 276418 - DNA, 15 bp, Homo sapiens
tcatttccccaatat

SEQ ID NO: 276419 - DNA, 15 bp, Homo sapiens
ttcatttccccaata

SEQ ID NO: 276420 - DNA, 15 bp, Homo sapiens
gttcatttccccaat

SEQ ID NO: 276421 - DNA, 15 bp, Homo sapiens
agttcatttccccaa

SEQ ID NO: 276422 - DNA, 15 bp, Homo sapiens
tagttcatttcccca

SEQ ID NO: 276423 - DNA, 15 bp, Homo sapiens
ctagttcatttcccc

SEQ ID NO: 276424 - DNA, 15 bp, Homo sapiens
cctagttcatttccc

SEQ ID NO: 276425 - DNA, 15 bp, Homo sapiens
acctagttcatttcc

SEQ ID NO: 276426 - DNA, 15 bp, Homo sapiens
tacctagttcatttc

SEQ ID NO: 276427 - DNA, 15 bp, Homo sapiens
atacctagttcattt

SEQ ID NO: 276428 - DNA, 15 bp, Homo sapiens
catacctagttcatt

SEQ ID NO: 276429 - DNA, 15 bp, Homo sapiens
ccatacctagttcat

SEQ ID NO: 276430 - DNA, 15 bp, Homo sapiens
accatacctagttca

SEQ ID NO: 276431 - DNA, 15 bp, Homo sapiens
aaccatacctagttc

SEQ ID NO: 276432 - DNA, 15 bp, Homo sapiens
aaaccatacctagtt

SEQ ID NO: 276433 - DNA, 15 bp, Homo sapiens
taaaccatacctagt

SEQ ID NO: 276434 - DNA, 15 bp, Homo sapiens
ataaaccatacctag

SEQ ID NO: 276435 - DNA, 15 bp, Homo sapiens
aataaaccataccta

SEQ ID NO: 276436 - DNA, 15 bp, Homo sapiens
aaataaaccatacct

SEQ ID NO: 276437 - DNA, 15 bp, Homo sapiens
aaaataaaccatacc

SEQ ID NO: 276438 - DNA, 15 bp, Homo sapiens
gaaaataaaccatac

SEQ ID NO: 276439 - DNA, 15 bp, Homo sapiens
tgaaaataaaccata

SEQ ID NO: 276440 - DNA, 15 bp, Homo sapiens
ttgaaaataaaccat

SEQ ID NO: 276441 - DNA, 15 bp, Homo sapiens
gttgaaaataaacca

SEQ ID NO: 276442 - DNA, 15 bp, Homo sapiens
tgttgaaaataaacc

SEQ ID NO: 276443 - DNA, 15 bp, Homo sapiens
ctgttgaaaataaac

SEQ ID NO: 276444 - DNA, 15 bp, Homo sapiens
tctgttgaaaataaa

SEQ ID NO: 276445 - DNA, 15 bp, Homo sapiens
ctctgttgaaaataa

SEQ ID NO: 276446 - DNA, 15 bp, Homo sapiens
tctctgttgaaaata

SEQ ID NO: 276447 - DNA, 15 bp, Homo sapiens
ttctctgttgaaaat

SEQ ID NO: 276448 - DNA, 15 bp, Homo sapiens
attctctgttgaaaa

SEQ ID NO: 276449 - DNA, 15 bp, Homo sapiens
cattctctgttgaaa

SEQ ID NO: 276450 - DNA, 15 bp, Homo sapiens
tcattctctgttgaa

SEQ ID NO: 276451 - DNA, 15 bp, Homo sapiens
ttcattctctgttga

SEQ ID NO: 276452 - DNA, 15 bp, Homo sapiens
tttcattctctgttg

SEQ ID NO: 276453 - DNA, 15 bp, Homo sapiens
ttttcattctctgtt

SEQ ID NO: 276454 - DNA, 15 bp, Homo sapiens
tttttcattctctgt

SEQ ID NO: 276455 - DNA, 15 bp, Homo sapiens
ctttttcattctctg

SEQ ID NO: 276456 - DNA, 15 bp, Homo sapiens
actttttcattctct

SEQ ID NO: 276457 - DNA, 15 bp, Homo sapiens
tactttttcattctc

SEQ ID NO: 276458 - DNA, 15 bp, Homo sapiens
atactttttcattct

SEQ ID NO: 276459 - DNA, 15 bp, Homo sapiens
tatactttttcattc

SEQ ID NO: 276460 - DNA, 15 bp, Homo sapiens
ttatactttttcatt

SEQ ID NO: 276461 - DNA, 15 bp, Homo sapiens
tttatactttttcat

SEQ ID NO: 276462 - DNA, 15 bp, Homo sapiens
gtttatactttttca

SEQ ID NO: 276463 - DNA, 15 bp, Homo sapiens
tgtttatactttttc

SEQ ID NO: 276464 - DNA, 15 bp, Homo sapiens
atgtttatacttttt

SEQ ID NO: 276465 - DNA, 15 bp, Homo sapiens
tatgtttatactttt

SEQ ID NO: 276466 - DNA, 15 bp, Homo sapiens
atatgtttatacttt

SEQ ID NO: 276467 - DNA, 15 bp, Homo sapiens
gatatgtttatactt

SEQ ID NO: 276468 - DNA, 15 bp, Homo sapiens
tgatatgtttatact

SEQ ID NO: 276469 - DNA, 15 bp, Homo sapiens
gtgatatgtttatac

SEQ ID NO: 276470 - DNA, 15 bp, Homo sapiens
agtgatatgtttata

SEQ ID NO: 276471 - DNA, 15 bp, Homo sapiens
cagtgatatgtttat

SEQ ID NO: 276472 - DNA, 15 bp, Homo sapiens
ccagtgatatgttta

SEQ ID NO: 276473 - DNA, 15 bp, Homo sapiens
tccagtgatatgttt

SEQ ID NO: 276474 - DNA, 15 bp, Homo sapiens
atccagtgatatgtt

SEQ ID NO: 276475 - DNA, 15 bp, Homo sapiens
tatccagtgatatgt

SEQ ID NO: 276476 - DNA, 15 bp, Homo sapiens
atatccagtgatatg

SEQ ID NO: 276477 - DNA, 15 bp, Homo sapiens
tatatccagtgatat

SEQ ID NO: 276478 - DNA, 15 bp, Homo sapiens
atatatccagtgata

SEQ ID NO: 276479 - DNA, 15 bp, Homo sapiens
aatatatccagtgat

SEQ ID NO: 276480 - DNA, 15 bp, Homo sapiens
aaatatatccagtga

SEQ ID NO: 276481 - DNA, 15 bp, Homo sapiens
taaatatatccagtg

SEQ ID NO: 276482 - DNA, 15 bp, Homo sapiens
ctaaatatatccagt

SEQ ID NO: 276483 - DNA, 15 bp, Homo sapiens
actaaatatatccag

SEQ ID NO: 276484 - DNA, 15 bp, Homo sapiens
cactaaatatatcca

SEQ ID NO: 276485 - DNA, 15 bp, Homo sapiens
tcactaaatatatcc

SEQ ID NO: 276486 - DNA, 15 bp, Homo sapiens
atcactaaatatatc

SEQ ID NO: 276487 - DNA, 15 bp, Homo sapiens
catcactaaatatat

SEQ ID NO: 276488 - DNA, 15 bp, Homo sapiens
tcatcactaaatata

SEQ ID NO: 276489 - DNA, 15 bp, Homo sapiens
ctcatcactaaatat

SEQ ID NO: 276490 - DNA, 15 bp, Homo sapiens
actcatcactaaata

SEQ ID NO: 276491 - DNA, 15 bp, Homo sapiens
aactcatcactaaat

SEQ ID NO: 276492 - DNA, 15 bp, Homo sapiens
gaactcatcactaaa

SEQ ID NO: 276493 - DNA, 15 bp, Homo sapiens
agaactcatcactaa

SEQ ID NO: 276494 - DNA, 15 bp, Homo sapiens
aagaactcatcacta

SEQ ID NO: 276495 - DNA, 15 bp, Homo sapiens
taagaactcatcact

SEQ ID NO: 276496 - DNA, 15 bp, Homo sapiens
ataagaactcatcac

SEQ ID NO: 276497 - DNA, 15 bp, Homo sapiens
aataagaactcatca

SEQ ID NO: 276498 - DNA, 15 bp, Homo sapiens
caataagaactcatc

SEQ ID NO: 276499 - DNA, 15 bp, Homo sapiens
gcaataagaactcat

SEQ ID NO: 276500 - DNA, 15 bp, Homo sapiens
ggcaataagaactca

SEQ ID NO: 276501 - DNA, 15 bp, Homo sapiens
tggcaataagaactc

SEQ ID NO: 276502 - DNA, 15 bp, Homo sapiens
ttggcaataagaact

SEQ ID NO: 276503 - DNA, 15 bp, Homo sapiens
cttggcaataagaac

SEQ ID NO: 276504 - DNA, 15 bp, Homo sapiens
acttggcaataagaa

SEQ ID NO: 276505 - DNA, 15 bp, Homo sapiens
cacttggcaataaga

SEQ ID NO: 276506 - DNA, 15 bp, Homo sapiens
acacttggcaataag

SEQ ID NO: 276507 - DNA, 15 bp, Homo sapiens
aacacttggcaataa

SEQ ID NO: 276508 - DNA, 15 bp, Homo sapiens
aaacacttggcaata

SEQ ID NO: 276509 - DNA, 15 bp, Homo sapiens
aaaacacttggcaat

SEQ ID NO: 276510 - DNA, 15 bp, Homo sapiens
gaaaacacttggcaa

SEQ ID NO: 276511 - DNA, 15 bp, Homo sapiens
tgaaaacacttggca

SEQ ID NO: 276512 - DNA, 15 bp, Homo sapiens
atgaaaacacttggc

SEQ ID NO: 276513 - DNA, 15 bp, Homo sapiens
catgaaaacacttgg

SEQ ID NO: 276514 - DNA, 15 bp, Homo sapiens
tcatgaaaacacttg

SEQ ID NO: 276515 - DNA, 15 bp, Homo sapiens
ctcatgaaaacactt

SEQ ID NO: 276516 - DNA, 15 bp, Homo sapiens
tctcatgaaaacact

SEQ ID NO: 276517 - DNA, 15 bp, Homo sapiens
gtctcatgaaaacac

SEQ ID NO: 276518 - DNA, 15 bp, Homo sapiens
agtctcatgaaaaca

SEQ ID NO: 276519 - DNA, 15 bp, Homo sapiens
cagtctcatgaaaac

SEQ ID NO: 276520 - DNA, 15 bp, Homo sapiens
gcagtctcatgaaaa

SEQ ID NO: 276521 - DNA, 15 bp, Homo sapiens
agcagtctcatgaaa

SEQ ID NO: 276522 - DNA, 15 bp, Homo sapiens
aagcagtctcatgaa

SEQ ID NO: 276523 - DNA, 15 bp, Homo sapiens
aaagcagtctcatga

SEQ ID NO: 276524 - DNA, 15 bp, Homo sapiens
taaagcagtctcatg

SEQ ID NO: 276525 - DNA, 15 bp, Homo sapiens
ataaagcagtctcat

SEQ ID NO: 276526 - DNA, 15 bp, Homo sapiens
aataaagcagtctca

SEQ ID NO: 276527 - DNA, 15 bp, Homo sapiens
aaataaagcagtctc

SEQ ID NO: 276528 - DNA, 15 bp, Homo sapiens
gaaataaagcagtct

SEQ ID NO: 276529 - DNA, 15 bp, Homo sapiens
tgaaataaagcagtc

SEQ ID NO: 276530 - DNA, 15 bp, Homo sapiens
ttgaaataaagcagt

SEQ ID NO: 276531 - DNA, 15 bp, Homo sapiens
tttgaaataaagcag

SEQ ID NO: 276532 - DNA, 15 bp, Homo sapiens
ttttgaaataaagca

SEQ ID NO: 276533 - DNA, 15 bp, Homo sapiens
tttttgaaataaagc

SEQ ID NO: 276534 - DNA, 15 bp, Homo sapiens
atttttgaaataaag

SEQ ID NO: 276535 - DNA, 15 bp, Homo sapiens
catttttgaaataaa

SEQ ID NO: 276536 - DNA, 15 bp, Homo sapiens
gcatttttgaaataa

SEQ ID NO: 276537 - DNA, 15 bp, Homo sapiens
tgcatttttgaaata

SEQ ID NO: 276538 - DNA, 15 bp, Homo sapiens
atgcatttttgaaat

SEQ ID NO: 276539 - DNA, 15 bp, Homo sapiens
tatgcatttttgaaa

SEQ ID NO: 276540 - DNA, 15 bp, Homo sapiens
ttatgcatttttgaa

SEQ ID NO: 276541 - DNA, 15 bp, Homo sapiens
tttatgcatttttga

SEQ ID NO: 276542 - DNA, 15 bp, Homo sapiens
ttttatgcatttttg

SEQ ID NO: 276543 - DNA, 15 bp, Homo sapiens
gttttatgcattttt

SEQ ID NO: 276544 - DNA, 15 bp, Homo sapiens
agttttatgcatttt

SEQ ID NO: 276545 - DNA, 15 bp, Homo sapiens
tagttttatgcattt

SEQ ID NO: 276546 - DNA, 15 bp, Homo sapiens
gtagttttatgcatt

SEQ ID NO: 276547 - DNA, 15 bp, Homo sapiens
ggtagttttatgcat

SEQ ID NO: 276548 - DNA, 15 bp, Homo sapiens
tggtagttttatgca

SEQ ID NO: 276549 - DNA, 15 bp, Homo sapiens
ttggtagttttatgc

SEQ ID NO: 276550 - DNA, 15 bp, Homo sapiens
tttggtagttttatg

SEQ ID NO: 276551 - DNA, 15 bp, Homo sapiens
ttttggtagttttat

SEQ ID NO: 276552 - DNA, 15 bp, Homo sapiens
gttttggtagtttta

SEQ ID NO: 276553 - DNA, 15 bp, Homo sapiens
agttttggtagtttt

SEQ ID NO: 276554 - DNA, 15 bp, Homo sapiens
cagttttggtagttt

SEQ ID NO: 276555 - DNA, 15 bp, Homo sapiens
acagttttggtagtt

SEQ ID NO: 276556 - DNA, 15 bp, Homo sapiens
aacagttttggtagt

SEQ ID NO: 276557 - DNA, 15 bp, Homo sapiens
caacagttttggtag

SEQ ID NO: 276558 - DNA, 15 bp, Homo sapiens
tcaacagttttggta

SEQ ID NO: 276559 - DNA, 15 bp, Homo sapiens
gtcaacagttttggt

SEQ ID NO: 276560 - DNA, 15 bp, Homo sapiens
tgtcaacagttttgg

SEQ ID NO: 276561 - DNA, 15 bp, Homo sapiens
atgtcaacagttttg

SEQ ID NO: 276562 - DNA, 15 bp, Homo sapiens
aatgtcaacagtttt

SEQ ID NO: 276563 - DNA, 15 bp, Homo sapiens
aaatgtcaacagttt

SEQ ID NO: 276564 - DNA, 15 bp, Homo sapiens
taaatgtcaacagtt

SEQ ID NO: 276565 - DNA, 15 bp, Homo sapiens
ttaaatgtcaacagt

SEQ ID NO: 276566 - DNA, 15 bp, Homo sapiens
attaaatgtcaacag

SEQ ID NO: 276567 - DNA, 15 bp, Homo sapiens
aattaaatgtcaaca

SEQ ID NO: 276568 - DNA, 15 bp, Homo sapiens
caattaaatgtcaac

SEQ ID NO: 276569 - DNA, 15 bp, Homo sapiens
gcaattaaatgtcaa

SEQ ID NO: 276570 - DNA, 15 bp, Homo sapiens
tgcaattaaatgtca

SEQ ID NO: 276571 - DNA, 15 bp, Homo sapiens
atgcaattaaatgtc

SEQ ID NO: 276572 - DNA, 15 bp, Homo sapiens
gatgcaattaaatgt

SEQ ID NO: 276573 - DNA, 15 bp, Homo sapiens
tgatgcaattaaatg

SEQ ID NO: 276574 - DNA, 15 bp, Homo sapiens
ttgatgcaattaaat

SEQ ID NO: 276575 - DNA, 15 bp, Homo sapiens
attgatgcaattaaa

SEQ ID NO: 276576 - DNA, 15 bp, Homo sapiens
aattgatgcaattaa

SEQ ID NO: 276577 - DNA, 15 bp, Homo sapiens
aaattgatgcaatta

SEQ ID NO: 276578 - DNA, 15 bp, Homo sapiens
taaattgatgcaatt

SEQ ID NO: 276579 - DNA, 15 bp, Homo sapiens
gtaaattgatgcaat

SEQ ID NO: 276580 - DNA, 15 bp, Homo sapiens
tgtaaattgatgcaa

SEQ ID NO: 276581 - DNA, 15 bp, Homo sapiens
atgtaaattgatgca

SEQ ID NO: 276582 - DNA, 15 bp, Homo sapiens
gatgtaaattgatgc

SEQ ID NO: 276583 - DNA, 15 bp, Homo sapiens
cgatgtaaattgatg

SEQ ID NO: 276584 - DNA, 15 bp, Homo sapiens
ccgatgtaaattgat

SEQ ID NO: 276585 - DNA, 15 bp, Homo sapiens
gccgatgtaaattga

SEQ ID NO: 276586 - DNA, 15 bp, Homo sapiens
agccgatgtaaattg

SEQ ID NO: 276587 - DNA, 15 bp, Homo sapiens
gagccgatgtaaatt

SEQ ID NO: 276588 - DNA, 15 bp, Homo sapiens
agagccgatgtaaat

SEQ ID NO: 276589 - DNA, 15 bp, Homo sapiens
cagagccgatgtaaa

SEQ ID NO: 276590 - DNA, 15 bp, Homo sapiens
tcagagccgatgtaa

SEQ ID NO: 276591 - DNA, 15 bp, Homo sapiens
atcagagccgatgta

SEQ ID NO: 276592 - DNA, 15 bp, Homo sapiens
aatcagagccgatgt

SEQ ID NO: 276593 - DNA, 15 bp, Homo sapiens
aaatcagagccgatg

SEQ ID NO: 276594 - DNA, 15 bp, Homo sapiens
aaaatcagagccgat

SEQ ID NO: 276595 - DNA, 15 bp, Homo sapiens
caaaatcagagccga

SEQ ID NO: 276596 - DNA, 15 bp, Homo sapiens
acaaaatcagagccg

SEQ ID NO: 276597 - DNA, 15 bp, Homo sapiens
aacaaaatcagagcc

SEQ ID NO: 276598 - DNA, 15 bp, Homo sapiens
taacaaaatcagagc

SEQ ID NO: 276599 - DNA, 15 bp, Homo sapiens
ataacaaaatcagag

SEQ ID NO: 276600 - DNA, 15 bp, Homo sapiens
tataacaaaatcaga

SEQ ID NO: 276601 - DNA, 15 bp, Homo sapiens
ctataacaaaatcag

SEQ ID NO: 276602 - DNA, 15 bp, Homo sapiens
tctataacaaaatca

SEQ ID NO: 276603 - DNA, 15 bp, Homo sapiens
atctataacaaaatc

SEQ ID NO: 276604 - DNA, 15 bp, Homo sapiens
ctatctataacaaaa

SEQ ID NO: 276605 - DNA, 15 bp, Homo sapiens
actatctataacaaa

SEQ ID NO: 276606 - DNA, 15 bp, Homo sapiens
aactatctataacaa

SEQ ID NO: 276607 - DNA, 15 bp, Homo sapiens
taactatctataaca

SEQ ID NO: 276608 - DNA, 15 bp, Homo sapiens
ataactatctataac

SEQ ID NO: 276609 - DNA, 15 bp, Homo sapiens
aataactatctataa

SEQ ID NO: 276610 - DNA, 15 bp, Homo sapiens
caataactatctata

SEQ ID NO: 276611 - DNA, 15 bp, Homo sapiens
gcaataactatctat

SEQ ID NO: 276612 - DNA, 15 bp, Homo sapiens
ggcaataactatcta

SEQ ID NO: 276613 - DNA, 15 bp, Homo sapiens
aggcaataactatct

SEQ ID NO: 276614 - DNA, 15 bp, Homo sapiens
aaggcaataactatc

SEQ ID NO: 276615 - DNA, 15 bp, Homo sapiens
gaaggcaataactat

SEQ ID NO: 276616 - DNA, 15 bp, Homo sapiens
ggaaggcaataacta

SEQ ID NO: 276617 - DNA, 15 bp, Homo sapiens
tggaaggcaataact

SEQ ID NO: 276618 - DNA, 15 bp, Homo sapiens
atggaaggcaataac

SEQ ID NO: 276619 - DNA, 15 bp, Homo sapiens
aatggaaggcaataa

SEQ ID NO: 276620 - DNA, 15 bp, Homo sapiens
aaatggaaggcaata

SEQ ID NO: 276621 - DNA, 15 bp, Homo sapiens
aaaatggaaggcaat

SEQ ID NO: 276622 - DNA, 15 bp, Homo sapiens
taaaatggaaggcaa

SEQ ID NO: 276623 - DNA, 15 bp, Homo sapiens
gtaaaatggaaggca

SEQ ID NO: 276624 - DNA, 15 bp, Homo sapiens
agtaaaatggaaggc

SEQ ID NO: 276625 - DNA, 15 bp, Homo sapiens
cagtaaaatggaagg

SEQ ID NO: 276626 - DNA, 15 bp, Homo sapiens
tcagtaaaatggaag

SEQ ID NO: 276627 - DNA, 15 bp, Homo sapiens
ctcagtaaaatggaa

SEQ ID NO: 276628 - DNA, 15 bp, Homo sapiens
tctcagtaaaatgga

SEQ ID NO: 276629 - DNA, 15 bp, Homo sapiens
ctctcagtaaaatgg

SEQ ID NO: 276630 - DNA, 15 bp, Homo sapiens
tctctcagtaaaatg

SEQ ID NO: 276631 - DNA, 15 bp, Homo sapiens
ttctctcagtaaaat

SEQ ID NO: 276632 - DNA, 15 bp, Homo sapiens
cttctctcagtaaaa

SEQ ID NO: 276633 - DNA, 15 bp, Homo sapiens
acttctctcagtaaa

SEQ ID NO: 276634 - DNA, 15 bp, Homo sapiens
cacttctctcagtaa

SEQ ID NO: 276635 - DNA, 15 bp, Homo sapiens
acacttctctcagta

SEQ ID NO: 276636 - DNA, 15 bp, Homo sapiens
tacacttctctcagt

SEQ ID NO: 276637 - DNA, 15 bp, Homo sapiens
ttacacttctctcag

SEQ ID NO: 276638 - DNA, 15 bp, Homo sapiens
attacacttctctca

SEQ ID NO: 276639 - DNA, 15 bp, Homo sapiens
aattacacttctctc

SEQ ID NO: 276640 - DNA, 15 bp, Homo sapiens
caattacacttctct

SEQ ID NO: 276641 - DNA, 15 bp, Homo sapiens
acaattacacttctc

SEQ ID NO: 276642 - DNA, 15 bp, Homo sapiens
aacaattacacttct

SEQ ID NO: 276643 - DNA, 15 bp, Homo sapiens
aaacaattacacttc

SEQ ID NO: 276644 - DNA, 15 bp, Homo sapiens
aaaacaattacactt

SEQ ID NO: 276645 - DNA, 15 bp, Homo sapiens
gaaaacaattacact

SEQ ID NO: 276646 - DNA, 15 bp, Homo sapiens
tgaaaacaattacac

SEQ ID NO: 276647 - DNA, 15 bp, Homo sapiens
ttgaaaacaattaca

SEQ ID NO: 276648 - DNA, 15 bp, Homo sapiens
gttgaaaacaattac

SEQ ID NO: 276649 - DNA, 15 bp, Homo sapiens
ggttgaaaacaatta

SEQ ID NO: 276650 - DNA, 15 bp, Homo sapiens
aaggttgaaaacaat

SEQ ID NO: 276651 - DNA, 15 bp, Homo sapiens
taaggttgaaaacaa

SEQ ID NO: 276652 - DNA, 15 bp, Homo sapiens
ataaggttgaaaaca

SEQ ID NO: 276653 - DNA, 15 bp, Homo sapiens
tataaggttgaaaac

SEQ ID NO: 276654 - DNA, 15 bp, Homo sapiens
ctataaggttgaaaa

SEQ ID NO: 276655 - DNA, 15 bp, Homo sapiens
tctataaggttgaaa

SEQ ID NO: 276656 - DNA, 15 bp, Homo sapiens
gtctataaggttgaa

SEQ ID NO: 276657 - DNA, 15 bp, Homo sapiens
tgtctataaggttga

SEQ ID NO: 276658 - DNA, 15 bp, Homo sapiens
ttgtctataaggttg

SEQ ID NO: 276659 - DNA, 15 bp, Homo sapiens
gttgtctataaggtt

SEQ ID NO: 276660 - DNA, 15 bp, Homo sapiens
tgttgtctataaggt

SEQ ID NO: 276661 - DNA, 15 bp, Homo sapiens
atgttgtctataagg

SEQ ID NO: 276662 - DNA, 15 bp, Homo sapiens
gatgttgtctataag

SEQ ID NO: 276663 - DNA, 15 bp, Homo sapiens
agatgttgtctataa

SEQ ID NO: 276664 - DNA, 15 bp, Homo sapiens
cagatgttgtctata

SEQ ID NO: 276665 - DNA, 15 bp, Homo sapiens
ccagatgttgtctat

SEQ ID NO: 276666 - DNA, 15 bp, Homo sapiens
cccagatgttgtcta

SEQ ID NO: 276667 - DNA, 15 bp, Homo sapiens
ccccagatgttgtct

SEQ ID NO: 276668 - DNA, 15 bp, Homo sapiens
tccccagatgttgtc

SEQ ID NO: 276669 - DNA, 15 bp, Homo sapiens
ttccccagatgttgt

SEQ ID NO: 276670 - DNA, 15 bp, Homo sapiens
cttccccagatgttg

SEQ ID NO: 276671 - DNA, 15 bp, Homo sapiens
tcttccccagatgtt

SEQ ID NO: 276672 - DNA, 15 bp, Homo sapiens
atcttccccagatgt

SEQ ID NO: 276673 - DNA, 15 bp, Homo sapiens
acatcttccccagat

SEQ ID NO: 276674 - DNA, 15 bp, Homo sapiens
tacatcttccccaga

SEQ ID NO: 276675 - DNA, 15 bp, Homo sapiens
gtacatcttccccag

SEQ ID NO: 276676 - DNA, 15 bp, Homo sapiens
cgtacatcttcccca

SEQ ID NO: 276677 - DNA, 15 bp, Homo sapiens
tcgtacatcttcccc

SEQ ID NO: 276678 - DNA, 15 bp, Homo sapiens
ctcgtacatcttccc

SEQ ID NO: 276679 - DNA, 15 bp, Homo sapiens
tctcgtacatcttcc

SEQ ID NO: 276680 - DNA, 15 bp, Homo sapiens
gtctcgtacatcttc

SEQ ID NO: 276681 - DNA, 15 bp, Homo sapiens
agtctcgtacatctt

SEQ ID NO: 276682 - DNA, 15 bp, Homo sapiens
aagtctcgtacatct

SEQ ID NO: 276683 - DNA, 15 bp, Homo sapiens
gaagtctcgtacatc

SEQ ID NO: 276684 - DNA, 15 bp, Homo sapiens
tgaagtctcgtacat

SEQ ID NO: 276685 - DNA, 15 bp, Homo sapiens
gtgaagtctcgtaca

SEQ ID NO: 276686 - DNA, 15 bp, Homo sapiens
tgtgaagtctcgtac

SEQ ID NO: 276687 - DNA, 15 bp, Homo sapiens
ttgtgaagtctcgta

SEQ ID NO: 276688 - DNA, 15 bp, Homo sapiens
tttgtgaagtctcgt

SEQ ID NO: 276689 - DNA, 15 bp, Homo sapiens
ctttgtgaagtctcg

SEQ ID NO: 276690 - DNA, 15 bp, Homo sapiens
cctttgtgaagtctc

SEQ ID NO: 276691 - DNA, 15 bp, Homo sapiens
acctttgtgaagtct

SEQ ID NO: 276692 - DNA, 15 bp, Homo sapiens
tacctttgtgaagtc

SEQ ID NO: 276693 - DNA, 15 bp, Homo sapiens
gtacctttgtgaagt

SEQ ID NO: 276694 - DNA, 15 bp, Homo sapiens
agtacctttgtgaag

SEQ ID NO: 276695 - DNA, 15 bp, Homo sapiens
aagtacctttgtgaa

SEQ ID NO: 276696 - DNA, 15 bp, Homo sapiens
taagtacctttgtga

SEQ ID NO: 276697 - DNA, 15 bp, Homo sapiens
ttaagtacctttgtg

SEQ ID NO: 276698 - DNA, 15 bp, Homo sapiens
cttaagtacctttgt

SEQ ID NO: 276699 - DNA, 15 bp, Homo sapiens
tcttaagtacctttg

SEQ ID NO: 276700 - DNA, 15 bp, Homo sapiens
ttcttaagtaccttt

SEQ ID NO: 276701 - DNA, 15 bp, Homo sapiens
gttcttaagtacctt

SEQ ID NO: 276702 - DNA, 15 bp, Homo sapiens
tgttcttaagtacct

SEQ ID NO: 276703 - DNA, 15 bp, Homo sapiens
ttgttcttaagtacc

SEQ ID NO: 276704 - DNA, 15 bp, Homo sapiens
cttgttcttaagtac

SEQ ID NO: 276705 - DNA, 15 bp, Homo sapiens
acttgttcttaagta

SEQ ID NO: 276706 - DNA, 15 bp, Homo sapiens
aacttgttcttaagt

SEQ ID NO: 276707 - DNA, 15 bp, Homo sapiens
gaacttgttcttaag

SEQ ID NO: 276708 - DNA, 15 bp, Homo sapiens
tgaacttgttcttaa

SEQ ID NO: 276709 - DNA, 15 bp, Homo sapiens
ctgaacttgttctta

SEQ ID NO: 276710 - DNA, 15 bp, Homo sapiens
cctgaacttgttctt

SEQ ID NO: 276711 - DNA, 15 bp, Homo sapiens
acctgaacttgttct

SEQ ID NO: 276712 - DNA, 15 bp, Homo sapiens
gacctgaacttgttc

SEQ ID NO: 276713 - DNA, 15 bp, Homo sapiens
cgacctgaacttgtt

SEQ ID NO: 276714 - DNA, 15 bp, Homo sapiens
tcgacctgaacttgt

SEQ ID NO: 276715 - DNA, 15 bp, Homo sapiens
ttcgacctgaacttg

SEQ ID NO: 276716 - DNA, 15 bp, Homo sapiens
cttcgacctgaactt

SEQ ID NO: 276717 - DNA, 15 bp, Homo sapiens
tcttcgacctgaact

SEQ ID NO: 276718 - DNA, 15 bp, Homo sapiens
ttcttcgacctgaac

SEQ ID NO: 276719 - DNA, 15 bp, Homo sapiens
cttcttcgacctgaa

SEQ ID NO: 276720 - DNA, 15 bp, Homo sapiens
acttcttcgacctga

SEQ ID NO: 276721 - DNA, 15 bp, Homo sapiens
tacttcttcgacctg

SEQ ID NO: 276722 - DNA, 15 bp, Homo sapiens
gtacttcttcgacct

SEQ ID NO: 276723 - DNA, 15 bp, Homo sapiens
agtacttcttcgacc

SEQ ID NO: 276724 - DNA, 15 bp, Homo sapiens
aagtacttcttcgac

SEQ ID NO: 276725 - DNA, 15 bp, Homo sapiens
aaagtacttcttcga

SEQ ID NO: 276726 - DNA, 15 bp, Homo sapiens
caaagtacttcttcg

SEQ ID NO: 276727 - DNA, 15 bp, Homo sapiens
gcaaagtacttcttc

SEQ ID NO: 276728 - DNA, 15 bp, Homo sapiens
ggcaaagtacttctt

SEQ ID NO: 276729 - DNA, 15 bp, Homo sapiens
tggcaaagtacttct

SEQ ID NO: 276730 - DNA, 15 bp, Homo sapiens
ttggcaaagtacttc

SEQ ID NO: 276731 - DNA, 15 bp, Homo sapiens
tttggcaaagtactt

SEQ ID NO: 276732 - DNA, 15 bp, Homo sapiens
gtttggcaaagtact

SEQ ID NO: 276733 - DNA, 15 bp, Homo sapiens
tgtttggcaaagtac

SEQ ID NO: 276734 - DNA, 15 bp, Homo sapiens
gtgtttggcaaagta

SEQ ID NO: 276735 - DNA, 15 bp, Homo sapiens
ggtgtttggcaaagt

SEQ ID NO: 276736 - DNA, 15 bp, Homo sapiens
gggtgtttggcaaag

SEQ ID NO: 276737 - DNA, 15 bp, Homo sapiens
agggtgtttggcaaa

SEQ ID NO: 276738 - DNA, 15 bp, Homo sapiens
gagggtgtttggcaa

SEQ ID NO: 276739 - DNA, 15 bp, Homo sapiens
cgagggtgtttggca

SEQ ID NO: 276740 - DNA, 15 bp, Homo sapiens
tcgagggtgtttggc

SEQ ID NO: 276741 - DNA, 15 bp, Homo sapiens
gtcgagggtgtttgg

SEQ ID NO: 276742 - DNA, 15 bp, Homo sapiens
agtcgagggtgtttg

SEQ ID NO: 276743 - DNA, 15 bp, Homo sapiens
aagtcgagggtgttt

SEQ ID NO: 276744 - DNA, 15 bp, Homo sapiens
caagtcgagggtgtt

SEQ ID NO: 276745 - DNA, 15 bp, Homo sapiens
ccaagtcgagggtgt

SEQ ID NO: 276746 - DNA, 15 bp, Homo sapiens
accaagtcgagggtg

SEQ ID NO: 276747 - DNA, 15 bp, Homo sapiens
aaccaagtcgagggt

SEQ ID NO: 276748 - DNA, 15 bp, Homo sapiens
taaccaagtcgaggg

SEQ ID NO: 276749 - DNA, 15 bp, Homo sapiens
gtaaccaagtcgagg

SEQ ID NO: 276750 - DNA, 15 bp, Homo sapiens
ggtaaccaagtcgag

SEQ ID NO: 276751 - DNA, 15 bp, Homo sapiens
aggtaaccaagtcga

SEQ ID NO: 276752 - DNA, 15 bp, Homo sapiens
caggtaaccaagtcg

SEQ ID NO: 276753 - DNA, 15 bp, Homo sapiens
gcaggtaaccaagtc

SEQ ID NO: 276754 - DNA, 15 bp, Homo sapiens
ggcaggtaaccaagt

SEQ ID NO: 276755 - DNA, 15 bp, Homo sapiens
aggcaggtaaccaag

SEQ ID NO: 276756 - DNA, 15 bp, Homo sapiens
caggcaggtaaccaa

SEQ ID NO: 276757 - DNA, 15 bp, Homo sapiens
acaggcaggtaacca

SEQ ID NO: 276758 - DNA, 15 bp, Homo sapiens
gacaggcaggtaacc

SEQ ID NO: 276759 - DNA, 15 bp, Homo sapiens
ggacaggcaggtaac

SEQ ID NO: 276760 - DNA, 15 bp, Homo sapiens
tggacaggcaggtaa

SEQ ID NO: 276761 - DNA, 15 bp, Homo sapiens
ctggacaggcaggta

SEQ ID NO: 276762 - DNA, 15 bp, Homo sapiens
tctggacaggcaggt

SEQ ID NO: 276763 - DNA, 15 bp, Homo sapiens
gtctggacaggcagg

SEQ ID NO: 276764 - DNA, 15 bp, Homo sapiens
tgtctggacaggcag

SEQ ID NO: 276765 - DNA, 15 bp, Homo sapiens
ctgtctggacaggca

SEQ ID NO: 276766 - DNA, 15 bp, Homo sapiens
actgtctggacaggc

SEQ ID NO: 276767 - DNA, 15 bp, Homo sapiens
aactgtctggacagg

SEQ ID NO: 276768 - DNA, 15 bp, Homo sapiens
gaactgtctggacag

SEQ ID NO: 276769 - DNA, 15 bp, Homo sapiens
agaactgtctggaca

SEQ ID NO: 276770 - DNA, 15 bp, Homo sapiens
aagaactgtctggac

SEQ ID NO: 276771 - DNA, 15 bp, Homo sapiens
caagaactgtctgga

SEQ ID NO: 276772 - DNA, 15 bp, Homo sapiens
tcaagaactgtctgg

SEQ ID NO: 276773 - DNA, 15 bp, Homo sapiens
ttcaagaactgtctg

SEQ ID NO: 276774 - DNA, 15 bp, Homo sapiens
cttcaagaactgtct

SEQ ID NO: 276775 - DNA, 15 bp, Homo sapiens
ccttcaagaactgtc

SEQ ID NO: 276776 - DNA, 15 bp, Homo sapiens
accttcaagaactgt

SEQ ID NO: 276777 - DNA, 15 bp, Homo sapiens
caccttcaagaactg

SEQ ID NO: 276778 - DNA, 15 bp, Homo sapiens
tcaccttcaagaact

SEQ ID NO: 276779 - DNA, 15 bp, Homo sapiens
gtcaccttcaagaac

SEQ ID NO: 276780 - DNA, 15 bp, Homo sapiens
tgtcaccttcaagaa

SEQ ID NO: 276781 - DNA, 15 bp, Homo sapiens
ttgtcaccttcaaga

SEQ ID NO: 276782 - DNA, 15 bp, Homo sapiens
gttgtcaccttcaag

SEQ ID NO: 276783 - DNA, 15 bp, Homo sapiens
agttgtcaccttcaa

SEQ ID NO: 276784 - DNA, 15 bp, Homo sapiens
aagttgtcaccttca

SEQ ID NO: 276785 - DNA, 15 bp, Homo sapiens
taagttgtcaccttc

SEQ ID NO: 276786 - DNA, 15 bp, Homo sapiens
ctaagttgtcacctt

SEQ ID NO: 276787 - DNA, 15 bp, Homo sapiens
tctaagttgtcacct

SEQ ID NO: 276788 - DNA, 15 bp, Homo sapiens
ctctaagttgtcacc

SEQ ID NO: 276789 - DNA, 15 bp, Homo sapiens
tctctaagttgtcac

SEQ ID NO: 276790 - DNA, 15 bp, Homo sapiens
gtctctaagttgtca

SEQ ID NO: 276791 - DNA, 15 bp, Homo sapiens
cgtctctaagttgtc

SEQ ID NO: 276792 - DNA, 15 bp, Homo sapiens
acgtctctaagttgt

SEQ ID NO: 276793 - DNA, 15 bp, Homo sapiens
tacgtctctaagttg

SEQ ID NO: 276794 - DNA, 15 bp, Homo sapiens
ttacgtctctaagtt

SEQ ID NO: 276795 - DNA, 15 bp, Homo sapiens
cttacgtctctaagt

SEQ ID NO: 276796 - DNA, 15 bp, Homo sapiens
acttacgtctctaag

SEQ ID NO: 276797 - DNA, 15 bp, Homo sapiens
aacttacgtctctaa

SEQ ID NO: 276798 - DNA, 15 bp, Homo sapiens
aaacttacgtctcta

SEQ ID NO: 276799 - DNA, 15 bp, Homo sapiens
caaacttacgtctct

SEQ ID NO: 276800 - DNA, 15 bp, Homo sapiens
tcaaacttacgtctc

SEQ ID NO: 276801 - DNA, 15 bp, Homo sapiens
atcaaacttacgtct

SEQ ID NO: 276802 - DNA, 15 bp, Homo sapiens
aatcaaacttacgtc

SEQ ID NO: 276803 - DNA, 15 bp, Homo sapiens
aaatcaaacttacgt

SEQ ID NO: 276804 - DNA, 15 bp, Homo sapiens
aaaatcaaacttacg

SEQ ID NO: 276805 - DNA, 15 bp, Homo sapiens
taaaatcaaacttac

SEQ ID NO: 276806 - DNA, 15 bp, Homo sapiens
ttaaaatcaaactta

SEQ ID NO: 276807 - DNA, 15 bp, Homo sapiens
attaaaatcaaactt

SEQ ID NO: 276808 - DNA, 15 bp, Homo sapiens
tattaaaatcaaact

SEQ ID NO: 276809 - DNA, 15 bp, Homo sapiens
atattaaaatcaaac

SEQ ID NO: 276810 - DNA, 15 bp, Homo sapiens
aatattaaaatcaaa

SEQ ID NO: 276811 - DNA, 15 bp, Homo sapiens
taatattaaaatcaa

SEQ ID NO: 276812 - DNA, 15 bp, Homo sapiens
ttaatattaaaatca

SEQ ID NO: 276813 - DNA, 15 bp, Homo sapiens
tttaatattaaaatc

SEQ ID NO: 276814 - DNA, 15 bp, Homo sapiens
atttaatattaaaat

SEQ ID NO: 276815 - DNA, 15 bp, Homo sapiens
gatttaatattaaaa

SEQ ID NO: 276816 - DNA, 15 bp, Homo sapiens
agatttaatattaaa

SEQ ID NO: 276817 - DNA, 15 bp, Homo sapiens
tagatttaatattaa

SEQ ID NO: 276818 - DNA, 15 bp, Homo sapiens
ctagatttaatatta

SEQ ID NO: 276819 - DNA, 15 bp, Homo sapiens
actagatttaatatt

SEQ ID NO: 276820 - DNA, 15 bp, Homo sapiens
cactagatttaatat

SEQ ID NO: 276821 - DNA, 15 bp, Homo sapiens
acactagatttaata

SEQ ID NO: 276822 - DNA, 15 bp, Homo sapiens
cacactagatttaat

SEQ ID NO: 276823 - DNA, 15 bp, Homo sapiens
tcacactagatttaa

SEQ ID NO: 276824 - DNA, 15 bp, Homo sapiens
ttcacactagattta

SEQ ID NO: 276825 - DNA, 15 bp, Homo sapiens
gttcacactagattt

SEQ ID NO: 276826 - DNA, 15 bp, Homo sapiens
tgttcacactagatt

SEQ ID NO: 276827 - DNA, 15 bp, Homo sapiens
atgttcacactagat

SEQ ID NO: 276828 - DNA, 15 bp, Homo sapiens
aatgttcacactaga

SEQ ID NO: 276829 - DNA, 15 bp, Homo sapiens
aaatgttcacactag

SEQ ID NO: 276830 - DNA, 15 bp, Homo sapiens
taaatgttcacacta

SEQ ID NO: 276831 - DNA, 15 bp, Homo sapiens
ataaatgttcacact

SEQ ID NO: 276832 - DNA, 15 bp, Homo sapiens
tataaatgttcacac

SEQ ID NO: 276833 - DNA, 15 bp, Homo sapiens
atataaatgttcaca

SEQ ID NO: 276834 - DNA, 15 bp, Homo sapiens
gatataaatgttcac

SEQ ID NO: 276835 - DNA, 15 bp, Homo sapiens
agatataaatgttca

SEQ ID NO: 276836 - DNA, 15 bp, Homo sapiens
cagatataaatgttc

SEQ ID NO: 276837 - DNA, 15 bp, Homo sapiens
tcagatataaatgtt

SEQ ID NO: 276838 - DNA, 15 bp, Homo sapiens
atcagatataaatgt

SEQ ID NO: 276839 - DNA, 15 bp, Homo sapiens
catcagatataaatg

SEQ ID NO: 276840 - DNA, 15 bp, Homo sapiens
acatcagatataaat

SEQ ID NO: 276841 - DNA, 15 bp, Homo sapiens
aacatcagatataaa

SEQ ID NO: 276842 - DNA, 15 bp, Homo sapiens
caacatcagatataa

SEQ ID NO: 276843 - DNA, 15 bp, Homo sapiens
acaacatcagatata

SEQ ID NO: 276844 - DNA, 15 bp, Homo sapiens
gacaacatcagatat

SEQ ID NO: 276845 - DNA, 15 bp, Homo sapiens
agacaacatcagata

SEQ ID NO: 276846 - DNA, 15 bp, Homo sapiens
aagacaacatcagat

SEQ ID NO: 276847 - DNA, 15 bp, Homo sapiens
aaagacaacatcaga

SEQ ID NO: 276848 - DNA, 15 bp, Homo sapiens
aaaagacaacatcag

SEQ ID NO: 276849 - DNA, 15 bp, Homo sapiens
aaaaagacaacatca

SEQ ID NO: 276850 - DNA, 15 bp, Homo sapiens
aaaaaagacaacatc

SEQ ID NO: 276851 - DNA, 15 bp, Homo sapiens
taaaaaagacaacat

SEQ ID NO: 276852 - DNA, 15 bp, Homo sapiens
ataaaaaagacaaca

SEQ ID NO: 276853 - DNA, 15 bp, Homo sapiens
cataaaaaagacaac

SEQ ID NO: 276854 - DNA, 15 bp, Homo sapiens
acataaaaaagacaa

SEQ ID NO: 276855 - DNA, 15 bp, Homo sapiens
aacataaaaaagaca

SEQ ID NO: 276856 - DNA, 15 bp, Homo sapiens
taacataaaaaagac

SEQ ID NO: 276857 - DNA, 15 bp, Homo sapiens
ctaacataaaaaaga

SEQ ID NO: 276858 - DNA, 15 bp, Homo sapiens
actaacataaaaaag

SEQ ID NO: 276859 - DNA, 15 bp, Homo sapiens
tactaacataaaaaa

SEQ ID NO: 276860 - DNA, 15 bp, Homo sapiens
ttactaacataaaaa

SEQ ID NO: 276861 - DNA, 15 bp, Homo sapiens
gttactaacataaaa

SEQ ID NO: 276862 - DNA, 15 bp, Homo sapiens
tgttactaacataaa

SEQ ID NO: 276863 - DNA, 15 bp, Homo sapiens
gtgttactaacataa

SEQ ID NO: 276864 - DNA, 15 bp, Homo sapiens
tgtgttactaacata

SEQ ID NO: 276865 - DNA, 15 bp, Homo sapiens
ttgtgttactaacat

SEQ ID NO: 276866 - DNA, 15 bp, Homo sapiens
cttgtgttactaaca

SEQ ID NO: 276867 - DNA, 15 bp, Homo sapiens
tcttgtgttactaac

SEQ ID NO: 276868 - DNA, 15 bp, Homo sapiens
ctcttgtgttactaa

SEQ ID NO: 276869 - DNA, 15 bp, Homo sapiens
tctcttgtgttacta

SEQ ID NO: 276870 - DNA, 15 bp, Homo sapiens
ttctcttgtgttact

SEQ ID NO: 276871 - DNA, 15 bp, Homo sapiens
tttctcttgtgttac

SEQ ID NO: 276872 - DNA, 15 bp, Homo sapiens
atttctcttgtgtta

SEQ ID NO: 276873 - DNA, 15 bp, Homo sapiens
aatttctcttgtgtt

SEQ ID NO: 276874 - DNA, 15 bp, Homo sapiens
caatttctcttgtgt

SEQ ID NO: 276875 - DNA, 15 bp, Homo sapiens
acaatttctcttgtg

SEQ ID NO: 276876 - DNA, 15 bp, Homo sapiens
aacaatttctcttgt

SEQ ID NO: 276877 - DNA, 15 bp, Homo sapiens
aaacaatttctcttg

SEQ ID NO: 276878 - DNA, 15 bp, Homo sapiens
taaacaatttctctt

SEQ ID NO: 276879 - DNA, 15 bp, Homo sapiens
ttaaacaatttctct

SEQ ID NO: 276880 - DNA, 15 bp, Homo sapiens
attaaacaatttctc

SEQ ID NO: 276881 - DNA, 15 bp, Homo sapiens
tattaaacaatttct

SEQ ID NO: 276882 - DNA, 15 bp, Homo sapiens
gtattaaacaatttc

SEQ ID NO: 276883 - DNA, 15 bp, Homo sapiens
ggtattaaacaattt

SEQ ID NO: 276884 - DNA, 15 bp, Homo sapiens
tggtattaaacaatt

SEQ ID NO: 276885 - DNA, 15 bp, Homo sapiens
ttggtattaaacaat

SEQ ID NO: 276886 - DNA, 15 bp, Homo sapiens
gttggtattaaacaa

SEQ ID NO: 276887 - DNA, 15 bp, Homo sapiens
agttggtattaaaca

SEQ ID NO: 276888 - DNA, 15 bp, Homo sapiens
cagttggtattaaac

SEQ ID NO: 276889 - DNA, 15 bp, Homo sapiens
gcagttggtattaaa

SEQ ID NO: 276890 - DNA, 15 bp, Homo sapiens
tgcagttggtattaa

SEQ ID NO: 276891 - DNA, 15 bp, Homo sapiens
atgcagttggtatta

SEQ ID NO: 276892 - DNA, 15 bp, Homo sapiens
aatgcagttggtatt

SEQ ID NO: 276893 - DNA, 15 bp, Homo sapiens
aaatgcagttggtat

SEQ ID NO: 276894 - DNA, 15 bp, Homo sapiens
aaaatgcagttggta

SEQ ID NO: 276895 - DNA, 15 bp, Homo sapiens
taaaatgcagttggt

SEQ ID NO: 276896 - DNA, 15 bp, Homo sapiens
ctaaaatgcagttgg

SEQ ID NO: 276897 - DNA, 15 bp, Homo sapiens
tctaaaatgcagttg

SEQ ID NO: 276898 - DNA, 15 bp, Homo sapiens
ctctaaaatgcagtt

SEQ ID NO: 276899 - DNA, 15 bp, Homo sapiens
cctctaaaatgcagt

SEQ ID NO: 276900 - DNA, 15 bp, Homo sapiens
cctcctctaaaatgc

SEQ ID NO: 276901 - DNA, 15 bp, Homo sapiens
acctcctctaaaatg

SEQ ID NO: 276902 - DNA, 15 bp, Homo sapiens
tacctcctctaaaat

SEQ ID NO: 276903 - DNA, 15 bp, Homo sapiens
ttacctcctctaaaa

SEQ ID NO: 276904 - DNA, 15 bp, Homo sapiens
tttacctcctctaaa

SEQ ID NO: 276905 - DNA, 15 bp, Homo sapiens
atttacctcctctaa

SEQ ID NO: 276906 - DNA, 15 bp, Homo sapiens
aatttacctcctcta

SEQ ID NO: 276907 - DNA, 15 bp, Homo sapiens
taatttacctcctct

SEQ ID NO: 276908 - DNA, 15 bp, Homo sapiens
ttaatttacctcctc

SEQ ID NO: 276909 - DNA, 15 bp, Homo sapiens
tttaatttacctcct

SEQ ID NO: 276910 - DNA, 15 bp, Homo sapiens
gtttaatttacctcc

SEQ ID NO: 276911 - DNA, 15 bp, Homo sapiens
agtttaatttacctc

SEQ ID NO: 276912 - DNA, 15 bp, Homo sapiens
aagtttaatttacct

SEQ ID NO: 276913 - DNA, 15 bp, Homo sapiens
caagtttaatttacc

SEQ ID NO: 276914 - DNA, 15 bp, Homo sapiens
ccaagtttaatttac

SEQ ID NO: 276915 - DNA, 15 bp, Homo sapiens
tccaagtttaattta

SEQ ID NO: 276916 - DNA, 15 bp, Homo sapiens
ttccaagtttaattt

SEQ ID NO: 276917 - DNA, 15 bp, Homo sapiens
attccaagtttaatt

SEQ ID NO: 276918 - DNA, 15 bp, Homo sapiens
gattccaagtttaat

SEQ ID NO: 276919 - DNA, 15 bp, Homo sapiens
tgattccaagtttaa

SEQ ID NO: 276920 - DNA, 15 bp, Homo sapiens
ctgattccaagttta

SEQ ID NO: 276921 - DNA, 15 bp, Homo sapiens
actgattccaagttt

SEQ ID NO: 276922 - DNA, 15 bp, Homo sapiens
gactgattccaagtt

SEQ ID NO: 276923 - DNA, 15 bp, Homo sapiens
agactgattccaagt

SEQ ID NO: 276924 - DNA, 15 bp, Homo sapiens
aagactgattccaag

SEQ ID NO: 276925 - DNA, 15 bp, Homo sapiens
gaagactgattccaa

SEQ ID NO: 276926 - DNA, 15 bp, Homo sapiens
tgaagactgattcca

SEQ ID NO: 276927 - DNA, 15 bp, Homo sapiens
gtgaagactgattcc

SEQ ID NO: 276928 - DNA, 15 bp, Homo sapiens
tgtgaagactgattc

SEQ ID NO: 276929 - DNA, 15 bp, Homo sapiens
ttgtgaagactgatt

SEQ ID NO: 276930 - DNA, 15 bp, Homo sapiens
gttgtgaagactgat

SEQ ID NO: 276931 - DNA, 15 bp, Homo sapiens
tgttgtgaagactga

SEQ ID NO: 276932 - DNA, 15 bp, Homo sapiens
atgttgtgaagactg

SEQ ID NO: 276933 - DNA, 15 bp, Homo sapiens
catgttgtgaagact

SEQ ID NO: 276934 - DNA, 15 bp, Homo sapiens
tcatgttgtgaagac

SEQ ID NO: 276935 - DNA, 15 bp, Homo sapiens
ttcatgttgtgaaga

SEQ ID NO: 276936 - DNA, 15 bp, Homo sapiens
attcatgttgtgaag

SEQ ID NO: 276937 - DNA, 15 bp, Homo sapiens
aattcatgttgtgaa

SEQ ID NO: 276938 - DNA, 15 bp, Homo sapiens
aaattcatgttgtga

SEQ ID NO: 276939 - DNA, 15 bp, Homo sapiens
aaaattcatgttgtg

SEQ ID NO: 276940 - DNA, 15 bp, Homo sapiens
aaaaattcatgttgt

SEQ ID NO: 276941 - DNA, 15 bp, Homo sapiens
taaaaattcatgttg

SEQ ID NO: 276942 - DNA, 15 bp, Homo sapiens
gtaaaaattcatgtt

SEQ ID NO: 276943 - DNA, 15 bp, Homo sapiens
tgtaaaaattcatgt

SEQ ID NO: 276944 - DNA, 15 bp, Homo sapiens
ttgtaaaaattcatg

SEQ ID NO: 276945 - DNA, 15 bp, Homo sapiens
attgtaaaaattcat

SEQ ID NO: 276946 - DNA, 15 bp, Homo sapiens
aattgtaaaaattca

SEQ ID NO: 276947 - DNA, 15 bp, Homo sapiens
gaattgtaaaaattc

SEQ ID NO: 276948 - DNA, 15 bp, Homo sapiens
tgaattgtaaaaatt

SEQ ID NO: 276949 - DNA, 15 bp, Homo sapiens
gtgaattgtaaaaat

SEQ ID NO: 276950 - DNA, 15 bp, Homo sapiens
agtgaattgtaaaaa

SEQ ID NO: 276951 - DNA, 15 bp, Homo sapiens
aagtgaattgtaaaa

SEQ ID NO: 276952 - DNA, 15 bp, Homo sapiens
aaagtgaattgtaaa

SEQ ID NO: 276953 - DNA, 15 bp, Homo sapiens
aaaagtgaattgtaa

SEQ ID NO: 276954 - DNA, 15 bp, Homo sapiens
caaaagtgaattgta

SEQ ID NO: 276955 - DNA, 15 bp, Homo sapiens
tcaaaagtgaattgt

SEQ ID NO: 276956 - DNA, 15 bp, Homo sapiens
gtcaaaagtgaattg

SEQ ID NO: 276957 - DNA, 15 bp, Homo sapiens
tgtcaaaagtgaatt

SEQ ID NO: 276958 - DNA, 15 bp, Homo sapiens
ttgtcaaaagtgaat

SEQ ID NO: 276959 - DNA, 15 bp, Homo sapiens
attgtcaaaagtgaa

SEQ ID NO: 276960 - DNA, 15 bp, Homo sapiens
cattgtcaaaagtga

SEQ ID NO: 276961 - DNA, 15 bp, Homo sapiens
acattgtcaaaagtg

SEQ ID NO: 276962 - DNA, 15 bp, Homo sapiens
gacattgtcaaaagt

SEQ ID NO: 276963 - DNA, 15 bp, Homo sapiens
tgacattgtcaaaag

SEQ ID NO: 276964 - DNA, 15 bp, Homo sapiens
gtgacattgtcaaaa

SEQ ID NO: 276965 - DNA, 15 bp, Homo sapiens
tgtgacattgtcaaa

SEQ ID NO: 276966 - DNA, 15 bp, Homo sapiens
ctgtgacattgtcaa

SEQ ID NO: 276967 - DNA, 15 bp, Homo sapiens
gctgtgacattgtca

SEQ ID NO: 276968 - DNA, 15 bp, Homo sapiens
ggctgtgacattgtc

SEQ ID NO: 276969 - DNA, 15 bp, Homo sapiens
tggctgtgacattgt

SEQ ID NO: 276970 - DNA, 15 bp, Homo sapiens
ttggctgtgacattg

SEQ ID NO: 276971 - DNA, 15 bp, Homo sapiens
tttggctgtgacatt

SEQ ID NO: 276972 - DNA, 15 bp, Homo sapiens
ttttggctgtgacat

SEQ ID NO: 276973 - DNA, 15 bp, Homo sapiens
attttggctgtgaca

SEQ ID NO: 276974 - DNA, 15 bp, Homo sapiens
aattttggctgtgac

SEQ ID NO: 276975 - DNA, 15 bp, Homo sapiens
aaattttggctgtga

SEQ ID NO: 276976 - DNA, 15 bp, Homo sapiens
gaaattttggctgtg

SEQ ID NO: 276977 - DNA, 15 bp, Homo sapiens
tgaaattttggctgt

SEQ ID NO: 276978 - DNA, 15 bp, Homo sapiens
ttgaaattttggctg

SEQ ID NO: 276979 - DNA, 15 bp, Homo sapiens
attgaaattttggct

SEQ ID NO: 276980 - DNA, 15 bp, Homo sapiens
aattgaaattttggc

SEQ ID NO: 276981 - DNA, 15 bp, Homo sapiens
aaattgaaattttgg

SEQ ID NO: 276982 - DNA, 15 bp, Homo sapiens
aaaattgaaattttg

SEQ ID NO: 276983 - DNA, 15 bp, Homo sapiens
taaaattgaaatttt

SEQ ID NO: 276984 - DNA, 15 bp, Homo sapiens
ttaaaattgaaattt

SEQ ID NO: 276985 - DNA, 15 bp, Homo sapiens
gttaaaattgaaatt

SEQ ID NO: 276986 - DNA, 15 bp, Homo sapiens
ggttaaaattgaaat

SEQ ID NO: 276987 - DNA, 15 bp, Homo sapiens
aggttaaaattgaaa

SEQ ID NO: 276988 - DNA, 15 bp, Homo sapiens
aaggttaaaattgaa

SEQ ID NO: 276989 - DNA, 15 bp, Homo sapiens
caaggttaaaattga

SEQ ID NO: 276990 - DNA, 15 bp, Homo sapiens
gcaaggttaaaattg

SEQ ID NO: 276991 - DNA, 15 bp, Homo sapiens
tgcaaggttaaaatt

SEQ ID NO: 276992 - DNA, 15 bp, Homo sapiens
gtgcaaggttaaaat

SEQ ID NO: 276993 - DNA, 15 bp, Homo sapiens
tgtgcaaggttaaaa

SEQ ID NO: 276994 - DNA, 15 bp, Homo sapiens
atgtgcaaggttaaa

SEQ ID NO: 276995 - DNA, 15 bp, Homo sapiens
catgtgcaaggttaa

SEQ ID NO: 276996 - DNA, 15 bp, Homo sapiens
acatgtgcaaggtta

SEQ ID NO: 276997 - DNA, 15 bp, Homo sapiens
gacatgtgcaaggtt

SEQ ID NO: 276998 - DNA, 15 bp, Homo sapiens
ggacatgtgcaaggt

SEQ ID NO: 276999 - DNA, 15 bp, Homo sapiens
aggacatgtgcaagg

SEQ ID NO: 277000 - DNA, 15 bp, Homo sapiens
aaggacatgtgcaag

SEQ ID NO: 277001 - DNA, 15 bp, Homo sapiens
taaggacatgtgcaa

SEQ ID NO: 277002 - DNA, 15 bp, Homo sapiens
ttaaggacatgtgca

SEQ ID NO: 277003 - DNA, 15 bp, Homo sapiens
tttaaggacatgtgc

SEQ ID NO: 277004 - DNA, 15 bp, Homo sapiens
atttaaggacatgtg

SEQ ID NO: 277005 - DNA, 15 bp, Homo sapiens
aatttaaggacatgt

SEQ ID NO: 277006 - DNA, 15 bp, Homo sapiens
aaatttaaggacatg

SEQ ID NO: 277007 - DNA, 15 bp, Homo sapiens
aaaatttaaggacat

SEQ ID NO: 277008 - DNA, 15 bp, Homo sapiens
taaaatttaaggaca

SEQ ID NO: 277009 - DNA, 15 bp, Homo sapiens
ttaaaatttaaggac

SEQ ID NO: 277010 - DNA, 15 bp, Homo sapiens
tttaaaatttaagga

SEQ ID NO: 277011 - DNA, 15 bp, Homo sapiens
ttttaaaatttaagg

SEQ ID NO: 277012 - DNA, 15 bp, Homo sapiens
tttttaaaatttaag

SEQ ID NO: 277013 - DNA, 15 bp, Homo sapiens
tatttttaaaattta

SEQ ID NO: 277014 - DNA, 15 bp, Homo sapiens
atatttttaaaattt

SEQ ID NO: 277015 - DNA, 15 bp, Homo sapiens
catatttttaaaatt

SEQ ID NO: 277016 - DNA, 15 bp, Homo sapiens
acatatttttaaaat

SEQ ID NO: 277017 - DNA, 15 bp, Homo sapiens
tacatatttttaaaa

SEQ ID NO: 277018 - DNA, 15 bp, Homo sapiens
atacatatttttaaa

SEQ ID NO: 277019 - DNA, 15 bp, Homo sapiens
aatacatatttttaa

SEQ ID NO: 277020 - DNA, 15 bp, Homo sapiens
taatacatattttta

SEQ ID NO: 277021 - DNA, 15 bp, Homo sapiens
ttaatacatattttt

SEQ ID NO: 277022 - DNA, 15 bp, Homo sapiens
attaatacatatttt

SEQ ID NO: 277023 - DNA, 15 bp, Homo sapiens
tattaatacatattt

SEQ ID NO: 277024 - DNA, 15 bp, Homo sapiens
atattaatacatatt

SEQ ID NO: 277025 - DNA, 15 bp, Homo sapiens
catattaatacatat

SEQ ID NO: 277026 - DNA, 15 bp, Homo sapiens
acatattaatacata

SEQ ID NO: 277027 - DNA, 15 bp, Homo sapiens
gacatattaatacat

SEQ ID NO: 277028 - DNA, 15 bp, Homo sapiens
tgacatattaataca

SEQ ID NO: 277029 - DNA, 15 bp, Homo sapiens
ttgacatattaatac

SEQ ID NO: 277030 - DNA, 15 bp, Homo sapiens
gttgacatattaata

SEQ ID NO: 277031 - DNA, 15 bp, Homo sapiens
ggttgacatattaat

SEQ ID NO: 277032 - DNA, 15 bp, Homo sapiens
aggttgacatattaa

SEQ ID NO: 277033 - DNA, 15 bp, Homo sapiens
aaggttgacatatta

SEQ ID NO: 277034 - DNA, 15 bp, Homo sapiens
taaggttgacatatt

SEQ ID NO: 277035 - DNA, 15 bp, Homo sapiens
ttaaggttgacatat

SEQ ID NO: 277036 - DNA, 15 bp, Homo sapiens
attaaggttgacata

SEQ ID NO: 277037 - DNA, 15 bp, Homo sapiens
tattaaggttgacat

SEQ ID NO: 277038 - DNA, 15 bp, Homo sapiens
gtattaaggttgaca

SEQ ID NO: 277039 - DNA, 15 bp, Homo sapiens
tgtattaaggttgac

SEQ ID NO: 277040 - DNA, 15 bp, Homo sapiens
gtgtattaaggttga

SEQ ID NO: 277041 - DNA, 15 bp, Homo sapiens
tgtgtattaaggttg

SEQ ID NO: 277042 - DNA, 15 bp, Homo sapiens
gtgtgtattaaggtt

SEQ ID NO: 277043 - DNA, 15 bp, Homo sapiens
agtgtgtattaaggt

SEQ ID NO: 277044 - DNA, 15 bp, Homo sapiens
cagtgtgtattaagg

SEQ ID NO: 277045 - DNA, 15 bp, Homo sapiens
ccagtgtgtattaag

SEQ ID NO: 277046 - DNA, 15 bp, Homo sapiens
accagtgtgtattaa

SEQ ID NO: 277047 - DNA, 15 bp, Homo sapiens
gaccagtgtgtatta

SEQ ID NO: 277048 - DNA, 15 bp, Homo sapiens
tgaccagtgtgtatt

SEQ ID NO: 277049 - DNA, 15 bp, Homo sapiens
atgaccagtgtgtat

SEQ ID NO: 277050 - DNA, 15 bp, Homo sapiens
gatgaccagtgtgta

SEQ ID NO: 277051 - DNA, 15 bp, Homo sapiens
agatgaccagtgtgt

SEQ ID NO: 277052 - DNA, 15 bp, Homo sapiens
gagatgaccagtgtg

SEQ ID NO: 277053 - DNA, 15 bp, Homo sapiens
agagatgaccagtgt

SEQ ID NO: 277054 - DNA, 15 bp, Homo sapiens
aagagatgaccagtg

SEQ ID NO: 277055 - DNA, 15 bp, Homo sapiens
aaagagatgaccagt

SEQ ID NO: 277056 - DNA, 15 bp, Homo sapiens
aaaagagatgaccag

SEQ ID NO: 277057 - DNA, 15 bp, Homo sapiens
caaaagagatgacca

SEQ ID NO: 277058 - DNA, 15 bp, Homo sapiens
acaaaagagatgacc

SEQ ID NO: 277059 - DNA, 15 bp, Homo sapiens
aacaaaagagatgac

SEQ ID NO: 277060 - DNA, 15 bp, Homo sapiens
caacaaaagagatga

SEQ ID NO: 277061 - DNA, 15 bp, Homo sapiens
ccaacaaaagagatg

SEQ ID NO: 277062 - DNA, 15 bp, Homo sapiens
accaacaaaagagat

SEQ ID NO: 277063 - DNA, 15 bp, Homo sapiens
gaccaacaaaagaga

SEQ ID NO: 277064 - DNA, 15 bp, Homo sapiens
tgaccaacaaaagag

SEQ ID NO: 277065 - DNA, 15 bp, Homo sapiens
atgaccaacaaaaga

SEQ ID NO: 277066 - DNA, 15 bp, Homo sapiens
gatgaccaacaaaag

SEQ ID NO: 277067 - DNA, 15 bp, Homo sapiens
agatgaccaacaaaa

SEQ ID NO: 277068 - DNA, 15 bp, Homo sapiens
gagatgaccaacaaa

SEQ ID NO: 277069 - DNA, 15 bp, Homo sapiens
agagatgaccaacaa

SEQ ID NO: 277070 - DNA, 15 bp, Homo sapiens
aagagatgaccaaca

SEQ ID NO: 277071 - DNA, 15 bp, Homo sapiens
aaagagatgaccaac

SEQ ID NO: 277072 - DNA, 15 bp, Homo sapiens
aaaagagatgaccaa

SEQ ID NO: 277073 - DNA, 15 bp, Homo sapiens
gaaaagagatgacca

SEQ ID NO: 277074 - DNA, 15 bp, Homo sapiens
agaaaagagatgacc

SEQ ID NO: 277075 - DNA, 15 bp, Homo sapiens
aagaaaagagatgac

SEQ ID NO: 277076 - DNA, 15 bp, Homo sapiens
aaagaaaagagatga

SEQ ID NO: 277077 - DNA, 15 bp, Homo sapiens
aaaagaaaagagatg

SEQ ID NO: 277078 - DNA, 15 bp, Homo sapiens
aaaaagaaaagagat

SEQ ID NO: 277079 - DNA, 15 bp, Homo sapiens
taaaaagaaaagaga

SEQ ID NO: 277080 - DNA, 15 bp, Homo sapiens
ttaaaaagaaaagag

SEQ ID NO: 277081 - DNA, 15 bp, Homo sapiens
gtttttaaaaagaaa

SEQ ID NO: 277082 - DNA, 15 bp, Homo sapiens
tgtttttaaaaagaa

SEQ ID NO: 277083 - DNA, 15 bp, Homo sapiens
gtgtttttaaaaaga

SEQ ID NO: 277084 - DNA, 15 bp, Homo sapiens
agtgtttttaaaaag

SEQ ID NO: 277085 - DNA, 15 bp, Homo sapiens
aagtgtttttaaaaa

SEQ ID NO: 277086 - DNA, 15 bp, Homo sapiens
taagtgtttttaaaa

SEQ ID NO: 277087 - DNA, 15 bp, Homo sapiens
ttaagtgtttttaaa

SEQ ID NO: 277088 - DNA, 15 bp, Homo sapiens
tttaagtgtttttaa

SEQ ID NO: 277089 - DNA, 15 bp, Homo sapiens
ctttaagtgttttta

SEQ ID NO: 277090 - DNA, 15 bp, Homo sapiens
actttaagtgttttt

SEQ ID NO: 277091 - DNA, 15 bp, Homo sapiens
cactttaagtgtttt

SEQ ID NO: 277092 - DNA, 15 bp, Homo sapiens
acactttaagtgttt

SEQ ID NO: 277093 - DNA, 15 bp, Homo sapiens
cacactttaagtgtt

SEQ ID NO: 277094 - DNA, 15 bp, Homo sapiens
ccacactttaagtgt

SEQ ID NO: 277095 - DNA, 15 bp, Homo sapiens
gccacactttaagtg

SEQ ID NO: 277096 - DNA, 15 bp, Homo sapiens
tgccacactttaagt

SEQ ID NO: 277097 - DNA, 15 bp, Homo sapiens
atgccacactttaag

SEQ ID NO: 277098 - DNA, 15 bp, Homo sapiens
aatgccacactttaa

SEQ ID NO: 277099 - DNA, 15 bp, Homo sapiens
taatgccacacttta

SEQ ID NO: 277100 - DNA, 15 bp, Homo sapiens
ataatgccacacttt

SEQ ID NO: 277101 - DNA, 15 bp, Homo sapiens
tataatgccacactt

SEQ ID NO: 277102 - DNA, 15 bp, Homo sapiens
atataatgccacact

SEQ ID NO: 277103 - DNA, 15 bp, Homo sapiens
tatataatgccacac

SEQ ID NO: 277104 - DNA, 15 bp, Homo sapiens
ctatataatgccaca

SEQ ID NO: 277105 - DNA, 15 bp, Homo sapiens
actatataatgccac

SEQ ID NO: 277106 - DNA, 15 bp, Homo sapiens
gactatataatgcca

SEQ ID NO: 277107 - DNA, 15 bp, Homo sapiens
agactatataatgcc

SEQ ID NO: 277108 - DNA, 15 bp, Homo sapiens
aagactatataatgc

SEQ ID NO: 277109 - DNA, 15 bp, Homo sapiens
aaagactatataatg

SEQ ID NO: 277110 - DNA, 15 bp, Homo sapiens
gaaagactatataat

SEQ ID NO: 277111 - DNA, 15 bp, Homo sapiens
tgaaagactatataa

SEQ ID NO: 277112 - DNA, 15 bp, Homo sapiens
atgaaagactatata

SEQ ID NO: 277113 - DNA, 15 bp, Homo sapiens
aatgaaagactatat

SEQ ID NO: 277114 - DNA, 15 bp, Homo sapiens
taatgaaagactata

SEQ ID NO: 277115 - DNA, 15 bp, Homo sapiens
ataatgaaagactat

SEQ ID NO: 277116 - DNA, 15 bp, Homo sapiens
aataatgaaagacta

SEQ ID NO: 277117 - DNA, 15 bp, Homo sapiens
aaataatgaaagact

SEQ ID NO: 277118 - DNA, 15 bp, Homo sapiens
taaataatgaaagac

SEQ ID NO: 277119 - DNA, 15 bp, Homo sapiens
ataaataatgaaaga

SEQ ID NO: 277120 - DNA, 15 bp, Homo sapiens
aataaataatgaaag

SEQ ID NO: 277121 - DNA, 15 bp, Homo sapiens
aaataaataatgaaa

SEQ ID NO: 277122 - DNA, 15 bp, Homo sapiens
aaaataaataatgaa

SEQ ID NO: 277123 - DNA, 15 bp, Homo sapiens
gaaaataaataatga

SEQ ID NO: 277124 - DNA, 15 bp, Homo sapiens
ggaaaataaataatg

SEQ ID NO: 277125 - DNA, 15 bp, Homo sapiens
aggaaaataaataat

SEQ ID NO: 277126 - DNA, 15 bp, Homo sapiens
aaggaaaataaataa

SEQ ID NO: 277127 - DNA, 15 bp, Homo sapiens
aaaggaaaataaata

SEQ ID NO: 277128 - DNA, 15 bp, Homo sapiens
aaaaggaaaataaat

SEQ ID NO: 277129 - DNA, 15 bp, Homo sapiens
aaaaaggaaaataaa

SEQ ID NO: 277130 - DNA, 15 bp, Homo sapiens
aaaaaaggaaaataa

SEQ ID NO: 277131 - DNA, 15 bp, Homo sapiens
aaaaaaaggaaaata

SEQ ID NO: 277132 - DNA, 15 bp, Homo sapiens
gaaaaaaaggaaaat

SEQ ID NO: 277133 - DNA, 15 bp, Homo sapiens
ggaaaaaaaggaaaa

SEQ ID NO: 277134 - DNA, 15 bp, Homo sapiens
gggaaaaaaaggaaa

SEQ ID NO: 277135 - DNA, 15 bp, Homo sapiens
ggggaaaaaaaggaa

SEQ ID NO: 277136 - DNA, 15 bp, Homo sapiens
aggggaaaaaaagga

SEQ ID NO: 277137 - DNA, 15 bp, Homo sapiens
aaggggaaaaaaagg

SEQ ID NO: 277138 - DNA, 15 bp, Homo sapiens
taaggggaaaaaaag

SEQ ID NO: 277139 - DNA, 15 bp, Homo sapiens
ataaggggaaaaaaa

SEQ ID NO: 277140 - DNA, 15 bp, Homo sapiens
cataaggggaaaaaa

SEQ ID NO: 277141 - DNA, 15 bp, Homo sapiens
ccataaggggaaaaa

SEQ ID NO: 277142 - DNA, 15 bp, Homo sapiens
cccataaggggaaaa

SEQ ID NO: 277143 - DNA, 15 bp, Homo sapiens
ccccataaggggaaa

SEQ ID NO: 277144 - DNA, 15 bp, Homo sapiens
cccccataaggggaa

SEQ ID NO: 277145 - DNA, 15 bp, Homo sapiens
ccccccataagggga

SEQ ID NO: 277146 - DNA, 15 bp, Homo sapiens
accccccataagggg

SEQ ID NO: 277147 - DNA, 15 bp, Homo sapiens
caccccccataaggg

SEQ ID NO: 277148 - DNA, 15 bp, Homo sapiens
acaccccccataagg

SEQ ID NO: 277149 - DNA, 15 bp, Homo sapiens
aacaccccccataag

SEQ ID NO: 277150 - DNA, 15 bp, Homo sapiens
aaacaccccccataa

SEQ ID NO: 277151 - DNA, 15 bp, Homo sapiens
aaaacaccccccata

SEQ ID NO: 277152 - DNA, 15 bp, Homo sapiens
taaaacaccccccat

SEQ ID NO: 277153 - DNA, 15 bp, Homo sapiens
gtaaaacacccccca

SEQ ID NO: 277154 - DNA, 15 bp, Homo sapiens
agtaaaacacccccc

SEQ ID NO: 277155 - DNA, 15 bp, Homo sapiens
tagtaaaacaccccc

SEQ ID NO: 277156 - DNA, 15 bp, Homo sapiens
atagtaaaacacccc

SEQ ID NO: 277157 - DNA, 15 bp, Homo sapiens
aatagtaaaacaccc

SEQ ID NO: 277158 - DNA, 15 bp, Homo sapiens
aaatagtaaaacacc

SEQ ID NO: 277159 - DNA, 15 bp, Homo sapiens
gaaatagtaaaacac

SEQ ID NO: 277160 - DNA, 15 bp, Homo sapiens
agaaatagtaaaaca

SEQ ID NO: 277161 - DNA, 15 bp, Homo sapiens
gagaaatagtaaaac

SEQ ID NO: 277162 - DNA, 15 bp, Homo sapiens
tgagaaatagtaaaa

SEQ ID NO: 277163 - DNA, 15 bp, Homo sapiens
ctgagaaatagtaaa

SEQ ID NO: 277164 - DNA, 15 bp, Homo sapiens
tctgagaaatagtaa

SEQ ID NO: 277165 - DNA, 15 bp, Homo sapiens
ctctgagaaatagta

SEQ ID NO: 277166 - DNA, 15 bp, Homo sapiens
actctgagaaatagt

SEQ ID NO: 277167 - DNA, 15 bp, Homo sapiens
tactctgagaaatag

SEQ ID NO: 277168 - DNA, 15 bp, Homo sapiens
atactctgagaaata

SEQ ID NO: 277169 - DNA, 15 bp, Homo sapiens
catactctgagaaat

SEQ ID NO: 277170 - DNA, 15 bp, Homo sapiens
acatactctgagaaa

SEQ ID NO: 277171 - DNA, 15 bp, Homo sapiens
aacatactctgagaa

SEQ ID NO: 277172 - DNA, 15 bp, Homo sapiens
aaacatactctgaga

SEQ ID NO: 277173 - DNA, 15 bp, Homo sapiens
aaaacatactctgag

SEQ ID NO: 277174 - DNA, 15 bp, Homo sapiens
taaaacatactctga

SEQ ID NO: 277175 - DNA, 15 bp, Homo sapiens
ataaaacatactctg

SEQ ID NO: 277176 - DNA, 15 bp, Homo sapiens
tataaaacatactct

SEQ ID NO: 277177 - DNA, 15 bp, Homo sapiens
gtataaaacatactc

SEQ ID NO: 277178 - DNA, 15 bp, Homo sapiens
agtataaaacatact

SEQ ID NO: 277179 - DNA, 15 bp, Homo sapiens
gagtataaaacatac

SEQ ID NO: 277180 - DNA, 15 bp, Homo sapiens
agagtataaaacata

SEQ ID NO: 277181 - DNA, 15 bp, Homo sapiens
aagagtataaaacat

SEQ ID NO: 277182 - DNA, 15 bp, Homo sapiens
aaagagtataaaaca

SEQ ID NO: 277183 - DNA, 15 bp, Homo sapiens
aaaagagtataaaac

SEQ ID NO: 277184 - DNA, 15 bp, Homo sapiens
aaaaagagtataaaa

SEQ ID NO: 277185 - DNA, 15 bp, Homo sapiens
caaaaagagtataaa

SEQ ID NO: 277186 - DNA, 15 bp, Homo sapiens
gcaaaaagagtataa

SEQ ID NO: 277187 - DNA, 15 bp, Homo sapiens
tgcaaaaagagtata

SEQ ID NO: 277188 - DNA, 15 bp, Homo sapiens
atgcaaaaagagtat

SEQ ID NO: 277189 - DNA, 15 bp, Homo sapiens
gatgcaaaaagagta

SEQ ID NO: 277190 - DNA, 15 bp, Homo sapiens
agatgcaaaaagagt

SEQ ID NO: 277191 - DNA, 15 bp, Homo sapiens
gagatgcaaaaagag

SEQ ID NO: 277192 - DNA, 15 bp, Homo sapiens
agagatgcaaaaaga

SEQ ID NO: 277193 - DNA, 15 bp, Homo sapiens
aagagatgcaaaaag

SEQ ID NO: 277194 - DNA, 15 bp, Homo sapiens
aaagagatgcaaaaa

SEQ ID NO: 277195 - DNA, 15 bp, Homo sapiens
taaagagatgcaaaa

SEQ ID NO: 277196 - DNA, 15 bp, Homo sapiens
ttaaagagatgcaaa

SEQ ID NO: 277197 - DNA, 15 bp, Homo sapiens
attaaagagatgcaa

SEQ ID NO: 277198 - DNA, 15 bp, Homo sapiens
tattaaagagatgca

SEQ ID NO: 277199 - DNA, 15 bp, Homo sapiens
atattaaagagatgc

SEQ ID NO: 277200 - DNA, 15 bp, Homo sapiens
tatattaaagagatg

SEQ ID NO: 277201 - DNA, 15 bp, Homo sapiens
ttatattaaagagat

SEQ ID NO: 277202 - DNA, 15 bp, Homo sapiens
tttatattaaagaga

SEQ ID NO: 277203 - DNA, 15 bp, Homo sapiens
atttatattaaagag

SEQ ID NO: 277204 - DNA, 15 bp, Homo sapiens
aatttatattaaaga

SEQ ID NO: 277205 - DNA, 15 bp, Homo sapiens
aaatttatattaaag

SEQ ID NO: 277206 - DNA, 15 bp, Homo sapiens
taaatttatattaaa

SEQ ID NO: 277207 - DNA, 15 bp, Homo sapiens
ataaatttatattaa

SEQ ID NO: 277208 - DNA, 15 bp, Homo sapiens
aataaatttatatta

SEQ ID NO: 277209 - DNA, 15 bp, Homo sapiens
taataaatttatatt

SEQ ID NO: 277210 - DNA, 15 bp, Homo sapiens
ttaataaatttatat

SEQ ID NO: 277211 - DNA, 15 bp, Homo sapiens
attaataaatttata

SEQ ID NO: 277212 - DNA, 15 bp, Homo sapiens
tattaataaatttat

SEQ ID NO: 277213 - DNA, 15 bp, Homo sapiens
ttattaataaattta

SEQ ID NO: 277214 - DNA, 15 bp, Homo sapiens
attattaataaattt

SEQ ID NO: 277215 - DNA, 15 bp, Homo sapiens
tattattaataaatt

SEQ ID NO: 277216 - DNA, 15 bp, Homo sapiens
gtattattaataaat

SEQ ID NO: 277217 - DNA, 15 bp, Homo sapiens
agtattattaataaa

SEQ ID NO: 277218 - DNA, 15 bp, Homo sapiens
aagtattattaataa

SEQ ID NO: 277219 - DNA, 15 bp, Homo sapiens
taagtattattaata

SEQ ID NO: 277220 - DNA, 15 bp, Homo sapiens
ttaagtattattaat

SEQ ID NO: 277221 - DNA, 15 bp, Homo sapiens
attaagtattattaa

SEQ ID NO: 277222 - DNA, 15 bp, Homo sapiens
gattaagtattatta

SEQ ID NO: 277223 - DNA, 15 bp, Homo sapiens
agattaagtattatt

SEQ ID NO: 277224 - DNA, 15 bp, Homo sapiens
cagattaagtattat

SEQ ID NO: 277225 - DNA, 15 bp, Homo sapiens
acagattaagtatta

SEQ ID NO: 277226 - DNA, 15 bp, Homo sapiens
aacagattaagtatt

SEQ ID NO: 277227 - DNA, 15 bp, Homo sapiens
caacagattaagtat

SEQ ID NO: 277228 - DNA, 15 bp, Homo sapiens
tcaacagattaagta

SEQ ID NO: 277229 - DNA, 15 bp, Homo sapiens
atcaacagattaagt

SEQ ID NO: 277230 - DNA, 15 bp, Homo sapiens
aatcaacagattaag

SEQ ID NO: 277231 - DNA, 15 bp, Homo sapiens
gaatcaacagattaa

SEQ ID NO: 277232 - DNA, 15 bp, Homo sapiens
tgaatcaacagatta

SEQ ID NO: 277233 - DNA, 15 bp, Homo sapiens
ctgaatcaacagatt

SEQ ID NO: 277234 - DNA, 15 bp, Homo sapiens
tctgaatcaacagat

SEQ ID NO: 277235 - DNA, 15 bp, Homo sapiens
atctgaatcaacaga

SEQ ID NO: 277236 - DNA, 15 bp, Homo sapiens
tatctgaatcaacag

SEQ ID NO: 277237 - DNA, 15 bp, Homo sapiens
atatctgaatcaaca

SEQ ID NO: 277238 - DNA, 15 bp, Homo sapiens
aatatctgaatcaac

SEQ ID NO: 277239 - DNA, 15 bp, Homo sapiens
aaatatctgaatcaa

SEQ ID NO: 277240 - DNA, 15 bp, Homo sapiens
taaatatctgaatca

SEQ ID NO: 277241 - DNA, 15 bp, Homo sapiens
ataaatatctgaatc

SEQ ID NO: 277242 - DNA, 15 bp, Homo sapiens
cataaatatctgaat

SEQ ID NO: 277243 - DNA, 15 bp, Homo sapiens
gcataaatatctgaa

SEQ ID NO: 277244 - DNA, 15 bp, Homo sapiens
agcataaatatctga

SEQ ID NO: 277245 - DNA, 15 bp, Homo sapiens
tagcataaatatctg

SEQ ID NO: 277246 - DNA, 15 bp, Homo sapiens
ttagcataaatatct

SEQ ID NO: 277247 - DNA, 15 bp, Homo sapiens
tttagcataaatatc

SEQ ID NO: 277248 - DNA, 15 bp, Homo sapiens
ttttagcataaatat

SEQ ID NO: 277249 - DNA, 15 bp, Homo sapiens
attttagcataaata

SEQ ID NO: 277250 - DNA, 15 bp, Homo sapiens
aattttagcataaat

SEQ ID NO: 277251 - DNA, 15 bp, Homo sapiens
gaattttagcataaa

SEQ ID NO: 277252 - DNA, 15 bp, Homo sapiens
agaattttagcataa

SEQ ID NO: 277253 - DNA, 15 bp, Homo sapiens
tagaattttagcata

SEQ ID NO: 277254 - DNA, 15 bp, Homo sapiens
ttagaattttagcat

SEQ ID NO: 277255 - DNA, 15 bp, Homo sapiens
tttagaattttagca

SEQ ID NO: 277256 - DNA, 15 bp, Homo sapiens
ctttagaattttagc

SEQ ID NO: 277257 - DNA, 15 bp, Homo sapiens
actttagaattttag

SEQ ID NO: 277258 - DNA, 15 bp, Homo sapiens
tactttagaatttta

SEQ ID NO: 277259 - DNA, 15 bp, Homo sapiens
atactttagaatttt

SEQ ID NO: 277260 - DNA, 15 bp, Homo sapiens
gatactttagaattt

SEQ ID NO: 277261 - DNA, 15 bp, Homo sapiens
tgatactttagaatt

SEQ ID NO: 277262 - DNA, 15 bp, Homo sapiens
gtgatactttagaat

SEQ ID NO: 277263 - DNA, 15 bp, Homo sapiens
tgtgatactttagaa

SEQ ID NO: 277264 - DNA, 15 bp, Homo sapiens
atgtgatactttaga

SEQ ID NO: 277265 - DNA, 15 bp, Homo sapiens
aatgtgatactttag

SEQ ID NO: 277266 - DNA, 15 bp, Homo sapiens
taatgtgatacttta

SEQ ID NO: 277267 - DNA, 15 bp, Homo sapiens
ataatgtgatacttt

SEQ ID NO: 277268 - DNA, 15 bp, Homo sapiens
cataatgtgatactt

SEQ ID NO: 277269 - DNA, 15 bp, Homo sapiens
tcataatgtgatact

SEQ ID NO: 277270 - DNA, 15 bp, Homo sapiens
atcataatgtgatac

SEQ ID NO: 277271 - DNA, 15 bp, Homo sapiens
aatcataatgtgata

SEQ ID NO: 277272 - DNA, 15 bp, Homo sapiens
gaatcataatgtgat

SEQ ID NO: 277273 - DNA, 15 bp, Homo sapiens
agaatcataatgtga

SEQ ID NO: 277274 - DNA, 15 bp, Homo sapiens
tagaatcataatgtg

SEQ ID NO: 277275 - DNA, 15 bp, Homo sapiens
ttagaatcataatgt

SEQ ID NO: 277276 - DNA, 15 bp, Homo sapiens
attagaatcataatg

SEQ ID NO: 277277 - DNA, 15 bp, Homo sapiens
gattagaatcataat

SEQ ID NO: 277278 - DNA, 15 bp, Homo sapiens
agattagaatcataa

SEQ ID NO: 277279 - DNA, 15 bp, Homo sapiens
tagattagaatcata

SEQ ID NO: 277280 - DNA, 15 bp, Homo sapiens
atagattagaatcat

SEQ ID NO: 277281 - DNA, 15 bp, Homo sapiens
aatagattagaatca

SEQ ID NO: 277282 - DNA, 15 bp, Homo sapiens
aaatagattagaatc

SEQ ID NO: 277283 - DNA, 15 bp, Homo sapiens
aaaatagattagaat

SEQ ID NO: 277284 - DNA, 15 bp, Homo sapiens
aaaaatagattagaa

SEQ ID NO: 277285 - DNA, 15 bp, Homo sapiens
aaaaaatagattaga

SEQ ID NO: 277286 - DNA, 15 bp, Homo sapiens
taaaaaatagattag

SEQ ID NO: 277287 - DNA, 15 bp, Homo sapiens
ataaaaaatagatta

SEQ ID NO: 277288 - DNA, 15 bp, Homo sapiens
aataaaaaatagatt

SEQ ID NO: 277289 - DNA, 15 bp, Homo sapiens
caataaaaaatagat

SEQ ID NO: 277290 - DNA, 15 bp, Homo sapiens
tcaataaaaaataga

SEQ ID NO: 277291 - DNA, 15 bp, Homo sapiens
ttcaataaaaaatag

SEQ ID NO: 277292 - DNA, 15 bp, Homo sapiens
tttcaataaaaaata

SEQ ID NO: 277293 - DNA, 15 bp, Homo sapiens
ttttcaataaaaaat

SEQ ID NO: 277294 - DNA, 15 bp, Homo sapiens
attttcaataaaaaa

SEQ ID NO: 277295 - DNA, 15 bp, Homo sapiens
cattttcaataaaaa

SEQ ID NO: 277296 - DNA, 15 bp, Homo sapiens
tcattttcaataaaa

SEQ ID NO: 277297 - DNA, 15 bp, Homo sapiens
ttcattttcaataaa

SEQ ID NO: 277298 - DNA, 15 bp, Homo sapiens
cttcattttcaataa

SEQ ID NO: 277299 - DNA, 15 bp, Homo sapiens
tcttcattttcaata

SEQ ID NO: 277300 - DNA, 15 bp, Homo sapiens
gtcttcattttcaat

SEQ ID NO: 277301 - DNA, 15 bp, Homo sapiens
tgtcttcattttcaa

SEQ ID NO: 277302 - DNA, 15 bp, Homo sapiens
ctgtcttcattttca

SEQ ID NO: 277303 - DNA, 15 bp, Homo sapiens
gctgtcttcattttc

SEQ ID NO: 277304 - DNA, 15 bp, Homo sapiens
tgctgtcttcatttt

SEQ ID NO: 277305 - DNA, 15 bp, Homo sapiens
ttgctgtcttcattt

SEQ ID NO: 277306 - DNA, 15 bp, Homo sapiens
tttgctgtcttcatt

SEQ ID NO: 277307 - DNA, 15 bp, Homo sapiens
gtttgctgtcttcat

SEQ ID NO: 277308 - DNA, 15 bp, Homo sapiens
agtttgctgtcttca

SEQ ID NO: 277309 - DNA, 15 bp, Homo sapiens
cagtttgctgtcttc

SEQ ID NO: 277310 - DNA, 15 bp, Homo sapiens
tcagtttgctgtctt

SEQ ID NO: 277311 - DNA, 15 bp, Homo sapiens
ctcagtttgctgtct

SEQ ID NO: 277312 - DNA, 15 bp, Homo sapiens
tctcagtttgctgtc

SEQ ID NO: 277313 - DNA, 15 bp, Homo sapiens
atctcagtttgctgt

SEQ ID NO: 277314 - DNA, 15 bp, Homo sapiens
tatctcagtttgctg

SEQ ID NO: 277315 - DNA, 15 bp, Homo sapiens
ctatctcagtttgct

SEQ ID NO: 277316 - DNA, 15 bp, Homo sapiens
gctatctcagtttgc

SEQ ID NO: 277317 - DNA, 15 bp, Homo sapiens
agctatctcagtttg

SEQ ID NO: 277318 - DNA, 15 bp, Homo sapiens
aagctatctcagttt

SEQ ID NO: 277319 - DNA, 15 bp, Homo sapiens
aaagctatctcagtt

SEQ ID NO: 277320 - DNA, 15 bp, Homo sapiens
taaagctatctcagt

SEQ ID NO: 277321 - DNA, 15 bp, Homo sapiens
ataaagctatctcag

SEQ ID NO: 277322 - DNA, 15 bp, Homo sapiens
tataaagctatctca

SEQ ID NO: 277323 - DNA, 15 bp, Homo sapiens
atataaagctatctc

SEQ ID NO: 277324 - DNA, 15 bp, Homo sapiens
tatataaagctatct

SEQ ID NO: 277325 - DNA, 15 bp, Homo sapiens
atatataaagctatc

SEQ ID NO: 277326 - DNA, 15 bp, Homo sapiens
aatatataaagctat

SEQ ID NO: 277327 - DNA, 15 bp, Homo sapiens
taatatataaagcta

SEQ ID NO: 277328 - DNA, 15 bp, Homo sapiens
gtaatatataaagct

SEQ ID NO: 277329 - DNA, 15 bp, Homo sapiens
tgtaatatataaagc

SEQ ID NO: 277330 - DNA, 15 bp, Homo sapiens
atgtaatatataaag

SEQ ID NO: 277331 - DNA, 15 bp, Homo sapiens
tatgtaatatataaa

SEQ ID NO: 277332 - DNA, 15 bp, Homo sapiens
ttatgtaatatataa

SEQ ID NO: 277333 - DNA, 15 bp, Homo sapiens
tttatgtaatatata

SEQ ID NO: 277334 - DNA, 15 bp, Homo sapiens
ttttatgtaatatat

SEQ ID NO: 277335 - DNA, 15 bp, Homo sapiens
attttatgtaatata

SEQ ID NO: 277336 - DNA, 15 bp, Homo sapiens
tattttatgtaatat

SEQ ID NO: 277337 - DNA, 15 bp, Homo sapiens
ctattttatgtaata

SEQ ID NO: 277338 - DNA, 15 bp, Homo sapiens
tctattttatgtaat

SEQ ID NO: 277339 - DNA, 15 bp, Homo sapiens
ttctattttatgtaa

SEQ ID NO: 277340 - DNA, 15 bp, Homo sapiens
tttctattttatgta

SEQ ID NO: 277341 - DNA, 15 bp, Homo sapiens
ttttctattttatgt

SEQ ID NO: 277342 - DNA, 15 bp, Homo sapiens
tttttctattttatg

SEQ ID NO: 277343 - DNA, 15 bp, Homo sapiens
ttttttctattttat

SEQ ID NO: 277344 - DNA, 15 bp, Homo sapiens
attttttctatttta

SEQ ID NO: 277345 - DNA, 15 bp, Homo sapiens
aattttttctatttt

SEQ ID NO: 277346 - DNA, 15 bp, Homo sapiens
aaattttttctattt

SEQ ID NO: 277347 - DNA, 15 bp, Homo sapiens
taaattttttctatt

SEQ ID NO: 277348 - DNA, 15 bp, Homo sapiens
ataaattttttctat

SEQ ID NO: 277349 - DNA, 15 bp, Homo sapiens
aataaattttttcta

SEQ ID NO: 277350 - DNA, 15 bp, Homo sapiens
gaataaattttttct

SEQ ID NO: 277351 - DNA, 15 bp, Homo sapiens
tgaataaattttttc

SEQ ID NO: 277352 - DNA, 15 bp, Homo sapiens
ttgaataaatttttt

SEQ ID NO: 277353 - DNA, 15 bp, Homo sapiens
tttgaataaattttt

SEQ ID NO: 277354 - DNA, 15 bp, Homo sapiens
ctttgaataaatttt

SEQ ID NO: 277355 - DNA, 15 bp, Homo sapiens
actttgaataaattt

SEQ ID NO: 277356 - DNA, 15 bp, Homo sapiens
cactttgaataaatt

SEQ ID NO: 277357 - DNA, 15 bp, Homo sapiens
acactttgaataaat

SEQ ID NO: 277358 - DNA, 15 bp, Homo sapiens
tacactttgaataaa

SEQ ID NO: 277359 - DNA, 15 bp, Homo sapiens
atacactttgaataa

SEQ ID NO: 277360 - DNA, 15 bp, Homo sapiens
tatacactttgaata

SEQ ID NO: 277361 - DNA, 15 bp, Homo sapiens
ttatacactttgaat

SEQ ID NO: 277362 - DNA, 15 bp, Homo sapiens
attatacactttgaa

SEQ ID NO: 277363 - DNA, 15 bp, Homo sapiens
aattatacactttga

SEQ ID NO: 277364 - DNA, 15 bp, Homo sapiens
aaattatacactttg

SEQ ID NO: 277365 - DNA, 15 bp, Homo sapiens
caaattatacacttt

SEQ ID NO: 277366 - DNA, 15 bp, Homo sapiens
tcaaattatacactt

SEQ ID NO: 277367 - DNA, 15 bp, Homo sapiens
ctcaaattatacact

SEQ ID NO: 277368 - DNA, 15 bp, Homo sapiens
actcaaattatacac

SEQ ID NO: 277369 - DNA, 15 bp, Homo sapiens
aactcaaattataca

SEQ ID NO: 277370 - DNA, 15 bp, Homo sapiens
caactcaaattatac

SEQ ID NO: 277371 - DNA, 15 bp, Homo sapiens
ccaactcaaattata

SEQ ID NO: 277372 - DNA, 15 bp, Homo sapiens
accaactcaaattat

SEQ ID NO: 277373 - DNA, 15 bp, Homo sapiens
aaccaactcaaatta

SEQ ID NO: 277374 - DNA, 15 bp, Homo sapiens
taaccaactcaaatt

SEQ ID NO: 277375 - DNA, 15 bp, Homo sapiens
ctaaccaactcaaat

SEQ ID NO: 277376 - DNA, 15 bp, Homo sapiens
gctaaccaactcaaa

SEQ ID NO: 277377 - DNA, 15 bp, Homo sapiens
tgctaaccaactcaa

SEQ ID NO: 277378 - DNA, 15 bp, Homo sapiens
atgctaaccaactca

SEQ ID NO: 277379 - DNA, 15 bp, Homo sapiens
tatgctaaccaactc

SEQ ID NO: 277380 - DNA, 15 bp, Homo sapiens
gtatgctaaccaact

SEQ ID NO: 277381 - DNA, 15 bp, Homo sapiens
tgtatgctaaccaac

SEQ ID NO: 277382 - DNA, 15 bp, Homo sapiens
atgtatgctaaccaa

SEQ ID NO: 277383 - DNA, 15 bp, Homo sapiens
catgtatgctaacca

SEQ ID NO: 277384 - DNA, 15 bp, Homo sapiens
tcatgtatgctaacc

SEQ ID NO: 277385 - DNA, 15 bp, Homo sapiens
ttcatgtatgctaac

SEQ ID NO: 277386 - DNA, 15 bp, Homo sapiens
tttcatgtatgctaa

SEQ ID NO: 277387 - DNA, 15 bp, Homo sapiens
ctttcatgtatgcta

SEQ ID NO: 277388 - DNA, 15 bp, Homo sapiens
actttcatgtatgct

SEQ ID NO: 277389 - DNA, 15 bp, Homo sapiens
aactttcatgtatgc

SEQ ID NO: 277390 - DNA, 15 bp, Homo sapiens
aaactttcatgtatg

SEQ ID NO: 277391 - DNA, 15 bp, Homo sapiens
gaaactttcatgtat

SEQ ID NO: 277392 - DNA, 15 bp, Homo sapiens
tgaaactttcatgta

SEQ ID NO: 277393 - DNA, 15 bp, Homo sapiens
ttgaaactttcatgt

SEQ ID NO: 277394 - DNA, 15 bp, Homo sapiens
cttgaaactttcatg

SEQ ID NO: 277395 - DNA, 15 bp, Homo sapiens
tcttgaaactttcat

SEQ ID NO: 277396 - DNA, 15 bp, Homo sapiens
atcttgaaactttca

SEQ ID NO: 277397 - DNA, 15 bp, Homo sapiens
catcttgaaactttc

SEQ ID NO: 277398 - DNA, 15 bp, Homo sapiens
ccatcttgaaacttt

SEQ ID NO: 277399 - DNA, 15 bp, Homo sapiens
accatcttgaaactt

SEQ ID NO: 277400 - DNA, 15 bp, Homo sapiens
caccatcttgaaact

SEQ ID NO: 277401 - DNA, 15 bp, Homo sapiens
tcaccatcttgaaac

SEQ ID NO: 277402 - DNA, 15 bp, Homo sapiens
ttcaccatcttgaaa

SEQ ID NO: 277403 - DNA, 15 bp, Homo sapiens
tttcaccatcttgaa

SEQ ID NO: 277404 - DNA, 15 bp, Homo sapiens
atttcaccatcttga

SEQ ID NO: 277405 - DNA, 15 bp, Homo sapiens
aatttcaccatcttg

SEQ ID NO: 277406 - DNA, 15 bp, Homo sapiens
taatttcaccatctt

SEQ ID NO: 277407 - DNA, 15 bp, Homo sapiens
gtaatttcaccatct

SEQ ID NO: 277408 - DNA, 15 bp, Homo sapiens
ggtaatttcaccatc

SEQ ID NO: 277409 - DNA, 15 bp, Homo sapiens
tggtaatttcaccat

SEQ ID NO: 277410 - DNA, 15 bp, Homo sapiens
atggtaatttcacca

SEQ ID NO: 277411 - DNA, 15 bp, Homo sapiens
catggtaatttcacc

SEQ ID NO: 277412 - DNA, 15 bp, Homo sapiens
acatggtaatttcac

SEQ ID NO: 277413 - DNA, 15 bp, Homo sapiens
cacatggtaatttca

SEQ ID NO: 277414 - DNA, 15 bp, Homo sapiens
tcacatggtaatttc

SEQ ID NO: 277415 - DNA, 15 bp, Homo sapiens
atcacatggtaattt

SEQ ID NO: 277416 - DNA, 15 bp, Homo sapiens
aatcacatggtaatt

SEQ ID NO: 277417 - DNA, 15 bp, Homo sapiens
taatcacatggtaat

SEQ ID NO: 277418 - DNA, 15 bp, Homo sapiens
ataatcacatggtaa

SEQ ID NO: 277419 - DNA, 15 bp, Homo sapiens
tataatcacatggta

SEQ ID NO: 277420 - DNA, 15 bp, Homo sapiens
ttataatcacatggt

SEQ ID NO: 277421 - DNA, 15 bp, Homo sapiens
tttataatcacatgg

SEQ ID NO: 277422 - DNA, 15 bp, Homo sapiens
ctttataatcacatg

SEQ ID NO: 277423 - DNA, 15 bp, Homo sapiens
gctttataatcacat

SEQ ID NO: 277424 - DNA, 15 bp, Homo sapiens
tgctttataatcaca

SEQ ID NO: 277425 - DNA, 15 bp, Homo sapiens
ttgctttataatcac

SEQ ID NO: 277426 - DNA, 15 bp, Homo sapiens
tttgctttataatca

SEQ ID NO: 277427 - DNA, 15 bp, Homo sapiens
ctttgctttataatc

SEQ ID NO: 277428 - DNA, 15 bp, Homo sapiens
cctttgctttataat

SEQ ID NO: 277429 - DNA, 15 bp, Homo sapiens
ccctttgctttataa

SEQ ID NO: 277430 - DNA, 15 bp, Homo sapiens
tccctttgctttata

SEQ ID NO: 277431 - DNA, 15 bp, Homo sapiens
ttccctttgctttat

SEQ ID NO: 277432 - DNA, 15 bp, Homo sapiens
attccctttgcttta

SEQ ID NO: 277433 - DNA, 15 bp, Homo sapiens
tattccctttgcttt

SEQ ID NO: 277434 - DNA, 15 bp, Homo sapiens
ttattccctttgctt

SEQ ID NO: 277435 - DNA, 15 bp, Homo sapiens
cttattccctttgct

SEQ ID NO: 277436 - DNA, 15 bp, Homo sapiens
tcttattccctttgc

SEQ ID NO: 277437 - DNA, 15 bp, Homo sapiens
ttcttattccctttg

SEQ ID NO: 277438 - DNA, 15 bp, Homo sapiens
attcttattcccttt

SEQ ID NO: 277439 - DNA, 15 bp, Homo sapiens
aattcttattccctt

SEQ ID NO: 277440 - DNA, 15 bp, Homo sapiens
aaattcttattccct

SEQ ID NO: 277441 - DNA, 15 bp, Homo sapiens
taaattcttattccc

SEQ ID NO: 277442 - DNA, 15 bp, Homo sapiens
ataaattcttattcc

SEQ ID NO: 277443 - DNA, 15 bp, Homo sapiens
cataaattcttattc

SEQ ID NO: 277444 - DNA, 15 bp, Homo sapiens
ccataaattcttatt

SEQ ID NO: 277445 - DNA, 15 bp, Homo sapiens
gccataaattcttat

SEQ ID NO: 277446 - DNA, 15 bp, Homo sapiens
ggccataaattctta

SEQ ID NO: 277447 - DNA, 15 bp, Homo sapiens
aggccataaattctt

SEQ ID NO: 277448 - DNA, 15 bp, Homo sapiens
caggccataaattct

SEQ ID NO: 277449 - DNA, 15 bp, Homo sapiens
tcaggccataaattc

SEQ ID NO: 277450 - DNA, 15 bp, Homo sapiens
ttcaggccataaatt

SEQ ID NO: 277451 - DNA, 15 bp, Homo sapiens
cttcaggccataaat

SEQ ID NO: 277452 - DNA, 15 bp, Homo sapiens
acttcaggccataaa

SEQ ID NO: 277453 - DNA, 15 bp, Homo sapiens
cacttcaggccataa

SEQ ID NO: 277454 - DNA, 15 bp, Homo sapiens
tcacttcaggccata

SEQ ID NO: 277455 - DNA, 15 bp, Homo sapiens
ttcacttcaggccat

SEQ ID NO: 277456 - DNA, 15 bp, Homo sapiens
tttcacttcaggcca

SEQ ID NO: 277457 - DNA, 15 bp, Homo sapiens
ttttcacttcaggcc

SEQ ID NO: 277458 - DNA, 15 bp, Homo sapiens
cttttcacttcaggc

SEQ ID NO: 277459 - DNA, 15 bp, Homo sapiens
tcttttcacttcagg

SEQ ID NO: 277460 - DNA, 15 bp, Homo sapiens
ttcttttcacttcag

SEQ ID NO: 277461 - DNA, 15 bp, Homo sapiens
tttcttttcacttca

SEQ ID NO: 277462 - DNA, 15 bp, Homo sapiens
ttttcttttcacttc

SEQ ID NO: 277463 - DNA, 15 bp, Homo sapiens
tttttcttttcactt

SEQ ID NO: 277464 - DNA, 15 bp, Homo sapiens
ttttttcttttcact

SEQ ID NO: 277465 - DNA, 15 bp, Homo sapiens
tttttttcttttcac

SEQ ID NO: 277466 - DNA, 15 bp, Homo sapiens
ttttttttcttttca

SEQ ID NO: 277467 - DNA, 15 bp, Homo sapiens
attttttttcttttc

SEQ ID NO: 277468 - DNA, 15 bp, Homo sapiens
cattttttttctttt

SEQ ID NO: 277469 - DNA, 15 bp, Homo sapiens
acattttttttcttt

SEQ ID NO: 277470 - DNA, 15 bp, Homo sapiens
aacattttttttctt

SEQ ID NO: 277471 - DNA, 15 bp, Homo sapiens
aaacattttttttct

SEQ ID NO: 277472 - DNA, 15 bp, Homo sapiens
aaaacattttttttc

SEQ ID NO: 277473 - DNA, 15 bp, Homo sapiens
aaaaacatttttttt

SEQ ID NO: 277474 - DNA, 15 bp, Homo sapiens
gaaaaacattttttt

SEQ ID NO: 277475 - DNA, 15 bp, Homo sapiens
tgaaaaacatttttt

SEQ ID NO: 277476 - DNA, 15 bp, Homo sapiens
ttgaaaaacattttt

SEQ ID NO: 277477 - DNA, 15 bp, Homo sapiens
attgaaaaacatttt

SEQ ID NO: 277478 - DNA, 15 bp, Homo sapiens
cattgaaaaacattt

SEQ ID NO: 277479 - DNA, 15 bp, Homo sapiens
tcattgaaaaacatt

SEQ ID NO: 277480 - DNA, 15 bp, Homo sapiens
gtcattgaaaaacat

SEQ ID NO: 277481 - DNA, 15 bp, Homo sapiens
ggtcattgaaaaaca

SEQ ID NO: 277482 - DNA, 15 bp, Homo sapiens
gggtcattgaaaaac

SEQ ID NO: 277483 - DNA, 15 bp, Homo sapiens
tgggtcattgaaaaa

SEQ ID NO: 277484 - DNA, 15 bp, Homo sapiens
ctgggtcattgaaaa

SEQ ID NO: 277485 - DNA, 15 bp, Homo sapiens
tctgggtcattgaaa

SEQ ID NO: 277486 - DNA, 15 bp, Homo sapiens
ttctgggtcattgaa

SEQ ID NO: 277487 - DNA, 15 bp, Homo sapiens
tttctgggtcattga

SEQ ID NO: 277488 - DNA, 15 bp, Homo sapiens
ttttctgggtcattg

SEQ ID NO: 277489 - DNA, 15 bp, Homo sapiens
tttttctgggtcatt

SEQ ID NO: 277490 - DNA, 15 bp, Homo sapiens
ttttttctgggtcat

SEQ ID NO: 277491 - DNA, 15 bp, Homo sapiens
attttttctgggtca

SEQ ID NO: 277492 - DNA, 15 bp, Homo sapiens
cattttttctgggtc

SEQ ID NO: 277493 - DNA, 15 bp, Homo sapiens
gcattttttctgggt

SEQ ID NO: 277494 - DNA, 15 bp, Homo sapiens
tgcattttttctggg

SEQ ID NO: 277495 - DNA, 15 bp, Homo sapiens
ttgcattttttctgg

SEQ ID NO: 277496 - DNA, 15 bp, Homo sapiens
tttgcattttttctg

SEQ ID NO: 277497 - DNA, 15 bp, Homo sapiens
ctttgcattttttct

SEQ ID NO: 277498 - DNA, 15 bp, Homo sapiens
tctttgcattttttc

SEQ ID NO: 277499 - DNA, 15 bp, Homo sapiens
ttctttgcatttttt

SEQ ID NO: 277500 - DNA, 15 bp, Homo sapiens
cttctttgcattttt

SEQ ID NO: 277501 - DNA, 15 bp, Homo sapiens
acttctttgcatttt

SEQ ID NO: 277502 - DNA, 15 bp, Homo sapiens
tacttctttgcattt

SEQ ID NO: 277503 - DNA, 15 bp, Homo sapiens
ttacttctttgcatt

SEQ ID NO: 277504 - DNA, 15 bp, Homo sapiens
attacttctttgcat

SEQ ID NO: 277505 - DNA, 15 bp, Homo sapiens
aattacttctttgca

SEQ ID NO: 277506 - DNA, 15 bp, Homo sapiens
aaattacttctttgc

SEQ ID NO: 277507 - DNA, 15 bp, Homo sapiens
aaaattacttctttg

SEQ ID NO: 277508 - DNA, 15 bp, Homo sapiens
taaaattacttcttt

SEQ ID NO: 277509 - DNA, 15 bp, Homo sapiens
ttaaaattacttctt

SEQ ID NO: 277510 - DNA, 15 bp, Homo sapiens
cttaaaattacttct

SEQ ID NO: 277511 - DNA, 15 bp, Homo sapiens
tcttaaaattacttc

SEQ ID NO: 277512 - DNA, 15 bp, Homo sapiens
atcttaaaattactt

SEQ ID NO: 277513 - DNA, 15 bp, Homo sapiens
tatcttaaaattact

SEQ ID NO: 277514 - DNA, 15 bp, Homo sapiens
gtatcttaaaattac

SEQ ID NO: 277515 - DNA, 15 bp, Homo sapiens
agtatcttaaaatta

SEQ ID NO: 277516 - DNA, 15 bp, Homo sapiens
tagtatcttaaaatt

SEQ ID NO: 277517 - DNA, 15 bp, Homo sapiens
ttagtatcttaaaat

SEQ ID NO: 277518 - DNA, 15 bp, Homo sapiens
tttagtatcttaaaa

SEQ ID NO: 277519 - DNA, 15 bp, Homo sapiens
gtttagtatcttaaa

SEQ ID NO: 277520 - DNA, 15 bp, Homo sapiens
tgtttagtatcttaa

SEQ ID NO: 277521 - DNA, 15 bp, Homo sapiens
ttgtttagtatctta

SEQ ID NO: 277522 - DNA, 15 bp, Homo sapiens
attgtttagtatctt

SEQ ID NO: 277523 - DNA, 15 bp, Homo sapiens
aattgtttagtatct

SEQ ID NO: 277524 - DNA, 15 bp, Homo sapiens
taattgtttagtatc

SEQ ID NO: 277525 - DNA, 15 bp, Homo sapiens
ataattgtttagtat

SEQ ID NO: 277526 - DNA, 15 bp, Homo sapiens
cataattgtttagta

SEQ ID NO: 277527 - DNA, 15 bp, Homo sapiens
acataattgtttagt

SEQ ID NO: 277528 - DNA, 15 bp, Homo sapiens
cacataattgtttag

SEQ ID NO: 277529 - DNA, 15 bp, Homo sapiens
acacataattgttta

SEQ ID NO: 277530 - DNA, 15 bp, Homo sapiens
aacacataattgttt

SEQ ID NO: 277531 - DNA, 15 bp, Homo sapiens
taacacataattgtt

SEQ ID NO: 277532 - DNA, 15 bp, Homo sapiens
ttaacacataattgt

SEQ ID NO: 277533 - DNA, 15 bp, Homo sapiens
cttaacacataattg

SEQ ID NO: 277534 - DNA, 15 bp, Homo sapiens
tcttaacacataatt

SEQ ID NO: 277535 - DNA, 15 bp, Homo sapiens
atcttaacacataat

SEQ ID NO: 277536 - DNA, 15 bp, Homo sapiens
gatcttaacacataa

SEQ ID NO: 277537 - DNA, 15 bp, Homo sapiens
ggatcttaacacata

SEQ ID NO: 277538 - DNA, 15 bp, Homo sapiens
tggatcttaacacat

SEQ ID NO: 277539 - DNA, 15 bp, Homo sapiens
ttggatcttaacaca

SEQ ID NO: 277540 - DNA, 15 bp, Homo sapiens
tttggatcttaacac

SEQ ID NO: 277541 - DNA, 15 bp, Homo sapiens
atttggatcttaaca

SEQ ID NO: 277542 - DNA, 15 bp, Homo sapiens
tatttggatcttaac

SEQ ID NO: 277543 - DNA, 15 bp, Homo sapiens
ctatttggatcttaa

SEQ ID NO: 277544 - DNA, 15 bp, Homo sapiens
tctatttggatctta

SEQ ID NO: 277545 - DNA, 15 bp, Homo sapiens
atctatttggatctt

SEQ ID NO: 277546 - DNA, 15 bp, Homo sapiens
tatctatttggatct

SEQ ID NO: 277547 - DNA, 15 bp, Homo sapiens
ctatctatttggatc

SEQ ID NO: 277548 - DNA, 15 bp, Homo sapiens
tctatctatttggat

SEQ ID NO: 277549 - DNA, 15 bp, Homo sapiens
atctatctatttgga

SEQ ID NO: 277550 - DNA, 15 bp, Homo sapiens
aatctatctatttgg

SEQ ID NO: 277551 - DNA, 15 bp, Homo sapiens
aaatctatctatttg

SEQ ID NO: 277552 - DNA, 15 bp, Homo sapiens
aaaatctatctattt

SEQ ID NO: 277553 - DNA, 15 bp, Homo sapiens
taaaatctatctatt

SEQ ID NO: 277554 - DNA, 15 bp, Homo sapiens
ttaaaatctatctat

SEQ ID NO: 277555 - DNA, 15 bp, Homo sapiens
tttaaaatctatcta

SEQ ID NO: 277556 - DNA, 15 bp, Homo sapiens
atttaaaatctatct

SEQ ID NO: 277557 - DNA, 15 bp, Homo sapiens
gatttaaaatctatc

SEQ ID NO: 277558 - DNA, 15 bp, Homo sapiens
agatttaaaatctat

SEQ ID NO: 277559 - DNA, 15 bp, Homo sapiens
aagatttaaaatcta

SEQ ID NO: 277560 - DNA, 15 bp, Homo sapiens
aaagatttaaaatct

SEQ ID NO: 277561 - DNA, 15 bp, Homo sapiens
caaagatttaaaatc

SEQ ID NO: 277562 - DNA, 15 bp, Homo sapiens
tcaaagatttaaaat

SEQ ID NO: 277563 - DNA, 15 bp, Homo sapiens
ttcaaagatttaaaa

SEQ ID NO: 277564 - DNA, 15 bp, Homo sapiens
attcaaagatttaaa

SEQ ID NO: 277565 - DNA, 15 bp, Homo sapiens
aattcaaagatttaa

SEQ ID NO: 277566 - DNA, 15 bp, Homo sapiens
caattcaaagattta

SEQ ID NO: 277567 - DNA, 15 bp, Homo sapiens
gcaattcaaagattt

SEQ ID NO: 277568 - DNA, 15 bp, Homo sapiens
agcaattcaaagatt

SEQ ID NO: 277569 - DNA, 15 bp, Homo sapiens
aagcaattcaaagat

SEQ ID NO: 277570 - DNA, 15 bp, Homo sapiens
aaagcaattcaaaga

SEQ ID NO: 277571 - DNA, 15 bp, Homo sapiens
aaaagcaattcaaag

SEQ ID NO: 277572 - DNA, 15 bp, Homo sapiens
aaaaagcaattcaaa

SEQ ID NO: 277573 - DNA, 15 bp, Homo sapiens
gaaaaagcaattcaa

SEQ ID NO: 277574 - DNA, 15 bp, Homo sapiens
tgaaaaagcaattca

SEQ ID NO: 277575 - DNA, 15 bp, Homo sapiens
atgaaaaagcaattc

SEQ ID NO: 277576 - DNA, 15 bp, Homo sapiens
tatgaaaaagcaatt

SEQ ID NO: 277577 - DNA, 15 bp, Homo sapiens
atatgaaaaagcaat

SEQ ID NO: 277578 - DNA, 15 bp, Homo sapiens
catatgaaaaagcaa

SEQ ID NO: 277579 - DNA, 15 bp, Homo sapiens
acatatgaaaaagca

SEQ ID NO: 277580 - DNA, 15 bp, Homo sapiens
gacatatgaaaaagc

SEQ ID NO: 277581 - DNA, 15 bp, Homo sapiens
tgacatatgaaaaag

SEQ ID NO: 277582 - DNA, 15 bp, Homo sapiens
ctgacatatgaaaaa

SEQ ID NO: 277583 - DNA, 15 bp, Homo sapiens
cctgacatatgaaaa

SEQ ID NO: 277584 - DNA, 15 bp, Homo sapiens
tcctgacatatgaaa

SEQ ID NO: 277585 - DNA, 15 bp, Homo sapiens
atcctgacatatgaa

SEQ ID NO: 277586 - DNA, 15 bp, Homo sapiens
tatcctgacatatga

SEQ ID NO: 277587 - DNA, 15 bp, Homo sapiens
ttatcctgacatatg

SEQ ID NO: 277588 - DNA, 15 bp, Homo sapiens
tttatcctgacatat

SEQ ID NO: 277589 - DNA, 15 bp, Homo sapiens
atttatcctgacata

SEQ ID NO: 277590 - DNA, 15 bp, Homo sapiens
tatttatcctgacat

SEQ ID NO: 277591 - DNA, 15 bp, Homo sapiens
atatttatcctgaca

SEQ ID NO: 277592 - DNA, 15 bp, Homo sapiens
aatatttatcctgac

SEQ ID NO: 277593 - DNA, 15 bp, Homo sapiens
gaatatttatcctga

SEQ ID NO: 277594 - DNA, 15 bp, Homo sapiens
ggaatatttatcctg

SEQ ID NO: 277595 - DNA, 15 bp, Homo sapiens
aggaatatttatcct

SEQ ID NO: 277596 - DNA, 15 bp, Homo sapiens
caggaatatttatcc

SEQ ID NO: 277597 - DNA, 15 bp, Homo sapiens
gcaggaatatttatc

SEQ ID NO: 277598 - DNA, 15 bp, Homo sapiens
agcaggaatatttat

SEQ ID NO: 277599 - DNA, 15 bp, Homo sapiens
tagcaggaatattta

SEQ ID NO: 277600 - DNA, 15 bp, Homo sapiens
ttagcaggaatattt

SEQ ID NO: 277601 - DNA, 15 bp, Homo sapiens
cttagcaggaatatt

SEQ ID NO: 277602 - DNA, 15 bp, Homo sapiens
ccttagcaggaatat

SEQ ID NO: 277603 - DNA, 15 bp, Homo sapiens
gccttagcaggaata

SEQ ID NO: 277604 - DNA, 15 bp, Homo sapiens
ggccttagcaggaat

SEQ ID NO: 277605 - DNA, 15 bp, Homo sapiens
tggccttagcaggaa

SEQ ID NO: 277606 - DNA, 15 bp, Homo sapiens
atggccttagcagga

SEQ ID NO: 277607 - DNA, 15 bp, Homo sapiens
aatggccttagcagg

SEQ ID NO: 277608 - DNA, 15 bp, Homo sapiens
aaatggccttagcag

SEQ ID NO: 277609 - DNA, 15 bp, Homo sapiens
aaaatggccttagca

SEQ ID NO: 277610 - DNA, 15 bp, Homo sapiens
gaaaatggccttagc

SEQ ID NO: 277611 - DNA, 15 bp, Homo sapiens
agaaaatggccttag

SEQ ID NO: 277612 - DNA, 15 bp, Homo sapiens
aagaaaatggcctta

SEQ ID NO: 277613 - DNA, 15 bp, Homo sapiens
caagaaaatggcctt

SEQ ID NO: 277614 - DNA, 15 bp, Homo sapiens
acaagaaaatggcct

SEQ ID NO: 277615 - DNA, 15 bp, Homo sapiens
cacaagaaaatggcc

SEQ ID NO: 277616 - DNA, 15 bp, Homo sapiens
ccacaagaaaatggc

SEQ ID NO: 277617 - DNA, 15 bp, Homo sapiens
accacaagaaaatgg

SEQ ID NO: 277618 - DNA, 15 bp, Homo sapiens
aaccacaagaaaatg

SEQ ID NO: 277619 - DNA, 15 bp, Homo sapiens
caaccacaagaaaat

SEQ ID NO: 277620 - DNA, 15 bp, Homo sapiens
tcaaccacaagaaaa

SEQ ID NO: 277621 - DNA, 15 bp, Homo sapiens
ttcaaccacaagaaa

SEQ ID NO: 277622 - DNA, 15 bp, Homo sapiens
attcaaccacaagaa

SEQ ID NO: 277623 - DNA, 15 bp, Homo sapiens
gattcaaccacaaga

SEQ ID NO: 277624 - DNA, 15 bp, Homo sapiens
agattcaaccacaag

SEQ ID NO: 277625 - DNA, 15 bp, Homo sapiens
aagattcaaccacaa

SEQ ID NO: 277626 - DNA, 15 bp, Homo sapiens
caagattcaaccaca

SEQ ID NO: 277627 - DNA, 15 bp, Homo sapiens
ccaagattcaaccac

SEQ ID NO: 277628 - DNA, 15 bp, Homo sapiens
cccaagattcaacca

SEQ ID NO: 277629 - DNA, 15 bp, Homo sapiens
ccccaagattcaacc

SEQ ID NO: 277630 - DNA, 15 bp, Homo sapiens
tccccaagattcaac

SEQ ID NO: 277631 - DNA, 15 bp, Homo sapiens
ttccccaagattcaa

SEQ ID NO: 277632 - DNA, 15 bp, Homo sapiens
tttccccaagattca

SEQ ID NO: 277633 - DNA, 15 bp, Homo sapiens
ttttccccaagattc

SEQ ID NO: 277634 - DNA, 15 bp, Homo sapiens
attttccccaagatt

SEQ ID NO: 277635 - DNA, 15 bp, Homo sapiens
cattttccccaagat

SEQ ID NO: 277636 - DNA, 15 bp, Homo sapiens
tcattttccccaaga

SEQ ID NO: 277637 - DNA, 15 bp, Homo sapiens
ttcattttccccaag

SEQ ID NO: 277638 - DNA, 15 bp, Homo sapiens
gttcattttccccaa

SEQ ID NO: 277639 - DNA, 15 bp, Homo sapiens
agttcattttcccca

SEQ ID NO: 277640 - DNA, 15 bp, Homo sapiens
aagttcattttcccc

SEQ ID NO: 277641 - DNA, 15 bp, Homo sapiens
aaagttcattttccc

SEQ ID NO: 277642 - DNA, 15 bp, Homo sapiens
aaaagttcattttcc

SEQ ID NO: 277643 - DNA, 15 bp, Homo sapiens
taaaagttcattttc

SEQ ID NO: 277644 - DNA, 15 bp, Homo sapiens
ataaaagttcatttt

SEQ ID NO: 277645 - DNA, 15 bp, Homo sapiens
aataaaagttcattt

SEQ ID NO: 277646 - DNA, 15 bp, Homo sapiens
taataaaagttcatt

SEQ ID NO: 277647 - DNA, 15 bp, Homo sapiens
gtaataaaagttcat

SEQ ID NO: 277648 - DNA, 15 bp, Homo sapiens
agtaataaaagttca

SEQ ID NO: 277649 - DNA, 15 bp, Homo sapiens
tagtaataaaagttc

SEQ ID NO: 277650 - DNA, 15 bp, Homo sapiens
ttagtaataaaagtt

SEQ ID NO: 277651 - DNA, 15 bp, Homo sapiens
attagtaataaaagt

SEQ ID NO: 277652 - DNA, 15 bp, Homo sapiens
gattagtaataaaag

SEQ ID NO: 277653 - DNA, 15 bp, Homo sapiens
tgattagtaataaaa

SEQ ID NO: 277654 - DNA, 15 bp, Homo sapiens
atgattagtaataaa

SEQ ID NO: 277655 - DNA, 15 bp, Homo sapiens
gatgattagtaataa

SEQ ID NO: 277656 - DNA, 15 bp, Homo sapiens
tgatgattagtaata

SEQ ID NO: 277657 - DNA, 15 bp, Homo sapiens
ttgatgattagtaat

SEQ ID NO: 277658 - DNA, 15 bp, Homo sapiens
gttgatgattagtaa

SEQ ID NO: 277659 - DNA, 15 bp, Homo sapiens
tgttgatgattagta

SEQ ID NO: 277660 - DNA, 15 bp, Homo sapiens
ctgttgatgattagt

SEQ ID NO: 277661 - DNA, 15 bp, Homo sapiens
tctgttgatgattag

SEQ ID NO: 277662 - DNA, 15 bp, Homo sapiens
ctctgttgatgatta

SEQ ID NO: 277663 - DNA, 15 bp, Homo sapiens
actctgttgatgatt

SEQ ID NO: 277664 - DNA, 15 bp, Homo sapiens
cactctgttgatgat

SEQ ID NO: 277665 - DNA, 15 bp, Homo sapiens
gcactctgttgatga

SEQ ID NO: 277666 - DNA, 15 bp, Homo sapiens
ggcactctgttgatg

SEQ ID NO: 277667 - DNA, 15 bp, Homo sapiens
gggcactctgttgat

SEQ ID NO: 277668 - DNA, 15 bp, Homo sapiens
tgggcactctgttga

SEQ ID NO: 277669 - DNA, 15 bp, Homo sapiens
ctgggcactctgttg

SEQ ID NO: 277670 - DNA, 15 bp, Homo sapiens
actgggcactctgtt

SEQ ID NO: 277671 - DNA, 15 bp, Homo sapiens
aactgggcactctgt

SEQ ID NO: 277672 - DNA, 15 bp, Homo sapiens
caactgggcactctg

SEQ ID NO: 277673 - DNA, 15 bp, Homo sapiens
acaactgggcactct

SEQ ID NO: 277674 - DNA, 15 bp, Homo sapiens
tacaactgggcactc

SEQ ID NO: 277675 - DNA, 15 bp, Homo sapiens
atacaactgggcact

SEQ ID NO: 277676 - DNA, 15 bp, Homo sapiens
tatacaactgggcac

SEQ ID NO: 277677 - DNA, 15 bp, Homo sapiens
ctatacaactgggca

SEQ ID NO: 277678 - DNA, 15 bp, Homo sapiens
gctatacaactgggc

SEQ ID NO: 277679 - DNA, 15 bp, Homo sapiens
tgctatacaactggg

SEQ ID NO: 277680 - DNA, 15 bp, Homo sapiens
atgctatacaactgg

SEQ ID NO: 277681 - DNA, 15 bp, Homo sapiens
tatgctatacaactg

SEQ ID NO: 277682 - DNA, 15 bp, Homo sapiens
ttatgctatacaact

SEQ ID NO: 277683 - DNA, 15 bp, Homo sapiens
attatgctatacaac

SEQ ID NO: 277684 - DNA, 15 bp, Homo sapiens
cattatgctatacaa

SEQ ID NO: 277685 - DNA, 15 bp, Homo sapiens
tcattatgctataca

SEQ ID NO: 277686 - DNA, 15 bp, Homo sapiens
ttcattatgctatac

SEQ ID NO: 277687 - DNA, 15 bp, Homo sapiens
cttcattatgctata

SEQ ID NO: 277688 - DNA, 15 bp, Homo sapiens
acttcattatgctat

SEQ ID NO: 277689 - DNA, 15 bp, Homo sapiens
aacttcattatgcta

SEQ ID NO: 277690 - DNA, 15 bp, Homo sapiens
gaacttcattatgct

SEQ ID NO: 277691 - DNA, 15 bp, Homo sapiens
agaacttcattatgc

SEQ ID NO: 277692 - DNA, 15 bp, Homo sapiens
tagaacttcattatg

SEQ ID NO: 277693 - DNA, 15 bp, Homo sapiens
ctagaacttcattat

SEQ ID NO: 277694 - DNA, 15 bp, Homo sapiens
actagaacttcatta

SEQ ID NO: 277695 - DNA, 15 bp, Homo sapiens
gactagaacttcatt

SEQ ID NO: 277696 - DNA, 15 bp, Homo sapiens
tgactagaacttcat

SEQ ID NO: 277697 - DNA, 15 bp, Homo sapiens
ctgactagaacttca

SEQ ID NO: 277698 - DNA, 15 bp, Homo sapiens
tctgactagaacttc

SEQ ID NO: 277699 - DNA, 15 bp, Homo sapiens
ctctgactagaactt

SEQ ID NO: 277700 - DNA, 15 bp, Homo sapiens
tctctgactagaact

SEQ ID NO: 277701 - DNA, 15 bp, Homo sapiens
ttctctgactagaac

SEQ ID NO: 277702 - DNA, 15 bp, Homo sapiens
tttctctgactagaa

SEQ ID NO: 277703 - DNA, 15 bp, Homo sapiens
ctttctctgactaga

SEQ ID NO: 277704 - DNA, 15 bp, Homo sapiens
tctttctctgactag

SEQ ID NO: 277705 - DNA, 15 bp, Homo sapiens
gtctttctctgacta

SEQ ID NO: 277706 - DNA, 15 bp, Homo sapiens
tgtctttctctgact

SEQ ID NO: 277707 - DNA, 15 bp, Homo sapiens
gtgtctttctctgac

SEQ ID NO: 277708 - DNA, 15 bp, Homo sapiens
ggtgtctttctctga

SEQ ID NO: 277709 - DNA, 15 bp, Homo sapiens
cggtgtctttctctg

SEQ ID NO: 277710 - DNA, 15 bp, Homo sapiens
acggtgtctttctct

SEQ ID NO: 277711 - DNA, 15 bp, Homo sapiens
gacggtgtctttctc

SEQ ID NO: 277712 - DNA, 15 bp, Homo sapiens
agacggtgtctttct

SEQ ID NO: 277713 - DNA, 15 bp, Homo sapiens
gagacggtgtctttc

SEQ ID NO: 277714 - DNA, 15 bp, Homo sapiens
tgagacggtgtcttt

SEQ ID NO: 277715 - DNA, 15 bp, Homo sapiens
ctgagacggtgtctt

SEQ ID NO: 277716 - DNA, 15 bp, Homo sapiens
tctgagacggtgtct

SEQ ID NO: 277717 - DNA, 15 bp, Homo sapiens
atctgagacggtgtc

SEQ ID NO: 277718 - DNA, 15 bp, Homo sapiens
catctgagacggtgt

SEQ ID NO: 277719 - DNA, 15 bp, Homo sapiens
tcatctgagacggtg

SEQ ID NO: 277720 - DNA, 15 bp, Homo sapiens
gtcatctgagacggt

SEQ ID NO: 277721 - DNA, 15 bp, Homo sapiens
agtcatctgagacgg

SEQ ID NO: 277722 - DNA, 15 bp, Homo sapiens
tagtcatctgagacg

SEQ ID NO: 277723 - DNA, 15 bp, Homo sapiens
ctagtcatctgagac

SEQ ID NO: 277724 - DNA, 15 bp, Homo sapiens
tctagtcatctgaga

SEQ ID NO: 277725 - DNA, 15 bp, Homo sapiens
ctctagtcatctgag

SEQ ID NO: 277726 - DNA, 15 bp, Homo sapiens
tctctagtcatctga

SEQ ID NO: 277727 - DNA, 15 bp, Homo sapiens
ttctctagtcatctg

SEQ ID NO: 277728 - DNA, 15 bp, Homo sapiens
cttctctagtcatct

SEQ ID NO: 277729 - DNA, 15 bp, Homo sapiens
tcttctctagtcatc

SEQ ID NO: 277730 - DNA, 15 bp, Homo sapiens
ctcttctctagtcat

SEQ ID NO: 277731 - DNA, 15 bp, Homo sapiens
tctcttctctagtca

SEQ ID NO: 277732 - DNA, 15 bp, Homo sapiens
ttctcttctctagtc

SEQ ID NO: 277733 - DNA, 15 bp, Homo sapiens
tttctcttctctagt

SEQ ID NO: 277734 - DNA, 15 bp, Homo sapiens
gtttctcttctctag

SEQ ID NO: 277735 - DNA, 15 bp, Homo sapiens
agtttctcttctcta

SEQ ID NO: 277736 - DNA, 15 bp, Homo sapiens
gagtttctcttctct

SEQ ID NO: 277737 - DNA, 15 bp, Homo sapiens
tgagtttctcttctc

SEQ ID NO: 277738 - DNA, 15 bp, Homo sapiens
ttgagtttctcttct

SEQ ID NO: 277739 - DNA, 15 bp, Homo sapiens
tttgagtttctcttc

SEQ ID NO: 277740 - DNA, 15 bp, Homo sapiens
ttttgagtttctctt

SEQ ID NO: 277741 - DNA, 15 bp, Homo sapiens
cttttgagtttctct

SEQ ID NO: 277742 - DNA, 15 bp, Homo sapiens
acttttgagtttctc

SEQ ID NO: 277743 - DNA, 15 bp, Homo sapiens
cacttttgagtttct

SEQ ID NO: 277744 - DNA, 15 bp, Homo sapiens
acacttttgagtttc

SEQ ID NO: 277745 - DNA, 15 bp, Homo sapiens
cacacttttgagttt

SEQ ID NO: 277746 - DNA, 15 bp, Homo sapiens
tcacacttttgagtt

SEQ ID NO: 277747 - DNA, 15 bp, Homo sapiens
ttcacacttttgagt

SEQ ID NO: 277748 - DNA, 15 bp, Homo sapiens
cttcacacttttgag

SEQ ID NO: 277749 - DNA, 15 bp, Homo sapiens
acttcacacttttga

SEQ ID NO: 277750 - DNA, 15 bp, Homo sapiens
aacttcacacttttg

SEQ ID NO: 277751 - DNA, 15 bp, Homo sapiens
aaacttcacactttt

SEQ ID NO: 277752 - DNA, 15 bp, Homo sapiens
aaaacttcacacttt

SEQ ID NO: 277753 - DNA, 15 bp, Homo sapiens
gaaaacttcacactt

SEQ ID NO: 277754 - DNA, 15 bp, Homo sapiens
agaaaacttcacact

SEQ ID NO: 277755 - DNA, 15 bp, Homo sapiens
tagaaaacttcacac

SEQ ID NO: 277756 - DNA, 15 bp, Homo sapiens
gtagaaaacttcaca

SEQ ID NO: 277757 - DNA, 15 bp, Homo sapiens
agtagaaaacttcac

SEQ ID NO: 277758 - DNA, 15 bp, Homo sapiens
aagtagaaaacttca

SEQ ID NO: 277759 - DNA, 15 bp, Homo sapiens
aaagtagaaaacttc

SEQ ID NO: 277760 - DNA, 15 bp, Homo sapiens
taaagtagaaaactt

SEQ ID NO: 277761 - DNA, 15 bp, Homo sapiens
ataaagtagaaaact

SEQ ID NO: 277762 - DNA, 15 bp, Homo sapiens
tataaagtagaaaac

SEQ ID NO: 277763 - DNA, 15 bp, Homo sapiens
ttataaagtagaaaa

SEQ ID NO: 277764 - DNA, 15 bp, Homo sapiens
tttataaagtagaaa

SEQ ID NO: 277765 - DNA, 15 bp, Homo sapiens
ttttataaagtagaa

SEQ ID NO: 277766 - DNA, 15 bp, Homo sapiens
tttttataaagtaga

SEQ ID NO: 277767 - DNA, 15 bp, Homo sapiens
ttttttataaagtag

SEQ ID NO: 277768 - DNA, 15 bp, Homo sapiens
attttttataaagta

SEQ ID NO: 277769 - DNA, 15 bp, Homo sapiens
tattttttataaagt

SEQ ID NO: 277770 - DNA, 15 bp, Homo sapiens
ctattttttataaag

SEQ ID NO: 277771 - DNA, 15 bp, Homo sapiens
tctattttttataaa

SEQ ID NO: 277772 - DNA, 15 bp, Homo sapiens
ctctattttttataa

SEQ ID NO: 277773 - DNA, 15 bp, Homo sapiens
tctctattttttata

SEQ ID NO: 277774 - DNA, 15 bp, Homo sapiens
ttctctattttttat

SEQ ID NO: 277775 - DNA, 15 bp, Homo sapiens
tttctctatttttta

SEQ ID NO: 277776 - DNA, 15 bp, Homo sapiens
ttttctctatttttt

SEQ ID NO: 277777 - DNA, 15 bp, Homo sapiens
attttctctattttt

SEQ ID NO: 277778 - DNA, 15 bp, Homo sapiens
aattttctctatttt

SEQ ID NO: 277779 - DNA, 15 bp, Homo sapiens
caattttctctattt

SEQ ID NO: 277780 - DNA, 15 bp, Homo sapiens
acaattttctctatt

SEQ ID NO: 277781 - DNA, 15 bp, Homo sapiens
tacaattttctctat

SEQ ID NO: 277782 - DNA, 15 bp, Homo sapiens
ctacaattttctcta

SEQ ID NO: 277783 - DNA, 15 bp, Homo sapiens
actacaattttctct

SEQ ID NO: 277784 - DNA, 15 bp, Homo sapiens
tactacaattttctc

SEQ ID NO: 277785 - DNA, 15 bp, Homo sapiens
ttactacaattttct

SEQ ID NO: 277786 - DNA, 15 bp, Homo sapiens
cttactacaattttc

SEQ ID NO: 277787 - DNA, 15 bp, Homo sapiens
tcttactacaatttt

SEQ ID NO: 277788 - DNA, 15 bp, Homo sapiens
ttcttactacaattt

SEQ ID NO: 277789 - DNA, 15 bp, Homo sapiens
cttcttactacaatt

SEQ ID NO: 277790 - DNA, 15 bp, Homo sapiens
acttcttactacaat

SEQ ID NO: 277791 - DNA, 15 bp, Homo sapiens
tacttcttactacaa

SEQ ID NO: 277792 - DNA, 15 bp, Homo sapiens
atacttcttactaca

SEQ ID NO: 277793 - DNA, 15 bp, Homo sapiens
tatacttcttactac

SEQ ID NO: 277794 - DNA, 15 bp, Homo sapiens
ttatacttcttacta

SEQ ID NO: 277795 - DNA, 15 bp, Homo sapiens
tttatacttcttact

SEQ ID NO: 277796 - DNA, 15 bp, Homo sapiens
ttttatacttcttac

SEQ ID NO: 277797 - DNA, 15 bp, Homo sapiens
tttttatacttctta

SEQ ID NO: 277798 - DNA, 15 bp, Homo sapiens
ttttttatacttctt

SEQ ID NO: 277799 - DNA, 15 bp, Homo sapiens
attttttatacttct

SEQ ID NO: 277800 - DNA, 15 bp, Homo sapiens
cattttttatacttc

SEQ ID NO: 277801 - DNA, 15 bp, Homo sapiens
acattttttatactt

SEQ ID NO: 277802 - DNA, 15 bp, Homo sapiens
gacattttttatact

SEQ ID NO: 277803 - DNA, 15 bp, Homo sapiens
tgacattttttatac

SEQ ID NO: 277804 - DNA, 15 bp, Homo sapiens
ttgacattttttata

SEQ ID NO: 277805 - DNA, 15 bp, Homo sapiens
cttgacattttttat

SEQ ID NO: 277806 - DNA, 15 bp, Homo sapiens
acttgacatttttta

SEQ ID NO: 277807 - DNA, 15 bp, Homo sapiens
cacttgacatttttt

SEQ ID NO: 277808 - DNA, 15 bp, Homo sapiens
gcacttgacattttt

SEQ ID NO: 277809 - DNA, 15 bp, Homo sapiens
tgcacttgacatttt

SEQ ID NO: 277810 - DNA, 15 bp, Homo sapiens
ttgcacttgacattt

SEQ ID NO: 277811 - DNA, 15 bp, Homo sapiens
attgcacttgacatt

SEQ ID NO: 277812 - DNA, 15 bp, Homo sapiens
aattgcacttgacat

SEQ ID NO: 277813 - DNA, 15 bp, Homo sapiens
aaattgcacttgaca

SEQ ID NO: 277814 - DNA, 15 bp, Homo sapiens
aaaattgcacttgac

SEQ ID NO: 277815 - DNA, 15 bp, Homo sapiens
aaaaattgcacttga

SEQ ID NO: 277816 - DNA, 15 bp, Homo sapiens
caaaaattgcacttg

SEQ ID NO: 277817 - DNA, 15 bp, Homo sapiens
acaaaaattgcactt

SEQ ID NO: 277818 - DNA, 15 bp, Homo sapiens
cacaaaaattgcact

SEQ ID NO: 277819 - DNA, 15 bp, Homo sapiens
tcacaaaaattgcac

SEQ ID NO: 277820 - DNA, 15 bp, Homo sapiens
ttcacaaaaattgca

SEQ ID NO: 277821 - DNA, 15 bp, Homo sapiens
tttcacaaaaattgc

SEQ ID NO: 277822 - DNA, 15 bp, Homo sapiens
atttcacaaaaattg

SEQ ID NO: 277823 - DNA, 15 bp, Homo sapiens
catttcacaaaaatt

SEQ ID NO: 277824 - DNA, 15 bp, Homo sapiens
tcatttcacaaaaat

SEQ ID NO: 277825 - DNA, 15 bp, Homo sapiens
ttcatttcacaaaaa

SEQ ID NO: 277826 - DNA, 15 bp, Homo sapiens
tttcatttcacaaaa

SEQ ID NO: 277827 - DNA, 15 bp, Homo sapiens
gtttcatttcacaaa

SEQ ID NO: 277828 - DNA, 15 bp, Homo sapiens
agtttcatttcacaa

SEQ ID NO: 277829 - DNA, 15 bp, Homo sapiens
aagtttcatttcaca

SEQ ID NO: 277830 - DNA, 15 bp, Homo sapiens
aaagtttcatttcac

SEQ ID NO: 277831 - DNA, 15 bp, Homo sapiens
taaagtttcatttca

SEQ ID NO: 277832 - DNA, 15 bp, Homo sapiens
ctaaagtttcatttc

SEQ ID NO: 277833 - DNA, 15 bp, Homo sapiens
gctaaagtttcattt

SEQ ID NO: 277834 - DNA, 15 bp, Homo sapiens
ggctaaagtttcatt

SEQ ID NO: 277835 - DNA, 15 bp, Homo sapiens
aggctaaagtttcat

SEQ ID NO: 277836 - DNA, 15 bp, Homo sapiens
aaggctaaagtttca

SEQ ID NO: 277837 - DNA, 15 bp, Homo sapiens
gaaggctaaagtttc

SEQ ID NO: 277838 - DNA, 15 bp, Homo sapiens
tgaaggctaaagttt

SEQ ID NO: 277839 - DNA, 15 bp, Homo sapiens
ctgaaggctaaagtt

SEQ ID NO: 277840 - DNA, 15 bp, Homo sapiens
tctgaaggctaaagt

SEQ ID NO: 277841 - DNA, 15 bp, Homo sapiens
atctgaaggctaaag

SEQ ID NO: 277842 - DNA, 15 bp, Homo sapiens
aatctgaaggctaaa

SEQ ID NO: 277843 - DNA, 15 bp, Homo sapiens
gaatctgaaggctaa

SEQ ID NO: 277844 - DNA, 15 bp, Homo sapiens
tgaatctgaaggcta

SEQ ID NO: 277845 - DNA, 15 bp, Homo sapiens
atgaatctgaaggct

SEQ ID NO: 277846 - DNA, 15 bp, Homo sapiens
tatgaatctgaaggc

SEQ ID NO: 277847 - DNA, 15 bp, Homo sapiens
ctatgaatctgaagg

SEQ ID NO: 277848 - DNA, 15 bp, Homo sapiens
actatgaatctgaag

SEQ ID NO: 277849 - DNA, 15 bp, Homo sapiens
aactatgaatctgaa

SEQ ID NO: 277850 - DNA, 15 bp, Homo sapiens
gaactatgaatctga

SEQ ID NO: 277851 - DNA, 15 bp, Homo sapiens
tgaactatgaatctg

SEQ ID NO: 277852 - DNA, 15 bp, Homo sapiens
atgaactatgaatct

SEQ ID NO: 277853 - DNA, 15 bp, Homo sapiens
aatgaactatgaatc

SEQ ID NO: 277854 - DNA, 15 bp, Homo sapiens
aaatgaactatgaat

SEQ ID NO: 277855 - DNA, 15 bp, Homo sapiens
aaaatgaactatgaa

SEQ ID NO: 277856 - DNA, 15 bp, Homo sapiens
taaaatgaactatga

SEQ ID NO: 277857 - DNA, 15 bp, Homo sapiens
ataaaatgaactatg

SEQ ID NO: 277858 - DNA, 15 bp, Homo sapiens
aataaaatgaactat

SEQ ID NO: 277859 - DNA, 15 bp, Homo sapiens
aaataaaatgaacta

SEQ ID NO: 277860 - DNA, 15 bp, Homo sapiens
aaaataaaatgaact

SEQ ID NO: 277861 - DNA, 15 bp, Homo sapiens
caaaataaaatgaac

SEQ ID NO: 277862 - DNA, 15 bp, Homo sapiens
acaaaataaaatgaa

SEQ ID NO: 277863 - DNA, 15 bp, Homo sapiens
tacaaaataaaatga

SEQ ID NO: 277864 - DNA, 15 bp, Homo sapiens
gtacaaaataaaatg

SEQ ID NO: 277865 - DNA, 15 bp, Homo sapiens
tgtacaaaataaaat

SEQ ID NO: 277866 - DNA, 15 bp, Homo sapiens
atgtacaaaataaaa

SEQ ID NO: 277867 - DNA, 15 bp, Homo sapiens
catgtacaaaataaa

SEQ ID NO: 277868 - DNA, 15 bp, Homo sapiens
tcatgtacaaaataa

SEQ ID NO: 277869 - DNA, 15 bp, Homo sapiens
atcatgtacaaaata

SEQ ID NO: 277870 - DNA, 15 bp, Homo sapiens
tatcatgtacaaaat

SEQ ID NO: 277871 - DNA, 15 bp, Homo sapiens
ctatcatgtacaaaa

SEQ ID NO: 277872 - DNA, 15 bp, Homo sapiens
tctatcatgtacaaa

SEQ ID NO: 277873 - DNA, 15 bp, Homo sapiens
ttctatcatgtacaa

SEQ ID NO: 277874 - DNA, 15 bp, Homo sapiens
tttctatcatgtaca

SEQ ID NO: 277875 - DNA, 15 bp, Homo sapiens
ttttctatcatgtac

SEQ ID NO: 277876 - DNA, 15 bp, Homo sapiens
attttctatcatgta

SEQ ID NO: 277877 - DNA, 15 bp, Homo sapiens
gattttctatcatgt

SEQ ID NO: 277878 - DNA, 15 bp, Homo sapiens
tgattttctatcatg

SEQ ID NO: 277879 - DNA, 15 bp, Homo sapiens
ctgattttctatcat

SEQ ID NO: 277880 - DNA, 15 bp, Homo sapiens
cctgattttctatca

SEQ ID NO: 277881 - DNA, 15 bp, Homo sapiens
tcctgattttctatc

SEQ ID NO: 277882 - DNA, 15 bp, Homo sapiens
ttcctgattttctat

SEQ ID NO: 277883 - DNA, 15 bp, Homo sapiens
cttcctgattttcta

SEQ ID NO: 277884 - DNA, 15 bp, Homo sapiens
acttcctgattttct

SEQ ID NO: 277885 - DNA, 15 bp, Homo sapiens
tacttcctgattttc

SEQ ID NO: 277886 - DNA, 15 bp, Homo sapiens
ctacttcctgatttt

SEQ ID NO: 277887 - DNA, 15 bp, Homo sapiens
actacttcctgattt

SEQ ID NO: 277888 - DNA, 15 bp, Homo sapiens
tactacttcctgatt

SEQ ID NO: 277889 - DNA, 15 bp, Homo sapiens
ttactacttcctgat

SEQ ID NO: 277890 - DNA, 15 bp, Homo sapiens
attactacttcctga

SEQ ID NO: 277891 - DNA, 15 bp, Homo sapiens
tattactacttcctg

SEQ ID NO: 277892 - DNA, 15 bp, Homo sapiens
atattactacttcct

SEQ ID NO: 277893 - DNA, 15 bp, Homo sapiens
aatattactacttcc

SEQ ID NO: 277894 - DNA, 15 bp, Homo sapiens
aaatattactacttc

SEQ ID NO: 277895 - DNA, 15 bp, Homo sapiens
aaaatattactactt

SEQ ID NO: 277896 - DNA, 15 bp, Homo sapiens
taaaatattactact

SEQ ID NO: 277897 - DNA, 15 bp, Homo sapiens
ctaaaatattactac

SEQ ID NO: 277898 - DNA, 15 bp, Homo sapiens
actaaaatattacta

SEQ ID NO: 277899 - DNA, 15 bp, Homo sapiens
cactaaaatattact

SEQ ID NO: 277900 - DNA, 15 bp, Homo sapiens
gcactaaaatattac

SEQ ID NO: 277901 - DNA, 15 bp, Homo sapiens
agcactaaaatatta

SEQ ID NO: 277902 - DNA, 15 bp, Homo sapiens
aagcactaaaatatt

SEQ ID NO: 277903 - DNA, 15 bp, Homo sapiens
aaagcactaaaatat

SEQ ID NO: 277904 - DNA, 15 bp, Homo sapiens
caaagcactaaaata

SEQ ID NO: 277905 - DNA, 15 bp, Homo sapiens
acaaagcactaaaat

SEQ ID NO: 277906 - DNA, 15 bp, Homo sapiens
cacaaagcactaaaa

SEQ ID NO: 277907 - DNA, 15 bp, Homo sapiens
tcacaaagcactaaa

SEQ ID NO: 277908 - DNA, 15 bp, Homo sapiens
atcacaaagcactaa

SEQ ID NO: 277909 - DNA, 15 bp, Homo sapiens
tatcacaaagcacta

SEQ ID NO: 277910 - DNA, 15 bp, Homo sapiens
ctatcacaaagcact

SEQ ID NO: 277911 - DNA, 15 bp, Homo sapiens
actatcacaaagcac

SEQ ID NO: 277912 - DNA, 15 bp, Homo sapiens
gactatcacaaagca

SEQ ID NO: 277913 - DNA, 15 bp, Homo sapiens
tgactatcacaaagc

SEQ ID NO: 277914 - DNA, 15 bp, Homo sapiens
ttgactatcacaaag

SEQ ID NO: 277915 - DNA, 15 bp, Homo sapiens
attgactatcacaaa

SEQ ID NO: 277916 - DNA, 15 bp, Homo sapiens
cattgactatcacaa

SEQ ID NO: 277917 - DNA, 15 bp, Homo sapiens
acattgactatcaca

SEQ ID NO: 277918 - DNA, 15 bp, Homo sapiens
gacattgactatcac

SEQ ID NO: 277919 - DNA, 15 bp, Homo sapiens
agacattgactatca

SEQ ID NO: 277920 - DNA, 15 bp, Homo sapiens
gagacattgactatc

SEQ ID NO: 277921 - DNA, 15 bp, Homo sapiens
tgagacattgactat

SEQ ID NO: 277922 - DNA, 15 bp, Homo sapiens
ttgagacattgacta

SEQ ID NO: 277923 - DNA, 15 bp, Homo sapiens
tttgagacattgact

SEQ ID NO: 277924 - DNA, 15 bp, Homo sapiens
gtttgagacattgac

SEQ ID NO: 277925 - DNA, 15 bp, Homo sapiens
tgtttgagacattga

SEQ ID NO: 277926 - DNA, 15 bp, Homo sapiens
atgtttgagacattg

SEQ ID NO: 277927 - DNA, 15 bp, Homo sapiens
catgtttgagacatt

SEQ ID NO: 277928 - DNA, 15 bp, Homo sapiens
acatgtttgagacat

SEQ ID NO: 277929 - DNA, 15 bp, Homo sapiens
gacatgtttgagaca

SEQ ID NO: 277930 - DNA, 15 bp, Homo sapiens
tgacatgtttgagac

SEQ ID NO: 277931 - DNA, 15 bp, Homo sapiens
ttgacatgtttgaga

SEQ ID NO: 277932 - DNA, 15 bp, Homo sapiens
tttgacatgtttgag

SEQ ID NO: 277933 - DNA, 15 bp, Homo sapiens
ttttgacatgtttga

SEQ ID NO: 277934 - DNA, 15 bp, Homo sapiens
attttgacatgtttg

SEQ ID NO: 277935 - DNA, 15 bp, Homo sapiens
tattttgacatgttt

SEQ ID NO: 277936 - DNA, 15 bp, Homo sapiens
ctattttgacatgtt

SEQ ID NO: 277937 - DNA, 15 bp, Homo sapiens
tctattttgacatgt

SEQ ID NO: 277938 - DNA, 15 bp, Homo sapiens
ttctattttgacatg

SEQ ID NO: 277939 - DNA, 15 bp, Homo sapiens
cttctattttgacat

SEQ ID NO: 277940 - DNA, 15 bp, Homo sapiens
tcttctattttgaca

SEQ ID NO: 277941 - DNA, 15 bp, Homo sapiens
ttcttctattttgac

SEQ ID NO: 277942 - DNA, 15 bp, Homo sapiens
attcttctattttga

SEQ ID NO: 277943 - DNA, 15 bp, Homo sapiens
tattcttctattttg

SEQ ID NO: 277944 - DNA, 15 bp, Homo sapiens
gtattcttctatttt

SEQ ID NO: 277945 - DNA, 15 bp, Homo sapiens
tgtattcttctattt

SEQ ID NO: 277946 - DNA, 15 bp, Homo sapiens
ctgtattcttctatt

SEQ ID NO: 277947 - DNA, 15 bp, Homo sapiens
actgtattcttctat

SEQ ID NO: 277948 - DNA, 15 bp, Homo sapiens
tactgtattcttcta

SEQ ID NO: 277949 - DNA, 15 bp, Homo sapiens
atactgtattcttct

SEQ ID NO: 277950 - DNA, 15 bp, Homo sapiens
aatactgtattcttc

SEQ ID NO: 277951 - DNA, 15 bp, Homo sapiens
aaatactgtattctt

SEQ ID NO: 277952 - DNA, 15 bp, Homo sapiens
caaatactgtattct

SEQ ID NO: 277953 - DNA, 15 bp, Homo sapiens
ccaaatactgtattc

SEQ ID NO: 277954 - DNA, 15 bp, Homo sapiens
accaaatactgtatt

SEQ ID NO: 277955 - DNA, 15 bp, Homo sapiens
gaccaaatactgtat

SEQ ID NO: 277956 - DNA, 15 bp, Homo sapiens
agaccaaatactgta

SEQ ID NO: 277957 - DNA, 15 bp, Homo sapiens
cagaccaaatactgt

SEQ ID NO: 277958 - DNA, 15 bp, Homo sapiens
gcagaccaaatactg

SEQ ID NO: 277959 - DNA, 15 bp, Homo sapiens
tgcagaccaaatact

SEQ ID NO: 277960 - DNA, 15 bp, Homo sapiens
ctgcagaccaaatac

SEQ ID NO: 277961 - DNA, 15 bp, Homo sapiens
tctgcagaccaaata

SEQ ID NO: 277962 - DNA, 15 bp, Homo sapiens
gtctgcagaccaaat

SEQ ID NO: 277963 - DNA, 15 bp, Homo sapiens
ttttggtctgcagac

SEQ ID NO: 277964 - DNA, 15 bp, Homo sapiens
attttggtctgcaga

SEQ ID NO: 277965 - DNA, 15 bp, Homo sapiens
tattttggtctgcag

SEQ ID NO: 277966 - DNA, 15 bp, Homo sapiens
ctattttggtctgca

SEQ ID NO: 277967 - DNA, 15 bp, Homo sapiens
tctattttggtctgc

SEQ ID NO: 277968 - DNA, 15 bp, Homo sapiens
atctattttggtctg

SEQ ID NO: 277969 - DNA, 15 bp, Homo sapiens
aatctattttggtct

SEQ ID NO: 277970 - DNA, 15 bp, Homo sapiens
aaatctattttggtc

SEQ ID NO: 277971 - DNA, 15 bp, Homo sapiens
aaaatctattttggt

SEQ ID NO: 277972 - DNA, 15 bp, Homo sapiens
aaaaatctattttgg

SEQ ID NO: 277973 - DNA, 15 bp, Homo sapiens
aaaaaatctattttg

SEQ ID NO: 277974 - DNA, 15 bp, Homo sapiens
aaaaaaatctatttt

SEQ ID NO: 277975 - DNA, 15 bp, Homo sapiens
taaaaaaatctattt

SEQ ID NO: 277976 - DNA, 15 bp, Homo sapiens
ttaaaaaaatctatt

SEQ ID NO: 277977 - DNA, 15 bp, Homo sapiens
tttaaaaaaatctat

SEQ ID NO: 277978 - DNA, 15 bp, Homo sapiens
atttaaaaaaatcta

SEQ ID NO: 277979 - DNA, 15 bp, Homo sapiens
gatttaaaaaaatct

SEQ ID NO: 277980 - DNA, 15 bp, Homo sapiens
ggatttaaaaaaatc

SEQ ID NO: 277981 - DNA, 15 bp, Homo sapiens
gggatttaaaaaaat

SEQ ID NO: 277982 - DNA, 15 bp, Homo sapiens
agggatttaaaaaaa

SEQ ID NO: 277983 - DNA, 15 bp, Homo sapiens
cagggatttaaaaaa

SEQ ID NO: 277984 - DNA, 15 bp, Homo sapiens
acagggatttaaaaa

SEQ ID NO: 277985 - DNA, 15 bp, Homo sapiens
tacagggatttaaaa

SEQ ID NO: 277986 - DNA, 15 bp, Homo sapiens
ctacagggatttaaa

SEQ ID NO: 277987 - DNA, 15 bp, Homo sapiens
tctacagggatttaa

SEQ ID NO: 277988 - DNA, 15 bp, Homo sapiens
gtctacagggattta

SEQ ID NO: 277989 - DNA, 15 bp, Homo sapiens
ggtctacagggattt

SEQ ID NO: 277990 - DNA, 15 bp, Homo sapiens
aggtctacagggatt

SEQ ID NO: 277991 - DNA, 15 bp, Homo sapiens
gaggtctacagggat

SEQ ID NO: 277992 - DNA, 15 bp, Homo sapiens
tgaggtctacaggga

SEQ ID NO: 277993 - DNA, 15 bp, Homo sapiens
ttgaggtctacaggg

SEQ ID NO: 277994 - DNA, 15 bp, Homo sapiens
tttgaggtctacagg

SEQ ID NO: 277995 - DNA, 15 bp, Homo sapiens
gtttgaggtctacag

SEQ ID NO: 277996 - DNA, 15 bp, Homo sapiens
agtttgaggtctaca

SEQ ID NO: 277997 - DNA, 15 bp, Homo sapiens
aagtttgaggtctac

SEQ ID NO: 277998 - DNA, 15 bp, Homo sapiens
aaagtttgaggtcta

SEQ ID NO: 277999 - DNA, 15 bp, Homo sapiens
caaagtttgaggtct

SEQ ID NO: 278000 - DNA, 15 bp, Homo sapiens
gcaaagtttgaggtc

SEQ ID NO: 278001 - DNA, 15 bp, Homo sapiens
agcaaagtttgaggt

SEQ ID NO: 278002 - DNA, 15 bp, Homo sapiens
tagcaaagtttgagg

SEQ ID NO: 278003 - DNA, 15 bp, Homo sapiens
ttagcaaagtttgag

SEQ ID NO: 278004 - DNA, 15 bp, Homo sapiens
tttagcaaagtttga

SEQ ID NO: 278005 - DNA, 15 bp, Homo sapiens
atttagcaaagtttg

SEQ ID NO: 278006 - DNA, 15 bp, Homo sapiens
aatttagcaaagttt

SEQ ID NO: 278007 - DNA, 15 bp, Homo sapiens
aaatttagcaaagtt

SEQ ID NO: 278008 - DNA, 15 bp, Homo sapiens
taaatttagcaaagt

SEQ ID NO: 278009 - DNA, 15 bp, Homo sapiens
ataaatttagcaaag

SEQ ID NO: 278010 - DNA, 15 bp, Homo sapiens
cataaatttagcaaa

SEQ ID NO: 278011 - DNA, 15 bp, Homo sapiens
acataaatttagcaa

SEQ ID NO: 278012 - DNA, 15 bp, Homo sapiens
tacataaatttagca

SEQ ID NO: 278013 - DNA, 15 bp, Homo sapiens
gtacataaatttagc

SEQ ID NO: 278014 - DNA, 15 bp, Homo sapiens
ggtacataaatttag

SEQ ID NO: 278015 - DNA, 15 bp, Homo sapiens
tggtacataaattta

SEQ ID NO: 278016 - DNA, 15 bp, Homo sapiens
ctggtacataaattt

SEQ ID NO: 278017 - DNA, 15 bp, Homo sapiens
actggtacataaatt

SEQ ID NO: 278018 - DNA, 15 bp, Homo sapiens
aactggtacataaat

SEQ ID NO: 278019 - DNA, 15 bp, Homo sapiens
aaactggtacataaa

SEQ ID NO: 278020 - DNA, 15 bp, Homo sapiens
taaactggtacataa

SEQ ID NO: 278021 - DNA, 15 bp, Homo sapiens
ataaactggtacata

SEQ ID NO: 278022 - DNA, 15 bp, Homo sapiens
gataaactggtacat

SEQ ID NO: 278023 - DNA, 15 bp, Homo sapiens
agataaactggtaca

SEQ ID NO: 278024 - DNA, 15 bp, Homo sapiens
gagataaactggtac

SEQ ID NO: 278025 - DNA, 15 bp, Homo sapiens
agagataaactggta

SEQ ID NO: 278026 - DNA, 15 bp, Homo sapiens
aagagataaactggt

SEQ ID NO: 278027 - DNA, 15 bp, Homo sapiens
aaagagataaactgg

SEQ ID NO: 278028 - DNA, 15 bp, Homo sapiens
aaaagagataaactg

SEQ ID NO: 278029 - DNA, 15 bp, Homo sapiens
taaaagagataaact

SEQ ID NO: 278030 - DNA, 15 bp, Homo sapiens
ataaaagagataaac

SEQ ID NO: 278031 - DNA, 15 bp, Homo sapiens
aataaaagagataaa

SEQ ID NO: 278032 - DNA, 15 bp, Homo sapiens
aaataaaagagataa

SEQ ID NO: 278033 - DNA, 15 bp, Homo sapiens
caaataaaagagata

SEQ ID NO: 278034 - DNA, 15 bp, Homo sapiens
acaaataaaagagat

SEQ ID NO: 278035 - DNA, 15 bp, Homo sapiens
cacaaataaaagaga

SEQ ID NO: 278036 - DNA, 15 bp, Homo sapiens
ccacaaataaaagag

SEQ ID NO: 278037 - DNA, 15 bp, Homo sapiens
tccacaaataaaaga

SEQ ID NO: 278038 - DNA, 15 bp, Homo sapiens
ttccacaaataaaag

SEQ ID NO: 278039 - DNA, 15 bp, Homo sapiens
attccacaaataaaa

SEQ ID NO: 278040 - DNA, 15 bp, Homo sapiens
cattccacaaataaa

SEQ ID NO: 278041 - DNA, 15 bp, Homo sapiens
ccattccacaaataa

SEQ ID NO: 278042 - DNA, 15 bp, Homo sapiens
gccattccacaaata

SEQ ID NO: 278043 - DNA, 15 bp, Homo sapiens
agccattccacaaat

SEQ ID NO: 278044 - DNA, 15 bp, Homo sapiens
tagccattccacaaa

SEQ ID NO: 278045 - DNA, 15 bp, Homo sapiens
ttagccattccacaa

SEQ ID NO: 278046 - DNA, 15 bp, Homo sapiens
cttagccattccaca

SEQ ID NO: 278047 - DNA, 15 bp, Homo sapiens
tcttagccattccac

SEQ ID NO: 278048 - DNA, 15 bp, Homo sapiens
ttcttagccattcca

SEQ ID NO: 278049 - DNA, 15 bp, Homo sapiens
tttcttagccattcc

SEQ ID NO: 278050 - DNA, 15 bp, Homo sapiens
atttcttagccattc

SEQ ID NO: 278051 - DNA, 15 bp, Homo sapiens
tatttcttagccatt

SEQ ID NO: 278052 - DNA, 15 bp, Homo sapiens
ctatttcttagccat

SEQ ID NO: 278053 - DNA, 15 bp, Homo sapiens
tctatttcttagcca

SEQ ID NO: 278054 - DNA, 15 bp, Homo sapiens
ttctatttcttagcc

SEQ ID NO: 278055 - DNA, 15 bp, Homo sapiens
cttctatttcttagc

SEQ ID NO: 278056 - DNA, 15 bp, Homo sapiens
tcttctatttcttag

SEQ ID NO: 278057 - DNA, 15 bp, Homo sapiens
ttcttctatttctta

SEQ ID NO: 278058 - DNA, 15 bp, Homo sapiens
tttcttctatttctt

SEQ ID NO: 278059 - DNA, 15 bp, Homo sapiens
ctttcttctatttct

SEQ ID NO: 278060 - DNA, 15 bp, Homo sapiens
tctttcttctatttc

SEQ ID NO: 278061 - DNA, 15 bp, Homo sapiens
ttctttcttctattt

SEQ ID NO: 278062 - DNA, 15 bp, Homo sapiens
gttctttcttctatt

SEQ ID NO: 278063 - DNA, 15 bp, Homo sapiens
tgttctttcttctat

SEQ ID NO: 278064 - DNA, 15 bp, Homo sapiens
gtgttctttcttcta

SEQ ID NO: 278065 - DNA, 15 bp, Homo sapiens
tgtgttctttcttct

SEQ ID NO: 278066 - DNA, 15 bp, Homo sapiens
ctgtgttctttcttc

SEQ ID NO: 278067 - DNA, 15 bp, Homo sapiens
gctgtgttctttctt

SEQ ID NO: 278068 - DNA, 15 bp, Homo sapiens
ggctgtgttctttct

SEQ ID NO: 278069 - DNA, 15 bp, Homo sapiens
tggctgtgttctttc

SEQ ID NO: 278070 - DNA, 15 bp, Homo sapiens
ttggctgtgttcttt

SEQ ID NO: 278071 - DNA, 15 bp, Homo sapiens
tttggctgtgttctt

SEQ ID NO: 278072 - DNA, 15 bp, Homo sapiens
ctttggctgtgttct

SEQ ID NO: 278073 - DNA, 15 bp, Homo sapiens
gctttggctgtgttc

SEQ ID NO: 278074 - DNA, 15 bp, Homo sapiens
tgctttggctgtgtt

SEQ ID NO: 278075 - DNA, 15 bp, Homo sapiens
atgctttggctgtgt

SEQ ID NO: 278076 - DNA, 15 bp, Homo sapiens
tatgctttggctgtg

SEQ ID NO: 278077 - DNA, 15 bp, Homo sapiens
ctatgctttggctgt

SEQ ID NO: 278078 - DNA, 15 bp, Homo sapiens
cctatgctttggctg

SEQ ID NO: 278079 - DNA, 15 bp, Homo sapiens
tcctatgctttggct

SEQ ID NO: 278080 - DNA, 15 bp, Homo sapiens
ctcctatgctttggc

SEQ ID NO: 278081 - DNA, 15 bp, Homo sapiens
tctcctatgctttgg

SEQ ID NO: 278082 - DNA, 15 bp, Homo sapiens
atctcctatgctttg

SEQ ID NO: 278083 - DNA, 15 bp, Homo sapiens
tatctcctatgcttt

SEQ ID NO: 278084 - DNA, 15 bp, Homo sapiens
gtatctcctatgctt

SEQ ID NO: 278085 - DNA, 15 bp, Homo sapiens
ggtatctcctatgct

SEQ ID NO: 278086 - DNA, 15 bp, Homo sapiens
aggtatctcctatgc

SEQ ID NO: 278087 - DNA, 15 bp, Homo sapiens
aaggtatctcctatg

SEQ ID NO: 278088 - DNA, 15 bp, Homo sapiens
aaaggtatctcctat

SEQ ID NO: 278089 - DNA, 15 bp, Homo sapiens
aaaaggtatctccta

SEQ ID NO: 278090 - DNA, 15 bp, Homo sapiens
aaaaaggtatctcct

SEQ ID NO: 278091 - DNA, 15 bp, Homo sapiens
gaaaaaggtatctcc

SEQ ID NO: 278092 - DNA, 15 bp, Homo sapiens
ggaaaaaggtatctc

SEQ ID NO: 278093 - DNA, 15 bp, Homo sapiens
gggaaaaaggtatct

SEQ ID NO: 278094 - DNA, 15 bp, Homo sapiens
agggaaaaaggtatc

SEQ ID NO: 278095 - DNA, 15 bp, Homo sapiens
gagggaaaaaggtat

SEQ ID NO: 278096 - DNA, 15 bp, Homo sapiens
agagggaaaaaggta

SEQ ID NO: 278097 - DNA, 15 bp, Homo sapiens
tagagggaaaaaggt

SEQ ID NO: 278098 - DNA, 15 bp, Homo sapiens
atagagggaaaaagg

SEQ ID NO: 278099 - DNA, 15 bp, Homo sapiens
tatagagggaaaaag

SEQ ID NO: 278100 - DNA, 15 bp, Homo sapiens
ctatagagggaaaaa

SEQ ID NO: 278101 - DNA, 15 bp, Homo sapiens
cctatagagggaaaa

SEQ ID NO: 278102 - DNA, 15 bp, Homo sapiens
acctatagagggaaa

SEQ ID NO: 278103 - DNA, 15 bp, Homo sapiens
tacctatagagggaa

SEQ ID NO: 278104 - DNA, 15 bp, Homo sapiens
ttacctatagaggga

SEQ ID NO: 278105 - DNA, 15 bp, Homo sapiens
attacctatagaggg

SEQ ID NO: 278106 - DNA, 15 bp, Homo sapiens
cattacctatagagg

SEQ ID NO: 278107 - DNA, 15 bp, Homo sapiens
acattacctatagag

SEQ ID NO: 278108 - DNA, 15 bp, Homo sapiens
gacattacctataga

SEQ ID NO: 278109 - DNA, 15 bp, Homo sapiens
cgacattacctatag

SEQ ID NO: 278110 - DNA, 15 bp, Homo sapiens
acgacattacctata

SEQ ID NO: 278111 - DNA, 15 bp, Homo sapiens
cacgacattacctat

SEQ ID NO: 278112 - DNA, 15 bp, Homo sapiens
acacgacattaccta

SEQ ID NO: 278113 - DNA, 15 bp, Homo sapiens
cacacgacattacct

SEQ ID NO: 278114 - DNA, 15 bp, Homo sapiens
acacacgacattacc

SEQ ID NO: 278115 - DNA, 15 bp, Homo sapiens
cacacacgacattac

SEQ ID NO: 278116 - DNA, 15 bp, Homo sapiens
acacacacgacatta

SEQ ID NO: 278117 - DNA, 15 bp, Homo sapiens
cacacacacgacatt

SEQ ID NO: 278118 - DNA, 15 bp, Homo sapiens
acacacacacgacat

SEQ ID NO: 278119 - DNA, 15 bp, Homo sapiens
tacacacacacgaca

SEQ ID NO: 278120 - DNA, 15 bp, Homo sapiens
ttacacacacacgac

SEQ ID NO: 278121 - DNA, 15 bp, Homo sapiens
tttacacacacacga

SEQ ID NO: 278122 - DNA, 15 bp, Homo sapiens
gtttacacacacacg

SEQ ID NO: 278123 - DNA, 15 bp, Homo sapiens
tgtttacacacacac

SEQ ID NO: 278124 - DNA, 15 bp, Homo sapiens
ctgtttacacacaca

SEQ ID NO: 278125 - DNA, 15 bp, Homo sapiens
tctgtttacacacac

SEQ ID NO: 278126 - DNA, 15 bp, Homo sapiens
ttctgtttacacaca

SEQ ID NO: 278127 - DNA, 15 bp, Homo sapiens
tttctgtttacacac

SEQ ID NO: 278128 - DNA, 15 bp, Homo sapiens
ctttctgtttacaca

SEQ ID NO: 278129 - DNA, 15 bp, Homo sapiens
tctttctgtttacac

SEQ ID NO: 278130 - DNA, 15 bp, Homo sapiens
ttctttctgtttaca

SEQ ID NO: 278131 - DNA, 15 bp, Homo sapiens
tttctttctgtttac

SEQ ID NO: 278132 - DNA, 15 bp, Homo sapiens
atttctttctgttta

SEQ ID NO: 278133 - DNA, 15 bp, Homo sapiens
tatttctttctgttt

SEQ ID NO: 278134 - DNA, 15 bp, Homo sapiens
gtatttctttctgtt

SEQ ID NO: 278135 - DNA, 15 bp, Homo sapiens
tgtatttctttctgt

SEQ ID NO: 278136 - DNA, 15 bp, Homo sapiens
ttgtatttctttctg

SEQ ID NO: 278137 - DNA, 15 bp, Homo sapiens
attgtatttctttct

SEQ ID NO: 278138 - DNA, 15 bp, Homo sapiens
cattgtatttctttc

SEQ ID NO: 278139 - DNA, 15 bp, Homo sapiens
gcattgtatttcttt

SEQ ID NO: 278140 - DNA, 15 bp, Homo sapiens
tgcattgtatttctt

SEQ ID NO: 278141 - DNA, 15 bp, Homo sapiens
ttgcattgtatttct

SEQ ID NO: 278142 - DNA, 15 bp, Homo sapiens
tttgcattgtatttc

SEQ ID NO: 278143 - DNA, 15 bp, Homo sapiens
atttgcattgtattt

SEQ ID NO: 278144 - DNA, 15 bp, Homo sapiens
catttgcattgtatt

SEQ ID NO: 278145 - DNA, 15 bp, Homo sapiens
gcatttgcattgtat

SEQ ID NO: 278146 - DNA, 15 bp, Homo sapiens
tgcatttgcattgta

SEQ ID NO: 278147 - DNA, 15 bp, Homo sapiens
atgcatttgcattgt

SEQ ID NO: 278148 - DNA, 15 bp, Homo sapiens
tatgcatttgcattg

SEQ ID NO: 278149 - DNA, 15 bp, Homo sapiens
atatgcatttgcatt

SEQ ID NO: 278150 - DNA, 15 bp, Homo sapiens
aatatgcatttgcat

SEQ ID NO: 278151 - DNA, 15 bp, Homo sapiens
aaatatgcatttgca

SEQ ID NO: 278152 - DNA, 15 bp, Homo sapiens
taaatatgcatttgc

SEQ ID NO: 278153 - DNA, 15 bp, Homo sapiens
ctaaatatgcatttg

SEQ ID NO: 278154 - DNA, 15 bp, Homo sapiens
tctaaatatgcattt

SEQ ID NO: 278155 - DNA, 15 bp, Homo sapiens
atctaaatatgcatt

SEQ ID NO: 278156 - DNA, 15 bp, Homo sapiens
tatctaaatatgcat

SEQ ID NO: 278157 - DNA, 15 bp, Homo sapiens
ctatctaaatatgca

SEQ ID NO: 278158 - DNA, 15 bp, Homo sapiens
cctatctaaatatgc

SEQ ID NO: 278159 - DNA, 15 bp, Homo sapiens
acctatctaaatatg

SEQ ID NO: 278160 - DNA, 15 bp, Homo sapiens
gacctatctaaatat

SEQ ID NO: 278161 - DNA, 15 bp, Homo sapiens
ggacctatctaaata

SEQ ID NO: 278162 - DNA, 15 bp, Homo sapiens
tggacctatctaaat

SEQ ID NO: 278163 - DNA, 15 bp, Homo sapiens
atggacctatctaaa

SEQ ID NO: 278164 - DNA, 15 bp, Homo sapiens
catggacctatctaa

SEQ ID NO: 278165 - DNA, 15 bp, Homo sapiens
acatggacctatcta

SEQ ID NO: 278166 - DNA, 15 bp, Homo sapiens
tacatggacctatct

SEQ ID NO: 278167 - DNA, 15 bp, Homo sapiens
atacatggacctatc

SEQ ID NO: 278168 - DNA, 15 bp, Homo sapiens
tatacatggacctat

SEQ ID NO: 278169 - DNA, 15 bp, Homo sapiens
ttatacatggaccta

SEQ ID NO: 278170 - DNA, 15 bp, Homo sapiens
gttatacatggacct

SEQ ID NO: 278171 - DNA, 15 bp, Homo sapiens
tgttatacatggacc

SEQ ID NO: 278172 - DNA, 15 bp, Homo sapiens
gtgttatacatggac

SEQ ID NO: 278173 - DNA, 15 bp, Homo sapiens
tgtgttatacatgga

SEQ ID NO: 278174 - DNA, 15 bp, Homo sapiens
atgtgttatacatgg

SEQ ID NO: 278175 - DNA, 15 bp, Homo sapiens
tatgtgttatacatg

SEQ ID NO: 278176 - DNA, 15 bp, Homo sapiens
gtatgtgttatacat

SEQ ID NO: 278177 - DNA, 15 bp, Homo sapiens
tgtatgtgttataca

SEQ ID NO: 278178 - DNA, 15 bp, Homo sapiens
gtgtatgtgttatac

SEQ ID NO: 278179 - DNA, 15 bp, Homo sapiens
tgtgtatgtgttata

SEQ ID NO: 278180 - DNA, 15 bp, Homo sapiens
atgtgtatgtgttat

SEQ ID NO: 278181 - DNA, 15 bp, Homo sapiens
tatgtgtatgtgtta

SEQ ID NO: 278182 - DNA, 15 bp, Homo sapiens
gtatgtgtatgtgtt

SEQ ID NO: 278183 - DNA, 15 bp, Homo sapiens
tgtatgtgtatgtgt

SEQ ID NO: 278184 - DNA, 15 bp, Homo sapiens
ttgtatgtgtatgtg

SEQ ID NO: 278185 - DNA, 15 bp, Homo sapiens
tttgtatgtgtatgt

SEQ ID NO: 278186 - DNA, 15 bp, Homo sapiens
ttttgtatgtgtatg

SEQ ID NO: 278187 - DNA, 15 bp, Homo sapiens
cttttgtatgtgtat

SEQ ID NO: 278188 - DNA, 15 bp, Homo sapiens
ccttttgtatgtgta

SEQ ID NO: 278189 - DNA, 15 bp, Homo sapiens
accttttgtatgtgt

SEQ ID NO: 278190 - DNA, 15 bp, Homo sapiens
taccttttgtatgtg

SEQ ID NO: 278191 - DNA, 15 bp, Homo sapiens
ttaccttttgtatgt

SEQ ID NO: 278192 - DNA, 15 bp, Homo sapiens
cttaccttttgtatg

SEQ ID NO: 278193 - DNA, 15 bp, Homo sapiens
tcttaccttttgtat

SEQ ID NO: 278194 - DNA, 15 bp, Homo sapiens
ttcttaccttttgta

SEQ ID NO: 278195 - DNA, 15 bp, Homo sapiens
tttcttaccttttgt

SEQ ID NO: 278196 - DNA, 15 bp, Homo sapiens
ttttcttaccttttg

SEQ ID NO: 278197 - DNA, 15 bp, Homo sapiens
tttttcttacctttt

SEQ ID NO: 278198 - DNA, 15 bp, Homo sapiens
ttttttcttaccttt

SEQ ID NO: 278199 - DNA, 15 bp, Homo sapiens
attttttcttacctt

SEQ ID NO: 278200 - DNA, 15 bp, Homo sapiens
aattttttcttacct

SEQ ID NO: 278201 - DNA, 15 bp, Homo sapiens
aaattttttcttacc

SEQ ID NO: 278202 - DNA, 15 bp, Homo sapiens
gaaattttttcttac

SEQ ID NO: 278203 - DNA, 15 bp, Homo sapiens
tgaaattttttctta

SEQ ID NO: 278204 - DNA, 15 bp, Homo sapiens
ttgaaattttttctt

SEQ ID NO: 278205 - DNA, 15 bp, Homo sapiens
gttgaaattttttct

SEQ ID NO: 278206 - DNA, 15 bp, Homo sapiens
agttgaaattttttc

SEQ ID NO: 278207 - DNA, 15 bp, Homo sapiens
cagttgaaatttttt

SEQ ID NO: 278208 - DNA, 15 bp, Homo sapiens
acagttgaaattttt

SEQ ID NO: 278209 - DNA, 15 bp, Homo sapiens
cacagttgaaatttt

SEQ ID NO: 278210 - DNA, 15 bp, Homo sapiens
acacagttgaaattt

SEQ ID NO: 278211 - DNA, 15 bp, Homo sapiens
cacacagttgaaatt

SEQ ID NO: 278212 - DNA, 15 bp, Homo sapiens
tcacacagttgaaat

SEQ ID NO: 278213 - DNA, 15 bp, Homo sapiens
atcacacagttgaaa

SEQ ID NO: 278214 - DNA, 15 bp, Homo sapiens
aatcacacagttgaa

SEQ ID NO: 278215 - DNA, 15 bp, Homo sapiens
taatcacacagttga

SEQ ID NO: 278216 - DNA, 15 bp, Homo sapiens
gtaatcacacagttg

SEQ ID NO: 278217 - DNA, 15 bp, Homo sapiens
agtaatcacacagtt

SEQ ID NO: 278218 - DNA, 15 bp, Homo sapiens
cagtaatcacacagt

SEQ ID NO: 278219 - DNA, 15 bp, Homo sapiens
acagtaatcacacag

SEQ ID NO: 278220 - DNA, 15 bp, Homo sapiens
cacagtaatcacaca

SEQ ID NO: 278221 - DNA, 15 bp, Homo sapiens
gcacagtaatcacac

SEQ ID NO: 278222 - DNA, 15 bp, Homo sapiens
agcacagtaatcaca

SEQ ID NO: 278223 - DNA, 15 bp, Homo sapiens
aagcacagtaatcac

SEQ ID NO: 278224 - DNA, 15 bp, Homo sapiens
caagcacagtaatca

SEQ ID NO: 278225 - DNA, 15 bp, Homo sapiens
tcaagcacagtaatc

SEQ ID NO: 278226 - DNA, 15 bp, Homo sapiens
atcaagcacagtaat

SEQ ID NO: 278227 - DNA, 15 bp, Homo sapiens
tatcaagcacagtaa

SEQ ID NO: 278228 - DNA, 15 bp, Homo sapiens
atatcaagcacagta

SEQ ID NO: 278229 - DNA, 15 bp, Homo sapiens
gatatcaagcacagt

SEQ ID NO: 278230 - DNA, 15 bp, Homo sapiens
tgatatcaagcacag

SEQ ID NO: 278231 - DNA, 15 bp, Homo sapiens
ttgatatcaagcaca

SEQ ID NO: 278232 - DNA, 15 bp, Homo sapiens
tttgatatcaagcac

SEQ ID NO: 278233 - DNA, 15 bp, Homo sapiens
gtttgatatcaagca

SEQ ID NO: 278234 - DNA, 15 bp, Homo sapiens
agtttgatatcaagc

SEQ ID NO: 278235 - DNA, 15 bp, Homo sapiens
cagtttgatatcaag

SEQ ID NO: 278236 - DNA, 15 bp, Homo sapiens
acagtttgatatcaa

SEQ ID NO: 278237 - DNA, 15 bp, Homo sapiens
cacagtttgatatca

SEQ ID NO: 278238 - DNA, 15 bp, Homo sapiens
acacagtttgatatc

SEQ ID NO: 278239 - DNA, 15 bp, Homo sapiens
tacacagtttgatat

SEQ ID NO: 278240 - DNA, 15 bp, Homo sapiens
gtacacagtttgata

SEQ ID NO: 278241 - DNA, 15 bp, Homo sapiens
tgtacacagtttgat

SEQ ID NO: 278242 - DNA, 15 bp, Homo sapiens
gtgtacacagtttga

SEQ ID NO: 278243 - DNA, 15 bp, Homo sapiens
agtgtacacagtttg

SEQ ID NO: 278244 - DNA, 15 bp, Homo sapiens
aagtgtacacagttt

SEQ ID NO: 278245 - DNA, 15 bp, Homo sapiens
taagtgtacacagtt

SEQ ID NO: 278246 - DNA, 15 bp, Homo sapiens
ttaagtgtacacagt

SEQ ID NO: 278247 - DNA, 15 bp, Homo sapiens
cttaagtgtacacag

SEQ ID NO: 278248 - DNA, 15 bp, Homo sapiens
tcttaagtgtacaca

SEQ ID NO: 278249 - DNA, 15 bp, Homo sapiens
atcttaagtgtacac

SEQ ID NO: 278250 - DNA, 15 bp, Homo sapiens
tatcttaagtgtaca

SEQ ID NO: 278251 - DNA, 15 bp, Homo sapiens
atatcttaagtgtac

SEQ ID NO: 278252 - DNA, 15 bp, Homo sapiens
tatatcttaagtgta

SEQ ID NO: 278253 - DNA, 15 bp, Homo sapiens
atatatcttaagtgt

SEQ ID NO: 278254 - DNA, 15 bp, Homo sapiens
aatatatcttaagtg

SEQ ID NO: 278255 - DNA, 15 bp, Homo sapiens
gaatatatcttaagt

SEQ ID NO: 278256 - DNA, 15 bp, Homo sapiens
agaatatatcttaag

SEQ ID NO: 278257 - DNA, 15 bp, Homo sapiens
aagaatatatcttaa

SEQ ID NO: 278258 - DNA, 15 bp, Homo sapiens
aaagaatatatctta

SEQ ID NO: 278259 - DNA, 15 bp, Homo sapiens
gaaagaatatatctt

SEQ ID NO: 278260 - DNA, 15 bp, Homo sapiens
ggaaagaatatatct

SEQ ID NO: 278261 - DNA, 15 bp, Homo sapiens
tggaaagaatatatc

SEQ ID NO: 278262 - DNA, 15 bp, Homo sapiens
gtggaaagaatatat

SEQ ID NO: 278263 - DNA, 15 bp, Homo sapiens
agtggaaagaatata

SEQ ID NO: 278264 - DNA, 15 bp, Homo sapiens
aagtggaaagaatat

SEQ ID NO: 278265 - DNA, 15 bp, Homo sapiens
caagtggaaagaata

SEQ ID NO: 278266 - DNA, 15 bp, Homo sapiens
tcaagtggaaagaat

SEQ ID NO: 278267 - DNA, 15 bp, Homo sapiens
atcaagtggaaagaa

SEQ ID NO: 278268 - DNA, 15 bp, Homo sapiens
tatcaagtggaaaga

SEQ ID NO: 278269 - DNA, 15 bp, Homo sapiens
atatcaagtggaaag

SEQ ID NO: 278270 - DNA, 15 bp, Homo sapiens
gatatcaagtggaaa

SEQ ID NO: 278271 - DNA, 15 bp, Homo sapiens
tgatatcaagtggaa

SEQ ID NO: 278272 - DNA, 15 bp, Homo sapiens
ttgatatcaagtgga

SEQ ID NO: 278273 - DNA, 15 bp, Homo sapiens
tttgatatcaagtgg

SEQ ID NO: 278274 - DNA, 15 bp, Homo sapiens
gtttgatatcaagtg

SEQ ID NO: 278275 - DNA, 15 bp, Homo sapiens
agtttgatatcaagt

SEQ ID NO: 278276 - DNA, 15 bp, Homo sapiens
ttgtacacagtttga

SEQ ID NO: 278277 - DNA, 15 bp, Homo sapiens
attgtacacagtttg

SEQ ID NO: 278278 - DNA, 15 bp, Homo sapiens
aattgtacacagttt

SEQ ID NO: 278279 - DNA, 15 bp, Homo sapiens
taattgtacacagtt

SEQ ID NO: 278280 - DNA, 15 bp, Homo sapiens
ttaattgtacacagt

SEQ ID NO: 278281 - DNA, 15 bp, Homo sapiens
cttaattgtacacag

SEQ ID NO: 278282 - DNA, 15 bp, Homo sapiens
tcttaattgtacaca

SEQ ID NO: 278283 - DNA, 15 bp, Homo sapiens
atcttaattgtacac

SEQ ID NO: 278284 - DNA, 15 bp, Homo sapiens
gatcttaattgtaca

SEQ ID NO: 278285 - DNA, 15 bp, Homo sapiens
agatcttaattgtac

SEQ ID NO: 278286 - DNA, 15 bp, Homo sapiens
cagatcttaattgta

SEQ ID NO: 278287 - DNA, 15 bp, Homo sapiens
acagatcttaattgt

SEQ ID NO: 278288 - DNA, 15 bp, Homo sapiens
cacagatcttaattg

SEQ ID NO: 278289 - DNA, 15 bp, Homo sapiens
acacagatcttaatt

SEQ ID NO: 278290 - DNA, 15 bp, Homo sapiens
gacacagatcttaat

SEQ ID NO: 278291 - DNA, 15 bp, Homo sapiens
agacacagatcttaa

SEQ ID NO: 278292 - DNA, 15 bp, Homo sapiens
aagacacagatctta

SEQ ID NO: 278293 - DNA, 15 bp, Homo sapiens
aaagacacagatctt

SEQ ID NO: 278294 - DNA, 15 bp, Homo sapiens
gaaagacacagatct

SEQ ID NO: 278295 - DNA, 15 bp, Homo sapiens
agaaagacacagatc

SEQ ID NO: 278296 - DNA, 15 bp, Homo sapiens
tagaaagacacagat

SEQ ID NO: 278297 - DNA, 15 bp, Homo sapiens
ttagaaagacacaga

SEQ ID NO: 278298 - DNA, 15 bp, Homo sapiens
tttagaaagacacag

SEQ ID NO: 278299 - DNA, 15 bp, Homo sapiens
gtttagaaagacaca

SEQ ID NO: 278300 - DNA, 15 bp, Homo sapiens
tgtttagaaagacac

SEQ ID NO: 278301 - DNA, 15 bp, Homo sapiens
atgtttagaaagaca

SEQ ID NO: 278302 - DNA, 15 bp, Homo sapiens
aatgtttagaaagac

SEQ ID NO: 278303 - DNA, 15 bp, Homo sapiens
gaatgtttagaaaga

SEQ ID NO: 278304 - DNA, 15 bp, Homo sapiens
agaatgtttagaaag

SEQ ID NO: 278305 - DNA, 15 bp, Homo sapiens
aagaatgtttagaaa

SEQ ID NO: 278306 - DNA, 15 bp, Homo sapiens
aaagaatgtttagaa

SEQ ID NO: 278307 - DNA, 15 bp, Homo sapiens
aaaagaatgtttaga

SEQ ID NO: 278308 - DNA, 15 bp, Homo sapiens
caaaagaatgtttag

SEQ ID NO: 278309 - DNA, 15 bp, Homo sapiens
gcaaaagaatgttta

SEQ ID NO: 278310 - DNA, 15 bp, Homo sapiens
tgcaaaagaatgttt

SEQ ID NO: 278311 - DNA, 15 bp, Homo sapiens
atgcaaaagaatgtt

SEQ ID NO: 278312 - DNA, 15 bp, Homo sapiens
tatgcaaaagaatgt

SEQ ID NO: 278313 - DNA, 15 bp, Homo sapiens
ctatgcaaaagaatg

SEQ ID NO: 278314 - DNA, 15 bp, Homo sapiens
actatgcaaaagaat

SEQ ID NO: 278315 - DNA, 15 bp, Homo sapiens
tactatgcaaaagaa

SEQ ID NO: 278316 - DNA, 15 bp, Homo sapiens
gtactatgcaaaaga

SEQ ID NO: 278317 - DNA, 15 bp, Homo sapiens
tgtactatgcaaaag

SEQ ID NO: 278318 - DNA, 15 bp, Homo sapiens
ttgtactatgcaaaa

SEQ ID NO: 278319 - DNA, 15 bp, Homo sapiens
attgtactatgcaaa

SEQ ID NO: 278320 - DNA, 15 bp, Homo sapiens
aattgtactatgcaa

SEQ ID NO: 278321 - DNA, 15 bp, Homo sapiens
aaattgtactatgca

SEQ ID NO: 278322 - DNA, 15 bp, Homo sapiens
taaattgtactatgc

SEQ ID NO: 278323 - DNA, 15 bp, Homo sapiens
ctaaattgtactatg

SEQ ID NO: 278324 - DNA, 15 bp, Homo sapiens
tctaaattgtactat

SEQ ID NO: 278325 - DNA, 15 bp, Homo sapiens
ttctaaattgtacta

SEQ ID NO: 278326 - DNA, 15 bp, Homo sapiens
tttctaaattgtact

SEQ ID NO: 278327 - DNA, 15 bp, Homo sapiens
ttttctaaattgtac

SEQ ID NO: 278328 - DNA, 15 bp, Homo sapiens
tttttctaaattgta

SEQ ID NO: 278329 - DNA, 15 bp, Homo sapiens
ctttttctaaattgt

SEQ ID NO: 278330 - DNA, 15 bp, Homo sapiens
actttttctaaattg

SEQ ID NO: 278331 - DNA, 15 bp, Homo sapiens
aactttttctaaatt

SEQ ID NO: 278332 - DNA, 15 bp, Homo sapiens
aaactttttctaaat

SEQ ID NO: 278333 - DNA, 15 bp, Homo sapiens
aaaactttttctaaa

SEQ ID NO: 278334 - DNA, 15 bp, Homo sapiens
taaaactttttctaa

SEQ ID NO: 278335 - DNA, 15 bp, Homo sapiens
ttaaaactttttcta

SEQ ID NO: 278336 - DNA, 15 bp, Homo sapiens
attaaaactttttct

SEQ ID NO: 278337 - DNA, 15 bp, Homo sapiens
tattaaaactttttc

SEQ ID NO: 278338 - DNA, 15 bp, Homo sapiens
ttattaaaacttttt

SEQ ID NO: 278339 - DNA, 15 bp, Homo sapiens
tttattaaaactttt

SEQ ID NO: 278340 - DNA, 15 bp, Homo sapiens
ctttattaaaacttt

SEQ ID NO: 278341 - DNA, 15 bp, Homo sapiens
gctttattaaaactt

SEQ ID NO: 278342 - DNA, 15 bp, Homo sapiens
tgctttattaaaact

SEQ ID NO: 278343 - DNA, 15 bp, Homo sapiens
ttgctttattaaaac

SEQ ID NO: 278344 - DNA, 15 bp, Homo sapiens
attgctttattaaaa

SEQ ID NO: 278345 - DNA, 15 bp, Homo sapiens
aattgctttattaaa

SEQ ID NO: 278346 - DNA, 15 bp, Homo sapiens
aaattgctttattaa

SEQ ID NO: 278347 - DNA, 15 bp, Homo sapiens
gaaattgctttatta

SEQ ID NO: 278348 - DNA, 15 bp, Homo sapiens
tgaaattgctttatt

SEQ ID NO: 278349 - DNA, 15 bp, Homo sapiens
ttgaaattgctttat

SEQ ID NO: 278350 - DNA, 15 bp, Homo sapiens
attgaaattgcttta

SEQ ID NO: 278351 - DNA, 15 bp, Homo sapiens
aattgaaattgcttt

SEQ ID NO: 278352 - DNA, 15 bp, Homo sapiens
caattgaaattgctt

SEQ ID NO: 278353 - DNA, 15 bp, Homo sapiens
tcaattgaaattgct

SEQ ID NO: 278354 - DNA, 15 bp, Homo sapiens
ttcaattgaaattgc

SEQ ID NO: 278355 - DNA, 15 bp, Homo sapiens
tttcaattgaaattg

SEQ ID NO: 278356 - DNA, 15 bp, Homo sapiens
ctttcaattgaaatt

SEQ ID NO: 278357 - DNA, 15 bp, Homo sapiens
tctttcaattgaaat

SEQ ID NO: 278358 - DNA, 15 bp, Homo sapiens
ctctttcaattgaaa

SEQ ID NO: 278359 - DNA, 15 bp, Homo sapiens
tctctttcaattgaa

SEQ ID NO: 278360 - DNA, 15 bp, Homo sapiens
ctctctttcaattga

SEQ ID NO: 278361 - DNA, 15 bp, Homo sapiens
gctctctttcaattg

SEQ ID NO: 278362 - DNA, 15 bp, Homo sapiens
agctctctttcaatt

SEQ ID NO: 278363 - DNA, 15 bp, Homo sapiens
cagctctctttcaat

SEQ ID NO: 278364 - DNA, 15 bp, Homo sapiens
acagctctctttcaa

SEQ ID NO: 278365 - DNA, 15 bp, Homo sapiens
aacagctctctttca

SEQ ID NO: 278366 - DNA, 15 bp, Homo sapiens
gaacagctctctttc

SEQ ID NO: 278367 - DNA, 15 bp, Homo sapiens
cgaacagctctcttt

SEQ ID NO: 278368 - DNA, 15 bp, Homo sapiens
tcgaacagctctctt

SEQ ID NO: 278369 - DNA, 15 bp, Homo sapiens
ttcgaacagctctct

SEQ ID NO: 278370 - DNA, 15 bp, Homo sapiens
attcgaacagctctc

SEQ ID NO: 278371 - DNA, 15 bp, Homo sapiens
tattcgaacagctct

SEQ ID NO: 278372 - DNA, 15 bp, Homo sapiens
gtattcgaacagctc

SEQ ID NO: 278373 - DNA, 15 bp, Homo sapiens
tgtattcgaacagct

SEQ ID NO: 278374 - DNA, 15 bp, Homo sapiens
atgtattcgaacagc

SEQ ID NO: 278375 - DNA, 15 bp, Homo sapiens
aatgtattcgaacag

SEQ ID NO: 278376 - DNA, 15 bp, Homo sapiens
gaatgtattcgaaca

SEQ ID NO: 278377 - DNA, 15 bp, Homo sapiens
tgaatgtattcgaac

SEQ ID NO: 278378 - DNA, 15 bp, Homo sapiens
ctgaatgtattcgaa

SEQ ID NO: 278379 - DNA, 15 bp, Homo sapiens
cctgaatgtattcga

SEQ ID NO: 278380 - DNA, 15 bp, Homo sapiens
tcctgaatgtattcg

SEQ ID NO: 278381 - DNA, 15 bp, Homo sapiens
ttcctgaatgtattc

SEQ ID NO: 278382 - DNA, 15 bp, Homo sapiens
gttcctgaatgtatt

SEQ ID NO: 278383 - DNA, 15 bp, Homo sapiens
tgttcctgaatgtat

SEQ ID NO: 278384 - DNA, 15 bp, Homo sapiens
ctgttcctgaatgta

SEQ ID NO: 278385 - DNA, 15 bp, Homo sapiens
actgttcctgaatgt

SEQ ID NO: 278386 - DNA, 15 bp, Homo sapiens
tactgttcctgaatg

SEQ ID NO: 278387 - DNA, 15 bp, Homo sapiens
ctactgttcctgaat

SEQ ID NO: 278388 - DNA, 15 bp, Homo sapiens
tctactgttcctgaa

SEQ ID NO: 278389 - DNA, 15 bp, Homo sapiens
gtctactgttcctga

SEQ ID NO: 278390 - DNA, 15 bp, Homo sapiens
agtctactgttcctg

SEQ ID NO: 278391 - DNA, 15 bp, Homo sapiens
aagtctactgttcct

SEQ ID NO: 278392 - DNA, 15 bp, Homo sapiens
aaagtctactgttcc

SEQ ID NO: 278393 - DNA, 15 bp, Homo sapiens
aaaagtctactgttc

SEQ ID NO: 278394 - DNA, 15 bp, Homo sapiens
caaaagtctactgtt

SEQ ID NO: 278395 - DNA, 15 bp, Homo sapiens
ccaaaagtctactgt

SEQ ID NO: 278396 - DNA, 15 bp, Homo sapiens
accaaaagtctactg

SEQ ID NO: 278397 - DNA, 15 bp, Homo sapiens
gaccaaaagtctact

SEQ ID NO: 278398 - DNA, 15 bp, Homo sapiens
ggaccaaaagtctac

SEQ ID NO: 278399 - DNA, 15 bp, Homo sapiens
aggaccaaaagtcta

SEQ ID NO: 278400 - DNA, 15 bp, Homo sapiens
gaggaccaaaagtct

SEQ ID NO: 278401 - DNA, 15 bp, Homo sapiens
agaggaccaaaagtc

SEQ ID NO: 278402 - DNA, 15 bp, Homo sapiens
aagaggaccaaaagt

SEQ ID NO: 278403 - DNA, 15 bp, Homo sapiens
aaagaggaccaaaag

SEQ ID NO: 278404 - DNA, 15 bp, Homo sapiens
aaaagaggaccaaaa

SEQ ID NO: 278405 - DNA, 15 bp, Homo sapiens
aaaaagaggaccaaa

SEQ ID NO: 278406 - DNA, 15 bp, Homo sapiens
caaaaagaggaccaa

SEQ ID NO: 278407 - DNA, 15 bp, Homo sapiens
tcaaaaagaggacca

SEQ ID NO: 278408 - DNA, 15 bp, Homo sapiens
atcaaaaagaggacc

SEQ ID NO: 278409 - DNA, 15 bp, Homo sapiens
aatcaaaaagaggac

SEQ ID NO: 278410 - DNA, 15 bp, Homo sapiens
aaatcaaaaagagga

SEQ ID NO: 278411 - DNA, 15 bp, Homo sapiens
caaatcaaaaagagg

SEQ ID NO: 278412 - DNA, 15 bp, Homo sapiens
acaaatcaaaaagag

SEQ ID NO: 278413 - DNA, 15 bp, Homo sapiens
cacaaatcaaaaaga

SEQ ID NO: 278414 - DNA, 15 bp, Homo sapiens
ccacaaatcaaaaag

SEQ ID NO: 278415 - DNA, 15 bp, Homo sapiens
cccacaaatcaaaaa

SEQ ID NO: 278416 - DNA, 15 bp, Homo sapiens
acccacaaatcaaaa

SEQ ID NO: 278417 - DNA, 15 bp, Homo sapiens
tacccacaaatcaaa

SEQ ID NO: 278418 - DNA, 15 bp, Homo sapiens
atacccacaaatcaa

SEQ ID NO: 278419 - DNA, 15 bp, Homo sapiens
catacccacaaatca

SEQ ID NO: 278420 - DNA, 15 bp, Homo sapiens
gcatacccacaaatc

SEQ ID NO: 278421 - DNA, 15 bp, Homo sapiens
agcatacccacaaat

SEQ ID NO: 278422 - DNA, 15 bp, Homo sapiens
aagcatacccacaaa

SEQ ID NO: 278423 - DNA, 15 bp, Homo sapiens
aaagcatacccacaa

SEQ ID NO: 278424 - DNA, 15 bp, Homo sapiens
aaaagcatacccaca

SEQ ID NO: 278425 - DNA, 15 bp, Homo sapiens
caaaagcatacccac

SEQ ID NO: 278426 - DNA, 15 bp, Homo sapiens
acaaaagcataccca

SEQ ID NO: 278427 - DNA, 15 bp, Homo sapiens
gacaaaagcataccc

SEQ ID NO: 278428 - DNA, 15 bp, Homo sapiens
ggacaaaagcatacc

SEQ ID NO: 278429 - DNA, 15 bp, Homo sapiens
aggacaaaagcatac

SEQ ID NO: 278430 - DNA, 15 bp, Homo sapiens
aaggacaaaagcata

SEQ ID NO: 278431 - DNA, 15 bp, Homo sapiens
aaaggacaaaagcat

SEQ ID NO: 278432 - DNA, 15 bp, Homo sapiens
gaaaggacaaaagca

SEQ ID NO: 278433 - DNA, 15 bp, Homo sapiens
ggaaaggacaaaagc

SEQ ID NO: 278434 - DNA, 15 bp, Homo sapiens
aggaaaggacaaaag

SEQ ID NO: 278435 - DNA, 15 bp, Homo sapiens
aaggaaaggacaaaa

SEQ ID NO: 278436 - DNA, 15 bp, Homo sapiens
gaaggaaaggacaaa

SEQ ID NO: 278437 - DNA, 15 bp, Homo sapiens
tgaaggaaaggacaa

SEQ ID NO: 278438 - DNA, 15 bp, Homo sapiens
ttgaaggaaaggaca

SEQ ID NO: 278439 - DNA, 15 bp, Homo sapiens
tttgaaggaaaggac

SEQ ID NO: 278440 - DNA, 15 bp, Homo sapiens
ttttgaaggaaagga

SEQ ID NO: 278441 - DNA, 15 bp, Homo sapiens
cttttgaaggaaagg

SEQ ID NO: 278442 - DNA, 15 bp, Homo sapiens
ccttttgaaggaaag

SEQ ID NO: 278443 - DNA, 15 bp, Homo sapiens
accttttgaaggaaa

SEQ ID NO: 278444 - DNA, 15 bp, Homo sapiens
aaccttttgaaggaa

SEQ ID NO: 278445 - DNA, 15 bp, Homo sapiens
caaccttttgaagga

SEQ ID NO: 278446 - DNA, 15 bp, Homo sapiens
acaaccttttgaagg

SEQ ID NO: 278447 - DNA, 15 bp, Homo sapiens
cacaaccttttgaag

SEQ ID NO: 278448 - DNA, 15 bp, Homo sapiens
acacaaccttttgaa

SEQ ID NO: 278449 - DNA, 15 bp, Homo sapiens
cacacaaccttttga

SEQ ID NO: 278450 - DNA, 15 bp, Homo sapiens
tcacacaaccttttg

SEQ ID NO: 278451 - DNA, 15 bp, Homo sapiens
atcacacaacctttt

SEQ ID NO: 278452 - DNA, 15 bp, Homo sapiens
tatcacacaaccttt

SEQ ID NO: 278453 - DNA, 15 bp, Homo sapiens
ttatcacacaacctt

SEQ ID NO: 278454 - DNA, 15 bp, Homo sapiens
attatcacacaacct

SEQ ID NO: 278455 - DNA, 15 bp, Homo sapiens
tattatcacacaacc

SEQ ID NO: 278456 - DNA, 15 bp, Homo sapiens
ctattatcacacaac

SEQ ID NO: 278457 - DNA, 15 bp, Homo sapiens
tctattatcacacaa

SEQ ID NO: 278458 - DNA, 15 bp, Homo sapiens
atctattatcacaca

SEQ ID NO: 278459 - DNA, 15 bp, Homo sapiens
aatctattatcacac

SEQ ID NO: 278460 - DNA, 15 bp, Homo sapiens
gaatctattatcaca

SEQ ID NO: 278461 - DNA, 15 bp, Homo sapiens
agaatctattatcac

SEQ ID NO: 278462 - DNA, 15 bp, Homo sapiens
aagaatctattatca

SEQ ID NO: 278463 - DNA, 15 bp, Homo sapiens
taagaatctattatc

SEQ ID NO: 278464 - DNA, 15 bp, Homo sapiens
ataagaatctattat

SEQ ID NO: 278465 - DNA, 15 bp, Homo sapiens
aataagaatctatta

SEQ ID NO: 278466 - DNA, 15 bp, Homo sapiens
aaataagaatctatt

SEQ ID NO: 278467 - DNA, 15 bp, Homo sapiens
caaataagaatctat

SEQ ID NO: 278468 - DNA, 15 bp, Homo sapiens
acaaataagaatcta

SEQ ID NO: 278469 - DNA, 15 bp, Homo sapiens
gacaaataagaatct

SEQ ID NO: 278470 - DNA, 15 bp, Homo sapiens
agacaaataagaatc

SEQ ID NO: 278471 - DNA, 15 bp, Homo sapiens
aagacaaataagaat

SEQ ID NO: 278472 - DNA, 15 bp, Homo sapiens
taagacaaataagaa

SEQ ID NO: 278473 - DNA, 15 bp, Homo sapiens
ctaagacaaataaga

SEQ ID NO: 278474 - DNA, 15 bp, Homo sapiens
actaagacaaataag

SEQ ID NO: 278475 - DNA, 15 bp, Homo sapiens
tactaagacaaataa

SEQ ID NO: 278476 - DNA, 15 bp, Homo sapiens
atactaagacaaata

SEQ ID NO: 278477 - DNA, 15 bp, Homo sapiens
gatactaagacaaat

SEQ ID NO: 278478 - DNA, 15 bp, Homo sapiens
agatactaagacaaa

SEQ ID NO: 278479 - DNA, 15 bp, Homo sapiens
tagatactaagacaa

SEQ ID NO: 278480 - DNA, 15 bp, Homo sapiens
ttagatactaagaca

SEQ ID NO: 278481 - DNA, 15 bp, Homo sapiens
attagatactaagac

SEQ ID NO: 278482 - DNA, 15 bp, Homo sapiens
tattagatactaaga

SEQ ID NO: 278483 - DNA, 15 bp, Homo sapiens
atattagatactaag

SEQ ID NO: 278484 - DNA, 15 bp, Homo sapiens
tatattagatactaa

SEQ ID NO: 278485 - DNA, 15 bp, Homo sapiens
atatattagatacta

SEQ ID NO: 278486 - DNA, 15 bp, Homo sapiens
catatattagatact

SEQ ID NO: 278487 - DNA, 15 bp, Homo sapiens
acatatattagatac

SEQ ID NO: 278488 - DNA, 15 bp, Homo sapiens
aacatatattagata

SEQ ID NO: 278489 - DNA, 15 bp, Homo sapiens
aaacatatattagat

SEQ ID NO: 278490 - DNA, 15 bp, Homo sapiens
taaacatatattaga

SEQ ID NO: 278491 - DNA, 15 bp, Homo sapiens
ttaaacatatattag

SEQ ID NO: 278492 - DNA, 15 bp, Homo sapiens
gttaaacatatatta

SEQ ID NO: 278493 - DNA, 15 bp, Homo sapiens
agttaaacatatatt

SEQ ID NO: 278494 - DNA, 15 bp, Homo sapiens
cagttaaacatatat

SEQ ID NO: 278495 - DNA, 15 bp, Homo sapiens
acagttaaacatata

SEQ ID NO: 278496 - DNA, 15 bp, Homo sapiens
cacagttaaacatat

SEQ ID NO: 278497 - DNA, 15 bp, Homo sapiens
gcacagttaaacata

SEQ ID NO: 278498 - DNA, 15 bp, Homo sapiens
agcacagttaaacat

SEQ ID NO: 278499 - DNA, 15 bp, Homo sapiens
cagcacagttaaaca

SEQ ID NO: 278500 - DNA, 15 bp, Homo sapiens
tcagcacagttaaac

SEQ ID NO: 278501 - DNA, 15 bp, Homo sapiens
atcagcacagttaaa

SEQ ID NO: 278502 - DNA, 15 bp, Homo sapiens
catcagcacagttaa

SEQ ID NO: 278503 - DNA, 15 bp, Homo sapiens
gcatcagcacagtta

SEQ ID NO: 278504 - DNA, 15 bp, Homo sapiens
ggcatcagcacagtt

SEQ ID NO: 278505 - DNA, 15 bp, Homo sapiens
aggcatcagcacagt

SEQ ID NO: 278506 - DNA, 15 bp, Homo sapiens
aaggcatcagcacag

SEQ ID NO: 278507 - DNA, 15 bp, Homo sapiens
taaggcatcagcaca

SEQ ID NO: 278508 - DNA, 15 bp, Homo sapiens
ctaaggcatcagcac

SEQ ID NO: 278509 - DNA, 15 bp, Homo sapiens
cctaaggcatcagca

SEQ ID NO: 278510 - DNA, 15 bp, Homo sapiens
tcctaaggcatcagc

SEQ ID NO: 278511 - DNA, 15 bp, Homo sapiens
atcctaaggcatcag

SEQ ID NO: 278512 - DNA, 15 bp, Homo sapiens
tatcctaaggcatca

SEQ ID NO: 278513 - DNA, 15 bp, Homo sapiens
ttatcctaaggcatc

SEQ ID NO: 278514 - DNA, 15 bp, Homo sapiens
tttatcctaaggcat

SEQ ID NO: 278515 - DNA, 15 bp, Homo sapiens
ctttatcctaaggca

SEQ ID NO: 278516 - DNA, 15 bp, Homo sapiens
tctttatcctaaggc

SEQ ID NO: 278517 - DNA, 15 bp, Homo sapiens
gtctttatcctaagg

SEQ ID NO: 278518 - DNA, 15 bp, Homo sapiens
tgtctttatcctaag

SEQ ID NO: 278519 - DNA, 15 bp, Homo sapiens
ttgtctttatcctaa

SEQ ID NO: 278520 - DNA, 15 bp, Homo sapiens
tttgtctttatccta

SEQ ID NO: 278521 - DNA, 15 bp, Homo sapiens
ttttgtctttatcct

SEQ ID NO: 278522 - DNA, 15 bp, Homo sapiens
attttgtctttatcc

SEQ ID NO: 278523 - DNA, 15 bp, Homo sapiens
aattttgtctttatc

SEQ ID NO: 278524 - DNA, 15 bp, Homo sapiens
caattttgtctttat

SEQ ID NO: 278525 - DNA, 15 bp, Homo sapiens
acaattttgtcttta

SEQ ID NO: 278526 - DNA, 15 bp, Homo sapiens
tacaattttgtcttt

SEQ ID NO: 278527 - DNA, 15 bp, Homo sapiens
gtacaattttgtctt

SEQ ID NO: 278528 - DNA, 15 bp, Homo sapiens
agtacaattttgtct

SEQ ID NO: 278529 - DNA, 15 bp, Homo sapiens
aagtacaattttgtc

SEQ ID NO: 278530 - DNA, 15 bp, Homo sapiens
aaagtacaattttgt

SEQ ID NO: 278531 - DNA, 15 bp, Homo sapiens
aaaagtacaattttg

SEQ ID NO: 278532 - DNA, 15 bp, Homo sapiens
aaaaagtacaatttt

SEQ ID NO: 278533 - DNA, 15 bp, Homo sapiens
aaaaaagtacaattt

SEQ ID NO: 278534 - DNA, 15 bp, Homo sapiens
aaaaaaagtacaatt

SEQ ID NO: 278535 - DNA, 15 bp, Homo sapiens
caaaaaaagtacaat

SEQ ID NO: 278536 - DNA, 15 bp, Homo sapiens
acaaaaaaagtacaa

SEQ ID NO: 278537 - DNA, 15 bp, Homo sapiens
tacaaaaaaagtaca

SEQ ID NO: 278538 - DNA, 15 bp, Homo sapiens
atacaaaaaaagtac

SEQ ID NO: 278539 - DNA, 15 bp, Homo sapiens
gatacaaaaaaagta

SEQ ID NO: 278540 - DNA, 15 bp, Homo sapiens
ggatacaaaaaaagt

SEQ ID NO: 278541 - DNA, 15 bp, Homo sapiens
gggatacaaaaaaag

SEQ ID NO: 278542 - DNA, 15 bp, Homo sapiens
tgggatacaaaaaaa

SEQ ID NO: 278543 - DNA, 15 bp, Homo sapiens
atgggatacaaaaaa

SEQ ID NO: 278544 - DNA, 15 bp, Homo sapiens
gatgggatacaaaaa

SEQ ID NO: 278545 - DNA, 15 bp, Homo sapiens
ggatgggatacaaaa

SEQ ID NO: 278546 - DNA, 15 bp, Homo sapiens
tggatgggatacaaa

SEQ ID NO: 278547 - DNA, 15 bp, Homo sapiens
ctggatgggatacaa

SEQ ID NO: 278548 - DNA, 15 bp, Homo sapiens
actggatgggataca

SEQ ID NO: 278549 - DNA, 15 bp, Homo sapiens
aactggatgggatac

SEQ ID NO: 278550 - DNA, 15 bp, Homo sapiens
taactggatgggata

SEQ ID NO: 278551 - DNA, 15 bp, Homo sapiens
ttaactggatgggat

SEQ ID NO: 278552 - DNA, 15 bp, Homo sapiens
gttaactggatggga

SEQ ID NO: 278553 - DNA, 15 bp, Homo sapiens
ggttaactggatggg

SEQ ID NO: 278554 - DNA, 15 bp, Homo sapiens
aggttaactggatgg

SEQ ID NO: 278555 - DNA, 15 bp, Homo sapiens
aaggttaactggatg

SEQ ID NO: 278556 - DNA, 15 bp, Homo sapiens
aaaggttaactggat

SEQ ID NO: 278557 - DNA, 15 bp, Homo sapiens
caaaggttaactgga

SEQ ID NO: 278558 - DNA, 15 bp, Homo sapiens
ccaaaggttaactgg

SEQ ID NO: 278559 - DNA, 15 bp, Homo sapiens
tccaaaggttaactg

SEQ ID NO: 278560 - DNA, 15 bp, Homo sapiens
ttccaaaggttaact

SEQ ID NO: 278561 - DNA, 15 bp, Homo sapiens
attccaaaggttaac

SEQ ID NO: 278562 - DNA, 15 bp, Homo sapiens
cattccaaaggttaa

SEQ ID NO: 278563 - DNA, 15 bp, Homo sapiens
ccattccaaaggtta

SEQ ID NO: 278564 - DNA, 15 bp, Homo sapiens
tccattccaaaggtt

SEQ ID NO: 278565 - DNA, 15 bp, Homo sapiens
atccattccaaaggt

SEQ ID NO: 278566 - DNA, 15 bp, Homo sapiens
tatccattccaaagg

SEQ ID NO: 278567 - DNA, 15 bp, Homo sapiens
ttatccattccaaag

SEQ ID NO: 278568 - DNA, 15 bp, Homo sapiens
attatccattccaaa

SEQ ID NO: 278569 - DNA, 15 bp, Homo sapiens
aattatccattccaa

SEQ ID NO: 278570 - DNA, 15 bp, Homo sapiens
gaattatccattcca

SEQ ID NO: 278571 - DNA, 15 bp, Homo sapiens
agaattatccattcc

SEQ ID NO: 278572 - DNA, 15 bp, Homo sapiens
cagaattatccattc

SEQ ID NO: 278573 - DNA, 15 bp, Homo sapiens
tcagaattatccatt

SEQ ID NO: 278574 - DNA, 15 bp, Homo sapiens
ctcagaattatccat

SEQ ID NO: 278575 - DNA, 15 bp, Homo sapiens
cctcagaattatcca

SEQ ID NO: 278576 - DNA, 15 bp, Homo sapiens
gcctcagaattatcc

SEQ ID NO: 278577 - DNA, 15 bp, Homo sapiens
tgcctcagaattatc

SEQ ID NO: 278578 - DNA, 15 bp, Homo sapiens
gtgcctcagaattat

SEQ ID NO: 278579 - DNA, 15 bp, Homo sapiens
tgtgcctcagaatta

SEQ ID NO: 278580 - DNA, 15 bp, Homo sapiens
ctgtgcctcagaatt

SEQ ID NO: 278581 - DNA, 15 bp, Homo sapiens
tctgtgcctcagaat

SEQ ID NO: 278582 - DNA, 15 bp, Homo sapiens
ttctgtgcctcagaa

SEQ ID NO: 278583 - DNA, 15 bp, Homo sapiens
attctgtgcctcaga

SEQ ID NO: 278584 - DNA, 15 bp, Homo sapiens
aattctgtgcctcag

SEQ ID NO: 278585 - DNA, 15 bp, Homo sapiens
taattctgtgcctca

SEQ ID NO: 278586 - DNA, 15 bp, Homo sapiens
ataattctgtgcctc

SEQ ID NO: 278587 - DNA, 15 bp, Homo sapiens
aataattctgtgcct

SEQ ID NO: 278588 - DNA, 15 bp, Homo sapiens
taataattctgtgcc

SEQ ID NO: 278589 - DNA, 15 bp, Homo sapiens
gtaataattctgtgc

SEQ ID NO: 278590 - DNA, 15 bp, Homo sapiens
agtaataattctgtg

SEQ ID NO: 278591 - DNA, 15 bp, Homo sapiens
aagtaataattctgt

SEQ ID NO: 278592 - DNA, 15 bp, Homo sapiens
caagtaataattctg

SEQ ID NO: 278593 - DNA, 15 bp, Homo sapiens
ccaagtaataattct

SEQ ID NO: 278594 - DNA, 15 bp, Homo sapiens
accaagtaataattc

SEQ ID NO: 278595 - DNA, 15 bp, Homo sapiens
caccaagtaataatt

SEQ ID NO: 278596 - DNA, 15 bp, Homo sapiens
gcaccaagtaataat

SEQ ID NO: 278597 - DNA, 15 bp, Homo sapiens
agcaccaagtaataa

SEQ ID NO: 278598 - DNA, 15 bp, Homo sapiens
aagcaccaagtaata

SEQ ID NO: 278599 - DNA, 15 bp, Homo sapiens
aaagcaccaagtaat

SEQ ID NO: 278600 - DNA, 15 bp, Homo sapiens
taaagcaccaagtaa

SEQ ID NO: 278601 - DNA, 15 bp, Homo sapiens
ttaaagcaccaagta

SEQ ID NO: 278602 - DNA, 15 bp, Homo sapiens
attaaagcaccaagt

SEQ ID NO: 278603 - DNA, 15 bp, Homo sapiens
aattaaagcaccaag

SEQ ID NO: 278604 - DNA, 15 bp, Homo sapiens
aaattaaagcaccaa

SEQ ID NO: 278605 - DNA, 15 bp, Homo sapiens
taaattaaagcacca

SEQ ID NO: 278606 - DNA, 15 bp, Homo sapiens
gtaaattaaagcacc

SEQ ID NO: 278607 - DNA, 15 bp, Homo sapiens
cgtaaattaaagcac

SEQ ID NO: 278608 - DNA, 15 bp, Homo sapiens
ccgtaaattaaagca

SEQ ID NO: 278609 - DNA, 15 bp, Homo sapiens
cccgtaaattaaagc

SEQ ID NO: 278610 - DNA, 15 bp, Homo sapiens
tcccgtaaattaaag

SEQ ID NO: 278611 - DNA, 15 bp, Homo sapiens
atcccgtaaattaaa

SEQ ID NO: 278612 - DNA, 15 bp, Homo sapiens
tatcccgtaaattaa

SEQ ID NO: 278613 - DNA, 15 bp, Homo sapiens
ttatcccgtaaatta

SEQ ID NO: 278614 - DNA, 15 bp, Homo sapiens
attatcccgtaaatt

SEQ ID NO: 278615 - DNA, 15 bp, Homo sapiens
aattatcccgtaaat

SEQ ID NO: 278616 - DNA, 15 bp, Homo sapiens
aaattatcccgtaaa

SEQ ID NO: 278617 - DNA, 15 bp, Homo sapiens
caaattatcccgtaa

SEQ ID NO: 278618 - DNA, 15 bp, Homo sapiens
tcaaattatcccgta

SEQ ID NO: 278619 - DNA, 15 bp, Homo sapiens
atcaaattatcccgt

SEQ ID NO: 278620 - DNA, 15 bp, Homo sapiens
tatcaaattatcccg

SEQ ID NO: 278621 - DNA, 15 bp, Homo sapiens
ctatcaaattatccc

SEQ ID NO: 278622 - DNA, 15 bp, Homo sapiens
cctatcaaattatcc

SEQ ID NO: 278623 - DNA, 15 bp, Homo sapiens
acctatcaaattatc

SEQ ID NO: 278624 - DNA, 15 bp, Homo sapiens
aacctatcaaattat

SEQ ID NO: 278625 - DNA, 15 bp, Homo sapiens
aaacctatcaaatta

SEQ ID NO: 278626 - DNA, 15 bp, Homo sapiens
caaacctatcaaatt

SEQ ID NO: 278627 - DNA, 15 bp, Homo sapiens
tcaaacctatcaaat

SEQ ID NO: 278628 - DNA, 15 bp, Homo sapiens
ttcaaacctatcaaa

SEQ ID NO: 278629 - DNA, 15 bp, Homo sapiens
gttcaaacctatcaa

SEQ ID NO: 278630 - DNA, 15 bp, Homo sapiens
agttcaaacctatca

SEQ ID NO: 278631 - DNA, 15 bp, Homo sapiens
tagttcaaacctatc

SEQ ID NO: 278632 - DNA, 15 bp, Homo sapiens
ttagttcaaacctat

SEQ ID NO: 278633 - DNA, 15 bp, Homo sapiens
cttagttcaaaccta

SEQ ID NO: 278634 - DNA, 15 bp, Homo sapiens
gcttagttcaaacct

SEQ ID NO: 278635 - DNA, 15 bp, Homo sapiens
cgcttagttcaaacc

SEQ ID NO: 278636 - DNA, 15 bp, Homo sapiens
tcgcttagttcaaac

SEQ ID NO: 278637 - DNA, 15 bp, Homo sapiens
atcgcttagttcaaa

SEQ ID NO: 278638 - DNA, 15 bp, Homo sapiens
catcgcttagttcaa

SEQ ID NO: 278639 - DNA, 15 bp, Homo sapiens
acatcgcttagttca

SEQ ID NO: 278640 - DNA, 15 bp, Homo sapiens
cacatcgcttagttc

SEQ ID NO: 278641 - DNA, 15 bp, Homo sapiens
gcacatcgcttagtt

SEQ ID NO: 278642 - DNA, 15 bp, Homo sapiens
ggcacatcgcttagt

SEQ ID NO: 278643 - DNA, 15 bp, Homo sapiens
aggcacatcgcttag

SEQ ID NO: 278644 - DNA, 15 bp, Homo sapiens
aaggcacatcgctta

SEQ ID NO: 278645 - DNA, 15 bp, Homo sapiens
aaaggcacatcgctt

SEQ ID NO: 278646 - DNA, 15 bp, Homo sapiens
aaaaggcacatcgct

SEQ ID NO: 278647 - DNA, 15 bp, Homo sapiens
taaaaggcacatcgc

SEQ ID NO: 278648 - DNA, 15 bp, Homo sapiens
ttaaaaggcacatcg

SEQ ID NO: 278649 - DNA, 15 bp, Homo sapiens
attaaaaggcacatc

SEQ ID NO: 278650 - DNA, 15 bp, Homo sapiens
gattaaaaggcacat

SEQ ID NO: 278651 - DNA, 15 bp, Homo sapiens
agattaaaaggcaca

SEQ ID NO: 278652 - DNA, 15 bp, Homo sapiens
aagattaaaaggcac

SEQ ID NO: 278653 - DNA, 15 bp, Homo sapiens
aaagattaaaaggca

SEQ ID NO: 278654 - DNA, 15 bp, Homo sapiens
aaaagattaaaaggc

SEQ ID NO: 278655 - DNA, 15 bp, Homo sapiens
caaaagattaaaagg

SEQ ID NO: 278656 - DNA, 15 bp, Homo sapiens
gcaaaagattaaaag

SEQ ID NO: 278657 - DNA, 15 bp, Homo sapiens
agcaaaagattaaaa

SEQ ID NO: 278658 - DNA, 15 bp, Homo sapiens
tagcaaaagattaaa

SEQ ID NO: 278659 - DNA, 15 bp, Homo sapiens
ttagcaaaagattaa

SEQ ID NO: 278660 - DNA, 15 bp, Homo sapiens
tttagcaaaagatta

SEQ ID NO: 278661 - DNA, 15 bp, Homo sapiens
gtttagcaaaagatt

SEQ ID NO: 278662 - DNA, 15 bp, Homo sapiens
ggtttagcaaaagat

SEQ ID NO: 278663 - DNA, 15 bp, Homo sapiens
tggtttagcaaaaga

SEQ ID NO: 278664 - DNA, 15 bp, Homo sapiens
atggtttagcaaaag

SEQ ID NO: 278665 - DNA, 15 bp, Homo sapiens
aatggtttagcaaaa

SEQ ID NO: 278666 - DNA, 15 bp, Homo sapiens
caatggtttagcaaa

SEQ ID NO: 278667 - DNA, 15 bp, Homo sapiens
ccaatggtttagcaa

SEQ ID NO: 278668 - DNA, 15 bp, Homo sapiens
gccaatggtttagca

SEQ ID NO: 278669 - DNA, 15 bp, Homo sapiens
tgccaatggtttagc

SEQ ID NO: 278670 - DNA, 15 bp, Homo sapiens
atgccaatggtttag

SEQ ID NO: 278671 - DNA, 15 bp, Homo sapiens
aatgccaatggttta

SEQ ID NO: 278672 - DNA, 15 bp, Homo sapiens
aaatgccaatggttt

SEQ ID NO: 278673 - DNA, 15 bp, Homo sapiens
aaaatgccaatggtt

SEQ ID NO: 278674 - DNA, 15 bp, Homo sapiens
caaaatgccaatggt

SEQ ID NO: 278675 - DNA, 15 bp, Homo sapiens
gcaaaatgccaatgg

SEQ ID NO: 278676 - DNA, 15 bp, Homo sapiens
tgcaaaatgccaatg

SEQ ID NO: 278677 - DNA, 15 bp, Homo sapiens
atgcaaaatgccaat

SEQ ID NO: 278678 - DNA, 15 bp, Homo sapiens
gatgcaaaatgccaa

SEQ ID NO: 278679 - DNA, 15 bp, Homo sapiens
tgatgcaaaatgcca

SEQ ID NO: 278680 - DNA, 15 bp, Homo sapiens
gtgatgcaaaatgcc

SEQ ID NO: 278681 - DNA, 15 bp, Homo sapiens
tgtgatgcaaaatgc

SEQ ID NO: 278682 - DNA, 15 bp, Homo sapiens
ttgtgatgcaaaatg

SEQ ID NO: 278683 - DNA, 15 bp, Homo sapiens
tttgtgatgcaaaat

SEQ ID NO: 278684 - DNA, 15 bp, Homo sapiens
atttgtgatgcaaaa

SEQ ID NO: 278685 - DNA, 15 bp, Homo sapiens
tatttgtgatgcaaa

SEQ ID NO: 278686 - DNA, 15 bp, Homo sapiens
atatttgtgatgcaa

SEQ ID NO: 278687 - DNA, 15 bp, Homo sapiens
gatatttgtgatgca

SEQ ID NO: 278688 - DNA, 15 bp, Homo sapiens
agatatttgtgatgc

SEQ ID NO: 278689 - DNA, 15 bp, Homo sapiens
tagatatttgtgatg

SEQ ID NO: 278690 - DNA, 15 bp, Homo sapiens
gtagatatttgtgat

SEQ ID NO: 278691 - DNA, 15 bp, Homo sapiens
tgtagatatttgtga

SEQ ID NO: 278692 - DNA, 15 bp, Homo sapiens
gtgtagatatttgtg

SEQ ID NO: 278693 - DNA, 15 bp, Homo sapiens
cgtgtagatatttgt

SEQ ID NO: 278694 - DNA, 15 bp, Homo sapiens
gcgtgtagatatttg

SEQ ID NO: 278695 - DNA, 15 bp, Homo sapiens
agcgtgtagatattt

SEQ ID NO: 278696 - DNA, 15 bp, Homo sapiens
aagcgtgtagatatt

SEQ ID NO: 278697 - DNA, 15 bp, Homo sapiens
aaagcgtgtagatat

SEQ ID NO: 278698 - DNA, 15 bp, Homo sapiens
taaagcgtgtagata

SEQ ID NO: 278699 - DNA, 15 bp, Homo sapiens
gtaaagcgtgtagat

SEQ ID NO: 278700 - DNA, 15 bp, Homo sapiens
tgtaaagcgtgtaga

SEQ ID NO: 278701 - DNA, 15 bp, Homo sapiens
ctgtaaagcgtgtag

SEQ ID NO: 278702 - DNA, 15 bp, Homo sapiens
cctgtaaagcgtgta

SEQ ID NO: 278703 - DNA, 15 bp, Homo sapiens
tcctgtaaagcgtgt

SEQ ID NO: 278704 - DNA, 15 bp, Homo sapiens
ttcctgtaaagcgtg

SEQ ID NO: 278705 - DNA, 15 bp, Homo sapiens
attcctgtaaagcgt

SEQ ID NO: 278706 - DNA, 15 bp, Homo sapiens
gattcctgtaaagcg

SEQ ID NO: 278707 - DNA, 15 bp, Homo sapiens
tgattcctgtaaagc

SEQ ID NO: 278708 - DNA, 15 bp, Homo sapiens
atgattcctgtaaag

SEQ ID NO: 278709 - DNA, 15 bp, Homo sapiens
catgattcctgtaaa

SEQ ID NO: 278710 - DNA, 15 bp, Homo sapiens
gcatgattcctgtaa

SEQ ID NO: 278711 - DNA, 15 bp, Homo sapiens
tgcatgattcctgta

SEQ ID NO: 278712 - DNA, 15 bp, Homo sapiens
ctgcatgattcctgt

SEQ ID NO: 278713 - DNA, 15 bp, Homo sapiens
tctgcatgattcctg

SEQ ID NO: 278714 - DNA, 15 bp, Homo sapiens
atctgcatgattcct

SEQ ID NO: 278715 - DNA, 15 bp, Homo sapiens
tatctgcatgattcc

SEQ ID NO: 278716 - DNA, 15 bp, Homo sapiens
ctatctgcatgattc

SEQ ID NO: 278717 - DNA, 15 bp, Homo sapiens
tctatctgcatgatt

SEQ ID NO: 278718 - DNA, 15 bp, Homo sapiens
atctatctgcatgat

SEQ ID NO: 278719 - DNA, 15 bp, Homo sapiens
catctatctgcatga

SEQ ID NO: 278720 - DNA, 15 bp, Homo sapiens
gcatctatctgcatg

SEQ ID NO: 278721 - DNA, 15 bp, Homo sapiens
tgcatctatctgcat

SEQ ID NO: 278722 - DNA, 15 bp, Homo sapiens
atgcatctatctgca

SEQ ID NO: 278723 - DNA, 15 bp, Homo sapiens
tatgcatctatctgc

SEQ ID NO: 278724 - DNA, 15 bp, Homo sapiens
atatgcatctatctg

SEQ ID NO: 278725 - DNA, 15 bp, Homo sapiens
aatatgcatctatct

SEQ ID NO: 278726 - DNA, 15 bp, Homo sapiens
aaatatgcatctatc

SEQ ID NO: 278727 - DNA, 15 bp, Homo sapiens
aaaatatgcatctat

SEQ ID NO: 278728 - DNA, 15 bp, Homo sapiens
taaaatatgcatcta

SEQ ID NO: 278729 - DNA, 15 bp, Homo sapiens
ataaaatatgcatct

SEQ ID NO: 278730 - DNA, 15 bp, Homo sapiens
tataaaatatgcatc

SEQ ID NO: 278731 - DNA, 15 bp, Homo sapiens
gtataaaatatgcat

SEQ ID NO: 278732 - DNA, 15 bp, Homo sapiens
agtataaaatatgca

SEQ ID NO: 278733 - DNA, 15 bp, Homo sapiens
gagtataaaatatgc

SEQ ID NO: 278734 - DNA, 15 bp, Homo sapiens
ggagtataaaatatg

SEQ ID NO: 278735 - DNA, 15 bp, Homo sapiens
aggagtataaaatat

SEQ ID NO: 278736 - DNA, 15 bp, Homo sapiens
aaggagtataaaata

SEQ ID NO: 278737 - DNA, 15 bp, Homo sapiens
aaaggagtataaaat

SEQ ID NO: 278738 - DNA, 15 bp, Homo sapiens
taaaggagtataaaa

SEQ ID NO: 278739 - DNA, 15 bp, Homo sapiens
ttaaaggagtataaa

SEQ ID NO: 278740 - DNA, 15 bp, Homo sapiens
tttaaaggagtataa

SEQ ID NO: 278741 - DNA, 15 bp, Homo sapiens
ttttaaaggagtata

SEQ ID NO: 278742 - DNA, 15 bp, Homo sapiens
gttttaaaggagtat

SEQ ID NO: 278743 - DNA, 15 bp, Homo sapiens
tgttttaaaggagta

SEQ ID NO: 278744 - DNA, 15 bp, Homo sapiens
atgttttaaaggagt

SEQ ID NO: 278745 - DNA, 15 bp, Homo sapiens
aatgttttaaaggag

SEQ ID NO: 278746 - DNA, 15 bp, Homo sapiens
aaatgttttaaagga

SEQ ID NO: 278747 - DNA, 15 bp, Homo sapiens
aaaatgttttaaagg

SEQ ID NO: 278748 - DNA, 15 bp, Homo sapiens
aaaaatgttttaaag

SEQ ID NO: 278749 - DNA, 15 bp, Homo sapiens
taaaaatgttttaaa

SEQ ID NO: 278750 - DNA, 15 bp, Homo sapiens
ttaaaaatgttttaa

SEQ ID NO: 278751 - DNA, 15 bp, Homo sapiens
attaaaaatgtttta

SEQ ID NO: 278752 - DNA, 15 bp, Homo sapiens
aattaaaaatgtttt

SEQ ID NO: 278753 - DNA, 15 bp, Homo sapiens
aaattaaaaatgttt

SEQ ID NO: 278754 - DNA, 15 bp, Homo sapiens
caaattaaaaatgtt

SEQ ID NO: 278755 - DNA, 15 bp, Homo sapiens
gcaaattaaaaatgt

SEQ ID NO: 278756 - DNA, 15 bp, Homo sapiens
ggcaaattaaaaatg

SEQ ID NO: 278757 - DNA, 15 bp, Homo sapiens
aggcaaattaaaaat

SEQ ID NO: 278758 - DNA, 15 bp, Homo sapiens
aaggcaaattaaaaa

SEQ ID NO: 278759 - DNA, 15 bp, Homo sapiens
aaaggcaaattaaaa

SEQ ID NO: 278760 - DNA, 15 bp, Homo sapiens
gaaaggcaaattaaa

SEQ ID NO: 278761 - DNA, 15 bp, Homo sapiens
tgaaaggcaaattaa

SEQ ID NO: 278762 - DNA, 15 bp, Homo sapiens
ttgaaaggcaaatta

SEQ ID NO: 278763 - DNA, 15 bp, Homo sapiens
attgaaaggcaaatt

SEQ ID NO: 278764 - DNA, 15 bp, Homo sapiens
cattgaaaggcaaat

SEQ ID NO: 278765 - DNA, 15 bp, Homo sapiens
acattgaaaggcaaa

SEQ ID NO: 278766 - DNA, 15 bp, Homo sapiens
gacattgaaaggcaa

SEQ ID NO: 278767 - DNA, 15 bp, Homo sapiens
tgacattgaaaggca

SEQ ID NO: 278768 - DNA, 15 bp, Homo sapiens
ttgacattgaaaggc

SEQ ID NO: 278769 - DNA, 15 bp, Homo sapiens
tttgacattgaaagg

SEQ ID NO: 278770 - DNA, 15 bp, Homo sapiens
ttttgacattgaaag

SEQ ID NO: 278771 - DNA, 15 bp, Homo sapiens
attttgacattgaaa

SEQ ID NO: 278772 - DNA, 15 bp, Homo sapiens
tattttgacattgaa

SEQ ID NO: 278773 - DNA, 15 bp, Homo sapiens
ttattttgacattga

SEQ ID NO: 278774 - DNA, 15 bp, Homo sapiens
attattttgacattg

SEQ ID NO: 278775 - DNA, 15 bp, Homo sapiens
gattattttgacatt

SEQ ID NO: 278776 - DNA, 15 bp, Homo sapiens
tgattattttgacat

SEQ ID NO: 278777 - DNA, 15 bp, Homo sapiens
atgattattttgaca

SEQ ID NO: 278778 - DNA, 15 bp, Homo sapiens
aatgattattttgac

SEQ ID NO: 278779 - DNA, 15 bp, Homo sapiens
caatgattattttga

SEQ ID NO: 278780 - DNA, 15 bp, Homo sapiens
ccaatgattattttg

SEQ ID NO: 278781 - DNA, 15 bp, Homo sapiens
accaatgattatttt

SEQ ID NO: 278782 - DNA, 15 bp, Homo sapiens
caccaatgattattt

SEQ ID NO: 278783 - DNA, 15 bp, Homo sapiens
acaccaatgattatt

SEQ ID NO: 278784 - DNA, 15 bp, Homo sapiens
gacaccaatgattat

SEQ ID NO: 278785 - DNA, 15 bp, Homo sapiens
tgacaccaatgatta

SEQ ID NO: 278786 - DNA, 15 bp, Homo sapiens
ctgacaccaatgatt

SEQ ID NO: 278787 - DNA, 15 bp, Homo sapiens
actgacaccaatgat

SEQ ID NO: 278788 - DNA, 15 bp, Homo sapiens
gactgacaccaatga

SEQ ID NO: 278789 - DNA, 15 bp, Homo sapiens
tgactgacaccaatg

SEQ ID NO: 278790 - DNA, 15 bp, Homo sapiens
atgactgacaccaat

SEQ ID NO: 278791 - DNA, 15 bp, Homo sapiens
gatgactgacaccaa

SEQ ID NO: 278792 - DNA, 15 bp, Homo sapiens
ggatgactgacacca

SEQ ID NO: 278793 - DNA, 15 bp, Homo sapiens
aggatgactgacacc

SEQ ID NO: 278794 - DNA, 15 bp, Homo sapiens
taggatgactgacac

SEQ ID NO: 278795 - DNA, 15 bp, Homo sapiens
ataggatgactgaca

SEQ ID NO: 278796 - DNA, 15 bp, Homo sapiens
aataggatgactgac

SEQ ID NO: 278797 - DNA, 15 bp, Homo sapiens
gaataggatgactga

SEQ ID NO: 278798 - DNA, 15 bp, Homo sapiens
agaataggatgactg

SEQ ID NO: 278799 - DNA, 15 bp, Homo sapiens
cagaataggatgact

SEQ ID NO: 278800 - DNA, 15 bp, Homo sapiens
tcagaataggatgac

SEQ ID NO: 278801 - DNA, 15 bp, Homo sapiens
ctcagaataggatga

SEQ ID NO: 278802 - DNA, 15 bp, Homo sapiens
actcagaataggatg

SEQ ID NO: 278803 - DNA, 15 bp, Homo sapiens
cactcagaataggat

SEQ ID NO: 278804 - DNA, 15 bp, Homo sapiens
tcactcagaatagga

SEQ ID NO: 278805 - DNA, 15 bp, Homo sapiens
gtcactcagaatagg

SEQ ID NO: 278806 - DNA, 15 bp, Homo sapiens
agtcactcagaatag

SEQ ID NO: 278807 - DNA, 15 bp, Homo sapiens
gagtcactcagaata

SEQ ID NO: 278808 - DNA, 15 bp, Homo sapiens
agagtcactcagaat

SEQ ID NO: 278809 - DNA, 15 bp, Homo sapiens
tagagtcactcagaa

SEQ ID NO: 278810 - DNA, 15 bp, Homo sapiens
atagagtcactcaga

SEQ ID NO: 278811 - DNA, 15 bp, Homo sapiens
aatagagtcactcag

SEQ ID NO: 278812 - DNA, 15 bp, Homo sapiens
taatagagtcactca

SEQ ID NO: 278813 - DNA, 15 bp, Homo sapiens
ctaatagagtcactc

SEQ ID NO: 278814 - DNA, 15 bp, Homo sapiens
cctaatagagtcact

SEQ ID NO: 278815 - DNA, 15 bp, Homo sapiens
acctaatagagtcac

SEQ ID NO: 278816 - DNA, 15 bp, Homo sapiens
tacctaatagagtca

SEQ ID NO: 278817 - DNA, 15 bp, Homo sapiens
ttacctaatagagtc

SEQ ID NO: 278818 - DNA, 15 bp, Homo sapiens
tttacctaatagagt

SEQ ID NO: 278819 - DNA, 15 bp, Homo sapiens
ttttacctaatagag

SEQ ID NO: 278820 - DNA, 15 bp, Homo sapiens
tttttacctaataga

SEQ ID NO: 278821 - DNA, 15 bp, Homo sapiens
atttttacctaatag

SEQ ID NO: 278822 - DNA, 15 bp, Homo sapiens
aatttttacctaata

SEQ ID NO: 278823 - DNA, 15 bp, Homo sapiens
taatttttacctaat

SEQ ID NO: 278824 - DNA, 15 bp, Homo sapiens
ttaatttttacctaa

SEQ ID NO: 278825 - DNA, 15 bp, Homo sapiens
gttaatttttaccta

SEQ ID NO: 278826 - DNA, 15 bp, Homo sapiens
tgttaatttttacct

SEQ ID NO: 278827 - DNA, 15 bp, Homo sapiens
ctgttaatttttacc

SEQ ID NO: 278828 - DNA, 15 bp, Homo sapiens
tctgttaatttttac

SEQ ID NO: 278829 - DNA, 15 bp, Homo sapiens
ttctgttaattttta

SEQ ID NO: 278830 - DNA, 15 bp, Homo sapiens
tttctgttaattttt

SEQ ID NO: 278831 - DNA, 15 bp, Homo sapiens
cttttctgttaattt

SEQ ID NO: 278832 - DNA, 15 bp, Homo sapiens
gcttttctgttaatt

SEQ ID NO: 278833 - DNA, 15 bp, Homo sapiens
tgcttttctgttaat

SEQ ID NO: 278834 - DNA, 15 bp, Homo sapiens
atgcttttctgttaa

SEQ ID NO: 278835 - DNA, 15 bp, Homo sapiens
catgcttttctgtta

SEQ ID NO: 278836 - DNA, 15 bp, Homo sapiens
gcatgcttttctgtt

SEQ ID NO: 278837 - DNA, 15 bp, Homo sapiens
ggcatgcttttctgt

SEQ ID NO: 278838 - DNA, 15 bp, Homo sapiens
tggcatgcttttctg

SEQ ID NO: 278839 - DNA, 15 bp, Homo sapiens
ttggcatgcttttct

SEQ ID NO: 278840 - DNA, 15 bp, Homo sapiens
tttggcatgcttttc

SEQ ID NO: 278841 - DNA, 15 bp, Homo sapiens
atttggcatgctttt

SEQ ID NO: 278842 - DNA, 15 bp, Homo sapiens
tatttggcatgcttt

SEQ ID NO: 278843 - DNA, 15 bp, Homo sapiens
ttatttggcatgctt

SEQ ID NO: 278844 - DNA, 15 bp, Homo sapiens
attatttggcatgct

SEQ ID NO: 278845 - DNA, 15 bp, Homo sapiens
aattatttggcatgc

SEQ ID NO: 278846 - DNA, 15 bp, Homo sapiens
aaattatttggcatg

SEQ ID NO: 278847 - DNA, 15 bp, Homo sapiens
aaaattatttggcat

SEQ ID NO: 278848 - DNA, 15 bp, Homo sapiens
caaaattatttggca

SEQ ID NO: 278849 - DNA, 15 bp, Homo sapiens
acaaaattatttggc

SEQ ID NO: 278850 - DNA, 15 bp, Homo sapiens
cacaaaattatttgg

SEQ ID NO: 278851 - DNA, 15 bp, Homo sapiens
gcacaaaattatttg

SEQ ID NO: 278852 - DNA, 15 bp, Homo sapiens
agcacaaaattattt

SEQ ID NO: 278853 - DNA, 15 bp, Homo sapiens
cagcacaaaattatt

SEQ ID NO: 278854 - DNA, 15 bp, Homo sapiens
acagcacaaaattat

SEQ ID NO: 278855 - DNA, 15 bp, Homo sapiens
cacagcacaaaatta

SEQ ID NO: 278856 - DNA, 15 bp, Homo sapiens
tcacagcacaaaatt

SEQ ID NO: 278857 - DNA, 15 bp, Homo sapiens
atcacagcacaaaat

SEQ ID NO: 278858 - DNA, 15 bp, Homo sapiens
aatcacagcacaaaa

SEQ ID NO: 278859 - DNA, 15 bp, Homo sapiens
aaatcacagcacaaa

SEQ ID NO: 278860 - DNA, 15 bp, Homo sapiens
aaaatcacagcacaa

SEQ ID NO: 278861 - DNA, 15 bp, Homo sapiens
caaaatcacagcaca

SEQ ID NO: 278862 - DNA, 15 bp, Homo sapiens
ccaaaatcacagcac

SEQ ID NO: 278863 - DNA, 15 bp, Homo sapiens
cccaaaatcacagca

SEQ ID NO: 278864 - DNA, 15 bp, Homo sapiens
ccccaaaatcacagc

SEQ ID NO: 278865 - DNA, 15 bp, Homo sapiens
accccaaaatcacag

SEQ ID NO: 278866 - DNA, 15 bp, Homo sapiens
caccccaaaatcaca

SEQ ID NO: 278867 - DNA, 15 bp, Homo sapiens
acaccccaaaatcac

SEQ ID NO: 278868 - DNA, 15 bp, Homo sapiens
tacaccccaaaatca

SEQ ID NO: 278869 - DNA, 15 bp, Homo sapiens
ttacaccccaaaatc

SEQ ID NO: 278870 - DNA, 15 bp, Homo sapiens
attacaccccaaaat

SEQ ID NO: 278871 - DNA, 15 bp, Homo sapiens
aattacaccccaaaa

SEQ ID NO: 278872 - DNA, 15 bp, Homo sapiens
gaattacaccccaaa

SEQ ID NO: 278873 - DNA, 15 bp, Homo sapiens
agaattacaccccaa

SEQ ID NO: 278874 - DNA, 15 bp, Homo sapiens
cagaattacacccca

SEQ ID NO: 278875 - DNA, 15 bp, Homo sapiens
tcagaattacacccc

SEQ ID NO: 278876 - DNA, 15 bp, Homo sapiens
ttcagaattacaccc

SEQ ID NO: 278877 - DNA, 15 bp, Homo sapiens
tttcagaattacacc

SEQ ID NO: 278878 - DNA, 15 bp, Homo sapiens
ttttcagaattacac

SEQ ID NO: 278879 - DNA, 15 bp, Homo sapiens
attttcagaattaca

SEQ ID NO: 278880 - DNA, 15 bp, Homo sapiens
cattttcagaattac

SEQ ID NO: 278881 - DNA, 15 bp, Homo sapiens
gcattttcagaatta

SEQ ID NO: 278882 - DNA, 15 bp, Homo sapiens
ggcattttcagaatt

SEQ ID NO: 278883 - DNA, 15 bp, Homo sapiens
aggcattttcagaat

SEQ ID NO: 278884 - DNA, 15 bp, Homo sapiens
gaggcattttcagaa

SEQ ID NO: 278885 - DNA, 15 bp, Homo sapiens
cgaggcattttcaga

SEQ ID NO: 278886 - DNA, 15 bp, Homo sapiens
gcgaggcattttcag

SEQ ID NO: 278887 - DNA, 15 bp, Homo sapiens
ggcgaggcattttca

SEQ ID NO: 278888 - DNA, 15 bp, Homo sapiens
aggcgaggcattttc

SEQ ID NO: 278889 - DNA, 15 bp, Homo sapiens
gaggcgaggcatttt

SEQ ID NO: 278890 - DNA, 15 bp, Homo sapiens
tgaggcgaggcattt

SEQ ID NO: 278891 - DNA, 15 bp, Homo sapiens
ttgaggcgaggcatt

SEQ ID NO: 278892 - DNA, 15 bp, Homo sapiens
attgaggcgaggcat

SEQ ID NO: 278893 - DNA, 15 bp, Homo sapiens
aattgaggcgaggca

SEQ ID NO: 278894 - DNA, 15 bp, Homo sapiens
gaattgaggcgaggc

SEQ ID NO: 278895 - DNA, 15 bp, Homo sapiens
tgaattgaggcgagg

SEQ ID NO: 278896 - DNA, 15 bp, Homo sapiens
atgaattgaggcgag

SEQ ID NO: 278897 - DNA, 15 bp, Homo sapiens
aatgaattgaggcga

SEQ ID NO: 278898 - DNA, 15 bp, Homo sapiens
gaatgaattgaggcg

SEQ ID NO: 278899 - DNA, 15 bp, Homo sapiens
tgaatgaattgaggc

SEQ ID NO: 278900 - DNA, 15 bp, Homo sapiens
ttgaatgaattgagg

SEQ ID NO: 278901 - DNA, 15 bp, Homo sapiens
attgaatgaattgag

SEQ ID NO: 278902 - DNA, 15 bp, Homo sapiens
aattgaatgaattga

SEQ ID NO: 278903 - DNA, 15 bp, Homo sapiens
caattgaatgaattg

SEQ ID NO: 278904 - DNA, 15 bp, Homo sapiens
tcaattgaatgaatt

SEQ ID NO: 278905 - DNA, 15 bp, Homo sapiens
ttcaattgaatgaat

SEQ ID NO: 278906 - DNA, 15 bp, Homo sapiens
tttcaattgaatgaa

SEQ ID NO: 278907 - DNA, 15 bp, Homo sapiens
ttttcaattgaatga

SEQ ID NO: 278908 - DNA, 15 bp, Homo sapiens
attttcaattgaatg

SEQ ID NO: 278909 - DNA, 15 bp, Homo sapiens
cattttcaattgaat

SEQ ID NO: 278910 - DNA, 15 bp, Homo sapiens
tcattttcaattgaa

SEQ ID NO: 278911 - DNA, 15 bp, Homo sapiens
ttcattttcaattga

SEQ ID NO: 278912 - DNA, 15 bp, Homo sapiens
attcattttcaattg

SEQ ID NO: 278913 - DNA, 15 bp, Homo sapiens
aattcattttcaatt

SEQ ID NO: 278914 - DNA, 15 bp, Homo sapiens
aaattcattttcaat

SEQ ID NO: 278915 - DNA, 15 bp, Homo sapiens
taaattcattttcaa

SEQ ID NO: 278916 - DNA, 15 bp, Homo sapiens
ataaattcattttca

SEQ ID NO: 278917 - DNA, 15 bp, Homo sapiens
cataaattcattttc

SEQ ID NO: 278918 - DNA, 15 bp, Homo sapiens
tcataaattcatttt

SEQ ID NO: 278919 - DNA, 15 bp, Homo sapiens
ctcataaattcattt

SEQ ID NO: 278920 - DNA, 15 bp, Homo sapiens
gctcataaattcatt

SEQ ID NO: 278921 - DNA, 15 bp, Homo sapiens
tgctcataaattcat

SEQ ID NO: 278922 - DNA, 15 bp, Homo sapiens
atgctcataaattca

SEQ ID NO: 278923 - DNA, 15 bp, Homo sapiens
aatgctcataaattc

SEQ ID NO: 278924 - DNA, 15 bp, Homo sapiens
aaatgctcataaatt

SEQ ID NO: 278925 - DNA, 15 bp, Homo sapiens
aaaatgctcataaat

SEQ ID NO: 278926 - DNA, 15 bp, Homo sapiens
aaaaatgctcataaa

SEQ ID NO: 278927 - DNA, 15 bp, Homo sapiens
aaaaaatgctcataa

SEQ ID NO: 278928 - DNA, 15 bp, Homo sapiens
caaaaaatgctcata

SEQ ID NO: 278929 - DNA, 15 bp, Homo sapiens
acaaaaaatgctcat

SEQ ID NO: 278930 - DNA, 15 bp, Homo sapiens
cacaaaaaatgctca

SEQ ID NO: 278931 - DNA, 15 bp, Homo sapiens
tcacaaaaaatgctc

SEQ ID NO: 278932 - DNA, 15 bp, Homo sapiens
ctcacaaaaaatgct

SEQ ID NO: 278933 - DNA, 15 bp, Homo sapiens
tctcacaaaaaatgc

SEQ ID NO: 278934 - DNA, 15 bp, Homo sapiens
ctctcacaaaaaatg

SEQ ID NO: 278935 - DNA, 15 bp, Homo sapiens
cctctcacaaaaaat

SEQ ID NO: 278936 - DNA, 15 bp, Homo sapiens
tcctctcacaaaaaa

SEQ ID NO: 278937 - DNA, 15 bp, Homo sapiens
ttcctctcacaaaaa

SEQ ID NO: 278938 - DNA, 15 bp, Homo sapiens
tttcctctcacaaaa

SEQ ID NO: 278939 - DNA, 15 bp, Homo sapiens
ttttcctctcacaaa

SEQ ID NO: 278940 - DNA, 15 bp, Homo sapiens
gttttcctctcacaa

SEQ ID NO: 278941 - DNA, 15 bp, Homo sapiens
tgttttcctctcaca

SEQ ID NO: 278942 - DNA, 15 bp, Homo sapiens
ttgttttcctctcac

SEQ ID NO: 278943 - DNA, 15 bp, Homo sapiens
cttgttttcctctca

SEQ ID NO: 278944 - DNA, 15 bp, Homo sapiens
tcttgttttcctctc

SEQ ID NO: 278945 - DNA, 15 bp, Homo sapiens
ctcttgttttcctct

SEQ ID NO: 278946 - DNA, 15 bp, Homo sapiens
tctcttgttttcctc

SEQ ID NO: 278947 - DNA, 15 bp, Homo sapiens
ttctcttgttttcct

SEQ ID NO: 278948 - DNA, 15 bp, Homo sapiens
tttctcttgttttcc

SEQ ID NO: 278949 - DNA, 15 bp, Homo sapiens
ttttctcttgttttc

SEQ ID NO: 278950 - DNA, 15 bp, Homo sapiens
tttttctcttgtttt

SEQ ID NO: 278951 - DNA, 15 bp, Homo sapiens
ttttttctcttgttt

SEQ ID NO: 278952 - DNA, 15 bp, Homo sapiens
tttttttctcttgtt

SEQ ID NO: 278953 - DNA, 15 bp, Homo sapiens
ctttttttctcttgt

SEQ ID NO: 278954 - DNA, 15 bp, Homo sapiens
cctttttttctcttg

SEQ ID NO: 278955 - DNA, 15 bp, Homo sapiens
tcctttttttctctt

SEQ ID NO: 278956 - DNA, 15 bp, Homo sapiens
ttcctttttttctct

SEQ ID NO: 278957 - DNA, 15 bp, Homo sapiens
cttcctttttttctc

SEQ ID NO: 278958 - DNA, 15 bp, Homo sapiens
tcttcctttttttct

SEQ ID NO: 278959 - DNA, 15 bp, Homo sapiens
ttcttcctttttttc

SEQ ID NO: 278960 - DNA, 15 bp, Homo sapiens
cttcttccttttttt

SEQ ID NO: 278961 - DNA, 15 bp, Homo sapiens
acttcttcctttttt

SEQ ID NO: 278962 - DNA, 15 bp, Homo sapiens
cacttcttccttttt

SEQ ID NO: 278963 - DNA, 15 bp, Homo sapiens
acacttcttcctttt

SEQ ID NO: 278964 - DNA, 15 bp, Homo sapiens
tacacttcttccttt

SEQ ID NO: 278965 - DNA, 15 bp, Homo sapiens
ttacacttcttcctt

SEQ ID NO: 278966 - DNA, 15 bp, Homo sapiens
cttacacttcttcct

SEQ ID NO: 278967 - DNA, 15 bp, Homo sapiens
gcttacacttcttcc

SEQ ID NO: 278968 - DNA, 15 bp, Homo sapiens
agcttacacttcttc

SEQ ID NO: 278969 - DNA, 15 bp, Homo sapiens
aagcttacacttctt

SEQ ID NO: 278970 - DNA, 15 bp, Homo sapiens
caagcttacacttct

SEQ ID NO: 278971 - DNA, 15 bp, Homo sapiens
gcaagcttacacttc

SEQ ID NO: 278972 - DNA, 15 bp, Homo sapiens
tgcaagcttacactt

SEQ ID NO: 278973 - DNA, 15 bp, Homo sapiens
atgcaagcttacact

SEQ ID NO: 278974 - DNA, 15 bp, Homo sapiens
gatgcaagcttacac

SEQ ID NO: 278975 - DNA, 15 bp, Homo sapiens
tgatgcaagcttaca

SEQ ID NO: 278976 - DNA, 15 bp, Homo sapiens
ctgatgcaagcttac

SEQ ID NO: 278977 - DNA, 15 bp, Homo sapiens
tctgatgcaagctta

SEQ ID NO: 278978 - DNA, 15 bp, Homo sapiens
atctgatgcaagctt

SEQ ID NO: 278979 - DNA, 15 bp, Homo sapiens
catctgatgcaagct

SEQ ID NO: 278980 - DNA, 15 bp, Homo sapiens
gcatctgatgcaagc

SEQ ID NO: 278981 - DNA, 15 bp, Homo sapiens
tgcatctgatgcaag

SEQ ID NO: 278982 - DNA, 15 bp, Homo sapiens
gtgcatctgatgcaa

SEQ ID NO: 278983 - DNA, 15 bp, Homo sapiens
ggtgcatctgatgca

SEQ ID NO: 278984 - DNA, 15 bp, Homo sapiens
tggtgcatctgatgc

SEQ ID NO: 278985 - DNA, 15 bp, Homo sapiens
ttggtgcatctgatg

SEQ ID NO: 278986 - DNA, 15 bp, Homo sapiens
cttggtgcatctgat

SEQ ID NO: 278987 - DNA, 15 bp, Homo sapiens
tcttggtgcatctga

SEQ ID NO: 278988 - DNA, 15 bp, Homo sapiens
atcttggtgcatctg

SEQ ID NO: 278989 - DNA, 15 bp, Homo sapiens
gatcttggtgcatct

SEQ ID NO: 278990 - DNA, 15 bp, Homo sapiens
ggatcttggtgcatc

SEQ ID NO: 278991 - DNA, 15 bp, Homo sapiens
aggatcttggtgcat

SEQ ID NO: 278992 - DNA, 15 bp, Homo sapiens
aaggatcttggtgca

SEQ ID NO: 278993 - DNA, 15 bp, Homo sapiens
aaaggatcttggtgc

SEQ ID NO: 278994 - DNA, 15 bp, Homo sapiens
aaaaggatcttggtg

SEQ ID NO: 278995 - DNA, 15 bp, Homo sapiens
aaaaaggatcttggt

SEQ ID NO: 278996 - DNA, 15 bp, Homo sapiens
caaaaaggatcttgg

SEQ ID NO: 278997 - DNA, 15 bp, Homo sapiens
ccaaaaaggatcttg

SEQ ID NO: 278998 - DNA, 15 bp, Homo sapiens
tccaaaaaggatctt

SEQ ID NO: 278999 - DNA, 15 bp, Homo sapiens
gtccaaaaaggatct

SEQ ID NO: 279000 - DNA, 15 bp, Homo sapiens
tgtccaaaaaggatc

SEQ ID NO: 279001 - DNA, 15 bp, Homo sapiens
ctgtccaaaaaggat

SEQ ID NO: 279002 - DNA, 15 bp, Homo sapiens
tctgtccaaaaagga

SEQ ID NO: 279003 - DNA, 15 bp, Homo sapiens
atctgtccaaaaagg

SEQ ID NO: 279004 - DNA, 15 bp, Homo sapiens
aatctgtccaaaaag

SEQ ID NO: 279005 - DNA, 15 bp, Homo sapiens
aaatctgtccaaaaa

SEQ ID NO: 279006 - DNA, 15 bp, Homo sapiens
taaatctgtccaaaa

SEQ ID NO: 279007 - DNA, 15 bp, Homo sapiens
ataaatctgtccaaa

SEQ ID NO: 279008 - DNA, 15 bp, Homo sapiens
cataaatctgtccaa

SEQ ID NO: 279009 - DNA, 15 bp, Homo sapiens
tcataaatctgtcca

SEQ ID NO: 279010 - DNA, 15 bp, Homo sapiens
ttcataaatctgtcc

SEQ ID NO: 279011 - DNA, 15 bp, Homo sapiens
gttcataaatctgtc

SEQ ID NO: 279012 - DNA, 15 bp, Homo sapiens
agttcataaatctgt

SEQ ID NO: 279013 - DNA, 15 bp, Homo sapiens
tagttcataaatctg

SEQ ID NO: 279014 - DNA, 15 bp, Homo sapiens
gtagttcataaatct

SEQ ID NO: 279015 - DNA, 15 bp, Homo sapiens
agtagttcataaatc

SEQ ID NO: 279016 - DNA, 15 bp, Homo sapiens
tagtagttcataaat

SEQ ID NO: 279017 - DNA, 15 bp, Homo sapiens
ctagtagttcataaa

SEQ ID NO: 279018 - DNA, 15 bp, Homo sapiens
tctagtagttcataa

SEQ ID NO: 279019 - DNA, 15 bp, Homo sapiens
atctagtagttcata

SEQ ID NO: 279020 - DNA, 15 bp, Homo sapiens
tatctagtagttcat

SEQ ID NO: 279021 - DNA, 15 bp, Homo sapiens
atatctagtagttca

SEQ ID NO: 279022 - DNA, 15 bp, Homo sapiens
tatatctagtagttc

SEQ ID NO: 279023 - DNA, 15 bp, Homo sapiens
ctatatctagtagtt

SEQ ID NO: 279024 - DNA, 15 bp, Homo sapiens
actatatctagtagt

SEQ ID NO: 279025 - DNA, 15 bp, Homo sapiens
cactatatctagtag

SEQ ID NO: 279026 - DNA, 15 bp, Homo sapiens
ccactatatctagta

SEQ ID NO: 279027 - DNA, 15 bp, Homo sapiens
cccactatatctagt

SEQ ID NO: 279028 - DNA, 15 bp, Homo sapiens
gcccactatatctag

SEQ ID NO: 279029 - DNA, 15 bp, Homo sapiens
tgcccactatatcta

SEQ ID NO: 279030 - DNA, 15 bp, Homo sapiens
ctgcccactatatct

SEQ ID NO: 279031 - DNA, 15 bp, Homo sapiens
cctgcccactatatc

SEQ ID NO: 279032 - DNA, 15 bp, Homo sapiens
acctgcccactatat

SEQ ID NO: 279033 - DNA, 15 bp, Homo sapiens
aacctgcccactata

SEQ ID NO: 279034 - DNA, 15 bp, Homo sapiens
aaacctgcccactat

SEQ ID NO: 279035 - DNA, 15 bp, Homo sapiens
aaaacctgcccacta

SEQ ID NO: 279036 - DNA, 15 bp, Homo sapiens
gaaaacctgcccact

SEQ ID NO: 279037 - DNA, 15 bp, Homo sapiens
agaaaacctgcccac

SEQ ID NO: 279038 - DNA, 15 bp, Homo sapiens
aagaaaacctgccca

SEQ ID NO: 279039 - DNA, 15 bp, Homo sapiens
aaagaaaacctgccc

SEQ ID NO: 279040 - DNA, 15 bp, Homo sapiens
aaaagaaaacctgcc

SEQ ID NO: 279041 - DNA, 15 bp, Homo sapiens
aaaaagaaaacctgc

SEQ ID NO: 279042 - DNA, 15 bp, Homo sapiens
aaaaaagaaaacctg

SEQ ID NO: 279043 - DNA, 15 bp, Homo sapiens
aaaaaaagaaaacct

SEQ ID NO: 279044 - DNA, 15 bp, Homo sapiens
taaaaaaagaaaacc

SEQ ID NO: 279045 - DNA, 15 bp, Homo sapiens
ttaaaaaaagaaaac

SEQ ID NO: 279046 - DNA, 15 bp, Homo sapiens
attaaaaaaagaaaa

SEQ ID NO: 279047 - DNA, 15 bp, Homo sapiens
gattaaaaaaagaaa

SEQ ID NO: 279048 - DNA, 15 bp, Homo sapiens
ggattaaaaaaagaa

SEQ ID NO: 279049 - DNA, 15 bp, Homo sapiens
aggattaaaaaaaga

SEQ ID NO: 279050 - DNA, 15 bp, Homo sapiens
taggattaaaaaaag

SEQ ID NO: 279051 - DNA, 15 bp, Homo sapiens
ctaggattaaaaaaa

SEQ ID NO: 279052 - DNA, 15 bp, Homo sapiens
tctaggattaaaaaa

SEQ ID NO: 279053 - DNA, 15 bp, Homo sapiens
gtctaggattaaaaa

SEQ ID NO: 279054 - DNA, 15 bp, Homo sapiens
ggtctaggattaaaa

SEQ ID NO: 279055 - DNA, 15 bp, Homo sapiens
tggtctaggattaaa

SEQ ID NO: 279056 - DNA, 15 bp, Homo sapiens
ttggtctaggattaa

SEQ ID NO: 279057 - DNA, 15 bp, Homo sapiens
cttggtctaggatta

SEQ ID NO: 279058 - DNA, 15 bp, Homo sapiens
gcttggtctaggatt

SEQ ID NO: 279059 - DNA, 15 bp, Homo sapiens
agcttggtctaggat

SEQ ID NO: 279060 - DNA, 15 bp, Homo sapiens
gagcttggtctagga

SEQ ID NO: 279061 - DNA, 15 bp, Homo sapiens
agagcttggtctagg

SEQ ID NO: 279062 - DNA, 15 bp, Homo sapiens
gagagcttggtctag

SEQ ID NO: 279063 - DNA, 15 bp, Homo sapiens
cgagagcttggtcta

SEQ ID NO: 279064 - DNA, 15 bp, Homo sapiens
ccgagagcttggtct

SEQ ID NO: 279065 - DNA, 15 bp, Homo sapiens
cccgagagcttggtc

SEQ ID NO: 279066 - DNA, 15 bp, Homo sapiens
tcccgagagcttggt

SEQ ID NO: 279067 - DNA, 15 bp, Homo sapiens
atcccgagagcttgg

SEQ ID NO: 279068 - DNA, 15 bp, Homo sapiens
aatcccgagagcttg

SEQ ID NO: 279069 - DNA, 15 bp, Homo sapiens
aaatcccgagagctt

SEQ ID NO: 279070 - DNA, 15 bp, Homo sapiens
caaatcccgagagct

SEQ ID NO: 279071 - DNA, 15 bp, Homo sapiens
tcaaatcccgagagc

SEQ ID NO: 279072 - DNA, 15 bp, Homo sapiens
atcaaatcccgagag

SEQ ID NO: 279073 - DNA, 15 bp, Homo sapiens
tatcaaatcccgaga

SEQ ID NO: 279074 - DNA, 15 bp, Homo sapiens
atatcaaatcccgag

SEQ ID NO: 279075 - DNA, 15 bp, Homo sapiens
tatatcaaatcccga

SEQ ID NO: 279076 - DNA, 15 bp, Homo sapiens
ctatatcaaatcccg

SEQ ID NO: 279077 - DNA, 15 bp, Homo sapiens
actatatcaaatccc

SEQ ID NO: 279078 - DNA, 15 bp, Homo sapiens
aactatatcaaatcc

SEQ ID NO: 279079 - DNA, 15 bp, Homo sapiens
gaactatatcaaatc

SEQ ID NO: 279080 - DNA, 15 bp, Homo sapiens
tgaactatatcaaat

SEQ ID NO: 279081 - DNA, 15 bp, Homo sapiens
gtgaactatatcaaa

SEQ ID NO: 279082 - DNA, 15 bp, Homo sapiens
agtgaactatatcaa

SEQ ID NO: 279083 - DNA, 15 bp, Homo sapiens
aagtgaactatatca

SEQ ID NO: 279084 - DNA, 15 bp, Homo sapiens
aaagtgaactatatc

SEQ ID NO: 279085 - DNA, 15 bp, Homo sapiens
aaaagtgaactatat

SEQ ID NO: 279086 - DNA, 15 bp, Homo sapiens
gaaaagtgaactata

SEQ ID NO: 279087 - DNA, 15 bp, Homo sapiens
cgaaaagtgaactat

SEQ ID NO: 279088 - DNA, 15 bp, Homo sapiens
ccgaaaagtgaacta

SEQ ID NO: 279089 - DNA, 15 bp, Homo sapiens
gccgaaaagtgaact

SEQ ID NO: 279090 - DNA, 15 bp, Homo sapiens
agccgaaaagtgaac

SEQ ID NO: 279091 - DNA, 15 bp, Homo sapiens
cagccgaaaagtgaa

SEQ ID NO: 279092 - DNA, 15 bp, Homo sapiens
tcagccgaaaagtga

SEQ ID NO: 279093 - DNA, 15 bp, Homo sapiens
ctcagccgaaaagtg

SEQ ID NO: 279094 - DNA, 15 bp, Homo sapiens
gctcagccgaaaagt

SEQ ID NO: 279095 - DNA, 15 bp, Homo sapiens
ggctcagccgaaaag

SEQ ID NO: 279096 - DNA, 15 bp, Homo sapiens
gggctcagccgaaaa

SEQ ID NO: 279097 - DNA, 15 bp, Homo sapiens
agggctcagccgaaa

SEQ ID NO: 279098 - DNA, 15 bp, Homo sapiens
aagggctcagccgaa

SEQ ID NO: 279099 - DNA, 15 bp, Homo sapiens
aaagggctcagccga

SEQ ID NO: 279100 - DNA, 15 bp, Homo sapiens
gaaagggctcagccg

SEQ ID NO: 279101 - DNA, 15 bp, Homo sapiens
agaaagggctcagcc

SEQ ID NO: 279102 - DNA, 15 bp, Homo sapiens
tagaaagggctcagc

SEQ ID NO: 279103 - DNA, 15 bp, Homo sapiens
ctagaaagggctcag

SEQ ID NO: 279104 - DNA, 15 bp, Homo sapiens
actagaaagggctca

SEQ ID NO: 279105 - DNA, 15 bp, Homo sapiens
tactagaaagggctc

SEQ ID NO: 279106 - DNA, 15 bp, Homo sapiens
gtactagaaagggct

SEQ ID NO: 279107 - DNA, 15 bp, Homo sapiens
tgtactagaaagggc

SEQ ID NO: 279108 - DNA, 15 bp, Homo sapiens
ctgtactagaaaggg

SEQ ID NO: 279109 - DNA, 15 bp, Homo sapiens
cctgtactagaaagg

SEQ ID NO: 279110 - DNA, 15 bp, Homo sapiens
ccctgtactagaaag

SEQ ID NO: 279111 - DNA, 15 bp, Homo sapiens
gccctgtactagaaa

SEQ ID NO: 279112 - DNA, 15 bp, Homo sapiens
ggccctgtactagaa

SEQ ID NO: 279113 - DNA, 15 bp, Homo sapiens
cggccctgtactaga

SEQ ID NO: 279114 - DNA, 15 bp, Homo sapiens
gcggccctgtactag

SEQ ID NO: 279115 - DNA, 15 bp, Homo sapiens
agcggccctgtacta

SEQ ID NO: 279116 - DNA, 15 bp, Homo sapiens
aagcggccctgtact

SEQ ID NO: 279117 - DNA, 15 bp, Homo sapiens
taagcggccctgtac

SEQ ID NO: 279118 - DNA, 15 bp, Homo sapiens
ttaagcggccctgta

SEQ ID NO: 279119 - DNA, 15 bp, Homo sapiens
attaagcggccctgt

SEQ ID NO: 279120 - DNA, 15 bp, Homo sapiens
gattaagcggccctg

SEQ ID NO: 279121 - DNA, 15 bp, Homo sapiens
agattaagcggccct

SEQ ID NO: 279122 - DNA, 15 bp, Homo sapiens
aagattaagcggccc

SEQ ID NO: 279123 - DNA, 15 bp, Homo sapiens
gaagattaagcggcc

SEQ ID NO: 279124 - DNA, 15 bp, Homo sapiens
agaagattaagcggc

SEQ ID NO: 279125 - DNA, 15 bp, Homo sapiens
cagaagattaagcgg

SEQ ID NO: 279126 - DNA, 15 bp, Homo sapiens
ccagaagattaagcg

SEQ ID NO: 279127 - DNA, 15 bp, Homo sapiens
accagaagattaagc

SEQ ID NO: 279128 - DNA, 15 bp, Homo sapiens
caccagaagattaag

SEQ ID NO: 279129 - DNA, 15 bp, Homo sapiens
acaccagaagattaa

SEQ ID NO: 279130 - DNA, 15 bp, Homo sapiens
tacaccagaagatta

SEQ ID NO: 279131 - DNA, 15 bp, Homo sapiens
ttacaccagaagatt

SEQ ID NO: 279132 - DNA, 15 bp, Homo sapiens
gttacaccagaagat

SEQ ID NO: 279133 - DNA, 15 bp, Homo sapiens
tgttacaccagaaga

SEQ ID NO: 279134 - DNA, 15 bp, Homo sapiens
ttgttacaccagaag

SEQ ID NO: 279135 - DNA, 15 bp, Homo sapiens
attgttacaccagaa

SEQ ID NO: 279136 - DNA, 15 bp, Homo sapiens
aattgttacaccaga

SEQ ID NO: 279137 - DNA, 15 bp, Homo sapiens
aaattgttacaccag

SEQ ID NO: 279138 - DNA, 15 bp, Homo sapiens
taaattgttacacca

SEQ ID NO: 279139 - DNA, 15 bp, Homo sapiens
ataaattgttacacc

SEQ ID NO: 279140 - DNA, 15 bp, Homo sapiens
cataaattgttacac

SEQ ID NO: 279141 - DNA, 15 bp, Homo sapiens
acataaattgttaca

SEQ ID NO: 279142 - DNA, 15 bp, Homo sapiens
cacataaattgttac

SEQ ID NO: 279143 - DNA, 15 bp, Homo sapiens
tcacataaattgtta

SEQ ID NO: 279144 - DNA, 15 bp, Homo sapiens
ctcacataaattgtt

SEQ ID NO: 279145 - DNA, 15 bp, Homo sapiens
actcacataaattgt

SEQ ID NO: 279146 - DNA, 15 bp, Homo sapiens
cactcacataaattg

SEQ ID NO: 279147 - DNA, 15 bp, Homo sapiens
ccactcacataaatt

SEQ ID NO: 279148 - DNA, 15 bp, Homo sapiens
cccactcacataaat

SEQ ID NO: 279149 - DNA, 15 bp, Homo sapiens
acccactcacataaa

SEQ ID NO: 279150 - DNA, 15 bp, Homo sapiens
tacccactcacataa

SEQ ID NO: 279151 - DNA, 15 bp, Homo sapiens
ttacccactcacata

SEQ ID NO: 279152 - DNA, 15 bp, Homo sapiens
attacccactcacat

SEQ ID NO: 279153 - DNA, 15 bp, Homo sapiens
tattacccactcaca

SEQ ID NO: 279154 - DNA, 15 bp, Homo sapiens
ttattacccactcac

SEQ ID NO: 279155 - DNA, 15 bp, Homo sapiens
tttattacccactca

SEQ ID NO: 279156 - DNA, 15 bp, Homo sapiens
ttttattacccactc

SEQ ID NO: 279157 - DNA, 15 bp, Homo sapiens
tttttattacccact

SEQ ID NO: 279158 - DNA, 15 bp, Homo sapiens
ttttttattacccac

SEQ ID NO: 279159 - DNA, 15 bp, Homo sapiens
cttttttattaccca

SEQ ID NO: 279160 - DNA, 15 bp, Homo sapiens
acttttttattaccc

SEQ ID NO: 279161 - DNA, 15 bp, Homo sapiens
aacttttttattacc

SEQ ID NO: 279162 - DNA, 15 bp, Homo sapiens
aaacttttttattac

SEQ ID NO: 279163 - DNA, 15 bp, Homo sapiens
caaacttttttatta

SEQ ID NO: 279164 - DNA, 15 bp, Homo sapiens
tcaaacttttttatt

SEQ ID NO: 279165 - DNA, 15 bp, Homo sapiens
atcaaacttttttat

SEQ ID NO: 279166 - DNA, 15 bp, Homo sapiens
aatcaaactttttta

SEQ ID NO: 279167 - DNA, 15 bp, Homo sapiens
aaatcaaactttttt

SEQ ID NO: 279168 - DNA, 15 bp, Homo sapiens
aaaatcaaacttttt

SEQ ID NO: 279169 - DNA, 15 bp, Homo sapiens
caaaatcaaactttt

SEQ ID NO: 279170 - DNA, 15 bp, Homo sapiens
acaaaatcaaacttt

SEQ ID NO: 279171 - DNA, 15 bp, Homo sapiens
aacaaaatcaaactt

SEQ ID NO: 279172 - DNA, 15 bp, Homo sapiens
aaacaaaatcaaact

SEQ ID NO: 279173 - DNA, 15 bp, Homo sapiens
taaacaaaatcaaac

SEQ ID NO: 279174 - DNA, 15 bp, Homo sapiens
ataaacaaaatcaaa

SEQ ID NO: 279175 - DNA, 15 bp, Homo sapiens
aataaacaaaatcaa

SEQ ID NO: 279176 - DNA, 15 bp, Homo sapiens
gaataaacaaaatca

SEQ ID NO: 279177 - DNA, 15 bp, Homo sapiens
agaataaacaaaatc

SEQ ID NO: 279178 - DNA, 15 bp, Homo sapiens
gagaataaacaaaat

SEQ ID NO: 279179 - DNA, 15 bp, Homo sapiens
ggagaataaacaaaa

SEQ ID NO: 279180 - DNA, 15 bp, Homo sapiens
aggagaataaacaaa

SEQ ID NO: 279181 - DNA, 15 bp, Homo sapiens
taggagaataaacaa

SEQ ID NO: 279182 - DNA, 15 bp, Homo sapiens
ataggagaataaaca

SEQ ID NO: 279183 - DNA, 15 bp, Homo sapiens
aataggagaataaac

SEQ ID NO: 279184 - DNA, 15 bp, Homo sapiens
aaataggagaataaa

SEQ ID NO: 279185 - DNA, 15 bp, Homo sapiens
caaataggagaataa

SEQ ID NO: 279186 - DNA, 15 bp, Homo sapiens
acaaataggagaata

SEQ ID NO: 279187 - DNA, 15 bp, Homo sapiens
cacaaataggagaat

SEQ ID NO: 279188 - DNA, 15 bp, Homo sapiens
ccacaaataggagaa

SEQ ID NO: 279189 - DNA, 15 bp, Homo sapiens
cccacaaataggaga

SEQ ID NO: 279190 - DNA, 15 bp, Homo sapiens
tcccacaaataggag

SEQ ID NO: 279191 - DNA, 15 bp, Homo sapiens
ctcccacaaatagga

SEQ ID NO: 279192 - DNA, 15 bp, Homo sapiens
cctcccacaaatagg

SEQ ID NO: 279193 - DNA, 15 bp, Homo sapiens
tcctcccacaaatag

SEQ ID NO: 279194 - DNA, 15 bp, Homo sapiens
ctcctcccacaaata

SEQ ID NO: 279195 - DNA, 15 bp, Homo sapiens
tctcctcccacaaat

SEQ ID NO: 279196 - DNA, 15 bp, Homo sapiens
ttctcctcccacaaa

SEQ ID NO: 279197 - DNA, 15 bp, Homo sapiens
gttctcctcccacaa

SEQ ID NO: 279198 - DNA, 15 bp, Homo sapiens
tgttctcctcccaca

SEQ ID NO: 279199 - DNA, 15 bp, Homo sapiens
atgttctcctcccac

SEQ ID NO: 279200 - DNA, 15 bp, Homo sapiens
aatgttctcctccca

SEQ ID NO: 279201 - DNA, 15 bp, Homo sapiens
caatgttctcctccc

SEQ ID NO: 279202 - DNA, 15 bp, Homo sapiens
ccaatgttctcctcc

SEQ ID NO: 279203 - DNA, 15 bp, Homo sapiens
tccaatgttctcctc

SEQ ID NO: 279204 - DNA, 15 bp, Homo sapiens
ctccaatgttctcct

SEQ ID NO: 279205 - DNA, 15 bp, Homo sapiens
tctccaatgttctcc

SEQ ID NO: 279206 - DNA, 15 bp, Homo sapiens
ttctccaatgttctc

SEQ ID NO: 279207 - DNA, 15 bp, Homo sapiens
tttctccaatgttct

SEQ ID NO: 279208 - DNA, 15 bp, Homo sapiens
ttttctccaatgttc

SEQ ID NO: 279209 - DNA, 15 bp, Homo sapiens
tttttctccaatgtt

SEQ ID NO: 279210 - DNA, 15 bp, Homo sapiens
gtttttctccaatgt

SEQ ID NO: 279211 - DNA, 15 bp, Homo sapiens
ggtttttctccaatg

SEQ ID NO: 279212 - DNA, 15 bp, Homo sapiens
tggtttttctccaat

SEQ ID NO: 279213 - DNA, 15 bp, Homo sapiens
ctggtttttctccaa

SEQ ID NO: 279214 - DNA, 15 bp, Homo sapiens
gctggtttttctcca

SEQ ID NO: 279215 - DNA, 15 bp, Homo sapiens
cgctggtttttctcc

SEQ ID NO: 279216 - DNA, 15 bp, Homo sapiens
tcgctggtttttctc

SEQ ID NO: 279217 - DNA, 15 bp, Homo sapiens
ttcgctggtttttct

SEQ ID NO: 279218 - DNA, 15 bp, Homo sapiens
cttcgctggtttttc

SEQ ID NO: 279219 - DNA, 15 bp, Homo sapiens
acttcgctggttttt

SEQ ID NO: 279220 - DNA, 15 bp, Homo sapiens
cacttcgctggtttt

SEQ ID NO: 279221 - DNA, 15 bp, Homo sapiens
ccacttcgctggttt

SEQ ID NO: 279222 - DNA, 15 bp, Homo sapiens
gccacttcgctggtt

SEQ ID NO: 279223 - DNA, 15 bp, Homo sapiens
tgccacttcgctggt

SEQ ID NO: 279224 - DNA, 15 bp, Homo sapiens
ttgccacttcgctgg

SEQ ID NO: 279225 - DNA, 15 bp, Homo sapiens
tttgccacttcgctg

SEQ ID NO: 279226 - DNA, 15 bp, Homo sapiens
atttgccacttcgct

SEQ ID NO: 279227 - DNA, 15 bp, Homo sapiens
catttgccacttcgc

SEQ ID NO: 279228 - DNA, 15 bp, Homo sapiens
acatttgccacttcg

SEQ ID NO: 279229 - DNA, 15 bp, Homo sapiens
cacatttgccacttc

SEQ ID NO: 279230 - DNA, 15 bp, Homo sapiens
acacatttgccactt

SEQ ID NO: 279231 - DNA, 15 bp, Homo sapiens
aacacatttgccact

SEQ ID NO: 279232 - DNA, 15 bp, Homo sapiens
caacacatttgccac

SEQ ID NO: 279233 - DNA, 15 bp, Homo sapiens
tcaacacatttgcca

SEQ ID NO: 279234 - DNA, 15 bp, Homo sapiens
ttcaacacatttgcc

SEQ ID NO: 279235 - DNA, 15 bp, Homo sapiens
cttcaacacatttgc

SEQ ID NO: 279236 - DNA, 15 bp, Homo sapiens
acttcaacacatttg

SEQ ID NO: 279237 - DNA, 15 bp, Homo sapiens
aacttcaacacattt

SEQ ID NO: 279238 - DNA, 15 bp, Homo sapiens
taacttcaacacatt

SEQ ID NO: 279239 - DNA, 15 bp, Homo sapiens
ataacttcaacacat

SEQ ID NO: 279240 - DNA, 15 bp, Homo sapiens
aataacttcaacaca

SEQ ID NO: 279241 - DNA, 15 bp, Homo sapiens
aaataacttcaacac

SEQ ID NO: 279242 - DNA, 15 bp, Homo sapiens
taaataacttcaaca

SEQ ID NO: 279243 - DNA, 15 bp, Homo sapiens
ataaataacttcaac

SEQ ID NO: 279244 - DNA, 15 bp, Homo sapiens
cataaataacttcaa

SEQ ID NO: 279245 - DNA, 15 bp, Homo sapiens
tcataaataacttca

SEQ ID NO: 279246 - DNA, 15 bp, Homo sapiens
ttcataaataacttc

SEQ ID NO: 279247 - DNA, 15 bp, Homo sapiens
cttcataaataactt

SEQ ID NO: 279248 - DNA, 15 bp, Homo sapiens
gcttcataaataact

SEQ ID NO: 279249 - DNA, 15 bp, Homo sapiens
agcttcataaataac

SEQ ID NO: 279250 - DNA, 15 bp, Homo sapiens
tagcttcataaataa

SEQ ID NO: 279251 - DNA, 15 bp, Homo sapiens
ttagcttcataaata

SEQ ID NO: 279252 - DNA, 15 bp, Homo sapiens
attagcttcataaat

SEQ ID NO: 279253 - DNA, 15 bp, Homo sapiens
aattagcttcataaa

SEQ ID NO: 279254 - DNA, 15 bp, Homo sapiens
taattagcttcataa

SEQ ID NO: 279255 - DNA, 15 bp, Homo sapiens
ctaattagcttcata

SEQ ID NO: 279256 - DNA, 15 bp, Homo sapiens
tctaattagcttcat

SEQ ID NO: 279257 - DNA, 15 bp, Homo sapiens
ttctaattagcttca

SEQ ID NO: 279258 - DNA, 15 bp, Homo sapiens
attctaattagcttc

SEQ ID NO: 279259 - DNA, 15 bp, Homo sapiens
aattctaattagctt

SEQ ID NO: 279260 - DNA, 15 bp, Homo sapiens
aaattctaattagct

SEQ ID NO: 279261 - DNA, 15 bp, Homo sapiens
aaaattctaattagc

SEQ ID NO: 279262 - DNA, 15 bp, Homo sapiens
gaaaattctaattag

SEQ ID NO: 279263 - DNA, 15 bp, Homo sapiens
agaaaattctaatta

SEQ ID NO: 279264 - DNA, 15 bp, Homo sapiens
aagaaaattctaatt

SEQ ID NO: 279265 - DNA, 15 bp, Homo sapiens
aaagaaaattctaat

SEQ ID NO: 279266 - DNA, 15 bp, Homo sapiens
aaaagaaaattctaa

SEQ ID NO: 279267 - DNA, 15 bp, Homo sapiens
caaaagaaaattcta

SEQ ID NO: 279268 - DNA, 15 bp, Homo sapiens
gcaaaagaaaattct

SEQ ID NO: 279269 - DNA, 15 bp, Homo sapiens
agcaaaagaaaattc

SEQ ID NO: 279270 - DNA, 15 bp, Homo sapiens
aagcaaaagaaaatt

SEQ ID NO: 279271 - DNA, 15 bp, Homo sapiens
gaagcaaaagaaaat

SEQ ID NO: 279272 - DNA, 15 bp, Homo sapiens
agaagcaaaagaaaa

SEQ ID NO: 279273 - DNA, 15 bp, Homo sapiens
aagaagcaaaagaaa

SEQ ID NO: 279274 - DNA, 15 bp, Homo sapiens
aaagaagcaaaagaa

SEQ ID NO: 279275 - DNA, 15 bp, Homo sapiens
gaaagaagcaaaaga

SEQ ID NO: 279276 - DNA, 15 bp, Homo sapiens
agaaagaagcaaaag

SEQ ID NO: 279277 - DNA, 15 bp, Homo sapiens
aagaaagaagcaaaa

SEQ ID NO: 279278 - DNA, 15 bp, Homo sapiens
aaagaaagaagcaaa

SEQ ID NO: 279279 - DNA, 15 bp, Homo sapiens
aaaagaaagaagcaa

SEQ ID NO: 279280 - DNA, 15 bp, Homo sapiens
aaaaagaaagaagca

SEQ ID NO: 279281 - DNA, 15 bp, Homo sapiens
gaaaaagaaagaagc

SEQ ID NO: 279282 - DNA, 15 bp, Homo sapiens
tgaaaaagaaagaag

SEQ ID NO: 279283 - DNA, 15 bp, Homo sapiens
atgaaaaagaaagaa

SEQ ID NO: 279284 - DNA, 15 bp, Homo sapiens
gatgaaaaagaaaga

SEQ ID NO: 279285 - DNA, 15 bp, Homo sapiens
ggatgaaaaagaaag

SEQ ID NO: 279286 - DNA, 15 bp, Homo sapiens
aggatgaaaaagaaa

SEQ ID NO: 279287 - DNA, 15 bp, Homo sapiens
aaggatgaaaaagaa

SEQ ID NO: 279288 - DNA, 15 bp, Homo sapiens
caaggatgaaaaaga

SEQ ID NO: 279289 - DNA, 15 bp, Homo sapiens
gcaaggatgaaaaag

SEQ ID NO: 279290 - DNA, 15 bp, Homo sapiens
tgcaaggatgaaaaa

SEQ ID NO: 279291 - DNA, 15 bp, Homo sapiens
ttgcaaggatgaaaa

SEQ ID NO: 279292 - DNA, 15 bp, Homo sapiens
tttgcaaggatgaaa

SEQ ID NO: 279293 - DNA, 15 bp, Homo sapiens
ttttgcaaggatgaa

SEQ ID NO: 279294 - DNA, 15 bp, Homo sapiens
attttgcaaggatga

SEQ ID NO: 279295 - DNA, 15 bp, Homo sapiens
cattttgcaaggatg

SEQ ID NO: 279296 - DNA, 15 bp, Homo sapiens
acattttgcaaggat

SEQ ID NO: 279297 - DNA, 15 bp, Homo sapiens
tacattttgcaagga

SEQ ID NO: 279298 - DNA, 15 bp, Homo sapiens
ctacattttgcaagg

SEQ ID NO: 279299 - DNA, 15 bp, Homo sapiens
gctacattttgcaag

SEQ ID NO: 279300 - DNA, 15 bp, Homo sapiens
tgctacattttgcaa

SEQ ID NO: 279301 - DNA, 15 bp, Homo sapiens
atgctacattttgca

SEQ ID NO: 279302 - DNA, 15 bp, Homo sapiens
aatgctacattttgc

SEQ ID NO: 279303 - DNA, 15 bp, Homo sapiens
aaaatgctacatttt

SEQ ID NO: 279304 - DNA, 15 bp, Homo sapiens
caaaatgctacattt

SEQ ID NO: 279305 - DNA, 15 bp, Homo sapiens
acaaaatgctacatt

SEQ ID NO: 279306 - DNA, 15 bp, Homo sapiens
gacaaaatgctacat

SEQ ID NO: 279307 - DNA, 15 bp, Homo sapiens
ggacaaaatgctaca

SEQ ID NO: 279308 - DNA, 15 bp, Homo sapiens
ggttcttgctaactt

SEQ ID NO: 279309 - DNA, 15 bp, Homo sapiens
tggttcttgctaact

SEQ ID NO: 279310 - DNA, 15 bp, Homo sapiens
ctggttcttgctaac

SEQ ID NO: 279311 - DNA, 15 bp, Homo sapiens
actggttcttgctaa

SEQ ID NO: 279312 - DNA, 15 bp, Homo sapiens
gactggttcttgcta

SEQ ID NO: 279313 - DNA, 15 bp, Homo sapiens
tgactggttcttgct

SEQ ID NO: 279314 - DNA, 15 bp, Homo sapiens
ttgactggttcttgc

SEQ ID NO: 279315 - DNA, 15 bp, Homo sapiens
cttgactggttcttg

SEQ ID NO: 279316 - DNA, 15 bp, Homo sapiens
gcttgactggttctt

SEQ ID NO: 279317 - DNA, 15 bp, Homo sapiens
tgcttgactggttct

SEQ ID NO: 279318 - DNA, 15 bp, Homo sapiens
ttgcttgactggttc

SEQ ID NO: 279319 - DNA, 15 bp, Homo sapiens
attgcttgactggtt

SEQ ID NO: 279320 - DNA, 15 bp, Homo sapiens
aattgcttgactggt

SEQ ID NO: 279321 - DNA, 15 bp, Homo sapiens
aaattgcttgactgg

SEQ ID NO: 279322 - DNA, 15 bp, Homo sapiens
caaattgcttgactg

SEQ ID NO: 279323 - DNA, 15 bp, Homo sapiens
tcaaattgcttgact

SEQ ID NO: 279324 - DNA, 15 bp, Homo sapiens
gtcaaattgcttgac

SEQ ID NO: 279325 - DNA, 15 bp, Homo sapiens
tgtcaaattgcttga

SEQ ID NO: 279326 - DNA, 15 bp, Homo sapiens
ctgtcaaattgcttg

SEQ ID NO: 279327 - DNA, 15 bp, Homo sapiens
tctgtcaaattgctt

SEQ ID NO: 279328 - DNA, 15 bp, Homo sapiens
ctctgtcaaattgct

SEQ ID NO: 279329 - DNA, 15 bp, Homo sapiens
gctctgtcaaattgc

SEQ ID NO: 279330 - DNA, 15 bp, Homo sapiens
agctctgtcaaattg

SEQ ID NO: 279331 - DNA, 15 bp, Homo sapiens
aagctctgtcaaatt

SEQ ID NO: 279332 - DNA, 15 bp, Homo sapiens
aaagctctgtcaaat

SEQ ID NO: 279333 - DNA, 15 bp, Homo sapiens
gaaagctctgtcaaa

SEQ ID NO: 279334 - DNA, 15 bp, Homo sapiens
ggaaagctctgtcaa

SEQ ID NO: 279335 - DNA, 15 bp, Homo sapiens
gggaaagctctgtca

SEQ ID NO: 279336 - DNA, 15 bp, Homo sapiens
tgggaaagctctgtc

SEQ ID NO: 279337 - DNA, 15 bp, Homo sapiens
ttgggaaagctctgt

SEQ ID NO: 279338 - DNA, 15 bp, Homo sapiens
cttgggaaagctctg

SEQ ID NO: 279339 - DNA, 15 bp, Homo sapiens
ccttgggaaagctct

SEQ ID NO: 279340 - DNA, 15 bp, Homo sapiens
accttgggaaagctc

SEQ ID NO: 279341 - DNA, 15 bp, Homo sapiens
aaccttgggaaagct

SEQ ID NO: 279342 - DNA, 15 bp, Homo sapiens
caaccttgggaaagc

SEQ ID NO: 279343 - DNA, 15 bp, Homo sapiens
tcaaccttgggaaag

SEQ ID NO: 279344 - DNA, 15 bp, Homo sapiens
atcaaccttgggaaa

SEQ ID NO: 279345 - DNA, 15 bp, Homo sapiens
aatcaaccttgggaa

SEQ ID NO: 279346 - DNA, 15 bp, Homo sapiens
taatcaaccttggga

SEQ ID NO: 279347 - DNA, 15 bp, Homo sapiens
ttaatcaaccttggg

SEQ ID NO: 279348 - DNA, 15 bp, Homo sapiens
cttaatcaaccttgg

SEQ ID NO: 279349 - DNA, 15 bp, Homo sapiens
tcttaatcaaccttg

SEQ ID NO: 279350 - DNA, 15 bp, Homo sapiens
gtcttaatcaacctt

SEQ ID NO: 279351 - DNA, 15 bp, Homo sapiens
tgtcttaatcaacct

SEQ ID NO: 279352 - DNA, 15 bp, Homo sapiens
ttgtcttaatcaacc

SEQ ID NO: 279353 - DNA, 15 bp, Homo sapiens
tttgtcttaatcaac

SEQ ID NO: 279354 - DNA, 15 bp, Homo sapiens
ttttgtcttaatcaa

SEQ ID NO: 279355 - DNA, 15 bp, Homo sapiens
tttttgtcttaatca

SEQ ID NO: 279356 - DNA, 15 bp, Homo sapiens
ttttttgtcttaatc

SEQ ID NO: 279357 - DNA, 15 bp, Homo sapiens
tttttttgtcttaat

SEQ ID NO: 279358 - DNA, 15 bp, Homo sapiens
ttttttttgtcttaa

SEQ ID NO: 279359 - DNA, 15 bp, Homo sapiens
attttttttgtctta

SEQ ID NO: 279360 - DNA, 15 bp, Homo sapiens
tattttttttgtctt

SEQ ID NO: 279361 - DNA, 15 bp, Homo sapiens
gtattttttttgtct

SEQ ID NO: 279362 - DNA, 15 bp, Homo sapiens
tgtattttttttgtc

SEQ ID NO: 279363 - DNA, 15 bp, Homo sapiens
gtgtattttttttgt

SEQ ID NO: 279364 - DNA, 15 bp, Homo sapiens
tgtgtattttttttg

SEQ ID NO: 279365 - DNA, 15 bp, Homo sapiens
gtgtgtatttttttt

SEQ ID NO: 279366 - DNA, 15 bp, Homo sapiens
agtgtgtattttttt

SEQ ID NO: 279367 - DNA, 15 bp, Homo sapiens
aagtgtgtatttttt

SEQ ID NO: 279368 - DNA, 15 bp, Homo sapiens
aaagtgtgtattttt

SEQ ID NO: 279369 - DNA, 15 bp, Homo sapiens
aaaagtgtgtatttt

SEQ ID NO: 279370 - DNA, 15 bp, Homo sapiens
gaaaagtgtgtattt

SEQ ID NO: 279371 - DNA, 15 bp, Homo sapiens
agaaaagtgtgtatt

SEQ ID NO: 279372 - DNA, 15 bp, Homo sapiens
aagaaaagtgtgtat

SEQ ID NO: 279373 - DNA, 15 bp, Homo sapiens
gaagaaaagtgtgta

SEQ ID NO: 279374 - DNA, 15 bp, Homo sapiens
agaagaaaagtgtgt

SEQ ID NO: 279375 - DNA, 15 bp, Homo sapiens
tagaagaaaagtgtg

SEQ ID NO: 279376 - DNA, 15 bp, Homo sapiens
atagaagaaaagtgt

SEQ ID NO: 279377 - DNA, 15 bp, Homo sapiens
aatagaagaaaagtg

SEQ ID NO: 279378 - DNA, 15 bp, Homo sapiens
aaatagaagaaaagt

SEQ ID NO: 279379 - DNA, 15 bp, Homo sapiens
caaatagaagaaaag

SEQ ID NO: 279380 - DNA, 15 bp, Homo sapiens
tcaaatagaagaaaa

SEQ ID NO: 279381 - DNA, 15 bp, Homo sapiens
ttcaaatagaagaaa

SEQ ID NO: 279382 - DNA, 15 bp, Homo sapiens
cttcaaatagaagaa

SEQ ID NO: 279383 - DNA, 15 bp, Homo sapiens
acttcaaatagaaga

SEQ ID NO: 279384 - DNA, 15 bp, Homo sapiens
aacttcaaatagaag

SEQ ID NO: 279385 - DNA, 15 bp, Homo sapiens
gaacttcaaatagaa

SEQ ID NO: 279386 - DNA, 15 bp, Homo sapiens
cgaacttcaaataga

SEQ ID NO: 279387 - DNA, 15 bp, Homo sapiens
acgaacttcaaatag

SEQ ID NO: 279388 - DNA, 15 bp, Homo sapiens
cacgaacttcaaata

SEQ ID NO: 279389 - DNA, 15 bp, Homo sapiens
ccacgaacttcaaat

SEQ ID NO: 279390 - DNA, 15 bp, Homo sapiens
gccacgaacttcaaa

SEQ ID NO: 279391 - DNA, 15 bp, Homo sapiens
tgccacgaacttcaa

SEQ ID NO: 279392 - DNA, 15 bp, Homo sapiens
atgccacgaacttca

SEQ ID NO: 279393 - DNA, 15 bp, Homo sapiens
tatgccacgaacttc

SEQ ID NO: 279394 - DNA, 15 bp, Homo sapiens
atatgccacgaactt

SEQ ID NO: 279395 - DNA, 15 bp, Homo sapiens
catatgccacgaact

SEQ ID NO: 279396 - DNA, 15 bp, Homo sapiens
acatatgccacgaac

SEQ ID NO: 279397 - DNA, 15 bp, Homo sapiens
aacatatgccacgaa

SEQ ID NO: 279398 - DNA, 15 bp, Homo sapiens
aaacatatgccacga

SEQ ID NO: 279399 - DNA, 15 bp, Homo sapiens
aaaacatatgccacg

SEQ ID NO: 279400 - DNA, 15 bp, Homo sapiens
caaaacatatgccac

SEQ ID NO: 279401 - DNA, 15 bp, Homo sapiens
gcaaaacatatgcca

SEQ ID NO: 279402 - DNA, 15 bp, Homo sapiens
agcaaaacatatgcc

SEQ ID NO: 279403 - DNA, 15 bp, Homo sapiens
tagcaaaacatatgc

SEQ ID NO: 279404 - DNA, 15 bp, Homo sapiens
gtagcaaaacatatg

SEQ ID NO: 279405 - DNA, 15 bp, Homo sapiens
tgtagcaaaacatat

SEQ ID NO: 279406 - DNA, 15 bp, Homo sapiens
gtgtagcaaaacata

SEQ ID NO: 279407 - DNA, 15 bp, Homo sapiens
agtgtagcaaaacat

SEQ ID NO: 279408 - DNA, 15 bp, Homo sapiens
aagtgtagcaaaaca

SEQ ID NO: 279409 - DNA, 15 bp, Homo sapiens
caagtgtagcaaaac

SEQ ID NO: 279410 - DNA, 15 bp, Homo sapiens
tcaagtgtagcaaaa

SEQ ID NO: 279411 - DNA, 15 bp, Homo sapiens
ttcaagtgtagcaaa

SEQ ID NO: 279412 - DNA, 15 bp, Homo sapiens
attcaagtgtagcaa

SEQ ID NO: 279413 - DNA, 15 bp, Homo sapiens
aattcaagtgtagca

SEQ ID NO: 279414 - DNA, 15 bp, Homo sapiens
aaattcaagtgtagc

SEQ ID NO: 279415 - DNA, 15 bp, Homo sapiens
aaaattcaagtgtag

SEQ ID NO: 279416 - DNA, 15 bp, Homo sapiens
caaaattcaagtgta

SEQ ID NO: 279417 - DNA, 15 bp, Homo sapiens
ccaaaattcaagtgt

SEQ ID NO: 279418 - DNA, 15 bp, Homo sapiens
tccaaaattcaagtg

SEQ ID NO: 279419 - DNA, 15 bp, Homo sapiens
ttccaaaattcaagt

SEQ ID NO: 279420 - DNA, 15 bp, Homo sapiens
tttccaaaattcaag

SEQ ID NO: 279421 - DNA, 15 bp, Homo sapiens
atttccaaaattcaa

SEQ ID NO: 279422 - DNA, 15 bp, Homo sapiens
tatttccaaaattca

SEQ ID NO: 279423 - DNA, 15 bp, Homo sapiens
ttatttccaaaattc

SEQ ID NO: 279424 - DNA, 15 bp, Homo sapiens
attatttccaaaatt

SEQ ID NO: 279425 - DNA, 15 bp, Homo sapiens
gattatttccaaaat

SEQ ID NO: 279426 - DNA, 15 bp, Homo sapiens
agattatttccaaaa

SEQ ID NO: 279427 - DNA, 15 bp, Homo sapiens
gagattatttccaaa

SEQ ID NO: 279428 - DNA, 15 bp, Homo sapiens
agagattatttccaa

SEQ ID NO: 279429 - DNA, 15 bp, Homo sapiens
aagagattatttcca

SEQ ID NO: 279430 - DNA, 15 bp, Homo sapiens
taagagattatttcc

SEQ ID NO: 279431 - DNA, 15 bp, Homo sapiens
ttaagagattatttc

SEQ ID NO: 279432 - DNA, 15 bp, Homo sapiens
cttaagagattattt

SEQ ID NO: 279433 - DNA, 15 bp, Homo sapiens
gcttaagagattatt

SEQ ID NO: 279434 - DNA, 15 bp, Homo sapiens
tgcttaagagattat

SEQ ID NO: 279435 - DNA, 15 bp, Homo sapiens
ctgcttaagagatta

SEQ ID NO: 279436 - DNA, 15 bp, Homo sapiens
actgcttaagagatt

SEQ ID NO: 279437 - DNA, 15 bp, Homo sapiens
aactgcttaagagat

SEQ ID NO: 279438 - DNA, 15 bp, Homo sapiens
taactgcttaagaga

SEQ ID NO: 279439 - DNA, 15 bp, Homo sapiens
gtaactgcttaagag

SEQ ID NO: 279440 - DNA, 15 bp, Homo sapiens
acagtaactgcttaa

SEQ ID NO: 279441 - DNA, 15 bp, Homo sapiens
aacagtaactgctta

SEQ ID NO: 279442 - DNA, 15 bp, Homo sapiens
aaacagtaactgctt

SEQ ID NO: 279443 - DNA, 15 bp, Homo sapiens
aaaacagtaactgct

SEQ ID NO: 279444 - DNA, 15 bp, Homo sapiens
aaaaacagtaactgc

SEQ ID NO: 279445 - DNA, 15 bp, Homo sapiens
taaaaacagtaactg

SEQ ID NO: 279446 - DNA, 15 bp, Homo sapiens
ctaaaaacagtaact

SEQ ID NO: 279447 - DNA, 15 bp, Homo sapiens
tctaaaaacagtaac

SEQ ID NO: 279448 - DNA, 15 bp, Homo sapiens
ttctaaaaacagtaa

SEQ ID NO: 279449 - DNA, 15 bp, Homo sapiens
tttctaaaaacagta

SEQ ID NO: 279450 - DNA, 15 bp, Homo sapiens
ctttctaaaaacagt

SEQ ID NO: 279451 - DNA, 15 bp, Homo sapiens
actttctaaaaacag

SEQ ID NO: 279452 - DNA, 15 bp, Homo sapiens
tactttctaaaaaca

SEQ ID NO: 279453 - DNA, 15 bp, Homo sapiens
atactttctaaaaac

SEQ ID NO: 279454 - DNA, 15 bp, Homo sapiens
tatactttctaaaaa

SEQ ID NO: 279455 - DNA, 15 bp, Homo sapiens
atatactttctaaaa

SEQ ID NO: 279456 - DNA, 15 bp, Homo sapiens
tatatactttctaaa

SEQ ID NO: 279457 - DNA, 15 bp, Homo sapiens
ctatatactttctaa

SEQ ID NO: 279458 - DNA, 15 bp, Homo sapiens
gctatatactttcta

SEQ ID NO: 279459 - DNA, 15 bp, Homo sapiens
tgctatatactttct

SEQ ID NO: 279460 - DNA, 15 bp, Homo sapiens
atgctatatactttc

SEQ ID NO: 279461 - DNA, 15 bp, Homo sapiens
tatgctatatacttt

SEQ ID NO: 279462 - DNA, 15 bp, Homo sapiens
atatgctatatactt

SEQ ID NO: 279463 - DNA, 15 bp, Homo sapiens
gatatgctatatact

SEQ ID NO: 279464 - DNA, 15 bp, Homo sapiens
tgatatgctatatac

SEQ ID NO: 279465 - DNA, 15 bp, Homo sapiens
atgatatgctatata

SEQ ID NO: 279466 - DNA, 15 bp, Homo sapiens
aatgatatgctatat

SEQ ID NO: 279467 - DNA, 15 bp, Homo sapiens
gaatgatatgctata

SEQ ID NO: 279468 - DNA, 15 bp, Homo sapiens
tgaatgatatgctat

SEQ ID NO: 279469 - DNA, 15 bp, Homo sapiens
gtgaatgatatgcta

SEQ ID NO: 279470 - DNA, 15 bp, Homo sapiens
ggtgaatgatatgct

SEQ ID NO: 279471 - DNA, 15 bp, Homo sapiens
aggtgaatgatatgc

SEQ ID NO: 279472 - DNA, 15 bp, Homo sapiens
caggtgaatgatatg

SEQ ID NO: 279473 - DNA, 15 bp, Homo sapiens
tcaggtgaatgatat

SEQ ID NO: 279474 - DNA, 15 bp, Homo sapiens
gtcaggtgaatgata

SEQ ID NO: 279475 - DNA, 15 bp, Homo sapiens
tgtcaggtgaatgat

SEQ ID NO: 279476 - DNA, 15 bp, Homo sapiens
atgtcaggtgaatga

SEQ ID NO: 279477 - DNA, 15 bp, Homo sapiens
aatgtcaggtgaatg

SEQ ID NO: 279478 - DNA, 15 bp, Homo sapiens
aaatgtcaggtgaat

SEQ ID NO: 279479 - DNA, 15 bp, Homo sapiens
taaatgtcaggtgaa

SEQ ID NO: 279480 - DNA, 15 bp, Homo sapiens
ttaaatgtcaggtga

SEQ ID NO: 279481 - DNA, 15 bp, Homo sapiens
gttaaatgtcaggtg

SEQ ID NO: 279482 - DNA, 15 bp, Homo sapiens
tgttaaatgtcaggt

SEQ ID NO: 279483 - DNA, 15 bp, Homo sapiens
atgttaaatgtcagg

SEQ ID NO: 279484 - DNA, 15 bp, Homo sapiens
tatgttaaatgtcag

SEQ ID NO: 279485 - DNA, 15 bp, Homo sapiens
atatgttaaatgtca

SEQ ID NO: 279486 - DNA, 15 bp, Homo sapiens
aatatgttaaatgtc

SEQ ID NO: 279487 - DNA, 15 bp, Homo sapiens
gaatatgttaaatgt

SEQ ID NO: 279488 - DNA, 15 bp, Homo sapiens
tgaatatgttaaatg

SEQ ID NO: 279489 - DNA, 15 bp, Homo sapiens
ctgaatatgttaaat

SEQ ID NO: 279490 - DNA, 15 bp, Homo sapiens
cctgaatatgttaaa

SEQ ID NO: 279491 - DNA, 15 bp, Homo sapiens
ccctgaatatgttaa

SEQ ID NO: 279492 - DNA, 15 bp, Homo sapiens
accctgaatatgtta

SEQ ID NO: 279493 - DNA, 15 bp, Homo sapiens
aaccctgaatatgtt

SEQ ID NO: 279494 - DNA, 15 bp, Homo sapiens
taaccctgaatatgt

SEQ ID NO: 279495 - DNA, 15 bp, Homo sapiens
ttaaccctgaatatg

SEQ ID NO: 279496 - DNA, 15 bp, Homo sapiens
attaaccctgaatat

SEQ ID NO: 279497 - DNA, 15 bp, Homo sapiens
cattaaccctgaata

SEQ ID NO: 279498 - DNA, 15 bp, Homo sapiens
tcattaaccctgaat

SEQ ID NO: 279499 - DNA, 15 bp, Homo sapiens
ttcattaaccctgaa

SEQ ID NO: 279500 - DNA, 15 bp, Homo sapiens
cttcattaaccctga

SEQ ID NO: 279501 - DNA, 15 bp, Homo sapiens
tcttcattaaccctg

SEQ ID NO: 279502 - DNA, 15 bp, Homo sapiens
ttcttcattaaccct

SEQ ID NO: 279503 - DNA, 15 bp, Homo sapiens
gttcttcattaaccc

SEQ ID NO: 279504 - DNA, 15 bp, Homo sapiens
tgttcttcattaacc

SEQ ID NO: 279505 - DNA, 15 bp, Homo sapiens
ctgttcttcattaac

SEQ ID NO: 279506 - DNA, 15 bp, Homo sapiens
actgttcttcattaa

SEQ ID NO: 279507 - DNA, 15 bp, Homo sapiens
cactgttcttcatta

SEQ ID NO: 279508 - DNA, 15 bp, Homo sapiens
tcactgttcttcatt

SEQ ID NO: 279509 - DNA, 15 bp, Homo sapiens
gtcactgttcttcat

SEQ ID NO: 279510 - DNA, 15 bp, Homo sapiens
cgtcactgttcttca

SEQ ID NO: 279511 - DNA, 15 bp, Homo sapiens
acgtcactgttcttc

SEQ ID NO: 279512 - DNA, 15 bp, Homo sapiens
cacgtcactgttctt

SEQ ID NO: 279513 - DNA, 15 bp, Homo sapiens
ccacgtcactgttct

SEQ ID NO: 279514 - DNA, 15 bp, Homo sapiens
tccacgtcactgttc

SEQ ID NO: 279515 - DNA, 15 bp, Homo sapiens
ttccacgtcactgtt

SEQ ID NO: 279516 - DNA, 15 bp, Homo sapiens
tttccacgtcactgt

SEQ ID NO: 279517 - DNA, 15 bp, Homo sapiens
atttccacgtcactg

SEQ ID NO: 279518 - DNA, 15 bp, Homo sapiens
tatttccacgtcact

SEQ ID NO: 279519 - DNA, 15 bp, Homo sapiens
ctatttccacgtcac

SEQ ID NO: 279520 - DNA, 15 bp, Homo sapiens
actatttccacgtca

SEQ ID NO: 279521 - DNA, 15 bp, Homo sapiens
tactatttccacgtc

SEQ ID NO: 279522 - DNA, 15 bp, Homo sapiens
atactatttccacgt

SEQ ID NO: 279523 - DNA, 15 bp, Homo sapiens
aatactatttccacg

SEQ ID NO: 279524 - DNA, 15 bp, Homo sapiens
caatactatttccac

SEQ ID NO: 279525 - DNA, 15 bp, Homo sapiens
tcaatactatttcca

SEQ ID NO: 279526 - DNA, 15 bp, Homo sapiens
gtcaatactatttcc

SEQ ID NO: 279527 - DNA, 15 bp, Homo sapiens
agtcaatactatttc

SEQ ID NO: 279528 - DNA, 15 bp, Homo sapiens
tagtcaatactattt

SEQ ID NO: 279529 - DNA, 15 bp, Homo sapiens
ttagtcaatactatt

SEQ ID NO: 279530 - DNA, 15 bp, Homo sapiens
attagtcaatactat

SEQ ID NO: 279531 - DNA, 15 bp, Homo sapiens
tattagtcaatacta

SEQ ID NO: 279532 - DNA, 15 bp, Homo sapiens
gtattagtcaatact

SEQ ID NO: 279533 - DNA, 15 bp, Homo sapiens
agtattagtcaatac

SEQ ID NO: 279534 - DNA, 15 bp, Homo sapiens
tagtattagtcaata

SEQ ID NO: 279535 - DNA, 15 bp, Homo sapiens
atagtattagtcaat

SEQ ID NO: 279536 - DNA, 15 bp, Homo sapiens
catagtattagtcaa

SEQ ID NO: 279537 - DNA, 15 bp, Homo sapiens
acatagtattagtca

SEQ ID NO: 279538 - DNA, 15 bp, Homo sapiens
aacatagtattagtc

SEQ ID NO: 279539 - DNA, 15 bp, Homo sapiens
caacatagtattagt

SEQ ID NO: 279540 - DNA, 15 bp, Homo sapiens
acaacatagtattag

SEQ ID NO: 279541 - DNA, 15 bp, Homo sapiens
aacaacatagtatta

SEQ ID NO: 279542 - DNA, 15 bp, Homo sapiens
aaacaacatagtatt

SEQ ID NO: 279543 - DNA, 15 bp, Homo sapiens
aaaacaacatagtat

SEQ ID NO: 279544 - DNA, 15 bp, Homo sapiens
taaaacaacatagta

SEQ ID NO: 279545 - DNA, 15 bp, Homo sapiens
ataaaacaacatagt

SEQ ID NO: 279546 - DNA, 15 bp, Homo sapiens
aataaaacaacatag

SEQ ID NO: 279547 - DNA, 15 bp, Homo sapiens
caataaaacaacata

SEQ ID NO: 279548 - DNA, 15 bp, Homo sapiens
acaataaaacaacat

SEQ ID NO: 279549 - DNA, 15 bp, Homo sapiens
aacaataaaacaaca

SEQ ID NO: 279550 - DNA, 15 bp, Homo sapiens
taacaataaaacaac

SEQ ID NO: 279551 - DNA, 15 bp, Homo sapiens
ataacaataaaacaa

SEQ ID NO: 279552 - DNA, 15 bp, Homo sapiens
aataacaataaaaca

SEQ ID NO: 279553 - DNA, 15 bp, Homo sapiens
caataacaataaaac

SEQ ID NO: 279554 - DNA, 15 bp, Homo sapiens
acaataacaataaaa

SEQ ID NO: 279555 - DNA, 15 bp, Homo sapiens
tacaataacaataaa

SEQ ID NO: 279556 - DNA, 15 bp, Homo sapiens
atacaataacaataa

SEQ ID NO: 279557 - DNA, 15 bp, Homo sapiens
gatacaataacaata

SEQ ID NO: 279558 - DNA, 15 bp, Homo sapiens
agatacaataacaat

SEQ ID NO: 279559 - DNA, 15 bp, Homo sapiens
tagatacaataacaa

SEQ ID NO: 279560 - DNA, 15 bp, Homo sapiens
atagatacaataaca

SEQ ID NO: 279561 - DNA, 15 bp, Homo sapiens
aatagatacaataac

SEQ ID NO: 279562 - DNA, 15 bp, Homo sapiens
aaatagatacaataa

SEQ ID NO: 279563 - DNA, 15 bp, Homo sapiens
aaaatagatacaata

SEQ ID NO: 279564 - DNA, 15 bp, Homo sapiens
taaaatagatacaat

SEQ ID NO: 279565 - DNA, 15 bp, Homo sapiens
gtaaaatagatacaa

SEQ ID NO: 279566 - DNA, 15 bp, Homo sapiens
tgtaaaatagataca

SEQ ID NO: 279567 - DNA, 15 bp, Homo sapiens
gtgtaaaatagatac

SEQ ID NO: 279568 - DNA, 15 bp, Homo sapiens
tgtgtaaaatagata

SEQ ID NO: 279569 - DNA, 15 bp, Homo sapiens
atgtgtaaaatagat

SEQ ID NO: 279570 - DNA, 15 bp, Homo sapiens
tatgtgtaaaataga

SEQ ID NO: 279571 - DNA, 15 bp, Homo sapiens
atatgtgtaaaatag

SEQ ID NO: 279572 - DNA, 15 bp, Homo sapiens
catatgtgtaaaata

SEQ ID NO: 279573 - DNA, 15 bp, Homo sapiens
acatatgtgtaaaat

SEQ ID NO: 279574 - DNA, 15 bp, Homo sapiens
tacatatgtgtaaaa

SEQ ID NO: 279575 - DNA, 15 bp, Homo sapiens
ttacatatgtgtaaa

SEQ ID NO: 279576 - DNA, 15 bp, Homo sapiens
tttacatatgtgtaa

SEQ ID NO: 279577 - DNA, 15 bp, Homo sapiens
atttacatatgtgta

SEQ ID NO: 279578 - DNA, 15 bp, Homo sapiens
aatttacatatgtgt

SEQ ID NO: 279579 - DNA, 15 bp, Homo sapiens
taatttacatatgtg

SEQ ID NO: 279580 - DNA, 15 bp, Homo sapiens
ttaatttacatatgt

SEQ ID NO: 279581 - DNA, 15 bp, Homo sapiens
cttaatttacatatg

SEQ ID NO: 279582 - DNA, 15 bp, Homo sapiens
acttaatttacatat

SEQ ID NO: 279583 - DNA, 15 bp, Homo sapiens
aacttaatttacata

SEQ ID NO: 279584 - DNA, 15 bp, Homo sapiens
aaacttaatttacat

SEQ ID NO: 279585 - DNA, 15 bp, Homo sapiens
taaacttaatttaca

SEQ ID NO: 279586 - DNA, 15 bp, Homo sapiens
gtaaacttaatttac

SEQ ID NO: 279587 - DNA, 15 bp, Homo sapiens
agtaaacttaattta

SEQ ID NO: 279588 - DNA, 15 bp, Homo sapiens
cagtaaacttaattt

SEQ ID NO: 279589 - DNA, 15 bp, Homo sapiens
tcagtaaacttaatt

SEQ ID NO: 279590 - DNA, 15 bp, Homo sapiens
gtcagtaaacttaat

SEQ ID NO: 279591 - DNA, 15 bp, Homo sapiens
tgtcagtaaacttaa

SEQ ID NO: 279592 - DNA, 15 bp, Homo sapiens
ctgtcagtaaactta

SEQ ID NO: 279593 - DNA, 15 bp, Homo sapiens
actgtcagtaaactt

SEQ ID NO: 279594 - DNA, 15 bp, Homo sapiens
tactgtcagtaaact

SEQ ID NO: 279595 - DNA, 15 bp, Homo sapiens
atactgtcagtaaac

SEQ ID NO: 279596 - DNA, 15 bp, Homo sapiens
tatactgtcagtaaa

SEQ ID NO: 279597 - DNA, 15 bp, Homo sapiens
ctatactgtcagtaa

SEQ ID NO: 279598 - DNA, 15 bp, Homo sapiens
tctatactgtcagta

SEQ ID NO: 279599 - DNA, 15 bp, Homo sapiens
atctatactgtcagt

SEQ ID NO: 279600 - DNA, 15 bp, Homo sapiens
tatctatactgtcag

SEQ ID NO: 279601 - DNA, 15 bp, Homo sapiens
atatctatactgtca

SEQ ID NO: 279602 - DNA, 15 bp, Homo sapiens
aatatctatactgtc

SEQ ID NO: 279603 - DNA, 15 bp, Homo sapiens
gaatatctatactgt

SEQ ID NO: 279604 - DNA, 15 bp, Homo sapiens
cagaatatctatact

SEQ ID NO: 279605 - DNA, 15 bp, Homo sapiens
tcagaatatctatac

SEQ ID NO: 279606 - DNA, 15 bp, Homo sapiens
gtcagaatatctata

SEQ ID NO: 279607 - DNA, 15 bp, Homo sapiens
tgtcagaatatctat

SEQ ID NO: 279608 - DNA, 15 bp, Homo sapiens
ttgtcagaatatcta

SEQ ID NO: 279609 - DNA, 15 bp, Homo sapiens
tttgtcagaatatct

SEQ ID NO: 279610 - DNA, 15 bp, Homo sapiens
gtttgtcagaatatc

SEQ ID NO: 279611 - DNA, 15 bp, Homo sapiens
tgtttgtcagaatat

SEQ ID NO: 279612 - DNA, 15 bp, Homo sapiens
ctgtttgtcagaata

SEQ ID NO: 279613 - DNA, 15 bp, Homo sapiens
actgtttgtcagaat

SEQ ID NO: 279614 - DNA, 15 bp, Homo sapiens
gactgtttgtcagaa

SEQ ID NO: 279615 - DNA, 15 bp, Homo sapiens
agactgtttgtcaga

SEQ ID NO: 279616 - DNA, 15 bp, Homo sapiens
cagactgtttgtcag

SEQ ID NO: 279617 - DNA, 15 bp, Homo sapiens
ccagactgtttgtca

SEQ ID NO: 279618 - DNA, 15 bp, Homo sapiens
tccagactgtttgtc

SEQ ID NO: 279619 - DNA, 15 bp, Homo sapiens
atccagactgtttgt

SEQ ID NO: 279620 - DNA, 15 bp, Homo sapiens
tatccagactgtttg

SEQ ID NO: 279621 - DNA, 15 bp, Homo sapiens
ttatccagactgttt

SEQ ID NO: 279622 - DNA, 15 bp, Homo sapiens
tttatccagactgtt

SEQ ID NO: 279623 - DNA, 15 bp, Homo sapiens
atttatccagactgt

SEQ ID NO: 279624 - DNA, 15 bp, Homo sapiens
catttatccagactg

SEQ ID NO: 279625 - DNA, 15 bp, Homo sapiens
gcatttatccagact

SEQ ID NO: 279626 - DNA, 15 bp, Homo sapiens
ggcatttatccagac

SEQ ID NO: 279627 - DNA, 15 bp, Homo sapiens
aggcatttatccaga

SEQ ID NO: 279628 - DNA, 15 bp, Homo sapiens
caggcatttatccag

SEQ ID NO: 279629 - DNA, 15 bp, Homo sapiens
ccaggcatttatcca

SEQ ID NO: 279630 - DNA, 15 bp, Homo sapiens
accaggcatttatcc

SEQ ID NO: 279631 - DNA, 15 bp, Homo sapiens
aaccaggcatttatc

SEQ ID NO: 279632 - DNA, 15 bp, Homo sapiens
gaaccaggcatttat

SEQ ID NO: 279633 - DNA, 15 bp, Homo sapiens
agaaccaggcattta

SEQ ID NO: 279634 - DNA, 15 bp, Homo sapiens
cagaaccaggcattt

SEQ ID NO: 279635 - DNA, 15 bp, Homo sapiens
gcagaaccaggcatt

SEQ ID NO: 279636 - DNA, 15 bp, Homo sapiens
tgcagaaccaggcat

SEQ ID NO: 279637 - DNA, 15 bp, Homo sapiens
ctgcagaaccaggca

SEQ ID NO: 279638 - DNA, 15 bp, Homo sapiens
actgcagaaccaggc

SEQ ID NO: 279639 - DNA, 15 bp, Homo sapiens
cactgcagaaccagg

SEQ ID NO: 279640 - DNA, 15 bp, Homo sapiens
tcactgcagaaccag

SEQ ID NO: 279641 - DNA, 15 bp, Homo sapiens
ctcactgcagaacca

SEQ ID NO: 279642 - DNA, 15 bp, Homo sapiens
tctcactgcagaacc

SEQ ID NO: 279643 - DNA, 15 bp, Homo sapiens
ttctcactgcagaac

SEQ ID NO: 279644 - DNA, 15 bp, Homo sapiens
gttctcactgcagaa

SEQ ID NO: 279645 - DNA, 15 bp, Homo sapiens
tgttctcactgcaga

SEQ ID NO: 279646 - DNA, 15 bp, Homo sapiens
gtgttctcactgcag

SEQ ID NO: 279647 - DNA, 15 bp, Homo sapiens
tgtgttctcactgca

SEQ ID NO: 279648 - DNA, 15 bp, Homo sapiens
atgtgttctcactgc

SEQ ID NO: 279649 - DNA, 15 bp, Homo sapiens
catgtgttctcactg

SEQ ID NO: 279650 - DNA, 15 bp, Homo sapiens
ccatgtgttctcact

SEQ ID NO: 279651 - DNA, 15 bp, Homo sapiens
tccatgtgttctcac

SEQ ID NO: 279652 - DNA, 15 bp, Homo sapiens
tcctgtgtccatgtg

SEQ ID NO: 279653 - DNA, 15 bp, Homo sapiens
ttcctgtgtccatgt

SEQ ID NO: 279654 - DNA, 15 bp, Homo sapiens
cttcctgtgtccatg

SEQ ID NO: 279655 - DNA, 15 bp, Homo sapiens
ccttcctgtgtccat

SEQ ID NO: 279656 - DNA, 15 bp, Homo sapiens
cccttcctgtgtcca

SEQ ID NO: 279657 - DNA, 15 bp, Homo sapiens
ccccttcctgtgtcc

SEQ ID NO: 279658 - DNA, 15 bp, Homo sapiens
tccccttcctgtgtc

SEQ ID NO: 279659 - DNA, 15 bp, Homo sapiens
ttccccttcctgtgt

SEQ ID NO: 279660 - DNA, 15 bp, Homo sapiens
gttccccttcctgtg

SEQ ID NO: 279661 - DNA, 15 bp, Homo sapiens
tgttccccttcctgt

SEQ ID NO: 279662 - DNA, 15 bp, Homo sapiens
atgttccccttcctg

SEQ ID NO: 279663 - DNA, 15 bp, Homo sapiens
gatgttccccttcct

SEQ ID NO: 279664 - DNA, 15 bp, Homo sapiens
tgatgttccccttcc

SEQ ID NO: 279665 - DNA, 15 bp, Homo sapiens
gtgatgttccccttc

SEQ ID NO: 279666 - DNA, 15 bp, Homo sapiens
tgtgatgttcccctt

SEQ ID NO: 279667 - DNA, 15 bp, Homo sapiens
gtgtgatgttcccct

SEQ ID NO: 279668 - DNA, 15 bp, Homo sapiens
tgtgtgatgttcccc

SEQ ID NO: 279669 - DNA, 15 bp, Homo sapiens
gtgtgtgatgttccc

SEQ ID NO: 279670 - DNA, 15 bp, Homo sapiens
ggtgtgtgatgttcc

SEQ ID NO: 279671 - DNA, 15 bp, Homo sapiens
cggtgtgtgatgttc

SEQ ID NO: 279672 - DNA, 15 bp, Homo sapiens
ccggtgtgtgatgtt

SEQ ID NO: 279673 - DNA, 15 bp, Homo sapiens
tccggtgtgtgatgt

SEQ ID NO: 279674 - DNA, 15 bp, Homo sapiens
ctccggtgtgtgatg

SEQ ID NO: 279675 - DNA, 15 bp, Homo sapiens
tctccggtgtgtgat

SEQ ID NO: 279676 - DNA, 15 bp, Homo sapiens
gtctccggtgtgtga

SEQ ID NO: 279677 - DNA, 15 bp, Homo sapiens
agtctccggtgtgtg

SEQ ID NO: 279678 - DNA, 15 bp, Homo sapiens
cagtctccggtgtgt

SEQ ID NO: 279679 - DNA, 15 bp, Homo sapiens
acagtctccggtgtg

SEQ ID NO: 279680 - DNA, 15 bp, Homo sapiens
aacagtctccggtgt

SEQ ID NO: 279681 - DNA, 15 bp, Homo sapiens
caacagtctccggtg

SEQ ID NO: 279682 - DNA, 15 bp, Homo sapiens
acaacagtctccggt

SEQ ID NO: 279683 - DNA, 15 bp, Homo sapiens
cacaacagtctccgg

SEQ ID NO: 279684 - DNA, 15 bp, Homo sapiens
ccacaacagtctccg

SEQ ID NO: 279685 - DNA, 15 bp, Homo sapiens
cccacaacagtctcc

SEQ ID NO: 279686 - DNA, 15 bp, Homo sapiens
ccccacaacagtctc

SEQ ID NO: 279687 - DNA, 15 bp, Homo sapiens
accccacaacagtct

SEQ ID NO: 279688 - DNA, 15 bp, Homo sapiens
caccccacaacagtc

SEQ ID NO: 279689 - DNA, 15 bp, Homo sapiens
ccaccccacaacagt

SEQ ID NO: 279690 - DNA, 15 bp, Homo sapiens
cccaccccacaacag

SEQ ID NO: 279691 - DNA, 15 bp, Homo sapiens
ccccaccccacaaca

SEQ ID NO: 279692 - DNA, 15 bp, Homo sapiens
cccccaccccacaac

SEQ ID NO: 279693 - DNA, 15 bp, Homo sapiens
ccccccaccccacaa

SEQ ID NO: 279694 - DNA, 15 bp, Homo sapiens
tccccccaccccaca

SEQ ID NO: 279695 - DNA, 15 bp, Homo sapiens
ctccccccaccccac

SEQ ID NO: 279696 - DNA, 15 bp, Homo sapiens
cctccccccacccca

SEQ ID NO: 279697 - DNA, 15 bp, Homo sapiens
ccctccccccacccc

SEQ ID NO: 279698 - DNA, 15 bp, Homo sapiens
cccctccccccaccc

SEQ ID NO: 279699 - DNA, 15 bp, Homo sapiens
tcccctccccccacc

SEQ ID NO: 279700 - DNA, 15 bp, Homo sapiens
ctcccctccccccac

SEQ ID NO: 279701 - DNA, 15 bp, Homo sapiens
tctcccctcccccca

SEQ ID NO: 279702 - DNA, 15 bp, Homo sapiens
ctctcccctcccccc

SEQ ID NO: 279703 - DNA, 15 bp, Homo sapiens
cctctcccctccccc

SEQ ID NO: 279704 - DNA, 15 bp, Homo sapiens
ccctctcccctcccc

SEQ ID NO: 279705 - DNA, 15 bp, Homo sapiens
tccctctcccctccc

SEQ ID NO: 279706 - DNA, 15 bp, Homo sapiens
atccctctcccctcc

SEQ ID NO: 279707 - DNA, 15 bp, Homo sapiens
tatccctctcccctc

SEQ ID NO: 279708 - DNA, 15 bp, Homo sapiens
ctatccctctcccct

SEQ ID NO: 279709 - DNA, 15 bp, Homo sapiens
gctatccctctcccc

SEQ ID NO: 279710 - DNA, 15 bp, Homo sapiens
tgctatccctctccc

SEQ ID NO: 279711 - DNA, 15 bp, Homo sapiens
atgctatccctctcc

SEQ ID NO: 279712 - DNA, 15 bp, Homo sapiens
aatgctatccctctc

SEQ ID NO: 279713 - DNA, 15 bp, Homo sapiens
taatgctatccctct

SEQ ID NO: 279714 - DNA, 15 bp, Homo sapiens
ctaatgctatccctc

SEQ ID NO: 279715 - DNA, 15 bp, Homo sapiens
cctaatgctatccct

SEQ ID NO: 279716 - DNA, 15 bp, Homo sapiens
tcctaatgctatccc

SEQ ID NO: 279717 - DNA, 15 bp, Homo sapiens
ctcctaatgctatcc

SEQ ID NO: 279718 - DNA, 15 bp, Homo sapiens
gcattaggtatatct

SEQ ID NO: 279719 - DNA, 15 bp, Homo sapiens
agcattaggtatatc

SEQ ID NO: 279720 - DNA, 15 bp, Homo sapiens
tagcattaggtatat

SEQ ID NO: 279721 - DNA, 15 bp, Homo sapiens
ttagcattaggtata

SEQ ID NO: 279722 - DNA, 15 bp, Homo sapiens
tttagcattaggtat

SEQ ID NO: 279723 - DNA, 15 bp, Homo sapiens
atttagcattaggta

SEQ ID NO: 279724 - DNA, 15 bp, Homo sapiens
catttagcattaggt

SEQ ID NO: 279725 - DNA, 15 bp, Homo sapiens
tcatttagcattagg

SEQ ID NO: 279726 - DNA, 15 bp, Homo sapiens
atcatttagcattag

SEQ ID NO: 279727 - DNA, 15 bp, Homo sapiens
catcatttagcatta

SEQ ID NO: 279728 - DNA, 15 bp, Homo sapiens
tcatcatttagcatt

SEQ ID NO: 279729 - DNA, 15 bp, Homo sapiens
ctcatcatttagcat

SEQ ID NO: 279730 - DNA, 15 bp, Homo sapiens
actcatcatttagca

SEQ ID NO: 279731 - DNA, 15 bp, Homo sapiens
aactcatcatttagc

SEQ ID NO: 279732 - DNA, 15 bp, Homo sapiens
taactcatcatttag

SEQ ID NO: 279733 - DNA, 15 bp, Homo sapiens
ttaactcatcattta

SEQ ID NO: 279734 - DNA, 15 bp, Homo sapiens
attaactcatcattt

SEQ ID NO: 279735 - DNA, 15 bp, Homo sapiens
cattaactcatcatt

SEQ ID NO: 279736 - DNA, 15 bp, Homo sapiens
ccattaactcatcat

SEQ ID NO: 279737 - DNA, 15 bp, Homo sapiens
cccattaactcatca

SEQ ID NO: 279738 - DNA, 15 bp, Homo sapiens
acccattaactcatc

SEQ ID NO: 279739 - DNA, 15 bp, Homo sapiens
cacccattaactcat

SEQ ID NO: 279740 - DNA, 15 bp, Homo sapiens
gcacccattaactca

SEQ ID NO: 279741 - DNA, 15 bp, Homo sapiens
tgcacccattaactc

SEQ ID NO: 279742 - DNA, 15 bp, Homo sapiens
ctgcacccattaact

SEQ ID NO: 279743 - DNA, 15 bp, Homo sapiens
gctgcacccattaac

SEQ ID NO: 279744 - DNA, 15 bp, Homo sapiens
tgctgcacccattaa

SEQ ID NO: 279745 - DNA, 15 bp, Homo sapiens
gtgctgcacccatta

SEQ ID NO: 279746 - DNA, 15 bp, Homo sapiens
tggtgtgctgcaccc

SEQ ID NO: 279747 - DNA, 15 bp, Homo sapiens
ttggtgtgctgcacc

SEQ ID NO: 279748 - DNA, 15 bp, Homo sapiens
gttggtgtgctgcac

SEQ ID NO: 279749 - DNA, 15 bp, Homo sapiens
tgttggtgtgctgca

SEQ ID NO: 279750 - DNA, 15 bp, Homo sapiens
atgttggtgtgctgc

SEQ ID NO: 279751 - DNA, 15 bp, Homo sapiens
catgttggtgtgctg

SEQ ID NO: 279752 - DNA, 15 bp, Homo sapiens
ccatgttggtgtgct

SEQ ID NO: 279753 - DNA, 15 bp, Homo sapiens
gccatgttggtgtgc

SEQ ID NO: 279754 - DNA, 15 bp, Homo sapiens
tgccatgttggtgtg

SEQ ID NO: 279755 - DNA, 15 bp, Homo sapiens
gtgccatgttggtgt

SEQ ID NO: 279756 - DNA, 15 bp, Homo sapiens
tgtgccatgttggtg

SEQ ID NO: 279757 - DNA, 15 bp, Homo sapiens
atgtgccatgttggt

SEQ ID NO: 279758 - DNA, 15 bp, Homo sapiens
catgtgccatgttgg

SEQ ID NO: 279759 - DNA, 15 bp, Homo sapiens
acatgtgccatgttg

SEQ ID NO: 279760 - DNA, 15 bp, Homo sapiens
tacatgtgccatgtt

SEQ ID NO: 279761 - DNA, 15 bp, Homo sapiens
catgcaggtttgtta

SEQ ID NO: 279762 - DNA, 15 bp, Homo sapiens
acatgcaggtttgtt

SEQ ID NO: 279763 - DNA, 15 bp, Homo sapiens
aacatgcaggtttgt

SEQ ID NO: 279764 - DNA, 15 bp, Homo sapiens
caacatgcaggtttg

SEQ ID NO: 279765 - DNA, 15 bp, Homo sapiens
acaacatgcaggttt

SEQ ID NO: 279766 - DNA, 15 bp, Homo sapiens
cacaacatgcaggtt

SEQ ID NO: 279767 - DNA, 15 bp, Homo sapiens
gcacaacatgcaggt

SEQ ID NO: 279768 - DNA, 15 bp, Homo sapiens
tgcacaacatgcagg

SEQ ID NO: 279769 - DNA, 15 bp, Homo sapiens
gtgcacaacatgcag

SEQ ID NO: 279770 - DNA, 15 bp, Homo sapiens
tgtgcacaacatgca

SEQ ID NO: 279771 - DNA, 15 bp, Homo sapiens
atgtgcacaacatgc

SEQ ID NO: 279772 - DNA, 15 bp, Homo sapiens
catgtgcacaacatg

SEQ ID NO: 279773 - DNA, 15 bp, Homo sapiens
acatgtgcacaacat

SEQ ID NO: 279774 - DNA, 15 bp, Homo sapiens
tacatgtgcacaaca

SEQ ID NO: 279775 - DNA, 15 bp, Homo sapiens
tttattattattata

SEQ ID NO: 279776 - DNA, 15 bp, Homo sapiens
cttttattattatta

SEQ ID NO: 279777 - DNA, 15 bp, Homo sapiens
tcttttattattatt

SEQ ID NO: 279778 - DNA, 15 bp, Homo sapiens
ttcttttattattat

SEQ ID NO: 279779 - DNA, 15 bp, Homo sapiens
tttcttttattatta

SEQ ID NO: 279780 - DNA, 15 bp, Homo sapiens
ttttcttttattatt

SEQ ID NO: 279781 - DNA, 15 bp, Homo sapiens
tttttcttttattat

SEQ ID NO: 279782 - DNA, 15 bp, Homo sapiens
ttttttcttttatta

SEQ ID NO: 279783 - DNA, 15 bp, Homo sapiens
attttttcttttatt

SEQ ID NO: 279784 - DNA, 15 bp, Homo sapiens
tattttttcttttat

SEQ ID NO: 279785 - DNA, 15 bp, Homo sapiens
ttattttttctttta

SEQ ID NO: 279786 - DNA, 15 bp, Homo sapiens
tttattttttctttt

SEQ ID NO: 279787 - DNA, 15 bp, Homo sapiens
atttattttttcttt

SEQ ID NO: 279788 - DNA, 15 bp, Homo sapiens
tatttattttttctt

SEQ ID NO: 279789 - DNA, 15 bp, Homo sapiens
ttatttattttttct

SEQ ID NO: 279790 - DNA, 15 bp, Homo sapiens
tttatttattttttc

SEQ ID NO: 279791 - DNA, 15 bp, Homo sapiens
gcatttatttattta

SEQ ID NO: 279792 - DNA, 15 bp, Homo sapiens
ggcatttatttattt

SEQ ID NO: 279793 - DNA, 15 bp, Homo sapiens
aggcatttatttatt

SEQ ID NO: 279794 - DNA, 15 bp, Homo sapiens
caggcatttatttat

SEQ ID NO: 279795 - DNA, 15 bp, Homo sapiens
ccaggcatttattta

SEQ ID NO: 279796 - DNA, 15 bp, Homo sapiens
accaggcatttattt

SEQ ID NO: 279797 - DNA, 15 bp, Homo sapiens
aaccaggcatttatt

SEQ ID NO: 279798 - DNA, 15 bp, Homo sapiens
tcagaaccaggcatt

SEQ ID NO: 279799 - DNA, 15 bp, Homo sapiens
ttcagaaccaggcat

SEQ ID NO: 279800 - DNA, 15 bp, Homo sapiens
tttcagaaccaggca

SEQ ID NO: 279801 - DNA, 15 bp, Homo sapiens
ttttcagaaccaggc

SEQ ID NO: 279802 - DNA, 15 bp, Homo sapiens
attttcagaaccagg

SEQ ID NO: 279803 - DNA, 15 bp, Homo sapiens
tattttcagaaccag

SEQ ID NO: 279804 - DNA, 15 bp, Homo sapiens
ctattttcagaacca

SEQ ID NO: 279805 - DNA, 15 bp, Homo sapiens
tctattttcagaacc

SEQ ID NO: 279806 - DNA, 15 bp, Homo sapiens
atctattttcagaac

SEQ ID NO: 279807 - DNA, 15 bp, Homo sapiens
gatctattttcagaa

SEQ ID NO: 279808 - DNA, 15 bp, Homo sapiens
agatctattttcaga

SEQ ID NO: 279809 - DNA, 15 bp, Homo sapiens
cagatctattttcag

SEQ ID NO: 279810 - DNA, 15 bp, Homo sapiens
tcagatctattttca

SEQ ID NO: 279811 - DNA, 15 bp, Homo sapiens
ttcagatctattttc

SEQ ID NO: 279812 - DNA, 15 bp, Homo sapiens
cttcagatctatttt

SEQ ID NO: 279813 - DNA, 15 bp, Homo sapiens
tcttcagatctattt

SEQ ID NO: 279814 - DNA, 15 bp, Homo sapiens
ctcttcagatctatt

SEQ ID NO: 279815 - DNA, 15 bp, Homo sapiens
actcttcagatctat

SEQ ID NO: 279816 - DNA, 15 bp, Homo sapiens
gactcttcagatcta

SEQ ID NO: 279817 - DNA, 15 bp, Homo sapiens
agactcttcagatct

SEQ ID NO: 279818 - DNA, 15 bp, Homo sapiens
aagactcttcagatc

SEQ ID NO: 279819 - DNA, 15 bp, Homo sapiens
taagactcttcagat

SEQ ID NO: 279820 - DNA, 15 bp, Homo sapiens
ctaagactcttcaga

SEQ ID NO: 279821 - DNA, 15 bp, Homo sapiens
actaagactcttcag

SEQ ID NO: 279822 - DNA, 15 bp, Homo sapiens
aactaagactcttca

SEQ ID NO: 279823 - DNA, 15 bp, Homo sapiens
aaactaagactcttc

SEQ ID NO: 279824 - DNA, 15 bp, Homo sapiens
aaaactaagactctt

SEQ ID NO: 279825 - DNA, 15 bp, Homo sapiens
aaaaactaagactct

SEQ ID NO: 279826 - DNA, 15 bp, Homo sapiens
gaaaaactaagactc

SEQ ID NO: 279827 - DNA, 15 bp, Homo sapiens
tgaaaaactaagact

SEQ ID NO: 279828 - DNA, 15 bp, Homo sapiens
atgaaaaactaagac

SEQ ID NO: 279829 - DNA, 15 bp, Homo sapiens
gatgaaaaactaaga

SEQ ID NO: 279830 - DNA, 15 bp, Homo sapiens
ggatgaaaaactaag

SEQ ID NO: 279831 - DNA, 15 bp, Homo sapiens
gggatgaaaaactaa

SEQ ID NO: 279832 - DNA, 15 bp, Homo sapiens
tgggatgaaaaacta

SEQ ID NO: 279833 - DNA, 15 bp, Homo sapiens
ttgggatgaaaaact

SEQ ID NO: 279834 - DNA, 15 bp, Homo sapiens
attgggatgaaaaac

SEQ ID NO: 279835 - DNA, 15 bp, Homo sapiens
tattgggatgaaaaa

SEQ ID NO: 279836 - DNA, 15 bp, Homo sapiens
ttattgggatgaaaa

SEQ ID NO: 279837 - DNA, 15 bp, Homo sapiens
cttattgggatgaaa

SEQ ID NO: 279838 - DNA, 15 bp, Homo sapiens
tcttattgggatgaa

SEQ ID NO: 279839 - DNA, 15 bp, Homo sapiens
atcttattgggatga

SEQ ID NO: 279840 - DNA, 15 bp, Homo sapiens
tatcttattgggatg

SEQ ID NO: 279841 - DNA, 15 bp, Homo sapiens
ttatcttattgggat

SEQ ID NO: 279842 - DNA, 15 bp, Homo sapiens
attatcttattggga

SEQ ID NO: 279843 - DNA, 15 bp, Homo sapiens
cattatcttattggg

SEQ ID NO: 279844 - DNA, 15 bp, Homo sapiens
acattatcttattgg

SEQ ID NO: 279845 - DNA, 15 bp, Homo sapiens
aacattatcttattg

SEQ ID NO: 279846 - DNA, 15 bp, Homo sapiens
gaacattatcttatt

SEQ ID NO: 279847 - DNA, 15 bp, Homo sapiens
tgaacattatcttat

SEQ ID NO: 279848 - DNA, 15 bp, Homo sapiens
ttgaacattatctta

SEQ ID NO: 279849 - DNA, 15 bp, Homo sapiens
tttgaacattatctt

SEQ ID NO: 279850 - DNA, 15 bp, Homo sapiens
ttttgaacattatct

SEQ ID NO: 279851 - DNA, 15 bp, Homo sapiens
cttttgaacattatc

SEQ ID NO: 279852 - DNA, 15 bp, Homo sapiens
acttttgaacattat

SEQ ID NO: 279853 - DNA, 15 bp, Homo sapiens
gacttttgaacatta

SEQ ID NO: 279854 - DNA, 15 bp, Homo sapiens
agacttttgaacatt

SEQ ID NO: 279855 - DNA, 15 bp, Homo sapiens
aagacttttgaacat

SEQ ID NO: 279856 - DNA, 15 bp, Homo sapiens
aaagacttttgaaca

SEQ ID NO: 279857 - DNA, 15 bp, Homo sapiens
caaagacttttgaac

SEQ ID NO: 279858 - DNA, 15 bp, Homo sapiens
gcaaagacttttgaa

SEQ ID NO: 279859 - DNA, 15 bp, Homo sapiens
agcaaagacttttga

SEQ ID NO: 279860 - DNA, 15 bp, Homo sapiens
cagcaaagacttttg

SEQ ID NO: 279861 - DNA, 15 bp, Homo sapiens
acagcaaagactttt

SEQ ID NO: 279862 - DNA, 15 bp, Homo sapiens
cacagcaaagacttt

SEQ ID NO: 279863 - DNA, 15 bp, Homo sapiens
gcacagcaaagactt

SEQ ID NO: 279864 - DNA, 15 bp, Homo sapiens
tgcacagcaaagact

SEQ ID NO: 279865 - DNA, 15 bp, Homo sapiens
ctgcacagcaaagac

SEQ ID NO: 279866 - DNA, 15 bp, Homo sapiens
cctgcacagcaaaga

SEQ ID NO: 279867 - DNA, 15 bp, Homo sapiens
gcctgcacagcaaag

SEQ ID NO: 279868 - DNA, 15 bp, Homo sapiens
tgcctgcacagcaaa

SEQ ID NO: 279869 - DNA, 15 bp, Homo sapiens
atgcctgcacagcaa

SEQ ID NO: 279870 - DNA, 15 bp, Homo sapiens
gatgcctgcacagca

SEQ ID NO: 279871 - DNA, 15 bp, Homo sapiens
tgatgcctgcacagc

SEQ ID NO: 279872 - DNA, 15 bp, Homo sapiens
ttgatgcctgcacag

SEQ ID NO: 279873 - DNA, 15 bp, Homo sapiens
gttgatgcctgcaca

SEQ ID NO: 279874 - DNA, 15 bp, Homo sapiens
ggttgatgcctgcac

SEQ ID NO: 279875 - DNA, 15 bp, Homo sapiens
aggttgatgcctgca

SEQ ID NO: 279876 - DNA, 15 bp, Homo sapiens
caggttgatgcctgc

SEQ ID NO: 279877 - DNA, 15 bp, Homo sapiens
gcaggttgatgcctg

SEQ ID NO: 279878 - DNA, 15 bp, Homo sapiens
tgcaggttgatgcct

SEQ ID NO: 279879 - DNA, 15 bp, Homo sapiens
gtgcaggttgatgcc

SEQ ID NO: 279880 - DNA, 15 bp, Homo sapiens
agtgcaggttgatgc

SEQ ID NO: 279881 - DNA, 15 bp, Homo sapiens
aagtgcaggttgatg

SEQ ID NO: 279882 - DNA, 15 bp, Homo sapiens
gaagtgcaggttgat

SEQ ID NO: 279883 - DNA, 15 bp, Homo sapiens
tgaagtgcaggttga

SEQ ID NO: 279884 - DNA, 15 bp, Homo sapiens
gtgaagtgcaggttg

SEQ ID NO: 279885 - DNA, 15 bp, Homo sapiens
agtgaagtgcaggtt

SEQ ID NO: 279886 - DNA, 15 bp, Homo sapiens
tagtgaagtgcaggt

SEQ ID NO: 279887 - DNA, 15 bp, Homo sapiens
atagtgaagtgcagg

SEQ ID NO: 279888 - DNA, 15 bp, Homo sapiens
tatagtgaagtgcag

SEQ ID NO: 279889 - DNA, 15 bp, Homo sapiens
ctatagtgaagtgca

SEQ ID NO: 279890 - DNA, 15 bp, Homo sapiens
cctatagtgaagtgc

SEQ ID NO: 279891 - DNA, 15 bp, Homo sapiens
tcctatagtgaagtg

SEQ ID NO: 279892 - DNA, 15 bp, Homo sapiens
ctcctatagtgaagt

SEQ ID NO: 279893 - DNA, 15 bp, Homo sapiens
tctcctatagtgaag

SEQ ID NO: 279894 - DNA, 15 bp, Homo sapiens
atctcctatagtgaa

SEQ ID NO: 279895 - DNA, 15 bp, Homo sapiens
catctcctatagtga

SEQ ID NO: 279896 - DNA, 15 bp, Homo sapiens
tcatctcctatagtg

SEQ ID NO: 279897 - DNA, 15 bp, Homo sapiens
ttcatctcctatagt

SEQ ID NO: 279898 - DNA, 15 bp, Homo sapiens
cttcatctcctatag

SEQ ID NO: 279899 - DNA, 15 bp, Homo sapiens
tcttcatctcctata

SEQ ID NO: 279900 - DNA, 15 bp, Homo sapiens
ctcttcatctcctat

SEQ ID NO: 279901 - DNA, 15 bp, Homo sapiens
tctcttcatctccta

SEQ ID NO: 279902 - DNA, 15 bp, Homo sapiens
ttctcttcatctcct

SEQ ID NO: 279903 - DNA, 15 bp, Homo sapiens
tttctcttcatctcc

SEQ ID NO: 279904 - DNA, 15 bp, Homo sapiens
ttttctcttcatctc

SEQ ID NO: 279905 - DNA, 15 bp, Homo sapiens
cttttctcttcatct

SEQ ID NO: 279906 - DNA, 15 bp, Homo sapiens
acttttctcttcatc

SEQ ID NO: 279907 - DNA, 15 bp, Homo sapiens
tacttttctcttcat

SEQ ID NO: 279908 - DNA, 15 bp, Homo sapiens
ctacttttctcttca

SEQ ID NO: 279909 - DNA, 15 bp, Homo sapiens
cctacttttctcttc

SEQ ID NO: 279910 - DNA, 15 bp, Homo sapiens
gcctacttttctctt

SEQ ID NO: 279911 - DNA, 15 bp, Homo sapiens
tgcctacttttctct

SEQ ID NO: 279912 - DNA, 15 bp, Homo sapiens
atgcctacttttctc

SEQ ID NO: 279913 - DNA, 15 bp, Homo sapiens
aatgcctacttttct

SEQ ID NO: 279914 - DNA, 15 bp, Homo sapiens
taatgcctacttttc

SEQ ID NO: 279915 - DNA, 15 bp, Homo sapiens
ataatgcctactttt

SEQ ID NO: 279916 - DNA, 15 bp, Homo sapiens
tataatgcctacttt

SEQ ID NO: 279917 - DNA, 15 bp, Homo sapiens
ctataatgcctactt

SEQ ID NO: 279918 - DNA, 15 bp, Homo sapiens
tctataatgcctact

SEQ ID NO: 279919 - DNA, 15 bp, Homo sapiens
atctataatgcctac

SEQ ID NO: 279920 - DNA, 15 bp, Homo sapiens
tatctataatgccta

SEQ ID NO: 279921 - DNA, 15 bp, Homo sapiens
gtatctataatgcct

SEQ ID NO: 279922 - DNA, 15 bp, Homo sapiens
ggtatctataatgcc

SEQ ID NO: 279923 - DNA, 15 bp, Homo sapiens
aggtatctataatgc

SEQ ID NO: 279924 - DNA, 15 bp, Homo sapiens
taggtatctataatg

SEQ ID NO: 279925 - DNA, 15 bp, Homo sapiens
gtaggtatctataat

SEQ ID NO: 279926 - DNA, 15 bp, Homo sapiens
agtaggtatctataa

SEQ ID NO: 279927 - DNA, 15 bp, Homo sapiens
aagtaggtatctata

SEQ ID NO: 279928 - DNA, 15 bp, Homo sapiens
aaagtaggtatctat

SEQ ID NO: 279929 - DNA, 15 bp, Homo sapiens
gaaagtaggtatcta

SEQ ID NO: 279930 - DNA, 15 bp, Homo sapiens
agaaagtaggtatct

SEQ ID NO: 279931 - DNA, 15 bp, Homo sapiens
aagaaagtaggtatc

SEQ ID NO: 279932 - DNA, 15 bp, Homo sapiens
aaagaaagtaggtat

SEQ ID NO: 279933 - DNA, 15 bp, Homo sapiens
caaagaaagtaggta

SEQ ID NO: 279934 - DNA, 15 bp, Homo sapiens
acaaagaaagtaggt

SEQ ID NO: 279935 - DNA, 15 bp, Homo sapiens
gacaaagaaagtagg

SEQ ID NO: 279936 - DNA, 15 bp, Homo sapiens
agacaaagaaagtag

SEQ ID NO: 279937 - DNA, 15 bp, Homo sapiens
tagacaaagaaagta

SEQ ID NO: 279938 - DNA, 15 bp, Homo sapiens
ttagacaaagaaagt

SEQ ID NO: 279939 - DNA, 15 bp, Homo sapiens
cttagacaaagaaag

SEQ ID NO: 279940 - DNA, 15 bp, Homo sapiens
acttagacaaagaaa

SEQ ID NO: 279941 - DNA, 15 bp, Homo sapiens
tacttagacaaagaa

SEQ ID NO: 279942 - DNA, 15 bp, Homo sapiens
ctacttagacaaaga

SEQ ID NO: 279943 - DNA, 15 bp, Homo sapiens
cctacttagacaaag

SEQ ID NO: 279944 - DNA, 15 bp, Homo sapiens
acctacttagacaaa

SEQ ID NO: 279945 - DNA, 15 bp, Homo sapiens
tacctacttagacaa

SEQ ID NO: 279946 - DNA, 15 bp, Homo sapiens
atacctacttagaca

SEQ ID NO: 279947 - DNA, 15 bp, Homo sapiens
catacctacttagac

SEQ ID NO: 279948 - DNA, 15 bp, Homo sapiens
acatacctacttaga

SEQ ID NO: 279949 - DNA, 15 bp, Homo sapiens
tacatacctacttag

SEQ ID NO: 279950 - DNA, 15 bp, Homo sapiens
atacatacctactta

SEQ ID NO: 279951 - DNA, 15 bp, Homo sapiens
tatacatacctactt

SEQ ID NO: 279952 - DNA, 15 bp, Homo sapiens
ttatacatacctact

SEQ ID NO: 279953 - DNA, 15 bp, Homo sapiens
attatacatacctac

SEQ ID NO: 279954 - DNA, 15 bp, Homo sapiens
tattatacataccta

SEQ ID NO: 279955 - DNA, 15 bp, Homo sapiens
ctattatacatacct

SEQ ID NO: 279956 - DNA, 15 bp, Homo sapiens
tctattatacatacc

SEQ ID NO: 279957 - DNA, 15 bp, Homo sapiens
ttctattatacatac

SEQ ID NO: 279958 - DNA, 15 bp, Homo sapiens
tttctattatacata

SEQ ID NO: 279959 - DNA, 15 bp, Homo sapiens
atttctattatacat

SEQ ID NO: 279960 - DNA, 15 bp, Homo sapiens
tatttctattataca

SEQ ID NO: 279961 - DNA, 15 bp, Homo sapiens
ctatttctattatac

SEQ ID NO: 279962 - DNA, 15 bp, Homo sapiens
cctatttctattata

SEQ ID NO: 279963 - DNA, 15 bp, Homo sapiens
tcctatttctattat

SEQ ID NO: 279964 - DNA, 15 bp, Homo sapiens
ctcctatttctatta

SEQ ID NO: 279965 - DNA, 15 bp, Homo sapiens
tctcctatttctatt

SEQ ID NO: 279966 - DNA, 15 bp, Homo sapiens
ttctcctatttctat

SEQ ID NO: 279967 - DNA, 15 bp, Homo sapiens
attctcctatttcta

SEQ ID NO: 279968 - DNA, 15 bp, Homo sapiens
gattctcctatttct

SEQ ID NO: 279969 - DNA, 15 bp, Homo sapiens
tgattctcctatttc

SEQ ID NO: 279970 - DNA, 15 bp, Homo sapiens
ttgattctcctattt

SEQ ID NO: 279971 - DNA, 15 bp, Homo sapiens
cttgattctcctatt

SEQ ID NO: 279972 - DNA, 15 bp, Homo sapiens
ccttgattctcctat

SEQ ID NO: 279973 - DNA, 15 bp, Homo sapiens
tccttgattctccta

SEQ ID NO: 279974 - DNA, 15 bp, Homo sapiens
ctccttgattctcct

SEQ ID NO: 279975 - DNA, 15 bp, Homo sapiens
actccttgattctcc

SEQ ID NO: 279976 - DNA, 15 bp, Homo sapiens
aactccttgattctc

SEQ ID NO: 279977 - DNA, 15 bp, Homo sapiens
aaactccttgattct

SEQ ID NO: 279978 - DNA, 15 bp, Homo sapiens
aaaactccttgattc

SEQ ID NO: 279979 - DNA, 15 bp, Homo sapiens
caaaactccttgatt

SEQ ID NO: 279980 - DNA, 15 bp, Homo sapiens
ccaaaactccttgat

SEQ ID NO: 279981 - DNA, 15 bp, Homo sapiens
tccaaaactccttga

SEQ ID NO: 279982 - DNA, 15 bp, Homo sapiens
ttccaaaactccttg

SEQ ID NO: 279983 - DNA, 15 bp, Homo sapiens
attccaaaactcctt

SEQ ID NO: 279984 - DNA, 15 bp, Homo sapiens
tattccaaaactcct

SEQ ID NO: 279985 - DNA, 15 bp, Homo sapiens
ttattccaaaactcc

SEQ ID NO: 279986 - DNA, 15 bp, Homo sapiens
attattccaaaactc

SEQ ID NO: 279987 - DNA, 15 bp, Homo sapiens
aattattccaaaact

SEQ ID NO: 279988 - DNA, 15 bp, Homo sapiens
aaattattccaaaac

SEQ ID NO: 279989 - DNA, 15 bp, Homo sapiens
aaaattattccaaaa

SEQ ID NO: 279990 - DNA, 15 bp, Homo sapiens
caaaattattccaaa

SEQ ID NO: 279991 - DNA, 15 bp, Homo sapiens
acaaaattattccaa

SEQ ID NO: 279992 - DNA, 15 bp, Homo sapiens
aacaaaattattcca

SEQ ID NO: 279993 - DNA, 15 bp, Homo sapiens
aaacaaaattattcc

SEQ ID NO: 279994 - DNA, 15 bp, Homo sapiens
gaaacaaaattattc

SEQ ID NO: 279995 - DNA, 15 bp, Homo sapiens
tgaaacaaaattatt

SEQ ID NO: 279996 - DNA, 15 bp, Homo sapiens
ttgaaacaaaattat

SEQ ID NO: 279997 - DNA, 15 bp, Homo sapiens
tttgaaacaaaatta

SEQ ID NO: 279998 - DNA, 15 bp, Homo sapiens
gtttgaaacaaaatt

SEQ ID NO: 279999 - DNA, 15 bp, Homo sapiens
tgtttgaaacaaaat

SEQ ID NO: 280000 - DNA, 15 bp, Homo sapiens
gtgtttgaaacaaaa

SEQ ID NO: 280001 - DNA, 15 bp, Homo sapiens
agtgtttgaaacaaa

SEQ ID NO: 280002 - DNA, 15 bp, Homo sapiens
cagtgtttgaaacaa

SEQ ID NO: 280003 - DNA, 15 bp, Homo sapiens
acagtgtttgaaaca

SEQ ID NO: 280004 - DNA, 15 bp, Homo sapiens
aacagtgtttgaaac

SEQ ID NO: 280005 - DNA, 15 bp, Homo sapiens
taacagtgtttgaaa

SEQ ID NO: 280006 - DNA, 15 bp, Homo sapiens
ctaacagtgtttgaa

SEQ ID NO: 280007 - DNA, 15 bp, Homo sapiens
gctaacagtgtttga

SEQ ID NO: 280008 - DNA, 15 bp, Homo sapiens
agctaacagtgtttg

SEQ ID NO: 280009 - DNA, 15 bp, Homo sapiens
aagctaacagtgttt

SEQ ID NO: 280010 - DNA, 15 bp, Homo sapiens
aaagctaacagtgtt

SEQ ID NO: 280011 - DNA, 15 bp, Homo sapiens
aaaagctaacagtgt

SEQ ID NO: 280012 - DNA, 15 bp, Homo sapiens
caaaagctaacagtg

SEQ ID NO: 280013 - DNA, 15 bp, Homo sapiens
gcaaaagctaacagt

SEQ ID NO: 280014 - DNA, 15 bp, Homo sapiens
tgcaaaagctaacag

SEQ ID NO: 280015 - DNA, 15 bp, Homo sapiens
ctgcaaaagctaaca

SEQ ID NO: 280016 - DNA, 15 bp, Homo sapiens
tctgcaaaagctaac

SEQ ID NO: 280017 - DNA, 15 bp, Homo sapiens
gtctgcaaaagctaa

SEQ ID NO: 280018 - DNA, 15 bp, Homo sapiens
agtctgcaaaagcta

SEQ ID NO: 280019 - DNA, 15 bp, Homo sapiens
aagtctgcaaaagct

SEQ ID NO: 280020 - DNA, 15 bp, Homo sapiens
aaagtctgcaaaagc

SEQ ID NO: 280021 - DNA, 15 bp, Homo sapiens
aaaagtctgcaaaag

SEQ ID NO: 280022 - DNA, 15 bp, Homo sapiens
taaaagtctgcaaaa

SEQ ID NO: 280023 - DNA, 15 bp, Homo sapiens
ataaaagtctgcaaa

SEQ ID NO: 280024 - DNA, 15 bp, Homo sapiens
aataaaagtctgcaa

SEQ ID NO: 280025 - DNA, 15 bp, Homo sapiens
aaataaaagtctgca

SEQ ID NO: 280026 - DNA, 15 bp, Homo sapiens
taaataaaagtctgc

SEQ ID NO: 280027 - DNA, 15 bp, Homo sapiens
ttaaataaaagtctg

SEQ ID NO: 280028 - DNA, 15 bp, Homo sapiens
attaaataaaagtct

SEQ ID NO: 280029 - DNA, 15 bp, Homo sapiens
aattaaataaaagtc

SEQ ID NO: 280030 - DNA, 15 bp, Homo sapiens
taattaaataaaagt

SEQ ID NO: 280031 - DNA, 15 bp, Homo sapiens
ttaattaaataaaag

SEQ ID NO: 280032 - DNA, 15 bp, Homo sapiens
tttaattaaataaaa

SEQ ID NO: 280033 - DNA, 15 bp, Homo sapiens
atttaattaaataaa

SEQ ID NO: 280034 - DNA, 15 bp, Homo sapiens
tatttaattaaataa

SEQ ID NO: 280035 - DNA, 15 bp, Homo sapiens
ctatttaattaaata

SEQ ID NO: 280036 - DNA, 15 bp, Homo sapiens
gctatttaattaaat

SEQ ID NO: 280037 - DNA, 15 bp, Homo sapiens
agctatttaattaaa

SEQ ID NO: 280038 - DNA, 15 bp, Homo sapiens
tagctatttaattaa

SEQ ID NO: 280039 - DNA, 15 bp, Homo sapiens
ttagctatttaatta

SEQ ID NO: 280040 - DNA, 15 bp, Homo sapiens
attagctatttaatt

SEQ ID NO: 280041 - DNA, 15 bp, Homo sapiens
aattagctatttaat

SEQ ID NO: 280042 - DNA, 15 bp, Homo sapiens
aaattagctatttaa

SEQ ID NO: 280043 - DNA, 15 bp, Homo sapiens
aaaattagctattta

SEQ ID NO: 280044 - DNA, 15 bp, Homo sapiens
gaaaattagctattt

SEQ ID NO: 280045 - DNA, 15 bp, Homo sapiens
agaaaattagctatt

SEQ ID NO: 280046 - DNA, 15 bp, Homo sapiens
aagaaaattagctat

SEQ ID NO: 280047 - DNA, 15 bp, Homo sapiens
aaagaaaattagcta

SEQ ID NO: 280048 - DNA, 15 bp, Homo sapiens
caaagaaaattagct

SEQ ID NO: 280049 - DNA, 15 bp, Homo sapiens
acaaagaaaattagc

SEQ ID NO: 280050 - DNA, 15 bp, Homo sapiens
tacaaagaaaattag

SEQ ID NO: 280051 - DNA, 15 bp, Homo sapiens
gtacaaagaaaatta

SEQ ID NO: 280052 - DNA, 15 bp, Homo sapiens
agtacaaagaaaatt

SEQ ID NO: 280053 - DNA, 15 bp, Homo sapiens
cagtacaaagaaaat

SEQ ID NO: 280054 - DNA, 15 bp, Homo sapiens
acagtacaaagaaaa

SEQ ID NO: 280055 - DNA, 15 bp, Homo sapiens
tacagtacaaagaaa

SEQ ID NO: 280056 - DNA, 15 bp, Homo sapiens
ttacagtacaaagaa

SEQ ID NO: 280057 - DNA, 15 bp, Homo sapiens
tttacagtacaaaga

SEQ ID NO: 280058 - DNA, 15 bp, Homo sapiens
atttacagtacaaag

SEQ ID NO: 280059 - DNA, 15 bp, Homo sapiens
catttacagtacaaa

SEQ ID NO: 280060 - DNA, 15 bp, Homo sapiens
acatttacagtacaa

SEQ ID NO: 280061 - DNA, 15 bp, Homo sapiens
aacatttacagtaca

SEQ ID NO: 280062 - DNA, 15 bp, Homo sapiens
gaacatttacagtac

SEQ ID NO: 280063 - DNA, 15 bp, Homo sapiens
agaacatttacagta

SEQ ID NO: 280064 - DNA, 15 bp, Homo sapiens
tagaacatttacagt

SEQ ID NO: 280065 - DNA, 15 bp, Homo sapiens
gtagaacatttacag

SEQ ID NO: 280066 - DNA, 15 bp, Homo sapiens
tgtagaacatttaca

SEQ ID NO: 280067 - DNA, 15 bp, Homo sapiens
atgtagaacatttac

SEQ ID NO: 280068 - DNA, 15 bp, Homo sapiens
aatgtagaacattta

SEQ ID NO: 280069 - DNA, 15 bp, Homo sapiens
gaatgtagaacattt

SEQ ID NO: 280070 - DNA, 15 bp, Homo sapiens
tgaatgtagaacatt

SEQ ID NO: 280071 - DNA, 15 bp, Homo sapiens
atgaatgtagaacat

SEQ ID NO: 280072 - DNA, 15 bp, Homo sapiens
aatgaatgtagaaca

SEQ ID NO: 280073 - DNA, 15 bp, Homo sapiens
aaatgaatgtagaac

SEQ ID NO: 280074 - DNA, 15 bp, Homo sapiens
taaatgaatgtagaa

SEQ ID NO: 280075 - DNA, 15 bp, Homo sapiens
gtaaatgaatgtaga

SEQ ID NO: 280076 - DNA, 15 bp, Homo sapiens
agtaaatgaatgtag

SEQ ID NO: 280077 - DNA, 15 bp, Homo sapiens
gagtaaatgaatgta

SEQ ID NO: 280078 - DNA, 15 bp, Homo sapiens
agagtaaatgaatgt

SEQ ID NO: 280079 - DNA, 15 bp, Homo sapiens
gagagtaaatgaatg

SEQ ID NO: 280080 - DNA, 15 bp, Homo sapiens
ggagagtaaatgaat

SEQ ID NO: 280081 - DNA, 15 bp, Homo sapiens
aggagagtaaatgaa

SEQ ID NO: 280082 - DNA, 15 bp, Homo sapiens
aaggagagtaaatga

SEQ ID NO: 280083 - DNA, 15 bp, Homo sapiens
gaaggagagtaaatg

SEQ ID NO: 280084 - DNA, 15 bp, Homo sapiens
ggaaggagagtaaat

SEQ ID NO: 280085 - DNA, 15 bp, Homo sapiens
aggaaggagagtaaa

SEQ ID NO: 280086 - DNA, 15 bp, Homo sapiens
gaggaaggagagtaa

SEQ ID NO: 280087 - DNA, 15 bp, Homo sapiens
ggaggaaggagagta

SEQ ID NO: 280088 - DNA, 15 bp, Homo sapiens
aggaggaaggagagt

SEQ ID NO: 280089 - DNA, 15 bp, Homo sapiens
gaggaggaaggagag

SEQ ID NO: 280090 - DNA, 15 bp, Homo sapiens
tgaggaggaaggaga

SEQ ID NO: 280091 - DNA, 15 bp, Homo sapiens
ttgaggaggaaggag

SEQ ID NO: 280092 - DNA, 15 bp, Homo sapiens
tttgaggaggaagga

SEQ ID NO: 280093 - DNA, 15 bp, Homo sapiens
ttttgaggaggaagg

SEQ ID NO: 280094 - DNA, 15 bp, Homo sapiens
tttttgaggaggaag

SEQ ID NO: 280095 - DNA, 15 bp, Homo sapiens
ctttttgaggaggaa

SEQ ID NO: 280096 - DNA, 15 bp, Homo sapiens
gctttttgaggagga

SEQ ID NO: 280097 - DNA, 15 bp, Homo sapiens
agctttttgaggagg

SEQ ID NO: 280098 - DNA, 15 bp, Homo sapiens
tagctttttgaggag

SEQ ID NO: 280099 - DNA, 15 bp, Homo sapiens
ctagctttttgagga

SEQ ID NO: 280100 - DNA, 15 bp, Homo sapiens
cctagctttttgagg

SEQ ID NO: 280101 - DNA, 15 bp, Homo sapiens
ccctagctttttgag

SEQ ID NO: 280102 - DNA, 15 bp, Homo sapiens
accctagctttttga

SEQ ID NO: 280103 - DNA, 15 bp, Homo sapiens
aaccctagctttttg

SEQ ID NO: 280104 - DNA, 15 bp, Homo sapiens
caaccctagcttttt

SEQ ID NO: 280105 - DNA, 15 bp, Homo sapiens
ccaaccctagctttt

SEQ ID NO: 280106 - DNA, 15 bp, Homo sapiens
tccaaccctagcttt

SEQ ID NO: 280107 - DNA, 15 bp, Homo sapiens
ttccaaccctagctt

SEQ ID NO: 280108 - DNA, 15 bp, Homo sapiens
gttccaaccctagct

SEQ ID NO: 280109 - DNA, 15 bp, Homo sapiens
agttccaaccctagc

SEQ ID NO: 280110 - DNA, 15 bp, Homo sapiens
tagttccaaccctag

SEQ ID NO: 280111 - DNA, 15 bp, Homo sapiens
ctagttccaacccta

SEQ ID NO: 280112 - DNA, 15 bp, Homo sapiens
gctagttccaaccct

SEQ ID NO: 280113 - DNA, 15 bp, Homo sapiens
agctagttccaaccc

SEQ ID NO: 280114 - DNA, 15 bp, Homo sapiens
aagctagttccaacc

SEQ ID NO: 280115 - DNA, 15 bp, Homo sapiens
aaagctagttccaac

SEQ ID NO: 280116 - DNA, 15 bp, Homo sapiens
aaaagctagttccaa

SEQ ID NO: 280117 - DNA, 15 bp, Homo sapiens
taaaagctagttcca

SEQ ID NO: 280118 - DNA, 15 bp, Homo sapiens
ttaaaagctagttcc

SEQ ID NO: 280119 - DNA, 15 bp, Homo sapiens
attaaaagctagttc

SEQ ID NO: 280120 - DNA, 15 bp, Homo sapiens
aattaaaagctagtt

SEQ ID NO: 280121 - DNA, 15 bp, Homo sapiens
taattaaaagctagt

SEQ ID NO: 280122 - DNA, 15 bp, Homo sapiens
ctaattaaaagctag

SEQ ID NO: 280123 - DNA, 15 bp, Homo sapiens
cctaattaaaagcta

SEQ ID NO: 280124 - DNA, 15 bp, Homo sapiens
tcctaattaaaagct

SEQ ID NO: 280125 - DNA, 15 bp, Homo sapiens
atcctaattaaaagc

SEQ ID NO: 280126 - DNA, 15 bp, Homo sapiens
gatcctaattaaaag

SEQ ID NO: 280127 - DNA, 15 bp, Homo sapiens
tgatcctaattaaaa

SEQ ID NO: 280128 - DNA, 15 bp, Homo sapiens
ctgatcctaattaaa

SEQ ID NO: 280129 - DNA, 15 bp, Homo sapiens
actgatcctaattaa

SEQ ID NO: 280130 - DNA, 15 bp, Homo sapiens
aactgatcctaatta

SEQ ID NO: 280131 - DNA, 15 bp, Homo sapiens
caactgatcctaatt

SEQ ID NO: 280132 - DNA, 15 bp, Homo sapiens
acaactgatcctaat

SEQ ID NO: 280133 - DNA, 15 bp, Homo sapiens
aacaactgatcctaa

SEQ ID NO: 280134 - DNA, 15 bp, Homo sapiens
aaacaactgatccta

SEQ ID NO: 280135 - DNA, 15 bp, Homo sapiens
aaaacaactgatcct

SEQ ID NO: 280136 - DNA, 15 bp, Homo sapiens
gaaaacaactgatcc

SEQ ID NO: 280137 - DNA, 15 bp, Homo sapiens
tttgaaaacaactga

SEQ ID NO: 280138 - DNA, 15 bp, Homo sapiens
ttttgaaaacaactg

SEQ ID NO: 280139 - DNA, 15 bp, Homo sapiens
cttttgaaaacaact

SEQ ID NO: 280140 - DNA, 15 bp, Homo sapiens
acttttgaaaacaac

SEQ ID NO: 280141 - DNA, 15 bp, Homo sapiens
tacttttgaaaacaa

SEQ ID NO: 280142 - DNA, 15 bp, Homo sapiens
atacttttgaaaaca

SEQ ID NO: 280143 - DNA, 15 bp, Homo sapiens
aatacttttgaaaac

SEQ ID NO: 280144 - DNA, 15 bp, Homo sapiens
aaatacttttgaaaa

SEQ ID NO: 280145 - DNA, 15 bp, Homo sapiens
gaaatacttttgaaa

SEQ ID NO: 280146 - DNA, 15 bp, Homo sapiens
tgaaatacttttgaa

SEQ ID NO: 280147 - DNA, 15 bp, Homo sapiens
atgaaatacttttga

SEQ ID NO: 280148 - DNA, 15 bp, Homo sapiens
catgaaatacttttg

SEQ ID NO: 280149 - DNA, 15 bp, Homo sapiens
ccatgaaatactttt

SEQ ID NO: 280150 - DNA, 15 bp, Homo sapiens
tccatgaaatacttt

SEQ ID NO: 280151 - DNA, 15 bp, Homo sapiens
ctccatgaaatactt

SEQ ID NO: 280152 - DNA, 15 bp, Homo sapiens
tctccatgaaatact

SEQ ID NO: 280153 - DNA, 15 bp, Homo sapiens
gtctccatgaaatac

SEQ ID NO: 280154 - DNA, 15 bp, Homo sapiens
agtctccatgaaata

SEQ ID NO: 280155 - DNA, 15 bp, Homo sapiens
aagtctccatgaaat

SEQ ID NO: 280156 - DNA, 15 bp, Homo sapiens
caagtctccatgaaa

SEQ ID NO: 280157 - DNA, 15 bp, Homo sapiens
ccaagtctccatgaa

SEQ ID NO: 280158 - DNA, 15 bp, Homo sapiens
cccaagtctccatga

SEQ ID NO: 280159 - DNA, 15 bp, Homo sapiens
tcccaagtctccatg

SEQ ID NO: 280160 - DNA, 15 bp, Homo sapiens
ttcccaagtctccat

SEQ ID NO: 280161 - DNA, 15 bp, Homo sapiens
attcccaagtctcca

SEQ ID NO: 280162 - DNA, 15 bp, Homo sapiens
aattcccaagtctcc

SEQ ID NO: 280163 - DNA, 15 bp, Homo sapiens
gaattcccaagtctc

SEQ ID NO: 280164 - DNA, 15 bp, Homo sapiens
agaattcccaagtct

SEQ ID NO: 280165 - DNA, 15 bp, Homo sapiens
aagaattcccaagtc

SEQ ID NO: 280166 - DNA, 15 bp, Homo sapiens
gaagaattcccaagt

SEQ ID NO: 280167 - DNA, 15 bp, Homo sapiens
ggaagaattcccaag

SEQ ID NO: 280168 - DNA, 15 bp, Homo sapiens
aggaagaattcccaa

SEQ ID NO: 280169 - DNA, 15 bp, Homo sapiens
taggaagaattccca

SEQ ID NO: 280170 - DNA, 15 bp, Homo sapiens
ctaggaagaattccc

SEQ ID NO: 280171 - DNA, 15 bp, Homo sapiens
cctaggaagaattcc

SEQ ID NO: 280172 - DNA, 15 bp, Homo sapiens
gcctaggaagaattc

SEQ ID NO: 280173 - DNA, 15 bp, Homo sapiens
tgcctaggaagaatt

SEQ ID NO: 280174 - DNA, 15 bp, Homo sapiens
ctgcctaggaagaat

SEQ ID NO: 280175 - DNA, 15 bp, Homo sapiens
actgcctaggaagaa

SEQ ID NO: 280176 - DNA, 15 bp, Homo sapiens
tactgcctaggaaga

SEQ ID NO: 280177 - DNA, 15 bp, Homo sapiens
atactgcctaggaag

SEQ ID NO: 280178 - DNA, 15 bp, Homo sapiens
tatactgcctaggaa

SEQ ID NO: 280179 - DNA, 15 bp, Homo sapiens
atatactgcctagga

SEQ ID NO: 280180 - DNA, 15 bp, Homo sapiens
catatactgcctagg

SEQ ID NO: 280181 - DNA, 15 bp, Homo sapiens
tcatatactgcctag

SEQ ID NO: 280182 - DNA, 15 bp, Homo sapiens
gtcatatactgccta

SEQ ID NO: 280183 - DNA, 15 bp, Homo sapiens
tgtcatatactgcct

SEQ ID NO: 280184 - DNA, 15 bp, Homo sapiens
atgtcatatactgcc

SEQ ID NO: 280185 - DNA, 15 bp, Homo sapiens
gatgtcatatactgc

SEQ ID NO: 280186 - DNA, 15 bp, Homo sapiens
ggatgtcatatactg

SEQ ID NO: 280187 - DNA, 15 bp, Homo sapiens
gggatgtcatatact

SEQ ID NO: 280188 - DNA, 15 bp, Homo sapiens
ggggatgtcatatac

SEQ ID NO: 280189 - DNA, 15 bp, Homo sapiens
tggggatgtcatata

SEQ ID NO: 280190 - DNA, 15 bp, Homo sapiens
ctggggatgtcatat

SEQ ID NO: 280191 - DNA, 15 bp, Homo sapiens
gctggggatgtcata

SEQ ID NO: 280192 - DNA, 15 bp, Homo sapiens
tgctggggatgtcat

SEQ ID NO: 280193 - DNA, 15 bp, Homo sapiens
atgctggggatgtca

SEQ ID NO: 280194 - DNA, 15 bp, Homo sapiens
aatgctggggatgtc

SEQ ID NO: 280195 - DNA, 15 bp, Homo sapiens
taatgctggggatgt

SEQ ID NO: 280196 - DNA, 15 bp, Homo sapiens
ttaatgctggggatg

SEQ ID NO: 280197 - DNA, 15 bp, Homo sapiens
cttaatgctggggat

SEQ ID NO: 280198 - DNA, 15 bp, Homo sapiens
tcttaatgctgggga

SEQ ID NO: 280199 - DNA, 15 bp, Homo sapiens
ctcttaatgctgggg

SEQ ID NO: 280200 - DNA, 15 bp, Homo sapiens
actcttaatgctggg

SEQ ID NO: 280201 - DNA, 15 bp, Homo sapiens
cactcttaatgctgg

SEQ ID NO: 280202 - DNA, 15 bp, Homo sapiens
tcactcttaatgctg

SEQ ID NO: 280203 - DNA, 15 bp, Homo sapiens
gtcactcttaatgct

SEQ ID NO: 280204 - DNA, 15 bp, Homo sapiens
tgtcactcttaatgc

SEQ ID NO: 280205 - DNA, 15 bp, Homo sapiens
gtgtcactcttaatg

SEQ ID NO: 280206 - DNA, 15 bp, Homo sapiens
agtgtcactcttaat

SEQ ID NO: 280207 - DNA, 15 bp, Homo sapiens
cagtgtcactcttaa

SEQ ID NO: 280208 - DNA, 15 bp, Homo sapiens
tcagtgtcactctta

SEQ ID NO: 280209 - DNA, 15 bp, Homo sapiens
ttcagtgtcactctt

SEQ ID NO: 280210 - DNA, 15 bp, Homo sapiens
attcagtgtcactct

SEQ ID NO: 280211 - DNA, 15 bp, Homo sapiens
cattcagtgtcactc

SEQ ID NO: 280212 - DNA, 15 bp, Homo sapiens
tcattcagtgtcact

SEQ ID NO: 280213 - DNA, 15 bp, Homo sapiens
atcattcagtgtcac

SEQ ID NO: 280214 - DNA, 15 bp, Homo sapiens
gatcattcagtgtca

SEQ ID NO: 280215 - DNA, 15 bp, Homo sapiens
agatcattcagtgtc

SEQ ID NO: 280216 - DNA, 15 bp, Homo sapiens
cagatcattcagtgt

SEQ ID NO: 280217 - DNA, 15 bp, Homo sapiens
ccagatcattcagtg

SEQ ID NO: 280218 - DNA, 15 bp, Homo sapiens
gccagatcattcagt

SEQ ID NO: 280219 - DNA, 15 bp, Homo sapiens
gtgtctggagccaga

SEQ ID NO: 280220 - DNA, 15 bp, Homo sapiens
tgtgtctggagccag

SEQ ID NO: 280221 - DNA, 15 bp, Homo sapiens
ttgtgtctggagcca

SEQ ID NO: 280222 - DNA, 15 bp, Homo sapiens
cttgtgtctggagcc

SEQ ID NO: 280223 - DNA, 15 bp, Homo sapiens
gcttgtgtctggagc

SEQ ID NO: 280224 - DNA, 15 bp, Homo sapiens
ggcttgtgtctggag

SEQ ID NO: 280225 - DNA, 15 bp, Homo sapiens
gggcttgtgtctgga

SEQ ID NO: 280226 - DNA, 15 bp, Homo sapiens
ggggcttgtgtctgg

SEQ ID NO: 280227 - DNA, 15 bp, Homo sapiens
aggggcttgtgtctg

SEQ ID NO: 280228 - DNA, 15 bp, Homo sapiens
caggggcttgtgtct

SEQ ID NO: 280229 - DNA, 15 bp, Homo sapiens
tcaggggcttgtgtc

SEQ ID NO: 280230 - DNA, 15 bp, Homo sapiens
ctcaggggcttgtgt

SEQ ID NO: 280231 - DNA, 15 bp, Homo sapiens
actcaggggcttgtg

SEQ ID NO: 280232 - DNA, 15 bp, Homo sapiens
gactcaggggcttgt

SEQ ID NO: 280233 - DNA, 15 bp, Homo sapiens
tgactcaggggcttg

SEQ ID NO: 280234 - DNA, 15 bp, Homo sapiens
ttgactcaggggctt

SEQ ID NO: 280235 - DNA, 15 bp, Homo sapiens
cttgactcaggggct

SEQ ID NO: 280236 - DNA, 15 bp, Homo sapiens
gcttgactcaggggc

SEQ ID NO: 280237 - DNA, 15 bp, Homo sapiens
tgcttgactcagggg

SEQ ID NO: 280238 - DNA, 15 bp, Homo sapiens
ctgcttgactcaggg

SEQ ID NO: 280239 - DNA, 15 bp, Homo sapiens
tctgcttgactcagg

SEQ ID NO: 280240 - DNA, 15 bp, Homo sapiens
ttctgcttgactcag

SEQ ID NO: 280241 - DNA, 15 bp, Homo sapiens
aaaaacttgttctgc

SEQ ID NO: 280242 - DNA, 15 bp, Homo sapiens
aaaaaacttgttctg

SEQ ID NO: 280243 - DNA, 15 bp, Homo sapiens
aaaaaaacttgttct

SEQ ID NO: 280244 - DNA, 15 bp, Homo sapiens
caaaaaaacttgttc

SEQ ID NO: 280245 - DNA, 15 bp, Homo sapiens
gcaaaaaaacttgtt

SEQ ID NO: 280246 - DNA, 15 bp, Homo sapiens
tgcaaaaaaacttgt

SEQ ID NO: 280247 - DNA, 15 bp, Homo sapiens
atgcaaaaaaacttg

SEQ ID NO: 280248 - DNA, 15 bp, Homo sapiens
gatgcaaaaaaactt

SEQ ID NO: 280249 - DNA, 15 bp, Homo sapiens
cgatgcaaaaaaact

SEQ ID NO: 280250 - DNA, 15 bp, Homo sapiens
tcgatgcaaaaaaac

SEQ ID NO: 280251 - DNA, 15 bp, Homo sapiens
atcgatgcaaaaaaa

SEQ ID NO: 280252 - DNA, 15 bp, Homo sapiens
aatcgatgcaaaaaa

SEQ ID NO: 280253 - DNA, 15 bp, Homo sapiens
gaatcgatgcaaaaa

SEQ ID NO: 280254 - DNA, 15 bp, Homo sapiens
tgaatcgatgcaaaa

SEQ ID NO: 280255 - DNA, 15 bp, Homo sapiens
atgaatcgatgcaaa

SEQ ID NO: 280256 - DNA, 15 bp, Homo sapiens
tatgaatcgatgcaa

SEQ ID NO: 280257 - DNA, 15 bp, Homo sapiens
ctatgaatcgatgca

SEQ ID NO: 280258 - DNA, 15 bp, Homo sapiens
actatgaatcgatgc

SEQ ID NO: 280259 - DNA, 15 bp, Homo sapiens
aactatgaatcgatg

SEQ ID NO: 280260 - DNA, 15 bp, Homo sapiens
aaactatgaatcgat

SEQ ID NO: 280261 - DNA, 15 bp, Homo sapiens
taaactatgaatcga

SEQ ID NO: 280262 - DNA, 15 bp, Homo sapiens
ttaaactatgaatcg

SEQ ID NO: 280263 - DNA, 15 bp, Homo sapiens
tttaaactatgaatc

SEQ ID NO: 280264 - DNA, 15 bp, Homo sapiens
gtttaaactatgaat

SEQ ID NO: 280265 - DNA, 15 bp, Homo sapiens
agtttaaactatgaa

SEQ ID NO: 280266 - DNA, 15 bp, Homo sapiens
aagtttaaactatga

SEQ ID NO: 280267 - DNA, 15 bp, Homo sapiens
gaagtttaaactatg

SEQ ID NO: 280268 - DNA, 15 bp, Homo sapiens
agaagtttaaactat

SEQ ID NO: 280269 - DNA, 15 bp, Homo sapiens
tagaagtttaaacta

SEQ ID NO: 280270 - DNA, 15 bp, Homo sapiens
ttagaagtttaaact

SEQ ID NO: 280271 - DNA, 15 bp, Homo sapiens
tttagaagtttaaac

SEQ ID NO: 280272 - DNA, 15 bp, Homo sapiens
ttttagaagtttaaa

SEQ ID NO: 280273 - DNA, 15 bp, Homo sapiens
tttttagaagtttaa

SEQ ID NO: 280274 - DNA, 15 bp, Homo sapiens
ttttttagaagttta

SEQ ID NO: 280275 - DNA, 15 bp, Homo sapiens
gttttttagaagttt

SEQ ID NO: 280276 - DNA, 15 bp, Homo sapiens
agttttttagaagtt

SEQ ID NO: 280277 - DNA, 15 bp, Homo sapiens
aagttttttagaagt

SEQ ID NO: 280278 - DNA, 15 bp, Homo sapiens
aaagttttttagaag

SEQ ID NO: 280279 - DNA, 15 bp, Homo sapiens
aaaagttttttagaa

SEQ ID NO: 280280 - DNA, 15 bp, Homo sapiens
aaaaaaagtttttta

SEQ ID NO: 280281 - DNA, 15 bp, Homo sapiens
caaaaaaaagttttt

SEQ ID NO: 280282 - DNA, 15 bp, Homo sapiens
tcaaaaaaaagtttt

SEQ ID NO: 280283 - DNA, 15 bp, Homo sapiens
ttcaaaaaaaagttt

SEQ ID NO: 280284 - DNA, 15 bp, Homo sapiens
cttcaaaaaaaagtt

SEQ ID NO: 280285 - DNA, 15 bp, Homo sapiens
tcttcaaaaaaaagt

SEQ ID NO: 280286 - DNA, 15 bp, Homo sapiens
ttcttcaaaaaaaag

SEQ ID NO: 280287 - DNA, 15 bp, Homo sapiens
tttcttcaaaaaaaa

SEQ ID NO: 280288 - DNA, 15 bp, Homo sapiens
ttttcttcaaaaaaa

SEQ ID NO: 280289 - DNA, 15 bp, Homo sapiens
attttcttcaaaaaa

SEQ ID NO: 280290 - DNA, 15 bp, Homo sapiens
cattttcttcaaaaa

SEQ ID NO: 280291 - DNA, 15 bp, Homo sapiens
acattttcttcaaaa

SEQ ID NO: 280292 - DNA, 15 bp, Homo sapiens
tacattttcttcaaa

SEQ ID NO: 280293 - DNA, 15 bp, Homo sapiens
atacattttcttcaa

SEQ ID NO: 280294 - DNA, 15 bp, Homo sapiens
gatacattttcttca

SEQ ID NO: 280295 - DNA, 15 bp, Homo sapiens
tgatacattttcttc

SEQ ID NO: 280296 - DNA, 15 bp, Homo sapiens
atgatacattttctt

SEQ ID NO: 280297 - DNA, 15 bp, Homo sapiens
catgatacattttct

SEQ ID NO: 280298 - DNA, 15 bp, Homo sapiens
tcatgatacattttc

SEQ ID NO: 280299 - DNA, 15 bp, Homo sapiens
atcatgatacatttt

SEQ ID NO: 280300 - DNA, 15 bp, Homo sapiens
gatcatgatacattt

SEQ ID NO: 280301 - DNA, 15 bp, Homo sapiens
agatcatgatacatt

SEQ ID NO: 280302 - DNA, 15 bp, Homo sapiens
gagatcatgatacat

SEQ ID NO: 280303 - DNA, 15 bp, Homo sapiens
tgagatcatgataca

SEQ ID NO: 280304 - DNA, 15 bp, Homo sapiens
ctgagatcatgatac

SEQ ID NO: 280305 - DNA, 15 bp, Homo sapiens
cctgagatcatgata

SEQ ID NO: 280306 - DNA, 15 bp, Homo sapiens
tcctgagatcatgat

SEQ ID NO: 280307 - DNA, 15 bp, Homo sapiens
ttcctgagatcatga

SEQ ID NO: 280308 - DNA, 15 bp, Homo sapiens
cttcctgagatcatg

SEQ ID NO: 280309 - DNA, 15 bp, Homo sapiens
acttcctgagatcat

SEQ ID NO: 280310 - DNA, 15 bp, Homo sapiens
aacttcctgagatca

SEQ ID NO: 280311 - DNA, 15 bp, Homo sapiens
caacttcctgagatc

SEQ ID NO: 280312 - DNA, 15 bp, Homo sapiens
gcaacttcctgagat

SEQ ID NO: 280313 - DNA, 15 bp, Homo sapiens
ggcaacttcctgaga

SEQ ID NO: 280314 - DNA, 15 bp, Homo sapiens
aggcaacttcctgag

SEQ ID NO: 280315 - DNA, 15 bp, Homo sapiens
aaggcaacttcctga

SEQ ID NO: 280316 - DNA, 15 bp, Homo sapiens
gaaggcaacttcctg

SEQ ID NO: 280317 - DNA, 15 bp, Homo sapiens
tgaaggcaacttcct

SEQ ID NO: 280318 - DNA, 15 bp, Homo sapiens
ctgaaggcaacttcc

SEQ ID NO: 280319 - DNA, 15 bp, Homo sapiens
actgaaggcaacttc

SEQ ID NO: 280320 - DNA, 15 bp, Homo sapiens
cactgaaggcaactt

SEQ ID NO: 280321 - DNA, 15 bp, Homo sapiens
acactgaaggcaact

SEQ ID NO: 280322 - DNA, 15 bp, Homo sapiens
aacactgaaggcaac

SEQ ID NO: 280323 - DNA, 15 bp, Homo sapiens
taacactgaaggcaa

SEQ ID NO: 280324 - DNA, 15 bp, Homo sapiens
ataacactgaaggca

SEQ ID NO: 280325 - DNA, 15 bp, Homo sapiens
aataacactgaaggc

SEQ ID NO: 280326 - DNA, 15 bp, Homo sapiens
aaataacactgaagg

SEQ ID NO: 280327 - DNA, 15 bp, Homo sapiens
taaataacactgaag

SEQ ID NO: 280328 - DNA, 15 bp, Homo sapiens
ataaataacactgaa

SEQ ID NO: 280329 - DNA, 15 bp, Homo sapiens
cataaataacactga

SEQ ID NO: 280330 - DNA, 15 bp, Homo sapiens
tcataaataacactg

SEQ ID NO: 280331 - DNA, 15 bp, Homo sapiens
atcataaataacact

SEQ ID NO: 280332 - DNA, 15 bp, Homo sapiens
catcataaataacac

SEQ ID NO: 280333 - DNA, 15 bp, Homo sapiens
acatcataaataaca

SEQ ID NO: 280334 - DNA, 15 bp, Homo sapiens
cacatcataaataac

SEQ ID NO: 280335 - DNA, 15 bp, Homo sapiens
tcacatcataaataa

SEQ ID NO: 280336 - DNA, 15 bp, Homo sapiens
gtcacatcataaata

SEQ ID NO: 280337 - DNA, 15 bp, Homo sapiens
tgtcacatcataaat

SEQ ID NO: 280338 - DNA, 15 bp, Homo sapiens
atgtcacatcataaa

SEQ ID NO: 280339 - DNA, 15 bp, Homo sapiens
aatgtcacatcataa

SEQ ID NO: 280340 - DNA, 15 bp, Homo sapiens
aaatgtcacatcata

SEQ ID NO: 280341 - DNA, 15 bp, Homo sapiens
aaaatgtcacatcat

SEQ ID NO: 280342 - DNA, 15 bp, Homo sapiens
aaaaatgtcacatca

SEQ ID NO: 280343 - DNA, 15 bp, Homo sapiens
caaaaatgtcacatc

SEQ ID NO: 280344 - DNA, 15 bp, Homo sapiens
ccaaaaatgtcacat

SEQ ID NO: 280345 - DNA, 15 bp, Homo sapiens
accaaaaatgtcaca

SEQ ID NO: 280346 - DNA, 15 bp, Homo sapiens
caccaaaaatgtcac

SEQ ID NO: 280347 - DNA, 15 bp, Homo sapiens
ccaccaaaaatgtca

SEQ ID NO: 280348 - DNA, 15 bp, Homo sapiens
cccaccaaaaatgtc

SEQ ID NO: 280349 - DNA, 15 bp, Homo sapiens
tcccaccaaaaatgt

SEQ ID NO: 280350 - DNA, 15 bp, Homo sapiens
atcccaccaaaaatg

SEQ ID NO: 280351 - DNA, 15 bp, Homo sapiens
gatcccaccaaaaat

SEQ ID NO: 280352 - DNA, 15 bp, Homo sapiens
agatcccaccaaaaa

SEQ ID NO: 280353 - DNA, 15 bp, Homo sapiens
tagatcccaccaaaa

SEQ ID NO: 280354 - DNA, 15 bp, Homo sapiens
ctagatcccaccaaa

SEQ ID NO: 280355 - DNA, 15 bp, Homo sapiens
cctagatcccaccaa

SEQ ID NO: 280356 - DNA, 15 bp, Homo sapiens
ccctagatcccacca

SEQ ID NO: 280357 - DNA, 15 bp, Homo sapiens
cccctagatcccacc

SEQ ID NO: 280358 - DNA, 15 bp, Homo sapiens
acccctagatcccac

SEQ ID NO: 280359 - DNA, 15 bp, Homo sapiens
cacccctagatccca

SEQ ID NO: 280360 - DNA, 15 bp, Homo sapiens
ccacccctagatccc

SEQ ID NO: 280361 - DNA, 15 bp, Homo sapiens
accacccctagatcc

SEQ ID NO: 280362 - DNA, 15 bp, Homo sapiens
taccacccctagatc

SEQ ID NO: 280363 - DNA, 15 bp, Homo sapiens
ataccacccctagat

SEQ ID NO: 280364 - DNA, 15 bp, Homo sapiens
gataccacccctaga

SEQ ID NO: 280365 - DNA, 15 bp, Homo sapiens
agataccacccctag

SEQ ID NO: 280366 - DNA, 15 bp, Homo sapiens
tagataccaccccta

SEQ ID NO: 280367 - DNA, 15 bp, Homo sapiens
ctagataccacccct

SEQ ID NO: 280368 - DNA, 15 bp, Homo sapiens
cctagataccacccc

SEQ ID NO: 280369 - DNA, 15 bp, Homo sapiens
acctagataccaccc

SEQ ID NO: 280370 - DNA, 15 bp, Homo sapiens
aacctagataccacc

SEQ ID NO: 280371 - DNA, 15 bp, Homo sapiens
caacctagataccac

SEQ ID NO: 280372 - DNA, 15 bp, Homo sapiens
gcaacctagatacca

SEQ ID NO: 280373 - DNA, 15 bp, Homo sapiens
tgcaacctagatacc

SEQ ID NO: 280374 - DNA, 15 bp, Homo sapiens
atgcaacctagatac

SEQ ID NO: 280375 - DNA, 15 bp, Homo sapiens
catgcaacctagata

SEQ ID NO: 280376 - DNA, 15 bp, Homo sapiens
acatgcaacctagat

SEQ ID NO: 280377 - DNA, 15 bp, Homo sapiens
aacatgcaacctaga

SEQ ID NO: 280378 - DNA, 15 bp, Homo sapiens
aaacatgcaacctag

SEQ ID NO: 280379 - DNA, 15 bp, Homo sapiens
caaacatgcaaccta

SEQ ID NO: 280380 - DNA, 15 bp, Homo sapiens
acaaacatgcaacct

SEQ ID NO: 280381 - DNA, 15 bp, Homo sapiens
aacaaacatgcaacc

SEQ ID NO: 280382 - DNA, 15 bp, Homo sapiens
gaacaaacatgcaac

SEQ ID NO: 280383 - DNA, 15 bp, Homo sapiens
tgaacaaacatgcaa

SEQ ID NO: 280384 - DNA, 15 bp, Homo sapiens
ttgaacaaacatgca

SEQ ID NO: 280385 - DNA, 15 bp, Homo sapiens
attgaacaaacatgc

SEQ ID NO: 280386 - DNA, 15 bp, Homo sapiens
cattgaacaaacatg

SEQ ID NO: 280387 - DNA, 15 bp, Homo sapiens
acattgaacaaacat

SEQ ID NO: 280388 - DNA, 15 bp, Homo sapiens
cacattgaacaaaca

SEQ ID NO: 280389 - DNA, 15 bp, Homo sapiens
acacattgaacaaac

SEQ ID NO: 280390 - DNA, 15 bp, Homo sapiens
cacacattgaacaaa

SEQ ID NO: 280391 - DNA, 15 bp, Homo sapiens
acacacattgaacaa

SEQ ID NO: 280392 - DNA, 15 bp, Homo sapiens
cacacacattgaaca

SEQ ID NO: 280393 - DNA, 15 bp, Homo sapiens
acacacacattgaac

SEQ ID NO: 280394 - DNA, 15 bp, Homo sapiens
cacacacacattgaa

SEQ ID NO: 280395 - DNA, 15 bp, Homo sapiens
tcacacacacattga

SEQ ID NO: 280396 - DNA, 15 bp, Homo sapiens
ctcacacacacattg

SEQ ID NO: 280397 - DNA, 15 bp, Homo sapiens
cctcacacacacatt

SEQ ID NO: 280398 - DNA, 15 bp, Homo sapiens
acctcacacacacat

SEQ ID NO: 280399 - DNA, 15 bp, Homo sapiens
aacctcacacacaca

SEQ ID NO: 280400 - DNA, 15 bp, Homo sapiens
caacctcacacacac

SEQ ID NO: 280401 - DNA, 15 bp, Homo sapiens
tcaacctcacacaca

SEQ ID NO: 280402 - DNA, 15 bp, Homo sapiens
ctcaacctcacacac

SEQ ID NO: 280403 - DNA, 15 bp, Homo sapiens
cctcaacctcacaca

SEQ ID NO: 280404 - DNA, 15 bp, Homo sapiens
acctcaacctcacac

SEQ ID NO: 280405 - DNA, 15 bp, Homo sapiens
tacctcaacctcaca

SEQ ID NO: 280406 - DNA, 15 bp, Homo sapiens
atacctcaacctcac

SEQ ID NO: 280407 - DNA, 15 bp, Homo sapiens
aatacctcaacctca

SEQ ID NO: 280408 - DNA, 15 bp, Homo sapiens
aaatacctcaacctc

SEQ ID NO: 280409 - DNA, 15 bp, Homo sapiens
aaaatacctcaacct

SEQ ID NO: 280410 - DNA, 15 bp, Homo sapiens
caaaatacctcaacc

SEQ ID NO: 280411 - DNA, 15 bp, Homo sapiens
ccaaaatacctcaac

SEQ ID NO: 280412 - DNA, 15 bp, Homo sapiens
cccaaaatacctcaa

SEQ ID NO: 280413 - DNA, 15 bp, Homo sapiens
acccaaaatacctca

SEQ ID NO: 280414 - DNA, 15 bp, Homo sapiens
tacccaaaatacctc

SEQ ID NO: 280415 - DNA, 15 bp, Homo sapiens
gtacccaaaatacct

SEQ ID NO: 280416 - DNA, 15 bp, Homo sapiens
tgtacccaaaatacc

SEQ ID NO: 280417 - DNA, 15 bp, Homo sapiens
atgtacccaaaatac

SEQ ID NO: 280418 - DNA, 15 bp, Homo sapiens
gatgtacccaaaata

SEQ ID NO: 280419 - DNA, 15 bp, Homo sapiens
agatgtacccaaaat

SEQ ID NO: 280420 - DNA, 15 bp, Homo sapiens
cagatgtacccaaaa

SEQ ID NO: 280421 - DNA, 15 bp, Homo sapiens
ccagatgtacccaaa

SEQ ID NO: 280422 - DNA, 15 bp, Homo sapiens
cccagatgtacccaa

SEQ ID NO: 280423 - DNA, 15 bp, Homo sapiens
acccagatgtaccca

SEQ ID NO: 280424 - DNA, 15 bp, Homo sapiens
aacccagatgtaccc

SEQ ID NO: 280425 - DNA, 15 bp, Homo sapiens
aaacccagatgtacc

SEQ ID NO: 280426 - DNA, 15 bp, Homo sapiens
caaacccagatgtac

SEQ ID NO: 280427 - DNA, 15 bp, Homo sapiens
ccaaacccagatgta

SEQ ID NO: 280428 - DNA, 15 bp, Homo sapiens
tccaaacccagatgt

SEQ ID NO: 280429 - DNA, 15 bp, Homo sapiens
atccaaacccagatg

SEQ ID NO: 280430 - DNA, 15 bp, Homo sapiens
catccaaacccagat

SEQ ID NO: 280431 - DNA, 15 bp, Homo sapiens
acatccaaacccaga

SEQ ID NO: 280432 - DNA, 15 bp, Homo sapiens
aacatccaaacccag

SEQ ID NO: 280433 - DNA, 15 bp, Homo sapiens
aaacatccaaaccca

SEQ ID NO: 280434 - DNA, 15 bp, Homo sapiens
taaacatccaaaccc

SEQ ID NO: 280435 - DNA, 15 bp, Homo sapiens
gtaaacatccaaacc

SEQ ID NO: 280436 - DNA, 15 bp, Homo sapiens
tgtaaacatccaaac

SEQ ID NO: 280437 - DNA, 15 bp, Homo sapiens
atgtaaacatccaaa

SEQ ID NO: 280438 - DNA, 15 bp, Homo sapiens
aatgtaaacatccaa

SEQ ID NO: 280439 - DNA, 15 bp, Homo sapiens
aaatgtaaacatcca

SEQ ID NO: 280440 - DNA, 15 bp, Homo sapiens
taaatgtaaacatcc

SEQ ID NO: 280441 - DNA, 15 bp, Homo sapiens
ttaaatgtaaacatc

SEQ ID NO: 280442 - DNA, 15 bp, Homo sapiens
tttaaatgtaaacat

SEQ ID NO: 280443 - DNA, 15 bp, Homo sapiens
ttttaaatgtaaaca

SEQ ID NO: 280444 - DNA, 15 bp, Homo sapiens
attttaaatgtaaac

SEQ ID NO: 280445 - DNA, 15 bp, Homo sapiens
aattttaaatgtaaa

SEQ ID NO: 280446 - DNA, 15 bp, Homo sapiens
taattttaaatgtaa

SEQ ID NO: 280447 - DNA, 15 bp, Homo sapiens
gtaattttaaatgta

SEQ ID NO: 280448 - DNA, 15 bp, Homo sapiens
tgtaattttaaatgt

SEQ ID NO: 280449 - DNA, 15 bp, Homo sapiens
atgtaattttaaatg

SEQ ID NO: 280450 - DNA, 15 bp, Homo sapiens
catgtaattttaaat

SEQ ID NO: 280451 - DNA, 15 bp, Homo sapiens
tcatgtaattttaaa

SEQ ID NO: 280452 - DNA, 15 bp, Homo sapiens
ttcatgtaattttaa

SEQ ID NO: 280453 - DNA, 15 bp, Homo sapiens
cttcatgtaatttta

SEQ ID NO: 280454 - DNA, 15 bp, Homo sapiens
tcttcatgtaatttt

SEQ ID NO: 280455 - DNA, 15 bp, Homo sapiens
ttcttcatgtaattt

SEQ ID NO: 280456 - DNA, 15 bp, Homo sapiens
gttcttcatgtaatt

SEQ ID NO: 280457 - DNA, 15 bp, Homo sapiens
tgttcttcatgtaat

SEQ ID NO: 280458 - DNA, 15 bp, Homo sapiens
ctgttcttcatgtaa

SEQ ID NO: 280459 - DNA, 15 bp, Homo sapiens
tctgttcttcatgta

SEQ ID NO: 280460 - DNA, 15 bp, Homo sapiens
ttctgttcttcatgt

SEQ ID NO: 280461 - DNA, 15 bp, Homo sapiens
tttctgttcttcatg

SEQ ID NO: 280462 - DNA, 15 bp, Homo sapiens
ttttctgttcttcat

SEQ ID NO: 280463 - DNA, 15 bp, Homo sapiens
cttttctgttcttca

SEQ ID NO: 280464 - DNA, 15 bp, Homo sapiens
acttttctgttcttc

SEQ ID NO: 280465 - DNA, 15 bp, Homo sapiens
gacttttctgttctt

SEQ ID NO: 280466 - DNA, 15 bp, Homo sapiens
agacttttctgttct

SEQ ID NO: 280467 - DNA, 15 bp, Homo sapiens
tagacttttctgttc

SEQ ID NO: 280468 - DNA, 15 bp, Homo sapiens
ttagacttttctgtt

SEQ ID NO: 280469 - DNA, 15 bp, Homo sapiens
attagacttttctgt

SEQ ID NO: 280470 - DNA, 15 bp, Homo sapiens
aattagacttttctg

SEQ ID NO: 280471 - DNA, 15 bp, Homo sapiens
aaattagacttttct

SEQ ID NO: 280472 - DNA, 15 bp, Homo sapiens
aaaattagacttttc

SEQ ID NO: 280473 - DNA, 15 bp, Homo sapiens
taaaattagactttt

SEQ ID NO: 280474 - DNA, 15 bp, Homo sapiens
ataaaattagacttt

SEQ ID NO: 280475 - DNA, 15 bp, Homo sapiens
aataaaattagactt

SEQ ID NO: 280476 - DNA, 15 bp, Homo sapiens
caataaaattagact

SEQ ID NO: 280477 - DNA, 15 bp, Homo sapiens
gcaataaaattagac

SEQ ID NO: 280478 - DNA, 15 bp, Homo sapiens
tgcaataaaattaga

SEQ ID NO: 280479 - DNA, 15 bp, Homo sapiens
gtgcaataaaattag

SEQ ID NO: 280480 - DNA, 15 bp, Homo sapiens
ggtgcaataaaatta

SEQ ID NO: 280481 - DNA, 15 bp, Homo sapiens
aggtgcaataaaatt

SEQ ID NO: 280482 - DNA, 15 bp, Homo sapiens
gaggtgcaataaaat

SEQ ID NO: 280483 - DNA, 15 bp, Homo sapiens
agaggtgcaataaaa

SEQ ID NO: 280484 - DNA, 15 bp, Homo sapiens
cagaggtgcaataaa

SEQ ID NO: 280485 - DNA, 15 bp, Homo sapiens
gcagaggtgcaataa

SEQ ID NO: 280486 - DNA, 15 bp, Homo sapiens
ggcagaggtgcaata

SEQ ID NO: 280487 - DNA, 15 bp, Homo sapiens
tggcagaggtgcaat

SEQ ID NO: 280488 - DNA, 15 bp, Homo sapiens
atggcagaggtgcaa

SEQ ID NO: 280489 - DNA, 15 bp, Homo sapiens
gatggcagaggtgca

SEQ ID NO: 280490 - DNA, 15 bp, Homo sapiens
tgatggcagaggtgc

SEQ ID NO: 280491 - DNA, 15 bp, Homo sapiens
ttgatggcagaggtg

SEQ ID NO: 280492 - DNA, 15 bp, Homo sapiens
gttgatggcagaggt

SEQ ID NO: 280493 - DNA, 15 bp, Homo sapiens
tgttgatggcagagg

SEQ ID NO: 280494 - DNA, 15 bp, Homo sapiens
atgttgatggcagag

SEQ ID NO: 280495 - DNA, 15 bp, Homo sapiens
tatgttgatggcaga

SEQ ID NO: 280496 - DNA, 15 bp, Homo sapiens
atatgttgatggcag

SEQ ID NO: 280497 - DNA, 15 bp, Homo sapiens
tatatgttgatggca

SEQ ID NO: 280498 - DNA, 15 bp, Homo sapiens
ttatatgttgatggc

SEQ ID NO: 280499 - DNA, 15 bp, Homo sapiens
attatatgttgatgg

SEQ ID NO: 280500 - DNA, 15 bp, Homo sapiens
cattatatgttgatg

SEQ ID NO: 280501 - DNA, 15 bp, Homo sapiens
acattatatgttgat

SEQ ID NO: 280502 - DNA, 15 bp, Homo sapiens
tacattatatgttga

SEQ ID NO: 280503 - DNA, 15 bp, Homo sapiens
ctacattatatgttg

SEQ ID NO: 280504 - DNA, 15 bp, Homo sapiens
actacattatatgtt

SEQ ID NO: 280505 - DNA, 15 bp, Homo sapiens
cactacattatatgt

SEQ ID NO: 280506 - DNA, 15 bp, Homo sapiens
acactacattatatg

SEQ ID NO: 280507 - DNA, 15 bp, Homo sapiens
aacactacattatat

SEQ ID NO: 280508 - DNA, 15 bp, Homo sapiens
aaacactacattata

SEQ ID NO: 280509 - DNA, 15 bp, Homo sapiens
gaaacactacattat

SEQ ID NO: 280510 - DNA, 15 bp, Homo sapiens
tgaaacactacatta

SEQ ID NO: 280511 - DNA, 15 bp, Homo sapiens
atgaaacactacatt

SEQ ID NO: 280512 - DNA, 15 bp, Homo sapiens
aatgaaacactacat

SEQ ID NO: 280513 - DNA, 15 bp, Homo sapiens
aaatgaaacactaca

SEQ ID NO: 280514 - DNA, 15 bp, Homo sapiens
aaaatgaaacactac

SEQ ID NO: 280515 - DNA, 15 bp, Homo sapiens
aaaaatgaaacacta

SEQ ID NO: 280516 - DNA, 15 bp, Homo sapiens
taaaaatgaaacact

SEQ ID NO: 280517 - DNA, 15 bp, Homo sapiens
ttaaaaatgaaacac

SEQ ID NO: 280518 - DNA, 15 bp, Homo sapiens
gttaaaaatgaaaca

SEQ ID NO: 280519 - DNA, 15 bp, Homo sapiens
agttaaaaatgaaac

SEQ ID NO: 280520 - DNA, 15 bp, Homo sapiens
aagttaaaaatgaaa

SEQ ID NO: 280521 - DNA, 15 bp, Homo sapiens
gaagttaaaaatgaa

SEQ ID NO: 280522 - DNA, 15 bp, Homo sapiens
tgaagttaaaaatga

SEQ ID NO: 280523 - DNA, 15 bp, Homo sapiens
atgaagttaaaaatg

SEQ ID NO: 280524 - DNA, 15 bp, Homo sapiens
gatgaagttaaaaat

SEQ ID NO: 280525 - DNA, 15 bp, Homo sapiens
agatgaagttaaaaa

SEQ ID NO: 280526 - DNA, 15 bp, Homo sapiens
aagatgaagttaaaa

SEQ ID NO: 280527 - DNA, 15 bp, Homo sapiens
aaagatgaagttaaa

SEQ ID NO: 280528 - DNA, 15 bp, Homo sapiens
gaaagatgaagttaa

SEQ ID NO: 280529 - DNA, 15 bp, Homo sapiens
agaaagatgaagtta

SEQ ID NO: 280530 - DNA, 15 bp, Homo sapiens
tagaaagatgaagtt

SEQ ID NO: 280531 - DNA, 15 bp, Homo sapiens
ttagaaagatgaagt

SEQ ID NO: 280532 - DNA, 15 bp, Homo sapiens
gttagaaagatgaag

SEQ ID NO: 280533 - DNA, 15 bp, Homo sapiens
ggttagaaagatgaa

SEQ ID NO: 280534 - DNA, 15 bp, Homo sapiens
tggttagaaagatga

SEQ ID NO: 280535 - DNA, 15 bp, Homo sapiens
ttggttagaaagatg

SEQ ID NO: 280536 - DNA, 15 bp, Homo sapiens
cttggttagaaagat

SEQ ID NO: 280537 - DNA, 15 bp, Homo sapiens
acttggttagaaaga

SEQ ID NO: 280538 - DNA, 15 bp, Homo sapiens
aacttggttagaaag

SEQ ID NO: 280539 - DNA, 15 bp, Homo sapiens
aaacttggttagaaa

SEQ ID NO: 280540 - DNA, 15 bp, Homo sapiens
gaaacttggttagaa

SEQ ID NO: 280541 - DNA, 15 bp, Homo sapiens
agaaacttggttaga

SEQ ID NO: 280542 - DNA, 15 bp, Homo sapiens
aagaaacttggttag

SEQ ID NO: 280543 - DNA, 15 bp, Homo sapiens
gaagaaacttggtta

SEQ ID NO: 280544 - DNA, 15 bp, Homo sapiens
agaagaaacttggtt

SEQ ID NO: 280545 - DNA, 15 bp, Homo sapiens
gagaagaaacttggt

SEQ ID NO: 280546 - DNA, 15 bp, Homo sapiens
agagaagaaacttgg

SEQ ID NO: 280547 - DNA, 15 bp, Homo sapiens
tagagaagaaacttg

SEQ ID NO: 280548 - DNA, 15 bp, Homo sapiens
ctagagaagaaactt

SEQ ID NO: 280549 - DNA, 15 bp, Homo sapiens
cctagagaagaaact

SEQ ID NO: 280550 - DNA, 15 bp, Homo sapiens
tttcctagagaagaa

SEQ ID NO: 280551 - DNA, 15 bp, Homo sapiens
ttttcctagagaaga

SEQ ID NO: 280552 - DNA, 15 bp, Homo sapiens
tttttcctagagaag

SEQ ID NO: 280553 - DNA, 15 bp, Homo sapiens
gtttttcctagagaa

SEQ ID NO: 280554 - DNA, 15 bp, Homo sapiens
tgtttttcctagaga

SEQ ID NO: 280555 - DNA, 15 bp, Homo sapiens
ttgtttttcctagag

SEQ ID NO: 280556 - DNA, 15 bp, Homo sapiens
tttgtttttcctaga

SEQ ID NO: 280557 - DNA, 15 bp, Homo sapiens
ttttgtttttcctag

SEQ ID NO: 280558 - DNA, 15 bp, Homo sapiens
tttttgtttttccta

SEQ ID NO: 280559 - DNA, 15 bp, Homo sapiens
atttttgtttttcct

SEQ ID NO: 280560 - DNA, 15 bp, Homo sapiens
tatttttgtttttcc

SEQ ID NO: 280561 - DNA, 15 bp, Homo sapiens
atatttttgtttttc

SEQ ID NO: 280562 - DNA, 15 bp, Homo sapiens
catatttttgttttt

SEQ ID NO: 280563 - DNA, 15 bp, Homo sapiens
tcatatttttgtttt

SEQ ID NO: 280564 - DNA, 15 bp, Homo sapiens
atcatatttttgttt

SEQ ID NO: 280565 - DNA, 15 bp, Homo sapiens
aatcatatttttgtt

SEQ ID NO: 280566 - DNA, 15 bp, Homo sapiens
caatcatatttttgt

SEQ ID NO: 280567 - DNA, 15 bp, Homo sapiens
gcaatcatatttttg

SEQ ID NO: 280568 - DNA, 15 bp, Homo sapiens
tgcaatcatattttt

SEQ ID NO: 280569 - DNA, 15 bp, Homo sapiens
atgcaatcatatttt

SEQ ID NO: 280570 - DNA, 15 bp, Homo sapiens
gatgcaatcatattt

SEQ ID NO: 280571 - DNA, 15 bp, Homo sapiens
ggatgcaatcatatt

SEQ ID NO: 280572 - DNA, 15 bp, Homo sapiens
gggatgcaatcatat

SEQ ID NO: 280573 - DNA, 15 bp, Homo sapiens
ggggatgcaatcata

SEQ ID NO: 280574 - DNA, 15 bp, Homo sapiens
gggggatgcaatcat

SEQ ID NO: 280575 - DNA, 15 bp, Homo sapiens
agggggatgcaatca

SEQ ID NO: 280576 - DNA, 15 bp, Homo sapiens
aagggggatgcaatc

SEQ ID NO: 280577 - DNA, 15 bp, Homo sapiens
caagggggatgcaat

SEQ ID NO: 280578 - DNA, 15 bp, Homo sapiens
ccaagggggatgcaa

SEQ ID NO: 280579 - DNA, 15 bp, Homo sapiens
accaagggggatgca

SEQ ID NO: 280580 - DNA, 15 bp, Homo sapiens
taccaagggggatgc

SEQ ID NO: 280581 - DNA, 15 bp, Homo sapiens
ataccaagggggatg

SEQ ID NO: 280582 - DNA, 15 bp, Homo sapiens
tataccaagggggat

SEQ ID NO: 280583 - DNA, 15 bp, Homo sapiens
atataccaaggggga

SEQ ID NO: 280584 - DNA, 15 bp, Homo sapiens
aatataccaaggggg

SEQ ID NO: 280585 - DNA, 15 bp, Homo sapiens
taatataccaagggg

SEQ ID NO: 280586 - DNA, 15 bp, Homo sapiens
ataatataccaaggg

SEQ ID NO: 280587 - DNA, 15 bp, Homo sapiens
tataatataccaagg

SEQ ID NO: 280588 - DNA, 15 bp, Homo sapiens
ctataatataccaag

SEQ ID NO: 280589 - DNA, 15 bp, Homo sapiens
tctataatataccaa

SEQ ID NO: 280590 - DNA, 15 bp, Homo sapiens
ttctataatatacca

SEQ ID NO: 280591 - DNA, 15 bp, Homo sapiens
attctataatatacc

SEQ ID NO: 280592 - DNA, 15 bp, Homo sapiens
cattctataatatac

SEQ ID NO: 280593 - DNA, 15 bp, Homo sapiens
ccattctataatata

SEQ ID NO: 280594 - DNA, 15 bp, Homo sapiens
accattctataatat

SEQ ID NO: 280595 - DNA, 15 bp, Homo sapiens
taccattctataata

SEQ ID NO: 280596 - DNA, 15 bp, Homo sapiens
ataccattctataat

SEQ ID NO: 280597 - DNA, 15 bp, Homo sapiens
gataccattctataa

SEQ ID NO: 280598 - DNA, 15 bp, Homo sapiens
agataccattctata

SEQ ID NO: 280599 - DNA, 15 bp, Homo sapiens
aagataccattctat

SEQ ID NO: 280600 - DNA, 15 bp, Homo sapiens
aaagataccattcta

SEQ ID NO: 280601 - DNA, 15 bp, Homo sapiens
taaagataccattct

SEQ ID NO: 280602 - DNA, 15 bp, Homo sapiens
gtaaagataccattc

SEQ ID NO: 280603 - DNA, 15 bp, Homo sapiens
tgtaaagataccatt

SEQ ID NO: 280604 - DNA, 15 bp, Homo sapiens
atgtaaagataccat

SEQ ID NO: 280605 - DNA, 15 bp, Homo sapiens
aatgtaaagatacca

SEQ ID NO: 280606 - DNA, 15 bp, Homo sapiens
taatgtaaagatacc

SEQ ID NO: 280607 - DNA, 15 bp, Homo sapiens
ataatgtaaagatac

SEQ ID NO: 280608 - DNA, 15 bp, Homo sapiens
aataatgtaaagata

SEQ ID NO: 280609 - DNA, 15 bp, Homo sapiens
gaataatgtaaagat

SEQ ID NO: 280610 - DNA, 15 bp, Homo sapiens
agaataatgtaaaga

SEQ ID NO: 280611 - DNA, 15 bp, Homo sapiens
tagaataatgtaaag

SEQ ID NO: 280612 - DNA, 15 bp, Homo sapiens
atagaataatgtaaa

SEQ ID NO: 280613 - DNA, 15 bp, Homo sapiens
tatagaataatgtaa

SEQ ID NO: 280614 - DNA, 15 bp, Homo sapiens
ttatagaataatgta

SEQ ID NO: 280615 - DNA, 15 bp, Homo sapiens
attatagaataatgt

SEQ ID NO: 280616 - DNA, 15 bp, Homo sapiens
aattatagaataatg

SEQ ID NO: 280617 - DNA, 15 bp, Homo sapiens
aaattatagaataat

SEQ ID NO: 280618 - DNA, 15 bp, Homo sapiens
aaaattatagaataa

SEQ ID NO: 280619 - DNA, 15 bp, Homo sapiens
caaaattatagaata

SEQ ID NO: 280620 - DNA, 15 bp, Homo sapiens
tcaaaattatagaat

SEQ ID NO: 280621 - DNA, 15 bp, Homo sapiens
ctcaaaattatagaa

SEQ ID NO: 280622 - DNA, 15 bp, Homo sapiens
actcaaaattataga

SEQ ID NO: 280623 - DNA, 15 bp, Homo sapiens
aactcaaaattatag

SEQ ID NO: 280624 - DNA, 15 bp, Homo sapiens
taactcaaaattata

SEQ ID NO: 280625 - DNA, 15 bp, Homo sapiens
ataactcaaaattat

SEQ ID NO: 280626 - DNA, 15 bp, Homo sapiens
aataactcaaaatta

SEQ ID NO: 280627 - DNA, 15 bp, Homo sapiens
aaataactcaaaatt

SEQ ID NO: 280628 - DNA, 15 bp, Homo sapiens
aaaataactcaaaat

SEQ ID NO: 280629 - DNA, 15 bp, Homo sapiens
aaaaataactcaaaa

SEQ ID NO: 280630 - DNA, 15 bp, Homo sapiens
caaaaataactcaaa

SEQ ID NO: 280631 - DNA, 15 bp, Homo sapiens
tcaaaaataactcaa

SEQ ID NO: 280632 - DNA, 15 bp, Homo sapiens
ctcaaaaataactca

SEQ ID NO: 280633 - DNA, 15 bp, Homo sapiens
gctcaaaaataactc

SEQ ID NO: 280634 - DNA, 15 bp, Homo sapiens
tgctcaaaaataact

SEQ ID NO: 280635 - DNA, 15 bp, Homo sapiens
atgctcaaaaataac

SEQ ID NO: 280636 - DNA, 15 bp, Homo sapiens
aatgctcaaaaataa

SEQ ID NO: 280637 - DNA, 15 bp, Homo sapiens
gaatgctcaaaaata

SEQ ID NO: 280638 - DNA, 15 bp, Homo sapiens
agaatgctcaaaaat

SEQ ID NO: 280639 - DNA, 15 bp, Homo sapiens
cagaatgctcaaaaa

SEQ ID NO: 280640 - DNA, 15 bp, Homo sapiens
ccagaatgctcaaaa

SEQ ID NO: 280641 - DNA, 15 bp, Homo sapiens
accagaatgctcaaa

SEQ ID NO: 280642 - DNA, 15 bp, Homo sapiens
aaccagaatgctcaa

SEQ ID NO: 280643 - DNA, 15 bp, Homo sapiens
aaaccagaatgctca

SEQ ID NO: 280644 - DNA, 15 bp, Homo sapiens
aaaaccagaatgctc

SEQ ID NO: 280645 - DNA, 15 bp, Homo sapiens
aaaaaccagaatgct

SEQ ID NO: 280646 - DNA, 15 bp, Homo sapiens
aaaaaaccagaatgc

SEQ ID NO: 280647 - DNA, 15 bp, Homo sapiens
gaaaaaaccagaatg

SEQ ID NO: 280648 - DNA, 15 bp, Homo sapiens
ggaaaaaaccagaat

SEQ ID NO: 280649 - DNA, 15 bp, Homo sapiens
gggaaaaaaccagaa

SEQ ID NO: 280650 - DNA, 15 bp, Homo sapiens
ggggaaaaaaccaga

SEQ ID NO: 280651 - DNA, 15 bp, Homo sapiens
tggggaaaaaaccag

SEQ ID NO: 280652 - DNA, 15 bp, Homo sapiens
ctggggaaaaaacca

SEQ ID NO: 280653 - DNA, 15 bp, Homo sapiens
actggggaaaaaacc

SEQ ID NO: 280654 - DNA, 15 bp, Homo sapiens
tactggggaaaaaac

SEQ ID NO: 280655 - DNA, 15 bp, Homo sapiens
atactggggaaaaaa

SEQ ID NO: 280656 - DNA, 15 bp, Homo sapiens
catactggggaaaaa

SEQ ID NO: 280657 - DNA, 15 bp, Homo sapiens
tcatactggggaaaa

SEQ ID NO: 280658 - DNA, 15 bp, Homo sapiens
gtcatactggggaaa

SEQ ID NO: 280659 - DNA, 15 bp, Homo sapiens
agtcatactggggaa

SEQ ID NO: 280660 - DNA, 15 bp, Homo sapiens
cagtcatactgggga

SEQ ID NO: 280661 - DNA, 15 bp, Homo sapiens
acagtcatactgggg

SEQ ID NO: 280662 - DNA, 15 bp, Homo sapiens
aacagtcatactggg

SEQ ID NO: 280663 - DNA, 15 bp, Homo sapiens
aaacagtcatactgg

SEQ ID NO: 280664 - DNA, 15 bp, Homo sapiens
taaacagtcatactg

SEQ ID NO: 280665 - DNA, 15 bp, Homo sapiens
ttaaacagtcatact

SEQ ID NO: 280666 - DNA, 15 bp, Homo sapiens
tttaaacagtcatac

SEQ ID NO: 280667 - DNA, 15 bp, Homo sapiens
ctttaaacagtcata

SEQ ID NO: 280668 - DNA, 15 bp, Homo sapiens
tctttaaacagtcat

SEQ ID NO: 280669 - DNA, 15 bp, Homo sapiens
atctttaaacagtca

SEQ ID NO: 280670 - DNA, 15 bp, Homo sapiens
catctttaaacagtc

SEQ ID NO: 280671 - DNA, 15 bp, Homo sapiens
acatctttaaacagt

SEQ ID NO: 280672 - DNA, 15 bp, Homo sapiens
cacatctttaaacag

SEQ ID NO: 280673 - DNA, 15 bp, Homo sapiens
acacatctttaaaca

SEQ ID NO: 280674 - DNA, 15 bp, Homo sapiens
aacacatctttaaac

SEQ ID NO: 280675 - DNA, 15 bp, Homo sapiens
aaacacatctttaaa

SEQ ID NO: 280676 - DNA, 15 bp, Homo sapiens
caaacacatctttaa

SEQ ID NO: 280677 - DNA, 15 bp, Homo sapiens
gcaaacacatcttta

SEQ ID NO: 280678 - DNA, 15 bp, Homo sapiens
agcaaacacatcttt

SEQ ID NO: 280679 - DNA, 15 bp, Homo sapiens
tagcaaacacatctt

SEQ ID NO: 280680 - DNA, 15 bp, Homo sapiens
atagcaaacacatct

SEQ ID NO: 280681 - DNA, 15 bp, Homo sapiens
gatagcaaacacatc

SEQ ID NO: 280682 - DNA, 15 bp, Homo sapiens
ggatagcaaacacat

SEQ ID NO: 280683 - DNA, 15 bp, Homo sapiens
aggatagcaaacaca

SEQ ID NO: 280684 - DNA, 15 bp, Homo sapiens
aaggatagcaaacac

SEQ ID NO: 280685 - DNA, 15 bp, Homo sapiens
caaggatagcaaaca

SEQ ID NO: 280686 - DNA, 15 bp, Homo sapiens
tcaaggatagcaaac

SEQ ID NO: 280687 - DNA, 15 bp, Homo sapiens
ttcaaggatagcaaa

SEQ ID NO: 280688 - DNA, 15 bp, Homo sapiens
gttcaaggatagcaa

SEQ ID NO: 280689 - DNA, 15 bp, Homo sapiens
tgttcaaggatagca

SEQ ID NO: 280690 - DNA, 15 bp, Homo sapiens
ttgttcaaggatagc

SEQ ID NO: 280691 - DNA, 15 bp, Homo sapiens
tttgttcaaggatag

SEQ ID NO: 280692 - DNA, 15 bp, Homo sapiens
atttgttcaaggata

SEQ ID NO: 280693 - DNA, 15 bp, Homo sapiens
tatttgttcaaggat

SEQ ID NO: 280694 - DNA, 15 bp, Homo sapiens
atatttgttcaagga

SEQ ID NO: 280695 - DNA, 15 bp, Homo sapiens
gatatttgttcaagg

SEQ ID NO: 280696 - DNA, 15 bp, Homo sapiens
ggatatttgttcaag

SEQ ID NO: 280697 - DNA, 15 bp, Homo sapiens
aggatatttgttcaa

SEQ ID NO: 280698 - DNA, 15 bp, Homo sapiens
caggatatttgttca

SEQ ID NO: 280699 - DNA, 15 bp, Homo sapiens
acaggatatttgttc

SEQ ID NO: 280700 - DNA, 15 bp, Homo sapiens
tacaggatatttgtt

SEQ ID NO: 280701 - DNA, 15 bp, Homo sapiens
ttacaggatatttgt

SEQ ID NO: 280702 - DNA, 15 bp, Homo sapiens
attacaggatatttg

SEQ ID NO: 280703 - DNA, 15 bp, Homo sapiens
tattacaggatattt

SEQ ID NO: 280704 - DNA, 15 bp, Homo sapiens
atattacaggatatt

SEQ ID NO: 280705 - DNA, 15 bp, Homo sapiens
gatattacaggatat

SEQ ID NO: 280706 - DNA, 15 bp, Homo sapiens
agatattacaggata

SEQ ID NO: 280707 - DNA, 15 bp, Homo sapiens
cagatattacaggat

SEQ ID NO: 280708 - DNA, 15 bp, Homo sapiens
acagatattacagga

SEQ ID NO: 280709 - DNA, 15 bp, Homo sapiens
cacagatattacagg

SEQ ID NO: 280710 - DNA, 15 bp, Homo sapiens
tcacagatattacag

SEQ ID NO: 280711 - DNA, 15 bp, Homo sapiens
ttcacagatattaca

SEQ ID NO: 280712 - DNA, 15 bp, Homo sapiens
tttcacagatattac

SEQ ID NO: 280713 - DNA, 15 bp, Homo sapiens
ttttcacagatatta

SEQ ID NO: 280714 - DNA, 15 bp, Homo sapiens
cttttcacagatatt

SEQ ID NO: 280715 - DNA, 15 bp, Homo sapiens
ccttttcacagatat

SEQ ID NO: 280716 - DNA, 15 bp, Homo sapiens
gccttttcacagata

SEQ ID NO: 280717 - DNA, 15 bp, Homo sapiens
ggccttttcacagat

SEQ ID NO: 280718 - DNA, 15 bp, Homo sapiens
gggccttttcacaga

SEQ ID NO: 280719 - DNA, 15 bp, Homo sapiens
ggggccttttcacag

SEQ ID NO: 280720 - DNA, 15 bp, Homo sapiens
aggggccttttcaca

SEQ ID NO: 280721 - DNA, 15 bp, Homo sapiens
caggggccttttcac

SEQ ID NO: 280722 - DNA, 15 bp, Homo sapiens
gcaggggccttttca

SEQ ID NO: 280723 - DNA, 15 bp, Homo sapiens
tgcaggggccttttc

SEQ ID NO: 280724 - DNA, 15 bp, Homo sapiens
ctgcaggggcctttt

SEQ ID NO: 280725 - DNA, 15 bp, Homo sapiens
tctgcaggggccttt

SEQ ID NO: 280726 - DNA, 15 bp, Homo sapiens
gtctgcaggggcctt

SEQ ID NO: 280727 - DNA, 15 bp, Homo sapiens
agtctgcaggggcct

SEQ ID NO: 280728 - DNA, 15 bp, Homo sapiens
gagtctgcaggggcc

SEQ ID NO: 280729 - DNA, 15 bp, Homo sapiens
agagtctgcaggggc

SEQ ID NO: 280730 - DNA, 15 bp, Homo sapiens
aagagtctgcagggg

SEQ ID NO: 280731 - DNA, 15 bp, Homo sapiens
caagagtctgcaggg

SEQ ID NO: 280732 - DNA, 15 bp, Homo sapiens
tcaagagtctgcagg

SEQ ID NO: 280733 - DNA, 15 bp, Homo sapiens
ttcaagagtctgcag

SEQ ID NO: 280734 - DNA, 15 bp, Homo sapiens
attcaagagtctgca

SEQ ID NO: 280735 - DNA, 15 bp, Homo sapiens
tattcaagagtctgc

SEQ ID NO: 280736 - DNA, 15 bp, Homo sapiens
gtattcaagagtctg

SEQ ID NO: 280737 - DNA, 15 bp, Homo sapiens
tgtattcaagagtct

SEQ ID NO: 280738 - DNA, 15 bp, Homo sapiens
gtgtattcaagagtc

SEQ ID NO: 280739 - DNA, 15 bp, Homo sapiens
cgtgtattcaagagt

SEQ ID NO: 280740 - DNA, 15 bp, Homo sapiens
ccgtgtattcaagag

SEQ ID NO: 280741 - DNA, 15 bp, Homo sapiens
gccgtgtattcaaga

SEQ ID NO: 280742 - DNA, 15 bp, Homo sapiens
cgccgtgtattcaag

SEQ ID NO: 280743 - DNA, 15 bp, Homo sapiens
tcgccgtgtattcaa

SEQ ID NO: 280744 - DNA, 15 bp, Homo sapiens
gtcgccgtgtattca

SEQ ID NO: 280745 - DNA, 15 bp, Homo sapiens
agtcgccgtgtattc

SEQ ID NO: 280746 - DNA, 15 bp, Homo sapiens
aagtcgccgtgtatt

SEQ ID NO: 280747 - DNA, 15 bp, Homo sapiens
gaagtcgccgtgtat

SEQ ID NO: 280748 - DNA, 15 bp, Homo sapiens
agaagtcgccgtgta

SEQ ID NO: 280749 - DNA, 15 bp, Homo sapiens
gagaagtcgccgtgt

SEQ ID NO: 280750 - DNA, 15 bp, Homo sapiens
agagaagtcgccgtg

SEQ ID NO: 280751 - DNA, 15 bp, Homo sapiens
tagagaagtcgccgt

SEQ ID NO: 280752 - DNA, 15 bp, Homo sapiens
ctagagaagtcgccg

SEQ ID NO: 280753 - DNA, 15 bp, Homo sapiens
tctagagaagtcgcc

SEQ ID NO: 280754 - DNA, 15 bp, Homo sapiens
ttctagagaagtcgc

SEQ ID NO: 280755 - DNA, 15 bp, Homo sapiens
attctagagaagtcg

SEQ ID NO: 280756 - DNA, 15 bp, Homo sapiens
tattctagagaagtc

SEQ ID NO: 280757 - DNA, 15 bp, Homo sapiens
gtattctagagaagt

SEQ ID NO: 280758 - DNA, 15 bp, Homo sapiens
tgtattctagagaag

SEQ ID NO: 280759 - DNA, 15 bp, Homo sapiens
gtgtattctagagaa

SEQ ID NO: 280760 - DNA, 15 bp, Homo sapiens
agtgtattctagaga

SEQ ID NO: 280761 - DNA, 15 bp, Homo sapiens
cagtgtattctagag

SEQ ID NO: 280762 - DNA, 15 bp, Homo sapiens
acagtgtattctaga

SEQ ID NO: 280763 - DNA, 15 bp, Homo sapiens
cacagtgtattctag

SEQ ID NO: 280764 - DNA, 15 bp, Homo sapiens
tcacagtgtattcta

SEQ ID NO: 280765 - DNA, 15 bp, Homo sapiens
gtcacagtgtattct

SEQ ID NO: 280766 - DNA, 15 bp, Homo sapiens
agtcacagtgtattc

SEQ ID NO: 280767 - DNA, 15 bp, Homo sapiens
aagtcacagtgtatt

SEQ ID NO: 280768 - DNA, 15 bp, Homo sapiens
gaagtcacagtgtat

SEQ ID NO: 280769 - DNA, 15 bp, Homo sapiens
agaagtcacagtgta

SEQ ID NO: 280770 - DNA, 15 bp, Homo sapiens
cagaagtcacagtgt

SEQ ID NO: 280771 - DNA, 15 bp, Homo sapiens
acagaagtcacagtg

SEQ ID NO: 280772 - DNA, 15 bp, Homo sapiens
aacagaagtcacagt

SEQ ID NO: 280773 - DNA, 15 bp, Homo sapiens
taacagaagtcacag

SEQ ID NO: 280774 - DNA, 15 bp, Homo sapiens
gtaacagaagtcaca

SEQ ID NO: 280775 - DNA, 15 bp, Homo sapiens
agtaacagaagtcac

SEQ ID NO: 280776 - DNA, 15 bp, Homo sapiens
aagtaacagaagtca

SEQ ID NO: 280777 - DNA, 15 bp, Homo sapiens
aaagtaacagaagtc

SEQ ID NO: 280778 - DNA, 15 bp, Homo sapiens
aaaagtaacagaagt

SEQ ID NO: 280779 - DNA, 15 bp, Homo sapiens
caaaagtaacagaag

SEQ ID NO: 280780 - DNA, 15 bp, Homo sapiens
tcaaaagtaacagaa

SEQ ID NO: 280781 - DNA, 15 bp, Homo sapiens
atcaaaagtaacaga

SEQ ID NO: 280782 - DNA, 15 bp, Homo sapiens
aatcaaaagtaacag

SEQ ID NO: 280783 - DNA, 15 bp, Homo sapiens
aaatcaaaagtaaca

SEQ ID NO: 280784 - DNA, 15 bp, Homo sapiens
gaaatcaaaagtaac

SEQ ID NO: 280785 - DNA, 15 bp, Homo sapiens
ggaaatcaaaagtaa

SEQ ID NO: 280786 - DNA, 15 bp, Homo sapiens
gggaaatcaaaagta

SEQ ID NO: 280787 - DNA, 15 bp, Homo sapiens
ggggaaatcaaaagt

SEQ ID NO: 280788 - DNA, 15 bp, Homo sapiens
tggggaaatcaaaag

SEQ ID NO: 280789 - DNA, 15 bp, Homo sapiens
atggggaaatcaaaa

SEQ ID NO: 280790 - DNA, 15 bp, Homo sapiens
catggggaaatcaaa

SEQ ID NO: 280791 - DNA, 15 bp, Homo sapiens
ccatggggaaatcaa

SEQ ID NO: 280792 - DNA, 15 bp, Homo sapiens
accatggggaaatca

SEQ ID NO: 280793 - DNA, 15 bp, Homo sapiens
caccatggggaaatc

SEQ ID NO: 280794 - DNA, 15 bp, Homo sapiens
ccaccatggggaaat

SEQ ID NO: 280795 - DNA, 15 bp, Homo sapiens
gccaccatggggaaa

SEQ ID NO: 280796 - DNA, 15 bp, Homo sapiens
agccaccatggggaa

SEQ ID NO: 280797 - DNA, 15 bp, Homo sapiens
gagccaccatgggga

SEQ ID NO: 280798 - DNA, 15 bp, Homo sapiens
agagccaccatgggg

SEQ ID NO: 280799 - DNA, 15 bp, Homo sapiens
gagagccaccatggg

SEQ ID NO: 280800 - DNA, 15 bp, Homo sapiens
tgagagccaccatgg

SEQ ID NO: 280801 - DNA, 15 bp, Homo sapiens
ctgagagccaccatg

SEQ ID NO: 280802 - DNA, 15 bp, Homo sapiens
cctgagagccaccat

SEQ ID NO: 280803 - DNA, 15 bp, Homo sapiens
ccctgagagccacca

SEQ ID NO: 280804 - DNA, 15 bp, Homo sapiens
gccctgagagccacc

SEQ ID NO: 280805 - DNA, 15 bp, Homo sapiens
tgccctgagagccac

SEQ ID NO: 280806 - DNA, 15 bp, Homo sapiens
ttgccctgagagcca

SEQ ID NO: 280807 - DNA, 15 bp, Homo sapiens
gttgccctgagagcc

SEQ ID NO: 280808 - DNA, 15 bp, Homo sapiens
ggttgccctgagagc

SEQ ID NO: 280809 - DNA, 15 bp, Homo sapiens
tggttgccctgagag

SEQ ID NO: 280810 - DNA, 15 bp, Homo sapiens
gtggttgccctgaga

SEQ ID NO: 280811 - DNA, 15 bp, Homo sapiens
tgtggttgccctgag

SEQ ID NO: 280812 - DNA, 15 bp, Homo sapiens
atgtggttgccctga

SEQ ID NO: 280813 - DNA, 15 bp, Homo sapiens
tatgtggttgccctg

SEQ ID NO: 280814 - DNA, 15 bp, Homo sapiens
atatgtggttgccct

SEQ ID NO: 280815 - DNA, 15 bp, Homo sapiens
tatatgtggttgccc

SEQ ID NO: 280816 - DNA, 15 bp, Homo sapiens
atatatgtggttgcc

SEQ ID NO: 280817 - DNA, 15 bp, Homo sapiens
catatatgtggttgc

SEQ ID NO: 280818 - DNA, 15 bp, Homo sapiens
tcatatatgtggttg

SEQ ID NO: 280819 - DNA, 15 bp, Homo sapiens
ctcatatatgtggtt

SEQ ID NO: 280820 - DNA, 15 bp, Homo sapiens
gctcatatatgtggt

SEQ ID NO: 280821 - DNA, 15 bp, Homo sapiens
cgctcatatatgtgg

SEQ ID NO: 280822 - DNA, 15 bp, Homo sapiens
ccgctcatatatgtg

SEQ ID NO: 280823 - DNA, 15 bp, Homo sapiens
tccgctcatatatgt

SEQ ID NO: 280824 - DNA, 15 bp, Homo sapiens
ttccgctcatatatg

SEQ ID NO: 280825 - DNA, 15 bp, Homo sapiens
cttccgctcatatat

SEQ ID NO: 280826 - DNA, 15 bp, Homo sapiens
tcttccgctcatata

SEQ ID NO: 280827 - DNA, 15 bp, Homo sapiens
atcttccgctcatat

SEQ ID NO: 280828 - DNA, 15 bp, Homo sapiens
tatcttccgctcata

SEQ ID NO: 280829 - DNA, 15 bp, Homo sapiens
ttatcttccgctcat

SEQ ID NO: 280830 - DNA, 15 bp, Homo sapiens
attatcttccgctca

SEQ ID NO: 280831 - DNA, 15 bp, Homo sapiens
aattatcttccgctc

SEQ ID NO: 280832 - DNA, 15 bp, Homo sapiens
caattatcttccgct

SEQ ID NO: 280833 - DNA, 15 bp, Homo sapiens
tcaattatcttccgc

SEQ ID NO: 280834 - DNA, 15 bp, Homo sapiens
ctcaattatcttccg

SEQ ID NO: 280835 - DNA, 15 bp, Homo sapiens
tctcaattatcttcc

SEQ ID NO: 280836 - DNA, 15 bp, Homo sapiens
ttctcaattatcttc

SEQ ID NO: 280837 - DNA, 15 bp, Homo sapiens
attctcaattatctt

SEQ ID NO: 280838 - DNA, 15 bp, Homo sapiens
gattctcaattatct

SEQ ID NO: 280839 - DNA, 15 bp, Homo sapiens
agattctcaattatc

SEQ ID NO: 280840 - DNA, 15 bp, Homo sapiens
gagattctcaattat

SEQ ID NO: 280841 - DNA, 15 bp, Homo sapiens
ggagattctcaatta

SEQ ID NO: 280842 - DNA, 15 bp, Homo sapiens
gggagattctcaatt

SEQ ID NO: 280843 - DNA, 15 bp, Homo sapiens
ggggagattctcaat

SEQ ID NO: 280844 - DNA, 15 bp, Homo sapiens
tggggagattctcaa

SEQ ID NO: 280845 - DNA, 15 bp, Homo sapiens
gtggggagattctca

SEQ ID NO: 280846 - DNA, 15 bp, Homo sapiens
tgtggggagattctc

SEQ ID NO: 280847 - DNA, 15 bp, Homo sapiens
gtgtggggagattct

SEQ ID NO: 280848 - DNA, 15 bp, Homo sapiens
ggtgtggggagattc

SEQ ID NO: 280849 - DNA, 15 bp, Homo sapiens
gggtgtggggagatt

SEQ ID NO: 280850 - DNA, 15 bp, Homo sapiens
ggggtgtggggagat

SEQ ID NO: 280851 - DNA, 15 bp, Homo sapiens
gggggtgtggggaga

SEQ ID NO: 280852 - DNA, 15 bp, Homo sapiens
tgggggtgtggggag

SEQ ID NO: 280853 - DNA, 15 bp, Homo sapiens
gtgggggtgtgggga

SEQ ID NO: 280854 - DNA, 15 bp, Homo sapiens
gcagtgggggtgtgg

SEQ ID NO: 280855 - DNA, 15 bp, Homo sapiens
agcagtgggggtgtg

SEQ ID NO: 280856 - DNA, 15 bp, Homo sapiens
aagcagtgggggtgt

SEQ ID NO: 280857 - DNA, 15 bp, Homo sapiens
aaagcagtgggggtg

SEQ ID NO: 280858 - DNA, 15 bp, Homo sapiens
aaaagcagtgggggt

SEQ ID NO: 280859 - DNA, 15 bp, Homo sapiens
caaaagcagtggggg

SEQ ID NO: 280860 - DNA, 15 bp, Homo sapiens
acaaaagcagtgggg

SEQ ID NO: 280861 - DNA, 15 bp, Homo sapiens
gacaaaagcagtggg

SEQ ID NO: 280862 - DNA, 15 bp, Homo sapiens
agacaaaagcagtgg

SEQ ID NO: 280863 - DNA, 15 bp, Homo sapiens
aagacaaaagcagtg

SEQ ID NO: 280864 - DNA, 15 bp, Homo sapiens
taagacaaaagcagt

SEQ ID NO: 280865 - DNA, 15 bp, Homo sapiens
ttaagacaaaagcag

SEQ ID NO: 280866 - DNA, 15 bp, Homo sapiens
tttaagacaaaagca

SEQ ID NO: 280867 - DNA, 15 bp, Homo sapiens
atttaagacaaaagc

SEQ ID NO: 280868 - DNA, 15 bp, Homo sapiens
aatttaagacaaaag

SEQ ID NO: 280869 - DNA, 15 bp, Homo sapiens
caatttaagacaaaa

SEQ ID NO: 280870 - DNA, 15 bp, Homo sapiens
gcaatttaagacaaa

SEQ ID NO: 280871 - DNA, 15 bp, Homo sapiens
agcaatttaagacaa

SEQ ID NO: 280872 - DNA, 15 bp, Homo sapiens
gagcaatttaagaca

SEQ ID NO: 280873 - DNA, 15 bp, Homo sapiens
agagcaatttaagac

SEQ ID NO: 280874 - DNA, 15 bp, Homo sapiens
tagagcaatttaaga

SEQ ID NO: 280875 - DNA, 15 bp, Homo sapiens
ttagagcaatttaag

SEQ ID NO: 280876 - DNA, 15 bp, Homo sapiens
tttagagcaatttaa

SEQ ID NO: 280877 - DNA, 15 bp, Homo sapiens
ctttagagcaattta

SEQ ID NO: 280878 - DNA, 15 bp, Homo sapiens
actttagagcaattt

SEQ ID NO: 280879 - DNA, 15 bp, Homo sapiens
cactttagagcaatt

SEQ ID NO: 280880 - DNA, 15 bp, Homo sapiens
acactttagagcaat

SEQ ID NO: 280881 - DNA, 15 bp, Homo sapiens
aacactttagagcaa

SEQ ID NO: 280882 - DNA, 15 bp, Homo sapiens
aaacactttagagca

SEQ ID NO: 280883 - DNA, 15 bp, Homo sapiens
caaacactttagagc

SEQ ID NO: 280884 - DNA, 15 bp, Homo sapiens
acaaacactttagag

SEQ ID NO: 280885 - DNA, 15 bp, Homo sapiens
aacaaacactttaga

SEQ ID NO: 280886 - DNA, 15 bp, Homo sapiens
gaacaaacactttag

SEQ ID NO: 280887 - DNA, 15 bp, Homo sapiens
agaacaaacacttta

SEQ ID NO: 280888 - DNA, 15 bp, Homo sapiens
cagaacaaacacttt

SEQ ID NO: 280889 - DNA, 15 bp, Homo sapiens
acagaacaaacactt

SEQ ID NO: 280890 - DNA, 15 bp, Homo sapiens
cacagaacaaacact

SEQ ID NO: 280891 - DNA, 15 bp, Homo sapiens
tcacagaacaaacac

SEQ ID NO: 280892 - DNA, 15 bp, Homo sapiens
gtcacagaacaaaca

SEQ ID NO: 280893 - DNA, 15 bp, Homo sapiens
agtcacagaacaaac

SEQ ID NO: 280894 - DNA, 15 bp, Homo sapiens
aagtcacagaacaaa

SEQ ID NO: 280895 - DNA, 15 bp, Homo sapiens
aaagtcacagaacaa

SEQ ID NO: 280896 - DNA, 15 bp, Homo sapiens
aaaagtcacagaaca

SEQ ID NO: 280897 - DNA, 15 bp, Homo sapiens
caaaagtcacagaac

SEQ ID NO: 280898 - DNA, 15 bp, Homo sapiens
acaaaagtcacagaa

SEQ ID NO: 280899 - DNA, 15 bp, Homo sapiens
gacaaaagtcacaga

SEQ ID NO: 280900 - DNA, 15 bp, Homo sapiens
agacaaaagtcacag

SEQ ID NO: 280901 - DNA, 15 bp, Homo sapiens
gagacaaaagtcaca

SEQ ID NO: 280902 - DNA, 15 bp, Homo sapiens
ggagacaaaagtcac

SEQ ID NO: 280903 - DNA, 15 bp, Homo sapiens
gggagacaaaagtca

SEQ ID NO: 280904 - DNA, 15 bp, Homo sapiens
agggagacaaaagtc

SEQ ID NO: 280905 - DNA, 15 bp, Homo sapiens
gagggagacaaaagt

SEQ ID NO: 280906 - DNA, 15 bp, Homo sapiens
agagggagacaaaag

SEQ ID NO: 280907 - DNA, 15 bp, Homo sapiens
gagagggagacaaaa

SEQ ID NO: 280908 - DNA, 15 bp, Homo sapiens
ggagagggagacaaa

SEQ ID NO: 280909 - DNA, 15 bp, Homo sapiens
gggagagggagacaa

SEQ ID NO: 280910 - DNA, 15 bp, Homo sapiens
ggggagagggagaca

SEQ ID NO: 280911 - DNA, 15 bp, Homo sapiens
aggggagagggagac

SEQ ID NO: 280912 - DNA, 15 bp, Homo sapiens
gaggggagagggaga

SEQ ID NO: 280913 - DNA, 15 bp, Homo sapiens
agaggggagagggag

SEQ ID NO: 280914 - DNA, 15 bp, Homo sapiens
caaagaggggagagg

SEQ ID NO: 280915 - DNA, 15 bp, Homo sapiens
gcaaagaggggagag

SEQ ID NO: 280916 - DNA, 15 bp, Homo sapiens
tgcaaagaggggaga

SEQ ID NO: 280917 - DNA, 15 bp, Homo sapiens
ctgcaaagaggggag

SEQ ID NO: 280918 - DNA, 15 bp, Homo sapiens
actgcaaagagggga

SEQ ID NO: 280919 - DNA, 15 bp, Homo sapiens
gactgcaaagagggg

SEQ ID NO: 280920 - DNA, 15 bp, Homo sapiens
ggactgcaaagaggg

SEQ ID NO: 280921 - DNA, 15 bp, Homo sapiens
aggactgcaaagagg

SEQ ID NO: 280922 - DNA, 15 bp, Homo sapiens
taggactgcaaagag

SEQ ID NO: 280923 - DNA, 15 bp, Homo sapiens
ataggactgcaaaga

SEQ ID NO: 280924 - DNA, 15 bp, Homo sapiens
gataggactgcaaag

SEQ ID NO: 280925 - DNA, 15 bp, Homo sapiens
tgataggactgcaaa

SEQ ID NO: 280926 - DNA, 15 bp, Homo sapiens
gtgataggactgcaa

SEQ ID NO: 280927 - DNA, 15 bp, Homo sapiens
tgtgataggactgca

SEQ ID NO: 280928 - DNA, 15 bp, Homo sapiens
gtgtgataggactgc

SEQ ID NO: 280929 - DNA, 15 bp, Homo sapiens
agtgtgataggactg

SEQ ID NO: 280930 - DNA, 15 bp, Homo sapiens
gagtgtgataggact

SEQ ID NO: 280931 - DNA, 15 bp, Homo sapiens
tgagtgtgataggac

SEQ ID NO: 280932 - DNA, 15 bp, Homo sapiens
atgagtgtgatagga

SEQ ID NO: 280933 - DNA, 15 bp, Homo sapiens
gatgagtgtgatagg

SEQ ID NO: 280934 - DNA, 15 bp, Homo sapiens
tgatgagtgtgatag

SEQ ID NO: 280935 - DNA, 15 bp, Homo sapiens
ctgatgagtgtgata

SEQ ID NO: 280936 - DNA, 15 bp, Homo sapiens
actgatgagtgtgat

SEQ ID NO: 280937 - DNA, 15 bp, Homo sapiens
tactgatgagtgtga

SEQ ID NO: 280938 - DNA, 15 bp, Homo sapiens
atactgatgagtgtg

SEQ ID NO: 280939 - DNA, 15 bp, Homo sapiens
catactgatgagtgt

SEQ ID NO: 280940 - DNA, 15 bp, Homo sapiens
acatactgatgagtg

SEQ ID NO: 280941 - DNA, 15 bp, Homo sapiens
cacatactgatgagt

SEQ ID NO: 280942 - DNA, 15 bp, Homo sapiens
ccacatactgatgag

SEQ ID NO: 280943 - DNA, 15 bp, Homo sapiens
gccacatactgatga

SEQ ID NO: 280944 - DNA, 15 bp, Homo sapiens
ggccacatactgatg

SEQ ID NO: 280945 - DNA, 15 bp, Homo sapiens
tggccacatactgat

SEQ ID NO: 280946 - DNA, 15 bp, Homo sapiens
ctggccacatactga

SEQ ID NO: 280947 - DNA, 15 bp, Homo sapiens
tctggccacatactg

SEQ ID NO: 280948 - DNA, 15 bp, Homo sapiens
ctctggccacatact

SEQ ID NO: 280949 - DNA, 15 bp, Homo sapiens
gctctggccacatac

SEQ ID NO: 280950 - DNA, 15 bp, Homo sapiens
tgctctggccacata

SEQ ID NO: 280951 - DNA, 15 bp, Homo sapiens
gtgctctggccacat

SEQ ID NO: 280952 - DNA, 15 bp, Homo sapiens
agtgctctggccaca

SEQ ID NO: 280953 - DNA, 15 bp, Homo sapiens
tagtgctctggccac

SEQ ID NO: 280954 - DNA, 15 bp, Homo sapiens
atagtgctctggcca

SEQ ID NO: 280955 - DNA, 15 bp, Homo sapiens
catagtgctctggcc

SEQ ID NO: 280956 - DNA, 15 bp, Homo sapiens
tcatagtgctctggc

SEQ ID NO: 280957 - DNA, 15 bp, Homo sapiens
ctcatagtgctctgg

SEQ ID NO: 280958 - DNA, 15 bp, Homo sapiens
actcatagtgctctg

SEQ ID NO: 280959 - DNA, 15 bp, Homo sapiens
cactcatagtgctct

SEQ ID NO: 280960 - DNA, 15 bp, Homo sapiens
tcactcatagtgctc

SEQ ID NO: 280961 - DNA, 15 bp, Homo sapiens
ctcactcatagtgct

SEQ ID NO: 280962 - DNA, 15 bp, Homo sapiens
actcactcatagtgc

SEQ ID NO: 280963 - DNA, 15 bp, Homo sapiens
tactcactcatagtg

SEQ ID NO: 280964 - DNA, 15 bp, Homo sapiens
atactcactcatagt

SEQ ID NO: 280965 - DNA, 15 bp, Homo sapiens
aatactcactcatag

SEQ ID NO: 280966 - DNA, 15 bp, Homo sapiens
gaatactcactcata

SEQ ID NO: 280967 - DNA, 15 bp, Homo sapiens
tgaatactcactcat

SEQ ID NO: 280968 - DNA, 15 bp, Homo sapiens
atgaatactcactca

SEQ ID NO: 280969 - DNA, 15 bp, Homo sapiens
tatgaatactcactc

SEQ ID NO: 280970 - DNA, 15 bp, Homo sapiens
ctatgaatactcact

SEQ ID NO: 280971 - DNA, 15 bp, Homo sapiens
gctatgaatactcac

SEQ ID NO: 280972 - DNA, 15 bp, Homo sapiens
ggctatgaatactca

SEQ ID NO: 280973 - DNA, 15 bp, Homo sapiens
gggctatgaatactc

SEQ ID NO: 280974 - DNA, 15 bp, Homo sapiens
tgggctatgaatact

SEQ ID NO: 280975 - DNA, 15 bp, Homo sapiens
gtgggctatgaatac

SEQ ID NO: 280976 - DNA, 15 bp, Homo sapiens
cgtgggctatgaata

SEQ ID NO: 280977 - DNA, 15 bp, Homo sapiens
acgtgggctatgaat

SEQ ID NO: 280978 - DNA, 15 bp, Homo sapiens
cacgtgggctatgaa

SEQ ID NO: 280979 - DNA, 15 bp, Homo sapiens
gcacgtgggctatga

SEQ ID NO: 280980 - DNA, 15 bp, Homo sapiens
tgcacgtgggctatg

SEQ ID NO: 280981 - DNA, 15 bp, Homo sapiens
ctgcacgtgggctat

SEQ ID NO: 280982 - DNA, 15 bp, Homo sapiens
cctgcacgtgggcta

SEQ ID NO: 280983 - DNA, 15 bp, Homo sapiens
tcctgcacgtgggct

SEQ ID NO: 280984 - DNA, 15 bp, Homo sapiens
ctcctgcacgtgggc

SEQ ID NO: 280985 - DNA, 15 bp, Homo sapiens
tctcctgcacgtggg

SEQ ID NO: 280986 - DNA, 15 bp, Homo sapiens
ctctcctgcacgtgg

SEQ ID NO: 280987 - DNA, 15 bp, Homo sapiens
cctctcctgcacgtg

SEQ ID NO: 280988 - DNA, 15 bp, Homo sapiens
acctctcctgcacgt

SEQ ID NO: 280989 - DNA, 15 bp, Homo sapiens
cacctctcctgcacg

SEQ ID NO: 280990 - DNA, 15 bp, Homo sapiens
acacctctcctgcac

SEQ ID NO: 280991 - DNA, 15 bp, Homo sapiens
aacacctctcctgca

SEQ ID NO: 280992 - DNA, 15 bp, Homo sapiens
gaacacctctcctgc

SEQ ID NO: 280993 - DNA, 15 bp, Homo sapiens
agaacacctctcctg

SEQ ID NO: 280994 - DNA, 15 bp, Homo sapiens
cagaacacctctcct

SEQ ID NO: 280995 - DNA, 15 bp, Homo sapiens
tcagaacacctctcc

SEQ ID NO: 280996 - DNA, 15 bp, Homo sapiens
atcagaacacctctc

SEQ ID NO: 280997 - DNA, 15 bp, Homo sapiens
gatcagaacacctct

SEQ ID NO: 280998 - DNA, 15 bp, Homo sapiens
tgatcagaacacctc

SEQ ID NO: 280999 - DNA, 15 bp, Homo sapiens
ctgatcagaacacct

SEQ ID NO: 281000 - DNA, 15 bp, Homo sapiens
actgatcagaacacc

SEQ ID NO: 281001 - DNA, 15 bp, Homo sapiens
cactgatcagaacac

SEQ ID NO: 281002 - DNA, 15 bp, Homo sapiens
ccactgatcagaaca

SEQ ID NO: 281003 - DNA, 15 bp, Homo sapiens
accactgatcagaac

SEQ ID NO: 281004 - DNA, 15 bp, Homo sapiens
taccactgatcagaa

SEQ ID NO: 281005 - DNA, 15 bp, Homo sapiens
gtaccactgatcaga

SEQ ID NO: 281006 - DNA, 15 bp, Homo sapiens
agtaccactgatcag

SEQ ID NO: 281007 - DNA, 15 bp, Homo sapiens
tagtaccactgatca

SEQ ID NO: 281008 - DNA, 15 bp, Homo sapiens
ctagtaccactgatc

SEQ ID NO: 281009 - DNA, 15 bp, Homo sapiens
gctagtaccactgat

SEQ ID NO: 281010 - DNA, 15 bp, Homo sapiens
tgctagtaccactga

SEQ ID NO: 281011 - DNA, 15 bp, Homo sapiens
atgctagtaccactg

SEQ ID NO: 281012 - DNA, 15 bp, Homo sapiens
catgctagtaccact

SEQ ID NO: 281013 - DNA, 15 bp, Homo sapiens
ccatgctagtaccac

SEQ ID NO: 281014 - DNA, 15 bp, Homo sapiens
cccatgctagtacca

SEQ ID NO: 281015 - DNA, 15 bp, Homo sapiens
ccccatgctagtacc

SEQ ID NO: 281016 - DNA, 15 bp, Homo sapiens
cccccatgctagtac

SEQ ID NO: 281017 - DNA, 15 bp, Homo sapiens
acccccatgctagta

SEQ ID NO: 281018 - DNA, 15 bp, Homo sapiens
gacccccatgctagt

SEQ ID NO: 281019 - DNA, 15 bp, Homo sapiens
agacccccatgctag

SEQ ID NO: 281020 - DNA, 15 bp, Homo sapiens
aagacccccatgcta

SEQ ID NO: 281021 - DNA, 15 bp, Homo sapiens
taagacccccatgct

SEQ ID NO: 281022 - DNA, 15 bp, Homo sapiens
gtaagacccccatgc

SEQ ID NO: 281023 - DNA, 15 bp, Homo sapiens
agtaagacccccatg

SEQ ID NO: 281024 - DNA, 15 bp, Homo sapiens
tagtaagacccccat

SEQ ID NO: 281025 - DNA, 15 bp, Homo sapiens
ttagtaagaccccca

SEQ ID NO: 281026 - DNA, 15 bp, Homo sapiens
tttagtaagaccccc

SEQ ID NO: 281027 - DNA, 15 bp, Homo sapiens
gtttagtaagacccc

SEQ ID NO: 281028 - DNA, 15 bp, Homo sapiens
agtttagtaagaccc

SEQ ID NO: 281029 - DNA, 15 bp, Homo sapiens
gagtttagtaagacc

SEQ ID NO: 281030 - DNA, 15 bp, Homo sapiens
agagtttagtaagac

SEQ ID NO: 281031 - DNA, 15 bp, Homo sapiens
aagagtttagtaaga

SEQ ID NO: 281032 - DNA, 15 bp, Homo sapiens
caagagtttagtaag

SEQ ID NO: 281033 - DNA, 15 bp, Homo sapiens
ccaagagtttagtaa

SEQ ID NO: 281034 - DNA, 15 bp, Homo sapiens
accaagagtttagta

SEQ ID NO: 281035 - DNA, 15 bp, Homo sapiens
gaccaagagtttagt

SEQ ID NO: 281036 - DNA, 15 bp, Homo sapiens
agaccaagagtttag

SEQ ID NO: 281037 - DNA, 15 bp, Homo sapiens
tagaccaagagttta

SEQ ID NO: 281038 - DNA, 15 bp, Homo sapiens
ttagaccaagagttt

SEQ ID NO: 281039 - DNA, 15 bp, Homo sapiens
tttagaccaagagtt

SEQ ID NO: 281040 - DNA, 15 bp, Homo sapiens
ttttagaccaagagt

SEQ ID NO: 281041 - DNA, 15 bp, Homo sapiens
attttagaccaagag

SEQ ID NO: 281042 - DNA, 15 bp, Homo sapiens
tattttagaccaaga

SEQ ID NO: 281043 - DNA, 15 bp, Homo sapiens
ttattttagaccaag

SEQ ID NO: 281044 - DNA, 15 bp, Homo sapiens
attattttagaccaa

SEQ ID NO: 281045 - DNA, 15 bp, Homo sapiens
tattattttagacca

SEQ ID NO: 281046 - DNA, 15 bp, Homo sapiens
gtattattttagacc

SEQ ID NO: 281047 - DNA, 15 bp, Homo sapiens
agtattattttagac

SEQ ID NO: 281048 - DNA, 15 bp, Homo sapiens
aagtattattttaga

SEQ ID NO: 281049 - DNA, 15 bp, Homo sapiens
agaagtattatttta

SEQ ID NO: 281050 - DNA, 15 bp, Homo sapiens
cagaagtattatttt

SEQ ID NO: 281051 - DNA, 15 bp, Homo sapiens
acagaagtattattt

SEQ ID NO: 281052 - DNA, 15 bp, Homo sapiens
cacagaagtattatt

SEQ ID NO: 281053 - DNA, 15 bp, Homo sapiens
acacagaagtattat

SEQ ID NO: 281054 - DNA, 15 bp, Homo sapiens
aacacagaagtatta

SEQ ID NO: 281055 - DNA, 15 bp, Homo sapiens
gaacacagaagtatt

SEQ ID NO: 281056 - DNA, 15 bp, Homo sapiens
ggaacacagaagtat

SEQ ID NO: 281057 - DNA, 15 bp, Homo sapiens
cggaacacagaagta

SEQ ID NO: 281058 - DNA, 15 bp, Homo sapiens
ccggaacacagaagt

SEQ ID NO: 281059 - DNA, 15 bp, Homo sapiens
cccggaacacagaag

SEQ ID NO: 281060 - DNA, 15 bp, Homo sapiens
acccggaacacagaa

SEQ ID NO: 281061 - DNA, 15 bp, Homo sapiens
tacccggaacacaga

SEQ ID NO: 281062 - DNA, 15 bp, Homo sapiens
ttacccggaacacag

SEQ ID NO: 281063 - DNA, 15 bp, Homo sapiens
gttacccggaacaca

SEQ ID NO: 281064 - DNA, 15 bp, Homo sapiens
tgttacccggaacac

SEQ ID NO: 281065 - DNA, 15 bp, Homo sapiens
ttgttacccggaaca

SEQ ID NO: 281066 - DNA, 15 bp, Homo sapiens
attgttacccggaac

SEQ ID NO: 281067 - DNA, 15 bp, Homo sapiens
gattgttacccggaa

SEQ ID NO: 281068 - DNA, 15 bp, Homo sapiens
ggattgttacccgga

SEQ ID NO: 281069 - DNA, 15 bp, Homo sapiens
aggattgttacccgg

SEQ ID NO: 281070 - DNA, 15 bp, Homo sapiens
taggattgttacccg

SEQ ID NO: 281071 - DNA, 15 bp, Homo sapiens
ctaggattgttaccc

SEQ ID NO: 281072 - DNA, 15 bp, Homo sapiens
actaggattgttacc

SEQ ID NO: 281073 - DNA, 15 bp, Homo sapiens
cactaggattgttac

SEQ ID NO: 281074 - DNA, 15 bp, Homo sapiens
ccactaggattgtta

SEQ ID NO: 281075 - DNA, 15 bp, Homo sapiens
accactaggattgtt

SEQ ID NO: 281076 - DNA, 15 bp, Homo sapiens
gaccactaggattgt

SEQ ID NO: 281077 - DNA, 15 bp, Homo sapiens
agaccactaggattg

SEQ ID NO: 281078 - DNA, 15 bp, Homo sapiens
cagaccactaggatt

SEQ ID NO: 281079 - DNA, 15 bp, Homo sapiens
acagaccactaggat

SEQ ID NO: 281080 - DNA, 15 bp, Homo sapiens
aacagaccactagga

SEQ ID NO: 281081 - DNA, 15 bp, Homo sapiens
aaacagaccactagg

SEQ ID NO: 281082 - DNA, 15 bp, Homo sapiens
caaacagaccactag

SEQ ID NO: 281083 - DNA, 15 bp, Homo sapiens
gcaaacagaccacta

SEQ ID NO: 281084 - DNA, 15 bp, Homo sapiens
tgcaaacagaccact

SEQ ID NO: 281085 - DNA, 15 bp, Homo sapiens
atgcaaacagaccac

SEQ ID NO: 281086 - DNA, 15 bp, Homo sapiens
catgcaaacagacca

SEQ ID NO: 281087 - DNA, 15 bp, Homo sapiens
ccatgcaaacagacc

SEQ ID NO: 281088 - DNA, 15 bp, Homo sapiens
gccatgcaaacagac

SEQ ID NO: 281089 - DNA, 15 bp, Homo sapiens
tgccatgcaaacaga

SEQ ID NO: 281090 - DNA, 15 bp, Homo sapiens
ctgccatgcaaacag

SEQ ID NO: 281091 - DNA, 15 bp, Homo sapiens
tctgccatgcaaaca

SEQ ID NO: 281092 - DNA, 15 bp, Homo sapiens
atctgccatgcaaac

SEQ ID NO: 281093 - DNA, 15 bp, Homo sapiens
aatctgccatgcaaa

SEQ ID NO: 281094 - DNA, 15 bp, Homo sapiens
gaatctgccatgcaa

SEQ ID NO: 281095 - DNA, 15 bp, Homo sapiens
tgaatctgccatgca

SEQ ID NO: 281096 - DNA, 15 bp, Homo sapiens
atgaatctgccatgc

SEQ ID NO: 281097 - DNA, 15 bp, Homo sapiens
aatgaatctgccatg

SEQ ID NO: 281098 - DNA, 15 bp, Homo sapiens
taatgaatctgccat

SEQ ID NO: 281099 - DNA, 15 bp, Homo sapiens
gtaatgaatctgcca

SEQ ID NO: 281100 - DNA, 15 bp, Homo sapiens
agtaatgaatctgcc

SEQ ID NO: 281101 - DNA, 15 bp, Homo sapiens
aagtaatgaatctgc

SEQ ID NO: 281102 - DNA, 15 bp, Homo sapiens
taagtaatgaatctg

SEQ ID NO: 281103 - DNA, 15 bp, Homo sapiens
ttaagtaatgaatct

SEQ ID NO: 281104 - DNA, 15 bp, Homo sapiens
cttaagtaatgaatc

SEQ ID NO: 281105 - DNA, 15 bp, Homo sapiens
acttaagtaatgaat

SEQ ID NO: 281106 - DNA, 15 bp, Homo sapiens
tacttaagtaatgaa

SEQ ID NO: 281107 - DNA, 15 bp, Homo sapiens
ttacttaagtaatga

SEQ ID NO: 281108 - DNA, 15 bp, Homo sapiens
gttacttaagtaatg

SEQ ID NO: 281109 - DNA, 15 bp, Homo sapiens
ggttacttaagtaat

SEQ ID NO: 281110 - DNA, 15 bp, Homo sapiens
aggttacttaagtaa

SEQ ID NO: 281111 - DNA, 15 bp, Homo sapiens
taggttacttaagta

SEQ ID NO: 281112 - DNA, 15 bp, Homo sapiens
ttaggttacttaagt

SEQ ID NO: 281113 - DNA, 15 bp, Homo sapiens
gttaggttacttaag

SEQ ID NO: 281114 - DNA, 15 bp, Homo sapiens
tgttaggttacttaa

SEQ ID NO: 281115 - DNA, 15 bp, Homo sapiens
atgttaggttactta

SEQ ID NO: 281116 - DNA, 15 bp, Homo sapiens
aatgttaggttactt

SEQ ID NO: 281117 - DNA, 15 bp, Homo sapiens
aaatgttaggttact

SEQ ID NO: 281118 - DNA, 15 bp, Homo sapiens
gaaatgttaggttac

SEQ ID NO: 281119 - DNA, 15 bp, Homo sapiens
agaaatgttaggtta

SEQ ID NO: 281120 - DNA, 15 bp, Homo sapiens
tagaaatgttaggtt

SEQ ID NO: 281121 - DNA, 15 bp, Homo sapiens
ttagaaatgttaggt

SEQ ID NO: 281122 - DNA, 15 bp, Homo sapiens
attagaaatgttagg

SEQ ID NO: 281123 - DNA, 15 bp, Homo sapiens
tattagaaatgttag

SEQ ID NO: 281124 - DNA, 15 bp, Homo sapiens
ctattagaaatgtta

SEQ ID NO: 281125 - DNA, 15 bp, Homo sapiens
actattagaaatgtt

SEQ ID NO: 281126 - DNA, 15 bp, Homo sapiens
tactattagaaatgt

SEQ ID NO: 281127 - DNA, 15 bp, Homo sapiens
ttactattagaaatg

SEQ ID NO: 281128 - DNA, 15 bp, Homo sapiens
gttactattagaaat

SEQ ID NO: 281129 - DNA, 15 bp, Homo sapiens
tgttactattagaaa

SEQ ID NO: 281130 - DNA, 15 bp, Homo sapiens
gtgttactattagaa

SEQ ID NO: 281131 - DNA, 15 bp, Homo sapiens
ggtgttactattaga

SEQ ID NO: 281132 - DNA, 15 bp, Homo sapiens
aggtgttactattag

SEQ ID NO: 281133 - DNA, 15 bp, Homo sapiens
taggtgttactatta

SEQ ID NO: 281134 - DNA, 15 bp, Homo sapiens
ataggtgttactatt

SEQ ID NO: 281135 - DNA, 15 bp, Homo sapiens
gataggtgttactat

SEQ ID NO: 281136 - DNA, 15 bp, Homo sapiens
tgataggtgttacta

SEQ ID NO: 281137 - DNA, 15 bp, Homo sapiens
ttgataggtgttact

SEQ ID NO: 281138 - DNA, 15 bp, Homo sapiens
attgataggtgttac

SEQ ID NO: 281139 - DNA, 15 bp, Homo sapiens
tattgataggtgtta

SEQ ID NO: 281140 - DNA, 15 bp, Homo sapiens
atattgataggtgtt

SEQ ID NO: 281141 - DNA, 15 bp, Homo sapiens
aatattgataggtgt

SEQ ID NO: 281142 - DNA, 15 bp, Homo sapiens
aaatattgataggtg

SEQ ID NO: 281143 - DNA, 15 bp, Homo sapiens
caaatattgataggt

SEQ ID NO: 281144 - DNA, 15 bp, Homo sapiens
ccaaatattgatagg

SEQ ID NO: 281145 - DNA, 15 bp, Homo sapiens
cccaaatattgatag

SEQ ID NO: 281146 - DNA, 15 bp, Homo sapiens
gcccaaatattgata

SEQ ID NO: 281147 - DNA, 15 bp, Homo sapiens
tgcccaaatattgat

SEQ ID NO: 281148 - DNA, 15 bp, Homo sapiens
atgcccaaatattga

SEQ ID NO: 281149 - DNA, 15 bp, Homo sapiens
tatgcccaaatattg

SEQ ID NO: 281150 - DNA, 15 bp, Homo sapiens
ttatgcccaaatatt

SEQ ID NO: 281151 - DNA, 15 bp, Homo sapiens
tttatgcccaaatat

SEQ ID NO: 281152 - DNA, 15 bp, Homo sapiens
ttttatgcccaaata

SEQ ID NO: 281153 - DNA, 15 bp, Homo sapiens
attttatgcccaaat

SEQ ID NO: 281154 - DNA, 15 bp, Homo sapiens
aattttatgcccaaa

SEQ ID NO: 281155 - DNA, 15 bp, Homo sapiens
taattttatgcccaa

SEQ ID NO: 281156 - DNA, 15 bp, Homo sapiens
ataattttatgccca

SEQ ID NO: 281157 - DNA, 15 bp, Homo sapiens
aataattttatgccc

SEQ ID NO: 281158 - DNA, 15 bp, Homo sapiens
caataattttatgcc

SEQ ID NO: 281159 - DNA, 15 bp, Homo sapiens
gcaataattttatgc

SEQ ID NO: 281160 - DNA, 15 bp, Homo sapiens
agcaataattttatg

SEQ ID NO: 281161 - DNA, 15 bp, Homo sapiens
aagcaataattttat

SEQ ID NO: 281162 - DNA, 15 bp, Homo sapiens
aaagcaataatttta

SEQ ID NO: 281163 - DNA, 15 bp, Homo sapiens
caaagcaataatttt

SEQ ID NO: 281164 - DNA, 15 bp, Homo sapiens
acaaagcaataattt

SEQ ID NO: 281165 - DNA, 15 bp, Homo sapiens
aacaaagcaataatt

SEQ ID NO: 281166 - DNA, 15 bp, Homo sapiens
aaacaaagcaataat

SEQ ID NO: 281167 - DNA, 15 bp, Homo sapiens
aaaacaaagcaataa

SEQ ID NO: 281168 - DNA, 15 bp, Homo sapiens
aaaaacaaagcaata

SEQ ID NO: 281169 - DNA, 15 bp, Homo sapiens
aaaaaacaaagcaat

SEQ ID NO: 281170 - DNA, 15 bp, Homo sapiens
aagaaaaaaacaaag

SEQ ID NO: 281171 - DNA, 15 bp, Homo sapiens
aaagaaaaaaacaaa

SEQ ID NO: 281172 - DNA, 15 bp, Homo sapiens
aaaagaaaaaaacaa

SEQ ID NO: 281173 - DNA, 15 bp, Homo sapiens
taaaagaaaaaaaca

SEQ ID NO: 281174 - DNA, 15 bp, Homo sapiens
ttaaaagaaaaaaac

SEQ ID NO: 281175 - DNA, 15 bp, Homo sapiens
tttaaaagaaaaaaa

SEQ ID NO: 281176 - DNA, 15 bp, Homo sapiens
gctttaaaagaaaaa

SEQ ID NO: 281177 - DNA, 15 bp, Homo sapiens
ggctttaaaagaaaa

SEQ ID NO: 281178 - DNA, 15 bp, Homo sapiens
gggctttaaaagaaa

SEQ ID NO: 281179 - DNA, 15 bp, Homo sapiens
ggggctttaaaagaa

SEQ ID NO: 281180 - DNA, 15 bp, Homo sapiens
aggggctttaaaaga

SEQ ID NO: 281181 - DNA, 15 bp, Homo sapiens
gaggggctttaaaag

SEQ ID NO: 281182 - DNA, 15 bp, Homo sapiens
tgaggggctttaaaa

SEQ ID NO: 281183 - DNA, 15 bp, Homo sapiens
gtgaggggctttaaa

SEQ ID NO: 281184 - DNA, 15 bp, Homo sapiens
tgtgaggggctttaa

SEQ ID NO: 281185 - DNA, 15 bp, Homo sapiens
ttgtgaggggcttta

SEQ ID NO: 281186 - DNA, 15 bp, Homo sapiens
attgtgaggggcttt

SEQ ID NO: 281187 - DNA, 15 bp, Homo sapiens
gattgtgaggggctt

SEQ ID NO: 281188 - DNA, 15 bp, Homo sapiens
agattgtgaggggct

SEQ ID NO: 281189 - DNA, 15 bp, Homo sapiens
gagattgtgaggggc

SEQ ID NO: 281190 - DNA, 15 bp, Homo sapiens
ggagattgtgagggg

SEQ ID NO: 281191 - DNA, 15 bp, Homo sapiens
aggagattgtgaggg

SEQ ID NO: 281192 - DNA, 15 bp, Homo sapiens
gaggagattgtgagg

SEQ ID NO: 281193 - DNA, 15 bp, Homo sapiens
tgaggagattgtgag

SEQ ID NO: 281194 - DNA, 15 bp, Homo sapiens
ttgaggagattgtga

SEQ ID NO: 281195 - DNA, 15 bp, Homo sapiens
gttgaggagattgtg

SEQ ID NO: 281196 - DNA, 15 bp, Homo sapiens
agttgaggagattgt

SEQ ID NO: 281197 - DNA, 15 bp, Homo sapiens
cagttgaggagattg

SEQ ID NO: 281198 - DNA, 15 bp, Homo sapiens
acagttgaggagatt

SEQ ID NO: 281199 - DNA, 15 bp, Homo sapiens
aacagttgaggagat

SEQ ID NO: 281200 - DNA, 15 bp, Homo sapiens
aaacagttgaggaga

SEQ ID NO: 281201 - DNA, 15 bp, Homo sapiens
gaaacagttgaggag

SEQ ID NO: 281202 - DNA, 15 bp, Homo sapiens
tgaaacagttgagga

SEQ ID NO: 281203 - DNA, 15 bp, Homo sapiens
atgaaacagttgagg

SEQ ID NO: 281204 - DNA, 15 bp, Homo sapiens
catgaaacagttgag

SEQ ID NO: 281205 - DNA, 15 bp, Homo sapiens
tcatgaaacagttga

SEQ ID NO: 281206 - DNA, 15 bp, Homo sapiens
atcatgaaacagttg

SEQ ID NO: 281207 - DNA, 15 bp, Homo sapiens
catcatgaaacagtt

SEQ ID NO: 281208 - DNA, 15 bp, Homo sapiens
tcatcatgaaacagt

SEQ ID NO: 281209 - DNA, 15 bp, Homo sapiens
gtcatcatgaaacag

SEQ ID NO: 281210 - DNA, 15 bp, Homo sapiens
tgtcatcatgaaaca

SEQ ID NO: 281211 - DNA, 15 bp, Homo sapiens
gtgtcatcatgaaac

SEQ ID NO: 281212 - DNA, 15 bp, Homo sapiens
ggtgtcatcatgaaa

SEQ ID NO: 281213 - DNA, 15 bp, Homo sapiens
gggtgtcatcatgaa

SEQ ID NO: 281214 - DNA, 15 bp, Homo sapiens
tgggtgtcatcatga

SEQ ID NO: 281215 - DNA, 15 bp, Homo sapiens
atgggtgtcatcatg

SEQ ID NO: 281216 - DNA, 15 bp, Homo sapiens
aatgggtgtcatcat

SEQ ID NO: 281217 - DNA, 15 bp, Homo sapiens
gaatgggtgtcatca

SEQ ID NO: 281218 - DNA, 15 bp, Homo sapiens
tgaatgggtgtcatc

SEQ ID NO: 281219 - DNA, 15 bp, Homo sapiens
ttgaatgggtgtcat

SEQ ID NO: 281220 - DNA, 15 bp, Homo sapiens
cttgaatgggtgtca

SEQ ID NO: 281221 - DNA, 15 bp, Homo sapiens
tcttgaatgggtgtc

SEQ ID NO: 281222 - DNA, 15 bp, Homo sapiens
ttcttgaatgggtgt

SEQ ID NO: 281223 - DNA, 15 bp, Homo sapiens
attcttgaatgggtg

SEQ ID NO: 281224 - DNA, 15 bp, Homo sapiens
tattcttgaatgggt

SEQ ID NO: 281225 - DNA, 15 bp, Homo sapiens
ctattcttgaatggg

SEQ ID NO: 281226 - DNA, 15 bp, Homo sapiens
tctattcttgaatgg

SEQ ID NO: 281227 - DNA, 15 bp, Homo sapiens
ttctattcttgaatg

SEQ ID NO: 281228 - DNA, 15 bp, Homo sapiens
gttctattcttgaat

SEQ ID NO: 281229 - DNA, 15 bp, Homo sapiens
tgttctattcttgaa

SEQ ID NO: 281230 - DNA, 15 bp, Homo sapiens
ttgttctattcttga

SEQ ID NO: 281231 - DNA, 15 bp, Homo sapiens
attgttctattcttg

SEQ ID NO: 281232 - DNA, 15 bp, Homo sapiens
tattgttctattctt

SEQ ID NO: 281233 - DNA, 15 bp, Homo sapiens
atattgttctattct

SEQ ID NO: 281234 - DNA, 15 bp, Homo sapiens
catattgttctattc

SEQ ID NO: 281235 - DNA, 15 bp, Homo sapiens
gcatattgttctatt

SEQ ID NO: 281236 - DNA, 15 bp, Homo sapiens
ggcatattgttctat

SEQ ID NO: 281237 - DNA, 15 bp, Homo sapiens
tggcatattgttcta

SEQ ID NO: 281238 - DNA, 15 bp, Homo sapiens
gtggcatattgttct

SEQ ID NO: 281239 - DNA, 15 bp, Homo sapiens
tgtggcatattgttc

SEQ ID NO: 281240 - DNA, 15 bp, Homo sapiens
gtgtggcatattgtt

SEQ ID NO: 281241 - DNA, 15 bp, Homo sapiens
cgtgtggcatattgt

SEQ ID NO: 281242 - DNA, 15 bp, Homo sapiens
ccgtgtggcatattg

SEQ ID NO: 281243 - DNA, 15 bp, Homo sapiens
accgtgtggcatatt

SEQ ID NO: 281244 - DNA, 15 bp, Homo sapiens
taccgtgtggcatat

SEQ ID NO: 281245 - DNA, 15 bp, Homo sapiens
ttaccgtgtggcata

SEQ ID NO: 281246 - DNA, 15 bp, Homo sapiens
cttaccgtgtggcat

SEQ ID NO: 281247 - DNA, 15 bp, Homo sapiens
tcttaccgtgtggca

SEQ ID NO: 281248 - DNA, 15 bp, Homo sapiens
ttcttaccgtgtggc

SEQ ID NO: 281249 - DNA, 15 bp, Homo sapiens
tttcttaccgtgtgg

SEQ ID NO: 281250 - DNA, 15 bp, Homo sapiens
gtttcttaccgtgtg

SEQ ID NO: 281251 - DNA, 15 bp, Homo sapiens
agtttcttaccgtgt

SEQ ID NO: 281252 - DNA, 15 bp, Homo sapiens
aagtttcttaccgtg

SEQ ID NO: 281253 - DNA, 15 bp, Homo sapiens
aaagtttcttaccgt

SEQ ID NO: 281254 - DNA, 15 bp, Homo sapiens
caaagtttcttaccg

SEQ ID NO: 281255 - DNA, 15 bp, Homo sapiens
tcaaagtttcttacc

SEQ ID NO: 281256 - DNA, 15 bp, Homo sapiens
atcaaagtttcttac

SEQ ID NO: 281257 - DNA, 15 bp, Homo sapiens
gatcaaagtttctta

SEQ ID NO: 281258 - DNA, 15 bp, Homo sapiens
tgatcaaagtttctt

SEQ ID NO: 281259 - DNA, 15 bp, Homo sapiens
ctgatcaaagtttct

SEQ ID NO: 281260 - DNA, 15 bp, Homo sapiens
tctgatcaaagtttc

SEQ ID NO: 281261 - DNA, 15 bp, Homo sapiens
ctctgatcaaagttt

SEQ ID NO: 281262 - DNA, 15 bp, Homo sapiens
gctctgatcaaagtt

SEQ ID NO: 281263 - DNA, 15 bp, Homo sapiens
ggctctgatcaaagt

SEQ ID NO: 281264 - DNA, 15 bp, Homo sapiens
gggctctgatcaaag

SEQ ID NO: 281265 - DNA, 15 bp, Homo sapiens
agggctctgatcaaa

SEQ ID NO: 281266 - DNA, 15 bp, Homo sapiens
gagggctctgatcaa

SEQ ID NO: 281267 - DNA, 15 bp, Homo sapiens
ggagggctctgatca

SEQ ID NO: 281268 - DNA, 15 bp, Homo sapiens
tggagggctctgatc

SEQ ID NO: 281269 - DNA, 15 bp, Homo sapiens
gtggagggctctgat

SEQ ID NO: 281270 - DNA, 15 bp, Homo sapiens
agtggagggctctga

SEQ ID NO: 281271 - DNA, 15 bp, Homo sapiens
cagtggagggctctg

SEQ ID NO: 281272 - DNA, 15 bp, Homo sapiens
gcagtggagggctct

SEQ ID NO: 281273 - DNA, 15 bp, Homo sapiens
tgcagtggagggctc

SEQ ID NO: 281274 - DNA, 15 bp, Homo sapiens
gtgcagtggagggct

SEQ ID NO: 281275 - DNA, 15 bp, Homo sapiens
agtgcagtggagggc

SEQ ID NO: 281276 - DNA, 15 bp, Homo sapiens
cagtgcagtggaggg

SEQ ID NO: 281277 - DNA, 15 bp, Homo sapiens
gcagtgcagtggagg

SEQ ID NO: 281278 - DNA, 15 bp, Homo sapiens
ggcagtgcagtggag

SEQ ID NO: 281279 - DNA, 15 bp, Homo sapiens
tggcagtgcagtgga

SEQ ID NO: 281280 - DNA, 15 bp, Homo sapiens
gtggcagtgcagtgg

SEQ ID NO: 281281 - DNA, 15 bp, Homo sapiens
ggtggcagtgcagtg

SEQ ID NO: 281282 - DNA, 15 bp, Homo sapiens
gggtggcagtgcagt

SEQ ID NO: 281283 - DNA, 15 bp, Homo sapiens
tgggtggcagtgcag

SEQ ID NO: 281284 - DNA, 15 bp, Homo sapiens
ctgggtggcagtgca

SEQ ID NO: 281285 - DNA, 15 bp, Homo sapiens
tctgggtggcagtgc

SEQ ID NO: 281286 - DNA, 15 bp, Homo sapiens
ttctgggtggcagtg

SEQ ID NO: 281287 - DNA, 15 bp, Homo sapiens
attctgggtggcagt

SEQ ID NO: 281288 - DNA, 15 bp, Homo sapiens
cattctgggtggcag

SEQ ID NO: 281289 - DNA, 15 bp, Homo sapiens
acattctgggtggca

SEQ ID NO: 281290 - DNA, 15 bp, Homo sapiens
tacattctgggtggc

SEQ ID NO: 281291 - DNA, 15 bp, Homo sapiens
atacattctgggtgg

SEQ ID NO: 281292 - DNA, 15 bp, Homo sapiens
gatacattctgggtg

SEQ ID NO: 281293 - DNA, 15 bp, Homo sapiens
agatacattctgggt

SEQ ID NO: 281294 - DNA, 15 bp, Homo sapiens
tagatacattctggg

SEQ ID NO: 281295 - DNA, 15 bp, Homo sapiens
atagatacattctgg

SEQ ID NO: 281296 - DNA, 15 bp, Homo sapiens
catagatacattctg

SEQ ID NO: 281297 - DNA, 15 bp, Homo sapiens
acatagatacattct

SEQ ID NO: 281298 - DNA, 15 bp, Homo sapiens
gacatagatacattc

SEQ ID NO: 281299 - DNA, 15 bp, Homo sapiens
agacatagatacatt

SEQ ID NO: 281300 - DNA, 15 bp, Homo sapiens
tagacatagatacat

SEQ ID NO: 281301 - DNA, 15 bp, Homo sapiens
ttagacatagataca

SEQ ID NO: 281302 - DNA, 15 bp, Homo sapiens
attagacatagatac

SEQ ID NO: 281303 - DNA, 15 bp, Homo sapiens
aattagacatagata

SEQ ID NO: 281304 - DNA, 15 bp, Homo sapiens
taattagacatagat

SEQ ID NO: 281305 - DNA, 15 bp, Homo sapiens
ttaattagacataga

SEQ ID NO: 281306 - DNA, 15 bp, Homo sapiens
attaattagacatag

SEQ ID NO: 281307 - DNA, 15 bp, Homo sapiens
gattaattagacata

SEQ ID NO: 281308 - DNA, 15 bp, Homo sapiens
agattaattagacat

SEQ ID NO: 281309 - DNA, 15 bp, Homo sapiens
tagattaattagaca

SEQ ID NO: 281310 - DNA, 15 bp, Homo sapiens
ttagattaattagac

SEQ ID NO: 281311 - DNA, 15 bp, Homo sapiens
attagattaattaga

SEQ ID NO: 281312 - DNA, 15 bp, Homo sapiens
tattagattaattag

SEQ ID NO: 281313 - DNA, 15 bp, Homo sapiens
atattagattaatta

SEQ ID NO: 281314 - DNA, 15 bp, Homo sapiens
gatattagattaatt

SEQ ID NO: 281315 - DNA, 15 bp, Homo sapiens
tgatattagattaat

SEQ ID NO: 281316 - DNA, 15 bp, Homo sapiens
atgatattagattaa

SEQ ID NO: 281317 - DNA, 15 bp, Homo sapiens
aatgatattagatta

SEQ ID NO: 281318 - DNA, 15 bp, Homo sapiens
taatgatattagatt

SEQ ID NO: 281319 - DNA, 15 bp, Homo sapiens
ttaatgatattagat

SEQ ID NO: 281320 - DNA, 15 bp, Homo sapiens
attaatgatattaga

SEQ ID NO: 281321 - DNA, 15 bp, Homo sapiens
tattaatgatattag

SEQ ID NO: 281322 - DNA, 15 bp, Homo sapiens
atattaatgatatta

SEQ ID NO: 281323 - DNA, 15 bp, Homo sapiens
tatattaatgatatt

SEQ ID NO: 281324 - DNA, 15 bp, Homo sapiens
gtatattaatgatat

SEQ ID NO: 281325 - DNA, 15 bp, Homo sapiens
ggtatattaatgata

SEQ ID NO: 281326 - DNA, 15 bp, Homo sapiens
aggtatattaatgat

SEQ ID NO: 281327 - DNA, 15 bp, Homo sapiens
aaggtatattaatga

SEQ ID NO: 281328 - DNA, 15 bp, Homo sapiens
caaggtatattaatg

SEQ ID NO: 281329 - DNA, 15 bp, Homo sapiens
tcaaggtatattaat

SEQ ID NO: 281330 - DNA, 15 bp, Homo sapiens
atcaaggtatattaa

SEQ ID NO: 281331 - DNA, 15 bp, Homo sapiens
aatcaaggtatatta

SEQ ID NO: 281332 - DNA, 15 bp, Homo sapiens
aaatcaaggtatatt

SEQ ID NO: 281333 - DNA, 15 bp, Homo sapiens
taaatcaaggtatat

SEQ ID NO: 281334 - DNA, 15 bp, Homo sapiens
ttaaatcaaggtata

SEQ ID NO: 281335 - DNA, 15 bp, Homo sapiens
cttaaatcaaggtat

SEQ ID NO: 281336 - DNA, 15 bp, Homo sapiens
tcttaaatcaaggta

SEQ ID NO: 281337 - DNA, 15 bp, Homo sapiens
ttcttaaatcaaggt

SEQ ID NO: 281338 - DNA, 15 bp, Homo sapiens
tttcttaaatcaagg

SEQ ID NO: 281339 - DNA, 15 bp, Homo sapiens
atttcttaaatcaag

SEQ ID NO: 281340 - DNA, 15 bp, Homo sapiens
catttcttaaatcaa

SEQ ID NO: 281341 - DNA, 15 bp, Homo sapiens
gcatttcttaaatca

SEQ ID NO: 281342 - DNA, 15 bp, Homo sapiens
tgcatttcttaaatc

SEQ ID NO: 281343 - DNA, 15 bp, Homo sapiens
ctgcatttcttaaat

SEQ ID NO: 281344 - DNA, 15 bp, Homo sapiens
actgcatttcttaaa

SEQ ID NO: 281345 - DNA, 15 bp, Homo sapiens
aactgcatttcttaa

SEQ ID NO: 281346 - DNA, 15 bp, Homo sapiens
aaactgcatttctta

SEQ ID NO: 281347 - DNA, 15 bp, Homo sapiens
aaaactgcatttctt

SEQ ID NO: 281348 - DNA, 15 bp, Homo sapiens
caaaactgcatttct

SEQ ID NO: 281349 - DNA, 15 bp, Homo sapiens
gcaaaactgcatttc

SEQ ID NO: 281350 - DNA, 15 bp, Homo sapiens
tgcaaaactgcattt

SEQ ID NO: 281351 - DNA, 15 bp, Homo sapiens
ctgcaaaactgcatt

SEQ ID NO: 281352 - DNA, 15 bp, Homo sapiens
cctgcaaaactgcat

SEQ ID NO: 281353 - DNA, 15 bp, Homo sapiens
tcctgcaaaactgca

SEQ ID NO: 281354 - DNA, 15 bp, Homo sapiens
ctcctgcaaaactgc

SEQ ID NO: 281355 - DNA, 15 bp, Homo sapiens
actcctgcaaaactg

SEQ ID NO: 281356 - DNA, 15 bp, Homo sapiens
aactcctgcaaaact

SEQ ID NO: 281357 - DNA, 15 bp, Homo sapiens
taactcctgcaaaac

SEQ ID NO: 281358 - DNA, 15 bp, Homo sapiens
ataactcctgcaaaa

SEQ ID NO: 281359 - DNA, 15 bp, Homo sapiens
cataactcctgcaaa

SEQ ID NO: 281360 - DNA, 15 bp, Homo sapiens
tcataactcctgcaa

SEQ ID NO: 281361 - DNA, 15 bp, Homo sapiens
atcataactcctgca

SEQ ID NO: 281362 - DNA, 15 bp, Homo sapiens
aatcataactcctgc

SEQ ID NO: 281363 - DNA, 15 bp, Homo sapiens
gaatcataactcctg

SEQ ID NO: 281364 - DNA, 15 bp, Homo sapiens
ggaatcataactcct

SEQ ID NO: 281365 - DNA, 15 bp, Homo sapiens
tggaatcataactcc

SEQ ID NO: 281366 - DNA, 15 bp, Homo sapiens
atggaatcataactc

SEQ ID NO: 281367 - DNA, 15 bp, Homo sapiens
aatggaatcataact

SEQ ID NO: 281368 - DNA, 15 bp, Homo sapiens
taatggaatcataac

SEQ ID NO: 281369 - DNA, 15 bp, Homo sapiens
tataatggaatcata

SEQ ID NO: 281370 - DNA, 15 bp, Homo sapiens
atataatggaatcat

SEQ ID NO: 281371 - DNA, 15 bp, Homo sapiens
aatataatggaatca

SEQ ID NO: 281372 - DNA, 15 bp, Homo sapiens
aaatataatggaatc

SEQ ID NO: 281373 - DNA, 15 bp, Homo sapiens
caaatataatggaat

SEQ ID NO: 281374 - DNA, 15 bp, Homo sapiens
ccaaatataatggaa

SEQ ID NO: 281375 - DNA, 15 bp, Homo sapiens
tccaaatataatgga

SEQ ID NO: 281376 - DNA, 15 bp, Homo sapiens
ttccaaatataatgg

SEQ ID NO: 281377 - DNA, 15 bp, Homo sapiens
attccaaatataatg

SEQ ID NO: 281378 - DNA, 15 bp, Homo sapiens
aattccaaatataat

SEQ ID NO: 281379 - DNA, 15 bp, Homo sapiens
aaattccaaatataa

SEQ ID NO: 281380 - DNA, 15 bp, Homo sapiens
caaattccaaatata

SEQ ID NO: 281381 - DNA, 15 bp, Homo sapiens
ccaaattccaaatat

SEQ ID NO: 281382 - DNA, 15 bp, Homo sapiens
cccaaattccaaata

SEQ ID NO: 281383 - DNA, 15 bp, Homo sapiens
gcccaaattccaaat

SEQ ID NO: 281384 - DNA, 15 bp, Homo sapiens
agcccaaattccaaa

SEQ ID NO: 281385 - DNA, 15 bp, Homo sapiens
gagcccaaattccaa

SEQ ID NO: 281386 - DNA, 15 bp, Homo sapiens
agagcccaaattcca

SEQ ID NO: 281387 - DNA, 15 bp, Homo sapiens
gagagcccaaattcc

SEQ ID NO: 281388 - DNA, 15 bp, Homo sapiens
tgagagcccaaattc

SEQ ID NO: 281389 - DNA, 15 bp, Homo sapiens
atgagagcccaaatt

SEQ ID NO: 281390 - DNA, 15 bp, Homo sapiens
tatgagagcccaaat

SEQ ID NO: 281391 - DNA, 15 bp, Homo sapiens
atatgagagcccaaa

SEQ ID NO: 281392 - DNA, 15 bp, Homo sapiens
aatatgagagcccaa

SEQ ID NO: 281393 - DNA, 15 bp, Homo sapiens
aaatatgagagccca

SEQ ID NO: 281394 - DNA, 15 bp, Homo sapiens
aaaatatgagagccc

SEQ ID NO: 281395 - DNA, 15 bp, Homo sapiens
gaaaatatgagagcc

SEQ ID NO: 281396 - DNA, 15 bp, Homo sapiens
tgaaaatatgagagc

SEQ ID NO: 281397 - DNA, 15 bp, Homo sapiens
atgaaaatatgagag

SEQ ID NO: 281398 - DNA, 15 bp, Homo sapiens
catgaaaatatgaga

SEQ ID NO: 281399 - DNA, 15 bp, Homo sapiens
tcatgaaaatatgag

SEQ ID NO: 281400 - DNA, 15 bp, Homo sapiens
gtcatgaaaatatga

SEQ ID NO: 281401 - DNA, 15 bp, Homo sapiens
tgtcatgaaaatatg

SEQ ID NO: 281402 - DNA, 15 bp, Homo sapiens
gtgtcatgaaaatat

SEQ ID NO: 281403 - DNA, 15 bp, Homo sapiens
tgtgtcatgaaaata

SEQ ID NO: 281404 - DNA, 15 bp, Homo sapiens
ctgtgtcatgaaaat

SEQ ID NO: 281405 - DNA, 15 bp, Homo sapiens
actgtgtcatgaaaa

SEQ ID NO: 281406 - DNA, 15 bp, Homo sapiens
aactgtgtcatgaaa

SEQ ID NO: 281407 - DNA, 15 bp, Homo sapiens
aaactgtgtcatgaa

SEQ ID NO: 281408 - DNA, 15 bp, Homo sapiens
caaactgtgtcatga

SEQ ID NO: 281409 - DNA, 15 bp, Homo sapiens
gcaaactgtgtcatg

SEQ ID NO: 281410 - DNA, 15 bp, Homo sapiens
tgcaaactgtgtcat

SEQ ID NO: 281411 - DNA, 15 bp, Homo sapiens
gtgcaaactgtgtca

SEQ ID NO: 281412 - DNA, 15 bp, Homo sapiens
agtgcaaactgtgtc

SEQ ID NO: 281413 - DNA, 15 bp, Homo sapiens
aagtgcaaactgtgt

SEQ ID NO: 281414 - DNA, 15 bp, Homo sapiens
aaagtgcaaactgtg

SEQ ID NO: 281415 - DNA, 15 bp, Homo sapiens
taaagtgcaaactgt

SEQ ID NO: 281416 - DNA, 15 bp, Homo sapiens
gtaaagtgcaaactg

SEQ ID NO: 281417 - DNA, 15 bp, Homo sapiens
ggtaaagtgcaaact

SEQ ID NO: 281418 - DNA, 15 bp, Homo sapiens
tggtaaagtgcaaac

SEQ ID NO: 281419 - DNA, 15 bp, Homo sapiens
ttggtaaagtgcaaa

SEQ ID NO: 281420 - DNA, 15 bp, Homo sapiens
tttggtaaagtgcaa

SEQ ID NO: 281421 - DNA, 15 bp, Homo sapiens
gtttggtaaagtgca

SEQ ID NO: 281422 - DNA, 15 bp, Homo sapiens
tgtttggtaaagtgc

SEQ ID NO: 281423 - DNA, 15 bp, Homo sapiens
gtgtttggtaaagtg

SEQ ID NO: 281424 - DNA, 15 bp, Homo sapiens
ggtgtttggtaaagt

SEQ ID NO: 281425 - DNA, 15 bp, Homo sapiens
aggtgtttggtaaag

SEQ ID NO: 281426 - DNA, 15 bp, Homo sapiens
caggtgtttggtaaa

SEQ ID NO: 281427 - DNA, 15 bp, Homo sapiens
gcaggtgtttggtaa

SEQ ID NO: 281428 - DNA, 15 bp, Homo sapiens
agcaggtgtttggta

SEQ ID NO: 281429 - DNA, 15 bp, Homo sapiens
tagcaggtgtttggt

SEQ ID NO: 281430 - DNA, 15 bp, Homo sapiens
atagcaggtgtttgg

SEQ ID NO: 281431 - DNA, 15 bp, Homo sapiens
tatagcaggtgtttg

SEQ ID NO: 281432 - DNA, 15 bp, Homo sapiens
atatagcaggtgttt

SEQ ID NO: 281433 - DNA, 15 bp, Homo sapiens
tatatagcaggtgtt

SEQ ID NO: 281434 - DNA, 15 bp, Homo sapiens
atatatagcaggtgt

SEQ ID NO: 281435 - DNA, 15 bp, Homo sapiens
aatatatagcaggtg

SEQ ID NO: 281436 - DNA, 15 bp, Homo sapiens
gaatatatagcaggt

SEQ ID NO: 281437 - DNA, 15 bp, Homo sapiens
agaatatatagcagg

SEQ ID NO: 281438 - DNA, 15 bp, Homo sapiens
tagaatatatagcag

SEQ ID NO: 281439 - DNA, 15 bp, Homo sapiens
atagaatatatagca

SEQ ID NO: 281440 - DNA, 15 bp, Homo sapiens
catagaatatatagc

SEQ ID NO: 281441 - DNA, 15 bp, Homo sapiens
tcatagaatatatag

SEQ ID NO: 281442 - DNA, 15 bp, Homo sapiens
ttcatagaatatata

SEQ ID NO: 281443 - DNA, 15 bp, Homo sapiens
tttcatagaatatat

SEQ ID NO: 281444 - DNA, 15 bp, Homo sapiens
ttttcatagaatata

SEQ ID NO: 281445 - DNA, 15 bp, Homo sapiens
tacttttcatagaat

SEQ ID NO: 281446 - DNA, 15 bp, Homo sapiens
ttacttttcatagaa

SEQ ID NO: 281447 - DNA, 15 bp, Homo sapiens
tttacttttcataga

SEQ ID NO: 281448 - DNA, 15 bp, Homo sapiens
gtttacttttcatag

SEQ ID NO: 281449 - DNA, 15 bp, Homo sapiens
ggtttacttttcata

SEQ ID NO: 281450 - DNA, 15 bp, Homo sapiens
aggtttacttttcat

SEQ ID NO: 281451 - DNA, 15 bp, Homo sapiens
taggtttacttttca

SEQ ID NO: 281452 - DNA, 15 bp, Homo sapiens
ttaggtttacttttc

SEQ ID NO: 281453 - DNA, 15 bp, Homo sapiens
gttaggtttactttt

SEQ ID NO: 281454 - DNA, 15 bp, Homo sapiens
ggttaggtttacttt

SEQ ID NO: 281455 - DNA, 15 bp, Homo sapiens
tggttaggtttactt

SEQ ID NO: 281456 - DNA, 15 bp, Homo sapiens
ctggttaggtttact

SEQ ID NO: 281457 - DNA, 15 bp, Homo sapiens
cctggttaggtttac

SEQ ID NO: 281458 - DNA, 15 bp, Homo sapiens
tcctggttaggttta

SEQ ID NO: 281459 - DNA, 15 bp, Homo sapiens
atcctggttaggttt

SEQ ID NO: 281460 - DNA, 15 bp, Homo sapiens
catcctggttaggtt

SEQ ID NO: 281461 - DNA, 15 bp, Homo sapiens
acatcctggttaggt

SEQ ID NO: 281462 - DNA, 15 bp, Homo sapiens
cacatcctggttagg

SEQ ID NO: 281463 - DNA, 15 bp, Homo sapiens
tcacatcctggttag

SEQ ID NO: 281464 - DNA, 15 bp, Homo sapiens
atcacatcctggtta

SEQ ID NO: 281465 - DNA, 15 bp, Homo sapiens
aatcacatcctggtt

SEQ ID NO: 281466 - DNA, 15 bp, Homo sapiens
gaatcacatcctggt

SEQ ID NO: 281467 - DNA, 15 bp, Homo sapiens
agaatcacatcctgg

SEQ ID NO: 281468 - DNA, 15 bp, Homo sapiens
gagaatcacatcctg

SEQ ID NO: 281469 - DNA, 15 bp, Homo sapiens
ggagaatcacatcct

SEQ ID NO: 281470 - DNA, 15 bp, Homo sapiens
tggagaatcacatcc

SEQ ID NO: 281471 - DNA, 15 bp, Homo sapiens
ctggagaatcacatc

SEQ ID NO: 281472 - DNA, 15 bp, Homo sapiens
gctggagaatcacat

SEQ ID NO: 281473 - DNA, 15 bp, Homo sapiens
agctggagaatcaca

SEQ ID NO: 281474 - DNA, 15 bp, Homo sapiens
tagctggagaatcac

SEQ ID NO: 281475 - DNA, 15 bp, Homo sapiens
ttagctggagaatca

SEQ ID NO: 281476 - DNA, 15 bp, Homo sapiens
attagctggagaatc

SEQ ID NO: 281477 - DNA, 15 bp, Homo sapiens
cattagctggagaat

SEQ ID NO: 281478 - DNA, 15 bp, Homo sapiens
tcattagctggagaa

SEQ ID NO: 281479 - DNA, 15 bp, Homo sapiens
ctcattagctggaga

SEQ ID NO: 281480 - DNA, 15 bp, Homo sapiens
tctcattagctggag

SEQ ID NO: 281481 - DNA, 15 bp, Homo sapiens
ttctcattagctgga

SEQ ID NO: 281482 - DNA, 15 bp, Homo sapiens
attctcattagctgg

SEQ ID NO: 281483 - DNA, 15 bp, Homo sapiens
gattctcattagctg

SEQ ID NO: 281484 - DNA, 15 bp, Homo sapiens
ggattctcattagct

SEQ ID NO: 281485 - DNA, 15 bp, Homo sapiens
tggattctcattagc

SEQ ID NO: 281486 - DNA, 15 bp, Homo sapiens
ttggattctcattag

SEQ ID NO: 281487 - DNA, 15 bp, Homo sapiens
tttggattctcatta

SEQ ID NO: 281488 - DNA, 15 bp, Homo sapiens
gtttggattctcatt

SEQ ID NO: 281489 - DNA, 15 bp, Homo sapiens
tgtttggattctcat

SEQ ID NO: 281490 - DNA, 15 bp, Homo sapiens
gtgtttggattctca

SEQ ID NO: 281491 - DNA, 15 bp, Homo sapiens
agtgtttggattctc

SEQ ID NO: 281492 - DNA, 15 bp, Homo sapiens
cagtgtttggattct

SEQ ID NO: 281493 - DNA, 15 bp, Homo sapiens
acagtgtttggattc

SEQ ID NO: 281494 - DNA, 15 bp, Homo sapiens
tacagtgtttggatt

SEQ ID NO: 281495 - DNA, 15 bp, Homo sapiens
gtacagtgtttggat

SEQ ID NO: 281496 - DNA, 15 bp, Homo sapiens
tgtacagtgtttgga

SEQ ID NO: 281497 - DNA, 15 bp, Homo sapiens
ttgtacagtgtttgg

SEQ ID NO: 281498 - DNA, 15 bp, Homo sapiens
cttgtacagtgtttg

SEQ ID NO: 281499 - DNA, 15 bp, Homo sapiens
gcttgtacagtgttt

SEQ ID NO: 281500 - DNA, 15 bp, Homo sapiens
tgcttgtacagtgtt

SEQ ID NO: 281501 - DNA, 15 bp, Homo sapiens
ctgcttgtacagtgt

SEQ ID NO: 281502 - DNA, 15 bp, Homo sapiens
cctgcttgtacagtg

SEQ ID NO: 281503 - DNA, 15 bp, Homo sapiens
tcctgcttgtacagt

SEQ ID NO: 281504 - DNA, 15 bp, Homo sapiens
atcctgcttgtacag

SEQ ID NO: 281505 - DNA, 15 bp, Homo sapiens
aatcctgcttgtaca

SEQ ID NO: 281506 - DNA, 15 bp, Homo sapiens
aaatcctgcttgtac

SEQ ID NO: 281507 - DNA, 15 bp, Homo sapiens
taaatcctgcttgta

SEQ ID NO: 281508 - DNA, 15 bp, Homo sapiens
ctaaatcctgcttgt

SEQ ID NO: 281509 - DNA, 15 bp, Homo sapiens
tctaaatcctgcttg

SEQ ID NO: 281510 - DNA, 15 bp, Homo sapiens
atctaaatcctgctt

SEQ ID NO: 281511 - DNA, 15 bp, Homo sapiens
catctaaatcctgct

SEQ ID NO: 281512 - DNA, 15 bp, Homo sapiens
ccatctaaatcctgc

SEQ ID NO: 281513 - DNA, 15 bp, Homo sapiens
accatctaaatcctg

SEQ ID NO: 281514 - DNA, 15 bp, Homo sapiens
caccatctaaatcct

SEQ ID NO: 281515 - DNA, 15 bp, Homo sapiens
acaccatctaaatcc

SEQ ID NO: 281516 - DNA, 15 bp, Homo sapiens
tacaccatctaaatc

SEQ ID NO: 281517 - DNA, 15 bp, Homo sapiens
ttacaccatctaaat

SEQ ID NO: 281518 - DNA, 15 bp, Homo sapiens
gttacaccatctaaa

SEQ ID NO: 281519 - DNA, 15 bp, Homo sapiens
ggttacaccatctaa

SEQ ID NO: 281520 - DNA, 15 bp, Homo sapiens
tggttacaccatcta

SEQ ID NO: 281521 - DNA, 15 bp, Homo sapiens
ttggttacaccatct

SEQ ID NO: 281522 - DNA, 15 bp, Homo sapiens
cttggttacaccatc

SEQ ID NO: 281523 - DNA, 15 bp, Homo sapiens
acttggttacaccat

SEQ ID NO: 281524 - DNA, 15 bp, Homo sapiens
aacttggttacacca

SEQ ID NO: 281525 - DNA, 15 bp, Homo sapiens
aaacttggttacacc

SEQ ID NO: 281526 - DNA, 15 bp, Homo sapiens
gaaacttggttacac

SEQ ID NO: 281527 - DNA, 15 bp, Homo sapiens
tgaaacttggttaca

SEQ ID NO: 281528 - DNA, 15 bp, Homo sapiens
ctgaaacttggttac

SEQ ID NO: 281529 - DNA, 15 bp, Homo sapiens
actgaaacttggtta

SEQ ID NO: 281530 - DNA, 15 bp, Homo sapiens
tactgaaacttggtt

SEQ ID NO: 281531 - DNA, 15 bp, Homo sapiens
ttactgaaacttggt

SEQ ID NO: 281532 - DNA, 15 bp, Homo sapiens
tttactgaaacttgg

SEQ ID NO: 281533 - DNA, 15 bp, Homo sapiens
atttactgaaacttg

SEQ ID NO: 281534 - DNA, 15 bp, Homo sapiens
catttactgaaactt

SEQ ID NO: 281535 - DNA, 15 bp, Homo sapiens
tcatttactgaaact

SEQ ID NO: 281536 - DNA, 15 bp, Homo sapiens
ttcatttactgaaac

SEQ ID NO: 281537 - DNA, 15 bp, Homo sapiens
tttcatttactgaaa

SEQ ID NO: 281538 - DNA, 15 bp, Homo sapiens
ctttcatttactgaa

SEQ ID NO: 281539 - DNA, 15 bp, Homo sapiens
actttcatttactga

SEQ ID NO: 281540 - DNA, 15 bp, Homo sapiens
cactttcatttactg

SEQ ID NO: 281541 - DNA, 15 bp, Homo sapiens
ccactttcatttact

SEQ ID NO: 281542 - DNA, 15 bp, Homo sapiens
cccactttcatttac

SEQ ID NO: 281543 - DNA, 15 bp, Homo sapiens
tcccactttcattta

SEQ ID NO: 281544 - DNA, 15 bp, Homo sapiens
atcccactttcattt

SEQ ID NO: 281545 - DNA, 15 bp, Homo sapiens
aatcccactttcatt

SEQ ID NO: 281546 - DNA, 15 bp, Homo sapiens
caatcccactttcat

SEQ ID NO: 281547 - DNA, 15 bp, Homo sapiens
gcaatcccactttca

SEQ ID NO: 281548 - DNA, 15 bp, Homo sapiens
tgcaatcccactttc

SEQ ID NO: 281549 - DNA, 15 bp, Homo sapiens
ctgcaatcccacttt

SEQ ID NO: 281550 - DNA, 15 bp, Homo sapiens
cctgcaatcccactt

SEQ ID NO: 281551 - DNA, 15 bp, Homo sapiens
acctgcaatcccact

SEQ ID NO: 281552 - DNA, 15 bp, Homo sapiens
tacctgcaatcccac

SEQ ID NO: 281553 - DNA, 15 bp, Homo sapiens
atacctgcaatccca

SEQ ID NO: 281554 - DNA, 15 bp, Homo sapiens
aatacctgcaatccc

SEQ ID NO: 281555 - DNA, 15 bp, Homo sapiens
gaatacctgcaatcc

SEQ ID NO: 281556 - DNA, 15 bp, Homo sapiens
agaatacctgcaatc

SEQ ID NO: 281557 - DNA, 15 bp, Homo sapiens
gagaatacctgcaat

SEQ ID NO: 281558 - DNA, 15 bp, Homo sapiens
tgagaatacctgcaa

SEQ ID NO: 281559 - DNA, 15 bp, Homo sapiens
ctgagaatacctgca

SEQ ID NO: 281560 - DNA, 15 bp, Homo sapiens
cctgagaatacctgc

SEQ ID NO: 281561 - DNA, 15 bp, Homo sapiens
tcctgagaatacctg

SEQ ID NO: 281562 - DNA, 15 bp, Homo sapiens
ctcctgagaatacct

SEQ ID NO: 281563 - DNA, 15 bp, Homo sapiens
tctcctgagaatacc

SEQ ID NO: 281564 - DNA, 15 bp, Homo sapiens
atctcctgagaatac

SEQ ID NO: 281565 - DNA, 15 bp, Homo sapiens
catctcctgagaata

SEQ ID NO: 281566 - DNA, 15 bp, Homo sapiens
ccatctcctgagaat

SEQ ID NO: 281567 - DNA, 15 bp, Homo sapiens
accatctcctgagaa

SEQ ID NO: 281568 - DNA, 15 bp, Homo sapiens
caccatctcctgaga

SEQ ID NO: 281569 - DNA, 15 bp, Homo sapiens
gcaccatctcctgag

SEQ ID NO: 281570 - DNA, 15 bp, Homo sapiens
tgcaccatctcctga

SEQ ID NO: 281571 - DNA, 15 bp, Homo sapiens
gtgcaccatctcctg

SEQ ID NO: 281572 - DNA, 15 bp, Homo sapiens
tgtgcaccatctcct

SEQ ID NO: 281573 - DNA, 15 bp, Homo sapiens
atgtgcaccatctcc

SEQ ID NO: 281574 - DNA, 15 bp, Homo sapiens
catgtgcaccatctc

SEQ ID NO: 281575 - DNA, 15 bp, Homo sapiens
acatgtgcaccatct

SEQ ID NO: 281576 - DNA, 15 bp, Homo sapiens
cacatgtgcaccatc

SEQ ID NO: 281577 - DNA, 15 bp, Homo sapiens
tcacatgtgcaccat

SEQ ID NO: 281578 - DNA, 15 bp, Homo sapiens
ttcacatgtgcacca

SEQ ID NO: 281579 - DNA, 15 bp, Homo sapiens
attcacatgtgcacc

SEQ ID NO: 281580 - DNA, 15 bp, Homo sapiens
aattcacatgtgcac

SEQ ID NO: 281581 - DNA, 15 bp, Homo sapiens
taattcacatgtgca

SEQ ID NO: 281582 - DNA, 15 bp, Homo sapiens
gtaattcacatgtgc

SEQ ID NO: 281583 - DNA, 15 bp, Homo sapiens
tgtaattcacatgtg

SEQ ID NO: 281584 - DNA, 15 bp, Homo sapiens
ttgtaattcacatgt

SEQ ID NO: 281585 - DNA, 15 bp, Homo sapiens
attgtaattcacatg

SEQ ID NO: 281586 - DNA, 15 bp, Homo sapiens
tattgtaattcacat

SEQ ID NO: 281587 - DNA, 15 bp, Homo sapiens
atattgtaattcaca

SEQ ID NO: 281588 - DNA, 15 bp, Homo sapiens
catattgtaattcac

SEQ ID NO: 281589 - DNA, 15 bp, Homo sapiens
acatattgtaattca

SEQ ID NO: 281590 - DNA, 15 bp, Homo sapiens
tacatattgtaattc

SEQ ID NO: 281591 - DNA, 15 bp, Homo sapiens
ttacatattgtaatt

SEQ ID NO: 281592 - DNA, 15 bp, Homo sapiens
attacatattgtaat

SEQ ID NO: 281593 - DNA, 15 bp, Homo sapiens
aattacatattgtaa

SEQ ID NO: 281594 - DNA, 15 bp, Homo sapiens
taattacatattgta

SEQ ID NO: 281595 - DNA, 15 bp, Homo sapiens
ttaattacatattgt

SEQ ID NO: 281596 - DNA, 15 bp, Homo sapiens
tttaattacatattg

SEQ ID NO: 281597 - DNA, 15 bp, Homo sapiens
atttaattacatatt

SEQ ID NO: 281598 - DNA, 15 bp, Homo sapiens
aatttaattacatat

SEQ ID NO: 281599 - DNA, 15 bp, Homo sapiens
aaatttaattacata

SEQ ID NO: 281600 - DNA, 15 bp, Homo sapiens
taaatttaattacat

SEQ ID NO: 281601 - DNA, 15 bp, Homo sapiens
ataaatttaattaca

SEQ ID NO: 281602 - DNA, 15 bp, Homo sapiens
cataaatttaattac

SEQ ID NO: 281603 - DNA, 15 bp, Homo sapiens
gcataaatttaatta

SEQ ID NO: 281604 - DNA, 15 bp, Homo sapiens
agcataaatttaatt

SEQ ID NO: 281605 - DNA, 15 bp, Homo sapiens
tagcataaatttaat

SEQ ID NO: 281606 - DNA, 15 bp, Homo sapiens
ttagcataaatttaa

SEQ ID NO: 281607 - DNA, 15 bp, Homo sapiens
attagcataaattta

SEQ ID NO: 281608 - DNA, 15 bp, Homo sapiens
cattagcataaattt

SEQ ID NO: 281609 - DNA, 15 bp, Homo sapiens
gcattagcataaatt

SEQ ID NO: 281610 - DNA, 15 bp, Homo sapiens
agcattagcataaat

SEQ ID NO: 281611 - DNA, 15 bp, Homo sapiens
aagcattagcataaa

SEQ ID NO: 281612 - DNA, 15 bp, Homo sapiens
aaagcattagcataa

SEQ ID NO: 281613 - DNA, 15 bp, Homo sapiens
taaagcattagcata

SEQ ID NO: 281614 - DNA, 15 bp, Homo sapiens
ctaaagcattagcat

SEQ ID NO: 281615 - DNA, 15 bp, Homo sapiens
cctaaagcattagca

SEQ ID NO: 281616 - DNA, 15 bp, Homo sapiens
tcctaaagcattagc

SEQ ID NO: 281617 - DNA, 15 bp, Homo sapiens
atcctaaagcattag

SEQ ID NO: 281618 - DNA, 15 bp, Homo sapiens
tatcctaaagcatta

SEQ ID NO: 281619 - DNA, 15 bp, Homo sapiens
ctatcctaaagcatt

SEQ ID NO: 281620 - DNA, 15 bp, Homo sapiens
cctatcctaaagcat

SEQ ID NO: 281621 - DNA, 15 bp, Homo sapiens
ccctatcctaaagca

SEQ ID NO: 281622 - DNA, 15 bp, Homo sapiens
cccctatcctaaagc

SEQ ID NO: 281623 - DNA, 15 bp, Homo sapiens
acccctatcctaaag

SEQ ID NO: 281624 - DNA, 15 bp, Homo sapiens
aacccctatcctaaa

SEQ ID NO: 281625 - DNA, 15 bp, Homo sapiens
aaacccctatcctaa

SEQ ID NO: 281626 - DNA, 15 bp, Homo sapiens
taaacccctatccta

SEQ ID NO: 281627 - DNA, 15 bp, Homo sapiens
ataaacccctatcct

SEQ ID NO: 281628 - DNA, 15 bp, Homo sapiens
aataaacccctatcc

SEQ ID NO: 281629 - DNA, 15 bp, Homo sapiens
aaataaacccctatc

SEQ ID NO: 281630 - DNA, 15 bp, Homo sapiens
aaaataaacccctat

SEQ ID NO: 281631 - DNA, 15 bp, Homo sapiens
taaaataaaccccta

SEQ ID NO: 281632 - DNA, 15 bp, Homo sapiens
ctaaaataaacccct

SEQ ID NO: 281633 - DNA, 15 bp, Homo sapiens
tctaaaataaacccc

SEQ ID NO: 281634 - DNA, 15 bp, Homo sapiens
ctctaaaataaaccc

SEQ ID NO: 281635 - DNA, 15 bp, Homo sapiens
actctaaaataaacc

SEQ ID NO: 281636 - DNA, 15 bp, Homo sapiens
gactctaaaataaac

SEQ ID NO: 281637 - DNA, 15 bp, Homo sapiens
agactctaaaataaa

SEQ ID NO: 281638 - DNA, 15 bp, Homo sapiens
gagactctaaaataa

SEQ ID NO: 281639 - DNA, 15 bp, Homo sapiens
agagactctaaaata

SEQ ID NO: 281640 - DNA, 15 bp, Homo sapiens
tagagactctaaaat

SEQ ID NO: 281641 - DNA, 15 bp, Homo sapiens
ttagagactctaaaa

SEQ ID NO: 281642 - DNA, 15 bp, Homo sapiens
tttagagactctaaa

SEQ ID NO: 281643 - DNA, 15 bp, Homo sapiens
atttagagactctaa

SEQ ID NO: 281644 - DNA, 15 bp, Homo sapiens
tatttagagactcta

SEQ ID NO: 281645 - DNA, 15 bp, Homo sapiens
ttatttagagactct

SEQ ID NO: 281646 - DNA, 15 bp, Homo sapiens
attatttagagactc

SEQ ID NO: 281647 - DNA, 15 bp, Homo sapiens
tattatttagagact

SEQ ID NO: 281648 - DNA, 15 bp, Homo sapiens
atattatttagagac

SEQ ID NO: 281649 - DNA, 15 bp, Homo sapiens
tatattatttagaga

SEQ ID NO: 281650 - DNA, 15 bp, Homo sapiens
atatattatttagag

SEQ ID NO: 281651 - DNA, 15 bp, Homo sapiens
tatatattatttaga

SEQ ID NO: 281652 - DNA, 15 bp, Homo sapiens
ctatatattatttag

SEQ ID NO: 281653 - DNA, 15 bp, Homo sapiens
cctatatattattta

SEQ ID NO: 281654 - DNA, 15 bp, Homo sapiens
gcctatatattattt

SEQ ID NO: 281655 - DNA, 15 bp, Homo sapiens
agcctatatattatt

SEQ ID NO: 281656 - DNA, 15 bp, Homo sapiens
cagcctatatattat

SEQ ID NO: 281657 - DNA, 15 bp, Homo sapiens
ccagcctatatatta

SEQ ID NO: 281658 - DNA, 15 bp, Homo sapiens
accagcctatatatt

SEQ ID NO: 281659 - DNA, 15 bp, Homo sapiens
gaccagcctatatat

SEQ ID NO: 281660 - DNA, 15 bp, Homo sapiens
agaccagcctatata

SEQ ID NO: 281661 - DNA, 15 bp, Homo sapiens
aagaccagcctatat

SEQ ID NO: 281662 - DNA, 15 bp, Homo sapiens
caagaccagcctata

SEQ ID NO: 281663 - DNA, 15 bp, Homo sapiens
tcaagaccagcctat

SEQ ID NO: 281664 - DNA, 15 bp, Homo sapiens
atcaagaccagccta

SEQ ID NO: 281665 - DNA, 15 bp, Homo sapiens
catcaagaccagcct

SEQ ID NO: 281666 - DNA, 15 bp, Homo sapiens
ccatcaagaccagcc

SEQ ID NO: 281667 - DNA, 15 bp, Homo sapiens
accatcaagaccagc

SEQ ID NO: 281668 - DNA, 15 bp, Homo sapiens
caccatcaagaccag

SEQ ID NO: 281669 - DNA, 15 bp, Homo sapiens
acaccatcaagacca

SEQ ID NO: 281670 - DNA, 15 bp, Homo sapiens
cacaccatcaagacc

SEQ ID NO: 281671 - DNA, 15 bp, Homo sapiens
gcacaccatcaagac

SEQ ID NO: 281672 - DNA, 15 bp, Homo sapiens
tgcacaccatcaaga

SEQ ID NO: 281673 - DNA, 15 bp, Homo sapiens
gtgcacaccatcaag

SEQ ID NO: 281674 - DNA, 15 bp, Homo sapiens
tgtgcacaccatcaa

SEQ ID NO: 281675 - DNA, 15 bp, Homo sapiens
ctgtgcacaccatca

SEQ ID NO: 281676 - DNA, 15 bp, Homo sapiens
tctgtgcacaccatc

SEQ ID NO: 281677 - DNA, 15 bp, Homo sapiens
gtctgtgcacaccat

SEQ ID NO: 281678 - DNA, 15 bp, Homo sapiens
agtctgtgcacacca

SEQ ID NO: 281679 - DNA, 15 bp, Homo sapiens
aagtctgtgcacacc

SEQ ID NO: 281680 - DNA, 15 bp, Homo sapiens
aaagtctgtgcacac

SEQ ID NO: 281681 - DNA, 15 bp, Homo sapiens
gaaagtctgtgcaca

SEQ ID NO: 281682 - DNA, 15 bp, Homo sapiens
tgaaagtctgtgcac

SEQ ID NO: 281683 - DNA, 15 bp, Homo sapiens
ctgaaagtctgtgca

SEQ ID NO: 281684 - DNA, 15 bp, Homo sapiens
tctgaaagtctgtgc

SEQ ID NO: 281685 - DNA, 15 bp, Homo sapiens
ttctgaaagtctgtg

SEQ ID NO: 281686 - DNA, 15 bp, Homo sapiens
tttctgaaagtctgt

SEQ ID NO: 281687 - DNA, 15 bp, Homo sapiens
ttttctgaaagtctg

SEQ ID NO: 281688 - DNA, 15 bp, Homo sapiens
cttttctgaaagtct

SEQ ID NO: 281689 - DNA, 15 bp, Homo sapiens
acttttctgaaagtc

SEQ ID NO: 281690 - DNA, 15 bp, Homo sapiens
cacttttctgaaagt

SEQ ID NO: 281691 - DNA, 15 bp, Homo sapiens
ccacttttctgaaag

SEQ ID NO: 281692 - DNA, 15 bp, Homo sapiens
accacttttctgaaa

SEQ ID NO: 281693 - DNA, 15 bp, Homo sapiens
taccacttttctgaa

SEQ ID NO: 281694 - DNA, 15 bp, Homo sapiens
ataccacttttctga

SEQ ID NO: 281695 - DNA, 15 bp, Homo sapiens
tataccacttttctg

SEQ ID NO: 281696 - DNA, 15 bp, Homo sapiens
atataccacttttct

SEQ ID NO: 281697 - DNA, 15 bp, Homo sapiens
tatataccacttttc

SEQ ID NO: 281698 - DNA, 15 bp, Homo sapiens
gtatataccactttt

SEQ ID NO: 281699 - DNA, 15 bp, Homo sapiens
agtatataccacttt

SEQ ID NO: 281700 - DNA, 15 bp, Homo sapiens
tagtatataccactt

SEQ ID NO: 281701 - DNA, 15 bp, Homo sapiens
ctagtatataccact

SEQ ID NO: 281702 - DNA, 15 bp, Homo sapiens
cctagtatataccac

SEQ ID NO: 281703 - DNA, 15 bp, Homo sapiens
acctagtatatacca

SEQ ID NO: 281704 - DNA, 15 bp, Homo sapiens
cacctagtatatacc

SEQ ID NO: 281705 - DNA, 15 bp, Homo sapiens
acacctagtatatac

SEQ ID NO: 281706 - DNA, 15 bp, Homo sapiens
gacacctagtatata

SEQ ID NO: 281707 - DNA, 15 bp, Homo sapiens
agacacctagtatat

SEQ ID NO: 281708 - DNA, 15 bp, Homo sapiens
cagacacctagtata

SEQ ID NO: 281709 - DNA, 15 bp, Homo sapiens
acagacacctagtat

SEQ ID NO: 281710 - DNA, 15 bp, Homo sapiens
cacagacacctagta

SEQ ID NO: 281711 - DNA, 15 bp, Homo sapiens
tcacagacacctagt

SEQ ID NO: 281712 - DNA, 15 bp, Homo sapiens
atcacagacacctag

SEQ ID NO: 281713 - DNA, 15 bp, Homo sapiens
aatcacagacaccta

SEQ ID NO: 281714 - DNA, 15 bp, Homo sapiens
gaatcacagacacct

SEQ ID NO: 281715 - DNA, 15 bp, Homo sapiens
agaatcacagacacc

SEQ ID NO: 281716 - DNA, 15 bp, Homo sapiens
tagaatcacagacac

SEQ ID NO: 281717 - DNA, 15 bp, Homo sapiens
ctagaatcacagaca

SEQ ID NO: 281718 - DNA, 15 bp, Homo sapiens
actagaatcacagac

SEQ ID NO: 281719 - DNA, 15 bp, Homo sapiens
tactagaatcacaga

SEQ ID NO: 281720 - DNA, 15 bp, Homo sapiens
ttactagaatcacag

SEQ ID NO: 281721 - DNA, 15 bp, Homo sapiens
cttactagaatcaca

SEQ ID NO: 281722 - DNA, 15 bp, Homo sapiens
acttactagaatcac

SEQ ID NO: 281723 - DNA, 15 bp, Homo sapiens
tacttactagaatca

SEQ ID NO: 281724 - DNA, 15 bp, Homo sapiens
ctacttactagaatc

SEQ ID NO: 281725 - DNA, 15 bp, Homo sapiens
gctacttactagaat

SEQ ID NO: 281726 - DNA, 15 bp, Homo sapiens
agctacttactagaa

SEQ ID NO: 281727 - DNA, 15 bp, Homo sapiens
aagctacttactaga

SEQ ID NO: 281728 - DNA, 15 bp, Homo sapiens
aaagctacttactag

SEQ ID NO: 281729 - DNA, 15 bp, Homo sapiens
caaagctacttacta

SEQ ID NO: 281730 - DNA, 15 bp, Homo sapiens
gcaaagctacttact

SEQ ID NO: 281731 - DNA, 15 bp, Homo sapiens
ggcaaagctacttac

SEQ ID NO: 281732 - DNA, 15 bp, Homo sapiens
aggcaaagctactta

SEQ ID NO: 281733 - DNA, 15 bp, Homo sapiens
taggcaaagctactt

SEQ ID NO: 281734 - DNA, 15 bp, Homo sapiens
ctaggcaaagctact

SEQ ID NO: 281735 - DNA, 15 bp, Homo sapiens
tctaggcaaagctac

SEQ ID NO: 281736 - DNA, 15 bp, Homo sapiens
ttctaggcaaagcta

SEQ ID NO: 281737 - DNA, 15 bp, Homo sapiens
tttctaggcaaagct

SEQ ID NO: 281738 - DNA, 15 bp, Homo sapiens
ctttctaggcaaagc

SEQ ID NO: 281739 - DNA, 15 bp, Homo sapiens
cctttctaggcaaag

SEQ ID NO: 281740 - DNA, 15 bp, Homo sapiens
acctttctaggcaaa

SEQ ID NO: 281741 - DNA, 15 bp, Homo sapiens
aacctttctaggcaa

SEQ ID NO: 281742 - DNA, 15 bp, Homo sapiens
taacctttctaggca

SEQ ID NO: 281743 - DNA, 15 bp, Homo sapiens
ttaacctttctaggc

SEQ ID NO: 281744 - DNA, 15 bp, Homo sapiens
attaacctttctagg

SEQ ID NO: 281745 - DNA, 15 bp, Homo sapiens
aattaacctttctag

SEQ ID NO: 281746 - DNA, 15 bp, Homo sapiens
gaattaacctttcta

SEQ ID NO: 281747 - DNA, 15 bp, Homo sapiens
tgaattaacctttct

SEQ ID NO: 281748 - DNA, 15 bp, Homo sapiens
ttgaattaacctttc

SEQ ID NO: 281749 - DNA, 15 bp, Homo sapiens
cttgaattaaccttt

SEQ ID NO: 281750 - DNA, 15 bp, Homo sapiens
gcttgaattaacctt

SEQ ID NO: 281751 - DNA, 15 bp, Homo sapiens
tgcttgaattaacct

SEQ ID NO: 281752 - DNA, 15 bp, Homo sapiens
atgcttgaattaacc

SEQ ID NO: 281753 - DNA, 15 bp, Homo sapiens
gatgcttgaattaac

SEQ ID NO: 281754 - DNA, 15 bp, Homo sapiens
tgatgcttgaattaa

SEQ ID NO: 281755 - DNA, 15 bp, Homo sapiens
atgatgcttgaatta

SEQ ID NO: 281756 - DNA, 15 bp, Homo sapiens
tatgatgcttgaatt

SEQ ID NO: 281757 - DNA, 15 bp, Homo sapiens
ttatgatgcttgaat

SEQ ID NO: 281758 - DNA, 15 bp, Homo sapiens
tttatgatgcttgaa

SEQ ID NO: 281759 - DNA, 15 bp, Homo sapiens
ttttatgatgcttga

SEQ ID NO: 281760 - DNA, 15 bp, Homo sapiens
tttttatgatgcttg

SEQ ID NO: 281761 - DNA, 15 bp, Homo sapiens
atttttatgatgctt

SEQ ID NO: 281762 - DNA, 15 bp, Homo sapiens
catttttatgatgct

SEQ ID NO: 281763 - DNA, 15 bp, Homo sapiens
ccatttttatgatgc

SEQ ID NO: 281764 - DNA, 15 bp, Homo sapiens
accatttttatgatg

SEQ ID NO: 281765 - DNA, 15 bp, Homo sapiens
taccatttttatgat

SEQ ID NO: 281766 - DNA, 15 bp, Homo sapiens
ttaccatttttatga

SEQ ID NO: 281767 - DNA, 15 bp, Homo sapiens
gttaccatttttatg

SEQ ID NO: 281768 - DNA, 15 bp, Homo sapiens
tgttaccatttttat

SEQ ID NO: 281769 - DNA, 15 bp, Homo sapiens
atgttaccattttta

SEQ ID NO: 281770 - DNA, 15 bp, Homo sapiens
aaatgttaccatttt

SEQ ID NO: 281771 - DNA, 15 bp, Homo sapiens
caaatgttaccattt

SEQ ID NO: 281772 - DNA, 15 bp, Homo sapiens
tcaaatgttaccatt

SEQ ID NO: 281773 - DNA, 15 bp, Homo sapiens
ttcaaatgttaccat

SEQ ID NO: 281774 - DNA, 15 bp, Homo sapiens
gttcaaatgttacca

SEQ ID NO: 281775 - DNA, 15 bp, Homo sapiens
agttcaaatgttacc

SEQ ID NO: 281776 - DNA, 15 bp, Homo sapiens
cagttcaaatgttac

SEQ ID NO: 281777 - DNA, 15 bp, Homo sapiens
ccagttcaaatgtta

SEQ ID NO: 281778 - DNA, 15 bp, Homo sapiens
cccagttcaaatgtt

SEQ ID NO: 281779 - DNA, 15 bp, Homo sapiens
acccagttcaaatgt

SEQ ID NO: 281780 - DNA, 15 bp, Homo sapiens
gacccagttcaaatg

SEQ ID NO: 281781 - DNA, 15 bp, Homo sapiens
agacccagttcaaat

SEQ ID NO: 281782 - DNA, 15 bp, Homo sapiens
tagacccagttcaaa

SEQ ID NO: 281783 - DNA, 15 bp, Homo sapiens
ctagacccagttcaa

SEQ ID NO: 281784 - DNA, 15 bp, Homo sapiens
cctagacccagttca

SEQ ID NO: 281785 - DNA, 15 bp, Homo sapiens
gcctagacccagttc

SEQ ID NO: 281786 - DNA, 15 bp, Homo sapiens
ggcctagacccagtt

SEQ ID NO: 281787 - DNA, 15 bp, Homo sapiens
tggcctagacccagt

SEQ ID NO: 281788 - DNA, 15 bp, Homo sapiens
ttggcctagacccag

SEQ ID NO: 281789 - DNA, 15 bp, Homo sapiens
gttggcctagaccca

SEQ ID NO: 281790 - DNA, 15 bp, Homo sapiens
agttggcctagaccc

SEQ ID NO: 281791 - DNA, 15 bp, Homo sapiens
tagttggcctagacc

SEQ ID NO: 281792 - DNA, 15 bp, Homo sapiens
ctagttggcctagac

SEQ ID NO: 281793 - DNA, 15 bp, Homo sapiens
tctagttggcctaga

SEQ ID NO: 281794 - DNA, 15 bp, Homo sapiens
ttctagttggcctag

SEQ ID NO: 281795 - DNA, 15 bp, Homo sapiens
attctagttggccta

SEQ ID NO: 281796 - DNA, 15 bp, Homo sapiens
aattctagttggcct

SEQ ID NO: 281797 - DNA, 15 bp, Homo sapiens
aaattctagttggcc

SEQ ID NO: 281798 - DNA, 15 bp, Homo sapiens
gaaattctagttggc

SEQ ID NO: 281799 - DNA, 15 bp, Homo sapiens
agaaattctagttgg

SEQ ID NO: 281800 - DNA, 15 bp, Homo sapiens
tagaaattctagttg

SEQ ID NO: 281801 - DNA, 15 bp, Homo sapiens
ctagaaattctagtt

SEQ ID NO: 281802 - DNA, 15 bp, Homo sapiens
cctagaaattctagt

SEQ ID NO: 281803 - DNA, 15 bp, Homo sapiens
ccctagaaattctag

SEQ ID NO: 281804 - DNA, 15 bp, Homo sapiens
cccctagaaattcta

SEQ ID NO: 281805 - DNA, 15 bp, Homo sapiens
tcccctagaaattct

SEQ ID NO: 281806 - DNA, 15 bp, Homo sapiens
ttcccctagaaattc

SEQ ID NO: 281807 - DNA, 15 bp, Homo sapiens
tttcccctagaaatt

SEQ ID NO: 281808 - DNA, 15 bp, Homo sapiens
ctttcccctagaaat

SEQ ID NO: 281809 - DNA, 15 bp, Homo sapiens
actttcccctagaaa

SEQ ID NO: 281810 - DNA, 15 bp, Homo sapiens
gactttcccctagaa

SEQ ID NO: 281811 - DNA, 15 bp, Homo sapiens
agactttcccctaga

SEQ ID NO: 281812 - DNA, 15 bp, Homo sapiens
aagactttcccctag

SEQ ID NO: 281813 - DNA, 15 bp, Homo sapiens
caagactttccccta

SEQ ID NO: 281814 - DNA, 15 bp, Homo sapiens
ccaagactttcccct

SEQ ID NO: 281815 - DNA, 15 bp, Homo sapiens
tccaagactttcccc

SEQ ID NO: 281816 - DNA, 15 bp, Homo sapiens
gtccaagactttccc

SEQ ID NO: 281817 - DNA, 15 bp, Homo sapiens
agtccaagactttcc

SEQ ID NO: 281818 - DNA, 15 bp, Homo sapiens
tagtccaagactttc

SEQ ID NO: 281819 - DNA, 15 bp, Homo sapiens
ttagtccaagacttt

SEQ ID NO: 281820 - DNA, 15 bp, Homo sapiens
attagtccaagactt

SEQ ID NO: 281821 - DNA, 15 bp, Homo sapiens
cattagtccaagact

SEQ ID NO: 281822 - DNA, 15 bp, Homo sapiens
ccattagtccaagac

SEQ ID NO: 281823 - DNA, 15 bp, Homo sapiens
tccattagtccaaga

SEQ ID NO: 281824 - DNA, 15 bp, Homo sapiens
ttccattagtccaag

SEQ ID NO: 281825 - DNA, 15 bp, Homo sapiens
attccattagtccaa

SEQ ID NO: 281826 - DNA, 15 bp, Homo sapiens
tattccattagtcca

SEQ ID NO: 281827 - DNA, 15 bp, Homo sapiens
ttattccattagtcc

SEQ ID NO: 281828 - DNA, 15 bp, Homo sapiens
attattccattagtc

SEQ ID NO: 281829 - DNA, 15 bp, Homo sapiens
tattattccattagt

SEQ ID NO: 281830 - DNA, 15 bp, Homo sapiens
atattattccattag

SEQ ID NO: 281831 - DNA, 15 bp, Homo sapiens
tatattattccatta

SEQ ID NO: 281832 - DNA, 15 bp, Homo sapiens
gtatattattccatt

SEQ ID NO: 281833 - DNA, 15 bp, Homo sapiens
agtatattattccat

SEQ ID NO: 281834 - DNA, 15 bp, Homo sapiens
gagtatattattcca

SEQ ID NO: 281835 - DNA, 15 bp, Homo sapiens
tgagtatattattcc

SEQ ID NO: 281836 - DNA, 15 bp, Homo sapiens
ttgagtatattattc

SEQ ID NO: 281837 - DNA, 15 bp, Homo sapiens
tttgagtatattatt

SEQ ID NO: 281838 - DNA, 15 bp, Homo sapiens
ttttgagtatattat

SEQ ID NO: 281839 - DNA, 15 bp, Homo sapiens
cttttgagtatatta

SEQ ID NO: 281840 - DNA, 15 bp, Homo sapiens
gcttttgagtatatt

SEQ ID NO: 281841 - DNA, 15 bp, Homo sapiens
tgcttttgagtatat

SEQ ID NO: 281842 - DNA, 15 bp, Homo sapiens
atgcttttgagtata

SEQ ID NO: 281843 - DNA, 15 bp, Homo sapiens
aatgcttttgagtat

SEQ ID NO: 281844 - DNA, 15 bp, Homo sapiens
caatgcttttgagta

SEQ ID NO: 281845 - DNA, 15 bp, Homo sapiens
tcaatgcttttgagt

SEQ ID NO: 281846 - DNA, 15 bp, Homo sapiens
ctcaatgcttttgag

SEQ ID NO: 281847 - DNA, 15 bp, Homo sapiens
gctcaatgcttttga

SEQ ID NO: 281848 - DNA, 15 bp, Homo sapiens
agctcaatgcttttg

SEQ ID NO: 281849 - DNA, 15 bp, Homo sapiens
cagctcaatgctttt

SEQ ID NO: 281850 - DNA, 15 bp, Homo sapiens
ccagctcaatgcttt

SEQ ID NO: 281851 - DNA, 15 bp, Homo sapiens
cccagctcaatgctt

SEQ ID NO: 281852 - DNA, 15 bp, Homo sapiens
tcccagctcaatgct

SEQ ID NO: 281853 - DNA, 15 bp, Homo sapiens
ttcccagctcaatgc

SEQ ID NO: 281854 - DNA, 15 bp, Homo sapiens
tttcccagctcaatg

SEQ ID NO: 281855 - DNA, 15 bp, Homo sapiens
ctttcccagctcaat

SEQ ID NO: 281856 - DNA, 15 bp, Homo sapiens
cctttcccagctcaa

SEQ ID NO: 281857 - DNA, 15 bp, Homo sapiens
ccctttcccagctca

SEQ ID NO: 281858 - DNA, 15 bp, Homo sapiens
gccctttcccagctc

SEQ ID NO: 281859 - DNA, 15 bp, Homo sapiens
tgccctttcccagct

SEQ ID NO: 281860 - DNA, 15 bp, Homo sapiens
atgccctttcccagc

SEQ ID NO: 281861 - DNA, 15 bp, Homo sapiens
catgccctttcccag

SEQ ID NO: 281862 - DNA, 15 bp, Homo sapiens
ccatgccctttccca

SEQ ID NO: 281863 - DNA, 15 bp, Homo sapiens
accatgccctttccc

SEQ ID NO: 281864 - DNA, 15 bp, Homo sapiens
aaccatgccctttcc

SEQ ID NO: 281865 - DNA, 15 bp, Homo sapiens
aaaccatgccctttc

SEQ ID NO: 281866 - DNA, 15 bp, Homo sapiens
caaaccatgcccttt

SEQ ID NO: 281867 - DNA, 15 bp, Homo sapiens
acaaaccatgccctt

SEQ ID NO: 281868 - DNA, 15 bp, Homo sapiens
aacaaaccatgccct

SEQ ID NO: 281869 - DNA, 15 bp, Homo sapiens
aaacaaaccatgccc

SEQ ID NO: 281870 - DNA, 15 bp, Homo sapiens
taaacaaaccatgcc

SEQ ID NO: 281871 - DNA, 15 bp, Homo sapiens
gtaaacaaaccatgc

SEQ ID NO: 281872 - DNA, 15 bp, Homo sapiens
agtaaacaaaccatg

SEQ ID NO: 281873 - DNA, 15 bp, Homo sapiens
cagtaaacaaaccat

SEQ ID NO: 281874 - DNA, 15 bp, Homo sapiens
tcagtaaacaaacca

SEQ ID NO: 281875 - DNA, 15 bp, Homo sapiens
ttcagtaaacaaacc

SEQ ID NO: 281876 - DNA, 15 bp, Homo sapiens
gttcagtaaacaaac

SEQ ID NO: 281877 - DNA, 15 bp, Homo sapiens
agttcagtaaacaaa

SEQ ID NO: 281878 - DNA, 15 bp, Homo sapiens
cagttcagtaaacaa

SEQ ID NO: 281879 - DNA, 15 bp, Homo sapiens
gcagttcagtaaaca

SEQ ID NO: 281880 - DNA, 15 bp, Homo sapiens
tgcagttcagtaaac

SEQ ID NO: 281881 - DNA, 15 bp, Homo sapiens
ctgcagttcagtaaa

SEQ ID NO: 281882 - DNA, 15 bp, Homo sapiens
cctgcagttcagtaa

SEQ ID NO: 281883 - DNA, 15 bp, Homo sapiens
acctgcagttcagta

SEQ ID NO: 281884 - DNA, 15 bp, Homo sapiens
tacctgcagttcagt

SEQ ID NO: 281885 - DNA, 15 bp, Homo sapiens
ctacctgcagttcag

SEQ ID NO: 281886 - DNA, 15 bp, Homo sapiens
cctacctgcagttca

SEQ ID NO: 281887 - DNA, 15 bp, Homo sapiens
ccctacctgcagttc

SEQ ID NO: 281888 - DNA, 15 bp, Homo sapiens
cccctacctgcagtt

SEQ ID NO: 281889 - DNA, 15 bp, Homo sapiens
tcccctacctgcagt

SEQ ID NO: 281890 - DNA, 15 bp, Homo sapiens
ttcccctacctgcag

SEQ ID NO: 281891 - DNA, 15 bp, Homo sapiens
tttcccctacctgca

SEQ ID NO: 281892 - DNA, 15 bp, Homo sapiens
ctttcccctacctgc

SEQ ID NO: 281893 - DNA, 15 bp, Homo sapiens
tctttcccctacctg

SEQ ID NO: 281894 - DNA, 15 bp, Homo sapiens
ctctttcccctacct

SEQ ID NO: 281895 - DNA, 15 bp, Homo sapiens
tctctttcccctacc

SEQ ID NO: 281896 - DNA, 15 bp, Homo sapiens
ttctctttcccctac

SEQ ID NO: 281897 - DNA, 15 bp, Homo sapiens
tttctctttccccta

SEQ ID NO: 281898 - DNA, 15 bp, Homo sapiens
atttctctttcccct

SEQ ID NO: 281899 - DNA, 15 bp, Homo sapiens
tatttctctttcccc

SEQ ID NO: 281900 - DNA, 15 bp, Homo sapiens
ctatttctctttccc

SEQ ID NO: 281901 - DNA, 15 bp, Homo sapiens
tctatttctctttcc

SEQ ID NO: 281902 - DNA, 15 bp, Homo sapiens
atctatttctctttc

SEQ ID NO: 281903 - DNA, 15 bp, Homo sapiens
catctatttctcttt

SEQ ID NO: 281904 - DNA, 15 bp, Homo sapiens
tcatctatttctctt

SEQ ID NO: 281905 - DNA, 15 bp, Homo sapiens
ctcatctatttctct

SEQ ID NO: 281906 - DNA, 15 bp, Homo sapiens
tctcatctatttctc

SEQ ID NO: 281907 - DNA, 15 bp, Homo sapiens
ttctcatctatttct

SEQ ID NO: 281908 - DNA, 15 bp, Homo sapiens
tttctcatctatttc

SEQ ID NO: 281909 - DNA, 15 bp, Homo sapiens
ctttctcatctattt

SEQ ID NO: 281910 - DNA, 15 bp, Homo sapiens
actttctcatctatt

SEQ ID NO: 281911 - DNA, 15 bp, Homo sapiens
cactttctcatctat

SEQ ID NO: 281912 - DNA, 15 bp, Homo sapiens
tcactttctcatcta

SEQ ID NO: 281913 - DNA, 15 bp, Homo sapiens
ttcactttctcatct

SEQ ID NO: 281914 - DNA, 15 bp, Homo sapiens
cttcactttctcatc

SEQ ID NO: 281915 - DNA, 15 bp, Homo sapiens
ccttcactttctcat

SEQ ID NO: 281916 - DNA, 15 bp, Homo sapiens
tccttcactttctca

SEQ ID NO: 281917 - DNA, 15 bp, Homo sapiens
gtccttcactttctc

SEQ ID NO: 281918 - DNA, 15 bp, Homo sapiens
tgtccttcactttct

SEQ ID NO: 281919 - DNA, 15 bp, Homo sapiens
gtgtccttcactttc

SEQ ID NO: 281920 - DNA, 15 bp, Homo sapiens
tgtgtccttcacttt

SEQ ID NO: 281921 - DNA, 15 bp, Homo sapiens
ctgtgtccttcactt

SEQ ID NO: 281922 - DNA, 15 bp, Homo sapiens
tctgtgtccttcact

SEQ ID NO: 281923 - DNA, 15 bp, Homo sapiens
ttctgtgtccttcac

SEQ ID NO: 281924 - DNA, 15 bp, Homo sapiens
cttctgtgtccttca

SEQ ID NO: 281925 - DNA, 15 bp, Homo sapiens
acttctgtgtccttc

SEQ ID NO: 281926 - DNA, 15 bp, Homo sapiens
aacttctgtgtcctt

SEQ ID NO: 281927 - DNA, 15 bp, Homo sapiens
caacttctgtgtcct

SEQ ID NO: 281928 - DNA, 15 bp, Homo sapiens
tcaacttctgtgtcc

SEQ ID NO: 281929 - DNA, 15 bp, Homo sapiens
ctcaacttctgtgtc

SEQ ID NO: 281930 - DNA, 15 bp, Homo sapiens
cctcaacttctgtgt

SEQ ID NO: 281931 - DNA, 15 bp, Homo sapiens
acctcaacttctgtg

SEQ ID NO: 281932 - DNA, 15 bp, Homo sapiens
gacctcaacttctgt

SEQ ID NO: 281933 - DNA, 15 bp, Homo sapiens
agacctcaacttctg

SEQ ID NO: 281934 - DNA, 15 bp, Homo sapiens
cagacctcaacttct

SEQ ID NO: 281935 - DNA, 15 bp, Homo sapiens
tcagacctcaacttc

SEQ ID NO: 281936 - DNA, 15 bp, Homo sapiens
atcagacctcaactt

SEQ ID NO: 281937 - DNA, 15 bp, Homo sapiens
tatcagacctcaact

SEQ ID NO: 281938 - DNA, 15 bp, Homo sapiens
ttatcagacctcaac

SEQ ID NO: 281939 - DNA, 15 bp, Homo sapiens
attatcagacctcaa

SEQ ID NO: 281940 - DNA, 15 bp, Homo sapiens
cattatcagacctca

SEQ ID NO: 281941 - DNA, 15 bp, Homo sapiens
tcattatcagacctc

SEQ ID NO: 281942 - DNA, 15 bp, Homo sapiens
ttcattatcagacct

SEQ ID NO: 281943 - DNA, 15 bp, Homo sapiens
tttcattatcagacc

SEQ ID NO: 281944 - DNA, 15 bp, Homo sapiens
ttttcattatcagac

SEQ ID NO: 281945 - DNA, 15 bp, Homo sapiens
tttttcattatcaga

SEQ ID NO: 281946 - DNA, 15 bp, Homo sapiens
gtttttcattatcag

SEQ ID NO: 281947 - DNA, 15 bp, Homo sapiens
ggtttttcattatca

SEQ ID NO: 281948 - DNA, 15 bp, Homo sapiens
gggtttttcattatc

SEQ ID NO: 281949 - DNA, 15 bp, Homo sapiens
tgggtttttcattat

SEQ ID NO: 281950 - DNA, 15 bp, Homo sapiens
ctgggtttttcatta

SEQ ID NO: 281951 - DNA, 15 bp, Homo sapiens
gctgggtttttcatt

SEQ ID NO: 281952 - DNA, 15 bp, Homo sapiens
ggctgggtttttcat

SEQ ID NO: 281953 - DNA, 15 bp, Homo sapiens
tggctgggtttttca

SEQ ID NO: 281954 - DNA, 15 bp, Homo sapiens
gtggctgggtttttc

SEQ ID NO: 281955 - DNA, 15 bp, Homo sapiens
agtggctgggttttt

SEQ ID NO: 281956 - DNA, 15 bp, Homo sapiens
cagtggctgggtttt

SEQ ID NO: 281957 - DNA, 15 bp, Homo sapiens
tcagtggctgggttt

SEQ ID NO: 281958 - DNA, 15 bp, Homo sapiens
ttcagtggctgggtt

SEQ ID NO: 281959 - DNA, 15 bp, Homo sapiens
cttcagtggctgggt

SEQ ID NO: 281960 - DNA, 15 bp, Homo sapiens
tcttcagtggctggg

SEQ ID NO: 281961 - DNA, 15 bp, Homo sapiens
ctcttcagtggctgg

SEQ ID NO: 281962 - DNA, 15 bp, Homo sapiens
actcttcagtggctg

SEQ ID NO: 281963 - DNA, 15 bp, Homo sapiens
aactcttcagtggct

SEQ ID NO: 281964 - DNA, 15 bp, Homo sapiens
caactcttcagtggc

SEQ ID NO: 281965 - DNA, 15 bp, Homo sapiens
ccaactcttcagtgg

SEQ ID NO: 281966 - DNA, 15 bp, Homo sapiens
tccaactcttcagtg

SEQ ID NO: 281967 - DNA, 15 bp, Homo sapiens
atccaactcttcagt

SEQ ID NO: 281968 - DNA, 15 bp, Homo sapiens
gatccaactcttcag

SEQ ID NO: 281969 - DNA, 15 bp, Homo sapiens
tgatccaactcttca

SEQ ID NO: 281970 - DNA, 15 bp, Homo sapiens
atgatccaactcttc

SEQ ID NO: 281971 - DNA, 15 bp, Homo sapiens
catgatccaactctt

SEQ ID NO: 281972 - DNA, 15 bp, Homo sapiens
acatgatccaactct

SEQ ID NO: 281973 - DNA, 15 bp, Homo sapiens
gacatgatccaactc

SEQ ID NO: 281974 - DNA, 15 bp, Homo sapiens
ggacatgatccaact

SEQ ID NO: 281975 - DNA, 15 bp, Homo sapiens
aggacatgatccaac

SEQ ID NO: 281976 - DNA, 15 bp, Homo sapiens
aaggacatgatccaa

SEQ ID NO: 281977 - DNA, 15 bp, Homo sapiens
taaggacatgatcca

SEQ ID NO: 281978 - DNA, 15 bp, Homo sapiens
ctaaggacatgatcc

SEQ ID NO: 281979 - DNA, 15 bp, Homo sapiens
actaaggacatgatc

SEQ ID NO: 281980 - DNA, 15 bp, Homo sapiens
aactaaggacatgat

SEQ ID NO: 281981 - DNA, 15 bp, Homo sapiens
caactaaggacatga

SEQ ID NO: 281982 - DNA, 15 bp, Homo sapiens
tcaactaaggacatg

SEQ ID NO: 281983 - DNA, 15 bp, Homo sapiens
ttcaactaaggacat

SEQ ID NO: 281984 - DNA, 15 bp, Homo sapiens
cttcaactaaggaca

SEQ ID NO: 281985 - DNA, 15 bp, Homo sapiens
ccttcaactaaggac

SEQ ID NO: 281986 - DNA, 15 bp, Homo sapiens
cccttcaactaagga

SEQ ID NO: 281987 - DNA, 15 bp, Homo sapiens
tcccttcaactaagg

SEQ ID NO: 281988 - DNA, 15 bp, Homo sapiens
ttcccttcaactaag

SEQ ID NO: 281989 - DNA, 15 bp, Homo sapiens
cttcccttcaactaa

SEQ ID NO: 281990 - DNA, 15 bp, Homo sapiens
acttcccttcaacta

SEQ ID NO: 281991 - DNA, 15 bp, Homo sapiens
gacttcccttcaact

SEQ ID NO: 281992 - DNA, 15 bp, Homo sapiens
tgacttcccttcaac

SEQ ID NO: 281993 - DNA, 15 bp, Homo sapiens
atgacttcccttcaa

SEQ ID NO: 281994 - DNA, 15 bp, Homo sapiens
catgacttcccttca

SEQ ID NO: 281995 - DNA, 15 bp, Homo sapiens
ccatgacttcccttc

SEQ ID NO: 281996 - DNA, 15 bp, Homo sapiens
tccatgacttccctt

SEQ ID NO: 281997 - DNA, 15 bp, Homo sapiens
ctccatgacttccct

SEQ ID NO: 281998 - DNA, 15 bp, Homo sapiens
tctccatgacttccc

SEQ ID NO: 281999 - DNA, 15 bp, Homo sapiens
ctctccatgacttcc

SEQ ID NO: 282000 - DNA, 15 bp, Homo sapiens
actctccatgacttc

SEQ ID NO: 282001 - DNA, 15 bp, Homo sapiens
aactctccatgactt

SEQ ID NO: 282002 - DNA, 15 bp, Homo sapiens
aaactctccatgact

SEQ ID NO: 282003 - DNA, 15 bp, Homo sapiens
aaaactctccatgac

SEQ ID NO: 282004 - DNA, 15 bp, Homo sapiens
aaaaactctccatga

SEQ ID NO: 282005 - DNA, 15 bp, Homo sapiens
caaaaactctccatg

SEQ ID NO: 282006 - DNA, 15 bp, Homo sapiens
acaaaaactctccat

SEQ ID NO: 282007 - DNA, 15 bp, Homo sapiens
aacaaaaactctcca

SEQ ID NO: 282008 - DNA, 15 bp, Homo sapiens
taacaaaaactctcc

SEQ ID NO: 282009 - DNA, 15 bp, Homo sapiens
ataacaaaaactctc

SEQ ID NO: 282010 - DNA, 15 bp, Homo sapiens
cataacaaaaactct

SEQ ID NO: 282011 - DNA, 15 bp, Homo sapiens
tcataacaaaaactc

SEQ ID NO: 282012 - DNA, 15 bp, Homo sapiens
ctcataacaaaaact

SEQ ID NO: 282013 - DNA, 15 bp, Homo sapiens
tctcataacaaaaac

SEQ ID NO: 282014 - DNA, 15 bp, Homo sapiens
ctctcataacaaaaa

SEQ ID NO: 282015 - DNA, 15 bp, Homo sapiens
cctctcataacaaaa

SEQ ID NO: 282016 - DNA, 15 bp, Homo sapiens
tcctctcataacaaa

SEQ ID NO: 282017 - DNA, 15 bp, Homo sapiens
ttcctctcataacaa

SEQ ID NO: 282018 - DNA, 15 bp, Homo sapiens
gttcctctcataaca

SEQ ID NO: 282019 - DNA, 15 bp, Homo sapiens
tgttcctctcataac

SEQ ID NO: 282020 - DNA, 15 bp, Homo sapiens
atgttcctctcataa

SEQ ID NO: 282021 - DNA, 15 bp, Homo sapiens
gatgttcctctcata

SEQ ID NO: 282022 - DNA, 15 bp, Homo sapiens
tgatgttcctctcat

SEQ ID NO: 282023 - DNA, 15 bp, Homo sapiens
atgatgttcctctca

SEQ ID NO: 282024 - DNA, 15 bp, Homo sapiens
aatgatgttcctctc

SEQ ID NO: 282025 - DNA, 15 bp, Homo sapiens
aaatgatgttcctct

SEQ ID NO: 282026 - DNA, 15 bp, Homo sapiens
aaaatgatgttcctc

SEQ ID NO: 282027 - DNA, 15 bp, Homo sapiens
taaaatgatgttcct

SEQ ID NO: 282028 - DNA, 15 bp, Homo sapiens
ataaaatgatgttcc

SEQ ID NO: 282029 - DNA, 15 bp, Homo sapiens
aataaaatgatgttc

SEQ ID NO: 282030 - DNA, 15 bp, Homo sapiens
aaataaaatgatgtt

SEQ ID NO: 282031 - DNA, 15 bp, Homo sapiens
caaataaaatgatgt

SEQ ID NO: 282032 - DNA, 15 bp, Homo sapiens
acaaataaaatgatg

SEQ ID NO: 282033 - DNA, 15 bp, Homo sapiens
aacaaataaaatgat

SEQ ID NO: 282034 - DNA, 15 bp, Homo sapiens
aaacaaataaaatga

SEQ ID NO: 282035 - DNA, 15 bp, Homo sapiens
caaacaaataaaatg

SEQ ID NO: 282036 - DNA, 15 bp, Homo sapiens
tcaaacaaataaaat

SEQ ID NO: 282037 - DNA, 15 bp, Homo sapiens
ctcaaacaaataaaa

SEQ ID NO: 282038 - DNA, 15 bp, Homo sapiens
tctcaaacaaataaa

SEQ ID NO: 282039 - DNA, 15 bp, Homo sapiens
ttctcaaacaaataa

SEQ ID NO: 282040 - DNA, 15 bp, Homo sapiens
attctcaaacaaata

SEQ ID NO: 282041 - DNA, 15 bp, Homo sapiens
cattctcaaacaaat

SEQ ID NO: 282042 - DNA, 15 bp, Homo sapiens
acattctcaaacaaa

SEQ ID NO: 282043 - DNA, 15 bp, Homo sapiens
gacattctcaaacaa

SEQ ID NO: 282044 - DNA, 15 bp, Homo sapiens
tgacattctcaaaca

SEQ ID NO: 282045 - DNA, 15 bp, Homo sapiens
gtgacattctcaaac

SEQ ID NO: 282046 - DNA, 15 bp, Homo sapiens
cgtgacattctcaaa

SEQ ID NO: 282047 - DNA, 15 bp, Homo sapiens
gcgtgacattctcaa

SEQ ID NO: 282048 - DNA, 15 bp, Homo sapiens
agcgtgacattctca

SEQ ID NO: 282049 - DNA, 15 bp, Homo sapiens
gagcgtgacattctc

SEQ ID NO: 282050 - DNA, 15 bp, Homo sapiens
tgagcgtgacattct

SEQ ID NO: 282051 - DNA, 15 bp, Homo sapiens
gtgagcgtgacattc

SEQ ID NO: 282052 - DNA, 15 bp, Homo sapiens
agtgagcgtgacatt

SEQ ID NO: 282053 - DNA, 15 bp, Homo sapiens
aagtgagcgtgacat

SEQ ID NO: 282054 - DNA, 15 bp, Homo sapiens
taagtgagcgtgaca

SEQ ID NO: 282055 - DNA, 15 bp, Homo sapiens
ctaagtgagcgtgac

SEQ ID NO: 282056 - DNA, 15 bp, Homo sapiens
tctaagtgagcgtga

SEQ ID NO: 282057 - DNA, 15 bp, Homo sapiens
atctaagtgagcgtg

SEQ ID NO: 282058 - DNA, 15 bp, Homo sapiens
catctaagtgagcgt

SEQ ID NO: 282059 - DNA, 15 bp, Homo sapiens
acatctaagtgagcg

SEQ ID NO: 282060 - DNA, 15 bp, Homo sapiens
tacatctaagtgagc

SEQ ID NO: 282061 - DNA, 15 bp, Homo sapiens
ctacatctaagtgag

SEQ ID NO: 282062 - DNA, 15 bp, Homo sapiens
tctacatctaagtga

SEQ ID NO: 282063 - DNA, 15 bp, Homo sapiens
gtctacatctaagtg

SEQ ID NO: 282064 - DNA, 15 bp, Homo sapiens
ggtctacatctaagt

SEQ ID NO: 282065 - DNA, 15 bp, Homo sapiens
tggtctacatctaag

SEQ ID NO: 282066 - DNA, 15 bp, Homo sapiens
ttggtctacatctaa

SEQ ID NO: 282067 - DNA, 15 bp, Homo sapiens
gttggtctacatcta

SEQ ID NO: 282068 - DNA, 15 bp, Homo sapiens
agttggtctacatct

SEQ ID NO: 282069 - DNA, 15 bp, Homo sapiens
tagttggtctacatc

SEQ ID NO: 282070 - DNA, 15 bp, Homo sapiens
ctagttggtctacat

SEQ ID NO: 282071 - DNA, 15 bp, Homo sapiens
tctagttggtctaca

SEQ ID NO: 282072 - DNA, 15 bp, Homo sapiens
ctctagttggtctac

SEQ ID NO: 282073 - DNA, 15 bp, Homo sapiens
cctctagttggtcta

SEQ ID NO: 282074 - DNA, 15 bp, Homo sapiens
ccctctagttggtct

SEQ ID NO: 282075 - DNA, 15 bp, Homo sapiens
accctctagttggtc

SEQ ID NO: 282076 - DNA, 15 bp, Homo sapiens
aaccctctagttggt

SEQ ID NO: 282077 - DNA, 15 bp, Homo sapiens
taaccctctagttgg

SEQ ID NO: 282078 - DNA, 15 bp, Homo sapiens
ttaaccctctagttg

SEQ ID NO: 282079 - DNA, 15 bp, Homo sapiens
cttaaccctctagtt

SEQ ID NO: 282080 - DNA, 15 bp, Homo sapiens
ccttaaccctctagt

SEQ ID NO: 282081 - DNA, 15 bp, Homo sapiens
tccttaaccctctag

SEQ ID NO: 282082 - DNA, 15 bp, Homo sapiens
ttccttaaccctcta

SEQ ID NO: 282083 - DNA, 15 bp, Homo sapiens
tttccttaaccctct

SEQ ID NO: 282084 - DNA, 15 bp, Homo sapiens
ctttccttaaccctc

SEQ ID NO: 282085 - DNA, 15 bp, Homo sapiens
gctttccttaaccct

SEQ ID NO: 282086 - DNA, 15 bp, Homo sapiens
ggctttccttaaccc

SEQ ID NO: 282087 - DNA, 15 bp, Homo sapiens
aggctttccttaacc

SEQ ID NO: 282088 - DNA, 15 bp, Homo sapiens
taggctttccttaac

SEQ ID NO: 282089 - DNA, 15 bp, Homo sapiens
ctaggctttccttaa

SEQ ID NO: 282090 - DNA, 15 bp, Homo sapiens
cctaggctttcctta

SEQ ID NO: 282091 - DNA, 15 bp, Homo sapiens
acctaggctttcctt

SEQ ID NO: 282092 - DNA, 15 bp, Homo sapiens
gacctaggctttcct

SEQ ID NO: 282093 - DNA, 15 bp, Homo sapiens
agacctaggctttcc

SEQ ID NO: 282094 - DNA, 15 bp, Homo sapiens
cagacctaggctttc

SEQ ID NO: 282095 - DNA, 15 bp, Homo sapiens
ccagacctaggcttt

SEQ ID NO: 282096 - DNA, 15 bp, Homo sapiens
cccagacctaggctt

SEQ ID NO: 282097 - DNA, 15 bp, Homo sapiens
tcccagacctaggct

SEQ ID NO: 282098 - DNA, 15 bp, Homo sapiens
ctcccagacctaggc

SEQ ID NO: 282099 - DNA, 15 bp, Homo sapiens
gctcccagacctagg

SEQ ID NO: 282100 - DNA, 15 bp, Homo sapiens
agctcccagacctag

SEQ ID NO: 282101 - DNA, 15 bp, Homo sapiens
gagctcccagaccta

SEQ ID NO: 282102 - DNA, 15 bp, Homo sapiens
tgagctcccagacct

SEQ ID NO: 282103 - DNA, 15 bp, Homo sapiens
ttgagctcccagacc

SEQ ID NO: 282104 - DNA, 15 bp, Homo sapiens
attgagctcccagac

SEQ ID NO: 282105 - DNA, 15 bp, Homo sapiens
aattgagctcccaga

SEQ ID NO: 282106 - DNA, 15 bp, Homo sapiens
taattgagctcccag

SEQ ID NO: 282107 - DNA, 15 bp, Homo sapiens
ctaattgagctccca

SEQ ID NO: 282108 - DNA, 15 bp, Homo sapiens
tctaattgagctccc

SEQ ID NO: 282109 - DNA, 15 bp, Homo sapiens
ttctaattgagctcc

SEQ ID NO: 282110 - DNA, 15 bp, Homo sapiens
cttctaattgagctc

SEQ ID NO: 282111 - DNA, 15 bp, Homo sapiens
tcttctaattgagct

SEQ ID NO: 282112 - DNA, 15 bp, Homo sapiens
atcttctaattgagc

SEQ ID NO: 282113 - DNA, 15 bp, Homo sapiens
aatcttctaattgag

SEQ ID NO: 282114 - DNA, 15 bp, Homo sapiens
taatcttctaattga

SEQ ID NO: 282115 - DNA, 15 bp, Homo sapiens
ctaatcttctaattg

SEQ ID NO: 282116 - DNA, 15 bp, Homo sapiens
cctaatcttctaatt

SEQ ID NO: 282117 - DNA, 15 bp, Homo sapiens
acctaatcttctaat

SEQ ID NO: 282118 - DNA, 15 bp, Homo sapiens
gacctaatcttctaa

SEQ ID NO: 282119 - DNA, 15 bp, Homo sapiens
tgacctaatcttcta

SEQ ID NO: 282120 - DNA, 15 bp, Homo sapiens
ctgacctaatcttct

SEQ ID NO: 282121 - DNA, 15 bp, Homo sapiens
actgacctaatcttc

SEQ ID NO: 282122 - DNA, 15 bp, Homo sapiens
aactgacctaatctt

SEQ ID NO: 282123 - DNA, 15 bp, Homo sapiens
taactgacctaatct

SEQ ID NO: 282124 - DNA, 15 bp, Homo sapiens
ctaactgacctaatc

SEQ ID NO: 282125 - DNA, 15 bp, Homo sapiens
cctaactgacctaat

SEQ ID NO: 282126 - DNA, 15 bp, Homo sapiens
tcctaactgacctaa

SEQ ID NO: 282127 - DNA, 15 bp, Homo sapiens
ctcctaactgaccta

SEQ ID NO: 282128 - DNA, 15 bp, Homo sapiens
tctcctaactgacct

SEQ ID NO: 282129 - DNA, 15 bp, Homo sapiens
gtctcctaactgacc

SEQ ID NO: 282130 - DNA, 15 bp, Homo sapiens
agtctcctaactgac

SEQ ID NO: 282131 - DNA, 15 bp, Homo sapiens
aagtctcctaactga

SEQ ID NO: 282132 - DNA, 15 bp, Homo sapiens
aaagtctcctaactg

SEQ ID NO: 282133 - DNA, 15 bp, Homo sapiens
taaagtctcctaact

SEQ ID NO: 282134 - DNA, 15 bp, Homo sapiens
gtaaagtctcctaac

SEQ ID NO: 282135 - DNA, 15 bp, Homo sapiens
tgtaaagtctcctaa

SEQ ID NO: 282136 - DNA, 15 bp, Homo sapiens
ttgtaaagtctccta

SEQ ID NO: 282137 - DNA, 15 bp, Homo sapiens
gttgtaaagtctcct

SEQ ID NO: 282138 - DNA, 15 bp, Homo sapiens
tgttgtaaagtctcc

SEQ ID NO: 282139 - DNA, 15 bp, Homo sapiens
atgttgtaaagtctc

SEQ ID NO: 282140 - DNA, 15 bp, Homo sapiens
catgttgtaaagtct

SEQ ID NO: 282141 - DNA, 15 bp, Homo sapiens
ccatgttgtaaagtc

SEQ ID NO: 282142 - DNA, 15 bp, Homo sapiens
gccatgttgtaaagt

SEQ ID NO: 282143 - DNA, 15 bp, Homo sapiens
cgccatgttgtaaag

SEQ ID NO: 282144 - DNA, 15 bp, Homo sapiens
acgccatgttgtaaa

SEQ ID NO: 282145 - DNA, 15 bp, Homo sapiens
tacgccatgttgtaa

SEQ ID NO: 282146 - DNA, 15 bp, Homo sapiens
ttacgccatgttgta

SEQ ID NO: 282147 - DNA, 15 bp, Homo sapiens
cttacgccatgttgt

SEQ ID NO: 282148 - DNA, 15 bp, Homo sapiens
tcttacgccatgttg

SEQ ID NO: 282149 - DNA, 15 bp, Homo sapiens
atcttacgccatgtt

SEQ ID NO: 282150 - DNA, 15 bp, Homo sapiens
tatcttacgccatgt

SEQ ID NO: 282151 - DNA, 15 bp, Homo sapiens
ttatcttacgccatg

SEQ ID NO: 282152 - DNA, 15 bp, Homo sapiens
tttatcttacgccat

SEQ ID NO: 282153 - DNA, 15 bp, Homo sapiens
ctttatcttacgcca

SEQ ID NO: 282154 - DNA, 15 bp, Homo sapiens
cctttatcttacgcc

SEQ ID NO: 282155 - DNA, 15 bp, Homo sapiens
gcctttatcttacgc

SEQ ID NO: 282156 - DNA, 15 bp, Homo sapiens
ggcctttatcttacg

SEQ ID NO: 282157 - DNA, 15 bp, Homo sapiens
aggcctttatcttac

SEQ ID NO: 282158 - DNA, 15 bp, Homo sapiens
taggcctttatctta

SEQ ID NO: 282159 - DNA, 15 bp, Homo sapiens
gtaggcctttatctt

SEQ ID NO: 282160 - DNA, 15 bp, Homo sapiens
tgtaggcctttatct

SEQ ID NO: 282161 - DNA, 15 bp, Homo sapiens
ctgtaggcctttatc

SEQ ID NO: 282162 - DNA, 15 bp, Homo sapiens
cctgtaggcctttat

SEQ ID NO: 282163 - DNA, 15 bp, Homo sapiens
gcctgtaggccttta

SEQ ID NO: 282164 - DNA, 15 bp, Homo sapiens
tgcctgtaggccttt

SEQ ID NO: 282165 - DNA, 15 bp, Homo sapiens
atgcctgtaggcctt

SEQ ID NO: 282166 - DNA, 15 bp, Homo sapiens
aatgcctgtaggcct

SEQ ID NO: 282167 - DNA, 15 bp, Homo sapiens
taatgcctgtaggcc

SEQ ID NO: 282168 - DNA, 15 bp, Homo sapiens
ttaatgcctgtaggc

SEQ ID NO: 282169 - DNA, 15 bp, Homo sapiens
cttaatgcctgtagg

SEQ ID NO: 282170 - DNA, 15 bp, Homo sapiens
ccttaatgcctgtag

SEQ ID NO: 282171 - DNA, 15 bp, Homo sapiens
gccttaatgcctgta

SEQ ID NO: 282172 - DNA, 15 bp, Homo sapiens
tgccttaatgcctgt

SEQ ID NO: 282173 - DNA, 15 bp, Homo sapiens
ctgccttaatgcctg

SEQ ID NO: 282174 - DNA, 15 bp, Homo sapiens
actgccttaatgcct

SEQ ID NO: 282175 - DNA, 15 bp, Homo sapiens
cactgccttaatgcc

SEQ ID NO: 282176 - DNA, 15 bp, Homo sapiens
ccactgccttaatgc

SEQ ID NO: 282177 - DNA, 15 bp, Homo sapiens
accactgccttaatg

SEQ ID NO: 282178 - DNA, 15 bp, Homo sapiens
caccactgccttaat

SEQ ID NO: 282179 - DNA, 15 bp, Homo sapiens
tcaccactgccttaa

SEQ ID NO: 282180 - DNA, 15 bp, Homo sapiens
atcaccactgcctta

SEQ ID NO: 282181 - DNA, 15 bp, Homo sapiens
tatcaccactgcctt

SEQ ID NO: 282182 - DNA, 15 bp, Homo sapiens
ctatcaccactgcct

SEQ ID NO: 282183 - DNA, 15 bp, Homo sapiens
tctatcaccactgcc

SEQ ID NO: 282184 - DNA, 15 bp, Homo sapiens
ttctatcaccactgc

SEQ ID NO: 282185 - DNA, 15 bp, Homo sapiens
tttctatcaccactg

SEQ ID NO: 282186 - DNA, 15 bp, Homo sapiens
ctttctatcaccact

SEQ ID NO: 282187 - DNA, 15 bp, Homo sapiens
cctttctatcaccac

SEQ ID NO: 282188 - DNA, 15 bp, Homo sapiens
acctttctatcacca

SEQ ID NO: 282189 - DNA, 15 bp, Homo sapiens
tacctttctatcacc

SEQ ID NO: 282190 - DNA, 15 bp, Homo sapiens
ctacctttctatcac

SEQ ID NO: 282191 - DNA, 15 bp, Homo sapiens
gctacctttctatca

SEQ ID NO: 282192 - DNA, 15 bp, Homo sapiens
agctacctttctatc

SEQ ID NO: 282193 - DNA, 15 bp, Homo sapiens
gagctacctttctat

SEQ ID NO: 282194 - DNA, 15 bp, Homo sapiens
tgagctacctttcta

SEQ ID NO: 282195 - DNA, 15 bp, Homo sapiens
ttgagctacctttct

SEQ ID NO: 282196 - DNA, 15 bp, Homo sapiens
gttgagctacctttc

SEQ ID NO: 282197 - DNA, 15 bp, Homo sapiens
tgttgagctaccttt

SEQ ID NO: 282198 - DNA, 15 bp, Homo sapiens
atgttgagctacctt

SEQ ID NO: 282199 - DNA, 15 bp, Homo sapiens
catgttgagctacct

SEQ ID NO: 282200 - DNA, 15 bp, Homo sapiens
tcatgttgagctacc

SEQ ID NO: 282201 - DNA, 15 bp, Homo sapiens
ttcatgttgagctac

SEQ ID NO: 282202 - DNA, 15 bp, Homo sapiens
tttcatgttgagcta

SEQ ID NO: 282203 - DNA, 15 bp, Homo sapiens
gtttcatgttgagct

SEQ ID NO: 282204 - DNA, 15 bp, Homo sapiens
cgtttcatgttgagc

SEQ ID NO: 282205 - DNA, 15 bp, Homo sapiens
acgtttcatgttgag

SEQ ID NO: 282206 - DNA, 15 bp, Homo sapiens
aacgtttcatgttga

SEQ ID NO: 282207 - DNA, 15 bp, Homo sapiens
aaacgtttcatgttg

SEQ ID NO: 282208 - DNA, 15 bp, Homo sapiens
aaaacgtttcatgtt

SEQ ID NO: 282209 - DNA, 15 bp, Homo sapiens
taaaacgtttcatgt

SEQ ID NO: 282210 - DNA, 15 bp, Homo sapiens
ctaaaacgtttcatg

SEQ ID NO: 282211 - DNA, 15 bp, Homo sapiens
actaaaacgtttcat

SEQ ID NO: 282212 - DNA, 15 bp, Homo sapiens
aactaaaacgtttca

SEQ ID NO: 282213 - DNA, 15 bp, Homo sapiens
aaactaaaacgtttc

SEQ ID NO: 282214 - DNA, 15 bp, Homo sapiens
aaaactaaaacgttt

SEQ ID NO: 282215 - DNA, 15 bp, Homo sapiens
taaaactaaaacgtt

SEQ ID NO: 282216 - DNA, 15 bp, Homo sapiens
gtaaaactaaaacgt

SEQ ID NO: 282217 - DNA, 15 bp, Homo sapiens
tgtaaaactaaaacg

SEQ ID NO: 282218 - DNA, 15 bp, Homo sapiens
ctgtaaaactaaaac

SEQ ID NO: 282219 - DNA, 15 bp, Homo sapiens
actgtaaaactaaaa

SEQ ID NO: 282220 - DNA, 15 bp, Homo sapiens
gactgtaaaactaaa

SEQ ID NO: 282221 - DNA, 15 bp, Homo sapiens
cgactgtaaaactaa

SEQ ID NO: 282222 - DNA, 15 bp, Homo sapiens
acgactgtaaaacta

SEQ ID NO: 282223 - DNA, 15 bp, Homo sapiens
cacgactgtaaaact

SEQ ID NO: 282224 - DNA, 15 bp, Homo sapiens
acacgactgtaaaac

SEQ ID NO: 282225 - DNA, 15 bp, Homo sapiens
aacacgactgtaaaa

SEQ ID NO: 282226 - DNA, 15 bp, Homo sapiens
taacacgactgtaaa

SEQ ID NO: 282227 - DNA, 15 bp, Homo sapiens
ctaacacgactgtaa

SEQ ID NO: 282228 - DNA, 15 bp, Homo sapiens
cctaacacgactgta

SEQ ID NO: 282229 - DNA, 15 bp, Homo sapiens
tcctaacacgactgt

SEQ ID NO: 282230 - DNA, 15 bp, Homo sapiens
ctcctaacacgactg

SEQ ID NO: 282231 - DNA, 15 bp, Homo sapiens
tctcctaacacgact

SEQ ID NO: 282232 - DNA, 15 bp, Homo sapiens
atctcctaacacgac

SEQ ID NO: 282233 - DNA, 15 bp, Homo sapiens
aatctcctaacacga

SEQ ID NO: 282234 - DNA, 15 bp, Homo sapiens
aaatctcctaacacg

SEQ ID NO: 282235 - DNA, 15 bp, Homo sapiens
caaatctcctaacac

SEQ ID NO: 282236 - DNA, 15 bp, Homo sapiens
ccaaatctcctaaca

SEQ ID NO: 282237 - DNA, 15 bp, Homo sapiens
tccaaatctcctaac

SEQ ID NO: 282238 - DNA, 15 bp, Homo sapiens
atccaaatctcctaa

SEQ ID NO: 282239 - DNA, 15 bp, Homo sapiens
gatccaaatctccta

SEQ ID NO: 282240 - DNA, 15 bp, Homo sapiens
agatccaaatctcct

SEQ ID NO: 282241 - DNA, 15 bp, Homo sapiens
aagatccaaatctcc

SEQ ID NO: 282242 - DNA, 15 bp, Homo sapiens
aaagatccaaatctc

SEQ ID NO: 282243 - DNA, 15 bp, Homo sapiens
gaaagatccaaatct

SEQ ID NO: 282244 - DNA, 15 bp, Homo sapiens
agaaagatccaaatc

SEQ ID NO: 282245 - DNA, 15 bp, Homo sapiens
tagaaagatccaaat

SEQ ID NO: 282246 - DNA, 15 bp, Homo sapiens
atagaaagatccaaa

SEQ ID NO: 282247 - DNA, 15 bp, Homo sapiens
catagaaagatccaa

SEQ ID NO: 282248 - DNA, 15 bp, Homo sapiens
acatagaaagatcca

SEQ ID NO: 282249 - DNA, 15 bp, Homo sapiens
aacatagaaagatcc

SEQ ID NO: 282250 - DNA, 15 bp, Homo sapiens
aaacatagaaagatc

SEQ ID NO: 282251 - DNA, 15 bp, Homo sapiens
aaaacatagaaagat

SEQ ID NO: 282252 - DNA, 15 bp, Homo sapiens
caaaacatagaaaga

SEQ ID NO: 282253 - DNA, 15 bp, Homo sapiens
acaaaacatagaaag

SEQ ID NO: 282254 - DNA, 15 bp, Homo sapiens
gacaaaacatagaaa

SEQ ID NO: 282255 - DNA, 15 bp, Homo sapiens
tgacaaaacatagaa

SEQ ID NO: 282256 - DNA, 15 bp, Homo sapiens
ctgacaaaacataga

SEQ ID NO: 282257 - DNA, 15 bp, Homo sapiens
tctgacaaaacatag

SEQ ID NO: 282258 - DNA, 15 bp, Homo sapiens
ttctgacaaaacata

SEQ ID NO: 282259 - DNA, 15 bp, Homo sapiens
attctgacaaaacat

SEQ ID NO: 282260 - DNA, 15 bp, Homo sapiens
aattctgacaaaaca

SEQ ID NO: 282261 - DNA, 15 bp, Homo sapiens
aaattctgacaaaac

SEQ ID NO: 282262 - DNA, 15 bp, Homo sapiens
aaaattctgacaaaa

SEQ ID NO: 282263 - DNA, 15 bp, Homo sapiens
caaaattctgacaaa

SEQ ID NO: 282264 - DNA, 15 bp, Homo sapiens
tcaaaattctgacaa

SEQ ID NO: 282265 - DNA, 15 bp, Homo sapiens
gtcaaaattctgaca

SEQ ID NO: 282266 - DNA, 15 bp, Homo sapiens
tgtcaaaattctgac

SEQ ID NO: 282267 - DNA, 15 bp, Homo sapiens
ttgtcaaaattctga

SEQ ID NO: 282268 - DNA, 15 bp, Homo sapiens
attgtcaaaattctg

SEQ ID NO: 282269 - DNA, 15 bp, Homo sapiens
aattgtcaaaattct

SEQ ID NO: 282270 - DNA, 15 bp, Homo sapiens
aaattgtcaaaattc

SEQ ID NO: 282271 - DNA, 15 bp, Homo sapiens
taaattgtcaaaatt

SEQ ID NO: 282272 - DNA, 15 bp, Homo sapiens
ttaaattgtcaaaat

SEQ ID NO: 282273 - DNA, 15 bp, Homo sapiens
tttaaattgtcaaaa

SEQ ID NO: 282274 - DNA, 15 bp, Homo sapiens
ttttaaattgtcaaa

SEQ ID NO: 282275 - DNA, 15 bp, Homo sapiens
tttttaaattgtcaa

SEQ ID NO: 282276 - DNA, 15 bp, Homo sapiens
atttttaaattgtca

SEQ ID NO: 282277 - DNA, 15 bp, Homo sapiens
catttttaaattgtc

SEQ ID NO: 282278 - DNA, 15 bp, Homo sapiens
tcatttttaaattgt

SEQ ID NO: 282279 - DNA, 15 bp, Homo sapiens
atcatttttaaattg

SEQ ID NO: 282280 - DNA, 15 bp, Homo sapiens
aatcatttttaaatt

SEQ ID NO: 282281 - DNA, 15 bp, Homo sapiens
taatcatttttaaat

SEQ ID NO: 282282 - DNA, 15 bp, Homo sapiens
ttaatcatttttaaa

SEQ ID NO: 282283 - DNA, 15 bp, Homo sapiens
cttaatcatttttaa

SEQ ID NO: 282284 - DNA, 15 bp, Homo sapiens
ccttaatcattttta

SEQ ID NO: 282285 - DNA, 15 bp, Homo sapiens
tccttaatcattttt

SEQ ID NO: 282286 - DNA, 15 bp, Homo sapiens
atccttaatcatttt

SEQ ID NO: 282287 - DNA, 15 bp, Homo sapiens
catccttaatcattt

SEQ ID NO: 282288 - DNA, 15 bp, Homo sapiens
acatccttaatcatt

SEQ ID NO: 282289 - DNA, 15 bp, Homo sapiens
tacatccttaatcat

SEQ ID NO: 282290 - DNA, 15 bp, Homo sapiens
gtacatccttaatca

SEQ ID NO: 282291 - DNA, 15 bp, Homo sapiens
cgtacatccttaatc

SEQ ID NO: 282292 - DNA, 15 bp, Homo sapiens
acgtacatccttaat

SEQ ID NO: 282293 - DNA, 15 bp, Homo sapiens
gacgtacatccttaa

SEQ ID NO: 282294 - DNA, 15 bp, Homo sapiens
ggacgtacatcctta

SEQ ID NO: 282295 - DNA, 15 bp, Homo sapiens
tggacgtacatcctt

SEQ ID NO: 282296 - DNA, 15 bp, Homo sapiens
ttggacgtacatcct

SEQ ID NO: 282297 - DNA, 15 bp, Homo sapiens
attggacgtacatcc

SEQ ID NO: 282298 - DNA, 15 bp, Homo sapiens
aattggacgtacatc

SEQ ID NO: 282299 - DNA, 15 bp, Homo sapiens
caattggacgtacat

SEQ ID NO: 282300 - DNA, 15 bp, Homo sapiens
tcaattggacgtaca

SEQ ID NO: 282301 - DNA, 15 bp, Homo sapiens
gtcaattggacgtac

SEQ ID NO: 282302 - DNA, 15 bp, Homo sapiens
ggtcaattggacgta

SEQ ID NO: 282303 - DNA, 15 bp, Homo sapiens
tggtcaattggacgt

SEQ ID NO: 282304 - DNA, 15 bp, Homo sapiens
atggtcaattggacg

SEQ ID NO: 282305 - DNA, 15 bp, Homo sapiens
catggtcaattggac

SEQ ID NO: 282306 - DNA, 15 bp, Homo sapiens
acatggtcaattgga

SEQ ID NO: 282307 - DNA, 15 bp, Homo sapiens
gacatggtcaattgg

SEQ ID NO: 282308 - DNA, 15 bp, Homo sapiens
ggacatggtcaattg

SEQ ID NO: 282309 - DNA, 15 bp, Homo sapiens
aggacatggtcaatt

SEQ ID NO: 282310 - DNA, 15 bp, Homo sapiens
taggacatggtcaat

SEQ ID NO: 282311 - DNA, 15 bp, Homo sapiens
ataggacatggtcaa

SEQ ID NO: 282312 - DNA, 15 bp, Homo sapiens
tataggacatggtca

SEQ ID NO: 282313 - DNA, 15 bp, Homo sapiens
atataggacatggtc

SEQ ID NO: 282314 - DNA, 15 bp, Homo sapiens
catataggacatggt

SEQ ID NO: 282315 - DNA, 15 bp, Homo sapiens
ccatataggacatgg

SEQ ID NO: 282316 - DNA, 15 bp, Homo sapiens
gccatataggacatg

SEQ ID NO: 282317 - DNA, 15 bp, Homo sapiens
ggccatataggacat

SEQ ID NO: 282318 - DNA, 15 bp, Homo sapiens
tggccatataggaca

SEQ ID NO: 282319 - DNA, 15 bp, Homo sapiens
atggccatataggac

SEQ ID NO: 282320 - DNA, 15 bp, Homo sapiens
catggccatatagga

SEQ ID NO: 282321 - DNA, 15 bp, Homo sapiens
acatggccatatagg

SEQ ID NO: 282322 - DNA, 15 bp, Homo sapiens
aacatggccatatag

SEQ ID NO: 282323 - DNA, 15 bp, Homo sapiens
caacatggccatata

SEQ ID NO: 282324 - DNA, 15 bp, Homo sapiens
acaacatggccatat

SEQ ID NO: 282325 - DNA, 15 bp, Homo sapiens
gacaacatggccata

SEQ ID NO: 282326 - DNA, 15 bp, Homo sapiens
agacaacatggccat

SEQ ID NO: 282327 - DNA, 15 bp, Homo sapiens
tagacaacatggcca

SEQ ID NO: 282328 - DNA, 15 bp, Homo sapiens
ttagacaacatggcc

SEQ ID NO: 282329 - DNA, 15 bp, Homo sapiens
gttagacaacatggc

SEQ ID NO: 282330 - DNA, 15 bp, Homo sapiens
ggttagacaacatgg

SEQ ID NO: 282331 - DNA, 15 bp, Homo sapiens
aggttagacaacatg

SEQ ID NO: 282332 - DNA, 15 bp, Homo sapiens
gaggttagacaacat

SEQ ID NO: 282333 - DNA, 15 bp, Homo sapiens
ggaggttagacaaca

SEQ ID NO: 282334 - DNA, 15 bp, Homo sapiens
aggaggttagacaac

SEQ ID NO: 282335 - DNA, 15 bp, Homo sapiens
aaggaggttagacaa

SEQ ID NO: 282336 - DNA, 15 bp, Homo sapiens
taaggaggttagaca

SEQ ID NO: 282337 - DNA, 15 bp, Homo sapiens
ataaggaggttagac

SEQ ID NO: 282338 - DNA, 15 bp, Homo sapiens
aataaggaggttaga

SEQ ID NO: 282339 - DNA, 15 bp, Homo sapiens
aaataaggaggttag

SEQ ID NO: 282340 - DNA, 15 bp, Homo sapiens
aaaataaggaggtta

SEQ ID NO: 282341 - DNA, 15 bp, Homo sapiens
aaaaataaggaggtt

SEQ ID NO: 282342 - DNA, 15 bp, Homo sapiens
taaaaataaggaggt

SEQ ID NO: 282343 - DNA, 15 bp, Homo sapiens
ataaaaataaggagg

SEQ ID NO: 282344 - DNA, 15 bp, Homo sapiens
aataaaaataaggag

SEQ ID NO: 282345 - DNA, 15 bp, Homo sapiens
aaataaaaataagga

SEQ ID NO: 282346 - DNA, 15 bp, Homo sapiens
aaaataaaaataagg

SEQ ID NO: 282347 - DNA, 15 bp, Homo sapiens
caaaataaaaataag

SEQ ID NO: 282348 - DNA, 15 bp, Homo sapiens
gcaaaataaaaataa

SEQ ID NO: 282349 - DNA, 15 bp, Homo sapiens
tgcaaaataaaaata

SEQ ID NO: 282350 - DNA, 15 bp, Homo sapiens
ctgcaaaataaaaat

SEQ ID NO: 282351 - DNA, 15 bp, Homo sapiens
tctgcaaaataaaaa

SEQ ID NO: 282352 - DNA, 15 bp, Homo sapiens
gtctgcaaaataaaa

SEQ ID NO: 282353 - DNA, 15 bp, Homo sapiens
agtctgcaaaataaa

SEQ ID NO: 282354 - DNA, 15 bp, Homo sapiens
cagtctgcaaaataa

SEQ ID NO: 282355 - DNA, 15 bp, Homo sapiens
ccagtctgcaaaata

SEQ ID NO: 282356 - DNA, 15 bp, Homo sapiens
gccagtctgcaaaat

SEQ ID NO: 282357 - DNA, 15 bp, Homo sapiens
ggccagtctgcaaaa

SEQ ID NO: 282358 - DNA, 15 bp, Homo sapiens
gggccagtctgcaaa

SEQ ID NO: 282359 - DNA, 15 bp, Homo sapiens
tgggccagtctgcaa

SEQ ID NO: 282360 - DNA, 15 bp, Homo sapiens
ctgggccagtctgca

SEQ ID NO: 282361 - DNA, 15 bp, Homo sapiens
tctgggccagtctgc

SEQ ID NO: 282362 - DNA, 15 bp, Homo sapiens
atctgggccagtctg

SEQ ID NO: 282363 - DNA, 15 bp, Homo sapiens
catctgggccagtct

SEQ ID NO: 282364 - DNA, 15 bp, Homo sapiens
ccatctgggccagtc

SEQ ID NO: 282365 - DNA, 15 bp, Homo sapiens
tccatctgggccagt

SEQ ID NO: 282366 - DNA, 15 bp, Homo sapiens
ttccatctgggccag

SEQ ID NO: 282367 - DNA, 15 bp, Homo sapiens
tttccatctgggcca

SEQ ID NO: 282368 - DNA, 15 bp, Homo sapiens
ctttccatctgggcc

SEQ ID NO: 282369 - DNA, 15 bp, Homo sapiens
cctttccatctgggc

SEQ ID NO: 282370 - DNA, 15 bp, Homo sapiens
tcctttccatctggg

SEQ ID NO: 282371 - DNA, 15 bp, Homo sapiens
gtcctttccatctgg

SEQ ID NO: 282372 - DNA, 15 bp, Homo sapiens
agtcctttccatctg

SEQ ID NO: 282373 - DNA, 15 bp, Homo sapiens
tagtcctttccatct

SEQ ID NO: 282374 - DNA, 15 bp, Homo sapiens
ttagtcctttccatc

SEQ ID NO: 282375 - DNA, 15 bp, Homo sapiens
attagtcctttccat

SEQ ID NO: 282376 - DNA, 15 bp, Homo sapiens
cattagtcctttcca

SEQ ID NO: 282377 - DNA, 15 bp, Homo sapiens
ccattagtcctttcc

SEQ ID NO: 282378 - DNA, 15 bp, Homo sapiens
cccattagtcctttc

SEQ ID NO: 282379 - DNA, 15 bp, Homo sapiens
acccattagtccttt

SEQ ID NO: 282380 - DNA, 15 bp, Homo sapiens
gacccattagtcctt

SEQ ID NO: 282381 - DNA, 15 bp, Homo sapiens
agacccattagtcct

SEQ ID NO: 282382 - DNA, 15 bp, Homo sapiens
aagacccattagtcc

SEQ ID NO: 282383 - DNA, 15 bp, Homo sapiens
aaagacccattagtc

SEQ ID NO: 282384 - DNA, 15 bp, Homo sapiens
aaaagacccattagt

SEQ ID NO: 282385 - DNA, 15 bp, Homo sapiens
gaaaagacccattag

SEQ ID NO: 282386 - DNA, 15 bp, Homo sapiens
agaaaagacccatta

SEQ ID NO: 282387 - DNA, 15 bp, Homo sapiens
gagaaaagacccatt

SEQ ID NO: 282388 - DNA, 15 bp, Homo sapiens
tgagaaaagacccat

SEQ ID NO: 282389 - DNA, 15 bp, Homo sapiens
gtgagaaaagaccca

SEQ ID NO: 282390 - DNA, 15 bp, Homo sapiens
agtgagaaaagaccc

SEQ ID NO: 282391 - DNA, 15 bp, Homo sapiens
cagtgagaaaagacc

SEQ ID NO: 282392 - DNA, 15 bp, Homo sapiens
tcagtgagaaaagac

SEQ ID NO: 282393 - DNA, 15 bp, Homo sapiens
tatcagtgagaaaag

SEQ ID NO: 282394 - DNA, 15 bp, Homo sapiens
ctatcagtgagaaaa

SEQ ID NO: 282395 - DNA, 15 bp, Homo sapiens
gctatcagtgagaaa

SEQ ID NO: 282396 - DNA, 15 bp, Homo sapiens
tgctatcagtgagaa

SEQ ID NO: 282397 - DNA, 15 bp, Homo sapiens
ctgctatcagtgaga

SEQ ID NO: 282398 - DNA, 15 bp, Homo sapiens
gctgctatcagtgag

SEQ ID NO: 282399 - DNA, 15 bp, Homo sapiens
agctgctatcagtga

SEQ ID NO: 282400 - DNA, 15 bp, Homo sapiens
gagctgctatcagtg

SEQ ID NO: 282401 - DNA, 15 bp, Homo sapiens
ggagctgctatcagt

SEQ ID NO: 282402 - DNA, 15 bp, Homo sapiens
tggagctgctatcag

SEQ ID NO: 282403 - DNA, 15 bp, Homo sapiens
gtggagctgctatca

SEQ ID NO: 282404 - DNA, 15 bp, Homo sapiens
ggtggagctgctatc

SEQ ID NO: 282405 - DNA, 15 bp, Homo sapiens
tggtggagctgctat

SEQ ID NO: 282406 - DNA, 15 bp, Homo sapiens
gtggtggagctgcta

SEQ ID NO: 282407 - DNA, 15 bp, Homo sapiens
tgtggtggagctgct

SEQ ID NO: 282408 - DNA, 15 bp, Homo sapiens
ctgtggtggagctgc

SEQ ID NO: 282409 - DNA, 15 bp, Homo sapiens
cctgtggtggagctg

SEQ ID NO: 282410 - DNA, 15 bp, Homo sapiens
tcctgtggtggagct

SEQ ID NO: 282411 - DNA, 15 bp, Homo sapiens
ttcctgtggtggagc

SEQ ID NO: 282412 - DNA, 15 bp, Homo sapiens
cttcctgtggtggag

SEQ ID NO: 282413 - DNA, 15 bp, Homo sapiens
acttcctgtggtgga

SEQ ID NO: 282414 - DNA, 15 bp, Homo sapiens
cacttcctgtggtgg

SEQ ID NO: 282415 - DNA, 15 bp, Homo sapiens
acacttcctgtggtg

SEQ ID NO: 282416 - DNA, 15 bp, Homo sapiens
cacacttcctgtggt

SEQ ID NO: 282417 - DNA, 15 bp, Homo sapiens
acacacttcctgtgg

SEQ ID NO: 282418 - DNA, 15 bp, Homo sapiens
tacacacttcctgtg

SEQ ID NO: 282419 - DNA, 15 bp, Homo sapiens
ttacacacttcctgt

SEQ ID NO: 282420 - DNA, 15 bp, Homo sapiens
cttacacacttcctg

SEQ ID NO: 282421 - DNA, 15 bp, Homo sapiens
acttacacacttcct

SEQ ID NO: 282422 - DNA, 15 bp, Homo sapiens
tacttacacacttcc

SEQ ID NO: 282423 - DNA, 15 bp, Homo sapiens
ttacttacacacttc

SEQ ID NO: 282424 - DNA, 15 bp, Homo sapiens
tttacttacacactt

SEQ ID NO: 282425 - DNA, 15 bp, Homo sapiens
atttacttacacact

SEQ ID NO: 282426 - DNA, 15 bp, Homo sapiens
gatttacttacacac

SEQ ID NO: 282427 - DNA, 15 bp, Homo sapiens
tgatttacttacaca

SEQ ID NO: 282428 - DNA, 15 bp, Homo sapiens
atgatttacttacac

SEQ ID NO: 282429 - DNA, 15 bp, Homo sapiens
catgatttacttaca

SEQ ID NO: 282430 - DNA, 15 bp, Homo sapiens
tcatgatttacttac

SEQ ID NO: 282431 - DNA, 15 bp, Homo sapiens
ttcatgatttactta

SEQ ID NO: 282432 - DNA, 15 bp, Homo sapiens
tttcatgatttactt

SEQ ID NO: 282433 - DNA, 15 bp, Homo sapiens
atttcatgatttact

SEQ ID NO: 282434 - DNA, 15 bp, Homo sapiens
aatttcatgatttac

SEQ ID NO: 282435 - DNA, 15 bp, Homo sapiens
taatttcatgattta

SEQ ID NO: 282436 - DNA, 15 bp, Homo sapiens
ctaatttcatgattt

SEQ ID NO: 282437 - DNA, 15 bp, Homo sapiens
actaatttcatgatt

SEQ ID NO: 282438 - DNA, 15 bp, Homo sapiens
cactaatttcatgat

SEQ ID NO: 282439 - DNA, 15 bp, Homo sapiens
gcactaatttcatga

SEQ ID NO: 282440 - DNA, 15 bp, Homo sapiens
agcactaatttcatg

SEQ ID NO: 282441 - DNA, 15 bp, Homo sapiens
cagcactaatttcat

SEQ ID NO: 282442 - DNA, 15 bp, Homo sapiens
gcagcactaatttca

SEQ ID NO: 282443 - DNA, 15 bp, Homo sapiens
ggcagcactaatttc

SEQ ID NO: 282444 - DNA, 15 bp, Homo sapiens
aggcagcactaattt

SEQ ID NO: 282445 - DNA, 15 bp, Homo sapiens
caggcagcactaatt

SEQ ID NO: 282446 - DNA, 15 bp, Homo sapiens
ccaggcagcactaat

SEQ ID NO: 282447 - DNA, 15 bp, Homo sapiens
cccaggcagcactaa

SEQ ID NO: 282448 - DNA, 15 bp, Homo sapiens
tcccaggcagcacta

SEQ ID NO: 282449 - DNA, 15 bp, Homo sapiens
ttcccaggcagcact

SEQ ID NO: 282450 - DNA, 15 bp, Homo sapiens
cttcccaggcagcac

SEQ ID NO: 282451 - DNA, 15 bp, Homo sapiens
ccttcccaggcagca

SEQ ID NO: 282452 - DNA, 15 bp, Homo sapiens
gccttcccaggcagc

SEQ ID NO: 282453 - DNA, 15 bp, Homo sapiens
agccttcccaggcag

SEQ ID NO: 282454 - DNA, 15 bp, Homo sapiens
tagccttcccaggca

SEQ ID NO: 282455 - DNA, 15 bp, Homo sapiens
ctagccttcccaggc

SEQ ID NO: 282456 - DNA, 15 bp, Homo sapiens
actagccttcccagg

SEQ ID NO: 282457 - DNA, 15 bp, Homo sapiens
aactagccttcccag

SEQ ID NO: 282458 - DNA, 15 bp, Homo sapiens
gaactagccttccca

SEQ ID NO: 282459 - DNA, 15 bp, Homo sapiens
agaactagccttccc

SEQ ID NO: 282460 - DNA, 15 bp, Homo sapiens
aagaactagccttcc

SEQ ID NO: 282461 - DNA, 15 bp, Homo sapiens
caagaactagccttc

SEQ ID NO: 282462 - DNA, 15 bp, Homo sapiens
acaagaactagcctt

SEQ ID NO: 282463 - DNA, 15 bp, Homo sapiens
tacaagaactagcct

SEQ ID NO: 282464 - DNA, 15 bp, Homo sapiens
atacaagaactagcc

SEQ ID NO: 282465 - DNA, 15 bp, Homo sapiens
aatacaagaactagc

SEQ ID NO: 282466 - DNA, 15 bp, Homo sapiens
taatacaagaactag

SEQ ID NO: 282467 - DNA, 15 bp, Homo sapiens
ataatacaagaacta

SEQ ID NO: 282468 - DNA, 15 bp, Homo sapiens
cataatacaagaact

SEQ ID NO: 282469 - DNA, 15 bp, Homo sapiens
ccataatacaagaac

SEQ ID NO: 282470 - DNA, 15 bp, Homo sapiens
gccataatacaagaa

SEQ ID NO: 282471 - DNA, 15 bp, Homo sapiens
agccataatacaaga

SEQ ID NO: 282472 - DNA, 15 bp, Homo sapiens
cagccataatacaag

SEQ ID NO: 282473 - DNA, 15 bp, Homo sapiens
acagccataatacaa

SEQ ID NO: 282474 - DNA, 15 bp, Homo sapiens
gacagccataataca

SEQ ID NO: 282475 - DNA, 15 bp, Homo sapiens
tgacagccataatac

SEQ ID NO: 282476 - DNA, 15 bp, Homo sapiens
ctgacagccataata

SEQ ID NO: 282477 - DNA, 15 bp, Homo sapiens
tctgacagccataat

SEQ ID NO: 282478 - DNA, 15 bp, Homo sapiens
ttctgacagccataa

SEQ ID NO: 282479 - DNA, 15 bp, Homo sapiens
tttctgacagccata

SEQ ID NO: 282480 - DNA, 15 bp, Homo sapiens
gtttctgacagccat

SEQ ID NO: 282481 - DNA, 15 bp, Homo sapiens
tgtttctgacagcca

SEQ ID NO: 282482 - DNA, 15 bp, Homo sapiens
ttgtttctgacagcc

SEQ ID NO: 282483 - DNA, 15 bp, Homo sapiens
attgtttctgacagc

SEQ ID NO: 282484 - DNA, 15 bp, Homo sapiens
gattgtttctgacag

SEQ ID NO: 282485 - DNA, 15 bp, Homo sapiens
agattgtttctgaca

SEQ ID NO: 282486 - DNA, 15 bp, Homo sapiens
aagattgtttctgac

SEQ ID NO: 282487 - DNA, 15 bp, Homo sapiens
gaagattgtttctga

SEQ ID NO: 282488 - DNA, 15 bp, Homo sapiens
tgaagattgtttctg

SEQ ID NO: 282489 - DNA, 15 bp, Homo sapiens
gtgaagattgtttct

SEQ ID NO: 282490 - DNA, 15 bp, Homo sapiens
agtgaagattgtttc

SEQ ID NO: 282491 - DNA, 15 bp, Homo sapiens
cagtgaagattgttt

SEQ ID NO: 282492 - DNA, 15 bp, Homo sapiens
tcagtgaagattgtt

SEQ ID NO: 282493 - DNA, 15 bp, Homo sapiens
atcagtgaagattgt

SEQ ID NO: 282494 - DNA, 15 bp, Homo sapiens
catcagtgaagattg

SEQ ID NO: 282495 - DNA, 15 bp, Homo sapiens
acatcagtgaagatt

SEQ ID NO: 282496 - DNA, 15 bp, Homo sapiens
cacatcagtgaagat

SEQ ID NO: 282497 - DNA, 15 bp, Homo sapiens
ccacatcagtgaaga

SEQ ID NO: 282498 - DNA, 15 bp, Homo sapiens
gccacatcagtgaag

SEQ ID NO: 282499 - DNA, 15 bp, Homo sapiens
agccacatcagtgaa

SEQ ID NO: 282500 - DNA, 15 bp, Homo sapiens
gagccacatcagtga

SEQ ID NO: 282501 - DNA, 15 bp, Homo sapiens
agagccacatcagtg

SEQ ID NO: 282502 - DNA, 15 bp, Homo sapiens
cagagccacatcagt

SEQ ID NO: 282503 - DNA, 15 bp, Homo sapiens
tcagagccacatcag

SEQ ID NO: 282504 - DNA, 15 bp, Homo sapiens
ttcagagccacatca

SEQ ID NO: 282505 - DNA, 15 bp, Homo sapiens
attcagagccacatc

SEQ ID NO: 282506 - DNA, 15 bp, Homo sapiens
gattcagagccacat

SEQ ID NO: 282507 - DNA, 15 bp, Homo sapiens
agattcagagccaca

SEQ ID NO: 282508 - DNA, 15 bp, Homo sapiens
aagattcagagccac

SEQ ID NO: 282509 - DNA, 15 bp, Homo sapiens
caagattcagagcca

SEQ ID NO: 282510 - DNA, 15 bp, Homo sapiens
tcaagattcagagcc

SEQ ID NO: 282511 - DNA, 15 bp, Homo sapiens
atcaagattcagagc

SEQ ID NO: 282512 - DNA, 15 bp, Homo sapiens
gatcaagattcagag

SEQ ID NO: 282513 - DNA, 15 bp, Homo sapiens
ggatcaagattcaga

SEQ ID NO: 282514 - DNA, 15 bp, Homo sapiens
gggatcaagattcag

SEQ ID NO: 282515 - DNA, 15 bp, Homo sapiens
tgggatcaagattca

SEQ ID NO: 282516 - DNA, 15 bp, Homo sapiens
ttgggatcaagattc

SEQ ID NO: 282517 - DNA, 15 bp, Homo sapiens
attgggatcaagatt

SEQ ID NO: 282518 - DNA, 15 bp, Homo sapiens
gattgggatcaagat

SEQ ID NO: 282519 - DNA, 15 bp, Homo sapiens
tgattgggatcaaga

SEQ ID NO: 282520 - DNA, 15 bp, Homo sapiens
ttgattgggatcaag

SEQ ID NO: 282521 - DNA, 15 bp, Homo sapiens
tttgattgggatcaa

SEQ ID NO: 282522 - DNA, 15 bp, Homo sapiens
ttttgattgggatca

SEQ ID NO: 282523 - DNA, 15 bp, Homo sapiens
attttgattgggatc

SEQ ID NO: 282524 - DNA, 15 bp, Homo sapiens
aattttgattgggat

SEQ ID NO: 282525 - DNA, 15 bp, Homo sapiens
taattttgattggga

SEQ ID NO: 282526 - DNA, 15 bp, Homo sapiens
ataattttgattggg

SEQ ID NO: 282527 - DNA, 15 bp, Homo sapiens
aataattttgattgg

SEQ ID NO: 282528 - DNA, 15 bp, Homo sapiens
taataattttgattg

SEQ ID NO: 282529 - DNA, 15 bp, Homo sapiens
ttaataattttgatt

SEQ ID NO: 282530 - DNA, 15 bp, Homo sapiens
cttaataattttgat

SEQ ID NO: 282531 - DNA, 15 bp, Homo sapiens
acttaataattttga

SEQ ID NO: 282532 - DNA, 15 bp, Homo sapiens
cacttaataattttg

SEQ ID NO: 282533 - DNA, 15 bp, Homo sapiens
acacttaataatttt

SEQ ID NO: 282534 - DNA, 15 bp, Homo sapiens
cacacttaataattt

SEQ ID NO: 282535 - DNA, 15 bp, Homo sapiens
ccacacttaataatt

SEQ ID NO: 282536 - DNA, 15 bp, Homo sapiens
accacacttaataat

SEQ ID NO: 282537 - DNA, 15 bp, Homo sapiens
aaccacacttaataa

SEQ ID NO: 282538 - DNA, 15 bp, Homo sapiens
gaaccacacttaata

SEQ ID NO: 282539 - DNA, 15 bp, Homo sapiens
ggaaccacacttaat

SEQ ID NO: 282540 - DNA, 15 bp, Homo sapiens
tggaaccacacttaa

SEQ ID NO: 282541 - DNA, 15 bp, Homo sapiens
ttggaaccacactta

SEQ ID NO: 282542 - DNA, 15 bp, Homo sapiens
tttggaaccacactt

SEQ ID NO: 282543 - DNA, 15 bp, Homo sapiens
ttttggaaccacact

SEQ ID NO: 282544 - DNA, 15 bp, Homo sapiens
tttttggaaccacac

SEQ ID NO: 282545 - DNA, 15 bp, Homo sapiens
atttttggaaccaca

SEQ ID NO: 282546 - DNA, 15 bp, Homo sapiens
aaatttttggaacca

SEQ ID NO: 282547 - DNA, 15 bp, Homo sapiens
gaaatttttggaacc

SEQ ID NO: 282548 - DNA, 15 bp, Homo sapiens
agaaatttttggaac

SEQ ID NO: 282549 - DNA, 15 bp, Homo sapiens
tagaaatttttggaa

SEQ ID NO: 282550 - DNA, 15 bp, Homo sapiens
gtagaaatttttgga

SEQ ID NO: 282551 - DNA, 15 bp, Homo sapiens
cgtagaaatttttgg

SEQ ID NO: 282552 - DNA, 15 bp, Homo sapiens
acgtagaaatttttg

SEQ ID NO: 282553 - DNA, 15 bp, Homo sapiens
tacgtagaaattttt

SEQ ID NO: 282554 - DNA, 15 bp, Homo sapiens
ctacgtagaaatttt

SEQ ID NO: 282555 - DNA, 15 bp, Homo sapiens
tctacgtagaaattt

SEQ ID NO: 282556 - DNA, 15 bp, Homo sapiens
atctacgtagaaatt

SEQ ID NO: 282557 - DNA, 15 bp, Homo sapiens
aatctacgtagaaat

SEQ ID NO: 282558 - DNA, 15 bp, Homo sapiens
aaatctacgtagaaa

SEQ ID NO: 282559 - DNA, 15 bp, Homo sapiens
aaaatctacgtagaa

SEQ ID NO: 282560 - DNA, 15 bp, Homo sapiens
taaaatctacgtaga

SEQ ID NO: 282561 - DNA, 15 bp, Homo sapiens
ataaaatctacgtag

SEQ ID NO: 282562 - DNA, 15 bp, Homo sapiens
cataaaatctacgta

SEQ ID NO: 282563 - DNA, 15 bp, Homo sapiens
gcataaaatctacgt

SEQ ID NO: 282564 - DNA, 15 bp, Homo sapiens
agcataaaatctacg

SEQ ID NO: 282565 - DNA, 15 bp, Homo sapiens
aagcataaaatctac

SEQ ID NO: 282566 - DNA, 15 bp, Homo sapiens
aaagcataaaatcta

SEQ ID NO: 282567 - DNA, 15 bp, Homo sapiens
gaaagcataaaatct

SEQ ID NO: 282568 - DNA, 15 bp, Homo sapiens
tgaaagcataaaatc

SEQ ID NO: 282569 - DNA, 15 bp, Homo sapiens
ttgaaagcataaaat

SEQ ID NO: 282570 - DNA, 15 bp, Homo sapiens
tttgaaagcataaaa

SEQ ID NO: 282571 - DNA, 15 bp, Homo sapiens
gtttgaaagcataaa

SEQ ID NO: 282572 - DNA, 15 bp, Homo sapiens
ggtttgaaagcataa

SEQ ID NO: 282573 - DNA, 15 bp, Homo sapiens
tggtttgaaagcata

SEQ ID NO: 282574 - DNA, 15 bp, Homo sapiens
atggtttgaaagcat

SEQ ID NO: 282575 - DNA, 15 bp, Homo sapiens
catggtttgaaagca

SEQ ID NO: 282576 - DNA, 15 bp, Homo sapiens
tcatggtttgaaagc

SEQ ID NO: 282577 - DNA, 15 bp, Homo sapiens
atcatggtttgaaag

SEQ ID NO: 282578 - DNA, 15 bp, Homo sapiens
tatcatggtttgaaa

SEQ ID NO: 282579 - DNA, 15 bp, Homo sapiens
ctatcatggtttgaa

SEQ ID NO: 282580 - DNA, 15 bp, Homo sapiens
actatcatggtttga

SEQ ID NO: 282581 - DNA, 15 bp, Homo sapiens
tactatcatggtttg

SEQ ID NO: 282582 - DNA, 15 bp, Homo sapiens
atactatcatggttt

SEQ ID NO: 282583 - DNA, 15 bp, Homo sapiens
tatactatcatggtt

SEQ ID NO: 282584 - DNA, 15 bp, Homo sapiens
ttatactatcatggt

SEQ ID NO: 282585 - DNA, 15 bp, Homo sapiens
tttatactatcatgg

SEQ ID NO: 282586 - DNA, 15 bp, Homo sapiens
gtttatactatcatg

SEQ ID NO: 282587 - DNA, 15 bp, Homo sapiens
agtttatactatcat

SEQ ID NO: 282588 - DNA, 15 bp, Homo sapiens
gagtttatactatca

SEQ ID NO: 282589 - DNA, 15 bp, Homo sapiens
tgagtttatactatc

SEQ ID NO: 282590 - DNA, 15 bp, Homo sapiens
ttgagtttatactat

SEQ ID NO: 282591 - DNA, 15 bp, Homo sapiens
attgagtttatacta

SEQ ID NO: 282592 - DNA, 15 bp, Homo sapiens
tattgagtttatact

SEQ ID NO: 282593 - DNA, 15 bp, Homo sapiens
atattgagtttatac

SEQ ID NO: 282594 - DNA, 15 bp, Homo sapiens
catattgagtttata

SEQ ID NO: 282595 - DNA, 15 bp, Homo sapiens
acatattgagtttat

SEQ ID NO: 282596 - DNA, 15 bp, Homo sapiens
aacatattgagttta

SEQ ID NO: 282597 - DNA, 15 bp, Homo sapiens
aaacatattgagttt

SEQ ID NO: 282598 - DNA, 15 bp, Homo sapiens
taaacatattgagtt

SEQ ID NO: 282599 - DNA, 15 bp, Homo sapiens
ataaacatattgagt

SEQ ID NO: 282600 - DNA, 15 bp, Homo sapiens
aataaacatattgag

SEQ ID NO: 282601 - DNA, 15 bp, Homo sapiens
aaataaacatattga

SEQ ID NO: 282602 - DNA, 15 bp, Homo sapiens
taaataaacatattg

SEQ ID NO: 282603 - DNA, 15 bp, Homo sapiens
gtaaataaacatatt

SEQ ID NO: 282604 - DNA, 15 bp, Homo sapiens
agtaaataaacatat

SEQ ID NO: 282605 - DNA, 15 bp, Homo sapiens
aagtaaataaacata

SEQ ID NO: 282606 - DNA, 15 bp, Homo sapiens
aaagtaaataaacat

SEQ ID NO: 282607 - DNA, 15 bp, Homo sapiens
acaaagtaaataaac

SEQ ID NO: 282608 - DNA, 15 bp, Homo sapiens
aacaaagtaaataaa

SEQ ID NO: 282609 - DNA, 15 bp, Homo sapiens
aaacaaagtaaataa

SEQ ID NO: 282610 - DNA, 15 bp, Homo sapiens
gaaacaaagtaaata

SEQ ID NO: 282611 - DNA, 15 bp, Homo sapiens
tgaaacaaagtaaat

SEQ ID NO: 282612 - DNA, 15 bp, Homo sapiens
atgaaacaaagtaaa

SEQ ID NO: 282613 - DNA, 15 bp, Homo sapiens
tatgaaacaaagtaa

SEQ ID NO: 282614 - DNA, 15 bp, Homo sapiens
ttatatgaaacaaag

SEQ ID NO: 282615 - DNA, 15 bp, Homo sapiens
cttatatgaaacaaa

SEQ ID NO: 282616 - DNA, 15 bp, Homo sapiens
acttatatgaaacaa

SEQ ID NO: 282617 - DNA, 15 bp, Homo sapiens
aacttatatgaaaca

SEQ ID NO: 282618 - DNA, 15 bp, Homo sapiens
taacttatatgaaac

SEQ ID NO: 282619 - DNA, 15 bp, Homo sapiens
ttaacttatatgaaa

SEQ ID NO: 282620 - DNA, 15 bp, Homo sapiens
attaacttatatgaa

SEQ ID NO: 282621 - DNA, 15 bp, Homo sapiens
cattaacttatatga

SEQ ID NO: 282622 - DNA, 15 bp, Homo sapiens
tcattaacttatatg

SEQ ID NO: 282623 - DNA, 15 bp, Homo sapiens
ttcattaacttatat

SEQ ID NO: 282624 - DNA, 15 bp, Homo sapiens
tttcattaacttata

SEQ ID NO: 282625 - DNA, 15 bp, Homo sapiens
ttttcattaacttat

SEQ ID NO: 282626 - DNA, 15 bp, Homo sapiens
tttttcattaactta

SEQ ID NO: 282627 - DNA, 15 bp, Homo sapiens
ttttttcattaactt

SEQ ID NO: 282628 - DNA, 15 bp, Homo sapiens
tttttttcattaact

SEQ ID NO: 282629 - DNA, 15 bp, Homo sapiens
atttttttcattaac

SEQ ID NO: 282630 - DNA, 15 bp, Homo sapiens
agatttttttcatta

SEQ ID NO: 282631 - DNA, 15 bp, Homo sapiens
aagatttttttcatt

SEQ ID NO: 282632 - DNA, 15 bp, Homo sapiens
taagatttttttcat

SEQ ID NO: 282633 - DNA, 15 bp, Homo sapiens
gtaagatttttttca

SEQ ID NO: 282634 - DNA, 15 bp, Homo sapiens
tgtaagatttttttc

SEQ ID NO: 282635 - DNA, 15 bp, Homo sapiens
atgtaagattttttt

SEQ ID NO: 282636 - DNA, 15 bp, Homo sapiens
aatgtaagatttttt

SEQ ID NO: 282637 - DNA, 15 bp, Homo sapiens
aaatgtaagattttt

SEQ ID NO: 282638 - DNA, 15 bp, Homo sapiens
caaatgtaagatttt

SEQ ID NO: 282639 - DNA, 15 bp, Homo sapiens
acaaatgtaagattt

SEQ ID NO: 282640 - DNA, 15 bp, Homo sapiens
gacaaatgtaagatt

SEQ ID NO: 282641 - DNA, 15 bp, Homo sapiens
tgacaaatgtaagat

SEQ ID NO: 282642 - DNA, 15 bp, Homo sapiens
ttgacaaatgtaaga

SEQ ID NO: 282643 - DNA, 15 bp, Homo sapiens
gttgacaaatgtaag

SEQ ID NO: 282644 - DNA, 15 bp, Homo sapiens
agttgacaaatgtaa

SEQ ID NO: 282645 - DNA, 15 bp, Homo sapiens
aagttgacaaatgta

SEQ ID NO: 282646 - DNA, 15 bp, Homo sapiens
taagttgacaaatgt

SEQ ID NO: 282647 - DNA, 15 bp, Homo sapiens
ataagttgacaaatg

SEQ ID NO: 282648 - DNA, 15 bp, Homo sapiens
tataagttgacaaat

SEQ ID NO: 282649 - DNA, 15 bp, Homo sapiens
atataagttgacaaa

SEQ ID NO: 282650 - DNA, 15 bp, Homo sapiens
tatataagttgacaa

SEQ ID NO: 282651 - DNA, 15 bp, Homo sapiens
gtatataagttgaca

SEQ ID NO: 282652 - DNA, 15 bp, Homo sapiens
ggtatataagttgac

SEQ ID NO: 282653 - DNA, 15 bp, Homo sapiens
gggtatataagttga

SEQ ID NO: 282654 - DNA, 15 bp, Homo sapiens
ggggtatataagttg

SEQ ID NO: 282655 - DNA, 15 bp, Homo sapiens
tggggtatataagtt

SEQ ID NO: 282656 - DNA, 15 bp, Homo sapiens
gtggggtatataagt

SEQ ID NO: 282657 - DNA, 15 bp, Homo sapiens
cgtggggtatataag

SEQ ID NO: 282658 - DNA, 15 bp, Homo sapiens
tcgtggggtatataa

SEQ ID NO: 282659 - DNA, 15 bp, Homo sapiens
ttcgtggggtatata

SEQ ID NO: 282660 - DNA, 15 bp, Homo sapiens
tttcgtggggtatat

SEQ ID NO: 282661 - DNA, 15 bp, Homo sapiens
ttttcgtggggtata

SEQ ID NO: 282662 - DNA, 15 bp, Homo sapiens
attttcgtggggtat

SEQ ID NO: 282663 - DNA, 15 bp, Homo sapiens
gattttcgtggggta

SEQ ID NO: 282664 - DNA, 15 bp, Homo sapiens
tgattttcgtggggt

SEQ ID NO: 282665 - DNA, 15 bp, Homo sapiens
ctgattttcgtgggg

SEQ ID NO: 282666 - DNA, 15 bp, Homo sapiens
tctgattttcgtggg

SEQ ID NO: 282667 - DNA, 15 bp, Homo sapiens
atctgattttcgtgg

SEQ ID NO: 282668 - DNA, 15 bp, Homo sapiens
aatctgattttcgtg

SEQ ID NO: 282669 - DNA, 15 bp, Homo sapiens
caatctgattttcgt

SEQ ID NO: 282670 - DNA, 15 bp, Homo sapiens
acaatctgattttcg

SEQ ID NO: 282671 - DNA, 15 bp, Homo sapiens
aacaatctgattttc

SEQ ID NO: 282672 - DNA, 15 bp, Homo sapiens
aaacaatctgatttt

SEQ ID NO: 282673 - DNA, 15 bp, Homo sapiens
aaaacaatctgattt

SEQ ID NO: 282674 - DNA, 15 bp, Homo sapiens
taaaacaatctgatt

SEQ ID NO: 282675 - DNA, 15 bp, Homo sapiens
ataaaacaatctgat

SEQ ID NO: 282676 - DNA, 15 bp, Homo sapiens
aataaaacaatctga

SEQ ID NO: 282677 - DNA, 15 bp, Homo sapiens
aaataaaacaatctg

SEQ ID NO: 282678 - DNA, 15 bp, Homo sapiens
taaataaaacaatct

SEQ ID NO: 282679 - DNA, 15 bp, Homo sapiens
ctaaataaaacaatc

SEQ ID NO: 282680 - DNA, 15 bp, Homo sapiens
cctaaataaaacaat

SEQ ID NO: 282681 - DNA, 15 bp, Homo sapiens
tcctaaataaaacaa

SEQ ID NO: 282682 - DNA, 15 bp, Homo sapiens
atcctaaataaaaca

SEQ ID NO: 282683 - DNA, 15 bp, Homo sapiens
tatcctaaataaaac

SEQ ID NO: 282684 - DNA, 15 bp, Homo sapiens
ttatcctaaataaaa

SEQ ID NO: 282685 - DNA, 15 bp, Homo sapiens
gttatcctaaataaa

SEQ ID NO: 282686 - DNA, 15 bp, Homo sapiens
tgttatcctaaataa

SEQ ID NO: 282687 - DNA, 15 bp, Homo sapiens
ctgttatcctaaata

SEQ ID NO: 282688 - DNA, 15 bp, Homo sapiens
cctgttatcctaaat

SEQ ID NO: 282689 - DNA, 15 bp, Homo sapiens
acctgttatcctaaa

SEQ ID NO: 282690 - DNA, 15 bp, Homo sapiens
cacctgttatcctaa

SEQ ID NO: 282691 - DNA, 15 bp, Homo sapiens
acacctgttatccta

SEQ ID NO: 282692 - DNA, 15 bp, Homo sapiens
tacacctgttatcct

SEQ ID NO: 282693 - DNA, 15 bp, Homo sapiens
atacacctgttatcc

SEQ ID NO: 282694 - DNA, 15 bp, Homo sapiens
tatacacctgttatc

SEQ ID NO: 282695 - DNA, 15 bp, Homo sapiens
atatacacctgttat

SEQ ID NO: 282696 - DNA, 15 bp, Homo sapiens
tatatacacctgtta

SEQ ID NO: 282697 - DNA, 15 bp, Homo sapiens
atatatacacctgtt

SEQ ID NO: 282698 - DNA, 15 bp, Homo sapiens
aatatatacacctgt

SEQ ID NO: 282699 - DNA, 15 bp, Homo sapiens
gaatatatacacctg

SEQ ID NO: 282700 - DNA, 15 bp, Homo sapiens
tgaatatatacacct

SEQ ID NO: 282701 - DNA, 15 bp, Homo sapiens
atgaatatatacacc

SEQ ID NO: 282702 - DNA, 15 bp, Homo sapiens
aatgaatatatacac

SEQ ID NO: 282703 - DNA, 15 bp, Homo sapiens
gaatgaatatataca

SEQ ID NO: 282704 - DNA, 15 bp, Homo sapiens
ggaatgaatatatac

SEQ ID NO: 282705 - DNA, 15 bp, Homo sapiens
tggaatgaatatata

SEQ ID NO: 282706 - DNA, 15 bp, Homo sapiens
atggaatgaatatat

SEQ ID NO: 282707 - DNA, 15 bp, Homo sapiens
aatggaatgaatata

SEQ ID NO: 282708 - DNA, 15 bp, Homo sapiens
aaatggaatgaatat

SEQ ID NO: 282709 - DNA, 15 bp, Homo sapiens
caaatggaatgaata

SEQ ID NO: 282710 - DNA, 15 bp, Homo sapiens
acaaatggaatgaat

SEQ ID NO: 282711 - DNA, 15 bp, Homo sapiens
gacaaatggaatgaa

SEQ ID NO: 282712 - DNA, 15 bp, Homo sapiens
agacaaatggaatga

SEQ ID NO: 282713 - DNA, 15 bp, Homo sapiens
aagacaaatggaatg

SEQ ID NO: 282714 - DNA, 15 bp, Homo sapiens
taagacaaatggaat

SEQ ID NO: 282715 - DNA, 15 bp, Homo sapiens
ataagacaaatggaa

SEQ ID NO: 282716 - DNA, 15 bp, Homo sapiens
atataagacaaatgg

SEQ ID NO: 282717 - DNA, 15 bp, Homo sapiens
aatataagacaaatg

SEQ ID NO: 282718 - DNA, 15 bp, Homo sapiens
aaatataagacaaat

SEQ ID NO: 282719 - DNA, 15 bp, Homo sapiens
gaaatataagacaaa

SEQ ID NO: 282720 - DNA, 15 bp, Homo sapiens
agaaatataagacaa

SEQ ID NO: 282721 - DNA, 15 bp, Homo sapiens
aagaaatataagaca

SEQ ID NO: 282722 - DNA, 15 bp, Homo sapiens
taagaaatataagac

SEQ ID NO: 282723 - DNA, 15 bp, Homo sapiens
ataagaaatataaga

SEQ ID NO: 282724 - DNA, 15 bp, Homo sapiens
aataagaaatataag

SEQ ID NO: 282725 - DNA, 15 bp, Homo sapiens
taataagaaatataa

SEQ ID NO: 282726 - DNA, 15 bp, Homo sapiens
ttaataagaaatata

SEQ ID NO: 282727 - DNA, 15 bp, Homo sapiens
attaataagaaatat

SEQ ID NO: 282728 - DNA, 15 bp, Homo sapiens
aattaataagaaata

SEQ ID NO: 282729 - DNA, 15 bp, Homo sapiens
aaattaataagaaat

SEQ ID NO: 282730 - DNA, 15 bp, Homo sapiens
taaattaataagaaa

SEQ ID NO: 282731 - DNA, 15 bp, Homo sapiens
ttaaattaataagaa

SEQ ID NO: 282732 - DNA, 15 bp, Homo sapiens
gttaaattaataaga

SEQ ID NO: 282733 - DNA, 15 bp, Homo sapiens
tgttaaattaataag

SEQ ID NO: 282734 - DNA, 15 bp, Homo sapiens
ttgttaaattaataa

SEQ ID NO: 282735 - DNA, 15 bp, Homo sapiens
tttgttaaattaata

SEQ ID NO: 282736 - DNA, 15 bp, Homo sapiens
ctttgttaaattaat

SEQ ID NO: 282737 - DNA, 15 bp, Homo sapiens
cctttgttaaattaa

SEQ ID NO: 282738 - DNA, 15 bp, Homo sapiens
acctttgttaaatta

SEQ ID NO: 282739 - DNA, 15 bp, Homo sapiens
tacctttgttaaatt

SEQ ID NO: 282740 - DNA, 15 bp, Homo sapiens
ttacctttgttaaat

SEQ ID NO: 282741 - DNA, 15 bp, Homo sapiens
attacctttgttaaa

SEQ ID NO: 282742 - DNA, 15 bp, Homo sapiens
aattacctttgttaa

SEQ ID NO: 282743 - DNA, 15 bp, Homo sapiens
aaattacctttgtta

SEQ ID NO: 282744 - DNA, 15 bp, Homo sapiens
caaattacctttgtt

SEQ ID NO: 282745 - DNA, 15 bp, Homo sapiens
tcaaattacctttgt

SEQ ID NO: 282746 - DNA, 15 bp, Homo sapiens
gtcaaattacctttg

SEQ ID NO: 282747 - DNA, 15 bp, Homo sapiens
tgtcaaattaccttt

SEQ ID NO: 282748 - DNA, 15 bp, Homo sapiens
ctgtcaaattacctt

SEQ ID NO: 282749 - DNA, 15 bp, Homo sapiens
tctgtcaaattacct

SEQ ID NO: 282750 - DNA, 15 bp, Homo sapiens
ttctgtcaaattacc

SEQ ID NO: 282751 - DNA, 15 bp, Homo sapiens
attctgtcaaattac

SEQ ID NO: 282752 - DNA, 15 bp, Homo sapiens
tattctgtcaaatta

SEQ ID NO: 282753 - DNA, 15 bp, Homo sapiens
atattctgtcaaatt

SEQ ID NO: 282754 - DNA, 15 bp, Homo sapiens
catattctgtcaaat

SEQ ID NO: 282755 - DNA, 15 bp, Homo sapiens
acatattctgtcaaa

SEQ ID NO: 282756 - DNA, 15 bp, Homo sapiens
cacatattctgtcaa

SEQ ID NO: 282757 - DNA, 15 bp, Homo sapiens
gcacatattctgtca

SEQ ID NO: 282758 - DNA, 15 bp, Homo sapiens
ggcacatattctgtc

SEQ ID NO: 282759 - DNA, 15 bp, Homo sapiens
gggcacatattctgt

SEQ ID NO: 282760 - DNA, 15 bp, Homo sapiens
agggcacatattctg

SEQ ID NO: 282761 - DNA, 15 bp, Homo sapiens
aagggcacatattct

SEQ ID NO: 282762 - DNA, 15 bp, Homo sapiens
aaagggcacatattc

SEQ ID NO: 282763 - DNA, 15 bp, Homo sapiens
gaaagggcacatatt

SEQ ID NO: 282764 - DNA, 15 bp, Homo sapiens
agaaagggcacatat

SEQ ID NO: 282765 - DNA, 15 bp, Homo sapiens
cagaaagggcacata

SEQ ID NO: 282766 - DNA, 15 bp, Homo sapiens
acagaaagggcacat

SEQ ID NO: 282767 - DNA, 15 bp, Homo sapiens
cacagaaagggcaca

SEQ ID NO: 282768 - DNA, 15 bp, Homo sapiens
tcacagaaagggcac

SEQ ID NO: 282769 - DNA, 15 bp, Homo sapiens
ttcacagaaagggca

SEQ ID NO: 282770 - DNA, 15 bp, Homo sapiens
tttcacagaaagggc

SEQ ID NO: 282771 - DNA, 15 bp, Homo sapiens
atttcacagaaaggg

SEQ ID NO: 282772 - DNA, 15 bp, Homo sapiens
gatttcacagaaagg

SEQ ID NO: 282773 - DNA, 15 bp, Homo sapiens
ggatttcacagaaag

SEQ ID NO: 282774 - DNA, 15 bp, Homo sapiens
aggatttcacagaaa

SEQ ID NO: 282775 - DNA, 15 bp, Homo sapiens
gaggatttcacagaa

SEQ ID NO: 282776 - DNA, 15 bp, Homo sapiens
agaggatttcacaga

SEQ ID NO: 282777 - DNA, 15 bp, Homo sapiens
aagaggatttcacag

SEQ ID NO: 282778 - DNA, 15 bp, Homo sapiens
aaagaggatttcaca

SEQ ID NO: 282779 - DNA, 15 bp, Homo sapiens
gaaagaggatttcac

SEQ ID NO: 282780 - DNA, 15 bp, Homo sapiens
agaaagaggatttca

SEQ ID NO: 282781 - DNA, 15 bp, Homo sapiens
aagaaagaggatttc

SEQ ID NO: 282782 - DNA, 15 bp, Homo sapiens
gaagaaagaggattt

SEQ ID NO: 282783 - DNA, 15 bp, Homo sapiens
ggaagaaagaggatt

SEQ ID NO: 282784 - DNA, 15 bp, Homo sapiens
tggaagaaagaggat

SEQ ID NO: 282785 - DNA, 15 bp, Homo sapiens
gtggaagaaagagga

SEQ ID NO: 282786 - DNA, 15 bp, Homo sapiens
agtggaagaaagagg

SEQ ID NO: 282787 - DNA, 15 bp, Homo sapiens
tagtggaagaaagag

SEQ ID NO: 282788 - DNA, 15 bp, Homo sapiens
ctagtggaagaaaga

SEQ ID NO: 282789 - DNA, 15 bp, Homo sapiens
gctagtggaagaaag

SEQ ID NO: 282790 - DNA, 15 bp, Homo sapiens
agctagtggaagaaa

SEQ ID NO: 282791 - DNA, 15 bp, Homo sapiens
tagctagtggaagaa

SEQ ID NO: 282792 - DNA, 15 bp, Homo sapiens
ttagctagtggaaga

SEQ ID NO: 282793 - DNA, 15 bp, Homo sapiens
gttagctagtggaag

SEQ ID NO: 282794 - DNA, 15 bp, Homo sapiens
tgttagctagtggaa

SEQ ID NO: 282795 - DNA, 15 bp, Homo sapiens
atgttagctagtgga

SEQ ID NO: 282796 - DNA, 15 bp, Homo sapiens
aatgttagctagtgg

SEQ ID NO: 282797 - DNA, 15 bp, Homo sapiens
aaatgttagctagtg

SEQ ID NO: 282798 - DNA, 15 bp, Homo sapiens
aaaatgttagctagt

SEQ ID NO: 282799 - DNA, 15 bp, Homo sapiens
aaaaatgttagctag

SEQ ID NO: 282800 - DNA, 15 bp, Homo sapiens
aaaaaatgttagcta

SEQ ID NO: 282801 - DNA, 15 bp, Homo sapiens
gaaaaaatgttagct

SEQ ID NO: 282802 - DNA, 15 bp, Homo sapiens
ggaaaaaatgttagc

SEQ ID NO: 282803 - DNA, 15 bp, Homo sapiens
tggaaaaaatgttag

SEQ ID NO: 282804 - DNA, 15 bp, Homo sapiens
atggaaaaaatgtta

SEQ ID NO: 282805 - DNA, 15 bp, Homo sapiens
tatggaaaaaatgtt

SEQ ID NO: 282806 - DNA, 15 bp, Homo sapiens
ttatggaaaaaatgt

SEQ ID NO: 282807 - DNA, 15 bp, Homo sapiens
attatggaaaaaatg

SEQ ID NO: 282808 - DNA, 15 bp, Homo sapiens
tattatggaaaaaat

SEQ ID NO: 282809 - DNA, 15 bp, Homo sapiens
atattatggaaaaaa

SEQ ID NO: 282810 - DNA, 15 bp, Homo sapiens
gatattatggaaaaa

SEQ ID NO: 282811 - DNA, 15 bp, Homo sapiens
agatattatggaaaa

SEQ ID NO: 282812 - DNA, 15 bp, Homo sapiens
cagatattatggaaa

SEQ ID NO: 282813 - DNA, 15 bp, Homo sapiens
gcagatattatggaa

SEQ ID NO: 282814 - DNA, 15 bp, Homo sapiens
tgcagatattatgga

SEQ ID NO: 282815 - DNA, 15 bp, Homo sapiens
atgcagatattatgg

SEQ ID NO: 282816 - DNA, 15 bp, Homo sapiens
aatgcagatattatg

SEQ ID NO: 282817 - DNA, 15 bp, Homo sapiens
aaatgcagatattat

SEQ ID NO: 282818 - DNA, 15 bp, Homo sapiens
taaatgcagatatta

SEQ ID NO: 282819 - DNA, 15 bp, Homo sapiens
ctaaatgcagatatt

SEQ ID NO: 282820 - DNA, 15 bp, Homo sapiens
gctaaatgcagatat

SEQ ID NO: 282821 - DNA, 15 bp, Homo sapiens
tgctaaatgcagata

SEQ ID NO: 282822 - DNA, 15 bp, Homo sapiens
gtgctaaatgcagat

SEQ ID NO: 282823 - DNA, 15 bp, Homo sapiens
ggtgctaaatgcaga

SEQ ID NO: 282824 - DNA, 15 bp, Homo sapiens
aggtgctaaatgcag

SEQ ID NO: 282825 - DNA, 15 bp, Homo sapiens
gaggtgctaaatgca

SEQ ID NO: 282826 - DNA, 15 bp, Homo sapiens
agaggtgctaaatgc

SEQ ID NO: 282827 - DNA, 15 bp, Homo sapiens
cagaggtgctaaatg

SEQ ID NO: 282828 - DNA, 15 bp, Homo sapiens
tcagaggtgctaaat

SEQ ID NO: 282829 - DNA, 15 bp, Homo sapiens
gtcagaggtgctaaa

SEQ ID NO: 282830 - DNA, 15 bp, Homo sapiens
ggtcagaggtgctaa

SEQ ID NO: 282831 - DNA, 15 bp, Homo sapiens
gggtcagaggtgcta

SEQ ID NO: 282832 - DNA, 15 bp, Homo sapiens
tgggtcagaggtgct

SEQ ID NO: 282833 - DNA, 15 bp, Homo sapiens
gtgggtcagaggtgc

SEQ ID NO: 282834 - DNA, 15 bp, Homo sapiens
tgtgggtcagaggtg

SEQ ID NO: 282835 - DNA, 15 bp, Homo sapiens
gtgtgggtcagaggt

SEQ ID NO: 282836 - DNA, 15 bp, Homo sapiens
tgtgtgggtcagagg

SEQ ID NO: 282837 - DNA, 15 bp, Homo sapiens
atgtgtgggtcagag

SEQ ID NO: 282838 - DNA, 15 bp, Homo sapiens
tatgtgtgggtcaga

SEQ ID NO: 282839 - DNA, 15 bp, Homo sapiens
gtatgtgtgggtcag

SEQ ID NO: 282840 - DNA, 15 bp, Homo sapiens
agtatgtgtgggtca

SEQ ID NO: 282841 - DNA, 15 bp, Homo sapiens
aagtatgtgtgggtc

SEQ ID NO: 282842 - DNA, 15 bp, Homo sapiens
taagtatgtgtgggt

SEQ ID NO: 282843 - DNA, 15 bp, Homo sapiens
ctaagtatgtgtggg

SEQ ID NO: 282844 - DNA, 15 bp, Homo sapiens
tctaagtatgtgtgg

SEQ ID NO: 282845 - DNA, 15 bp, Homo sapiens
atctaagtatgtgtg

SEQ ID NO: 282846 - DNA, 15 bp, Homo sapiens
tatctaagtatgtgt

SEQ ID NO: 282847 - DNA, 15 bp, Homo sapiens
atatctaagtatgtg

SEQ ID NO: 282848 - DNA, 15 bp, Homo sapiens
tatatctaagtatgt

SEQ ID NO: 282849 - DNA, 15 bp, Homo sapiens
atatatctaagtatg

SEQ ID NO: 282850 - DNA, 15 bp, Homo sapiens
tatatatctaagtat

SEQ ID NO: 282851 - DNA, 15 bp, Homo sapiens
gtatatatctaagta

SEQ ID NO: 282852 - DNA, 15 bp, Homo sapiens
agtatatatctaagt

SEQ ID NO: 282853 - DNA, 15 bp, Homo sapiens
gagtatatatctaag

SEQ ID NO: 282854 - DNA, 15 bp, Homo sapiens
ggagtatatatctaa

SEQ ID NO: 282855 - DNA, 15 bp, Homo sapiens
aggagtatatatcta

SEQ ID NO: 282856 - DNA, 15 bp, Homo sapiens
taggagtatatatct

SEQ ID NO: 282857 - DNA, 15 bp, Homo sapiens
gtaggagtatatatc

SEQ ID NO: 282858 - DNA, 15 bp, Homo sapiens
ggtaggagtatatat

SEQ ID NO: 282859 - DNA, 15 bp, Homo sapiens
gggtaggagtatata

SEQ ID NO: 282860 - DNA, 15 bp, Homo sapiens
agggtaggagtatat

SEQ ID NO: 282861 - DNA, 15 bp, Homo sapiens
aagggtaggagtata

SEQ ID NO: 282862 - DNA, 15 bp, Homo sapiens
gaagggtaggagtat

SEQ ID NO: 282863 - DNA, 15 bp, Homo sapiens
tgaagggtaggagta

SEQ ID NO: 282864 - DNA, 15 bp, Homo sapiens
atgaagggtaggagt

SEQ ID NO: 282865 - DNA, 15 bp, Homo sapiens
aatgaagggtaggag

SEQ ID NO: 282866 - DNA, 15 bp, Homo sapiens
caatgaagggtagga

SEQ ID NO: 282867 - DNA, 15 bp, Homo sapiens
tcaatgaagggtagg

SEQ ID NO: 282868 - DNA, 15 bp, Homo sapiens
ttcaatgaagggtag

SEQ ID NO: 282869 - DNA, 15 bp, Homo sapiens
tttcaatgaagggta

SEQ ID NO: 282870 - DNA, 15 bp, Homo sapiens
ttttcaatgaagggt

SEQ ID NO: 282871 - DNA, 15 bp, Homo sapiens
gttttcaatgaaggg

SEQ ID NO: 282872 - DNA, 15 bp, Homo sapiens
agttttcaatgaagg

SEQ ID NO: 282873 - DNA, 15 bp, Homo sapiens
cagttttcaatgaag

SEQ ID NO: 282874 - DNA, 15 bp, Homo sapiens
acagttttcaatgaa

SEQ ID NO: 282875 - DNA, 15 bp, Homo sapiens
aacagttttcaatga

SEQ ID NO: 282876 - DNA, 15 bp, Homo sapiens
taacagttttcaatg

SEQ ID NO: 282877 - DNA, 15 bp, Homo sapiens
ttaacagttttcaat

SEQ ID NO: 282878 - DNA, 15 bp, Homo sapiens
gttaacagttttcaa

SEQ ID NO: 282879 - DNA, 15 bp, Homo sapiens
agttaacagttttca

SEQ ID NO: 282880 - DNA, 15 bp, Homo sapiens
gagttaacagttttc

SEQ ID NO: 282881 - DNA, 15 bp, Homo sapiens
ggagttaacagtttt

SEQ ID NO: 282882 - DNA, 15 bp, Homo sapiens
aggagttaacagttt

SEQ ID NO: 282883 - DNA, 15 bp, Homo sapiens
gaggagttaacagtt

SEQ ID NO: 282884 - DNA, 15 bp, Homo sapiens
agaggagttaacagt

SEQ ID NO: 282885 - DNA, 15 bp, Homo sapiens
cagaggagttaacag

SEQ ID NO: 282886 - DNA, 15 bp, Homo sapiens
gcagaggagttaaca

SEQ ID NO: 282887 - DNA, 15 bp, Homo sapiens
ggcagaggagttaac

SEQ ID NO: 282888 - DNA, 15 bp, Homo sapiens
tggcagaggagttaa

SEQ ID NO: 282889 - DNA, 15 bp, Homo sapiens
ttggcagaggagtta

SEQ ID NO: 282890 - DNA, 15 bp, Homo sapiens
attggcagaggagtt

SEQ ID NO: 282891 - DNA, 15 bp, Homo sapiens
tattggcagaggagt

SEQ ID NO: 282892 - DNA, 15 bp, Homo sapiens
atattggcagaggag

SEQ ID NO: 282893 - DNA, 15 bp, Homo sapiens
aatattggcagagga

SEQ ID NO: 282894 - DNA, 15 bp, Homo sapiens
aaatattggcagagg

SEQ ID NO: 282895 - DNA, 15 bp, Homo sapiens
aaaatattggcagag

SEQ ID NO: 282896 - DNA, 15 bp, Homo sapiens
taaaatattggcaga

SEQ ID NO: 282897 - DNA, 15 bp, Homo sapiens
ataaaatattggcag

SEQ ID NO: 282898 - DNA, 15 bp, Homo sapiens
aataaaatattggca

SEQ ID NO: 282899 - DNA, 15 bp, Homo sapiens
aaataaaatattggc

SEQ ID NO: 282900 - DNA, 15 bp, Homo sapiens
aaaataaaatattgg

SEQ ID NO: 282901 - DNA, 15 bp, Homo sapiens
taaaataaaatattg

SEQ ID NO: 282902 - DNA, 15 bp, Homo sapiens
ctaataaaataaaat

SEQ ID NO: 282903 - DNA, 15 bp, Homo sapiens
gctaataaaataaaa

SEQ ID NO: 282904 - DNA, 15 bp, Homo sapiens
tgctaataaaataaa

SEQ ID NO: 282905 - DNA, 15 bp, Homo sapiens
ttgctaataaaataa

SEQ ID NO: 282906 - DNA, 15 bp, Homo sapiens
gttgctaataaaata

SEQ ID NO: 282907 - DNA, 15 bp, Homo sapiens
agttgctaataaaat

SEQ ID NO: 282908 - DNA, 15 bp, Homo sapiens
tagttgctaataaaa

SEQ ID NO: 282909 - DNA, 15 bp, Homo sapiens
ttagttgctaataaa

SEQ ID NO: 282910 - DNA, 15 bp, Homo sapiens
cttagttgctaataa

SEQ ID NO: 282911 - DNA, 15 bp, Homo sapiens
tcttagttgctaata

SEQ ID NO: 282912 - DNA, 15 bp, Homo sapiens
ttcttagttgctaat

SEQ ID NO: 282913 - DNA, 15 bp, Homo sapiens
tttcttagttgctaa

SEQ ID NO: 282914 - DNA, 15 bp, Homo sapiens
ttttcttagttgcta

SEQ ID NO: 282915 - DNA, 15 bp, Homo sapiens
cttttcttagttgct

SEQ ID NO: 282916 - DNA, 15 bp, Homo sapiens
gcttttcttagttgc

SEQ ID NO: 282917 - DNA, 15 bp, Homo sapiens
ggcttttcttagttg

SEQ ID NO: 282918 - DNA, 15 bp, Homo sapiens
aggcttttcttagtt

SEQ ID NO: 282919 - DNA, 15 bp, Homo sapiens
gaggcttttcttagt

SEQ ID NO: 282920 - DNA, 15 bp, Homo sapiens
tgaggcttttcttag

SEQ ID NO: 282921 - DNA, 15 bp, Homo sapiens
atgaggcttttctta

SEQ ID NO: 282922 - DNA, 15 bp, Homo sapiens
aatgaggcttttctt

SEQ ID NO: 282923 - DNA, 15 bp, Homo sapiens
caatgaggcttttct

SEQ ID NO: 282924 - DNA, 15 bp, Homo sapiens
tcaatgaggcttttc

SEQ ID NO: 282925 - DNA, 15 bp, Homo sapiens
gtcaatgaggctttt

SEQ ID NO: 282926 - DNA, 15 bp, Homo sapiens
agtcaatgaggcttt

SEQ ID NO: 282927 - DNA, 15 bp, Homo sapiens
aagtcaatgaggctt

SEQ ID NO: 282928 - DNA, 15 bp, Homo sapiens
aaagtcaatgaggct

SEQ ID NO: 282929 - DNA, 15 bp, Homo sapiens
taaagtcaatgaggc

SEQ ID NO: 282930 - DNA, 15 bp, Homo sapiens
ctaaagtcaatgagg

SEQ ID NO: 282931 - DNA, 15 bp, Homo sapiens
tctaaagtcaatgag

SEQ ID NO: 282932 - DNA, 15 bp, Homo sapiens
ttctaaagtcaatga

SEQ ID NO: 282933 - DNA, 15 bp, Homo sapiens
attctaaagtcaatg

SEQ ID NO: 282934 - DNA, 15 bp, Homo sapiens
tattctaaagtcaat

SEQ ID NO: 282935 - DNA, 15 bp, Homo sapiens
gtattctaaagtcaa

SEQ ID NO: 282936 - DNA, 15 bp, Homo sapiens
agtattctaaagtca

SEQ ID NO: 282937 - DNA, 15 bp, Homo sapiens
tagtattctaaagtc

SEQ ID NO: 282938 - DNA, 15 bp, Homo sapiens
ttagtattctaaagt

SEQ ID NO: 282939 - DNA, 15 bp, Homo sapiens
tttagtattctaaag

SEQ ID NO: 282940 - DNA, 15 bp, Homo sapiens
ttttagtattctaaa

SEQ ID NO: 282941 - DNA, 15 bp, Homo sapiens
tttttagtattctaa

SEQ ID NO: 282942 - DNA, 15 bp, Homo sapiens
ctttttagtattcta

SEQ ID NO: 282943 - DNA, 15 bp, Homo sapiens
tctttttagtattct

SEQ ID NO: 282944 - DNA, 15 bp, Homo sapiens
atctttttagtattc

SEQ ID NO: 282945 - DNA, 15 bp, Homo sapiens
tatctttttagtatt

SEQ ID NO: 282946 - DNA, 15 bp, Homo sapiens
atatctttttagtat

SEQ ID NO: 282947 - DNA, 15 bp, Homo sapiens
aatatctttttagta

SEQ ID NO: 282948 - DNA, 15 bp, Homo sapiens
taatatctttttagt

SEQ ID NO: 282949 - DNA, 15 bp, Homo sapiens
ataatatctttttag

SEQ ID NO: 282950 - DNA, 15 bp, Homo sapiens
tataatatcttttta

SEQ ID NO: 282951 - DNA, 15 bp, Homo sapiens
atataatatcttttt

SEQ ID NO: 282952 - DNA, 15 bp, Homo sapiens
tatataatatctttt

SEQ ID NO: 282953 - DNA, 15 bp, Homo sapiens
gtatataatatcttt

SEQ ID NO: 282954 - DNA, 15 bp, Homo sapiens
agtatataatatctt

SEQ ID NO: 282955 - DNA, 15 bp, Homo sapiens
tagtatataatatct

SEQ ID NO: 282956 - DNA, 15 bp, Homo sapiens
ttagtatataatatc

SEQ ID NO: 282957 - DNA, 15 bp, Homo sapiens
tttagtatataatat

SEQ ID NO: 282958 - DNA, 15 bp, Homo sapiens
ttttagtatataata

SEQ ID NO: 282959 - DNA, 15 bp, Homo sapiens
tttttagtatataat

SEQ ID NO: 282960 - DNA, 15 bp, Homo sapiens
ctttttagtatataa

SEQ ID NO: 282961 - DNA, 15 bp, Homo sapiens
gctttttagtatata

SEQ ID NO: 282962 - DNA, 15 bp, Homo sapiens
agctttttagtatat

SEQ ID NO: 282963 - DNA, 15 bp, Homo sapiens
aagctttttagtata

SEQ ID NO: 282964 - DNA, 15 bp, Homo sapiens
aaagctttttagtat

SEQ ID NO: 282965 - DNA, 15 bp, Homo sapiens
gaaagctttttagta

SEQ ID NO: 282966 - DNA, 15 bp, Homo sapiens
agaaagctttttagt

SEQ ID NO: 282967 - DNA, 15 bp, Homo sapiens
tagaaagctttttag

SEQ ID NO: 282968 - DNA, 15 bp, Homo sapiens
ctagaaagcttttta

SEQ ID NO: 282969 - DNA, 15 bp, Homo sapiens
gctagaaagcttttt

SEQ ID NO: 282970 - DNA, 15 bp, Homo sapiens
ggctagaaagctttt

SEQ ID NO: 282971 - DNA, 15 bp, Homo sapiens
tggctagaaagcttt

SEQ ID NO: 282972 - DNA, 15 bp, Homo sapiens
ttggctagaaagctt

SEQ ID NO: 282973 - DNA, 15 bp, Homo sapiens
attggctagaaagct

SEQ ID NO: 282974 - DNA, 15 bp, Homo sapiens
aattggctagaaagc

SEQ ID NO: 282975 - DNA, 15 bp, Homo sapiens
taattggctagaaag

SEQ ID NO: 282976 - DNA, 15 bp, Homo sapiens
ctaattggctagaaa

SEQ ID NO: 282977 - DNA, 15 bp, Homo sapiens
actaattggctagaa

SEQ ID NO: 282978 - DNA, 15 bp, Homo sapiens
aactaattggctaga

SEQ ID NO: 282979 - DNA, 15 bp, Homo sapiens
aaactaattggctag

SEQ ID NO: 282980 - DNA, 15 bp, Homo sapiens
taaactaattggcta

SEQ ID NO: 282981 - DNA, 15 bp, Homo sapiens
ataaactaattggct

SEQ ID NO: 282982 - DNA, 15 bp, Homo sapiens
aataaactaattggc

SEQ ID NO: 282983 - DNA, 15 bp, Homo sapiens
aaataaactaattgg

SEQ ID NO: 282984 - DNA, 15 bp, Homo sapiens
gaaataaactaattg

SEQ ID NO: 282985 - DNA, 15 bp, Homo sapiens
agaaataaactaatt

SEQ ID NO: 282986 - DNA, 15 bp, Homo sapiens
cagaaataaactaat

SEQ ID NO: 282987 - DNA, 15 bp, Homo sapiens
tcagaaataaactaa

SEQ ID NO: 282988 - DNA, 15 bp, Homo sapiens
atcagaaataaacta

SEQ ID NO: 282989 - DNA, 15 bp, Homo sapiens
aatcagaaataaact

SEQ ID NO: 282990 - DNA, 15 bp, Homo sapiens
aaatcagaaataaac

SEQ ID NO: 282991 - DNA, 15 bp, Homo sapiens
gaaatcagaaataaa

SEQ ID NO: 282992 - DNA, 15 bp, Homo sapiens
ggaaatcagaaataa

SEQ ID NO: 282993 - DNA, 15 bp, Homo sapiens
gggaaatcagaaata

SEQ ID NO: 282994 - DNA, 15 bp, Homo sapiens
ggggaaatcagaaat

SEQ ID NO: 282995 - DNA, 15 bp, Homo sapiens
tggggaaatcagaaa

SEQ ID NO: 282996 - DNA, 15 bp, Homo sapiens
atggggaaatcagaa

SEQ ID NO: 282997 - DNA, 15 bp, Homo sapiens
tatggggaaatcaga

SEQ ID NO: 282998 - DNA, 15 bp, Homo sapiens
atatggggaaatcag

SEQ ID NO: 282999 - DNA, 15 bp, Homo sapiens
catatggggaaatca

SEQ ID NO: 283000 - DNA, 15 bp, Homo sapiens
acatatggggaaatc

SEQ ID NO: 283001 - DNA, 15 bp, Homo sapiens
cacatatggggaaat

SEQ ID NO: 283002 - DNA, 15 bp, Homo sapiens
acacatatggggaaa

SEQ ID NO: 283003 - DNA, 15 bp, Homo sapiens
tacacatatggggaa

SEQ ID NO: 283004 - DNA, 15 bp, Homo sapiens
atacacatatgggga

SEQ ID NO: 283005 - DNA, 15 bp, Homo sapiens
tatacacatatgggg

SEQ ID NO: 283006 - DNA, 15 bp, Homo sapiens
atatacacatatggg

SEQ ID NO: 283007 - DNA, 15 bp, Homo sapiens
aatatacacatatgg

SEQ ID NO: 283008 - DNA, 15 bp, Homo sapiens
gaatatacacatatg

SEQ ID NO: 283009 - DNA, 15 bp, Homo sapiens
ggaatatacacatat

SEQ ID NO: 283010 - DNA, 15 bp, Homo sapiens
tggaatatacacata

SEQ ID NO: 283011 - DNA, 15 bp, Homo sapiens
gtggaatatacacat

SEQ ID NO: 283012 - DNA, 15 bp, Homo sapiens
agtggaatatacaca

SEQ ID NO: 283013 - DNA, 15 bp, Homo sapiens
aagtggaatatacac

SEQ ID NO: 283014 - DNA, 15 bp, Homo sapiens
caagtggaatataca

SEQ ID NO: 283015 - DNA, 15 bp, Homo sapiens
ccaagtggaatatac

SEQ ID NO: 283016 - DNA, 15 bp, Homo sapiens
accaagtggaatata

SEQ ID NO: 283017 - DNA, 15 bp, Homo sapiens
aaccaagtggaatat

SEQ ID NO: 283018 - DNA, 15 bp, Homo sapiens
caaccaagtggaata

SEQ ID NO: 283019 - DNA, 15 bp, Homo sapiens
acaaccaagtggaat

SEQ ID NO: 283020 - DNA, 15 bp, Homo sapiens
cacaaccaagtggaa

SEQ ID NO: 283021 - DNA, 15 bp, Homo sapiens
ccacaaccaagtgga

SEQ ID NO: 283022 - DNA, 15 bp, Homo sapiens
tccacaaccaagtgg

SEQ ID NO: 283023 - DNA, 15 bp, Homo sapiens
ttccacaaccaagtg

SEQ ID NO: 283024 - DNA, 15 bp, Homo sapiens
gttccacaaccaagt

SEQ ID NO: 283025 - DNA, 15 bp, Homo sapiens
agttccacaaccaag

SEQ ID NO: 283026 - DNA, 15 bp, Homo sapiens
aagttccacaaccaa

SEQ ID NO: 283027 - DNA, 15 bp, Homo sapiens
aaagttccacaacca

SEQ ID NO: 283028 - DNA, 15 bp, Homo sapiens
gaaagttccacaacc

SEQ ID NO: 283029 - DNA, 15 bp, Homo sapiens
agaaagttccacaac

SEQ ID NO: 283030 - DNA, 15 bp, Homo sapiens
gagaaagttccacaa

SEQ ID NO: 283031 - DNA, 15 bp, Homo sapiens
tgagaaagttccaca

SEQ ID NO: 283032 - DNA, 15 bp, Homo sapiens
ctgagaaagttccac

SEQ ID NO: 283033 - DNA, 15 bp, Homo sapiens
gctgagaaagttcca

SEQ ID NO: 283034 - DNA, 15 bp, Homo sapiens
tgctgagaaagttcc

SEQ ID NO: 283035 - DNA, 15 bp, Homo sapiens
ttgctgagaaagttc

SEQ ID NO: 283036 - DNA, 15 bp, Homo sapiens
tttgctgagaaagtt

SEQ ID NO: 283037 - DNA, 15 bp, Homo sapiens
atttgctgagaaagt

SEQ ID NO: 283038 - DNA, 15 bp, Homo sapiens
tatttgctgagaaag

SEQ ID NO: 283039 - DNA, 15 bp, Homo sapiens
atatttgctgagaaa

SEQ ID NO: 283040 - DNA, 15 bp, Homo sapiens
aatatttgctgagaa

SEQ ID NO: 283041 - DNA, 15 bp, Homo sapiens
aaatatttgctgaga

SEQ ID NO: 283042 - DNA, 15 bp, Homo sapiens
aaaatatttgctgag

SEQ ID NO: 283043 - DNA, 15 bp, Homo sapiens
taaaatatttgctga

SEQ ID NO: 283044 - DNA, 15 bp, Homo sapiens
ataaaatatttgctg

SEQ ID NO: 283045 - DNA, 15 bp, Homo sapiens
gataaaatatttgct

SEQ ID NO: 283046 - DNA, 15 bp, Homo sapiens
tgataaaatatttgc

SEQ ID NO: 283047 - DNA, 15 bp, Homo sapiens
gtgataaaatatttg

SEQ ID NO: 283048 - DNA, 15 bp, Homo sapiens
agtgataaaatattt

SEQ ID NO: 283049 - DNA, 15 bp, Homo sapiens
cagtgataaaatatt

SEQ ID NO: 283050 - DNA, 15 bp, Homo sapiens
tcagtgataaaatat

SEQ ID NO: 283051 - DNA, 15 bp, Homo sapiens
atcagtgataaaata

SEQ ID NO: 283052 - DNA, 15 bp, Homo sapiens
aatcagtgataaaat

SEQ ID NO: 283053 - DNA, 15 bp, Homo sapiens
taatcagtgataaaa

SEQ ID NO: 283054 - DNA, 15 bp, Homo sapiens
ataatcagtgataaa

SEQ ID NO: 283055 - DNA, 15 bp, Homo sapiens
gataatcagtgataa

SEQ ID NO: 283056 - DNA, 15 bp, Homo sapiens
ggataatcagtgata

SEQ ID NO: 283057 - DNA, 15 bp, Homo sapiens
gggataatcagtgat

SEQ ID NO: 283058 - DNA, 15 bp, Homo sapiens
tgggataatcagtga

SEQ ID NO: 283059 - DNA, 15 bp, Homo sapiens
gtgggataatcagtg

SEQ ID NO: 283060 - DNA, 15 bp, Homo sapiens
agtgggataatcagt

SEQ ID NO: 283061 - DNA, 15 bp, Homo sapiens
tagtgggataatcag

SEQ ID NO: 283062 - DNA, 15 bp, Homo sapiens
atagtgggataatca

SEQ ID NO: 283063 - DNA, 15 bp, Homo sapiens
aatagtgggataatc

SEQ ID NO: 283064 - DNA, 15 bp, Homo sapiens
caatagtgggataat

SEQ ID NO: 283065 - DNA, 15 bp, Homo sapiens
acaatagtgggataa

SEQ ID NO: 283066 - DNA, 15 bp, Homo sapiens
cacaatagtgggata

SEQ ID NO: 283067 - DNA, 15 bp, Homo sapiens
acacaatagtgggat

SEQ ID NO: 283068 - DNA, 15 bp, Homo sapiens
cacacaatagtggga

SEQ ID NO: 283069 - DNA, 15 bp, Homo sapiens
acacacaatagtggg

SEQ ID NO: 283070 - DNA, 15 bp, Homo sapiens
tacacacaatagtgg

SEQ ID NO: 283071 - DNA, 15 bp, Homo sapiens
gtacacacaatagtg

SEQ ID NO: 283072 - DNA, 15 bp, Homo sapiens
agtacacacaatagt

SEQ ID NO: 283073 - DNA, 15 bp, Homo sapiens
gagtacacacaatag

SEQ ID NO: 283074 - DNA, 15 bp, Homo sapiens
agagtacacacaata

SEQ ID NO: 283075 - DNA, 15 bp, Homo sapiens
aagagtacacacaat

SEQ ID NO: 283076 - DNA, 15 bp, Homo sapiens
taagagtacacacaa

SEQ ID NO: 283077 - DNA, 15 bp, Homo sapiens
gtaagagtacacaca

SEQ ID NO: 283078 - DNA, 15 bp, Homo sapiens
agtaagagtacacac

SEQ ID NO: 283079 - DNA, 15 bp, Homo sapiens
aagtaagagtacaca

SEQ ID NO: 283080 - DNA, 15 bp, Homo sapiens
aaagtaagagtacac

SEQ ID NO: 283081 - DNA, 15 bp, Homo sapiens
aaaagtaagagtaca

SEQ ID NO: 283082 - DNA, 15 bp, Homo sapiens
caaaagtaagagtac

SEQ ID NO: 283083 - DNA, 15 bp, Homo sapiens
ccaaaagtaagagta

SEQ ID NO: 283084 - DNA, 15 bp, Homo sapiens
tccaaaagtaagagt

SEQ ID NO: 283085 - DNA, 15 bp, Homo sapiens
ttccaaaagtaagag

SEQ ID NO: 283086 - DNA, 15 bp, Homo sapiens
gttccaaaagtaaga

SEQ ID NO: 283087 - DNA, 15 bp, Homo sapiens
agttccaaaagtaag

SEQ ID NO: 283088 - DNA, 15 bp, Homo sapiens
aagttccaaaagtaa

SEQ ID NO: 283089 - DNA, 15 bp, Homo sapiens
aaagttccaaaagta

SEQ ID NO: 283090 - DNA, 15 bp, Homo sapiens
aaaagttccaaaagt

SEQ ID NO: 283091 - DNA, 15 bp, Homo sapiens
aaaaagttccaaaag

SEQ ID NO: 283092 - DNA, 15 bp, Homo sapiens
taaaaagttccaaaa

SEQ ID NO: 283093 - DNA, 15 bp, Homo sapiens
ataaaaagttccaaa

SEQ ID NO: 283094 - DNA, 15 bp, Homo sapiens
aataaaaagttccaa

SEQ ID NO: 283095 - DNA, 15 bp, Homo sapiens
gaataaaaagttcca

SEQ ID NO: 283096 - DNA, 15 bp, Homo sapiens
agaataaaaagttcc

SEQ ID NO: 283097 - DNA, 15 bp, Homo sapiens
aagaataaaaagttc

SEQ ID NO: 283098 - DNA, 15 bp, Homo sapiens
aaagaataaaaagtt

SEQ ID NO: 283099 - DNA, 15 bp, Homo sapiens
aaaagaataaaaagt

SEQ ID NO: 283100 - DNA, 15 bp, Homo sapiens
aaaaagaataaaaag

SEQ ID NO: 283101 - DNA, 15 bp, Homo sapiens
aaaaaagaataaaaa

SEQ ID NO: 283102 - DNA, 15 bp, Homo sapiens
aaaaaaagaataaaa

SEQ ID NO: 283103 - DNA, 15 bp, Homo sapiens
caaaaaaaagaataa

SEQ ID NO: 283104 - DNA, 15 bp, Homo sapiens
acaaaaaaaagaata

SEQ ID NO: 283105 - DNA, 15 bp, Homo sapiens
cacaaaaaaaagaat

SEQ ID NO: 283106 - DNA, 15 bp, Homo sapiens
gcacaaaaaaaagaa

SEQ ID NO: 283107 - DNA, 15 bp, Homo sapiens
ggcacaaaaaaaaga

SEQ ID NO: 283108 - DNA, 15 bp, Homo sapiens
gggcacaaaaaaaag

SEQ ID NO: 283109 - DNA, 15 bp, Homo sapiens
agggcacaaaaaaaa

SEQ ID NO: 283110 - DNA, 15 bp, Homo sapiens
cagggcacaaaaaaa

SEQ ID NO: 283111 - DNA, 15 bp, Homo sapiens
ccagggcacaaaaaa

SEQ ID NO: 283112 - DNA, 15 bp, Homo sapiens
tccagggcacaaaaa

SEQ ID NO: 283113 - DNA, 15 bp, Homo sapiens
ttccagggcacaaaa

SEQ ID NO: 283114 - DNA, 15 bp, Homo sapiens
attccagggcacaaa

SEQ ID NO: 283115 - DNA, 15 bp, Homo sapiens
aattccagggcacaa

SEQ ID NO: 283116 - DNA, 15 bp, Homo sapiens
gaattccagggcaca

SEQ ID NO: 283117 - DNA, 15 bp, Homo sapiens
tgaattccagggcac

SEQ ID NO: 283118 - DNA, 15 bp, Homo sapiens
gtgaattccagggca

SEQ ID NO: 283119 - DNA, 15 bp, Homo sapiens
tgtgaattccagggc

SEQ ID NO: 283120 - DNA, 15 bp, Homo sapiens
atgtgaattccaggg

SEQ ID NO: 283121 - DNA, 15 bp, Homo sapiens
aatgtgaattccagg

SEQ ID NO: 283122 - DNA, 15 bp, Homo sapiens
aaatgtgaattccag

SEQ ID NO: 283123 - DNA, 15 bp, Homo sapiens
aaaatgtgaattcca

SEQ ID NO: 283124 - DNA, 15 bp, Homo sapiens
aaaaatgtgaattcc

SEQ ID NO: 283125 - DNA, 15 bp, Homo sapiens
taaaaatgtgaattc

SEQ ID NO: 283126 - DNA, 15 bp, Homo sapiens
ttaaaaatgtgaatt

SEQ ID NO: 283127 - DNA, 15 bp, Homo sapiens
attaaaaatgtgaat

SEQ ID NO: 283128 - DNA, 15 bp, Homo sapiens
gattaaaaatgtgaa

SEQ ID NO: 283129 - DNA, 15 bp, Homo sapiens
ggattaaaaatgtga

SEQ ID NO: 283130 - DNA, 15 bp, Homo sapiens
aggattaaaaatgtg

SEQ ID NO: 283131 - DNA, 15 bp, Homo sapiens
caggattaaaaatgt

SEQ ID NO: 283132 - DNA, 15 bp, Homo sapiens
tcaggattaaaaatg

SEQ ID NO: 283133 - DNA, 15 bp, Homo sapiens
ttcaggattaaaaat

SEQ ID NO: 283134 - DNA, 15 bp, Homo sapiens
attcaggattaaaaa

SEQ ID NO: 283135 - DNA, 15 bp, Homo sapiens
tattcaggattaaaa

SEQ ID NO: 283136 - DNA, 15 bp, Homo sapiens
ttattcaggattaaa

SEQ ID NO: 283137 - DNA, 15 bp, Homo sapiens
attattcaggattaa

SEQ ID NO: 283138 - DNA, 15 bp, Homo sapiens
tattattcaggatta

SEQ ID NO: 283139 - DNA, 15 bp, Homo sapiens
atattattcaggatt

SEQ ID NO: 283140 - DNA, 15 bp, Homo sapiens
gatattattcaggat

SEQ ID NO: 283141 - DNA, 15 bp, Homo sapiens
agatattattcagga

SEQ ID NO: 283142 - DNA, 15 bp, Homo sapiens
tagatattattcagg

SEQ ID NO: 283143 - DNA, 15 bp, Homo sapiens
ttagatattattcag

SEQ ID NO: 283144 - DNA, 15 bp, Homo sapiens
ttttagatattattc

SEQ ID NO: 283145 - DNA, 15 bp, Homo sapiens
cttttagatattatt

SEQ ID NO: 283146 - DNA, 15 bp, Homo sapiens
tcttttagatattat

SEQ ID NO: 283147 - DNA, 15 bp, Homo sapiens
gtcttttagatatta

SEQ ID NO: 283148 - DNA, 15 bp, Homo sapiens
agtcttttagatatt

SEQ ID NO: 283149 - DNA, 15 bp, Homo sapiens
tagtcttttagatat

SEQ ID NO: 283150 - DNA, 15 bp, Homo sapiens
ttagtcttttagata

SEQ ID NO: 283151 - DNA, 15 bp, Homo sapiens
attagtcttttagat

SEQ ID NO: 283152 - DNA, 15 bp, Homo sapiens
tattagtcttttaga

SEQ ID NO: 283153 - DNA, 15 bp, Homo sapiens
gtattagtcttttag

SEQ ID NO: 283154 - DNA, 15 bp, Homo sapiens
agtattagtctttta

SEQ ID NO: 283155 - DNA, 15 bp, Homo sapiens
cagtattagtctttt

SEQ ID NO: 283156 - DNA, 15 bp, Homo sapiens
acagtattagtcttt

SEQ ID NO: 283157 - DNA, 15 bp, Homo sapiens
gacagtattagtctt

SEQ ID NO: 283158 - DNA, 15 bp, Homo sapiens
tgacagtattagtct

SEQ ID NO: 283159 - DNA, 15 bp, Homo sapiens
ttgacagtattagtc

SEQ ID NO: 283160 - DNA, 15 bp, Homo sapiens
cttgacagtattagt

SEQ ID NO: 283161 - DNA, 15 bp, Homo sapiens
gcttgacagtattag

SEQ ID NO: 283162 - DNA, 15 bp, Homo sapiens
agcttgacagtatta

SEQ ID NO: 283163 - DNA, 15 bp, Homo sapiens
aagcttgacagtatt

SEQ ID NO: 283164 - DNA, 15 bp, Homo sapiens
taagcttgacagtat

SEQ ID NO: 283165 - DNA, 15 bp, Homo sapiens
ataagcttgacagta

SEQ ID NO: 283166 - DNA, 15 bp, Homo sapiens
cataagcttgacagt

SEQ ID NO: 283167 - DNA, 15 bp, Homo sapiens
acataagcttgacag

SEQ ID NO: 283168 - DNA, 15 bp, Homo sapiens
cacataagcttgaca

SEQ ID NO: 283169 - DNA, 15 bp, Homo sapiens
tcacataagcttgac

SEQ ID NO: 283170 - DNA, 15 bp, Homo sapiens
gtcacataagcttga

SEQ ID NO: 283171 - DNA, 15 bp, Homo sapiens
agtcacataagcttg

SEQ ID NO: 283172 - DNA, 15 bp, Homo sapiens
tagtcacataagctt

SEQ ID NO: 283173 - DNA, 15 bp, Homo sapiens
ttagtcacataagct

SEQ ID NO: 283174 - DNA, 15 bp, Homo sapiens
gttagtcacataagc

SEQ ID NO: 283175 - DNA, 15 bp, Homo sapiens
tgttagtcacataag

SEQ ID NO: 283176 - DNA, 15 bp, Homo sapiens
ttgttagtcacataa

SEQ ID NO: 283177 - DNA, 15 bp, Homo sapiens
tttgttagtcacata

SEQ ID NO: 283178 - DNA, 15 bp, Homo sapiens
ctttgttagtcacat

SEQ ID NO: 283179 - DNA, 15 bp, Homo sapiens
gctttgttagtcaca

SEQ ID NO: 283180 - DNA, 15 bp, Homo sapiens
agctttgttagtcac

SEQ ID NO: 283181 - DNA, 15 bp, Homo sapiens
gagctttgttagtca

SEQ ID NO: 283182 - DNA, 15 bp, Homo sapiens
agagctttgttagtc

SEQ ID NO: 283183 - DNA, 15 bp, Homo sapiens
tagagctttgttagt

SEQ ID NO: 283184 - DNA, 15 bp, Homo sapiens
atagagctttgttag

SEQ ID NO: 283185 - DNA, 15 bp, Homo sapiens
aatagagctttgtta

SEQ ID NO: 283186 - DNA, 15 bp, Homo sapiens
caatagagctttgtt

SEQ ID NO: 283187 - DNA, 15 bp, Homo sapiens
acaatagagctttgt

SEQ ID NO: 283188 - DNA, 15 bp, Homo sapiens
cacaatagagctttg

SEQ ID NO: 283189 - DNA, 15 bp, Homo sapiens
ccacaatagagcttt

SEQ ID NO: 283190 - DNA, 15 bp, Homo sapiens
accacaatagagctt

SEQ ID NO: 283191 - DNA, 15 bp, Homo sapiens
aaccacaatagagct

SEQ ID NO: 283192 - DNA, 15 bp, Homo sapiens
aaaccacaatagagc

SEQ ID NO: 283193 - DNA, 15 bp, Homo sapiens
caaaccacaatagag

SEQ ID NO: 283194 - DNA, 15 bp, Homo sapiens
ccaaaccacaataga

SEQ ID NO: 283195 - DNA, 15 bp, Homo sapiens
tccaaaccacaatag

SEQ ID NO: 283196 - DNA, 15 bp, Homo sapiens
atccaaaccacaata

SEQ ID NO: 283197 - DNA, 15 bp, Homo sapiens
gatccaaaccacaat

SEQ ID NO: 283198 - DNA, 15 bp, Homo sapiens
agatccaaaccacaa

SEQ ID NO: 283199 - DNA, 15 bp, Homo sapiens
cagatccaaaccaca

SEQ ID NO: 283200 - DNA, 15 bp, Homo sapiens
tcagatccaaaccac

SEQ ID NO: 283201 - DNA, 15 bp, Homo sapiens
atcagatccaaacca

SEQ ID NO: 283202 - DNA, 15 bp, Homo sapiens
catcagatccaaacc

SEQ ID NO: 283203 - DNA, 15 bp, Homo sapiens
ccatcagatccaaac

SEQ ID NO: 283204 - DNA, 15 bp, Homo sapiens
cccatcagatccaaa

SEQ ID NO: 283205 - DNA, 15 bp, Homo sapiens
tcccatcagatccaa

SEQ ID NO: 283206 - DNA, 15 bp, Homo sapiens
ttcccatcagatcca

SEQ ID NO: 283207 - DNA, 15 bp, Homo sapiens
attcccatcagatcc

SEQ ID NO: 283208 - DNA, 15 bp, Homo sapiens
gattcccatcagatc

SEQ ID NO: 283209 - DNA, 15 bp, Homo sapiens
agattcccatcagat

SEQ ID NO: 283210 - DNA, 15 bp, Homo sapiens
cagattcccatcaga

SEQ ID NO: 283211 - DNA, 15 bp, Homo sapiens
acagattcccatcag

SEQ ID NO: 283212 - DNA, 15 bp, Homo sapiens
tacagattcccatca

SEQ ID NO: 283213 - DNA, 15 bp, Homo sapiens
ttacagattcccatc

SEQ ID NO: 283214 - DNA, 15 bp, Homo sapiens
tttacagattcccat

SEQ ID NO: 283215 - DNA, 15 bp, Homo sapiens
ctttacagattccca

SEQ ID NO: 283216 - DNA, 15 bp, Homo sapiens
actttacagattccc

SEQ ID NO: 283217 - DNA, 15 bp, Homo sapiens
tactttacagattcc

SEQ ID NO: 283218 - DNA, 15 bp, Homo sapiens
ctactttacagattc

SEQ ID NO: 283219 - DNA, 15 bp, Homo sapiens
tctactttacagatt

SEQ ID NO: 283220 - DNA, 15 bp, Homo sapiens
gtctactttacagat

SEQ ID NO: 283221 - DNA, 15 bp, Homo sapiens
tgtctactttacaga

SEQ ID NO: 283222 - DNA, 15 bp, Homo sapiens
ctgtctactttacag

SEQ ID NO: 283223 - DNA, 15 bp, Homo sapiens
tctgtctactttaca

SEQ ID NO: 283224 - DNA, 15 bp, Homo sapiens
ttctgtctactttac

SEQ ID NO: 283225 - DNA, 15 bp, Homo sapiens
tttctgtctacttta

SEQ ID NO: 283226 - DNA, 15 bp, Homo sapiens
ttttctgtctacttt

SEQ ID NO: 283227 - DNA, 15 bp, Homo sapiens
cttttctgtctactt

SEQ ID NO: 283228 - DNA, 15 bp, Homo sapiens
acttttctgtctact

SEQ ID NO: 283229 - DNA, 15 bp, Homo sapiens
aacttttctgtctac

SEQ ID NO: 283230 - DNA, 15 bp, Homo sapiens
caacttttctgtcta

SEQ ID NO: 283231 - DNA, 15 bp, Homo sapiens
acaacttttctgtct

SEQ ID NO: 283232 - DNA, 15 bp, Homo sapiens
gacaacttttctgtc

SEQ ID NO: 283233 - DNA, 15 bp, Homo sapiens
tgacaacttttctgt

SEQ ID NO: 283234 - DNA, 15 bp, Homo sapiens
ttgacaacttttctg

SEQ ID NO: 283235 - DNA, 15 bp, Homo sapiens
tttgacaacttttct

SEQ ID NO: 283236 - DNA, 15 bp, Homo sapiens
gtttgacaacttttc

SEQ ID NO: 283237 - DNA, 15 bp, Homo sapiens
tgtttgacaactttt

SEQ ID NO: 283238 - DNA, 15 bp, Homo sapiens
atgtttgacaacttt

SEQ ID NO: 283239 - DNA, 15 bp, Homo sapiens
tatgtttgacaactt

SEQ ID NO: 283240 - DNA, 15 bp, Homo sapiens
ctatgtttgacaact

SEQ ID NO: 283241 - DNA, 15 bp, Homo sapiens
actatgtttgacaac

SEQ ID NO: 283242 - DNA, 15 bp, Homo sapiens
tactatgtttgacaa

SEQ ID NO: 283243 - DNA, 15 bp, Homo sapiens
ctactatgtttgaca

SEQ ID NO: 283244 - DNA, 15 bp, Homo sapiens
actactatgtttgac

SEQ ID NO: 283245 - DNA, 15 bp, Homo sapiens
aactactatgtttga

SEQ ID NO: 283246 - DNA, 15 bp, Homo sapiens
caactactatgtttg

SEQ ID NO: 283247 - DNA, 15 bp, Homo sapiens
ccaactactatgttt

SEQ ID NO: 283248 - DNA, 15 bp, Homo sapiens
cccaactactatgtt

SEQ ID NO: 283249 - DNA, 15 bp, Homo sapiens
acccaactactatgt

SEQ ID NO: 283250 - DNA, 15 bp, Homo sapiens
cacccaactactatg

SEQ ID NO: 283251 - DNA, 15 bp, Homo sapiens
acacccaactactat

SEQ ID NO: 283252 - DNA, 15 bp, Homo sapiens
aacacccaactacta

SEQ ID NO: 283253 - DNA, 15 bp, Homo sapiens
aaacacccaactact

SEQ ID NO: 283254 - DNA, 15 bp, Homo sapiens
aaaacacccaactac

SEQ ID NO: 283255 - DNA, 15 bp, Homo sapiens
gaaaacacccaacta

SEQ ID NO: 283256 - DNA, 15 bp, Homo sapiens
tgaaaacacccaact

SEQ ID NO: 283257 - DNA, 15 bp, Homo sapiens
gtgaaaacacccaac

SEQ ID NO: 283258 - DNA, 15 bp, Homo sapiens
agtgaaaacacccaa

SEQ ID NO: 283259 - DNA, 15 bp, Homo sapiens
tagtgaaaacaccca

SEQ ID NO: 283260 - DNA, 15 bp, Homo sapiens
ttagtgaaaacaccc

SEQ ID NO: 283261 - DNA, 15 bp, Homo sapiens
tttagtgaaaacacc

SEQ ID NO: 283262 - DNA, 15 bp, Homo sapiens
ttttagtgaaaacac

SEQ ID NO: 283263 - DNA, 15 bp, Homo sapiens
tttttagtgaaaaca

SEQ ID NO: 283264 - DNA, 15 bp, Homo sapiens
ttttttagtgaaaac

SEQ ID NO: 283265 - DNA, 15 bp, Homo sapiens
tttttttagtgaaaa

SEQ ID NO: 283266 - DNA, 15 bp, Homo sapiens
ttttttttagtgaaa

SEQ ID NO: 283267 - DNA, 15 bp, Homo sapiens
tttttttttagtgaa

SEQ ID NO: 283268 - DNA, 15 bp, Homo sapiens
ttttttttttagtga

SEQ ID NO: 283269 - DNA, 15 bp, Homo sapiens
tttttttttttagtg

SEQ ID NO: 283270 - DNA, 15 bp, Homo sapiens
tagtttttttttttt

SEQ ID NO: 283271 - DNA, 15 bp, Homo sapiens
atagttttttttttt

SEQ ID NO: 283272 - DNA, 15 bp, Homo sapiens
catagtttttttttt

SEQ ID NO: 283273 - DNA, 15 bp, Homo sapiens
ccatagttttttttt

SEQ ID NO: 283274 - DNA, 15 bp, Homo sapiens
tccatagtttttttt

SEQ ID NO: 283275 - DNA, 15 bp, Homo sapiens
ctccatagttttttt

SEQ ID NO: 283276 - DNA, 15 bp, Homo sapiens
tctccatagtttttt

SEQ ID NO: 283277 - DNA, 15 bp, Homo sapiens
ctctccatagttttt

SEQ ID NO: 283278 - DNA, 15 bp, Homo sapiens
actctccatagtttt

SEQ ID NO: 283279 - DNA, 15 bp, Homo sapiens
cactctccatagttt

SEQ ID NO: 283280 - DNA, 15 bp, Homo sapiens
gcactctccatagtt

SEQ ID NO: 283281 - DNA, 15 bp, Homo sapiens
agcactctccatagt

SEQ ID NO: 283282 - DNA, 15 bp, Homo sapiens
tagcactctccatag

SEQ ID NO: 283283 - DNA, 15 bp, Homo sapiens
ctagcactctccata

SEQ ID NO: 283284 - DNA, 15 bp, Homo sapiens
cctagcactctccat

SEQ ID NO: 283285 - DNA, 15 bp, Homo sapiens
acctagcactctcca

SEQ ID NO: 283286 - DNA, 15 bp, Homo sapiens
aacctagcactctcc

SEQ ID NO: 283287 - DNA, 15 bp, Homo sapiens
taacctagcactctc

SEQ ID NO: 283288 - DNA, 15 bp, Homo sapiens
ttaacctagcactct

SEQ ID NO: 283289 - DNA, 15 bp, Homo sapiens
tttaacctagcactc

SEQ ID NO: 283290 - DNA, 15 bp, Homo sapiens
ttttaacctagcact

SEQ ID NO: 283291 - DNA, 15 bp, Homo sapiens
attttaacctagcac

SEQ ID NO: 283292 - DNA, 15 bp, Homo sapiens
tattttaacctagca

SEQ ID NO: 283293 - DNA, 15 bp, Homo sapiens
gtattttaacctagc

SEQ ID NO: 283294 - DNA, 15 bp, Homo sapiens
agtattttaacctag

SEQ ID NO: 283295 - DNA, 15 bp, Homo sapiens
aagtattttaaccta

SEQ ID NO: 283296 - DNA, 15 bp, Homo sapiens
taagtattttaacct

SEQ ID NO: 283297 - DNA, 15 bp, Homo sapiens
ttaagtattttaacc

SEQ ID NO: 283298 - DNA, 15 bp, Homo sapiens
tttaagtattttaac

SEQ ID NO: 283299 - DNA, 15 bp, Homo sapiens
ctttaagtattttaa

SEQ ID NO: 283300 - DNA, 15 bp, Homo sapiens
actttaagtatttta

SEQ ID NO: 283301 - DNA, 15 bp, Homo sapiens
cactttaagtatttt

SEQ ID NO: 283302 - DNA, 15 bp, Homo sapiens
gcactttaagtattt

SEQ ID NO: 283303 - DNA, 15 bp, Homo sapiens
agcactttaagtatt

SEQ ID NO: 283304 - DNA, 15 bp, Homo sapiens
gagcactttaagtat

SEQ ID NO: 283305 - DNA, 15 bp, Homo sapiens
tgagcactttaagta

SEQ ID NO: 283306 - DNA, 15 bp, Homo sapiens
ttgagcactttaagt

SEQ ID NO: 283307 - DNA, 15 bp, Homo sapiens
tttgagcactttaag

SEQ ID NO: 283308 - DNA, 15 bp, Homo sapiens
atttgagcactttaa

SEQ ID NO: 283309 - DNA, 15 bp, Homo sapiens
tatttgagcacttta

SEQ ID NO: 283310 - DNA, 15 bp, Homo sapiens
atatttgagcacttt

SEQ ID NO: 283311 - DNA, 15 bp, Homo sapiens
tatatttgagcactt

SEQ ID NO: 283312 - DNA, 15 bp, Homo sapiens
ctatatttgagcact

SEQ ID NO: 283313 - DNA, 15 bp, Homo sapiens
tctatatttgagcac

SEQ ID NO: 283314 - DNA, 15 bp, Homo sapiens
ttctatatttgagca

SEQ ID NO: 283315 - DNA, 15 bp, Homo sapiens
attctatatttgagc

SEQ ID NO: 283316 - DNA, 15 bp, Homo sapiens
tattctatatttgag

SEQ ID NO: 283317 - DNA, 15 bp, Homo sapiens
atattctatatttga

SEQ ID NO: 283318 - DNA, 15 bp, Homo sapiens
aatattctatatttg

SEQ ID NO: 283319 - DNA, 15 bp, Homo sapiens
gaatattctatattt

SEQ ID NO: 283320 - DNA, 15 bp, Homo sapiens
agaatattctatatt

SEQ ID NO: 283321 - DNA, 15 bp, Homo sapiens
gagaatattctatat

SEQ ID NO: 283322 - DNA, 15 bp, Homo sapiens
agagaatattctata

SEQ ID NO: 283323 - DNA, 15 bp, Homo sapiens
aagagaatattctat

SEQ ID NO: 283324 - DNA, 15 bp, Homo sapiens
aaagagaatattcta

SEQ ID NO: 283325 - DNA, 15 bp, Homo sapiens
gaaagagaatattct

SEQ ID NO: 283326 - DNA, 15 bp, Homo sapiens
ggaaagagaatattc

SEQ ID NO: 283327 - DNA, 15 bp, Homo sapiens
tggaaagagaatatt

SEQ ID NO: 283328 - DNA, 15 bp, Homo sapiens
atggaaagagaatat

SEQ ID NO: 283329 - DNA, 15 bp, Homo sapiens
tatggaaagagaata

SEQ ID NO: 283330 - DNA, 15 bp, Homo sapiens
atatggaaagagaat

SEQ ID NO: 283331 - DNA, 15 bp, Homo sapiens
aatatggaaagagaa

SEQ ID NO: 283332 - DNA, 15 bp, Homo sapiens
aaatatggaaagaga

SEQ ID NO: 283333 - DNA, 15 bp, Homo sapiens
aaaatatggaaagag

SEQ ID NO: 283334 - DNA, 15 bp, Homo sapiens
gaaaatatggaaaga

SEQ ID NO: 283335 - DNA, 15 bp, Homo sapiens
agaaaatatggaaag

SEQ ID NO: 283336 - DNA, 15 bp, Homo sapiens
tagaaaatatggaaa

SEQ ID NO: 283337 - DNA, 15 bp, Homo sapiens
ttagaaaatatggaa

SEQ ID NO: 283338 - DNA, 15 bp, Homo sapiens
tttagaaaatatgga

SEQ ID NO: 283339 - DNA, 15 bp, Homo sapiens
ttttagaaaatatgg

SEQ ID NO: 283340 - DNA, 15 bp, Homo sapiens
gttttagaaaatatg

SEQ ID NO: 283341 - DNA, 15 bp, Homo sapiens
agttttagaaaatat

SEQ ID NO: 283342 - DNA, 15 bp, Homo sapiens
aagttttagaaaata

SEQ ID NO: 283343 - DNA, 15 bp, Homo sapiens
caagttttagaaaat

SEQ ID NO: 283344 - DNA, 15 bp, Homo sapiens
acaagttttagaaaa

SEQ ID NO: 283345 - DNA, 15 bp, Homo sapiens
aacaagttttagaaa

SEQ ID NO: 283346 - DNA, 15 bp, Homo sapiens
aaacaagttttagaa

SEQ ID NO: 283347 - DNA, 15 bp, Homo sapiens
aaaacaagttttaga

SEQ ID NO: 283348 - DNA, 15 bp, Homo sapiens
taaaacaagttttag

SEQ ID NO: 283349 - DNA, 15 bp, Homo sapiens
ataaaacaagtttta

SEQ ID NO: 283350 - DNA, 15 bp, Homo sapiens
aataaaacaagtttt

SEQ ID NO: 283351 - DNA, 15 bp, Homo sapiens
aaataaaacaagttt

SEQ ID NO: 283352 - DNA, 15 bp, Homo sapiens
taaataaaacaagtt

SEQ ID NO: 283353 - DNA, 15 bp, Homo sapiens
ataaataaaacaagt

SEQ ID NO: 283354 - DNA, 15 bp, Homo sapiens
aataaataaaacaag

SEQ ID NO: 283355 - DNA, 15 bp, Homo sapiens
taataaataaaacaa

SEQ ID NO: 283356 - DNA, 15 bp, Homo sapiens
ataataaataaaaca

SEQ ID NO: 283357 - DNA, 15 bp, Homo sapiens
cataataaataaaac

SEQ ID NO: 283358 - DNA, 15 bp, Homo sapiens
ccataataaataaaa

SEQ ID NO: 283359 - DNA, 15 bp, Homo sapiens
accataataaataaa

SEQ ID NO: 283360 - DNA, 15 bp, Homo sapiens
aaccataataaataa

SEQ ID NO: 283361 - DNA, 15 bp, Homo sapiens
taaccataataaata

SEQ ID NO: 283362 - DNA, 15 bp, Homo sapiens
ataaccataataaat

SEQ ID NO: 283363 - DNA, 15 bp, Homo sapiens
tataaccataataaa

SEQ ID NO: 283364 - DNA, 15 bp, Homo sapiens
ttataaccataataa

SEQ ID NO: 283365 - DNA, 15 bp, Homo sapiens
tttataaccataata

SEQ ID NO: 283366 - DNA, 15 bp, Homo sapiens
atttataaccataat

SEQ ID NO: 283367 - DNA, 15 bp, Homo sapiens
tatttataaccataa

SEQ ID NO: 283368 - DNA, 15 bp, Homo sapiens
ttatttataaccata

SEQ ID NO: 283369 - DNA, 15 bp, Homo sapiens
tttatttataaccat

SEQ ID NO: 283370 - DNA, 15 bp, Homo sapiens
ttttatttataacca

SEQ ID NO: 283371 - DNA, 15 bp, Homo sapiens
cttttatttataacc

SEQ ID NO: 283372 - DNA, 15 bp, Homo sapiens
acttttatttataac

SEQ ID NO: 283373 - DNA, 15 bp, Homo sapiens
aacttttatttataa

SEQ ID NO: 283374 - DNA, 15 bp, Homo sapiens
taacttttatttata

SEQ ID NO: 283375 - DNA, 15 bp, Homo sapiens
ataacttttatttat

SEQ ID NO: 283376 - DNA, 15 bp, Homo sapiens
gataacttttattta

SEQ ID NO: 283377 - DNA, 15 bp, Homo sapiens
tgataacttttattt

SEQ ID NO: 283378 - DNA, 15 bp, Homo sapiens
ctgataacttttatt

SEQ ID NO: 283379 - DNA, 15 bp, Homo sapiens
cctgataacttttat

SEQ ID NO: 283380 - DNA, 15 bp, Homo sapiens
tcctgataactttta

SEQ ID NO: 283381 - DNA, 15 bp, Homo sapiens
ctcctgataactttt

SEQ ID NO: 283382 - DNA, 15 bp, Homo sapiens
cctcctgataacttt

SEQ ID NO: 283383 - DNA, 15 bp, Homo sapiens
acctcctgataactt

SEQ ID NO: 283384 - DNA, 15 bp, Homo sapiens
aacctcctgataact

SEQ ID NO: 283385 - DNA, 15 bp, Homo sapiens
aaacctcctgataac

SEQ ID NO: 283386 - DNA, 15 bp, Homo sapiens
aaaacctcctgataa

SEQ ID NO: 283387 - DNA, 15 bp, Homo sapiens
aaaaacctcctgata

SEQ ID NO: 283388 - DNA, 15 bp, Homo sapiens
gaaaaacctcctgat

SEQ ID NO: 283389 - DNA, 15 bp, Homo sapiens
tgaaaaacctcctga

SEQ ID NO: 283390 - DNA, 15 bp, Homo sapiens
ttgaaaaacctcctg

SEQ ID NO: 283391 - DNA, 15 bp, Homo sapiens
attgaaaaacctcct

SEQ ID NO: 283392 - DNA, 15 bp, Homo sapiens
aattgaaaaacctcc

SEQ ID NO: 283393 - DNA, 15 bp, Homo sapiens
aaattgaaaaacctc

SEQ ID NO: 283394 - DNA, 15 bp, Homo sapiens
gaaattgaaaaacct

SEQ ID NO: 283395 - DNA, 15 bp, Homo sapiens
tgaaattgaaaaacc

SEQ ID NO: 283396 - DNA, 15 bp, Homo sapiens
ttgaaattgaaaaac

SEQ ID NO: 283397 - DNA, 15 bp, Homo sapiens
tttgaaattgaaaaa

SEQ ID NO: 283398 - DNA, 15 bp, Homo sapiens
atttgaaattgaaaa

SEQ ID NO: 283399 - DNA, 15 bp, Homo sapiens
aatttgaaattgaaa

SEQ ID NO: 283400 - DNA, 15 bp, Homo sapiens
aaatttgaaattgaa

SEQ ID NO: 283401 - DNA, 15 bp, Homo sapiens
gaaatttgaaattga

SEQ ID NO: 283402 - DNA, 15 bp, Homo sapiens
tgaaatttgaaattg

SEQ ID NO: 283403 - DNA, 15 bp, Homo sapiens
ttgaaatttgaaatt

SEQ ID NO: 283404 - DNA, 15 bp, Homo sapiens
tttgaaatttgaaat

SEQ ID NO: 283405 - DNA, 15 bp, Homo sapiens
ctttgaaatttgaaa

SEQ ID NO: 283406 - DNA, 15 bp, Homo sapiens
tctttgaaatttgaa

SEQ ID NO: 283407 - DNA, 15 bp, Homo sapiens
atctttgaaatttga

SEQ ID NO: 283408 - DNA, 15 bp, Homo sapiens
aatctttgaaatttg

SEQ ID NO: 283409 - DNA, 15 bp, Homo sapiens
caatctttgaaattt

SEQ ID NO: 283410 - DNA, 15 bp, Homo sapiens
gcaatctttgaaatt

SEQ ID NO: 283411 - DNA, 15 bp, Homo sapiens
tgcaatctttgaaat

SEQ ID NO: 283412 - DNA, 15 bp, Homo sapiens
atgcaatctttgaaa

SEQ ID NO: 283413 - DNA, 15 bp, Homo sapiens
gatgcaatctttgaa

SEQ ID NO: 283414 - DNA, 15 bp, Homo sapiens
agatgcaatctttga

SEQ ID NO: 283415 - DNA, 15 bp, Homo sapiens
aagatgcaatctttg

SEQ ID NO: 283416 - DNA, 15 bp, Homo sapiens
taagatgcaatcttt

SEQ ID NO: 283417 - DNA, 15 bp, Homo sapiens
ttaagatgcaatctt

SEQ ID NO: 283418 - DNA, 15 bp, Homo sapiens
attaagatgcaatct

SEQ ID NO: 283419 - DNA, 15 bp, Homo sapiens
tattaagatgcaatc

SEQ ID NO: 283420 - DNA, 15 bp, Homo sapiens
gtattaagatgcaat

SEQ ID NO: 283421 - DNA, 15 bp, Homo sapiens
agtattaagatgcaa

SEQ ID NO: 283422 - DNA, 15 bp, Homo sapiens
aagtattaagatgca

SEQ ID NO: 283423 - DNA, 15 bp, Homo sapiens
caagtattaagatgc

SEQ ID NO: 283424 - DNA, 15 bp, Homo sapiens
tcaagtattaagatg

SEQ ID NO: 283425 - DNA, 15 bp, Homo sapiens
gtcaagtattaagat

SEQ ID NO: 283426 - DNA, 15 bp, Homo sapiens
tgtcaagtattaaga

SEQ ID NO: 283427 - DNA, 15 bp, Homo sapiens
ctgtcaagtattaag

SEQ ID NO: 283428 - DNA, 15 bp, Homo sapiens
actgtcaagtattaa

SEQ ID NO: 283429 - DNA, 15 bp, Homo sapiens
tactgtcaagtatta

SEQ ID NO: 283430 - DNA, 15 bp, Homo sapiens
ttactgtcaagtatt

SEQ ID NO: 283431 - DNA, 15 bp, Homo sapiens
attactgtcaagtat

SEQ ID NO: 283432 - DNA, 15 bp, Homo sapiens
cattactgtcaagta

SEQ ID NO: 283433 - DNA, 15 bp, Homo sapiens
acattactgtcaagt

SEQ ID NO: 283434 - DNA, 15 bp, Homo sapiens
tacattactgtcaag

SEQ ID NO: 283435 - DNA, 15 bp, Homo sapiens
ctacattactgtcaa

SEQ ID NO: 283436 - DNA, 15 bp, Homo sapiens
actacattactgtca

SEQ ID NO: 283437 - DNA, 15 bp, Homo sapiens
tactacattactgtc

SEQ ID NO: 283438 - DNA, 15 bp, Homo sapiens
ctactacattactgt

SEQ ID NO: 283439 - DNA, 15 bp, Homo sapiens
tctactacattactg

SEQ ID NO: 283440 - DNA, 15 bp, Homo sapiens
ctctactacattact

SEQ ID NO: 283441 - DNA, 15 bp, Homo sapiens
tctctactacattac

SEQ ID NO: 283442 - DNA, 15 bp, Homo sapiens
atctctactacatta

SEQ ID NO: 283443 - DNA, 15 bp, Homo sapiens
aatctctactacatt

SEQ ID NO: 283444 - DNA, 15 bp, Homo sapiens
aaatctctactacat

SEQ ID NO: 283445 - DNA, 15 bp, Homo sapiens
taaatctctactaca

SEQ ID NO: 283446 - DNA, 15 bp, Homo sapiens
ataaatctctactac

SEQ ID NO: 283447 - DNA, 15 bp, Homo sapiens
tataaatctctacta

SEQ ID NO: 283448 - DNA, 15 bp, Homo sapiens
gtataaatctctact

SEQ ID NO: 283449 - DNA, 15 bp, Homo sapiens
tgtataaatctctac

SEQ ID NO: 283450 - DNA, 15 bp, Homo sapiens
atgtataaatctcta

SEQ ID NO: 283451 - DNA, 15 bp, Homo sapiens
aatgtataaatctct

SEQ ID NO: 283452 - DNA, 15 bp, Homo sapiens
taatgtataaatctc

SEQ ID NO: 283453 - DNA, 15 bp, Homo sapiens
ataatgtataaatct

SEQ ID NO: 283454 - DNA, 15 bp, Homo sapiens
gataatgtataaatc

SEQ ID NO: 283455 - DNA, 15 bp, Homo sapiens
tgataatgtataaat

SEQ ID NO: 283456 - DNA, 15 bp, Homo sapiens
atgataatgtataaa

SEQ ID NO: 283457 - DNA, 15 bp, Homo sapiens
aatgataatgtataa

SEQ ID NO: 283458 - DNA, 15 bp, Homo sapiens
gaatgataatgtata

SEQ ID NO: 283459 - DNA, 15 bp, Homo sapiens
tgaatgataatgtat

SEQ ID NO: 283460 - DNA, 15 bp, Homo sapiens
atgaatgataatgta

SEQ ID NO: 283461 - DNA, 15 bp, Homo sapiens
catgaatgataatgt

SEQ ID NO: 283462 - DNA, 15 bp, Homo sapiens
acatgaatgataatg

SEQ ID NO: 283463 - DNA, 15 bp, Homo sapiens
tacatgaatgataat

SEQ ID NO: 283464 - DNA, 15 bp, Homo sapiens
gtacatgaatgataa

SEQ ID NO: 283465 - DNA, 15 bp, Homo sapiens
agtacatgaatgata

SEQ ID NO: 283466 - DNA, 15 bp, Homo sapiens
tagtacatgaatgat

SEQ ID NO: 283467 - DNA, 15 bp, Homo sapiens
atagtacatgaatga

SEQ ID NO: 283468 - DNA, 15 bp, Homo sapiens
catagtacatgaatg

SEQ ID NO: 283469 - DNA, 15 bp, Homo sapiens
tcatagtacatgaat

SEQ ID NO: 283470 - DNA, 15 bp, Homo sapiens
ctcatagtacatgaa

SEQ ID NO: 283471 - DNA, 15 bp, Homo sapiens
actcatagtacatga

SEQ ID NO: 283472 - DNA, 15 bp, Homo sapiens
cactcatagtacatg

SEQ ID NO: 283473 - DNA, 15 bp, Homo sapiens
acactcatagtacat

SEQ ID NO: 283474 - DNA, 15 bp, Homo sapiens
cacactcatagtaca

SEQ ID NO: 283475 - DNA, 15 bp, Homo sapiens
tcacactcatagtac

SEQ ID NO: 283476 - DNA, 15 bp, Homo sapiens
ttcacactcatagta

SEQ ID NO: 283477 - DNA, 15 bp, Homo sapiens
tttcacactcatagt

SEQ ID NO: 283478 - DNA, 15 bp, Homo sapiens
gtttcacactcatag

SEQ ID NO: 283479 - DNA, 15 bp, Homo sapiens
tgtttcacactcata

SEQ ID NO: 283480 - DNA, 15 bp, Homo sapiens
ttgtttcacactcat

SEQ ID NO: 283481 - DNA, 15 bp, Homo sapiens
attgtttcacactca

SEQ ID NO: 283482 - DNA, 15 bp, Homo sapiens
aattgtttcacactc

SEQ ID NO: 283483 - DNA, 15 bp, Homo sapiens
gaattgtttcacact

SEQ ID NO: 283484 - DNA, 15 bp, Homo sapiens
ggaattgtttcacac

SEQ ID NO: 283485 - DNA, 15 bp, Homo sapiens
gggaattgtttcaca

SEQ ID NO: 283486 - DNA, 15 bp, Homo sapiens
tgggaattgtttcac

SEQ ID NO: 283487 - DNA, 15 bp, Homo sapiens
ttgggaattgtttca

SEQ ID NO: 283488 - DNA, 15 bp, Homo sapiens
tttgggaattgtttc

SEQ ID NO: 283489 - DNA, 15 bp, Homo sapiens
atttgggaattgttt

SEQ ID NO: 283490 - DNA, 15 bp, Homo sapiens
gatttgggaattgtt

SEQ ID NO: 283491 - DNA, 15 bp, Homo sapiens
tgatttgggaattgt

SEQ ID NO: 283492 - DNA, 15 bp, Homo sapiens
ttgatttgggaattg

SEQ ID NO: 283493 - DNA, 15 bp, Homo sapiens
tttgatttgggaatt

SEQ ID NO: 283494 - DNA, 15 bp, Homo sapiens
ttttgatttgggaat

SEQ ID NO: 283495 - DNA, 15 bp, Homo sapiens
attttgatttgggaa

SEQ ID NO: 283496 - DNA, 15 bp, Homo sapiens
tattttgatttggga

SEQ ID NO: 283497 - DNA, 15 bp, Homo sapiens
ttattttgatttggg

SEQ ID NO: 283498 - DNA, 15 bp, Homo sapiens
tttattttgatttgg

SEQ ID NO: 283499 - DNA, 15 bp, Homo sapiens
ctttattttgatttg

SEQ ID NO: 283500 - DNA, 15 bp, Homo sapiens
cctttattttgattt

SEQ ID NO: 283501 - DNA, 15 bp, Homo sapiens
acctttattttgatt

SEQ ID NO: 283502 - DNA, 15 bp, Homo sapiens
cacctttattttgat

SEQ ID NO: 283503 - DNA, 15 bp, Homo sapiens
acacctttattttga

SEQ ID NO: 283504 - DNA, 15 bp, Homo sapiens
tacacctttattttg

SEQ ID NO: 283505 - DNA, 15 bp, Homo sapiens
atacacctttatttt

SEQ ID NO: 283506 - DNA, 15 bp, Homo sapiens
aatacacctttattt

SEQ ID NO: 283507 - DNA, 15 bp, Homo sapiens
gaatacacctttatt

SEQ ID NO: 283508 - DNA, 15 bp, Homo sapiens
tgaatacacctttat

SEQ ID NO: 283509 - DNA, 15 bp, Homo sapiens
atgaatacaccttta

SEQ ID NO: 283510 - DNA, 15 bp, Homo sapiens
tatgaatacaccttt

SEQ ID NO: 283511 - DNA, 15 bp, Homo sapiens
ttatgaatacacctt

SEQ ID NO: 283512 - DNA, 15 bp, Homo sapiens
attatgaatacacct

SEQ ID NO: 283513 - DNA, 15 bp, Homo sapiens
cattatgaatacacc

SEQ ID NO: 283514 - DNA, 15 bp, Homo sapiens
acattatgaatacac

SEQ ID NO: 283515 - DNA, 15 bp, Homo sapiens
aacattatgaataca

SEQ ID NO: 283516 - DNA, 15 bp, Homo sapiens
aaacattatgaatac

SEQ ID NO: 283517 - DNA, 15 bp, Homo sapiens
caaacattatgaata

SEQ ID NO: 283518 - DNA, 15 bp, Homo sapiens
acaaacattatgaat

SEQ ID NO: 283519 - DNA, 15 bp, Homo sapiens
aacaaacattatgaa

SEQ ID NO: 283520 - DNA, 15 bp, Homo sapiens
aaacaaacattatga

SEQ ID NO: 283521 - DNA, 15 bp, Homo sapiens
gaaacaaacattatg

SEQ ID NO: 283522 - DNA, 15 bp, Homo sapiens
tgaaacaaacattat

SEQ ID NO: 283523 - DNA, 15 bp, Homo sapiens
atgaaacaaacatta

SEQ ID NO: 283524 - DNA, 15 bp, Homo sapiens
tatgaaacaaacatt

SEQ ID NO: 283525 - DNA, 15 bp, Homo sapiens
atatgaaacaaacat

SEQ ID NO: 283526 - DNA, 15 bp, Homo sapiens
aatatgaaacaaaca

SEQ ID NO: 283527 - DNA, 15 bp, Homo sapiens
aaatatgaaacaaac

SEQ ID NO: 283528 - DNA, 15 bp, Homo sapiens
taaatatgaaacaaa

SEQ ID NO: 283529 - DNA, 15 bp, Homo sapiens
ttaaatatgaaacaa

SEQ ID NO: 283530 - DNA, 15 bp, Homo sapiens
gttaaatatgaaaca

SEQ ID NO: 283531 - DNA, 15 bp, Homo sapiens
ggttaaatatgaaac

SEQ ID NO: 283532 - DNA, 15 bp, Homo sapiens
aggttaaatatgaaa

SEQ ID NO: 283533 - DNA, 15 bp, Homo sapiens
taggttaaatatgaa

SEQ ID NO: 283534 - DNA, 15 bp, Homo sapiens
gtaggttaaatatga

SEQ ID NO: 283535 - DNA, 15 bp, Homo sapiens
agtaggttaaatatg

SEQ ID NO: 283536 - DNA, 15 bp, Homo sapiens
cagtaggttaaatat

SEQ ID NO: 283537 - DNA, 15 bp, Homo sapiens
ccagtaggttaaata

SEQ ID NO: 283538 - DNA, 15 bp, Homo sapiens
accagtaggttaaat

SEQ ID NO: 283539 - DNA, 15 bp, Homo sapiens
caccagtaggttaaa

SEQ ID NO: 283540 - DNA, 15 bp, Homo sapiens
acaccagtaggttaa

SEQ ID NO: 283541 - DNA, 15 bp, Homo sapiens
cacaccagtaggtta

SEQ ID NO: 283542 - DNA, 15 bp, Homo sapiens
gcacaccagtaggtt

SEQ ID NO: 283543 - DNA, 15 bp, Homo sapiens
tgcacaccagtaggt

SEQ ID NO: 283544 - DNA, 15 bp, Homo sapiens
atgcacaccagtagg

SEQ ID NO: 283545 - DNA, 15 bp, Homo sapiens
aatgcacaccagtag

SEQ ID NO: 283546 - DNA, 15 bp, Homo sapiens
aaatgcacaccagta

SEQ ID NO: 283547 - DNA, 15 bp, Homo sapiens
gaaatgcacaccagt

SEQ ID NO: 283548 - DNA, 15 bp, Homo sapiens
tgaaatgcacaccag

SEQ ID NO: 283549 - DNA, 15 bp, Homo sapiens
atgaaatgcacacca

SEQ ID NO: 283550 - DNA, 15 bp, Homo sapiens
catgaaatgcacacc

SEQ ID NO: 283551 - DNA, 15 bp, Homo sapiens
acatgaaatgcacac

SEQ ID NO: 283552 - DNA, 15 bp, Homo sapiens
tacatgaaatgcaca

SEQ ID NO: 283553 - DNA, 15 bp, Homo sapiens
ttacatgaaatgcac

SEQ ID NO: 283554 - DNA, 15 bp, Homo sapiens
tttacatgaaatgca

SEQ ID NO: 283555 - DNA, 15 bp, Homo sapiens
ctttacatgaaatgc

SEQ ID NO: 283556 - DNA, 15 bp, Homo sapiens
actttacatgaaatg

SEQ ID NO: 283557 - DNA, 15 bp, Homo sapiens
tactttacatgaaat

SEQ ID NO: 283558 - DNA, 15 bp, Homo sapiens
ctactttacatgaaa

SEQ ID NO: 283559 - DNA, 15 bp, Homo sapiens
actactttacatgaa

SEQ ID NO: 283560 - DNA, 15 bp, Homo sapiens
aactactttacatga

SEQ ID NO: 283561 - DNA, 15 bp, Homo sapiens
taactactttacatg

SEQ ID NO: 283562 - DNA, 15 bp, Homo sapiens
ttaactactttacat

SEQ ID NO: 283563 - DNA, 15 bp, Homo sapiens
cttaactactttaca

SEQ ID NO: 283564 - DNA, 15 bp, Homo sapiens
acttaactactttac

SEQ ID NO: 283565 - DNA, 15 bp, Homo sapiens
tacttaactacttta

SEQ ID NO: 283566 - DNA, 15 bp, Homo sapiens
atacttaactacttt

SEQ ID NO: 283567 - DNA, 15 bp, Homo sapiens
gatacttaactactt

SEQ ID NO: 283568 - DNA, 15 bp, Homo sapiens
agatacttaactact

SEQ ID NO: 283569 - DNA, 15 bp, Homo sapiens
aagatacttaactac

SEQ ID NO: 283570 - DNA, 15 bp, Homo sapiens
caagatacttaacta

SEQ ID NO: 283571 - DNA, 15 bp, Homo sapiens
tcaagatacttaact

SEQ ID NO: 283572 - DNA, 15 bp, Homo sapiens
ttcaagatacttaac

SEQ ID NO: 283573 - DNA, 15 bp, Homo sapiens
attcaagatacttaa

SEQ ID NO: 283574 - DNA, 15 bp, Homo sapiens
gattcaagatactta

SEQ ID NO: 283575 - DNA, 15 bp, Homo sapiens
agattcaagatactt

SEQ ID NO: 283576 - DNA, 15 bp, Homo sapiens
aagattcaagatact

SEQ ID NO: 283577 - DNA, 15 bp, Homo sapiens
aaagattcaagatac

SEQ ID NO: 283578 - DNA, 15 bp, Homo sapiens
gaaagattcaagata

SEQ ID NO: 283579 - DNA, 15 bp, Homo sapiens
ggaaagattcaagat

SEQ ID NO: 283580 - DNA, 15 bp, Homo sapiens
aggaaagattcaaga

SEQ ID NO: 283581 - DNA, 15 bp, Homo sapiens
taggaaagattcaag

SEQ ID NO: 283582 - DNA, 15 bp, Homo sapiens
ttaggaaagattcaa

SEQ ID NO: 283583 - DNA, 15 bp, Homo sapiens
tttaggaaagattca

SEQ ID NO: 283584 - DNA, 15 bp, Homo sapiens
atttaggaaagattc

SEQ ID NO: 283585 - DNA, 15 bp, Homo sapiens
gatttaggaaagatt

SEQ ID NO: 283586 - DNA, 15 bp, Homo sapiens
tgatttaggaaagat

SEQ ID NO: 283587 - DNA, 15 bp, Homo sapiens
ttgatttaggaaaga

SEQ ID NO: 283588 - DNA, 15 bp, Homo sapiens
gttgatttaggaaag

SEQ ID NO: 283589 - DNA, 15 bp, Homo sapiens
tgttgatttaggaaa

SEQ ID NO: 283590 - DNA, 15 bp, Homo sapiens
ttgttgatttaggaa

SEQ ID NO: 283591 - DNA, 15 bp, Homo sapiens
tttgttgatttagga

SEQ ID NO: 283592 - DNA, 15 bp, Homo sapiens
atttgttgatttagg

SEQ ID NO: 283593 - DNA, 15 bp, Homo sapiens
aatttgttgatttag

SEQ ID NO: 283594 - DNA, 15 bp, Homo sapiens
aaatttgttgattta

SEQ ID NO: 283595 - DNA, 15 bp, Homo sapiens
gaaatttgttgattt

SEQ ID NO: 283596 - DNA, 15 bp, Homo sapiens
ggaaatttgttgatt

SEQ ID NO: 283597 - DNA, 15 bp, Homo sapiens
aggaaatttgttgat

SEQ ID NO: 283598 - DNA, 15 bp, Homo sapiens
gaggaaatttgttga

SEQ ID NO: 283599 - DNA, 15 bp, Homo sapiens
tgaggaaatttgttg

SEQ ID NO: 283600 - DNA, 15 bp, Homo sapiens
ttgaggaaatttgtt

SEQ ID NO: 283601 - DNA, 15 bp, Homo sapiens
cttgaggaaatttgt

SEQ ID NO: 283602 - DNA, 15 bp, Homo sapiens
ccttgaggaaatttg

SEQ ID NO: 283603 - DNA, 15 bp, Homo sapiens
gccttgaggaaattt

SEQ ID NO: 283604 - DNA, 15 bp, Homo sapiens
agccttgaggaaatt

SEQ ID NO: 283605 - DNA, 15 bp, Homo sapiens
cagccttgaggaaat

SEQ ID NO: 283606 - DNA, 15 bp, Homo sapiens
tcagccttgaggaaa

SEQ ID NO: 283607 - DNA, 15 bp, Homo sapiens
gtcagccttgaggaa

SEQ ID NO: 283608 - DNA, 15 bp, Homo sapiens
ggtcagccttgagga

SEQ ID NO: 283609 - DNA, 15 bp, Homo sapiens
tggtcagccttgagg

SEQ ID NO: 283610 - DNA, 15 bp, Homo sapiens
atggtcagccttgag

SEQ ID NO: 283611 - DNA, 15 bp, Homo sapiens
tatggtcagccttga

SEQ ID NO: 283612 - DNA, 15 bp, Homo sapiens
ctatggtcagccttg

SEQ ID NO: 283613 - DNA, 15 bp, Homo sapiens
gctatggtcagcctt

SEQ ID NO: 283614 - DNA, 15 bp, Homo sapiens
ggctatggtcagcct

SEQ ID NO: 283615 - DNA, 15 bp, Homo sapiens
tggctatggtcagcc

SEQ ID NO: 283616 - DNA, 15 bp, Homo sapiens
ttggctatggtcagc

SEQ ID NO: 283617 - DNA, 15 bp, Homo sapiens
tttggctatggtcag

SEQ ID NO: 283618 - DNA, 15 bp, Homo sapiens
ctttggctatggtca

SEQ ID NO: 283619 - DNA, 15 bp, Homo sapiens
gctttggctatggtc

SEQ ID NO: 283620 - DNA, 15 bp, Homo sapiens
cgctttggctatggt

SEQ ID NO: 283621 - DNA, 15 bp, Homo sapiens
acgctttggctatgg

SEQ ID NO: 283622 - DNA, 15 bp, Homo sapiens
aacgctttggctatg

SEQ ID NO: 283623 - DNA, 15 bp, Homo sapiens
taacgctttggctat

SEQ ID NO: 283624 - DNA, 15 bp, Homo sapiens
ttaacgctttggcta

SEQ ID NO: 283625 - DNA, 15 bp, Homo sapiens
tttaacgctttggct

SEQ ID NO: 283626 - DNA, 15 bp, Homo sapiens
ctttaacgctttggc

SEQ ID NO: 283627 - DNA, 15 bp, Homo sapiens
cctttaacgctttgg

SEQ ID NO: 283628 - DNA, 15 bp, Homo sapiens
tcctttaacgctttg

SEQ ID NO: 283629 - DNA, 15 bp, Homo sapiens
ttcctttaacgcttt

SEQ ID NO: 283630 - DNA, 15 bp, Homo sapiens
tttcctttaacgctt

SEQ ID NO: 283631 - DNA, 15 bp, Homo sapiens
atttcctttaacgct

SEQ ID NO: 283632 - DNA, 15 bp, Homo sapiens
tatttcctttaacgc

SEQ ID NO: 283633 - DNA, 15 bp, Homo sapiens
ttatttcctttaacg

SEQ ID NO: 283634 - DNA, 15 bp, Homo sapiens
tttatttcctttaac

SEQ ID NO: 283635 - DNA, 15 bp, Homo sapiens
ttttatttcctttaa

SEQ ID NO: 283636 - DNA, 15 bp, Homo sapiens
cttttatttccttta

SEQ ID NO: 283637 - DNA, 15 bp, Homo sapiens
tcttttatttccttt

SEQ ID NO: 283638 - DNA, 15 bp, Homo sapiens
atcttttatttcctt

SEQ ID NO: 283639 - DNA, 15 bp, Homo sapiens
tatcttttatttcct

SEQ ID NO: 283640 - DNA, 15 bp, Homo sapiens
ttatcttttatttcc

SEQ ID NO: 283641 - DNA, 15 bp, Homo sapiens
attatcttttatttc

SEQ ID NO: 283642 - DNA, 15 bp, Homo sapiens
tattatcttttattt

SEQ ID NO: 283643 - DNA, 15 bp, Homo sapiens
ttattatcttttatt

SEQ ID NO: 283644 - DNA, 15 bp, Homo sapiens
gaattattatctttt

SEQ ID NO: 283645 - DNA, 15 bp, Homo sapiens
tgaattattatcttt

SEQ ID NO: 283646 - DNA, 15 bp, Homo sapiens
ctgaattattatctt

SEQ ID NO: 283647 - DNA, 15 bp, Homo sapiens
tctgaattattatct

SEQ ID NO: 283648 - DNA, 15 bp, Homo sapiens
ttctgaattattatc

SEQ ID NO: 283649 - DNA, 15 bp, Homo sapiens
gttctgaattattat

SEQ ID NO: 283650 - DNA, 15 bp, Homo sapiens
tgttctgaattatta

SEQ ID NO: 283651 - DNA, 15 bp, Homo sapiens
ttgttctgaattatt

SEQ ID NO: 283652 - DNA, 15 bp, Homo sapiens
tttgttctgaattat

SEQ ID NO: 283653 - DNA, 15 bp, Homo sapiens
ttttgttctgaatta

SEQ ID NO: 283654 - DNA, 15 bp, Homo sapiens
attttgttctgaatt

SEQ ID NO: 283655 - DNA, 15 bp, Homo sapiens
gattttgttctgaat

SEQ ID NO: 283656 - DNA, 15 bp, Homo sapiens
agattttgttctgaa

SEQ ID NO: 283657 - DNA, 15 bp, Homo sapiens
aagattttgttctga

SEQ ID NO: 283658 - DNA, 15 bp, Homo sapiens
taagattttgttctg

SEQ ID NO: 283659 - DNA, 15 bp, Homo sapiens
gtaagattttgttct

SEQ ID NO: 283660 - DNA, 15 bp, Homo sapiens
agtaagattttgttc

SEQ ID NO: 283661 - DNA, 15 bp, Homo sapiens
aagtaagattttgtt

SEQ ID NO: 283662 - DNA, 15 bp, Homo sapiens
gaagtaagattttgt

SEQ ID NO: 283663 - DNA, 15 bp, Homo sapiens
agaagtaagattttg

SEQ ID NO: 283664 - DNA, 15 bp, Homo sapiens
aagaagtaagatttt

SEQ ID NO: 283665 - DNA, 15 bp, Homo sapiens
aaagaagtaagattt

SEQ ID NO: 283666 - DNA, 15 bp, Homo sapiens
taaagaagtaagatt

SEQ ID NO: 283667 - DNA, 15 bp, Homo sapiens
ttaaagaagtaagat

SEQ ID NO: 283668 - DNA, 15 bp, Homo sapiens
tttaaagaagtaaga

SEQ ID NO: 283669 - DNA, 15 bp, Homo sapiens
ttttaaagaagtaag

SEQ ID NO: 283670 - DNA, 15 bp, Homo sapiens
attttaaagaagtaa

SEQ ID NO: 283671 - DNA, 15 bp, Homo sapiens
cattttaaagaagta

SEQ ID NO: 283672 - DNA, 15 bp, Homo sapiens
acattttaaagaagt

SEQ ID NO: 283673 - DNA, 15 bp, Homo sapiens
aacattttaaagaag

SEQ ID NO: 283674 - DNA, 15 bp, Homo sapiens
aaacattttaaagaa

SEQ ID NO: 283675 - DNA, 15 bp, Homo sapiens
aaaacattttaaaga

SEQ ID NO: 283676 - DNA, 15 bp, Homo sapiens
caaaacattttaaag

SEQ ID NO: 283677 - DNA, 15 bp, Homo sapiens
acaaaacattttaaa

SEQ ID NO: 283678 - DNA, 15 bp, Homo sapiens
gacaaaacattttaa

SEQ ID NO: 283679 - DNA, 15 bp, Homo sapiens
tgacaaaacatttta

SEQ ID NO: 283680 - DNA, 15 bp, Homo sapiens
atgacaaaacatttt

SEQ ID NO: 283681 - DNA, 15 bp, Homo sapiens
catgacaaaacattt

SEQ ID NO: 283682 - DNA, 15 bp, Homo sapiens
gcatgacaaaacatt

SEQ ID NO: 283683 - DNA, 15 bp, Homo sapiens
ggcatgacaaaacat

SEQ ID NO: 283684 - DNA, 15 bp, Homo sapiens
gggcatgacaaaaca

SEQ ID NO: 283685 - DNA, 15 bp, Homo sapiens
agggcatgacaaaac

SEQ ID NO: 283686 - DNA, 15 bp, Homo sapiens
cagggcatgacaaaa

SEQ ID NO: 283687 - DNA, 15 bp, Homo sapiens
acagggcatgacaaa

SEQ ID NO: 283688 - DNA, 15 bp, Homo sapiens
cacagggcatgacaa

SEQ ID NO: 283689 - DNA, 15 bp, Homo sapiens
tcacagggcatgaca

SEQ ID NO: 283690 - DNA, 15 bp, Homo sapiens
ttcacagggcatgac

SEQ ID NO: 283691 - DNA, 15 bp, Homo sapiens
gttcacagggcatga

SEQ ID NO: 283692 - DNA, 15 bp, Homo sapiens
tgttcacagggcatg

SEQ ID NO: 283693 - DNA, 15 bp, Homo sapiens
gtgttcacagggcat

SEQ ID NO: 283694 - DNA, 15 bp, Homo sapiens
tgtgttcacagggca

SEQ ID NO: 283695 - DNA, 15 bp, Homo sapiens
ctgtgttcacagggc

SEQ ID NO: 283696 - DNA, 15 bp, Homo sapiens
actgtgttcacaggg

SEQ ID NO: 283697 - DNA, 15 bp, Homo sapiens
tactgtgttcacagg

SEQ ID NO: 283698 - DNA, 15 bp, Homo sapiens
ttactgtgttcacag

SEQ ID NO: 283699 - DNA, 15 bp, Homo sapiens
tttactgtgttcaca

SEQ ID NO: 283700 - DNA, 15 bp, Homo sapiens
ctttactgtgttcac

SEQ ID NO: 283701 - DNA, 15 bp, Homo sapiens
cctttactgtgttca

SEQ ID NO: 283702 - DNA, 15 bp, Homo sapiens
acctttactgtgttc

SEQ ID NO: 283703 - DNA, 15 bp, Homo sapiens
tacctttactgtgtt

SEQ ID NO: 283704 - DNA, 15 bp, Homo sapiens
ttacctttactgtgt

SEQ ID NO: 283705 - DNA, 15 bp, Homo sapiens
attacctttactgtg

SEQ ID NO: 283706 - DNA, 15 bp, Homo sapiens
cattacctttactgt

SEQ ID NO: 283707 - DNA, 15 bp, Homo sapiens
gcattacctttactg

SEQ ID NO: 283708 - DNA, 15 bp, Homo sapiens
agcattacctttact

SEQ ID NO: 283709 - DNA, 15 bp, Homo sapiens
gagcattacctttac

SEQ ID NO: 283710 - DNA, 15 bp, Homo sapiens
tgagcattaccttta

SEQ ID NO: 283711 - DNA, 15 bp, Homo sapiens
ttgagcattaccttt

SEQ ID NO: 283712 - DNA, 15 bp, Homo sapiens
tttgagcattacctt

SEQ ID NO: 283713 - DNA, 15 bp, Homo sapiens
atttgagcattacct

SEQ ID NO: 283714 - DNA, 15 bp, Homo sapiens
aatttgagcattacc

SEQ ID NO: 283715 - DNA, 15 bp, Homo sapiens
aaatttgagcattac

SEQ ID NO: 283716 - DNA, 15 bp, Homo sapiens
taaatttgagcatta

SEQ ID NO: 283717 - DNA, 15 bp, Homo sapiens
ctaaatttgagcatt

SEQ ID NO: 283718 - DNA, 15 bp, Homo sapiens
actaaatttgagcat

SEQ ID NO: 283719 - DNA, 15 bp, Homo sapiens
tactaaatttgagca

SEQ ID NO: 283720 - DNA, 15 bp, Homo sapiens
atactaaatttgagc

SEQ ID NO: 283721 - DNA, 15 bp, Homo sapiens
tatactaaatttgag

SEQ ID NO: 283722 - DNA, 15 bp, Homo sapiens
atatactaaatttga

SEQ ID NO: 283723 - DNA, 15 bp, Homo sapiens
aatatactaaatttg

SEQ ID NO: 283724 - DNA, 15 bp, Homo sapiens
caatatactaaattt

SEQ ID NO: 283725 - DNA, 15 bp, Homo sapiens
acaatatactaaatt

SEQ ID NO: 283726 - DNA, 15 bp, Homo sapiens
tacaatatactaaat

SEQ ID NO: 283727 - DNA, 15 bp, Homo sapiens
atacaatatactaaa

SEQ ID NO: 283728 - DNA, 15 bp, Homo sapiens
gatacaatatactaa

SEQ ID NO: 283729 - DNA, 15 bp, Homo sapiens
agatacaatatacta

SEQ ID NO: 283730 - DNA, 15 bp, Homo sapiens
aagatacaatatact

SEQ ID NO: 283731 - DNA, 15 bp, Homo sapiens
taagatacaatatac

SEQ ID NO: 283732 - DNA, 15 bp, Homo sapiens
ttaagatacaatata

SEQ ID NO: 283733 - DNA, 15 bp, Homo sapiens
tttaagatacaatat

SEQ ID NO: 283734 - DNA, 15 bp, Homo sapiens
ttttaagatacaata

SEQ ID NO: 283735 - DNA, 15 bp, Homo sapiens
attttaagatacaat

SEQ ID NO: 283736 - DNA, 15 bp, Homo sapiens
tattttaagatacaa

SEQ ID NO: 283737 - DNA, 15 bp, Homo sapiens
ctattttaagataca

SEQ ID NO: 283738 - DNA, 15 bp, Homo sapiens
cctattttaagatac

SEQ ID NO: 283739 - DNA, 15 bp, Homo sapiens
tcctattttaagata

SEQ ID NO: 283740 - DNA, 15 bp, Homo sapiens
ttcctattttaagat

SEQ ID NO: 283741 - DNA, 15 bp, Homo sapiens
attcctattttaaga

SEQ ID NO: 283742 - DNA, 15 bp, Homo sapiens
tattcctattttaag

SEQ ID NO: 283743 - DNA, 15 bp, Homo sapiens
ttattcctattttaa

SEQ ID NO: 283744 - DNA, 15 bp, Homo sapiens
tttattcctatttta

SEQ ID NO: 283745 - DNA, 15 bp, Homo sapiens
atttattcctatttt

SEQ ID NO: 283746 - DNA, 15 bp, Homo sapiens
tatttattcctattt

SEQ ID NO: 283747 - DNA, 15 bp, Homo sapiens
gtatttattcctatt

SEQ ID NO: 283748 - DNA, 15 bp, Homo sapiens
agtatttattcctat

SEQ ID NO: 283749 - DNA, 15 bp, Homo sapiens
tagtatttattccta

SEQ ID NO: 283750 - DNA, 15 bp, Homo sapiens
atagtatttattcct

SEQ ID NO: 283751 - DNA, 15 bp, Homo sapiens
aatagtatttattcc

SEQ ID NO: 283752 - DNA, 15 bp, Homo sapiens
aaatagtatttattc

SEQ ID NO: 283753 - DNA, 15 bp, Homo sapiens
aaaatagtatttatt

SEQ ID NO: 283754 - DNA, 15 bp, Homo sapiens
gaaaatagtatttat

SEQ ID NO: 283755 - DNA, 15 bp, Homo sapiens
tgaaaatagtattta

SEQ ID NO: 283756 - DNA, 15 bp, Homo sapiens
ctgaaaatagtattt

SEQ ID NO: 283757 - DNA, 15 bp, Homo sapiens
tctgaaaatagtatt

SEQ ID NO: 283758 - DNA, 15 bp, Homo sapiens
atctgaaaatagtat

SEQ ID NO: 283759 - DNA, 15 bp, Homo sapiens
aatctgaaaatagta

SEQ ID NO: 283760 - DNA, 15 bp, Homo sapiens
aaatctgaaaatagt

SEQ ID NO: 283761 - DNA, 15 bp, Homo sapiens
taaatctgaaaatag

SEQ ID NO: 283762 - DNA, 15 bp, Homo sapiens
ctaaatctgaaaata

SEQ ID NO: 283763 - DNA, 15 bp, Homo sapiens
gctaaatctgaaaat

SEQ ID NO: 283764 - DNA, 15 bp, Homo sapiens
tgctaaatctgaaaa

SEQ ID NO: 283765 - DNA, 15 bp, Homo sapiens
gtgctaaatctgaaa

SEQ ID NO: 283766 - DNA, 15 bp, Homo sapiens
agtgctaaatctgaa

SEQ ID NO: 283767 - DNA, 15 bp, Homo sapiens
cagtgctaaatctga

SEQ ID NO: 283768 - DNA, 15 bp, Homo sapiens
acagtgctaaatctg

SEQ ID NO: 283769 - DNA, 15 bp, Homo sapiens
aacagtgctaaatct

SEQ ID NO: 283770 - DNA, 15 bp, Homo sapiens
aaacagtgctaaatc

SEQ ID NO: 283771 - DNA, 15 bp, Homo sapiens
gaaacagtgctaaat

SEQ ID NO: 283772 - DNA, 15 bp, Homo sapiens
tgaaacagtgctaaa

SEQ ID NO: 283773 - DNA, 15 bp, Homo sapiens
ctgaaacagtgctaa

SEQ ID NO: 283774 - DNA, 15 bp, Homo sapiens
tctgaaacagtgcta

SEQ ID NO: 283775 - DNA, 15 bp, Homo sapiens
ttctgaaacagtgct

SEQ ID NO: 283776 - DNA, 15 bp, Homo sapiens
tttctgaaacagtgc

SEQ ID NO: 283777 - DNA, 15 bp, Homo sapiens
ttttctgaaacagtg

SEQ ID NO: 283778 - DNA, 15 bp, Homo sapiens
cttttctgaaacagt

SEQ ID NO: 283779 - DNA, 15 bp, Homo sapiens
tcttttctgaaacag

SEQ ID NO: 283780 - DNA, 15 bp, Homo sapiens
atcttttctgaaaca

SEQ ID NO: 283781 - DNA, 15 bp, Homo sapiens
aatcttttctgaaac

SEQ ID NO: 283782 - DNA, 15 bp, Homo sapiens
taatcttttctgaaa

SEQ ID NO: 283783 - DNA, 15 bp, Homo sapiens
ttaatcttttctgaa

SEQ ID NO: 283784 - DNA, 15 bp, Homo sapiens
gttaatcttttctga

SEQ ID NO: 283785 - DNA, 15 bp, Homo sapiens
tgttaatcttttctg

SEQ ID NO: 283786 - DNA, 15 bp, Homo sapiens
atgttaatcttttct

SEQ ID NO: 283787 - DNA, 15 bp, Homo sapiens
aatgttaatcttttc

SEQ ID NO: 283788 - DNA, 15 bp, Homo sapiens
aaatgttaatctttt

SEQ ID NO: 283789 - DNA, 15 bp, Homo sapiens
aaaatgttaatcttt

SEQ ID NO: 283790 - DNA, 15 bp, Homo sapiens
aaaaatgttaatctt

SEQ ID NO: 283791 - DNA, 15 bp, Homo sapiens
aaaaaatgttaatct

SEQ ID NO: 283792 - DNA, 15 bp, Homo sapiens
taaaaaatgttaatc

SEQ ID NO: 283793 - DNA, 15 bp, Homo sapiens
ttaaaaaatgttaat

SEQ ID NO: 283794 - DNA, 15 bp, Homo sapiens
tttaaaaaatgttaa

SEQ ID NO: 283795 - DNA, 15 bp, Homo sapiens
ttttaaaaaatgtta

SEQ ID NO: 283796 - DNA, 15 bp, Homo sapiens
tttttaaaaaatgtt

SEQ ID NO: 283797 - DNA, 15 bp, Homo sapiens
ctttttaaaaaatgt

SEQ ID NO: 283798 - DNA, 15 bp, Homo sapiens
tctttttaaaaaatg

SEQ ID NO: 283799 - DNA, 15 bp, Homo sapiens
ttcttttctttttaa

SEQ ID NO: 283800 - DNA, 15 bp, Homo sapiens
tttcttttcttttta

SEQ ID NO: 283801 - DNA, 15 bp, Homo sapiens
ttttttcttttcttt

SEQ ID NO: 283802 - DNA, 15 bp, Homo sapiens
cttttttcttttctt

SEQ ID NO: 283803 - DNA, 15 bp, Homo sapiens
acttttttcttttct

SEQ ID NO: 283804 - DNA, 15 bp, Homo sapiens
gacttttttcttttc

SEQ ID NO: 283805 - DNA, 15 bp, Homo sapiens
tgacttttttctttt

SEQ ID NO: 283806 - DNA, 15 bp, Homo sapiens
ctgacttttttcttt

SEQ ID NO: 283807 - DNA, 15 bp, Homo sapiens
tctgacttttttctt

SEQ ID NO: 283808 - DNA, 15 bp, Homo sapiens
ttctgacttttttct

SEQ ID NO: 283809 - DNA, 15 bp, Homo sapiens
cttctgacttttttc

SEQ ID NO: 283810 - DNA, 15 bp, Homo sapiens
tcttctgactttttt

SEQ ID NO: 283811 - DNA, 15 bp, Homo sapiens
atcttctgacttttt

SEQ ID NO: 283812 - DNA, 15 bp, Homo sapiens
aatcttctgactttt

SEQ ID NO: 283813 - DNA, 15 bp, Homo sapiens
taatcttctgacttt

SEQ ID NO: 283814 - DNA, 15 bp, Homo sapiens
ttaatcttctgactt

SEQ ID NO: 283815 - DNA, 15 bp, Homo sapiens
gttaatcttctgact

SEQ ID NO: 283816 - DNA, 15 bp, Homo sapiens
tgttaatcttctgac

SEQ ID NO: 283817 - DNA, 15 bp, Homo sapiens
ctgttaatcttctga

SEQ ID NO: 283818 - DNA, 15 bp, Homo sapiens
actgttaatcttctg

SEQ ID NO: 283819 - DNA, 15 bp, Homo sapiens
gactgttaatcttct

SEQ ID NO: 283820 - DNA, 15 bp, Homo sapiens
tgactgttaatcttc

SEQ ID NO: 283821 - DNA, 15 bp, Homo sapiens
ctgactgttaatctt

SEQ ID NO: 283822 - DNA, 15 bp, Homo sapiens
tctgactgttaatct

SEQ ID NO: 283823 - DNA, 15 bp, Homo sapiens
atctgactgttaatc

SEQ ID NO: 283824 - DNA, 15 bp, Homo sapiens
tatctgactgttaat

SEQ ID NO: 283825 - DNA, 15 bp, Homo sapiens
gtatctgactgttaa

SEQ ID NO: 283826 - DNA, 15 bp, Homo sapiens
tgtatctgactgtta

SEQ ID NO: 283827 - DNA, 15 bp, Homo sapiens
atgtatctgactgtt

SEQ ID NO: 283828 - DNA, 15 bp, Homo sapiens
aatgtatctgactgt

SEQ ID NO: 283829 - DNA, 15 bp, Homo sapiens
aaatgtatctgactg

SEQ ID NO: 283830 - DNA, 15 bp, Homo sapiens
aaaatgtatctgact

SEQ ID NO: 283831 - DNA, 15 bp, Homo sapiens
taaaatgtatctgac

SEQ ID NO: 283832 - DNA, 15 bp, Homo sapiens
ttaaaatgtatctga

SEQ ID NO: 283833 - DNA, 15 bp, Homo sapiens
attaaaatgtatctg

SEQ ID NO: 283834 - DNA, 15 bp, Homo sapiens
tattaaaatgtatct

SEQ ID NO: 283835 - DNA, 15 bp, Homo sapiens
atattaaaatgtatc

SEQ ID NO: 283836 - DNA, 15 bp, Homo sapiens
tatattaaaatgtat

SEQ ID NO: 283837 - DNA, 15 bp, Homo sapiens
gtatattaaaatgta

SEQ ID NO: 283838 - DNA, 15 bp, Homo sapiens
agtatattaaaatgt

SEQ ID NO: 283839 - DNA, 15 bp, Homo sapiens
cagtatattaaaatg

SEQ ID NO: 283840 - DNA, 15 bp, Homo sapiens
acagtatattaaaat

SEQ ID NO: 283841 - DNA, 15 bp, Homo sapiens
gacagtatattaaaa

SEQ ID NO: 283842 - DNA, 15 bp, Homo sapiens
tgacagtatattaaa

SEQ ID NO: 283843 - DNA, 15 bp, Homo sapiens
atgacagtatattaa

SEQ ID NO: 283844 - DNA, 15 bp, Homo sapiens
aatgacagtatatta

SEQ ID NO: 283845 - DNA, 15 bp, Homo sapiens
taatgacagtatatt

SEQ ID NO: 283846 - DNA, 15 bp, Homo sapiens
ataatgacagtatat

SEQ ID NO: 283847 - DNA, 15 bp, Homo sapiens
tataatgacagtata

SEQ ID NO: 283848 - DNA, 15 bp, Homo sapiens
atataatgacagtat

SEQ ID NO: 283849 - DNA, 15 bp, Homo sapiens
tatataatgacagta

SEQ ID NO: 283850 - DNA, 15 bp, Homo sapiens
atatataatgacagt

SEQ ID NO: 283851 - DNA, 15 bp, Homo sapiens
tatatataatgacag

SEQ ID NO: 283852 - DNA, 15 bp, Homo sapiens
atatatataatgaca

SEQ ID NO: 283853 - DNA, 15 bp, Homo sapiens
aatatatataatgac

SEQ ID NO: 283854 - DNA, 15 bp, Homo sapiens
taatatatataatga

SEQ ID NO: 283855 - DNA, 15 bp, Homo sapiens
ttaatatatataatg

SEQ ID NO: 283856 - DNA, 15 bp, Homo sapiens
gttaatatatataat

SEQ ID NO: 283857 - DNA, 15 bp, Homo sapiens
agttaatatatataa

SEQ ID NO: 283858 - DNA, 15 bp, Homo sapiens
gagttaatatatata

SEQ ID NO: 283859 - DNA, 15 bp, Homo sapiens
tgagttaatatatat

SEQ ID NO: 283860 - DNA, 15 bp, Homo sapiens
atgagttaatatata

SEQ ID NO: 283861 - DNA, 15 bp, Homo sapiens
aatgagttaatatat

SEQ ID NO: 283862 - DNA, 15 bp, Homo sapiens
gaatgagttaatata

SEQ ID NO: 283863 - DNA, 15 bp, Homo sapiens
tgaatgagttaatat

SEQ ID NO: 283864 - DNA, 15 bp, Homo sapiens
gtgaatgagttaata

SEQ ID NO: 283865 - DNA, 15 bp, Homo sapiens
ggtgaatgagttaat

SEQ ID NO: 283866 - DNA, 15 bp, Homo sapiens
gggtgaatgagttaa

SEQ ID NO: 283867 - DNA, 15 bp, Homo sapiens
tgggtgaatgagtta

SEQ ID NO: 283868 - DNA, 15 bp, Homo sapiens
atgggtgaatgagtt

SEQ ID NO: 283869 - DNA, 15 bp, Homo sapiens
gatgggtgaatgagt

SEQ ID NO: 283870 - DNA, 15 bp, Homo sapiens
ggatgggtgaatgag

SEQ ID NO: 283871 - DNA, 15 bp, Homo sapiens
tggatgggtgaatga

SEQ ID NO: 283872 - DNA, 15 bp, Homo sapiens
ttggatgggtgaatg

SEQ ID NO: 283873 - DNA, 15 bp, Homo sapiens
gttggatgggtgaat

SEQ ID NO: 283874 - DNA, 15 bp, Homo sapiens
tgttggatgggtgaa

SEQ ID NO: 283875 - DNA, 15 bp, Homo sapiens
ctgttggatgggtga

SEQ ID NO: 283876 - DNA, 15 bp, Homo sapiens
tctgttggatgggtg

SEQ ID NO: 283877 - DNA, 15 bp, Homo sapiens
gtctgttggatgggt

SEQ ID NO: 283878 - DNA, 15 bp, Homo sapiens
tgtctgttggatggg

SEQ ID NO: 283879 - DNA, 15 bp, Homo sapiens
ctgtctgttggatgg

SEQ ID NO: 283880 - DNA, 15 bp, Homo sapiens
actgtctgttggatg

SEQ ID NO: 283881 - DNA, 15 bp, Homo sapiens
aactgtctgttggat

SEQ ID NO: 283882 - DNA, 15 bp, Homo sapiens
caactgtctgttgga

SEQ ID NO: 283883 - DNA, 15 bp, Homo sapiens
acaactgtctgttgg

SEQ ID NO: 283884 - DNA, 15 bp, Homo sapiens
aacaactgtctgttg

SEQ ID NO: 283885 - DNA, 15 bp, Homo sapiens
taacaactgtctgtt

SEQ ID NO: 283886 - DNA, 15 bp, Homo sapiens
ataacaactgtctgt

SEQ ID NO: 283887 - DNA, 15 bp, Homo sapiens
aataacaactgtctg

SEQ ID NO: 283888 - DNA, 15 bp, Homo sapiens
taataacaactgtct

SEQ ID NO: 283889 - DNA, 15 bp, Homo sapiens
ttaataacaactgtc

SEQ ID NO: 283890 - DNA, 15 bp, Homo sapiens
attaataacaactgt

SEQ ID NO: 283891 - DNA, 15 bp, Homo sapiens
tattaataacaactg

SEQ ID NO: 283892 - DNA, 15 bp, Homo sapiens
atattaataacaact

SEQ ID NO: 283893 - DNA, 15 bp, Homo sapiens
tatattaataacaac

SEQ ID NO: 283894 - DNA, 15 bp, Homo sapiens
atatattaataacaa

SEQ ID NO: 283895 - DNA, 15 bp, Homo sapiens
tatatattaataaca

SEQ ID NO: 283896 - DNA, 15 bp, Homo sapiens
gtatatattaataac

SEQ ID NO: 283897 - DNA, 15 bp, Homo sapiens
ggtatatattaataa

SEQ ID NO: 283898 - DNA, 15 bp, Homo sapiens
aggtatatattaata

SEQ ID NO: 283899 - DNA, 15 bp, Homo sapiens
taggtatatattaat

SEQ ID NO: 283900 - DNA, 15 bp, Homo sapiens
gtaggtatatattaa

SEQ ID NO: 283901 - DNA, 15 bp, Homo sapiens
ggtaggtatatatta

SEQ ID NO: 283902 - DNA, 15 bp, Homo sapiens
tggtaggtatatatt

SEQ ID NO: 283903 - DNA, 15 bp, Homo sapiens
atggtaggtatatat

SEQ ID NO: 283904 - DNA, 15 bp, Homo sapiens
catggtaggtatata

SEQ ID NO: 283905 - DNA, 15 bp, Homo sapiens
acatggtaggtatat

SEQ ID NO: 283906 - DNA, 15 bp, Homo sapiens
tacatggtaggtata

SEQ ID NO: 283907 - DNA, 15 bp, Homo sapiens
ttacatggtaggtat

SEQ ID NO: 283908 - DNA, 15 bp, Homo sapiens
attacatggtaggta

SEQ ID NO: 283909 - DNA, 15 bp, Homo sapiens
cattacatggtaggt

SEQ ID NO: 283910 - DNA, 15 bp, Homo sapiens
ccattacatggtagg

SEQ ID NO: 283911 - DNA, 15 bp, Homo sapiens
accattacatggtag

SEQ ID NO: 283912 - DNA, 15 bp, Homo sapiens
taccattacatggta

SEQ ID NO: 283913 - DNA, 15 bp, Homo sapiens
ataccattacatggt

SEQ ID NO: 283914 - DNA, 15 bp, Homo sapiens
cataccattacatgg

SEQ ID NO: 283915 - DNA, 15 bp, Homo sapiens
gcataccattacatg

SEQ ID NO: 283916 - DNA, 15 bp, Homo sapiens
agcataccattacat

SEQ ID NO: 283917 - DNA, 15 bp, Homo sapiens
cagcataccattaca

SEQ ID NO: 283918 - DNA, 15 bp, Homo sapiens
ccagcataccattac

SEQ ID NO: 283919 - DNA, 15 bp, Homo sapiens
tccagcataccatta

SEQ ID NO: 283920 - DNA, 15 bp, Homo sapiens
ctccagcataccatt

SEQ ID NO: 283921 - DNA, 15 bp, Homo sapiens
gctccagcataccat

SEQ ID NO: 283922 - DNA, 15 bp, Homo sapiens
ggctccagcatacca

SEQ ID NO: 283923 - DNA, 15 bp, Homo sapiens
tggctccagcatacc

SEQ ID NO: 283924 - DNA, 15 bp, Homo sapiens
ttggctccagcatac

SEQ ID NO: 283925 - DNA, 15 bp, Homo sapiens
attggctccagcata

SEQ ID NO: 283926 - DNA, 15 bp, Homo sapiens
aattggctccagcat

SEQ ID NO: 283927 - DNA, 15 bp, Homo sapiens
caattggctccagca

SEQ ID NO: 283928 - DNA, 15 bp, Homo sapiens
acaattggctccagc

SEQ ID NO: 283929 - DNA, 15 bp, Homo sapiens
cacaattggctccag

SEQ ID NO: 283930 - DNA, 15 bp, Homo sapiens
tcacaattggctcca

SEQ ID NO: 283931 - DNA, 15 bp, Homo sapiens
ctcacaattggctcc

SEQ ID NO: 283932 - DNA, 15 bp, Homo sapiens
tctcacaattggctc

SEQ ID NO: 283933 - DNA, 15 bp, Homo sapiens
ctctcacaattggct

SEQ ID NO: 283934 - DNA, 15 bp, Homo sapiens
gctctcacaattggc

SEQ ID NO: 283935 - DNA, 15 bp, Homo sapiens
agctctcacaattgg

SEQ ID NO: 283936 - DNA, 15 bp, Homo sapiens
cagctctcacaattg

SEQ ID NO: 283937 - DNA, 15 bp, Homo sapiens
tcagctctcacaatt

SEQ ID NO: 283938 - DNA, 15 bp, Homo sapiens
atcagctctcacaat

SEQ ID NO: 283939 - DNA, 15 bp, Homo sapiens
aatcagctctcacaa

SEQ ID NO: 283940 - DNA, 15 bp, Homo sapiens
caatcagctctcaca

SEQ ID NO: 283941 - DNA, 15 bp, Homo sapiens
acaatcagctctcac

SEQ ID NO: 283942 - DNA, 15 bp, Homo sapiens
aacaatcagctctca

SEQ ID NO: 283943 - DNA, 15 bp, Homo sapiens
taacaatcagctctc

SEQ ID NO: 283944 - DNA, 15 bp, Homo sapiens
gtaacaatcagctct

SEQ ID NO: 283945 - DNA, 15 bp, Homo sapiens
tgtaacaatcagctc

SEQ ID NO: 283946 - DNA, 15 bp, Homo sapiens
atgtaacaatcagct

SEQ ID NO: 283947 - DNA, 15 bp, Homo sapiens
aatgtaacaatcagc

SEQ ID NO: 283948 - DNA, 15 bp, Homo sapiens
aaatgtaacaatcag

SEQ ID NO: 283949 - DNA, 15 bp, Homo sapiens
aaaatgtaacaatca

SEQ ID NO: 283950 - DNA, 15 bp, Homo sapiens
gaaaatgtaacaatc

SEQ ID NO: 283951 - DNA, 15 bp, Homo sapiens
tgaaaatgtaacaat

SEQ ID NO: 283952 - DNA, 15 bp, Homo sapiens
ctgaaaatgtaacaa

SEQ ID NO: 283953 - DNA, 15 bp, Homo sapiens
cctgaaaatgtaaca

SEQ ID NO: 283954 - DNA, 15 bp, Homo sapiens
tcctgaaaatgtaac

SEQ ID NO: 283955 - DNA, 15 bp, Homo sapiens
atcctgaaaatgtaa

SEQ ID NO: 283956 - DNA, 15 bp, Homo sapiens
catcctgaaaatgta

SEQ ID NO: 283957 - DNA, 15 bp, Homo sapiens
acatcctgaaaatgt

SEQ ID NO: 283958 - DNA, 15 bp, Homo sapiens
aacatcctgaaaatg

SEQ ID NO: 283959 - DNA, 15 bp, Homo sapiens
aaacatcctgaaaat

SEQ ID NO: 283960 - DNA, 15 bp, Homo sapiens
caaacatcctgaaaa

SEQ ID NO: 283961 - DNA, 15 bp, Homo sapiens
acaaacatcctgaaa

SEQ ID NO: 283962 - DNA, 15 bp, Homo sapiens
tacaaacatcctgaa

SEQ ID NO: 283963 - DNA, 15 bp, Homo sapiens
ttacaaacatcctga

SEQ ID NO: 283964 - DNA, 15 bp, Homo sapiens
cttacaaacatcctg

SEQ ID NO: 283965 - DNA, 15 bp, Homo sapiens
gcttacaaacatcct

SEQ ID NO: 283966 - DNA, 15 bp, Homo sapiens
agcttacaaacatcc

SEQ ID NO: 283967 - DNA, 15 bp, Homo sapiens
cagcttacaaacatc

SEQ ID NO: 283968 - DNA, 15 bp, Homo sapiens
acagcttacaaacat

SEQ ID NO: 283969 - DNA, 15 bp, Homo sapiens
aacagcttacaaaca

SEQ ID NO: 283970 - DNA, 15 bp, Homo sapiens
taacagcttacaaac

SEQ ID NO: 283971 - DNA, 15 bp, Homo sapiens
ttaacagcttacaaa

SEQ ID NO: 283972 - DNA, 15 bp, Homo sapiens
tttaacagcttacaa

SEQ ID NO: 283973 - DNA, 15 bp, Homo sapiens
gtttaacagcttaca

SEQ ID NO: 283974 - DNA, 15 bp, Homo sapiens
tgtttaacagcttac

SEQ ID NO: 283975 - DNA, 15 bp, Homo sapiens
ctgtttaacagctta

SEQ ID NO: 283976 - DNA, 15 bp, Homo sapiens
tctgtttaacagctt

SEQ ID NO: 283977 - DNA, 15 bp, Homo sapiens
ctctgtttaacagct

SEQ ID NO: 283978 - DNA, 15 bp, Homo sapiens
gctctgtttaacagc

SEQ ID NO: 283979 - DNA, 15 bp, Homo sapiens
ggctctgtttaacag

SEQ ID NO: 283980 - DNA, 15 bp, Homo sapiens
aggctctgtttaaca

SEQ ID NO: 283981 - DNA, 15 bp, Homo sapiens
aaggctctgtttaac

SEQ ID NO: 283982 - DNA, 15 bp, Homo sapiens
aaaggctctgtttaa

SEQ ID NO: 283983 - DNA, 15 bp, Homo sapiens
aaaaggctctgttta

SEQ ID NO: 283984 - DNA, 15 bp, Homo sapiens
aaaaaggctctgttt

SEQ ID NO: 283985 - DNA, 15 bp, Homo sapiens
taaaaaggctctgtt

SEQ ID NO: 283986 - DNA, 15 bp, Homo sapiens
ttaaaaaggctctgt

SEQ ID NO: 283987 - DNA, 15 bp, Homo sapiens
tttaaaaaggctctg

SEQ ID NO: 283988 - DNA, 15 bp, Homo sapiens
ttttaaaaaggctct

SEQ ID NO: 283989 - DNA, 15 bp, Homo sapiens
tttttaaaaaggctc

SEQ ID NO: 283990 - DNA, 15 bp, Homo sapiens
atttttaaaaaggct

SEQ ID NO: 283991 - DNA, 15 bp, Homo sapiens
tatttttaaaaaggc

SEQ ID NO: 283992 - DNA, 15 bp, Homo sapiens
ttatttttaaaaagg

SEQ ID NO: 283993 - DNA, 15 bp, Homo sapiens
attatttttaaaaag

SEQ ID NO: 283994 - DNA, 15 bp, Homo sapiens
aattatttttaaaaa

SEQ ID NO: 283995 - DNA, 15 bp, Homo sapiens
aaattatttttaaaa

SEQ ID NO: 283996 - DNA, 15 bp, Homo sapiens
taaattatttttaaa

SEQ ID NO: 283997 - DNA, 15 bp, Homo sapiens
ataaattatttttaa

SEQ ID NO: 283998 - DNA, 15 bp, Homo sapiens
tataaattattttta

SEQ ID NO: 283999 - DNA, 15 bp, Homo sapiens
atataaattattttt

SEQ ID NO: 284000 - DNA, 15 bp, Homo sapiens
tatataaattatttt

SEQ ID NO: 284001 - DNA, 15 bp, Homo sapiens
gtatataaattattt

SEQ ID NO: 284002 - DNA, 15 bp, Homo sapiens
tgtatataaattatt

SEQ ID NO: 284003 - DNA, 15 bp, Homo sapiens
atgtatataaattat

SEQ ID NO: 284004 - DNA, 15 bp, Homo sapiens
catgtatataaatta

SEQ ID NO: 284005 - DNA, 15 bp, Homo sapiens
acatgtatataaatt

SEQ ID NO: 284006 - DNA, 15 bp, Homo sapiens
tacatgtatataaat

SEQ ID NO: 284007 - DNA, 15 bp, Homo sapiens
atacatgtatataaa

SEQ ID NO: 284008 - DNA, 15 bp, Homo sapiens
tatacatgtatataa

SEQ ID NO: 284009 - DNA, 15 bp, Homo sapiens
gtatatacatgtata

SEQ ID NO: 284010 - DNA, 15 bp, Homo sapiens
tgtatatacatgtat

SEQ ID NO: 284011 - DNA, 15 bp, Homo sapiens
ctgtatatacatgta

SEQ ID NO: 284012 - DNA, 15 bp, Homo sapiens
actgtatatacatgt

SEQ ID NO: 284013 - DNA, 15 bp, Homo sapiens
aactgtatatacatg

SEQ ID NO: 284014 - DNA, 15 bp, Homo sapiens
taactgtatatacat

SEQ ID NO: 284015 - DNA, 15 bp, Homo sapiens
gtaactgtatataca

SEQ ID NO: 284016 - DNA, 15 bp, Homo sapiens
tgtaactgtatatac

SEQ ID NO: 284017 - DNA, 15 bp, Homo sapiens
ttgtaactgtatata

SEQ ID NO: 284018 - DNA, 15 bp, Homo sapiens
attgtaactgtatat

SEQ ID NO: 284019 - DNA, 15 bp, Homo sapiens
aattgtaactgtata

SEQ ID NO: 284020 - DNA, 15 bp, Homo sapiens
taattgtaactgtat

SEQ ID NO: 284021 - DNA, 15 bp, Homo sapiens
ttaattgtaactgta

SEQ ID NO: 284022 - DNA, 15 bp, Homo sapiens
tttaattgtaactgt

SEQ ID NO: 284023 - DNA, 15 bp, Homo sapiens
atttaattgtaactg

SEQ ID NO: 284024 - DNA, 15 bp, Homo sapiens
tatttaattgtaact

SEQ ID NO: 284025 - DNA, 15 bp, Homo sapiens
ttatttaattgtaac

SEQ ID NO: 284026 - DNA, 15 bp, Homo sapiens
tttatttaattgtaa

SEQ ID NO: 284027 - DNA, 15 bp, Homo sapiens
atttatttaattgta

SEQ ID NO: 284028 - DNA, 15 bp, Homo sapiens
aatttatttaattgt

SEQ ID NO: 284029 - DNA, 15 bp, Homo sapiens
taatttatttaattg

SEQ ID NO: 284030 - DNA, 15 bp, Homo sapiens
ctaatttatttaatt

SEQ ID NO: 284031 - DNA, 15 bp, Homo sapiens
tctaatttatttaat

SEQ ID NO: 284032 - DNA, 15 bp, Homo sapiens
atctaatttatttaa

SEQ ID NO: 284033 - DNA, 15 bp, Homo sapiens
aatctaatttattta

SEQ ID NO: 284034 - DNA, 15 bp, Homo sapiens
taatctaatttattt

SEQ ID NO: 284035 - DNA, 15 bp, Homo sapiens
ttaatctaatttatt

SEQ ID NO: 284036 - DNA, 15 bp, Homo sapiens
tttaatctaatttat

SEQ ID NO: 284037 - DNA, 15 bp, Homo sapiens
ttttaatctaattta

SEQ ID NO: 284038 - DNA, 15 bp, Homo sapiens
gttttaatctaattt

SEQ ID NO: 284039 - DNA, 15 bp, Homo sapiens
tgttttaatctaatt

SEQ ID NO: 284040 - DNA, 15 bp, Homo sapiens
ttgttttaatctaat

SEQ ID NO: 284041 - DNA, 15 bp, Homo sapiens
tttgttttaatctaa

SEQ ID NO: 284042 - DNA, 15 bp, Homo sapiens
ttttgttttaatcta

SEQ ID NO: 284043 - DNA, 15 bp, Homo sapiens
tttttgttttaatct

SEQ ID NO: 284044 - DNA, 15 bp, Homo sapiens
gtttttgttttaatc

SEQ ID NO: 284045 - DNA, 15 bp, Homo sapiens
tgtttttgttttaat

SEQ ID NO: 284046 - DNA, 15 bp, Homo sapiens
ttgtttttgttttaa

SEQ ID NO: 284047 - DNA, 15 bp, Homo sapiens
acttttgtttttgtt

SEQ ID NO: 284048 - DNA, 15 bp, Homo sapiens
tacttttgtttttgt

SEQ ID NO: 284049 - DNA, 15 bp, Homo sapiens
ttacttttgtttttg

SEQ ID NO: 284050 - DNA, 15 bp, Homo sapiens
attacttttgttttt

SEQ ID NO: 284051 - DNA, 15 bp, Homo sapiens
aattacttttgtttt

SEQ ID NO: 284052 - DNA, 15 bp, Homo sapiens
gaattacttttgttt

SEQ ID NO: 284053 - DNA, 15 bp, Homo sapiens
agaattacttttgtt

SEQ ID NO: 284054 - DNA, 15 bp, Homo sapiens
gagaattacttttgt

SEQ ID NO: 284055 - DNA, 15 bp, Homo sapiens
tgagaattacttttg

SEQ ID NO: 284056 - DNA, 15 bp, Homo sapiens
ttgagaattactttt

SEQ ID NO: 284057 - DNA, 15 bp, Homo sapiens
tttgagaattacttt

SEQ ID NO: 284058 - DNA, 15 bp, Homo sapiens
ttttgagaattactt

SEQ ID NO: 284059 - DNA, 15 bp, Homo sapiens
gttttgagaattact

SEQ ID NO: 284060 - DNA, 15 bp, Homo sapiens
agttttgagaattac

SEQ ID NO: 284061 - DNA, 15 bp, Homo sapiens
gagttttgagaatta

SEQ ID NO: 284062 - DNA, 15 bp, Homo sapiens
tgagttttgagaatt

SEQ ID NO: 284063 - DNA, 15 bp, Homo sapiens
atgagttttgagaat

SEQ ID NO: 284064 - DNA, 15 bp, Homo sapiens
gatgagttttgagaa

SEQ ID NO: 284065 - DNA, 15 bp, Homo sapiens
tgatgagttttgaga

SEQ ID NO: 284066 - DNA, 15 bp, Homo sapiens
gtgatgagttttgag

SEQ ID NO: 284067 - DNA, 15 bp, Homo sapiens
tgtgatgagttttga

SEQ ID NO: 284068 - DNA, 15 bp, Homo sapiens
gtgtgatgagttttg

SEQ ID NO: 284069 - DNA, 15 bp, Homo sapiens
ggtgtgatgagtttt

SEQ ID NO: 284070 - DNA, 15 bp, Homo sapiens
gggtgtgatgagttt

SEQ ID NO: 284071 - DNA, 15 bp, Homo sapiens
agggtgtgatgagtt

SEQ ID NO: 284072 - DNA, 15 bp, Homo sapiens
tagggtgtgatgagt

SEQ ID NO: 284073 - DNA, 15 bp, Homo sapiens
ttagggtgtgatgag

SEQ ID NO: 284074 - DNA, 15 bp, Homo sapiens
attagggtgtgatga

SEQ ID NO: 284075 - DNA, 15 bp, Homo sapiens
cattagggtgtgatg

SEQ ID NO: 284076 - DNA, 15 bp, Homo sapiens
tcattagggtgtgat

SEQ ID NO: 284077 - DNA, 15 bp, Homo sapiens
atcattagggtgtga

SEQ ID NO: 284078 - DNA, 15 bp, Homo sapiens
aatcattagggtgtg

SEQ ID NO: 284079 - DNA, 15 bp, Homo sapiens
aaatcattagggtgt

SEQ ID NO: 284080 - DNA, 15 bp, Homo sapiens
aaaatcattagggtg

SEQ ID NO: 284081 - DNA, 15 bp, Homo sapiens
taaaatcattagggt

SEQ ID NO: 284082 - DNA, 15 bp, Homo sapiens
gtaaaatcattaggg

SEQ ID NO: 284083 - DNA, 15 bp, Homo sapiens
agtaaaatcattagg

SEQ ID NO: 284084 - DNA, 15 bp, Homo sapiens
aagtaaaatcattag

SEQ ID NO: 284085 - DNA, 15 bp, Homo sapiens
gaagtaaaatcatta

SEQ ID NO: 284086 - DNA, 15 bp, Homo sapiens
tgaagtaaaatcatt

SEQ ID NO: 284087 - DNA, 15 bp, Homo sapiens
atgaagtaaaatcat

SEQ ID NO: 284088 - DNA, 15 bp, Homo sapiens
aatgaagtaaaatca

SEQ ID NO: 284089 - DNA, 15 bp, Homo sapiens
aaatgaagtaaaatc

SEQ ID NO: 284090 - DNA, 15 bp, Homo sapiens
gaaatgaagtaaaat

SEQ ID NO: 284091 - DNA, 15 bp, Homo sapiens
tgaaatgaagtaaaa

SEQ ID NO: 284092 - DNA, 15 bp, Homo sapiens
gtgaaatgaagtaaa

SEQ ID NO: 284093 - DNA, 15 bp, Homo sapiens
agtgaaatgaagtaa

SEQ ID NO: 284094 - DNA, 15 bp, Homo sapiens
tagtgaaatgaagta

SEQ ID NO: 284095 - DNA, 15 bp, Homo sapiens
ttagtgaaatgaagt

SEQ ID NO: 284096 - DNA, 15 bp, Homo sapiens
attagtgaaatgaag

SEQ ID NO: 284097 - DNA, 15 bp, Homo sapiens
tattagtgaaatgaa

SEQ ID NO: 284098 - DNA, 15 bp, Homo sapiens
atattagtgaaatga

SEQ ID NO: 284099 - DNA, 15 bp, Homo sapiens
gatattagtgaaatg

SEQ ID NO: 284100 - DNA, 15 bp, Homo sapiens
agatattagtgaaat

SEQ ID NO: 284101 - DNA, 15 bp, Homo sapiens
tagatattagtgaaa

SEQ ID NO: 284102 - DNA, 15 bp, Homo sapiens
atagatattagtgaa

SEQ ID NO: 284103 - DNA, 15 bp, Homo sapiens
catagatattagtga

SEQ ID NO: 284104 - DNA, 15 bp, Homo sapiens
gcatagatattagtg

SEQ ID NO: 284105 - DNA, 15 bp, Homo sapiens
ggcatagatattagt

SEQ ID NO: 284106 - DNA, 15 bp, Homo sapiens
gggcatagatattag

SEQ ID NO: 284107 - DNA, 15 bp, Homo sapiens
agggcatagatatta

SEQ ID NO: 284108 - DNA, 15 bp, Homo sapiens
aagggcatagatatt

SEQ ID NO: 284109 - DNA, 15 bp, Homo sapiens
caagggcatagatat

SEQ ID NO: 284110 - DNA, 15 bp, Homo sapiens
ccaagggcatagata

SEQ ID NO: 284111 - DNA, 15 bp, Homo sapiens
cccaagggcatagat

SEQ ID NO: 284112 - DNA, 15 bp, Homo sapiens
tcccaagggcataga

SEQ ID NO: 284113 - DNA, 15 bp, Homo sapiens
atcccaagggcatag

SEQ ID NO: 284114 - DNA, 15 bp, Homo sapiens
aatcccaagggcata

SEQ ID NO: 284115 - DNA, 15 bp, Homo sapiens
taatcccaagggcat

SEQ ID NO: 284116 - DNA, 15 bp, Homo sapiens
ataatcccaagggca

SEQ ID NO: 284117 - DNA, 15 bp, Homo sapiens
aataatcccaagggc

SEQ ID NO: 284118 - DNA, 15 bp, Homo sapiens
aaataatcccaaggg

SEQ ID NO: 284119 - DNA, 15 bp, Homo sapiens
taaataatcccaagg

SEQ ID NO: 284120 - DNA, 15 bp, Homo sapiens
ataaataatcccaag

SEQ ID NO: 284121 - DNA, 15 bp, Homo sapiens
aataaataatcccaa

SEQ ID NO: 284122 - DNA, 15 bp, Homo sapiens
taataaataatccca

SEQ ID NO: 284123 - DNA, 15 bp, Homo sapiens
ataataaataatccc

SEQ ID NO: 284124 - DNA, 15 bp, Homo sapiens
tataataaataatcc

SEQ ID NO: 284125 - DNA, 15 bp, Homo sapiens
ttataataaataatc

SEQ ID NO: 284126 - DNA, 15 bp, Homo sapiens
tttataataaataat

SEQ ID NO: 284127 - DNA, 15 bp, Homo sapiens
gtttataataaataa

SEQ ID NO: 284128 - DNA, 15 bp, Homo sapiens
agtttataataaata

SEQ ID NO: 284129 - DNA, 15 bp, Homo sapiens
aagtttataataaat

SEQ ID NO: 284130 - DNA, 15 bp, Homo sapiens
caagtttataataaa

SEQ ID NO: 284131 - DNA, 15 bp, Homo sapiens
acaagtttataataa

SEQ ID NO: 284132 - DNA, 15 bp, Homo sapiens
gacaagtttataata

SEQ ID NO: 284133 - DNA, 15 bp, Homo sapiens
ggacaagtttataat

SEQ ID NO: 284134 - DNA, 15 bp, Homo sapiens
tggacaagtttataa

SEQ ID NO: 284135 - DNA, 15 bp, Homo sapiens
atggacaagtttata

SEQ ID NO: 284136 - DNA, 15 bp, Homo sapiens
gatggacaagtttat

SEQ ID NO: 284137 - DNA, 15 bp, Homo sapiens
ggatggacaagttta

SEQ ID NO: 284138 - DNA, 15 bp, Homo sapiens
aggatggacaagttt

SEQ ID NO: 284139 - DNA, 15 bp, Homo sapiens
caggatggacaagtt

SEQ ID NO: 284140 - DNA, 15 bp, Homo sapiens
gcaggatggacaagt

SEQ ID NO: 284141 - DNA, 15 bp, Homo sapiens
tgcaggatggacaag

SEQ ID NO: 284142 - DNA, 15 bp, Homo sapiens
ttgcaggatggacaa

SEQ ID NO: 284143 - DNA, 15 bp, Homo sapiens
gttgcaggatggaca

SEQ ID NO: 284144 - DNA, 15 bp, Homo sapiens
ggttgcaggatggac

SEQ ID NO: 284145 - DNA, 15 bp, Homo sapiens
gggttgcaggatgga

SEQ ID NO: 284146 - DNA, 15 bp, Homo sapiens
tgggttgcaggatgg

SEQ ID NO: 284147 - DNA, 15 bp, Homo sapiens
gtgggttgcaggatg

SEQ ID NO: 284148 - DNA, 15 bp, Homo sapiens
tgtgggttgcaggat

SEQ ID NO: 284149 - DNA, 15 bp, Homo sapiens
ctgtgggttgcagga

SEQ ID NO: 284150 - DNA, 15 bp, Homo sapiens
cctgtgggttgcagg

SEQ ID NO: 284151 - DNA, 15 bp, Homo sapiens
gcctgtgggttgcag

SEQ ID NO: 284152 - DNA, 15 bp, Homo sapiens
ggcctgtgggttgca

SEQ ID NO: 284153 - DNA, 15 bp, Homo sapiens
tggcctgtgggttgc

SEQ ID NO: 284154 - DNA, 15 bp, Homo sapiens
gtggcctgtgggttg

SEQ ID NO: 284155 - DNA, 15 bp, Homo sapiens
tgtggcctgtgggtt

SEQ ID NO: 284156 - DNA, 15 bp, Homo sapiens
atgtggcctgtgggt

SEQ ID NO: 284157 - DNA, 15 bp, Homo sapiens
catgtggcctgtggg

SEQ ID NO: 284158 - DNA, 15 bp, Homo sapiens
acatgtggcctgtgg

SEQ ID NO: 284159 - DNA, 15 bp, Homo sapiens
cacatgtggcctgtg

SEQ ID NO: 284160 - DNA, 15 bp, Homo sapiens
ccacatgtggcctgt

SEQ ID NO: 284161 - DNA, 15 bp, Homo sapiens
gccacatgtggcctg

SEQ ID NO: 284162 - DNA, 15 bp, Homo sapiens
ggccacatgtggcct

SEQ ID NO: 284163 - DNA, 15 bp, Homo sapiens
gggccacatgtggcc

SEQ ID NO: 284164 - DNA, 15 bp, Homo sapiens
tgggccacatgtggc

SEQ ID NO: 284165 - DNA, 15 bp, Homo sapiens
ctgggccacatgtgg

SEQ ID NO: 284166 - DNA, 15 bp, Homo sapiens
cctgggccacatgtg

SEQ ID NO: 284167 - DNA, 15 bp, Homo sapiens
tcctgggccacatgt

SEQ ID NO: 284168 - DNA, 15 bp, Homo sapiens
gtcctgggccacatg

SEQ ID NO: 284169 - DNA, 15 bp, Homo sapiens
tgtcctgggccacat

SEQ ID NO: 284170 - DNA, 15 bp, Homo sapiens
ctgtcctgggccaca

SEQ ID NO: 284171 - DNA, 15 bp, Homo sapiens
gctgtcctgggccac

SEQ ID NO: 284172 - DNA, 15 bp, Homo sapiens
agctgtcctgggcca

SEQ ID NO: 284173 - DNA, 15 bp, Homo sapiens
aagctgtcctgggcc

SEQ ID NO: 284174 - DNA, 15 bp, Homo sapiens
aaagctgtcctgggc

SEQ ID NO: 284175 - DNA, 15 bp, Homo sapiens
caaagctgtcctggg

SEQ ID NO: 284176 - DNA, 15 bp, Homo sapiens
tcaaagctgtcctgg

SEQ ID NO: 284177 - DNA, 15 bp, Homo sapiens
ttcaaagctgtcctg

SEQ ID NO: 284178 - DNA, 15 bp, Homo sapiens
attcaaagctgtcct

SEQ ID NO: 284179 - DNA, 15 bp, Homo sapiens
cattcaaagctgtcc

SEQ ID NO: 284180 - DNA, 15 bp, Homo sapiens
gcattcaaagctgtc

SEQ ID NO: 284181 - DNA, 15 bp, Homo sapiens
tgcattcaaagctgt

SEQ ID NO: 284182 - DNA, 15 bp, Homo sapiens
ctgcattcaaagctg

SEQ ID NO: 284183 - DNA, 15 bp, Homo sapiens
gctgcattcaaagct

SEQ ID NO: 284184 - DNA, 15 bp, Homo sapiens
ggctgcattcaaagc

SEQ ID NO: 284185 - DNA, 15 bp, Homo sapiens
gggctgcattcaaag

SEQ ID NO: 284186 - DNA, 15 bp, Homo sapiens
tgggctgcattcaaa

SEQ ID NO: 284187 - DNA, 15 bp, Homo sapiens
ttgggctgcattcaa

SEQ ID NO: 284188 - DNA, 15 bp, Homo sapiens
gttgggctgcattca

SEQ ID NO: 284189 - DNA, 15 bp, Homo sapiens
tgttgggctgcattc

SEQ ID NO: 284190 - DNA, 15 bp, Homo sapiens
gtgttgggctgcatt

SEQ ID NO: 284191 - DNA, 15 bp, Homo sapiens
tgtgttgggctgcat

SEQ ID NO: 284192 - DNA, 15 bp, Homo sapiens
ttgtgttgggctgca

SEQ ID NO: 284193 - DNA, 15 bp, Homo sapiens
tttgtgttgggctgc

SEQ ID NO: 284194 - DNA, 15 bp, Homo sapiens
atttgtgttgggctg

SEQ ID NO: 284195 - DNA, 15 bp, Homo sapiens
aatttgtgttgggct

SEQ ID NO: 284196 - DNA, 15 bp, Homo sapiens
gaatttgtgttgggc

SEQ ID NO: 284197 - DNA, 15 bp, Homo sapiens
tgaatttgtgttggg

SEQ ID NO: 284198 - DNA, 15 bp, Homo sapiens
atgaatttgtgttgg

SEQ ID NO: 284199 - DNA, 15 bp, Homo sapiens
tatgaatttgtgttg

SEQ ID NO: 284200 - DNA, 15 bp, Homo sapiens
ttatgaatttgtgtt

SEQ ID NO: 284201 - DNA, 15 bp, Homo sapiens
tttatgaatttgtgt

SEQ ID NO: 284202 - DNA, 15 bp, Homo sapiens
gtttatgaatttgtg

SEQ ID NO: 284203 - DNA, 15 bp, Homo sapiens
agtttatgaatttgt

SEQ ID NO: 284204 - DNA, 15 bp, Homo sapiens
aagtttatgaatttg

SEQ ID NO: 284205 - DNA, 15 bp, Homo sapiens
aaagtttatgaattt

SEQ ID NO: 284206 - DNA, 15 bp, Homo sapiens
gaaagtttatgaatt

SEQ ID NO: 284207 - DNA, 15 bp, Homo sapiens
agaaagtttatgaat

SEQ ID NO: 284208 - DNA, 15 bp, Homo sapiens
cagaaagtttatgaa

SEQ ID NO: 284209 - DNA, 15 bp, Homo sapiens
tcagaaagtttatga

SEQ ID NO: 284210 - DNA, 15 bp, Homo sapiens
ttcagaaagtttatg

SEQ ID NO: 284211 - DNA, 15 bp, Homo sapiens
tttcagaaagtttat

SEQ ID NO: 284212 - DNA, 15 bp, Homo sapiens
ttttcagaaagttta

SEQ ID NO: 284213 - DNA, 15 bp, Homo sapiens
gttttcagaaagttt

SEQ ID NO: 284214 - DNA, 15 bp, Homo sapiens
tgttttcagaaagtt

SEQ ID NO: 284215 - DNA, 15 bp, Homo sapiens
atgttttcagaaagt

SEQ ID NO: 284216 - DNA, 15 bp, Homo sapiens
aatgttttcagaaag

SEQ ID NO: 284217 - DNA, 15 bp, Homo sapiens
taatgttttcagaaa

SEQ ID NO: 284218 - DNA, 15 bp, Homo sapiens
ataatgttttcagaa

SEQ ID NO: 284219 - DNA, 15 bp, Homo sapiens
tataatgttttcaga

SEQ ID NO: 284220 - DNA, 15 bp, Homo sapiens
ttataatgttttcag

SEQ ID NO: 284221 - DNA, 15 bp, Homo sapiens
cttataatgttttca

SEQ ID NO: 284222 - DNA, 15 bp, Homo sapiens
tcttataatgttttc

SEQ ID NO: 284223 - DNA, 15 bp, Homo sapiens
atcttataatgtttt

SEQ ID NO: 284224 - DNA, 15 bp, Homo sapiens
aatcttataatgttt

SEQ ID NO: 284225 - DNA, 15 bp, Homo sapiens
aaatcttataatgtt

SEQ ID NO: 284226 - DNA, 15 bp, Homo sapiens
caaatcttataatgt

SEQ ID NO: 284227 - DNA, 15 bp, Homo sapiens
acaaatcttataatg

SEQ ID NO: 284228 - DNA, 15 bp, Homo sapiens
gacaaatcttataat

SEQ ID NO: 284229 - DNA, 15 bp, Homo sapiens
agacaaatcttataa

SEQ ID NO: 284230 - DNA, 15 bp, Homo sapiens
cagacaaatcttata

SEQ ID NO: 284231 - DNA, 15 bp, Homo sapiens
acagacaaatcttat

SEQ ID NO: 284232 - DNA, 15 bp, Homo sapiens
cacagacaaatctta

SEQ ID NO: 284233 - DNA, 15 bp, Homo sapiens
tcacagacaaatctt

SEQ ID NO: 284234 - DNA, 15 bp, Homo sapiens
atcacagacaaatct

SEQ ID NO: 284235 - DNA, 15 bp, Homo sapiens
aatcacagacaaatc

SEQ ID NO: 284236 - DNA, 15 bp, Homo sapiens
aaatcacagacaaat

SEQ ID NO: 284237 - DNA, 15 bp, Homo sapiens
caaatcacagacaaa

SEQ ID NO: 284238 - DNA, 15 bp, Homo sapiens
acaaatcacagacaa

SEQ ID NO: 284239 - DNA, 15 bp, Homo sapiens
aacaaatcacagaca

SEQ ID NO: 284240 - DNA, 15 bp, Homo sapiens
aaacaaatcacagac

SEQ ID NO: 284241 - DNA, 15 bp, Homo sapiens
aaaacaaatcacaga

SEQ ID NO: 284242 - DNA, 15 bp, Homo sapiens
aaaaacaaatcacag

SEQ ID NO: 284243 - DNA, 15 bp, Homo sapiens
aaaaaacaaatcaca

SEQ ID NO: 284244 - DNA, 15 bp, Homo sapiens
caaaaaacaaatcac

SEQ ID NO: 284245 - DNA, 15 bp, Homo sapiens
acaaaaaacaaatca

SEQ ID NO: 284246 - DNA, 15 bp, Homo sapiens
aacaaaaaacaaatc

SEQ ID NO: 284247 - DNA, 15 bp, Homo sapiens
aaacaaaaaacaaat

SEQ ID NO: 284248 - DNA, 15 bp, Homo sapiens
caaaaaacaaaaaac

SEQ ID NO: 284249 - DNA, 15 bp, Homo sapiens
aaaaaaacaaaaaac

SEQ ID NO: 284250 - DNA, 15 bp, Homo sapiens
caaaaaaaaaacaaa

SEQ ID NO: 284251 - DNA, 15 bp, Homo sapiens
gcaaaaaaaaaacaa

SEQ ID NO: 284252 - DNA, 15 bp, Homo sapiens
agcaaaaaaaaaaca

SEQ ID NO: 284253 - DNA, 15 bp, Homo sapiens
aagcaaaaaaaaaac

SEQ ID NO: 284254 - DNA, 15 bp, Homo sapiens
aaaaagcaaaaaaaa

SEQ ID NO: 284255 - DNA, 15 bp, Homo sapiens
aaaaaagcaaaaaaa

SEQ ID NO: 284256 - DNA, 15 bp, Homo sapiens
taaaaaagcaaaaaa

SEQ ID NO: 284257 - DNA, 15 bp, Homo sapiens
ctaaaaaagcaaaaa

SEQ ID NO: 284258 - DNA, 15 bp, Homo sapiens
gctaaaaaagcaaaa

SEQ ID NO: 284259 - DNA, 15 bp, Homo sapiens
agctaaaaaagcaaa

SEQ ID NO: 284260 - DNA, 15 bp, Homo sapiens
gagctaaaaaagcaa

SEQ ID NO: 284261 - DNA, 15 bp, Homo sapiens
tgagctaaaaaagca

SEQ ID NO: 284262 - DNA, 15 bp, Homo sapiens
atgagctaaaaaagc

SEQ ID NO: 284263 - DNA, 15 bp, Homo sapiens
gatgagctaaaaaag

SEQ ID NO: 284264 - DNA, 15 bp, Homo sapiens
tgatgagctaaaaaa

SEQ ID NO: 284265 - DNA, 15 bp, Homo sapiens
ctgatgagctaaaaa

SEQ ID NO: 284266 - DNA, 15 bp, Homo sapiens
gctgatgagctaaaa

SEQ ID NO: 284267 - DNA, 15 bp, Homo sapiens
agctgatgagctaaa

SEQ ID NO: 284268 - DNA, 15 bp, Homo sapiens
tagctgatgagctaa

SEQ ID NO: 284269 - DNA, 15 bp, Homo sapiens
atagctgatgagcta

SEQ ID NO: 284270 - DNA, 15 bp, Homo sapiens
gatagctgatgagct

SEQ ID NO: 284271 - DNA, 15 bp, Homo sapiens
tgatagctgatgagc

SEQ ID NO: 284272 - DNA, 15 bp, Homo sapiens
atgatagctgatgag

SEQ ID NO: 284273 - DNA, 15 bp, Homo sapiens
aatgatagctgatga

SEQ ID NO: 284274 - DNA, 15 bp, Homo sapiens
taatgatagctgatg

SEQ ID NO: 284275 - DNA, 15 bp, Homo sapiens
ctaatgatagctgat

SEQ ID NO: 284276 - DNA, 15 bp, Homo sapiens
actaatgatagctga

SEQ ID NO: 284277 - DNA, 15 bp, Homo sapiens
cactaatgatagctg

SEQ ID NO: 284278 - DNA, 15 bp, Homo sapiens
acactaatgatagct

SEQ ID NO: 284279 - DNA, 15 bp, Homo sapiens
aacactaatgatagc

SEQ ID NO: 284280 - DNA, 15 bp, Homo sapiens
taacactaatgatag

SEQ ID NO: 284281 - DNA, 15 bp, Homo sapiens
ctaacactaatgata

SEQ ID NO: 284282 - DNA, 15 bp, Homo sapiens
actaacactaatgat

SEQ ID NO: 284283 - DNA, 15 bp, Homo sapiens
cactaacactaatga

SEQ ID NO: 284284 - DNA, 15 bp, Homo sapiens
acactaacactaatg

SEQ ID NO: 284285 - DNA, 15 bp, Homo sapiens
tacactaacactaat

SEQ ID NO: 284286 - DNA, 15 bp, Homo sapiens
atacactaacactaa

SEQ ID NO: 284287 - DNA, 15 bp, Homo sapiens
aatacactaacacta

SEQ ID NO: 284288 - DNA, 15 bp, Homo sapiens
aaatacactaacact

SEQ ID NO: 284289 - DNA, 15 bp, Homo sapiens
taaatacactaacac

SEQ ID NO: 284290 - DNA, 15 bp, Homo sapiens
ttaaatacactaaca

SEQ ID NO: 284291 - DNA, 15 bp, Homo sapiens
attaaatacactaac

SEQ ID NO: 284292 - DNA, 15 bp, Homo sapiens
cattaaatacactaa

SEQ ID NO: 284293 - DNA, 15 bp, Homo sapiens
acattaaatacacta

SEQ ID NO: 284294 - DNA, 15 bp, Homo sapiens
cacattaaatacact

SEQ ID NO: 284295 - DNA, 15 bp, Homo sapiens
acacattaaatacac

SEQ ID NO: 284296 - DNA, 15 bp, Homo sapiens
cacacattaaataca

SEQ ID NO: 284297 - DNA, 15 bp, Homo sapiens
ccacacattaaatac

SEQ ID NO: 284298 - DNA, 15 bp, Homo sapiens
gccacacattaaata

SEQ ID NO: 284299 - DNA, 15 bp, Homo sapiens
ggccacacattaaat

SEQ ID NO: 284300 - DNA, 15 bp, Homo sapiens
gggccacacattaaa

SEQ ID NO: 284301 - DNA, 15 bp, Homo sapiens
tgggccacacattaa

SEQ ID NO: 284302 - DNA, 15 bp, Homo sapiens
ttgggccacacatta

SEQ ID NO: 284303 - DNA, 15 bp, Homo sapiens
cttgggccacacatt

SEQ ID NO: 284304 - DNA, 15 bp, Homo sapiens
tcttgggccacacat

SEQ ID NO: 284305 - DNA, 15 bp, Homo sapiens
ttcttgggccacaca

SEQ ID NO: 284306 - DNA, 15 bp, Homo sapiens
tttcttgggccacac

SEQ ID NO: 284307 - DNA, 15 bp, Homo sapiens
ttttcttgggccaca

SEQ ID NO: 284308 - DNA, 15 bp, Homo sapiens
attttcttgggccac

SEQ ID NO: 284309 - DNA, 15 bp, Homo sapiens
aattttcttgggcca

SEQ ID NO: 284310 - DNA, 15 bp, Homo sapiens
gaattttcttgggcc

SEQ ID NO: 284311 - DNA, 15 bp, Homo sapiens
agaattttcttgggc

SEQ ID NO: 284312 - DNA, 15 bp, Homo sapiens
aagaattttcttggg

SEQ ID NO: 284313 - DNA, 15 bp, Homo sapiens
taagaattttcttgg

SEQ ID NO: 284314 - DNA, 15 bp, Homo sapiens
ataagaattttcttg

SEQ ID NO: 284315 - DNA, 15 bp, Homo sapiens
aataagaattttctt

SEQ ID NO: 284316 - DNA, 15 bp, Homo sapiens
gaataagaattttct

SEQ ID NO: 284317 - DNA, 15 bp, Homo sapiens
agaataagaattttc

SEQ ID NO: 284318 - DNA, 15 bp, Homo sapiens
aagaataagaatttt

SEQ ID NO: 284319 - DNA, 15 bp, Homo sapiens
aaagaataagaattt

SEQ ID NO: 284320 - DNA, 15 bp, Homo sapiens
gaaagaataagaatt

SEQ ID NO: 284321 - DNA, 15 bp, Homo sapiens
tgaaagaataagaat

SEQ ID NO: 284322 - DNA, 15 bp, Homo sapiens
ttgaaagaataagaa

SEQ ID NO: 284323 - DNA, 15 bp, Homo sapiens
attgaaagaataaga

SEQ ID NO: 284324 - DNA, 15 bp, Homo sapiens
cattgaaagaataag

SEQ ID NO: 284325 - DNA, 15 bp, Homo sapiens
acattgaaagaataa

SEQ ID NO: 284326 - DNA, 15 bp, Homo sapiens
cacattgaaagaata

SEQ ID NO: 284327 - DNA, 15 bp, Homo sapiens
ccacattgaaagaat

SEQ ID NO: 284328 - DNA, 15 bp, Homo sapiens
accacattgaaagaa

SEQ ID NO: 284329 - DNA, 15 bp, Homo sapiens
aaccacattgaaaga

SEQ ID NO: 284330 - DNA, 15 bp, Homo sapiens
gaaccacattgaaag

SEQ ID NO: 284331 - DNA, 15 bp, Homo sapiens
ggaaccacattgaaa

SEQ ID NO: 284332 - DNA, 15 bp, Homo sapiens
aggaaccacattgaa

SEQ ID NO: 284333 - DNA, 15 bp, Homo sapiens
caggaaccacattga

SEQ ID NO: 284334 - DNA, 15 bp, Homo sapiens
ccaggaaccacattg

SEQ ID NO: 284335 - DNA, 15 bp, Homo sapiens
tccaggaaccacatt

SEQ ID NO: 284336 - DNA, 15 bp, Homo sapiens
ttccaggaaccacat

SEQ ID NO: 284337 - DNA, 15 bp, Homo sapiens
cttccaggaaccaca

SEQ ID NO: 284338 - DNA, 15 bp, Homo sapiens
gcttccaggaaccac

SEQ ID NO: 284339 - DNA, 15 bp, Homo sapiens
ggcttccaggaacca

SEQ ID NO: 284340 - DNA, 15 bp, Homo sapiens
tggcttccaggaacc

SEQ ID NO: 284341 - DNA, 15 bp, Homo sapiens
ttggcttccaggaac

SEQ ID NO: 284342 - DNA, 15 bp, Homo sapiens
tttggcttccaggaa

SEQ ID NO: 284343 - DNA, 15 bp, Homo sapiens
ttttggcttccagga

SEQ ID NO: 284344 - DNA, 15 bp, Homo sapiens
cttttggcttccagg

SEQ ID NO: 284345 - DNA, 15 bp, Homo sapiens
tcttttggcttccag

SEQ ID NO: 284346 - DNA, 15 bp, Homo sapiens
atcttttggcttcca

SEQ ID NO: 284347 - DNA, 15 bp, Homo sapiens
aatcttttggcttcc

SEQ ID NO: 284348 - DNA, 15 bp, Homo sapiens
caatcttttggcttc

SEQ ID NO: 284349 - DNA, 15 bp, Homo sapiens
tcaatcttttggctt

SEQ ID NO: 284350 - DNA, 15 bp, Homo sapiens
ttcaatcttttggct

SEQ ID NO: 284351 - DNA, 15 bp, Homo sapiens
attcaatcttttggc

SEQ ID NO: 284352 - DNA, 15 bp, Homo sapiens
tattcaatcttttgg

SEQ ID NO: 284353 - DNA, 15 bp, Homo sapiens
gtattcaatcttttg

SEQ ID NO: 284354 - DNA, 15 bp, Homo sapiens
agtattcaatctttt

SEQ ID NO: 284355 - DNA, 15 bp, Homo sapiens
gagtattcaatcttt

SEQ ID NO: 284356 - DNA, 15 bp, Homo sapiens
ggagtattcaatctt

SEQ ID NO: 284357 - DNA, 15 bp, Homo sapiens
aggagtattcaatct

SEQ ID NO: 284358 - DNA, 15 bp, Homo sapiens
caggagtattcaatc

SEQ ID NO: 284359 - DNA, 15 bp, Homo sapiens
tcaggagtattcaat

SEQ ID NO: 284360 - DNA, 15 bp, Homo sapiens
atcaggagtattcaa

SEQ ID NO: 284361 - DNA, 15 bp, Homo sapiens
aatcaggagtattca

SEQ ID NO: 284362 - DNA, 15 bp, Homo sapiens
gaatcaggagtattc

SEQ ID NO: 284363 - DNA, 15 bp, Homo sapiens
tgaatcaggagtatt

SEQ ID NO: 284364 - DNA, 15 bp, Homo sapiens
atgaatcaggagtat

SEQ ID NO: 284365 - DNA, 15 bp, Homo sapiens
aatgaatcaggagta

SEQ ID NO: 284366 - DNA, 15 bp, Homo sapiens
taatgaatcaggagt

SEQ ID NO: 284367 - DNA, 15 bp, Homo sapiens
ataatgaatcaggag

SEQ ID NO: 284368 - DNA, 15 bp, Homo sapiens
gataatgaatcagga

SEQ ID NO: 284369 - DNA, 15 bp, Homo sapiens
agataatgaatcagg

SEQ ID NO: 284370 - DNA, 15 bp, Homo sapiens
gagataatgaatcag

SEQ ID NO: 284371 - DNA, 15 bp, Homo sapiens
agagataatgaatca

SEQ ID NO: 284372 - DNA, 15 bp, Homo sapiens
cagagataatgaatc

SEQ ID NO: 284373 - DNA, 15 bp, Homo sapiens
acagagataatgaat

SEQ ID NO: 284374 - DNA, 15 bp, Homo sapiens
gacagagataatgaa

SEQ ID NO: 284375 - DNA, 15 bp, Homo sapiens
tgacagagataatga

SEQ ID NO: 284376 - DNA, 15 bp, Homo sapiens
ctgacagagataatg

SEQ ID NO: 284377 - DNA, 15 bp, Homo sapiens
cctgacagagataat

SEQ ID NO: 284378 - DNA, 15 bp, Homo sapiens
acctgacagagataa

SEQ ID NO: 284379 - DNA, 15 bp, Homo sapiens
cacctgacagagata

SEQ ID NO: 284380 - DNA, 15 bp, Homo sapiens
ccacctgacagagat

SEQ ID NO: 284381 - DNA, 15 bp, Homo sapiens
accacctgacagaga

SEQ ID NO: 284382 - DNA, 15 bp, Homo sapiens
caccacctgacagag

SEQ ID NO: 284383 - DNA, 15 bp, Homo sapiens
acaccacctgacaga

SEQ ID NO: 284384 - DNA, 15 bp, Homo sapiens
tacaccacctgacag

SEQ ID NO: 284385 - DNA, 15 bp, Homo sapiens
gtacaccacctgaca

SEQ ID NO: 284386 - DNA, 15 bp, Homo sapiens
tgtacaccacctgac

SEQ ID NO: 284387 - DNA, 15 bp, Homo sapiens
ttgtacaccacctga

SEQ ID NO: 284388 - DNA, 15 bp, Homo sapiens
tttgtacaccacctg

SEQ ID NO: 284389 - DNA, 15 bp, Homo sapiens
atttgtacaccacct

SEQ ID NO: 284390 - DNA, 15 bp, Homo sapiens
catttgtacaccacc

SEQ ID NO: 284391 - DNA, 15 bp, Homo sapiens
acatttgtacaccac

SEQ ID NO: 284392 - DNA, 15 bp, Homo sapiens
cacatttgtacacca

SEQ ID NO: 284393 - DNA, 15 bp, Homo sapiens
acacatttgtacacc

SEQ ID NO: 284394 - DNA, 15 bp, Homo sapiens
tacacatttgtacac

SEQ ID NO: 284395 - DNA, 15 bp, Homo sapiens
atacacatttgtaca

SEQ ID NO: 284396 - DNA, 15 bp, Homo sapiens
gatacacatttgtac

SEQ ID NO: 284397 - DNA, 15 bp, Homo sapiens
agatacacatttgta

SEQ ID NO: 284398 - DNA, 15 bp, Homo sapiens
aagatacacatttgt

SEQ ID NO: 284399 - DNA, 15 bp, Homo sapiens
aaagatacacatttg

SEQ ID NO: 284400 - DNA, 15 bp, Homo sapiens
aaaagatacacattt

SEQ ID NO: 284401 - DNA, 15 bp, Homo sapiens
gaaaagatacacatt

SEQ ID NO: 284402 - DNA, 15 bp, Homo sapiens
ggaaaagatacacat

SEQ ID NO: 284403 - DNA, 15 bp, Homo sapiens
gggaaaagatacaca

SEQ ID NO: 284404 - DNA, 15 bp, Homo sapiens
tgggaaaagatacac

SEQ ID NO: 284405 - DNA, 15 bp, Homo sapiens
ctgggaaaagataca

SEQ ID NO: 284406 - DNA, 15 bp, Homo sapiens
actgggaaaagatac

SEQ ID NO: 284407 - DNA, 15 bp, Homo sapiens
aactgggaaaagata

SEQ ID NO: 284408 - DNA, 15 bp, Homo sapiens
gaactgggaaaagat

SEQ ID NO: 284409 - DNA, 15 bp, Homo sapiens
ggaactgggaaaaga

SEQ ID NO: 284410 - DNA, 15 bp, Homo sapiens
tggaactgggaaaag

SEQ ID NO: 284411 - DNA, 15 bp, Homo sapiens
gtggaactgggaaaa

SEQ ID NO: 284412 - DNA, 15 bp, Homo sapiens
tgtggaactgggaaa

SEQ ID NO: 284413 - DNA, 15 bp, Homo sapiens
atgtggaactgggaa

SEQ ID NO: 284414 - DNA, 15 bp, Homo sapiens
aatgtggaactggga

SEQ ID NO: 284415 - DNA, 15 bp, Homo sapiens
gaatgtggaactggg

SEQ ID NO: 284416 - DNA, 15 bp, Homo sapiens
tgaatgtggaactgg

SEQ ID NO: 284417 - DNA, 15 bp, Homo sapiens
ctgaatgtggaactg

SEQ ID NO: 284418 - DNA, 15 bp, Homo sapiens
actgaatgtggaact

SEQ ID NO: 284419 - DNA, 15 bp, Homo sapiens
cactgaatgtggaac

SEQ ID NO: 284420 - DNA, 15 bp, Homo sapiens
tcactgaatgtggaa

SEQ ID NO: 284421 - DNA, 15 bp, Homo sapiens
ttcactgaatgtgga

SEQ ID NO: 284422 - DNA, 15 bp, Homo sapiens
cttcactgaatgtgg

SEQ ID NO: 284423 - DNA, 15 bp, Homo sapiens
acttcactgaatgtg

SEQ ID NO: 284424 - DNA, 15 bp, Homo sapiens
gacttcactgaatgt

SEQ ID NO: 284425 - DNA, 15 bp, Homo sapiens
tgacttcactgaatg

SEQ ID NO: 284426 - DNA, 15 bp, Homo sapiens
atgacttcactgaat

SEQ ID NO: 284427 - DNA, 15 bp, Homo sapiens
catgacttcactgaa

SEQ ID NO: 284428 - DNA, 15 bp, Homo sapiens
tcatgacttcactga

SEQ ID NO: 284429 - DNA, 15 bp, Homo sapiens
ttcatgacttcactg

SEQ ID NO: 284430 - DNA, 15 bp, Homo sapiens
gttcatgacttcact

SEQ ID NO: 284431 - DNA, 15 bp, Homo sapiens
agttcatgacttcac

SEQ ID NO: 284432 - DNA, 15 bp, Homo sapiens
aagttcatgacttca

SEQ ID NO: 284433 - DNA, 15 bp, Homo sapiens
caagttcatgacttc

SEQ ID NO: 284434 - DNA, 15 bp, Homo sapiens
tcaagttcatgactt

SEQ ID NO: 284435 - DNA, 15 bp, Homo sapiens
ttcaagttcatgact

SEQ ID NO: 284436 - DNA, 15 bp, Homo sapiens
tttcaagttcatgac

SEQ ID NO: 284437 - DNA, 15 bp, Homo sapiens
atttcaagttcatga

SEQ ID NO: 284438 - DNA, 15 bp, Homo sapiens
aatttcaagttcatg

SEQ ID NO: 284439 - DNA, 15 bp, Homo sapiens
caatttcaagttcat

SEQ ID NO: 284440 - DNA, 15 bp, Homo sapiens
ccaatttcaagttca

SEQ ID NO: 284441 - DNA, 15 bp, Homo sapiens
gccaatttcaagttc

SEQ ID NO: 284442 - DNA, 15 bp, Homo sapiens
ggccaatttcaagtt

SEQ ID NO: 284443 - DNA, 15 bp, Homo sapiens
tggccaatttcaagt

SEQ ID NO: 284444 - DNA, 15 bp, Homo sapiens
atggccaatttcaag

SEQ ID NO: 284445 - DNA, 15 bp, Homo sapiens
catggccaatttcaa

SEQ ID NO: 284446 - DNA, 15 bp, Homo sapiens
tcatggccaatttca

SEQ ID NO: 284447 - DNA, 15 bp, Homo sapiens
atcatggccaatttc

SEQ ID NO: 284448 - DNA, 15 bp, Homo sapiens
gatcatggccaattt

SEQ ID NO: 284449 - DNA, 15 bp, Homo sapiens
tgatcatggccaatt

SEQ ID NO: 284450 - DNA, 15 bp, Homo sapiens
ttgatcatggccaat

SEQ ID NO: 284451 - DNA, 15 bp, Homo sapiens
tttgatcatggccaa

SEQ ID NO: 284452 - DNA, 15 bp, Homo sapiens
ttttgatcatggcca

SEQ ID NO: 284453 - DNA, 15 bp, Homo sapiens
tttttgatcatggcc

SEQ ID NO: 284454 - DNA, 15 bp, Homo sapiens
ctttttgatcatggc

SEQ ID NO: 284455 - DNA, 15 bp, Homo sapiens
actttttgatcatgg

SEQ ID NO: 284456 - DNA, 15 bp, Homo sapiens
tactttttgatcatg

SEQ ID NO: 284457 - DNA, 15 bp, Homo sapiens
atactttttgatcat

SEQ ID NO: 284458 - DNA, 15 bp, Homo sapiens
aatactttttgatca

SEQ ID NO: 284459 - DNA, 15 bp, Homo sapiens
aaatactttttgatc

SEQ ID NO: 284460 - DNA, 15 bp, Homo sapiens
taaatactttttgat

SEQ ID NO: 284461 - DNA, 15 bp, Homo sapiens
ttaaatactttttga

SEQ ID NO: 284462 - DNA, 15 bp, Homo sapiens
tttaaatactttttg

SEQ ID NO: 284463 - DNA, 15 bp, Homo sapiens
atttaaatacttttt

SEQ ID NO: 284464 - DNA, 15 bp, Homo sapiens
gatttaaatactttt

SEQ ID NO: 284465 - DNA, 15 bp, Homo sapiens
tgatttaaatacttt

SEQ ID NO: 284466 - DNA, 15 bp, Homo sapiens
gtgatttaaatactt

SEQ ID NO: 284467 - DNA, 15 bp, Homo sapiens
tgtgatttaaatact

SEQ ID NO: 284468 - DNA, 15 bp, Homo sapiens
ctgtgatttaaatac

SEQ ID NO: 284469 - DNA, 15 bp, Homo sapiens
tctgtgatttaaata

SEQ ID NO: 284470 - DNA, 15 bp, Homo sapiens
cttctgtgatttaaa

SEQ ID NO: 284471 - DNA, 15 bp, Homo sapiens
acttctgtgatttaa

SEQ ID NO: 284472 - DNA, 15 bp, Homo sapiens
aacttctgtgattta

SEQ ID NO: 284473 - DNA, 15 bp, Homo sapiens
caacttctgtgattt

SEQ ID NO: 284474 - DNA, 15 bp, Homo sapiens
gcaacttctgtgatt

SEQ ID NO: 284475 - DNA, 15 bp, Homo sapiens
tgcaacttctgtgat

SEQ ID NO: 284476 - DNA, 15 bp, Homo sapiens
ttgcaacttctgtga

SEQ ID NO: 284477 - DNA, 15 bp, Homo sapiens
tttgcaacttctgtg

SEQ ID NO: 284478 - DNA, 15 bp, Homo sapiens
atttgcaacttctgt

SEQ ID NO: 284479 - DNA, 15 bp, Homo sapiens
catttgcaacttctg

SEQ ID NO: 284480 - DNA, 15 bp, Homo sapiens
gcatttgcaacttct

SEQ ID NO: 284481 - DNA, 15 bp, Homo sapiens
ggcatttgcaacttc

SEQ ID NO: 284482 - DNA, 15 bp, Homo sapiens
tggcatttgcaactt

SEQ ID NO: 284483 - DNA, 15 bp, Homo sapiens
gtggcatttgcaact

SEQ ID NO: 284484 - DNA, 15 bp, Homo sapiens
tgtggcatttgcaac

SEQ ID NO: 284485 - DNA, 15 bp, Homo sapiens
ttgtggcatttgcaa

SEQ ID NO: 284486 - DNA, 15 bp, Homo sapiens
tttgtggcatttgca

SEQ ID NO: 284487 - DNA, 15 bp, Homo sapiens
atttgtggcatttgc

SEQ ID NO: 284488 - DNA, 15 bp, Homo sapiens
gatttgtggcatttg

SEQ ID NO: 284489 - DNA, 15 bp, Homo sapiens
tgatttgtggcattt

SEQ ID NO: 284490 - DNA, 15 bp, Homo sapiens
ttgatttgtggcatt

SEQ ID NO: 284491 - DNA, 15 bp, Homo sapiens
cttgatttgtggcat

SEQ ID NO: 284492 - DNA, 15 bp, Homo sapiens
ccttgatttgtggca

SEQ ID NO: 284493 - DNA, 15 bp, Homo sapiens
accttgatttgtggc

SEQ ID NO: 284494 - DNA, 15 bp, Homo sapiens
gaccttgatttgtgg

SEQ ID NO: 284495 - DNA, 15 bp, Homo sapiens
agaccttgatttgtg

SEQ ID NO: 284496 - DNA, 15 bp, Homo sapiens
aagaccttgatttgt

SEQ ID NO: 284497 - DNA, 15 bp, Homo sapiens
aaagaccttgatttg

SEQ ID NO: 284498 - DNA, 15 bp, Homo sapiens
aaaagaccttgattt

SEQ ID NO: 284499 - DNA, 15 bp, Homo sapiens
aaaaagaccttgatt

SEQ ID NO: 284500 - DNA, 15 bp, Homo sapiens
gaaaaagaccttgat

SEQ ID NO: 284501 - DNA, 15 bp, Homo sapiens
agaaaaagaccttga

SEQ ID NO: 284502 - DNA, 15 bp, Homo sapiens
gagaaaaagaccttg

SEQ ID NO: 284503 - DNA, 15 bp, Homo sapiens
agagaaaaagacctt

SEQ ID NO: 284504 - DNA, 15 bp, Homo sapiens
aagagaaaaagacct

SEQ ID NO: 284505 - DNA, 15 bp, Homo sapiens
caagagaaaaagacc

SEQ ID NO: 284506 - DNA, 15 bp, Homo sapiens
ccaagagaaaaagac

SEQ ID NO: 284507 - DNA, 15 bp, Homo sapiens
tccaagagaaaaaga

SEQ ID NO: 284508 - DNA, 15 bp, Homo sapiens
ctccaagagaaaaag

SEQ ID NO: 284509 - DNA, 15 bp, Homo sapiens
tctccaagagaaaaa

SEQ ID NO: 284510 - DNA, 15 bp, Homo sapiens
ttctccaagagaaaa

SEQ ID NO: 284511 - DNA, 15 bp, Homo sapiens
gttctccaagagaaa

SEQ ID NO: 284512 - DNA, 15 bp, Homo sapiens
ggttctccaagagaa

SEQ ID NO: 284513 - DNA, 15 bp, Homo sapiens
aggttctccaagaga

SEQ ID NO: 284514 - DNA, 15 bp, Homo sapiens
caggttctccaagag

SEQ ID NO: 284515 - DNA, 15 bp, Homo sapiens
acaggttctccaaga

SEQ ID NO: 284516 - DNA, 15 bp, Homo sapiens
aacaggttctccaag

SEQ ID NO: 284517 - DNA, 15 bp, Homo sapiens
taacaggttctccaa

SEQ ID NO: 284518 - DNA, 15 bp, Homo sapiens
ttaacaggttctcca

SEQ ID NO: 284519 - DNA, 15 bp, Homo sapiens
tttaacaggttctcc

SEQ ID NO: 284520 - DNA, 15 bp, Homo sapiens
gtttaacaggttctc

SEQ ID NO: 284521 - DNA, 15 bp, Homo sapiens
tgtttaacaggttct

SEQ ID NO: 284522 - DNA, 15 bp, Homo sapiens
atgtttaacaggttc

SEQ ID NO: 284523 - DNA, 15 bp, Homo sapiens
aatgtttaacaggtt

SEQ ID NO: 284524 - DNA, 15 bp, Homo sapiens
aaatgtttaacaggt

SEQ ID NO: 284525 - DNA, 15 bp, Homo sapiens
taaatgtttaacagg

SEQ ID NO: 284526 - DNA, 15 bp, Homo sapiens
gtaaatgtttaacag

SEQ ID NO: 284527 - DNA, 15 bp, Homo sapiens
ggtaaatgtttaaca

SEQ ID NO: 284528 - DNA, 15 bp, Homo sapiens
tggtaaatgtttaac

SEQ ID NO: 284529 - DNA, 15 bp, Homo sapiens
ttggtaaatgtttaa

SEQ ID NO: 284530 - DNA, 15 bp, Homo sapiens
gttggtaaatgttta

SEQ ID NO: 284531 - DNA, 15 bp, Homo sapiens
agttggtaaatgttt

SEQ ID NO: 284532 - DNA, 15 bp, Homo sapiens
gagttggtaaatgtt

SEQ ID NO: 284533 - DNA, 15 bp, Homo sapiens
tgagttggtaaatgt

SEQ ID NO: 284534 - DNA, 15 bp, Homo sapiens
gtgagttggtaaatg

SEQ ID NO: 284535 - DNA, 15 bp, Homo sapiens
cgtgagttggtaaat

SEQ ID NO: 284536 - DNA, 15 bp, Homo sapiens
tcgtgagttggtaaa

SEQ ID NO: 284537 - DNA, 15 bp, Homo sapiens
gtcgtgagttggtaa

SEQ ID NO: 284538 - DNA, 15 bp, Homo sapiens
ggtcgtgagttggta

SEQ ID NO: 284539 - DNA, 15 bp, Homo sapiens
cggtcgtgagttggt

SEQ ID NO: 284540 - DNA, 15 bp, Homo sapiens
gcggtcgtgagttgg

SEQ ID NO: 284541 - DNA, 15 bp, Homo sapiens
ggcggtcgtgagttg

SEQ ID NO: 284542 - DNA, 15 bp, Homo sapiens
tggcggtcgtgagtt

SEQ ID NO: 284543 - DNA, 15 bp, Homo sapiens
atggcggtcgtgagt

SEQ ID NO: 284544 - DNA, 15 bp, Homo sapiens
catggcggtcgtgag

SEQ ID NO: 284545 - DNA, 15 bp, Homo sapiens
gcatggcggtcgtga

SEQ ID NO: 284546 - DNA, 15 bp, Homo sapiens
tgcatggcggtcgtg

SEQ ID NO: 284547 - DNA, 15 bp, Homo sapiens
gtgcatggcggtcgt

SEQ ID NO: 284548 - DNA, 15 bp, Homo sapiens
ggtgcatggcggtcg

SEQ ID NO: 284549 - DNA, 15 bp, Homo sapiens
gggtgcatggcggtc

SEQ ID NO: 284550 - DNA, 15 bp, Homo sapiens
tgggtgcatggcggt

SEQ ID NO: 284551 - DNA, 15 bp, Homo sapiens
ttgggtgcatggcgg

SEQ ID NO: 284552 - DNA, 15 bp, Homo sapiens
attgggtgcatggcg

SEQ ID NO: 284553 - DNA, 15 bp, Homo sapiens
tattgggtgcatggc

SEQ ID NO: 284554 - DNA, 15 bp, Homo sapiens
gtattgggtgcatgg

SEQ ID NO: 284555 - DNA, 15 bp, Homo sapiens
agtattgggtgcatg

SEQ ID NO: 284556 - DNA, 15 bp, Homo sapiens
cagtattgggtgcat

SEQ ID NO: 284557 - DNA, 15 bp, Homo sapiens
gcagtattgggtgca

SEQ ID NO: 284558 - DNA, 15 bp, Homo sapiens
tgcagtattgggtgc

SEQ ID NO: 284559 - DNA, 15 bp, Homo sapiens
ttgcagtattgggtg

SEQ ID NO: 284560 - DNA, 15 bp, Homo sapiens
attgcagtattgggt

SEQ ID NO: 284561 - DNA, 15 bp, Homo sapiens
tattgcagtattggg

SEQ ID NO: 284562 - DNA, 15 bp, Homo sapiens
ctattgcagtattgg

SEQ ID NO: 284563 - DNA, 15 bp, Homo sapiens
cctattgcagtattg

SEQ ID NO: 284564 - DNA, 15 bp, Homo sapiens
acctattgcagtatt

SEQ ID NO: 284565 - DNA, 15 bp, Homo sapiens
gacctattgcagtat

SEQ ID NO: 284566 - DNA, 15 bp, Homo sapiens
agacctattgcagta

SEQ ID NO: 284567 - DNA, 15 bp, Homo sapiens
tagacctattgcagt

SEQ ID NO: 284568 - DNA, 15 bp, Homo sapiens
atagacctattgcag

SEQ ID NO: 284569 - DNA, 15 bp, Homo sapiens
tatagacctattgca

SEQ ID NO: 284570 - DNA, 15 bp, Homo sapiens
ctatagacctattgc

SEQ ID NO: 284571 - DNA, 15 bp, Homo sapiens
tctatagacctattg

SEQ ID NO: 284572 - DNA, 15 bp, Homo sapiens
atctatagacctatt

SEQ ID NO: 284573 - DNA, 15 bp, Homo sapiens
catctatagacctat

SEQ ID NO: 284574 - DNA, 15 bp, Homo sapiens
gcatctatagaccta

SEQ ID NO: 284575 - DNA, 15 bp, Homo sapiens
tgcatctatagacct

SEQ ID NO: 284576 - DNA, 15 bp, Homo sapiens
ctgcatctatagacc

SEQ ID NO: 284577 - DNA, 15 bp, Homo sapiens
tctgcatctatagac

SEQ ID NO: 284578 - DNA, 15 bp, Homo sapiens
atctgcatctataga

SEQ ID NO: 284579 - DNA, 15 bp, Homo sapiens
tatctgcatctatag

SEQ ID NO: 284580 - DNA, 15 bp, Homo sapiens
gtatctgcatctata

SEQ ID NO: 284581 - DNA, 15 bp, Homo sapiens
agtatctgcatctat

SEQ ID NO: 284582 - DNA, 15 bp, Homo sapiens
cagtatctgcatcta

SEQ ID NO: 284583 - DNA, 15 bp, Homo sapiens
acagtatctgcatct

SEQ ID NO: 284584 - DNA, 15 bp, Homo sapiens
gacagtatctgcatc

SEQ ID NO: 284585 - DNA, 15 bp, Homo sapiens
agacagtatctgcat

SEQ ID NO: 284586 - DNA, 15 bp, Homo sapiens
gagacagtatctgca

SEQ ID NO: 284587 - DNA, 15 bp, Homo sapiens
ggagacagtatctgc

SEQ ID NO: 284588 - DNA, 15 bp, Homo sapiens
tggagacagtatctg

SEQ ID NO: 284589 - DNA, 15 bp, Homo sapiens
atggagacagtatct

SEQ ID NO: 284590 - DNA, 15 bp, Homo sapiens
catggagacagtatc

SEQ ID NO: 284591 - DNA, 15 bp, Homo sapiens
tcatggagacagtat

SEQ ID NO: 284592 - DNA, 15 bp, Homo sapiens
ttcatggagacagta

SEQ ID NO: 284593 - DNA, 15 bp, Homo sapiens
attcatggagacagt

SEQ ID NO: 284594 - DNA, 15 bp, Homo sapiens
gattcatggagacag

SEQ ID NO: 284595 - DNA, 15 bp, Homo sapiens
agattcatggagaca

SEQ ID NO: 284596 - DNA, 15 bp, Homo sapiens
aagattcatggagac

SEQ ID NO: 284597 - DNA, 15 bp, Homo sapiens
taagattcatggaga

SEQ ID NO: 284598 - DNA, 15 bp, Homo sapiens
ataagattcatggag

SEQ ID NO: 284599 - DNA, 15 bp, Homo sapiens
tataagattcatgga

SEQ ID NO: 284600 - DNA, 15 bp, Homo sapiens
ctataagattcatgg

SEQ ID NO: 284601 - DNA, 15 bp, Homo sapiens
cctataagattcatg

SEQ ID NO: 284602 - DNA, 15 bp, Homo sapiens
gcctataagattcat

SEQ ID NO: 284603 - DNA, 15 bp, Homo sapiens
agcctataagattca

SEQ ID NO: 284604 - DNA, 15 bp, Homo sapiens
tagcctataagattc

SEQ ID NO: 284605 - DNA, 15 bp, Homo sapiens
ctagcctataagatt

SEQ ID NO: 284606 - DNA, 15 bp, Homo sapiens
tctagcctataagat

SEQ ID NO: 284607 - DNA, 15 bp, Homo sapiens
ttctagcctataaga

SEQ ID NO: 284608 - DNA, 15 bp, Homo sapiens
tttctagcctataag

SEQ ID NO: 284609 - DNA, 15 bp, Homo sapiens
ctttctagcctataa

SEQ ID NO: 284610 - DNA, 15 bp, Homo sapiens
cctttctagcctata

SEQ ID NO: 284611 - DNA, 15 bp, Homo sapiens
tcctttctagcctat

SEQ ID NO: 284612 - DNA, 15 bp, Homo sapiens
ttcctttctagccta

SEQ ID NO: 284613 - DNA, 15 bp, Homo sapiens
tttcctttctagcct

SEQ ID NO: 284614 - DNA, 15 bp, Homo sapiens
atttcctttctagcc

SEQ ID NO: 284615 - DNA, 15 bp, Homo sapiens
tatttcctttctagc

SEQ ID NO: 284616 - DNA, 15 bp, Homo sapiens
ctatttcctttctag

SEQ ID NO: 284617 - DNA, 15 bp, Homo sapiens
tctatttcctttcta

SEQ ID NO: 284618 - DNA, 15 bp, Homo sapiens
atctatttcctttct

SEQ ID NO: 284619 - DNA, 15 bp, Homo sapiens
tatctatttcctttc

SEQ ID NO: 284620 - DNA, 15 bp, Homo sapiens
ttatctatttccttt

SEQ ID NO: 284621 - DNA, 15 bp, Homo sapiens
cttatctatttcctt

SEQ ID NO: 284622 - DNA, 15 bp, Homo sapiens
acttatctatttcct

SEQ ID NO: 284623 - DNA, 15 bp, Homo sapiens
tacttatctatttcc

SEQ ID NO: 284624 - DNA, 15 bp, Homo sapiens
ctacttatctatttc

SEQ ID NO: 284625 - DNA, 15 bp, Homo sapiens
actacttatctattt

SEQ ID NO: 284626 - DNA, 15 bp, Homo sapiens
gactacttatctatt

SEQ ID NO: 284627 - DNA, 15 bp, Homo sapiens
ggactacttatctat

SEQ ID NO: 284628 - DNA, 15 bp, Homo sapiens
aggactacttatcta

SEQ ID NO: 284629 - DNA, 15 bp, Homo sapiens
taggactacttatct

SEQ ID NO: 284630 - DNA, 15 bp, Homo sapiens
gtaggactacttatc

SEQ ID NO: 284631 - DNA, 15 bp, Homo sapiens
ggtaggactacttat

SEQ ID NO: 284632 - DNA, 15 bp, Homo sapiens
tggtaggactactta

SEQ ID NO: 284633 - DNA, 15 bp, Homo sapiens
ctggtaggactactt

SEQ ID NO: 284634 - DNA, 15 bp, Homo sapiens
tctggtaggactact

SEQ ID NO: 284635 - DNA, 15 bp, Homo sapiens
ttctggtaggactac

SEQ ID NO: 284636 - DNA, 15 bp, Homo sapiens
cttctggtaggacta

SEQ ID NO: 284637 - DNA, 15 bp, Homo sapiens
tcttctggtaggact

SEQ ID NO: 284638 - DNA, 15 bp, Homo sapiens
ttcttctggtaggac

SEQ ID NO: 284639 - DNA, 15 bp, Homo sapiens
gttcttctggtagga

SEQ ID NO: 284640 - DNA, 15 bp, Homo sapiens
tgttcttctggtagg

SEQ ID NO: 284641 - DNA, 15 bp, Homo sapiens
atgttcttctggtag

SEQ ID NO: 284642 - DNA, 15 bp, Homo sapiens
catgttcttctggta

SEQ ID NO: 284643 - DNA, 15 bp, Homo sapiens
tcatgttcttctggt

SEQ ID NO: 284644 - DNA, 15 bp, Homo sapiens
atcatgttcttctgg

SEQ ID NO: 284645 - DNA, 15 bp, Homo sapiens
catcatgttcttctg

SEQ ID NO: 284646 - DNA, 15 bp, Homo sapiens
tcatcatgttcttct

SEQ ID NO: 284647 - DNA, 15 bp, Homo sapiens
ttcatcatgttcttc

SEQ ID NO: 284648 - DNA, 15 bp, Homo sapiens
cttcatcatgttctt

SEQ ID NO: 284649 - DNA, 15 bp, Homo sapiens
ccttcatcatgttct

SEQ ID NO: 284650 - DNA, 15 bp, Homo sapiens
gccttcatcatgttc

SEQ ID NO: 284651 - DNA, 15 bp, Homo sapiens
tgccttcatcatgtt

SEQ ID NO: 284652 - DNA, 15 bp, Homo sapiens
atgccttcatcatgt

SEQ ID NO: 284653 - DNA, 15 bp, Homo sapiens
aatgccttcatcatg

SEQ ID NO: 284654 - DNA, 15 bp, Homo sapiens
aaatgccttcatcat

SEQ ID NO: 284655 - DNA, 15 bp, Homo sapiens
caaatgccttcatca

SEQ ID NO: 284656 - DNA, 15 bp, Homo sapiens
acaaatgccttcatc

SEQ ID NO: 284657 - DNA, 15 bp, Homo sapiens
cacaaatgccttcat

SEQ ID NO: 284658 - DNA, 15 bp, Homo sapiens
ccacaaatgccttca

SEQ ID NO: 284659 - DNA, 15 bp, Homo sapiens
accacaaatgccttc

SEQ ID NO: 284660 - DNA, 15 bp, Homo sapiens
taccacaaatgcctt

SEQ ID NO: 284661 - DNA, 15 bp, Homo sapiens
ttaccacaaatgcct

SEQ ID NO: 284662 - DNA, 15 bp, Homo sapiens
tttaccacaaatgcc

SEQ ID NO: 284663 - DNA, 15 bp, Homo sapiens
gtttaccacaaatgc

SEQ ID NO: 284664 - DNA, 15 bp, Homo sapiens
tgtttaccacaaatg

SEQ ID NO: 284665 - DNA, 15 bp, Homo sapiens
ctgtttaccacaaat

SEQ ID NO: 284666 - DNA, 15 bp, Homo sapiens
tctgtttaccacaaa

SEQ ID NO: 284667 - DNA, 15 bp, Homo sapiens
ttctgtttaccacaa

SEQ ID NO: 284668 - DNA, 15 bp, Homo sapiens
attctgtttaccaca

SEQ ID NO: 284669 - DNA, 15 bp, Homo sapiens
cattctgtttaccac

SEQ ID NO: 284670 - DNA, 15 bp, Homo sapiens
tcattctgtttacca

SEQ ID NO: 284671 - DNA, 15 bp, Homo sapiens
atcattctgtttacc

SEQ ID NO: 284672 - DNA, 15 bp, Homo sapiens
catcattctgtttac

SEQ ID NO: 284673 - DNA, 15 bp, Homo sapiens
ccatcattctgttta

SEQ ID NO: 284674 - DNA, 15 bp, Homo sapiens
gccatcattctgttt

SEQ ID NO: 284675 - DNA, 15 bp, Homo sapiens
ggccatcattctgtt

SEQ ID NO: 284676 - DNA, 15 bp, Homo sapiens
gggccatcattctgt

SEQ ID NO: 284677 - DNA, 15 bp, Homo sapiens
ggggccatcattctg

SEQ ID NO: 284678 - DNA, 15 bp, Homo sapiens
gggggccatcattct

SEQ ID NO: 284679 - DNA, 15 bp, Homo sapiens
ggggggccatcattc

SEQ ID NO: 284680 - DNA, 15 bp, Homo sapiens
tggggggccatcatt

SEQ ID NO: 284681 - DNA, 15 bp, Homo sapiens
ttggggggccatcat

SEQ ID NO: 284682 - DNA, 15 bp, Homo sapiens
tttggggggccatca

SEQ ID NO: 284683 - DNA, 15 bp, Homo sapiens
ctttggggggccatc

SEQ ID NO: 284684 - DNA, 15 bp, Homo sapiens
tctttggggggccat

SEQ ID NO: 284685 - DNA, 15 bp, Homo sapiens
atctttggggggcca

SEQ ID NO: 284686 - DNA, 15 bp, Homo sapiens
catctttggggggcc

SEQ ID NO: 284687 - DNA, 15 bp, Homo sapiens
acatctttggggggc

SEQ ID NO: 284688 - DNA, 15 bp, Homo sapiens
gacatctttgggggg

SEQ ID NO: 284689 - DNA, 15 bp, Homo sapiens
ggacatctttggggg

SEQ ID NO: 284690 - DNA, 15 bp, Homo sapiens
tggacatctttgggg

SEQ ID NO: 284691 - DNA, 15 bp, Homo sapiens
gtggacatctttggg

SEQ ID NO: 284692 - DNA, 15 bp, Homo sapiens
tgtggacatctttgg

SEQ ID NO: 284693 - DNA, 15 bp, Homo sapiens
atgtggacatctttg

SEQ ID NO: 284694 - DNA, 15 bp, Homo sapiens
gatgtggacatcttt

SEQ ID NO: 284695 - DNA, 15 bp, Homo sapiens
ggatgtggacatctt

SEQ ID NO: 284696 - DNA, 15 bp, Homo sapiens
aggatgtggacatct

SEQ ID NO: 284697 - DNA, 15 bp, Homo sapiens
taggatgtggacatc

SEQ ID NO: 284698 - DNA, 15 bp, Homo sapiens
ttaggatgtggacat

SEQ ID NO: 284699 - DNA, 15 bp, Homo sapiens
attaggatgtggaca

SEQ ID NO: 284700 - DNA, 15 bp, Homo sapiens
gattaggatgtggac

SEQ ID NO: 284701 - DNA, 15 bp, Homo sapiens
ggattaggatgtgga

SEQ ID NO: 284702 - DNA, 15 bp, Homo sapiens
gggattaggatgtgg

SEQ ID NO: 284703 - DNA, 15 bp, Homo sapiens
agggattaggatgtg

SEQ ID NO: 284704 - DNA, 15 bp, Homo sapiens
cagggattaggatgt

SEQ ID NO: 284705 - DNA, 15 bp, Homo sapiens
tcagggattaggatg

SEQ ID NO: 284706 - DNA, 15 bp, Homo sapiens
ttcagggattaggat

SEQ ID NO: 284707 - DNA, 15 bp, Homo sapiens
cttcagggattagga

SEQ ID NO: 284708 - DNA, 15 bp, Homo sapiens
gcttcagggattagg

SEQ ID NO: 284709 - DNA, 15 bp, Homo sapiens
ggcttcagggattag

SEQ ID NO: 284710 - DNA, 15 bp, Homo sapiens
aggcttcagggatta

SEQ ID NO: 284711 - DNA, 15 bp, Homo sapiens
taggcttcagggatt

SEQ ID NO: 284712 - DNA, 15 bp, Homo sapiens
ataggcttcagggat

SEQ ID NO: 284713 - DNA, 15 bp, Homo sapiens
cataggcttcaggga

SEQ ID NO: 284714 - DNA, 15 bp, Homo sapiens
tcataggcttcaggg

SEQ ID NO: 284715 - DNA, 15 bp, Homo sapiens
ttcataggcttcagg

SEQ ID NO: 284716 - DNA, 15 bp, Homo sapiens
attcataggcttcag

SEQ ID NO: 284717 - DNA, 15 bp, Homo sapiens
tattcataggcttca

SEQ ID NO: 284718 - DNA, 15 bp, Homo sapiens
atattcataggcttc

SEQ ID NO: 284719 - DNA, 15 bp, Homo sapiens
tatattcataggctt

SEQ ID NO: 284720 - DNA, 15 bp, Homo sapiens
gtatattcataggct

SEQ ID NO: 284721 - DNA, 15 bp, Homo sapiens
agtatattcataggc

SEQ ID NO: 284722 - DNA, 15 bp, Homo sapiens
tagtatattcatagg

SEQ ID NO: 284723 - DNA, 15 bp, Homo sapiens
gtagtatattcatag

SEQ ID NO: 284724 - DNA, 15 bp, Homo sapiens
agtagtatattcata

SEQ ID NO: 284725 - DNA, 15 bp, Homo sapiens
aagtagtatattcat

SEQ ID NO: 284726 - DNA, 15 bp, Homo sapiens
aaagtagtatattca

SEQ ID NO: 284727 - DNA, 15 bp, Homo sapiens
taaagtagtatattc

SEQ ID NO: 284728 - DNA, 15 bp, Homo sapiens
gtaaagtagtatatt

SEQ ID NO: 284729 - DNA, 15 bp, Homo sapiens
agtaaagtagtatat

SEQ ID NO: 284730 - DNA, 15 bp, Homo sapiens
aagtaaagtagtata

SEQ ID NO: 284731 - DNA, 15 bp, Homo sapiens
caagtaaagtagtat

SEQ ID NO: 284732 - DNA, 15 bp, Homo sapiens
ccaagtaaagtagta

SEQ ID NO: 284733 - DNA, 15 bp, Homo sapiens
gccaagtaaagtagt

SEQ ID NO: 284734 - DNA, 15 bp, Homo sapiens
tgccaagtaaagtag

SEQ ID NO: 284735 - DNA, 15 bp, Homo sapiens
ttgccaagtaaagta

SEQ ID NO: 284736 - DNA, 15 bp, Homo sapiens
tttgccaagtaaagt

SEQ ID NO: 284737 - DNA, 15 bp, Homo sapiens
ttttgccaagtaaag

SEQ ID NO: 284738 - DNA, 15 bp, Homo sapiens
cttttgccaagtaaa

SEQ ID NO: 284739 - DNA, 15 bp, Homo sapiens
ccttttgccaagtaa

SEQ ID NO: 284740 - DNA, 15 bp, Homo sapiens
cccttttgccaagta

SEQ ID NO: 284741 - DNA, 15 bp, Homo sapiens
tcccttttgccaagt

SEQ ID NO: 284742 - DNA, 15 bp, Homo sapiens
gtcccttttgccaag

SEQ ID NO: 284743 - DNA, 15 bp, Homo sapiens
agtcccttttgccaa

SEQ ID NO: 284744 - DNA, 15 bp, Homo sapiens
aagtcccttttgcca

SEQ ID NO: 284745 - DNA, 15 bp, Homo sapiens
aaagtcccttttgcc

SEQ ID NO: 284746 - DNA, 15 bp, Homo sapiens
caaagtcccttttgc

SEQ ID NO: 284747 - DNA, 15 bp, Homo sapiens
gcaaagtcccttttg

SEQ ID NO: 284748 - DNA, 15 bp, Homo sapiens
ggcaaagtccctttt

SEQ ID NO: 284749 - DNA, 15 bp, Homo sapiens
tggcaaagtcccttt

SEQ ID NO: 284750 - DNA, 15 bp, Homo sapiens
gtggcaaagtccctt

SEQ ID NO: 284751 - DNA, 15 bp, Homo sapiens
tgtggcaaagtccct

SEQ ID NO: 284752 - DNA, 15 bp, Homo sapiens
ctgtggcaaagtccc

SEQ ID NO: 284753 - DNA, 15 bp, Homo sapiens
cctgtggcaaagtcc

SEQ ID NO: 284754 - DNA, 15 bp, Homo sapiens
acctgtggcaaagtc

SEQ ID NO: 284755 - DNA, 15 bp, Homo sapiens
aacctgtggcaaagt

SEQ ID NO: 284756 - DNA, 15 bp, Homo sapiens
aaacctgtggcaaag

SEQ ID NO: 284757 - DNA, 15 bp, Homo sapiens
aaaacctgtggcaaa

SEQ ID NO: 284758 - DNA, 15 bp, Homo sapiens
aaaaacctgtggcaa

SEQ ID NO: 284759 - DNA, 15 bp, Homo sapiens
taaaaacctgtggca

SEQ ID NO: 284760 - DNA, 15 bp, Homo sapiens
ttaaaaacctgtggc

SEQ ID NO: 284761 - DNA, 15 bp, Homo sapiens
attaaaaacctgtgg

SEQ ID NO: 284762 - DNA, 15 bp, Homo sapiens
aattaaaaacctgtg

SEQ ID NO: 284763 - DNA, 15 bp, Homo sapiens
taattaaaaacctgt

SEQ ID NO: 284764 - DNA, 15 bp, Homo sapiens
ttaattaaaaacctg

SEQ ID NO: 284765 - DNA, 15 bp, Homo sapiens
cttaattaaaaacct

SEQ ID NO: 284766 - DNA, 15 bp, Homo sapiens
ccttaattaaaaacc

SEQ ID NO: 284767 - DNA, 15 bp, Homo sapiens
tccttaattaaaaac

SEQ ID NO: 284768 - DNA, 15 bp, Homo sapiens
gtccttaattaaaaa

SEQ ID NO: 284769 - DNA, 15 bp, Homo sapiens
ggtccttaattaaaa

SEQ ID NO: 284770 - DNA, 15 bp, Homo sapiens
aggtccttaattaaa

SEQ ID NO: 284771 - DNA, 15 bp, Homo sapiens
aaggtccttaattaa

SEQ ID NO: 284772 - DNA, 15 bp, Homo sapiens
caaggtccttaatta

SEQ ID NO: 284773 - DNA, 15 bp, Homo sapiens
tcaaggtccttaatt

SEQ ID NO: 284774 - DNA, 15 bp, Homo sapiens
ttcaaggtccttaat

SEQ ID NO: 284775 - DNA, 15 bp, Homo sapiens
tttcaaggtccttaa

SEQ ID NO: 284776 - DNA, 15 bp, Homo sapiens
atttcaaggtcctta

SEQ ID NO: 284777 - DNA, 15 bp, Homo sapiens
tatttcaaggtcctt

SEQ ID NO: 284778 - DNA, 15 bp, Homo sapiens
ctatttcaaggtcct

SEQ ID NO: 284779 - DNA, 15 bp, Homo sapiens
tctatttcaaggtcc

SEQ ID NO: 284780 - DNA, 15 bp, Homo sapiens
ctctatttcaaggtc

SEQ ID NO: 284781 - DNA, 15 bp, Homo sapiens
tctctatttcaaggt

SEQ ID NO: 284782 - DNA, 15 bp, Homo sapiens
ctctctatttcaagg

SEQ ID NO: 284783 - DNA, 15 bp, Homo sapiens
tctctctatttcaag

SEQ ID NO: 284784 - DNA, 15 bp, Homo sapiens
atctctctatttcaa

SEQ ID NO: 284785 - DNA, 15 bp, Homo sapiens
aatctctctatttca

SEQ ID NO: 284786 - DNA, 15 bp, Homo sapiens
taatctctctatttc

SEQ ID NO: 284787 - DNA, 15 bp, Homo sapiens
ataatctctctattt

SEQ ID NO: 284788 - DNA, 15 bp, Homo sapiens
gataatctctctatt

SEQ ID NO: 284789 - DNA, 15 bp, Homo sapiens
ggataatctctctat

SEQ ID NO: 284790 - DNA, 15 bp, Homo sapiens
aggataatctctcta

SEQ ID NO: 284791 - DNA, 15 bp, Homo sapiens
caggataatctctct

SEQ ID NO: 284792 - DNA, 15 bp, Homo sapiens
ccaggataatctctc

SEQ ID NO: 284793 - DNA, 15 bp, Homo sapiens
tccaggataatctct

SEQ ID NO: 284794 - DNA, 15 bp, Homo sapiens
atccaggataatctc

SEQ ID NO: 284795 - DNA, 15 bp, Homo sapiens
tatccaggataatct

SEQ ID NO: 284796 - DNA, 15 bp, Homo sapiens
ttatccaggataatc

SEQ ID NO: 284797 - DNA, 15 bp, Homo sapiens
attatccaggataat

SEQ ID NO: 284798 - DNA, 15 bp, Homo sapiens
gattatccaggataa

SEQ ID NO: 284799 - DNA, 15 bp, Homo sapiens
ggattatccaggata

SEQ ID NO: 284800 - DNA, 15 bp, Homo sapiens
tggattatccaggat

SEQ ID NO: 284801 - DNA, 15 bp, Homo sapiens
ctggattatccagga

SEQ ID NO: 284802 - DNA, 15 bp, Homo sapiens
tctggattatccagg

SEQ ID NO: 284803 - DNA, 15 bp, Homo sapiens
atctggattatccag

SEQ ID NO: 284804 - DNA, 15 bp, Homo sapiens
catctggattatcca

SEQ ID NO: 284805 - DNA, 15 bp, Homo sapiens
ccatctggattatcc

SEQ ID NO: 284806 - DNA, 15 bp, Homo sapiens
gccatctggattatc

SEQ ID NO: 284807 - DNA, 15 bp, Homo sapiens
ggccatctggattat

SEQ ID NO: 284808 - DNA, 15 bp, Homo sapiens
gggccatctggatta

SEQ ID NO: 284809 - DNA, 15 bp, Homo sapiens
ggggccatctggatt

SEQ ID NO: 284810 - DNA, 15 bp, Homo sapiens
tggggccatctggat

SEQ ID NO: 284811 - DNA, 15 bp, Homo sapiens
ctggggccatctgga

SEQ ID NO: 284812 - DNA, 15 bp, Homo sapiens
actggggccatctgg

SEQ ID NO: 284813 - DNA, 15 bp, Homo sapiens
cactggggccatctg

SEQ ID NO: 284814 - DNA, 15 bp, Homo sapiens
acactggggccatct

SEQ ID NO: 284815 - DNA, 15 bp, Homo sapiens
tacactggggccatc

SEQ ID NO: 284816 - DNA, 15 bp, Homo sapiens
ttacactggggccat

SEQ ID NO: 284817 - DNA, 15 bp, Homo sapiens
attacactggggcca

SEQ ID NO: 284818 - DNA, 15 bp, Homo sapiens
gattacactggggcc

SEQ ID NO: 284819 - DNA, 15 bp, Homo sapiens
ggattacactggggc

SEQ ID NO: 284820 - DNA, 15 bp, Homo sapiens
gggattacactgggg

SEQ ID NO: 284821 - DNA, 15 bp, Homo sapiens
tgggattacactggg

SEQ ID NO: 284822 - DNA, 15 bp, Homo sapiens
ttgggattacactgg

SEQ ID NO: 284823 - DNA, 15 bp, Homo sapiens
cttgggattacactg

SEQ ID NO: 284824 - DNA, 15 bp, Homo sapiens
ccttgggattacact

SEQ ID NO: 284825 - DNA, 15 bp, Homo sapiens
cccttgggattacac

SEQ ID NO: 284826 - DNA, 15 bp, Homo sapiens
acccttgggattaca

SEQ ID NO: 284827 - DNA, 15 bp, Homo sapiens
gacccttgggattac

SEQ ID NO: 284828 - DNA, 15 bp, Homo sapiens
ggacccttgggatta

SEQ ID NO: 284829 - DNA, 15 bp, Homo sapiens
aggacccttgggatt

SEQ ID NO: 284830 - DNA, 15 bp, Homo sapiens
gaggacccttgggat

SEQ ID NO: 284831 - DNA, 15 bp, Homo sapiens
tgaggacccttggga

SEQ ID NO: 284832 - DNA, 15 bp, Homo sapiens
atgaggacccttggg

SEQ ID NO: 284833 - DNA, 15 bp, Homo sapiens
tatgaggacccttgg

SEQ ID NO: 284834 - DNA, 15 bp, Homo sapiens
ttatgaggacccttg

SEQ ID NO: 284835 - DNA, 15 bp, Homo sapiens
tttatgaggaccctt

SEQ ID NO: 284836 - DNA, 15 bp, Homo sapiens
ctttatgaggaccct

SEQ ID NO: 284837 - DNA, 15 bp, Homo sapiens
cctttatgaggaccc

SEQ ID NO: 284838 - DNA, 15 bp, Homo sapiens
ccctttatgaggacc

SEQ ID NO: 284839 - DNA, 15 bp, Homo sapiens
accctttatgaggac

SEQ ID NO: 284840 - DNA, 15 bp, Homo sapiens
taccctttatgagga

SEQ ID NO: 284841 - DNA, 15 bp, Homo sapiens
ctaccctttatgagg

SEQ ID NO: 284842 - DNA, 15 bp, Homo sapiens
cctaccctttatgag

SEQ ID NO: 284843 - DNA, 15 bp, Homo sapiens
tcctaccctttatga

SEQ ID NO: 284844 - DNA, 15 bp, Homo sapiens
ttcctaccctttatg

SEQ ID NO: 284845 - DNA, 15 bp, Homo sapiens
cttcctaccctttat

SEQ ID NO: 284846 - DNA, 15 bp, Homo sapiens
ccttcctacccttta

SEQ ID NO: 284847 - DNA, 15 bp, Homo sapiens
tccttcctacccttt

SEQ ID NO: 284848 - DNA, 15 bp, Homo sapiens
ctccttcctaccctt

SEQ ID NO: 284849 - DNA, 15 bp, Homo sapiens
tctccttcctaccct

SEQ ID NO: 284850 - DNA, 15 bp, Homo sapiens
ctctccttcctaccc

SEQ ID NO: 284851 - DNA, 15 bp, Homo sapiens
gctctccttcctacc

SEQ ID NO: 284852 - DNA, 15 bp, Homo sapiens
ggctctccttcctac

SEQ ID NO: 284853 - DNA, 15 bp, Homo sapiens
tggctctccttccta

SEQ ID NO: 284854 - DNA, 15 bp, Homo sapiens
ctggctctccttcct

SEQ ID NO: 284855 - DNA, 15 bp, Homo sapiens
tctggctctccttcc

SEQ ID NO: 284856 - DNA, 15 bp, Homo sapiens
ctctggctctccttc

SEQ ID NO: 284857 - DNA, 15 bp, Homo sapiens
actctggctctcctt

SEQ ID NO: 284858 - DNA, 15 bp, Homo sapiens
gactctggctctcct

SEQ ID NO: 284859 - DNA, 15 bp, Homo sapiens
tgactctggctctcc

SEQ ID NO: 284860 - DNA, 15 bp, Homo sapiens
ctgactctggctctc

SEQ ID NO: 284861 - DNA, 15 bp, Homo sapiens
tctgactctggctct

SEQ ID NO: 284862 - DNA, 15 bp, Homo sapiens
ctctgactctggctc

SEQ ID NO: 284863 - DNA, 15 bp, Homo sapiens
tctctgactctggct

SEQ ID NO: 284864 - DNA, 15 bp, Homo sapiens
ttctctgactctggc

SEQ ID NO: 284865 - DNA, 15 bp, Homo sapiens
cttctctgactctgg

SEQ ID NO: 284866 - DNA, 15 bp, Homo sapiens
ccttctctgactctg

SEQ ID NO: 284867 - DNA, 15 bp, Homo sapiens
tccttctctgactct

SEQ ID NO: 284868 - DNA, 15 bp, Homo sapiens
ctccttctctgactc

SEQ ID NO: 284869 - DNA, 15 bp, Homo sapiens
tctccttctctgact

SEQ ID NO: 284870 - DNA, 15 bp, Homo sapiens
gtctccttctctgac

SEQ ID NO: 284871 - DNA, 15 bp, Homo sapiens
cgtctccttctctga

SEQ ID NO: 284872 - DNA, 15 bp, Homo sapiens
acgtctccttctctg

SEQ ID NO: 284873 - DNA, 15 bp, Homo sapiens
tacgtctccttctct

SEQ ID NO: 284874 - DNA, 15 bp, Homo sapiens
ctacgtctccttctc

SEQ ID NO: 284875 - DNA, 15 bp, Homo sapiens
gctacgtctccttct

SEQ ID NO: 284876 - DNA, 15 bp, Homo sapiens
tgctacgtctccttc

SEQ ID NO: 284877 - DNA, 15 bp, Homo sapiens
ttgctacgtctcctt

SEQ ID NO: 284878 - DNA, 15 bp, Homo sapiens
attgctacgtctcct

SEQ ID NO: 284879 - DNA, 15 bp, Homo sapiens
cattgctacgtctcc

SEQ ID NO: 284880 - DNA, 15 bp, Homo sapiens
ccattgctacgtctc

SEQ ID NO: 284881 - DNA, 15 bp, Homo sapiens
tccattgctacgtct

SEQ ID NO: 284882 - DNA, 15 bp, Homo sapiens
ctccattgctacgtc

SEQ ID NO: 284883 - DNA, 15 bp, Homo sapiens
cctccattgctacgt

SEQ ID NO: 284884 - DNA, 15 bp, Homo sapiens
gcctccattgctacg

SEQ ID NO: 284885 - DNA, 15 bp, Homo sapiens
tgcctccattgctac

SEQ ID NO: 284886 - DNA, 15 bp, Homo sapiens
ctgcctccattgcta

SEQ ID NO: 284887 - DNA, 15 bp, Homo sapiens
tctgcctccattgct

SEQ ID NO: 284888 - DNA, 15 bp, Homo sapiens
ctctgcctccattgc

SEQ ID NO: 284889 - DNA, 15 bp, Homo sapiens
cctctgcctccattg

SEQ ID NO: 284890 - DNA, 15 bp, Homo sapiens
acctctgcctccatt

SEQ ID NO: 284891 - DNA, 15 bp, Homo sapiens
gacctctgcctccat

SEQ ID NO: 284892 - DNA, 15 bp, Homo sapiens
tgacctctgcctcca

SEQ ID NO: 284893 - DNA, 15 bp, Homo sapiens
ctgacctctgcctcc

SEQ ID NO: 284894 - DNA, 15 bp, Homo sapiens
tctgacctctgcctc

SEQ ID NO: 284895 - DNA, 15 bp, Homo sapiens
ctctgacctctgcct

SEQ ID NO: 284896 - DNA, 15 bp, Homo sapiens
tctctgacctctgcc

SEQ ID NO: 284897 - DNA, 15 bp, Homo sapiens
ctctctgacctctgc

SEQ ID NO: 284898 - DNA, 15 bp, Homo sapiens
ctctctctgacctct

SEQ ID NO: 284899 - DNA, 15 bp, Homo sapiens
tctctctctgacctc

SEQ ID NO: 284900 - DNA, 15 bp, Homo sapiens
atctctctctgacct

SEQ ID NO: 284901 - DNA, 15 bp, Homo sapiens
gatctctctctgacc

SEQ ID NO: 284902 - DNA, 15 bp, Homo sapiens
agatctctctctgac

SEQ ID NO: 284903 - DNA, 15 bp, Homo sapiens
gcagatctctctctg

SEQ ID NO: 284904 - DNA, 15 bp, Homo sapiens
tgcagatctctctct

SEQ ID NO: 284905 - DNA, 15 bp, Homo sapiens
ctgcagatctctctc

SEQ ID NO: 284906 - DNA, 15 bp, Homo sapiens
tctgcagatctctct

SEQ ID NO: 284907 - DNA, 15 bp, Homo sapiens
atctgcagatctctc

SEQ ID NO: 284908 - DNA, 15 bp, Homo sapiens
catctgcagatctct

SEQ ID NO: 284909 - DNA, 15 bp, Homo sapiens
gcatctgcagatctc

SEQ ID NO: 284910 - DNA, 15 bp, Homo sapiens
agcatctgcagatct

SEQ ID NO: 284911 - DNA, 15 bp, Homo sapiens
cagcatctgcagatc

SEQ ID NO: 284912 - DNA, 15 bp, Homo sapiens
gcagcatctgcagat

SEQ ID NO: 284913 - DNA, 15 bp, Homo sapiens
agcagcatctgcaga

SEQ ID NO: 284914 - DNA, 15 bp, Homo sapiens
cagcagcatctgcag

SEQ ID NO: 284915 - DNA, 15 bp, Homo sapiens
acagcagcatctgca

SEQ ID NO: 284916 - DNA, 15 bp, Homo sapiens
cacagcagcatctgc

SEQ ID NO: 284917 - DNA, 15 bp, Homo sapiens
acacagcagcatctg

SEQ ID NO: 284918 - DNA, 15 bp, Homo sapiens
aacacagcagcatct

SEQ ID NO: 284919 - DNA, 15 bp, Homo sapiens
caacacagcagcatc

SEQ ID NO: 284920 - DNA, 15 bp, Homo sapiens
ccaacacagcagcat

SEQ ID NO: 284921 - DNA, 15 bp, Homo sapiens
gccaacacagcagca

SEQ ID NO: 284922 - DNA, 15 bp, Homo sapiens
agccaacacagcagc

SEQ ID NO: 284923 - DNA, 15 bp, Homo sapiens
aagccaacacagcag

SEQ ID NO: 284924 - DNA, 15 bp, Homo sapiens
aaagccaacacagca

SEQ ID NO: 284925 - DNA, 15 bp, Homo sapiens
caaagccaacacagc

SEQ ID NO: 284926 - DNA, 15 bp, Homo sapiens
tcaaagccaacacag

SEQ ID NO: 284927 - DNA, 15 bp, Homo sapiens
ttcaaagccaacaca

SEQ ID NO: 284928 - DNA, 15 bp, Homo sapiens
tttcaaagccaacac

SEQ ID NO: 284929 - DNA, 15 bp, Homo sapiens
ttttcaaagccaaca

SEQ ID NO: 284930 - DNA, 15 bp, Homo sapiens
attttcaaagccaac

SEQ ID NO: 284931 - DNA, 15 bp, Homo sapiens
cattttcaaagccaa

SEQ ID NO: 284932 - DNA, 15 bp, Homo sapiens
tcattttcaaagcca

SEQ ID NO: 284933 - DNA, 15 bp, Homo sapiens
ctcattttcaaagcc

SEQ ID NO: 284934 - DNA, 15 bp, Homo sapiens
cctcattttcaaagc

SEQ ID NO: 284935 - DNA, 15 bp, Homo sapiens
tcctcattttcaaag

SEQ ID NO: 284936 - DNA, 15 bp, Homo sapiens
ttcctcattttcaaa

SEQ ID NO: 284937 - DNA, 15 bp, Homo sapiens
attcctcattttcaa

SEQ ID NO: 284938 - DNA, 15 bp, Homo sapiens
cattcctcattttca

SEQ ID NO: 284939 - DNA, 15 bp, Homo sapiens
gcattcctcattttc

SEQ ID NO: 284940 - DNA, 15 bp, Homo sapiens
tgcattcctcatttt

SEQ ID NO: 284941 - DNA, 15 bp, Homo sapiens
ctgcattcctcattt

SEQ ID NO: 284942 - DNA, 15 bp, Homo sapiens
cctgcattcctcatt

SEQ ID NO: 284943 - DNA, 15 bp, Homo sapiens
acctgcattcctcat

SEQ ID NO: 284944 - DNA, 15 bp, Homo sapiens
cacctgcattcctca

SEQ ID NO: 284945 - DNA, 15 bp, Homo sapiens
tcacctgcattcctc

SEQ ID NO: 284946 - DNA, 15 bp, Homo sapiens
gtcacctgcattcct

SEQ ID NO: 284947 - DNA, 15 bp, Homo sapiens
ggtcacctgcattcc

SEQ ID NO: 284948 - DNA, 15 bp, Homo sapiens
aggtcacctgcattc

SEQ ID NO: 284949 - DNA, 15 bp, Homo sapiens
gaggtcacctgcatt

SEQ ID NO: 284950 - DNA, 15 bp, Homo sapiens
tgaggtcacctgcat

SEQ ID NO: 284951 - DNA, 15 bp, Homo sapiens
ttgaggtcacctgca

SEQ ID NO: 284952 - DNA, 15 bp, Homo sapiens
cttgaggtcacctgc

SEQ ID NO: 284953 - DNA, 15 bp, Homo sapiens
ccttgaggtcacctg

SEQ ID NO: 284954 - DNA, 15 bp, Homo sapiens
accttgaggtcacct

SEQ ID NO: 284955 - DNA, 15 bp, Homo sapiens
caccttgaggtcacc

SEQ ID NO: 284956 - DNA, 15 bp, Homo sapiens
gcaccttgaggtcac

SEQ ID NO: 284957 - DNA, 15 bp, Homo sapiens
agcaccttgaggtca

SEQ ID NO: 284958 - DNA, 15 bp, Homo sapiens
tagcaccttgaggtc

SEQ ID NO: 284959 - DNA, 15 bp, Homo sapiens
ctagcaccttgaggt

SEQ ID NO: 284960 - DNA, 15 bp, Homo sapiens
tctagcaccttgagg

SEQ ID NO: 284961 - DNA, 15 bp, Homo sapiens
atctagcaccttgag

SEQ ID NO: 284962 - DNA, 15 bp, Homo sapiens
catctagcaccttga

SEQ ID NO: 284963 - DNA, 15 bp, Homo sapiens
tcatctagcaccttg

SEQ ID NO: 284964 - DNA, 15 bp, Homo sapiens
atcatctagcacctt

SEQ ID NO: 284965 - DNA, 15 bp, Homo sapiens
catcatctagcacct

SEQ ID NO: 284966 - DNA, 15 bp, Homo sapiens
gcatcatctagcacc

SEQ ID NO: 284967 - DNA, 15 bp, Homo sapiens
tgcatcatctagcac

SEQ ID NO: 284968 - DNA, 15 bp, Homo sapiens
ttgcatcatctagca

SEQ ID NO: 284969 - DNA, 15 bp, Homo sapiens
cttgcatcatctagc

SEQ ID NO: 284970 - DNA, 15 bp, Homo sapiens
ccttgcatcatctag

SEQ ID NO: 284971 - DNA, 15 bp, Homo sapiens
tccttgcatcatcta

SEQ ID NO: 284972 - DNA, 15 bp, Homo sapiens
ttccttgcatcatct

SEQ ID NO: 284973 - DNA, 15 bp, Homo sapiens
tttccttgcatcatc

SEQ ID NO: 284974 - DNA, 15 bp, Homo sapiens
gtttccttgcatcat

SEQ ID NO: 284975 - DNA, 15 bp, Homo sapiens
tgtttccttgcatca

SEQ ID NO: 284976 - DNA, 15 bp, Homo sapiens
ttgtttccttgcatc

SEQ ID NO: 284977 - DNA, 15 bp, Homo sapiens
tttgtttccttgcat

SEQ ID NO: 284978 - DNA, 15 bp, Homo sapiens
atttgtttccttgca

SEQ ID NO: 284979 - DNA, 15 bp, Homo sapiens
tatttgtttccttgc

SEQ ID NO: 284980 - DNA, 15 bp, Homo sapiens
ttatttgtttccttg

SEQ ID NO: 284981 - DNA, 15 bp, Homo sapiens
attatttgtttcctt

SEQ ID NO: 284982 - DNA, 15 bp, Homo sapiens
gattatttgtttcct

SEQ ID NO: 284983 - DNA, 15 bp, Homo sapiens
agattatttgtttcc

SEQ ID NO: 284984 - DNA, 15 bp, Homo sapiens
gagattatttgtttc

SEQ ID NO: 284985 - DNA, 15 bp, Homo sapiens
ggagattatttgttt

SEQ ID NO: 284986 - DNA, 15 bp, Homo sapiens
aggagattatttgtt

SEQ ID NO: 284987 - DNA, 15 bp, Homo sapiens
taggagattatttgt

SEQ ID NO: 284988 - DNA, 15 bp, Homo sapiens
ataggagattatttg

SEQ ID NO: 284989 - DNA, 15 bp, Homo sapiens
cataggagattattt

SEQ ID NO: 284990 - DNA, 15 bp, Homo sapiens
tcataggagattatt

SEQ ID NO: 284991 - DNA, 15 bp, Homo sapiens
ttcataggagattat

SEQ ID NO: 284992 - DNA, 15 bp, Homo sapiens
gttcataggagatta

SEQ ID NO: 284993 - DNA, 15 bp, Homo sapiens
ggttcataggagatt

SEQ ID NO: 284994 - DNA, 15 bp, Homo sapiens
gggttcataggagat

SEQ ID NO: 284995 - DNA, 15 bp, Homo sapiens
agggttcataggaga

SEQ ID NO: 284996 - DNA, 15 bp, Homo sapiens
tagggttcataggag

SEQ ID NO: 284997 - DNA, 15 bp, Homo sapiens
ctagggttcatagga

SEQ ID NO: 284998 - DNA, 15 bp, Homo sapiens
cctagggttcatagg

SEQ ID NO: 284999 - DNA, 15 bp, Homo sapiens
tcctagggttcatag

SEQ ID NO: 285000 - DNA, 15 bp, Homo sapiens
atcctagggttcata

SEQ ID NO: 285001 - DNA, 15 bp, Homo sapiens
catcctagggttcat

SEQ ID NO: 285002 - DNA, 15 bp, Homo sapiens
ccatcctagggttca

SEQ ID NO: 285003 - DNA, 15 bp, Homo sapiens
cccatcctagggttc

SEQ ID NO: 285004 - DNA, 15 bp, Homo sapiens
gcccatcctagggtt

SEQ ID NO: 285005 - DNA, 15 bp, Homo sapiens
tgcccatcctagggt

SEQ ID NO: 285006 - DNA, 15 bp, Homo sapiens
atgcccatcctaggg

SEQ ID NO: 285007 - DNA, 15 bp, Homo sapiens
aatgcccatcctagg

SEQ ID NO: 285008 - DNA, 15 bp, Homo sapiens
taatgcccatcctag

SEQ ID NO: 285009 - DNA, 15 bp, Homo sapiens
ataatgcccatccta

SEQ ID NO: 285010 - DNA, 15 bp, Homo sapiens
aataatgcccatcct

SEQ ID NO: 285011 - DNA, 15 bp, Homo sapiens
taataatgcccatcc

SEQ ID NO: 285012 - DNA, 15 bp, Homo sapiens
ataataatgcccatc

SEQ ID NO: 285013 - DNA, 15 bp, Homo sapiens
cataataatgcccat

SEQ ID NO: 285014 - DNA, 15 bp, Homo sapiens
tcataataatgccca

SEQ ID NO: 285015 - DNA, 15 bp, Homo sapiens
ctcataataatgccc

SEQ ID NO: 285016 - DNA, 15 bp, Homo sapiens
actcataataatgcc

SEQ ID NO: 285017 - DNA, 15 bp, Homo sapiens
gactcataataatgc

SEQ ID NO: 285018 - DNA, 15 bp, Homo sapiens
ggactcataataatg

SEQ ID NO: 285019 - DNA, 15 bp, Homo sapiens
aggactcataataat

SEQ ID NO: 285020 - DNA, 15 bp, Homo sapiens
taggactcataataa

SEQ ID NO: 285021 - DNA, 15 bp, Homo sapiens
ataggactcataata

SEQ ID NO: 285022 - DNA, 15 bp, Homo sapiens
aataggactcataat

SEQ ID NO: 285023 - DNA, 15 bp, Homo sapiens
aaataggactcataa

SEQ ID NO: 285024 - DNA, 15 bp, Homo sapiens
aaaataggactcata

SEQ ID NO: 285025 - DNA, 15 bp, Homo sapiens
taaaataggactcat

SEQ ID NO: 285026 - DNA, 15 bp, Homo sapiens
ataaaataggactca

SEQ ID NO: 285027 - DNA, 15 bp, Homo sapiens
tataaaataggactc

SEQ ID NO: 285028 - DNA, 15 bp, Homo sapiens
ttataaaataggact

SEQ ID NO: 285029 - DNA, 15 bp, Homo sapiens
tttataaaataggac

SEQ ID NO: 285030 - DNA, 15 bp, Homo sapiens
gtttataaaatagga

SEQ ID NO: 285031 - DNA, 15 bp, Homo sapiens
tgtttataaaatagg

SEQ ID NO: 285032 - DNA, 15 bp, Homo sapiens
ttgtttataaaatag

SEQ ID NO: 285033 - DNA, 15 bp, Homo sapiens
cttgtttataaaata

SEQ ID NO: 285034 - DNA, 15 bp, Homo sapiens
ccttgtttataaaat

SEQ ID NO: 285035 - DNA, 15 bp, Homo sapiens
tccttgtttataaaa

SEQ ID NO: 285036 - DNA, 15 bp, Homo sapiens
ttccttgtttataaa

SEQ ID NO: 285037 - DNA, 15 bp, Homo sapiens
cttccttgtttataa

SEQ ID NO: 285038 - DNA, 15 bp, Homo sapiens
gcttccttgtttata

SEQ ID NO: 285039 - DNA, 15 bp, Homo sapiens
agcttccttgtttat

SEQ ID NO: 285040 - DNA, 15 bp, Homo sapiens
cagcttccttgttta

SEQ ID NO: 285041 - DNA, 15 bp, Homo sapiens
tcagcttccttgttt

SEQ ID NO: 285042 - DNA, 15 bp, Homo sapiens
gtcagcttccttgtt

SEQ ID NO: 285043 - DNA, 15 bp, Homo sapiens
tgtcagcttccttgt

SEQ ID NO: 285044 - DNA, 15 bp, Homo sapiens
atgtcagcttccttg

SEQ ID NO: 285045 - DNA, 15 bp, Homo sapiens
gatgtcagcttcctt

SEQ ID NO: 285046 - DNA, 15 bp, Homo sapiens
ggatgtcagcttcct

SEQ ID NO: 285047 - DNA, 15 bp, Homo sapiens
tggatgtcagcttcc

SEQ ID NO: 285048 - DNA, 15 bp, Homo sapiens
ctggatgtcagcttc

SEQ ID NO: 285049 - DNA, 15 bp, Homo sapiens
tctggatgtcagctt

SEQ ID NO: 285050 - DNA, 15 bp, Homo sapiens
ttctggatgtcagct

SEQ ID NO: 285051 - DNA, 15 bp, Homo sapiens
tttctggatgtcagc

SEQ ID NO: 285052 - DNA, 15 bp, Homo sapiens
ctttctggatgtcag

SEQ ID NO: 285053 - DNA, 15 bp, Homo sapiens
tctttctggatgtca

SEQ ID NO: 285054 - DNA, 15 bp, Homo sapiens
atctttctggatgtc

SEQ ID NO: 285055 - DNA, 15 bp, Homo sapiens
tatctttctggatgt

SEQ ID NO: 285056 - DNA, 15 bp, Homo sapiens
ttatctttctggatg

SEQ ID NO: 285057 - DNA, 15 bp, Homo sapiens
tttatctttctggat

SEQ ID NO: 285058 - DNA, 15 bp, Homo sapiens
atttatctttctgga

SEQ ID NO: 285059 - DNA, 15 bp, Homo sapiens
catttatctttctgg

SEQ ID NO: 285060 - DNA, 15 bp, Homo sapiens
tcatttatctttctg

SEQ ID NO: 285061 - DNA, 15 bp, Homo sapiens
gtcatttatctttct

SEQ ID NO: 285062 - DNA, 15 bp, Homo sapiens
tgtcatttatctttc

SEQ ID NO: 285063 - DNA, 15 bp, Homo sapiens
atgtcatttatcttt

SEQ ID NO: 285064 - DNA, 15 bp, Homo sapiens
catgtcatttatctt

SEQ ID NO: 285065 - DNA, 15 bp, Homo sapiens
acatgtcatttatct

SEQ ID NO: 285066 - DNA, 15 bp, Homo sapiens
gacatgtcatttatc

SEQ ID NO: 285067 - DNA, 15 bp, Homo sapiens
ggacatgtcatttat

SEQ ID NO: 285068 - DNA, 15 bp, Homo sapiens
gggacatgtcattta

SEQ ID NO: 285069 - DNA, 15 bp, Homo sapiens
agggacatgtcattt

SEQ ID NO: 285070 - DNA, 15 bp, Homo sapiens
cagggacatgtcatt

SEQ ID NO: 285071 - DNA, 15 bp, Homo sapiens
tcagggacatgtcat

SEQ ID NO: 285072 - DNA, 15 bp, Homo sapiens
atcagggacatgtca

SEQ ID NO: 285073 - DNA, 15 bp, Homo sapiens
gatcagggacatgtc

SEQ ID NO: 285074 - DNA, 15 bp, Homo sapiens
tgatcagggacatgt

SEQ ID NO: 285075 - DNA, 15 bp, Homo sapiens
gtgatcagggacatg

SEQ ID NO: 285076 - DNA, 15 bp, Homo sapiens
ggtgatcagggacat

SEQ ID NO: 285077 - DNA, 15 bp, Homo sapiens
gggtgatcagggaca

SEQ ID NO: 285078 - DNA, 15 bp, Homo sapiens
tgggtgatcagggac

SEQ ID NO: 285079 - DNA, 15 bp, Homo sapiens
atgggtgatcaggga

SEQ ID NO: 285080 - DNA, 15 bp, Homo sapiens
tatgggtgatcaggg

SEQ ID NO: 285081 - DNA, 15 bp, Homo sapiens
atatgggtgatcagg

SEQ ID NO: 285082 - DNA, 15 bp, Homo sapiens
tatatgggtgatcag

SEQ ID NO: 285083 - DNA, 15 bp, Homo sapiens
atatatgggtgatca

SEQ ID NO: 285084 - DNA, 15 bp, Homo sapiens
gatatatgggtgatc

SEQ ID NO: 285085 - DNA, 15 bp, Homo sapiens
agatatatgggtgat

SEQ ID NO: 285086 - DNA, 15 bp, Homo sapiens
tagatatatgggtga

SEQ ID NO: 285087 - DNA, 15 bp, Homo sapiens
atagatatatgggtg

SEQ ID NO: 285088 - DNA, 15 bp, Homo sapiens
aatagatatatgggt

SEQ ID NO: 285089 - DNA, 15 bp, Homo sapiens
taatagatatatggg

SEQ ID NO: 285090 - DNA, 15 bp, Homo sapiens
gtaatagatatatgg

SEQ ID NO: 285091 - DNA, 15 bp, Homo sapiens
tgtaatagatatatg

SEQ ID NO: 285092 - DNA, 15 bp, Homo sapiens
ttgtaatagatatat

SEQ ID NO: 285093 - DNA, 15 bp, Homo sapiens
attgtaatagatata

SEQ ID NO: 285094 - DNA, 15 bp, Homo sapiens
aattgtaatagatat

SEQ ID NO: 285095 - DNA, 15 bp, Homo sapiens
taattgtaatagata

SEQ ID NO: 285096 - DNA, 15 bp, Homo sapiens
ctaattgtaatagat

SEQ ID NO: 285097 - DNA, 15 bp, Homo sapiens
tctaattgtaataga

SEQ ID NO: 285098 - DNA, 15 bp, Homo sapiens
atctaattgtaatag

SEQ ID NO: 285099 - DNA, 15 bp, Homo sapiens
tatctaattgtaata

SEQ ID NO: 285100 - DNA, 15 bp, Homo sapiens
gtatctaattgtaat

SEQ ID NO: 285101 - DNA, 15 bp, Homo sapiens
tgtatctaattgtaa

SEQ ID NO: 285102 - DNA, 15 bp, Homo sapiens
atgtatctaattgta

SEQ ID NO: 285103 - DNA, 15 bp, Homo sapiens
catgtatctaattgt

SEQ ID NO: 285104 - DNA, 15 bp, Homo sapiens
tcatgtatctaattg

SEQ ID NO: 285105 - DNA, 15 bp, Homo sapiens
ctcatgtatctaatt

SEQ ID NO: 285106 - DNA, 15 bp, Homo sapiens
actcatgtatctaat

SEQ ID NO: 285107 - DNA, 15 bp, Homo sapiens
tactcatgtatctaa

SEQ ID NO: 285108 - DNA, 15 bp, Homo sapiens
gtactcatgtatcta

SEQ ID NO: 285109 - DNA, 15 bp, Homo sapiens
cgtactcatgtatct

SEQ ID NO: 285110 - DNA, 15 bp, Homo sapiens
acgtactcatgtatc

SEQ ID NO: 285111 - DNA, 15 bp, Homo sapiens
aacgtactcatgtat

SEQ ID NO: 285112 - DNA, 15 bp, Homo sapiens
gaacgtactcatgta

SEQ ID NO: 285113 - DNA, 15 bp, Homo sapiens
cgaacgtactcatgt

SEQ ID NO: 285114 - DNA, 15 bp, Homo sapiens
tcgaacgtactcatg

SEQ ID NO: 285115 - DNA, 15 bp, Homo sapiens
atcgaacgtactcat

SEQ ID NO: 285116 - DNA, 15 bp, Homo sapiens
aatcgaacgtactca

SEQ ID NO: 285117 - DNA, 15 bp, Homo sapiens
caatcgaacgtactc

SEQ ID NO: 285118 - DNA, 15 bp, Homo sapiens
tcaatcgaacgtact

SEQ ID NO: 285119 - DNA, 15 bp, Homo sapiens
gtcaatcgaacgtac

SEQ ID NO: 285120 - DNA, 15 bp, Homo sapiens
agtcaatcgaacgta

SEQ ID NO: 285121 - DNA, 15 bp, Homo sapiens
gagtcaatcgaacgt

SEQ ID NO: 285122 - DNA, 15 bp, Homo sapiens
agagtcaatcgaacg

SEQ ID NO: 285123 - DNA, 15 bp, Homo sapiens
cagagtcaatcgaac

SEQ ID NO: 285124 - DNA, 15 bp, Homo sapiens
ccagagtcaatcgaa

SEQ ID NO: 285125 - DNA, 15 bp, Homo sapiens
tccagagtcaatcga

SEQ ID NO: 285126 - DNA, 15 bp, Homo sapiens
gtccagagtcaatcg

SEQ ID NO: 285127 - DNA, 15 bp, Homo sapiens
tgtccagagtcaatc

SEQ ID NO: 285128 - DNA, 15 bp, Homo sapiens
ttgtccagagtcaat

SEQ ID NO: 285129 - DNA, 15 bp, Homo sapiens
attgtccagagtcaa

SEQ ID NO: 285130 - DNA, 15 bp, Homo sapiens
aattgtccagagtca

SEQ ID NO: 285131 - DNA, 15 bp, Homo sapiens
aaattgtccagagtc

SEQ ID NO: 285132 - DNA, 15 bp, Homo sapiens
taaattgtccagagt

SEQ ID NO: 285133 - DNA, 15 bp, Homo sapiens
ttaaattgtccagag

SEQ ID NO: 285134 - DNA, 15 bp, Homo sapiens
tttaaattgtccaga

SEQ ID NO: 285135 - DNA, 15 bp, Homo sapiens
ttttaaattgtccag

SEQ ID NO: 285136 - DNA, 15 bp, Homo sapiens
cttttaaattgtcca

SEQ ID NO: 285137 - DNA, 15 bp, Homo sapiens
ccttttaaattgtcc

SEQ ID NO: 285138 - DNA, 15 bp, Homo sapiens
tccttttaaattgtc

SEQ ID NO: 285139 - DNA, 15 bp, Homo sapiens
ttccttttaaattgt

SEQ ID NO: 285140 - DNA, 15 bp, Homo sapiens
tttccttttaaattg

SEQ ID NO: 285141 - DNA, 15 bp, Homo sapiens
atttccttttaaatt

SEQ ID NO: 285142 - DNA, 15 bp, Homo sapiens
aatttccttttaaat

SEQ ID NO: 285143 - DNA, 15 bp, Homo sapiens
caatttccttttaaa

SEQ ID NO: 285144 - DNA, 15 bp, Homo sapiens
tcaatttccttttaa

SEQ ID NO: 285145 - DNA, 15 bp, Homo sapiens
atcaatttcctttta

SEQ ID NO: 285146 - DNA, 15 bp, Homo sapiens
catcaatttcctttt

SEQ ID NO: 285147 - DNA, 15 bp, Homo sapiens
acatcaatttccttt

SEQ ID NO: 285148 - DNA, 15 bp, Homo sapiens
aacatcaatttcctt

SEQ ID NO: 285149 - DNA, 15 bp, Homo sapiens
taacatcaatttcct

SEQ ID NO: 285150 - DNA, 15 bp, Homo sapiens
gtaacatcaatttcc

SEQ ID NO: 285151 - DNA, 15 bp, Homo sapiens
cgtaacatcaatttc

SEQ ID NO: 285152 - DNA, 15 bp, Homo sapiens
tcgtaacatcaattt

SEQ ID NO: 285153 - DNA, 15 bp, Homo sapiens
ttcgtaacatcaatt

SEQ ID NO: 285154 - DNA, 15 bp, Homo sapiens
attcgtaacatcaat

SEQ ID NO: 285155 - DNA, 15 bp, Homo sapiens
tattcgtaacatcaa

SEQ ID NO: 285156 - DNA, 15 bp, Homo sapiens
gtattcgtaacatca

SEQ ID NO: 285157 - DNA, 15 bp, Homo sapiens
agtattcgtaacatc

SEQ ID NO: 285158 - DNA, 15 bp, Homo sapiens
tagtattcgtaacat

SEQ ID NO: 285159 - DNA, 15 bp, Homo sapiens
gtagtattcgtaaca

SEQ ID NO: 285160 - DNA, 15 bp, Homo sapiens
tgtagtattcgtaac

SEQ ID NO: 285161 - DNA, 15 bp, Homo sapiens
atgtagtattcgtaa

SEQ ID NO: 285162 - DNA, 15 bp, Homo sapiens
tatgtagtattcgta

SEQ ID NO: 285163 - DNA, 15 bp, Homo sapiens
atatgtagtattcgt

SEQ ID NO: 285164 - DNA, 15 bp, Homo sapiens
gatatgtagtattcg

SEQ ID NO: 285165 - DNA, 15 bp, Homo sapiens
agatatgtagtattc

SEQ ID NO: 285166 - DNA, 15 bp, Homo sapiens
aagatatgtagtatt

SEQ ID NO: 285167 - DNA, 15 bp, Homo sapiens
aaagatatgtagtat

SEQ ID NO: 285168 - DNA, 15 bp, Homo sapiens
caaagatatgtagta

SEQ ID NO: 285169 - DNA, 15 bp, Homo sapiens
tcaaagatatgtagt

SEQ ID NO: 285170 - DNA, 15 bp, Homo sapiens
ttcaaagatatgtag

SEQ ID NO: 285171 - DNA, 15 bp, Homo sapiens
cttcaaagatatgta

SEQ ID NO: 285172 - DNA, 15 bp, Homo sapiens
ccttcaaagatatgt

SEQ ID NO: 285173 - DNA, 15 bp, Homo sapiens
tccttcaaagatatg

SEQ ID NO: 285174 - DNA, 15 bp, Homo sapiens
ttccttcaaagatat

SEQ ID NO: 285175 - DNA, 15 bp, Homo sapiens
tttccttcaaagata

SEQ ID NO: 285176 - DNA, 15 bp, Homo sapiens
ttttccttcaaagat

SEQ ID NO: 285177 - DNA, 15 bp, Homo sapiens
tttttccttcaaaga

SEQ ID NO: 285178 - DNA, 15 bp, Homo sapiens
atttttccttcaaag

SEQ ID NO: 285179 - DNA, 15 bp, Homo sapiens
aatttttccttcaaa

SEQ ID NO: 285180 - DNA, 15 bp, Homo sapiens
caatttttccttcaa

SEQ ID NO: 285181 - DNA, 15 bp, Homo sapiens
tcaatttttccttca

SEQ ID NO: 285182 - DNA, 15 bp, Homo sapiens
ctcaatttttccttc

SEQ ID NO: 285183 - DNA, 15 bp, Homo sapiens
gctcaatttttcctt

SEQ ID NO: 285184 - DNA, 15 bp, Homo sapiens
tgctcaatttttcct

SEQ ID NO: 285185 - DNA, 15 bp, Homo sapiens
ctgctcaatttttcc

SEQ ID NO: 285186 - DNA, 15 bp, Homo sapiens
actgctcaatttttc

SEQ ID NO: 285187 - DNA, 15 bp, Homo sapiens
cactgctcaattttt

SEQ ID NO: 285188 - DNA, 15 bp, Homo sapiens
tcactgctcaatttt

SEQ ID NO: 285189 - DNA, 15 bp, Homo sapiens
gtcactgctcaattt

SEQ ID NO: 285190 - DNA, 15 bp, Homo sapiens
tgtcactgctcaatt

SEQ ID NO: 285191 - DNA, 15 bp, Homo sapiens
atgtcactgctcaat

SEQ ID NO: 285192 - DNA, 15 bp, Homo sapiens
gatgtcactgctcaa

SEQ ID NO: 285193 - DNA, 15 bp, Homo sapiens
agatgtcactgctca

SEQ ID NO: 285194 - DNA, 15 bp, Homo sapiens
gagatgtcactgctc

SEQ ID NO: 285195 - DNA, 15 bp, Homo sapiens
tgagatgtcactgct

SEQ ID NO: 285196 - DNA, 15 bp, Homo sapiens
ctgagatgtcactgc

SEQ ID NO: 285197 - DNA, 15 bp, Homo sapiens
cctgagatgtcactg

SEQ ID NO: 285198 - DNA, 15 bp, Homo sapiens
tcctgagatgtcact

SEQ ID NO: 285199 - DNA, 15 bp, Homo sapiens
gtcctgagatgtcac

SEQ ID NO: 285200 - DNA, 15 bp, Homo sapiens
tgtcctgagatgtca

SEQ ID NO: 285201 - DNA, 15 bp, Homo sapiens
ctgtcctgagatgtc

SEQ ID NO: 285202 - DNA, 15 bp, Homo sapiens
cctgtcctgagatgt

SEQ ID NO: 285203 - DNA, 15 bp, Homo sapiens
tcctgtcctgagatg

SEQ ID NO: 285204 - DNA, 15 bp, Homo sapiens
atcctgtcctgagat

SEQ ID NO: 285205 - DNA, 15 bp, Homo sapiens
tatcctgtcctgaga

SEQ ID NO: 285206 - DNA, 15 bp, Homo sapiens
ctatcctgtcctgag

SEQ ID NO: 285207 - DNA, 15 bp, Homo sapiens
cctatcctgtcctga

SEQ ID NO: 285208 - DNA, 15 bp, Homo sapiens
tcctatcctgtcctg

SEQ ID NO: 285209 - DNA, 15 bp, Homo sapiens
gtcctatcctgtcct

SEQ ID NO: 285210 - DNA, 15 bp, Homo sapiens
agtcctatcctgtcc

SEQ ID NO: 285211 - DNA, 15 bp, Homo sapiens
gagtcctatcctgtc

SEQ ID NO: 285212 - DNA, 15 bp, Homo sapiens
tgagtcctatcctgt

SEQ ID NO: 285213 - DNA, 15 bp, Homo sapiens
atgagtcctatcctg

SEQ ID NO: 285214 - DNA, 15 bp, Homo sapiens
catgagtcctatcct

SEQ ID NO: 285215 - DNA, 15 bp, Homo sapiens
tcatgagtcctatcc

SEQ ID NO: 285216 - DNA, 15 bp, Homo sapiens
gtcatgagtcctatc

SEQ ID NO: 285217 - DNA, 15 bp, Homo sapiens
cgtcatgagtcctat

SEQ ID NO: 285218 - DNA, 15 bp, Homo sapiens
ccgtcatgagtccta

SEQ ID NO: 285219 - DNA, 15 bp, Homo sapiens
accgtcatgagtcct

SEQ ID NO: 285220 - DNA, 15 bp, Homo sapiens
aaccgtcatgagtcc

SEQ ID NO: 285221 - DNA, 15 bp, Homo sapiens
gaaccgtcatgagtc

SEQ ID NO: 285222 - DNA, 15 bp, Homo sapiens
agaaccgtcatgagt

SEQ ID NO: 285223 - DNA, 15 bp, Homo sapiens
cagaaccgtcatgag

SEQ ID NO: 285224 - DNA, 15 bp, Homo sapiens
ccagaaccgtcatga

SEQ ID NO: 285225 - DNA, 15 bp, Homo sapiens
cccagaaccgtcatg

SEQ ID NO: 285226 - DNA, 15 bp, Homo sapiens
ccccagaaccgtcat

SEQ ID NO: 285227 - DNA, 15 bp, Homo sapiens
tccccagaaccgtca

SEQ ID NO: 285228 - DNA, 15 bp, Homo sapiens
ttccccagaaccgtc

SEQ ID NO: 285229 - DNA, 15 bp, Homo sapiens
attccccagaaccgt

SEQ ID NO: 285230 - DNA, 15 bp, Homo sapiens
gattccccagaaccg

SEQ ID NO: 285231 - DNA, 15 bp, Homo sapiens
agattccccagaacc

SEQ ID NO: 285232 - DNA, 15 bp, Homo sapiens
gagattccccagaac

SEQ ID NO: 285233 - DNA, 15 bp, Homo sapiens
tgagattccccagaa

SEQ ID NO: 285234 - DNA, 15 bp, Homo sapiens
ctgagattccccaga

SEQ ID NO: 285235 - DNA, 15 bp, Homo sapiens
tctgagattccccag

SEQ ID NO: 285236 - DNA, 15 bp, Homo sapiens
ttctgagattcccca

SEQ ID NO: 285237 - DNA, 15 bp, Homo sapiens
cttctgagattcccc

SEQ ID NO: 285238 - DNA, 15 bp, Homo sapiens
acttctgagattccc

SEQ ID NO: 285239 - DNA, 15 bp, Homo sapiens
cacttctgagattcc

SEQ ID NO: 285240 - DNA, 15 bp, Homo sapiens
ccacttctgagattc

SEQ ID NO: 285241 - DNA, 15 bp, Homo sapiens
cccacttctgagatt

SEQ ID NO: 285242 - DNA, 15 bp, Homo sapiens
tcccacttctgagat

SEQ ID NO: 285243 - DNA, 15 bp, Homo sapiens
ttcccacttctgaga

SEQ ID NO: 285244 - DNA, 15 bp, Homo sapiens
gttcccacttctgag

SEQ ID NO: 285245 - DNA, 15 bp, Homo sapiens
cgttcccacttctga

SEQ ID NO: 285246 - DNA, 15 bp, Homo sapiens
gcgttcccacttctg

SEQ ID NO: 285247 - DNA, 15 bp, Homo sapiens
tgcgttcccacttct

SEQ ID NO: 285248 - DNA, 15 bp, Homo sapiens
ttgcgttcccacttc

SEQ ID NO: 285249 - DNA, 15 bp, Homo sapiens
cttgcgttcccactt

SEQ ID NO: 285250 - DNA, 15 bp, Homo sapiens
ccttgcgttcccact

SEQ ID NO: 285251 - DNA, 15 bp, Homo sapiens
tccttgcgttcccac

SEQ ID NO: 285252 - DNA, 15 bp, Homo sapiens
gtccttgcgttccca

SEQ ID NO: 285253 - DNA, 15 bp, Homo sapiens
tgtccttgcgttccc

SEQ ID NO: 285254 - DNA, 15 bp, Homo sapiens
ttgtccttgcgttcc

SEQ ID NO: 285255 - DNA, 15 bp, Homo sapiens
attgtccttgcgttc

SEQ ID NO: 285256 - DNA, 15 bp, Homo sapiens
aattgtccttgcgtt

SEQ ID NO: 285257 - DNA, 15 bp, Homo sapiens
gaattgtccttgcgt

SEQ ID NO: 285258 - DNA, 15 bp, Homo sapiens
ggaattgtccttgcg

SEQ ID NO: 285259 - DNA, 15 bp, Homo sapiens
aggaattgtccttgc

SEQ ID NO: 285260 - DNA, 15 bp, Homo sapiens
aaggaattgtccttg

SEQ ID NO: 285261 - DNA, 15 bp, Homo sapiens
caaggaattgtcctt

SEQ ID NO: 285262 - DNA, 15 bp, Homo sapiens
ccaaggaattgtcct

SEQ ID NO: 285263 - DNA, 15 bp, Homo sapiens
cccaaggaattgtcc

SEQ ID NO: 285264 - DNA, 15 bp, Homo sapiens
gcccaaggaattgtc

SEQ ID NO: 285265 - DNA, 15 bp, Homo sapiens
ggcccaaggaattgt

SEQ ID NO: 285266 - DNA, 15 bp, Homo sapiens
tggcccaaggaattg

SEQ ID NO: 285267 - DNA, 15 bp, Homo sapiens
atggcccaaggaatt

SEQ ID NO: 285268 - DNA, 15 bp, Homo sapiens
catggcccaaggaat

SEQ ID NO: 285269 - DNA, 15 bp, Homo sapiens
ccatggcccaaggaa

SEQ ID NO: 285270 - DNA, 15 bp, Homo sapiens
gccatggcccaagga

SEQ ID NO: 285271 - DNA, 15 bp, Homo sapiens
agccatggcccaagg

SEQ ID NO: 285272 - DNA, 15 bp, Homo sapiens
tagccatggcccaag

SEQ ID NO: 285273 - DNA, 15 bp, Homo sapiens
atagccatggcccaa

SEQ ID NO: 285274 - DNA, 15 bp, Homo sapiens
gatagccatggccca

SEQ ID NO: 285275 - DNA, 15 bp, Homo sapiens
tgatagccatggccc

SEQ ID NO: 285276 - DNA, 15 bp, Homo sapiens
ctgatagccatggcc

SEQ ID NO: 285277 - DNA, 15 bp, Homo sapiens
cctgatagccatggc

SEQ ID NO: 285278 - DNA, 15 bp, Homo sapiens
tcctgatagccatgg

SEQ ID NO: 285279 - DNA, 15 bp, Homo sapiens
gtcctgatagccatg

SEQ ID NO: 285280 - DNA, 15 bp, Homo sapiens
cgtcctgatagccat

SEQ ID NO: 285281 - DNA, 15 bp, Homo sapiens
acgtcctgatagcca

SEQ ID NO: 285282 - DNA, 15 bp, Homo sapiens
gacgtcctgatagcc

SEQ ID NO: 285283 - DNA, 15 bp, Homo sapiens
agacgtcctgatagc

SEQ ID NO: 285284 - DNA, 15 bp, Homo sapiens
gagacgtcctgatag

SEQ ID NO: 285285 - DNA, 15 bp, Homo sapiens
tgagacgtcctgata

SEQ ID NO: 285286 - DNA, 15 bp, Homo sapiens
gtgagacgtcctgat

SEQ ID NO: 285287 - DNA, 15 bp, Homo sapiens
agtgagacgtcctga

SEQ ID NO: 285288 - DNA, 15 bp, Homo sapiens
gagtgagacgtcctg

SEQ ID NO: 285289 - DNA, 15 bp, Homo sapiens
ggagtgagacgtcct

SEQ ID NO: 285290 - DNA, 15 bp, Homo sapiens
tggagtgagacgtcc

SEQ ID NO: 285291 - DNA, 15 bp, Homo sapiens
atggagtgagacgtc

SEQ ID NO: 285292 - DNA, 15 bp, Homo sapiens
gatggagtgagacgt

SEQ ID NO: 285293 - DNA, 15 bp, Homo sapiens
agatggagtgagacg

SEQ ID NO: 285294 - DNA, 15 bp, Homo sapiens
cagatggagtgagac

SEQ ID NO: 285295 - DNA, 15 bp, Homo sapiens
gcagatggagtgaga

SEQ ID NO: 285296 - DNA, 15 bp, Homo sapiens
ggcagatggagtgag

SEQ ID NO: 285297 - DNA, 15 bp, Homo sapiens
tggcagatggagtga

SEQ ID NO: 285298 - DNA, 15 bp, Homo sapiens
atggcagatggagtg

SEQ ID NO: 285299 - DNA, 15 bp, Homo sapiens
gatggcagatggagt

SEQ ID NO: 285300 - DNA, 15 bp, Homo sapiens
agatggcagatggag

SEQ ID NO: 285301 - DNA, 15 bp, Homo sapiens
cagatggcagatgga

SEQ ID NO: 285302 - DNA, 15 bp, Homo sapiens
gcagatggcagatgg

SEQ ID NO: 285303 - DNA, 15 bp, Homo sapiens
ggcagatggcagatg

SEQ ID NO: 285304 - DNA, 15 bp, Homo sapiens
gggcagatggcagat

SEQ ID NO: 285305 - DNA, 15 bp, Homo sapiens
agggcagatggcaga

SEQ ID NO: 285306 - DNA, 15 bp, Homo sapiens
aagggcagatggcag

SEQ ID NO: 285307 - DNA, 15 bp, Homo sapiens
caagggcagatggca

SEQ ID NO: 285308 - DNA, 15 bp, Homo sapiens
ccaagggcagatggc

SEQ ID NO: 285309 - DNA, 15 bp, Homo sapiens
cccaagggcagatgg

SEQ ID NO: 285310 - DNA, 15 bp, Homo sapiens
acccaagggcagatg

SEQ ID NO: 285311 - DNA, 15 bp, Homo sapiens
cacccaagggcagat

SEQ ID NO: 285312 - DNA, 15 bp, Homo sapiens
tcacccaagggcaga

SEQ ID NO: 285313 - DNA, 15 bp, Homo sapiens
gtcacccaagggcag

SEQ ID NO: 285314 - DNA, 15 bp, Homo sapiens
tgtcacccaagggca

SEQ ID NO: 285315 - DNA, 15 bp, Homo sapiens
gtgtcacccaagggc

SEQ ID NO: 285316 - DNA, 15 bp, Homo sapiens
agtgtcacccaaggg

SEQ ID NO: 285317 - DNA, 15 bp, Homo sapiens
cagtgtcacccaagg

SEQ ID NO: 285318 - DNA, 15 bp, Homo sapiens
ccagtgtcacccaag

SEQ ID NO: 285319 - DNA, 15 bp, Homo sapiens
tccagtgtcacccaa

SEQ ID NO: 285320 - DNA, 15 bp, Homo sapiens
ttccagtgtcaccca

SEQ ID NO: 285321 - DNA, 15 bp, Homo sapiens
tttccagtgtcaccc

SEQ ID NO: 285322 - DNA, 15 bp, Homo sapiens
ctttccagtgtcacc

SEQ ID NO: 285323 - DNA, 15 bp, Homo sapiens
tctttccagtgtcac

SEQ ID NO: 285324 - DNA, 15 bp, Homo sapiens
ttctttccagtgtca

SEQ ID NO: 285325 - DNA, 15 bp, Homo sapiens
tttctttccagtgtc

SEQ ID NO: 285326 - DNA, 15 bp, Homo sapiens
ctttctttccagtgt

SEQ ID NO: 285327 - DNA, 15 bp, Homo sapiens
tctttctttccagtg

SEQ ID NO: 285328 - DNA, 15 bp, Homo sapiens
ttctttctttccagt

SEQ ID NO: 285329 - DNA, 15 bp, Homo sapiens
attctttctttccag

SEQ ID NO: 285330 - DNA, 15 bp, Homo sapiens
cattctttctttcca

SEQ ID NO: 285331 - DNA, 15 bp, Homo sapiens
ccattctttctttcc

SEQ ID NO: 285332 - DNA, 15 bp, Homo sapiens
cccattctttctttc

SEQ ID NO: 285333 - DNA, 15 bp, Homo sapiens
ccccattctttcttt

SEQ ID NO: 285334 - DNA, 15 bp, Homo sapiens
tccccattctttctt

SEQ ID NO: 285335 - DNA, 15 bp, Homo sapiens
ctccccattctttct

SEQ ID NO: 285336 - DNA, 15 bp, Homo sapiens
cctccccattctttc

SEQ ID NO: 285337 - DNA, 15 bp, Homo sapiens
gcctccccattcttt

SEQ ID NO: 285338 - DNA, 15 bp, Homo sapiens
agcctccccattctt

SEQ ID NO: 285339 - DNA, 15 bp, Homo sapiens
cagcctccccattct

SEQ ID NO: 285340 - DNA, 15 bp, Homo sapiens
tcagcctccccattc

SEQ ID NO: 285341 - DNA, 15 bp, Homo sapiens
gtcagcctccccatt

SEQ ID NO: 285342 - DNA, 15 bp, Homo sapiens
agtcagcctccccat

SEQ ID NO: 285343 - DNA, 15 bp, Homo sapiens
cagtcagcctcccca

SEQ ID NO: 285344 - DNA, 15 bp, Homo sapiens
acagtcagcctcccc

SEQ ID NO: 285345 - DNA, 15 bp, Homo sapiens
cacagtcagcctccc

SEQ ID NO: 285346 - DNA, 15 bp, Homo sapiens
ccacagtcagcctcc

SEQ ID NO: 285347 - DNA, 15 bp, Homo sapiens
accacagtcagcctc

SEQ ID NO: 285348 - DNA, 15 bp, Homo sapiens
aaccacagtcagcct

SEQ ID NO: 285349 - DNA, 15 bp, Homo sapiens
aaaccacagtcagcc

SEQ ID NO: 285350 - DNA, 15 bp, Homo sapiens
taaaccacagtcagc

SEQ ID NO: 285351 - DNA, 15 bp, Homo sapiens
gtaaaccacagtcag

SEQ ID NO: 285352 - DNA, 15 bp, Homo sapiens
tgtaaaccacagtca

SEQ ID NO: 285353 - DNA, 15 bp, Homo sapiens
gtgtaaaccacagtc

SEQ ID NO: 285354 - DNA, 15 bp, Homo sapiens
tgtgtaaaccacagt

SEQ ID NO: 285355 - DNA, 15 bp, Homo sapiens
ctgtgtaaaccacag

SEQ ID NO: 285356 - DNA, 15 bp, Homo sapiens
cctgtgtaaaccaca

SEQ ID NO: 285357 - DNA, 15 bp, Homo sapiens
gcctgtgtaaaccac

SEQ ID NO: 285358 - DNA, 15 bp, Homo sapiens
tgcctgtgtaaacca

SEQ ID NO: 285359 - DNA, 15 bp, Homo sapiens
atgcctgtgtaaacc

SEQ ID NO: 285360 - DNA, 15 bp, Homo sapiens
aatgcctgtgtaaac

SEQ ID NO: 285361 - DNA, 15 bp, Homo sapiens
caatgcctgtgtaaa

SEQ ID NO: 285362 - DNA, 15 bp, Homo sapiens
gcaatgcctgtgtaa

SEQ ID NO: 285363 - DNA, 15 bp, Homo sapiens
tgcaatgcctgtgta

SEQ ID NO: 285364 - DNA, 15 bp, Homo sapiens
ctgcaatgcctgtgt

SEQ ID NO: 285365 - DNA, 15 bp, Homo sapiens
actgcaatgcctgtg

SEQ ID NO: 285366 - DNA, 15 bp, Homo sapiens
aactgcaatgcctgt

SEQ ID NO: 285367 - DNA, 15 bp, Homo sapiens
aaactgcaatgcctg

SEQ ID NO: 285368 - DNA, 15 bp, Homo sapiens
caaactgcaatgcct

SEQ ID NO: 285369 - DNA, 15 bp, Homo sapiens
gcaaactgcaatgcc

SEQ ID NO: 285370 - DNA, 15 bp, Homo sapiens
tgcaaactgcaatgc

SEQ ID NO: 285371 - DNA, 15 bp, Homo sapiens
ttgcaaactgcaatg

SEQ ID NO: 285372 - DNA, 15 bp, Homo sapiens
tttgcaaactgcaat

SEQ ID NO: 285373 - DNA, 15 bp, Homo sapiens
atttgcaaactgcaa

SEQ ID NO: 285374 - DNA, 15 bp, Homo sapiens
gatttgcaaactgca

SEQ ID NO: 285375 - DNA, 15 bp, Homo sapiens
agatttgcaaactgc

SEQ ID NO: 285376 - DNA, 15 bp, Homo sapiens
cagatttgcaaactg

SEQ ID NO: 285377 - DNA, 15 bp, Homo sapiens
tcagatttgcaaact

SEQ ID NO: 285378 - DNA, 15 bp, Homo sapiens
ttcagatttgcaaac

SEQ ID NO: 285379 - DNA, 15 bp, Homo sapiens
tttcagatttgcaaa

SEQ ID NO: 285380 - DNA, 15 bp, Homo sapiens
gtttcagatttgcaa

SEQ ID NO: 285381 - DNA, 15 bp, Homo sapiens
ggtttcagatttgca

SEQ ID NO: 285382 - DNA, 15 bp, Homo sapiens
aggtttcagatttgc

SEQ ID NO: 285383 - DNA, 15 bp, Homo sapiens
taggtttcagatttg

SEQ ID NO: 285384 - DNA, 15 bp, Homo sapiens
ctaggtttcagattt

SEQ ID NO: 285385 - DNA, 15 bp, Homo sapiens
tctaggtttcagatt

SEQ ID NO: 285386 - DNA, 15 bp, Homo sapiens
ttctaggtttcagat

SEQ ID NO: 285387 - DNA, 15 bp, Homo sapiens
gttctaggtttcaga

SEQ ID NO: 285388 - DNA, 15 bp, Homo sapiens
tgttctaggtttcag

SEQ ID NO: 285389 - DNA, 15 bp, Homo sapiens
ctgttctaggtttca

SEQ ID NO: 285390 - DNA, 15 bp, Homo sapiens
tctgttctaggtttc

SEQ ID NO: 285391 - DNA, 15 bp, Homo sapiens
ttctgttctaggttt

SEQ ID NO: 285392 - DNA, 15 bp, Homo sapiens
gttctgttctaggtt

SEQ ID NO: 285393 - DNA, 15 bp, Homo sapiens
tgttctgttctaggt

SEQ ID NO: 285394 - DNA, 15 bp, Homo sapiens
ttgttctgttctagg

SEQ ID NO: 285395 - DNA, 15 bp, Homo sapiens
attgttctgttctag

SEQ ID NO: 285396 - DNA, 15 bp, Homo sapiens
gattgttctgttcta

SEQ ID NO: 285397 - DNA, 15 bp, Homo sapiens
ggattgttctgttct

SEQ ID NO: 285398 - DNA, 15 bp, Homo sapiens
aggattgttctgttc

SEQ ID NO: 285399 - DNA, 15 bp, Homo sapiens
aaggattgttctgtt

SEQ ID NO: 285400 - DNA, 15 bp, Homo sapiens
taaggattgttctgt

SEQ ID NO: 285401 - DNA, 15 bp, Homo sapiens
ttaaggattgttctg

SEQ ID NO: 285402 - DNA, 15 bp, Homo sapiens
tttaaggattgttct

SEQ ID NO: 285403 - DNA, 15 bp, Homo sapiens
ttttaaggattgttc

SEQ ID NO: 285404 - DNA, 15 bp, Homo sapiens
cttttaaggattgtt

SEQ ID NO: 285405 - DNA, 15 bp, Homo sapiens
tcttttaaggattgt

SEQ ID NO: 285406 - DNA, 15 bp, Homo sapiens
ttcttttaaggattg

SEQ ID NO: 285407 - DNA, 15 bp, Homo sapiens
tttcttttaaggatt

SEQ ID NO: 285408 - DNA, 15 bp, Homo sapiens
ctttcttttaaggat

SEQ ID NO: 285409 - DNA, 15 bp, Homo sapiens
tctttcttttaagga

SEQ ID NO: 285410 - DNA, 15 bp, Homo sapiens
ttctttcttttaagg

SEQ ID NO: 285411 - DNA, 15 bp, Homo sapiens
tttctttcttttaag

SEQ ID NO: 285412 - DNA, 15 bp, Homo sapiens
ttttctttcttttaa

SEQ ID NO: 285413 - DNA, 15 bp, Homo sapiens
attttctttctttta

SEQ ID NO: 285414 - DNA, 15 bp, Homo sapiens
gattttctttctttt

SEQ ID NO: 285415 - DNA, 15 bp, Homo sapiens
tgattttctttcttt

SEQ ID NO: 285416 - DNA, 15 bp, Homo sapiens
atgattttctttctt

SEQ ID NO: 285417 - DNA, 15 bp, Homo sapiens
aatgattttctttct

SEQ ID NO: 285418 - DNA, 15 bp, Homo sapiens
taatgattttctttc

SEQ ID NO: 285419 - DNA, 15 bp, Homo sapiens
ataatgattttcttt

SEQ ID NO: 285420 - DNA, 15 bp, Homo sapiens
aataatgattttctt

SEQ ID NO: 285421 - DNA, 15 bp, Homo sapiens
aaataatgattttct

SEQ ID NO: 285422 - DNA, 15 bp, Homo sapiens
aaaataatgattttc

SEQ ID NO: 285423 - DNA, 15 bp, Homo sapiens
aaaaataatgatttt

SEQ ID NO: 285424 - DNA, 15 bp, Homo sapiens
taaaaataatgattt

SEQ ID NO: 285425 - DNA, 15 bp, Homo sapiens
ataaaaataatgatt

SEQ ID NO: 285426 - DNA, 15 bp, Homo sapiens
aataaaaataatgat

SEQ ID NO: 285427 - DNA, 15 bp, Homo sapiens
aaataaaaataatga

SEQ ID NO: 285428 - DNA, 15 bp, Homo sapiens
taaataaaaataatg

SEQ ID NO: 285429 - DNA, 15 bp, Homo sapiens
ataaataaaaataat

SEQ ID NO: 285430 - DNA, 15 bp, Homo sapiens
cataaataaaaataa

SEQ ID NO: 285431 - DNA, 15 bp, Homo sapiens
acataaataaaaata

SEQ ID NO: 285432 - DNA, 15 bp, Homo sapiens
gacataaataaaaat

SEQ ID NO: 285433 - DNA, 15 bp, Homo sapiens
agacataaataaaaa

SEQ ID NO: 285434 - DNA, 15 bp, Homo sapiens
aagacataaataaaa

SEQ ID NO: 285435 - DNA, 15 bp, Homo sapiens
caagacataaataaa

SEQ ID NO: 285436 - DNA, 15 bp, Homo sapiens
acaagacataaataa

SEQ ID NO: 285437 - DNA, 15 bp, Homo sapiens
gacaagacataaata

SEQ ID NO: 285438 - DNA, 15 bp, Homo sapiens
agacaagacataaat

SEQ ID NO: 285439 - DNA, 15 bp, Homo sapiens
tagacaagacataaa

SEQ ID NO: 285440 - DNA, 15 bp, Homo sapiens
gtagacaagacataa

SEQ ID NO: 285441 - DNA, 15 bp, Homo sapiens
agtagacaagacata

SEQ ID NO: 285442 - DNA, 15 bp, Homo sapiens
aagtagacaagacat

SEQ ID NO: 285443 - DNA, 15 bp, Homo sapiens
aaagtagacaagaca

SEQ ID NO: 285444 - DNA, 15 bp, Homo sapiens
gaaagtagacaagac

SEQ ID NO: 285445 - DNA, 15 bp, Homo sapiens
tgaaagtagacaaga

SEQ ID NO: 285446 - DNA, 15 bp, Homo sapiens
ttgaaagtagacaag

SEQ ID NO: 285447 - DNA, 15 bp, Homo sapiens
tttgaaagtagacaa

SEQ ID NO: 285448 - DNA, 15 bp, Homo sapiens
ttttgaaagtagaca

SEQ ID NO: 285449 - DNA, 15 bp, Homo sapiens
cttttgaaagtagac

SEQ ID NO: 285450 - DNA, 15 bp, Homo sapiens
acttttgaaagtaga

SEQ ID NO: 285451 - DNA, 15 bp, Homo sapiens
aacttttgaaagtag

SEQ ID NO: 285452 - DNA, 15 bp, Homo sapiens
gaacttttgaaagta

SEQ ID NO: 285453 - DNA, 15 bp, Homo sapiens
tgaacttttgaaagt

SEQ ID NO: 285454 - DNA, 15 bp, Homo sapiens
atgaacttttgaaag

SEQ ID NO: 285455 - DNA, 15 bp, Homo sapiens
aatgaacttttgaaa

SEQ ID NO: 285456 - DNA, 15 bp, Homo sapiens
caatgaacttttgaa

SEQ ID NO: 285457 - DNA, 15 bp, Homo sapiens
tcaatgaacttttga

SEQ ID NO: 285458 - DNA, 15 bp, Homo sapiens
ttcaatgaacttttg

SEQ ID NO: 285459 - DNA, 15 bp, Homo sapiens
attcaatgaactttt

SEQ ID NO: 285460 - DNA, 15 bp, Homo sapiens
cattcaatgaacttt

SEQ ID NO: 285461 - DNA, 15 bp, Homo sapiens
tcattcaatgaactt

SEQ ID NO: 285462 - DNA, 15 bp, Homo sapiens
ttcattcaatgaact

SEQ ID NO: 285463 - DNA, 15 bp, Homo sapiens
attcattcaatgaac

SEQ ID NO: 285464 - DNA, 15 bp, Homo sapiens
gattcattcaatgaa

SEQ ID NO: 285465 - DNA, 15 bp, Homo sapiens
tgattcattcaatga

SEQ ID NO: 285466 - DNA, 15 bp, Homo sapiens
gtgattcattcaatg

SEQ ID NO: 285467 - DNA, 15 bp, Homo sapiens
tgtgattcattcaat

SEQ ID NO: 285468 - DNA, 15 bp, Homo sapiens
ctgtgattcattcaa

SEQ ID NO: 285469 - DNA, 15 bp, Homo sapiens
actgtgattcattca

SEQ ID NO: 285470 - DNA, 15 bp, Homo sapiens
aactgtgattcattc

SEQ ID NO: 285471 - DNA, 15 bp, Homo sapiens
aaactgtgattcatt

SEQ ID NO: 285472 - DNA, 15 bp, Homo sapiens
aaaactgtgattcat

SEQ ID NO: 285473 - DNA, 15 bp, Homo sapiens
aaaaactgtgattca

SEQ ID NO: 285474 - DNA, 15 bp, Homo sapiens
aaaaaactgtgattc

SEQ ID NO: 285475 - DNA, 15 bp, Homo sapiens
aaaaaaactgtgatt

SEQ ID NO: 285476 - DNA, 15 bp, Homo sapiens
caaaaaaactgtgat

SEQ ID NO: 285477 - DNA, 15 bp, Homo sapiens
acaaaaaaactgtga

SEQ ID NO: 285478 - DNA, 15 bp, Homo sapiens
gacaaaaaaactgtg

SEQ ID NO: 285479 - DNA, 15 bp, Homo sapiens
tgacaaaaaaactgt

SEQ ID NO: 285480 - DNA, 15 bp, Homo sapiens
atgacaaaaaaactg

SEQ ID NO: 285481 - DNA, 15 bp, Homo sapiens
gatgacaaaaaaact

SEQ ID NO: 285482 - DNA, 15 bp, Homo sapiens
agatgacaaaaaaac

SEQ ID NO: 285483 - DNA, 15 bp, Homo sapiens
cagatgacaaaaaaa

SEQ ID NO: 285484 - DNA, 15 bp, Homo sapiens
tcagatgacaaaaaa

SEQ ID NO: 285485 - DNA, 15 bp, Homo sapiens
atcagatgacaaaaa

SEQ ID NO: 285486 - DNA, 15 bp, Homo sapiens
tatcagatgacaaaa

SEQ ID NO: 285487 - DNA, 15 bp, Homo sapiens
atatcagatgacaaa

SEQ ID NO: 285488 - DNA, 15 bp, Homo sapiens
catatcagatgacaa

SEQ ID NO: 285489 - DNA, 15 bp, Homo sapiens
acatatcagatgaca

SEQ ID NO: 285490 - DNA, 15 bp, Homo sapiens
tacatatcagatgac

SEQ ID NO: 285491 - DNA, 15 bp, Homo sapiens
gtacatatcagatga

SEQ ID NO: 285492 - DNA, 15 bp, Homo sapiens
agtacatatcagatg

SEQ ID NO: 285493 - DNA, 15 bp, Homo sapiens
tagtacatatcagat

SEQ ID NO: 285494 - DNA, 15 bp, Homo sapiens
ttagtacatatcaga

SEQ ID NO: 285495 - DNA, 15 bp, Homo sapiens
attagtacatatcag

SEQ ID NO: 285496 - DNA, 15 bp, Homo sapiens
aattagtacatatca

SEQ ID NO: 285497 - DNA, 15 bp, Homo sapiens
aaattagtacatatc

SEQ ID NO: 285498 - DNA, 15 bp, Homo sapiens
aaaattagtacatat

SEQ ID NO: 285499 - DNA, 15 bp, Homo sapiens
caaaattagtacata

SEQ ID NO: 285500 - DNA, 15 bp, Homo sapiens
acaaaattagtacat

SEQ ID NO: 285501 - DNA, 15 bp, Homo sapiens
tacaaaattagtaca

SEQ ID NO: 285502 - DNA, 15 bp, Homo sapiens
ttacaaaattagtac

SEQ ID NO: 285503 - DNA, 15 bp, Homo sapiens
attacaaaattagta

SEQ ID NO: 285504 - DNA, 15 bp, Homo sapiens
gattacaaaattagt

SEQ ID NO: 285505 - DNA, 15 bp, Homo sapiens
agattacaaaattag

SEQ ID NO: 285506 - DNA, 15 bp, Homo sapiens
tagattacaaaatta

SEQ ID NO: 285507 - DNA, 15 bp, Homo sapiens
ctagattacaaaatt

SEQ ID NO: 285508 - DNA, 15 bp, Homo sapiens
tctagattacaaaat

SEQ ID NO: 285509 - DNA, 15 bp, Homo sapiens
atctagattacaaaa

SEQ ID NO: 285510 - DNA, 15 bp, Homo sapiens
tatctagattacaaa

SEQ ID NO: 285511 - DNA, 15 bp, Homo sapiens
ctatctagattacaa

SEQ ID NO: 285512 - DNA, 15 bp, Homo sapiens
actatctagattaca

SEQ ID NO: 285513 - DNA, 15 bp, Homo sapiens
cactatctagattac

SEQ ID NO: 285514 - DNA, 15 bp, Homo sapiens
acactatctagatta

SEQ ID NO: 285515 - DNA, 15 bp, Homo sapiens
aacactatctagatt

SEQ ID NO: 285516 - DNA, 15 bp, Homo sapiens
aaacactatctagat

SEQ ID NO: 285517 - DNA, 15 bp, Homo sapiens
taaacactatctaga

SEQ ID NO: 285518 - DNA, 15 bp, Homo sapiens
gtaaacactatctag

SEQ ID NO: 285519 - DNA, 15 bp, Homo sapiens
agtaaacactatcta

SEQ ID NO: 285520 - DNA, 15 bp, Homo sapiens
tagtaaacactatct

SEQ ID NO: 285521 - DNA, 15 bp, Homo sapiens
atagtaaacactatc

SEQ ID NO: 285522 - DNA, 15 bp, Homo sapiens
catagtaaacactat

SEQ ID NO: 285523 - DNA, 15 bp, Homo sapiens
acatagtaaacacta

SEQ ID NO: 285524 - DNA, 15 bp, Homo sapiens
cacatagtaaacact

SEQ ID NO: 285525 - DNA, 15 bp, Homo sapiens
acacatagtaaacac

SEQ ID NO: 285526 - DNA, 15 bp, Homo sapiens
cacacatagtaaaca

SEQ ID NO: 285527 - DNA, 15 bp, Homo sapiens
tcacacatagtaaac

SEQ ID NO: 285528 - DNA, 15 bp, Homo sapiens
gtcacacatagtaaa

SEQ ID NO: 285529 - DNA, 15 bp, Homo sapiens
agtcacacatagtaa

SEQ ID NO: 285530 - DNA, 15 bp, Homo sapiens
aagtcacacatagta

SEQ ID NO: 285531 - DNA, 15 bp, Homo sapiens
taagtcacacatagt

SEQ ID NO: 285532 - DNA, 15 bp, Homo sapiens
ttaagtcacacatag

SEQ ID NO: 285533 - DNA, 15 bp, Homo sapiens
gttaagtcacacata

SEQ ID NO: 285534 - DNA, 15 bp, Homo sapiens
agttaagtcacacat

SEQ ID NO: 285535 - DNA, 15 bp, Homo sapiens
cagttaagtcacaca

SEQ ID NO: 285536 - DNA, 15 bp, Homo sapiens
acagttaagtcacac

SEQ ID NO: 285537 - DNA, 15 bp, Homo sapiens
tacagttaagtcaca

SEQ ID NO: 285538 - DNA, 15 bp, Homo sapiens
ctacagttaagtcac

SEQ ID NO: 285539 - DNA, 15 bp, Homo sapiens
actacagttaagtca

SEQ ID NO: 285540 - DNA, 15 bp, Homo sapiens
tactacagttaagtc

SEQ ID NO: 285541 - DNA, 15 bp, Homo sapiens
atactacagttaagt

SEQ ID NO: 285542 - DNA, 15 bp, Homo sapiens
tatactacagttaag

SEQ ID NO: 285543 - DNA, 15 bp, Homo sapiens
ttatactacagttaa

SEQ ID NO: 285544 - DNA, 15 bp, Homo sapiens
attatactacagtta

SEQ ID NO: 285545 - DNA, 15 bp, Homo sapiens
aattatactacagtt

SEQ ID NO: 285546 - DNA, 15 bp, Homo sapiens
taattatactacagt

SEQ ID NO: 285547 - DNA, 15 bp, Homo sapiens
ataattatactacag

SEQ ID NO: 285548 - DNA, 15 bp, Homo sapiens
tataattatactaca

SEQ ID NO: 285549 - DNA, 15 bp, Homo sapiens
atataattatactac

SEQ ID NO: 285550 - DNA, 15 bp, Homo sapiens
aatataattatacta

SEQ ID NO: 285551 - DNA, 15 bp, Homo sapiens
gaatataattatact

SEQ ID NO: 285552 - DNA, 15 bp, Homo sapiens
ggaatataattatac

SEQ ID NO: 285553 - DNA, 15 bp, Homo sapiens
tggaatataattata

SEQ ID NO: 285554 - DNA, 15 bp, Homo sapiens
atggaatataattat

SEQ ID NO: 285555 - DNA, 15 bp, Homo sapiens
gatggaatataatta

SEQ ID NO: 285556 - DNA, 15 bp, Homo sapiens
agatggaatataatt

SEQ ID NO: 285557 - DNA, 15 bp, Homo sapiens
tagatggaatataat

SEQ ID NO: 285558 - DNA, 15 bp, Homo sapiens
ttagatggaatataa

SEQ ID NO: 285559 - DNA, 15 bp, Homo sapiens
attagatggaatata

SEQ ID NO: 285560 - DNA, 15 bp, Homo sapiens
cattagatggaatat

SEQ ID NO: 285561 - DNA, 15 bp, Homo sapiens
tcattagatggaata

SEQ ID NO: 285562 - DNA, 15 bp, Homo sapiens
atcattagatggaat

SEQ ID NO: 285563 - DNA, 15 bp, Homo sapiens
tatcattagatggaa

SEQ ID NO: 285564 - DNA, 15 bp, Homo sapiens
atatcattagatgga

SEQ ID NO: 285565 - DNA, 15 bp, Homo sapiens
aatatcattagatgg

SEQ ID NO: 285566 - DNA, 15 bp, Homo sapiens
aaatatcattagatg

SEQ ID NO: 285567 - DNA, 15 bp, Homo sapiens
gaaatatcattagat

SEQ ID NO: 285568 - DNA, 15 bp, Homo sapiens
ggaaatatcattaga

SEQ ID NO: 285569 - DNA, 15 bp, Homo sapiens
aggaaatatcattag

SEQ ID NO: 285570 - DNA, 15 bp, Homo sapiens
aaggaaatatcatta

SEQ ID NO: 285571 - DNA, 15 bp, Homo sapiens
caaggaaatatcatt

SEQ ID NO: 285572 - DNA, 15 bp, Homo sapiens
ccaaggaaatatcat

SEQ ID NO: 285573 - DNA, 15 bp, Homo sapiens
accaaggaaatatca

SEQ ID NO: 285574 - DNA, 15 bp, Homo sapiens
caccaaggaaatatc

SEQ ID NO: 285575 - DNA, 15 bp, Homo sapiens
gcaccaaggaaatat

SEQ ID NO: 285576 - DNA, 15 bp, Homo sapiens
tgcaccaaggaaata

SEQ ID NO: 285577 - DNA, 15 bp, Homo sapiens
ttgcaccaaggaaat

SEQ ID NO: 285578 - DNA, 15 bp, Homo sapiens
tttgcaccaaggaaa

SEQ ID NO: 285579 - DNA, 15 bp, Homo sapiens
gtttgcaccaaggaa

SEQ ID NO: 285580 - DNA, 15 bp, Homo sapiens
ggtttgcaccaagga

SEQ ID NO: 285581 - DNA, 15 bp, Homo sapiens
aggtttgcaccaagg

SEQ ID NO: 285582 - DNA, 15 bp, Homo sapiens
taggtttgcaccaag

SEQ ID NO: 285583 - DNA, 15 bp, Homo sapiens
ataggtttgcaccaa

SEQ ID NO: 285584 - DNA, 15 bp, Homo sapiens
aataggtttgcacca

SEQ ID NO: 285585 - DNA, 15 bp, Homo sapiens
taataggtttgcacc

SEQ ID NO: 285586 - DNA, 15 bp, Homo sapiens
ataataggtttgcac

SEQ ID NO: 285587 - DNA, 15 bp, Homo sapiens
aataataggtttgca

SEQ ID NO: 285588 - DNA, 15 bp, Homo sapiens
aaataataggtttgc

SEQ ID NO: 285589 - DNA, 15 bp, Homo sapiens
aaaataataggtttg

SEQ ID NO: 285590 - DNA, 15 bp, Homo sapiens
aaaaataataggttt

SEQ ID NO: 285591 - DNA, 15 bp, Homo sapiens
caaaaataataggtt

SEQ ID NO: 285592 - DNA, 15 bp, Homo sapiens
gcaaaaataataggt

SEQ ID NO: 285593 - DNA, 15 bp, Homo sapiens
tgcaaaaataatagg

SEQ ID NO: 285594 - DNA, 15 bp, Homo sapiens
ttgcaaaaataatag

SEQ ID NO: 285595 - DNA, 15 bp, Homo sapiens
gttgcaaaaataata

SEQ ID NO: 285596 - DNA, 15 bp, Homo sapiens
tgttgcaaaaataat

SEQ ID NO: 285597 - DNA, 15 bp, Homo sapiens
atgttgcaaaaataa

SEQ ID NO: 285598 - DNA, 15 bp, Homo sapiens
aatgttgcaaaaata

SEQ ID NO: 285599 - DNA, 15 bp, Homo sapiens
aaatgttgcaaaaat

SEQ ID NO: 285600 - DNA, 15 bp, Homo sapiens
aaaatgttgcaaaaa

SEQ ID NO: 285601 - DNA, 15 bp, Homo sapiens
gaaaatgttgcaaaa

SEQ ID NO: 285602 - DNA, 15 bp, Homo sapiens
agaaaatgttgcaaa

SEQ ID NO: 285603 - DNA, 15 bp, Homo sapiens
tagaaaatgttgcaa

SEQ ID NO: 285604 - DNA, 15 bp, Homo sapiens
atagaaaatgttgca

SEQ ID NO: 285605 - DNA, 15 bp, Homo sapiens
aatagaaaatgttgc

SEQ ID NO: 285606 - DNA, 15 bp, Homo sapiens
aaatagaaaatgttg

SEQ ID NO: 285607 - DNA, 15 bp, Homo sapiens
aaaatagaaaatgtt

SEQ ID NO: 285608 - DNA, 15 bp, Homo sapiens
taaaatagaaaatgt

SEQ ID NO: 285609 - DNA, 15 bp, Homo sapiens
ctaaaatagaaaatg

SEQ ID NO: 285610 - DNA, 15 bp, Homo sapiens
gctaaaatagaaaat

SEQ ID NO: 285611 - DNA, 15 bp, Homo sapiens
gggctaaaatagaaa

SEQ ID NO: 285612 - DNA, 15 bp, Homo sapiens
tgggctaaaatagaa

SEQ ID NO: 285613 - DNA, 15 bp, Homo sapiens
ttgggctaaaataga

SEQ ID NO: 285614 - DNA, 15 bp, Homo sapiens
cttgggctaaaatag

SEQ ID NO: 285615 - DNA, 15 bp, Homo sapiens
tcttgggctaaaata

SEQ ID NO: 285616 - DNA, 15 bp, Homo sapiens
gtcttgggctaaaat

SEQ ID NO: 285617 - DNA, 15 bp, Homo sapiens
tgtcttgggctaaaa

SEQ ID NO: 285618 - DNA, 15 bp, Homo sapiens
atgtcttgggctaaa

SEQ ID NO: 285619 - DNA, 15 bp, Homo sapiens
tatgtcttgggctaa

SEQ ID NO: 285620 - DNA, 15 bp, Homo sapiens
gtatgtcttgggcta

SEQ ID NO: 285621 - DNA, 15 bp, Homo sapiens
cgtatgtcttgggct

SEQ ID NO: 285622 - DNA, 15 bp, Homo sapiens
tcgtatgtcttgggc

SEQ ID NO: 285623 - DNA, 15 bp, Homo sapiens
atcgtatgtcttggg

SEQ ID NO: 285624 - DNA, 15 bp, Homo sapiens
aatcgtatgtcttgg

SEQ ID NO: 285625 - DNA, 15 bp, Homo sapiens
caatcgtatgtcttg

SEQ ID NO: 285626 - DNA, 15 bp, Homo sapiens
tcaatcgtatgtctt

SEQ ID NO: 285627 - DNA, 15 bp, Homo sapiens
atcaatcgtatgtct

SEQ ID NO: 285628 - DNA, 15 bp, Homo sapiens
catcaatcgtatgtc

SEQ ID NO: 285629 - DNA, 15 bp, Homo sapiens
acatcaatcgtatgt

SEQ ID NO: 285630 - DNA, 15 bp, Homo sapiens
aacatcaatcgtatg

SEQ ID NO: 285631 - DNA, 15 bp, Homo sapiens
aaacatcaatcgtat

SEQ ID NO: 285632 - DNA, 15 bp, Homo sapiens
taaacatcaatcgta

SEQ ID NO: 285633 - DNA, 15 bp, Homo sapiens
ttaaacatcaatcgt

SEQ ID NO: 285634 - DNA, 15 bp, Homo sapiens
attaaacatcaatcg

SEQ ID NO: 285635 - DNA, 15 bp, Homo sapiens
cattaaacatcaatc

SEQ ID NO: 285636 - DNA, 15 bp, Homo sapiens
acattaaacatcaat

SEQ ID NO: 285637 - DNA, 15 bp, Homo sapiens
gacattaaacatcaa

SEQ ID NO: 285638 - DNA, 15 bp, Homo sapiens
ggacattaaacatca

SEQ ID NO: 285639 - DNA, 15 bp, Homo sapiens
gggacattaaacatc

SEQ ID NO: 285640 - DNA, 15 bp, Homo sapiens
agggacattaaacat

SEQ ID NO: 285641 - DNA, 15 bp, Homo sapiens
cagggacattaaaca

SEQ ID NO: 285642 - DNA, 15 bp, Homo sapiens
tcagggacattaaac

SEQ ID NO: 285643 - DNA, 15 bp, Homo sapiens
atcagggacattaaa

SEQ ID NO: 285644 - DNA, 15 bp, Homo sapiens
gatcagggacattaa

SEQ ID NO: 285645 - DNA, 15 bp, Homo sapiens
agatcagggacatta

SEQ ID NO: 285646 - DNA, 15 bp, Homo sapiens
cagatcagggacatt

SEQ ID NO: 285647 - DNA, 15 bp, Homo sapiens
ccagatcagggacat

SEQ ID NO: 285648 - DNA, 15 bp, Homo sapiens
accagatcagggaca

SEQ ID NO: 285649 - DNA, 15 bp, Homo sapiens
taccagatcagggac

SEQ ID NO: 285650 - DNA, 15 bp, Homo sapiens
gtaccagatcaggga

SEQ ID NO: 285651 - DNA, 15 bp, Homo sapiens
ggtaccagatcaggg

SEQ ID NO: 285652 - DNA, 15 bp, Homo sapiens
aggtaccagatcagg

SEQ ID NO: 285653 - DNA, 15 bp, Homo sapiens
gaggtaccagatcag

SEQ ID NO: 285654 - DNA, 15 bp, Homo sapiens
tgaggtaccagatca

SEQ ID NO: 285655 - DNA, 15 bp, Homo sapiens
atgaggtaccagatc

SEQ ID NO: 285656 - DNA, 15 bp, Homo sapiens
catgaggtaccagat

SEQ ID NO: 285657 - DNA, 15 bp, Homo sapiens
acatgaggtaccaga

SEQ ID NO: 285658 - DNA, 15 bp, Homo sapiens
aacatgaggtaccag

SEQ ID NO: 285659 - DNA, 15 bp, Homo sapiens
gaacatgaggtacca

SEQ ID NO: 285660 - DNA, 15 bp, Homo sapiens
agaacatgaggtacc

SEQ ID NO: 285661 - DNA, 15 bp, Homo sapiens
tagaacatgaggtac

SEQ ID NO: 285662 - DNA, 15 bp, Homo sapiens
atagaacatgaggta

SEQ ID NO: 285663 - DNA, 15 bp, Homo sapiens
gatagaacatgaggt

SEQ ID NO: 285664 - DNA, 15 bp, Homo sapiens
agatagaacatgagg

SEQ ID NO: 285665 - DNA, 15 bp, Homo sapiens
cagatagaacatgag

SEQ ID NO: 285666 - DNA, 15 bp, Homo sapiens
gcagatagaacatga

SEQ ID NO: 285667 - DNA, 15 bp, Homo sapiens
tgcagatagaacatg

SEQ ID NO: 285668 - DNA, 15 bp, Homo sapiens
atgcagatagaacat

SEQ ID NO: 285669 - DNA, 15 bp, Homo sapiens
aatgcagatagaaca

SEQ ID NO: 285670 - DNA, 15 bp, Homo sapiens
aaatgcagatagaac

SEQ ID NO: 285671 - DNA, 15 bp, Homo sapiens
taaatgcagatagaa

SEQ ID NO: 285672 - DNA, 15 bp, Homo sapiens
ttaaatgcagataga

SEQ ID NO: 285673 - DNA, 15 bp, Homo sapiens
tttaaatgcagatag

SEQ ID NO: 285674 - DNA, 15 bp, Homo sapiens
ctttaaatgcagata

SEQ ID NO: 285675 - DNA, 15 bp, Homo sapiens
tctttaaatgcagat

SEQ ID NO: 285676 - DNA, 15 bp, Homo sapiens
ctctttaaatgcaga

SEQ ID NO: 285677 - DNA, 15 bp, Homo sapiens
actctttaaatgcag

SEQ ID NO: 285678 - DNA, 15 bp, Homo sapiens
aactctttaaatgca

SEQ ID NO: 285679 - DNA, 15 bp, Homo sapiens
aaactctttaaatgc

SEQ ID NO: 285680 - DNA, 15 bp, Homo sapiens
caaactctttaaatg

SEQ ID NO: 285681 - DNA, 15 bp, Homo sapiens
acaaactctttaaat

SEQ ID NO: 285682 - DNA, 15 bp, Homo sapiens
aacaaactctttaaa

SEQ ID NO: 285683 - DNA, 15 bp, Homo sapiens
taacaaactctttaa

SEQ ID NO: 285684 - DNA, 15 bp, Homo sapiens
ataacaaactcttta

SEQ ID NO: 285685 - DNA, 15 bp, Homo sapiens
aataacaaactcttt

SEQ ID NO: 285686 - DNA, 15 bp, Homo sapiens
caataacaaactctt

SEQ ID NO: 285687 - DNA, 15 bp, Homo sapiens
ccaataacaaactct

SEQ ID NO: 285688 - DNA, 15 bp, Homo sapiens
accaataacaaactc

SEQ ID NO: 285689 - DNA, 15 bp, Homo sapiens
aaccaataacaaact

SEQ ID NO: 285690 - DNA, 15 bp, Homo sapiens
aaaccaataacaaac

SEQ ID NO: 285691 - DNA, 15 bp, Homo sapiens
aaaaccaataacaaa

SEQ ID NO: 285692 - DNA, 15 bp, Homo sapiens
aaaaaccaataacaa

SEQ ID NO: 285693 - DNA, 15 bp, Homo sapiens
taaaaaccaataaca

SEQ ID NO: 285694 - DNA, 15 bp, Homo sapiens
gtaaaaaccaataac

SEQ ID NO: 285695 - DNA, 15 bp, Homo sapiens
agtaaaaaccaataa

SEQ ID NO: 285696 - DNA, 15 bp, Homo sapiens
tagtaaaaaccaata

SEQ ID NO: 285697 - DNA, 15 bp, Homo sapiens
atagtaaaaaccaat

SEQ ID NO: 285698 - DNA, 15 bp, Homo sapiens
tatagtaaaaaccaa

SEQ ID NO: 285699 - DNA, 15 bp, Homo sapiens
atatagtaaaaacca

SEQ ID NO: 285700 - DNA, 15 bp, Homo sapiens
catatagtaaaaacc

SEQ ID NO: 285701 - DNA, 15 bp, Homo sapiens
acatatagtaaaaac

SEQ ID NO: 285702 - DNA, 15 bp, Homo sapiens
tacatatagtaaaaa

SEQ ID NO: 285703 - DNA, 15 bp, Homo sapiens
ttacatatagtaaaa

SEQ ID NO: 285704 - DNA, 15 bp, Homo sapiens
attacatatagtaaa

SEQ ID NO: 285705 - DNA, 15 bp, Homo sapiens
aattacatatagtaa

SEQ ID NO: 285706 - DNA, 15 bp, Homo sapiens
taattacatatagta

SEQ ID NO: 285707 - DNA, 15 bp, Homo sapiens
ttaattacatatagt

SEQ ID NO: 285708 - DNA, 15 bp, Homo sapiens
cttaattacatatag

SEQ ID NO: 285709 - DNA, 15 bp, Homo sapiens
tcttaattacatata

SEQ ID NO: 285710 - DNA, 15 bp, Homo sapiens
ttcttaattacatat

SEQ ID NO: 285711 - DNA, 15 bp, Homo sapiens
gttcttaattacata

SEQ ID NO: 285712 - DNA, 15 bp, Homo sapiens
agttcttaattacat

SEQ ID NO: 285713 - DNA, 15 bp, Homo sapiens
tagttcttaattaca

SEQ ID NO: 285714 - DNA, 15 bp, Homo sapiens
ctagttcttaattac

SEQ ID NO: 285715 - DNA, 15 bp, Homo sapiens
tctagttcttaatta

SEQ ID NO: 285716 - DNA, 15 bp, Homo sapiens
ttctagttcttaatt

SEQ ID NO: 285717 - DNA, 15 bp, Homo sapiens
attctagttcttaat

SEQ ID NO: 285718 - DNA, 15 bp, Homo sapiens
cattctagttcttaa

SEQ ID NO: 285719 - DNA, 15 bp, Homo sapiens
acattctagttctta

SEQ ID NO: 285720 - DNA, 15 bp, Homo sapiens
tacattctagttctt

SEQ ID NO: 285721 - DNA, 15 bp, Homo sapiens
atacattctagttct

SEQ ID NO: 285722 - DNA, 15 bp, Homo sapiens
gatacattctagttc

SEQ ID NO: 285723 - DNA, 15 bp, Homo sapiens
agatacattctagtt

SEQ ID NO: 285724 - DNA, 15 bp, Homo sapiens
tagatacattctagt

SEQ ID NO: 285725 - DNA, 15 bp, Homo sapiens
atagatacattctag

SEQ ID NO: 285726 - DNA, 15 bp, Homo sapiens
aatagatacattcta

SEQ ID NO: 285727 - DNA, 15 bp, Homo sapiens
aaatagatacattct

SEQ ID NO: 285728 - DNA, 15 bp, Homo sapiens
aaaatagatacattc

SEQ ID NO: 285729 - DNA, 15 bp, Homo sapiens
aaaaatagatacatt

SEQ ID NO: 285730 - DNA, 15 bp, Homo sapiens
taaaaatagatacat

SEQ ID NO: 285731 - DNA, 15 bp, Homo sapiens
ataaaaatagataca

SEQ ID NO: 285732 - DNA, 15 bp, Homo sapiens
tataaaaatagatac

SEQ ID NO: 285733 - DNA, 15 bp, Homo sapiens
atataaaaatagata

SEQ ID NO: 285734 - DNA, 15 bp, Homo sapiens
aatataaaaatagat

SEQ ID NO: 285735 - DNA, 15 bp, Homo sapiens
gaatataaaaataga

SEQ ID NO: 285736 - DNA, 15 bp, Homo sapiens
tgaatataaaaatag

SEQ ID NO: 285737 - DNA, 15 bp, Homo sapiens
ttgaatataaaaata

SEQ ID NO: 285738 - DNA, 15 bp, Homo sapiens
gttgaatataaaaat

SEQ ID NO: 285739 - DNA, 15 bp, Homo sapiens
tgttgaatataaaaa

SEQ ID NO: 285740 - DNA, 15 bp, Homo sapiens
atgttgaatataaaa

SEQ ID NO: 285741 - DNA, 15 bp, Homo sapiens
aatgttgaatataaa

SEQ ID NO: 285742 - DNA, 15 bp, Homo sapiens
aaatgttgaatataa

SEQ ID NO: 285743 - DNA, 15 bp, Homo sapiens
taaatgttgaatata

SEQ ID NO: 285744 - DNA, 15 bp, Homo sapiens
ctaaatgttgaatat

SEQ ID NO: 285745 - DNA, 15 bp, Homo sapiens
tctaaatgttgaata

SEQ ID NO: 285746 - DNA, 15 bp, Homo sapiens
gtctaaatgttgaat

SEQ ID NO: 285747 - DNA, 15 bp, Homo sapiens
ggtctaaatgttgaa

SEQ ID NO: 285748 - DNA, 15 bp, Homo sapiens
aggtctaaatgttga

SEQ ID NO: 285749 - DNA, 15 bp, Homo sapiens
taggtctaaatgttg

SEQ ID NO: 285750 - DNA, 15 bp, Homo sapiens
ttaggtctaaatgtt

SEQ ID NO: 285751 - DNA, 15 bp, Homo sapiens
attaggtctaaatgt

SEQ ID NO: 285752 - DNA, 15 bp, Homo sapiens
tattaggtctaaatg

SEQ ID NO: 285753 - DNA, 15 bp, Homo sapiens
ttattaggtctaaat

SEQ ID NO: 285754 - DNA, 15 bp, Homo sapiens
attattaggtctaaa

SEQ ID NO: 285755 - DNA, 15 bp, Homo sapiens
gattattaggtctaa

SEQ ID NO: 285756 - DNA, 15 bp, Homo sapiens
agattattaggtcta

SEQ ID NO: 285757 - DNA, 15 bp, Homo sapiens
cagattattaggtct

SEQ ID NO: 285758 - DNA, 15 bp, Homo sapiens
acagattattaggtc

SEQ ID NO: 285759 - DNA, 15 bp, Homo sapiens
cacagattattaggt

SEQ ID NO: 285760 - DNA, 15 bp, Homo sapiens
tcacagattattagg

SEQ ID NO: 285761 - DNA, 15 bp, Homo sapiens
ttcacagattattag

SEQ ID NO: 285762 - DNA, 15 bp, Homo sapiens
tttcacagattatta

SEQ ID NO: 285763 - DNA, 15 bp, Homo sapiens
ttttcacagattatt

SEQ ID NO: 285764 - DNA, 15 bp, Homo sapiens
tttttcacagattat

SEQ ID NO: 285765 - DNA, 15 bp, Homo sapiens
gtttttcacagatta

SEQ ID NO: 285766 - DNA, 15 bp, Homo sapiens
tgtttttcacagatt

SEQ ID NO: 285767 - DNA, 15 bp, Homo sapiens
gtgtttttcacagat

SEQ ID NO: 285768 - DNA, 15 bp, Homo sapiens
agtgtttttcacaga

SEQ ID NO: 285769 - DNA, 15 bp, Homo sapiens
aagtgtttttcacag

SEQ ID NO: 285770 - DNA, 15 bp, Homo sapiens
taagtgtttttcaca

SEQ ID NO: 285771 - DNA, 15 bp, Homo sapiens
ttaagtgtttttcac

SEQ ID NO: 285772 - DNA, 15 bp, Homo sapiens
cttaagtgtttttca

SEQ ID NO: 285773 - DNA, 15 bp, Homo sapiens
tcttaagtgtttttc

SEQ ID NO: 285774 - DNA, 15 bp, Homo sapiens
gtcttaagtgttttt

SEQ ID NO: 285775 - DNA, 15 bp, Homo sapiens
agtcttaagtgtttt

SEQ ID NO: 285776 - DNA, 15 bp, Homo sapiens
tagtcttaagtgttt

SEQ ID NO: 285777 - DNA, 15 bp, Homo sapiens
ttagtcttaagtgtt

SEQ ID NO: 285778 - DNA, 15 bp, Homo sapiens
tttagtcttaagtgt

SEQ ID NO: 285779 - DNA, 15 bp, Homo sapiens
ttttagtcttaagtg

SEQ ID NO: 285780 - DNA, 15 bp, Homo sapiens
attttagtcttaagt

SEQ ID NO: 285781 - DNA, 15 bp, Homo sapiens
aattttagtcttaag

SEQ ID NO: 285782 - DNA, 15 bp, Homo sapiens
caattttagtcttaa

SEQ ID NO: 285783 - DNA, 15 bp, Homo sapiens
acaattttagtctta

SEQ ID NO: 285784 - DNA, 15 bp, Homo sapiens
tacaattttagtctt

SEQ ID NO: 285785 - DNA, 15 bp, Homo sapiens
atacaattttagtct

SEQ ID NO: 285786 - DNA, 15 bp, Homo sapiens
catacaattttagtc

SEQ ID NO: 285787 - DNA, 15 bp, Homo sapiens
acatacaattttagt

SEQ ID NO: 285788 - DNA, 15 bp, Homo sapiens
aacatacaattttag

SEQ ID NO: 285789 - DNA, 15 bp, Homo sapiens
aaacatacaatttta

SEQ ID NO: 285790 - DNA, 15 bp, Homo sapiens
aaaacatacaatttt

SEQ ID NO: 285791 - DNA, 15 bp, Homo sapiens
taaaacatacaattt

SEQ ID NO: 285792 - DNA, 15 bp, Homo sapiens
ataaaacatacaatt

SEQ ID NO: 285793 - DNA, 15 bp, Homo sapiens
tataaaacatacaat

SEQ ID NO: 285794 - DNA, 15 bp, Homo sapiens
atataaaacatacaa

SEQ ID NO: 285795 - DNA, 15 bp, Homo sapiens
tatataaaacataca

SEQ ID NO: 285796 - DNA, 15 bp, Homo sapiens
ttatataaaacatac

SEQ ID NO: 285797 - DNA, 15 bp, Homo sapiens
tttatataaaacata

SEQ ID NO: 285798 - DNA, 15 bp, Homo sapiens
atttatataaaacat

SEQ ID NO: 285799 - DNA, 15 bp, Homo sapiens
catttatataaaaca

SEQ ID NO: 285800 - DNA, 15 bp, Homo sapiens
tcatttatataaaac

SEQ ID NO: 285801 - DNA, 15 bp, Homo sapiens
atcatttatataaaa

SEQ ID NO: 285802 - DNA, 15 bp, Homo sapiens
aatcatttatataaa

SEQ ID NO: 285803 - DNA, 15 bp, Homo sapiens
caatcatttatataa

SEQ ID NO: 285804 - DNA, 15 bp, Homo sapiens
acaatcatttatata

SEQ ID NO: 285805 - DNA, 15 bp, Homo sapiens
aacaatcatttatat

SEQ ID NO: 285806 - DNA, 15 bp, Homo sapiens
taacaatcatttata

SEQ ID NO: 285807 - DNA, 15 bp, Homo sapiens
ttaacaatcatttat

SEQ ID NO: 285808 - DNA, 15 bp, Homo sapiens
tttaacaatcattta

SEQ ID NO: 285809 - DNA, 15 bp, Homo sapiens
atttaacaatcattt

SEQ ID NO: 285810 - DNA, 15 bp, Homo sapiens
aatttaacaatcatt

SEQ ID NO: 285811 - DNA, 15 bp, Homo sapiens
gaatttaacaatcat

SEQ ID NO: 285812 - DNA, 15 bp, Homo sapiens
agaatttaacaatca

SEQ ID NO: 285813 - DNA, 15 bp, Homo sapiens
aagaatttaacaatc

SEQ ID NO: 285814 - DNA, 15 bp, Homo sapiens
ataagaatttaacaa

SEQ ID NO: 285815 - DNA, 15 bp, Homo sapiens
aataagaatttaaca

SEQ ID NO: 285816 - DNA, 15 bp, Homo sapiens
aaataagaatttaac

SEQ ID NO: 285817 - DNA, 15 bp, Homo sapiens
aaaataagaatttaa

SEQ ID NO: 285818 - DNA, 15 bp, Homo sapiens
aaaaataagaattta

SEQ ID NO: 285819 - DNA, 15 bp, Homo sapiens
caaaaataagaattt

SEQ ID NO: 285820 - DNA, 15 bp, Homo sapiens
acaaaaataagaatt

SEQ ID NO: 285821 - DNA, 15 bp, Homo sapiens
cacaaaaataagaat

SEQ ID NO: 285822 - DNA, 15 bp, Homo sapiens
tcacaaaaataagaa

SEQ ID NO: 285823 - DNA, 15 bp, Homo sapiens
ttcacaaaaataaga

SEQ ID NO: 285824 - DNA, 15 bp, Homo sapiens
tttcacaaaaataag

SEQ ID NO: 285825 - DNA, 15 bp, Homo sapiens
ttttcacaaaaataa

SEQ ID NO: 285826 - DNA, 15 bp, Homo sapiens
gttttcacaaaaata

SEQ ID NO: 285827 - DNA, 15 bp, Homo sapiens
agttttcacaaaaat

SEQ ID NO: 285828 - DNA, 15 bp, Homo sapiens
cagttttcacaaaaa

SEQ ID NO: 285829 - DNA, 15 bp, Homo sapiens
gcagttttcacaaaa

SEQ ID NO: 285830 - DNA, 15 bp, Homo sapiens
ggcagttttcacaaa

SEQ ID NO: 285831 - DNA, 15 bp, Homo sapiens
aggcagttttcacaa

SEQ ID NO: 285832 - DNA, 15 bp, Homo sapiens
aaggcagttttcaca

SEQ ID NO: 285833 - DNA, 15 bp, Homo sapiens
taaggcagttttcac

SEQ ID NO: 285834 - DNA, 15 bp, Homo sapiens
ttaaggcagttttca

SEQ ID NO: 285835 - DNA, 15 bp, Homo sapiens
gttaaggcagttttc

SEQ ID NO: 285836 - DNA, 15 bp, Homo sapiens
agttaaggcagtttt

SEQ ID NO: 285837 - DNA, 15 bp, Homo sapiens
gagttaaggcagttt

SEQ ID NO: 285838 - DNA, 15 bp, Homo sapiens
agagttaaggcagtt

SEQ ID NO: 285839 - DNA, 15 bp, Homo sapiens
gagagttaaggcagt

SEQ ID NO: 285840 - DNA, 15 bp, Homo sapiens
agagagttaaggcag

SEQ ID NO: 285841 - DNA, 15 bp, Homo sapiens
aagagagttaaggca

SEQ ID NO: 285842 - DNA, 15 bp, Homo sapiens
gaagagagttaaggc

SEQ ID NO: 285843 - DNA, 15 bp, Homo sapiens
ggaagagagttaagg

SEQ ID NO: 285844 - DNA, 15 bp, Homo sapiens
tggaagagagttaag

SEQ ID NO: 285845 - DNA, 15 bp, Homo sapiens
ctggaagagagttaa

SEQ ID NO: 285846 - DNA, 15 bp, Homo sapiens
tctggaagagagtta

SEQ ID NO: 285847 - DNA, 15 bp, Homo sapiens
atctggaagagagtt

SEQ ID NO: 285848 - DNA, 15 bp, Homo sapiens
tatctggaagagagt

SEQ ID NO: 285849 - DNA, 15 bp, Homo sapiens
gtatctggaagagag

SEQ ID NO: 285850 - DNA, 15 bp, Homo sapiens
ggtatctggaagaga

SEQ ID NO: 285851 - DNA, 15 bp, Homo sapiens
tggtatctggaagag

SEQ ID NO: 285852 - DNA, 15 bp, Homo sapiens
atggtatctggaaga

SEQ ID NO: 285853 - DNA, 15 bp, Homo sapiens
tatggtatctggaag

SEQ ID NO: 285854 - DNA, 15 bp, Homo sapiens
ttatggtatctggaa

SEQ ID NO: 285855 - DNA, 15 bp, Homo sapiens
attatggtatctgga

SEQ ID NO: 285856 - DNA, 15 bp, Homo sapiens
cattatggtatctgg

SEQ ID NO: 285857 - DNA, 15 bp, Homo sapiens
tcattatggtatctg

SEQ ID NO: 285858 - DNA, 15 bp, Homo sapiens
ttcattatggtatct

SEQ ID NO: 285859 - DNA, 15 bp, Homo sapiens
tttcattatggtatc

SEQ ID NO: 285860 - DNA, 15 bp, Homo sapiens
ctttcattatggtat

SEQ ID NO: 285861 - DNA, 15 bp, Homo sapiens
tctttcattatggta

SEQ ID NO: 285862 - DNA, 15 bp, Homo sapiens
ttctttcattatggt

SEQ ID NO: 285863 - DNA, 15 bp, Homo sapiens
attctttcattatgg

SEQ ID NO: 285864 - DNA, 15 bp, Homo sapiens
cattctttcattatg

SEQ ID NO: 285865 - DNA, 15 bp, Homo sapiens
gcattctttcattat

SEQ ID NO: 285866 - DNA, 15 bp, Homo sapiens
tgcattctttcatta

SEQ ID NO: 285867 - DNA, 15 bp, Homo sapiens
ttgcattctttcatt

SEQ ID NO: 285868 - DNA, 15 bp, Homo sapiens
attgcattctttcat

SEQ ID NO: 285869 - DNA, 15 bp, Homo sapiens
cattgcattctttca

SEQ ID NO: 285870 - DNA, 15 bp, Homo sapiens
tcattgcattctttc

SEQ ID NO: 285871 - DNA, 15 bp, Homo sapiens
atcattgcattcttt

SEQ ID NO: 285872 - DNA, 15 bp, Homo sapiens
tatcattgcattctt

SEQ ID NO: 285873 - DNA, 15 bp, Homo sapiens
ctatcattgcattct

SEQ ID NO: 285874 - DNA, 15 bp, Homo sapiens
actatcattgcattc

SEQ ID NO: 285875 - DNA, 15 bp, Homo sapiens
cactatcattgcatt

SEQ ID NO: 285876 - DNA, 15 bp, Homo sapiens
ccactatcattgcat

SEQ ID NO: 285877 - DNA, 15 bp, Homo sapiens
cccactatcattgca

SEQ ID NO: 285878 - DNA, 15 bp, Homo sapiens
ccccactatcattgc

SEQ ID NO: 285879 - DNA, 15 bp, Homo sapiens
tccccactatcattg

SEQ ID NO: 285880 - DNA, 15 bp, Homo sapiens
atccccactatcatt

SEQ ID NO: 285881 - DNA, 15 bp, Homo sapiens
catccccactatcat

SEQ ID NO: 285882 - DNA, 15 bp, Homo sapiens
tcatccccactatca

SEQ ID NO: 285883 - DNA, 15 bp, Homo sapiens
atcatccccactatc

SEQ ID NO: 285884 - DNA, 15 bp, Homo sapiens
tatcatccccactat

SEQ ID NO: 285885 - DNA, 15 bp, Homo sapiens
ttatcatccccacta

SEQ ID NO: 285886 - DNA, 15 bp, Homo sapiens
attatcatccccact

SEQ ID NO: 285887 - DNA, 15 bp, Homo sapiens
aattatcatccccac

SEQ ID NO: 285888 - DNA, 15 bp, Homo sapiens
taattatcatcccca

SEQ ID NO: 285889 - DNA, 15 bp, Homo sapiens
ataattatcatcccc

SEQ ID NO: 285890 - DNA, 15 bp, Homo sapiens
tataattatcatccc

SEQ ID NO: 285891 - DNA, 15 bp, Homo sapiens
ttataattatcatcc

SEQ ID NO: 285892 - DNA, 15 bp, Homo sapiens
attataattatcatc

SEQ ID NO: 285893 - DNA, 15 bp, Homo sapiens
tattataattatcat

SEQ ID NO: 285894 - DNA, 15 bp, Homo sapiens
ttattataattatca

SEQ ID NO: 285895 - DNA, 15 bp, Homo sapiens
attattataattatc

SEQ ID NO: 285896 - DNA, 15 bp, Homo sapiens
cattattataattat

SEQ ID NO: 285897 - DNA, 15 bp, Homo sapiens
acattattataatta

SEQ ID NO: 285898 - DNA, 15 bp, Homo sapiens
cacattattataatt

SEQ ID NO: 285899 - DNA, 15 bp, Homo sapiens
acacattattataat

SEQ ID NO: 285900 - DNA, 15 bp, Homo sapiens
aacacattattataa

SEQ ID NO: 285901 - DNA, 15 bp, Homo sapiens
taacacattattata

SEQ ID NO: 285902 - DNA, 15 bp, Homo sapiens
ttaacacattattat

SEQ ID NO: 285903 - DNA, 15 bp, Homo sapiens
tttaacacattatta

SEQ ID NO: 285904 - DNA, 15 bp, Homo sapiens
gtttaacacattatt

SEQ ID NO: 285905 - DNA, 15 bp, Homo sapiens
agtttaacacattat

SEQ ID NO: 285906 - DNA, 15 bp, Homo sapiens
gagtttaacacatta

SEQ ID NO: 285907 - DNA, 15 bp, Homo sapiens
agagtttaacacatt

SEQ ID NO: 285908 - DNA, 15 bp, Homo sapiens
tagagtttaacacat

SEQ ID NO: 285909 - DNA, 15 bp, Homo sapiens
atagagtttaacaca

SEQ ID NO: 285910 - DNA, 15 bp, Homo sapiens
gatagagtttaacac

SEQ ID NO: 285911 - DNA, 15 bp, Homo sapiens
tgatagagtttaaca

SEQ ID NO: 285912 - DNA, 15 bp, Homo sapiens
ctgatagagtttaac

SEQ ID NO: 285913 - DNA, 15 bp, Homo sapiens
gctgatagagtttaa

SEQ ID NO: 285914 - DNA, 15 bp, Homo sapiens
agctgatagagttta

SEQ ID NO: 285915 - DNA, 15 bp, Homo sapiens
aagctgatagagttt

SEQ ID NO: 285916 - DNA, 15 bp, Homo sapiens
gaagctgatagagtt

SEQ ID NO: 285917 - DNA, 15 bp, Homo sapiens
ggaagctgatagagt

SEQ ID NO: 285918 - DNA, 15 bp, Homo sapiens
gggaagctgatagag

SEQ ID NO: 285919 - DNA, 15 bp, Homo sapiens
ggggaagctgataga

SEQ ID NO: 285920 - DNA, 15 bp, Homo sapiens
tggggaagctgatag

SEQ ID NO: 285921 - DNA, 15 bp, Homo sapiens
ctggggaagctgata

SEQ ID NO: 285922 - DNA, 15 bp, Homo sapiens
tctggggaagctgat

SEQ ID NO: 285923 - DNA, 15 bp, Homo sapiens
ctctggggaagctga

SEQ ID NO: 285924 - DNA, 15 bp, Homo sapiens
tctctggggaagctg

SEQ ID NO: 285925 - DNA, 15 bp, Homo sapiens
ttctctggggaagct

SEQ ID NO: 285926 - DNA, 15 bp, Homo sapiens
cttctctggggaagc

SEQ ID NO: 285927 - DNA, 15 bp, Homo sapiens
acttctctggggaag

SEQ ID NO: 285928 - DNA, 15 bp, Homo sapiens
cacttctctggggaa

SEQ ID NO: 285929 - DNA, 15 bp, Homo sapiens
tcacttctctgggga

SEQ ID NO: 285930 - DNA, 15 bp, Homo sapiens
ttcacttctctgggg

SEQ ID NO: 285931 - DNA, 15 bp, Homo sapiens
attcacttctctggg

SEQ ID NO: 285932 - DNA, 15 bp, Homo sapiens
gattcacttctctgg

SEQ ID NO: 285933 - DNA, 15 bp, Homo sapiens
agattcacttctctg

SEQ ID NO: 285934 - DNA, 15 bp, Homo sapiens
tagattcacttctct

SEQ ID NO: 285935 - DNA, 15 bp, Homo sapiens
atagattcacttctc

SEQ ID NO: 285936 - DNA, 15 bp, Homo sapiens
tatagattcacttct

SEQ ID NO: 285937 - DNA, 15 bp, Homo sapiens
atatagattcacttc

SEQ ID NO: 285938 - DNA, 15 bp, Homo sapiens
catatagattcactt

SEQ ID NO: 285939 - DNA, 15 bp, Homo sapiens
acatatagattcact

SEQ ID NO: 285940 - DNA, 15 bp, Homo sapiens
tacatatagattcac

SEQ ID NO: 285941 - DNA, 15 bp, Homo sapiens
atacatatagattca

SEQ ID NO: 285942 - DNA, 15 bp, Homo sapiens
catacatatagattc

SEQ ID NO: 285943 - DNA, 15 bp, Homo sapiens
acatacatatagatt

SEQ ID NO: 285944 - DNA, 15 bp, Homo sapiens
aacatacatatagat

SEQ ID NO: 285945 - DNA, 15 bp, Homo sapiens
caacatacatataga

SEQ ID NO: 285946 - DNA, 15 bp, Homo sapiens
tcaacatacatatag

SEQ ID NO: 285947 - DNA, 15 bp, Homo sapiens
gtcaacatacatata

SEQ ID NO: 285948 - DNA, 15 bp, Homo sapiens
tgtcaacatacatat

SEQ ID NO: 285949 - DNA, 15 bp, Homo sapiens
ttgtcaacatacata

SEQ ID NO: 285950 - DNA, 15 bp, Homo sapiens
gttgtcaacatacat

SEQ ID NO: 285951 - DNA, 15 bp, Homo sapiens
tgttgtcaacataca

SEQ ID NO: 285952 - DNA, 15 bp, Homo sapiens
ttgttgtcaacatac

SEQ ID NO: 285953 - DNA, 15 bp, Homo sapiens
tttgttgtcaacata

SEQ ID NO: 285954 - DNA, 15 bp, Homo sapiens
ttttgttgtcaacat

SEQ ID NO: 285955 - DNA, 15 bp, Homo sapiens
tttttgttgtcaaca

SEQ ID NO: 285956 - DNA, 15 bp, Homo sapiens
atttttgttgtcaac

SEQ ID NO: 285957 - DNA, 15 bp, Homo sapiens
tatttttgttgtcaa

SEQ ID NO: 285958 - DNA, 15 bp, Homo sapiens
gtatttttgttgtca

SEQ ID NO: 285959 - DNA, 15 bp, Homo sapiens
tgtatttttgttgtc

SEQ ID NO: 285960 - DNA, 15 bp, Homo sapiens
atgtatttttgttgt

SEQ ID NO: 285961 - DNA, 15 bp, Homo sapiens
gatgtatttttgttg

SEQ ID NO: 285962 - DNA, 15 bp, Homo sapiens
agatgtatttttgtt

SEQ ID NO: 285963 - DNA, 15 bp, Homo sapiens
gagatgtatttttgt

SEQ ID NO: 285964 - DNA, 15 bp, Homo sapiens
tgagatgtatttttg

SEQ ID NO: 285965 - DNA, 15 bp, Homo sapiens
ttgagatgtattttt

SEQ ID NO: 285966 - DNA, 15 bp, Homo sapiens
tttgagatgtatttt

SEQ ID NO: 285967 - DNA, 15 bp, Homo sapiens
atttgagatgtattt

SEQ ID NO: 285968 - DNA, 15 bp, Homo sapiens
gatttgagatgtatt

SEQ ID NO: 285969 - DNA, 15 bp, Homo sapiens
agatttgagatgtat

SEQ ID NO: 285970 - DNA, 15 bp, Homo sapiens
tagatttgagatgta

SEQ ID NO: 285971 - DNA, 15 bp, Homo sapiens
ttagatttgagatgt

SEQ ID NO: 285972 - DNA, 15 bp, Homo sapiens
attagatttgagatg

SEQ ID NO: 285973 - DNA, 15 bp, Homo sapiens
aattagatttgagat

SEQ ID NO: 285974 - DNA, 15 bp, Homo sapiens
aaattagatttgaga

SEQ ID NO: 285975 - DNA, 15 bp, Homo sapiens
aaaattagatttgag

SEQ ID NO: 285976 - DNA, 15 bp, Homo sapiens
caaaattagatttga

SEQ ID NO: 285977 - DNA, 15 bp, Homo sapiens
ccaaaattagatttg

SEQ ID NO: 285978 - DNA, 15 bp, Homo sapiens
gccaaaattagattt

SEQ ID NO: 285979 - DNA, 15 bp, Homo sapiens
agccaaaattagatt

SEQ ID NO: 285980 - DNA, 15 bp, Homo sapiens
cagccaaaattagat

SEQ ID NO: 285981 - DNA, 15 bp, Homo sapiens
ccagccaaaattaga

SEQ ID NO: 285982 - DNA, 15 bp, Homo sapiens
accagccaaaattag

SEQ ID NO: 285983 - DNA, 15 bp, Homo sapiens
aaccagccaaaatta

SEQ ID NO: 285984 - DNA, 15 bp, Homo sapiens
aaaccagccaaaatt

SEQ ID NO: 285985 - DNA, 15 bp, Homo sapiens
gaaaccagccaaaat

SEQ ID NO: 285986 - DNA, 15 bp, Homo sapiens
tgaaaccagccaaaa

SEQ ID NO: 285987 - DNA, 15 bp, Homo sapiens
gtgaaaccagccaaa

SEQ ID NO: 285988 - DNA, 15 bp, Homo sapiens
agtgaaaccagccaa

SEQ ID NO: 285989 - DNA, 15 bp, Homo sapiens
tagtgaaaccagcca

SEQ ID NO: 285990 - DNA, 15 bp, Homo sapiens
atagtgaaaccagcc

SEQ ID NO: 285991 - DNA, 15 bp, Homo sapiens
catagtgaaaccagc

SEQ ID NO: 285992 - DNA, 15 bp, Homo sapiens
ccatagtgaaaccag

SEQ ID NO: 285993 - DNA, 15 bp, Homo sapiens
tccatagtgaaacca

SEQ ID NO: 285994 - DNA, 15 bp, Homo sapiens
atccatagtgaaacc

SEQ ID NO: 285995 - DNA, 15 bp, Homo sapiens
tatccatagtgaaac

SEQ ID NO: 285996 - DNA, 15 bp, Homo sapiens
ctatccatagtgaaa

SEQ ID NO: 285997 - DNA, 15 bp, Homo sapiens
actatccatagtgaa

SEQ ID NO: 285998 - DNA, 15 bp, Homo sapiens
gactatccatagtga

SEQ ID NO: 285999 - DNA, 15 bp, Homo sapiens
tgactatccatagtg

SEQ ID NO: 286000 - DNA, 15 bp, Homo sapiens
ctgactatccatagt

SEQ ID NO: 286001 - DNA, 15 bp, Homo sapiens
actgactatccatag

SEQ ID NO: 286002 - DNA, 15 bp, Homo sapiens
gactgactatccata

SEQ ID NO: 286003 - DNA, 15 bp, Homo sapiens
agactgactatccat

SEQ ID NO: 286004 - DNA, 15 bp, Homo sapiens
gagactgactatcca

SEQ ID NO: 286005 - DNA, 15 bp, Homo sapiens
ggagactgactatcc

SEQ ID NO: 286006 - DNA, 15 bp, Homo sapiens
tggagactgactatc

SEQ ID NO: 286007 - DNA, 15 bp, Homo sapiens
ttggagactgactat

SEQ ID NO: 286008 - DNA, 15 bp, Homo sapiens
tttggagactgacta

SEQ ID NO: 286009 - DNA, 15 bp, Homo sapiens
atttggagactgact

SEQ ID NO: 286010 - DNA, 15 bp, Homo sapiens
gatttggagactgac

SEQ ID NO: 286011 - DNA, 15 bp, Homo sapiens
agatttggagactga

SEQ ID NO: 286012 - DNA, 15 bp, Homo sapiens
aagatttggagactg

SEQ ID NO: 286013 - DNA, 15 bp, Homo sapiens
aaagatttggagact

SEQ ID NO: 286014 - DNA, 15 bp, Homo sapiens
taaagatttggagac

SEQ ID NO: 286015 - DNA, 15 bp, Homo sapiens
ttaaagatttggaga

SEQ ID NO: 286016 - DNA, 15 bp, Homo sapiens
tttaaagatttggag

SEQ ID NO: 286017 - DNA, 15 bp, Homo sapiens
ttttaaagatttgga

SEQ ID NO: 286018 - DNA, 15 bp, Homo sapiens
gttttaaagatttgg

SEQ ID NO: 286019 - DNA, 15 bp, Homo sapiens
tgttttaaagatttg

SEQ ID NO: 286020 - DNA, 15 bp, Homo sapiens
ttgttttaaagattt

SEQ ID NO: 286021 - DNA, 15 bp, Homo sapiens
tttgttttaaagatt

SEQ ID NO: 286022 - DNA, 15 bp, Homo sapiens
ttttgttttaaagat

SEQ ID NO: 286023 - DNA, 15 bp, Homo sapiens
tttttgttttaaaga

SEQ ID NO: 286024 - DNA, 15 bp, Homo sapiens
atttttgttttaaag

SEQ ID NO: 286025 - DNA, 15 bp, Homo sapiens
aatttttgttttaaa

SEQ ID NO: 286026 - DNA, 15 bp, Homo sapiens
aaatttttgttttaa

SEQ ID NO: 286027 - DNA, 15 bp, Homo sapiens
taaatttttgtttta

SEQ ID NO: 286028 - DNA, 15 bp, Homo sapiens
gtaaatttttgtttt

SEQ ID NO: 286029 - DNA, 15 bp, Homo sapiens
agtaaatttttgttt

SEQ ID NO: 286030 - DNA, 15 bp, Homo sapiens
aagtaaatttttgtt

SEQ ID NO: 286031 - DNA, 15 bp, Homo sapiens
caagtaaatttttgt

SEQ ID NO: 286032 - DNA, 15 bp, Homo sapiens
ccaagtaaatttttg

SEQ ID NO: 286033 - DNA, 15 bp, Homo sapiens
accaagtaaattttt

SEQ ID NO: 286034 - DNA, 15 bp, Homo sapiens
taccaagtaaatttt

SEQ ID NO: 286035 - DNA, 15 bp, Homo sapiens
ataccaagtaaattt

SEQ ID NO: 286036 - DNA, 15 bp, Homo sapiens
aataccaagtaaatt

SEQ ID NO: 286037 - DNA, 15 bp, Homo sapiens
taataccaagtaaat

SEQ ID NO: 286038 - DNA, 15 bp, Homo sapiens
ttaataccaagtaaa

SEQ ID NO: 286039 - DNA, 15 bp, Homo sapiens
attaataccaagtaa

SEQ ID NO: 286040 - DNA, 15 bp, Homo sapiens
tattaataccaagta

SEQ ID NO: 286041 - DNA, 15 bp, Homo sapiens
atattaataccaagt

SEQ ID NO: 286042 - DNA, 15 bp, Homo sapiens
aatattaataccaag

SEQ ID NO: 286043 - DNA, 15 bp, Homo sapiens
taatattaataccaa

SEQ ID NO: 286044 - DNA, 15 bp, Homo sapiens
ttaatattaatacca

SEQ ID NO: 286045 - DNA, 15 bp, Homo sapiens
cttaatattaatacc

SEQ ID NO: 286046 - DNA, 15 bp, Homo sapiens
gcttaatattaatac

SEQ ID NO: 286047 - DNA, 15 bp, Homo sapiens
tgcttaatattaata

SEQ ID NO: 286048 - DNA, 15 bp, Homo sapiens
gtgcttaatattaat

SEQ ID NO: 286049 - DNA, 15 bp, Homo sapiens
agtgcttaatattaa

SEQ ID NO: 286050 - DNA, 15 bp, Homo sapiens
cagtgcttaatatta

SEQ ID NO: 286051 - DNA, 15 bp, Homo sapiens
tcagtgcttaatatt

SEQ ID NO: 286052 - DNA, 15 bp, Homo sapiens
ttcagtgcttaatat

SEQ ID NO: 286053 - DNA, 15 bp, Homo sapiens
cttcagtgcttaata

SEQ ID NO: 286054 - DNA, 15 bp, Homo sapiens
acttcagtgcttaat

SEQ ID NO: 286055 - DNA, 15 bp, Homo sapiens
aacttcagtgcttaa

SEQ ID NO: 286056 - DNA, 15 bp, Homo sapiens
taacttcagtgctta

SEQ ID NO: 286057 - DNA, 15 bp, Homo sapiens
ttaacttcagtgctt

SEQ ID NO: 286058 - DNA, 15 bp, Homo sapiens
attaacttcagtgct

SEQ ID NO: 286059 - DNA, 15 bp, Homo sapiens
gattaacttcagtgc

SEQ ID NO: 286060 - DNA, 15 bp, Homo sapiens
ggattaacttcagtg

SEQ ID NO: 286061 - DNA, 15 bp, Homo sapiens
tggattaacttcagt

SEQ ID NO: 286062 - DNA, 15 bp, Homo sapiens
atggattaacttcag

SEQ ID NO: 286063 - DNA, 15 bp, Homo sapiens
catggattaacttca

SEQ ID NO: 286064 - DNA, 15 bp, Homo sapiens
tcatggattaacttc

SEQ ID NO: 286065 - DNA, 15 bp, Homo sapiens
ctcatggattaactt

SEQ ID NO: 286066 - DNA, 15 bp, Homo sapiens
cctcatggattaact

SEQ ID NO: 286067 - DNA, 15 bp, Homo sapiens
acctcatggattaac

SEQ ID NO: 286068 - DNA, 15 bp, Homo sapiens
gacctcatggattaa

SEQ ID NO: 286069 - DNA, 15 bp, Homo sapiens
tgacctcatggatta

SEQ ID NO: 286070 - DNA, 15 bp, Homo sapiens
ctgacctcatggatt

SEQ ID NO: 286071 - DNA, 15 bp, Homo sapiens
cctgacctcatggat

SEQ ID NO: 286072 - DNA, 15 bp, Homo sapiens
acctgacctcatgga

SEQ ID NO: 286073 - DNA, 15 bp, Homo sapiens
cacctgacctcatgg

SEQ ID NO: 286074 - DNA, 15 bp, Homo sapiens
gcacctgacctcatg

SEQ ID NO: 286075 - DNA, 15 bp, Homo sapiens
agcacctgacctcat

SEQ ID NO: 286076 - DNA, 15 bp, Homo sapiens
cagcacctgacctca

SEQ ID NO: 286077 - DNA, 15 bp, Homo sapiens
acagcacctgacctc

SEQ ID NO: 286078 - DNA, 15 bp, Homo sapiens
tacagcacctgacct

SEQ ID NO: 286079 - DNA, 15 bp, Homo sapiens
ctacagcacctgacc

SEQ ID NO: 286080 - DNA, 15 bp, Homo sapiens
actacagcacctgac

SEQ ID NO: 286081 - DNA, 15 bp, Homo sapiens
tactacagcacctga

SEQ ID NO: 286082 - DNA, 15 bp, Homo sapiens
ttactacagcacctg

SEQ ID NO: 286083 - DNA, 15 bp, Homo sapiens
tttactacagcacct

SEQ ID NO: 286084 - DNA, 15 bp, Homo sapiens
atttactacagcacc

SEQ ID NO: 286085 - DNA, 15 bp, Homo sapiens
catttactacagcac

SEQ ID NO: 286086 - DNA, 15 bp, Homo sapiens
acatttactacagca

SEQ ID NO: 286087 - DNA, 15 bp, Homo sapiens
aacatttactacagc

SEQ ID NO: 286088 - DNA, 15 bp, Homo sapiens
gaacatttactacag

SEQ ID NO: 286089 - DNA, 15 bp, Homo sapiens
agaacatttactaca

SEQ ID NO: 286090 - DNA, 15 bp, Homo sapiens
cagaacatttactac

SEQ ID NO: 286091 - DNA, 15 bp, Homo sapiens
tcagaacatttacta

SEQ ID NO: 286092 - DNA, 15 bp, Homo sapiens
ctcagaacatttact

SEQ ID NO: 286093 - DNA, 15 bp, Homo sapiens
cctcagaacatttac

SEQ ID NO: 286094 - DNA, 15 bp, Homo sapiens
ccctcagaacattta

SEQ ID NO: 286095 - DNA, 15 bp, Homo sapiens
gccctcagaacattt

SEQ ID NO: 286096 - DNA, 15 bp, Homo sapiens
tgccctcagaacatt

SEQ ID NO: 286097 - DNA, 15 bp, Homo sapiens
atgccctcagaacat

SEQ ID NO: 286098 - DNA, 15 bp, Homo sapiens
tatgccctcagaaca

SEQ ID NO: 286099 - DNA, 15 bp, Homo sapiens
ttatgccctcagaac

SEQ ID NO: 286100 - DNA, 15 bp, Homo sapiens
attatgccctcagaa

SEQ ID NO: 286101 - DNA, 15 bp, Homo sapiens
cattatgccctcaga

SEQ ID NO: 286102 - DNA, 15 bp, Homo sapiens
ccattatgccctcag

SEQ ID NO: 286103 - DNA, 15 bp, Homo sapiens
accattatgccctca

SEQ ID NO: 286104 - DNA, 15 bp, Homo sapiens
caccattatgccctc

SEQ ID NO: 286105 - DNA, 15 bp, Homo sapiens
ccaccattatgccct

SEQ ID NO: 286106 - DNA, 15 bp, Homo sapiens
gccaccattatgccc

SEQ ID NO: 286107 - DNA, 15 bp, Homo sapiens
agccaccattatgcc

SEQ ID NO: 286108 - DNA, 15 bp, Homo sapiens
aagccaccattatgc

SEQ ID NO: 286109 - DNA, 15 bp, Homo sapiens
caagccaccattatg

SEQ ID NO: 286110 - DNA, 15 bp, Homo sapiens
acaagccaccattat

SEQ ID NO: 286111 - DNA, 15 bp, Homo sapiens
cacaagccaccatta

SEQ ID NO: 286112 - DNA, 15 bp, Homo sapiens
tcacaagccaccatt

SEQ ID NO: 286113 - DNA, 15 bp, Homo sapiens
atcacaagccaccat

SEQ ID NO: 286114 - DNA, 15 bp, Homo sapiens
gatcacaagccacca

SEQ ID NO: 286115 - DNA, 15 bp, Homo sapiens
agatcacaagccacc

SEQ ID NO: 286116 - DNA, 15 bp, Homo sapiens
aagatcacaagccac

SEQ ID NO: 286117 - DNA, 15 bp, Homo sapiens
caagatcacaagcca

SEQ ID NO: 286118 - DNA, 15 bp, Homo sapiens
ccaagatcacaagcc

SEQ ID NO: 286119 - DNA, 15 bp, Homo sapiens
tccaagatcacaagc

SEQ ID NO: 286120 - DNA, 15 bp, Homo sapiens
ctccaagatcacaag

SEQ ID NO: 286121 - DNA, 15 bp, Homo sapiens
cctccaagatcacaa

SEQ ID NO: 286122 - DNA, 15 bp, Homo sapiens
tcctccaagatcaca

SEQ ID NO: 286123 - DNA, 15 bp, Homo sapiens
ttcctccaagatcac

SEQ ID NO: 286124 - DNA, 15 bp, Homo sapiens
gttcctccaagatca

SEQ ID NO: 286125 - DNA, 15 bp, Homo sapiens
agttcctccaagatc

SEQ ID NO: 286126 - DNA, 15 bp, Homo sapiens
gagttcctccaagat

SEQ ID NO: 286127 - DNA, 15 bp, Homo sapiens
agagttcctccaaga

SEQ ID NO: 286128 - DNA, 15 bp, Homo sapiens
tagagttcctccaag

SEQ ID NO: 286129 - DNA, 15 bp, Homo sapiens
gtagagttcctccaa

SEQ ID NO: 286130 - DNA, 15 bp, Homo sapiens
cgtagagttcctcca

SEQ ID NO: 286131 - DNA, 15 bp, Homo sapiens
gcgtagagttcctcc

SEQ ID NO: 286132 - DNA, 15 bp, Homo sapiens
ggcgtagagttcctc

SEQ ID NO: 286133 - DNA, 15 bp, Homo sapiens
tggcgtagagttcct

SEQ ID NO: 286134 - DNA, 15 bp, Homo sapiens
ctggcgtagagttcc

SEQ ID NO: 286135 - DNA, 15 bp, Homo sapiens
cctggcgtagagttc

SEQ ID NO: 286136 - DNA, 15 bp, Homo sapiens
tcctggcgtagagtt

SEQ ID NO: 286137 - DNA, 15 bp, Homo sapiens
atcctggcgtagagt

SEQ ID NO: 286138 - DNA, 15 bp, Homo sapiens
gatcctggcgtagag

SEQ ID NO: 286139 - DNA, 15 bp, Homo sapiens
agatcctggcgtaga

SEQ ID NO: 286140 - DNA, 15 bp, Homo sapiens
cagatcctggcgtag

SEQ ID NO: 286141 - DNA, 15 bp, Homo sapiens
acagatcctggcgta

SEQ ID NO: 286142 - DNA, 15 bp, Homo sapiens
cacagatcctggcgt

SEQ ID NO: 286143 - DNA, 15 bp, Homo sapiens
ccacagatcctggcg

SEQ ID NO: 286144 - DNA, 15 bp, Homo sapiens
accacagatcctggc

SEQ ID NO: 286145 - DNA, 15 bp, Homo sapiens
gaccacagatcctgg

SEQ ID NO: 286146 - DNA, 15 bp, Homo sapiens
tgaccacagatcctg

SEQ ID NO: 286147 - DNA, 15 bp, Homo sapiens
ttgaccacagatcct

SEQ ID NO: 286148 - DNA, 15 bp, Homo sapiens
tttgaccacagatcc

SEQ ID NO: 286149 - DNA, 15 bp, Homo sapiens
atttgaccacagatc

SEQ ID NO: 286150 - DNA, 15 bp, Homo sapiens
gatttgaccacagat

SEQ ID NO: 286151 - DNA, 15 bp, Homo sapiens
tgatttgaccacaga

SEQ ID NO: 286152 - DNA, 15 bp, Homo sapiens
atgatttgaccacag

SEQ ID NO: 286153 - DNA, 15 bp, Homo sapiens
catgatttgaccaca

SEQ ID NO: 286154 - DNA, 15 bp, Homo sapiens
ccatgatttgaccac

SEQ ID NO: 286155 - DNA, 15 bp, Homo sapiens
gccatgatttgacca

SEQ ID NO: 286156 - DNA, 15 bp, Homo sapiens
ggccatgatttgacc

SEQ ID NO: 286157 - DNA, 15 bp, Homo sapiens
tggccatgatttgac

SEQ ID NO: 286158 - DNA, 15 bp, Homo sapiens
gtggccatgatttga

SEQ ID NO: 286159 - DNA, 15 bp, Homo sapiens
tgtggccatgatttg

SEQ ID NO: 286160 - DNA, 15 bp, Homo sapiens
ttgtggccatgattt

SEQ ID NO: 286161 - DNA, 15 bp, Homo sapiens
cttgtggccatgatt

SEQ ID NO: 286162 - DNA, 15 bp, Homo sapiens
tcttgtggccatgat

SEQ ID NO: 286163 - DNA, 15 bp, Homo sapiens
atcttgtggccatga

SEQ ID NO: 286164 - DNA, 15 bp, Homo sapiens
gatcttgtggccatg

SEQ ID NO: 286165 - DNA, 15 bp, Homo sapiens
tgatcttgtggccat

SEQ ID NO: 286166 - DNA, 15 bp, Homo sapiens
ctgatcttgtggcca

SEQ ID NO: 286167 - DNA, 15 bp, Homo sapiens
gctgatcttgtggcc

SEQ ID NO: 286168 - DNA, 15 bp, Homo sapiens
ggctgatcttgtggc

SEQ ID NO: 286169 - DNA, 15 bp, Homo sapiens
tggctgatcttgtgg

SEQ ID NO: 286170 - DNA, 15 bp, Homo sapiens
gtggctgatcttgtg

SEQ ID NO: 286171 - DNA, 15 bp, Homo sapiens
tgtggctgatcttgt

SEQ ID NO: 286172 - DNA, 15 bp, Homo sapiens
atgtggctgatcttg

SEQ ID NO: 286173 - DNA, 15 bp, Homo sapiens
tatgtggctgatctt

SEQ ID NO: 286174 - DNA, 15 bp, Homo sapiens
ctatgtggctgatct

SEQ ID NO: 286175 - DNA, 15 bp, Homo sapiens
gctatgtggctgatc

SEQ ID NO: 286176 - DNA, 15 bp, Homo sapiens
agctatgtggctgat

SEQ ID NO: 286177 - DNA, 15 bp, Homo sapiens
aagctatgtggctga

SEQ ID NO: 286178 - DNA, 15 bp, Homo sapiens
taagctatgtggctg

SEQ ID NO: 286179 - DNA, 15 bp, Homo sapiens
ttaagctatgtggct

SEQ ID NO: 286180 - DNA, 15 bp, Homo sapiens
tttaagctatgtggc

SEQ ID NO: 286181 - DNA, 15 bp, Homo sapiens
ctttaagctatgtgg

SEQ ID NO: 286182 - DNA, 15 bp, Homo sapiens
cctttaagctatgtg

SEQ ID NO: 286183 - DNA, 15 bp, Homo sapiens
ccctttaagctatgt

SEQ ID NO: 286184 - DNA, 15 bp, Homo sapiens
tccctttaagctatg

SEQ ID NO: 286185 - DNA, 15 bp, Homo sapiens
atccctttaagctat

SEQ ID NO: 286186 - DNA, 15 bp, Homo sapiens
gatccctttaagcta

SEQ ID NO: 286187 - DNA, 15 bp, Homo sapiens
ggatccctttaagct

SEQ ID NO: 286188 - DNA, 15 bp, Homo sapiens
tggatccctttaagc

SEQ ID NO: 286189 - DNA, 15 bp, Homo sapiens
ttggatccctttaag

SEQ ID NO: 286190 - DNA, 15 bp, Homo sapiens
cttggatccctttaa

SEQ ID NO: 286191 - DNA, 15 bp, Homo sapiens
acttggatcccttta

SEQ ID NO: 286192 - DNA, 15 bp, Homo sapiens
aacttggatcccttt

SEQ ID NO: 286193 - DNA, 15 bp, Homo sapiens
aaacttggatccctt

SEQ ID NO: 286194 - DNA, 15 bp, Homo sapiens
aaaacttggatccct

SEQ ID NO: 286195 - DNA, 15 bp, Homo sapiens
gaaaacttggatccc

SEQ ID NO: 286196 - DNA, 15 bp, Homo sapiens
agaaaacttggatcc

SEQ ID NO: 286197 - DNA, 15 bp, Homo sapiens
aagaaaacttggatc

SEQ ID NO: 286198 - DNA, 15 bp, Homo sapiens
aaagaaaacttggat

SEQ ID NO: 286199 - DNA, 15 bp, Homo sapiens
aaaagaaaacttgga

SEQ ID NO: 286200 - DNA, 15 bp, Homo sapiens
taaaagaaaacttgg

SEQ ID NO: 286201 - DNA, 15 bp, Homo sapiens
ttaaaagaaaacttg

SEQ ID NO: 286202 - DNA, 15 bp, Homo sapiens
attaaaagaaaactt

SEQ ID NO: 286203 - DNA, 15 bp, Homo sapiens
aattaaaagaaaact

SEQ ID NO: 286204 - DNA, 15 bp, Homo sapiens
gaattaaaagaaaac

SEQ ID NO: 286205 - DNA, 15 bp, Homo sapiens
agaattaaaagaaaa

SEQ ID NO: 286206 - DNA, 15 bp, Homo sapiens
aagaattaaaagaaa

SEQ ID NO: 286207 - DNA, 15 bp, Homo sapiens
caagaattaaaagaa

SEQ ID NO: 286208 - DNA, 15 bp, Homo sapiens
acaagaattaaaaga

SEQ ID NO: 286209 - DNA, 15 bp, Homo sapiens
aacaagaattaaaag

SEQ ID NO: 286210 - DNA, 15 bp, Homo sapiens
caacaagaattaaaa

SEQ ID NO: 286211 - DNA, 15 bp, Homo sapiens
acaacaagaattaaa

SEQ ID NO: 286212 - DNA, 15 bp, Homo sapiens
gacaacaagaattaa

SEQ ID NO: 286213 - DNA, 15 bp, Homo sapiens
ggacaacaagaatta

SEQ ID NO: 286214 - DNA, 15 bp, Homo sapiens
aggacaacaagaatt

SEQ ID NO: 286215 - DNA, 15 bp, Homo sapiens
aaggacaacaagaat

SEQ ID NO: 286216 - DNA, 15 bp, Homo sapiens
taaggacaacaagaa

SEQ ID NO: 286217 - DNA, 15 bp, Homo sapiens
ataaggacaacaaga

SEQ ID NO: 286218 - DNA, 15 bp, Homo sapiens
tataaggacaacaag

SEQ ID NO: 286219 - DNA, 15 bp, Homo sapiens
atataaggacaacaa

SEQ ID NO: 286220 - DNA, 15 bp, Homo sapiens
aatataaggacaaca

SEQ ID NO: 286221 - DNA, 15 bp, Homo sapiens
taatataaggacaac

SEQ ID NO: 286222 - DNA, 15 bp, Homo sapiens
ctaatataaggacaa

SEQ ID NO: 286223 - DNA, 15 bp, Homo sapiens
actaatataaggaca

SEQ ID NO: 286224 - DNA, 15 bp, Homo sapiens
aactaatataaggac

SEQ ID NO: 286225 - DNA, 15 bp, Homo sapiens
gaactaatataagga

SEQ ID NO: 286226 - DNA, 15 bp, Homo sapiens
agaactaatataagg

SEQ ID NO: 286227 - DNA, 15 bp, Homo sapiens
aagaactaatataag

SEQ ID NO: 286228 - DNA, 15 bp, Homo sapiens
taagaactaatataa

SEQ ID NO: 286229 - DNA, 15 bp, Homo sapiens
ataagaactaatata

SEQ ID NO: 286230 - DNA, 15 bp, Homo sapiens
aataagaactaatat

SEQ ID NO: 286231 - DNA, 15 bp, Homo sapiens
aaataagaactaata

SEQ ID NO: 286232 - DNA, 15 bp, Homo sapiens
aaaataagaactaat

SEQ ID NO: 286233 - DNA, 15 bp, Homo sapiens
taaaataagaactaa

SEQ ID NO: 286234 - DNA, 15 bp, Homo sapiens
ttaaaataagaacta

SEQ ID NO: 286235 - DNA, 15 bp, Homo sapiens
cttaaaataagaact

SEQ ID NO: 286236 - DNA, 15 bp, Homo sapiens
acttaaaataagaac

SEQ ID NO: 286237 - DNA, 15 bp, Homo sapiens
gacttaaaataagaa

SEQ ID NO: 286238 - DNA, 15 bp, Homo sapiens
agacttaaaataaga

SEQ ID NO: 286239 - DNA, 15 bp, Homo sapiens
aagacttaaaataag

SEQ ID NO: 286240 - DNA, 15 bp, Homo sapiens
aaagacttaaaataa

SEQ ID NO: 286241 - DNA, 15 bp, Homo sapiens
aaaagacttaaaata

SEQ ID NO: 286242 - DNA, 15 bp, Homo sapiens
gaaaagacttaaaat

SEQ ID NO: 286243 - DNA, 15 bp, Homo sapiens
agaaaagacttaaaa

SEQ ID NO: 286244 - DNA, 15 bp, Homo sapiens
aagaaaagacttaaa

SEQ ID NO: 286245 - DNA, 15 bp, Homo sapiens
aaagaaaagacttaa

SEQ ID NO: 286246 - DNA, 15 bp, Homo sapiens
gaaagaaaagactta

SEQ ID NO: 286247 - DNA, 15 bp, Homo sapiens
ggaaagaaaagactt

SEQ ID NO: 286248 - DNA, 15 bp, Homo sapiens
tggaaagaaaagact

SEQ ID NO: 286249 - DNA, 15 bp, Homo sapiens
atggaaagaaaagac

SEQ ID NO: 286250 - DNA, 15 bp, Homo sapiens
tatggaaagaaaaga

SEQ ID NO: 286251 - DNA, 15 bp, Homo sapiens
atatggaaagaaaag

SEQ ID NO: 286252 - DNA, 15 bp, Homo sapiens
aatatggaaagaaaa

SEQ ID NO: 286253 - DNA, 15 bp, Homo sapiens
aaatatggaaagaaa

SEQ ID NO: 286254 - DNA, 15 bp, Homo sapiens
taaatatggaaagaa

SEQ ID NO: 286255 - DNA, 15 bp, Homo sapiens
ataaatatggaaaga

SEQ ID NO: 286256 - DNA, 15 bp, Homo sapiens
aataaatatggaaag

SEQ ID NO: 286257 - DNA, 15 bp, Homo sapiens
taataaatatggaaa

SEQ ID NO: 286258 - DNA, 15 bp, Homo sapiens
ataataaatatggaa

SEQ ID NO: 286259 - DNA, 15 bp, Homo sapiens
aataataaatatgga

SEQ ID NO: 286260 - DNA, 15 bp, Homo sapiens
aaataataaatatgg

SEQ ID NO: 286261 - DNA, 15 bp, Homo sapiens
aaaataataaatatg

SEQ ID NO: 286262 - DNA, 15 bp, Homo sapiens
gaaaataataaatat

SEQ ID NO: 286263 - DNA, 15 bp, Homo sapiens
agaaaataataaata

SEQ ID NO: 286264 - DNA, 15 bp, Homo sapiens
aagaaaataataaat

SEQ ID NO: 286265 - DNA, 15 bp, Homo sapiens
aaagaaaataataaa

SEQ ID NO: 286266 - DNA, 15 bp, Homo sapiens
aaaagaaaataataa

SEQ ID NO: 286267 - DNA, 15 bp, Homo sapiens
cctaaaagaaaataa

SEQ ID NO: 286268 - DNA, 15 bp, Homo sapiens
acctaaaagaaaata

SEQ ID NO: 286269 - DNA, 15 bp, Homo sapiens
tacctaaaagaaaat

SEQ ID NO: 286270 - DNA, 15 bp, Homo sapiens
atacctaaaagaaaa

SEQ ID NO: 286271 - DNA, 15 bp, Homo sapiens
catacctaaaagaaa

SEQ ID NO: 286272 - DNA, 15 bp, Homo sapiens
acatacctaaaagaa

SEQ ID NO: 286273 - DNA, 15 bp, Homo sapiens
aacatacctaaaaga

SEQ ID NO: 286274 - DNA, 15 bp, Homo sapiens
taacatacctaaaag

SEQ ID NO: 286275 - DNA, 15 bp, Homo sapiens
ataacatacctaaaa

SEQ ID NO: 286276 - DNA, 15 bp, Homo sapiens
aataacatacctaaa

SEQ ID NO: 286277 - DNA, 15 bp, Homo sapiens
caataacatacctaa

SEQ ID NO: 286278 - DNA, 15 bp, Homo sapiens
tcaataacataccta

SEQ ID NO: 286279 - DNA, 15 bp, Homo sapiens
atcaataacatacct

SEQ ID NO: 286280 - DNA, 15 bp, Homo sapiens
tatcaataacatacc

SEQ ID NO: 286281 - DNA, 15 bp, Homo sapiens
ctatcaataacatac

SEQ ID NO: 286282 - DNA, 15 bp, Homo sapiens
cctatcaataacata

SEQ ID NO: 286283 - DNA, 15 bp, Homo sapiens
acctatcaataacat

SEQ ID NO: 286284 - DNA, 15 bp, Homo sapiens
tacctatcaataaca

SEQ ID NO: 286285 - DNA, 15 bp, Homo sapiens
atacctatcaataac

SEQ ID NO: 286286 - DNA, 15 bp, Homo sapiens
gatacctatcaataa

SEQ ID NO: 286287 - DNA, 15 bp, Homo sapiens
tgatacctatcaata

SEQ ID NO: 286288 - DNA, 15 bp, Homo sapiens
atgatacctatcaat

SEQ ID NO: 286289 - DNA, 15 bp, Homo sapiens
tatgatacctatcaa

SEQ ID NO: 286290 - DNA, 15 bp, Homo sapiens
ctatgatacctatca

SEQ ID NO: 286291 - DNA, 15 bp, Homo sapiens
tctatgatacctatc

SEQ ID NO: 286292 - DNA, 15 bp, Homo sapiens
ttctatgatacctat

SEQ ID NO: 286293 - DNA, 15 bp, Homo sapiens
gttctatgataccta

SEQ ID NO: 286294 - DNA, 15 bp, Homo sapiens
agttctatgatacct

SEQ ID NO: 286295 - DNA, 15 bp, Homo sapiens
tagttctatgatacc

SEQ ID NO: 286296 - DNA, 15 bp, Homo sapiens
ttagttctatgatac

SEQ ID NO: 286297 - DNA, 15 bp, Homo sapiens
attagttctatgata

SEQ ID NO: 286298 - DNA, 15 bp, Homo sapiens
aattagttctatgat

SEQ ID NO: 286299 - DNA, 15 bp, Homo sapiens
aaattagttctatga

SEQ ID NO: 286300 - DNA, 15 bp, Homo sapiens
aaaattagttctatg

SEQ ID NO: 286301 - DNA, 15 bp, Homo sapiens
aaaaattagttctat

SEQ ID NO: 286302 - DNA, 15 bp, Homo sapiens
aaaaaattagttcta

SEQ ID NO: 286303 - DNA, 15 bp, Homo sapiens
caaaaaattagttct

SEQ ID NO: 286304 - DNA, 15 bp, Homo sapiens
acaaaaaattagttc

SEQ ID NO: 286305 - DNA, 15 bp, Homo sapiens
aacaaaaaattagtt

SEQ ID NO: 286306 - DNA, 15 bp, Homo sapiens
aaacaaaaaattagt

SEQ ID NO: 286307 - DNA, 15 bp, Homo sapiens
caaacaaaaaattag

SEQ ID NO: 286308 - DNA, 15 bp, Homo sapiens
acaaacaaaaaatta

SEQ ID NO: 286309 - DNA, 15 bp, Homo sapiens
aacaaacaaaaaatt

SEQ ID NO: 286310 - DNA, 15 bp, Homo sapiens
aaacaaacaaaaaat

SEQ ID NO: 286311 - DNA, 15 bp, Homo sapiens
aacaaaacaaacaaa

SEQ ID NO: 286312 - DNA, 15 bp, Homo sapiens
aaacaaaacaaacaa

SEQ ID NO: 286313 - DNA, 15 bp, Homo sapiens
caaacaaaacaaaca

SEQ ID NO: 286314 - DNA, 15 bp, Homo sapiens
acaaacaaaacaaac

SEQ ID NO: 286315 - DNA, 15 bp, Homo sapiens
aacaaacaaaacaaa

SEQ ID NO: 286316 - DNA, 15 bp, Homo sapiens
caacaaacaaaacaa

SEQ ID NO: 286317 - DNA, 15 bp, Homo sapiens
acaacaaacaaaaca

SEQ ID NO: 286318 - DNA, 15 bp, Homo sapiens
aacaacaaacaaaac

SEQ ID NO: 286319 - DNA, 15 bp, Homo sapiens
aaacaacaaacaaaa

SEQ ID NO: 286320 - DNA, 15 bp, Homo sapiens
aaaacaacaaacaaa

SEQ ID NO: 286321 - DNA, 15 bp, Homo sapiens
caaaacaacaaacaa

SEQ ID NO: 286322 - DNA, 15 bp, Homo sapiens
acaaaacaacaaaca

SEQ ID NO: 286323 - DNA, 15 bp, Homo sapiens
aacaaaacaacaaac

SEQ ID NO: 286324 - DNA, 15 bp, Homo sapiens
caaaaacaaaacaaa

SEQ ID NO: 286325 - DNA, 15 bp, Homo sapiens
tcaaaaacaaaacaa

SEQ ID NO: 286326 - DNA, 15 bp, Homo sapiens
ctcaaaaacaaaaca

SEQ ID NO: 286327 - DNA, 15 bp, Homo sapiens
tctcaaaaacaaaac

SEQ ID NO: 286328 - DNA, 15 bp, Homo sapiens
gtctcaaaaacaaaa

SEQ ID NO: 286329 - DNA, 15 bp, Homo sapiens
tctgtctcaaaaaca

SEQ ID NO: 286330 - DNA, 15 bp, Homo sapiens
ctctgtctcaaaaac

SEQ ID NO: 286331 - DNA, 15 bp, Homo sapiens
gggcgacagagtgag

SEQ ID NO: 286332 - DNA, 15 bp, Homo sapiens
tgggcgacagagtga

SEQ ID NO: 286333 - DNA, 15 bp, Homo sapiens
ctgggcgacagagtg

SEQ ID NO: 286334 - DNA, 15 bp, Homo sapiens
cctgggcgacagagt

SEQ ID NO: 286335 - DNA, 15 bp, Homo sapiens
gagattgtgccactg

SEQ ID NO: 286336 - DNA, 15 bp, Homo sapiens
tgagattgtgccact

SEQ ID NO: 286337 - DNA, 15 bp, Homo sapiens
ctgagattgtgccac

SEQ ID NO: 286338 - DNA, 15 bp, Homo sapiens
agtgagctgagattg

SEQ ID NO: 286339 - DNA, 15 bp, Homo sapiens
caaggttgcagtgag

SEQ ID NO: 286340 - DNA, 15 bp, Homo sapiens
ccaaggttgcagtga

SEQ ID NO: 286341 - DNA, 15 bp, Homo sapiens
gccaaggttgcagtg

SEQ ID NO: 286342 - DNA, 15 bp, Homo sapiens
agccaaggttgcagt

SEQ ID NO: 286343 - DNA, 15 bp, Homo sapiens
aagccaaggttgcag

SEQ ID NO: 286344 - DNA, 15 bp, Homo sapiens
gaagccaaggttgca

SEQ ID NO: 286345 - DNA, 15 bp, Homo sapiens
ggaagccaaggttgc

SEQ ID NO: 286346 - DNA, 15 bp, Homo sapiens
gggaagccaaggttg

SEQ ID NO: 286347 - DNA, 15 bp, Homo sapiens
cgggaagccaaggtt

SEQ ID NO: 286348 - DNA, 15 bp, Homo sapiens
ccgggaagccaaggt

SEQ ID NO: 286349 - DNA, 15 bp, Homo sapiens
cccgggaagccaagg

SEQ ID NO: 286350 - DNA, 15 bp, Homo sapiens
acccgggaagccaag

SEQ ID NO: 286351 - DNA, 15 bp, Homo sapiens
aacccgggaagccaa

SEQ ID NO: 286352 - DNA, 15 bp, Homo sapiens
gaacccgggaagcca

SEQ ID NO: 286353 - DNA, 15 bp, Homo sapiens
tgaacccgggaagcc

SEQ ID NO: 286354 - DNA, 15 bp, Homo sapiens
ttgaacccgggaagc

SEQ ID NO: 286355 - DNA, 15 bp, Homo sapiens
cttgaacccgggaag

SEQ ID NO: 286356 - DNA, 15 bp, Homo sapiens
acttgaacccgggaa

SEQ ID NO: 286357 - DNA, 15 bp, Homo sapiens
gcacctataatccca

SEQ ID NO: 286358 - DNA, 15 bp, Homo sapiens
ggcacctataatccc

SEQ ID NO: 286359 - DNA, 15 bp, Homo sapiens
gggcacctataatcc

SEQ ID NO: 286360 - DNA, 15 bp, Homo sapiens
tgggcacctataatc

SEQ ID NO: 286361 - DNA, 15 bp, Homo sapiens
gtgggcacctataat

SEQ ID NO: 286362 - DNA, 15 bp, Homo sapiens
ggtgggcacctataa

SEQ ID NO: 286363 - DNA, 15 bp, Homo sapiens
tggtgggcacctata

SEQ ID NO: 286364 - DNA, 15 bp, Homo sapiens
gtggtgggcacctat

SEQ ID NO: 286365 - DNA, 15 bp, Homo sapiens
ggtggtgggcaccta

SEQ ID NO: 286366 - DNA, 15 bp, Homo sapiens
ttggtggtgggcacc

SEQ ID NO: 286367 - DNA, 15 bp, Homo sapiens
cttggtggtgggcac

SEQ ID NO: 286368 - DNA, 15 bp, Homo sapiens
gcttggtggtgggca

SEQ ID NO: 286369 - DNA, 15 bp, Homo sapiens
ggcttggtggtgggc

SEQ ID NO: 286370 - DNA, 15 bp, Homo sapiens
gggcttggtggtggg

SEQ ID NO: 286371 - DNA, 15 bp, Homo sapiens
tgggcttggtggtgg

SEQ ID NO: 286372 - DNA, 15 bp, Homo sapiens
ttgggcttggtggtg

SEQ ID NO: 286373 - DNA, 15 bp, Homo sapiens
gttgggcttggtggt

SEQ ID NO: 286374 - DNA, 15 bp, Homo sapiens
agttgggcttggtgg

SEQ ID NO: 286375 - DNA, 15 bp, Homo sapiens
tagttgggcttggtg

SEQ ID NO: 286376 - DNA, 15 bp, Homo sapiens
ttagttgggcttggt

SEQ ID NO: 286377 - DNA, 15 bp, Homo sapiens
attagttgggcttgg

SEQ ID NO: 286378 - DNA, 15 bp, Homo sapiens
aattagttgggcttg

SEQ ID NO: 286379 - DNA, 15 bp, Homo sapiens
aaattagttgggctt

SEQ ID NO: 286380 - DNA, 15 bp, Homo sapiens
aaaattagttgggct

SEQ ID NO: 286381 - DNA, 15 bp, Homo sapiens
aaaaattagttgggc

SEQ ID NO: 286382 - DNA, 15 bp, Homo sapiens
caaaaattagttggg

SEQ ID NO: 286383 - DNA, 15 bp, Homo sapiens
acaaaaattagttgg

SEQ ID NO: 286384 - DNA, 15 bp, Homo sapiens
tacaaaaattagttg

SEQ ID NO: 286385 - DNA, 15 bp, Homo sapiens
atacaaaaattagtt

SEQ ID NO: 286386 - DNA, 15 bp, Homo sapiens
aatacaaaaattagt

SEQ ID NO: 286387 - DNA, 15 bp, Homo sapiens
tgagaccagcctgac

SEQ ID NO: 286388 - DNA, 15 bp, Homo sapiens
ttgagaccagcctga

SEQ ID NO: 286389 - DNA, 15 bp, Homo sapiens
cttgagaccagcctg

SEQ ID NO: 286390 - DNA, 15 bp, Homo sapiens
gcttgagaccagcct

SEQ ID NO: 286391 - DNA, 15 bp, Homo sapiens
agcttgagaccagcc

SEQ ID NO: 286392 - DNA, 15 bp, Homo sapiens
gagcttgagaccagc

SEQ ID NO: 286393 - DNA, 15 bp, Homo sapiens
ggagcttgagaccag

SEQ ID NO: 286394 - DNA, 15 bp, Homo sapiens
aggagcttgagacca

SEQ ID NO: 286395 - DNA, 15 bp, Homo sapiens
caggagcttgagacc

SEQ ID NO: 286396 - DNA, 15 bp, Homo sapiens
tcaggagcttgagac

SEQ ID NO: 286397 - DNA, 15 bp, Homo sapiens
gtcaggagcttgaga

SEQ ID NO: 286398 - DNA, 15 bp, Homo sapiens
ggtcaggagcttgag

SEQ ID NO: 286399 - DNA, 15 bp, Homo sapiens
aggtcaggagcttga

SEQ ID NO: 286400 - DNA, 15 bp, Homo sapiens
gaggtcaggagcttg

SEQ ID NO: 286401 - DNA, 15 bp, Homo sapiens
tgaggtcaggagctt

SEQ ID NO: 286402 - DNA, 15 bp, Homo sapiens
ttgaggtcaggagct

SEQ ID NO: 286403 - DNA, 15 bp, Homo sapiens
cttgaggtcaggagc

SEQ ID NO: 286404 - DNA, 15 bp, Homo sapiens
tgggcagatcacttg

SEQ ID NO: 286405 - DNA, 15 bp, Homo sapiens
atgggcagatcactt

SEQ ID NO: 286406 - DNA, 15 bp, Homo sapiens
gatgggcagatcact

SEQ ID NO: 286407 - DNA, 15 bp, Homo sapiens
agatgggcagatcac

SEQ ID NO: 286408 - DNA, 15 bp, Homo sapiens
gagatgggcagatca

SEQ ID NO: 286409 - DNA, 15 bp, Homo sapiens
cgagatgggcagatc

SEQ ID NO: 286410 - DNA, 15 bp, Homo sapiens
tcgagatgggcagat

SEQ ID NO: 286411 - DNA, 15 bp, Homo sapiens
gtcgagatgggcaga

SEQ ID NO: 286412 - DNA, 15 bp, Homo sapiens
ggtcgagatgggcag

SEQ ID NO: 286413 - DNA, 15 bp, Homo sapiens
aggtcgagatgggca

SEQ ID NO: 286414 - DNA, 15 bp, Homo sapiens
gaggtcgagatgggc

SEQ ID NO: 286415 - DNA, 15 bp, Homo sapiens
ggaggtcgagatggg

SEQ ID NO: 286416 - DNA, 15 bp, Homo sapiens
gggaggtcgagatgg

SEQ ID NO: 286417 - DNA, 15 bp, Homo sapiens
tgggaggtcgagatg

SEQ ID NO: 286418 - DNA, 15 bp, Homo sapiens
ttgggaggtcgagat

SEQ ID NO: 286419 - DNA, 15 bp, Homo sapiens
acggtggctcacgcc

SEQ ID NO: 286420 - DNA, 15 bp, Homo sapiens
cacggtggctcacgc

SEQ ID NO: 286421 - DNA, 15 bp, Homo sapiens
gcacggtggctcacg

SEQ ID NO: 286422 - DNA, 15 bp, Homo sapiens
gttggctgggcacgg

SEQ ID NO: 286423 - DNA, 15 bp, Homo sapiens
agttggctgggcacg

SEQ ID NO: 286424 - DNA, 15 bp, Homo sapiens
tagttggctgggcac

SEQ ID NO: 286425 - DNA, 15 bp, Homo sapiens
ttagttggctgggca

SEQ ID NO: 286426 - DNA, 15 bp, Homo sapiens
attagttggctgggc

SEQ ID NO: 286427 - DNA, 15 bp, Homo sapiens
aattagttggctggg

SEQ ID NO: 286428 - DNA, 15 bp, Homo sapiens
caattagttggctgg

SEQ ID NO: 286429 - DNA, 15 bp, Homo sapiens
acaattagttggctg

SEQ ID NO: 286430 - DNA, 15 bp, Homo sapiens
aacaattagttggct

SEQ ID NO: 286431 - DNA, 15 bp, Homo sapiens
aaacaattagttggc

SEQ ID NO: 286432 - DNA, 15 bp, Homo sapiens
aaaacaattagttgg

SEQ ID NO: 286433 - DNA, 15 bp, Homo sapiens
aaaaacaattagttg

SEQ ID NO: 286434 - DNA, 15 bp, Homo sapiens
aaaaaacaattagtt

SEQ ID NO: 286435 - DNA, 15 bp, Homo sapiens
aaaaaaacaattagt

SEQ ID NO: 286436 - DNA, 15 bp, Homo sapiens
taaaaaaacaattag

SEQ ID NO: 286437 - DNA, 15 bp, Homo sapiens
ttaaaaaaacaatta

SEQ ID NO: 286438 - DNA, 15 bp, Homo sapiens
gttaaaaaaacaatt

SEQ ID NO: 286439 - DNA, 15 bp, Homo sapiens
agttaaaaaaacaat

SEQ ID NO: 286440 - DNA, 15 bp, Homo sapiens
tagttaaaaaaacaa

SEQ ID NO: 286441 - DNA, 15 bp, Homo sapiens
ttagttaaaaaaaca

SEQ ID NO: 286442 - DNA, 15 bp, Homo sapiens
attagttaaaaaaac

SEQ ID NO: 286443 - DNA, 15 bp, Homo sapiens
tattagttaaaaaaa

SEQ ID NO: 286444 - DNA, 15 bp, Homo sapiens
atattagttaaaaaa

SEQ ID NO: 286445 - DNA, 15 bp, Homo sapiens
aatattagttaaaaa

SEQ ID NO: 286446 - DNA, 15 bp, Homo sapiens
taatattagttaaaa

SEQ ID NO: 286447 - DNA, 15 bp, Homo sapiens
ctaatattagttaaa

SEQ ID NO: 286448 - DNA, 15 bp, Homo sapiens
tctaatattagttaa

SEQ ID NO: 286449 - DNA, 15 bp, Homo sapiens
ttctaatattagtta

SEQ ID NO: 286450 - DNA, 15 bp, Homo sapiens
attctaatattagtt

SEQ ID NO: 286451 - DNA, 15 bp, Homo sapiens
tattctaatattagt

SEQ ID NO: 286452 - DNA, 15 bp, Homo sapiens
ttattctaatattag

SEQ ID NO: 286453 - DNA, 15 bp, Homo sapiens
cttattctaatatta

SEQ ID NO: 286454 - DNA, 15 bp, Homo sapiens
acttattctaatatt

SEQ ID NO: 286455 - DNA, 15 bp, Homo sapiens
aacttattctaatat

SEQ ID NO: 286456 - DNA, 15 bp, Homo sapiens
aaacttattctaata

SEQ ID NO: 286457 - DNA, 15 bp, Homo sapiens
taaacttattctaat

SEQ ID NO: 286458 - DNA, 15 bp, Homo sapiens
gtaaacttattctaa

SEQ ID NO: 286459 - DNA, 15 bp, Homo sapiens
ggtaaacttattcta

SEQ ID NO: 286460 - DNA, 15 bp, Homo sapiens
aggtaaacttattct

SEQ ID NO: 286461 - DNA, 15 bp, Homo sapiens
gaggtaaacttattc

SEQ ID NO: 286462 - DNA, 15 bp, Homo sapiens
agaggtaaacttatt

SEQ ID NO: 286463 - DNA, 15 bp, Homo sapiens
tagaggtaaacttat

SEQ ID NO: 286464 - DNA, 15 bp, Homo sapiens
atagaggtaaactta

SEQ ID NO: 286465 - DNA, 15 bp, Homo sapiens
aatagaggtaaactt

SEQ ID NO: 286466 - DNA, 15 bp, Homo sapiens
aaatagaggtaaact

SEQ ID NO: 286467 - DNA, 15 bp, Homo sapiens
aaaatagaggtaaac

SEQ ID NO: 286468 - DNA, 15 bp, Homo sapiens
aaaaatagaggtaaa

SEQ ID NO: 286469 - DNA, 15 bp, Homo sapiens
taaaaatagaggtaa

SEQ ID NO: 286470 - DNA, 15 bp, Homo sapiens
ataaaaatagaggta

SEQ ID NO: 286471 - DNA, 15 bp, Homo sapiens
gataaaaatagaggt

SEQ ID NO: 286472 - DNA, 15 bp, Homo sapiens
cgataaaaatagagg

SEQ ID NO: 286473 - DNA, 15 bp, Homo sapiens
acgataaaaatagag

SEQ ID NO: 286474 - DNA, 15 bp, Homo sapiens
tacgataaaaataga

SEQ ID NO: 286475 - DNA, 15 bp, Homo sapiens
ttacgataaaaatag

SEQ ID NO: 286476 - DNA, 15 bp, Homo sapiens
gttacgataaaaata

SEQ ID NO: 286477 - DNA, 15 bp, Homo sapiens
tgttacgataaaaat

SEQ ID NO: 286478 - DNA, 15 bp, Homo sapiens
gtgttacgataaaaa

SEQ ID NO: 286479 - DNA, 15 bp, Homo sapiens
ggtgttacgataaaa

SEQ ID NO: 286480 - DNA, 15 bp, Homo sapiens
aggtgttacgataaa

SEQ ID NO: 286481 - DNA, 15 bp, Homo sapiens
caggtgttacgataa

SEQ ID NO: 286482 - DNA, 15 bp, Homo sapiens
tcaggtgttacgata

SEQ ID NO: 286483 - DNA, 15 bp, Homo sapiens
ctcaggtgttacgat

SEQ ID NO: 286484 - DNA, 15 bp, Homo sapiens
tctcaggtgttacga

SEQ ID NO: 286485 - DNA, 15 bp, Homo sapiens
atctcaggtgttacg

SEQ ID NO: 286486 - DNA, 15 bp, Homo sapiens
aatctcaggtgttac

SEQ ID NO: 286487 - DNA, 15 bp, Homo sapiens
taatctcaggtgtta

SEQ ID NO: 286488 - DNA, 15 bp, Homo sapiens
gtaatctcaggtgtt

SEQ ID NO: 286489 - DNA, 15 bp, Homo sapiens
ggtaatctcaggtgt

SEQ ID NO: 286490 - DNA, 15 bp, Homo sapiens
tggtaatctcaggtg

SEQ ID NO: 286491 - DNA, 15 bp, Homo sapiens
atggtaatctcaggt

SEQ ID NO: 286492 - DNA, 15 bp, Homo sapiens
gatggtaatctcagg

SEQ ID NO: 286493 - DNA, 15 bp, Homo sapiens
agatggtaatctcag

SEQ ID NO: 286494 - DNA, 15 bp, Homo sapiens
tagatggtaatctca

SEQ ID NO: 286495 - DNA, 15 bp, Homo sapiens
gtagatggtaatctc

SEQ ID NO: 286496 - DNA, 15 bp, Homo sapiens
agtagatggtaatct

SEQ ID NO: 286497 - DNA, 15 bp, Homo sapiens
aagtagatggtaatc

SEQ ID NO: 286498 - DNA, 15 bp, Homo sapiens
aaagtagatggtaat

SEQ ID NO: 286499 - DNA, 15 bp, Homo sapiens
taaagtagatggtaa

SEQ ID NO: 286500 - DNA, 15 bp, Homo sapiens
ctaaagtagatggta

SEQ ID NO: 286501 - DNA, 15 bp, Homo sapiens
actaaagtagatggt

SEQ ID NO: 286502 - DNA, 15 bp, Homo sapiens
aactaaagtagatgg

SEQ ID NO: 286503 - DNA, 15 bp, Homo sapiens
gaactaaagtagatg

SEQ ID NO: 286504 - DNA, 15 bp, Homo sapiens
ggaactaaagtagat

SEQ ID NO: 286505 - DNA, 15 bp, Homo sapiens
tggaactaaagtaga

SEQ ID NO: 286506 - DNA, 15 bp, Homo sapiens
atggaactaaagtag

SEQ ID NO: 286507 - DNA, 15 bp, Homo sapiens
aatggaactaaagta

SEQ ID NO: 286508 - DNA, 15 bp, Homo sapiens
aaatggaactaaagt

SEQ ID NO: 286509 - DNA, 15 bp, Homo sapiens
aaaatggaactaaag

SEQ ID NO: 286510 - DNA, 15 bp, Homo sapiens
caaaatggaactaaa

SEQ ID NO: 286511 - DNA, 15 bp, Homo sapiens
gcaaaatggaactaa

SEQ ID NO: 286512 - DNA, 15 bp, Homo sapiens
tgcaaaatggaacta

SEQ ID NO: 286513 - DNA, 15 bp, Homo sapiens
atgcaaaatggaact

SEQ ID NO: 286514 - DNA, 15 bp, Homo sapiens
aatgcaaaatggaac

SEQ ID NO: 286515 - DNA, 15 bp, Homo sapiens
taatgcaaaatggaa

SEQ ID NO: 286516 - DNA, 15 bp, Homo sapiens
ataatgcaaaatgga

SEQ ID NO: 286517 - DNA, 15 bp, Homo sapiens
gataatgcaaaatgg

SEQ ID NO: 286518 - DNA, 15 bp, Homo sapiens
ggataatgcaaaatg

SEQ ID NO: 286519 - DNA, 15 bp, Homo sapiens
aggataatgcaaaat

SEQ ID NO: 286520 - DNA, 15 bp, Homo sapiens
aaggataatgcaaaa

SEQ ID NO: 286521 - DNA, 15 bp, Homo sapiens
caaggataatgcaaa

SEQ ID NO: 286522 - DNA, 15 bp, Homo sapiens
gcaaggataatgcaa

SEQ ID NO: 286523 - DNA, 15 bp, Homo sapiens
agcaaggataatgca

SEQ ID NO: 286524 - DNA, 15 bp, Homo sapiens
gagcaaggataatgc

SEQ ID NO: 286525 - DNA, 15 bp, Homo sapiens
tgagcaaggataatg

SEQ ID NO: 286526 - DNA, 15 bp, Homo sapiens
atgagcaaggataat

SEQ ID NO: 286527 - DNA, 15 bp, Homo sapiens
aatgagcaaggataa

SEQ ID NO: 286528 - DNA, 15 bp, Homo sapiens
gaatgagcaaggata

SEQ ID NO: 286529 - DNA, 15 bp, Homo sapiens
agaatgagcaaggat

SEQ ID NO: 286530 - DNA, 15 bp, Homo sapiens
aagaatgagcaagga

SEQ ID NO: 286531 - DNA, 15 bp, Homo sapiens
aaagaatgagcaagg

SEQ ID NO: 286532 - DNA, 15 bp, Homo sapiens
gaaagaatgagcaag

SEQ ID NO: 286533 - DNA, 15 bp, Homo sapiens
agaaagaatgagcaa

SEQ ID NO: 286534 - DNA, 15 bp, Homo sapiens
aagaaagaatgagca

SEQ ID NO: 286535 - DNA, 15 bp, Homo sapiens
aaagaaagaatgagc

SEQ ID NO: 286536 - DNA, 15 bp, Homo sapiens
gaaagaaagaatgag

SEQ ID NO: 286537 - DNA, 15 bp, Homo sapiens
tgaaagaaagaatga

SEQ ID NO: 286538 - DNA, 15 bp, Homo sapiens
atgaaagaaagaatg

SEQ ID NO: 286539 - DNA, 15 bp, Homo sapiens
tatgaaagaaagaat

SEQ ID NO: 286540 - DNA, 15 bp, Homo sapiens
atatgaaagaaagaa

SEQ ID NO: 286541 - DNA, 15 bp, Homo sapiens
catatgaaagaaaga

SEQ ID NO: 286542 - DNA, 15 bp, Homo sapiens
gcatatgaaagaaag

SEQ ID NO: 286543 - DNA, 15 bp, Homo sapiens
agcatatgaaagaaa

SEQ ID NO: 286544 - DNA, 15 bp, Homo sapiens
tagcatatgaaagaa

SEQ ID NO: 286545 - DNA, 15 bp, Homo sapiens
atagcatatgaaaga

SEQ ID NO: 286546 - DNA, 15 bp, Homo sapiens
catagcatatgaaag

SEQ ID NO: 286547 - DNA, 15 bp, Homo sapiens
acatagcatatgaaa

SEQ ID NO: 286548 - DNA, 15 bp, Homo sapiens
cacatagcatatgaa

SEQ ID NO: 286549 - DNA, 15 bp, Homo sapiens
ccacatagcatatga

SEQ ID NO: 286550 - DNA, 15 bp, Homo sapiens
tccacatagcatatg

SEQ ID NO: 286551 - DNA, 15 bp, Homo sapiens
gtccacatagcatat

SEQ ID NO: 286552 - DNA, 15 bp, Homo sapiens
tgtccacatagcata

SEQ ID NO: 286553 - DNA, 15 bp, Homo sapiens
ttgtccacatagcat

SEQ ID NO: 286554 - DNA, 15 bp, Homo sapiens
tttgtccacatagca

SEQ ID NO: 286555 - DNA, 15 bp, Homo sapiens
ctttgtccacatagc

SEQ ID NO: 286556 - DNA, 15 bp, Homo sapiens
actttgtccacatag

SEQ ID NO: 286557 - DNA, 15 bp, Homo sapiens
cactttgtccacata

SEQ ID NO: 286558 - DNA, 15 bp, Homo sapiens
gcactttgtccacat

SEQ ID NO: 286559 - DNA, 15 bp, Homo sapiens
agcactttgtccaca

SEQ ID NO: 286560 - DNA, 15 bp, Homo sapiens
aagcactttgtccac

SEQ ID NO: 286561 - DNA, 15 bp, Homo sapiens
aaagcactttgtcca

SEQ ID NO: 286562 - DNA, 15 bp, Homo sapiens
caaagcactttgtcc

SEQ ID NO: 286563 - DNA, 15 bp, Homo sapiens
gcaaagcactttgtc

SEQ ID NO: 286564 - DNA, 15 bp, Homo sapiens
ggcaaagcactttgt

SEQ ID NO: 286565 - DNA, 15 bp, Homo sapiens
aggcaaagcactttg

SEQ ID NO: 286566 - DNA, 15 bp, Homo sapiens
caggcaaagcacttt

SEQ ID NO: 286567 - DNA, 15 bp, Homo sapiens
acaggcaaagcactt

SEQ ID NO: 286568 - DNA, 15 bp, Homo sapiens
tacaggcaaagcact

SEQ ID NO: 286569 - DNA, 15 bp, Homo sapiens
gtacaggcaaagcac

SEQ ID NO: 286570 - DNA, 15 bp, Homo sapiens
tgtacaggcaaagca

SEQ ID NO: 286571 - DNA, 15 bp, Homo sapiens
gtgtacaggcaaagc

SEQ ID NO: 286572 - DNA, 15 bp, Homo sapiens
agtgtacaggcaaag

SEQ ID NO: 286573 - DNA, 15 bp, Homo sapiens
aagtgtacaggcaaa

SEQ ID NO: 286574 - DNA, 15 bp, Homo sapiens
caagtgtacaggcaa

SEQ ID NO: 286575 - DNA, 15 bp, Homo sapiens
tcaagtgtacaggca

SEQ ID NO: 286576 - DNA, 15 bp, Homo sapiens
ttcaagtgtacaggc

SEQ ID NO: 286577 - DNA, 15 bp, Homo sapiens
attcaagtgtacagg

SEQ ID NO: 286578 - DNA, 15 bp, Homo sapiens
cattcaagtgtacag

SEQ ID NO: 286579 - DNA, 15 bp, Homo sapiens
tcattcaagtgtaca

SEQ ID NO: 286580 - DNA, 15 bp, Homo sapiens
gtcattcaagtgtac

SEQ ID NO: 286581 - DNA, 15 bp, Homo sapiens
ggtcattcaagtgta

SEQ ID NO: 286582 - DNA, 15 bp, Homo sapiens
aggtcattcaagtgt

SEQ ID NO: 286583 - DNA, 15 bp, Homo sapiens
caggtcattcaagtg

SEQ ID NO: 286584 - DNA, 15 bp, Homo sapiens
gcaggtcattcaagt

SEQ ID NO: 286585 - DNA, 15 bp, Homo sapiens
ggcaggtcattcaag

SEQ ID NO: 286586 - DNA, 15 bp, Homo sapiens
aggcaggtcattcaa

SEQ ID NO: 286587 - DNA, 15 bp, Homo sapiens
caggcaggtcattca

SEQ ID NO: 286588 - DNA, 15 bp, Homo sapiens
ccaggcaggtcattc

SEQ ID NO: 286589 - DNA, 15 bp, Homo sapiens
accaggcaggtcatt

SEQ ID NO: 286590 - DNA, 15 bp, Homo sapiens
gaccaggcaggtcat

SEQ ID NO: 286591 - DNA, 15 bp, Homo sapiens
tgaccaggcaggtca

SEQ ID NO: 286592 - DNA, 15 bp, Homo sapiens
atgaccaggcaggtc

SEQ ID NO: 286593 - DNA, 15 bp, Homo sapiens
tatgaccaggcaggt

SEQ ID NO: 286594 - DNA, 15 bp, Homo sapiens
atatgaccaggcagg

SEQ ID NO: 286595 - DNA, 15 bp, Homo sapiens
catatgaccaggcag

SEQ ID NO: 286596 - DNA, 15 bp, Homo sapiens
ccatatgaccaggca

SEQ ID NO: 286597 - DNA, 15 bp, Homo sapiens
tccatatgaccaggc

SEQ ID NO: 286598 - DNA, 15 bp, Homo sapiens
atccatatgaccagg

SEQ ID NO: 286599 - DNA, 15 bp, Homo sapiens
catccatatgaccag

SEQ ID NO: 286600 - DNA, 15 bp, Homo sapiens
ccatccatatgacca

SEQ ID NO: 286601 - DNA, 15 bp, Homo sapiens
tccatccatatgacc

SEQ ID NO: 286602 - DNA, 15 bp, Homo sapiens
atccatccatatgac

SEQ ID NO: 286603 - DNA, 15 bp, Homo sapiens
tatccatccatatga

SEQ ID NO: 286604 - DNA, 15 bp, Homo sapiens
ctatccatccatatg

SEQ ID NO: 286605 - DNA, 15 bp, Homo sapiens
cctatccatccatat

SEQ ID NO: 286606 - DNA, 15 bp, Homo sapiens
acctatccatccata

SEQ ID NO: 286607 - DNA, 15 bp, Homo sapiens
aacctatccatccat

SEQ ID NO: 286608 - DNA, 15 bp, Homo sapiens
taacctatccatcca

SEQ ID NO: 286609 - DNA, 15 bp, Homo sapiens
ctaacctatccatcc

SEQ ID NO: 286610 - DNA, 15 bp, Homo sapiens
cctaacctatccatc

SEQ ID NO: 286611 - DNA, 15 bp, Homo sapiens
tcctaacctatccat

SEQ ID NO: 286612 - DNA, 15 bp, Homo sapiens
gtcctaacctatcca

SEQ ID NO: 286613 - DNA, 15 bp, Homo sapiens
agtcctaacctatcc

SEQ ID NO: 286614 - DNA, 15 bp, Homo sapiens
cagtcctaacctatc

SEQ ID NO: 286615 - DNA, 15 bp, Homo sapiens
acagtcctaacctat

SEQ ID NO: 286616 - DNA, 15 bp, Homo sapiens
tacagtcctaaccta

SEQ ID NO: 286617 - DNA, 15 bp, Homo sapiens
ctacagtcctaacct

SEQ ID NO: 286618 - DNA, 15 bp, Homo sapiens
tctacagtcctaacc

SEQ ID NO: 286619 - DNA, 15 bp, Homo sapiens
atctacagtcctaac

SEQ ID NO: 286620 - DNA, 15 bp, Homo sapiens
tatctacagtcctaa

SEQ ID NO: 286621 - DNA, 15 bp, Homo sapiens
atatctacagtccta

SEQ ID NO: 286622 - DNA, 15 bp, Homo sapiens
aatatctacagtcct

SEQ ID NO: 286623 - DNA, 15 bp, Homo sapiens
caatatctacagtcc

SEQ ID NO: 286624 - DNA, 15 bp, Homo sapiens
gcaatatctacagtc

SEQ ID NO: 286625 - DNA, 15 bp, Homo sapiens
agcaatatctacagt

SEQ ID NO: 286626 - DNA, 15 bp, Homo sapiens
gagcaatatctacag

SEQ ID NO: 286627 - DNA, 15 bp, Homo sapiens
ggagcaatatctaca

SEQ ID NO: 286628 - DNA, 15 bp, Homo sapiens
tggagcaatatctac

SEQ ID NO: 286629 - DNA, 15 bp, Homo sapiens
atggagcaatatcta

SEQ ID NO: 286630 - DNA, 15 bp, Homo sapiens
aatggagcaatatct

SEQ ID NO: 286631 - DNA, 15 bp, Homo sapiens
caatggagcaatatc

SEQ ID NO: 286632 - DNA, 15 bp, Homo sapiens
acaatggagcaatat

SEQ ID NO: 286633 - DNA, 15 bp, Homo sapiens
gacaatggagcaata

SEQ ID NO: 286634 - DNA, 15 bp, Homo sapiens
agacaatggagcaat

SEQ ID NO: 286635 - DNA, 15 bp, Homo sapiens
aagacaatggagcaa

SEQ ID NO: 286636 - DNA, 15 bp, Homo sapiens
aaagacaatggagca

SEQ ID NO: 286637 - DNA, 15 bp, Homo sapiens
caaagacaatggagc

SEQ ID NO: 286638 - DNA, 15 bp, Homo sapiens
ccaaagacaatggag

SEQ ID NO: 286639 - DNA, 15 bp, Homo sapiens
tccaaagacaatgga

SEQ ID NO: 286640 - DNA, 15 bp, Homo sapiens
gtccaaagacaatgg

SEQ ID NO: 286641 - DNA, 15 bp, Homo sapiens
tgtccaaagacaatg

SEQ ID NO: 286642 - DNA, 15 bp, Homo sapiens
atgtccaaagacaat

SEQ ID NO: 286643 - DNA, 15 bp, Homo sapiens
aatgtccaaagacaa

SEQ ID NO: 286644 - DNA, 15 bp, Homo sapiens
aaatgtccaaagaca

SEQ ID NO: 286645 - DNA, 15 bp, Homo sapiens
taaatgtccaaagac

SEQ ID NO: 286646 - DNA, 15 bp, Homo sapiens
ttaaatgtccaaaga

SEQ ID NO: 286647 - DNA, 15 bp, Homo sapiens
attaaatgtccaaag

SEQ ID NO: 286648 - DNA, 15 bp, Homo sapiens
tattaaatgtccaaa

SEQ ID NO: 286649 - DNA, 15 bp, Homo sapiens
atattaaatgtccaa

SEQ ID NO: 286650 - DNA, 15 bp, Homo sapiens
aatattaaatgtcca

SEQ ID NO: 286651 - DNA, 15 bp, Homo sapiens
taatattaaatgtcc

SEQ ID NO: 286652 - DNA, 15 bp, Homo sapiens
ataatattaaatgtc

SEQ ID NO: 286653 - DNA, 15 bp, Homo sapiens
cataatattaaatgt

SEQ ID NO: 286654 - DNA, 15 bp, Homo sapiens
ccataatattaaatg

SEQ ID NO: 286655 - DNA, 15 bp, Homo sapiens
tccataatattaaat

SEQ ID NO: 286656 - DNA, 15 bp, Homo sapiens
ttccataatattaaa

SEQ ID NO: 286657 - DNA, 15 bp, Homo sapiens
tttccataatattaa

SEQ ID NO: 286658 - DNA, 15 bp, Homo sapiens
ttttccataatatta

SEQ ID NO: 286659 - DNA, 15 bp, Homo sapiens
attttccataatatt

SEQ ID NO: 286660 - DNA, 15 bp, Homo sapiens
tattttccataatat

SEQ ID NO: 286661 - DNA, 15 bp, Homo sapiens
ctattttccataata

SEQ ID NO: 286662 - DNA, 15 bp, Homo sapiens
cctattttccataat

SEQ ID NO: 286663 - DNA, 15 bp, Homo sapiens
tcctattttccataa

SEQ ID NO: 286664 - DNA, 15 bp, Homo sapiens
ttcctattttccata

SEQ ID NO: 286665 - DNA, 15 bp, Homo sapiens
cttcctattttccat

SEQ ID NO: 286666 - DNA, 15 bp, Homo sapiens
gcttcctattttcca

SEQ ID NO: 286667 - DNA, 15 bp, Homo sapiens
agcttcctattttcc

SEQ ID NO: 286668 - DNA, 15 bp, Homo sapiens
tagcttcctattttc

SEQ ID NO: 286669 - DNA, 15 bp, Homo sapiens
ttagcttcctatttt

SEQ ID NO: 286670 - DNA, 15 bp, Homo sapiens
tttagcttcctattt

SEQ ID NO: 286671 - DNA, 15 bp, Homo sapiens
gtttagcttcctatt

SEQ ID NO: 286672 - DNA, 15 bp, Homo sapiens
ggtttagcttcctat

SEQ ID NO: 286673 - DNA, 15 bp, Homo sapiens
aggtttagcttccta

SEQ ID NO: 286674 - DNA, 15 bp, Homo sapiens
aaggtttagcttcct

SEQ ID NO: 286675 - DNA, 15 bp, Homo sapiens
aaaggtttagcttcc

SEQ ID NO: 286676 - DNA, 15 bp, Homo sapiens
aaaaggtttagcttc

SEQ ID NO: 286677 - DNA, 15 bp, Homo sapiens
aaaaaggtttagctt

SEQ ID NO: 286678 - DNA, 15 bp, Homo sapiens
gaaaaaggtttagct

SEQ ID NO: 286679 - DNA, 15 bp, Homo sapiens
ggaaaaaggtttagc

SEQ ID NO: 286680 - DNA, 15 bp, Homo sapiens
tggaaaaaggtttag

SEQ ID NO: 286681 - DNA, 15 bp, Homo sapiens
gtggaaaaaggttta

SEQ ID NO: 286682 - DNA, 15 bp, Homo sapiens
ggtggaaaaaggttt

SEQ ID NO: 286683 - DNA, 15 bp, Homo sapiens
cggtggaaaaaggtt

SEQ ID NO: 286684 - DNA, 15 bp, Homo sapiens
gcggtggaaaaaggt

SEQ ID NO: 286685 - DNA, 15 bp, Homo sapiens
agcggtggaaaaagg

SEQ ID NO: 286686 - DNA, 15 bp, Homo sapiens
cagcggtggaaaaag

SEQ ID NO: 286687 - DNA, 15 bp, Homo sapiens
tcagcggtggaaaaa

SEQ ID NO: 286688 - DNA, 15 bp, Homo sapiens
ttcagcggtggaaaa

SEQ ID NO: 286689 - DNA, 15 bp, Homo sapiens
gttcagcggtggaaa

SEQ ID NO: 286690 - DNA, 15 bp, Homo sapiens
tgttcagcggtggaa

SEQ ID NO: 286691 - DNA, 15 bp, Homo sapiens
atgttcagcggtgga

SEQ ID NO: 286692 - DNA, 15 bp, Homo sapiens
catgttcagcggtgg

SEQ ID NO: 286693 - DNA, 15 bp, Homo sapiens
tcatgttcagcggtg

SEQ ID NO: 286694 - DNA, 15 bp, Homo sapiens
atcatgttcagcggt

SEQ ID NO: 286695 - DNA, 15 bp, Homo sapiens
aatcatgttcagcgg

SEQ ID NO: 286696 - DNA, 15 bp, Homo sapiens
aaatcatgttcagcg

SEQ ID NO: 286697 - DNA, 15 bp, Homo sapiens
taaatcatgttcagc

SEQ ID NO: 286698 - DNA, 15 bp, Homo sapiens
gtaaatcatgttcag

SEQ ID NO: 286699 - DNA, 15 bp, Homo sapiens
agtaaatcatgttca

SEQ ID NO: 286700 - DNA, 15 bp, Homo sapiens
cagtaaatcatgttc

SEQ ID NO: 286701 - DNA, 15 bp, Homo sapiens
acagtaaatcatgtt

SEQ ID NO: 286702 - DNA, 15 bp, Homo sapiens
aacagtaaatcatgt

SEQ ID NO: 286703 - DNA, 15 bp, Homo sapiens
aaacagtaaatcatg

SEQ ID NO: 286704 - DNA, 15 bp, Homo sapiens
aaaacagtaaatcat

SEQ ID NO: 286705 - DNA, 15 bp, Homo sapiens
taaaacagtaaatca

SEQ ID NO: 286706 - DNA, 15 bp, Homo sapiens
ataaaacagtaaatc

SEQ ID NO: 286707 - DNA, 15 bp, Homo sapiens
aataaaacagtaaat

SEQ ID NO: 286708 - DNA, 15 bp, Homo sapiens
aaataaaacagtaaa

SEQ ID NO: 286709 - DNA, 15 bp, Homo sapiens
aaaataaaacagtaa

SEQ ID NO: 286710 - DNA, 15 bp, Homo sapiens
caaaataaaacagta

SEQ ID NO: 286711 - DNA, 15 bp, Homo sapiens
tcaaaataaaacagt

SEQ ID NO: 286712 - DNA, 15 bp, Homo sapiens
atcaaaataaaacag

SEQ ID NO: 286713 - DNA, 15 bp, Homo sapiens
aatcaaaataaaaca

SEQ ID NO: 286714 - DNA, 15 bp, Homo sapiens
aaatcaaaataaaac

SEQ ID NO: 286715 - DNA, 15 bp, Homo sapiens
gaaatcaaaataaaa

SEQ ID NO: 286716 - DNA, 15 bp, Homo sapiens
agaaatcaaaataaa

SEQ ID NO: 286717 - DNA, 15 bp, Homo sapiens
cagaaatcaaaataa

SEQ ID NO: 286718 - DNA, 15 bp, Homo sapiens
ccagaaatcaaaata

SEQ ID NO: 286719 - DNA, 15 bp, Homo sapiens
gccagaaatcaaaat

SEQ ID NO: 286720 - DNA, 15 bp, Homo sapiens
tgccagaaatcaaaa

SEQ ID NO: 286721 - DNA, 15 bp, Homo sapiens
ctgccagaaatcaaa

SEQ ID NO: 286722 - DNA, 15 bp, Homo sapiens
tctgccagaaatcaa

SEQ ID NO: 286723 - DNA, 15 bp, Homo sapiens
atctgccagaaatca

SEQ ID NO: 286724 - DNA, 15 bp, Homo sapiens
aatctgccagaaatc

SEQ ID NO: 286725 - DNA, 15 bp, Homo sapiens
caatctgccagaaat

SEQ ID NO: 286726 - DNA, 15 bp, Homo sapiens
gcaatctgccagaaa

SEQ ID NO: 286727 - DNA, 15 bp, Homo sapiens
agcaatctgccagaa

SEQ ID NO: 286728 - DNA, 15 bp, Homo sapiens
aagcaatctgccaga

SEQ ID NO: 286729 - DNA, 15 bp, Homo sapiens
caagcaatctgccag

SEQ ID NO: 286730 - DNA, 15 bp, Homo sapiens
acaagcaatctgcca

SEQ ID NO: 286731 - DNA, 15 bp, Homo sapiens
cacaagcaatctgcc

SEQ ID NO: 286732 - DNA, 15 bp, Homo sapiens
tcacaagcaatctgc

SEQ ID NO: 286733 - DNA, 15 bp, Homo sapiens
atcacaagcaatctg

SEQ ID NO: 286734 - DNA, 15 bp, Homo sapiens
tatcacaagcaatct

SEQ ID NO: 286735 - DNA, 15 bp, Homo sapiens
gtatcacaagcaatc

SEQ ID NO: 286736 - DNA, 15 bp, Homo sapiens
agtatcacaagcaat

SEQ ID NO: 286737 - DNA, 15 bp, Homo sapiens
aagtatcacaagcaa

SEQ ID NO: 286738 - DNA, 15 bp, Homo sapiens
aaagtatcacaagca

SEQ ID NO: 286739 - DNA, 15 bp, Homo sapiens
taaagtatcacaagc

SEQ ID NO: 286740 - DNA, 15 bp, Homo sapiens
ataaagtatcacaag

SEQ ID NO: 286741 - DNA, 15 bp, Homo sapiens
gataaagtatcacaa

SEQ ID NO: 286742 - DNA, 15 bp, Homo sapiens
agataaagtatcaca

SEQ ID NO: 286743 - DNA, 15 bp, Homo sapiens
aagataaagtatcac

SEQ ID NO: 286744 - DNA, 15 bp, Homo sapiens
aaagataaagtatca

SEQ ID NO: 286745 - DNA, 15 bp, Homo sapiens
taaagataaagtatc

SEQ ID NO: 286746 - DNA, 15 bp, Homo sapiens
ttaaagataaagtat

SEQ ID NO: 286747 - DNA, 15 bp, Homo sapiens
tttaaagataaagta

SEQ ID NO: 286748 - DNA, 15 bp, Homo sapiens
ttttaaagataaagt

SEQ ID NO: 286749 - DNA, 15 bp, Homo sapiens
attttaaagataaag

SEQ ID NO: 286750 - DNA, 15 bp, Homo sapiens
tattttaaagataaa

SEQ ID NO: 286751 - DNA, 15 bp, Homo sapiens
gtattttaaagataa

SEQ ID NO: 286752 - DNA, 15 bp, Homo sapiens
tgtattttaaagata

SEQ ID NO: 286753 - DNA, 15 bp, Homo sapiens
ctgtattttaaagat

SEQ ID NO: 286754 - DNA, 15 bp, Homo sapiens
tctgtattttaaaga

SEQ ID NO: 286755 - DNA, 15 bp, Homo sapiens
gtctgtattttaaag

SEQ ID NO: 286756 - DNA, 15 bp, Homo sapiens
tgtctgtattttaaa

SEQ ID NO: 286757 - DNA, 15 bp, Homo sapiens
atgtctgtattttaa

SEQ ID NO: 286758 - DNA, 15 bp, Homo sapiens
aatgtctgtatttta

SEQ ID NO: 286759 - DNA, 15 bp, Homo sapiens
aaatgtctgtatttt

SEQ ID NO: 286760 - DNA, 15 bp, Homo sapiens
aaaatgtctgtattt

SEQ ID NO: 286761 - DNA, 15 bp, Homo sapiens
gaaaatgtctgtatt

SEQ ID NO: 286762 - DNA, 15 bp, Homo sapiens
ggaaaatgtctgtat

SEQ ID NO: 286763 - DNA, 15 bp, Homo sapiens
tggaaaatgtctgta

SEQ ID NO: 286764 - DNA, 15 bp, Homo sapiens
ctggaaaatgtctgt

SEQ ID NO: 286765 - DNA, 15 bp, Homo sapiens
cctggaaaatgtctg

SEQ ID NO: 286766 - DNA, 15 bp, Homo sapiens
ccctggaaaatgtct

SEQ ID NO: 286767 - DNA, 15 bp, Homo sapiens
tccctggaaaatgtc

SEQ ID NO: 286768 - DNA, 15 bp, Homo sapiens
atccctggaaaatgt

SEQ ID NO: 286769 - DNA, 15 bp, Homo sapiens
tatccctggaaaatg

SEQ ID NO: 286770 - DNA, 15 bp, Homo sapiens
gtatccctggaaaat

SEQ ID NO: 286771 - DNA, 15 bp, Homo sapiens
tgtatccctggaaaa

SEQ ID NO: 286772 - DNA, 15 bp, Homo sapiens
atgtatccctggaaa

SEQ ID NO: 286773 - DNA, 15 bp, Homo sapiens
tatgtatccctggaa

SEQ ID NO: 286774 - DNA, 15 bp, Homo sapiens
atatgtatccctgga

SEQ ID NO: 286775 - DNA, 15 bp, Homo sapiens
catatgtatccctgg

SEQ ID NO: 286776 - DNA, 15 bp, Homo sapiens
tcatatgtatccctg

SEQ ID NO: 286777 - DNA, 15 bp, Homo sapiens
ttcatatgtatccct

SEQ ID NO: 286778 - DNA, 15 bp, Homo sapiens
attcatatgtatccc

SEQ ID NO: 286779 - DNA, 15 bp, Homo sapiens
cattcatatgtatcc

SEQ ID NO: 286780 - DNA, 15 bp, Homo sapiens
acattcatatgtatc

SEQ ID NO: 286781 - DNA, 15 bp, Homo sapiens
cacattcatatgtat

SEQ ID NO: 286782 - DNA, 15 bp, Homo sapiens
gcacattcatatgta

SEQ ID NO: 286783 - DNA, 15 bp, Homo sapiens
agcacattcatatgt

SEQ ID NO: 286784 - DNA, 15 bp, Homo sapiens
aagcacattcatatg

SEQ ID NO: 286785 - DNA, 15 bp, Homo sapiens
gaagcacattcatat

SEQ ID NO: 286786 - DNA, 15 bp, Homo sapiens
agaagcacattcata

SEQ ID NO: 286787 - DNA, 15 bp, Homo sapiens
aagaagcacattcat

SEQ ID NO: 286788 - DNA, 15 bp, Homo sapiens
aaagaagcacattca

SEQ ID NO: 286789 - DNA, 15 bp, Homo sapiens
aaaagaagcacattc

SEQ ID NO: 286790 - DNA, 15 bp, Homo sapiens
caaaagaagcacatt

SEQ ID NO: 286791 - DNA, 15 bp, Homo sapiens
acaaaagaagcacat

SEQ ID NO: 286792 - DNA, 15 bp, Homo sapiens
aacaaaagaagcaca

SEQ ID NO: 286793 - DNA, 15 bp, Homo sapiens
taacaaaagaagcac

SEQ ID NO: 286794 - DNA, 15 bp, Homo sapiens
ataacaaaagaagca

SEQ ID NO: 286795 - DNA, 15 bp, Homo sapiens
aataacaaaagaagc

SEQ ID NO: 286796 - DNA, 15 bp, Homo sapiens
taataacaaaagaag

SEQ ID NO: 286797 - DNA, 15 bp, Homo sapiens
ataataacaaaagaa

SEQ ID NO: 286798 - DNA, 15 bp, Homo sapiens
aataataacaaaaga

SEQ ID NO: 286799 - DNA, 15 bp, Homo sapiens
aaataataataacaa

SEQ ID NO: 286800 - DNA, 15 bp, Homo sapiens
aaaataataataaca

SEQ ID NO: 286801 - DNA, 15 bp, Homo sapiens
aaaaataataataac

SEQ ID NO: 286802 - DNA, 15 bp, Homo sapiens
caaaaataataataa

SEQ ID NO: 286803 - DNA, 15 bp, Homo sapiens
ccaaaaataataata

SEQ ID NO: 286804 - DNA, 15 bp, Homo sapiens
cccaaaaataataat

SEQ ID NO: 286805 - DNA, 15 bp, Homo sapiens
acccaaaaataataa

SEQ ID NO: 286806 - DNA, 15 bp, Homo sapiens
tacccaaaaataata

SEQ ID NO: 286807 - DNA, 15 bp, Homo sapiens
gtacccaaaaataat

SEQ ID NO: 286808 - DNA, 15 bp, Homo sapiens
agtacccaaaaataa

SEQ ID NO: 286809 - DNA, 15 bp, Homo sapiens
gagtacccaaaaata

SEQ ID NO: 286810 - DNA, 15 bp, Homo sapiens
agagtacccaaaaat

SEQ ID NO: 286811 - DNA, 15 bp, Homo sapiens
cagagtacccaaaaa

SEQ ID NO: 286812 - DNA, 15 bp, Homo sapiens
acagagtacccaaaa

SEQ ID NO: 286813 - DNA, 15 bp, Homo sapiens
gacagagtacccaaa

SEQ ID NO: 286814 - DNA, 15 bp, Homo sapiens
agacagagtacccaa

SEQ ID NO: 286815 - DNA, 15 bp, Homo sapiens
aagacagagtaccca

SEQ ID NO: 286816 - DNA, 15 bp, Homo sapiens
aaagacagagtaccc

SEQ ID NO: 286817 - DNA, 15 bp, Homo sapiens
taaagacagagtacc

SEQ ID NO: 286818 - DNA, 15 bp, Homo sapiens
ataaagacagagtac

SEQ ID NO: 286819 - DNA, 15 bp, Homo sapiens
tataaagacagagta

SEQ ID NO: 286820 - DNA, 15 bp, Homo sapiens
ctataaagacagagt

SEQ ID NO: 286821 - DNA, 15 bp, Homo sapiens
actataaagacagag

SEQ ID NO: 286822 - DNA, 15 bp, Homo sapiens
aactataaagacaga

SEQ ID NO: 286823 - DNA, 15 bp, Homo sapiens
aaactataaagacag

SEQ ID NO: 286824 - DNA, 15 bp, Homo sapiens
gaaactataaagaca

SEQ ID NO: 286825 - DNA, 15 bp, Homo sapiens
agaaactataaagac

SEQ ID NO: 286826 - DNA, 15 bp, Homo sapiens
tagaaactataaaga

SEQ ID NO: 286827 - DNA, 15 bp, Homo sapiens
atagaaactataaag

SEQ ID NO: 286828 - DNA, 15 bp, Homo sapiens
tatagaaactataaa

SEQ ID NO: 286829 - DNA, 15 bp, Homo sapiens
gtatagaaactataa

SEQ ID NO: 286830 - DNA, 15 bp, Homo sapiens
agtatagaaactata

SEQ ID NO: 286831 - DNA, 15 bp, Homo sapiens
gagtatagaaactat

SEQ ID NO: 286832 - DNA, 15 bp, Homo sapiens
tgagtatagaaacta

SEQ ID NO: 286833 - DNA, 15 bp, Homo sapiens
ctgagtatagaaact

SEQ ID NO: 286834 - DNA, 15 bp, Homo sapiens
tctgagtatagaaac

SEQ ID NO: 286835 - DNA, 15 bp, Homo sapiens
atctgagtatagaaa

SEQ ID NO: 286836 - DNA, 15 bp, Homo sapiens
gatctgagtatagaa

SEQ ID NO: 286837 - DNA, 15 bp, Homo sapiens
agatctgagtataga

SEQ ID NO: 286838 - DNA, 15 bp, Homo sapiens
aagatctgagtatag

SEQ ID NO: 286839 - DNA, 15 bp, Homo sapiens
aaagatctgagtata

SEQ ID NO: 286840 - DNA, 15 bp, Homo sapiens
aaaagatctgagtat

SEQ ID NO: 286841 - DNA, 15 bp, Homo sapiens
aaaaagatctgagta

SEQ ID NO: 286842 - DNA, 15 bp, Homo sapiens
gaaaaagatctgagt

SEQ ID NO: 286843 - DNA, 15 bp, Homo sapiens
tgaaaaagatctgag

SEQ ID NO: 286844 - DNA, 15 bp, Homo sapiens
atgaaaaagatctga

SEQ ID NO: 286845 - DNA, 15 bp, Homo sapiens
gatgaaaaagatctg

SEQ ID NO: 286846 - DNA, 15 bp, Homo sapiens
ggatgaaaaagatct

SEQ ID NO: 286847 - DNA, 15 bp, Homo sapiens
aggatgaaaaagatc

SEQ ID NO: 286848 - DNA, 15 bp, Homo sapiens
caggatgaaaaagat

SEQ ID NO: 286849 - DNA, 15 bp, Homo sapiens
tcaggatgaaaaaga

SEQ ID NO: 286850 - DNA, 15 bp, Homo sapiens
ctcaggatgaaaaag

SEQ ID NO: 286851 - DNA, 15 bp, Homo sapiens
tctcaggatgaaaaa

SEQ ID NO: 286852 - DNA, 15 bp, Homo sapiens
ttctcaggatgaaaa

SEQ ID NO: 286853 - DNA, 15 bp, Homo sapiens
tttctcaggatgaaa

SEQ ID NO: 286854 - DNA, 15 bp, Homo sapiens
atttctcaggatgaa

SEQ ID NO: 286855 - DNA, 15 bp, Homo sapiens
catttctcaggatga

SEQ ID NO: 286856 - DNA, 15 bp, Homo sapiens
tcatttctcaggatg

SEQ ID NO: 286857 - DNA, 15 bp, Homo sapiens
ctcatttctcaggat

SEQ ID NO: 286858 - DNA, 15 bp, Homo sapiens
tctcatttctcagga

SEQ ID NO: 286859 - DNA, 15 bp, Homo sapiens
ttctcatttctcagg

SEQ ID NO: 286860 - DNA, 15 bp, Homo sapiens
tttctcatttctcag

SEQ ID NO: 286861 - DNA, 15 bp, Homo sapiens
atttctcatttctca

SEQ ID NO: 286862 - DNA, 15 bp, Homo sapiens
tatttctcatttctc

SEQ ID NO: 286863 - DNA, 15 bp, Homo sapiens
atatttctcatttct

SEQ ID NO: 286864 - DNA, 15 bp, Homo sapiens
aatatttctcatttc

SEQ ID NO: 286865 - DNA, 15 bp, Homo sapiens
aaatatttctcattt

SEQ ID NO: 286866 - DNA, 15 bp, Homo sapiens
taaatatttctcatt

SEQ ID NO: 286867 - DNA, 15 bp, Homo sapiens
gtaaatatttctcat

SEQ ID NO: 286868 - DNA, 15 bp, Homo sapiens
tgtaaatatttctca

SEQ ID NO: 286869 - DNA, 15 bp, Homo sapiens
ctgtaaatatttctc

SEQ ID NO: 286870 - DNA, 15 bp, Homo sapiens
cctgtaaatatttct

SEQ ID NO: 286871 - DNA, 15 bp, Homo sapiens
tcctgtaaatatttc

SEQ ID NO: 286872 - DNA, 15 bp, Homo sapiens
atcctgtaaatattt

SEQ ID NO: 286873 - DNA, 15 bp, Homo sapiens
catcctgtaaatatt

SEQ ID NO: 286874 - DNA, 15 bp, Homo sapiens
acatcctgtaaatat

SEQ ID NO: 286875 - DNA, 15 bp, Homo sapiens
aacatcctgtaaata

SEQ ID NO: 286876 - DNA, 15 bp, Homo sapiens
gaacatcctgtaaat

SEQ ID NO: 286877 - DNA, 15 bp, Homo sapiens
agaacatcctgtaaa

SEQ ID NO: 286878 - DNA, 15 bp, Homo sapiens
tagaacatcctgtaa

SEQ ID NO: 286879 - DNA, 15 bp, Homo sapiens
gtagaacatcctgta

SEQ ID NO: 286880 - DNA, 15 bp, Homo sapiens
agtagaacatcctgt

SEQ ID NO: 286881 - DNA, 15 bp, Homo sapiens
cagtagaacatcctg

SEQ ID NO: 286882 - DNA, 15 bp, Homo sapiens
tcagtagaacatcct

SEQ ID NO: 286883 - DNA, 15 bp, Homo sapiens
ttcagtagaacatcc

SEQ ID NO: 286884 - DNA, 15 bp, Homo sapiens
gttcagtagaacatc

SEQ ID NO: 286885 - DNA, 15 bp, Homo sapiens
agttcagtagaacat

SEQ ID NO: 286886 - DNA, 15 bp, Homo sapiens
gagttcagtagaaca

SEQ ID NO: 286887 - DNA, 15 bp, Homo sapiens
agagttcagtagaac

SEQ ID NO: 286888 - DNA, 15 bp, Homo sapiens
aagagttcagtagaa

SEQ ID NO: 286889 - DNA, 15 bp, Homo sapiens
taagagttcagtaga

SEQ ID NO: 286890 - DNA, 15 bp, Homo sapiens
ataagagttcagtag

SEQ ID NO: 286891 - DNA, 15 bp, Homo sapiens
aataagagttcagta

SEQ ID NO: 286892 - DNA, 15 bp, Homo sapiens
aaataagagttcagt

SEQ ID NO: 286893 - DNA, 15 bp, Homo sapiens
aaaataagagttcag

SEQ ID NO: 286894 - DNA, 15 bp, Homo sapiens
caaaataagagttca

SEQ ID NO: 286895 - DNA, 15 bp, Homo sapiens
gcaaaataagagttc

SEQ ID NO: 286896 - DNA, 15 bp, Homo sapiens
agcaaaataagagtt

SEQ ID NO: 286897 - DNA, 15 bp, Homo sapiens
cagcaaaataagagt

SEQ ID NO: 286898 - DNA, 15 bp, Homo sapiens
acagcaaaataagag

SEQ ID NO: 286899 - DNA, 15 bp, Homo sapiens
aacagcaaaataaga

SEQ ID NO: 286900 - DNA, 15 bp, Homo sapiens
aaacagcaaaataag

SEQ ID NO: 286901 - DNA, 15 bp, Homo sapiens
aaaacagcaaaataa

SEQ ID NO: 286902 - DNA, 15 bp, Homo sapiens
taaaacagcaaaata

SEQ ID NO: 286903 - DNA, 15 bp, Homo sapiens
ataaaacagcaaaat

SEQ ID NO: 286904 - DNA, 15 bp, Homo sapiens
aataaaacagcaaaa

SEQ ID NO: 286905 - DNA, 15 bp, Homo sapiens
aaataaaacagcaaa

SEQ ID NO: 286906 - DNA, 15 bp, Homo sapiens
aaaataaaacagcaa

SEQ ID NO: 286907 - DNA, 15 bp, Homo sapiens
taaaataaaacagca

SEQ ID NO: 286908 - DNA, 15 bp, Homo sapiens
ataaaataaaacagc

SEQ ID NO: 286909 - DNA, 15 bp, Homo sapiens
tataaaataaaacag

SEQ ID NO: 286910 - DNA, 15 bp, Homo sapiens
atataaaataaaaca

SEQ ID NO: 286911 - DNA, 15 bp, Homo sapiens
gatataaaataaaac

SEQ ID NO: 286912 - DNA, 15 bp, Homo sapiens
agatataaaataaaa

SEQ ID NO: 286913 - DNA, 15 bp, Homo sapiens
tagatataaaataaa

SEQ ID NO: 286914 - DNA, 15 bp, Homo sapiens
atagatataaaataa

SEQ ID NO: 286915 - DNA, 15 bp, Homo sapiens
gatagatataaaata

SEQ ID NO: 286916 - DNA, 15 bp, Homo sapiens
agatagatataaaat

SEQ ID NO: 286917 - DNA, 15 bp, Homo sapiens
tagatagatataaaa

SEQ ID NO: 286918 - DNA, 15 bp, Homo sapiens
gtagatagatataaa

SEQ ID NO: 286919 - DNA, 15 bp, Homo sapiens
agtagatagatataa

SEQ ID NO: 286920 - DNA, 15 bp, Homo sapiens
tagtagatagatata

SEQ ID NO: 286921 - DNA, 15 bp, Homo sapiens
atagtagatagatat

SEQ ID NO: 286922 - DNA, 15 bp, Homo sapiens
tatagtagatagata

SEQ ID NO: 286923 - DNA, 15 bp, Homo sapiens
atatagtagatagat

SEQ ID NO: 286924 - DNA, 15 bp, Homo sapiens
gatatagtagataga

SEQ ID NO: 286925 - DNA, 15 bp, Homo sapiens
agatatagtagatag

SEQ ID NO: 286926 - DNA, 15 bp, Homo sapiens
aagatatagtagata

SEQ ID NO: 286927 - DNA, 15 bp, Homo sapiens
aaagatatagtagat

SEQ ID NO: 286928 - DNA, 15 bp, Homo sapiens
taaagatatagtaga

SEQ ID NO: 286929 - DNA, 15 bp, Homo sapiens
gtaaagatatagtag

SEQ ID NO: 286930 - DNA, 15 bp, Homo sapiens
cgtaaagatatagta

SEQ ID NO: 286931 - DNA, 15 bp, Homo sapiens
gcgtaaagatatagt

SEQ ID NO: 286932 - DNA, 15 bp, Homo sapiens
agcgtaaagatatag

SEQ ID NO: 286933 - DNA, 15 bp, Homo sapiens
aagcgtaaagatata

SEQ ID NO: 286934 - DNA, 15 bp, Homo sapiens
aaagcgtaaagatat

SEQ ID NO: 286935 - DNA, 15 bp, Homo sapiens
caaagcgtaaagata

SEQ ID NO: 286936 - DNA, 15 bp, Homo sapiens
acaaagcgtaaagat

SEQ ID NO: 286937 - DNA, 15 bp, Homo sapiens
gacaaagcgtaaaga

SEQ ID NO: 286938 - DNA, 15 bp, Homo sapiens
ggacaaagcgtaaag

SEQ ID NO: 286939 - DNA, 15 bp, Homo sapiens
tggacaaagcgtaaa

SEQ ID NO: 286940 - DNA, 15 bp, Homo sapiens
atggacaaagcgtaa

SEQ ID NO: 286941 - DNA, 15 bp, Homo sapiens
aatggacaaagcgta

SEQ ID NO: 286942 - DNA, 15 bp, Homo sapiens
aaatggacaaagcgt

SEQ ID NO: 286943 - DNA, 15 bp, Homo sapiens
caaatggacaaagcg

SEQ ID NO: 286944 - DNA, 15 bp, Homo sapiens
acaaatggacaaagc

SEQ ID NO: 286945 - DNA, 15 bp, Homo sapiens
gacaaatggacaaag

SEQ ID NO: 286946 - DNA, 15 bp, Homo sapiens
ggacaaatggacaaa

SEQ ID NO: 286947 - DNA, 15 bp, Homo sapiens
aggacaaatggacaa

SEQ ID NO: 286948 - DNA, 15 bp, Homo sapiens
taggacaaatggaca

SEQ ID NO: 286949 - DNA, 15 bp, Homo sapiens
ataggacaaatggac

SEQ ID NO: 286950 - DNA, 15 bp, Homo sapiens
gataggacaaatgga

SEQ ID NO: 286951 - DNA, 15 bp, Homo sapiens
ggataggacaaatgg

SEQ ID NO: 286952 - DNA, 15 bp, Homo sapiens
tggataggacaaatg

SEQ ID NO: 286953 - DNA, 15 bp, Homo sapiens
atggataggacaaat

SEQ ID NO: 286954 - DNA, 15 bp, Homo sapiens
tatggataggacaaa

SEQ ID NO: 286955 - DNA, 15 bp, Homo sapiens
atatggataggacaa

SEQ ID NO: 286956 - DNA, 15 bp, Homo sapiens
catatggataggaca

SEQ ID NO: 286957 - DNA, 15 bp, Homo sapiens
acatatggataggac

SEQ ID NO: 286958 - DNA, 15 bp, Homo sapiens
aacatatggatagga

SEQ ID NO: 286959 - DNA, 15 bp, Homo sapiens
taacatatggatagg

SEQ ID NO: 286960 - DNA, 15 bp, Homo sapiens
ctaacatatggatag

SEQ ID NO: 286961 - DNA, 15 bp, Homo sapiens
tctaacatatggata

SEQ ID NO: 286962 - DNA, 15 bp, Homo sapiens
ctctaacatatggat

SEQ ID NO: 286963 - DNA, 15 bp, Homo sapiens
gctctaacatatgga

SEQ ID NO: 286964 - DNA, 15 bp, Homo sapiens
agctctaacatatgg

SEQ ID NO: 286965 - DNA, 15 bp, Homo sapiens
cagctctaacatatg

SEQ ID NO: 286966 - DNA, 15 bp, Homo sapiens
gcagctctaacatat

SEQ ID NO: 286967 - DNA, 15 bp, Homo sapiens
agcagctctaacata

SEQ ID NO: 286968 - DNA, 15 bp, Homo sapiens
gagcagctctaacat

SEQ ID NO: 286969 - DNA, 15 bp, Homo sapiens
agagcagctctaaca

SEQ ID NO: 286970 - DNA, 15 bp, Homo sapiens
aagagcagctctaac

SEQ ID NO: 286971 - DNA, 15 bp, Homo sapiens
aaagagcagctctaa

SEQ ID NO: 286972 - DNA, 15 bp, Homo sapiens
aaaagagcagctcta

SEQ ID NO: 286973 - DNA, 15 bp, Homo sapiens
caaaagagcagctct

SEQ ID NO: 286974 - DNA, 15 bp, Homo sapiens
acaaaagagcagctc

SEQ ID NO: 286975 - DNA, 15 bp, Homo sapiens
gacaaaagagcagct

SEQ ID NO: 286976 - DNA, 15 bp, Homo sapiens
tgacaaaagagcagc

SEQ ID NO: 286977 - DNA, 15 bp, Homo sapiens
atgacaaaagagcag

SEQ ID NO: 286978 - DNA, 15 bp, Homo sapiens
catgacaaaagagca

SEQ ID NO: 286979 - DNA, 15 bp, Homo sapiens
acatgacaaaagagc

SEQ ID NO: 286980 - DNA, 15 bp, Homo sapiens
aacatgacaaaagag

SEQ ID NO: 286981 - DNA, 15 bp, Homo sapiens
aaacatgacaaaaga

SEQ ID NO: 286982 - DNA, 15 bp, Homo sapiens
aaaacatgacaaaag

SEQ ID NO: 286983 - DNA, 15 bp, Homo sapiens
taaaacatgacaaaa

SEQ ID NO: 286984 - DNA, 15 bp, Homo sapiens
ataaaacatgacaaa

SEQ ID NO: 286985 - DNA, 15 bp, Homo sapiens
gataaaacatgacaa

SEQ ID NO: 286986 - DNA, 15 bp, Homo sapiens
tgataaaacatgaca

SEQ ID NO: 286987 - DNA, 15 bp, Homo sapiens
gtgataaaacatgac

SEQ ID NO: 286988 - DNA, 15 bp, Homo sapiens
ggtgataaaacatga

SEQ ID NO: 286989 - DNA, 15 bp, Homo sapiens
aggtgataaaacatg

SEQ ID NO: 286990 - DNA, 15 bp, Homo sapiens
gaggtgataaaacat

SEQ ID NO: 286991 - DNA, 15 bp, Homo sapiens
agaggtgataaaaca

SEQ ID NO: 286992 - DNA, 15 bp, Homo sapiens
gagaggtgataaaac

SEQ ID NO: 286993 - DNA, 15 bp, Homo sapiens
agagaggtgataaaa

SEQ ID NO: 286994 - DNA, 15 bp, Homo sapiens
gagagaggtgataaa

SEQ ID NO: 286995 - DNA, 15 bp, Homo sapiens
agagagaggtgataa

SEQ ID NO: 286996 - DNA, 15 bp, Homo sapiens
aagagagaggtgata

SEQ ID NO: 286997 - DNA, 15 bp, Homo sapiens
gaagagagaggtgat

SEQ ID NO: 286998 - DNA, 15 bp, Homo sapiens
tgaagagagaggtga

SEQ ID NO: 286999 - DNA, 15 bp, Homo sapiens
gtgaagagagaggtg

SEQ ID NO: 287000 - DNA, 15 bp, Homo sapiens
tgtgaagagagaggt

SEQ ID NO: 287001 - DNA, 15 bp, Homo sapiens
atgtgaagagagagg

SEQ ID NO: 287002 - DNA, 15 bp, Homo sapiens
catgtgaagagagag

SEQ ID NO: 287003 - DNA, 15 bp, Homo sapiens
tcatgtgaagagaga

SEQ ID NO: 287004 - DNA, 15 bp, Homo sapiens
ttcatgtgaagagag

SEQ ID NO: 287005 - DNA, 15 bp, Homo sapiens
gttcatgtgaagaga

SEQ ID NO: 287006 - DNA, 15 bp, Homo sapiens
agttcatgtgaagag

SEQ ID NO: 287007 - DNA, 15 bp, Homo sapiens
aagttcatgtgaaga

SEQ ID NO: 287008 - DNA, 15 bp, Homo sapiens
caagttcatgtgaag

SEQ ID NO: 287009 - DNA, 15 bp, Homo sapiens
ccaagttcatgtgaa

SEQ ID NO: 287010 - DNA, 15 bp, Homo sapiens
accaagttcatgtga

SEQ ID NO: 287011 - DNA, 15 bp, Homo sapiens
caccaagttcatgtg

SEQ ID NO: 287012 - DNA, 15 bp, Homo sapiens
tcaccaagttcatgt

SEQ ID NO: 287013 - DNA, 15 bp, Homo sapiens
ctcaccaagttcatg

SEQ ID NO: 287014 - DNA, 15 bp, Homo sapiens
cctcaccaagttcat

SEQ ID NO: 287015 - DNA, 15 bp, Homo sapiens
acctcaccaagttca

SEQ ID NO: 287016 - DNA, 15 bp, Homo sapiens
cacctcaccaagttc

SEQ ID NO: 287017 - DNA, 15 bp, Homo sapiens
gcacctcaccaagtt

SEQ ID NO: 287018 - DNA, 15 bp, Homo sapiens
ggcacctcaccaagt

SEQ ID NO: 287019 - DNA, 15 bp, Homo sapiens
aggcacctcaccaag

SEQ ID NO: 287020 - DNA, 15 bp, Homo sapiens
gaggcacctcaccaa

SEQ ID NO: 287021 - DNA, 15 bp, Homo sapiens
ggaggcacctcacca

SEQ ID NO: 287022 - DNA, 15 bp, Homo sapiens
tggaggcacctcacc

SEQ ID NO: 287023 - DNA, 15 bp, Homo sapiens
ctggaggcacctcac

SEQ ID NO: 287024 - DNA, 15 bp, Homo sapiens
cctggaggcacctca

SEQ ID NO: 287025 - DNA, 15 bp, Homo sapiens
gcctggaggcacctc

SEQ ID NO: 287026 - DNA, 15 bp, Homo sapiens
tgcctggaggcacct

SEQ ID NO: 287027 - DNA, 15 bp, Homo sapiens
atgcctggaggcacc

SEQ ID NO: 287028 - DNA, 15 bp, Homo sapiens
gatgcctggaggcac

SEQ ID NO: 287029 - DNA, 15 bp, Homo sapiens
cgatgcctggaggca

SEQ ID NO: 287030 - DNA, 15 bp, Homo sapiens
gcgatgcctggaggc

SEQ ID NO: 287031 - DNA, 15 bp, Homo sapiens
agcgatgcctggagg

SEQ ID NO: 287032 - DNA, 15 bp, Homo sapiens
cagcgatgcctggag

SEQ ID NO: 287033 - DNA, 15 bp, Homo sapiens
tcagcgatgcctgga

SEQ ID NO: 287034 - DNA, 15 bp, Homo sapiens
gtcagcgatgcctgg

SEQ ID NO: 287035 - DNA, 15 bp, Homo sapiens
agtcagcgatgcctg

SEQ ID NO: 287036 - DNA, 15 bp, Homo sapiens
aagtcagcgatgcct

SEQ ID NO: 287037 - DNA, 15 bp, Homo sapiens
aaagtcagcgatgcc

SEQ ID NO: 287038 - DNA, 15 bp, Homo sapiens
caaagtcagcgatgc

SEQ ID NO: 287039 - DNA, 15 bp, Homo sapiens
gcaaagtcagcgatg

SEQ ID NO: 287040 - DNA, 15 bp, Homo sapiens
tgcaaagtcagcgat

SEQ ID NO: 287041 - DNA, 15 bp, Homo sapiens
atgcaaagtcagcga

SEQ ID NO: 287042 - DNA, 15 bp, Homo sapiens
aatgcaaagtcagcg

SEQ ID NO: 287043 - DNA, 15 bp, Homo sapiens
caatgcaaagtcagc

SEQ ID NO: 287044 - DNA, 15 bp, Homo sapiens
acaatgcaaagtcag

SEQ ID NO: 287045 - DNA, 15 bp, Homo sapiens
cacaatgcaaagtca

SEQ ID NO: 287046 - DNA, 15 bp, Homo sapiens
acacaatgcaaagtc

SEQ ID NO: 287047 - DNA, 15 bp, Homo sapiens
tacacaatgcaaagt

SEQ ID NO: 287048 - DNA, 15 bp, Homo sapiens
ttacacaatgcaaag

SEQ ID NO: 287049 - DNA, 15 bp, Homo sapiens
attacacaatgcaaa

SEQ ID NO: 287050 - DNA, 15 bp, Homo sapiens
aattacacaatgcaa

SEQ ID NO: 287051 - DNA, 15 bp, Homo sapiens
gaattacacaatgca

SEQ ID NO: 287052 - DNA, 15 bp, Homo sapiens
tgaattacacaatgc

SEQ ID NO: 287053 - DNA, 15 bp, Homo sapiens
gtgaattacacaatg

SEQ ID NO: 287054 - DNA, 15 bp, Homo sapiens
agtgaattacacaat

SEQ ID NO: 287055 - DNA, 15 bp, Homo sapiens
cagtgaattacacaa

SEQ ID NO: 287056 - DNA, 15 bp, Homo sapiens
gcagtgaattacaca

SEQ ID NO: 287057 - DNA, 15 bp, Homo sapiens
tgcagtgaattacac

SEQ ID NO: 287058 - DNA, 15 bp, Homo sapiens
ctgcagtgaattaca

SEQ ID NO: 287059 - DNA, 15 bp, Homo sapiens
gctgcagtgaattac

SEQ ID NO: 287060 - DNA, 15 bp, Homo sapiens
agctgcagtgaatta

SEQ ID NO: 287061 - DNA, 15 bp, Homo sapiens
gagctgcagtgaatt

SEQ ID NO: 287062 - DNA, 15 bp, Homo sapiens
tgagctgcagtgaat

SEQ ID NO: 287063 - DNA, 15 bp, Homo sapiens
atgagctgcagtgaa

SEQ ID NO: 287064 - DNA, 15 bp, Homo sapiens
aatgagctgcagtga

SEQ ID NO: 287065 - DNA, 15 bp, Homo sapiens
caatgagctgcagtg

SEQ ID NO: 287066 - DNA, 15 bp, Homo sapiens
ccaatgagctgcagt

SEQ ID NO: 287067 - DNA, 15 bp, Homo sapiens
accaatgagctgcag

SEQ ID NO: 287068 - DNA, 15 bp, Homo sapiens
caccaatgagctgca

SEQ ID NO: 287069 - DNA, 15 bp, Homo sapiens
acaccaatgagctgc

SEQ ID NO: 287070 - DNA, 15 bp, Homo sapiens
gacaccaatgagctg

SEQ ID NO: 287071 - DNA, 15 bp, Homo sapiens
ggacaccaatgagct

SEQ ID NO: 287072 - DNA, 15 bp, Homo sapiens
aggacaccaatgagc

SEQ ID NO: 287073 - DNA, 15 bp, Homo sapiens
caggacaccaatgag

SEQ ID NO: 287074 - DNA, 15 bp, Homo sapiens
ccaggacaccaatga

SEQ ID NO: 287075 - DNA, 15 bp, Homo sapiens
accaggacaccaatg

SEQ ID NO: 287076 - DNA, 15 bp, Homo sapiens
caccaggacaccaat

SEQ ID NO: 287077 - DNA, 15 bp, Homo sapiens
ccaccaggacaccaa

SEQ ID NO: 287078 - DNA, 15 bp, Homo sapiens
accaccaggacacca

SEQ ID NO: 287079 - DNA, 15 bp, Homo sapiens
caccaccaggacacc

SEQ ID NO: 287080 - DNA, 15 bp, Homo sapiens
acaccaccaggacac

SEQ ID NO: 287081 - DNA, 15 bp, Homo sapiens
aacaccaccaggaca

SEQ ID NO: 287082 - DNA, 15 bp, Homo sapiens
caacaccaccaggac

SEQ ID NO: 287083 - DNA, 15 bp, Homo sapiens
tcaacaccaccagga

SEQ ID NO: 287084 - DNA, 15 bp, Homo sapiens
ctcaacaccaccagg

SEQ ID NO: 287085 - DNA, 15 bp, Homo sapiens
tctcaacaccaccag

SEQ ID NO: 287086 - DNA, 15 bp, Homo sapiens
gtctcaacaccacca

SEQ ID NO: 287087 - DNA, 15 bp, Homo sapiens
tgtctcaacaccacc

SEQ ID NO: 287088 - DNA, 15 bp, Homo sapiens
atgtctcaacaccac

SEQ ID NO: 287089 - DNA, 15 bp, Homo sapiens
aatgtctcaacacca

SEQ ID NO: 287090 - DNA, 15 bp, Homo sapiens
taatgtctcaacacc

SEQ ID NO: 287091 - DNA, 15 bp, Homo sapiens
ctaatgtctcaacac

SEQ ID NO: 287092 - DNA, 15 bp, Homo sapiens
actaatgtctcaaca

SEQ ID NO: 287093 - DNA, 15 bp, Homo sapiens
gactaatgtctcaac

SEQ ID NO: 287094 - DNA, 15 bp, Homo sapiens
agactaatgtctcaa

SEQ ID NO: 287095 - DNA, 15 bp, Homo sapiens
aagactaatgtctca

SEQ ID NO: 287096 - DNA, 15 bp, Homo sapiens
taagactaatgtctc

SEQ ID NO: 287097 - DNA, 15 bp, Homo sapiens
gtaagactaatgtct

SEQ ID NO: 287098 - DNA, 15 bp, Homo sapiens
tgtaagactaatgtc

SEQ ID NO: 287099 - DNA, 15 bp, Homo sapiens
ctgtaagactaatgt

SEQ ID NO: 287100 - DNA, 15 bp, Homo sapiens
gctgtaagactaatg

SEQ ID NO: 287101 - DNA, 15 bp, Homo sapiens
agctgtaagactaat

SEQ ID NO: 287102 - DNA, 15 bp, Homo sapiens
aagctgtaagactaa

SEQ ID NO: 287103 - DNA, 15 bp, Homo sapiens
caagctgtaagacta

SEQ ID NO: 287104 - DNA, 15 bp, Homo sapiens
gcaagctgtaagact

SEQ ID NO: 287105 - DNA, 15 bp, Homo sapiens
agcaagctgtaagac

SEQ ID NO: 287106 - DNA, 15 bp, Homo sapiens
aagcaagctgtaaga

SEQ ID NO: 287107 - DNA, 15 bp, Homo sapiens
gaagcaagctgtaag

SEQ ID NO: 287108 - DNA, 15 bp, Homo sapiens
agaagcaagctgtaa

SEQ ID NO: 287109 - DNA, 15 bp, Homo sapiens
cagaagcaagctgta

SEQ ID NO: 287110 - DNA, 15 bp, Homo sapiens
gcagaagcaagctgt

SEQ ID NO: 287111 - DNA, 15 bp, Homo sapiens
ggcagaagcaagctg

SEQ ID NO: 287112 - DNA, 15 bp, Homo sapiens
gggcagaagcaagct

SEQ ID NO: 287113 - DNA, 15 bp, Homo sapiens
ggggcagaagcaagc

SEQ ID NO: 287114 - DNA, 15 bp, Homo sapiens
cggggcagaagcaag

SEQ ID NO: 287115 - DNA, 15 bp, Homo sapiens
ccggggcagaagcaa

SEQ ID NO: 287116 - DNA, 15 bp, Homo sapiens
tccggggcagaagca

SEQ ID NO: 287117 - DNA, 15 bp, Homo sapiens
atccggggcagaagc

SEQ ID NO: 287118 - DNA, 15 bp, Homo sapiens
tatccggggcagaag

SEQ ID NO: 287119 - DNA, 15 bp, Homo sapiens
ttatccggggcagaa

SEQ ID NO: 287120 - DNA, 15 bp, Homo sapiens
gttatccggggcaga

SEQ ID NO: 287121 - DNA, 15 bp, Homo sapiens
tgttatccggggcag

SEQ ID NO: 287122 - DNA, 15 bp, Homo sapiens
gtgttatccggggca

SEQ ID NO: 287123 - DNA, 15 bp, Homo sapiens
tgtgttatccggggc

SEQ ID NO: 287124 - DNA, 15 bp, Homo sapiens
ctgtgttatccgggg

SEQ ID NO: 287125 - DNA, 15 bp, Homo sapiens
gctgtgttatccggg

SEQ ID NO: 287126 - DNA, 15 bp, Homo sapiens
agctgtgttatccgg

SEQ ID NO: 287127 - DNA, 15 bp, Homo sapiens
tagctgtgttatccg

SEQ ID NO: 287128 - DNA, 15 bp, Homo sapiens
ctagctgtgttatcc

SEQ ID NO: 287129 - DNA, 15 bp, Homo sapiens
cctagctgtgttatc

SEQ ID NO: 287130 - DNA, 15 bp, Homo sapiens
acctagctgtgttat

SEQ ID NO: 287131 - DNA, 15 bp, Homo sapiens
aacctagctgtgtta

SEQ ID NO: 287132 - DNA, 15 bp, Homo sapiens
aaacctagctgtgtt

SEQ ID NO: 287133 - DNA, 15 bp, Homo sapiens
taaacctagctgtgt

SEQ ID NO: 287134 - DNA, 15 bp, Homo sapiens
ctaaacctagctgtg

SEQ ID NO: 287135 - DNA, 15 bp, Homo sapiens
cctaaacctagctgt

SEQ ID NO: 287136 - DNA, 15 bp, Homo sapiens
ccctaaacctagctg

SEQ ID NO: 287137 - DNA, 15 bp, Homo sapiens
accctaaacctagct

SEQ ID NO: 287138 - DNA, 15 bp, Homo sapiens
caccctaaacctagc

SEQ ID NO: 287139 - DNA, 15 bp, Homo sapiens
acaccctaaacctag

SEQ ID NO: 287140 - DNA, 15 bp, Homo sapiens
aacaccctaaaccta

SEQ ID NO: 287141 - DNA, 15 bp, Homo sapiens
caacaccctaaacct

SEQ ID NO: 287142 - DNA, 15 bp, Homo sapiens
ccaacaccctaaacc

SEQ ID NO: 287143 - DNA, 15 bp, Homo sapiens
gccaacaccctaaac

SEQ ID NO: 287144 - DNA, 15 bp, Homo sapiens
ggccaacaccctaaa

SEQ ID NO: 287145 - DNA, 15 bp, Homo sapiens
tggccaacaccctaa

SEQ ID NO: 287146 - DNA, 15 bp, Homo sapiens
atggccaacacccta

SEQ ID NO: 287147 - DNA, 15 bp, Homo sapiens
aatggccaacaccct

SEQ ID NO: 287148 - DNA, 15 bp, Homo sapiens
aaatggccaacaccc

SEQ ID NO: 287149 - DNA, 15 bp, Homo sapiens
taaatggccaacacc

SEQ ID NO: 287150 - DNA, 15 bp, Homo sapiens
gtaaatggccaacac

SEQ ID NO: 287151 - DNA, 15 bp, Homo sapiens
agtaaatggccaaca

SEQ ID NO: 287152 - DNA, 15 bp, Homo sapiens
aagtaaatggccaac

SEQ ID NO: 287153 - DNA, 15 bp, Homo sapiens
gaagtaaatggccaa

SEQ ID NO: 287154 - DNA, 15 bp, Homo sapiens
ggaagtaaatggcca

SEQ ID NO: 287155 - DNA, 15 bp, Homo sapiens
aggaagtaaatggcc

SEQ ID NO: 287156 - DNA, 15 bp, Homo sapiens
taggaagtaaatggc

SEQ ID NO: 287157 - DNA, 15 bp, Homo sapiens
ataggaagtaaatgg

SEQ ID NO: 287158 - DNA, 15 bp, Homo sapiens
cataggaagtaaatg

SEQ ID NO: 287159 - DNA, 15 bp, Homo sapiens
tcataggaagtaaat

SEQ ID NO: 287160 - DNA, 15 bp, Homo sapiens
ctcataggaagtaaa

SEQ ID NO: 287161 - DNA, 15 bp, Homo sapiens
cctcataggaagtaa

SEQ ID NO: 287162 - DNA, 15 bp, Homo sapiens
tcctcataggaagta

SEQ ID NO: 287163 - DNA, 15 bp, Homo sapiens
ttcctcataggaagt

SEQ ID NO: 287164 - DNA, 15 bp, Homo sapiens
tttcctcataggaag

SEQ ID NO: 287165 - DNA, 15 bp, Homo sapiens
ttttcctcataggaa

SEQ ID NO: 287166 - DNA, 15 bp, Homo sapiens
attttcctcatagga

SEQ ID NO: 287167 - DNA, 15 bp, Homo sapiens
tattttcctcatagg

SEQ ID NO: 287168 - DNA, 15 bp, Homo sapiens
atattttcctcatag

SEQ ID NO: 287169 - DNA, 15 bp, Homo sapiens
tatattttcctcata

SEQ ID NO: 287170 - DNA, 15 bp, Homo sapiens
gtatattttcctcat

SEQ ID NO: 287171 - DNA, 15 bp, Homo sapiens
tgtatattttcctca

SEQ ID NO: 287172 - DNA, 15 bp, Homo sapiens
gtgtatattttcctc

SEQ ID NO: 287173 - DNA, 15 bp, Homo sapiens
tgtgtatattttcct

SEQ ID NO: 287174 - DNA, 15 bp, Homo sapiens
atgtgtatattttcc

SEQ ID NO: 287175 - DNA, 15 bp, Homo sapiens
tatgtgtatattttc

SEQ ID NO: 287176 - DNA, 15 bp, Homo sapiens
gtatgtgtatatttt

SEQ ID NO: 287177 - DNA, 15 bp, Homo sapiens
tgtatgtgtatattt

SEQ ID NO: 287178 - DNA, 15 bp, Homo sapiens
gtgtatgtgtatatt

SEQ ID NO: 287179 - DNA, 15 bp, Homo sapiens
ctgtgtatgtgtata

SEQ ID NO: 287180 - DNA, 15 bp, Homo sapiens
tctgtgtatgtgtat

SEQ ID NO: 287181 - DNA, 15 bp, Homo sapiens
gtctgtgtatgtgta

SEQ ID NO: 287182 - DNA, 15 bp, Homo sapiens
ggtctgtgtatgtgt

SEQ ID NO: 287183 - DNA, 15 bp, Homo sapiens
gggtctgtgtatgtg

SEQ ID NO: 287184 - DNA, 15 bp, Homo sapiens
tgggtctgtgtatgt

SEQ ID NO: 287185 - DNA, 15 bp, Homo sapiens
atgggtctgtgtatg

SEQ ID NO: 287186 - DNA, 15 bp, Homo sapiens
tatgggtctgtgtat

SEQ ID NO: 287187 - DNA, 15 bp, Homo sapiens
atatgggtctgtgta

SEQ ID NO: 287188 - DNA, 15 bp, Homo sapiens
gatatgggtctgtgt

SEQ ID NO: 287189 - DNA, 15 bp, Homo sapiens
agatatgggtctgtg

SEQ ID NO: 287190 - DNA, 15 bp, Homo sapiens
gagatatgggtctgt

SEQ ID NO: 287191 - DNA, 15 bp, Homo sapiens
ggagatatgggtctg

SEQ ID NO: 287192 - DNA, 15 bp, Homo sapiens
gggagatatgggtct

SEQ ID NO: 287193 - DNA, 15 bp, Homo sapiens
agggagatatgggtc

SEQ ID NO: 287194 - DNA, 15 bp, Homo sapiens
cagggagatatgggt

SEQ ID NO: 287195 - DNA, 15 bp, Homo sapiens
gcagggagatatggg

SEQ ID NO: 287196 - DNA, 15 bp, Homo sapiens
ggcagggagatatgg

SEQ ID NO: 287197 - DNA, 15 bp, Homo sapiens
tggcagggagatatg

SEQ ID NO: 287198 - DNA, 15 bp, Homo sapiens
ctggcagggagatat

SEQ ID NO: 287199 - DNA, 15 bp, Homo sapiens
actggcagggagata

SEQ ID NO: 287200 - DNA, 15 bp, Homo sapiens
gactggcagggagat

SEQ ID NO: 287201 - DNA, 15 bp, Homo sapiens
agactggcagggaga

SEQ ID NO: 287202 - DNA, 15 bp, Homo sapiens
cagactggcagggag

SEQ ID NO: 287203 - DNA, 15 bp, Homo sapiens
acagactggcaggga

SEQ ID NO: 287204 - DNA, 15 bp, Homo sapiens
aacagactggcaggg

SEQ ID NO: 287205 - DNA, 15 bp, Homo sapiens
aaacagactggcagg

SEQ ID NO: 287206 - DNA, 15 bp, Homo sapiens
caaacagactggcag

SEQ ID NO: 287207 - DNA, 15 bp, Homo sapiens
tcaaacagactggca

SEQ ID NO: 287208 - DNA, 15 bp, Homo sapiens
atcaaacagactggc

SEQ ID NO: 287209 - DNA, 15 bp, Homo sapiens
aatcaaacagactgg

SEQ ID NO: 287210 - DNA, 15 bp, Homo sapiens
aaatcaaacagactg

SEQ ID NO: 287211 - DNA, 15 bp, Homo sapiens
taaatcaaacagact

SEQ ID NO: 287212 - DNA, 15 bp, Homo sapiens
ctaaatcaaacagac

SEQ ID NO: 287213 - DNA, 15 bp, Homo sapiens
gctaaatcaaacaga

SEQ ID NO: 287214 - DNA, 15 bp, Homo sapiens
agctaaatcaaacag

SEQ ID NO: 287215 - DNA, 15 bp, Homo sapiens
tagctaaatcaaaca

SEQ ID NO: 287216 - DNA, 15 bp, Homo sapiens
gtagctaaatcaaac

SEQ ID NO: 287217 - DNA, 15 bp, Homo sapiens
tgtagctaaatcaaa

SEQ ID NO: 287218 - DNA, 15 bp, Homo sapiens
atgtagctaaatcaa

SEQ ID NO: 287219 - DNA, 15 bp, Homo sapiens
catgtagctaaatca

SEQ ID NO: 287220 - DNA, 15 bp, Homo sapiens
ccatgtagctaaatc

SEQ ID NO: 287221 - DNA, 15 bp, Homo sapiens
cccatgtagctaaat

SEQ ID NO: 287222 - DNA, 15 bp, Homo sapiens
tcccatgtagctaaa

SEQ ID NO: 287223 - DNA, 15 bp, Homo sapiens
ttcccatgtagctaa

SEQ ID NO: 287224 - DNA, 15 bp, Homo sapiens
tttcccatgtagcta

SEQ ID NO: 287225 - DNA, 15 bp, Homo sapiens
gtttcccatgtagct

SEQ ID NO: 287226 - DNA, 15 bp, Homo sapiens
agtttcccatgtagc

SEQ ID NO: 287227 - DNA, 15 bp, Homo sapiens
cagtttcccatgtag

SEQ ID NO: 287228 - DNA, 15 bp, Homo sapiens
tcagtttcccatgta

SEQ ID NO: 287229 - DNA, 15 bp, Homo sapiens
ctcagtttcccatgt

SEQ ID NO: 287230 - DNA, 15 bp, Homo sapiens
cctcagtttcccatg

SEQ ID NO: 287231 - DNA, 15 bp, Homo sapiens
tcctcagtttcccat

SEQ ID NO: 287232 - DNA, 15 bp, Homo sapiens
ctcctcagtttccca

SEQ ID NO: 287233 - DNA, 15 bp, Homo sapiens
gctcctcagtttccc

SEQ ID NO: 287234 - DNA, 15 bp, Homo sapiens
agctcctcagtttcc

SEQ ID NO: 287235 - DNA, 15 bp, Homo sapiens
aagctcctcagtttc

SEQ ID NO: 287236 - DNA, 15 bp, Homo sapiens
aaagctcctcagttt

SEQ ID NO: 287237 - DNA, 15 bp, Homo sapiens
aaaagctcctcagtt

SEQ ID NO: 287238 - DNA, 15 bp, Homo sapiens
caaaagctcctcagt

SEQ ID NO: 287239 - DNA, 15 bp, Homo sapiens
ccaaaagctcctcag

SEQ ID NO: 287240 - DNA, 15 bp, Homo sapiens
tccaaaagctcctca

SEQ ID NO: 287241 - DNA, 15 bp, Homo sapiens
atccaaaagctcctc

SEQ ID NO: 287242 - DNA, 15 bp, Homo sapiens
aatccaaaagctcct

SEQ ID NO: 287243 - DNA, 15 bp, Homo sapiens
caatccaaaagctcc

SEQ ID NO: 287244 - DNA, 15 bp, Homo sapiens
gcaatccaaaagctc

SEQ ID NO: 287245 - DNA, 15 bp, Homo sapiens
agcaatccaaaagct

SEQ ID NO: 287246 - DNA, 15 bp, Homo sapiens
aagcaatccaaaagc

SEQ ID NO: 287247 - DNA, 15 bp, Homo sapiens
aaagcaatccaaaag

SEQ ID NO: 287248 - DNA, 15 bp, Homo sapiens
gaaagcaatccaaaa

SEQ ID NO: 287249 - DNA, 15 bp, Homo sapiens
tgaaagcaatccaaa

SEQ ID NO: 287250 - DNA, 15 bp, Homo sapiens
ttgaaagcaatccaa

SEQ ID NO: 287251 - DNA, 15 bp, Homo sapiens
tttgaaagcaatcca

SEQ ID NO: 287252 - DNA, 15 bp, Homo sapiens
atttgaaagcaatcc

SEQ ID NO: 287253 - DNA, 15 bp, Homo sapiens
catttgaaagcaatc

SEQ ID NO: 287254 - DNA, 15 bp, Homo sapiens
gcatttgaaagcaat

SEQ ID NO: 287255 - DNA, 15 bp, Homo sapiens
agcatttgaaagcaa

SEQ ID NO: 287256 - DNA, 15 bp, Homo sapiens
cagcatttgaaagca

SEQ ID NO: 287257 - DNA, 15 bp, Homo sapiens
gcagcatttgaaagc

SEQ ID NO: 287258 - DNA, 15 bp, Homo sapiens
agcagcatttgaaag

SEQ ID NO: 287259 - DNA, 15 bp, Homo sapiens
gagcagcatttgaaa

SEQ ID NO: 287260 - DNA, 15 bp, Homo sapiens
agagcagcatttgaa

SEQ ID NO: 287261 - DNA, 15 bp, Homo sapiens
gagagcagcatttga

SEQ ID NO: 287262 - DNA, 15 bp, Homo sapiens
agagagcagcatttg

SEQ ID NO: 287263 - DNA, 15 bp, Homo sapiens
cagagagcagcattt

SEQ ID NO: 287264 - DNA, 15 bp, Homo sapiens
gcagagagcagcatt

SEQ ID NO: 287265 - DNA, 15 bp, Homo sapiens
tgcagagagcagcat

SEQ ID NO: 287266 - DNA, 15 bp, Homo sapiens
ctgcagagagcagca

SEQ ID NO: 287267 - DNA, 15 bp, Homo sapiens
actgcagagagcagc

SEQ ID NO: 287268 - DNA, 15 bp, Homo sapiens
cactgcagagagcag

SEQ ID NO: 287269 - DNA, 15 bp, Homo sapiens
ccactgcagagagca

SEQ ID NO: 287270 - DNA, 15 bp, Homo sapiens
accactgcagagagc

SEQ ID NO: 287271 - DNA, 15 bp, Homo sapiens
caccactgcagagag

SEQ ID NO: 287272 - DNA, 15 bp, Homo sapiens
gcaccactgcagaga

SEQ ID NO: 287273 - DNA, 15 bp, Homo sapiens
tgcaccactgcagag

SEQ ID NO: 287274 - DNA, 15 bp, Homo sapiens
ctgcaccactgcaga

SEQ ID NO: 287275 - DNA, 15 bp, Homo sapiens
actgcaccactgcag

SEQ ID NO: 287276 - DNA, 15 bp, Homo sapiens
tactgcaccactgca

SEQ ID NO: 287277 - DNA, 15 bp, Homo sapiens
gtactgcaccactgc

SEQ ID NO: 287278 - DNA, 15 bp, Homo sapiens
ggtactgcaccactg

SEQ ID NO: 287279 - DNA, 15 bp, Homo sapiens
gggtactgcaccact

SEQ ID NO: 287280 - DNA, 15 bp, Homo sapiens
tgggtactgcaccac

SEQ ID NO: 287281 - DNA, 15 bp, Homo sapiens
atgggtactgcacca

SEQ ID NO: 287282 - DNA, 15 bp, Homo sapiens
tatgggtactgcacc

SEQ ID NO: 287283 - DNA, 15 bp, Homo sapiens
gtatgggtactgcac

SEQ ID NO: 287284 - DNA, 15 bp, Homo sapiens
agtatgggtactgca

SEQ ID NO: 287285 - DNA, 15 bp, Homo sapiens
gagtatgggtactgc

SEQ ID NO: 287286 - DNA, 15 bp, Homo sapiens
agagtatgggtactg

SEQ ID NO: 287287 - DNA, 15 bp, Homo sapiens
gagagtatgggtact

SEQ ID NO: 287288 - DNA, 15 bp, Homo sapiens
agagagtatgggtac

SEQ ID NO: 287289 - DNA, 15 bp, Homo sapiens
aagagagtatgggta

SEQ ID NO: 287290 - DNA, 15 bp, Homo sapiens
gaagagagtatgggt

SEQ ID NO: 287291 - DNA, 15 bp, Homo sapiens
agaagagagtatggg

SEQ ID NO: 287292 - DNA, 15 bp, Homo sapiens
aagaagagagtatgg

SEQ ID NO: 287293 - DNA, 15 bp, Homo sapiens
gaagaagagagtatg

SEQ ID NO: 287294 - DNA, 15 bp, Homo sapiens
agaagaagagagtat

SEQ ID NO: 287295 - DNA, 15 bp, Homo sapiens
gagaagaagagagta

SEQ ID NO: 287296 - DNA, 15 bp, Homo sapiens
cgagaagaagagagt

SEQ ID NO: 287297 - DNA, 15 bp, Homo sapiens
acgagaagaagagag

SEQ ID NO: 287298 - DNA, 15 bp, Homo sapiens
gacgagaagaagaga

SEQ ID NO: 287299 - DNA, 15 bp, Homo sapiens
ggacgagaagaagag

SEQ ID NO: 287300 - DNA, 15 bp, Homo sapiens
aggacgagaagaaga

SEQ ID NO: 287301 - DNA, 15 bp, Homo sapiens
aaggacgagaagaag

SEQ ID NO: 287302 - DNA, 15 bp, Homo sapiens
gaaggacgagaagaa

SEQ ID NO: 287303 - DNA, 15 bp, Homo sapiens
agaaggacgagaaga

SEQ ID NO: 287304 - DNA, 15 bp, Homo sapiens
tagaaggacgagaag

SEQ ID NO: 287305 - DNA, 15 bp, Homo sapiens
ttagaaggacgagaa

SEQ ID NO: 287306 - DNA, 15 bp, Homo sapiens
tttagaaggacgaga

SEQ ID NO: 287307 - DNA, 15 bp, Homo sapiens
gtttagaaggacgag

SEQ ID NO: 287308 - DNA, 15 bp, Homo sapiens
ggtttagaaggacga

SEQ ID NO: 287309 - DNA, 15 bp, Homo sapiens
gggtttagaaggacg

SEQ ID NO: 287310 - DNA, 15 bp, Homo sapiens
tgggtttagaaggac

SEQ ID NO: 287311 - DNA, 15 bp, Homo sapiens
ctgggtttagaagga

SEQ ID NO: 287312 - DNA, 15 bp, Homo sapiens
cctgggtttagaagg

SEQ ID NO: 287313 - DNA, 15 bp, Homo sapiens
tcctgggtttagaag

SEQ ID NO: 287314 - DNA, 15 bp, Homo sapiens
ttcctgggtttagaa

SEQ ID NO: 287315 - DNA, 15 bp, Homo sapiens
gttcctgggtttaga

SEQ ID NO: 287316 - DNA, 15 bp, Homo sapiens
tgttcctgggtttag

SEQ ID NO: 287317 - DNA, 15 bp, Homo sapiens
ttgttcctgggttta

SEQ ID NO: 287318 - DNA, 15 bp, Homo sapiens
cttgttcctgggttt

SEQ ID NO: 287319 - DNA, 15 bp, Homo sapiens
gcttgttcctgggtt

SEQ ID NO: 287320 - DNA, 15 bp, Homo sapiens
tgcttgttcctgggt

SEQ ID NO: 287321 - DNA, 15 bp, Homo sapiens
atgcttgttcctggg

SEQ ID NO: 287322 - DNA, 15 bp, Homo sapiens
catgcttgttcctgg

SEQ ID NO: 287323 - DNA, 15 bp, Homo sapiens
ccatgcttgttcctg

SEQ ID NO: 287324 - DNA, 15 bp, Homo sapiens
cccatgcttgttcct

SEQ ID NO: 287325 - DNA, 15 bp, Homo sapiens
ccccatgcttgttcc

SEQ ID NO: 287326 - DNA, 15 bp, Homo sapiens
accccatgcttgttc

SEQ ID NO: 287327 - DNA, 15 bp, Homo sapiens
aaccccatgcttgtt

SEQ ID NO: 287328 - DNA, 15 bp, Homo sapiens
gaaccccatgcttgt

SEQ ID NO: 287329 - DNA, 15 bp, Homo sapiens
agaaccccatgcttg

SEQ ID NO: 287330 - DNA, 15 bp, Homo sapiens
aagaaccccatgctt

SEQ ID NO: 287331 - DNA, 15 bp, Homo sapiens
caagaaccccatgct

SEQ ID NO: 287332 - DNA, 15 bp, Homo sapiens
gcaagaaccccatgc

SEQ ID NO: 287333 - DNA, 15 bp, Homo sapiens
tgcaagaaccccatg

SEQ ID NO: 287334 - DNA, 15 bp, Homo sapiens
ctgcaagaaccccat

SEQ ID NO: 287335 - DNA, 15 bp, Homo sapiens
tctgcaagaacccca

SEQ ID NO: 287336 - DNA, 15 bp, Homo sapiens
ctctgcaagaacccc

SEQ ID NO: 287337 - DNA, 15 bp, Homo sapiens
cctctgcaagaaccc

SEQ ID NO: 287338 - DNA, 15 bp, Homo sapiens
acctctgcaagaacc

SEQ ID NO: 287339 - DNA, 15 bp, Homo sapiens
aacctctgcaagaac

SEQ ID NO: 287340 - DNA, 15 bp, Homo sapiens
gaacctctgcaagaa

SEQ ID NO: 287341 - DNA, 15 bp, Homo sapiens
ggaacctctgcaaga

SEQ ID NO: 287342 - DNA, 15 bp, Homo sapiens
aggaacctctgcaag

SEQ ID NO: 287343 - DNA, 15 bp, Homo sapiens
aaggaacctctgcaa

SEQ ID NO: 287344 - DNA, 15 bp, Homo sapiens
gaaggaacctctgca

SEQ ID NO: 287345 - DNA, 15 bp, Homo sapiens
tgaaggaacctctgc

SEQ ID NO: 287346 - DNA, 15 bp, Homo sapiens
atgaaggaacctctg

SEQ ID NO: 287347 - DNA, 15 bp, Homo sapiens
aatgaaggaacctct

SEQ ID NO: 287348 - DNA, 15 bp, Homo sapiens
gaatgaaggaacctc

SEQ ID NO: 287349 - DNA, 15 bp, Homo sapiens
tgaatgaaggaacct

SEQ ID NO: 287350 - DNA, 15 bp, Homo sapiens
atgaatgaaggaacc

SEQ ID NO: 287351 - DNA, 15 bp, Homo sapiens
aatgaatgaaggaac

SEQ ID NO: 287352 - DNA, 15 bp, Homo sapiens
aaatgaatgaaggaa

SEQ ID NO: 287353 - DNA, 15 bp, Homo sapiens
gaaatgaatgaagga

SEQ ID NO: 287354 - DNA, 15 bp, Homo sapiens
ggaaatgaatgaagg

SEQ ID NO: 287355 - DNA, 15 bp, Homo sapiens
gggaaatgaatgaag

SEQ ID NO: 287356 - DNA, 15 bp, Homo sapiens
tgggaaatgaatgaa

SEQ ID NO: 287357 - DNA, 15 bp, Homo sapiens
ctgggaaatgaatga

SEQ ID NO: 287358 - DNA, 15 bp, Homo sapiens
actgggaaatgaatg

SEQ ID NO: 287359 - DNA, 15 bp, Homo sapiens
cactgggaaatgaat

SEQ ID NO: 287360 - DNA, 15 bp, Homo sapiens
tcactgggaaatgaa

SEQ ID NO: 287361 - DNA, 15 bp, Homo sapiens
atcactgggaaatga

SEQ ID NO: 287362 - DNA, 15 bp, Homo sapiens
catcactgggaaatg

SEQ ID NO: 287363 - DNA, 15 bp, Homo sapiens
gcatcactgggaaat

SEQ ID NO: 287364 - DNA, 15 bp, Homo sapiens
agcatcactgggaaa

SEQ ID NO: 287365 - DNA, 15 bp, Homo sapiens
cagcatcactgggaa

SEQ ID NO: 287366 - DNA, 15 bp, Homo sapiens
gcagcatcactggga

SEQ ID NO: 287367 - DNA, 15 bp, Homo sapiens
cgcagcatcactggg

SEQ ID NO: 287368 - DNA, 15 bp, Homo sapiens
acgcagcatcactgg

SEQ ID NO: 287369 - DNA, 15 bp, Homo sapiens
aacgcagcatcactg

SEQ ID NO: 287370 - DNA, 15 bp, Homo sapiens
aaacgcagcatcact

SEQ ID NO: 287371 - DNA, 15 bp, Homo sapiens
aaaacgcagcatcac

SEQ ID NO: 287372 - DNA, 15 bp, Homo sapiens
gaaaacgcagcatca

SEQ ID NO: 287373 - DNA, 15 bp, Homo sapiens
agaaaacgcagcatc

SEQ ID NO: 287374 - DNA, 15 bp, Homo sapiens
gagaaaacgcagcat

SEQ ID NO: 287375 - DNA, 15 bp, Homo sapiens
tgagaaaacgcagca

SEQ ID NO: 287376 - DNA, 15 bp, Homo sapiens
ctgagaaaacgcagc

SEQ ID NO: 287377 - DNA, 15 bp, Homo sapiens
cctgagaaaacgcag

SEQ ID NO: 287378 - DNA, 15 bp, Homo sapiens
tcctgagaaaacgca

SEQ ID NO: 287379 - DNA, 15 bp, Homo sapiens
ttcctgagaaaacgc

SEQ ID NO: 287380 - DNA, 15 bp, Homo sapiens
tttcctgagaaaacg

SEQ ID NO: 287381 - DNA, 15 bp, Homo sapiens
ctttcctgagaaaac

SEQ ID NO: 287382 - DNA, 15 bp, Homo sapiens
cctttcctgagaaaa

SEQ ID NO: 287383 - DNA, 15 bp, Homo sapiens
ccctttcctgagaaa

SEQ ID NO: 287384 - DNA, 15 bp, Homo sapiens
tccctttcctgagaa

SEQ ID NO: 287385 - DNA, 15 bp, Homo sapiens
ttccctttcctgaga

SEQ ID NO: 287386 - DNA, 15 bp, Homo sapiens
attccctttcctgag

SEQ ID NO: 287387 - DNA, 15 bp, Homo sapiens
gattccctttcctga

SEQ ID NO: 287388 - DNA, 15 bp, Homo sapiens
tgattccctttcctg

SEQ ID NO: 287389 - DNA, 15 bp, Homo sapiens
ttgattccctttcct

SEQ ID NO: 287390 - DNA, 15 bp, Homo sapiens
tttgattccctttcc

SEQ ID NO: 287391 - DNA, 15 bp, Homo sapiens
ctttgattccctttc

SEQ ID NO: 287392 - DNA, 15 bp, Homo sapiens
cctttgattcccttt

SEQ ID NO: 287393 - DNA, 15 bp, Homo sapiens
tcctttgattccctt

SEQ ID NO: 287394 - DNA, 15 bp, Homo sapiens
atcctttgattccct

SEQ ID NO: 287395 - DNA, 15 bp, Homo sapiens
tatcctttgattccc

SEQ ID NO: 287396 - DNA, 15 bp, Homo sapiens
ttatcctttgattcc

SEQ ID NO: 287397 - DNA, 15 bp, Homo sapiens
attatcctttgattc

SEQ ID NO: 287398 - DNA, 15 bp, Homo sapiens
cattatcctttgatt

SEQ ID NO: 287399 - DNA, 15 bp, Homo sapiens
gcattatcctttgat

SEQ ID NO: 287400 - DNA, 15 bp, Homo sapiens
ggcattatcctttga

SEQ ID NO: 287401 - DNA, 15 bp, Homo sapiens
cggcattatcctttg

SEQ ID NO: 287402 - DNA, 15 bp, Homo sapiens
gcggcattatccttt

SEQ ID NO: 287403 - DNA, 15 bp, Homo sapiens
tgcggcattatcctt

SEQ ID NO: 287404 - DNA, 15 bp, Homo sapiens
ctgcggcattatcct

SEQ ID NO: 287405 - DNA, 15 bp, Homo sapiens
gctgcggcattatcc

SEQ ID NO: 287406 - DNA, 15 bp, Homo sapiens
agctgcggcattatc

SEQ ID NO: 287407 - DNA, 15 bp, Homo sapiens
aagctgcggcattat

SEQ ID NO: 287408 - DNA, 15 bp, Homo sapiens
taagctgcggcatta

SEQ ID NO: 287409 - DNA, 15 bp, Homo sapiens
gtaagctgcggcatt

SEQ ID NO: 287410 - DNA, 15 bp, Homo sapiens
agtaagctgcggcat

SEQ ID NO: 287411 - DNA, 15 bp, Homo sapiens
aagtaagctgcggca

SEQ ID NO: 287412 - DNA, 15 bp, Homo sapiens
gaagtaagctgcggc

SEQ ID NO: 287413 - DNA, 15 bp, Homo sapiens
tgaagtaagctgcgg

SEQ ID NO: 287414 - DNA, 15 bp, Homo sapiens
ttgaagtaagctgcg

SEQ ID NO: 287415 - DNA, 15 bp, Homo sapiens
attgaagtaagctgc

SEQ ID NO: 287416 - DNA, 15 bp, Homo sapiens
gattgaagtaagctg

SEQ ID NO: 287417 - DNA, 15 bp, Homo sapiens
ggattgaagtaagct

SEQ ID NO: 287418 - DNA, 15 bp, Homo sapiens
aggattgaagtaagc

SEQ ID NO: 287419 - DNA, 15 bp, Homo sapiens
aaggattgaagtaag

SEQ ID NO: 287420 - DNA, 15 bp, Homo sapiens
taaggattgaagtaa

SEQ ID NO: 287421 - DNA, 15 bp, Homo sapiens
ttaaggattgaagta

SEQ ID NO: 287422 - DNA, 15 bp, Homo sapiens
gttaaggattgaagt

SEQ ID NO: 287423 - DNA, 15 bp, Homo sapiens
ggttaaggattgaag

SEQ ID NO: 287424 - DNA, 15 bp, Homo sapiens
gggttaaggattgaa

SEQ ID NO: 287425 - DNA, 15 bp, Homo sapiens
tgggttaaggattga

SEQ ID NO: 287426 - DNA, 15 bp, Homo sapiens
gtgggttaaggattg

SEQ ID NO: 287427 - DNA, 15 bp, Homo sapiens
agtgggttaaggatt

SEQ ID NO: 287428 - DNA, 15 bp, Homo sapiens
cagtgggttaaggat

SEQ ID NO: 287429 - DNA, 15 bp, Homo sapiens
ccagtgggttaagga

SEQ ID NO: 287430 - DNA, 15 bp, Homo sapiens
accagtgggttaagg

SEQ ID NO: 287431 - DNA, 15 bp, Homo sapiens
caccagtgggttaag

SEQ ID NO: 287432 - DNA, 15 bp, Homo sapiens
acaccagtgggttaa

SEQ ID NO: 287433 - DNA, 15 bp, Homo sapiens
aacaccagtgggtta

SEQ ID NO: 287434 - DNA, 15 bp, Homo sapiens
gaacaccagtgggtt

SEQ ID NO: 287435 - DNA, 15 bp, Homo sapiens
ggaacaccagtgggt

SEQ ID NO: 287436 - DNA, 15 bp, Homo sapiens
aggaacaccagtggg

SEQ ID NO: 287437 - DNA, 15 bp, Homo sapiens
aaggaacaccagtgg

SEQ ID NO: 287438 - DNA, 15 bp, Homo sapiens
taaggaacaccagtg

SEQ ID NO: 287439 - DNA, 15 bp, Homo sapiens
ataaggaacaccagt

SEQ ID NO: 287440 - DNA, 15 bp, Homo sapiens
aataaggaacaccag

SEQ ID NO: 287441 - DNA, 15 bp, Homo sapiens
aaataaggaacacca

SEQ ID NO: 287442 - DNA, 15 bp, Homo sapiens
gaaataaggaacacc

SEQ ID NO: 287443 - DNA, 15 bp, Homo sapiens
ggaaataaggaacac

SEQ ID NO: 287444 - DNA, 15 bp, Homo sapiens
tggaaataaggaaca

SEQ ID NO: 287445 - DNA, 15 bp, Homo sapiens
ctggaaataaggaac

SEQ ID NO: 287446 - DNA, 15 bp, Homo sapiens
actggaaataaggaa

SEQ ID NO: 287447 - DNA, 15 bp, Homo sapiens
aactggaaataagga

SEQ ID NO: 287448 - DNA, 15 bp, Homo sapiens
caactggaaataagg

SEQ ID NO: 287449 - DNA, 15 bp, Homo sapiens
gcaactggaaataag

SEQ ID NO: 287450 - DNA, 15 bp, Homo sapiens
agcaactggaaataa

SEQ ID NO: 287451 - DNA, 15 bp, Homo sapiens
tagcaactggaaata

SEQ ID NO: 287452 - DNA, 15 bp, Homo sapiens
ttagcaactggaaat

SEQ ID NO: 287453 - DNA, 15 bp, Homo sapiens
gttagcaactggaaa

SEQ ID NO: 287454 - DNA, 15 bp, Homo sapiens
agttagcaactggaa

SEQ ID NO: 287455 - DNA, 15 bp, Homo sapiens
cagttagcaactgga

SEQ ID NO: 287456 - DNA, 15 bp, Homo sapiens
acagttagcaactgg

SEQ ID NO: 287457 - DNA, 15 bp, Homo sapiens
cacagttagcaactg

SEQ ID NO: 287458 - DNA, 15 bp, Homo sapiens
acacagttagcaact

SEQ ID NO: 287459 - DNA, 15 bp, Homo sapiens
aacacagttagcaac

SEQ ID NO: 287460 - DNA, 15 bp, Homo sapiens
caacacagttagcaa

SEQ ID NO: 287461 - DNA, 15 bp, Homo sapiens
acaacacagttagca

SEQ ID NO: 287462 - DNA, 15 bp, Homo sapiens
tacaacacagttagc

SEQ ID NO: 287463 - DNA, 15 bp, Homo sapiens
ttacaacacagttag

SEQ ID NO: 287464 - DNA, 15 bp, Homo sapiens
cttacaacacagtta

SEQ ID NO: 287465 - DNA, 15 bp, Homo sapiens
ccttacaacacagtt

SEQ ID NO: 287466 - DNA, 15 bp, Homo sapiens
cccttacaacacagt

SEQ ID NO: 287467 - DNA, 15 bp, Homo sapiens
acccttacaacacag

SEQ ID NO: 287468 - DNA, 15 bp, Homo sapiens
gacccttacaacaca

SEQ ID NO: 287469 - DNA, 15 bp, Homo sapiens
ggacccttacaacac

SEQ ID NO: 287470 - DNA, 15 bp, Homo sapiens
gggacccttacaaca

SEQ ID NO: 287471 - DNA, 15 bp, Homo sapiens
tgggacccttacaac

SEQ ID NO: 287472 - DNA, 15 bp, Homo sapiens
gtgggacccttacaa

SEQ ID NO: 287473 - DNA, 15 bp, Homo sapiens
ggtgggacccttaca

SEQ ID NO: 287474 - DNA, 15 bp, Homo sapiens
gggtgggacccttac

SEQ ID NO: 287475 - DNA, 15 bp, Homo sapiens
ggggtgggaccctta

SEQ ID NO: 287476 - DNA, 15 bp, Homo sapiens
tggggtgggaccctt

SEQ ID NO: 287477 - DNA, 15 bp, Homo sapiens
atggggtgggaccct

SEQ ID NO: 287478 - DNA, 15 bp, Homo sapiens
gatggggtgggaccc

SEQ ID NO: 287479 - DNA, 15 bp, Homo sapiens
ggatggggtgggacc

SEQ ID NO: 287480 - DNA, 15 bp, Homo sapiens
aggatggggtgggac

SEQ ID NO: 287481 - DNA, 15 bp, Homo sapiens
gaggatggggtggga

SEQ ID NO: 287482 - DNA, 15 bp, Homo sapiens
agaggatggggtggg

SEQ ID NO: 287483 - DNA, 15 bp, Homo sapiens
aagaggatggggtgg

SEQ ID NO: 287484 - DNA, 15 bp, Homo sapiens
aaagaggatggggtg

SEQ ID NO: 287485 - DNA, 15 bp, Homo sapiens
aaaagaggatggggt

SEQ ID NO: 287486 - DNA, 15 bp, Homo sapiens
taaaagaggatgggg

SEQ ID NO: 287487 - DNA, 15 bp, Homo sapiens
ttaaaagaggatggg

SEQ ID NO: 287488 - DNA, 15 bp, Homo sapiens
tttaaaagaggatgg

SEQ ID NO: 287489 - DNA, 15 bp, Homo sapiens
ttttaaaagaggatg

SEQ ID NO: 287490 - DNA, 15 bp, Homo sapiens
attttaaaagaggat

SEQ ID NO: 287491 - DNA, 15 bp, Homo sapiens
aattttaaaagagga

SEQ ID NO: 287492 - DNA, 15 bp, Homo sapiens
aaattttaaaagagg

SEQ ID NO: 287493 - DNA, 15 bp, Homo sapiens
taaattttaaaagag

SEQ ID NO: 287494 - DNA, 15 bp, Homo sapiens
ataaattttaaaaga

SEQ ID NO: 287495 - DNA, 15 bp, Homo sapiens
aataaattttaaaag

SEQ ID NO: 287496 - DNA, 15 bp, Homo sapiens
aaataaattttaaaa

SEQ ID NO: 287497 - DNA, 15 bp, Homo sapiens
caaataaattttaaa

SEQ ID NO: 287498 - DNA, 15 bp, Homo sapiens
tcaaataaattttaa

SEQ ID NO: 287499 - DNA, 15 bp, Homo sapiens
atcaaataaatttta

SEQ ID NO: 287500 - DNA, 15 bp, Homo sapiens
tatcaaataaatttt

SEQ ID NO: 287501 - DNA, 15 bp, Homo sapiens
ttatcaaataaattt

SEQ ID NO: 287502 - DNA, 15 bp, Homo sapiens
tttatcaaataaatt

SEQ ID NO: 287503 - DNA, 15 bp, Homo sapiens
ttttatcaaataaat

SEQ ID NO: 287504 - DNA, 15 bp, Homo sapiens
cttttatcaaataaa

SEQ ID NO: 287505 - DNA, 15 bp, Homo sapiens
gcttttatcaaataa

SEQ ID NO: 287506 - DNA, 15 bp, Homo sapiens
tgcttttatcaaata

SEQ ID NO: 287507 - DNA, 15 bp, Homo sapiens
ttgcttttatcaaat

SEQ ID NO: 287508 - DNA, 15 bp, Homo sapiens
cttgcttttatcaaa

SEQ ID NO: 287509 - DNA, 15 bp, Homo sapiens
tcttgcttttatcaa

SEQ ID NO: 287510 - DNA, 15 bp, Homo sapiens
ttcttgcttttatca

SEQ ID NO: 287511 - DNA, 15 bp, Homo sapiens
cttcttgcttttatc

SEQ ID NO: 287512 - DNA, 15 bp, Homo sapiens
ccttcttgcttttat

SEQ ID NO: 287513 - DNA, 15 bp, Homo sapiens
accttcttgctttta

SEQ ID NO: 287514 - DNA, 15 bp, Homo sapiens
gaccttcttgctttt

SEQ ID NO: 287515 - DNA, 15 bp, Homo sapiens
tgaccttcttgcttt

SEQ ID NO: 287516 - DNA, 15 bp, Homo sapiens
ctgaccttcttgctt

SEQ ID NO: 287517 - DNA, 15 bp, Homo sapiens
cctgaccttcttgct

SEQ ID NO: 287518 - DNA, 15 bp, Homo sapiens
acctgaccttcttgc

SEQ ID NO: 287519 - DNA, 15 bp, Homo sapiens
aacctgaccttcttg

SEQ ID NO: 287520 - DNA, 15 bp, Homo sapiens
taacctgaccttctt

SEQ ID NO: 287521 - DNA, 15 bp, Homo sapiens
ctaacctgaccttct

SEQ ID NO: 287522 - DNA, 15 bp, Homo sapiens
cctaacctgaccttc

SEQ ID NO: 287523 - DNA, 15 bp, Homo sapiens
acctaacctgacctt

SEQ ID NO: 287524 - DNA, 15 bp, Homo sapiens
tacctaacctgacct

SEQ ID NO: 287525 - DNA, 15 bp, Homo sapiens
gtacctaacctgacc

SEQ ID NO: 287526 - DNA, 15 bp, Homo sapiens
agtacctaacctgac

SEQ ID NO: 287527 - DNA, 15 bp, Homo sapiens
aagtacctaacctga

SEQ ID NO: 287528 - DNA, 15 bp, Homo sapiens
taagtacctaacctg

SEQ ID NO: 287529 - DNA, 15 bp, Homo sapiens
ataagtacctaacct

SEQ ID NO: 287530 - DNA, 15 bp, Homo sapiens
aataagtacctaacc

SEQ ID NO: 287531 - DNA, 15 bp, Homo sapiens
taataagtacctaac

SEQ ID NO: 287532 - DNA, 15 bp, Homo sapiens
ataataagtacctaa

SEQ ID NO: 287533 - DNA, 15 bp, Homo sapiens
aataataagtaccta

SEQ ID NO: 287534 - DNA, 15 bp, Homo sapiens
taataataagtacct

SEQ ID NO: 287535 - DNA, 15 bp, Homo sapiens
ataataataagtacc

SEQ ID NO: 287536 - DNA, 15 bp, Homo sapiens
tataataataagtac

SEQ ID NO: 287537 - DNA, 15 bp, Homo sapiens
atataataataagta

SEQ ID NO: 287538 - DNA, 15 bp, Homo sapiens
aatataataataagt

SEQ ID NO: 287539 - DNA, 15 bp, Homo sapiens
caatataataataag

SEQ ID NO: 287540 - DNA, 15 bp, Homo sapiens
acaatataataataa

SEQ ID NO: 287541 - DNA, 15 bp, Homo sapiens
cacaatataataata

SEQ ID NO: 287542 - DNA, 15 bp, Homo sapiens
ccacaatataataat

SEQ ID NO: 287543 - DNA, 15 bp, Homo sapiens
gccacaatataataa

SEQ ID NO: 287544 - DNA, 15 bp, Homo sapiens
ggccacaatataata

SEQ ID NO: 287545 - DNA, 15 bp, Homo sapiens
aggccacaatataat

SEQ ID NO: 287546 - DNA, 15 bp, Homo sapiens
aaggccacaatataa

SEQ ID NO: 287547 - DNA, 15 bp, Homo sapiens
taaggccacaatata

SEQ ID NO: 287548 - DNA, 15 bp, Homo sapiens
ttaaggccacaatat

SEQ ID NO: 287549 - DNA, 15 bp, Homo sapiens
gttaaggccacaata

SEQ ID NO: 287550 - DNA, 15 bp, Homo sapiens
ggttaaggccacaat

SEQ ID NO: 287551 - DNA, 15 bp, Homo sapiens
tggttaaggccacaa

SEQ ID NO: 287552 - DNA, 15 bp, Homo sapiens
ttggttaaggccaca

SEQ ID NO: 287553 - DNA, 15 bp, Homo sapiens
tttggttaaggccac

SEQ ID NO: 287554 - DNA, 15 bp, Homo sapiens
ctttggttaaggcca

SEQ ID NO: 287555 - DNA, 15 bp, Homo sapiens
actttggttaaggcc

SEQ ID NO: 287556 - DNA, 15 bp, Homo sapiens
tactttggttaaggc

SEQ ID NO: 287557 - DNA, 15 bp, Homo sapiens
atactttggttaagg

SEQ ID NO: 287558 - DNA, 15 bp, Homo sapiens
tatactttggttaag

SEQ ID NO: 287559 - DNA, 15 bp, Homo sapiens
atatactttggttaa

SEQ ID NO: 287560 - DNA, 15 bp, Homo sapiens
catatactttggtta

SEQ ID NO: 287561 - DNA, 15 bp, Homo sapiens
tcatatactttggtt

SEQ ID NO: 287562 - DNA, 15 bp, Homo sapiens
gtcatatactttggt

SEQ ID NO: 287563 - DNA, 15 bp, Homo sapiens
ggtcatatactttgg

SEQ ID NO: 287564 - DNA, 15 bp, Homo sapiens
aggtcatatactttg

SEQ ID NO: 287565 - DNA, 15 bp, Homo sapiens
aaggtcatatacttt

SEQ ID NO: 287566 - DNA, 15 bp, Homo sapiens
aaaggtcatatactt

SEQ ID NO: 287567 - DNA, 15 bp, Homo sapiens
taaaggtcatatact

SEQ ID NO: 287568 - DNA, 15 bp, Homo sapiens
ataaaggtcatatac

SEQ ID NO: 287569 - DNA, 15 bp, Homo sapiens
aataaaggtcatata

SEQ ID NO: 287570 - DNA, 15 bp, Homo sapiens
aaataaaggtcatat

SEQ ID NO: 287571 - DNA, 15 bp, Homo sapiens
taaataaaggtcata

SEQ ID NO: 287572 - DNA, 15 bp, Homo sapiens
ttaaataaaggtcat

SEQ ID NO: 287573 - DNA, 15 bp, Homo sapiens
tttaaataaaggtca

SEQ ID NO: 287574 - DNA, 15 bp, Homo sapiens
atttaaataaaggtc

SEQ ID NO: 287575 - DNA, 15 bp, Homo sapiens
tatttaaataaaggt

SEQ ID NO: 287576 - DNA, 15 bp, Homo sapiens
atatttaaataaagg

SEQ ID NO: 287577 - DNA, 15 bp, Homo sapiens
tatatttaaataaag

SEQ ID NO: 287578 - DNA, 15 bp, Homo sapiens
atatatttaaataaa

SEQ ID NO: 287579 - DNA, 15 bp, Homo sapiens
tatatatttaaataa

SEQ ID NO: 287580 - DNA, 15 bp, Homo sapiens
atatatatttaaata

SEQ ID NO: 287581 - DNA, 15 bp, Homo sapiens
tatatatatttaaat

SEQ ID NO: 287582 - DNA, 15 bp, Homo sapiens
atatatatatttaaa

SEQ ID NO: 287583 - DNA, 15 bp, Homo sapiens
tatatatatatttaa

SEQ ID NO: 287584 - DNA, 15 bp, Homo sapiens
gtatatatatattta

SEQ ID NO: 287585 - DNA, 15 bp, Homo sapiens
agtatatatatattt

SEQ ID NO: 287586 - DNA, 15 bp, Homo sapiens
gagtatatatatatt

SEQ ID NO: 287587 - DNA, 15 bp, Homo sapiens
tgagtatatatatat

SEQ ID NO: 287588 - DNA, 15 bp, Homo sapiens
gtgagtatatatata

SEQ ID NO: 287589 - DNA, 15 bp, Homo sapiens
tgtgagtatatatat

SEQ ID NO: 287590 - DNA, 15 bp, Homo sapiens
atgtgagtatatata

SEQ ID NO: 287591 - DNA, 15 bp, Homo sapiens
tatgtgagtatatat

SEQ ID NO: 287592 - DNA, 15 bp, Homo sapiens
gtatgtgagtatata

SEQ ID NO: 287593 - DNA, 15 bp, Homo sapiens
tgtatgtgagtatat

SEQ ID NO: 287594 - DNA, 15 bp, Homo sapiens
gtgtatgtgagtata

SEQ ID NO: 287595 - DNA, 15 bp, Homo sapiens
tgtgtatgtgagtat

SEQ ID NO: 287596 - DNA, 15 bp, Homo sapiens
gtgtgtatgtgagta

SEQ ID NO: 287597 - DNA, 15 bp, Homo sapiens
tgtgtgtatgtgagt

SEQ ID NO: 287598 - DNA, 15 bp, Homo sapiens
atgtgtgtatgtgag

SEQ ID NO: 287599 - DNA, 15 bp, Homo sapiens
catgtgtgtatgtga

SEQ ID NO: 287600 - DNA, 15 bp, Homo sapiens
acatgtgtgtatgtg

SEQ ID NO: 287601 - DNA, 15 bp, Homo sapiens
aacatgtgtgtatgt

SEQ ID NO: 287602 - DNA, 15 bp, Homo sapiens
gaacatgtgtgtatg

SEQ ID NO: 287603 - DNA, 15 bp, Homo sapiens
tgaacatgtgtgtat

SEQ ID NO: 287604 - DNA, 15 bp, Homo sapiens
atgaacatgtgtgta

SEQ ID NO: 287605 - DNA, 15 bp, Homo sapiens
tatgaacatgtgtgt

SEQ ID NO: 287606 - DNA, 15 bp, Homo sapiens
atatgaacatgtgtg

SEQ ID NO: 287607 - DNA, 15 bp, Homo sapiens
gatatgaacatgtgt

SEQ ID NO: 287608 - DNA, 15 bp, Homo sapiens
agatatgaacatgtg

SEQ ID NO: 287609 - DNA, 15 bp, Homo sapiens
tagatatgaacatgt

SEQ ID NO: 287610 - DNA, 15 bp, Homo sapiens
atagatatgaacatg

SEQ ID NO: 287611 - DNA, 15 bp, Homo sapiens
tatagatatgaacat

SEQ ID NO: 287612 - DNA, 15 bp, Homo sapiens
atatagatatgaaca

SEQ ID NO: 287613 - DNA, 15 bp, Homo sapiens
gatatagatatgaac

SEQ ID NO: 287614 - DNA, 15 bp, Homo sapiens
agatatagatatgaa

SEQ ID NO: 287615 - DNA, 15 bp, Homo sapiens
tagatatagatatga

SEQ ID NO: 287616 - DNA, 15 bp, Homo sapiens
atagatatagatatg

SEQ ID NO: 287617 - DNA, 15 bp, Homo sapiens
tatagatatagatat

SEQ ID NO: 287618 - DNA, 15 bp, Homo sapiens
atatagatatagata

SEQ ID NO: 287619 - DNA, 15 bp, Homo sapiens
tatatagatatagat

SEQ ID NO: 287620 - DNA, 15 bp, Homo sapiens
atatatagatataga

SEQ ID NO: 287621 - DNA, 15 bp, Homo sapiens
aatatatagatatag

SEQ ID NO: 287622 - DNA, 15 bp, Homo sapiens
aaatatatagatata

SEQ ID NO: 287623 - DNA, 15 bp, Homo sapiens
gaaatatatagatat

SEQ ID NO: 287624 - DNA, 15 bp, Homo sapiens
agaaatatatagata

SEQ ID NO: 287625 - DNA, 15 bp, Homo sapiens
tagaaatatatagat

SEQ ID NO: 287626 - DNA, 15 bp, Homo sapiens
ctagaaatatataga

SEQ ID NO: 287627 - DNA, 15 bp, Homo sapiens
tctagaaatatatag

SEQ ID NO: 287628 - DNA, 15 bp, Homo sapiens
ctctagaaatatata

SEQ ID NO: 287629 - DNA, 15 bp, Homo sapiens
ccctctagaaatata

SEQ ID NO: 287630 - DNA, 15 bp, Homo sapiens
tccctctagaaatat

SEQ ID NO: 287631 - DNA, 15 bp, Homo sapiens
ctccctctagaaata

SEQ ID NO: 287632 - DNA, 15 bp, Homo sapiens
tctccctctagaaat

SEQ ID NO: 287633 - DNA, 15 bp, Homo sapiens
ctctccctctagaaa

SEQ ID NO: 287634 - DNA, 15 bp, Homo sapiens
tctctccctctagaa

SEQ ID NO: 287635 - DNA, 15 bp, Homo sapiens
ttctctccctctaga

SEQ ID NO: 287636 - DNA, 15 bp, Homo sapiens
tttctctccctctag

SEQ ID NO: 287637 - DNA, 15 bp, Homo sapiens
ttttctctccctcta

SEQ ID NO: 287638 - DNA, 15 bp, Homo sapiens
tttttctctccctct

SEQ ID NO: 287639 - DNA, 15 bp, Homo sapiens
ctttttctctccctc

SEQ ID NO: 287640 - DNA, 15 bp, Homo sapiens
ctctttttctctccc

SEQ ID NO: 287641 - DNA, 15 bp, Homo sapiens
tctctttttctctcc

SEQ ID NO: 287642 - DNA, 15 bp, Homo sapiens
ctctctttttctctc

SEQ ID NO: 287643 - DNA, 15 bp, Homo sapiens
cctctctttttctct

SEQ ID NO: 287644 - DNA, 15 bp, Homo sapiens
ccctctctttttctc

SEQ ID NO: 287645 - DNA, 15 bp, Homo sapiens
cccctctctttttct

SEQ ID NO: 287646 - DNA, 15 bp, Homo sapiens
ccccctctctttttc

SEQ ID NO: 287647 - DNA, 15 bp, Homo sapiens
accccctctcttttt

SEQ ID NO: 287648 - DNA, 15 bp, Homo sapiens
aaccccctctctttt

SEQ ID NO: 287649 - DNA, 15 bp, Homo sapiens
aaaccccctctcttt

SEQ ID NO: 287650 - DNA, 15 bp, Homo sapiens
taaaccccctctctt

SEQ ID NO: 287651 - DNA, 15 bp, Homo sapiens
ataaaccccctctct

SEQ ID NO: 287652 - DNA, 15 bp, Homo sapiens
aataaaccccctctc

SEQ ID NO: 287653 - DNA, 15 bp, Homo sapiens
caataaaccccctct

SEQ ID NO: 287654 - DNA, 15 bp, Homo sapiens
tcaataaaccccctc

SEQ ID NO: 287655 - DNA, 15 bp, Homo sapiens
atcaataaaccccct

SEQ ID NO: 287656 - DNA, 15 bp, Homo sapiens
catcaataaaccccc

SEQ ID NO: 287657 - DNA, 15 bp, Homo sapiens
tcatcaataaacccc

SEQ ID NO: 287658 - DNA, 15 bp, Homo sapiens
ttcatcaataaaccc

SEQ ID NO: 287659 - DNA, 15 bp, Homo sapiens
cttcatcaataaacc

SEQ ID NO: 287660 - DNA, 15 bp, Homo sapiens
tcttcatcaataaac

SEQ ID NO: 287661 - DNA, 15 bp, Homo sapiens
ttcttcatcaataaa

SEQ ID NO: 287662 - DNA, 15 bp, Homo sapiens
tttcttcatcaataa

SEQ ID NO: 287663 - DNA, 15 bp, Homo sapiens
ctttcttcatcaata

SEQ ID NO: 287664 - DNA, 15 bp, Homo sapiens
gctttcttcatcaat

SEQ ID NO: 287665 - DNA, 15 bp, Homo sapiens
tgctttcttcatcaa

SEQ ID NO: 287666 - DNA, 15 bp, Homo sapiens
ttgctttcttcatca

SEQ ID NO: 287667 - DNA, 15 bp, Homo sapiens
tttgctttcttcatc

SEQ ID NO: 287668 - DNA, 15 bp, Homo sapiens
ttttgctttcttcat

SEQ ID NO: 287669 - DNA, 15 bp, Homo sapiens
attttgctttcttca

SEQ ID NO: 287670 - DNA, 15 bp, Homo sapiens
tattttgctttcttc

SEQ ID NO: 287671 - DNA, 15 bp, Homo sapiens
ttattttgctttctt

SEQ ID NO: 287672 - DNA, 15 bp, Homo sapiens
tttattttgctttct

SEQ ID NO: 287673 - DNA, 15 bp, Homo sapiens
atttattttgctttc

SEQ ID NO: 287674 - DNA, 15 bp, Homo sapiens
gatttattttgcttt

SEQ ID NO: 287675 - DNA, 15 bp, Homo sapiens
ttgatttattttgct

SEQ ID NO: 287676 - DNA, 15 bp, Homo sapiens
gttgatttattttgc

SEQ ID NO: 287677 - DNA, 15 bp, Homo sapiens
tgttgatttattttg

SEQ ID NO: 287678 - DNA, 15 bp, Homo sapiens
ttgttgatttatttt

SEQ ID NO: 287679 - DNA, 15 bp, Homo sapiens
cttgttgatttattt

SEQ ID NO: 287680 - DNA, 15 bp, Homo sapiens
acttgttgatttatt

SEQ ID NO: 287681 - DNA, 15 bp, Homo sapiens
cacttgttgatttat

SEQ ID NO: 287682 - DNA, 15 bp, Homo sapiens
ccacttgttgattta

SEQ ID NO: 287683 - DNA, 15 bp, Homo sapiens
gccacttgttgattt

SEQ ID NO: 287684 - DNA, 15 bp, Homo sapiens
tgccacttgttgatt

SEQ ID NO: 287685 - DNA, 15 bp, Homo sapiens
gtgccacttgttgat

SEQ ID NO: 287686 - DNA, 15 bp, Homo sapiens
tgtgccacttgttga

SEQ ID NO: 287687 - DNA, 15 bp, Homo sapiens
atgtgccacttgttg

SEQ ID NO: 287688 - DNA, 15 bp, Homo sapiens
gatgtgccacttgtt

SEQ ID NO: 287689 - DNA, 15 bp, Homo sapiens
agatgtgccacttgt

SEQ ID NO: 287690 - DNA, 15 bp, Homo sapiens
cagatgtgccacttg

SEQ ID NO: 287691 - DNA, 15 bp, Homo sapiens
tcagatgtgccactt

SEQ ID NO: 287692 - DNA, 15 bp, Homo sapiens
ttcagatgtgccact

SEQ ID NO: 287693 - DNA, 15 bp, Homo sapiens
gttcagatgtgccac

SEQ ID NO: 287694 - DNA, 15 bp, Homo sapiens
agttcagatgtgcca

SEQ ID NO: 287695 - DNA, 15 bp, Homo sapiens
aagttcagatgtgcc

SEQ ID NO: 287696 - DNA, 15 bp, Homo sapiens
aaagttcagatgtgc

SEQ ID NO: 287697 - DNA, 15 bp, Homo sapiens
aaaagttcagatgtg

SEQ ID NO: 287698 - DNA, 15 bp, Homo sapiens
caaaagttcagatgt

SEQ ID NO: 287699 - DNA, 15 bp, Homo sapiens
gcaaaagttcagatg

SEQ ID NO: 287700 - DNA, 15 bp, Homo sapiens
agcaaaagttcagat

SEQ ID NO: 287701 - DNA, 15 bp, Homo sapiens
aagcaaaagttcaga

SEQ ID NO: 287702 - DNA, 15 bp, Homo sapiens
aaagcaaaagttcag

SEQ ID NO: 287703 - DNA, 15 bp, Homo sapiens
caaagcaaaagttca

SEQ ID NO: 287704 - DNA, 15 bp, Homo sapiens
ccaaagcaaaagttc

SEQ ID NO: 287705 - DNA, 15 bp, Homo sapiens
gccaaagcaaaagtt

SEQ ID NO: 287706 - DNA, 15 bp, Homo sapiens
agccaaagcaaaagt

SEQ ID NO: 287707 - DNA, 15 bp, Homo sapiens
cagccaaagcaaaag

SEQ ID NO: 287708 - DNA, 15 bp, Homo sapiens
acagccaaagcaaaa

SEQ ID NO: 287709 - DNA, 15 bp, Homo sapiens
aacagccaaagcaaa

SEQ ID NO: 287710 - DNA, 15 bp, Homo sapiens
aaacagccaaagcaa

SEQ ID NO: 287711 - DNA, 15 bp, Homo sapiens
caaacagccaaagca

SEQ ID NO: 287712 - DNA, 15 bp, Homo sapiens
tcaaacagccaaagc

SEQ ID NO: 287713 - DNA, 15 bp, Homo sapiens
gtcaaacagccaaag

SEQ ID NO: 287714 - DNA, 15 bp, Homo sapiens
tgtcaaacagccaaa

SEQ ID NO: 287715 - DNA, 15 bp, Homo sapiens
ttgtcaaacagccaa

SEQ ID NO: 287716 - DNA, 15 bp, Homo sapiens
cttgtcaaacagcca

SEQ ID NO: 287717 - DNA, 15 bp, Homo sapiens
gcttgtcaaacagcc

SEQ ID NO: 287718 - DNA, 15 bp, Homo sapiens
tgcttgtcaaacagc

SEQ ID NO: 287719 - DNA, 15 bp, Homo sapiens
atgcttgtcaaacag

SEQ ID NO: 287720 - DNA, 15 bp, Homo sapiens
tatgcttgtcaaaca

SEQ ID NO: 287721 - DNA, 15 bp, Homo sapiens
ttatgcttgtcaaac

SEQ ID NO: 287722 - DNA, 15 bp, Homo sapiens
attatgcttgtcaaa

SEQ ID NO: 287723 - DNA, 15 bp, Homo sapiens
tattatgcttgtcaa

SEQ ID NO: 287724 - DNA, 15 bp, Homo sapiens
gtattatgcttgtca

SEQ ID NO: 287725 - DNA, 15 bp, Homo sapiens
ggtattatgcttgtc

SEQ ID NO: 287726 - DNA, 15 bp, Homo sapiens
tggtattatgcttgt

SEQ ID NO: 287727 - DNA, 15 bp, Homo sapiens
ctggtattatgcttg

SEQ ID NO: 287728 - DNA, 15 bp, Homo sapiens
tctggtattatgctt

SEQ ID NO: 287729 - DNA, 15 bp, Homo sapiens
ttctggtattatgct

SEQ ID NO: 287730 - DNA, 15 bp, Homo sapiens
gttctggtattatgc

SEQ ID NO: 287731 - DNA, 15 bp, Homo sapiens
cgttctggtattatg

SEQ ID NO: 287732 - DNA, 15 bp, Homo sapiens
acgttctggtattat

SEQ ID NO: 287733 - DNA, 15 bp, Homo sapiens
aacgttctggtatta

SEQ ID NO: 287734 - DNA, 15 bp, Homo sapiens
gaacgttctggtatt

SEQ ID NO: 287735 - DNA, 15 bp, Homo sapiens
tgaacgttctggtat

SEQ ID NO: 287736 - DNA, 15 bp, Homo sapiens
ctgaacgttctggta

SEQ ID NO: 287737 - DNA, 15 bp, Homo sapiens
actgaacgttctggt

SEQ ID NO: 287738 - DNA, 15 bp, Homo sapiens
aactgaacgttctgg

SEQ ID NO: 287739 - DNA, 15 bp, Homo sapiens
aaactgaacgttctg

SEQ ID NO: 287740 - DNA, 15 bp, Homo sapiens
aaaactgaacgttct

SEQ ID NO: 287741 - DNA, 15 bp, Homo sapiens
gaaaactgaacgttc

SEQ ID NO: 287742 - DNA, 15 bp, Homo sapiens
agaaaactgaacgtt

SEQ ID NO: 287743 - DNA, 15 bp, Homo sapiens
gagaaaactgaacgt

SEQ ID NO: 287744 - DNA, 15 bp, Homo sapiens
tgagaaaactgaacg

SEQ ID NO: 287745 - DNA, 15 bp, Homo sapiens
ttgagaaaactgaac

SEQ ID NO: 287746 - DNA, 15 bp, Homo sapiens
attgagaaaactgaa

SEQ ID NO: 287747 - DNA, 15 bp, Homo sapiens
aattgagaaaactga

SEQ ID NO: 287748 - DNA, 15 bp, Homo sapiens
caattgagaaaactg

SEQ ID NO: 287749 - DNA, 15 bp, Homo sapiens
gcaattgagaaaact

SEQ ID NO: 287750 - DNA, 15 bp, Homo sapiens
agcaattgagaaaac

SEQ ID NO: 287751 - DNA, 15 bp, Homo sapiens
aagcaattgagaaaa

SEQ ID NO: 287752 - DNA, 15 bp, Homo sapiens
gaagcaattgagaaa

SEQ ID NO: 287753 - DNA, 15 bp, Homo sapiens
tgaagcaattgagaa

SEQ ID NO: 287754 - DNA, 15 bp, Homo sapiens
atgaagcaattgaga

SEQ ID NO: 287755 - DNA, 15 bp, Homo sapiens
gatgaagcaattgag

SEQ ID NO: 287756 - DNA, 15 bp, Homo sapiens
agatgaagcaattga

SEQ ID NO: 287757 - DNA, 15 bp, Homo sapiens
tagatgaagcaattg

SEQ ID NO: 287758 - DNA, 15 bp, Homo sapiens
ctagatgaagcaatt

SEQ ID NO: 287759 - DNA, 15 bp, Homo sapiens
gctagatgaagcaat

SEQ ID NO: 287760 - DNA, 15 bp, Homo sapiens
agctagatgaagcaa

SEQ ID NO: 287761 - DNA, 15 bp, Homo sapiens
gagctagatgaagca

SEQ ID NO: 287762 - DNA, 15 bp, Homo sapiens
agagctagatgaagc

SEQ ID NO: 287763 - DNA, 15 bp, Homo sapiens
gagagctagatgaag

SEQ ID NO: 287764 - DNA, 15 bp, Homo sapiens
agagagctagatgaa

SEQ ID NO: 287765 - DNA, 15 bp, Homo sapiens
cagagagctagatga

SEQ ID NO: 287766 - DNA, 15 bp, Homo sapiens
tcagagagctagatg

SEQ ID NO: 287767 - DNA, 15 bp, Homo sapiens
atcagagagctagat

SEQ ID NO: 287768 - DNA, 15 bp, Homo sapiens
gatcagagagctaga

SEQ ID NO: 287769 - DNA, 15 bp, Homo sapiens
agatcagagagctag

SEQ ID NO: 287770 - DNA, 15 bp, Homo sapiens
gagatcagagagcta

SEQ ID NO: 287771 - DNA, 15 bp, Homo sapiens
tgagatcagagagct

SEQ ID NO: 287772 - DNA, 15 bp, Homo sapiens
ttgagatcagagagc

SEQ ID NO: 287773 - DNA, 15 bp, Homo sapiens
attgagatcagagag

SEQ ID NO: 287774 - DNA, 15 bp, Homo sapiens
cattgagatcagaga

SEQ ID NO: 287775 - DNA, 15 bp, Homo sapiens
gcattgagatcagag

SEQ ID NO: 287776 - DNA, 15 bp, Homo sapiens
agcattgagatcaga

SEQ ID NO: 287777 - DNA, 15 bp, Homo sapiens
aagcattgagatcag

SEQ ID NO: 287778 - DNA, 15 bp, Homo sapiens
taagcattgagatca

SEQ ID NO: 287779 - DNA, 15 bp, Homo sapiens
ctaagcattgagatc

SEQ ID NO: 287780 - DNA, 15 bp, Homo sapiens
cctaagcattgagat

SEQ ID NO: 287781 - DNA, 15 bp, Homo sapiens
tcctaagcattgaga

SEQ ID NO: 287782 - DNA, 15 bp, Homo sapiens
atcctaagcattgag

SEQ ID NO: 287783 - DNA, 15 bp, Homo sapiens
tatcctaagcattga

SEQ ID NO: 287784 - DNA, 15 bp, Homo sapiens
ttatcctaagcattg

SEQ ID NO: 287785 - DNA, 15 bp, Homo sapiens
tttatcctaagcatt

SEQ ID NO: 287786 - DNA, 15 bp, Homo sapiens
gtttatcctaagcat

SEQ ID NO: 287787 - DNA, 15 bp, Homo sapiens
ggtttatcctaagca

SEQ ID NO: 287788 - DNA, 15 bp, Homo sapiens
aggtttatcctaagc

SEQ ID NO: 287789 - DNA, 15 bp, Homo sapiens
aaggtttatcctaag

SEQ ID NO: 287790 - DNA, 15 bp, Homo sapiens
aaaggtttatcctaa

SEQ ID NO: 287791 - DNA, 15 bp, Homo sapiens
aaaaggtttatccta

SEQ ID NO: 287792 - DNA, 15 bp, Homo sapiens
gaaaaggtttatcct

SEQ ID NO: 287793 - DNA, 15 bp, Homo sapiens
agaaaaggtttatcc

SEQ ID NO: 287794 - DNA, 15 bp, Homo sapiens
tagaaaaggtttatc

SEQ ID NO: 287795 - DNA, 15 bp, Homo sapiens
ctagaaaaggtttat

SEQ ID NO: 287796 - DNA, 15 bp, Homo sapiens
cctagaaaaggttta

SEQ ID NO: 287797 - DNA, 15 bp, Homo sapiens
tcctagaaaaggttt

SEQ ID NO: 287798 - DNA, 15 bp, Homo sapiens
ttcctagaaaaggtt

SEQ ID NO: 287799 - DNA, 15 bp, Homo sapiens
attcctagaaaaggt

SEQ ID NO: 287800 - DNA, 15 bp, Homo sapiens
aattcctagaaaagg

SEQ ID NO: 287801 - DNA, 15 bp, Homo sapiens
gaattcctagaaaag

SEQ ID NO: 287802 - DNA, 15 bp, Homo sapiens
tgaattcctagaaaa

SEQ ID NO: 287803 - DNA, 15 bp, Homo sapiens
gtgaattcctagaaa

SEQ ID NO: 287804 - DNA, 15 bp, Homo sapiens
ggtgaattcctagaa

SEQ ID NO: 287805 - DNA, 15 bp, Homo sapiens
tggtgaattcctaga

SEQ ID NO: 287806 - DNA, 15 bp, Homo sapiens
ttggtgaattcctag

SEQ ID NO: 287807 - DNA, 15 bp, Homo sapiens
gttggtgaattccta

SEQ ID NO: 287808 - DNA, 15 bp, Homo sapiens
agttggtgaattcct

SEQ ID NO: 287809 - DNA, 15 bp, Homo sapiens
cagttggtgaattcc

SEQ ID NO: 287810 - DNA, 15 bp, Homo sapiens
acagttggtgaattc

SEQ ID NO: 287811 - DNA, 15 bp, Homo sapiens
gacagttggtgaatt

SEQ ID NO: 287812 - DNA, 15 bp, Homo sapiens
agacagttggtgaat

SEQ ID NO: 287813 - DNA, 15 bp, Homo sapiens
cagacagttggtgaa

SEQ ID NO: 287814 - DNA, 15 bp, Homo sapiens
tcagacagttggtga

SEQ ID NO: 287815 - DNA, 15 bp, Homo sapiens
atcagacagttggtg

SEQ ID NO: 287816 - DNA, 15 bp, Homo sapiens
tatcagacagttggt

SEQ ID NO: 287817 - DNA, 15 bp, Homo sapiens
gtatcagacagttgg

SEQ ID NO: 287818 - DNA, 15 bp, Homo sapiens
tgtatcagacagttg

SEQ ID NO: 287819 - DNA, 15 bp, Homo sapiens
ttgtatcagacagtt

SEQ ID NO: 287820 - DNA, 15 bp, Homo sapiens
attgtatcagacagt

SEQ ID NO: 287821 - DNA, 15 bp, Homo sapiens
aattgtatcagacag

SEQ ID NO: 287822 - DNA, 15 bp, Homo sapiens
aaattgtatcagaca

SEQ ID NO: 287823 - DNA, 15 bp, Homo sapiens
gaaattgtatcagac

SEQ ID NO: 287824 - DNA, 15 bp, Homo sapiens
tgaaattgtatcaga

SEQ ID NO: 287825 - DNA, 15 bp, Homo sapiens
ttgaaattgtatcag

SEQ ID NO: 287826 - DNA, 15 bp, Homo sapiens
cttgaaattgtatca

SEQ ID NO: 287827 - DNA, 15 bp, Homo sapiens
acttgaaattgtatc

SEQ ID NO: 287828 - DNA, 15 bp, Homo sapiens
gacttgaaattgtat

SEQ ID NO: 287829 - DNA, 15 bp, Homo sapiens
ggacttgaaattgta

SEQ ID NO: 287830 - DNA, 15 bp, Homo sapiens
gggacttgaaattgt

SEQ ID NO: 287831 - DNA, 15 bp, Homo sapiens
agggacttgaaattg

SEQ ID NO: 287832 - DNA, 15 bp, Homo sapiens
aagggacttgaaatt

SEQ ID NO: 287833 - DNA, 15 bp, Homo sapiens
gaagggacttgaaat

SEQ ID NO: 287834 - DNA, 15 bp, Homo sapiens
ggaagggacttgaaa

SEQ ID NO: 287835 - DNA, 15 bp, Homo sapiens
aggaagggacttgaa

SEQ ID NO: 287836 - DNA, 15 bp, Homo sapiens
aaggaagggacttga

SEQ ID NO: 287837 - DNA, 15 bp, Homo sapiens
caaggaagggacttg

SEQ ID NO: 287838 - DNA, 15 bp, Homo sapiens
acaaggaagggactt

SEQ ID NO: 287839 - DNA, 15 bp, Homo sapiens
aacaaggaagggact

SEQ ID NO: 287840 - DNA, 15 bp, Homo sapiens
taacaaggaagggac

SEQ ID NO: 287841 - DNA, 15 bp, Homo sapiens
ctaacaaggaaggga

SEQ ID NO: 287842 - DNA, 15 bp, Homo sapiens
tctaacaaggaaggg

SEQ ID NO: 287843 - DNA, 15 bp, Homo sapiens
ctctaacaaggaagg

SEQ ID NO: 287844 - DNA, 15 bp, Homo sapiens
actctaacaaggaag

SEQ ID NO: 287845 - DNA, 15 bp, Homo sapiens
tactctaacaaggaa

SEQ ID NO: 287846 - DNA, 15 bp, Homo sapiens
ttactctaacaagga

SEQ ID NO: 287847 - DNA, 15 bp, Homo sapiens
tttactctaacaagg

SEQ ID NO: 287848 - DNA, 15 bp, Homo sapiens
gtttactctaacaag

SEQ ID NO: 287849 - DNA, 15 bp, Homo sapiens
agtttactctaacaa

SEQ ID NO: 287850 - DNA, 15 bp, Homo sapiens
cagtttactctaaca

SEQ ID NO: 287851 - DNA, 15 bp, Homo sapiens
gcagtttactctaac

SEQ ID NO: 287852 - DNA, 15 bp, Homo sapiens
tgcagtttactctaa

SEQ ID NO: 287853 - DNA, 15 bp, Homo sapiens
ctgcagtttactcta

SEQ ID NO: 287854 - DNA, 15 bp, Homo sapiens
actgcagtttactct

SEQ ID NO: 287855 - DNA, 15 bp, Homo sapiens
tactgcagtttactc

SEQ ID NO: 287856 - DNA, 15 bp, Homo sapiens
ttactgcagtttact

SEQ ID NO: 287857 - DNA, 15 bp, Homo sapiens
gttactgcagtttac

SEQ ID NO: 287858 - DNA, 15 bp, Homo sapiens
tgttactgcagttta

SEQ ID NO: 287859 - DNA, 15 bp, Homo sapiens
gtgttactgcagttt

SEQ ID NO: 287860 - DNA, 15 bp, Homo sapiens
ggtgttactgcagtt

SEQ ID NO: 287861 - DNA, 15 bp, Homo sapiens
tggtgttactgcagt

SEQ ID NO: 287862 - DNA, 15 bp, Homo sapiens
ttggtgttactgcag

SEQ ID NO: 287863 - DNA, 15 bp, Homo sapiens
cttggtgttactgca

SEQ ID NO: 287864 - DNA, 15 bp, Homo sapiens
tcttggtgttactgc

SEQ ID NO: 287865 - DNA, 15 bp, Homo sapiens
atcttggtgttactg

SEQ ID NO: 287866 - DNA, 15 bp, Homo sapiens
catcttggtgttact

SEQ ID NO: 287867 - DNA, 15 bp, Homo sapiens
tcatcttggtgttac

SEQ ID NO: 287868 - DNA, 15 bp, Homo sapiens
ttcatcttggtgtta

SEQ ID NO: 287869 - DNA, 15 bp, Homo sapiens
attcatcttggtgtt

SEQ ID NO: 287870 - DNA, 15 bp, Homo sapiens
aattcatcttggtgt

SEQ ID NO: 287871 - DNA, 15 bp, Homo sapiens
aaattcatcttggtg

SEQ ID NO: 287872 - DNA, 15 bp, Homo sapiens
aaaattcatcttggt

SEQ ID NO: 287873 - DNA, 15 bp, Homo sapiens
gaaaattcatcttgg

SEQ ID NO: 287874 - DNA, 15 bp, Homo sapiens
tgaaaattcatcttg

SEQ ID NO: 287875 - DNA, 15 bp, Homo sapiens
ttgaaaattcatctt

SEQ ID NO: 287876 - DNA, 15 bp, Homo sapiens
tttgaaaattcatct

SEQ ID NO: 287877 - DNA, 15 bp, Homo sapiens
gtttgaaaattcatc

SEQ ID NO: 287878 - DNA, 15 bp, Homo sapiens
ggtttgaaaattcat

SEQ ID NO: 287879 - DNA, 15 bp, Homo sapiens
tggtttgaaaattca

SEQ ID NO: 287880 - DNA, 15 bp, Homo sapiens
ctggtttgaaaattc

SEQ ID NO: 287881 - DNA, 15 bp, Homo sapiens
tctggtttgaaaatt

SEQ ID NO: 287882 - DNA, 15 bp, Homo sapiens
ttctggtttgaaaat

SEQ ID NO: 287883 - DNA, 15 bp, Homo sapiens
attctggtttgaaaa

SEQ ID NO: 287884 - DNA, 15 bp, Homo sapiens
aattctggtttgaaa

SEQ ID NO: 287885 - DNA, 15 bp, Homo sapiens
taattctggtttgaa

SEQ ID NO: 287886 - DNA, 15 bp, Homo sapiens
gtaattctggtttga

SEQ ID NO: 287887 - DNA, 15 bp, Homo sapiens
tgtaattctggtttg

SEQ ID NO: 287888 - DNA, 15 bp, Homo sapiens
ttgtaattctggttt

SEQ ID NO: 287889 - DNA, 15 bp, Homo sapiens
cttgtaattctggtt

SEQ ID NO: 287890 - DNA, 15 bp, Homo sapiens
acttgtaattctggt

SEQ ID NO: 287891 - DNA, 15 bp, Homo sapiens
tacttgtaattctgg

SEQ ID NO: 287892 - DNA, 15 bp, Homo sapiens
gtacttgtaattctg

SEQ ID NO: 287893 - DNA, 15 bp, Homo sapiens
ggtacttgtaattct

SEQ ID NO: 287894 - DNA, 15 bp, Homo sapiens
tggtacttgtaattc

SEQ ID NO: 287895 - DNA, 15 bp, Homo sapiens
ctggtacttgtaatt

SEQ ID NO: 287896 - DNA, 15 bp, Homo sapiens
tctggtacttgtaat

SEQ ID NO: 287897 - DNA, 15 bp, Homo sapiens
ctctggtacttgtaa

SEQ ID NO: 287898 - DNA, 15 bp, Homo sapiens
cctctggtacttgta

SEQ ID NO: 287899 - DNA, 15 bp, Homo sapiens
acctctggtacttgt

SEQ ID NO: 287900 - DNA, 15 bp, Homo sapiens
gacctctggtacttg

SEQ ID NO: 287901 - DNA, 15 bp, Homo sapiens
agacctctggtactt

SEQ ID NO: 287902 - DNA, 15 bp, Homo sapiens
aagacctctggtact

SEQ ID NO: 287903 - DNA, 15 bp, Homo sapiens
gaagacctctggtac

SEQ ID NO: 287904 - DNA, 15 bp, Homo sapiens
ggaagacctctggta

SEQ ID NO: 287905 - DNA, 15 bp, Homo sapiens
gggaagacctctggt

SEQ ID NO: 287906 - DNA, 15 bp, Homo sapiens
ggggaagacctctgg

SEQ ID NO: 287907 - DNA, 15 bp, Homo sapiens
tggggaagacctctg

SEQ ID NO: 287908 - DNA, 15 bp, Homo sapiens
ctggggaagacctct

SEQ ID NO: 287909 - DNA, 15 bp, Homo sapiens
gctggggaagacctc

SEQ ID NO: 287910 - DNA, 15 bp, Homo sapiens
tgctggggaagacct

SEQ ID NO: 287911 - DNA, 15 bp, Homo sapiens
atgctggggaagacc

SEQ ID NO: 287912 - DNA, 15 bp, Homo sapiens
gatgctggggaagac

SEQ ID NO: 287913 - DNA, 15 bp, Homo sapiens
tgatgctggggaaga

SEQ ID NO: 287914 - DNA, 15 bp, Homo sapiens
ttgatgctggggaag

SEQ ID NO: 287915 - DNA, 15 bp, Homo sapiens
cttgatgctggggaa

SEQ ID NO: 287916 - DNA, 15 bp, Homo sapiens
acttgatgctgggga

SEQ ID NO: 287917 - DNA, 15 bp, Homo sapiens
cacttgatgctgggg

SEQ ID NO: 287918 - DNA, 15 bp, Homo sapiens
acacttgatgctggg

SEQ ID NO: 287919 - DNA, 15 bp, Homo sapiens
aacacttgatgctgg

SEQ ID NO: 287920 - DNA, 15 bp, Homo sapiens
taacacttgatgctg

SEQ ID NO: 287921 - DNA, 15 bp, Homo sapiens
gtaacacttgatgct

SEQ ID NO: 287922 - DNA, 15 bp, Homo sapiens
agtaacacttgatgc

SEQ ID NO: 287923 - DNA, 15 bp, Homo sapiens
gagtaacacttgatg

SEQ ID NO: 287924 - DNA, 15 bp, Homo sapiens
tgagtaacacttgat

SEQ ID NO: 287925 - DNA, 15 bp, Homo sapiens
atgagtaacacttga

SEQ ID NO: 287926 - DNA, 15 bp, Homo sapiens
gatgagtaacacttg

SEQ ID NO: 287927 - DNA, 15 bp, Homo sapiens
tgatgagtaacactt

SEQ ID NO: 287928 - DNA, 15 bp, Homo sapiens
ctgatgagtaacact

SEQ ID NO: 287929 - DNA, 15 bp, Homo sapiens
gctgatgagtaacac

SEQ ID NO: 287930 - DNA, 15 bp, Homo sapiens
agctgatgagtaaca

SEQ ID NO: 287931 - DNA, 15 bp, Homo sapiens
gagctgatgagtaac

SEQ ID NO: 287932 - DNA, 15 bp, Homo sapiens
tgagctgatgagtaa

SEQ ID NO: 287933 - DNA, 15 bp, Homo sapiens
ttgagctgatgagta

SEQ ID NO: 287934 - DNA, 15 bp, Homo sapiens
cttgagctgatgagt

SEQ ID NO: 287935 - DNA, 15 bp, Homo sapiens
ccttgagctgatgag

SEQ ID NO: 287936 - DNA, 15 bp, Homo sapiens
cccttgagctgatga

SEQ ID NO: 287937 - DNA, 15 bp, Homo sapiens
gcccttgagctgatg

SEQ ID NO: 287938 - DNA, 15 bp, Homo sapiens
tgcccttgagctgat

SEQ ID NO: 287939 - DNA, 15 bp, Homo sapiens
gtgcccttgagctga

SEQ ID NO: 287940 - DNA, 15 bp, Homo sapiens
tgtgcccttgagctg

SEQ ID NO: 287941 - DNA, 15 bp, Homo sapiens
ctgtgcccttgagct

SEQ ID NO: 287942 - DNA, 15 bp, Homo sapiens
cctgtgcccttgagc

SEQ ID NO: 287943 - DNA, 15 bp, Homo sapiens
acctgtgcccttgag

SEQ ID NO: 287944 - DNA, 15 bp, Homo sapiens
tacctgtgcccttga

SEQ ID NO: 287945 - DNA, 15 bp, Homo sapiens
ttacctgtgcccttg

SEQ ID NO: 287946 - DNA, 15 bp, Homo sapiens
attacctgtgccctt

SEQ ID NO: 287947 - DNA, 15 bp, Homo sapiens
gattacctgtgccct

SEQ ID NO: 287948 - DNA, 15 bp, Homo sapiens
agattacctgtgccc

SEQ ID NO: 287949 - DNA, 15 bp, Homo sapiens
gagattacctgtgcc

SEQ ID NO: 287950 - DNA, 15 bp, Homo sapiens
tgagattacctgtgc

SEQ ID NO: 287951 - DNA, 15 bp, Homo sapiens
ttgagattacctgtg

SEQ ID NO: 287952 - DNA, 15 bp, Homo sapiens
cttgagattacctgt

SEQ ID NO: 287953 - DNA, 15 bp, Homo sapiens
ccttgagattacctg

SEQ ID NO: 287954 - DNA, 15 bp, Homo sapiens
gccttgagattacct

SEQ ID NO: 287955 - DNA, 15 bp, Homo sapiens
agccttgagattacc

SEQ ID NO: 287956 - DNA, 15 bp, Homo sapiens
gagccttgagattac

SEQ ID NO: 287957 - DNA, 15 bp, Homo sapiens
agagccttgagatta

SEQ ID NO: 287958 - DNA, 15 bp, Homo sapiens
cagagccttgagatt

SEQ ID NO: 287959 - DNA, 15 bp, Homo sapiens
ccagagccttgagat

SEQ ID NO: 287960 - DNA, 15 bp, Homo sapiens
accagagccttgaga

SEQ ID NO: 287961 - DNA, 15 bp, Homo sapiens
caccagagccttgag

SEQ ID NO: 287962 - DNA, 15 bp, Homo sapiens
tcaccagagccttga

SEQ ID NO: 287963 - DNA, 15 bp, Homo sapiens
ttcaccagagccttg

SEQ ID NO: 287964 - DNA, 15 bp, Homo sapiens
cttcaccagagcctt

SEQ ID NO: 287965 - DNA, 15 bp, Homo sapiens
gcttcaccagagcct

SEQ ID NO: 287966 - DNA, 15 bp, Homo sapiens
agcttcaccagagcc

SEQ ID NO: 287967 - DNA, 15 bp, Homo sapiens
cagcttcaccagagc

SEQ ID NO: 287968 - DNA, 15 bp, Homo sapiens
tcagcttcaccagag

SEQ ID NO: 287969 - DNA, 15 bp, Homo sapiens
ctcagcttcaccaga

SEQ ID NO: 287970 - DNA, 15 bp, Homo sapiens
tctcagcttcaccag

SEQ ID NO: 287971 - DNA, 15 bp, Homo sapiens
ctctcagcttcacca

SEQ ID NO: 287972 - DNA, 15 bp, Homo sapiens
tctctcagcttcacc

SEQ ID NO: 287973 - DNA, 15 bp, Homo sapiens
ctctctcagcttcac

SEQ ID NO: 287974 - DNA, 15 bp, Homo sapiens
cctctctcagcttca

SEQ ID NO: 287975 - DNA, 15 bp, Homo sapiens
gcctctctcagcttc

SEQ ID NO: 287976 - DNA, 15 bp, Homo sapiens
ggcctctctcagctt

SEQ ID NO: 287977 - DNA, 15 bp, Homo sapiens
gggcctctctcagct

SEQ ID NO: 287978 - DNA, 15 bp, Homo sapiens
tgggcctctctcagc

SEQ ID NO: 287979 - DNA, 15 bp, Homo sapiens
ctgggcctctctcag

SEQ ID NO: 287980 - DNA, 15 bp, Homo sapiens
cctgggcctctctca

SEQ ID NO: 287981 - DNA, 15 bp, Homo sapiens
tcctgggcctctctc

SEQ ID NO: 287982 - DNA, 15 bp, Homo sapiens
gtcctgggcctctct

SEQ ID NO: 287983 - DNA, 15 bp, Homo sapiens
agtcctgggcctctc

SEQ ID NO: 287984 - DNA, 15 bp, Homo sapiens
cagtcctgggcctct

SEQ ID NO: 287985 - DNA, 15 bp, Homo sapiens
gcagtcctgggcctc

SEQ ID NO: 287986 - DNA, 15 bp, Homo sapiens
ggcagtcctgggcct

SEQ ID NO: 287987 - DNA, 15 bp, Homo sapiens
tggcagtcctgggcc

SEQ ID NO: 287988 - DNA, 15 bp, Homo sapiens
ctggcagtcctgggc

SEQ ID NO: 287989 - DNA, 15 bp, Homo sapiens
gctggcagtcctggg

SEQ ID NO: 287990 - DNA, 15 bp, Homo sapiens
tgctggcagtcctgg

SEQ ID NO: 287991 - DNA, 15 bp, Homo sapiens
gtgctggcagtcctg

SEQ ID NO: 287992 - DNA, 15 bp, Homo sapiens
ggtgctggcagtcct

SEQ ID NO: 287993 - DNA, 15 bp, Homo sapiens
tggtgctggcagtcc

SEQ ID NO: 287994 - DNA, 15 bp, Homo sapiens
gtggtgctggcagtc

SEQ ID NO: 287995 - DNA, 15 bp, Homo sapiens
tgtggtgctggcagt

SEQ ID NO: 287996 - DNA, 15 bp, Homo sapiens
gtgtggtgctggcag

SEQ ID NO: 287997 - DNA, 15 bp, Homo sapiens
tgtgtggtgctggca

SEQ ID NO: 287998 - DNA, 15 bp, Homo sapiens
gtgtgtggtgctggc

SEQ ID NO: 287999 - DNA, 15 bp, Homo sapiens
ggtgtgtggtgctgg

SEQ ID NO: 288000 - DNA, 15 bp, Homo sapiens
tggtgtgtggtgctg

SEQ ID NO: 288001 - DNA, 15 bp, Homo sapiens
ctggtgtgtggtgct

SEQ ID NO: 288002 - DNA, 15 bp, Homo sapiens
cctggtgtgtggtgc

SEQ ID NO: 288003 - DNA, 15 bp, Homo sapiens
acctggtgtgtggtg

SEQ ID NO: 288004 - DNA, 15 bp, Homo sapiens
aacctggtgtgtggt

SEQ ID NO: 288005 - DNA, 15 bp, Homo sapiens
gaacctggtgtgtgg

SEQ ID NO: 288006 - DNA, 15 bp, Homo sapiens
agaacctggtgtgtg

SEQ ID NO: 288007 - DNA, 15 bp, Homo sapiens
aagaacctggtgtgt

SEQ ID NO: 288008 - DNA, 15 bp, Homo sapiens
aaagaacctggtgtg

SEQ ID NO: 288009 - DNA, 15 bp, Homo sapiens
gaaagaacctggtgt

SEQ ID NO: 288010 - DNA, 15 bp, Homo sapiens
agaaagaacctggtg

SEQ ID NO: 288011 - DNA, 15 bp, Homo sapiens
cagaaagaacctggt

SEQ ID NO: 288012 - DNA, 15 bp, Homo sapiens
ccagaaagaacctgg

SEQ ID NO: 288013 - DNA, 15 bp, Homo sapiens
gccagaaagaacctg

SEQ ID NO: 288014 - DNA, 15 bp, Homo sapiens
agccagaaagaacct

SEQ ID NO: 288015 - DNA, 15 bp, Homo sapiens
cagccagaaagaacc

SEQ ID NO: 288016 - DNA, 15 bp, Homo sapiens
gcagccagaaagaac

SEQ ID NO: 288017 - DNA, 15 bp, Homo sapiens
tgcagccagaaagaa

SEQ ID NO: 288018 - DNA, 15 bp, Homo sapiens
ttgcagccagaaaga

SEQ ID NO: 288019 - DNA, 15 bp, Homo sapiens
gttgcagccagaaag

SEQ ID NO: 288020 - DNA, 15 bp, Homo sapiens
tgttgcagccagaaa

SEQ ID NO: 288021 - DNA, 15 bp, Homo sapiens
ctgttgcagccagaa

SEQ ID NO: 288022 - DNA, 15 bp, Homo sapiens
cctgttgcagccaga

SEQ ID NO: 288023 - DNA, 15 bp, Homo sapiens
tcctgttgcagccag

SEQ ID NO: 288024 - DNA, 15 bp, Homo sapiens
atcctgttgcagcca

SEQ ID NO: 288025 - DNA, 15 bp, Homo sapiens
catcctgttgcagcc

SEQ ID NO: 288026 - DNA, 15 bp, Homo sapiens
gcatcctgttgcagc

SEQ ID NO: 288027 - DNA, 15 bp, Homo sapiens
agcatcctgttgcag

SEQ ID NO: 288028 - DNA, 15 bp, Homo sapiens
cagcatcctgttgca

SEQ ID NO: 288029 - DNA, 15 bp, Homo sapiens
acagcatcctgttgc

SEQ ID NO: 288030 - DNA, 15 bp, Homo sapiens
gacagcatcctgttg

SEQ ID NO: 288031 - DNA, 15 bp, Homo sapiens
agacagcatcctgtt

SEQ ID NO: 288032 - DNA, 15 bp, Homo sapiens
cagacagcatcctgt

SEQ ID NO: 288033 - DNA, 15 bp, Homo sapiens
tcagacagcatcctg

SEQ ID NO: 288034 - DNA, 15 bp, Homo sapiens
gtcagacagcatcct

SEQ ID NO: 288035 - DNA, 15 bp, Homo sapiens
agtcagacagcatcc

SEQ ID NO: 288036 - DNA, 15 bp, Homo sapiens
gagtcagacagcatc

SEQ ID NO: 288037 - DNA, 15 bp, Homo sapiens
ggagtcagacagcat

SEQ ID NO: 288038 - DNA, 15 bp, Homo sapiens
tggagtcagacagca

SEQ ID NO: 288039 - DNA, 15 bp, Homo sapiens
ctggagtcagacagc

SEQ ID NO: 288040 - DNA, 15 bp, Homo sapiens
tctggagtcagacag

SEQ ID NO: 288041 - DNA, 15 bp, Homo sapiens
ctctggagtcagaca

SEQ ID NO: 288042 - DNA, 15 bp, Homo sapiens
actctggagtcagac

SEQ ID NO: 288043 - DNA, 15 bp, Homo sapiens
tactctggagtcaga

SEQ ID NO: 288044 - DNA, 15 bp, Homo sapiens
ttactctggagtcag

SEQ ID NO: 288045 - DNA, 15 bp, Homo sapiens
gttactctggagtca

SEQ ID NO: 288046 - DNA, 15 bp, Homo sapiens
tgttactctggagtc

SEQ ID NO: 288047 - DNA, 15 bp, Homo sapiens
ctgttactctggagt

SEQ ID NO: 288048 - DNA, 15 bp, Homo sapiens
tctgttactctggag

SEQ ID NO: 288049 - DNA, 15 bp, Homo sapiens
ttctgttactctgga

SEQ ID NO: 288050 - DNA, 15 bp, Homo sapiens
cttctgttactctgg

SEQ ID NO: 288051 - DNA, 15 bp, Homo sapiens
tcttctgttactctg

SEQ ID NO: 288052 - DNA, 15 bp, Homo sapiens
ttcttctgttactct

SEQ ID NO: 288053 - DNA, 15 bp, Homo sapiens
cttcttctgttactc

SEQ ID NO: 288054 - DNA, 15 bp, Homo sapiens
acttcttctgttact

SEQ ID NO: 288055 - DNA, 15 bp, Homo sapiens
gacttcttctgttac

SEQ ID NO: 288056 - DNA, 15 bp, Homo sapiens
agacttcttctgtta

SEQ ID NO: 288057 - DNA, 15 bp, Homo sapiens
gagacttcttctgtt

SEQ ID NO: 288058 - DNA, 15 bp, Homo sapiens
agagacttcttctgt

SEQ ID NO: 288059 - DNA, 15 bp, Homo sapiens
tagagacttcttctg

SEQ ID NO: 288060 - DNA, 15 bp, Homo sapiens
ttagagacttcttct

SEQ ID NO: 288061 - DNA, 15 bp, Homo sapiens
cttagagacttcttc

SEQ ID NO: 288062 - DNA, 15 bp, Homo sapiens
ccttagagacttctt

SEQ ID NO: 288063 - DNA, 15 bp, Homo sapiens
cccttagagacttct

SEQ ID NO: 288064 - DNA, 15 bp, Homo sapiens
tcccttagagacttc

SEQ ID NO: 288065 - DNA, 15 bp, Homo sapiens
atcccttagagactt

SEQ ID NO: 288066 - DNA, 15 bp, Homo sapiens
catcccttagagact

SEQ ID NO: 288067 - DNA, 15 bp, Homo sapiens
acatcccttagagac

SEQ ID NO: 288068 - DNA, 15 bp, Homo sapiens
aacatcccttagaga

SEQ ID NO: 288069 - DNA, 15 bp, Homo sapiens
gaacatcccttagag

SEQ ID NO: 288070 - DNA, 15 bp, Homo sapiens
cgaacatcccttaga

SEQ ID NO: 288071 - DNA, 15 bp, Homo sapiens
gcgaacatcccttag

SEQ ID NO: 288072 - DNA, 15 bp, Homo sapiens
tgcgaacatccctta

SEQ ID NO: 288073 - DNA, 15 bp, Homo sapiens
ctgcgaacatccctt

SEQ ID NO: 288074 - DNA, 15 bp, Homo sapiens
gctgcgaacatccct

SEQ ID NO: 288075 - DNA, 15 bp, Homo sapiens
ggctgcgaacatccc

SEQ ID NO: 288076 - DNA, 15 bp, Homo sapiens
gggctgcgaacatcc

SEQ ID NO: 288077 - DNA, 15 bp, Homo sapiens
ggggctgcgaacatc

SEQ ID NO: 288078 - DNA, 15 bp, Homo sapiens
gggggctgcgaacat

SEQ ID NO: 288079 - DNA, 15 bp, Homo sapiens
tgggggctgcgaaca

SEQ ID NO: 288080 - DNA, 15 bp, Homo sapiens
atgggggctgcgaac

SEQ ID NO: 288081 - DNA, 15 bp, Homo sapiens
gatgggggctgcgaa

SEQ ID NO: 288082 - DNA, 15 bp, Homo sapiens
cgatgggggctgcga

SEQ ID NO: 288083 - DNA, 15 bp, Homo sapiens
gcgatgggggctgcg

SEQ ID NO: 288084 - DNA, 15 bp, Homo sapiens
agcgatgggggctgc

SEQ ID NO: 288085 - DNA, 15 bp, Homo sapiens
aagcgatgggggctg

SEQ ID NO: 288086 - DNA, 15 bp, Homo sapiens
taagcgatgggggct

SEQ ID NO: 288087 - DNA, 15 bp, Homo sapiens
gtaagcgatgggggc

SEQ ID NO: 288088 - DNA, 15 bp, Homo sapiens
tgtaagcgatggggg

SEQ ID NO: 288089 - DNA, 15 bp, Homo sapiens
gtgtaagcgatgggg

SEQ ID NO: 288090 - DNA, 15 bp, Homo sapiens
tgtgtaagcgatggg

SEQ ID NO: 288091 - DNA, 15 bp, Homo sapiens
ctgtgtaagcgatgg

SEQ ID NO: 288092 - DNA, 15 bp, Homo sapiens
cctgtgtaagcgatg

SEQ ID NO: 288093 - DNA, 15 bp, Homo sapiens
tcctgtgtaagcgat

SEQ ID NO: 288094 - DNA, 15 bp, Homo sapiens
ttcctgtgtaagcga

SEQ ID NO: 288095 - DNA, 15 bp, Homo sapiens
cttcctgtgtaagcg

SEQ ID NO: 288096 - DNA, 15 bp, Homo sapiens
ccttcctgtgtaagc

SEQ ID NO: 288097 - DNA, 15 bp, Homo sapiens
tccttcctgtgtaag

SEQ ID NO: 288098 - DNA, 15 bp, Homo sapiens
ctccttcctgtgtaa

SEQ ID NO: 288099 - DNA, 15 bp, Homo sapiens
gctccttcctgtgta

SEQ ID NO: 288100 - DNA, 15 bp, Homo sapiens
agctccttcctgtgt

SEQ ID NO: 288101 - DNA, 15 bp, Homo sapiens
cagctccttcctgtg

SEQ ID NO: 288102 - DNA, 15 bp, Homo sapiens
gcagctccttcctgt

SEQ ID NO: 288103 - DNA, 15 bp, Homo sapiens
agcagctccttcctg

SEQ ID NO: 288104 - DNA, 15 bp, Homo sapiens
aagcagctccttcct

SEQ ID NO: 288105 - DNA, 15 bp, Homo sapiens
gaagcagctccttcc

SEQ ID NO: 288106 - DNA, 15 bp, Homo sapiens
tgaagcagctccttc

SEQ ID NO: 288107 - DNA, 15 bp, Homo sapiens
ctgaagcagctcctt

SEQ ID NO: 288108 - DNA, 15 bp, Homo sapiens
actgaagcagctcct

SEQ ID NO: 288109 - DNA, 15 bp, Homo sapiens
gactgaagcagctcc

SEQ ID NO: 288110 - DNA, 15 bp, Homo sapiens
tgactgaagcagctc

SEQ ID NO: 288111 - DNA, 15 bp, Homo sapiens
atgactgaagcagct

SEQ ID NO: 288112 - DNA, 15 bp, Homo sapiens
catgactgaagcagc

SEQ ID NO: 288113 - DNA, 15 bp, Homo sapiens
tcatgactgaagcag

SEQ ID NO: 288114 - DNA, 15 bp, Homo sapiens
ctcatgactgaagca

SEQ ID NO: 288115 - DNA, 15 bp, Homo sapiens
tctcatgactgaagc

SEQ ID NO: 288116 - DNA, 15 bp, Homo sapiens
atctcatgactgaag

SEQ ID NO: 288117 - DNA, 15 bp, Homo sapiens
tatctcatgactgaa

SEQ ID NO: 288118 - DNA, 15 bp, Homo sapiens
ctatctcatgactga

SEQ ID NO: 288119 - DNA, 15 bp, Homo sapiens
gctatctcatgactg

SEQ ID NO: 288120 - DNA, 15 bp, Homo sapiens
ggctatctcatgact

SEQ ID NO: 288121 - DNA, 15 bp, Homo sapiens
gggctatctcatgac

SEQ ID NO: 288122 - DNA, 15 bp, Homo sapiens
ggggctatctcatga

SEQ ID NO: 288123 - DNA, 15 bp, Homo sapiens
tggggctatctcatg

SEQ ID NO: 288124 - DNA, 15 bp, Homo sapiens
atggggctatctcat

SEQ ID NO: 288125 - DNA, 15 bp, Homo sapiens
aatggggctatctca

SEQ ID NO: 288126 - DNA, 15 bp, Homo sapiens
aaatggggctatctc

SEQ ID NO: 288127 - DNA, 15 bp, Homo sapiens
caaatggggctatct

SEQ ID NO: 288128 - DNA, 15 bp, Homo sapiens
tcaaatggggctatc

SEQ ID NO: 288129 - DNA, 15 bp, Homo sapiens
gtcaaatggggctat

SEQ ID NO: 288130 - DNA, 15 bp, Homo sapiens
tgtcaaatggggcta

SEQ ID NO: 288131 - DNA, 15 bp, Homo sapiens
gtgtcaaatggggct

SEQ ID NO: 288132 - DNA, 15 bp, Homo sapiens
agtgtcaaatggggc

SEQ ID NO: 288133 - DNA, 15 bp, Homo sapiens
gagtgtcaaatgggg

SEQ ID NO: 288134 - DNA, 15 bp, Homo sapiens
agagtgtcaaatggg

SEQ ID NO: 288135 - DNA, 15 bp, Homo sapiens
cagagtgtcaaatgg

SEQ ID NO: 288136 - DNA, 15 bp, Homo sapiens
tcagagtgtcaaatg

SEQ ID NO: 288137 - DNA, 15 bp, Homo sapiens
atcagagtgtcaaat

SEQ ID NO: 288138 - DNA, 15 bp, Homo sapiens
tatcagagtgtcaaa

SEQ ID NO: 288139 - DNA, 15 bp, Homo sapiens
ctatcagagtgtcaa

SEQ ID NO: 288140 - DNA, 15 bp, Homo sapiens
gctatcagagtgtca

SEQ ID NO: 288141 - DNA, 15 bp, Homo sapiens
agctatcagagtgtc

SEQ ID NO: 288142 - DNA, 15 bp, Homo sapiens
tagctatcagagtgt

SEQ ID NO: 288143 - DNA, 15 bp, Homo sapiens
gtagctatcagagtg

SEQ ID NO: 288144 - DNA, 15 bp, Homo sapiens
tgtagctatcagagt

SEQ ID NO: 288145 - DNA, 15 bp, Homo sapiens
atgtagctatcagag

SEQ ID NO: 288146 - DNA, 15 bp, Homo sapiens
tatgtagctatcaga

SEQ ID NO: 288147 - DNA, 15 bp, Homo sapiens
ttatgtagctatcag

SEQ ID NO: 288148 - DNA, 15 bp, Homo sapiens
gttatgtagctatca

SEQ ID NO: 288149 - DNA, 15 bp, Homo sapiens
agttatgtagctatc

SEQ ID NO: 288150 - DNA, 15 bp, Homo sapiens
cagttatgtagctat

SEQ ID NO: 288151 - DNA, 15 bp, Homo sapiens
tcagttatgtagcta

SEQ ID NO: 288152 - DNA, 15 bp, Homo sapiens
gtcagttatgtagct

SEQ ID NO: 288153 - DNA, 15 bp, Homo sapiens
tgtcagttatgtagc

SEQ ID NO: 288154 - DNA, 15 bp, Homo sapiens
atgtcagttatgtag

SEQ ID NO: 288155 - DNA, 15 bp, Homo sapiens
catgtcagttatgta

SEQ ID NO: 288156 - DNA, 15 bp, Homo sapiens
tcatgtcagttatgt

SEQ ID NO: 288157 - DNA, 15 bp, Homo sapiens
ctcatgtcagttatg

SEQ ID NO: 288158 - DNA, 15 bp, Homo sapiens
cctcatgtcagttat

SEQ ID NO: 288159 - DNA, 15 bp, Homo sapiens
acctcatgtcagtta

SEQ ID NO: 288160 - DNA, 15 bp, Homo sapiens
aacctcatgtcagtt

SEQ ID NO: 288161 - DNA, 15 bp, Homo sapiens
aaacctcatgtcagt

SEQ ID NO: 288162 - DNA, 15 bp, Homo sapiens
aaaacctcatgtcag

SEQ ID NO: 288163 - DNA, 15 bp, Homo sapiens
gaaaacctcatgtca

SEQ ID NO: 288164 - DNA, 15 bp, Homo sapiens
ggaaaacctcatgtc

SEQ ID NO: 288165 - DNA, 15 bp, Homo sapiens
aggaaaacctcatgt

SEQ ID NO: 288166 - DNA, 15 bp, Homo sapiens
caggaaaacctcatg

SEQ ID NO: 288167 - DNA, 15 bp, Homo sapiens
gcaggaaaacctcat

SEQ ID NO: 288168 - DNA, 15 bp, Homo sapiens
agcaggaaaacctca

SEQ ID NO: 288169 - DNA, 15 bp, Homo sapiens
cagcaggaaaacctc

SEQ ID NO: 288170 - DNA, 15 bp, Homo sapiens
gcagcaggaaaacct

SEQ ID NO: 288171 - DNA, 15 bp, Homo sapiens
ggcagcaggaaaacc

SEQ ID NO: 288172 - DNA, 15 bp, Homo sapiens
gggcagcaggaaaac

SEQ ID NO: 288173 - DNA, 15 bp, Homo sapiens
agggcagcaggaaaa

SEQ ID NO: 288174 - DNA, 15 bp, Homo sapiens
tagggcagcaggaaa

SEQ ID NO: 288175 - DNA, 15 bp, Homo sapiens
atagggcagcaggaa

SEQ ID NO: 288176 - DNA, 15 bp, Homo sapiens
gatagggcagcagga

SEQ ID NO: 288177 - DNA, 15 bp, Homo sapiens
ggatagggcagcagg

SEQ ID NO: 288178 - DNA, 15 bp, Homo sapiens
aggatagggcagcag

SEQ ID NO: 288179 - DNA, 15 bp, Homo sapiens
caggatagggcagca

SEQ ID NO: 288180 - DNA, 15 bp, Homo sapiens
acaggatagggcagc

SEQ ID NO: 288181 - DNA, 15 bp, Homo sapiens
tacaggatagggcag

SEQ ID NO: 288182 - DNA, 15 bp, Homo sapiens
ttacaggatagggca

SEQ ID NO: 288183 - DNA, 15 bp, Homo sapiens
tttacaggatagggc

SEQ ID NO: 288184 - DNA, 15 bp, Homo sapiens
ctttacaggataggg

SEQ ID NO: 288185 - DNA, 15 bp, Homo sapiens
gctttacaggatagg

SEQ ID NO: 288186 - DNA, 15 bp, Homo sapiens
ggctttacaggatag

SEQ ID NO: 288187 - DNA, 15 bp, Homo sapiens
tggctttacaggata

SEQ ID NO: 288188 - DNA, 15 bp, Homo sapiens
atggctttacaggat

SEQ ID NO: 288189 - DNA, 15 bp, Homo sapiens
gatggctttacagga

SEQ ID NO: 288190 - DNA, 15 bp, Homo sapiens
cgatggctttacagg

SEQ ID NO: 288191 - DNA, 15 bp, Homo sapiens
tcgatggctttacag

SEQ ID NO: 288192 - DNA, 15 bp, Homo sapiens
atcgatggctttaca

SEQ ID NO: 288193 - DNA, 15 bp, Homo sapiens
aatcgatggctttac

SEQ ID NO: 288194 - DNA, 15 bp, Homo sapiens
aaatcgatggcttta

SEQ ID NO: 288195 - DNA, 15 bp, Homo sapiens
gaaatcgatggcttt

SEQ ID NO: 288196 - DNA, 15 bp, Homo sapiens
ggaaatcgatggctt

SEQ ID NO: 288197 - DNA, 15 bp, Homo sapiens
tggaaatcgatggct

SEQ ID NO: 288198 - DNA, 15 bp, Homo sapiens
ctggaaatcgatggc

SEQ ID NO: 288199 - DNA, 15 bp, Homo sapiens
cctggaaatcgatgg

SEQ ID NO: 288200 - DNA, 15 bp, Homo sapiens
tcctggaaatcgatg

SEQ ID NO: 288201 - DNA, 15 bp, Homo sapiens
gtcctggaaatcgat

SEQ ID NO: 288202 - DNA, 15 bp, Homo sapiens
agtcctggaaatcga

SEQ ID NO: 288203 - DNA, 15 bp, Homo sapiens
aagtcctggaaatcg

SEQ ID NO: 288204 - DNA, 15 bp, Homo sapiens
caagtcctggaaatc

SEQ ID NO: 288205 - DNA, 15 bp, Homo sapiens
acaagtcctggaaat

SEQ ID NO: 288206 - DNA, 15 bp, Homo sapiens
aacaagtcctggaaa

SEQ ID NO: 288207 - DNA, 15 bp, Homo sapiens
aaacaagtcctggaa

SEQ ID NO: 288208 - DNA, 15 bp, Homo sapiens
taaacaagtcctgga

SEQ ID NO: 288209 - DNA, 15 bp, Homo sapiens
gtaaacaagtcctgg

SEQ ID NO: 288210 - DNA, 15 bp, Homo sapiens
ggtaaacaagtcctg

SEQ ID NO: 288211 - DNA, 15 bp, Homo sapiens
tggtaaacaagtcct

SEQ ID NO: 288212 - DNA, 15 bp, Homo sapiens
ttggtaaacaagtcc

SEQ ID NO: 288213 - DNA, 15 bp, Homo sapiens
tttggtaaacaagtc

SEQ ID NO: 288214 - DNA, 15 bp, Homo sapiens
ttttggtaaacaagt

SEQ ID NO: 288215 - DNA, 15 bp, Homo sapiens
cttttggtaaacaag

SEQ ID NO: 288216 - DNA, 15 bp, Homo sapiens
gcttttggtaaacaa

SEQ ID NO: 288217 - DNA, 15 bp, Homo sapiens
ggcttttggtaaaca

SEQ ID NO: 288218 - DNA, 15 bp, Homo sapiens
tggcttttggtaaac

SEQ ID NO: 288219 - DNA, 15 bp, Homo sapiens
atggcttttggtaaa

SEQ ID NO: 288220 - DNA, 15 bp, Homo sapiens
gatggcttttggtaa

SEQ ID NO: 288221 - DNA, 15 bp, Homo sapiens
tgatggcttttggta

SEQ ID NO: 288222 - DNA, 15 bp, Homo sapiens
ttgatggcttttggt

SEQ ID NO: 288223 - DNA, 15 bp, Homo sapiens
tttgatggcttttgg

SEQ ID NO: 288224 - DNA, 15 bp, Homo sapiens
ttttgatggcttttg

SEQ ID NO: 288225 - DNA, 15 bp, Homo sapiens
gttttgatggctttt

SEQ ID NO: 288226 - DNA, 15 bp, Homo sapiens
cgttttgatggcttt

SEQ ID NO: 288227 - DNA, 15 bp, Homo sapiens
ccgttttgatggctt

SEQ ID NO: 288228 - DNA, 15 bp, Homo sapiens
tccgttttgatggct

SEQ ID NO: 288229 - DNA, 15 bp, Homo sapiens
gtccgttttgatggc

SEQ ID NO: 288230 - DNA, 15 bp, Homo sapiens
ggtccgttttgatgg

SEQ ID NO: 288231 - DNA, 15 bp, Homo sapiens
tggtccgttttgatg

SEQ ID NO: 288232 - DNA, 15 bp, Homo sapiens
gtggtccgttttgat

SEQ ID NO: 288233 - DNA, 15 bp, Homo sapiens
cgtggtccgttttga

SEQ ID NO: 288234 - DNA, 15 bp, Homo sapiens
acgtggtccgttttg

SEQ ID NO: 288235 - DNA, 15 bp, Homo sapiens
cacgtggtccgtttt

SEQ ID NO: 288236 - DNA, 15 bp, Homo sapiens
gcacgtggtccgttt

SEQ ID NO: 288237 - DNA, 15 bp, Homo sapiens
ggcacgtggtccgtt

SEQ ID NO: 288238 - DNA, 15 bp, Homo sapiens
tggcacgtggtccgt

SEQ ID NO: 288239 - DNA, 15 bp, Homo sapiens
atggcacgtggtccg

SEQ ID NO: 288240 - DNA, 15 bp, Homo sapiens
gatggcacgtggtcc

SEQ ID NO: 288241 - DNA, 15 bp, Homo sapiens
agatggcacgtggtc

SEQ ID NO: 288242 - DNA, 15 bp, Homo sapiens
cagatggcacgtggt

SEQ ID NO: 288243 - DNA, 15 bp, Homo sapiens
gcagatggcacgtgg

SEQ ID NO: 288244 - DNA, 15 bp, Homo sapiens
agcagatggcacgtg

SEQ ID NO: 288245 - DNA, 15 bp, Homo sapiens
tagcagatggcacgt

SEQ ID NO: 288246 - DNA, 15 bp, Homo sapiens
ttagcagatggcacg

SEQ ID NO: 288247 - DNA, 15 bp, Homo sapiens
attagcagatggcac

SEQ ID NO: 288248 - DNA, 15 bp, Homo sapiens
cattagcagatggca

SEQ ID NO: 288249 - DNA, 15 bp, Homo sapiens
ccattagcagatggc

SEQ ID NO: 288250 - DNA, 15 bp, Homo sapiens
tccattagcagatgg

SEQ ID NO: 288251 - DNA, 15 bp, Homo sapiens
gtccattagcagatg

SEQ ID NO: 288252 - DNA, 15 bp, Homo sapiens
agtccattagcagat

SEQ ID NO: 288253 - DNA, 15 bp, Homo sapiens
cagtccattagcaga

SEQ ID NO: 288254 - DNA, 15 bp, Homo sapiens
gcagtccattagcag

SEQ ID NO: 288255 - DNA, 15 bp, Homo sapiens
ggcagtccattagca

SEQ ID NO: 288256 - DNA, 15 bp, Homo sapiens
gggcagtccattagc

SEQ ID NO: 288257 - DNA, 15 bp, Homo sapiens
agggcagtccattag

SEQ ID NO: 288258 - DNA, 15 bp, Homo sapiens
cagggcagtccatta

SEQ ID NO: 288259 - DNA, 15 bp, Homo sapiens
gcagggcagtccatt

SEQ ID NO: 288260 - DNA, 15 bp, Homo sapiens
agcagggcagtccat

SEQ ID NO: 288261 - DNA, 15 bp, Homo sapiens
tagcagggcagtcca

SEQ ID NO: 288262 - DNA, 15 bp, Homo sapiens
ctagcagggcagtcc

SEQ ID NO: 288263 - DNA, 15 bp, Homo sapiens
actagcagggcagtc

SEQ ID NO: 288264 - DNA, 15 bp, Homo sapiens
tactagcagggcagt

SEQ ID NO: 288265 - DNA, 15 bp, Homo sapiens
atactagcagggcag

SEQ ID NO: 288266 - DNA, 15 bp, Homo sapiens
aatactagcagggca

SEQ ID NO: 288267 - DNA, 15 bp, Homo sapiens
taatactagcagggc

SEQ ID NO: 288268 - DNA, 15 bp, Homo sapiens
ctaatactagcaggg

SEQ ID NO: 288269 - DNA, 15 bp, Homo sapiens
gctaatactagcagg

SEQ ID NO: 288270 - DNA, 15 bp, Homo sapiens
ggctaatactagcag

SEQ ID NO: 288271 - DNA, 15 bp, Homo sapiens
tggctaatactagca

SEQ ID NO: 288272 - DNA, 15 bp, Homo sapiens
ctggctaatactagc

SEQ ID NO: 288273 - DNA, 15 bp, Homo sapiens
cctggctaatactag

SEQ ID NO: 288274 - DNA, 15 bp, Homo sapiens
tcctggctaatacta

SEQ ID NO: 288275 - DNA, 15 bp, Homo sapiens
ctcctggctaatact

SEQ ID NO: 288276 - DNA, 15 bp, Homo sapiens
tctcctggctaatac

SEQ ID NO: 288277 - DNA, 15 bp, Homo sapiens
atctcctggctaata

SEQ ID NO: 288278 - DNA, 15 bp, Homo sapiens
aatctcctggctaat

SEQ ID NO: 288279 - DNA, 15 bp, Homo sapiens
caatctcctggctaa

SEQ ID NO: 288280 - DNA, 15 bp, Homo sapiens
ccaatctcctggcta

SEQ ID NO: 288281 - DNA, 15 bp, Homo sapiens
accaatctcctggct

SEQ ID NO: 288282 - DNA, 15 bp, Homo sapiens
taccaatctcctggc

SEQ ID NO: 288283 - DNA, 15 bp, Homo sapiens
ataccaatctcctgg

SEQ ID NO: 288284 - DNA, 15 bp, Homo sapiens
aataccaatctcctg

SEQ ID NO: 288285 - DNA, 15 bp, Homo sapiens
aaataccaatctcct

SEQ ID NO: 288286 - DNA, 15 bp, Homo sapiens
caaataccaatctcc

SEQ ID NO: 288287 - DNA, 15 bp, Homo sapiens
gcaaataccaatctc

SEQ ID NO: 288288 - DNA, 15 bp, Homo sapiens
tgcaaataccaatct

SEQ ID NO: 288289 - DNA, 15 bp, Homo sapiens
gtgcaaataccaatc

SEQ ID NO: 288290 - DNA, 15 bp, Homo sapiens
tgtgcaaataccaat

SEQ ID NO: 288291 - DNA, 15 bp, Homo sapiens
atgtgcaaataccaa

SEQ ID NO: 288292 - DNA, 15 bp, Homo sapiens
aatgtgcaaatacca

SEQ ID NO: 288293 - DNA, 15 bp, Homo sapiens
aaatgtgcaaatacc

SEQ ID NO: 288294 - DNA, 15 bp, Homo sapiens
taaatgtgcaaatac

SEQ ID NO: 288295 - DNA, 15 bp, Homo sapiens
ataaatgtgcaaata

SEQ ID NO: 288296 - DNA, 15 bp, Homo sapiens
tataaatgtgcaaat

SEQ ID NO: 288297 - DNA, 15 bp, Homo sapiens
ttataaatgtgcaaa

SEQ ID NO: 288298 - DNA, 15 bp, Homo sapiens
cttataaatgtgcaa

SEQ ID NO: 288299 - DNA, 15 bp, Homo sapiens
tcttataaatgtgca

SEQ ID NO: 288300 - DNA, 15 bp, Homo sapiens
atcttataaatgtgc

SEQ ID NO: 288301 - DNA, 15 bp, Homo sapiens
gatcttataaatgtg

SEQ ID NO: 288302 - DNA, 15 bp, Homo sapiens
agatcttataaatgt

SEQ ID NO: 288303 - DNA, 15 bp, Homo sapiens
gagatcttataaatg

SEQ ID NO: 288304 - DNA, 15 bp, Homo sapiens
tgagatcttataaat

SEQ ID NO: 288305 - DNA, 15 bp, Homo sapiens
gtgagatcttataaa

SEQ ID NO: 288306 - DNA, 15 bp, Homo sapiens
agtgagatcttataa

SEQ ID NO: 288307 - DNA, 15 bp, Homo sapiens
cagtgagatcttata

SEQ ID NO: 288308 - DNA, 15 bp, Homo sapiens
ccagtgagatcttat

SEQ ID NO: 288309 - DNA, 15 bp, Homo sapiens
tccagtgagatctta

SEQ ID NO: 288310 - DNA, 15 bp, Homo sapiens
atccagtgagatctt

SEQ ID NO: 288311 - DNA, 15 bp, Homo sapiens
gatccagtgagatct

SEQ ID NO: 288312 - DNA, 15 bp, Homo sapiens
agatccagtgagatc

SEQ ID NO: 288313 - DNA, 15 bp, Homo sapiens
gagatccagtgagat

SEQ ID NO: 288314 - DNA, 15 bp, Homo sapiens
agagatccagtgaga

SEQ ID NO: 288315 - DNA, 15 bp, Homo sapiens
gagagatccagtgag

SEQ ID NO: 288316 - DNA, 15 bp, Homo sapiens
agagagatccagtga

SEQ ID NO: 288317 - DNA, 15 bp, Homo sapiens
aagagagatccagtg

SEQ ID NO: 288318 - DNA, 15 bp, Homo sapiens
caagagagatccagt

SEQ ID NO: 288319 - DNA, 15 bp, Homo sapiens
acaagagagatccag

SEQ ID NO: 288320 - DNA, 15 bp, Homo sapiens
aacaagagagatcca

SEQ ID NO: 288321 - DNA, 15 bp, Homo sapiens
caacaagagagatcc

SEQ ID NO: 288322 - DNA, 15 bp, Homo sapiens
tcaacaagagagatc

SEQ ID NO: 288323 - DNA, 15 bp, Homo sapiens
ttcaacaagagagat

SEQ ID NO: 288324 - DNA, 15 bp, Homo sapiens
tttcaacaagagaga

SEQ ID NO: 288325 - DNA, 15 bp, Homo sapiens
ctttcaacaagagag

SEQ ID NO: 288326 - DNA, 15 bp, Homo sapiens
tctttcaacaagaga

SEQ ID NO: 288327 - DNA, 15 bp, Homo sapiens
ttctttcaacaagag

SEQ ID NO: 288328 - DNA, 15 bp, Homo sapiens
cttctttcaacaaga

SEQ ID NO: 288329 - DNA, 15 bp, Homo sapiens
tcttctttcaacaag

SEQ ID NO: 288330 - DNA, 15 bp, Homo sapiens
atcttctttcaacaa

SEQ ID NO: 288331 - DNA, 15 bp, Homo sapiens
tatcttctttcaaca

SEQ ID NO: 288332 - DNA, 15 bp, Homo sapiens
ttatcttctttcaac

SEQ ID NO: 288333 - DNA, 15 bp, Homo sapiens
cttatcttctttcaa

SEQ ID NO: 288334 - DNA, 15 bp, Homo sapiens
tcttatcttctttca

SEQ ID NO: 288335 - DNA, 15 bp, Homo sapiens
ttcttatcttctttc

SEQ ID NO: 288336 - DNA, 15 bp, Homo sapiens
tttcttatcttcttt

SEQ ID NO: 288337 - DNA, 15 bp, Homo sapiens
atttcttatcttctt

SEQ ID NO: 288338 - DNA, 15 bp, Homo sapiens
aatttcttatcttct

SEQ ID NO: 288339 - DNA, 15 bp, Homo sapiens
gaatttcttatcttc

SEQ ID NO: 288340 - DNA, 15 bp, Homo sapiens
ggaatttcttatctt

SEQ ID NO: 288341 - DNA, 15 bp, Homo sapiens
cggaatttcttatct

SEQ ID NO: 288342 - DNA, 15 bp, Homo sapiens
tcggaatttcttatc

SEQ ID NO: 288343 - DNA, 15 bp, Homo sapiens
ctcggaatttcttat

SEQ ID NO: 288344 - DNA, 15 bp, Homo sapiens
actcggaatttctta

SEQ ID NO: 288345 - DNA, 15 bp, Homo sapiens
gactcggaatttctt

SEQ ID NO: 288346 - DNA, 15 bp, Homo sapiens
agactcggaatttct

SEQ ID NO: 288347 - DNA, 15 bp, Homo sapiens
cagactcggaatttc

SEQ ID NO: 288348 - DNA, 15 bp, Homo sapiens
gcagactcggaattt

SEQ ID NO: 288349 - DNA, 15 bp, Homo sapiens
agcagactcggaatt

SEQ ID NO: 288350 - DNA, 15 bp, Homo sapiens
tagcagactcggaat

SEQ ID NO: 288351 - DNA, 15 bp, Homo sapiens
ctagcagactcggaa

SEQ ID NO: 288352 - DNA, 15 bp, Homo sapiens
tctagcagactcgga

SEQ ID NO: 288353 - DNA, 15 bp, Homo sapiens
ttctagcagactcgg

SEQ ID NO: 288354 - DNA, 15 bp, Homo sapiens
tttctagcagactcg

SEQ ID NO: 288355 - DNA, 15 bp, Homo sapiens
ctttctagcagactc

SEQ ID NO: 288356 - DNA, 15 bp, Homo sapiens
gctttctagcagact

SEQ ID NO: 288357 - DNA, 15 bp, Homo sapiens
tgctttctagcagac

SEQ ID NO: 288358 - DNA, 15 bp, Homo sapiens
atgctttctagcaga

SEQ ID NO: 288359 - DNA, 15 bp, Homo sapiens
aatgctttctagcag

SEQ ID NO: 288360 - DNA, 15 bp, Homo sapiens
aaatgctttctagca

SEQ ID NO: 288361 - DNA, 15 bp, Homo sapiens
aaaatgctttctagc

SEQ ID NO: 288362 - DNA, 15 bp, Homo sapiens
gaaaatgctttctag

SEQ ID NO: 288363 - DNA, 15 bp, Homo sapiens
agaaaatgctttcta

SEQ ID NO: 288364 - DNA, 15 bp, Homo sapiens
aagaaaatgctttct

SEQ ID NO: 288365 - DNA, 15 bp, Homo sapiens
caagaaaatgctttc

SEQ ID NO: 288366 - DNA, 15 bp, Homo sapiens
gcaagaaaatgcttt

SEQ ID NO: 288367 - DNA, 15 bp, Homo sapiens
ggcaagaaaatgctt

SEQ ID NO: 288368 - DNA, 15 bp, Homo sapiens
tggcaagaaaatgct

SEQ ID NO: 288369 - DNA, 15 bp, Homo sapiens
atggcaagaaaatgc

SEQ ID NO: 288370 - DNA, 15 bp, Homo sapiens
tatggcaagaaaatg

SEQ ID NO: 288371 - DNA, 15 bp, Homo sapiens
ttatggcaagaaaat

SEQ ID NO: 288372 - DNA, 15 bp, Homo sapiens
tttatggcaagaaaa

SEQ ID NO: 288373 - DNA, 15 bp, Homo sapiens
atttatggcaagaaa

SEQ ID NO: 288374 - DNA, 15 bp, Homo sapiens
tatttatggcaagaa

SEQ ID NO: 288375 - DNA, 15 bp, Homo sapiens
atatttatggcaaga

SEQ ID NO: 288376 - DNA, 15 bp, Homo sapiens
tatatttatggcaag

SEQ ID NO: 288377 - DNA, 15 bp, Homo sapiens
atatatttatggcaa

SEQ ID NO: 288378 - DNA, 15 bp, Homo sapiens
gatatatttatggca

SEQ ID NO: 288379 - DNA, 15 bp, Homo sapiens
tgatatatttatggc

SEQ ID NO: 288380 - DNA, 15 bp, Homo sapiens
ttgatatatttatgg

SEQ ID NO: 288381 - DNA, 15 bp, Homo sapiens
gttgatatatttatg

SEQ ID NO: 288382 - DNA, 15 bp, Homo sapiens
agttgatatatttat

SEQ ID NO: 288383 - DNA, 15 bp, Homo sapiens
aagttgatatattta

SEQ ID NO: 288384 - DNA, 15 bp, Homo sapiens
aaagttgatatattt

SEQ ID NO: 288385 - DNA, 15 bp, Homo sapiens
caaagttgatatatt

SEQ ID NO: 288386 - DNA, 15 bp, Homo sapiens
acaaagttgatatat

SEQ ID NO: 288387 - DNA, 15 bp, Homo sapiens
aacaaagttgatata

SEQ ID NO: 288388 - DNA, 15 bp, Homo sapiens
taacaaagttgatat

SEQ ID NO: 288389 - DNA, 15 bp, Homo sapiens
ctaacaaagttgata

SEQ ID NO: 288390 - DNA, 15 bp, Homo sapiens
tctaacaaagttgat

SEQ ID NO: 288391 - DNA, 15 bp, Homo sapiens
gtctaacaaagttga

SEQ ID NO: 288392 - DNA, 15 bp, Homo sapiens
tgtctaacaaagttg

SEQ ID NO: 288393 - DNA, 15 bp, Homo sapiens
atgtctaacaaagtt

SEQ ID NO: 288394 - DNA, 15 bp, Homo sapiens
aatgtctaacaaagt

SEQ ID NO: 288395 - DNA, 15 bp, Homo sapiens
gaatgtctaacaaag

SEQ ID NO: 288396 - DNA, 15 bp, Homo sapiens
tgaatgtctaacaaa

SEQ ID NO: 288397 - DNA, 15 bp, Homo sapiens
gtgaatgtctaacaa

SEQ ID NO: 288398 - DNA, 15 bp, Homo sapiens
agtgaatgtctaaca

SEQ ID NO: 288399 - DNA, 15 bp, Homo sapiens
aagtgaatgtctaac

SEQ ID NO: 288400 - DNA, 15 bp, Homo sapiens
taagtgaatgtctaa

SEQ ID NO: 288401 - DNA, 15 bp, Homo sapiens
ataagtgaatgtcta

SEQ ID NO: 288402 - DNA, 15 bp, Homo sapiens
cataagtgaatgtct

SEQ ID NO: 288403 - DNA, 15 bp, Homo sapiens
acataagtgaatgtc

SEQ ID NO: 288404 - DNA, 15 bp, Homo sapiens
gacataagtgaatgt

SEQ ID NO: 288405 - DNA, 15 bp, Homo sapiens
tgacataagtgaatg

SEQ ID NO: 288406 - DNA, 15 bp, Homo sapiens
ctgacataagtgaat

SEQ ID NO: 288407 - DNA, 15 bp, Homo sapiens
actgacataagtgaa

SEQ ID NO: 288408 - DNA, 15 bp, Homo sapiens
aactgacataagtga

SEQ ID NO: 288409 - DNA, 15 bp, Homo sapiens
taactgacataagtg

SEQ ID NO: 288410 - DNA, 15 bp, Homo sapiens
gtaactgacataagt

SEQ ID NO: 288411 - DNA, 15 bp, Homo sapiens
agtaactgacataag

SEQ ID NO: 288412 - DNA, 15 bp, Homo sapiens
tagtaactgacataa

SEQ ID NO: 288413 - DNA, 15 bp, Homo sapiens
ttagtaactgacata

SEQ ID NO: 288414 - DNA, 15 bp, Homo sapiens
attagtaactgacat

SEQ ID NO: 288415 - DNA, 15 bp, Homo sapiens
aattagtaactgaca

SEQ ID NO: 288416 - DNA, 15 bp, Homo sapiens
gaattagtaactgac

SEQ ID NO: 288417 - DNA, 15 bp, Homo sapiens
tgaattagtaactga

SEQ ID NO: 288418 - DNA, 15 bp, Homo sapiens
ttgaattagtaactg

SEQ ID NO: 288419 - DNA, 15 bp, Homo sapiens
gttgaattagtaact

SEQ ID NO: 288420 - DNA, 15 bp, Homo sapiens
ggttgaattagtaac

SEQ ID NO: 288421 - DNA, 15 bp, Homo sapiens
tggttgaattagtaa

SEQ ID NO: 288422 - DNA, 15 bp, Homo sapiens
gtggttgaattagta

SEQ ID NO: 288423 - DNA, 15 bp, Homo sapiens
cgtggttgaattagt

SEQ ID NO: 288424 - DNA, 15 bp, Homo sapiens
acgtggttgaattag

SEQ ID NO: 288425 - DNA, 15 bp, Homo sapiens
aacgtggttgaatta

SEQ ID NO: 288426 - DNA, 15 bp, Homo sapiens
taacgtggttgaatt

SEQ ID NO: 288427 - DNA, 15 bp, Homo sapiens
gtaacgtggttgaat

SEQ ID NO: 288428 - DNA, 15 bp, Homo sapiens
agtaacgtggttgaa

SEQ ID NO: 288429 - DNA, 15 bp, Homo sapiens
cagtaacgtggttga

SEQ ID NO: 288430 - DNA, 15 bp, Homo sapiens
gcagtaacgtggttg

SEQ ID NO: 288431 - DNA, 15 bp, Homo sapiens
agcagtaacgtggtt

SEQ ID NO: 288432 - DNA, 15 bp, Homo sapiens
tagcagtaacgtggt

SEQ ID NO: 288433 - DNA, 15 bp, Homo sapiens
atagcagtaacgtgg

SEQ ID NO: 288434 - DNA, 15 bp, Homo sapiens
catagcagtaacgtg

SEQ ID NO: 288435 - DNA, 15 bp, Homo sapiens
acatagcagtaacgt

SEQ ID NO: 288436 - DNA, 15 bp, Homo sapiens
gacatagcagtaacg

SEQ ID NO: 288437 - DNA, 15 bp, Homo sapiens
agacatagcagtaac

SEQ ID NO: 288438 - DNA, 15 bp, Homo sapiens
tagacatagcagtaa

SEQ ID NO: 288439 - DNA, 15 bp, Homo sapiens
ctagacatagcagta

SEQ ID NO: 288440 - DNA, 15 bp, Homo sapiens
actagacatagcagt

SEQ ID NO: 288441 - DNA, 15 bp, Homo sapiens
aactagacatagcag

SEQ ID NO: 288442 - DNA, 15 bp, Homo sapiens
gaactagacatagca

SEQ ID NO: 288443 - DNA, 15 bp, Homo sapiens
tgaactagacatagc

SEQ ID NO: 288444 - DNA, 15 bp, Homo sapiens
atgaactagacatag

SEQ ID NO: 288445 - DNA, 15 bp, Homo sapiens
aatgaactagacata

SEQ ID NO: 288446 - DNA, 15 bp, Homo sapiens
taatgaactagacat

SEQ ID NO: 288447 - DNA, 15 bp, Homo sapiens
ctaatgaactagaca

SEQ ID NO: 288448 - DNA, 15 bp, Homo sapiens
tctaatgaactagac

SEQ ID NO: 288449 - DNA, 15 bp, Homo sapiens
gtctaatgaactaga

SEQ ID NO: 288450 - DNA, 15 bp, Homo sapiens
tgtctaatgaactag

SEQ ID NO: 288451 - DNA, 15 bp, Homo sapiens
ctgtctaatgaacta

SEQ ID NO: 288452 - DNA, 15 bp, Homo sapiens
cctgtctaatgaact

SEQ ID NO: 288453 - DNA, 15 bp, Homo sapiens
acctgtctaatgaac

SEQ ID NO: 288454 - DNA, 15 bp, Homo sapiens
tacctgtctaatgaa

SEQ ID NO: 288455 - DNA, 15 bp, Homo sapiens
ctacctgtctaatga

SEQ ID NO: 288456 - DNA, 15 bp, Homo sapiens
actacctgtctaatg

SEQ ID NO: 288457 - DNA, 15 bp, Homo sapiens
aactacctgtctaat

SEQ ID NO: 288458 - DNA, 15 bp, Homo sapiens
taactacctgtctaa

SEQ ID NO: 288459 - DNA, 15 bp, Homo sapiens
ctaactacctgtcta

SEQ ID NO: 288460 - DNA, 15 bp, Homo sapiens
tctaactacctgtct

SEQ ID NO: 288461 - DNA, 15 bp, Homo sapiens
atctaactacctgtc

SEQ ID NO: 288462 - DNA, 15 bp, Homo sapiens
tatctaactacctgt

SEQ ID NO: 288463 - DNA, 15 bp, Homo sapiens
ttatctaactacctg

SEQ ID NO: 288464 - DNA, 15 bp, Homo sapiens
cttatctaactacct

SEQ ID NO: 288465 - DNA, 15 bp, Homo sapiens
acttatctaactacc

SEQ ID NO: 288466 - DNA, 15 bp, Homo sapiens
cacttatctaactac

SEQ ID NO: 288467 - DNA, 15 bp, Homo sapiens
ccacttatctaacta

SEQ ID NO: 288468 - DNA, 15 bp, Homo sapiens
cccacttatctaact

SEQ ID NO: 288469 - DNA, 15 bp, Homo sapiens
tcccacttatctaac

SEQ ID NO: 288470 - DNA, 15 bp, Homo sapiens
ctcccacttatctaa

SEQ ID NO: 288471 - DNA, 15 bp, Homo sapiens
tctcccacttatcta

SEQ ID NO: 288472 - DNA, 15 bp, Homo sapiens
ttctcccacttatct

SEQ ID NO: 288473 - DNA, 15 bp, Homo sapiens
gttctcccacttatc

SEQ ID NO: 288474 - DNA, 15 bp, Homo sapiens
ggttctcccacttat

SEQ ID NO: 288475 - DNA, 15 bp, Homo sapiens
gggttctcccactta

SEQ ID NO: 288476 - DNA, 15 bp, Homo sapiens
tgggttctcccactt

SEQ ID NO: 288477 - DNA, 15 bp, Homo sapiens
gtgggttctcccact

SEQ ID NO: 288478 - DNA, 15 bp, Homo sapiens
tgtgggttctcccac

SEQ ID NO: 288479 - DNA, 15 bp, Homo sapiens
atgtgggttctccca

SEQ ID NO: 288480 - DNA, 15 bp, Homo sapiens
catgtgggttctccc

SEQ ID NO: 288481 - DNA, 15 bp, Homo sapiens
gcatgtgggttctcc

SEQ ID NO: 288482 - DNA, 15 bp, Homo sapiens
tgcatgtgggttctc

SEQ ID NO: 288483 - DNA, 15 bp, Homo sapiens
atgcatgtgggttct

SEQ ID NO: 288484 - DNA, 15 bp, Homo sapiens
aatgcatgtgggttc

SEQ ID NO: 288485 - DNA, 15 bp, Homo sapiens
taatgcatgtgggtt

SEQ ID NO: 288486 - DNA, 15 bp, Homo sapiens
ttaatgcatgtgggt

SEQ ID NO: 288487 - DNA, 15 bp, Homo sapiens
tttaatgcatgtggg

SEQ ID NO: 288488 - DNA, 15 bp, Homo sapiens
atttaatgcatgtgg

SEQ ID NO: 288489 - DNA, 15 bp, Homo sapiens
catttaatgcatgtg

SEQ ID NO: 288490 - DNA, 15 bp, Homo sapiens
acatttaatgcatgt

SEQ ID NO: 288491 - DNA, 15 bp, Homo sapiens
tacatttaatgcatg

SEQ ID NO: 288492 - DNA, 15 bp, Homo sapiens
ctacatttaatgcat

SEQ ID NO: 288493 - DNA, 15 bp, Homo sapiens
actacatttaatgca

SEQ ID NO: 288494 - DNA, 15 bp, Homo sapiens
aactacatttaatgc

SEQ ID NO: 288495 - DNA, 15 bp, Homo sapiens
aaactacatttaatg

SEQ ID NO: 288496 - DNA, 15 bp, Homo sapiens
gaaactacatttaat

SEQ ID NO: 288497 - DNA, 15 bp, Homo sapiens
agaaactacatttaa

SEQ ID NO: 288498 - DNA, 15 bp, Homo sapiens
aagaaactacattta

SEQ ID NO: 288499 - DNA, 15 bp, Homo sapiens
caagaaactacattt

SEQ ID NO: 288500 - DNA, 15 bp, Homo sapiens
acaagaaactacatt

SEQ ID NO: 288501 - DNA, 15 bp, Homo sapiens
aacaagaaactacat

SEQ ID NO: 288502 - DNA, 15 bp, Homo sapiens
gaacaagaaactaca

SEQ ID NO: 288503 - DNA, 15 bp, Homo sapiens
agaacaagaaactac

SEQ ID NO: 288504 - DNA, 15 bp, Homo sapiens
tagaacaagaaacta

SEQ ID NO: 288505 - DNA, 15 bp, Homo sapiens
ttagaacaagaaact

SEQ ID NO: 288506 - DNA, 15 bp, Homo sapiens
attagaacaagaaac

SEQ ID NO: 288507 - DNA, 15 bp, Homo sapiens
cattagaacaagaaa

SEQ ID NO: 288508 - DNA, 15 bp, Homo sapiens
gcattagaacaagaa

SEQ ID NO: 288509 - DNA, 15 bp, Homo sapiens
tgcattagaacaaga

SEQ ID NO: 288510 - DNA, 15 bp, Homo sapiens
ctgcattagaacaag

SEQ ID NO: 288511 - DNA, 15 bp, Homo sapiens
tctgcattagaacaa

SEQ ID NO: 288512 - DNA, 15 bp, Homo sapiens
ctctgcattagaaca

SEQ ID NO: 288513 - DNA, 15 bp, Homo sapiens
actctgcattagaac

SEQ ID NO: 288514 - DNA, 15 bp, Homo sapiens
cactctgcattagaa

SEQ ID NO: 288515 - DNA, 15 bp, Homo sapiens
tcactctgcattaga

SEQ ID NO: 288516 - DNA, 15 bp, Homo sapiens
atcactctgcattag

SEQ ID NO: 288517 - DNA, 15 bp, Homo sapiens
gatcactctgcatta

SEQ ID NO: 288518 - DNA, 15 bp, Homo sapiens
tgatcactctgcatt

SEQ ID NO: 288519 - DNA, 15 bp, Homo sapiens
ttgatcactctgcat

SEQ ID NO: 288520 - DNA, 15 bp, Homo sapiens
gttgatcactctgca

SEQ ID NO: 288521 - DNA, 15 bp, Homo sapiens
ggttgatcactctgc

SEQ ID NO: 288522 - DNA, 15 bp, Homo sapiens
gggttgatcactctg

SEQ ID NO: 288523 - DNA, 15 bp, Homo sapiens
agggttgatcactct

SEQ ID NO: 288524 - DNA, 15 bp, Homo sapiens
tagggttgatcactc

SEQ ID NO: 288525 - DNA, 15 bp, Homo sapiens
ttagggttgatcact

SEQ ID NO: 288526 - DNA, 15 bp, Homo sapiens
tttagggttgatcac

SEQ ID NO: 288527 - DNA, 15 bp, Homo sapiens
ttttagggttgatca

SEQ ID NO: 288528 - DNA, 15 bp, Homo sapiens
tttttagggttgatc

SEQ ID NO: 288529 - DNA, 15 bp, Homo sapiens
atttttagggttgat

SEQ ID NO: 288530 - DNA, 15 bp, Homo sapiens
catttttagggttga

SEQ ID NO: 288531 - DNA, 15 bp, Homo sapiens
tcatttttagggttg

SEQ ID NO: 288532 - DNA, 15 bp, Homo sapiens
gtcatttttagggtt

SEQ ID NO: 288533 - DNA, 15 bp, Homo sapiens
ggtcatttttagggt

SEQ ID NO: 288534 - DNA, 15 bp, Homo sapiens
aggtcatttttaggg

SEQ ID NO: 288535 - DNA, 15 bp, Homo sapiens
caggtcatttttagg

SEQ ID NO: 288536 - DNA, 15 bp, Homo sapiens
gcaggtcatttttag

SEQ ID NO: 288537 - DNA, 15 bp, Homo sapiens
agcaggtcattttta

SEQ ID NO: 288538 - DNA, 15 bp, Homo sapiens
tagcaggtcattttt

SEQ ID NO: 288539 - DNA, 15 bp, Homo sapiens
ttagcaggtcatttt

SEQ ID NO: 288540 - DNA, 15 bp, Homo sapiens
attagcaggtcattt

SEQ ID NO: 288541 - DNA, 15 bp, Homo sapiens
tattagcaggtcatt

SEQ ID NO: 288542 - DNA, 15 bp, Homo sapiens
ttattagcaggtcat

SEQ ID NO: 288543 - DNA, 15 bp, Homo sapiens
attattagcaggtca

SEQ ID NO: 288544 - DNA, 15 bp, Homo sapiens
tattattagcaggtc

SEQ ID NO: 288545 - DNA, 15 bp, Homo sapiens
atattattagcaggt

SEQ ID NO: 288546 - DNA, 15 bp, Homo sapiens
tatattattagcagg

SEQ ID NO: 288547 - DNA, 15 bp, Homo sapiens
ttatattattagcag

SEQ ID NO: 288548 - DNA, 15 bp, Homo sapiens
tttatattattagca

SEQ ID NO: 288549 - DNA, 15 bp, Homo sapiens
ctttatattattagc

SEQ ID NO: 288550 - DNA, 15 bp, Homo sapiens
actttatattattag

SEQ ID NO: 288551 - DNA, 15 bp, Homo sapiens
tactttatattatta

SEQ ID NO: 288552 - DNA, 15 bp, Homo sapiens
ttactttatattatt

SEQ ID NO: 288553 - DNA, 15 bp, Homo sapiens
tttactttatattat

SEQ ID NO: 288554 - DNA, 15 bp, Homo sapiens
ttttactttatatta

SEQ ID NO: 288555 - DNA, 15 bp, Homo sapiens
attttactttatatt

SEQ ID NO: 288556 - DNA, 15 bp, Homo sapiens
tattttactttatat

SEQ ID NO: 288557 - DNA, 15 bp, Homo sapiens
atattttactttata

SEQ ID NO: 288558 - DNA, 15 bp, Homo sapiens
gatattttactttat

SEQ ID NO: 288559 - DNA, 15 bp, Homo sapiens
agatattttacttta

SEQ ID NO: 288560 - DNA, 15 bp, Homo sapiens
cagatattttacttt

SEQ ID NO: 288561 - DNA, 15 bp, Homo sapiens
acagatattttactt

SEQ ID NO: 288562 - DNA, 15 bp, Homo sapiens
tacagatattttact

SEQ ID NO: 288563 - DNA, 15 bp, Homo sapiens
ctacagatattttac

SEQ ID NO: 288564 - DNA, 15 bp, Homo sapiens
tctacagatatttta

SEQ ID NO: 288565 - DNA, 15 bp, Homo sapiens
ctctacagatatttt

SEQ ID NO: 288566 - DNA, 15 bp, Homo sapiens
tctctacagatattt

SEQ ID NO: 288567 - DNA, 15 bp, Homo sapiens
gtctctacagatatt

SEQ ID NO: 288568 - DNA, 15 bp, Homo sapiens
tgtctctacagatat

SEQ ID NO: 288569 - DNA, 15 bp, Homo sapiens
atgtctctacagata

SEQ ID NO: 288570 - DNA, 15 bp, Homo sapiens
aatgtctctacagat

SEQ ID NO: 288571 - DNA, 15 bp, Homo sapiens
taatgtctctacaga

SEQ ID NO: 288572 - DNA, 15 bp, Homo sapiens
ataatgtctctacag

SEQ ID NO: 288573 - DNA, 15 bp, Homo sapiens
tataatgtctctaca

SEQ ID NO: 288574 - DNA, 15 bp, Homo sapiens
ttataatgtctctac

SEQ ID NO: 288575 - DNA, 15 bp, Homo sapiens
tttataatgtctcta

SEQ ID NO: 288576 - DNA, 15 bp, Homo sapiens
atttataatgtctct

SEQ ID NO: 288577 - DNA, 15 bp, Homo sapiens
tatttataatgtctc

SEQ ID NO: 288578 - DNA, 15 bp, Homo sapiens
atatttataatgtct

SEQ ID NO: 288579 - DNA, 15 bp, Homo sapiens
gatatttataatgtc

SEQ ID NO: 288580 - DNA, 15 bp, Homo sapiens
agatatttataatgt

SEQ ID NO: 288581 - DNA, 15 bp, Homo sapiens
tagatatttataatg

SEQ ID NO: 288582 - DNA, 15 bp, Homo sapiens
gtagatatttataat

SEQ ID NO: 288583 - DNA, 15 bp, Homo sapiens
tgtagatatttataa

SEQ ID NO: 288584 - DNA, 15 bp, Homo sapiens
ttgtagatatttata

SEQ ID NO: 288585 - DNA, 15 bp, Homo sapiens
attgtagatatttat

SEQ ID NO: 288586 - DNA, 15 bp, Homo sapiens
aattgtagatattta

SEQ ID NO: 288587 - DNA, 15 bp, Homo sapiens
taattgtagatattt

SEQ ID NO: 288588 - DNA, 15 bp, Homo sapiens
ataattgtagatatt

SEQ ID NO: 288589 - DNA, 15 bp, Homo sapiens
tataattgtagatat

SEQ ID NO: 288590 - DNA, 15 bp, Homo sapiens
ttataattgtagata

SEQ ID NO: 288591 - DNA, 15 bp, Homo sapiens
attataattgtagat

SEQ ID NO: 288592 - DNA, 15 bp, Homo sapiens
aattataattgtaga

SEQ ID NO: 288593 - DNA, 15 bp, Homo sapiens
aaattataattgtag

SEQ ID NO: 288594 - DNA, 15 bp, Homo sapiens
caaattataattgta

SEQ ID NO: 288595 - DNA, 15 bp, Homo sapiens
acaaattataattgt

SEQ ID NO: 288596 - DNA, 15 bp, Homo sapiens
cacaaattataattg

SEQ ID NO: 288597 - DNA, 15 bp, Homo sapiens
gcacaaattataatt

SEQ ID NO: 288598 - DNA, 15 bp, Homo sapiens
agcacaaattataat

SEQ ID NO: 288599 - DNA, 15 bp, Homo sapiens
cagcacaaattataa

SEQ ID NO: 288600 - DNA, 15 bp, Homo sapiens
tcagcacaaattata

SEQ ID NO: 288601 - DNA, 15 bp, Homo sapiens
ctcagcacaaattat

SEQ ID NO: 288602 - DNA, 15 bp, Homo sapiens
gctcagcacaaatta

SEQ ID NO: 288603 - DNA, 15 bp, Homo sapiens
agctcagcacaaatt

SEQ ID NO: 288604 - DNA, 15 bp, Homo sapiens
tagctcagcacaaat

SEQ ID NO: 288605 - DNA, 15 bp, Homo sapiens
atagctcagcacaaa

SEQ ID NO: 288606 - DNA, 15 bp, Homo sapiens
aatagctcagcacaa

SEQ ID NO: 288607 - DNA, 15 bp, Homo sapiens
aaatagctcagcaca

SEQ ID NO: 288608 - DNA, 15 bp, Homo sapiens
taaatagctcagcac

SEQ ID NO: 288609 - DNA, 15 bp, Homo sapiens
ttaaatagctcagca

SEQ ID NO: 288610 - DNA, 15 bp, Homo sapiens
tttaaatagctcagc

SEQ ID NO: 288611 - DNA, 15 bp, Homo sapiens
atttaaatagctcag

SEQ ID NO: 288612 - DNA, 15 bp, Homo sapiens
tatttaaatagctca

SEQ ID NO: 288613 - DNA, 15 bp, Homo sapiens
ttatttaaatagctc

SEQ ID NO: 288614 - DNA, 15 bp, Homo sapiens
tttatttaaatagct

SEQ ID NO: 288615 - DNA, 15 bp, Homo sapiens
ttttatttaaatagc

SEQ ID NO: 288616 - DNA, 15 bp, Homo sapiens
cttttatttaaatag

SEQ ID NO: 288617 - DNA, 15 bp, Homo sapiens
tcttttatttaaata

SEQ ID NO: 288618 - DNA, 15 bp, Homo sapiens
ttcttttatttaaat

SEQ ID NO: 288619 - DNA, 15 bp, Homo sapiens
gttcttttatttaaa

SEQ ID NO: 288620 - DNA, 15 bp, Homo sapiens
tgttcttttatttaa

SEQ ID NO: 288621 - DNA, 15 bp, Homo sapiens
atgttcttttattta

SEQ ID NO: 288622 - DNA, 15 bp, Homo sapiens
tatgttcttttattt

SEQ ID NO: 288623 - DNA, 15 bp, Homo sapiens
ttatgttcttttatt

SEQ ID NO: 288624 - DNA, 15 bp, Homo sapiens
cttatgttcttttat

SEQ ID NO: 288625 - DNA, 15 bp, Homo sapiens
ccttatgttctttta

SEQ ID NO: 288626 - DNA, 15 bp, Homo sapiens
tccttatgttctttt

SEQ ID NO: 288627 - DNA, 15 bp, Homo sapiens
atccttatgttcttt

SEQ ID NO: 288628 - DNA, 15 bp, Homo sapiens
aatccttatgttctt

SEQ ID NO: 288629 - DNA, 15 bp, Homo sapiens
taatccttatgttct

SEQ ID NO: 288630 - DNA, 15 bp, Homo sapiens
ataatccttatgttc

SEQ ID NO: 288631 - DNA, 15 bp, Homo sapiens
tataatccttatgtt

SEQ ID NO: 288632 - DNA, 15 bp, Homo sapiens
ttataatccttatgt

SEQ ID NO: 288633 - DNA, 15 bp, Homo sapiens
tttataatccttatg

SEQ ID NO: 288634 - DNA, 15 bp, Homo sapiens
gtttataatccttat

SEQ ID NO: 288635 - DNA, 15 bp, Homo sapiens
ggtttataatcctta

SEQ ID NO: 288636 - DNA, 15 bp, Homo sapiens
aggtttataatcctt

SEQ ID NO: 288637 - DNA, 15 bp, Homo sapiens
aaggtttataatcct

SEQ ID NO: 288638 - DNA, 15 bp, Homo sapiens
caaggtttataatcc

SEQ ID NO: 288639 - DNA, 15 bp, Homo sapiens
acaaggtttataatc

SEQ ID NO: 288640 - DNA, 15 bp, Homo sapiens
gacaaggtttataat

SEQ ID NO: 288641 - DNA, 15 bp, Homo sapiens
tgacaaggtttataa

SEQ ID NO: 288642 - DNA, 15 bp, Homo sapiens
atgacaaggtttata

SEQ ID NO: 288643 - DNA, 15 bp, Homo sapiens
tatgacaaggtttat

SEQ ID NO: 288644 - DNA, 15 bp, Homo sapiens
atatgacaaggttta

SEQ ID NO: 288645 - DNA, 15 bp, Homo sapiens
catatgacaaggttt

SEQ ID NO: 288646 - DNA, 15 bp, Homo sapiens
ccatatgacaaggtt

SEQ ID NO: 288647 - DNA, 15 bp, Homo sapiens
cccatatgacaaggt

SEQ ID NO: 288648 - DNA, 15 bp, Homo sapiens
acccatatgacaagg

SEQ ID NO: 288649 - DNA, 15 bp, Homo sapiens
aacccatatgacaag

SEQ ID NO: 288650 - DNA, 15 bp, Homo sapiens
taacccatatgacaa

SEQ ID NO: 288651 - DNA, 15 bp, Homo sapiens
gtaacccatatgaca

SEQ ID NO: 288652 - DNA, 15 bp, Homo sapiens
tgtaacccatatgac

SEQ ID NO: 288653 - DNA, 15 bp, Homo sapiens
ttgtaacccatatga

SEQ ID NO: 288654 - DNA, 15 bp, Homo sapiens
tttgtaacccatatg

SEQ ID NO: 288655 - DNA, 15 bp, Homo sapiens
ctttgtaacccatat

SEQ ID NO: 288656 - DNA, 15 bp, Homo sapiens
gctttgtaacccata

SEQ ID NO: 288657 - DNA, 15 bp, Homo sapiens
tgctttgtaacccat

SEQ ID NO: 288658 - DNA, 15 bp, Homo sapiens
atgctttgtaaccca

SEQ ID NO: 288659 - DNA, 15 bp, Homo sapiens
aatgctttgtaaccc

SEQ ID NO: 288660 - DNA, 15 bp, Homo sapiens
aaatgctttgtaacc

SEQ ID NO: 288661 - DNA, 15 bp, Homo sapiens
gaaatgctttgtaac

SEQ ID NO: 288662 - DNA, 15 bp, Homo sapiens
tgaaatgctttgtaa

SEQ ID NO: 288663 - DNA, 15 bp, Homo sapiens
ttgaaatgctttgta

SEQ ID NO: 288664 - DNA, 15 bp, Homo sapiens
tttgaaatgctttgt

SEQ ID NO: 288665 - DNA, 15 bp, Homo sapiens
ctttgaaatgctttg

SEQ ID NO: 288666 - DNA, 15 bp, Homo sapiens
actttgaaatgcttt

SEQ ID NO: 288667 - DNA, 15 bp, Homo sapiens
aactttgaaatgctt

SEQ ID NO: 288668 - DNA, 15 bp, Homo sapiens
taactttgaaatgct

SEQ ID NO: 288669 - DNA, 15 bp, Homo sapiens
gtaactttgaaatgc

SEQ ID NO: 288670 - DNA, 15 bp, Homo sapiens
agtaactttgaaatg

SEQ ID NO: 288671 - DNA, 15 bp, Homo sapiens
aagtaactttgaaat

SEQ ID NO: 288672 - DNA, 15 bp, Homo sapiens
aaagtaactttgaaa

SEQ ID NO: 288673 - DNA, 15 bp, Homo sapiens
gaaagtaactttgaa

SEQ ID NO: 288674 - DNA, 15 bp, Homo sapiens
tgaaagtaactttga

SEQ ID NO: 288675 - DNA, 15 bp, Homo sapiens
ttgaaagtaactttg

SEQ ID NO: 288676 - DNA, 15 bp, Homo sapiens
gttgaaagtaacttt

SEQ ID NO: 288677 - DNA, 15 bp, Homo sapiens
cgttgaaagtaactt

SEQ ID NO: 288678 - DNA, 15 bp, Homo sapiens
tcgttgaaagtaact

SEQ ID NO: 288679 - DNA, 15 bp, Homo sapiens
ttcgttgaaagtaac

SEQ ID NO: 288680 - DNA, 15 bp, Homo sapiens
tttcgttgaaagtaa

SEQ ID NO: 288681 - DNA, 15 bp, Homo sapiens
atttcgttgaaagta

SEQ ID NO: 288682 - DNA, 15 bp, Homo sapiens
aatttcgttgaaagt

SEQ ID NO: 288683 - DNA, 15 bp, Homo sapiens
gaatttcgttgaaag

SEQ ID NO: 288684 - DNA, 15 bp, Homo sapiens
agaatttcgttgaaa

SEQ ID NO: 288685 - DNA, 15 bp, Homo sapiens
tagaatttcgttgaa

SEQ ID NO: 288686 - DNA, 15 bp, Homo sapiens
ttagaatttcgttga

SEQ ID NO: 288687 - DNA, 15 bp, Homo sapiens
tttagaatttcgttg

SEQ ID NO: 288688 - DNA, 15 bp, Homo sapiens
ctttagaatttcgtt

SEQ ID NO: 288689 - DNA, 15 bp, Homo sapiens
tctttagaatttcgt

SEQ ID NO: 288690 - DNA, 15 bp, Homo sapiens
gtctttagaatttcg

SEQ ID NO: 288691 - DNA, 15 bp, Homo sapiens
tgtctttagaatttc

SEQ ID NO: 288692 - DNA, 15 bp, Homo sapiens
ctgtctttagaattt

SEQ ID NO: 288693 - DNA, 15 bp, Homo sapiens
actgtctttagaatt

SEQ ID NO: 288694 - DNA, 15 bp, Homo sapiens
cactgtctttagaat

SEQ ID NO: 288695 - DNA, 15 bp, Homo sapiens
tcactgtctttagaa

SEQ ID NO: 288696 - DNA, 15 bp, Homo sapiens
ttcactgtctttaga

SEQ ID NO: 288697 - DNA, 15 bp, Homo sapiens
cttcactgtctttag

SEQ ID NO: 288698 - DNA, 15 bp, Homo sapiens
acttcactgtcttta

SEQ ID NO: 288699 - DNA, 15 bp, Homo sapiens
gacttcactgtcttt

SEQ ID NO: 288700 - DNA, 15 bp, Homo sapiens
tgacttcactgtctt

SEQ ID NO: 288701 - DNA, 15 bp, Homo sapiens
ctgacttcactgtct

SEQ ID NO: 288702 - DNA, 15 bp, Homo sapiens
tctgacttcactgtc

SEQ ID NO: 288703 - DNA, 15 bp, Homo sapiens
atctgacttcactgt

SEQ ID NO: 288704 - DNA, 15 bp, Homo sapiens
catctgacttcactg

SEQ ID NO: 288705 - DNA, 15 bp, Homo sapiens
tcatctgacttcact

SEQ ID NO: 288706 - DNA, 15 bp, Homo sapiens
atcatctgacttcac

SEQ ID NO: 288707 - DNA, 15 bp, Homo sapiens
aatcatctgacttca

SEQ ID NO: 288708 - DNA, 15 bp, Homo sapiens
gaatcatctgacttc

SEQ ID NO: 288709 - DNA, 15 bp, Homo sapiens
agaatcatctgactt

SEQ ID NO: 288710 - DNA, 15 bp, Homo sapiens
aagaatcatctgact

SEQ ID NO: 288711 - DNA, 15 bp, Homo sapiens
taagaatcatctgac

SEQ ID NO: 288712 - DNA, 15 bp, Homo sapiens
ttaagaatcatctga

SEQ ID NO: 288713 - DNA, 15 bp, Homo sapiens
attaagaatcatctg

SEQ ID NO: 288714 - DNA, 15 bp, Homo sapiens
aattaagaatcatct

SEQ ID NO: 288715 - DNA, 15 bp, Homo sapiens
gaattaagaatcatc

SEQ ID NO: 288716 - DNA, 15 bp, Homo sapiens
tgaattaagaatcat

SEQ ID NO: 288717 - DNA, 15 bp, Homo sapiens
ctgaattaagaatca

SEQ ID NO: 288718 - DNA, 15 bp, Homo sapiens
actgaattaagaatc

SEQ ID NO: 288719 - DNA, 15 bp, Homo sapiens
tactgaattaagaat

SEQ ID NO: 288720 - DNA, 15 bp, Homo sapiens
ctactgaattaagaa

SEQ ID NO: 288721 - DNA, 15 bp, Homo sapiens
actactgaattaaga

SEQ ID NO: 288722 - DNA, 15 bp, Homo sapiens
gactactgaattaag

SEQ ID NO: 288723 - DNA, 15 bp, Homo sapiens
agactactgaattaa

SEQ ID NO: 288724 - DNA, 15 bp, Homo sapiens
aagactactgaatta

SEQ ID NO: 288725 - DNA, 15 bp, Homo sapiens
aaagactactgaatt

SEQ ID NO: 288726 - DNA, 15 bp, Homo sapiens
aaaagactactgaat

SEQ ID NO: 288727 - DNA, 15 bp, Homo sapiens
taaaagactactgaa

SEQ ID NO: 288728 - DNA, 15 bp, Homo sapiens
ttaaaagactactga

SEQ ID NO: 288729 - DNA, 15 bp, Homo sapiens
attaaaagactactg

SEQ ID NO: 288730 - DNA, 15 bp, Homo sapiens
gattaaaagactact

SEQ ID NO: 288731 - DNA, 15 bp, Homo sapiens
tgattaaaagactac

SEQ ID NO: 288732 - DNA, 15 bp, Homo sapiens
ttgattaaaagacta

SEQ ID NO: 288733 - DNA, 15 bp, Homo sapiens
gttgattaaaagact

SEQ ID NO: 288734 - DNA, 15 bp, Homo sapiens
agttgattaaaagac

SEQ ID NO: 288735 - DNA, 15 bp, Homo sapiens
gagttgattaaaaga

SEQ ID NO: 288736 - DNA, 15 bp, Homo sapiens
agagttgattaaaag

SEQ ID NO: 288737 - DNA, 15 bp, Homo sapiens
aagagttgattaaaa

SEQ ID NO: 288738 - DNA, 15 bp, Homo sapiens
aaagagttgattaaa

SEQ ID NO: 288739 - DNA, 15 bp, Homo sapiens
taaagagttgattaa

SEQ ID NO: 288740 - DNA, 15 bp, Homo sapiens
ctaaagagttgatta

SEQ ID NO: 288741 - DNA, 15 bp, Homo sapiens
cctaaagagttgatt

SEQ ID NO: 288742 - DNA, 15 bp, Homo sapiens
gcctaaagagttgat

SEQ ID NO: 288743 - DNA, 15 bp, Homo sapiens
tgcctaaagagttga

SEQ ID NO: 288744 - DNA, 15 bp, Homo sapiens
atgcctaaagagttg

SEQ ID NO: 288745 - DNA, 15 bp, Homo sapiens
catgcctaaagagtt

SEQ ID NO: 288746 - DNA, 15 bp, Homo sapiens
ccatgcctaaagagt

SEQ ID NO: 288747 - DNA, 15 bp, Homo sapiens
tccatgcctaaagag

SEQ ID NO: 288748 - DNA, 15 bp, Homo sapiens
ctccatgcctaaaga

SEQ ID NO: 288749 - DNA, 15 bp, Homo sapiens
actccatgcctaaag

SEQ ID NO: 288750 - DNA, 15 bp, Homo sapiens
tactccatgcctaaa

SEQ ID NO: 288751 - DNA, 15 bp, Homo sapiens
ttactccatgcctaa

SEQ ID NO: 288752 - DNA, 15 bp, Homo sapiens
attactccatgccta

SEQ ID NO: 288753 - DNA, 15 bp, Homo sapiens
aattactccatgcct

SEQ ID NO: 288754 - DNA, 15 bp, Homo sapiens
caattactccatgcc

SEQ ID NO: 288755 - DNA, 15 bp, Homo sapiens
tcaattactccatgc

SEQ ID NO: 288756 - DNA, 15 bp, Homo sapiens
atcaattactccatg

SEQ ID NO: 288757 - DNA, 15 bp, Homo sapiens
aatcaattactccat

SEQ ID NO: 288758 - DNA, 15 bp, Homo sapiens
aaatcaattactcca

SEQ ID NO: 288759 - DNA, 15 bp, Homo sapiens
aaaatcaattactcc

SEQ ID NO: 288760 - DNA, 15 bp, Homo sapiens
caaaatcaattactc

SEQ ID NO: 288761 - DNA, 15 bp, Homo sapiens
acaaaatcaattact

SEQ ID NO: 288762 - DNA, 15 bp, Homo sapiens
gacaaaatcaattac

SEQ ID NO: 288763 - DNA, 15 bp, Homo sapiens
agacaaaatcaatta

SEQ ID NO: 288764 - DNA, 15 bp, Homo sapiens
tagacaaaatcaatt

SEQ ID NO: 288765 - DNA, 15 bp, Homo sapiens
gtagacaaaatcaat

SEQ ID NO: 288766 - DNA, 15 bp, Homo sapiens
tgtagacaaaatcaa

SEQ ID NO: 288767 - DNA, 15 bp, Homo sapiens
ctgtagacaaaatca

SEQ ID NO: 288768 - DNA, 15 bp, Homo sapiens
actgtagacaaaatc

SEQ ID NO: 288769 - DNA, 15 bp, Homo sapiens
tactgtagacaaaat

SEQ ID NO: 288770 - DNA, 15 bp, Homo sapiens
ctactgtagacaaaa

SEQ ID NO: 288771 - DNA, 15 bp, Homo sapiens
gctactgtagacaaa

SEQ ID NO: 288772 - DNA, 15 bp, Homo sapiens
agctactgtagacaa

SEQ ID NO: 288773 - DNA, 15 bp, Homo sapiens
aagctactgtagaca

SEQ ID NO: 288774 - DNA, 15 bp, Homo sapiens
aaagctactgtagac

SEQ ID NO: 288775 - DNA, 15 bp, Homo sapiens
aaaagctactgtaga

SEQ ID NO: 288776 - DNA, 15 bp, Homo sapiens
taaaagctactgtag

SEQ ID NO: 288777 - DNA, 15 bp, Homo sapiens
ataaaagctactgta

SEQ ID NO: 288778 - DNA, 15 bp, Homo sapiens
tataaaagctactgt

SEQ ID NO: 288779 - DNA, 15 bp, Homo sapiens
gtataaaagctactg

SEQ ID NO: 288780 - DNA, 15 bp, Homo sapiens
agtataaaagctact

SEQ ID NO: 288781 - DNA, 15 bp, Homo sapiens
tagtataaaagctac

SEQ ID NO: 288782 - DNA, 15 bp, Homo sapiens
ttagtataaaagcta

SEQ ID NO: 288783 - DNA, 15 bp, Homo sapiens
tttagtataaaagct

SEQ ID NO: 288784 - DNA, 15 bp, Homo sapiens
atttagtataaaagc

SEQ ID NO: 288785 - DNA, 15 bp, Homo sapiens
catttagtataaaag

SEQ ID NO: 288786 - DNA, 15 bp, Homo sapiens
gcatttagtataaaa

SEQ ID NO: 288787 - DNA, 15 bp, Homo sapiens
agcatttagtataaa

SEQ ID NO: 288788 - DNA, 15 bp, Homo sapiens
cagcatttagtataa

SEQ ID NO: 288789 - DNA, 15 bp, Homo sapiens
acagcatttagtata

SEQ ID NO: 288790 - DNA, 15 bp, Homo sapiens
aacagcatttagtat

SEQ ID NO: 288791 - DNA, 15 bp, Homo sapiens
gaacagcatttagta

SEQ ID NO: 288792 - DNA, 15 bp, Homo sapiens
ggaacagcatttagt

SEQ ID NO: 288793 - DNA, 15 bp, Homo sapiens
aggaacagcatttag

SEQ ID NO: 288794 - DNA, 15 bp, Homo sapiens
aaggaacagcattta

SEQ ID NO: 288795 - DNA, 15 bp, Homo sapiens
taaggaacagcattt

SEQ ID NO: 288796 - DNA, 15 bp, Homo sapiens
ataaggaacagcatt

SEQ ID NO: 288797 - DNA, 15 bp, Homo sapiens
aataaggaacagcat

SEQ ID NO: 288798 - DNA, 15 bp, Homo sapiens
aaataaggaacagca

SEQ ID NO: 288799 - DNA, 15 bp, Homo sapiens
aaaataaggaacagc

SEQ ID NO: 288800 - DNA, 15 bp, Homo sapiens
aaaaataaggaacag

SEQ ID NO: 288801 - DNA, 15 bp, Homo sapiens
caaaaataaggaaca

SEQ ID NO: 288802 - DNA, 15 bp, Homo sapiens
acaaaaataaggaac

SEQ ID NO: 288803 - DNA, 15 bp, Homo sapiens
aacaaaaataaggaa

SEQ ID NO: 288804 - DNA, 15 bp, Homo sapiens
aaacaaaaataagga

SEQ ID NO: 288805 - DNA, 15 bp, Homo sapiens
aaaacaaaaataagg

SEQ ID NO: 288806 - DNA, 15 bp, Homo sapiens
aaaaacaaaaataag

SEQ ID NO: 288807 - DNA, 15 bp, Homo sapiens
aaaaaacaaaaataa

SEQ ID NO: 288808 - DNA, 15 bp, Homo sapiens
gaaaaaacaaaaata

SEQ ID NO: 288809 - DNA, 15 bp, Homo sapiens
agaaaaaacaaaaat

SEQ ID NO: 288810 - DNA, 15 bp, Homo sapiens
cagaaaaaacaaaaa

SEQ ID NO: 288811 - DNA, 15 bp, Homo sapiens
gcagaaaaaacaaaa

SEQ ID NO: 288812 - DNA, 15 bp, Homo sapiens
agcagaaaaaacaaa

SEQ ID NO: 288813 - DNA, 15 bp, Homo sapiens
cagcagaaaaaacaa

SEQ ID NO: 288814 - DNA, 15 bp, Homo sapiens
tcagcagaaaaaaca

SEQ ID NO: 288815 - DNA, 15 bp, Homo sapiens
ctcagcagaaaaaac

SEQ ID NO: 288816 - DNA, 15 bp, Homo sapiens
actcagcagaaaaaa

SEQ ID NO: 288817 - DNA, 15 bp, Homo sapiens
tactcagcagaaaaa

SEQ ID NO: 288818 - DNA, 15 bp, Homo sapiens
ttactcagcagaaaa

SEQ ID NO: 288819 - DNA, 15 bp, Homo sapiens
cttactcagcagaaa

SEQ ID NO: 288820 - DNA, 15 bp, Homo sapiens
tcttactcagcagaa

SEQ ID NO: 288821 - DNA, 15 bp, Homo sapiens
atcttactcagcaga

SEQ ID NO: 288822 - DNA, 15 bp, Homo sapiens
tatcttactcagcag

SEQ ID NO: 288823 - DNA, 15 bp, Homo sapiens
atatcttactcagca

SEQ ID NO: 288824 - DNA, 15 bp, Homo sapiens
gatatcttactcagc

SEQ ID NO: 288825 - DNA, 15 bp, Homo sapiens
ggatatcttactcag

SEQ ID NO: 288826 - DNA, 15 bp, Homo sapiens
gggatatcttactca

SEQ ID NO: 288827 - DNA, 15 bp, Homo sapiens
agggatatcttactc

SEQ ID NO: 288828 - DNA, 15 bp, Homo sapiens
aagggatatcttact

SEQ ID NO: 288829 - DNA, 15 bp, Homo sapiens
gaagggatatcttac

SEQ ID NO: 288830 - DNA, 15 bp, Homo sapiens
agaagggatatctta

SEQ ID NO: 288831 - DNA, 15 bp, Homo sapiens
cagaagggatatctt

SEQ ID NO: 288832 - DNA, 15 bp, Homo sapiens
tcagaagggatatct

SEQ ID NO: 288833 - DNA, 15 bp, Homo sapiens
ttcagaagggatatc

SEQ ID NO: 288834 - DNA, 15 bp, Homo sapiens
cttcagaagggatat

SEQ ID NO: 288835 - DNA, 15 bp, Homo sapiens
acttcagaagggata

SEQ ID NO: 288836 - DNA, 15 bp, Homo sapiens
aacttcagaagggat

SEQ ID NO: 288837 - DNA, 15 bp, Homo sapiens
aaacttcagaaggga

SEQ ID NO: 288838 - DNA, 15 bp, Homo sapiens
taaacttcagaaggg

SEQ ID NO: 288839 - DNA, 15 bp, Homo sapiens
ataaacttcagaagg

SEQ ID NO: 288840 - DNA, 15 bp, Homo sapiens
cataaacttcagaag

SEQ ID NO: 288841 - DNA, 15 bp, Homo sapiens
tcataaacttcagaa

SEQ ID NO: 288842 - DNA, 15 bp, Homo sapiens
ctcataaacttcaga

SEQ ID NO: 288843 - DNA, 15 bp, Homo sapiens
tctcataaacttcag

SEQ ID NO: 288844 - DNA, 15 bp, Homo sapiens
atctcataaacttca

SEQ ID NO: 288845 - DNA, 15 bp, Homo sapiens
tatctcataaacttc

SEQ ID NO: 288846 - DNA, 15 bp, Homo sapiens
ctatctcataaactt

SEQ ID NO: 288847 - DNA, 15 bp, Homo sapiens
tctatctcataaact

SEQ ID NO: 288848 - DNA, 15 bp, Homo sapiens
ctctatctcataaac

SEQ ID NO: 288849 - DNA, 15 bp, Homo sapiens
gctctatctcataaa

SEQ ID NO: 288850 - DNA, 15 bp, Homo sapiens
agctctatctcataa

SEQ ID NO: 288851 - DNA, 15 bp, Homo sapiens
cagctctatctcata

SEQ ID NO: 288852 - DNA, 15 bp, Homo sapiens
acagctctatctcat

SEQ ID NO: 288853 - DNA, 15 bp, Homo sapiens
aacagctctatctca

SEQ ID NO: 288854 - DNA, 15 bp, Homo sapiens
taacagctctatctc

SEQ ID NO: 288855 - DNA, 15 bp, Homo sapiens
ctaacagctctatct

SEQ ID NO: 288856 - DNA, 15 bp, Homo sapiens
tctaacagctctatc

SEQ ID NO: 288857 - DNA, 15 bp, Homo sapiens
atctaacagctctat

SEQ ID NO: 288858 - DNA, 15 bp, Homo sapiens
catctaacagctcta

SEQ ID NO: 288859 - DNA, 15 bp, Homo sapiens
tcatctaacagctct

SEQ ID NO: 288860 - DNA, 15 bp, Homo sapiens
ttcatctaacagctc

SEQ ID NO: 288861 - DNA, 15 bp, Homo sapiens
tttcatctaacagct

SEQ ID NO: 288862 - DNA, 15 bp, Homo sapiens
ctttcatctaacagc

SEQ ID NO: 288863 - DNA, 15 bp, Homo sapiens
tctttcatctaacag

SEQ ID NO: 288864 - DNA, 15 bp, Homo sapiens
ctctttcatctaaca

SEQ ID NO: 288865 - DNA, 15 bp, Homo sapiens
tctctttcatctaac

SEQ ID NO: 288866 - DNA, 15 bp, Homo sapiens
ttctctttcatctaa

SEQ ID NO: 288867 - DNA, 15 bp, Homo sapiens
cttctctttcatcta

SEQ ID NO: 288868 - DNA, 15 bp, Homo sapiens
gcttctctttcatct

SEQ ID NO: 288869 - DNA, 15 bp, Homo sapiens
ggcttctctttcatc

SEQ ID NO: 288870 - DNA, 15 bp, Homo sapiens
aggcttctctttcat

SEQ ID NO: 288871 - DNA, 15 bp, Homo sapiens
caggcttctctttca

SEQ ID NO: 288872 - DNA, 15 bp, Homo sapiens
tcaggcttctctttc

SEQ ID NO: 288873 - DNA, 15 bp, Homo sapiens
ttcaggcttctcttt

SEQ ID NO: 288874 - DNA, 15 bp, Homo sapiens
tttcaggcttctctt

SEQ ID NO: 288875 - DNA, 15 bp, Homo sapiens
atttcaggcttctct

SEQ ID NO: 288876 - DNA, 15 bp, Homo sapiens
catttcaggcttctc

SEQ ID NO: 288877 - DNA, 15 bp, Homo sapiens
acatttcaggcttct

SEQ ID NO: 288878 - DNA, 15 bp, Homo sapiens
aacatttcaggcttc

SEQ ID NO: 288879 - DNA, 15 bp, Homo sapiens
caacatttcaggctt

SEQ ID NO: 288880 - DNA, 15 bp, Homo sapiens
tcaacatttcaggct

SEQ ID NO: 288881 - DNA, 15 bp, Homo sapiens
gtcaacatttcaggc

SEQ ID NO: 288882 - DNA, 15 bp, Homo sapiens
agtcaacatttcagg

SEQ ID NO: 288883 - DNA, 15 bp, Homo sapiens
gagtcaacatttcag

SEQ ID NO: 288884 - DNA, 15 bp, Homo sapiens
tgagtcaacatttca

SEQ ID NO: 288885 - DNA, 15 bp, Homo sapiens
atgagtcaacatttc

SEQ ID NO: 288886 - DNA, 15 bp, Homo sapiens
catgagtcaacattt

SEQ ID NO: 288887 - DNA, 15 bp, Homo sapiens
acatgagtcaacatt

SEQ ID NO: 288888 - DNA, 15 bp, Homo sapiens
tacatgagtcaacat

SEQ ID NO: 288889 - DNA, 15 bp, Homo sapiens
ttacatgagtcaaca

SEQ ID NO: 288890 - DNA, 15 bp, Homo sapiens
attacatgagtcaac

SEQ ID NO: 288891 - DNA, 15 bp, Homo sapiens
tattacatgagtcaa

SEQ ID NO: 288892 - DNA, 15 bp, Homo sapiens
atattacatgagtca

SEQ ID NO: 288893 - DNA, 15 bp, Homo sapiens
gatattacatgagtc

SEQ ID NO: 288894 - DNA, 15 bp, Homo sapiens
ggatattacatgagt

SEQ ID NO: 288895 - DNA, 15 bp, Homo sapiens
tggatattacatgag

SEQ ID NO: 288896 - DNA, 15 bp, Homo sapiens
atggatattacatga

SEQ ID NO: 288897 - DNA, 15 bp, Homo sapiens
catggatattacatg

SEQ ID NO: 288898 - DNA, 15 bp, Homo sapiens
gcatggatattacat

SEQ ID NO: 288899 - DNA, 15 bp, Homo sapiens
agcatggatattaca

SEQ ID NO: 288900 - DNA, 15 bp, Homo sapiens
gagcatggatattac

SEQ ID NO: 288901 - DNA, 15 bp, Homo sapiens
agagcatggatatta

SEQ ID NO: 288902 - DNA, 15 bp, Homo sapiens
cagagcatggatatt

SEQ ID NO: 288903 - DNA, 15 bp, Homo sapiens
gcagagcatggatat

SEQ ID NO: 288904 - DNA, 15 bp, Homo sapiens
agcagagcatggata

SEQ ID NO: 288905 - DNA, 15 bp, Homo sapiens
tagcagagcatggat

SEQ ID NO: 288906 - DNA, 15 bp, Homo sapiens
ctagcagagcatgga

SEQ ID NO: 288907 - DNA, 15 bp, Homo sapiens
tctagcagagcatgg

SEQ ID NO: 288908 - DNA, 15 bp, Homo sapiens
atctagcagagcatg

SEQ ID NO: 288909 - DNA, 15 bp, Homo sapiens
catctagcagagcat

SEQ ID NO: 288910 - DNA, 15 bp, Homo sapiens
tcatctagcagagca

SEQ ID NO: 288911 - DNA, 15 bp, Homo sapiens
ttcatctagcagagc

SEQ ID NO: 288912 - DNA, 15 bp, Homo sapiens
gttcatctagcagag

SEQ ID NO: 288913 - DNA, 15 bp, Homo sapiens
agttcatctagcaga

SEQ ID NO: 288914 - DNA, 15 bp, Homo sapiens
aagttcatctagcag

SEQ ID NO: 288915 - DNA, 15 bp, Homo sapiens
gaagttcatctagca

SEQ ID NO: 288916 - DNA, 15 bp, Homo sapiens
agaagttcatctagc

SEQ ID NO: 288917 - DNA, 15 bp, Homo sapiens
aagaagttcatctag

SEQ ID NO: 288918 - DNA, 15 bp, Homo sapiens
gaagaagttcatcta

SEQ ID NO: 288919 - DNA, 15 bp, Homo sapiens
ggaagaagttcatct

SEQ ID NO: 288920 - DNA, 15 bp, Homo sapiens
aggaagaagttcatc

SEQ ID NO: 288921 - DNA, 15 bp, Homo sapiens
taggaagaagttcat

SEQ ID NO: 288922 - DNA, 15 bp, Homo sapiens
ctaggaagaagttca

SEQ ID NO: 288923 - DNA, 15 bp, Homo sapiens
tctaggaagaagttc

SEQ ID NO: 288924 - DNA, 15 bp, Homo sapiens
ctctaggaagaagtt

SEQ ID NO: 288925 - DNA, 15 bp, Homo sapiens
actctaggaagaagt

SEQ ID NO: 288926 - DNA, 15 bp, Homo sapiens
aactctaggaagaag

SEQ ID NO: 288927 - DNA, 15 bp, Homo sapiens
aaactctaggaagaa

SEQ ID NO: 288928 - DNA, 15 bp, Homo sapiens
aaaactctaggaaga

SEQ ID NO: 288929 - DNA, 15 bp, Homo sapiens
taaaactctaggaag

SEQ ID NO: 288930 - DNA, 15 bp, Homo sapiens
ttaaaactctaggaa

SEQ ID NO: 288931 - DNA, 15 bp, Homo sapiens
tttaaaactctagga

SEQ ID NO: 288932 - DNA, 15 bp, Homo sapiens
ttttaaaactctagg

SEQ ID NO: 288933 - DNA, 15 bp, Homo sapiens
cttttaaaactctag

SEQ ID NO: 288934 - DNA, 15 bp, Homo sapiens
ccttttaaaactcta

SEQ ID NO: 288935 - DNA, 15 bp, Homo sapiens
cccttttaaaactct

SEQ ID NO: 288936 - DNA, 15 bp, Homo sapiens
tcccttttaaaactc

SEQ ID NO: 288937 - DNA, 15 bp, Homo sapiens
ctcccttttaaaact

SEQ ID NO: 288938 - DNA, 15 bp, Homo sapiens
cctcccttttaaaac

SEQ ID NO: 288939 - DNA, 15 bp, Homo sapiens
acctcccttttaaaa

SEQ ID NO: 288940 - DNA, 15 bp, Homo sapiens
gacctcccttttaaa

SEQ ID NO: 288941 - DNA, 15 bp, Homo sapiens
tgacctcccttttaa

SEQ ID NO: 288942 - DNA, 15 bp, Homo sapiens
atgacctccctttta

SEQ ID NO: 288943 - DNA, 15 bp, Homo sapiens
catgacctccctttt

SEQ ID NO: 288944 - DNA, 15 bp, Homo sapiens
ccatgacctcccttt

SEQ ID NO: 288945 - DNA, 15 bp, Homo sapiens
tccatgacctccctt

SEQ ID NO: 288946 - DNA, 15 bp, Homo sapiens
ctccatgacctccct

SEQ ID NO: 288947 - DNA, 15 bp, Homo sapiens
tctccatgacctccc

SEQ ID NO: 288948 - DNA, 15 bp, Homo sapiens
gtctccatgacctcc

SEQ ID NO: 288949 - DNA, 15 bp, Homo sapiens
tgtctccatgacctc

SEQ ID NO: 288950 - DNA, 15 bp, Homo sapiens
gtgtctccatgacct

SEQ ID NO: 288951 - DNA, 15 bp, Homo sapiens
agtgtctccatgacc

SEQ ID NO: 288952 - DNA, 15 bp, Homo sapiens
cagtgtctccatgac

SEQ ID NO: 288953 - DNA, 15 bp, Homo sapiens
tcagtgtctccatga

SEQ ID NO: 288954 - DNA, 15 bp, Homo sapiens
ctcagtgtctccatg

SEQ ID NO: 288955 - DNA, 15 bp, Homo sapiens
gctcagtgtctccat

SEQ ID NO: 288956 - DNA, 15 bp, Homo sapiens
agctcagtgtctcca

SEQ ID NO: 288957 - DNA, 15 bp, Homo sapiens
gagctcagtgtctcc

SEQ ID NO: 288958 - DNA, 15 bp, Homo sapiens
agagctcagtgtctc

SEQ ID NO: 288959 - DNA, 15 bp, Homo sapiens
tagagctcagtgtct

SEQ ID NO: 288960 - DNA, 15 bp, Homo sapiens
ttagagctcagtgtc

SEQ ID NO: 288961 - DNA, 15 bp, Homo sapiens
cttagagctcagtgt

SEQ ID NO: 288962 - DNA, 15 bp, Homo sapiens
tcttagagctcagtg

SEQ ID NO: 288963 - DNA, 15 bp, Homo sapiens
gtcttagagctcagt

SEQ ID NO: 288964 - DNA, 15 bp, Homo sapiens
tgtcttagagctcag

SEQ ID NO: 288965 - DNA, 15 bp, Homo sapiens
ttgtcttagagctca

SEQ ID NO: 288966 - DNA, 15 bp, Homo sapiens
tttgtcttagagctc

SEQ ID NO: 288967 - DNA, 15 bp, Homo sapiens
gtttgtcttagagct

SEQ ID NO: 288968 - DNA, 15 bp, Homo sapiens
agtttgtcttagagc

SEQ ID NO: 288969 - DNA, 15 bp, Homo sapiens
aagtttgtcttagag

SEQ ID NO: 288970 - DNA, 15 bp, Homo sapiens
caagtttgtcttaga

SEQ ID NO: 288971 - DNA, 15 bp, Homo sapiens
ccaagtttgtcttag

SEQ ID NO: 288972 - DNA, 15 bp, Homo sapiens
gccaagtttgtctta

SEQ ID NO: 288973 - DNA, 15 bp, Homo sapiens
ggccaagtttgtctt

SEQ ID NO: 288974 - DNA, 15 bp, Homo sapiens
gggccaagtttgtct

SEQ ID NO: 288975 - DNA, 15 bp, Homo sapiens
tgggccaagtttgtc

SEQ ID NO: 288976 - DNA, 15 bp, Homo sapiens
ctgggccaagtttgt

SEQ ID NO: 288977 - DNA, 15 bp, Homo sapiens
gctgggccaagtttg

SEQ ID NO: 288978 - DNA, 15 bp, Homo sapiens
ggctgggccaagttt

SEQ ID NO: 288979 - DNA, 15 bp, Homo sapiens
tggctgggccaagtt

SEQ ID NO: 288980 - DNA, 15 bp, Homo sapiens
gtggctgggccaagt

SEQ ID NO: 288981 - DNA, 15 bp, Homo sapiens
agtggctgggccaag

SEQ ID NO: 288982 - DNA, 15 bp, Homo sapiens
tagtggctgggccaa

SEQ ID NO: 288983 - DNA, 15 bp, Homo sapiens
atagtggctgggcca

SEQ ID NO: 288984 - DNA, 15 bp, Homo sapiens
gatagtggctgggcc

SEQ ID NO: 288985 - DNA, 15 bp, Homo sapiens
ggatagtggctgggc

SEQ ID NO: 288986 - DNA, 15 bp, Homo sapiens
aggatagtggctggg

SEQ ID NO: 288987 - DNA, 15 bp, Homo sapiens
caggatagtggctgg

SEQ ID NO: 288988 - DNA, 15 bp, Homo sapiens
acaggatagtggctg

SEQ ID NO: 288989 - DNA, 15 bp, Homo sapiens
gacaggatagtggct

SEQ ID NO: 288990 - DNA, 15 bp, Homo sapiens
ggacaggatagtggc

SEQ ID NO: 288991 - DNA, 15 bp, Homo sapiens
tggacaggatagtgg

SEQ ID NO: 288992 - DNA, 15 bp, Homo sapiens
atggacaggatagtg

SEQ ID NO: 288993 - DNA, 15 bp, Homo sapiens
gatggacaggatagt

SEQ ID NO: 288994 - DNA, 15 bp, Homo sapiens
tgatggacaggatag

SEQ ID NO: 288995 - DNA, 15 bp, Homo sapiens
atgatggacaggata

SEQ ID NO: 288996 - DNA, 15 bp, Homo sapiens
aatgatggacaggat

SEQ ID NO: 288997 - DNA, 15 bp, Homo sapiens
taatgatggacagga

SEQ ID NO: 288998 - DNA, 15 bp, Homo sapiens
ataatgatggacagg

SEQ ID NO: 288999 - DNA, 15 bp, Homo sapiens
aataatgatggacag

SEQ ID NO: 289000 - DNA, 15 bp, Homo sapiens
aaataatgatggaca

SEQ ID NO: 289001 - DNA, 15 bp, Homo sapiens
gaaataatgatggac

SEQ ID NO: 289002 - DNA, 15 bp, Homo sapiens
agaaataatgatgga

SEQ ID NO: 289003 - DNA, 15 bp, Homo sapiens
tagaaataatgatgg

SEQ ID NO: 289004 - DNA, 15 bp, Homo sapiens
gtagaaataatgatg

SEQ ID NO: 289005 - DNA, 15 bp, Homo sapiens
agtagaaataatgat

SEQ ID NO: 289006 - DNA, 15 bp, Homo sapiens
aagtagaaataatga

SEQ ID NO: 289007 - DNA, 15 bp, Homo sapiens
gaagtagaaataatg

SEQ ID NO: 289008 - DNA, 15 bp, Homo sapiens
ggaagtagaaataat

SEQ ID NO: 289009 - DNA, 15 bp, Homo sapiens
aggaagtagaaataa

SEQ ID NO: 289010 - DNA, 15 bp, Homo sapiens
aaggaagtagaaata

SEQ ID NO: 289011 - DNA, 15 bp, Homo sapiens
aaaggaagtagaaat

SEQ ID NO: 289012 - DNA, 15 bp, Homo sapiens
taaaggaagtagaaa

SEQ ID NO: 289013 - DNA, 15 bp, Homo sapiens
ataaaggaagtagaa

SEQ ID NO: 289014 - DNA, 15 bp, Homo sapiens
cataaaggaagtaga

SEQ ID NO: 289015 - DNA, 15 bp, Homo sapiens
acataaaggaagtag

SEQ ID NO: 289016 - DNA, 15 bp, Homo sapiens
gacataaaggaagta

SEQ ID NO: 289017 - DNA, 15 bp, Homo sapiens
ggacataaaggaagt

SEQ ID NO: 289018 - DNA, 15 bp, Homo sapiens
tggacataaaggaag

SEQ ID NO: 289019 - DNA, 15 bp, Homo sapiens
ttggacataaaggaa

SEQ ID NO: 289020 - DNA, 15 bp, Homo sapiens
tttggacataaagga

SEQ ID NO: 289021 - DNA, 15 bp, Homo sapiens
ttttggacataaagg

SEQ ID NO: 289022 - DNA, 15 bp, Homo sapiens
tttttggacataaag

SEQ ID NO: 289023 - DNA, 15 bp, Homo sapiens
gtttttggacataaa

SEQ ID NO: 289024 - DNA, 15 bp, Homo sapiens
tgtttttggacataa

SEQ ID NO: 289025 - DNA, 15 bp, Homo sapiens
atgtttttggacata

SEQ ID NO: 289026 - DNA, 15 bp, Homo sapiens
gatgtttttggacat

SEQ ID NO: 289027 - DNA, 15 bp, Homo sapiens
tgatgtttttggaca

SEQ ID NO: 289028 - DNA, 15 bp, Homo sapiens
gtgatgtttttggac

SEQ ID NO: 289029 - DNA, 15 bp, Homo sapiens
ggtgatgtttttgga

SEQ ID NO: 289030 - DNA, 15 bp, Homo sapiens
tggtgatgtttttgg

SEQ ID NO: 289031 - DNA, 15 bp, Homo sapiens
atggtgatgtttttg

SEQ ID NO: 289032 - DNA, 15 bp, Homo sapiens
gatggtgatgttttt

SEQ ID NO: 289033 - DNA, 15 bp, Homo sapiens
ggatggtgatgtttt

SEQ ID NO: 289034 - DNA, 15 bp, Homo sapiens
tggatggtgatgttt

SEQ ID NO: 289035 - DNA, 15 bp, Homo sapiens
ctggatggtgatgtt

SEQ ID NO: 289036 - DNA, 15 bp, Homo sapiens
tctggatggtgatgt

SEQ ID NO: 289037 - DNA, 15 bp, Homo sapiens
atctggatggtgatg

SEQ ID NO: 289038 - DNA, 15 bp, Homo sapiens
catctggatggtgat

SEQ ID NO: 289039 - DNA, 15 bp, Homo sapiens
acatctggatggtga

SEQ ID NO: 289040 - DNA, 15 bp, Homo sapiens
cacatctggatggtg

SEQ ID NO: 289041 - DNA, 15 bp, Homo sapiens
tcacatctggatggt

SEQ ID NO: 289042 - DNA, 15 bp, Homo sapiens
ctcacatctggatgg

SEQ ID NO: 289043 - DNA, 15 bp, Homo sapiens
gctcacatctggatg

SEQ ID NO: 289044 - DNA, 15 bp, Homo sapiens
ggctcacatctggat

SEQ ID NO: 289045 - DNA, 15 bp, Homo sapiens
aggctcacatctgga

SEQ ID NO: 289046 - DNA, 15 bp, Homo sapiens
gaggctcacatctgg

SEQ ID NO: 289047 - DNA, 15 bp, Homo sapiens
agaggctcacatctg

SEQ ID NO: 289048 - DNA, 15 bp, Homo sapiens
cagaggctcacatct

SEQ ID NO: 289049 - DNA, 15 bp, Homo sapiens
ccagaggctcacatc

SEQ ID NO: 289050 - DNA, 15 bp, Homo sapiens
cccagaggctcacat

SEQ ID NO: 289051 - DNA, 15 bp, Homo sapiens
acccagaggctcaca

SEQ ID NO: 289052 - DNA, 15 bp, Homo sapiens
gacccagaggctcac

SEQ ID NO: 289053 - DNA, 15 bp, Homo sapiens
agacccagaggctca

SEQ ID NO: 289054 - DNA, 15 bp, Homo sapiens
cagacccagaggctc

SEQ ID NO: 289055 - DNA, 15 bp, Homo sapiens
acagacccagaggct

SEQ ID NO: 289056 - DNA, 15 bp, Homo sapiens
aacagacccagaggc

SEQ ID NO: 289057 - DNA, 15 bp, Homo sapiens
aaacagacccagagg

SEQ ID NO: 289058 - DNA, 15 bp, Homo sapiens
gaaacagacccagag

SEQ ID NO: 289059 - DNA, 15 bp, Homo sapiens
ggaaacagacccaga

SEQ ID NO: 289060 - DNA, 15 bp, Homo sapiens
aggaaacagacccag

SEQ ID NO: 289061 - DNA, 15 bp, Homo sapiens
aaggaaacagaccca

SEQ ID NO: 289062 - DNA, 15 bp, Homo sapiens
aaaggaaacagaccc

SEQ ID NO: 289063 - DNA, 15 bp, Homo sapiens
caaaggaaacagacc

SEQ ID NO: 289064 - DNA, 15 bp, Homo sapiens
acaaaggaaacagac

SEQ ID NO: 289065 - DNA, 15 bp, Homo sapiens
gacaaaggaaacaga

SEQ ID NO: 289066 - DNA, 15 bp, Homo sapiens
agacaaaggaaacag

SEQ ID NO: 289067 - DNA, 15 bp, Homo sapiens
aagacaaaggaaaca

SEQ ID NO: 289068 - DNA, 15 bp, Homo sapiens
caagacaaaggaaac

SEQ ID NO: 289069 - DNA, 15 bp, Homo sapiens
gcaagacaaaggaaa

SEQ ID NO: 289070 - DNA, 15 bp, Homo sapiens
agcaagacaaaggaa

SEQ ID NO: 289071 - DNA, 15 bp, Homo sapiens
tagcaagacaaagga

SEQ ID NO: 289072 - DNA, 15 bp, Homo sapiens
ctagcaagacaaagg

SEQ ID NO: 289073 - DNA, 15 bp, Homo sapiens
cctagcaagacaaag

SEQ ID NO: 289074 - DNA, 15 bp, Homo sapiens
ccctagcaagacaaa

SEQ ID NO: 289075 - DNA, 15 bp, Homo sapiens
tccctagcaagacaa

SEQ ID NO: 289076 - DNA, 15 bp, Homo sapiens
ttccctagcaagaca

SEQ ID NO: 289077 - DNA, 15 bp, Homo sapiens
cttccctagcaagac

SEQ ID NO: 289078 - DNA, 15 bp, Homo sapiens
tcttccctagcaaga

SEQ ID NO: 289079 - DNA, 15 bp, Homo sapiens
gtcttccctagcaag

SEQ ID NO: 289080 - DNA, 15 bp, Homo sapiens
cgtcttccctagcaa

SEQ ID NO: 289081 - DNA, 15 bp, Homo sapiens
tcgtcttccctagca

SEQ ID NO: 289082 - DNA, 15 bp, Homo sapiens
ctcgtcttccctagc

SEQ ID NO: 289083 - DNA, 15 bp, Homo sapiens
gctcgtcttccctag

SEQ ID NO: 289084 - DNA, 15 bp, Homo sapiens
tgctcgtcttcccta

SEQ ID NO: 289085 - DNA, 15 bp, Homo sapiens
gtgctcgtcttccct

SEQ ID NO: 289086 - DNA, 15 bp, Homo sapiens
cgtgctcgtcttccc

SEQ ID NO: 289087 - DNA, 15 bp, Homo sapiens
gcgtgctcgtcttcc

SEQ ID NO: 289088 - DNA, 15 bp, Homo sapiens
ggcgtgctcgtcttc

SEQ ID NO: 289089 - DNA, 15 bp, Homo sapiens
gggcgtgctcgtctt

SEQ ID NO: 289090 - DNA, 15 bp, Homo sapiens
agggcgtgctcgtct

SEQ ID NO: 289091 - DNA, 15 bp, Homo sapiens
gagggcgtgctcgtc

SEQ ID NO: 289092 - DNA, 15 bp, Homo sapiens
tgagggcgtgctcgt

SEQ ID NO: 289093 - DNA, 15 bp, Homo sapiens
atgagggcgtgctcg

SEQ ID NO: 289094 - DNA, 15 bp, Homo sapiens
gatgagggcgtgctc

SEQ ID NO: 289095 - DNA, 15 bp, Homo sapiens
ggatgagggcgtgct

SEQ ID NO: 289096 - DNA, 15 bp, Homo sapiens
tggatgagggcgtgc

SEQ ID NO: 289097 - DNA, 15 bp, Homo sapiens
ctggatgagggcgtg

SEQ ID NO: 289098 - DNA, 15 bp, Homo sapiens
gctggatgagggcgt

SEQ ID NO: 289099 - DNA, 15 bp, Homo sapiens
tgctggatgagggcg

SEQ ID NO: 289100 - DNA, 15 bp, Homo sapiens
ctgctggatgagggc

SEQ ID NO: 289101 - DNA, 15 bp, Homo sapiens
actgctggatgaggg

SEQ ID NO: 289102 - DNA, 15 bp, Homo sapiens
tactgctggatgagg

SEQ ID NO: 289103 - DNA, 15 bp, Homo sapiens
atactgctggatgag

SEQ ID NO: 289104 - DNA, 15 bp, Homo sapiens
aatactgctggatga

SEQ ID NO: 289105 - DNA, 15 bp, Homo sapiens
caatactgctggatg

SEQ ID NO: 289106 - DNA, 15 bp, Homo sapiens
gcaatactgctggat

SEQ ID NO: 289107 - DNA, 15 bp, Homo sapiens
ggcaatactgctgga

SEQ ID NO: 289108 - DNA, 15 bp, Homo sapiens
tggcaatactgctgg

SEQ ID NO: 289109 - DNA, 15 bp, Homo sapiens
ttggcaatactgctg

SEQ ID NO: 289110 - DNA, 15 bp, Homo sapiens
tttggcaatactgct

SEQ ID NO: 289111 - DNA, 15 bp, Homo sapiens
gtttggcaatactgc

SEQ ID NO: 289112 - DNA, 15 bp, Homo sapiens
tgtttggcaatactg

SEQ ID NO: 289113 - DNA, 15 bp, Homo sapiens
gtgtttggcaatact

SEQ ID NO: 289114 - DNA, 15 bp, Homo sapiens
agtgtttggcaatac

SEQ ID NO: 289115 - DNA, 15 bp, Homo sapiens
gagtgtttggcaata

SEQ ID NO: 289116 - DNA, 15 bp, Homo sapiens
cgagtgtttggcaat

SEQ ID NO: 289117 - DNA, 15 bp, Homo sapiens
ccgagtgtttggcaa

SEQ ID NO: 289118 - DNA, 15 bp, Homo sapiens
tccgagtgtttggca

SEQ ID NO: 289119 - DNA, 15 bp, Homo sapiens
ctccgagtgtttggc

SEQ ID NO: 289120 - DNA, 15 bp, Homo sapiens
cctccgagtgtttgg

SEQ ID NO: 289121 - DNA, 15 bp, Homo sapiens
tcctccgagtgtttg

SEQ ID NO: 289122 - DNA, 15 bp, Homo sapiens
ctcctccgagtgttt

SEQ ID NO: 289123 - DNA, 15 bp, Homo sapiens
tctcctccgagtgtt

SEQ ID NO: 289124 - DNA, 15 bp, Homo sapiens
ctctcctccgagtgt

SEQ ID NO: 289125 - DNA, 15 bp, Homo sapiens
actctcctccgagtg

SEQ ID NO: 289126 - DNA, 15 bp, Homo sapiens
gactctcctccgagt

SEQ ID NO: 289127 - DNA, 15 bp, Homo sapiens
ggactctcctccgag

SEQ ID NO: 289128 - DNA, 15 bp, Homo sapiens
gggactctcctccga

SEQ ID NO: 289129 - DNA, 15 bp, Homo sapiens
ggggactctcctccg

SEQ ID NO: 289130 - DNA, 15 bp, Homo sapiens
tggggactctcctcc

SEQ ID NO: 289131 - DNA, 15 bp, Homo sapiens
ctggggactctcctc

SEQ ID NO: 289132 - DNA, 15 bp, Homo sapiens
actggggactctcct

SEQ ID NO: 289133 - DNA, 15 bp, Homo sapiens
cactggggactctcc

SEQ ID NO: 289134 - DNA, 15 bp, Homo sapiens
tcactggggactctc

SEQ ID NO: 289135 - DNA, 15 bp, Homo sapiens
ctcactggggactct

SEQ ID NO: 289136 - DNA, 15 bp, Homo sapiens
gctcactggggactc

SEQ ID NO: 289137 - DNA, 15 bp, Homo sapiens
ggctcactggggact

SEQ ID NO: 289138 - DNA, 15 bp, Homo sapiens
tggctcactggggac

SEQ ID NO: 289139 - DNA, 15 bp, Homo sapiens
ctggctcactgggga

SEQ ID NO: 289140 - DNA, 15 bp, Homo sapiens
gctggctcactgggg

SEQ ID NO: 289141 - DNA, 15 bp, Homo sapiens
ggctggctcactggg

SEQ ID NO: 289142 - DNA, 15 bp, Homo sapiens
cggctggctcactgg

SEQ ID NO: 289143 - DNA, 15 bp, Homo sapiens
gcggctggctcactg

SEQ ID NO: 289144 - DNA, 15 bp, Homo sapiens
tgcggctggctcact

SEQ ID NO: 289145 - DNA, 15 bp, Homo sapiens
ctgcggctggctcac

SEQ ID NO: 289146 - DNA, 15 bp, Homo sapiens
tctgcggctggctca

SEQ ID NO: 289147 - DNA, 15 bp, Homo sapiens
ctctgcggctggctc

SEQ ID NO: 289148 - DNA, 15 bp, Homo sapiens
gctctgcggctggct

SEQ ID NO: 289149 - DNA, 15 bp, Homo sapiens
ggctctgcggctggc

SEQ ID NO: 289150 - DNA, 15 bp, Homo sapiens
gggctctgcggctgg

SEQ ID NO: 289151 - DNA, 15 bp, Homo sapiens
tgggctctgcggctg

SEQ ID NO: 289152 - DNA, 15 bp, Homo sapiens
ctgggctctgcggct

SEQ ID NO: 289153 - DNA, 15 bp, Homo sapiens
gctgggctctgcggc

SEQ ID NO: 289154 - DNA, 15 bp, Homo sapiens
agctgggctctgcgg

SEQ ID NO: 289155 - DNA, 15 bp, Homo sapiens
gagctgggctctgcg

SEQ ID NO: 289156 - DNA, 15 bp, Homo sapiens
tgagctgggctctgc

SEQ ID NO: 289157 - DNA, 15 bp, Homo sapiens
ctgagctgggctctg

SEQ ID NO: 289158 - DNA, 15 bp, Homo sapiens
tctgagctgggctct

SEQ ID NO: 289159 - DNA, 15 bp, Homo sapiens
atctgagctgggctc

SEQ ID NO: 289160 - DNA, 15 bp, Homo sapiens
gatctgagctgggct

SEQ ID NO: 289161 - DNA, 15 bp, Homo sapiens
ggatctgagctgggc

SEQ ID NO: 289162 - DNA, 15 bp, Homo sapiens
aggatctgagctggg

SEQ ID NO: 289163 - DNA, 15 bp, Homo sapiens
caggatctgagctgg

SEQ ID NO: 289164 - DNA, 15 bp, Homo sapiens
tcaggatctgagctg

SEQ ID NO: 289165 - DNA, 15 bp, Homo sapiens
ttcaggatctgagct

SEQ ID NO: 289166 - DNA, 15 bp, Homo sapiens
cttcaggatctgagc

SEQ ID NO: 289167 - DNA, 15 bp, Homo sapiens
acttcaggatctgag

SEQ ID NO: 289168 - DNA, 15 bp, Homo sapiens
gacttcaggatctga

SEQ ID NO: 289169 - DNA, 15 bp, Homo sapiens
tgacttcaggatctg

SEQ ID NO: 289170 - DNA, 15 bp, Homo sapiens
ctgacttcaggatct

SEQ ID NO: 289171 - DNA, 15 bp, Homo sapiens
actgacttcaggatc

SEQ ID NO: 289172 - DNA, 15 bp, Homo sapiens
tactgacttcaggat

SEQ ID NO: 289173 - DNA, 15 bp, Homo sapiens
ctactgacttcagga

SEQ ID NO: 289174 - DNA, 15 bp, Homo sapiens
tctactgacttcagg

SEQ ID NO: 289175 - DNA, 15 bp, Homo sapiens
ctctactgacttcag

SEQ ID NO: 289176 - DNA, 15 bp, Homo sapiens
tctctactgacttca

SEQ ID NO: 289177 - DNA, 15 bp, Homo sapiens
ctctctactgacttc

SEQ ID NO: 289178 - DNA, 15 bp, Homo sapiens
cctctctactgactt

SEQ ID NO: 289179 - DNA, 15 bp, Homo sapiens
ccctctctactgact

SEQ ID NO: 289180 - DNA, 15 bp, Homo sapiens
tccctctctactgac

SEQ ID NO: 289181 - DNA, 15 bp, Homo sapiens
ttccctctctactga

SEQ ID NO: 289182 - DNA, 15 bp, Homo sapiens
cttccctctctactg

SEQ ID NO: 289183 - DNA, 15 bp, Homo sapiens
tcttccctctctact

SEQ ID NO: 289184 - DNA, 15 bp, Homo sapiens
ttcttccctctctac

SEQ ID NO: 289185 - DNA, 15 bp, Homo sapiens
gttcttccctctcta

SEQ ID NO: 289186 - DNA, 15 bp, Homo sapiens
cgttcttccctctct

SEQ ID NO: 289187 - DNA, 15 bp, Homo sapiens
acgttcttccctctc

SEQ ID NO: 289188 - DNA, 15 bp, Homo sapiens
cacgttcttccctct

SEQ ID NO: 289189 - DNA, 15 bp, Homo sapiens
ccacgttcttccctc

SEQ ID NO: 289190 - DNA, 15 bp, Homo sapiens
tccacgttcttccct

SEQ ID NO: 289191 - DNA, 15 bp, Homo sapiens
ctccacgttcttccc

SEQ ID NO: 289192 - DNA, 15 bp, Homo sapiens
tctccacgttcttcc

SEQ ID NO: 289193 - DNA, 15 bp, Homo sapiens
ttctccacgttcttc

SEQ ID NO: 289194 - DNA, 15 bp, Homo sapiens
gttctccacgttctt

SEQ ID NO: 289195 - DNA, 15 bp, Homo sapiens
agttctccacgttct

SEQ ID NO: 289196 - DNA, 15 bp, Homo sapiens
cagttctccacgttc

SEQ ID NO: 289197 - DNA, 15 bp, Homo sapiens
ccagttctccacgtt

SEQ ID NO: 289198 - DNA, 15 bp, Homo sapiens
tccagttctccacgt

SEQ ID NO: 289199 - DNA, 15 bp, Homo sapiens
ctccagttctccacg

SEQ ID NO: 289200 - DNA, 15 bp, Homo sapiens
tctccagttctccac

SEQ ID NO: 289201 - DNA, 15 bp, Homo sapiens
ctctccagttctcca

SEQ ID NO: 289202 - DNA, 15 bp, Homo sapiens
cctctccagttctcc

SEQ ID NO: 289203 - DNA, 15 bp, Homo sapiens
tcctctccagttctc

SEQ ID NO: 289204 - DNA, 15 bp, Homo sapiens
atcctctccagttct

SEQ ID NO: 289205 - DNA, 15 bp, Homo sapiens
gatcctctccagttc

SEQ ID NO: 289206 - DNA, 15 bp, Homo sapiens
tgatcctctccagtt

SEQ ID NO: 289207 - DNA, 15 bp, Homo sapiens
atgatcctctccagt

SEQ ID NO: 289208 - DNA, 15 bp, Homo sapiens
aatgatcctctccag

SEQ ID NO: 289209 - DNA, 15 bp, Homo sapiens
caatgatcctctcca

SEQ ID NO: 289210 - DNA, 15 bp, Homo sapiens
gcaatgatcctctcc

SEQ ID NO: 289211 - DNA, 15 bp, Homo sapiens
agcaatgatcctctc

SEQ ID NO: 289212 - DNA, 15 bp, Homo sapiens
cagcaatgatcctct

SEQ ID NO: 289213 - DNA, 15 bp, Homo sapiens
tcagcaatgatcctc

SEQ ID NO: 289214 - DNA, 15 bp, Homo sapiens
gtcagcaatgatcct

SEQ ID NO: 289215 - DNA, 15 bp, Homo sapiens
ggtcagcaatgatcc

SEQ ID NO: 289216 - DNA, 15 bp, Homo sapiens
aggtcagcaatgatc

SEQ ID NO: 289217 - DNA, 15 bp, Homo sapiens
caggtcagcaatgat

SEQ ID NO: 289218 - DNA, 15 bp, Homo sapiens
ccaggtcagcaatga

SEQ ID NO: 289219 - DNA, 15 bp, Homo sapiens
tccaggtcagcaatg

SEQ ID NO: 289220 - DNA, 15 bp, Homo sapiens
ctccaggtcagcaat

SEQ ID NO: 289221 - DNA, 15 bp, Homo sapiens
cctccaggtcagcaa

SEQ ID NO: 289222 - DNA, 15 bp, Homo sapiens
tcctccaggtcagca

SEQ ID NO: 289223 - DNA, 15 bp, Homo sapiens
ttcctccaggtcagc

SEQ ID NO: 289224 - DNA, 15 bp, Homo sapiens
cttcctccaggtcag

SEQ ID NO: 289225 - DNA, 15 bp, Homo sapiens
tcttcctccaggtca

SEQ ID NO: 289226 - DNA, 15 bp, Homo sapiens
ttcttcctccaggtc

SEQ ID NO: 289227 - DNA, 15 bp, Homo sapiens
gttcttcctccaggt

SEQ ID NO: 289228 - DNA, 15 bp, Homo sapiens
tgttcttcctccagg

SEQ ID NO: 289229 - DNA, 15 bp, Homo sapiens
ttgttcttcctccag

SEQ ID NO: 289230 - DNA, 15 bp, Homo sapiens
tttgttcttcctcca

SEQ ID NO: 289231 - DNA, 15 bp, Homo sapiens
ctttgttcttcctcc

SEQ ID NO: 289232 - DNA, 15 bp, Homo sapiens
cctttgttcttcctc

SEQ ID NO: 289233 - DNA, 15 bp, Homo sapiens
acctttgttcttcct

SEQ ID NO: 289234 - DNA, 15 bp, Homo sapiens
cacctttgttcttcc

SEQ ID NO: 289235 - DNA, 15 bp, Homo sapiens
acacctttgttcttc

SEQ ID NO: 289236 - DNA, 15 bp, Homo sapiens
cacacctttgttctt

SEQ ID NO: 289237 - DNA, 15 bp, Homo sapiens
gcacacctttgttct

SEQ ID NO: 289238 - DNA, 15 bp, Homo sapiens
agcacacctttgttc

SEQ ID NO: 289239 - DNA, 15 bp, Homo sapiens
tagcacacctttgtt

SEQ ID NO: 289240 - DNA, 15 bp, Homo sapiens
ctagcacacctttgt

SEQ ID NO: 289241 - DNA, 15 bp, Homo sapiens
cctagcacacctttg

SEQ ID NO: 289242 - DNA, 15 bp, Homo sapiens
gcctagcacaccttt

SEQ ID NO: 289243 - DNA, 15 bp, Homo sapiens
ggcctagcacacctt

SEQ ID NO: 289244 - DNA, 15 bp, Homo sapiens
aggcctagcacacct

SEQ ID NO: 289245 - DNA, 15 bp, Homo sapiens
caggcctagcacacc

SEQ ID NO: 289246 - DNA, 15 bp, Homo sapiens
ccaggcctagcacac

SEQ ID NO: 289247 - DNA, 15 bp, Homo sapiens
cccaggcctagcaca

SEQ ID NO: 289248 - DNA, 15 bp, Homo sapiens
tcccaggcctagcac

SEQ ID NO: 289249 - DNA, 15 bp, Homo sapiens
ctcccaggcctagca

SEQ ID NO: 289250 - DNA, 15 bp, Homo sapiens
tctcccaggcctagc

SEQ ID NO: 289251 - DNA, 15 bp, Homo sapiens
ttctcccaggcctag

SEQ ID NO: 289252 - DNA, 15 bp, Homo sapiens
cttctcccaggccta

SEQ ID NO: 289253 - DNA, 15 bp, Homo sapiens
ccttctcccaggcct

SEQ ID NO: 289254 - DNA, 15 bp, Homo sapiens
tccttctcccaggcc

SEQ ID NO: 289255 - DNA, 15 bp, Homo sapiens
ttccttctcccaggc

SEQ ID NO: 289256 - DNA, 15 bp, Homo sapiens
tttccttctcccagg

SEQ ID NO: 289257 - DNA, 15 bp, Homo sapiens
atttccttctcccag

SEQ ID NO: 289258 - DNA, 15 bp, Homo sapiens
tatttccttctccca

SEQ ID NO: 289259 - DNA, 15 bp, Homo sapiens
atatttccttctccc

SEQ ID NO: 289260 - DNA, 15 bp, Homo sapiens
catatttccttctcc

SEQ ID NO: 289261 - DNA, 15 bp, Homo sapiens
acatatttccttctc

SEQ ID NO: 289262 - DNA, 15 bp, Homo sapiens
gacatatttccttct

SEQ ID NO: 289263 - DNA, 15 bp, Homo sapiens
tgacatatttccttc

SEQ ID NO: 289264 - DNA, 15 bp, Homo sapiens
atgacatatttcctt

SEQ ID NO: 289265 - DNA, 15 bp, Homo sapiens
gatgacatatttcct

SEQ ID NO: 289266 - DNA, 15 bp, Homo sapiens
ggatgacatatttcc

SEQ ID NO: 289267 - DNA, 15 bp, Homo sapiens
aggatgacatatttc

SEQ ID NO: 289268 - DNA, 15 bp, Homo sapiens
aaggatgacatattt

SEQ ID NO: 289269 - DNA, 15 bp, Homo sapiens
aaaggatgacatatt

SEQ ID NO: 289270 - DNA, 15 bp, Homo sapiens
gaaaggatgacatat

SEQ ID NO: 289271 - DNA, 15 bp, Homo sapiens
agaaaggatgacata

SEQ ID NO: 289272 - DNA, 15 bp, Homo sapiens
aagaaaggatgacat

SEQ ID NO: 289273 - DNA, 15 bp, Homo sapiens
aaagaaaggatgaca

SEQ ID NO: 289274 - DNA, 15 bp, Homo sapiens
aaaagaaaggatgac

SEQ ID NO: 289275 - DNA, 15 bp, Homo sapiens
caaaagaaaggatga

SEQ ID NO: 289276 - DNA, 15 bp, Homo sapiens
acaaaagaaaggatg

SEQ ID NO: 289277 - DNA, 15 bp, Homo sapiens
tacaaaagaaaggat

SEQ ID NO: 289278 - DNA, 15 bp, Homo sapiens
atacaaaagaaagga

SEQ ID NO: 289279 - DNA, 15 bp, Homo sapiens
catacaaaagaaagg

SEQ ID NO: 289280 - DNA, 15 bp, Homo sapiens
tcatacaaaagaaag

SEQ ID NO: 289281 - DNA, 15 bp, Homo sapiens
ttcatacaaaagaaa

SEQ ID NO: 289282 - DNA, 15 bp, Homo sapiens
attcatacaaaagaa

SEQ ID NO: 289283 - DNA, 15 bp, Homo sapiens
aattcatacaaaaga

SEQ ID NO: 289284 - DNA, 15 bp, Homo sapiens
aaattcatacaaaag

SEQ ID NO: 289285 - DNA, 15 bp, Homo sapiens
gaaattcatacaaaa

SEQ ID NO: 289286 - DNA, 15 bp, Homo sapiens
tgaaattcatacaaa

SEQ ID NO: 289287 - DNA, 15 bp, Homo sapiens
gtgaaattcatacaa

SEQ ID NO: 289288 - DNA, 15 bp, Homo sapiens
agtgaaattcataca

SEQ ID NO: 289289 - DNA, 15 bp, Homo sapiens
cagtgaaattcatac

SEQ ID NO: 289290 - DNA, 15 bp, Homo sapiens
acagtgaaattcata

SEQ ID NO: 289291 - DNA, 15 bp, Homo sapiens
tacagtgaaattcat

SEQ ID NO: 289292 - DNA, 15 bp, Homo sapiens
ctacagtgaaattca

SEQ ID NO: 289293 - DNA, 15 bp, Homo sapiens
gctacagtgaaattc

SEQ ID NO: 289294 - DNA, 15 bp, Homo sapiens
ggctacagtgaaatt

SEQ ID NO: 289295 - DNA, 15 bp, Homo sapiens
gggctacagtgaaat

SEQ ID NO: 289296 - DNA, 15 bp, Homo sapiens
ggggctacagtgaaa

SEQ ID NO: 289297 - DNA, 15 bp, Homo sapiens
gggggctacagtgaa

SEQ ID NO: 289298 - DNA, 15 bp, Homo sapiens
tgggggctacagtga

SEQ ID NO: 289299 - DNA, 15 bp, Homo sapiens
atgggggctacagtg

SEQ ID NO: 289300 - DNA, 15 bp, Homo sapiens
aatgggggctacagt

SEQ ID NO: 289301 - DNA, 15 bp, Homo sapiens
aaatgggggctacag

SEQ ID NO: 289302 - DNA, 15 bp, Homo sapiens
taaatgggggctaca

SEQ ID NO: 289303 - DNA, 15 bp, Homo sapiens
ataaatgggggctac

SEQ ID NO: 289304 - DNA, 15 bp, Homo sapiens
aataaatgggggcta

SEQ ID NO: 289305 - DNA, 15 bp, Homo sapiens
gaataaatgggggct

SEQ ID NO: 289306 - DNA, 15 bp, Homo sapiens
agaataaatgggggc

SEQ ID NO: 289307 - DNA, 15 bp, Homo sapiens
gagaataaatggggg

SEQ ID NO: 289308 - DNA, 15 bp, Homo sapiens
agagaataaatgggg

SEQ ID NO: 289309 - DNA, 15 bp, Homo sapiens
aagagaataaatggg

SEQ ID NO: 289310 - DNA, 15 bp, Homo sapiens
aaagagaataaatgg

SEQ ID NO: 289311 - DNA, 15 bp, Homo sapiens
aaaagagaataaatg

SEQ ID NO: 289312 - DNA, 15 bp, Homo sapiens
aaaaagagaataaat

SEQ ID NO: 289313 - DNA, 15 bp, Homo sapiens
gaaaaagagaataaa

SEQ ID NO: 289314 - DNA, 15 bp, Homo sapiens
tgaaaaagagaataa

SEQ ID NO: 289315 - DNA, 15 bp, Homo sapiens
ttgaaaaagagaata

SEQ ID NO: 289316 - DNA, 15 bp, Homo sapiens
cttgaaaaagagaat

SEQ ID NO: 289317 - DNA, 15 bp, Homo sapiens
tcttgaaaaagagaa

SEQ ID NO: 289318 - DNA, 15 bp, Homo sapiens
gtcttgaaaaagaga

SEQ ID NO: 289319 - DNA, 15 bp, Homo sapiens
agtcttgaaaaagag

SEQ ID NO: 289320 - DNA, 15 bp, Homo sapiens
tagtcttgaaaaaga

SEQ ID NO: 289321 - DNA, 15 bp, Homo sapiens
atagtcttgaaaaag

SEQ ID NO: 289322 - DNA, 15 bp, Homo sapiens
aatagtcttgaaaaa

SEQ ID NO: 289323 - DNA, 15 bp, Homo sapiens
caatagtcttgaaaa

SEQ ID NO: 289324 - DNA, 15 bp, Homo sapiens
acaatagtcttgaaa

SEQ ID NO: 289325 - DNA, 15 bp, Homo sapiens
gacaatagtcttgaa

SEQ ID NO: 289326 - DNA, 15 bp, Homo sapiens
agacaatagtcttga

SEQ ID NO: 289327 - DNA, 15 bp, Homo sapiens
tagacaatagtcttg

SEQ ID NO: 289328 - DNA, 15 bp, Homo sapiens
ttagacaatagtctt

SEQ ID NO: 289329 - DNA, 15 bp, Homo sapiens
cttagacaatagtct

SEQ ID NO: 289330 - DNA, 15 bp, Homo sapiens
tcttagacaatagtc

SEQ ID NO: 289331 - DNA, 15 bp, Homo sapiens
ttcttagacaatagt

SEQ ID NO: 289332 - DNA, 15 bp, Homo sapiens
tttcttagacaatag

SEQ ID NO: 289333 - DNA, 15 bp, Homo sapiens
atttcttagacaata

SEQ ID NO: 289334 - DNA, 15 bp, Homo sapiens
gatttcttagacaat

SEQ ID NO: 289335 - DNA, 15 bp, Homo sapiens
agatttcttagacaa

SEQ ID NO: 289336 - DNA, 15 bp, Homo sapiens
gagatttcttagaca

SEQ ID NO: 289337 - DNA, 15 bp, Homo sapiens
tgagatttcttagac

SEQ ID NO: 289338 - DNA, 15 bp, Homo sapiens
ctgagatttcttaga

SEQ ID NO: 289339 - DNA, 15 bp, Homo sapiens
actgagatttcttag

SEQ ID NO: 289340 - DNA, 15 bp, Homo sapiens
cactgagatttctta

SEQ ID NO: 289341 - DNA, 15 bp, Homo sapiens
ccactgagatttctt

SEQ ID NO: 289342 - DNA, 15 bp, Homo sapiens
tccactgagatttct

SEQ ID NO: 289343 - DNA, 15 bp, Homo sapiens
ctccactgagatttc

SEQ ID NO: 289344 - DNA, 15 bp, Homo sapiens
actccactgagattt

SEQ ID NO: 289345 - DNA, 15 bp, Homo sapiens
cactccactgagatt

SEQ ID NO: 289346 - DNA, 15 bp, Homo sapiens
tcactccactgagat

SEQ ID NO: 289347 - DNA, 15 bp, Homo sapiens
ttcactccactgaga

SEQ ID NO: 289348 - DNA, 15 bp, Homo sapiens
tttcactccactgag

SEQ ID NO: 289349 - DNA, 15 bp, Homo sapiens
ttttcactccactga

SEQ ID NO: 289350 - DNA, 15 bp, Homo sapiens
attttcactccactg

SEQ ID NO: 289351 - DNA, 15 bp, Homo sapiens
aattttcactccact

SEQ ID NO: 289352 - DNA, 15 bp, Homo sapiens
aaattttcactccac

SEQ ID NO: 289353 - DNA, 15 bp, Homo sapiens
aaaattttcactcca

SEQ ID NO: 289354 - DNA, 15 bp, Homo sapiens
taaaattttcactcc

SEQ ID NO: 289355 - DNA, 15 bp, Homo sapiens
ctaaaattttcactc

SEQ ID NO: 289356 - DNA, 15 bp, Homo sapiens
tctaaaattttcact

SEQ ID NO: 289357 - DNA, 15 bp, Homo sapiens
ctctaaaattttcac

SEQ ID NO: 289358 - DNA, 15 bp, Homo sapiens
cctctaaaattttca

SEQ ID NO: 289359 - DNA, 15 bp, Homo sapiens
gcctctaaaattttc

SEQ ID NO: 289360 - DNA, 15 bp, Homo sapiens
agcctctaaaatttt

SEQ ID NO: 289361 - DNA, 15 bp, Homo sapiens
tagcctctaaaattt

SEQ ID NO: 289362 - DNA, 15 bp, Homo sapiens
atagcctctaaaatt

SEQ ID NO: 289363 - DNA, 15 bp, Homo sapiens
aatagcctctaaaat

SEQ ID NO: 289364 - DNA, 15 bp, Homo sapiens
taatagcctctaaaa

SEQ ID NO: 289365 - DNA, 15 bp, Homo sapiens
ttaatagcctctaaa

SEQ ID NO: 289366 - DNA, 15 bp, Homo sapiens
gttaatagcctctaa

SEQ ID NO: 289367 - DNA, 15 bp, Homo sapiens
tgttaatagcctcta

SEQ ID NO: 289368 - DNA, 15 bp, Homo sapiens
ttgttaatagcctct

SEQ ID NO: 289369 - DNA, 15 bp, Homo sapiens
tttgttaatagcctc

SEQ ID NO: 289370 - DNA, 15 bp, Homo sapiens
gtttgttaatagcct

SEQ ID NO: 289371 - DNA, 15 bp, Homo sapiens
agtttgttaatagcc

SEQ ID NO: 289372 - DNA, 15 bp, Homo sapiens
cagtttgttaatagc

SEQ ID NO: 289373 - DNA, 15 bp, Homo sapiens
ccagtttgttaatag

SEQ ID NO: 289374 - DNA, 15 bp, Homo sapiens
cccagtttgttaata

SEQ ID NO: 289375 - DNA, 15 bp, Homo sapiens
tcccagtttgttaat

SEQ ID NO: 289376 - DNA, 15 bp, Homo sapiens
atcccagtttgttaa

SEQ ID NO: 289377 - DNA, 15 bp, Homo sapiens
catcccagtttgtta

SEQ ID NO: 289378 - DNA, 15 bp, Homo sapiens
gcatcccagtttgtt

SEQ ID NO: 289379 - DNA, 15 bp, Homo sapiens
agcatcccagtttgt

SEQ ID NO: 289380 - DNA, 15 bp, Homo sapiens
cagcatcccagtttg

SEQ ID NO: 289381 - DNA, 15 bp, Homo sapiens
ccagcatcccagttt

SEQ ID NO: 289382 - DNA, 15 bp, Homo sapiens
gccagcatcccagtt

SEQ ID NO: 289383 - DNA, 15 bp, Homo sapiens
agccagcatcccagt

SEQ ID NO: 289384 - DNA, 15 bp, Homo sapiens
cagccagcatcccag

SEQ ID NO: 289385 - DNA, 15 bp, Homo sapiens
gcagccagcatccca

SEQ ID NO: 289386 - DNA, 15 bp, Homo sapiens
tgcagccagcatccc

SEQ ID NO: 289387 - DNA, 15 bp, Homo sapiens
ttgcagccagcatcc

SEQ ID NO: 289388 - DNA, 15 bp, Homo sapiens
attgcagccagcatc

SEQ ID NO: 289389 - DNA, 15 bp, Homo sapiens
tattgcagccagcat

SEQ ID NO: 289390 - DNA, 15 bp, Homo sapiens
gtattgcagccagca

SEQ ID NO: 289391 - DNA, 15 bp, Homo sapiens
tgtattgcagccagc

SEQ ID NO: 289392 - DNA, 15 bp, Homo sapiens
ctgtattgcagccag

SEQ ID NO: 289393 - DNA, 15 bp, Homo sapiens
gctgtattgcagcca

SEQ ID NO: 289394 - DNA, 15 bp, Homo sapiens
tgctgtattgcagcc

SEQ ID NO: 289395 - DNA, 15 bp, Homo sapiens
ctgctgtattgcagc

SEQ ID NO: 289396 - DNA, 15 bp, Homo sapiens
gctgctgtattgcag

SEQ ID NO: 289397 - DNA, 15 bp, Homo sapiens
tgctgctgtattgca

SEQ ID NO: 289398 - DNA, 15 bp, Homo sapiens
atgctgctgtattgc

SEQ ID NO: 289399 - DNA, 15 bp, Homo sapiens
aatgctgctgtattg

SEQ ID NO: 289400 - DNA, 15 bp, Homo sapiens
aaatgctgctgtatt

SEQ ID NO: 289401 - DNA, 15 bp, Homo sapiens
caaatgctgctgtat

SEQ ID NO: 289402 - DNA, 15 bp, Homo sapiens
ccaaatgctgctgta

SEQ ID NO: 289403 - DNA, 15 bp, Homo sapiens
cccaaatgctgctgt

SEQ ID NO: 289404 - DNA, 15 bp, Homo sapiens
ccccaaatgctgctg

SEQ ID NO: 289405 - DNA, 15 bp, Homo sapiens
cccccaaatgctgct

SEQ ID NO: 289406 - DNA, 15 bp, Homo sapiens
acccccaaatgctgc

SEQ ID NO: 289407 - DNA, 15 bp, Homo sapiens
aacccccaaatgctg

SEQ ID NO: 289408 - DNA, 15 bp, Homo sapiens
gaacccccaaatgct

SEQ ID NO: 289409 - DNA, 15 bp, Homo sapiens
tgaacccccaaatgc

SEQ ID NO: 289410 - DNA, 15 bp, Homo sapiens
atgaacccccaaatg

SEQ ID NO: 289411 - DNA, 15 bp, Homo sapiens
aatgaacccccaaat

SEQ ID NO: 289412 - DNA, 15 bp, Homo sapiens
caatgaacccccaaa

SEQ ID NO: 289413 - DNA, 15 bp, Homo sapiens
tcaatgaacccccaa

SEQ ID NO: 289414 - DNA, 15 bp, Homo sapiens
atcaatgaaccccca

SEQ ID NO: 289415 - DNA, 15 bp, Homo sapiens
catcaatgaaccccc

SEQ ID NO: 289416 - DNA, 15 bp, Homo sapiens
tcatcaatgaacccc

SEQ ID NO: 289417 - DNA, 15 bp, Homo sapiens
atcatcaatgaaccc

SEQ ID NO: 289418 - DNA, 15 bp, Homo sapiens
catcatcaatgaacc

SEQ ID NO: 289419 - DNA, 15 bp, Homo sapiens
acatcatcaatgaac

SEQ ID NO: 289420 - DNA, 15 bp, Homo sapiens
gacatcatcaatgaa

SEQ ID NO: 289421 - DNA, 15 bp, Homo sapiens
agacatcatcaatga

SEQ ID NO: 289422 - DNA, 15 bp, Homo sapiens
tagacatcatcaatg

SEQ ID NO: 289423 - DNA, 15 bp, Homo sapiens
gtagacatcatcaat

SEQ ID NO: 289424 - DNA, 15 bp, Homo sapiens
agtagacatcatcaa

SEQ ID NO: 289425 - DNA, 15 bp, Homo sapiens
cagtagacatcatca

SEQ ID NO: 289426 - DNA, 15 bp, Homo sapiens
ccagtagacatcatc

SEQ ID NO: 289427 - DNA, 15 bp, Homo sapiens
cccagtagacatcat

SEQ ID NO: 289428 - DNA, 15 bp, Homo sapiens
tcccagtagacatca

SEQ ID NO: 289429 - DNA, 15 bp, Homo sapiens
gtcccagtagacatc

SEQ ID NO: 289430 - DNA, 15 bp, Homo sapiens
tgtcccagtagacat

SEQ ID NO: 289431 - DNA, 15 bp, Homo sapiens
gtgtcccagtagaca

SEQ ID NO: 289432 - DNA, 15 bp, Homo sapiens
agtgtcccagtagac

SEQ ID NO: 289433 - DNA, 15 bp, Homo sapiens
aagtgtcccagtaga

SEQ ID NO: 289434 - DNA, 15 bp, Homo sapiens
caagtgtcccagtag

SEQ ID NO: 289435 - DNA, 15 bp, Homo sapiens
gcaagtgtcccagta

SEQ ID NO: 289436 - DNA, 15 bp, Homo sapiens
agcaagtgtcccagt

SEQ ID NO: 289437 - DNA, 15 bp, Homo sapiens
aagcaagtgtcccag

SEQ ID NO: 289438 - DNA, 15 bp, Homo sapiens
taagcaagtgtccca

SEQ ID NO: 289439 - DNA, 15 bp, Homo sapiens
ttaagcaagtgtccc

SEQ ID NO: 289440 - DNA, 15 bp, Homo sapiens
tttaagcaagtgtcc

SEQ ID NO: 289441 - DNA, 15 bp, Homo sapiens
ttttaagcaagtgtc

SEQ ID NO: 289442 - DNA, 15 bp, Homo sapiens
gttttaagcaagtgt

SEQ ID NO: 289443 - DNA, 15 bp, Homo sapiens
agttttaagcaagtg

SEQ ID NO: 289444 - DNA, 15 bp, Homo sapiens
tagttttaagcaagt

SEQ ID NO: 289445 - DNA, 15 bp, Homo sapiens
gtagttttaagcaag

SEQ ID NO: 289446 - DNA, 15 bp, Homo sapiens
tgtagttttaagcaa

SEQ ID NO: 289447 - DNA, 15 bp, Homo sapiens
ttgtagttttaagca

SEQ ID NO: 289448 - DNA, 15 bp, Homo sapiens
attgtagttttaagc

SEQ ID NO: 289449 - DNA, 15 bp, Homo sapiens
aattgtagttttaag

SEQ ID NO: 289450 - DNA, 15 bp, Homo sapiens
aaattgtagttttaa

SEQ ID NO: 289451 - DNA, 15 bp, Homo sapiens
aaaattgtagtttta

SEQ ID NO: 289452 - DNA, 15 bp, Homo sapiens
taaaattgtagtttt

SEQ ID NO: 289453 - DNA, 15 bp, Homo sapiens
ataaaattgtagttt

SEQ ID NO: 289454 - DNA, 15 bp, Homo sapiens
aataaaattgtagtt

SEQ ID NO: 289455 - DNA, 15 bp, Homo sapiens
gaataaaattgtagt

SEQ ID NO: 289456 - DNA, 15 bp, Homo sapiens
ggaataaaattgtag

SEQ ID NO: 289457 - DNA, 15 bp, Homo sapiens
aggaataaaattgta

SEQ ID NO: 289458 - DNA, 15 bp, Homo sapiens
caggaataaaattgt

SEQ ID NO: 289459 - DNA, 15 bp, Homo sapiens
gcaggaataaaattg

SEQ ID NO: 289460 - DNA, 15 bp, Homo sapiens
tgcaggaataaaatt

SEQ ID NO: 289461 - DNA, 15 bp, Homo sapiens
atgcaggaataaaat

SEQ ID NO: 289462 - DNA, 15 bp, Homo sapiens
catgcaggaataaaa

SEQ ID NO: 289463 - DNA, 15 bp, Homo sapiens
gcatgcaggaataaa

SEQ ID NO: 289464 - DNA, 15 bp, Homo sapiens
agcatgcaggaataa

SEQ ID NO: 289465 - DNA, 15 bp, Homo sapiens
gagcatgcaggaata

SEQ ID NO: 289466 - DNA, 15 bp, Homo sapiens
tgagcatgcaggaat

SEQ ID NO: 289467 - DNA, 15 bp, Homo sapiens
atgagcatgcaggaa

SEQ ID NO: 289468 - DNA, 15 bp, Homo sapiens
gatgagcatgcagga

SEQ ID NO: 289469 - DNA, 15 bp, Homo sapiens
ggatgagcatgcagg

SEQ ID NO: 289470 - DNA, 15 bp, Homo sapiens
aggatgagcatgcag

SEQ ID NO: 289471 - DNA, 15 bp, Homo sapiens
caggatgagcatgca

SEQ ID NO: 289472 - DNA, 15 bp, Homo sapiens
gcaggatgagcatgc

SEQ ID NO: 289473 - DNA, 15 bp, Homo sapiens
agcaggatgagcatg

SEQ ID NO: 289474 - DNA, 15 bp, Homo sapiens
tagcaggatgagcat

SEQ ID NO: 289475 - DNA, 15 bp, Homo sapiens
atagcaggatgagca

SEQ ID NO: 289476 - DNA, 15 bp, Homo sapiens
aatagcaggatgagc

SEQ ID NO: 289477 - DNA, 15 bp, Homo sapiens
taatagcaggatgag

SEQ ID NO: 289478 - DNA, 15 bp, Homo sapiens
ttaatagcaggatga

SEQ ID NO: 289479 - DNA, 15 bp, Homo sapiens
attaatagcaggatg

SEQ ID NO: 289480 - DNA, 15 bp, Homo sapiens
tattaatagcaggat

SEQ ID NO: 289481 - DNA, 15 bp, Homo sapiens
gtattaatagcagga

SEQ ID NO: 289482 - DNA, 15 bp, Homo sapiens
tgtattaatagcagg

SEQ ID NO: 289483 - DNA, 15 bp, Homo sapiens
gtgtattaatagcag

SEQ ID NO: 289484 - DNA, 15 bp, Homo sapiens
tgtgtattaatagca

SEQ ID NO: 289485 - DNA, 15 bp, Homo sapiens
atgtgtattaatagc

SEQ ID NO: 289486 - DNA, 15 bp, Homo sapiens
aatgtgtattaatag

SEQ ID NO: 289487 - DNA, 15 bp, Homo sapiens
aaatgtgtattaata

SEQ ID NO: 289488 - DNA, 15 bp, Homo sapiens
aaaatgtgtattaat

SEQ ID NO: 289489 - DNA, 15 bp, Homo sapiens
aaaaatgtgtattaa

SEQ ID NO: 289490 - DNA, 15 bp, Homo sapiens
taaaaatgtgtatta

SEQ ID NO: 289491 - DNA, 15 bp, Homo sapiens
ataaaaatgtgtatt

SEQ ID NO: 289492 - DNA, 15 bp, Homo sapiens
tataaaaatgtgtat

SEQ ID NO: 289493 - DNA, 15 bp, Homo sapiens
atataaaaatgtgta

SEQ ID NO: 289494 - DNA, 15 bp, Homo sapiens
tatataaaaatgtgt

SEQ ID NO: 289495 - DNA, 15 bp, Homo sapiens
ttatataaaaatgtg

SEQ ID NO: 289496 - DNA, 15 bp, Homo sapiens
cttatataaaaatgt

SEQ ID NO: 289497 - DNA, 15 bp, Homo sapiens
tcttatataaaaatg

SEQ ID NO: 289498 - DNA, 15 bp, Homo sapiens
ctcttatataaaaat

SEQ ID NO: 289499 - DNA, 15 bp, Homo sapiens
cctcttatataaaaa

SEQ ID NO: 289500 - DNA, 15 bp, Homo sapiens
tcctcttatataaaa

SEQ ID NO: 289501 - DNA, 15 bp, Homo sapiens
ttcctcttatataaa

SEQ ID NO: 289502 - DNA, 15 bp, Homo sapiens
gttcctcttatataa

SEQ ID NO: 289503 - DNA, 15 bp, Homo sapiens
agttcctcttatata

SEQ ID NO: 289504 - DNA, 15 bp, Homo sapiens
tagttcctcttatat

SEQ ID NO: 289505 - DNA, 15 bp, Homo sapiens
ctagttcctcttata

SEQ ID NO: 289506 - DNA, 15 bp, Homo sapiens
gctagttcctcttat

SEQ ID NO: 289507 - DNA, 15 bp, Homo sapiens
tgctagttcctctta

SEQ ID NO: 289508 - DNA, 15 bp, Homo sapiens
atgctagttcctctt

SEQ ID NO: 289509 - DNA, 15 bp, Homo sapiens
catgctagttcctct

SEQ ID NO: 289510 - DNA, 15 bp, Homo sapiens
tcatgctagttcctc

SEQ ID NO: 289511 - DNA, 15 bp, Homo sapiens
ctcatgctagttcct

SEQ ID NO: 289512 - DNA, 15 bp, Homo sapiens
gctcatgctagttcc

SEQ ID NO: 289513 - DNA, 15 bp, Homo sapiens
agctcatgctagttc

SEQ ID NO: 289514 - DNA, 15 bp, Homo sapiens
tagctcatgctagtt

SEQ ID NO: 289515 - DNA, 15 bp, Homo sapiens
ttagctcatgctagt

SEQ ID NO: 289516 - DNA, 15 bp, Homo sapiens
tttagctcatgctag

SEQ ID NO: 289517 - DNA, 15 bp, Homo sapiens
atttagctcatgcta

SEQ ID NO: 289518 - DNA, 15 bp, Homo sapiens
aatttagctcatgct

SEQ ID NO: 289519 - DNA, 15 bp, Homo sapiens
aaatttagctcatgc

SEQ ID NO: 289520 - DNA, 15 bp, Homo sapiens
caaatttagctcatg

SEQ ID NO: 289521 - DNA, 15 bp, Homo sapiens
tcaaatttagctcat

SEQ ID NO: 289522 - DNA, 15 bp, Homo sapiens
ttcaaatttagctca

SEQ ID NO: 289523 - DNA, 15 bp, Homo sapiens
gttcaaatttagctc

SEQ ID NO: 289524 - DNA, 15 bp, Homo sapiens
ggttcaaatttagct

SEQ ID NO: 289525 - DNA, 15 bp, Homo sapiens
aggttcaaatttagc

SEQ ID NO: 289526 - DNA, 15 bp, Homo sapiens
gaggttcaaatttag

SEQ ID NO: 289527 - DNA, 15 bp, Homo sapiens
tgaggttcaaattta

SEQ ID NO: 289528 - DNA, 15 bp, Homo sapiens
gtgaggttcaaattt

SEQ ID NO: 289529 - DNA, 15 bp, Homo sapiens
tgtgaggttcaaatt

SEQ ID NO: 289530 - DNA, 15 bp, Homo sapiens
ctgtgaggttcaaat

SEQ ID NO: 289531 - DNA, 15 bp, Homo sapiens
tctgtgaggttcaaa

SEQ ID NO: 289532 - DNA, 15 bp, Homo sapiens
gtctgtgaggttcaa

SEQ ID NO: 289533 - DNA, 15 bp, Homo sapiens
cgtctgtgaggttca

SEQ ID NO: 289534 - DNA, 15 bp, Homo sapiens
tcgtctgtgaggttc

SEQ ID NO: 289535 - DNA, 15 bp, Homo sapiens
atcgtctgtgaggtt

SEQ ID NO: 289536 - DNA, 15 bp, Homo sapiens
aatcgtctgtgaggt

SEQ ID NO: 289537 - DNA, 15 bp, Homo sapiens
aaatcgtctgtgagg

SEQ ID NO: 289538 - DNA, 15 bp, Homo sapiens
aaaatcgtctgtgag

SEQ ID NO: 289539 - DNA, 15 bp, Homo sapiens
caaaatcgtctgtga

SEQ ID NO: 289540 - DNA, 15 bp, Homo sapiens
ccaaaatcgtctgtg

SEQ ID NO: 289541 - DNA, 15 bp, Homo sapiens
tccaaaatcgtctgt

SEQ ID NO: 289542 - DNA, 15 bp, Homo sapiens
ctccaaaatcgtctg

SEQ ID NO: 289543 - DNA, 15 bp, Homo sapiens
tctccaaaatcgtct

SEQ ID NO: 289544 - DNA, 15 bp, Homo sapiens
ctctccaaaatcgtc

SEQ ID NO: 289545 - DNA, 15 bp, Homo sapiens
tctctccaaaatcgt

SEQ ID NO: 289546 - DNA, 15 bp, Homo sapiens
gtctctccaaaatcg

SEQ ID NO: 289547 - DNA, 15 bp, Homo sapiens
cgtctctccaaaatc

SEQ ID NO: 289548 - DNA, 15 bp, Homo sapiens
tcgtctctccaaaat

SEQ ID NO: 289549 - DNA, 15 bp, Homo sapiens
atcgtctctccaaaa

SEQ ID NO: 289550 - DNA, 15 bp, Homo sapiens
tatcgtctctccaaa

SEQ ID NO: 289551 - DNA, 15 bp, Homo sapiens
ttatcgtctctccaa

SEQ ID NO: 289552 - DNA, 15 bp, Homo sapiens
attatcgtctctcca

SEQ ID NO: 289553 - DNA, 15 bp, Homo sapiens
cattatcgtctctcc

SEQ ID NO: 289554 - DNA, 15 bp, Homo sapiens
gcattatcgtctctc

SEQ ID NO: 289555 - DNA, 15 bp, Homo sapiens
tgcattatcgtctct

SEQ ID NO: 289556 - DNA, 15 bp, Homo sapiens
gtgcattatcgtctc

SEQ ID NO: 289557 - DNA, 15 bp, Homo sapiens
cgtgcattatcgtct

SEQ ID NO: 289558 - DNA, 15 bp, Homo sapiens
acgtgcattatcgtc

SEQ ID NO: 289559 - DNA, 15 bp, Homo sapiens
cacgtgcattatcgt

SEQ ID NO: 289560 - DNA, 15 bp, Homo sapiens
ccacgtgcattatcg

SEQ ID NO: 289561 - DNA, 15 bp, Homo sapiens
accacgtgcattatc

SEQ ID NO: 289562 - DNA, 15 bp, Homo sapiens
taccacgtgcattat

SEQ ID NO: 289563 - DNA, 15 bp, Homo sapiens
ctaccacgtgcatta

SEQ ID NO: 289564 - DNA, 15 bp, Homo sapiens
actaccacgtgcatt

SEQ ID NO: 289565 - DNA, 15 bp, Homo sapiens
gactaccacgtgcat

SEQ ID NO: 289566 - DNA, 15 bp, Homo sapiens
tgactaccacgtgca

SEQ ID NO: 289567 - DNA, 15 bp, Homo sapiens
atgactaccacgtgc

SEQ ID NO: 289568 - DNA, 15 bp, Homo sapiens
aatgactaccacgtg

SEQ ID NO: 289569 - DNA, 15 bp, Homo sapiens
gaatgactaccacgt

SEQ ID NO: 289570 - DNA, 15 bp, Homo sapiens
agaatgactaccacg

SEQ ID NO: 289571 - DNA, 15 bp, Homo sapiens
cagaatgactaccac

SEQ ID NO: 289572 - DNA, 15 bp, Homo sapiens
acagaatgactacca

SEQ ID NO: 289573 - DNA, 15 bp, Homo sapiens
aacagaatgactacc

SEQ ID NO: 289574 - DNA, 15 bp, Homo sapiens
aaacagaatgactac

SEQ ID NO: 289575 - DNA, 15 bp, Homo sapiens
gaaacagaatgacta

SEQ ID NO: 289576 - DNA, 15 bp, Homo sapiens
agaaacagaatgact

SEQ ID NO: 289577 - DNA, 15 bp, Homo sapiens
gagaaacagaatgac

SEQ ID NO: 289578 - DNA, 15 bp, Homo sapiens
ggagaaacagaatga

SEQ ID NO: 289579 - DNA, 15 bp, Homo sapiens
gggagaaacagaatg

SEQ ID NO: 289580 - DNA, 15 bp, Homo sapiens
agggagaaacagaat

SEQ ID NO: 289581 - DNA, 15 bp, Homo sapiens
gagggagaaacagaa

SEQ ID NO: 289582 - DNA, 15 bp, Homo sapiens
agagggagaaacaga

SEQ ID NO: 289583 - DNA, 15 bp, Homo sapiens
aagagggagaaacag

SEQ ID NO: 289584 - DNA, 15 bp, Homo sapiens
aaagagggagaaaca

SEQ ID NO: 289585 - DNA, 15 bp, Homo sapiens
gaaagagggagaaac

SEQ ID NO: 289586 - DNA, 15 bp, Homo sapiens
agaaagagggagaaa

SEQ ID NO: 289587 - DNA, 15 bp, Homo sapiens
cagaaagagggagaa

SEQ ID NO: 289588 - DNA, 15 bp, Homo sapiens
acagaaagagggaga

SEQ ID NO: 289589 - DNA, 15 bp, Homo sapiens
tacagaaagagggag

SEQ ID NO: 289590 - DNA, 15 bp, Homo sapiens
atacagaaagaggga

SEQ ID NO: 289591 - DNA, 15 bp, Homo sapiens
aatacagaaagaggg

SEQ ID NO: 289592 - DNA, 15 bp, Homo sapiens
taatacagaaagagg

SEQ ID NO: 289593 - DNA, 15 bp, Homo sapiens
ctaatacagaaagag

SEQ ID NO: 289594 - DNA, 15 bp, Homo sapiens
tctaatacagaaaga

SEQ ID NO: 289595 - DNA, 15 bp, Homo sapiens
ttctaatacagaaag

SEQ ID NO: 289596 - DNA, 15 bp, Homo sapiens
tttctaatacagaaa

SEQ ID NO: 289597 - DNA, 15 bp, Homo sapiens
atttctaatacagaa

SEQ ID NO: 289598 - DNA, 15 bp, Homo sapiens
gatttctaatacaga

SEQ ID NO: 289599 - DNA, 15 bp, Homo sapiens
agatttctaatacag

SEQ ID NO: 289600 - DNA, 15 bp, Homo sapiens
tagatttctaataca

SEQ ID NO: 289601 - DNA, 15 bp, Homo sapiens
gtagatttctaatac

SEQ ID NO: 289602 - DNA, 15 bp, Homo sapiens
tgtagatttctaata

SEQ ID NO: 289603 - DNA, 15 bp, Homo sapiens
ctgtagatttctaat

SEQ ID NO: 289604 - DNA, 15 bp, Homo sapiens
cctgtagatttctaa

SEQ ID NO: 289605 - DNA, 15 bp, Homo sapiens
acctgtagatttcta

SEQ ID NO: 289606 - DNA, 15 bp, Homo sapiens
cacctgtagatttct

SEQ ID NO: 289607 - DNA, 15 bp, Homo sapiens
ccacctgtagatttc

SEQ ID NO: 289608 - DNA, 15 bp, Homo sapiens
tccacctgtagattt

SEQ ID NO: 289609 - DNA, 15 bp, Homo sapiens
ctccacctgtagatt

SEQ ID NO: 289610 - DNA, 15 bp, Homo sapiens
actccacctgtagat

SEQ ID NO: 289611 - DNA, 15 bp, Homo sapiens
tactccacctgtaga

SEQ ID NO: 289612 - DNA, 15 bp, Homo sapiens
atactccacctgtag

SEQ ID NO: 289613 - DNA, 15 bp, Homo sapiens
catactccacctgta

SEQ ID NO: 289614 - DNA, 15 bp, Homo sapiens
tcatactccacctgt

SEQ ID NO: 289615 - DNA, 15 bp, Homo sapiens
ctcatactccacctg

SEQ ID NO: 289616 - DNA, 15 bp, Homo sapiens
gctcatactccacct

SEQ ID NO: 289617 - DNA, 15 bp, Homo sapiens
tgctcatactccacc

SEQ ID NO: 289618 - DNA, 15 bp, Homo sapiens
ctgctcatactccac

SEQ ID NO: 289619 - DNA, 15 bp, Homo sapiens
gctgctcatactcca

SEQ ID NO: 289620 - DNA, 15 bp, Homo sapiens
agctgctcatactcc

SEQ ID NO: 289621 - DNA, 15 bp, Homo sapiens
cagctgctcatactc

SEQ ID NO: 289622 - DNA, 15 bp, Homo sapiens
tcagctgctcatact

SEQ ID NO: 289623 - DNA, 15 bp, Homo sapiens
ttcagctgctcatac

SEQ ID NO: 289624 - DNA, 15 bp, Homo sapiens
cttcagctgctcata

SEQ ID NO: 289625 - DNA, 15 bp, Homo sapiens
ccttcagctgctcat

SEQ ID NO: 289626 - DNA, 15 bp, Homo sapiens
tccttcagctgctca

SEQ ID NO: 289627 - DNA, 15 bp, Homo sapiens
gtccttcagctgctc

SEQ ID NO: 289628 - DNA, 15 bp, Homo sapiens
ggtccttcagctgct

SEQ ID NO: 289629 - DNA, 15 bp, Homo sapiens
tggtccttcagctgc

SEQ ID NO: 289630 - DNA, 15 bp, Homo sapiens
ctggtccttcagctg

SEQ ID NO: 289631 - DNA, 15 bp, Homo sapiens
gctggtccttcagct

SEQ ID NO: 289632 - DNA, 15 bp, Homo sapiens
tgctggtccttcagc

SEQ ID NO: 289633 - DNA, 15 bp, Homo sapiens
gtgctggtccttcag

SEQ ID NO: 289634 - DNA, 15 bp, Homo sapiens
ggtgctggtccttca

SEQ ID NO: 289635 - DNA, 15 bp, Homo sapiens
aggtgctggtccttc

SEQ ID NO: 289636 - DNA, 15 bp, Homo sapiens
gaggtgctggtcctt

SEQ ID NO: 289637 - DNA, 15 bp, Homo sapiens
ggaggtgctggtcct

SEQ ID NO: 289638 - DNA, 15 bp, Homo sapiens
cggaggtgctggtcc

SEQ ID NO: 289639 - DNA, 15 bp, Homo sapiens
tcggaggtgctggtc

SEQ ID NO: 289640 - DNA, 15 bp, Homo sapiens
ttcggaggtgctggt

SEQ ID NO: 289641 - DNA, 15 bp, Homo sapiens
cttcggaggtgctgg

SEQ ID NO: 289642 - DNA, 15 bp, Homo sapiens
ccttcggaggtgctg

SEQ ID NO: 289643 - DNA, 15 bp, Homo sapiens
cccttcggaggtgct

SEQ ID NO: 289644 - DNA, 15 bp, Homo sapiens
ccccttcggaggtgc

SEQ ID NO: 289645 - DNA, 15 bp, Homo sapiens
cccccttcggaggtg

SEQ ID NO: 289646 - DNA, 15 bp, Homo sapiens
gcccccttcggaggt

SEQ ID NO: 289647 - DNA, 15 bp, Homo sapiens
agcccccttcggagg

SEQ ID NO: 289648 - DNA, 15 bp, Homo sapiens
gagcccccttcggag

SEQ ID NO: 289649 - DNA, 15 bp, Homo sapiens
ggagcccccttcgga

SEQ ID NO: 289650 - DNA, 15 bp, Homo sapiens
gggagcccccttcgg

SEQ ID NO: 289651 - DNA, 15 bp, Homo sapiens
agggagcccccttcg

SEQ ID NO: 289652 - DNA, 15 bp, Homo sapiens
cagggagcccccttc

SEQ ID NO: 289653 - DNA, 15 bp, Homo sapiens
acagggagccccctt

SEQ ID NO: 289654 - DNA, 15 bp, Homo sapiens
gacagggagccccct

SEQ ID NO: 289655 - DNA, 15 bp, Homo sapiens
cgacagggagccccc

SEQ ID NO: 289656 - DNA, 15 bp, Homo sapiens
ccgacagggagcccc

SEQ ID NO: 289657 - DNA, 15 bp, Homo sapiens
accgacagggagccc

SEQ ID NO: 289658 - DNA, 15 bp, Homo sapiens
aaccgacagggagcc

SEQ ID NO: 289659 - DNA, 15 bp, Homo sapiens
gaaccgacagggagc

SEQ ID NO: 289660 - DNA, 15 bp, Homo sapiens
tgaaccgacagggag

SEQ ID NO: 289661 - DNA, 15 bp, Homo sapiens
gtgaaccgacaggga

SEQ ID NO: 289662 - DNA, 15 bp, Homo sapiens
ggtgaaccgacaggg

SEQ ID NO: 289663 - DNA, 15 bp, Homo sapiens
cggtgaaccgacagg

SEQ ID NO: 289664 - DNA, 15 bp, Homo sapiens
gcggtgaaccgacag

SEQ ID NO: 289665 - DNA, 15 bp, Homo sapiens
ggcggtgaaccgaca

SEQ ID NO: 289666 - DNA, 15 bp, Homo sapiens
tggcggtgaaccgac

SEQ ID NO: 289667 - DNA, 15 bp, Homo sapiens
ctggcggtgaaccga

SEQ ID NO: 289668 - DNA, 15 bp, Homo sapiens
tctggcggtgaaccg

SEQ ID NO: 289669 - DNA, 15 bp, Homo sapiens
ctctggcggtgaacc

SEQ ID NO: 289670 - DNA, 15 bp, Homo sapiens
actctggcggtgaac

SEQ ID NO: 289671 - DNA, 15 bp, Homo sapiens
gactctggcggtgaa

SEQ ID NO: 289672 - DNA, 15 bp, Homo sapiens
cgactctggcggtga

SEQ ID NO: 289673 - DNA, 15 bp, Homo sapiens
tcgactctggcggtg

SEQ ID NO: 289674 - DNA, 15 bp, Homo sapiens
atcgactctggcggt

SEQ ID NO: 289675 - DNA, 15 bp, Homo sapiens
aatcgactctggcgg

SEQ ID NO: 289676 - DNA, 15 bp, Homo sapiens
taatcgactctggcg

SEQ ID NO: 289677 - DNA, 15 bp, Homo sapiens
ataatcgactctggc

SEQ ID NO: 289678 - DNA, 15 bp, Homo sapiens
tataatcgactctgg

SEQ ID NO: 289679 - DNA, 15 bp, Homo sapiens
atataatcgactctg

SEQ ID NO: 289680 - DNA, 15 bp, Homo sapiens
gatataatcgactct

SEQ ID NO: 289681 - DNA, 15 bp, Homo sapiens
agatataatcgactc

SEQ ID NO: 289682 - DNA, 15 bp, Homo sapiens
gagatataatcgact

SEQ ID NO: 289683 - DNA, 15 bp, Homo sapiens
ggagatataatcgac

SEQ ID NO: 289684 - DNA, 15 bp, Homo sapiens
gggagatataatcga

SEQ ID NO: 289685 - DNA, 15 bp, Homo sapiens
ggggagatataatcg

SEQ ID NO: 289686 - DNA, 15 bp, Homo sapiens
tggggagatataatc

SEQ ID NO: 289687 - DNA, 15 bp, Homo sapiens
atggggagatataat

SEQ ID NO: 289688 - DNA, 15 bp, Homo sapiens
gatggggagatataa

SEQ ID NO: 289689 - DNA, 15 bp, Homo sapiens
tgatggggagatata

SEQ ID NO: 289690 - DNA, 15 bp, Homo sapiens
gtgatggggagatat

SEQ ID NO: 289691 - DNA, 15 bp, Homo sapiens
tgtgatggggagata

SEQ ID NO: 289692 - DNA, 15 bp, Homo sapiens
gtgtgatggggagat

SEQ ID NO: 289693 - DNA, 15 bp, Homo sapiens
cgtgtgatggggaga

SEQ ID NO: 289694 - DNA, 15 bp, Homo sapiens
acgtgtgatggggag

SEQ ID NO: 289695 - DNA, 15 bp, Homo sapiens
gacgtgtgatgggga

SEQ ID NO: 289696 - DNA, 15 bp, Homo sapiens
agacgtgtgatgggg

SEQ ID NO: 289697 - DNA, 15 bp, Homo sapiens
cagacgtgtgatggg

SEQ ID NO: 289698 - DNA, 15 bp, Homo sapiens
tcagacgtgtgatgg

SEQ ID NO: 289699 - DNA, 15 bp, Homo sapiens
ctcagacgtgtgatg

SEQ ID NO: 289700 - DNA, 15 bp, Homo sapiens
cctcagacgtgtgat

SEQ ID NO: 289701 - DNA, 15 bp, Homo sapiens
tcctcagacgtgtga

SEQ ID NO: 289702 - DNA, 15 bp, Homo sapiens
atcctcagacgtgtg

SEQ ID NO: 289703 - DNA, 15 bp, Homo sapiens
aatcctcagacgtgt

SEQ ID NO: 289704 - DNA, 15 bp, Homo sapiens
gaatcctcagacgtg

SEQ ID NO: 289705 - DNA, 15 bp, Homo sapiens
tgaatcctcagacgt

SEQ ID NO: 289706 - DNA, 15 bp, Homo sapiens
ctgaatcctcagacg

SEQ ID NO: 289707 - DNA, 15 bp, Homo sapiens
tctgaatcctcagac

SEQ ID NO: 289708 - DNA, 15 bp, Homo sapiens
ttctgaatcctcaga

SEQ ID NO: 289709 - DNA, 15 bp, Homo sapiens
gttctgaatcctcag

SEQ ID NO: 289710 - DNA, 15 bp, Homo sapiens
agttctgaatcctca

SEQ ID NO: 289711 - DNA, 15 bp, Homo sapiens
aagttctgaatcctc

SEQ ID NO: 289712 - DNA, 15 bp, Homo sapiens
taagttctgaatcct

SEQ ID NO: 289713 - DNA, 15 bp, Homo sapiens
ataagttctgaatcc

SEQ ID NO: 289714 - DNA, 15 bp, Homo sapiens
tataagttctgaatc

SEQ ID NO: 289715 - DNA, 15 bp, Homo sapiens
ctataagttctgaat

SEQ ID NO: 289716 - DNA, 15 bp, Homo sapiens
gctataagttctgaa

SEQ ID NO: 289717 - DNA, 15 bp, Homo sapiens
tgctataagttctga

SEQ ID NO: 289718 - DNA, 15 bp, Homo sapiens
ctgctataagttctg

SEQ ID NO: 289719 - DNA, 15 bp, Homo sapiens
tctgctataagttct

SEQ ID NO: 289720 - DNA, 15 bp, Homo sapiens
ttctgctataagttc

SEQ ID NO: 289721 - DNA, 15 bp, Homo sapiens
cttctgctataagtt

SEQ ID NO: 289722 - DNA, 15 bp, Homo sapiens
gcttctgctataagt

SEQ ID NO: 289723 - DNA, 15 bp, Homo sapiens
tgcttctgctataag

SEQ ID NO: 289724 - DNA, 15 bp, Homo sapiens
ttgcttctgctataa

SEQ ID NO: 289725 - DNA, 15 bp, Homo sapiens
tttgcttctgctata

SEQ ID NO: 289726 - DNA, 15 bp, Homo sapiens
ttttgcttctgctat

SEQ ID NO: 289727 - DNA, 15 bp, Homo sapiens
gttttgcttctgcta

SEQ ID NO: 289728 - DNA, 15 bp, Homo sapiens
agttttgcttctgct

SEQ ID NO: 289729 - DNA, 15 bp, Homo sapiens
gagttttgcttctgc

SEQ ID NO: 289730 - DNA, 15 bp, Homo sapiens
ggagttttgcttctg

SEQ ID NO: 289731 - DNA, 15 bp, Homo sapiens
aggagttttgcttct

SEQ ID NO: 289732 - DNA, 15 bp, Homo sapiens
gaggagttttgcttc

SEQ ID NO: 289733 - DNA, 15 bp, Homo sapiens
tgaggagttttgctt

SEQ ID NO: 289734 - DNA, 15 bp, Homo sapiens
ctgaggagttttgct

SEQ ID NO: 289735 - DNA, 15 bp, Homo sapiens
cctgaggagttttgc

SEQ ID NO: 289736 - DNA, 15 bp, Homo sapiens
gcctgaggagttttg

SEQ ID NO: 289737 - DNA, 15 bp, Homo sapiens
tgcctgaggagtttt

SEQ ID NO: 289738 - DNA, 15 bp, Homo sapiens
ctgcctgaggagttt

SEQ ID NO: 289739 - DNA, 15 bp, Homo sapiens
gctgcctgaggagtt

SEQ ID NO: 289740 - DNA, 15 bp, Homo sapiens
tgctgcctgaggagt

SEQ ID NO: 289741 - DNA, 15 bp, Homo sapiens
gtgctgcctgaggag

SEQ ID NO: 289742 - DNA, 15 bp, Homo sapiens
tgtgctgcctgagga

SEQ ID NO: 289743 - DNA, 15 bp, Homo sapiens
ttgtgctgcctgagg

SEQ ID NO: 289744 - DNA, 15 bp, Homo sapiens
tttgtgctgcctgag

SEQ ID NO: 289745 - DNA, 15 bp, Homo sapiens
ctttgtgctgcctga

SEQ ID NO: 289746 - DNA, 15 bp, Homo sapiens
cctttgtgctgcctg

SEQ ID NO: 289747 - DNA, 15 bp, Homo sapiens
acctttgtgctgcct

SEQ ID NO: 289748 - DNA, 15 bp, Homo sapiens
gacctttgtgctgcc

SEQ ID NO: 289749 - DNA, 15 bp, Homo sapiens
cgacctttgtgctgc

SEQ ID NO: 289750 - DNA, 15 bp, Homo sapiens
ccgacctttgtgctg

SEQ ID NO: 289751 - DNA, 15 bp, Homo sapiens
gccgacctttgtgct

SEQ ID NO: 289752 - DNA, 15 bp, Homo sapiens
agccgacctttgtgc

SEQ ID NO: 289753 - DNA, 15 bp, Homo sapiens
cagccgacctttgtg

SEQ ID NO: 289754 - DNA, 15 bp, Homo sapiens
ccagccgacctttgt

SEQ ID NO: 289755 - DNA, 15 bp, Homo sapiens
tccagccgacctttg

SEQ ID NO: 289756 - DNA, 15 bp, Homo sapiens
ctccagccgaccttt

SEQ ID NO: 289757 - DNA, 15 bp, Homo sapiens
cctccagccgacctt

SEQ ID NO: 289758 - DNA, 15 bp, Homo sapiens
gcctccagccgacct

SEQ ID NO: 289759 - DNA, 15 bp, Homo sapiens
agcctccagccgacc

SEQ ID NO: 289760 - DNA, 15 bp, Homo sapiens
tagcctccagccgac

SEQ ID NO: 289761 - DNA, 15 bp, Homo sapiens
ctagcctccagccga

SEQ ID NO: 289762 - DNA, 15 bp, Homo sapiens
cctagcctccagccg

SEQ ID NO: 289763 - DNA, 15 bp, Homo sapiens
tcctagcctccagcc

SEQ ID NO: 289764 - DNA, 15 bp, Homo sapiens
atcctagcctccagc

SEQ ID NO: 289765 - DNA, 15 bp, Homo sapiens
catcctagcctccag

SEQ ID NO: 289766 - DNA, 15 bp, Homo sapiens
gcatcctagcctcca

SEQ ID NO: 289767 - DNA, 15 bp, Homo sapiens
tgcatcctagcctcc

SEQ ID NO: 289768 - DNA, 15 bp, Homo sapiens
ctgcatcctagcctc

SEQ ID NO: 289769 - DNA, 15 bp, Homo sapiens
tctgcatcctagcct

SEQ ID NO: 289770 - DNA, 15 bp, Homo sapiens
atctgcatcctagcc

SEQ ID NO: 289771 - DNA, 15 bp, Homo sapiens
aatctgcatcctagc

SEQ ID NO: 289772 - DNA, 15 bp, Homo sapiens
aaatctgcatcctag

SEQ ID NO: 289773 - DNA, 15 bp, Homo sapiens
aaaatctgcatccta

SEQ ID NO: 289774 - DNA, 15 bp, Homo sapiens
taaaatctgcatcct

SEQ ID NO: 289775 - DNA, 15 bp, Homo sapiens
ctaaaatctgcatcc

SEQ ID NO: 289776 - DNA, 15 bp, Homo sapiens
tctaaaatctgcatc

SEQ ID NO: 289777 - DNA, 15 bp, Homo sapiens
ttctaaaatctgcat

SEQ ID NO: 289778 - DNA, 15 bp, Homo sapiens
cttctaaaatctgca

SEQ ID NO: 289779 - DNA, 15 bp, Homo sapiens
tcttctaaaatctgc

SEQ ID NO: 289780 - DNA, 15 bp, Homo sapiens
atcttctaaaatctg

SEQ ID NO: 289781 - DNA, 15 bp, Homo sapiens
gatcttctaaaatct

SEQ ID NO: 289782 - DNA, 15 bp, Homo sapiens
tgatcttctaaaatc

SEQ ID NO: 289783 - DNA, 15 bp, Homo sapiens
gtgatcttctaaaat

SEQ ID NO: 289784 - DNA, 15 bp, Homo sapiens
tgtgatcttctaaaa

SEQ ID NO: 289785 - DNA, 15 bp, Homo sapiens
ttgtgatcttctaaa

SEQ ID NO: 289786 - DNA, 15 bp, Homo sapiens
attgtgatcttctaa

SEQ ID NO: 289787 - DNA, 15 bp, Homo sapiens
tattgtgatcttcta

SEQ ID NO: 289788 - DNA, 15 bp, Homo sapiens
ttattgtgatcttct

SEQ ID NO: 289789 - DNA, 15 bp, Homo sapiens
tttattgtgatcttc

SEQ ID NO: 289790 - DNA, 15 bp, Homo sapiens
gtttattgtgatctt

SEQ ID NO: 289791 - DNA, 15 bp, Homo sapiens
tgtttattgtgatct

SEQ ID NO: 289792 - DNA, 15 bp, Homo sapiens
ctgtttattgtgatc

SEQ ID NO: 289793 - DNA, 15 bp, Homo sapiens
gctgtttattgtgat

SEQ ID NO: 289794 - DNA, 15 bp, Homo sapiens
agctgtttattgtga

SEQ ID NO: 289795 - DNA, 15 bp, Homo sapiens
cagctgtttattgtg

SEQ ID NO: 289796 - DNA, 15 bp, Homo sapiens
ccagctgtttattgt

SEQ ID NO: 289797 - DNA, 15 bp, Homo sapiens
tccagctgtttattg

SEQ ID NO: 289798 - DNA, 15 bp, Homo sapiens
ctccagctgtttatt

SEQ ID NO: 289799 - DNA, 15 bp, Homo sapiens
actccagctgtttat

SEQ ID NO: 289800 - DNA, 15 bp, Homo sapiens
gactccagctgttta

SEQ ID NO: 289801 - DNA, 15 bp, Homo sapiens
agactccagctgttt

SEQ ID NO: 289802 - DNA, 15 bp, Homo sapiens
gagactccagctgtt

SEQ ID NO: 289803 - DNA, 15 bp, Homo sapiens
tgagactccagctgt

SEQ ID NO: 289804 - DNA, 15 bp, Homo sapiens
ctgagactccagctg

SEQ ID NO: 289805 - DNA, 15 bp, Homo sapiens
gctgagactccagct

SEQ ID NO: 289806 - DNA, 15 bp, Homo sapiens
agctgagactccagc

SEQ ID NO: 289807 - DNA, 15 bp, Homo sapiens
gagctgagactccag

SEQ ID NO: 289808 - DNA, 15 bp, Homo sapiens
ggagctgagactcca

SEQ ID NO: 289809 - DNA, 15 bp, Homo sapiens
tggagctgagactcc

SEQ ID NO: 289810 - DNA, 15 bp, Homo sapiens
gtggagctgagactc

SEQ ID NO: 289811 - DNA, 15 bp, Homo sapiens
ggtggagctgagact

SEQ ID NO: 289812 - DNA, 15 bp, Homo sapiens
cggtggagctgagac

SEQ ID NO: 289813 - DNA, 15 bp, Homo sapiens
gcggtggagctgaga

SEQ ID NO: 289814 - DNA, 15 bp, Homo sapiens
ggcggtggagctgag

SEQ ID NO: 289815 - DNA, 15 bp, Homo sapiens
aggcggtggagctga

SEQ ID NO: 289816 - DNA, 15 bp, Homo sapiens
gaggcggtggagctg

SEQ ID NO: 289817 - DNA, 15 bp, Homo sapiens
ggaggcggtggagct

SEQ ID NO: 289818 - DNA, 15 bp, Homo sapiens
cggaggcggtggagc

SEQ ID NO: 289819 - DNA, 15 bp, Homo sapiens
tcggaggcggtggag

SEQ ID NO: 289820 - DNA, 15 bp, Homo sapiens
gtcggaggcggtgga

SEQ ID NO: 289821 - DNA, 15 bp, Homo sapiens
tgtcggaggcggtgg

SEQ ID NO: 289822 - DNA, 15 bp, Homo sapiens
ctgtcggaggcggtg

SEQ ID NO: 289823 - DNA, 15 bp, Homo sapiens
gctgtcggaggcggt

SEQ ID NO: 289824 - DNA, 15 bp, Homo sapiens
agctgtcggaggcgg

SEQ ID NO: 289825 - DNA, 15 bp, Homo sapiens
cagctgtcggaggcg

SEQ ID NO: 289826 - DNA, 15 bp, Homo sapiens
gcagctgtcggaggc

SEQ ID NO: 289827 - DNA, 15 bp, Homo sapiens
agcagctgtcggagg

SEQ ID NO: 289828 - DNA, 15 bp, Homo sapiens
cagcagctgtcggag

SEQ ID NO: 289829 - DNA, 15 bp, Homo sapiens
ccagcagctgtcgga

SEQ ID NO: 289830 - DNA, 15 bp, Homo sapiens
tccagcagctgtcgg

SEQ ID NO: 289831 - DNA, 15 bp, Homo sapiens
ctccagcagctgtcg

SEQ ID NO: 289832 - DNA, 15 bp, Homo sapiens
gctccagcagctgtc

SEQ ID NO: 289833 - DNA, 15 bp, Homo sapiens
tgctccagcagctgt

SEQ ID NO: 289834 - DNA, 15 bp, Homo sapiens
ctgctccagcagctg

SEQ ID NO: 289835 - DNA, 15 bp, Homo sapiens
cctgctccagcagct

SEQ ID NO: 289836 - DNA, 15 bp, Homo sapiens
acctgctccagcagc

SEQ ID NO: 289837 - DNA, 15 bp, Homo sapiens
tacctgctccagcag

SEQ ID NO: 289838 - DNA, 15 bp, Homo sapiens
ctacctgctccagca

SEQ ID NO: 289839 - DNA, 15 bp, Homo sapiens
cctacctgctccagc

SEQ ID NO: 289840 - DNA, 15 bp, Homo sapiens
ccctacctgctccag

SEQ ID NO: 289841 - DNA, 15 bp, Homo sapiens
accctacctgctcca

SEQ ID NO: 289842 - DNA, 15 bp, Homo sapiens
caccctacctgctcc

SEQ ID NO: 289843 - DNA, 15 bp, Homo sapiens
acaccctacctgctc

SEQ ID NO: 289844 - DNA, 15 bp, Homo sapiens
cacaccctacctgct

SEQ ID NO: 289845 - DNA, 15 bp, Homo sapiens
acacaccctacctgc

SEQ ID NO: 289846 - DNA, 15 bp, Homo sapiens
tacacaccctacctg

SEQ ID NO: 289847 - DNA, 15 bp, Homo sapiens
ctacacaccctacct

SEQ ID NO: 289848 - DNA, 15 bp, Homo sapiens
tctacacaccctacc

SEQ ID NO: 289849 - DNA, 15 bp, Homo sapiens
ttctacacaccctac

SEQ ID NO: 289850 - DNA, 15 bp, Homo sapiens
attctacacacccta

SEQ ID NO: 289851 - DNA, 15 bp, Homo sapiens
aattctacacaccct

SEQ ID NO: 289852 - DNA, 15 bp, Homo sapiens
gaattctacacaccc

SEQ ID NO: 289853 - DNA, 15 bp, Homo sapiens
tgaattctacacacc

SEQ ID NO: 289854 - DNA, 15 bp, Homo sapiens
ctgaattctacacac

SEQ ID NO: 289855 - DNA, 15 bp, Homo sapiens
gctgaattctacaca

SEQ ID NO: 289856 - DNA, 15 bp, Homo sapiens
cgctgaattctacac

SEQ ID NO: 289857 - DNA, 15 bp, Homo sapiens
acgctgaattctaca

SEQ ID NO: 289858 - DNA, 15 bp, Homo sapiens
gacgctgaattctac

SEQ ID NO: 289859 - DNA, 15 bp, Homo sapiens
tgacgctgaattcta

SEQ ID NO: 289860 - DNA, 15 bp, Homo sapiens
gtgacgctgaattct

SEQ ID NO: 289861 - DNA, 15 bp, Homo sapiens
tgtgacgctgaattc

SEQ ID NO: 289862 - DNA, 15 bp, Homo sapiens
gtgtgacgctgaatt

SEQ ID NO: 289863 - DNA, 15 bp, Homo sapiens
ggtgtgacgctgaat

SEQ ID NO: 289864 - DNA, 15 bp, Homo sapiens
aggtgtgacgctgaa

SEQ ID NO: 289865 - DNA, 15 bp, Homo sapiens
gaggtgtgacgctga

SEQ ID NO: 289866 - DNA, 15 bp, Homo sapiens
ggaggtgtgacgctg

SEQ ID NO: 289867 - DNA, 15 bp, Homo sapiens
gggaggtgtgacgct

SEQ ID NO: 289868 - DNA, 15 bp, Homo sapiens
ggggaggtgtgacgc

SEQ ID NO: 289869 - DNA, 15 bp, Homo sapiens
tggggaggtgtgacg

SEQ ID NO: 289870 - DNA, 15 bp, Homo sapiens
ctggggaggtgtgac

SEQ ID NO: 289871 - DNA, 15 bp, Homo sapiens
cctggggaggtgtga

SEQ ID NO: 289872 - DNA, 15 bp, Homo sapiens
gcctggggaggtgtg

SEQ ID NO: 289873 - DNA, 15 bp, Homo sapiens
ggcctggggaggtgt

SEQ ID NO: 289874 - DNA, 15 bp, Homo sapiens
tggcctggggaggtg

SEQ ID NO: 289875 - DNA, 15 bp, Homo sapiens
atggcctggggaggt

SEQ ID NO: 289876 - DNA, 15 bp, Homo sapiens
gatggcctggggagg

SEQ ID NO: 289877 - DNA, 15 bp, Homo sapiens
agatggcctggggag

SEQ ID NO: 289878 - DNA, 15 bp, Homo sapiens
cagatggcctgggga

SEQ ID NO: 289879 - DNA, 15 bp, Homo sapiens
acagatggcctgggg

SEQ ID NO: 289880 - DNA, 15 bp, Homo sapiens
gacagatggcctggg

SEQ ID NO: 289881 - DNA, 15 bp, Homo sapiens
ggacagatggcctgg

SEQ ID NO: 289882 - DNA, 15 bp, Homo sapiens
tggacagatggcctg

SEQ ID NO: 289883 - DNA, 15 bp, Homo sapiens
gtggacagatggcct

SEQ ID NO: 289884 - DNA, 15 bp, Homo sapiens
agtggacagatggcc

SEQ ID NO: 289885 - DNA, 15 bp, Homo sapiens
cagtggacagatggc

SEQ ID NO: 289886 - DNA, 15 bp, Homo sapiens
gcagtggacagatgg

SEQ ID NO: 289887 - DNA, 15 bp, Homo sapiens
ggcagtggacagatg

SEQ ID NO: 289888 - DNA, 15 bp, Homo sapiens
gggcagtggacagat

SEQ ID NO: 289889 - DNA, 15 bp, Homo sapiens
agggcagtggacaga

SEQ ID NO: 289890 - DNA, 15 bp, Homo sapiens
cagggcagtggacag

SEQ ID NO: 289891 - DNA, 15 bp, Homo sapiens
ccagggcagtggaca

SEQ ID NO: 289892 - DNA, 15 bp, Homo sapiens
cccagggcagtggac

SEQ ID NO: 289893 - DNA, 15 bp, Homo sapiens
tcccagggcagtgga

SEQ ID NO: 289894 - DNA, 15 bp, Homo sapiens
ctcccagggcagtgg

SEQ ID NO: 289895 - DNA, 15 bp, Homo sapiens
tctcccagggcagtg

SEQ ID NO: 289896 - DNA, 15 bp, Homo sapiens
atctcccagggcagt

SEQ ID NO: 289897 - DNA, 15 bp, Homo sapiens
catctcccagggcag

SEQ ID NO: 289898 - DNA, 15 bp, Homo sapiens
tcatctcccagggca

SEQ ID NO: 289899 - DNA, 15 bp, Homo sapiens
atcatctcccagggc

SEQ ID NO: 289900 - DNA, 15 bp, Homo sapiens
catcatctcccaggg

SEQ ID NO: 289901 - DNA, 15 bp, Homo sapiens
ccatcatctcccagg

SEQ ID NO: 289902 - DNA, 15 bp, Homo sapiens
accatcatctcccag

SEQ ID NO: 289903 - DNA, 15 bp, Homo sapiens
gaccatcatctccca

SEQ ID NO: 289904 - DNA, 15 bp, Homo sapiens
ggaccatcatctccc

SEQ ID NO: 289905 - DNA, 15 bp, Homo sapiens
tggaccatcatctcc

SEQ ID NO: 289906 - DNA, 15 bp, Homo sapiens
ctggaccatcatctc

SEQ ID NO: 289907 - DNA, 15 bp, Homo sapiens
cctggaccatcatct

SEQ ID NO: 289908 - DNA, 15 bp, Homo sapiens
acctggaccatcatc

SEQ ID NO: 289909 - DNA, 15 bp, Homo sapiens
cacctggaccatcat

SEQ ID NO: 289910 - DNA, 15 bp, Homo sapiens
acacctggaccatca

SEQ ID NO: 289911 - DNA, 15 bp, Homo sapiens
gacacctggaccatc

SEQ ID NO: 289912 - DNA, 15 bp, Homo sapiens
tgacacctggaccat

SEQ ID NO: 289913 - DNA, 15 bp, Homo sapiens
ctgacacctggacca

SEQ ID NO: 289914 - DNA, 15 bp, Homo sapiens
cctgacacctggacc

SEQ ID NO: 289915 - DNA, 15 bp, Homo sapiens
tcctgacacctggac

SEQ ID NO: 289916 - DNA, 15 bp, Homo sapiens
ctcctgacacctgga

SEQ ID NO: 289917 - DNA, 15 bp, Homo sapiens
tctcctgacacctgg

SEQ ID NO: 289918 - DNA, 15 bp, Homo sapiens
ctctcctgacacctg

SEQ ID NO: 289919 - DNA, 15 bp, Homo sapiens
cctctcctgacacct

SEQ ID NO: 289920 - DNA, 15 bp, Homo sapiens
gcctctcctgacacc

SEQ ID NO: 289921 - DNA, 15 bp, Homo sapiens
tgcctctcctgacac

SEQ ID NO: 289922 - DNA, 15 bp, Homo sapiens
ctgcctctcctgaca

SEQ ID NO: 289923 - DNA, 15 bp, Homo sapiens
tctgcctctcctgac

SEQ ID NO: 289924 - DNA, 15 bp, Homo sapiens
ctctgcctctcctga

SEQ ID NO: 289925 - DNA, 15 bp, Homo sapiens
tctctgcctctcctg

SEQ ID NO: 289926 - DNA, 15 bp, Homo sapiens
ttctctgcctctcct

SEQ ID NO: 289927 - DNA, 15 bp, Homo sapiens
cttctctgcctctcc

SEQ ID NO: 289928 - DNA, 15 bp, Homo sapiens
acttctctgcctctc

SEQ ID NO: 289929 - DNA, 15 bp, Homo sapiens
gacttctctgcctct

SEQ ID NO: 289930 - DNA, 15 bp, Homo sapiens
ggacttctctgcctc

SEQ ID NO: 289931 - DNA, 15 bp, Homo sapiens
tggacttctctgcct

SEQ ID NO: 289932 - DNA, 15 bp, Homo sapiens
gtggacttctctgcc

SEQ ID NO: 289933 - DNA, 15 bp, Homo sapiens
agtggacttctctgc

SEQ ID NO: 289934 - DNA, 15 bp, Homo sapiens
aagtggacttctctg

SEQ ID NO: 289935 - DNA, 15 bp, Homo sapiens
aaagtggacttctct

SEQ ID NO: 289936 - DNA, 15 bp, Homo sapiens
gaaagtggacttctc

SEQ ID NO: 289937 - DNA, 15 bp, Homo sapiens
tgaaagtggacttct

SEQ ID NO: 289938 - DNA, 15 bp, Homo sapiens
ttgaaagtggacttc

SEQ ID NO: 289939 - DNA, 15 bp, Homo sapiens
attgaaagtggactt

SEQ ID NO: 289940 - DNA, 15 bp, Homo sapiens
aattgaaagtggact

SEQ ID NO: 289941 - DNA, 15 bp, Homo sapiens
aaattgaaagtggac

SEQ ID NO: 289942 - DNA, 15 bp, Homo sapiens
gaaattgaaagtgga

SEQ ID NO: 289943 - DNA, 15 bp, Homo sapiens
agaaattgaaagtgg

SEQ ID NO: 289944 - DNA, 15 bp, Homo sapiens
aagaaattgaaagtg

SEQ ID NO: 289945 - DNA, 15 bp, Homo sapiens
taagaaattgaaagt

SEQ ID NO: 289946 - DNA, 15 bp, Homo sapiens
gtaagaaattgaaag

SEQ ID NO: 289947 - DNA, 15 bp, Homo sapiens
ggtaagaaattgaaa

SEQ ID NO: 289948 - DNA, 15 bp, Homo sapiens
aggtaagaaattgaa

SEQ ID NO: 289949 - DNA, 15 bp, Homo sapiens
gaggtaagaaattga

SEQ ID NO: 289950 - DNA, 15 bp, Homo sapiens
ggaggtaagaaattg

SEQ ID NO: 289951 - DNA, 15 bp, Homo sapiens
cggaggtaagaaatt

SEQ ID NO: 289952 - DNA, 15 bp, Homo sapiens
acggaggtaagaaat

SEQ ID NO: 289953 - DNA, 15 bp, Homo sapiens
tacggaggtaagaaa

SEQ ID NO: 289954 - DNA, 15 bp, Homo sapiens
ctacggaggtaagaa

SEQ ID NO: 289955 - DNA, 15 bp, Homo sapiens
actacggaggtaaga

SEQ ID NO: 289956 - DNA, 15 bp, Homo sapiens
aactacggaggtaag

SEQ ID NO: 289957 - DNA, 15 bp, Homo sapiens
taactacggaggtaa

SEQ ID NO: 289958 - DNA, 15 bp, Homo sapiens
ttaactacggaggta

SEQ ID NO: 289959 - DNA, 15 bp, Homo sapiens
attaactacggaggt

SEQ ID NO: 289960 - DNA, 15 bp, Homo sapiens
aattaactacggagg

SEQ ID NO: 289961 - DNA, 15 bp, Homo sapiens
gaattaactacggag

SEQ ID NO: 289962 - DNA, 15 bp, Homo sapiens
tgaattaactacgga

SEQ ID NO: 289963 - DNA, 15 bp, Homo sapiens
ctgaattaactacgg

SEQ ID NO: 289964 - DNA, 15 bp, Homo sapiens
tctgaattaactacg

SEQ ID NO: 289965 - DNA, 15 bp, Homo sapiens
gtctgaattaactac

SEQ ID NO: 289966 - DNA, 15 bp, Homo sapiens
agtctgaattaacta

SEQ ID NO: 289967 - DNA, 15 bp, Homo sapiens
cagtctgaattaact

SEQ ID NO: 289968 - DNA, 15 bp, Homo sapiens
ccagtctgaattaac

SEQ ID NO: 289969 - DNA, 15 bp, Homo sapiens
gccagtctgaattaa

SEQ ID NO: 289970 - DNA, 15 bp, Homo sapiens
agccagtctgaatta

SEQ ID NO: 289971 - DNA, 15 bp, Homo sapiens
aagccagtctgaatt

SEQ ID NO: 289972 - DNA, 15 bp, Homo sapiens
taagccagtctgaat

SEQ ID NO: 289973 - DNA, 15 bp, Homo sapiens
ctaagccagtctgaa

SEQ ID NO: 289974 - DNA, 15 bp, Homo sapiens
tctaagccagtctga

SEQ ID NO: 289975 - DNA, 15 bp, Homo sapiens
ttctaagccagtctg

SEQ ID NO: 289976 - DNA, 15 bp, Homo sapiens
tttctaagccagtct

SEQ ID NO: 289977 - DNA, 15 bp, Homo sapiens
atttctaagccagtc

SEQ ID NO: 289978 - DNA, 15 bp, Homo sapiens
aatttctaagccagt

SEQ ID NO: 289979 - DNA, 15 bp, Homo sapiens
aaatttctaagccag

SEQ ID NO: 289980 - DNA, 15 bp, Homo sapiens
gaaatttctaagcca

SEQ ID NO: 289981 - DNA, 15 bp, Homo sapiens
ggaaatttctaagcc

SEQ ID NO: 289982 - DNA, 15 bp, Homo sapiens
aggaaatttctaagc

SEQ ID NO: 289983 - DNA, 15 bp, Homo sapiens
aaggaaatttctaag

SEQ ID NO: 289984 - DNA, 15 bp, Homo sapiens
aaaggaaatttctaa

SEQ ID NO: 289985 - DNA, 15 bp, Homo sapiens
aaaaggaaatttcta

SEQ ID NO: 289986 - DNA, 15 bp, Homo sapiens
taaaaggaaatttct

SEQ ID NO: 289987 - DNA, 15 bp, Homo sapiens
gtaaaaggaaatttc

SEQ ID NO: 289988 - DNA, 15 bp, Homo sapiens
tgtaaaaggaaattt

SEQ ID NO: 289989 - DNA, 15 bp, Homo sapiens
atgtaaaaggaaatt

SEQ ID NO: 289990 - DNA, 15 bp, Homo sapiens
catgtaaaaggaaat

SEQ ID NO: 289991 - DNA, 15 bp, Homo sapiens
acatgtaaaaggaaa

SEQ ID NO: 289992 - DNA, 15 bp, Homo sapiens
tacatgtaaaaggaa

SEQ ID NO: 289993 - DNA, 15 bp, Homo sapiens
ttacatgtaaaagga

SEQ ID NO: 289994 - DNA, 15 bp, Homo sapiens
cttacatgtaaaagg

SEQ ID NO: 289995 - DNA, 15 bp, Homo sapiens
gcttacatgtaaaag

SEQ ID NO: 289996 - DNA, 15 bp, Homo sapiens
tgcttacatgtaaaa

SEQ ID NO: 289997 - DNA, 15 bp, Homo sapiens
atgcttacatgtaaa

SEQ ID NO: 289998 - DNA, 15 bp, Homo sapiens
tatgcttacatgtaa

SEQ ID NO: 289999 - DNA, 15 bp, Homo sapiens
atatgcttacatgta

SEQ ID NO: 290000 - DNA, 15 bp, Homo sapiens
tatatgcttacatgt

SEQ ID NO: 290001 - DNA, 15 bp, Homo sapiens
ttatatgcttacatg

SEQ ID NO: 290002 - DNA, 15 bp, Homo sapiens
tttatatgcttacat

SEQ ID NO: 290003 - DNA, 15 bp, Homo sapiens
atttatatgcttaca

SEQ ID NO: 290004 - DNA, 15 bp, Homo sapiens
gatttatatgcttac

SEQ ID NO: 290005 - DNA, 15 bp, Homo sapiens
ggatttatatgctta

SEQ ID NO: 290006 - DNA, 15 bp, Homo sapiens
aggatttatatgctt

SEQ ID NO: 290007 - DNA, 15 bp, Homo sapiens
gaggatttatatgct

SEQ ID NO: 290008 - DNA, 15 bp, Homo sapiens
tgaggatttatatgc

SEQ ID NO: 290009 - DNA, 15 bp, Homo sapiens
atgaggatttatatg

SEQ ID NO: 290010 - DNA, 15 bp, Homo sapiens
aatgaggatttatat

SEQ ID NO: 290011 - DNA, 15 bp, Homo sapiens
caatgaggatttata

SEQ ID NO: 290012 - DNA, 15 bp, Homo sapiens
ccaatgaggatttat

SEQ ID NO: 290013 - DNA, 15 bp, Homo sapiens
gccaatgaggattta

SEQ ID NO: 290014 - DNA, 15 bp, Homo sapiens
tgccaatgaggattt

SEQ ID NO: 290015 - DNA, 15 bp, Homo sapiens
gtgccaatgaggatt

SEQ ID NO: 290016 - DNA, 15 bp, Homo sapiens
tgtgccaatgaggat

SEQ ID NO: 290017 - DNA, 15 bp, Homo sapiens
gtgtgccaatgagga

SEQ ID NO: 290018 - DNA, 15 bp, Homo sapiens
tgtgtgccaatgagg

SEQ ID NO: 290019 - DNA, 15 bp, Homo sapiens
ttgtgtgccaatgag

SEQ ID NO: 290020 - DNA, 15 bp, Homo sapiens
tttgtgtgccaatga

SEQ ID NO: 290021 - DNA, 15 bp, Homo sapiens
ttttgtgtgccaatg

SEQ ID NO: 290022 - DNA, 15 bp, Homo sapiens
tttttgtgtgccaat

SEQ ID NO: 290023 - DNA, 15 bp, Homo sapiens
atttttgtgtgccaa

SEQ ID NO: 290024 - DNA, 15 bp, Homo sapiens
catttttgtgtgcca

SEQ ID NO: 290025 - DNA, 15 bp, Homo sapiens
acatttttgtgtgcc

SEQ ID NO: 290026 - DNA, 15 bp, Homo sapiens
cacatttttgtgtgc

SEQ ID NO: 290027 - DNA, 15 bp, Homo sapiens
acacatttttgtgtg

SEQ ID NO: 290028 - DNA, 15 bp, Homo sapiens
aacacatttttgtgt

SEQ ID NO: 290029 - DNA, 15 bp, Homo sapiens
aaacacatttttgtg

SEQ ID NO: 290030 - DNA, 15 bp, Homo sapiens
caaacacatttttgt

SEQ ID NO: 290031 - DNA, 15 bp, Homo sapiens
gcaaacacatttttg

SEQ ID NO: 290032 - DNA, 15 bp, Homo sapiens
ggcaaacacattttt

SEQ ID NO: 290033 - DNA, 15 bp, Homo sapiens
gggcaaacacatttt

SEQ ID NO: 290034 - DNA, 15 bp, Homo sapiens
tgggcaaacacattt

SEQ ID NO: 290035 - DNA, 15 bp, Homo sapiens
ctgggcaaacacatt

SEQ ID NO: 290036 - DNA, 15 bp, Homo sapiens
gctgggcaaacacat

SEQ ID NO: 290037 - DNA, 15 bp, Homo sapiens
agctgggcaaacaca

SEQ ID NO: 290038 - DNA, 15 bp, Homo sapiens
aagctgggcaaacac

SEQ ID NO: 290039 - DNA, 15 bp, Homo sapiens
taagctgggcaaaca

SEQ ID NO: 290040 - DNA, 15 bp, Homo sapiens
gtaagctgggcaaac

SEQ ID NO: 290041 - DNA, 15 bp, Homo sapiens
tgtaagctgggcaaa

SEQ ID NO: 290042 - DNA, 15 bp, Homo sapiens
ttgtaagctgggcaa

SEQ ID NO: 290043 - DNA, 15 bp, Homo sapiens
attgtaagctgggca

SEQ ID NO: 290044 - DNA, 15 bp, Homo sapiens
cattgtaagctgggc

SEQ ID NO: 290045 - DNA, 15 bp, Homo sapiens
ccattgtaagctggg

SEQ ID NO: 290046 - DNA, 15 bp, Homo sapiens
tccattgtaagctgg

SEQ ID NO: 290047 - DNA, 15 bp, Homo sapiens
ttccattgtaagctg

SEQ ID NO: 290048 - DNA, 15 bp, Homo sapiens
attccattgtaagct

SEQ ID NO: 290049 - DNA, 15 bp, Homo sapiens
aattccattgtaagc

SEQ ID NO: 290050 - DNA, 15 bp, Homo sapiens
aaattccattgtaag

SEQ ID NO: 290051 - DNA, 15 bp, Homo sapiens
gaaattccattgtaa

SEQ ID NO: 290052 - DNA, 15 bp, Homo sapiens
ggaaattccattgta

SEQ ID NO: 290053 - DNA, 15 bp, Homo sapiens
gggaaattccattgt

SEQ ID NO: 290054 - DNA, 15 bp, Homo sapiens
tgggaaattccattg

SEQ ID NO: 290055 - DNA, 15 bp, Homo sapiens
ctgggaaattccatt

SEQ ID NO: 290056 - DNA, 15 bp, Homo sapiens
actgggaaattccat

SEQ ID NO: 290057 - DNA, 15 bp, Homo sapiens
gactgggaaattcca

SEQ ID NO: 290058 - DNA, 15 bp, Homo sapiens
agactgggaaattcc

SEQ ID NO: 290059 - DNA, 15 bp, Homo sapiens
aagactgggaaattc

SEQ ID NO: 290060 - DNA, 15 bp, Homo sapiens
gaagactgggaaatt

SEQ ID NO: 290061 - DNA, 15 bp, Homo sapiens
agaagactgggaaat

SEQ ID NO: 290062 - DNA, 15 bp, Homo sapiens
aagaagactgggaaa

SEQ ID NO: 290063 - DNA, 15 bp, Homo sapiens
aaagaagactgggaa

SEQ ID NO: 290064 - DNA, 15 bp, Homo sapiens
taaagaagactggga

SEQ ID NO: 290065 - DNA, 15 bp, Homo sapiens
ttaaagaagactggg

SEQ ID NO: 290066 - DNA, 15 bp, Homo sapiens
gttaaagaagactgg

SEQ ID NO: 290067 - DNA, 15 bp, Homo sapiens
tgttaaagaagactg

SEQ ID NO: 290068 - DNA, 15 bp, Homo sapiens
ttgttaaagaagact

SEQ ID NO: 290069 - DNA, 15 bp, Homo sapiens
attgttaaagaagac

SEQ ID NO: 290070 - DNA, 15 bp, Homo sapiens
cattgttaaagaaga

SEQ ID NO: 290071 - DNA, 15 bp, Homo sapiens
tcattgttaaagaag

SEQ ID NO: 290072 - DNA, 15 bp, Homo sapiens
ttcattgttaaagaa

SEQ ID NO: 290073 - DNA, 15 bp, Homo sapiens
cttcattgttaaaga

SEQ ID NO: 290074 - DNA, 15 bp, Homo sapiens
acttcattgttaaag

SEQ ID NO: 290075 - DNA, 15 bp, Homo sapiens
gacttcattgttaaa

SEQ ID NO: 290076 - DNA, 15 bp, Homo sapiens
ggacttcattgttaa

SEQ ID NO: 290077 - DNA, 15 bp, Homo sapiens
cggacttcattgtta

SEQ ID NO: 290078 - DNA, 15 bp, Homo sapiens
gcggacttcattgtt

SEQ ID NO: 290079 - DNA, 15 bp, Homo sapiens
ggcggacttcattgt

SEQ ID NO: 290080 - DNA, 15 bp, Homo sapiens
aggcggacttcattg

SEQ ID NO: 290081 - DNA, 15 bp, Homo sapiens
gaggcggacttcatt

SEQ ID NO: 290082 - DNA, 15 bp, Homo sapiens
tgaggcggacttcat

SEQ ID NO: 290083 - DNA, 15 bp, Homo sapiens
ctgaggcggacttca

SEQ ID NO: 290084 - DNA, 15 bp, Homo sapiens
gctgaggcggacttc

SEQ ID NO: 290085 - DNA, 15 bp, Homo sapiens
agctgaggcggactt

SEQ ID NO: 290086 - DNA, 15 bp, Homo sapiens
gagctgaggcggact

SEQ ID NO: 290087 - DNA, 15 bp, Homo sapiens
agagctgaggcggac

SEQ ID NO: 290088 - DNA, 15 bp, Homo sapiens
cagagctgaggcgga

SEQ ID NO: 290089 - DNA, 15 bp, Homo sapiens
tcagagctgaggcgg

SEQ ID NO: 290090 - DNA, 15 bp, Homo sapiens
ttcagagctgaggcg

SEQ ID NO: 290091 - DNA, 15 bp, Homo sapiens
gttcagagctgaggc

SEQ ID NO: 290092 - DNA, 15 bp, Homo sapiens
agttcagagctgagg

SEQ ID NO: 290093 - DNA, 15 bp, Homo sapiens
cagttcagagctgag

SEQ ID NO: 290094 - DNA, 15 bp, Homo sapiens
acagttcagagctga

SEQ ID NO: 290095 - DNA, 15 bp, Homo sapiens
aacagttcagagctg

SEQ ID NO: 290096 - DNA, 15 bp, Homo sapiens
aaacagttcagagct

SEQ ID NO: 290097 - DNA, 15 bp, Homo sapiens
caaacagttcagagc

SEQ ID NO: 290098 - DNA, 15 bp, Homo sapiens
tcaaacagttcagag

SEQ ID NO: 290099 - DNA, 15 bp, Homo sapiens
ctcaaacagttcaga

SEQ ID NO: 290100 - DNA, 15 bp, Homo sapiens
tctcaaacagttcag

SEQ ID NO: 290101 - DNA, 15 bp, Homo sapiens
ctctcaaacagttca

SEQ ID NO: 290102 - DNA, 15 bp, Homo sapiens
tctctcaaacagttc

SEQ ID NO: 290103 - DNA, 15 bp, Homo sapiens
ttctctcaaacagtt

SEQ ID NO: 290104 - DNA, 15 bp, Homo sapiens
tttctctcaaacagt

SEQ ID NO: 290105 - DNA, 15 bp, Homo sapiens
ttttctctcaaacag

SEQ ID NO: 290106 - DNA, 15 bp, Homo sapiens
attttctctcaaaca

SEQ ID NO: 290107 - DNA, 15 bp, Homo sapiens
tattttctctcaaac

SEQ ID NO: 290108 - DNA, 15 bp, Homo sapiens
atattttctctcaaa

SEQ ID NO: 290109 - DNA, 15 bp, Homo sapiens
gatattttctctcaa

SEQ ID NO: 290110 - DNA, 15 bp, Homo sapiens
ggatattttctctca

SEQ ID NO: 290111 - DNA, 15 bp, Homo sapiens
aggatattttctctc

SEQ ID NO: 290112 - DNA, 15 bp, Homo sapiens
taggatattttctct

SEQ ID NO: 290113 - DNA, 15 bp, Homo sapiens
ataggatattttctc

SEQ ID NO: 290114 - DNA, 15 bp, Homo sapiens
cataggatattttct

SEQ ID NO: 290115 - DNA, 15 bp, Homo sapiens
tcataggatattttc

SEQ ID NO: 290116 - DNA, 15 bp, Homo sapiens
gtcataggatatttt

SEQ ID NO: 290117 - DNA, 15 bp, Homo sapiens
tgtcataggatattt

SEQ ID NO: 290118 - DNA, 15 bp, Homo sapiens
atgtcataggatatt

SEQ ID NO: 290119 - DNA, 15 bp, Homo sapiens
tatgtcataggatat

SEQ ID NO: 290120 - DNA, 15 bp, Homo sapiens
atatgtcataggata

SEQ ID NO: 290121 - DNA, 15 bp, Homo sapiens
tatatgtcataggat

SEQ ID NO: 290122 - DNA, 15 bp, Homo sapiens
atatatgtcatagga

SEQ ID NO: 290123 - DNA, 15 bp, Homo sapiens
gatatatgtcatagg

SEQ ID NO: 290124 - DNA, 15 bp, Homo sapiens
agatatatgtcatag

SEQ ID NO: 290125 - DNA, 15 bp, Homo sapiens
aagatatatgtcata

SEQ ID NO: 290126 - DNA, 15 bp, Homo sapiens
gaagatatatgtcat

SEQ ID NO: 290127 - DNA, 15 bp, Homo sapiens
ggaagatatatgtca

SEQ ID NO: 290128 - DNA, 15 bp, Homo sapiens
aggaagatatatgtc

SEQ ID NO: 290129 - DNA, 15 bp, Homo sapiens
taggaagatatatgt

SEQ ID NO: 290130 - DNA, 15 bp, Homo sapiens
ttaggaagatatatg

SEQ ID NO: 290131 - DNA, 15 bp, Homo sapiens
tttaggaagatatat

SEQ ID NO: 290132 - DNA, 15 bp, Homo sapiens
atttaggaagatata

SEQ ID NO: 290133 - DNA, 15 bp, Homo sapiens
aatttaggaagatat

SEQ ID NO: 290134 - DNA, 15 bp, Homo sapiens
taatttaggaagata

SEQ ID NO: 290135 - DNA, 15 bp, Homo sapiens
ataatttaggaagat

SEQ ID NO: 290136 - DNA, 15 bp, Homo sapiens
tataatttaggaaga

SEQ ID NO: 290137 - DNA, 15 bp, Homo sapiens
gtataatttaggaag

SEQ ID NO: 290138 - DNA, 15 bp, Homo sapiens
tgtataatttaggaa

SEQ ID NO: 290139 - DNA, 15 bp, Homo sapiens
atgtataatttagga

SEQ ID NO: 290140 - DNA, 15 bp, Homo sapiens
catgtataatttagg

SEQ ID NO: 290141 - DNA, 15 bp, Homo sapiens
ccatgtataatttag

SEQ ID NO: 290142 - DNA, 15 bp, Homo sapiens
cccatgtataattta

SEQ ID NO: 290143 - DNA, 15 bp, Homo sapiens
tcccatgtataattt

SEQ ID NO: 290144 - DNA, 15 bp, Homo sapiens
ttcccatgtataatt

SEQ ID NO: 290145 - DNA, 15 bp, Homo sapiens
cttcccatgtataat

SEQ ID NO: 290146 - DNA, 15 bp, Homo sapiens
gcttcccatgtataa

SEQ ID NO: 290147 - DNA, 15 bp, Homo sapiens
tgcttcccatgtata

SEQ ID NO: 290148 - DNA, 15 bp, Homo sapiens
atgcttcccatgtat

SEQ ID NO: 290149 - DNA, 15 bp, Homo sapiens
gatgcttcccatgta

SEQ ID NO: 290150 - DNA, 15 bp, Homo sapiens
agatgcttcccatgt

SEQ ID NO: 290151 - DNA, 15 bp, Homo sapiens
cagatgcttcccatg

SEQ ID NO: 290152 - DNA, 15 bp, Homo sapiens
acagatgcttcccat

SEQ ID NO: 290153 - DNA, 15 bp, Homo sapiens
tacagatgcttccca

SEQ ID NO: 290154 - DNA, 15 bp, Homo sapiens
atacagatgcttccc

SEQ ID NO: 290155 - DNA, 15 bp, Homo sapiens
aatacagatgcttcc

SEQ ID NO: 290156 - DNA, 15 bp, Homo sapiens
taatacagatgcttc

SEQ ID NO: 290157 - DNA, 15 bp, Homo sapiens
ttaatacagatgctt

SEQ ID NO: 290158 - DNA, 15 bp, Homo sapiens
cttaatacagatgct

SEQ ID NO: 290159 - DNA, 15 bp, Homo sapiens
ccttaatacagatgc

SEQ ID NO: 290160 - DNA, 15 bp, Homo sapiens
tccttaatacagatg

SEQ ID NO: 290161 - DNA, 15 bp, Homo sapiens
ttccttaatacagat

SEQ ID NO: 290162 - DNA, 15 bp, Homo sapiens
gttccttaatacaga

SEQ ID NO: 290163 - DNA, 15 bp, Homo sapiens
tgttccttaatacag

SEQ ID NO: 290164 - DNA, 15 bp, Homo sapiens
ctgttccttaataca

SEQ ID NO: 290165 - DNA, 15 bp, Homo sapiens
gctgttccttaatac

SEQ ID NO: 290166 - DNA, 15 bp, Homo sapiens
tgctgttccttaata

SEQ ID NO: 290167 - DNA, 15 bp, Homo sapiens
ttgctgttccttaat

SEQ ID NO: 290168 - DNA, 15 bp, Homo sapiens
cttgctgttccttaa

SEQ ID NO: 290169 - DNA, 15 bp, Homo sapiens
tcttgctgttcctta

SEQ ID NO: 290170 - DNA, 15 bp, Homo sapiens
ctcttgctgttcctt

SEQ ID NO: 290171 - DNA, 15 bp, Homo sapiens
tctcttgctgttcct

SEQ ID NO: 290172 - DNA, 15 bp, Homo sapiens
gtctcttgctgttcc

SEQ ID NO: 290173 - DNA, 15 bp, Homo sapiens
ggtctcttgctgttc

SEQ ID NO: 290174 - DNA, 15 bp, Homo sapiens
aggtctcttgctgtt

SEQ ID NO: 290175 - DNA, 15 bp, Homo sapiens
caggtctcttgctgt

SEQ ID NO: 290176 - DNA, 15 bp, Homo sapiens
tcaggtctcttgctg

SEQ ID NO: 290177 - DNA, 15 bp, Homo sapiens
ttcaggtctcttgct

SEQ ID NO: 290178 - DNA, 15 bp, Homo sapiens
tttcaggtctcttgc

SEQ ID NO: 290179 - DNA, 15 bp, Homo sapiens
atttcaggtctcttg

SEQ ID NO: 290180 - DNA, 15 bp, Homo sapiens
gatttcaggtctctt

SEQ ID NO: 290181 - DNA, 15 bp, Homo sapiens
cgatttcaggtctct

SEQ ID NO: 290182 - DNA, 15 bp, Homo sapiens
ccgatttcaggtctc

SEQ ID NO: 290183 - DNA, 15 bp, Homo sapiens
gccgatttcaggtct

SEQ ID NO: 290184 - DNA, 15 bp, Homo sapiens
tgccgatttcaggtc

SEQ ID NO: 290185 - DNA, 15 bp, Homo sapiens
atgccgatttcaggt

SEQ ID NO: 290186 - DNA, 15 bp, Homo sapiens
aatgccgatttcagg

SEQ ID NO: 290187 - DNA, 15 bp, Homo sapiens
gaatgccgatttcag

SEQ ID NO: 290188 - DNA, 15 bp, Homo sapiens
agaatgccgatttca

SEQ ID NO: 290189 - DNA, 15 bp, Homo sapiens
tagaatgccgatttc

SEQ ID NO: 290190 - DNA, 15 bp, Homo sapiens
ttagaatgccgattt

SEQ ID NO: 290191 - DNA, 15 bp, Homo sapiens
tttagaatgccgatt

SEQ ID NO: 290192 - DNA, 15 bp, Homo sapiens
ctttagaatgccgat

SEQ ID NO: 290193 - DNA, 15 bp, Homo sapiens
gctttagaatgccga

SEQ ID NO: 290194 - DNA, 15 bp, Homo sapiens
agctttagaatgccg

SEQ ID NO: 290195 - DNA, 15 bp, Homo sapiens
aagctttagaatgcc

SEQ ID NO: 290196 - DNA, 15 bp, Homo sapiens
aaagctttagaatgc

SEQ ID NO: 290197 - DNA, 15 bp, Homo sapiens
gaaagctttagaatg

SEQ ID NO: 290198 - DNA, 15 bp, Homo sapiens
agaaagctttagaat

SEQ ID NO: 290199 - DNA, 15 bp, Homo sapiens
aagaaagctttagaa

SEQ ID NO: 290200 - DNA, 15 bp, Homo sapiens
gaagaaagctttaga

SEQ ID NO: 290201 - DNA, 15 bp, Homo sapiens
ggaagaaagctttag

SEQ ID NO: 290202 - DNA, 15 bp, Homo sapiens
tggaagaaagcttta

SEQ ID NO: 290203 - DNA, 15 bp, Homo sapiens
ctggaagaaagcttt

SEQ ID NO: 290204 - DNA, 15 bp, Homo sapiens
actggaagaaagctt

SEQ ID NO: 290205 - DNA, 15 bp, Homo sapiens
cactggaagaaagct

SEQ ID NO: 290206 - DNA, 15 bp, Homo sapiens
tcactggaagaaagc

SEQ ID NO: 290207 - DNA, 15 bp, Homo sapiens
ctcactggaagaaag

SEQ ID NO: 290208 - DNA, 15 bp, Homo sapiens
tctcactggaagaaa

SEQ ID NO: 290209 - DNA, 15 bp, Homo sapiens
gtctcactggaagaa

SEQ ID NO: 290210 - DNA, 15 bp, Homo sapiens
tgtctcactggaaga

SEQ ID NO: 290211 - DNA, 15 bp, Homo sapiens
ttgtctcactggaag

SEQ ID NO: 290212 - DNA, 15 bp, Homo sapiens
cttgtctcactggaa

SEQ ID NO: 290213 - DNA, 15 bp, Homo sapiens
tcttgtctcactgga

SEQ ID NO: 290214 - DNA, 15 bp, Homo sapiens
ttcttgtctcactgg

SEQ ID NO: 290215 - DNA, 15 bp, Homo sapiens
attcttgtctcactg

SEQ ID NO: 290216 - DNA, 15 bp, Homo sapiens
cattcttgtctcact

SEQ ID NO: 290217 - DNA, 15 bp, Homo sapiens
gcattcttgtctcac

SEQ ID NO: 290218 - DNA, 15 bp, Homo sapiens
agcattcttgtctca

SEQ ID NO: 290219 - DNA, 15 bp, Homo sapiens
cagcattcttgtctc

SEQ ID NO: 290220 - DNA, 15 bp, Homo sapiens
tcagcattcttgtct

SEQ ID NO: 290221 - DNA, 15 bp, Homo sapiens
gtcagcattcttgtc

SEQ ID NO: 290222 - DNA, 15 bp, Homo sapiens
agtcagcattcttgt

SEQ ID NO: 290223 - DNA, 15 bp, Homo sapiens
gagtcagcattcttg

SEQ ID NO: 290224 - DNA, 15 bp, Homo sapiens
ggagtcagcattctt

SEQ ID NO: 290225 - DNA, 15 bp, Homo sapiens
tggagtcagcattct

SEQ ID NO: 290226 - DNA, 15 bp, Homo sapiens
ttggagtcagcattc

SEQ ID NO: 290227 - DNA, 15 bp, Homo sapiens
cttggagtcagcatt

SEQ ID NO: 290228 - DNA, 15 bp, Homo sapiens
tcttggagtcagcat

SEQ ID NO: 290229 - DNA, 15 bp, Homo sapiens
ttcttggagtcagca

SEQ ID NO: 290230 - DNA, 15 bp, Homo sapiens
attcttggagtcagc

SEQ ID NO: 290231 - DNA, 15 bp, Homo sapiens
gattcttggagtcag

SEQ ID NO: 290232 - DNA, 15 bp, Homo sapiens
tgattcttggagtca

SEQ ID NO: 290233 - DNA, 15 bp, Homo sapiens
atgattcttggagtc

SEQ ID NO: 290234 - DNA, 15 bp, Homo sapiens
aatgattcttggagt

SEQ ID NO: 290235 - DNA, 15 bp, Homo sapiens
taatgattcttggag

SEQ ID NO: 290236 - DNA, 15 bp, Homo sapiens
ataatgattcttgga

SEQ ID NO: 290237 - DNA, 15 bp, Homo sapiens
aataatgattcttgg

SEQ ID NO: 290238 - DNA, 15 bp, Homo sapiens
aaataatgattcttg

SEQ ID NO: 290239 - DNA, 15 bp, Homo sapiens
aaaataatgattctt

SEQ ID NO: 290240 - DNA, 15 bp, Homo sapiens
gaaaataatgattct

SEQ ID NO: 290241 - DNA, 15 bp, Homo sapiens
agaaaataatgattc

SEQ ID NO: 290242 - DNA, 15 bp, Homo sapiens
tagaaaataatgatt

SEQ ID NO: 290243 - DNA, 15 bp, Homo sapiens
atagaaaataatgat

SEQ ID NO: 290244 - DNA, 15 bp, Homo sapiens
aatagaaaataatga

SEQ ID NO: 290245 - DNA, 15 bp, Homo sapiens
gaatagaaaataatg

SEQ ID NO: 290246 - DNA, 15 bp, Homo sapiens
agaatagaaaataat

SEQ ID NO: 290247 - DNA, 15 bp, Homo sapiens
gagaatagaaaataa

SEQ ID NO: 290248 - DNA, 15 bp, Homo sapiens
tgagaatagaaaata

SEQ ID NO: 290249 - DNA, 15 bp, Homo sapiens
ttgagaatagaaaat

SEQ ID NO: 290250 - DNA, 15 bp, Homo sapiens
cttgagaatagaaaa

SEQ ID NO: 290251 - DNA, 15 bp, Homo sapiens
tcttgagaatagaaa

SEQ ID NO: 290252 - DNA, 15 bp, Homo sapiens
ttcttgagaatagaa

SEQ ID NO: 290253 - DNA, 15 bp, Homo sapiens
tttcttgagaataga

SEQ ID NO: 290254 - DNA, 15 bp, Homo sapiens
atttcttgagaatag

SEQ ID NO: 290255 - DNA, 15 bp, Homo sapiens
aatttcttgagaata

SEQ ID NO: 290256 - DNA, 15 bp, Homo sapiens
caatttcttgagaat

SEQ ID NO: 290257 - DNA, 15 bp, Homo sapiens
tcaatttcttgagaa

SEQ ID NO: 290258 - DNA, 15 bp, Homo sapiens
ctcaatttcttgaga

SEQ ID NO: 290259 - DNA, 15 bp, Homo sapiens
actcaatttcttgag

SEQ ID NO: 290260 - DNA, 15 bp, Homo sapiens
aactcaatttcttga

SEQ ID NO: 290261 - DNA, 15 bp, Homo sapiens
taactcaatttcttg

SEQ ID NO: 290262 - DNA, 15 bp, Homo sapiens
ttaactcaatttctt

SEQ ID NO: 290263 - DNA, 15 bp, Homo sapiens
tttaactcaatttct

SEQ ID NO: 290264 - DNA, 15 bp, Homo sapiens
ctttaactcaatttc

SEQ ID NO: 290265 - DNA, 15 bp, Homo sapiens
tctttaactcaattt

SEQ ID NO: 290266 - DNA, 15 bp, Homo sapiens
atctttaactcaatt

SEQ ID NO: 290267 - DNA, 15 bp, Homo sapiens
catctttaactcaat

SEQ ID NO: 290268 - DNA, 15 bp, Homo sapiens
ccatctttaactcaa

SEQ ID NO: 290269 - DNA, 15 bp, Homo sapiens
accatctttaactca

SEQ ID NO: 290270 - DNA, 15 bp, Homo sapiens
aaccatctttaactc

SEQ ID NO: 290271 - DNA, 15 bp, Homo sapiens
taaccatctttaact

SEQ ID NO: 290272 - DNA, 15 bp, Homo sapiens
ataaccatctttaac

SEQ ID NO: 290273 - DNA, 15 bp, Homo sapiens
aataaccatctttaa

SEQ ID NO: 290274 - DNA, 15 bp, Homo sapiens
taataaccatcttta

SEQ ID NO: 290275 - DNA, 15 bp, Homo sapiens
ttaataaccatcttt

SEQ ID NO: 290276 - DNA, 15 bp, Homo sapiens
attaataaccatctt

SEQ ID NO: 290277 - DNA, 15 bp, Homo sapiens
aattaataaccatct

SEQ ID NO: 290278 - DNA, 15 bp, Homo sapiens
aaattaataaccatc

SEQ ID NO: 290279 - DNA, 15 bp, Homo sapiens
caaattaataaccat

SEQ ID NO: 290280 - DNA, 15 bp, Homo sapiens
gcaaattaataacca

SEQ ID NO: 290281 - DNA, 15 bp, Homo sapiens
agcaaattaataacc

SEQ ID NO: 290282 - DNA, 15 bp, Homo sapiens
tagcaaattaataac

SEQ ID NO: 290283 - DNA, 15 bp, Homo sapiens
gtagcaaattaataa

SEQ ID NO: 290284 - DNA, 15 bp, Homo sapiens
agtagcaaattaata

SEQ ID NO: 290285 - DNA, 15 bp, Homo sapiens
tagtagcaaattaat

SEQ ID NO: 290286 - DNA, 15 bp, Homo sapiens
atagtagcaaattaa

SEQ ID NO: 290287 - DNA, 15 bp, Homo sapiens
aatagtagcaaatta

SEQ ID NO: 290288 - DNA, 15 bp, Homo sapiens
taatagtagcaaatt

SEQ ID NO: 290289 - DNA, 15 bp, Homo sapiens
ataatagtagcaaat

SEQ ID NO: 290290 - DNA, 15 bp, Homo sapiens
aataatagtagcaaa

SEQ ID NO: 290291 - DNA, 15 bp, Homo sapiens
aaataatagtagcaa

SEQ ID NO: 290292 - DNA, 15 bp, Homo sapiens
gaaataatagtagca

SEQ ID NO: 290293 - DNA, 15 bp, Homo sapiens
ggaaataatagtagc

SEQ ID NO: 290294 - DNA, 15 bp, Homo sapiens
aggaaataatagtag

SEQ ID NO: 290295 - DNA, 15 bp, Homo sapiens
taggaaataatagta

SEQ ID NO: 290296 - DNA, 15 bp, Homo sapiens
ttaggaaataatagt

SEQ ID NO: 290297 - DNA, 15 bp, Homo sapiens
gttaggaaataatag

SEQ ID NO: 290298 - DNA, 15 bp, Homo sapiens
tgttaggaaataata

SEQ ID NO: 290299 - DNA, 15 bp, Homo sapiens
gtgttaggaaataat

SEQ ID NO: 290300 - DNA, 15 bp, Homo sapiens
agtgttaggaaataa

SEQ ID NO: 290301 - DNA, 15 bp, Homo sapiens
cagtgttaggaaata

SEQ ID NO: 290302 - DNA, 15 bp, Homo sapiens
ccagtgttaggaaat

SEQ ID NO: 290303 - DNA, 15 bp, Homo sapiens
tccagtgttaggaaa

SEQ ID NO: 290304 - DNA, 15 bp, Homo sapiens
gtccagtgttaggaa

SEQ ID NO: 290305 - DNA, 15 bp, Homo sapiens
ggtccagtgttagga

SEQ ID NO: 290306 - DNA, 15 bp, Homo sapiens
tggtccagtgttagg

SEQ ID NO: 290307 - DNA, 15 bp, Homo sapiens
atggtccagtgttag

SEQ ID NO: 290308 - DNA, 15 bp, Homo sapiens
catggtccagtgtta

SEQ ID NO: 290309 - DNA, 15 bp, Homo sapiens
acatggtccagtgtt

SEQ ID NO: 290310 - DNA, 15 bp, Homo sapiens
aacatggtccagtgt

SEQ ID NO: 290311 - DNA, 15 bp, Homo sapiens
aaacatggtccagtg

SEQ ID NO: 290312 - DNA, 15 bp, Homo sapiens
aaaacatggtccagt

SEQ ID NO: 290313 - DNA, 15 bp, Homo sapiens
taaaacatggtccag

SEQ ID NO: 290314 - DNA, 15 bp, Homo sapiens
ataaaacatggtcca

SEQ ID NO: 290315 - DNA, 15 bp, Homo sapiens
cataaaacatggtcc

SEQ ID NO: 290316 - DNA, 15 bp, Homo sapiens
ccataaaacatggtc

SEQ ID NO: 290317 - DNA, 15 bp, Homo sapiens
cccataaaacatggt

SEQ ID NO: 290318 - DNA, 15 bp, Homo sapiens
tcccataaaacatgg

SEQ ID NO: 290319 - DNA, 15 bp, Homo sapiens
ctcccataaaacatg

SEQ ID NO: 290320 - DNA, 15 bp, Homo sapiens
actcccataaaacat

SEQ ID NO: 290321 - DNA, 15 bp, Homo sapiens
aactcccataaaaca

SEQ ID NO: 290322 - DNA, 15 bp, Homo sapiens
caactcccataaaac

SEQ ID NO: 290323 - DNA, 15 bp, Homo sapiens
gcaactcccataaaa

SEQ ID NO: 290324 - DNA, 15 bp, Homo sapiens
agcaactcccataaa

SEQ ID NO: 290325 - DNA, 15 bp, Homo sapiens
aagcaactcccataa

SEQ ID NO: 290326 - DNA, 15 bp, Homo sapiens
caagcaactcccata

SEQ ID NO: 290327 - DNA, 15 bp, Homo sapiens
gcaagcaactcccat

SEQ ID NO: 290328 - DNA, 15 bp, Homo sapiens
tgcaagcaactccca

SEQ ID NO: 290329 - DNA, 15 bp, Homo sapiens
ttgcaagcaactccc

SEQ ID NO: 290330 - DNA, 15 bp, Homo sapiens
cttgcaagcaactcc

SEQ ID NO: 290331 - DNA, 15 bp, Homo sapiens
gcttgcaagcaactc

SEQ ID NO: 290332 - DNA, 15 bp, Homo sapiens
agcttgcaagcaact

SEQ ID NO: 290333 - DNA, 15 bp, Homo sapiens
aagcttgcaagcaac

SEQ ID NO: 290334 - DNA, 15 bp, Homo sapiens
aaagcttgcaagcaa

SEQ ID NO: 290335 - DNA, 15 bp, Homo sapiens
gaaagcttgcaagca

SEQ ID NO: 290336 - DNA, 15 bp, Homo sapiens
agaaagcttgcaagc

SEQ ID NO: 290337 - DNA, 15 bp, Homo sapiens
cagaaagcttgcaag

SEQ ID NO: 290338 - DNA, 15 bp, Homo sapiens
ccagaaagcttgcaa

SEQ ID NO: 290339 - DNA, 15 bp, Homo sapiens
tccagaaagcttgca

SEQ ID NO: 290340 - DNA, 15 bp, Homo sapiens
atccagaaagcttgc

SEQ ID NO: 290341 - DNA, 15 bp, Homo sapiens
catccagaaagcttg

SEQ ID NO: 290342 - DNA, 15 bp, Homo sapiens
tcatccagaaagctt

SEQ ID NO: 290343 - DNA, 15 bp, Homo sapiens
atcatccagaaagct

SEQ ID NO: 290344 - DNA, 15 bp, Homo sapiens
tatcatccagaaagc

SEQ ID NO: 290345 - DNA, 15 bp, Homo sapiens
ttatcatccagaaag

SEQ ID NO: 290346 - DNA, 15 bp, Homo sapiens
cttatcatccagaaa

SEQ ID NO: 290347 - DNA, 15 bp, Homo sapiens
tcttatcatccagaa

SEQ ID NO: 290348 - DNA, 15 bp, Homo sapiens
ttcttatcatccaga

SEQ ID NO: 290349 - DNA, 15 bp, Homo sapiens
tttcttatcatccag

SEQ ID NO: 290350 - DNA, 15 bp, Homo sapiens
atttcttatcatcca

SEQ ID NO: 290351 - DNA, 15 bp, Homo sapiens
tatttcttatcatcc

SEQ ID NO: 290352 - DNA, 15 bp, Homo sapiens
gtatttcttatcatc

SEQ ID NO: 290353 - DNA, 15 bp, Homo sapiens
tgtatttcttatcat

SEQ ID NO: 290354 - DNA, 15 bp, Homo sapiens
ttgtatttcttatca

SEQ ID NO: 290355 - DNA, 15 bp, Homo sapiens
attgtatttcttatc

SEQ ID NO: 290356 - DNA, 15 bp, Homo sapiens
aattgtatttcttat

SEQ ID NO: 290357 - DNA, 15 bp, Homo sapiens
aaattgtatttctta

SEQ ID NO: 290358 - DNA, 15 bp, Homo sapiens
taaattgtatttctt

SEQ ID NO: 290359 - DNA, 15 bp, Homo sapiens
gtaaattgtatttct

SEQ ID NO: 290360 - DNA, 15 bp, Homo sapiens
tgtaaattgtatttc

SEQ ID NO: 290361 - DNA, 15 bp, Homo sapiens
atgtaaattgtattt

SEQ ID NO: 290362 - DNA, 15 bp, Homo sapiens
aatgtaaattgtatt

SEQ ID NO: 290363 - DNA, 15 bp, Homo sapiens
taatgtaaattgtat

SEQ ID NO: 290364 - DNA, 15 bp, Homo sapiens
ttaatgtaaattgta

SEQ ID NO: 290365 - DNA, 15 bp, Homo sapiens
cttaatgtaaattgt

SEQ ID NO: 290366 - DNA, 15 bp, Homo sapiens
tcttaatgtaaattg

SEQ ID NO: 290367 - DNA, 15 bp, Homo sapiens
atcttaatgtaaatt

SEQ ID NO: 290368 - DNA, 15 bp, Homo sapiens
catcttaatgtaaat

SEQ ID NO: 290369 - DNA, 15 bp, Homo sapiens
tcatcttaatgtaaa

SEQ ID NO: 290370 - DNA, 15 bp, Homo sapiens
ttcatcttaatgtaa

SEQ ID NO: 290371 - DNA, 15 bp, Homo sapiens
attcatcttaatgta

SEQ ID NO: 290372 - DNA, 15 bp, Homo sapiens
tattcatcttaatgt

SEQ ID NO: 290373 - DNA, 15 bp, Homo sapiens
gtattcatcttaatg

SEQ ID NO: 290374 - DNA, 15 bp, Homo sapiens
tgtattcatcttaat

SEQ ID NO: 290375 - DNA, 15 bp, Homo sapiens
atgtattcatcttaa

SEQ ID NO: 290376 - DNA, 15 bp, Homo sapiens
catgtattcatctta

SEQ ID NO: 290377 - DNA, 15 bp, Homo sapiens
gcatgtattcatctt

SEQ ID NO: 290378 - DNA, 15 bp, Homo sapiens
tgcatgtattcatct

SEQ ID NO: 290379 - DNA, 15 bp, Homo sapiens
atgcatgtattcatc

SEQ ID NO: 290380 - DNA, 15 bp, Homo sapiens
catgcatgtattcat

SEQ ID NO: 290381 - DNA, 15 bp, Homo sapiens
acatgcatgtattca

SEQ ID NO: 290382 - DNA, 15 bp, Homo sapiens
tacatgcatgtattc

SEQ ID NO: 290383 - DNA, 15 bp, Homo sapiens
atacatgcatgtatt

SEQ ID NO: 290384 - DNA, 15 bp, Homo sapiens
catacatgcatgtat

SEQ ID NO: 290385 - DNA, 15 bp, Homo sapiens
ccatacatgcatgta

SEQ ID NO: 290386 - DNA, 15 bp, Homo sapiens
tccatacatgcatgt

SEQ ID NO: 290387 - DNA, 15 bp, Homo sapiens
ctccatacatgcatg

SEQ ID NO: 290388 - DNA, 15 bp, Homo sapiens
tctccatacatgcat

SEQ ID NO: 290389 - DNA, 15 bp, Homo sapiens
ttctccatacatgca

SEQ ID NO: 290390 - DNA, 15 bp, Homo sapiens
attctccatacatgc

SEQ ID NO: 290391 - DNA, 15 bp, Homo sapiens
tattctccatacatg

SEQ ID NO: 290392 - DNA, 15 bp, Homo sapiens
gtattctccatacat

SEQ ID NO: 290393 - DNA, 15 bp, Homo sapiens
tgtattctccataca

SEQ ID NO: 290394 - DNA, 15 bp, Homo sapiens
ttgtattctccatac

SEQ ID NO: 290395 - DNA, 15 bp, Homo sapiens
tttgtattctccata

SEQ ID NO: 290396 - DNA, 15 bp, Homo sapiens
ttttgtattctccat

SEQ ID NO: 290397 - DNA, 15 bp, Homo sapiens
attttgtattctcca

SEQ ID NO: 290398 - DNA, 15 bp, Homo sapiens
tattttgtattctcc

SEQ ID NO: 290399 - DNA, 15 bp, Homo sapiens
ttattttgtattctc

SEQ ID NO: 290400 - DNA, 15 bp, Homo sapiens
attattttgtattct

SEQ ID NO: 290401 - DNA, 15 bp, Homo sapiens
tattattttgtattc

SEQ ID NO: 290402 - DNA, 15 bp, Homo sapiens
gtattattttgtatt

SEQ ID NO: 290403 - DNA, 15 bp, Homo sapiens
agtattattttgtat

SEQ ID NO: 290404 - DNA, 15 bp, Homo sapiens
aagtattattttgta

SEQ ID NO: 290405 - DNA, 15 bp, Homo sapiens
caagtattattttgt

SEQ ID NO: 290406 - DNA, 15 bp, Homo sapiens
gcaagtattattttg

SEQ ID NO: 290407 - DNA, 15 bp, Homo sapiens
ggcaagtattatttt

SEQ ID NO: 290408 - DNA, 15 bp, Homo sapiens
aggcaagtattattt

SEQ ID NO: 290409 - DNA, 15 bp, Homo sapiens
aaggcaagtattatt

SEQ ID NO: 290410 - DNA, 15 bp, Homo sapiens
aaaggcaagtattat

SEQ ID NO: 290411 - DNA, 15 bp, Homo sapiens
taaaggcaagtatta

SEQ ID NO: 290412 - DNA, 15 bp, Homo sapiens
ataaaggcaagtatt

SEQ ID NO: 290413 - DNA, 15 bp, Homo sapiens
tataaaggcaagtat

SEQ ID NO: 290414 - DNA, 15 bp, Homo sapiens
ctataaaggcaagta

SEQ ID NO: 290415 - DNA, 15 bp, Homo sapiens
tctataaaggcaagt

SEQ ID NO: 290416 - DNA, 15 bp, Homo sapiens
ctctataaaggcaag

SEQ ID NO: 290417 - DNA, 15 bp, Homo sapiens
tctctataaaggcaa

SEQ ID NO: 290418 - DNA, 15 bp, Homo sapiens
ttctctataaaggca

SEQ ID NO: 290419 - DNA, 15 bp, Homo sapiens
tttctctataaaggc

SEQ ID NO: 290420 - DNA, 15 bp, Homo sapiens
atttctctataaagg

SEQ ID NO: 290421 - DNA, 15 bp, Homo sapiens
catttctctataaag

SEQ ID NO: 290422 - DNA, 15 bp, Homo sapiens
gcatttctctataaa

SEQ ID NO: 290423 - DNA, 15 bp, Homo sapiens
ggcatttctctataa

SEQ ID NO: 290424 - DNA, 15 bp, Homo sapiens
tggcatttctctata

SEQ ID NO: 290425 - DNA, 15 bp, Homo sapiens
ctggcatttctctat

SEQ ID NO: 290426 - DNA, 15 bp, Homo sapiens
gctggcatttctcta

SEQ ID NO: 290427 - DNA, 15 bp, Homo sapiens
agctggcatttctct

SEQ ID NO: 290428 - DNA, 15 bp, Homo sapiens
gagctggcatttctc

SEQ ID NO: 290429 - DNA, 15 bp, Homo sapiens
agagctggcatttct

SEQ ID NO: 290430 - DNA, 15 bp, Homo sapiens
aagagctggcatttc

SEQ ID NO: 290431 - DNA, 15 bp, Homo sapiens
taagagctggcattt

SEQ ID NO: 290432 - DNA, 15 bp, Homo sapiens
ataagagctggcatt

SEQ ID NO: 290433 - DNA, 15 bp, Homo sapiens
aataagagctggcat

SEQ ID NO: 290434 - DNA, 15 bp, Homo sapiens
aaataagagctggca

SEQ ID NO: 290435 - DNA, 15 bp, Homo sapiens
aaaataagagctggc

SEQ ID NO: 290436 - DNA, 15 bp, Homo sapiens
gaaaataagagctgg

SEQ ID NO: 290437 - DNA, 15 bp, Homo sapiens
agaaaataagagctg

SEQ ID NO: 290438 - DNA, 15 bp, Homo sapiens
tagaaaataagagct

SEQ ID NO: 290439 - DNA, 15 bp, Homo sapiens
atagaaaataagagc

SEQ ID NO: 290440 - DNA, 15 bp, Homo sapiens
aatagaaaataagag

SEQ ID NO: 290441 - DNA, 15 bp, Homo sapiens
aaatagaaaataaga

SEQ ID NO: 290442 - DNA, 15 bp, Homo sapiens
aaaatagaaaataag

SEQ ID NO: 290443 - DNA, 15 bp, Homo sapiens
gaaaatagaaaataa

SEQ ID NO: 290444 - DNA, 15 bp, Homo sapiens
ggaaaatagaaaata

SEQ ID NO: 290445 - DNA, 15 bp, Homo sapiens
gggaaaatagaaaat

SEQ ID NO: 290446 - DNA, 15 bp, Homo sapiens
agggaaaatagaaaa

SEQ ID NO: 290447 - DNA, 15 bp, Homo sapiens
aagggaaaatagaaa

SEQ ID NO: 290448 - DNA, 15 bp, Homo sapiens
aaagggaaaatagaa

SEQ ID NO: 290449 - DNA, 15 bp, Homo sapiens
gaaagggaaaataga

SEQ ID NO: 290450 - DNA, 15 bp, Homo sapiens
agaaagggaaaatag

SEQ ID NO: 290451 - DNA, 15 bp, Homo sapiens
aagaaagggaaaata

SEQ ID NO: 290452 - DNA, 15 bp, Homo sapiens
gaagaaagggaaaat

SEQ ID NO: 290453 - DNA, 15 bp, Homo sapiens
ggaagaaagggaaaa

SEQ ID NO: 290454 - DNA, 15 bp, Homo sapiens
aggaagaaagggaaa

SEQ ID NO: 290455 - DNA, 15 bp, Homo sapiens
gaggaagaaagggaa

SEQ ID NO: 290456 - DNA, 15 bp, Homo sapiens
ggaggaagaaaggga

SEQ ID NO: 290457 - DNA, 15 bp, Homo sapiens
gggaggaagaaaggg

SEQ ID NO: 290458 - DNA, 15 bp, Homo sapiens
agggaggaagaaagg

SEQ ID NO: 290459 - DNA, 15 bp, Homo sapiens
gagggaggaagaaag

SEQ ID NO: 290460 - DNA, 15 bp, Homo sapiens
ggagggaggaagaaa

SEQ ID NO: 290461 - DNA, 15 bp, Homo sapiens
gggagggaggaagaa

SEQ ID NO: 290462 - DNA, 15 bp, Homo sapiens
agggagggaggaaga

SEQ ID NO: 290463 - DNA, 15 bp, Homo sapiens
aagggagggaggaag

SEQ ID NO: 290464 - DNA, 15 bp, Homo sapiens
aaagggagggaggaa

SEQ ID NO: 290465 - DNA, 15 bp, Homo sapiens
gaaagggagggagga

SEQ ID NO: 290466 - DNA, 15 bp, Homo sapiens
agaaagggagggagg

SEQ ID NO: 290467 - DNA, 15 bp, Homo sapiens
aagaaagggagggag

SEQ ID NO: 290468 - DNA, 15 bp, Homo sapiens
gaagaaagggaggga

SEQ ID NO: 290469 - DNA, 15 bp, Homo sapiens
ggaagaaagggaggg

SEQ ID NO: 290470 - DNA, 15 bp, Homo sapiens
aggaagaaagggagg

SEQ ID NO: 290471 - DNA, 15 bp, Homo sapiens
aaggaagaaagggag

SEQ ID NO: 290472 - DNA, 15 bp, Homo sapiens
gaaggaagaaaggga

SEQ ID NO: 290473 - DNA, 15 bp, Homo sapiens
agaaggaagaaaggg

SEQ ID NO: 290474 - DNA, 15 bp, Homo sapiens
cagaaggaagaaagg

SEQ ID NO: 290475 - DNA, 15 bp, Homo sapiens
acagaaggaagaaag

SEQ ID NO: 290476 - DNA, 15 bp, Homo sapiens
aacagaaggaagaaa

SEQ ID NO: 290477 - DNA, 15 bp, Homo sapiens
aaacagaaggaagaa

SEQ ID NO: 290478 - DNA, 15 bp, Homo sapiens
aaaacagaaggaaga

SEQ ID NO: 290479 - DNA, 15 bp, Homo sapiens
aaaaacagaaggaag

SEQ ID NO: 290480 - DNA, 15 bp, Homo sapiens
gaaaaacagaaggaa

SEQ ID NO: 290481 - DNA, 15 bp, Homo sapiens
agaaaaacagaagga

SEQ ID NO: 290482 - DNA, 15 bp, Homo sapiens
aagaaaaacagaagg

SEQ ID NO: 290483 - DNA, 15 bp, Homo sapiens
aaagaaaaacagaag

SEQ ID NO: 290484 - DNA, 15 bp, Homo sapiens
gaaagaaaaacagaa

SEQ ID NO: 290485 - DNA, 15 bp, Homo sapiens
agaaagaaaaacaga

SEQ ID NO: 290486 - DNA, 15 bp, Homo sapiens
aagaaagaaaaacag

SEQ ID NO: 290487 - DNA, 15 bp, Homo sapiens
taagaaagaaaaaca

SEQ ID NO: 290488 - DNA, 15 bp, Homo sapiens
ttaagaaagaaaaac

SEQ ID NO: 290489 - DNA, 15 bp, Homo sapiens
attaagaaagaaaaa

SEQ ID NO: 290490 - DNA, 15 bp, Homo sapiens
cattaagaaagaaaa

SEQ ID NO: 290491 - DNA, 15 bp, Homo sapiens
gcattaagaaagaaa

SEQ ID NO: 290492 - DNA, 15 bp, Homo sapiens
agcattaagaaagaa

SEQ ID NO: 290493 - DNA, 15 bp, Homo sapiens
cagcattaagaaaga

SEQ ID NO: 290494 - DNA, 15 bp, Homo sapiens
ccagcattaagaaag

SEQ ID NO: 290495 - DNA, 15 bp, Homo sapiens
accagcattaagaaa

SEQ ID NO: 290496 - DNA, 15 bp, Homo sapiens
gaccagcattaagaa

SEQ ID NO: 290497 - DNA, 15 bp, Homo sapiens
tgaccagcattaaga

SEQ ID NO: 290498 - DNA, 15 bp, Homo sapiens
ctgaccagcattaag

SEQ ID NO: 290499 - DNA, 15 bp, Homo sapiens
cctgaccagcattaa

SEQ ID NO: 290500 - DNA, 15 bp, Homo sapiens
tcctgaccagcatta

SEQ ID NO: 290501 - DNA, 15 bp, Homo sapiens
gtcctgaccagcatt

SEQ ID NO: 290502 - DNA, 15 bp, Homo sapiens
ggtcctgaccagcat

SEQ ID NO: 290503 - DNA, 15 bp, Homo sapiens
aggtcctgaccagca

SEQ ID NO: 290504 - DNA, 15 bp, Homo sapiens
taggtcctgaccagc

SEQ ID NO: 290505 - DNA, 15 bp, Homo sapiens
gtaggtcctgaccag

SEQ ID NO: 290506 - DNA, 15 bp, Homo sapiens
agtaggtcctgacca

SEQ ID NO: 290507 - DNA, 15 bp, Homo sapiens
tagtaggtcctgacc

SEQ ID NO: 290508 - DNA, 15 bp, Homo sapiens
ttagtaggtcctgac

SEQ ID NO: 290509 - DNA, 15 bp, Homo sapiens
tttagtaggtcctga

SEQ ID NO: 290510 - DNA, 15 bp, Homo sapiens
atttagtaggtcctg

SEQ ID NO: 290511 - DNA, 15 bp, Homo sapiens
aatttagtaggtcct

SEQ ID NO: 290512 - DNA, 15 bp, Homo sapiens
caatttagtaggtcc

SEQ ID NO: 290513 - DNA, 15 bp, Homo sapiens
tcaatttagtaggtc

SEQ ID NO: 290514 - DNA, 15 bp, Homo sapiens
atcaatttagtaggt

SEQ ID NO: 290515 - DNA, 15 bp, Homo sapiens
aatcaatttagtagg

SEQ ID NO: 290516 - DNA, 15 bp, Homo sapiens
gaatcaatttagtag

SEQ ID NO: 290517 - DNA, 15 bp, Homo sapiens
agaatcaatttagta

SEQ ID NO: 290518 - DNA, 15 bp, Homo sapiens
tagaatcaatttagt

SEQ ID NO: 290519 - DNA, 15 bp, Homo sapiens
atagaatcaatttag

SEQ ID NO: 290520 - DNA, 15 bp, Homo sapiens
tatagaatcaattta

SEQ ID NO: 290521 - DNA, 15 bp, Homo sapiens
ttatagaatcaattt

SEQ ID NO: 290522 - DNA, 15 bp, Homo sapiens
gttatagaatcaatt

SEQ ID NO: 290523 - DNA, 15 bp, Homo sapiens
agttatagaatcaat

SEQ ID NO: 290524 - DNA, 15 bp, Homo sapiens
gagttatagaatcaa

SEQ ID NO: 290525 - DNA, 15 bp, Homo sapiens
tgagttatagaatca

SEQ ID NO: 290526 - DNA, 15 bp, Homo sapiens
atgagttatagaatc

SEQ ID NO: 290527 - DNA, 15 bp, Homo sapiens
gatgagttatagaat

SEQ ID NO: 290528 - DNA, 15 bp, Homo sapiens
cgatgagttatagaa

SEQ ID NO: 290529 - DNA, 15 bp, Homo sapiens
ccgatgagttataga

SEQ ID NO: 290530 - DNA, 15 bp, Homo sapiens
accgatgagttatag

SEQ ID NO: 290531 - DNA, 15 bp, Homo sapiens
caccgatgagttata

SEQ ID NO: 290532 - DNA, 15 bp, Homo sapiens
ccaccgatgagttat

SEQ ID NO: 290533 - DNA, 15 bp, Homo sapiens
cccaccgatgagtta

SEQ ID NO: 290534 - DNA, 15 bp, Homo sapiens
acccaccgatgagtt

SEQ ID NO: 290535 - DNA, 15 bp, Homo sapiens
aacccaccgatgagt

SEQ ID NO: 290536 - DNA, 15 bp, Homo sapiens
taacccaccgatgag

SEQ ID NO: 290537 - DNA, 15 bp, Homo sapiens
ataacccaccgatga

SEQ ID NO: 290538 - DNA, 15 bp, Homo sapiens
aataacccaccgatg

SEQ ID NO: 290539 - DNA, 15 bp, Homo sapiens
caataacccaccgat

SEQ ID NO: 290540 - DNA, 15 bp, Homo sapiens
gcaataacccaccga

SEQ ID NO: 290541 - DNA, 15 bp, Homo sapiens
tgcaataacccaccg

SEQ ID NO: 290542 - DNA, 15 bp, Homo sapiens
atgcaataacccacc

SEQ ID NO: 290543 - DNA, 15 bp, Homo sapiens
aatgcaataacccac

SEQ ID NO: 290544 - DNA, 15 bp, Homo sapiens
gaatgcaataaccca

SEQ ID NO: 290545 - DNA, 15 bp, Homo sapiens
tgaatgcaataaccc

SEQ ID NO: 290546 - DNA, 15 bp, Homo sapiens
ctgaatgcaataacc

SEQ ID NO: 290547 - DNA, 15 bp, Homo sapiens
actgaatgcaataac

SEQ ID NO: 290548 - DNA, 15 bp, Homo sapiens
aactgaatgcaataa

SEQ ID NO: 290549 - DNA, 15 bp, Homo sapiens
aaactgaatgcaata

SEQ ID NO: 290550 - DNA, 15 bp, Homo sapiens
caaaactgaatgcaa

SEQ ID NO: 290551 - DNA, 15 bp, Homo sapiens
tcaaaactgaatgca

SEQ ID NO: 290552 - DNA, 15 bp, Homo sapiens
ttcaaaactgaatgc

SEQ ID NO: 290553 - DNA, 15 bp, Homo sapiens
tttcaaaactgaatg

SEQ ID NO: 290554 - DNA, 15 bp, Homo sapiens
ttttcaaaactgaat

SEQ ID NO: 290555 - DNA, 15 bp, Homo sapiens
tttttcaaaactgaa

SEQ ID NO: 290556 - DNA, 15 bp, Homo sapiens
gtttttcaaaactga

SEQ ID NO: 290557 - DNA, 15 bp, Homo sapiens
tgtttttcaaaactg

SEQ ID NO: 290558 - DNA, 15 bp, Homo sapiens
gtgtttttcaaaact

SEQ ID NO: 290559 - DNA, 15 bp, Homo sapiens
agtgtttttcaaaac

SEQ ID NO: 290560 - DNA, 15 bp, Homo sapiens
cagtgtttttcaaaa

SEQ ID NO: 290561 - DNA, 15 bp, Homo sapiens
acagtgtttttcaaa

SEQ ID NO: 290562 - DNA, 15 bp, Homo sapiens
aacagtgtttttcaa

SEQ ID NO: 290563 - DNA, 15 bp, Homo sapiens
gaacagtgtttttca

SEQ ID NO: 290564 - DNA, 15 bp, Homo sapiens
agaacagtgtttttc

SEQ ID NO: 290565 - DNA, 15 bp, Homo sapiens
aagaacagtgttttt

SEQ ID NO: 290566 - DNA, 15 bp, Homo sapiens
aaagaacagtgtttt

SEQ ID NO: 290567 - DNA, 15 bp, Homo sapiens
caaagaacagtgttt

SEQ ID NO: 290568 - DNA, 15 bp, Homo sapiens
tcaaagaacagtgtt

SEQ ID NO: 290569 - DNA, 15 bp, Homo sapiens
ctcaaagaacagtgt

SEQ ID NO: 290570 - DNA, 15 bp, Homo sapiens
tctcaaagaacagtg

SEQ ID NO: 290571 - DNA, 15 bp, Homo sapiens
atctcaaagaacagt

SEQ ID NO: 290572 - DNA, 15 bp, Homo sapiens
tatctcaaagaacag

SEQ ID NO: 290573 - DNA, 15 bp, Homo sapiens
atatctcaaagaaca

SEQ ID NO: 290574 - DNA, 15 bp, Homo sapiens
tatatctcaaagaac

SEQ ID NO: 290575 - DNA, 15 bp, Homo sapiens
ttatatctcaaagaa

SEQ ID NO: 290576 - DNA, 15 bp, Homo sapiens
tttatatctcaaaga

SEQ ID NO: 290577 - DNA, 15 bp, Homo sapiens
ttttatatctcaaag

SEQ ID NO: 290578 - DNA, 15 bp, Homo sapiens
cttttatatctcaaa

SEQ ID NO: 290579 - DNA, 15 bp, Homo sapiens
tcttttatatctcaa

SEQ ID NO: 290580 - DNA, 15 bp, Homo sapiens
ttcttttatatctca

SEQ ID NO: 290581 - DNA, 15 bp, Homo sapiens
cttcttttatatctc

SEQ ID NO: 290582 - DNA, 15 bp, Homo sapiens
gcttcttttatatct

SEQ ID NO: 290583 - DNA, 15 bp, Homo sapiens
tgcttcttttatatc

SEQ ID NO: 290584 - DNA, 15 bp, Homo sapiens
atgcttcttttatat

SEQ ID NO: 290585 - DNA, 15 bp, Homo sapiens
gatgcttcttttata

SEQ ID NO: 290586 - DNA, 15 bp, Homo sapiens
tgatgcttcttttat

SEQ ID NO: 290587 - DNA, 15 bp, Homo sapiens
ttgatgcttctttta

SEQ ID NO: 290588 - DNA, 15 bp, Homo sapiens
attgatgcttctttt

SEQ ID NO: 290589 - DNA, 15 bp, Homo sapiens
tattgatgcttcttt

SEQ ID NO: 290590 - DNA, 15 bp, Homo sapiens
gtattgatgcttctt

SEQ ID NO: 290591 - DNA, 15 bp, Homo sapiens
tgtattgatgcttct

SEQ ID NO: 290592 - DNA, 15 bp, Homo sapiens
ctgtattgatgcttc

SEQ ID NO: 290593 - DNA, 15 bp, Homo sapiens
actgtattgatgctt

SEQ ID NO: 290594 - DNA, 15 bp, Homo sapiens
aactgtattgatgct

SEQ ID NO: 290595 - DNA, 15 bp, Homo sapiens
aaactgtattgatgc

SEQ ID NO: 290596 - DNA, 15 bp, Homo sapiens
gaaactgtattgatg

SEQ ID NO: 290597 - DNA, 15 bp, Homo sapiens
agaaactgtattgat

SEQ ID NO: 290598 - DNA, 15 bp, Homo sapiens
cagaaactgtattga

SEQ ID NO: 290599 - DNA, 15 bp, Homo sapiens
gcagaaactgtattg

SEQ ID NO: 290600 - DNA, 15 bp, Homo sapiens
ggcagaaactgtatt

SEQ ID NO: 290601 - DNA, 15 bp, Homo sapiens
aggcagaaactgtat

SEQ ID NO: 290602 - DNA, 15 bp, Homo sapiens
aaggcagaaactgta

SEQ ID NO: 290603 - DNA, 15 bp, Homo sapiens
aaaggcagaaactgt

SEQ ID NO: 290604 - DNA, 15 bp, Homo sapiens
gaaaggcagaaactg

SEQ ID NO: 290605 - DNA, 15 bp, Homo sapiens
agaaaggcagaaact

SEQ ID NO: 290606 - DNA, 15 bp, Homo sapiens
cagaaaggcagaaac

SEQ ID NO: 290607 - DNA, 15 bp, Homo sapiens
ccagaaaggcagaaa

SEQ ID NO: 290608 - DNA, 15 bp, Homo sapiens
accagaaaggcagaa

SEQ ID NO: 290609 - DNA, 15 bp, Homo sapiens
caccagaaaggcaga

SEQ ID NO: 290610 - DNA, 15 bp, Homo sapiens
gcaccagaaaggcag

SEQ ID NO: 290611 - DNA, 15 bp, Homo sapiens
ggcaccagaaaggca

SEQ ID NO: 290612 - DNA, 15 bp, Homo sapiens
aggcaccagaaaggc

SEQ ID NO: 290613 - DNA, 15 bp, Homo sapiens
caggcaccagaaagg

SEQ ID NO: 290614 - DNA, 15 bp, Homo sapiens
gcaggcaccagaaag

SEQ ID NO: 290615 - DNA, 15 bp, Homo sapiens
ggcaggcaccagaaa

SEQ ID NO: 290616 - DNA, 15 bp, Homo sapiens
tggcaggcaccagaa

SEQ ID NO: 290617 - DNA, 15 bp, Homo sapiens
atggcaggcaccaga

SEQ ID NO: 290618 - DNA, 15 bp, Homo sapiens
gatggcaggcaccag

SEQ ID NO: 290619 - DNA, 15 bp, Homo sapiens
agatggcaggcacca

SEQ ID NO: 290620 - DNA, 15 bp, Homo sapiens
aagatggcaggcacc

SEQ ID NO: 290621 - DNA, 15 bp, Homo sapiens
caagatggcaggcac

SEQ ID NO: 290622 - DNA, 15 bp, Homo sapiens
acaagatggcaggca

SEQ ID NO: 290623 - DNA, 15 bp, Homo sapiens
aacaagatggcaggc

SEQ ID NO: 290624 - DNA, 15 bp, Homo sapiens
taacaagatggcagg

SEQ ID NO: 290625 - DNA, 15 bp, Homo sapiens
ctaacaagatggcag

SEQ ID NO: 290626 - DNA, 15 bp, Homo sapiens
tctaacaagatggca

SEQ ID NO: 290627 - DNA, 15 bp, Homo sapiens
ctctaacaagatggc

SEQ ID NO: 290628 - DNA, 15 bp, Homo sapiens
tctctaacaagatgg

SEQ ID NO: 290629 - DNA, 15 bp, Homo sapiens
atctctaacaagatg

SEQ ID NO: 290630 - DNA, 15 bp, Homo sapiens
gatctctaacaagat

SEQ ID NO: 290631 - DNA, 15 bp, Homo sapiens
tgatctctaacaaga

SEQ ID NO: 290632 - DNA, 15 bp, Homo sapiens
gtgatctctaacaag

SEQ ID NO: 290633 - DNA, 15 bp, Homo sapiens
tgtgatctctaacaa

SEQ ID NO: 290634 - DNA, 15 bp, Homo sapiens
ctgtgatctctaaca

SEQ ID NO: 290635 - DNA, 15 bp, Homo sapiens
gctgtgatctctaac

SEQ ID NO: 290636 - DNA, 15 bp, Homo sapiens
tgctgtgatctctaa

SEQ ID NO: 290637 - DNA, 15 bp, Homo sapiens
ttgctgtgatctcta

SEQ ID NO: 290638 - DNA, 15 bp, Homo sapiens
cttgctgtgatctct

SEQ ID NO: 290639 - DNA, 15 bp, Homo sapiens
tcttgctgtgatctc

SEQ ID NO: 290640 - DNA, 15 bp, Homo sapiens
atcttgctgtgatct

SEQ ID NO: 290641 - DNA, 15 bp, Homo sapiens
tatcttgctgtgatc

SEQ ID NO: 290642 - DNA, 15 bp, Homo sapiens
gtatcttgctgtgat

SEQ ID NO: 290643 - DNA, 15 bp, Homo sapiens
agtatcttgctgtga

SEQ ID NO: 290644 - DNA, 15 bp, Homo sapiens
aagtatcttgctgtg

SEQ ID NO: 290645 - DNA, 15 bp, Homo sapiens
aaagtatcttgctgt

SEQ ID NO: 290646 - DNA, 15 bp, Homo sapiens
gaaagtatcttgctg

SEQ ID NO: 290647 - DNA, 15 bp, Homo sapiens
tgaaagtatcttgct

SEQ ID NO: 290648 - DNA, 15 bp, Homo sapiens
atgaaagtatcttgc

SEQ ID NO: 290649 - DNA, 15 bp, Homo sapiens
tatgaaagtatcttg

SEQ ID NO: 290650 - DNA, 15 bp, Homo sapiens
atatgaaagtatctt

SEQ ID NO: 290651 - DNA, 15 bp, Homo sapiens
catatgaaagtatct

SEQ ID NO: 290652 - DNA, 15 bp, Homo sapiens
acatatgaaagtatc

SEQ ID NO: 290653 - DNA, 15 bp, Homo sapiens
cacatatgaaagtat

SEQ ID NO: 290654 - DNA, 15 bp, Homo sapiens
tcacatatgaaagta

SEQ ID NO: 290655 - DNA, 15 bp, Homo sapiens
ttcacatatgaaagt

SEQ ID NO: 290656 - DNA, 15 bp, Homo sapiens
cttcacatatgaaag

SEQ ID NO: 290657 - DNA, 15 bp, Homo sapiens
tcttcacatatgaaa

SEQ ID NO: 290658 - DNA, 15 bp, Homo sapiens
gtcttcacatatgaa

SEQ ID NO: 290659 - DNA, 15 bp, Homo sapiens
tgtcttcacatatga

SEQ ID NO: 290660 - DNA, 15 bp, Homo sapiens
gtgtcttcacatatg

SEQ ID NO: 290661 - DNA, 15 bp, Homo sapiens
tgtgtcttcacatat

SEQ ID NO: 290662 - DNA, 15 bp, Homo sapiens
ctgtgtcttcacata

SEQ ID NO: 290663 - DNA, 15 bp, Homo sapiens
gctgtgtcttcacat

SEQ ID NO: 290664 - DNA, 15 bp, Homo sapiens
tgctgtgtcttcaca

SEQ ID NO: 290665 - DNA, 15 bp, Homo sapiens
gtgctgtgtcttcac

SEQ ID NO: 290666 - DNA, 15 bp, Homo sapiens
tgtgctgtgtcttca

SEQ ID NO: 290667 - DNA, 15 bp, Homo sapiens
gtgtgctgtgtcttc

SEQ ID NO: 290668 - DNA, 15 bp, Homo sapiens
agtgtgctgtgtctt

SEQ ID NO: 290669 - DNA, 15 bp, Homo sapiens
cagtgtgctgtgtct

SEQ ID NO: 290670 - DNA, 15 bp, Homo sapiens
acagtgtgctgtgtc

SEQ ID NO: 290671 - DNA, 15 bp, Homo sapiens
tacagtgtgctgtgt

SEQ ID NO: 290672 - DNA, 15 bp, Homo sapiens
ctacagtgtgctgtg

SEQ ID NO: 290673 - DNA, 15 bp, Homo sapiens
cctacagtgtgctgt

SEQ ID NO: 290674 - DNA, 15 bp, Homo sapiens
ccctacagtgtgctg

SEQ ID NO: 290675 - DNA, 15 bp, Homo sapiens
tccctacagtgtgct

SEQ ID NO: 290676 - DNA, 15 bp, Homo sapiens
ttccctacagtgtgc

SEQ ID NO: 290677 - DNA, 15 bp, Homo sapiens
attccctacagtgtg

SEQ ID NO: 290678 - DNA, 15 bp, Homo sapiens
aattccctacagtgt

SEQ ID NO: 290679 - DNA, 15 bp, Homo sapiens
taattccctacagtg

SEQ ID NO: 290680 - DNA, 15 bp, Homo sapiens
ttaattccctacagt

SEQ ID NO: 290681 - DNA, 15 bp, Homo sapiens
cttaattccctacag

SEQ ID NO: 290682 - DNA, 15 bp, Homo sapiens
acttaattccctaca

SEQ ID NO: 290683 - DNA, 15 bp, Homo sapiens
cacttaattccctac

SEQ ID NO: 290684 - DNA, 15 bp, Homo sapiens
gcacttaattcccta

SEQ ID NO: 290685 - DNA, 15 bp, Homo sapiens
agcacttaattccct

SEQ ID NO: 290686 - DNA, 15 bp, Homo sapiens
aagcacttaattccc

SEQ ID NO: 290687 - DNA, 15 bp, Homo sapiens
caagcacttaattcc

SEQ ID NO: 290688 - DNA, 15 bp, Homo sapiens
tcaagcacttaattc

SEQ ID NO: 290689 - DNA, 15 bp, Homo sapiens
atcaagcacttaatt

SEQ ID NO: 290690 - DNA, 15 bp, Homo sapiens
catcaagcacttaat

SEQ ID NO: 290691 - DNA, 15 bp, Homo sapiens
ccatcaagcacttaa

SEQ ID NO: 290692 - DNA, 15 bp, Homo sapiens
gccatcaagcactta

SEQ ID NO: 290693 - DNA, 15 bp, Homo sapiens
tgccatcaagcactt

SEQ ID NO: 290694 - DNA, 15 bp, Homo sapiens
gtgccatcaagcact

SEQ ID NO: 290695 - DNA, 15 bp, Homo sapiens
tgtgccatcaagcac

SEQ ID NO: 290696 - DNA, 15 bp, Homo sapiens
atgtgccatcaagca

SEQ ID NO: 290697 - DNA, 15 bp, Homo sapiens
tatgtgccatcaagc

SEQ ID NO: 290698 - DNA, 15 bp, Homo sapiens
ctatgtgccatcaag

SEQ ID NO: 290699 - DNA, 15 bp, Homo sapiens
actatgtgccatcaa

SEQ ID NO: 290700 - DNA, 15 bp, Homo sapiens
tactatgtgccatca

SEQ ID NO: 290701 - DNA, 15 bp, Homo sapiens
ctactatgtgccatc

SEQ ID NO: 290702 - DNA, 15 bp, Homo sapiens
actactatgtgccat

SEQ ID NO: 290703 - DNA, 15 bp, Homo sapiens
aactactatgtgcca

SEQ ID NO: 290704 - DNA, 15 bp, Homo sapiens
taactactatgtgcc

SEQ ID NO: 290705 - DNA, 15 bp, Homo sapiens
ctaactactatgtgc

SEQ ID NO: 290706 - DNA, 15 bp, Homo sapiens
cctaactactatgtg

SEQ ID NO: 290707 - DNA, 15 bp, Homo sapiens
tcctaactactatgt

SEQ ID NO: 290708 - DNA, 15 bp, Homo sapiens
ttcctaactactatg

SEQ ID NO: 290709 - DNA, 15 bp, Homo sapiens
attcctaactactat

SEQ ID NO: 290710 - DNA, 15 bp, Homo sapiens
tattcctaactacta

SEQ ID NO: 290711 - DNA, 15 bp, Homo sapiens
ctattcctaactact

SEQ ID NO: 290712 - DNA, 15 bp, Homo sapiens
cctattcctaactac

SEQ ID NO: 290713 - DNA, 15 bp, Homo sapiens
tcctattcctaacta

SEQ ID NO: 290714 - DNA, 15 bp, Homo sapiens
ctcctattcctaact

SEQ ID NO: 290715 - DNA, 15 bp, Homo sapiens
actcctattcctaac

SEQ ID NO: 290716 - DNA, 15 bp, Homo sapiens
cactcctattcctaa

SEQ ID NO: 290717 - DNA, 15 bp, Homo sapiens
tcactcctattccta

SEQ ID NO: 290718 - DNA, 15 bp, Homo sapiens
atcactcctattcct

SEQ ID NO: 290719 - DNA, 15 bp, Homo sapiens
catcactcctattcc

SEQ ID NO: 290720 - DNA, 15 bp, Homo sapiens
acatcactcctattc

SEQ ID NO: 290721 - DNA, 15 bp, Homo sapiens
gacatcactcctatt

SEQ ID NO: 290722 - DNA, 15 bp, Homo sapiens
agacatcactcctat

SEQ ID NO: 290723 - DNA, 15 bp, Homo sapiens
gagacatcactccta

SEQ ID NO: 290724 - DNA, 15 bp, Homo sapiens
tgagacatcactcct

SEQ ID NO: 290725 - DNA, 15 bp, Homo sapiens
ctgagacatcactcc

SEQ ID NO: 290726 - DNA, 15 bp, Homo sapiens
tctgagacatcactc

SEQ ID NO: 290727 - DNA, 15 bp, Homo sapiens
ttctgagacatcact

SEQ ID NO: 290728 - DNA, 15 bp, Homo sapiens
cttctgagacatcac

SEQ ID NO: 290729 - DNA, 15 bp, Homo sapiens
acttctgagacatca

SEQ ID NO: 290730 - DNA, 15 bp, Homo sapiens
tacttctgagacatc

SEQ ID NO: 290731 - DNA, 15 bp, Homo sapiens
ctacttctgagacat

SEQ ID NO: 290732 - DNA, 15 bp, Homo sapiens
actacttctgagaca

SEQ ID NO: 290733 - DNA, 15 bp, Homo sapiens
cactacttctgagac

SEQ ID NO: 290734 - DNA, 15 bp, Homo sapiens
tcactacttctgaga

SEQ ID NO: 290735 - DNA, 15 bp, Homo sapiens
atcactacttctgag

SEQ ID NO: 290736 - DNA, 15 bp, Homo sapiens
catcactacttctga

SEQ ID NO: 290737 - DNA, 15 bp, Homo sapiens
ccatcactacttctg

SEQ ID NO: 290738 - DNA, 15 bp, Homo sapiens
tccatcactacttct

SEQ ID NO: 290739 - DNA, 15 bp, Homo sapiens
tctccatcactactt

SEQ ID NO: 290740 - DNA, 15 bp, Homo sapiens
ctctccatcactact

SEQ ID NO: 290741 - DNA, 15 bp, Homo sapiens
tctctccatcactac

SEQ ID NO: 290742 - DNA, 15 bp, Homo sapiens
gtctctccatcacta

SEQ ID NO: 290743 - DNA, 15 bp, Homo sapiens
ggtctctccatcact

SEQ ID NO: 290744 - DNA, 15 bp, Homo sapiens
aggtctctccatcac

SEQ ID NO: 290745 - DNA, 15 bp, Homo sapiens
aaggtctctccatca

SEQ ID NO: 290746 - DNA, 15 bp, Homo sapiens
aaaggtctctccatc

SEQ ID NO: 290747 - DNA, 15 bp, Homo sapiens
caaaggtctctccat

SEQ ID NO: 290748 - DNA, 15 bp, Homo sapiens
gcaaaggtctctcca

SEQ ID NO: 290749 - DNA, 15 bp, Homo sapiens
tgcaaaggtctctcc

SEQ ID NO: 290750 - DNA, 15 bp, Homo sapiens
ctgcaaaggtctctc

SEQ ID NO: 290751 - DNA, 15 bp, Homo sapiens
gctgcaaaggtctct

SEQ ID NO: 290752 - DNA, 15 bp, Homo sapiens
tgctgcaaaggtctc

SEQ ID NO: 290753 - DNA, 15 bp, Homo sapiens
ctgctgcaaaggtct

SEQ ID NO: 290754 - DNA, 15 bp, Homo sapiens
cctgctgcaaaggtc

SEQ ID NO: 290755 - DNA, 15 bp, Homo sapiens
acctgctgcaaaggt

SEQ ID NO: 290756 - DNA, 15 bp, Homo sapiens
cacctgctgcaaagg

SEQ ID NO: 290757 - DNA, 15 bp, Homo sapiens
gcacctgctgcaaag

SEQ ID NO: 290758 - DNA, 15 bp, Homo sapiens
tgcacctgctgcaaa

SEQ ID NO: 290759 - DNA, 15 bp, Homo sapiens
ctgcacctgctgcaa

SEQ ID NO: 290760 - DNA, 15 bp, Homo sapiens
tctgcacctgctgca

SEQ ID NO: 290761 - DNA, 15 bp, Homo sapiens
ctctgcacctgctgc

SEQ ID NO: 290762 - DNA, 15 bp, Homo sapiens
tctctgcacctgctg

SEQ ID NO: 290763 - DNA, 15 bp, Homo sapiens
ctctctgcacctgct

SEQ ID NO: 290764 - DNA, 15 bp, Homo sapiens
gctctctgcacctgc

SEQ ID NO: 290765 - DNA, 15 bp, Homo sapiens
cgctctctgcacctg

SEQ ID NO: 290766 - DNA, 15 bp, Homo sapiens
acgctctctgcacct

SEQ ID NO: 290767 - DNA, 15 bp, Homo sapiens
tacgctctctgcacc

SEQ ID NO: 290768 - DNA, 15 bp, Homo sapiens
ctacgctctctgcac

SEQ ID NO: 290769 - DNA, 15 bp, Homo sapiens
tctacgctctctgca

SEQ ID NO: 290770 - DNA, 15 bp, Homo sapiens
ctctacgctctctgc

SEQ ID NO: 290771 - DNA, 15 bp, Homo sapiens
actctacgctctctg

SEQ ID NO: 290772 - DNA, 15 bp, Homo sapiens
gactctacgctctct

SEQ ID NO: 290773 - DNA, 15 bp, Homo sapiens
ggactctacgctctc

SEQ ID NO: 290774 - DNA, 15 bp, Homo sapiens
gggactctacgctct

SEQ ID NO: 290775 - DNA, 15 bp, Homo sapiens
tgggactctacgctc

SEQ ID NO: 290776 - DNA, 15 bp, Homo sapiens
ctgggactctacgct

SEQ ID NO: 290777 - DNA, 15 bp, Homo sapiens
gctgggactctacgc

SEQ ID NO: 290778 - DNA, 15 bp, Homo sapiens
tgctgggactctacg

SEQ ID NO: 290779 - DNA, 15 bp, Homo sapiens
gtgctgggactctac

SEQ ID NO: 290780 - DNA, 15 bp, Homo sapiens
tgtgctgggactcta

SEQ ID NO: 290781 - DNA, 15 bp, Homo sapiens
ctgtgctgggactct

SEQ ID NO: 290782 - DNA, 15 bp, Homo sapiens
cctgtgctgggactc

SEQ ID NO: 290783 - DNA, 15 bp, Homo sapiens
ccctgtgctgggact

SEQ ID NO: 290784 - DNA, 15 bp, Homo sapiens
cccctgtgctgggac

SEQ ID NO: 290785 - DNA, 15 bp, Homo sapiens
gcccctgtgctggga

SEQ ID NO: 290786 - DNA, 15 bp, Homo sapiens
ggcccctgtgctggg

SEQ ID NO: 290787 - DNA, 15 bp, Homo sapiens
tggcccctgtgctgg

SEQ ID NO: 290788 - DNA, 15 bp, Homo sapiens
ttggcccctgtgctg

SEQ ID NO: 290789 - DNA, 15 bp, Homo sapiens
cttggcccctgtgct

SEQ ID NO: 290790 - DNA, 15 bp, Homo sapiens
tcttggcccctgtgc

SEQ ID NO: 290791 - DNA, 15 bp, Homo sapiens
ctcttggcccctgtg

SEQ ID NO: 290792 - DNA, 15 bp, Homo sapiens
gctcttggcccctgt

SEQ ID NO: 290793 - DNA, 15 bp, Homo sapiens
agctcttggcccctg

SEQ ID NO: 290794 - DNA, 15 bp, Homo sapiens
gagctcttggcccct

SEQ ID NO: 290795 - DNA, 15 bp, Homo sapiens
ggagctcttggcccc

SEQ ID NO: 290796 - DNA, 15 bp, Homo sapiens
aggagctcttggccc

SEQ ID NO: 290797 - DNA, 15 bp, Homo sapiens
gaggagctcttggcc

SEQ ID NO: 290798 - DNA, 15 bp, Homo sapiens
agaggagctcttggc

SEQ ID NO: 290799 - DNA, 15 bp, Homo sapiens
gagaggagctcttgg

SEQ ID NO: 290800 - DNA, 15 bp, Homo sapiens
agagaggagctcttg

SEQ ID NO: 290801 - DNA, 15 bp, Homo sapiens
gagagaggagctctt

SEQ ID NO: 290802 - DNA, 15 bp, Homo sapiens
agagagaggagctct

SEQ ID NO: 290803 - DNA, 15 bp, Homo sapiens
aagagagaggagctc

SEQ ID NO: 290804 - DNA, 15 bp, Homo sapiens
caagagagaggagct

SEQ ID NO: 290805 - DNA, 15 bp, Homo sapiens
tcaagagagaggagc

SEQ ID NO: 290806 - DNA, 15 bp, Homo sapiens
ttcaagagagaggag

SEQ ID NO: 290807 - DNA, 15 bp, Homo sapiens
cttcaagagagagga

SEQ ID NO: 290808 - DNA, 15 bp, Homo sapiens
tcttcaagagagagg

SEQ ID NO: 290809 - DNA, 15 bp, Homo sapiens
ttcttcaagagagag

SEQ ID NO: 290810 - DNA, 15 bp, Homo sapiens
attcttcaagagaga

SEQ ID NO: 290811 - DNA, 15 bp, Homo sapiens
gattcttcaagagag

SEQ ID NO: 290812 - DNA, 15 bp, Homo sapiens
ggattcttcaagaga

SEQ ID NO: 290813 - DNA, 15 bp, Homo sapiens
gggattcttcaagag

SEQ ID NO: 290814 - DNA, 15 bp, Homo sapiens
agggattcttcaaga

SEQ ID NO: 290815 - DNA, 15 bp, Homo sapiens
cagggattcttcaag

SEQ ID NO: 290816 - DNA, 15 bp, Homo sapiens
tcagggattcttcaa

SEQ ID NO: 290817 - DNA, 15 bp, Homo sapiens
gtcagggattcttca

SEQ ID NO: 290818 - DNA, 15 bp, Homo sapiens
tgtcagggattcttc

SEQ ID NO: 290819 - DNA, 15 bp, Homo sapiens
atgtcagggattctt

SEQ ID NO: 290820 - DNA, 15 bp, Homo sapiens
gatgtcagggattct

SEQ ID NO: 290821 - DNA, 15 bp, Homo sapiens
tgatgtcagggattc

SEQ ID NO: 290822 - DNA, 15 bp, Homo sapiens
ttgatgtcagggatt

SEQ ID NO: 290823 - DNA, 15 bp, Homo sapiens
gttgatgtcagggat

SEQ ID NO: 290824 - DNA, 15 bp, Homo sapiens
tgttgatgtcaggga

SEQ ID NO: 290825 - DNA, 15 bp, Homo sapiens
atgttgatgtcaggg

SEQ ID NO: 290826 - DNA, 15 bp, Homo sapiens
catgttgatgtcagg

SEQ ID NO: 290827 - DNA, 15 bp, Homo sapiens
gcatgttgatgtcag

SEQ ID NO: 290828 - DNA, 15 bp, Homo sapiens
tgcatgttgatgtca

SEQ ID NO: 290829 - DNA, 15 bp, Homo sapiens
atgcatgttgatgtc

SEQ ID NO: 290830 - DNA, 15 bp, Homo sapiens
catgcatgttgatgt

SEQ ID NO: 290831 - DNA, 15 bp, Homo sapiens
acatgcatgttgatg

SEQ ID NO: 290832 - DNA, 15 bp, Homo sapiens
gacatgcatgttgat

SEQ ID NO: 290833 - DNA, 15 bp, Homo sapiens
tgacatgcatgttga

SEQ ID NO: 290834 - DNA, 15 bp, Homo sapiens
atgacatgcatgttg

SEQ ID NO: 290835 - DNA, 15 bp, Homo sapiens
gatgacatgcatgtt

SEQ ID NO: 290836 - DNA, 15 bp, Homo sapiens
agatgacatgcatgt

SEQ ID NO: 290837 - DNA, 15 bp, Homo sapiens
aagatgacatgcatg

SEQ ID NO: 290838 - DNA, 15 bp, Homo sapiens
aaagatgacatgcat

SEQ ID NO: 290839 - DNA, 15 bp, Homo sapiens
taaagatgacatgca

SEQ ID NO: 290840 - DNA, 15 bp, Homo sapiens
ctaaagatgacatgc

SEQ ID NO: 290841 - DNA, 15 bp, Homo sapiens
actaaagatgacatg

SEQ ID NO: 290842 - DNA, 15 bp, Homo sapiens
gactaaagatgacat

SEQ ID NO: 290843 - DNA, 15 bp, Homo sapiens
agactaaagatgaca

SEQ ID NO: 290844 - DNA, 15 bp, Homo sapiens
aagactaaagatgac

SEQ ID NO: 290845 - DNA, 15 bp, Homo sapiens
aaagactaaagatga

SEQ ID NO: 290846 - DNA, 15 bp, Homo sapiens
aaaagactaaagatg

SEQ ID NO: 290847 - DNA, 15 bp, Homo sapiens
aaaaagactaaagat

SEQ ID NO: 290848 - DNA, 15 bp, Homo sapiens
gaaaaagactaaaga

SEQ ID NO: 290849 - DNA, 15 bp, Homo sapiens
agaaaaagactaaag

SEQ ID NO: 290850 - DNA, 15 bp, Homo sapiens
gagaaaaagactaaa

SEQ ID NO: 290851 - DNA, 15 bp, Homo sapiens
agagaaaaagactaa

SEQ ID NO: 290852 - DNA, 15 bp, Homo sapiens
tagagaaaaagacta

SEQ ID NO: 290853 - DNA, 15 bp, Homo sapiens
ctagagaaaaagact

SEQ ID NO: 290854 - DNA, 15 bp, Homo sapiens
gctagagaaaaagac

SEQ ID NO: 290855 - DNA, 15 bp, Homo sapiens
ggctagagaaaaaga

SEQ ID NO: 290856 - DNA, 15 bp, Homo sapiens
aggctagagaaaaag

SEQ ID NO: 290857 - DNA, 15 bp, Homo sapiens
caggctagagaaaaa

SEQ ID NO: 290858 - DNA, 15 bp, Homo sapiens
acaggctagagaaaa

SEQ ID NO: 290859 - DNA, 15 bp, Homo sapiens
cacaggctagagaaa

SEQ ID NO: 290860 - DNA, 15 bp, Homo sapiens
gcacaggctagagaa

SEQ ID NO: 290861 - DNA, 15 bp, Homo sapiens
agcacaggctagaga

SEQ ID NO: 290862 - DNA, 15 bp, Homo sapiens
cagcacaggctagag

SEQ ID NO: 290863 - DNA, 15 bp, Homo sapiens
acagcacaggctaga

SEQ ID NO: 290864 - DNA, 15 bp, Homo sapiens
cacagcacaggctag

SEQ ID NO: 290865 - DNA, 15 bp, Homo sapiens
acacagcacaggcta

SEQ ID NO: 290866 - DNA, 15 bp, Homo sapiens
cacacagcacaggct

SEQ ID NO: 290867 - DNA, 15 bp, Homo sapiens
ccacacagcacaggc

SEQ ID NO: 290868 - DNA, 15 bp, Homo sapiens
tccacacagcacagg

SEQ ID NO: 290869 - DNA, 15 bp, Homo sapiens
ctccacacagcacag

SEQ ID NO: 290870 - DNA, 15 bp, Homo sapiens
gctccacacagcaca

SEQ ID NO: 290871 - DNA, 15 bp, Homo sapiens
agctccacacagcac

SEQ ID NO: 290872 - DNA, 15 bp, Homo sapiens
gagctccacacagca

SEQ ID NO: 290873 - DNA, 15 bp, Homo sapiens
ggagctccacacagc

SEQ ID NO: 290874 - DNA, 15 bp, Homo sapiens
aggagctccacacag

SEQ ID NO: 290875 - DNA, 15 bp, Homo sapiens
taggagctccacaca

SEQ ID NO: 290876 - DNA, 15 bp, Homo sapiens
ataggagctccacac

SEQ ID NO: 290877 - DNA, 15 bp, Homo sapiens
cataggagctccaca

SEQ ID NO: 290878 - DNA, 15 bp, Homo sapiens
acataggagctccac

SEQ ID NO: 290879 - DNA, 15 bp, Homo sapiens
cacataggagctcca

SEQ ID NO: 290880 - DNA, 15 bp, Homo sapiens
tcacataggagctcc

SEQ ID NO: 290881 - DNA, 15 bp, Homo sapiens
atcacataggagctc

SEQ ID NO: 290882 - DNA, 15 bp, Homo sapiens
tatcacataggagct

SEQ ID NO: 290883 - DNA, 15 bp, Homo sapiens
atatcacataggagc

SEQ ID NO: 290884 - DNA, 15 bp, Homo sapiens
tatatcacataggag

SEQ ID NO: 290885 - DNA, 15 bp, Homo sapiens
ttatatcacatagga

SEQ ID NO: 290886 - DNA, 15 bp, Homo sapiens
attatatcacatagg

SEQ ID NO: 290887 - DNA, 15 bp, Homo sapiens
tattatatcacatag

SEQ ID NO: 290888 - DNA, 15 bp, Homo sapiens
ctattatatcacata

SEQ ID NO: 290889 - DNA, 15 bp, Homo sapiens
cctattatatcacat

SEQ ID NO: 290890 - DNA, 15 bp, Homo sapiens
tcctattatatcaca

SEQ ID NO: 290891 - DNA, 15 bp, Homo sapiens
ctcctattatatcac

SEQ ID NO: 290892 - DNA, 15 bp, Homo sapiens
actcctattatatca

SEQ ID NO: 290893 - DNA, 15 bp, Homo sapiens
cactcctattatatc

SEQ ID NO: 290894 - DNA, 15 bp, Homo sapiens
gcactcctattatat

SEQ ID NO: 290895 - DNA, 15 bp, Homo sapiens
ggcactcctattata

SEQ ID NO: 290896 - DNA, 15 bp, Homo sapiens
aggcactcctattat

SEQ ID NO: 290897 - DNA, 15 bp, Homo sapiens
aaggcactcctatta

SEQ ID NO: 290898 - DNA, 15 bp, Homo sapiens
aaaggcactcctatt

SEQ ID NO: 290899 - DNA, 15 bp, Homo sapiens
gaaaggcactcctat

SEQ ID NO: 290900 - DNA, 15 bp, Homo sapiens
agaaaggcactccta

SEQ ID NO: 290901 - DNA, 15 bp, Homo sapiens
gagaaaggcactcct

SEQ ID NO: 290902 - DNA, 15 bp, Homo sapiens
ggagaaaggcactcc

SEQ ID NO: 290903 - DNA, 15 bp, Homo sapiens
tggagaaaggcactc

SEQ ID NO: 290904 - DNA, 15 bp, Homo sapiens
ctggagaaaggcact

SEQ ID NO: 290905 - DNA, 15 bp, Homo sapiens
tctggagaaaggcac

SEQ ID NO: 290906 - DNA, 15 bp, Homo sapiens
ttctggagaaaggca

SEQ ID NO: 290907 - DNA, 15 bp, Homo sapiens
tttctggagaaaggc

SEQ ID NO: 290908 - DNA, 15 bp, Homo sapiens
atttctggagaaagg

SEQ ID NO: 290909 - DNA, 15 bp, Homo sapiens
catttctggagaaag

SEQ ID NO: 290910 - DNA, 15 bp, Homo sapiens
tcatttctggagaaa

SEQ ID NO: 290911 - DNA, 15 bp, Homo sapiens
atcatttctggagaa

SEQ ID NO: 290912 - DNA, 15 bp, Homo sapiens
aatcatttctggaga

SEQ ID NO: 290913 - DNA, 15 bp, Homo sapiens
aaatcatttctggag

SEQ ID NO: 290914 - DNA, 15 bp, Homo sapiens
taaatcatttctgga

SEQ ID NO: 290915 - DNA, 15 bp, Homo sapiens
ataaatcatttctgg

SEQ ID NO: 290916 - DNA, 15 bp, Homo sapiens
aataaatcatttctg

SEQ ID NO: 290917 - DNA, 15 bp, Homo sapiens
caataaatcatttct

SEQ ID NO: 290918 - DNA, 15 bp, Homo sapiens
tcaataaatcatttc

SEQ ID NO: 290919 - DNA, 15 bp, Homo sapiens
gtcaataaatcattt

SEQ ID NO: 290920 - DNA, 15 bp, Homo sapiens
agtcaataaatcatt

SEQ ID NO: 290921 - DNA, 15 bp, Homo sapiens
gagtcaataaatcat

SEQ ID NO: 290922 - DNA, 15 bp, Homo sapiens
tgagtcaataaatca

SEQ ID NO: 290923 - DNA, 15 bp, Homo sapiens
ttgagtcaataaatc

SEQ ID NO: 290924 - DNA, 15 bp, Homo sapiens
tttgagtcaataaat

SEQ ID NO: 290925 - DNA, 15 bp, Homo sapiens
ctttgagtcaataaa

SEQ ID NO: 290926 - DNA, 15 bp, Homo sapiens
gctttgagtcaataa

SEQ ID NO: 290927 - DNA, 15 bp, Homo sapiens
tgctttgagtcaata

SEQ ID NO: 290928 - DNA, 15 bp, Homo sapiens
ctgctttgagtcaat

SEQ ID NO: 290929 - DNA, 15 bp, Homo sapiens
cctgctttgagtcaa

SEQ ID NO: 290930 - DNA, 15 bp, Homo sapiens
tcctgctttgagtca

SEQ ID NO: 290931 - DNA, 15 bp, Homo sapiens
ttcctgctttgagtc

SEQ ID NO: 290932 - DNA, 15 bp, Homo sapiens
gttcctgctttgagt

SEQ ID NO: 290933 - DNA, 15 bp, Homo sapiens
tgttcctgctttgag

SEQ ID NO: 290934 - DNA, 15 bp, Homo sapiens
ttgttcctgctttga

SEQ ID NO: 290935 - DNA, 15 bp, Homo sapiens
gttgttcctgctttg

SEQ ID NO: 290936 - DNA, 15 bp, Homo sapiens
agttgttcctgcttt

SEQ ID NO: 290937 - DNA, 15 bp, Homo sapiens
aagttgttcctgctt

SEQ ID NO: 290938 - DNA, 15 bp, Homo sapiens
aaagttgttcctgct

SEQ ID NO: 290939 - DNA, 15 bp, Homo sapiens
gaaagttgttcctgc

SEQ ID NO: 290940 - DNA, 15 bp, Homo sapiens
agaaagttgttcctg

SEQ ID NO: 290941 - DNA, 15 bp, Homo sapiens
gagaaagttgttcct

SEQ ID NO: 290942 - DNA, 15 bp, Homo sapiens
agagaaagttgttcc

SEQ ID NO: 290943 - DNA, 15 bp, Homo sapiens
gagagaaagttgttc

SEQ ID NO: 290944 - DNA, 15 bp, Homo sapiens
ggagagaaagttgtt

SEQ ID NO: 290945 - DNA, 15 bp, Homo sapiens
tggagagaaagttgt

SEQ ID NO: 290946 - DNA, 15 bp, Homo sapiens
ctggagagaaagttg

SEQ ID NO: 290947 - DNA, 15 bp, Homo sapiens
actggagagaaagtt

SEQ ID NO: 290948 - DNA, 15 bp, Homo sapiens
cactggagagaaagt

SEQ ID NO: 290949 - DNA, 15 bp, Homo sapiens
tcactggagagaaag

SEQ ID NO: 290950 - DNA, 15 bp, Homo sapiens
atcactggagagaaa

SEQ ID NO: 290951 - DNA, 15 bp, Homo sapiens
aatcactggagagaa

SEQ ID NO: 290952 - DNA, 15 bp, Homo sapiens
gaatcactggagaga

SEQ ID NO: 290953 - DNA, 15 bp, Homo sapiens
agaatcactggagag

SEQ ID NO: 290954 - DNA, 15 bp, Homo sapiens
gagaatcactggaga

SEQ ID NO: 290955 - DNA, 15 bp, Homo sapiens
agagaatcactggag

SEQ ID NO: 290956 - DNA, 15 bp, Homo sapiens
gagagaatcactgga

SEQ ID NO: 290957 - DNA, 15 bp, Homo sapiens
tgagagaatcactgg

SEQ ID NO: 290958 - DNA, 15 bp, Homo sapiens
ttgagagaatcactg

SEQ ID NO: 290959 - DNA, 15 bp, Homo sapiens
tttgagagaatcact

SEQ ID NO: 290960 - DNA, 15 bp, Homo sapiens
atttgagagaatcac

SEQ ID NO: 290961 - DNA, 15 bp, Homo sapiens
aatttgagagaatca

SEQ ID NO: 290962 - DNA, 15 bp, Homo sapiens
aaatttgagagaatc

SEQ ID NO: 290963 - DNA, 15 bp, Homo sapiens
aaaatttgagagaat

SEQ ID NO: 290964 - DNA, 15 bp, Homo sapiens
taaaatttgagagaa

SEQ ID NO: 290965 - DNA, 15 bp, Homo sapiens
ctaaaatttgagaga

SEQ ID NO: 290966 - DNA, 15 bp, Homo sapiens
tctaaaatttgagag

SEQ ID NO: 290967 - DNA, 15 bp, Homo sapiens
ttctaaaatttgaga

SEQ ID NO: 290968 - DNA, 15 bp, Homo sapiens
tttctaaaatttgag

SEQ ID NO: 290969 - DNA, 15 bp, Homo sapiens
ttttctaaaatttga

SEQ ID NO: 290970 - DNA, 15 bp, Homo sapiens
gttttctaaaatttg

SEQ ID NO: 290971 - DNA, 15 bp, Homo sapiens
agttttctaaaattt

SEQ ID NO: 290972 - DNA, 15 bp, Homo sapiens
cagttttctaaaatt

SEQ ID NO: 290973 - DNA, 15 bp, Homo sapiens
gcagttttctaaaat

SEQ ID NO: 290974 - DNA, 15 bp, Homo sapiens
ggcagttttctaaaa

SEQ ID NO: 290975 - DNA, 15 bp, Homo sapiens
aggcagttttctaaa

SEQ ID NO: 290976 - DNA, 15 bp, Homo sapiens
aaggcagttttctaa

SEQ ID NO: 290977 - DNA, 15 bp, Homo sapiens
aaaggcagttttcta

SEQ ID NO: 290978 - DNA, 15 bp, Homo sapiens
aaaaggcagttttct

SEQ ID NO: 290979 - DNA, 15 bp, Homo sapiens
gaaaaggcagttttc

SEQ ID NO: 290980 - DNA, 15 bp, Homo sapiens
tgaaaaggcagtttt

SEQ ID NO: 290981 - DNA, 15 bp, Homo sapiens
gtgaaaaggcagttt

SEQ ID NO: 290982 - DNA, 15 bp, Homo sapiens
tgtgaaaaggcagtt

SEQ ID NO: 290983 - DNA, 15 bp, Homo sapiens
ctgtgaaaaggcagt

SEQ ID NO: 290984 - DNA, 15 bp, Homo sapiens
actgtgaaaaggcag

SEQ ID NO: 290985 - DNA, 15 bp, Homo sapiens
aactgtgaaaaggca

SEQ ID NO: 290986 - DNA, 15 bp, Homo sapiens
caactgtgaaaaggc

SEQ ID NO: 290987 - DNA, 15 bp, Homo sapiens
gcaactgtgaaaagg

SEQ ID NO: 290988 - DNA, 15 bp, Homo sapiens
agcaactgtgaaaag

SEQ ID NO: 290989 - DNA, 15 bp, Homo sapiens
gagcaactgtgaaaa

SEQ ID NO: 290990 - DNA, 15 bp, Homo sapiens
agagcaactgtgaaa

SEQ ID NO: 290991 - DNA, 15 bp, Homo sapiens
gagagcaactgtgaa

SEQ ID NO: 290992 - DNA, 15 bp, Homo sapiens
tgagagcaactgtga

SEQ ID NO: 290993 - DNA, 15 bp, Homo sapiens
ctgagagcaactgtg

SEQ ID NO: 290994 - DNA, 15 bp, Homo sapiens
actgagagcaactgt

SEQ ID NO: 290995 - DNA, 15 bp, Homo sapiens
gactgagagcaactg

SEQ ID NO: 290996 - DNA, 15 bp, Homo sapiens
agactgagagcaact

SEQ ID NO: 290997 - DNA, 15 bp, Homo sapiens
aagactgagagcaac

SEQ ID NO: 290998 - DNA, 15 bp, Homo sapiens
aaagactgagagcaa

SEQ ID NO: 290999 - DNA, 15 bp, Homo sapiens
aaaagactgagagca

SEQ ID NO: 291000 - DNA, 15 bp, Homo sapiens
aaaaagactgagagc

SEQ ID NO: 291001 - DNA, 15 bp, Homo sapiens
taaaaagactgagag

SEQ ID NO: 291002 - DNA, 15 bp, Homo sapiens
ttaaaaagactgaga

SEQ ID NO: 291003 - DNA, 15 bp, Homo sapiens
gttaaaaagactgag

SEQ ID NO: 291004 - DNA, 15 bp, Homo sapiens
agttaaaaagactga

SEQ ID NO: 291005 - DNA, 15 bp, Homo sapiens
aagttaaaaagactg

SEQ ID NO: 291006 - DNA, 15 bp, Homo sapiens
taagttaaaaagact

SEQ ID NO: 291007 - DNA, 15 bp, Homo sapiens
gtaagttaaaaagac

SEQ ID NO: 291008 - DNA, 15 bp, Homo sapiens
ggtaagttaaaaaga

SEQ ID NO: 291009 - DNA, 15 bp, Homo sapiens
tggtaagttaaaaag

SEQ ID NO: 291010 - DNA, 15 bp, Homo sapiens
ctggtaagttaaaaa

SEQ ID NO: 291011 - DNA, 15 bp, Homo sapiens
tctggtaagttaaaa

SEQ ID NO: 291012 - DNA, 15 bp, Homo sapiens
ttctggtaagttaaa

SEQ ID NO: 291013 - DNA, 15 bp, Homo sapiens
attctggtaagttaa

SEQ ID NO: 291014 - DNA, 15 bp, Homo sapiens
tattctggtaagtta

SEQ ID NO: 291015 - DNA, 15 bp, Homo sapiens
ttattctggtaagtt

SEQ ID NO: 291016 - DNA, 15 bp, Homo sapiens
attattctggtaagt

SEQ ID NO: 291017 - DNA, 15 bp, Homo sapiens
aattattctggtaag

SEQ ID NO: 291018 - DNA, 15 bp, Homo sapiens
gaattattctggtaa

SEQ ID NO: 291019 - DNA, 15 bp, Homo sapiens
tgaattattctggta

SEQ ID NO: 291020 - DNA, 15 bp, Homo sapiens
ttgaattattctggt

SEQ ID NO: 291021 - DNA, 15 bp, Homo sapiens
tttgaattattctgg

SEQ ID NO: 291022 - DNA, 15 bp, Homo sapiens
ttttgaattattctg

SEQ ID NO: 291023 - DNA, 15 bp, Homo sapiens
gttttgaattattct

SEQ ID NO: 291024 - DNA, 15 bp, Homo sapiens
tgttttgaattattc

SEQ ID NO: 291025 - DNA, 15 bp, Homo sapiens
ctgttttgaattatt

SEQ ID NO: 291026 - DNA, 15 bp, Homo sapiens
actgttttgaattat

SEQ ID NO: 291027 - DNA, 15 bp, Homo sapiens
cactgttttgaatta

SEQ ID NO: 291028 - DNA, 15 bp, Homo sapiens
acactgttttgaatt

SEQ ID NO: 291029 - DNA, 15 bp, Homo sapiens
gacactgttttgaat

SEQ ID NO: 291030 - DNA, 15 bp, Homo sapiens
tgacactgttttgaa

SEQ ID NO: 291031 - DNA, 15 bp, Homo sapiens
atgacactgttttga

SEQ ID NO: 291032 - DNA, 15 bp, Homo sapiens
aatgacactgttttg

SEQ ID NO: 291033 - DNA, 15 bp, Homo sapiens
aaatgacactgtttt

SEQ ID NO: 291034 - DNA, 15 bp, Homo sapiens
gaaatgacactgttt

SEQ ID NO: 291035 - DNA, 15 bp, Homo sapiens
agaaatgacactgtt

SEQ ID NO: 291036 - DNA, 15 bp, Homo sapiens
cagaaatgacactgt

SEQ ID NO: 291037 - DNA, 15 bp, Homo sapiens
gcagaaatgacactg

SEQ ID NO: 291038 - DNA, 15 bp, Homo sapiens
ggcagaaatgacact

SEQ ID NO: 291039 - DNA, 15 bp, Homo sapiens
aggcagaaatgacac

SEQ ID NO: 291040 - DNA, 15 bp, Homo sapiens
aaggcagaaatgaca

SEQ ID NO: 291041 - DNA, 15 bp, Homo sapiens
taaggcagaaatgac

SEQ ID NO: 291042 - DNA, 15 bp, Homo sapiens
gtaaggcagaaatga

SEQ ID NO: 291043 - DNA, 15 bp, Homo sapiens
ggtaaggcagaaatg

SEQ ID NO: 291044 - DNA, 15 bp, Homo sapiens
aggtaaggcagaaat

SEQ ID NO: 291045 - DNA, 15 bp, Homo sapiens
taggtaaggcagaaa

SEQ ID NO: 291046 - DNA, 15 bp, Homo sapiens
gtaggtaaggcagaa

SEQ ID NO: 291047 - DNA, 15 bp, Homo sapiens
tgtaggtaaggcaga

SEQ ID NO: 291048 - DNA, 15 bp, Homo sapiens
gtgtaggtaaggcag

SEQ ID NO: 291049 - DNA, 15 bp, Homo sapiens
tgtgtaggtaaggca

SEQ ID NO: 291050 - DNA, 15 bp, Homo sapiens
ctgtgtaggtaaggc

SEQ ID NO: 291051 - DNA, 15 bp, Homo sapiens
tctgtgtaggtaagg

SEQ ID NO: 291052 - DNA, 15 bp, Homo sapiens
ttctgtgtaggtaag

SEQ ID NO: 291053 - DNA, 15 bp, Homo sapiens
tttctgtgtaggtaa

SEQ ID NO: 291054 - DNA, 15 bp, Homo sapiens
atttctgtgtaggta

SEQ ID NO: 291055 - DNA, 15 bp, Homo sapiens
aatttctgtgtaggt

SEQ ID NO: 291056 - DNA, 15 bp, Homo sapiens
aaatttctgtgtagg

SEQ ID NO: 291057 - DNA, 15 bp, Homo sapiens
caaatttctgtgtag

SEQ ID NO: 291058 - DNA, 15 bp, Homo sapiens
acaaatttctgtgta

SEQ ID NO: 291059 - DNA, 15 bp, Homo sapiens
cacaaatttctgtgt

SEQ ID NO: 291060 - DNA, 15 bp, Homo sapiens
acacaaatttctgtg

SEQ ID NO: 291061 - DNA, 15 bp, Homo sapiens
tacacaaatttctgt

SEQ ID NO: 291062 - DNA, 15 bp, Homo sapiens
ctacacaaatttctg

SEQ ID NO: 291063 - DNA, 15 bp, Homo sapiens
cctacacaaatttct

SEQ ID NO: 291064 - DNA, 15 bp, Homo sapiens
gcctacacaaatttc

SEQ ID NO: 291065 - DNA, 15 bp, Homo sapiens
tgcctacacaaattt

SEQ ID NO: 291066 - DNA, 15 bp, Homo sapiens
ttgcctacacaaatt

SEQ ID NO: 291067 - DNA, 15 bp, Homo sapiens
attgcctacacaaat

SEQ ID NO: 291068 - DNA, 15 bp, Homo sapiens
aattgcctacacaaa

SEQ ID NO: 291069 - DNA, 15 bp, Homo sapiens
gaattgcctacacaa

SEQ ID NO: 291070 - DNA, 15 bp, Homo sapiens
tgaattgcctacaca

SEQ ID NO: 291071 - DNA, 15 bp, Homo sapiens
atgaattgcctacac

SEQ ID NO: 291072 - DNA, 15 bp, Homo sapiens
tatgaattgcctaca

SEQ ID NO: 291073 - DNA, 15 bp, Homo sapiens
ttatgaattgcctac

SEQ ID NO: 291074 - DNA, 15 bp, Homo sapiens
attatgaattgccta

SEQ ID NO: 291075 - DNA, 15 bp, Homo sapiens
aattatgaattgcct

SEQ ID NO: 291076 - DNA, 15 bp, Homo sapiens
aaattatgaattgcc

SEQ ID NO: 291077 - DNA, 15 bp, Homo sapiens
caaattatgaattgc

SEQ ID NO: 291078 - DNA, 15 bp, Homo sapiens
tcaaattatgaattg

SEQ ID NO: 291079 - DNA, 15 bp, Homo sapiens
gtcaaattatgaatt

SEQ ID NO: 291080 - DNA, 15 bp, Homo sapiens
ggtcaaattatgaat

SEQ ID NO: 291081 - DNA, 15 bp, Homo sapiens
tggtcaaattatgaa

SEQ ID NO: 291082 - DNA, 15 bp, Homo sapiens
atggtcaaattatga

SEQ ID NO: 291083 - DNA, 15 bp, Homo sapiens
tatggtcaaattatg

SEQ ID NO: 291084 - DNA, 15 bp, Homo sapiens
gtatggtcaaattat

SEQ ID NO: 291085 - DNA, 15 bp, Homo sapiens
tgtatggtcaaatta

SEQ ID NO: 291086 - DNA, 15 bp, Homo sapiens
gtgtatggtcaaatt

SEQ ID NO: 291087 - DNA, 15 bp, Homo sapiens
agtgtatggtcaaat

SEQ ID NO: 291088 - DNA, 15 bp, Homo sapiens
aagtgtatggtcaaa

SEQ ID NO: 291089 - DNA, 15 bp, Homo sapiens
aaagtgtatggtcaa

SEQ ID NO: 291090 - DNA, 15 bp, Homo sapiens
aaaagtgtatggtca

SEQ ID NO: 291091 - DNA, 15 bp, Homo sapiens
gaaaagtgtatggtc

SEQ ID NO: 291092 - DNA, 15 bp, Homo sapiens
agaaaagtgtatggt

SEQ ID NO: 291093 - DNA, 15 bp, Homo sapiens
gagaaaagtgtatgg

SEQ ID NO: 291094 - DNA, 15 bp, Homo sapiens
agagaaaagtgtatg

SEQ ID NO: 291095 - DNA, 15 bp, Homo sapiens
tagagaaaagtgtat

SEQ ID NO: 291096 - DNA, 15 bp, Homo sapiens
atagagaaaagtgta

SEQ ID NO: 291097 - DNA, 15 bp, Homo sapiens
catagagaaaagtgt

SEQ ID NO: 291098 - DNA, 15 bp, Homo sapiens
acatagagaaaagtg

SEQ ID NO: 291099 - DNA, 15 bp, Homo sapiens
gacatagagaaaagt

SEQ ID NO: 291100 - DNA, 15 bp, Homo sapiens
agacatagagaaaag

SEQ ID NO: 291101 - DNA, 15 bp, Homo sapiens
gagacatagagaaaa

SEQ ID NO: 291102 - DNA, 15 bp, Homo sapiens
agagacatagagaaa

SEQ ID NO: 291103 - DNA, 15 bp, Homo sapiens
gagagacatagagaa

SEQ ID NO: 291104 - DNA, 15 bp, Homo sapiens
tgagagacatagaga

SEQ ID NO: 291105 - DNA, 15 bp, Homo sapiens
ctgagagacatagag

SEQ ID NO: 291106 - DNA, 15 bp, Homo sapiens
actgagagacataga

SEQ ID NO: 291107 - DNA, 15 bp, Homo sapiens
cactgagagacatag

SEQ ID NO: 291108 - DNA, 15 bp, Homo sapiens
acactgagagacata

SEQ ID NO: 291109 - DNA, 15 bp, Homo sapiens
aacactgagagacat

SEQ ID NO: 291110 - DNA, 15 bp, Homo sapiens
aaacactgagagaca

SEQ ID NO: 291111 - DNA, 15 bp, Homo sapiens
gaaacactgagagac

SEQ ID NO: 291112 - DNA, 15 bp, Homo sapiens
tgaaacactgagaga

SEQ ID NO: 291113 - DNA, 15 bp, Homo sapiens
ctgaaacactgagag

SEQ ID NO: 291114 - DNA, 15 bp, Homo sapiens
tctgaaacactgaga

SEQ ID NO: 291115 - DNA, 15 bp, Homo sapiens
ttctgaaacactgag

SEQ ID NO: 291116 - DNA, 15 bp, Homo sapiens
attctgaaacactga

SEQ ID NO: 291117 - DNA, 15 bp, Homo sapiens
aattctgaaacactg

SEQ ID NO: 291118 - DNA, 15 bp, Homo sapiens
aaattctgaaacact

SEQ ID NO: 291119 - DNA, 15 bp, Homo sapiens
caaattctgaaacac

SEQ ID NO: 291120 - DNA, 15 bp, Homo sapiens
ccaaattctgaaaca

SEQ ID NO: 291121 - DNA, 15 bp, Homo sapiens
cccaaattctgaaac

SEQ ID NO: 291122 - DNA, 15 bp, Homo sapiens
acccaaattctgaaa

SEQ ID NO: 291123 - DNA, 15 bp, Homo sapiens
cacccaaattctgaa

SEQ ID NO: 291124 - DNA, 15 bp, Homo sapiens
tcacccaaattctga

SEQ ID NO: 291125 - DNA, 15 bp, Homo sapiens
ctcacccaaattctg

SEQ ID NO: 291126 - DNA, 15 bp, Homo sapiens
cctcacccaaattct

SEQ ID NO: 291127 - DNA, 15 bp, Homo sapiens
gcctcacccaaattc

SEQ ID NO: 291128 - DNA, 15 bp, Homo sapiens
agcctcacccaaatt

SEQ ID NO: 291129 - DNA, 15 bp, Homo sapiens
cagcctcacccaaat

SEQ ID NO: 291130 - DNA, 15 bp, Homo sapiens
acagcctcacccaaa

SEQ ID NO: 291131 - DNA, 15 bp, Homo sapiens
aacagcctcacccaa

SEQ ID NO: 291132 - DNA, 15 bp, Homo sapiens
gaacagcctcaccca

SEQ ID NO: 291133 - DNA, 15 bp, Homo sapiens
tgaacagcctcaccc

SEQ ID NO: 291134 - DNA, 15 bp, Homo sapiens
ttgaacagcctcacc

SEQ ID NO: 291135 - DNA, 15 bp, Homo sapiens
attgaacagcctcac

SEQ ID NO: 291136 - DNA, 15 bp, Homo sapiens
cattgaacagcctca

SEQ ID NO: 291137 - DNA, 15 bp, Homo sapiens
ccattgaacagcctc

SEQ ID NO: 291138 - DNA, 15 bp, Homo sapiens
tccattgaacagcct

SEQ ID NO: 291139 - DNA, 15 bp, Homo sapiens
ttccattgaacagcc

SEQ ID NO: 291140 - DNA, 15 bp, Homo sapiens
cttccattgaacagc

SEQ ID NO: 291141 - DNA, 15 bp, Homo sapiens
ccttccattgaacag

SEQ ID NO: 291142 - DNA, 15 bp, Homo sapiens
gccttccattgaaca

SEQ ID NO: 291143 - DNA, 15 bp, Homo sapiens
agccttccattgaac

SEQ ID NO: 291144 - DNA, 15 bp, Homo sapiens
aagccttccattgaa

SEQ ID NO: 291145 - DNA, 15 bp, Homo sapiens
taagccttccattga

SEQ ID NO: 291146 - DNA, 15 bp, Homo sapiens
gtaagccttccattg

SEQ ID NO: 291147 - DNA, 15 bp, Homo sapiens
agtaagccttccatt

SEQ ID NO: 291148 - DNA, 15 bp, Homo sapiens
aagtaagccttccat

SEQ ID NO: 291149 - DNA, 15 bp, Homo sapiens
gaagtaagccttcca

SEQ ID NO: 291150 - DNA, 15 bp, Homo sapiens
tgaagtaagccttcc

SEQ ID NO: 291151 - DNA, 15 bp, Homo sapiens
ctgaagtaagccttc

SEQ ID NO: 291152 - DNA, 15 bp, Homo sapiens
cctgaagtaagcctt

SEQ ID NO: 291153 - DNA, 15 bp, Homo sapiens
ccctgaagtaagcct

SEQ ID NO: 291154 - DNA, 15 bp, Homo sapiens
gccctgaagtaagcc

SEQ ID NO: 291155 - DNA, 15 bp, Homo sapiens
ggccctgaagtaagc

SEQ ID NO: 291156 - DNA, 15 bp, Homo sapiens
aggccctgaagtaag

SEQ ID NO: 291157 - DNA, 15 bp, Homo sapiens
gaggccctgaagtaa

SEQ ID NO: 291158 - DNA, 15 bp, Homo sapiens
agaggccctgaagta

SEQ ID NO: 291159 - DNA, 15 bp, Homo sapiens
gagaggccctgaagt

SEQ ID NO: 291160 - DNA, 15 bp, Homo sapiens
tgagaggccctgaag

SEQ ID NO: 291161 - DNA, 15 bp, Homo sapiens
ttgagaggccctgaa

SEQ ID NO: 291162 - DNA, 15 bp, Homo sapiens
attgagaggccctga

SEQ ID NO: 291163 - DNA, 15 bp, Homo sapiens
gattgagaggccctg

SEQ ID NO: 291164 - DNA, 15 bp, Homo sapiens
ggattgagaggccct

SEQ ID NO: 291165 - DNA, 15 bp, Homo sapiens
gggattgagaggccc

SEQ ID NO: 291166 - DNA, 15 bp, Homo sapiens
tgggattgagaggcc

SEQ ID NO: 291167 - DNA, 15 bp, Homo sapiens
gtgggattgagaggc

SEQ ID NO: 291168 - DNA, 15 bp, Homo sapiens
tgtgggattgagagg

SEQ ID NO: 291169 - DNA, 15 bp, Homo sapiens
ttgtgggattgagag

SEQ ID NO: 291170 - DNA, 15 bp, Homo sapiens
attgtgggattgaga

SEQ ID NO: 291171 - DNA, 15 bp, Homo sapiens
aattgtgggattgag

SEQ ID NO: 291172 - DNA, 15 bp, Homo sapiens
aaattgtgggattga

SEQ ID NO: 291173 - DNA, 15 bp, Homo sapiens
caaattgtgggattg

SEQ ID NO: 291174 - DNA, 15 bp, Homo sapiens
ccaaattgtgggatt

SEQ ID NO: 291175 - DNA, 15 bp, Homo sapiens
tccaaattgtgggat

SEQ ID NO: 291176 - DNA, 15 bp, Homo sapiens
ttccaaattgtggga

SEQ ID NO: 291177 - DNA, 15 bp, Homo sapiens
tttccaaattgtggg

SEQ ID NO: 291178 - DNA, 15 bp, Homo sapiens
ctttccaaattgtgg

SEQ ID NO: 291179 - DNA, 15 bp, Homo sapiens
actttccaaattgtg

SEQ ID NO: 291180 - DNA, 15 bp, Homo sapiens
tactttccaaattgt

SEQ ID NO: 291181 - DNA, 15 bp, Homo sapiens
ttactttccaaattg

SEQ ID NO: 291182 - DNA, 15 bp, Homo sapiens
cttactttccaaatt

SEQ ID NO: 291183 - DNA, 15 bp, Homo sapiens
tcttactttccaaat

SEQ ID NO: 291184 - DNA, 15 bp, Homo sapiens
ctcttactttccaaa

SEQ ID NO: 291185 - DNA, 15 bp, Homo sapiens
actcttactttccaa

SEQ ID NO: 291186 - DNA, 15 bp, Homo sapiens
aactcttactttcca

SEQ ID NO: 291187 - DNA, 15 bp, Homo sapiens
aaactcttactttcc

SEQ ID NO: 291188 - DNA, 15 bp, Homo sapiens
gaaactcttactttc

SEQ ID NO: 291189 - DNA, 15 bp, Homo sapiens
ggaaactcttacttt

SEQ ID NO: 291190 - DNA, 15 bp, Homo sapiens
gggaaactcttactt

SEQ ID NO: 291191 - DNA, 15 bp, Homo sapiens
tgggaaactcttact

SEQ ID NO: 291192 - DNA, 15 bp, Homo sapiens
ttgggaaactcttac

SEQ ID NO: 291193 - DNA, 15 bp, Homo sapiens
cttgggaaactctta

SEQ ID NO: 291194 - DNA, 15 bp, Homo sapiens
tcttgggaaactctt

SEQ ID NO: 291195 - DNA, 15 bp, Homo sapiens
ctcttgggaaactct

SEQ ID NO: 291196 - DNA, 15 bp, Homo sapiens
actcttgggaaactc

SEQ ID NO: 291197 - DNA, 15 bp, Homo sapiens
cactcttgggaaact

SEQ ID NO: 291198 - DNA, 15 bp, Homo sapiens
tcactcttgggaaac

SEQ ID NO: 291199 - DNA, 15 bp, Homo sapiens
gtcactcttgggaaa

SEQ ID NO: 291200 - DNA, 15 bp, Homo sapiens
ggtcactcttgggaa

SEQ ID NO: 291201 - DNA, 15 bp, Homo sapiens
gggtcactcttggga

SEQ ID NO: 291202 - DNA, 15 bp, Homo sapiens
tgggtcactcttggg

SEQ ID NO: 291203 - DNA, 15 bp, Homo sapiens
ttgggtcactcttgg

SEQ ID NO: 291204 - DNA, 15 bp, Homo sapiens
cttgggtcactcttg

SEQ ID NO: 291205 - DNA, 15 bp, Homo sapiens
tcttgggtcactctt

SEQ ID NO: 291206 - DNA, 15 bp, Homo sapiens
gtcttgggtcactct

SEQ ID NO: 291207 - DNA, 15 bp, Homo sapiens
cgtcttgggtcactc

SEQ ID NO: 291208 - DNA, 15 bp, Homo sapiens
acgtcttgggtcact

SEQ ID NO: 291209 - DNA, 15 bp, Homo sapiens
cacgtcttgggtcac

SEQ ID NO: 291210 - DNA, 15 bp, Homo sapiens
ccacgtcttgggtca

SEQ ID NO: 291211 - DNA, 15 bp, Homo sapiens
cccacgtcttgggtc

SEQ ID NO: 291212 - DNA, 15 bp, Homo sapiens
acccacgtcttgggt

SEQ ID NO: 291213 - DNA, 15 bp, Homo sapiens
aacccacgtcttggg

SEQ ID NO: 291214 - DNA, 15 bp, Homo sapiens
aaacccacgtcttgg

SEQ ID NO: 291215 - DNA, 15 bp, Homo sapiens
gaaacccacgtcttg

SEQ ID NO: 291216 - DNA, 15 bp, Homo sapiens
agaaacccacgtctt

SEQ ID NO: 291217 - DNA, 15 bp, Homo sapiens
aagaaacccacgtct

SEQ ID NO: 291218 - DNA, 15 bp, Homo sapiens
caagaaacccacgtc

SEQ ID NO: 291219 - DNA, 15 bp, Homo sapiens
tcaagaaacccacgt

SEQ ID NO: 291220 - DNA, 15 bp, Homo sapiens
ttcaagaaacccacg

SEQ ID NO: 291221 - DNA, 15 bp, Homo sapiens
cttcaagaaacccac

SEQ ID NO: 291222 - DNA, 15 bp, Homo sapiens
gcttcaagaaaccca

SEQ ID NO: 291223 - DNA, 15 bp, Homo sapiens
ggcttcaagaaaccc

SEQ ID NO: 291224 - DNA, 15 bp, Homo sapiens
gggcttcaagaaacc

SEQ ID NO: 291225 - DNA, 15 bp, Homo sapiens
agggcttcaagaaac

SEQ ID NO: 291226 - DNA, 15 bp, Homo sapiens
aagggcttcaagaaa

SEQ ID NO: 291227 - DNA, 15 bp, Homo sapiens
gaagggcttcaagaa

SEQ ID NO: 291228 - DNA, 15 bp, Homo sapiens
cgaagggcttcaaga

SEQ ID NO: 291229 - DNA, 15 bp, Homo sapiens
ccgaagggcttcaag

SEQ ID NO: 291230 - DNA, 15 bp, Homo sapiens
tccgaagggcttcaa

SEQ ID NO: 291231 - DNA, 15 bp, Homo sapiens
ttccgaagggcttca

SEQ ID NO: 291232 - DNA, 15 bp, Homo sapiens
attccgaagggcttc

SEQ ID NO: 291233 - DNA, 15 bp, Homo sapiens
cattccgaagggctt

SEQ ID NO: 291234 - DNA, 15 bp, Homo sapiens
acattccgaagggct

SEQ ID NO: 291235 - DNA, 15 bp, Homo sapiens
aacattccgaagggc

SEQ ID NO: 291236 - DNA, 15 bp, Homo sapiens
aaacattccgaaggg

SEQ ID NO: 291237 - DNA, 15 bp, Homo sapiens
caaacattccgaagg

SEQ ID NO: 291238 - DNA, 15 bp, Homo sapiens
tcaaacattccgaag

SEQ ID NO: 291239 - DNA, 15 bp, Homo sapiens
ctcaaacattccgaa

SEQ ID NO: 291240 - DNA, 15 bp, Homo sapiens
actcaaacattccga

SEQ ID NO: 291241 - DNA, 15 bp, Homo sapiens
gactcaaacattccg

SEQ ID NO: 291242 - DNA, 15 bp, Homo sapiens
agactcaaacattcc

SEQ ID NO: 291243 - DNA, 15 bp, Homo sapiens
aagactcaaacattc

SEQ ID NO: 291244 - DNA, 15 bp, Homo sapiens
taagactcaaacatt

SEQ ID NO: 291245 - DNA, 15 bp, Homo sapiens
gtaagactcaaacat

SEQ ID NO: 291246 - DNA, 15 bp, Homo sapiens
agtaagactcaaaca

SEQ ID NO: 291247 - DNA, 15 bp, Homo sapiens
aagtaagactcaaac

SEQ ID NO: 291248 - DNA, 15 bp, Homo sapiens
taagtaagactcaaa

SEQ ID NO: 291249 - DNA, 15 bp, Homo sapiens
ctaagtaagactcaa

SEQ ID NO: 291250 - DNA, 15 bp, Homo sapiens
actaagtaagactca

SEQ ID NO: 291251 - DNA, 15 bp, Homo sapiens
cactaagtaagactc

SEQ ID NO: 291252 - DNA, 15 bp, Homo sapiens
gcactaagtaagact

SEQ ID NO: 291253 - DNA, 15 bp, Homo sapiens
ggcactaagtaagac

SEQ ID NO: 291254 - DNA, 15 bp, Homo sapiens
tggcactaagtaaga

SEQ ID NO: 291255 - DNA, 15 bp, Homo sapiens
ctggcactaagtaag

SEQ ID NO: 291256 - DNA, 15 bp, Homo sapiens
gctggcactaagtaa

SEQ ID NO: 291257 - DNA, 15 bp, Homo sapiens
ggctggcactaagta

SEQ ID NO: 291258 - DNA, 15 bp, Homo sapiens
tggctggcactaagt

SEQ ID NO: 291259 - DNA, 15 bp, Homo sapiens
gtggctggcactaag

SEQ ID NO: 291260 - DNA, 15 bp, Homo sapiens
tgtggctggcactaa

SEQ ID NO: 291261 - DNA, 15 bp, Homo sapiens
atgtggctggcacta

SEQ ID NO: 291262 - DNA, 15 bp, Homo sapiens
tatgtggctggcact

SEQ ID NO: 291263 - DNA, 15 bp, Homo sapiens
gtatgtggctggcac

SEQ ID NO: 291264 - DNA, 15 bp, Homo sapiens
tgtatgtggctggca

SEQ ID NO: 291265 - DNA, 15 bp, Homo sapiens
atgtatgtggctggc

SEQ ID NO: 291266 - DNA, 15 bp, Homo sapiens
aatgtatgtggctgg

SEQ ID NO: 291267 - DNA, 15 bp, Homo sapiens
caatgtatgtggctg

SEQ ID NO: 291268 - DNA, 15 bp, Homo sapiens
tcaatgtatgtggct

SEQ ID NO: 291269 - DNA, 15 bp, Homo sapiens
ttcaatgtatgtggc

SEQ ID NO: 291270 - DNA, 15 bp, Homo sapiens
tttcaatgtatgtgg

SEQ ID NO: 291271 - DNA, 15 bp, Homo sapiens
ttttcaatgtatgtg

SEQ ID NO: 291272 - DNA, 15 bp, Homo sapiens
gttttcaatgtatgt

SEQ ID NO: 291273 - DNA, 15 bp, Homo sapiens
cgttttcaatgtatg

SEQ ID NO: 291274 - DNA, 15 bp, Homo sapiens
acgttttcaatgtat

SEQ ID NO: 291275 - DNA, 15 bp, Homo sapiens
aacgttttcaatgta

SEQ ID NO: 291276 - DNA, 15 bp, Homo sapiens
taacgttttcaatgt

SEQ ID NO: 291277 - DNA, 15 bp, Homo sapiens
gtaacgttttcaatg

SEQ ID NO: 291278 - DNA, 15 bp, Homo sapiens
tgtaacgttttcaat

SEQ ID NO: 291279 - DNA, 15 bp, Homo sapiens
atgtaacgttttcaa

SEQ ID NO: 291280 - DNA, 15 bp, Homo sapiens
aatgtaacgttttca

SEQ ID NO: 291281 - DNA, 15 bp, Homo sapiens
aaatgtaacgttttc

SEQ ID NO: 291282 - DNA, 15 bp, Homo sapiens
aaaatgtaacgtttt

SEQ ID NO: 291283 - DNA, 15 bp, Homo sapiens
aaaaatgtaacgttt

SEQ ID NO: 291284 - DNA, 15 bp, Homo sapiens
gaaaaatgtaacgtt

SEQ ID NO: 291285 - DNA, 15 bp, Homo sapiens
tgaaaaatgtaacgt

SEQ ID NO: 291286 - DNA, 15 bp, Homo sapiens
atgaaaaatgtaacg

SEQ ID NO: 291287 - DNA, 15 bp, Homo sapiens
aatgaaaaatgtaac

SEQ ID NO: 291288 - DNA, 15 bp, Homo sapiens
gaatgaaaaatgtaa

SEQ ID NO: 291289 - DNA, 15 bp, Homo sapiens
ggaatgaaaaatgta

SEQ ID NO: 291290 - DNA, 15 bp, Homo sapiens
cggaatgaaaaatgt

SEQ ID NO: 291291 - DNA, 15 bp, Homo sapiens
gcggaatgaaaaatg

SEQ ID NO: 291292 - DNA, 15 bp, Homo sapiens
cgcggaatgaaaaat

SEQ ID NO: 291293 - DNA, 15 bp, Homo sapiens
tcgcggaatgaaaaa

SEQ ID NO: 291294 - DNA, 15 bp, Homo sapiens
ttcgcggaatgaaaa

SEQ ID NO: 291295 - DNA, 15 bp, Homo sapiens
gttcgcggaatgaaa

SEQ ID NO: 291296 - DNA, 15 bp, Homo sapiens
agttcgcggaatgaa

SEQ ID NO: 291297 - DNA, 15 bp, Homo sapiens
aagttcgcggaatga

SEQ ID NO: 291298 - DNA, 15 bp, Homo sapiens
caagttcgcggaatg

SEQ ID NO: 291299 - DNA, 15 bp, Homo sapiens
tcaagttcgcggaat

SEQ ID NO: 291300 - DNA, 15 bp, Homo sapiens
ttcaagttcgcggaa

SEQ ID NO: 291301 - DNA, 15 bp, Homo sapiens
cttcaagttcgcgga

SEQ ID NO: 291302 - DNA, 15 bp, Homo sapiens
acttcaagttcgcgg

SEQ ID NO: 291303 - DNA, 15 bp, Homo sapiens
aacttcaagttcgcg

SEQ ID NO: 291304 - DNA, 15 bp, Homo sapiens
aaacttcaagttcgc

SEQ ID NO: 291305 - DNA, 15 bp, Homo sapiens
gaaacttcaagttcg

SEQ ID NO: 291306 - DNA, 15 bp, Homo sapiens
ggaaacttcaagttc

SEQ ID NO: 291307 - DNA, 15 bp, Homo sapiens
tggaaacttcaagtt

SEQ ID NO: 291308 - DNA, 15 bp, Homo sapiens
ttggaaacttcaagt

SEQ ID NO: 291309 - DNA, 15 bp, Homo sapiens
tttggaaacttcaag

SEQ ID NO: 291310 - DNA, 15 bp, Homo sapiens
atttggaaacttcaa

SEQ ID NO: 291311 - DNA, 15 bp, Homo sapiens
catttggaaacttca

SEQ ID NO: 291312 - DNA, 15 bp, Homo sapiens
ccatttggaaacttc

SEQ ID NO: 291313 - DNA, 15 bp, Homo sapiens
accatttggaaactt

SEQ ID NO: 291314 - DNA, 15 bp, Homo sapiens
caccatttggaaact

SEQ ID NO: 291315 - DNA, 15 bp, Homo sapiens
gcaccatttggaaac

SEQ ID NO: 291316 - DNA, 15 bp, Homo sapiens
agcaccatttggaaa

SEQ ID NO: 291317 - DNA, 15 bp, Homo sapiens
cagcaccatttggaa

SEQ ID NO: 291318 - DNA, 15 bp, Homo sapiens
acagcaccatttgga

SEQ ID NO: 291319 - DNA, 15 bp, Homo sapiens
cacagcaccatttgg

SEQ ID NO: 291320 - DNA, 15 bp, Homo sapiens
acacagcaccatttg

SEQ ID NO: 291321 - DNA, 15 bp, Homo sapiens
tacacagcaccattt

SEQ ID NO: 291322 - DNA, 15 bp, Homo sapiens
ttacacagcaccatt

SEQ ID NO: 291323 - DNA, 15 bp, Homo sapiens
cttacacagcaccat

SEQ ID NO: 291324 - DNA, 15 bp, Homo sapiens
ccttacacagcacca

SEQ ID NO: 291325 - DNA, 15 bp, Homo sapiens
cccttacacagcacc

SEQ ID NO: 291326 - DNA, 15 bp, Homo sapiens
tcccttacacagcac

SEQ ID NO: 291327 - DNA, 15 bp, Homo sapiens
atcccttacacagca

SEQ ID NO: 291328 - DNA, 15 bp, Homo sapiens
catcccttacacagc

SEQ ID NO: 291329 - DNA, 15 bp, Homo sapiens
ccatcccttacacag

SEQ ID NO: 291330 - DNA, 15 bp, Homo sapiens
tccatcccttacaca

SEQ ID NO: 291331 - DNA, 15 bp, Homo sapiens
atccatcccttacac

SEQ ID NO: 291332 - DNA, 15 bp, Homo sapiens
aatccatcccttaca

SEQ ID NO: 291333 - DNA, 15 bp, Homo sapiens
aaatccatcccttac

SEQ ID NO: 291334 - DNA, 15 bp, Homo sapiens
aaaatccatccctta

SEQ ID NO: 291335 - DNA, 15 bp, Homo sapiens
gaaaatccatccctt

SEQ ID NO: 291336 - DNA, 15 bp, Homo sapiens
agaaaatccatccct

SEQ ID NO: 291337 - DNA, 15 bp, Homo sapiens
gagaaaatccatccc

SEQ ID NO: 291338 - DNA, 15 bp, Homo sapiens
agagaaaatccatcc

SEQ ID NO: 291339 - DNA, 15 bp, Homo sapiens
aagagaaaatccatc

SEQ ID NO: 291340 - DNA, 15 bp, Homo sapiens
caagagaaaatccat

SEQ ID NO: 291341 - DNA, 15 bp, Homo sapiens
gcaagagaaaatcca

SEQ ID NO: 291342 - DNA, 15 bp, Homo sapiens
tgcaagagaaaatcc

SEQ ID NO: 291343 - DNA, 15 bp, Homo sapiens
ttgcaagagaaaatc

SEQ ID NO: 291344 - DNA, 15 bp, Homo sapiens
attgcaagagaaaat

SEQ ID NO: 291345 - DNA, 15 bp, Homo sapiens
gattgcaagagaaaa

SEQ ID NO: 291346 - DNA, 15 bp, Homo sapiens
agattgcaagagaaa

SEQ ID NO: 291347 - DNA, 15 bp, Homo sapiens
gagattgcaagagaa

SEQ ID NO: 291348 - DNA, 15 bp, Homo sapiens
agagattgcaagaga

SEQ ID NO: 291349 - DNA, 15 bp, Homo sapiens
aagagattgcaagag

SEQ ID NO: 291350 - DNA, 15 bp, Homo sapiens
caagagattgcaaga

SEQ ID NO: 291351 - DNA, 15 bp, Homo sapiens
acaagagattgcaag

SEQ ID NO: 291352 - DNA, 15 bp, Homo sapiens
aacaagagattgcaa

SEQ ID NO: 291353 - DNA, 15 bp, Homo sapiens
aaacaagagattgca

SEQ ID NO: 291354 - DNA, 15 bp, Homo sapiens
taaacaagagattgc

SEQ ID NO: 291355 - DNA, 15 bp, Homo sapiens
ctaaacaagagattg

SEQ ID NO: 291356 - DNA, 15 bp, Homo sapiens
tctaaacaagagatt

SEQ ID NO: 291357 - DNA, 15 bp, Homo sapiens
ttctaaacaagagat

SEQ ID NO: 291358 - DNA, 15 bp, Homo sapiens
attctaaacaagaga

SEQ ID NO: 291359 - DNA, 15 bp, Homo sapiens
tattctaaacaagag

SEQ ID NO: 291360 - DNA, 15 bp, Homo sapiens
atattctaaacaaga

SEQ ID NO: 291361 - DNA, 15 bp, Homo sapiens
catattctaaacaag

SEQ ID NO: 291362 - DNA, 15 bp, Homo sapiens
tcatattctaaacaa

SEQ ID NO: 291363 - DNA, 15 bp, Homo sapiens
ttcatattctaaaca

SEQ ID NO: 291364 - DNA, 15 bp, Homo sapiens
cttcatattctaaac

SEQ ID NO: 291365 - DNA, 15 bp, Homo sapiens
acttcatattctaaa

SEQ ID NO: 291366 - DNA, 15 bp, Homo sapiens
cacttcatattctaa

SEQ ID NO: 291367 - DNA, 15 bp, Homo sapiens
acacttcatattcta

SEQ ID NO: 291368 - DNA, 15 bp, Homo sapiens
aacacttcatattct

SEQ ID NO: 291369 - DNA, 15 bp, Homo sapiens
taacacttcatattc

SEQ ID NO: 291370 - DNA, 15 bp, Homo sapiens
ctaacacttcatatt

SEQ ID NO: 291371 - DNA, 15 bp, Homo sapiens
actaacacttcatat

SEQ ID NO: 291372 - DNA, 15 bp, Homo sapiens
cactaacacttcata

SEQ ID NO: 291373 - DNA, 15 bp, Homo sapiens
acactaacacttcat

SEQ ID NO: 291374 - DNA, 15 bp, Homo sapiens
aacactaacacttca

SEQ ID NO: 291375 - DNA, 15 bp, Homo sapiens
taacactaacacttc

SEQ ID NO: 291376 - DNA, 15 bp, Homo sapiens
ttaacactaacactt

SEQ ID NO: 291377 - DNA, 15 bp, Homo sapiens
gttaacactaacact

SEQ ID NO: 291378 - DNA, 15 bp, Homo sapiens
tgttaacactaacac

SEQ ID NO: 291379 - DNA, 15 bp, Homo sapiens
ttgttaacactaaca

SEQ ID NO: 291380 - DNA, 15 bp, Homo sapiens
gttgttaacactaac

SEQ ID NO: 291381 - DNA, 15 bp, Homo sapiens
agttgttaacactaa

SEQ ID NO: 291382 - DNA, 15 bp, Homo sapiens
aagttgttaacacta

SEQ ID NO: 291383 - DNA, 15 bp, Homo sapiens
taagttgttaacact

SEQ ID NO: 291384 - DNA, 15 bp, Homo sapiens
ctaagttgttaacac

SEQ ID NO: 291385 - DNA, 15 bp, Homo sapiens
actaagttgttaaca

SEQ ID NO: 291386 - DNA, 15 bp, Homo sapiens
cactaagttgttaac

SEQ ID NO: 291387 - DNA, 15 bp, Homo sapiens
gcactaagttgttaa

SEQ ID NO: 291388 - DNA, 15 bp, Homo sapiens
tgcactaagttgtta

SEQ ID NO: 291389 - DNA, 15 bp, Homo sapiens
atgcactaagttgtt

SEQ ID NO: 291390 - DNA, 15 bp, Homo sapiens
tatgcactaagttgt

SEQ ID NO: 291391 - DNA, 15 bp, Homo sapiens
ctatgcactaagttg

SEQ ID NO: 291392 - DNA, 15 bp, Homo sapiens
cctatgcactaagtt

SEQ ID NO: 291393 - DNA, 15 bp, Homo sapiens
acctatgcactaagt

SEQ ID NO: 291394 - DNA, 15 bp, Homo sapiens
cacctatgcactaag

SEQ ID NO: 291395 - DNA, 15 bp, Homo sapiens
ccacctatgcactaa

SEQ ID NO: 291396 - DNA, 15 bp, Homo sapiens
tccacctatgcacta

SEQ ID NO: 291397 - DNA, 15 bp, Homo sapiens
ttccacctatgcact

SEQ ID NO: 291398 - DNA, 15 bp, Homo sapiens
attccacctatgcac

SEQ ID NO: 291399 - DNA, 15 bp, Homo sapiens
aattccacctatgca

SEQ ID NO: 291400 - DNA, 15 bp, Homo sapiens
caattccacctatgc

SEQ ID NO: 291401 - DNA, 15 bp, Homo sapiens
gcaattccacctatg

SEQ ID NO: 291402 - DNA, 15 bp, Homo sapiens
agcaattccacctat

SEQ ID NO: 291403 - DNA, 15 bp, Homo sapiens
tagcaattccaccta

SEQ ID NO: 291404 - DNA, 15 bp, Homo sapiens
gtagcaattccacct

SEQ ID NO: 291405 - DNA, 15 bp, Homo sapiens
tgtagcaattccacc

SEQ ID NO: 291406 - DNA, 15 bp, Homo sapiens
ctgtagcaattccac

SEQ ID NO: 291407 - DNA, 15 bp, Homo sapiens
tctgtagcaattcca

SEQ ID NO: 291408 - DNA, 15 bp, Homo sapiens
ttctgtagcaattcc

SEQ ID NO: 291409 - DNA, 15 bp, Homo sapiens
cttctgtagcaattc

SEQ ID NO: 291410 - DNA, 15 bp, Homo sapiens
ccttctgtagcaatt

SEQ ID NO: 291411 - DNA, 15 bp, Homo sapiens
tccttctgtagcaat

SEQ ID NO: 291412 - DNA, 15 bp, Homo sapiens
ttccttctgtagcaa

SEQ ID NO: 291413 - DNA, 15 bp, Homo sapiens
cttccttctgtagca

SEQ ID NO: 291414 - DNA, 15 bp, Homo sapiens
gcttccttctgtagc

SEQ ID NO: 291415 - DNA, 15 bp, Homo sapiens
agcttccttctgtag

SEQ ID NO: 291416 - DNA, 15 bp, Homo sapiens
cagcttccttctgta

SEQ ID NO: 291417 - DNA, 15 bp, Homo sapiens
acagcttccttctgt

SEQ ID NO: 291418 - DNA, 15 bp, Homo sapiens
cacagcttccttctg

SEQ ID NO: 291419 - DNA, 15 bp, Homo sapiens
gcacagcttccttct

SEQ ID NO: 291420 - DNA, 15 bp, Homo sapiens
agcacagcttccttc

SEQ ID NO: 291421 - DNA, 15 bp, Homo sapiens
gagcacagcttcctt

SEQ ID NO: 291422 - DNA, 15 bp, Homo sapiens
tgagcacagcttcct

SEQ ID NO: 291423 - DNA, 15 bp, Homo sapiens
ttgagcacagcttcc

SEQ ID NO: 291424 - DNA, 15 bp, Homo sapiens
tttgagcacagcttc

SEQ ID NO: 291425 - DNA, 15 bp, Homo sapiens
ttttgagcacagctt

SEQ ID NO: 291426 - DNA, 15 bp, Homo sapiens
gttttgagcacagct

SEQ ID NO: 291427 - DNA, 15 bp, Homo sapiens
ggttttgagcacagc

SEQ ID NO: 291428 - DNA, 15 bp, Homo sapiens
aggttttgagcacag

SEQ ID NO: 291429 - DNA, 15 bp, Homo sapiens
aaggttttgagcaca

SEQ ID NO: 291430 - DNA, 15 bp, Homo sapiens
aaaggttttgagcac

SEQ ID NO: 291431 - DNA, 15 bp, Homo sapiens
taaaggttttgagca

SEQ ID NO: 291432 - DNA, 15 bp, Homo sapiens
ataaaggttttgagc

SEQ ID NO: 291433 - DNA, 15 bp, Homo sapiens
aataaaggttttgag

SEQ ID NO: 291434 - DNA, 15 bp, Homo sapiens
aaataaaggttttga

SEQ ID NO: 291435 - DNA, 15 bp, Homo sapiens
caaataaaggttttg

SEQ ID NO: 291436 - DNA, 15 bp, Homo sapiens
gcaaataaaggtttt

SEQ ID NO: 291437 - DNA, 15 bp, Homo sapiens
ggcaaataaaggttt

SEQ ID NO: 291438 - DNA, 15 bp, Homo sapiens
tggcaaataaaggtt

SEQ ID NO: 291439 - DNA, 15 bp, Homo sapiens
atggcaaataaaggt

SEQ ID NO: 291440 - DNA, 15 bp, Homo sapiens
catggcaaataaagg

SEQ ID NO: 291441 - DNA, 15 bp, Homo sapiens
ccatggcaaataaag

SEQ ID NO: 291442 - DNA, 15 bp, Homo sapiens
gccatggcaaataaa

SEQ ID NO: 291443 - DNA, 15 bp, Homo sapiens
agccatggcaaataa

SEQ ID NO: 291444 - DNA, 15 bp, Homo sapiens
cagccatggcaaata

SEQ ID NO: 291445 - DNA, 15 bp, Homo sapiens
ccagccatggcaaat

SEQ ID NO: 291446 - DNA, 15 bp, Homo sapiens
accagccatggcaaa

SEQ ID NO: 291447 - DNA, 15 bp, Homo sapiens
aaccagccatggcaa

SEQ ID NO: 291448 - DNA, 15 bp, Homo sapiens
caaccagccatggca

SEQ ID NO: 291449 - DNA, 15 bp, Homo sapiens
tcaaccagccatggc

SEQ ID NO: 291450 - DNA, 15 bp, Homo sapiens
atcaaccagccatgg

SEQ ID NO: 291451 - DNA, 15 bp, Homo sapiens
catcaaccagccatg

SEQ ID NO: 291452 - DNA, 15 bp, Homo sapiens
gcatcaaccagccat

SEQ ID NO: 291453 - DNA, 15 bp, Homo sapiens
ggcatcaaccagcca

SEQ ID NO: 291454 - DNA, 15 bp, Homo sapiens
gggcatcaaccagcc

SEQ ID NO: 291455 - DNA, 15 bp, Homo sapiens
tgggcatcaaccagc

SEQ ID NO: 291456 - DNA, 15 bp, Homo sapiens
gtgggcatcaaccag

SEQ ID NO: 291457 - DNA, 15 bp, Homo sapiens
tgtgggcatcaacca

SEQ ID NO: 291458 - DNA, 15 bp, Homo sapiens
ctgtgggcatcaacc

SEQ ID NO: 291459 - DNA, 15 bp, Homo sapiens
cctgtgggcatcaac

SEQ ID NO: 291460 - DNA, 15 bp, Homo sapiens
tcctgtgggcatcaa

SEQ ID NO: 291461 - DNA, 15 bp, Homo sapiens
ctcctgtgggcatca

SEQ ID NO: 291462 - DNA, 15 bp, Homo sapiens
tctcctgtgggcatc

SEQ ID NO: 291463 - DNA, 15 bp, Homo sapiens
ctctcctgtgggcat

SEQ ID NO: 291464 - DNA, 15 bp, Homo sapiens
gctctcctgtgggca

SEQ ID NO: 291465 - DNA, 15 bp, Homo sapiens
tgctctcctgtgggc

SEQ ID NO: 291466 - DNA, 15 bp, Homo sapiens
ttgctctcctgtggg

SEQ ID NO: 291467 - DNA, 15 bp, Homo sapiens
tttgctctcctgtgg

SEQ ID NO: 291468 - DNA, 15 bp, Homo sapiens
ttttgctctcctgtg

SEQ ID NO: 291469 - DNA, 15 bp, Homo sapiens
cttttgctctcctgt

SEQ ID NO: 291470 - DNA, 15 bp, Homo sapiens
ccttttgctctcctg

SEQ ID NO: 291471 - DNA, 15 bp, Homo sapiens
gccttttgctctcct

SEQ ID NO: 291472 - DNA, 15 bp, Homo sapiens
agccttttgctctcc

SEQ ID NO: 291473 - DNA, 15 bp, Homo sapiens
aagccttttgctctc

SEQ ID NO: 291474 - DNA, 15 bp, Homo sapiens
aaagccttttgctct

SEQ ID NO: 291475 - DNA, 15 bp, Homo sapiens
aaaagccttttgctc

SEQ ID NO: 291476 - DNA, 15 bp, Homo sapiens
gaaaagccttttgct

SEQ ID NO: 291477 - DNA, 15 bp, Homo sapiens
agaaaagccttttgc

SEQ ID NO: 291478 - DNA, 15 bp, Homo sapiens
cagaaaagccttttg

SEQ ID NO: 291479 - DNA, 15 bp, Homo sapiens
acagaaaagcctttt

SEQ ID NO: 291480 - DNA, 15 bp, Homo sapiens
aacagaaaagccttt

SEQ ID NO: 291481 - DNA, 15 bp, Homo sapiens
gaacagaaaagcctt

SEQ ID NO: 291482 - DNA, 15 bp, Homo sapiens
tgaacagaaaagcct

SEQ ID NO: 291483 - DNA, 15 bp, Homo sapiens
gtgaacagaaaagcc

SEQ ID NO: 291484 - DNA, 15 bp, Homo sapiens
ggtgaacagaaaagc

SEQ ID NO: 291485 - DNA, 15 bp, Homo sapiens
gggtgaacagaaaag

SEQ ID NO: 291486 - DNA, 15 bp, Homo sapiens
agggtgaacagaaaa

SEQ ID NO: 291487 - DNA, 15 bp, Homo sapiens
aagggtgaacagaaa

SEQ ID NO: 291488 - DNA, 15 bp, Homo sapiens
caagggtgaacagaa

SEQ ID NO: 291489 - DNA, 15 bp, Homo sapiens
gcaagggtgaacaga

SEQ ID NO: 291490 - DNA, 15 bp, Homo sapiens
ggcaagggtgaacag

SEQ ID NO: 291491 - DNA, 15 bp, Homo sapiens
aggcaagggtgaaca

SEQ ID NO: 291492 - DNA, 15 bp, Homo sapiens
aaggcaagggtgaac

SEQ ID NO: 291493 - DNA, 15 bp, Homo sapiens
gaaggcaagggtgaa

SEQ ID NO: 291494 - DNA, 15 bp, Homo sapiens
ggaaggcaagggtga

SEQ ID NO: 291495 - DNA, 15 bp, Homo sapiens
gggaaggcaagggtg

SEQ ID NO: 291496 - DNA, 15 bp, Homo sapiens
ggggaaggcaagggt

SEQ ID NO: 291497 - DNA, 15 bp, Homo sapiens
aggggaaggcaaggg

SEQ ID NO: 291498 - DNA, 15 bp, Homo sapiens
taggggaaggcaagg

SEQ ID NO: 291499 - DNA, 15 bp, Homo sapiens
gtaggggaaggcaag

SEQ ID NO: 291500 - DNA, 15 bp, Homo sapiens
agtaggggaaggcaa

SEQ ID NO: 291501 - DNA, 15 bp, Homo sapiens
gagtaggggaaggca

SEQ ID NO: 291502 - DNA, 15 bp, Homo sapiens
ggagtaggggaaggc

SEQ ID NO: 291503 - DNA, 15 bp, Homo sapiens
gggagtaggggaagg

SEQ ID NO: 291504 - DNA, 15 bp, Homo sapiens
agggagtaggggaag

SEQ ID NO: 291505 - DNA, 15 bp, Homo sapiens
gagggagtaggggaa

SEQ ID NO: 291506 - DNA, 15 bp, Homo sapiens
ggagggagtagggga

SEQ ID NO: 291507 - DNA, 15 bp, Homo sapiens
tggagggagtagggg

SEQ ID NO: 291508 - DNA, 15 bp, Homo sapiens
atggagggagtaggg

SEQ ID NO: 291509 - DNA, 15 bp, Homo sapiens
gatggagggagtagg

SEQ ID NO: 291510 - DNA, 15 bp, Homo sapiens
ggatggagggagtag

SEQ ID NO: 291511 - DNA, 15 bp, Homo sapiens
gggatggagggagta

SEQ ID NO: 291512 - DNA, 15 bp, Homo sapiens
tgggatggagggagt

SEQ ID NO: 291513 - DNA, 15 bp, Homo sapiens
atgggatggagggag

SEQ ID NO: 291514 - DNA, 15 bp, Homo sapiens
aatgggatggaggga

SEQ ID NO: 291515 - DNA, 15 bp, Homo sapiens
taatgggatggaggg

SEQ ID NO: 291516 - DNA, 15 bp, Homo sapiens
ctaatgggatggagg

SEQ ID NO: 291517 - DNA, 15 bp, Homo sapiens
tctaatgggatggag

SEQ ID NO: 291518 - DNA, 15 bp, Homo sapiens
gtctaatgggatgga

SEQ ID NO: 291519 - DNA, 15 bp, Homo sapiens
tgtctaatgggatgg

SEQ ID NO: 291520 - DNA, 15 bp, Homo sapiens
ctgtctaatgggatg

SEQ ID NO: 291521 - DNA, 15 bp, Homo sapiens
actgtctaatgggat

SEQ ID NO: 291522 - DNA, 15 bp, Homo sapiens
cactgtctaatggga

SEQ ID NO: 291523 - DNA, 15 bp, Homo sapiens
gcactgtctaatggg

SEQ ID NO: 291524 - DNA, 15 bp, Homo sapiens
agcactgtctaatgg

SEQ ID NO: 291525 - DNA, 15 bp, Homo sapiens
cagcactgtctaatg

SEQ ID NO: 291526 - DNA, 15 bp, Homo sapiens
gcagcactgtctaat

SEQ ID NO: 291527 - DNA, 15 bp, Homo sapiens
ggcagcactgtctaa

SEQ ID NO: 291528 - DNA, 15 bp, Homo sapiens
aggcagcactgtcta

SEQ ID NO: 291529 - DNA, 15 bp, Homo sapiens
caggcagcactgtct

SEQ ID NO: 291530 - DNA, 15 bp, Homo sapiens
tcaggcagcactgtc

SEQ ID NO: 291531 - DNA, 15 bp, Homo sapiens
atcaggcagcactgt

SEQ ID NO: 291532 - DNA, 15 bp, Homo sapiens
catcaggcagcactg

SEQ ID NO: 291533 - DNA, 15 bp, Homo sapiens
ccatcaggcagcact

SEQ ID NO: 291534 - DNA, 15 bp, Homo sapiens
gccatcaggcagcac

SEQ ID NO: 291535 - DNA, 15 bp, Homo sapiens
agccatcaggcagca

SEQ ID NO: 291536 - DNA, 15 bp, Homo sapiens
gagccatcaggcagc

SEQ ID NO: 291537 - DNA, 15 bp, Homo sapiens
tgagccatcaggcag

SEQ ID NO: 291538 - DNA, 15 bp, Homo sapiens
atgagccatcaggca

SEQ ID NO: 291539 - DNA, 15 bp, Homo sapiens
catgagccatcaggc

SEQ ID NO: 291540 - DNA, 15 bp, Homo sapiens
acatgagccatcagg

SEQ ID NO: 291541 - DNA, 15 bp, Homo sapiens
cacatgagccatcag

SEQ ID NO: 291542 - DNA, 15 bp, Homo sapiens
gcacatgagccatca

SEQ ID NO: 291543 - DNA, 15 bp, Homo sapiens
ggcacatgagccatc

SEQ ID NO: 291544 - DNA, 15 bp, Homo sapiens
aggcacatgagccat

SEQ ID NO: 291545 - DNA, 15 bp, Homo sapiens
aaggcacatgagcca

SEQ ID NO: 291546 - DNA, 15 bp, Homo sapiens
caaggcacatgagcc

SEQ ID NO: 291547 - DNA, 15 bp, Homo sapiens
tcaaggcacatgagc

SEQ ID NO: 291548 - DNA, 15 bp, Homo sapiens
ctcaaggcacatgag

SEQ ID NO: 291549 - DNA, 15 bp, Homo sapiens
tctcaaggcacatga

SEQ ID NO: 291550 - DNA, 15 bp, Homo sapiens
ttctcaaggcacatg

SEQ ID NO: 291551 - DNA, 15 bp, Homo sapiens
attctcaaggcacat

SEQ ID NO: 291552 - DNA, 15 bp, Homo sapiens
gattctcaaggcaca

SEQ ID NO: 291553 - DNA, 15 bp, Homo sapiens
tgattctcaaggcac

SEQ ID NO: 291554 - DNA, 15 bp, Homo sapiens
gtgattctcaaggca

SEQ ID NO: 291555 - DNA, 15 bp, Homo sapiens
tgtgattctcaaggc

SEQ ID NO: 291556 - DNA, 15 bp, Homo sapiens
atgtgattctcaagg

SEQ ID NO: 291557 - DNA, 15 bp, Homo sapiens
tatgtgattctcaag

SEQ ID NO: 291558 - DNA, 15 bp, Homo sapiens
ctatgtgattctcaa

SEQ ID NO: 291559 - DNA, 15 bp, Homo sapiens
gctatgtgattctca

SEQ ID NO: 291560 - DNA, 15 bp, Homo sapiens
tgctatgtgattctc

SEQ ID NO: 291561 - DNA, 15 bp, Homo sapiens
ttgctatgtgattct

SEQ ID NO: 291562 - DNA, 15 bp, Homo sapiens
attgctatgtgattc

SEQ ID NO: 291563 - DNA, 15 bp, Homo sapiens
cattgctatgtgatt

SEQ ID NO: 291564 - DNA, 15 bp, Homo sapiens
gcattgctatgtgat

SEQ ID NO: 291565 - DNA, 15 bp, Homo sapiens
agcattgctatgtga

SEQ ID NO: 291566 - DNA, 15 bp, Homo sapiens
aagcattgctatgtg

SEQ ID NO: 291567 - DNA, 15 bp, Homo sapiens
aaagcattgctatgt

SEQ ID NO: 291568 - DNA, 15 bp, Homo sapiens
aaaagcattgctatg

SEQ ID NO: 291569 - DNA, 15 bp, Homo sapiens
taaaagcattgctat

SEQ ID NO: 291570 - DNA, 15 bp, Homo sapiens
ctaaaagcattgcta

SEQ ID NO: 291571 - DNA, 15 bp, Homo sapiens
tctaaaagcattgct

SEQ ID NO: 291572 - DNA, 15 bp, Homo sapiens
ctctaaaagcattgc

SEQ ID NO: 291573 - DNA, 15 bp, Homo sapiens
tctctaaaagcattg

SEQ ID NO: 291574 - DNA, 15 bp, Homo sapiens
atctctaaaagcatt

SEQ ID NO: 291575 - DNA, 15 bp, Homo sapiens
tatctctaaaagcat

SEQ ID NO: 291576 - DNA, 15 bp, Homo sapiens
ctatctctaaaagca

SEQ ID NO: 291577 - DNA, 15 bp, Homo sapiens
gctatctctaaaagc

SEQ ID NO: 291578 - DNA, 15 bp, Homo sapiens
agctatctctaaaag

SEQ ID NO: 291579 - DNA, 15 bp, Homo sapiens
tagctatctctaaaa

SEQ ID NO: 291580 - DNA, 15 bp, Homo sapiens
ttagctatctctaaa

SEQ ID NO: 291581 - DNA, 15 bp, Homo sapiens
attagctatctctaa

SEQ ID NO: 291582 - DNA, 15 bp, Homo sapiens
tattagctatctcta

SEQ ID NO: 291583 - DNA, 15 bp, Homo sapiens
atattagctatctct

SEQ ID NO: 291584 - DNA, 15 bp, Homo sapiens
gatattagctatctc

SEQ ID NO: 291585 - DNA, 15 bp, Homo sapiens
ggatattagctatct

SEQ ID NO: 291586 - DNA, 15 bp, Homo sapiens
tggatattagctatc

SEQ ID NO: 291587 - DNA, 15 bp, Homo sapiens
ttggatattagctat

SEQ ID NO: 291588 - DNA, 15 bp, Homo sapiens
tttggatattagcta

SEQ ID NO: 291589 - DNA, 15 bp, Homo sapiens
atttggatattagct

SEQ ID NO: 291590 - DNA, 15 bp, Homo sapiens
catttggatattagc

SEQ ID NO: 291591 - DNA, 15 bp, Homo sapiens
ccatttggatattag

SEQ ID NO: 291592 - DNA, 15 bp, Homo sapiens
gccatttggatatta

SEQ ID NO: 291593 - DNA, 15 bp, Homo sapiens
agccatttggatatt

SEQ ID NO: 291594 - DNA, 15 bp, Homo sapiens
aagccatttggatat

SEQ ID NO: 291595 - DNA, 15 bp, Homo sapiens
gaagccatttggata

SEQ ID NO: 291596 - DNA, 15 bp, Homo sapiens
agaagccatttggat

SEQ ID NO: 291597 - DNA, 15 bp, Homo sapiens
tagaagccatttgga

SEQ ID NO: 291598 - DNA, 15 bp, Homo sapiens
atagaagccatttgg

SEQ ID NO: 291599 - DNA, 15 bp, Homo sapiens
tatagaagccatttg

SEQ ID NO: 291600 - DNA, 15 bp, Homo sapiens
atatagaagccattt

SEQ ID NO: 291601 - DNA, 15 bp, Homo sapiens
gatatagaagccatt

SEQ ID NO: 291602 - DNA, 15 bp, Homo sapiens
ggatatagaagccat

SEQ ID NO: 291603 - DNA, 15 bp, Homo sapiens
tggatatagaagcca

SEQ ID NO: 291604 - DNA, 15 bp, Homo sapiens
ttggatatagaagcc

SEQ ID NO: 291605 - DNA, 15 bp, Homo sapiens
cttggatatagaagc

SEQ ID NO: 291606 - DNA, 15 bp, Homo sapiens
tcttggatatagaag

SEQ ID NO: 291607 - DNA, 15 bp, Homo sapiens
gtcttggatatagaa

SEQ ID NO: 291608 - DNA, 15 bp, Homo sapiens
agtcttggatataga

SEQ ID NO: 291609 - DNA, 15 bp, Homo sapiens
cagtcttggatatag

SEQ ID NO: 291610 - DNA, 15 bp, Homo sapiens
gcagtcttggatata

SEQ ID NO: 291611 - DNA, 15 bp, Homo sapiens
tgcagtcttggatat

SEQ ID NO: 291612 - DNA, 15 bp, Homo sapiens
ctgcagtcttggata

SEQ ID NO: 291613 - DNA, 15 bp, Homo sapiens
tctgcagtcttggat

SEQ ID NO: 291614 - DNA, 15 bp, Homo sapiens
ctctgcagtcttgga

SEQ ID NO: 291615 - DNA, 15 bp, Homo sapiens
gctctgcagtcttgg

SEQ ID NO: 291616 - DNA, 15 bp, Homo sapiens
agctctgcagtcttg

SEQ ID NO: 291617 - DNA, 15 bp, Homo sapiens
gagctctgcagtctt

SEQ ID NO: 291618 - DNA, 15 bp, Homo sapiens
agagctctgcagtct

SEQ ID NO: 291619 - DNA, 15 bp, Homo sapiens
aagagctctgcagtc

SEQ ID NO: 291620 - DNA, 15 bp, Homo sapiens
taagagctctgcagt

SEQ ID NO: 291621 - DNA, 15 bp, Homo sapiens
ataagagctctgcag

SEQ ID NO: 291622 - DNA, 15 bp, Homo sapiens
gataagagctctgca

SEQ ID NO: 291623 - DNA, 15 bp, Homo sapiens
agataagagctctgc

SEQ ID NO: 291624 - DNA, 15 bp, Homo sapiens
gagataagagctctg

SEQ ID NO: 291625 - DNA, 15 bp, Homo sapiens
agagataagagctct

SEQ ID NO: 291626 - DNA, 15 bp, Homo sapiens
aagagataagagctc

SEQ ID NO: 291627 - DNA, 15 bp, Homo sapiens
gaagagataagagct

SEQ ID NO: 291628 - DNA, 15 bp, Homo sapiens
agaagagataagagc

SEQ ID NO: 291629 - DNA, 15 bp, Homo sapiens
tagaagagataagag

SEQ ID NO: 291630 - DNA, 15 bp, Homo sapiens
ttagaagagataaga

SEQ ID NO: 291631 - DNA, 15 bp, Homo sapiens
tttagaagagataag

SEQ ID NO: 291632 - DNA, 15 bp, Homo sapiens
gtttagaagagataa

SEQ ID NO: 291633 - DNA, 15 bp, Homo sapiens
tgtttagaagagata

SEQ ID NO: 291634 - DNA, 15 bp, Homo sapiens
ttgtttagaagagat

SEQ ID NO: 291635 - DNA, 15 bp, Homo sapiens
attgtttagaagaga

SEQ ID NO: 291636 - DNA, 15 bp, Homo sapiens
aattgtttagaagag

SEQ ID NO: 291637 - DNA, 15 bp, Homo sapiens
aaattgtttagaaga

SEQ ID NO: 291638 - DNA, 15 bp, Homo sapiens
taaattgtttagaag

SEQ ID NO: 291639 - DNA, 15 bp, Homo sapiens
ctaaattgtttagaa

SEQ ID NO: 291640 - DNA, 15 bp, Homo sapiens
cctaaattgtttaga

SEQ ID NO: 291641 - DNA, 15 bp, Homo sapiens
tcctaaattgtttag

SEQ ID NO: 291642 - DNA, 15 bp, Homo sapiens
atcctaaattgttta

SEQ ID NO: 291643 - DNA, 15 bp, Homo sapiens
catcctaaattgttt

SEQ ID NO: 291644 - DNA, 15 bp, Homo sapiens
tcatcctaaattgtt

SEQ ID NO: 291645 - DNA, 15 bp, Homo sapiens
atcatcctaaattgt

SEQ ID NO: 291646 - DNA, 15 bp, Homo sapiens
catcatcctaaattg

SEQ ID NO: 291647 - DNA, 15 bp, Homo sapiens
tcatcatcctaaatt

SEQ ID NO: 291648 - DNA, 15 bp, Homo sapiens
ttcatcatcctaaat

SEQ ID NO: 291649 - DNA, 15 bp, Homo sapiens
attcatcatcctaaa

SEQ ID NO: 291650 - DNA, 15 bp, Homo sapiens
cattcatcatcctaa

SEQ ID NO: 291651 - DNA, 15 bp, Homo sapiens
gcattcatcatccta

SEQ ID NO: 291652 - DNA, 15 bp, Homo sapiens
agcattcatcatcct

SEQ ID NO: 291653 - DNA, 15 bp, Homo sapiens
tagcattcatcatcc

SEQ ID NO: 291654 - DNA, 15 bp, Homo sapiens
ctagcattcatcatc

SEQ ID NO: 291655 - DNA, 15 bp, Homo sapiens
tctagcattcatcat

SEQ ID NO: 291656 - DNA, 15 bp, Homo sapiens
ttctagcattcatca

SEQ ID NO: 291657 - DNA, 15 bp, Homo sapiens
cttctagcattcatc

SEQ ID NO: 291658 - DNA, 15 bp, Homo sapiens
acttctagcattcat

SEQ ID NO: 291659 - DNA, 15 bp, Homo sapiens
tacttctagcattca

SEQ ID NO: 291660 - DNA, 15 bp, Homo sapiens
ctacttctagcattc

SEQ ID NO: 291661 - DNA, 15 bp, Homo sapiens
tctacttctagcatt

SEQ ID NO: 291662 - DNA, 15 bp, Homo sapiens
atctacttctagcat

SEQ ID NO: 291663 - DNA, 15 bp, Homo sapiens
catctacttctagca

SEQ ID NO: 291664 - DNA, 15 bp, Homo sapiens
ccatctacttctagc

SEQ ID NO: 291665 - DNA, 15 bp, Homo sapiens
tccatctacttctag

SEQ ID NO: 291666 - DNA, 15 bp, Homo sapiens
ttccatctacttcta

SEQ ID NO: 291667 - DNA, 15 bp, Homo sapiens
tttccatctacttct

SEQ ID NO: 291668 - DNA, 15 bp, Homo sapiens
ttttccatctacttc

SEQ ID NO: 291669 - DNA, 15 bp, Homo sapiens
attttccatctactt

SEQ ID NO: 291670 - DNA, 15 bp, Homo sapiens
aattttccatctact

SEQ ID NO: 291671 - DNA, 15 bp, Homo sapiens
gaattttccatctac

SEQ ID NO: 291672 - DNA, 15 bp, Homo sapiens
tgaattttccatcta

SEQ ID NO: 291673 - DNA, 15 bp, Homo sapiens
ttgaattttccatct

SEQ ID NO: 291674 - DNA, 15 bp, Homo sapiens
gttgaattttccatc

SEQ ID NO: 291675 - DNA, 15 bp, Homo sapiens
agttgaattttccat

SEQ ID NO: 291676 - DNA, 15 bp, Homo sapiens
gagttgaattttcca

SEQ ID NO: 291677 - DNA, 15 bp, Homo sapiens
agagttgaattttcc

SEQ ID NO: 291678 - DNA, 15 bp, Homo sapiens
tagagttgaattttc

SEQ ID NO: 291679 - DNA, 15 bp, Homo sapiens
ttagagttgaatttt

SEQ ID NO: 291680 - DNA, 15 bp, Homo sapiens
attagagttgaattt

SEQ ID NO: 291681 - DNA, 15 bp, Homo sapiens
tattagagttgaatt

SEQ ID NO: 291682 - DNA, 15 bp, Homo sapiens
ctattagagttgaat

SEQ ID NO: 291683 - DNA, 15 bp, Homo sapiens
actattagagttgaa

SEQ ID NO: 291684 - DNA, 15 bp, Homo sapiens
tactattagagttga

SEQ ID NO: 291685 - DNA, 15 bp, Homo sapiens
ttactattagagttg

SEQ ID NO: 291686 - DNA, 15 bp, Homo sapiens
tttactattagagtt

SEQ ID NO: 291687 - DNA, 15 bp, Homo sapiens
ttttactattagagt

SEQ ID NO: 291688 - DNA, 15 bp, Homo sapiens
tttttactattagag

SEQ ID NO: 291689 - DNA, 15 bp, Homo sapiens
gtttttactattaga

SEQ ID NO: 291690 - DNA, 15 bp, Homo sapiens
agtttttactattag

SEQ ID NO: 291691 - DNA, 15 bp, Homo sapiens
tagtttttactatta

SEQ ID NO: 291692 - DNA, 15 bp, Homo sapiens
ctagtttttactatt

SEQ ID NO: 291693 - DNA, 15 bp, Homo sapiens
gctagtttttactat

SEQ ID NO: 291694 - DNA, 15 bp, Homo sapiens
tgctagtttttacta

SEQ ID NO: 291695 - DNA, 15 bp, Homo sapiens
ctgctagtttttact

SEQ ID NO: 291696 - DNA, 15 bp, Homo sapiens
tctgctagtttttac

SEQ ID NO: 291697 - DNA, 15 bp, Homo sapiens
ttctgctagttttta

SEQ ID NO: 291698 - DNA, 15 bp, Homo sapiens
gttctgctagttttt

SEQ ID NO: 291699 - DNA, 15 bp, Homo sapiens
agttctgctagtttt

SEQ ID NO: 291700 - DNA, 15 bp, Homo sapiens
tagttctgctagttt

SEQ ID NO: 291701 - DNA, 15 bp, Homo sapiens
gtagttctgctagtt

SEQ ID NO: 291702 - DNA, 15 bp, Homo sapiens
ggtagttctgctagt

SEQ ID NO: 291703 - DNA, 15 bp, Homo sapiens
tggtagttctgctag

SEQ ID NO: 291704 - DNA, 15 bp, Homo sapiens
ctggtagttctgcta

SEQ ID NO: 291705 - DNA, 15 bp, Homo sapiens
cctggtagttctgct

SEQ ID NO: 291706 - DNA, 15 bp, Homo sapiens
gcctggtagttctgc

SEQ ID NO: 291707 - DNA, 15 bp, Homo sapiens
agcctggtagttctg

SEQ ID NO: 291708 - DNA, 15 bp, Homo sapiens
aagcctggtagttct

SEQ ID NO: 291709 - DNA, 15 bp, Homo sapiens
gaagcctggtagttc

SEQ ID NO: 291710 - DNA, 15 bp, Homo sapiens
tgaagcctggtagtt

SEQ ID NO: 291711 - DNA, 15 bp, Homo sapiens
ttgaagcctggtagt

SEQ ID NO: 291712 - DNA, 15 bp, Homo sapiens
gttgaagcctggtag

SEQ ID NO: 291713 - DNA, 15 bp, Homo sapiens
agttgaagcctggta

SEQ ID NO: 291714 - DNA, 15 bp, Homo sapiens
tagttgaagcctggt

SEQ ID NO: 291715 - DNA, 15 bp, Homo sapiens
ttagttgaagcctgg

SEQ ID NO: 291716 - DNA, 15 bp, Homo sapiens
attagttgaagcctg

SEQ ID NO: 291717 - DNA, 15 bp, Homo sapiens
tattagttgaagcct

SEQ ID NO: 291718 - DNA, 15 bp, Homo sapiens
atattagttgaagcc

SEQ ID NO: 291719 - DNA, 15 bp, Homo sapiens
tatattagttgaagc

SEQ ID NO: 291720 - DNA, 15 bp, Homo sapiens
ctatattagttgaag

SEQ ID NO: 291721 - DNA, 15 bp, Homo sapiens
tctatattagttgaa

SEQ ID NO: 291722 - DNA, 15 bp, Homo sapiens
atctatattagttga

SEQ ID NO: 291723 - DNA, 15 bp, Homo sapiens
aatctatattagttg

SEQ ID NO: 291724 - DNA, 15 bp, Homo sapiens
aaatctatattagtt

SEQ ID NO: 291725 - DNA, 15 bp, Homo sapiens
taaatctatattagt

SEQ ID NO: 291726 - DNA, 15 bp, Homo sapiens
ttaaatctatattag

SEQ ID NO: 291727 - DNA, 15 bp, Homo sapiens
attaaatctatatta

SEQ ID NO: 291728 - DNA, 15 bp, Homo sapiens
cattaaatctatatt

SEQ ID NO: 291729 - DNA, 15 bp, Homo sapiens
ccattaaatctatat

SEQ ID NO: 291730 - DNA, 15 bp, Homo sapiens
tccattaaatctata

SEQ ID NO: 291731 - DNA, 15 bp, Homo sapiens
ttccattaaatctat

SEQ ID NO: 291732 - DNA, 15 bp, Homo sapiens
tttccattaaatcta

SEQ ID NO: 291733 - DNA, 15 bp, Homo sapiens
ttttccattaaatct

SEQ ID NO: 291734 - DNA, 15 bp, Homo sapiens
tttttccattaaatc

SEQ ID NO: 291735 - DNA, 15 bp, Homo sapiens
atttttccattaaat

SEQ ID NO: 291736 - DNA, 15 bp, Homo sapiens
gatttttccattaaa

SEQ ID NO: 291737 - DNA, 15 bp, Homo sapiens
agatttttccattaa

SEQ ID NO: 291738 - DNA, 15 bp, Homo sapiens
cagatttttccatta

SEQ ID NO: 291739 - DNA, 15 bp, Homo sapiens
gcagatttttccatt

SEQ ID NO: 291740 - DNA, 15 bp, Homo sapiens
tgcagatttttccat

SEQ ID NO: 291741 - DNA, 15 bp, Homo sapiens
atgcagatttttcca

SEQ ID NO: 291742 - DNA, 15 bp, Homo sapiens
catgcagatttttcc

SEQ ID NO: 291743 - DNA, 15 bp, Homo sapiens
tcatgcagatttttc

SEQ ID NO: 291744 - DNA, 15 bp, Homo sapiens
ttcatgcagattttt

SEQ ID NO: 291745 - DNA, 15 bp, Homo sapiens
tttcatgcagatttt

SEQ ID NO: 291746 - DNA, 15 bp, Homo sapiens
ttttcatgcagattt

SEQ ID NO: 291747 - DNA, 15 bp, Homo sapiens
tttttcatgcagatt

SEQ ID NO: 291748 - DNA, 15 bp, Homo sapiens
gtttttcatgcagat

SEQ ID NO: 291749 - DNA, 15 bp, Homo sapiens
agtttttcatgcaga

SEQ ID NO: 291750 - DNA, 15 bp, Homo sapiens
aagtttttcatgcag

SEQ ID NO: 291751 - DNA, 15 bp, Homo sapiens
caagtttttcatgca

SEQ ID NO: 291752 - DNA, 15 bp, Homo sapiens
acaagtttttcatgc

SEQ ID NO: 291753 - DNA, 15 bp, Homo sapiens
tacaagtttttcatg

SEQ ID NO: 291754 - DNA, 15 bp, Homo sapiens
ttacaagtttttcat

SEQ ID NO: 291755 - DNA, 15 bp, Homo sapiens
gttacaagtttttca

SEQ ID NO: 291756 - DNA, 15 bp, Homo sapiens
tgttacaagtttttc

SEQ ID NO: 291757 - DNA, 15 bp, Homo sapiens
atgttacaagttttt

SEQ ID NO: 291758 - DNA, 15 bp, Homo sapiens
gatgttacaagtttt

SEQ ID NO: 291759 - DNA, 15 bp, Homo sapiens
agatgttacaagttt

SEQ ID NO: 291760 - DNA, 15 bp, Homo sapiens
cagatgttacaagtt

SEQ ID NO: 291761 - DNA, 15 bp, Homo sapiens
gcagatgttacaagt

SEQ ID NO: 291762 - DNA, 15 bp, Homo sapiens
tgcagatgttacaag

SEQ ID NO: 291763 - DNA, 15 bp, Homo sapiens
atgcagatgttacaa

SEQ ID NO: 291764 - DNA, 15 bp, Homo sapiens
aatgcagatgttaca

SEQ ID NO: 291765 - DNA, 15 bp, Homo sapiens
gaatgcagatgttac

SEQ ID NO: 291766 - DNA, 15 bp, Homo sapiens
ggaatgcagatgtta

SEQ ID NO: 291767 - DNA, 15 bp, Homo sapiens
gggaatgcagatgtt

SEQ ID NO: 291768 - DNA, 15 bp, Homo sapiens
agggaatgcagatgt

SEQ ID NO: 291769 - DNA, 15 bp, Homo sapiens
tagggaatgcagatg

SEQ ID NO: 291770 - DNA, 15 bp, Homo sapiens
atagggaatgcagat

SEQ ID NO: 291771 - DNA, 15 bp, Homo sapiens
tatagggaatgcaga

SEQ ID NO: 291772 - DNA, 15 bp, Homo sapiens
atatagggaatgcag

SEQ ID NO: 291773 - DNA, 15 bp, Homo sapiens
catatagggaatgca

SEQ ID NO: 291774 - DNA, 15 bp, Homo sapiens
tcatatagggaatgc

SEQ ID NO: 291775 - DNA, 15 bp, Homo sapiens
atcatatagggaatg

SEQ ID NO: 291776 - DNA, 15 bp, Homo sapiens
catcatatagggaat

SEQ ID NO: 291777 - DNA, 15 bp, Homo sapiens
ccatcatatagggaa

SEQ ID NO: 291778 - DNA, 15 bp, Homo sapiens
gccatcatataggga

SEQ ID NO: 291779 - DNA, 15 bp, Homo sapiens
agccatcatataggg

SEQ ID NO: 291780 - DNA, 15 bp, Homo sapiens
gagccatcatatagg

SEQ ID NO: 291781 - DNA, 15 bp, Homo sapiens
tgagccatcatatag

SEQ ID NO: 291782 - DNA, 15 bp, Homo sapiens
gtgagccatcatata

SEQ ID NO: 291783 - DNA, 15 bp, Homo sapiens
tgtgagccatcatat

SEQ ID NO: 291784 - DNA, 15 bp, Homo sapiens
gtgtgagccatcata

SEQ ID NO: 291785 - DNA, 15 bp, Homo sapiens
agtgtgagccatcat

SEQ ID NO: 291786 - DNA, 15 bp, Homo sapiens
aagtgtgagccatca

SEQ ID NO: 291787 - DNA, 15 bp, Homo sapiens
aaagtgtgagccatc

SEQ ID NO: 291788 - DNA, 15 bp, Homo sapiens
gaaagtgtgagccat

SEQ ID NO: 291789 - DNA, 15 bp, Homo sapiens
agaaagtgtgagcca

SEQ ID NO: 291790 - DNA, 15 bp, Homo sapiens
tagaaagtgtgagcc

SEQ ID NO: 291791 - DNA, 15 bp, Homo sapiens
ttagaaagtgtgagc

SEQ ID NO: 291792 - DNA, 15 bp, Homo sapiens
attagaaagtgtgag

SEQ ID NO: 291793 - DNA, 15 bp, Homo sapiens
aattagaaagtgtga

SEQ ID NO: 291794 - DNA, 15 bp, Homo sapiens
aaattagaaagtgtg

SEQ ID NO: 291795 - DNA, 15 bp, Homo sapiens
caaattagaaagtgt

SEQ ID NO: 291796 - DNA, 15 bp, Homo sapiens
tcaaattagaaagtg

SEQ ID NO: 291797 - DNA, 15 bp, Homo sapiens
gtcaaattagaaagt

SEQ ID NO: 291798 - DNA, 15 bp, Homo sapiens
ggtcaaattagaaag

SEQ ID NO: 291799 - DNA, 15 bp, Homo sapiens
tggtcaaattagaaa

SEQ ID NO: 291800 - DNA, 15 bp, Homo sapiens
atggtcaaattagaa

SEQ ID NO: 291801 - DNA, 15 bp, Homo sapiens
tatggtcaaattaga

SEQ ID NO: 291802 - DNA, 15 bp, Homo sapiens
atatggtcaaattag

SEQ ID NO: 291803 - DNA, 15 bp, Homo sapiens
tatatggtcaaatta

SEQ ID NO: 291804 - DNA, 15 bp, Homo sapiens
atatatggtcaaatt

SEQ ID NO: 291805 - DNA, 15 bp, Homo sapiens
aatatatggtcaaat

SEQ ID NO: 291806 - DNA, 15 bp, Homo sapiens
aaatatatggtcaaa

SEQ ID NO: 291807 - DNA, 15 bp, Homo sapiens
caaatatatggtcaa

SEQ ID NO: 291808 - DNA, 15 bp, Homo sapiens
acaaatatatggtca

SEQ ID NO: 291809 - DNA, 15 bp, Homo sapiens
gacaaatatatggtc

SEQ ID NO: 291810 - DNA, 15 bp, Homo sapiens
tgacaaatatatggt

SEQ ID NO: 291811 - DNA, 15 bp, Homo sapiens
ctgacaaatatatgg

SEQ ID NO: 291812 - DNA, 15 bp, Homo sapiens
gctgacaaatatatg

SEQ ID NO: 291813 - DNA, 15 bp, Homo sapiens
cgctgacaaatatat

SEQ ID NO: 291814 - DNA, 15 bp, Homo sapiens
acgctgacaaatata

SEQ ID NO: 291815 - DNA, 15 bp, Homo sapiens
tacgctgacaaatat

SEQ ID NO: 291816 - DNA, 15 bp, Homo sapiens
atacgctgacaaata

SEQ ID NO: 291817 - DNA, 15 bp, Homo sapiens
gatacgctgacaaat

SEQ ID NO: 291818 - DNA, 15 bp, Homo sapiens
ggatacgctgacaaa

SEQ ID NO: 291819 - DNA, 15 bp, Homo sapiens
tggatacgctgacaa

SEQ ID NO: 291820 - DNA, 15 bp, Homo sapiens
atggatacgctgaca

SEQ ID NO: 291821 - DNA, 15 bp, Homo sapiens
tatggatacgctgac

SEQ ID NO: 291822 - DNA, 15 bp, Homo sapiens
atatggatacgctga

SEQ ID NO: 291823 - DNA, 15 bp, Homo sapiens
aatatggatacgctg

SEQ ID NO: 291824 - DNA, 15 bp, Homo sapiens
caatatggatacgct

SEQ ID NO: 291825 - DNA, 15 bp, Homo sapiens
tcaatatggatacgc

SEQ ID NO: 291826 - DNA, 15 bp, Homo sapiens
ttcaatatggatacg

SEQ ID NO: 291827 - DNA, 15 bp, Homo sapiens
cttcaatatggatac

SEQ ID NO: 291828 - DNA, 15 bp, Homo sapiens
tcttcaatatggata

SEQ ID NO: 291829 - DNA, 15 bp, Homo sapiens
atcttcaatatggat

SEQ ID NO: 291830 - DNA, 15 bp, Homo sapiens
aatcttcaatatgga

SEQ ID NO: 291831 - DNA, 15 bp, Homo sapiens
aaatcttcaatatgg

SEQ ID NO: 291832 - DNA, 15 bp, Homo sapiens
caaatcttcaatatg

SEQ ID NO: 291833 - DNA, 15 bp, Homo sapiens
gcaaatcttcaatat

SEQ ID NO: 291834 - DNA, 15 bp, Homo sapiens
cgcaaatcttcaata

SEQ ID NO: 291835 - DNA, 15 bp, Homo sapiens
acgcaaatcttcaat

SEQ ID NO: 291836 - DNA, 15 bp, Homo sapiens
cacgcaaatcttcaa

SEQ ID NO: 291837 - DNA, 15 bp, Homo sapiens
tcacgcaaatcttca

SEQ ID NO: 291838 - DNA, 15 bp, Homo sapiens
ctcacgcaaatcttc

SEQ ID NO: 291839 - DNA, 15 bp, Homo sapiens
actcacgcaaatctt

SEQ ID NO: 291840 - DNA, 15 bp, Homo sapiens
cactcacgcaaatct

SEQ ID NO: 291841 - DNA, 15 bp, Homo sapiens
gcactcacgcaaatc

SEQ ID NO: 291842 - DNA, 15 bp, Homo sapiens
ggcactcacgcaaat

SEQ ID NO: 291843 - DNA, 15 bp, Homo sapiens
aggcactcacgcaaa

SEQ ID NO: 291844 - DNA, 15 bp, Homo sapiens
aaggcactcacgcaa

SEQ ID NO: 291845 - DNA, 15 bp, Homo sapiens
aaaggcactcacgca

SEQ ID NO: 291846 - DNA, 15 bp, Homo sapiens
taaaggcactcacgc

SEQ ID NO: 291847 - DNA, 15 bp, Homo sapiens
gtaaaggcactcacg

SEQ ID NO: 291848 - DNA, 15 bp, Homo sapiens
cgtaaaggcactcac

SEQ ID NO: 291849 - DNA, 15 bp, Homo sapiens
tcgtaaaggcactca

SEQ ID NO: 291850 - DNA, 15 bp, Homo sapiens
ttcgtaaaggcactc

SEQ ID NO: 291851 - DNA, 15 bp, Homo sapiens
cttcgtaaaggcact

SEQ ID NO: 291852 - DNA, 15 bp, Homo sapiens
acttcgtaaaggcac

SEQ ID NO: 291853 - DNA, 15 bp, Homo sapiens
tacttcgtaaaggca

SEQ ID NO: 291854 - DNA, 15 bp, Homo sapiens
atacttcgtaaaggc

SEQ ID NO: 291855 - DNA, 15 bp, Homo sapiens
aatacttcgtaaagg

SEQ ID NO: 291856 - DNA, 15 bp, Homo sapiens
aaatacttcgtaaag

SEQ ID NO: 291857 - DNA, 15 bp, Homo sapiens
taaatacttcgtaaa

SEQ ID NO: 291858 - DNA, 15 bp, Homo sapiens
gtaaatacttcgtaa

SEQ ID NO: 291859 - DNA, 15 bp, Homo sapiens
agtaaatacttcgta

SEQ ID NO: 291860 - DNA, 15 bp, Homo sapiens
tagtaaatacttcgt

SEQ ID NO: 291861 - DNA, 15 bp, Homo sapiens
ttagtaaatacttcg

SEQ ID NO: 291862 - DNA, 15 bp, Homo sapiens
cttagtaaatacttc

SEQ ID NO: 291863 - DNA, 15 bp, Homo sapiens
acttagtaaatactt

SEQ ID NO: 291864 - DNA, 15 bp, Homo sapiens
cacttagtaaatact

SEQ ID NO: 291865 - DNA, 15 bp, Homo sapiens
acacttagtaaatac

SEQ ID NO: 291866 - DNA, 15 bp, Homo sapiens
gacacttagtaaata

SEQ ID NO: 291867 - DNA, 15 bp, Homo sapiens
tgacacttagtaaat

SEQ ID NO: 291868 - DNA, 15 bp, Homo sapiens
ctgacacttagtaaa

SEQ ID NO: 291869 - DNA, 15 bp, Homo sapiens
cctgacacttagtaa

SEQ ID NO: 291870 - DNA, 15 bp, Homo sapiens
gcctgacacttagta

SEQ ID NO: 291871 - DNA, 15 bp, Homo sapiens
agcctgacacttagt

SEQ ID NO: 291872 - DNA, 15 bp, Homo sapiens
cagcctgacacttag

SEQ ID NO: 291873 - DNA, 15 bp, Homo sapiens
acagcctgacactta

SEQ ID NO: 291874 - DNA, 15 bp, Homo sapiens
aacagcctgacactt

SEQ ID NO: 291875 - DNA, 15 bp, Homo sapiens
gaacagcctgacact

SEQ ID NO: 291876 - DNA, 15 bp, Homo sapiens
agaacagcctgacac

SEQ ID NO: 291877 - DNA, 15 bp, Homo sapiens
tagaacagcctgaca

SEQ ID NO: 291878 - DNA, 15 bp, Homo sapiens
ttagaacagcctgac

SEQ ID NO: 291879 - DNA, 15 bp, Homo sapiens
gttagaacagcctga

SEQ ID NO: 291880 - DNA, 15 bp, Homo sapiens
ggttagaacagcctg

SEQ ID NO: 291881 - DNA, 15 bp, Homo sapiens
tggttagaacagcct

SEQ ID NO: 291882 - DNA, 15 bp, Homo sapiens
atggttagaacagcc

SEQ ID NO: 291883 - DNA, 15 bp, Homo sapiens
aatggttagaacagc

SEQ ID NO: 291884 - DNA, 15 bp, Homo sapiens
aaatggttagaacag

SEQ ID NO: 291885 - DNA, 15 bp, Homo sapiens
aaaatggttagaaca

SEQ ID NO: 291886 - DNA, 15 bp, Homo sapiens
taaaatggttagaac

SEQ ID NO: 291887 - DNA, 15 bp, Homo sapiens
ctaaaatggttagaa

SEQ ID NO: 291888 - DNA, 15 bp, Homo sapiens
tctaaaatggttaga

SEQ ID NO: 291889 - DNA, 15 bp, Homo sapiens
ttctaaaatggttag

SEQ ID NO: 291890 - DNA, 15 bp, Homo sapiens
tttctaaaatggtta

SEQ ID NO: 291891 - DNA, 15 bp, Homo sapiens
atttctaaaatggtt

SEQ ID NO: 291892 - DNA, 15 bp, Homo sapiens
tatttctaaaatggt

SEQ ID NO: 291893 - DNA, 15 bp, Homo sapiens
ctatttctaaaatgg

SEQ ID NO: 291894 - DNA, 15 bp, Homo sapiens
actatttctaaaatg

SEQ ID NO: 291895 - DNA, 15 bp, Homo sapiens
gactatttctaaaat

SEQ ID NO: 291896 - DNA, 15 bp, Homo sapiens
tgactatttctaaaa

SEQ ID NO: 291897 - DNA, 15 bp, Homo sapiens
atgactatttctaaa

SEQ ID NO: 291898 - DNA, 15 bp, Homo sapiens
aatgactatttctaa

SEQ ID NO: 291899 - DNA, 15 bp, Homo sapiens
gaatgactatttcta

SEQ ID NO: 291900 - DNA, 15 bp, Homo sapiens
agaatgactatttct

SEQ ID NO: 291901 - DNA, 15 bp, Homo sapiens
aagaatgactatttc

SEQ ID NO: 291902 - DNA, 15 bp, Homo sapiens
gaagaatgactattt

SEQ ID NO: 291903 - DNA, 15 bp, Homo sapiens
tgaagaatgactatt

SEQ ID NO: 291904 - DNA, 15 bp, Homo sapiens
gtgaagaatgactat

SEQ ID NO: 291905 - DNA, 15 bp, Homo sapiens
agtgaagaatgacta

SEQ ID NO: 291906 - DNA, 15 bp, Homo sapiens
gagtgaagaatgact

SEQ ID NO: 291907 - DNA, 15 bp, Homo sapiens
ggagtgaagaatgac

SEQ ID NO: 291908 - DNA, 15 bp, Homo sapiens
gggagtgaagaatga

SEQ ID NO: 291909 - DNA, 15 bp, Homo sapiens
ggggagtgaagaatg

SEQ ID NO: 291910 - DNA, 15 bp, Homo sapiens
aggggagtgaagaat

SEQ ID NO: 291911 - DNA, 15 bp, Homo sapiens
gaggggagtgaagaa

SEQ ID NO: 291912 - DNA, 15 bp, Homo sapiens
tgaggggagtgaaga

SEQ ID NO: 291913 - DNA, 15 bp, Homo sapiens
gtgaggggagtgaag

SEQ ID NO: 291914 - DNA, 15 bp, Homo sapiens
tgtgaggggagtgaa

SEQ ID NO: 291915 - DNA, 15 bp, Homo sapiens
ttgtgaggggagtga

SEQ ID NO: 291916 - DNA, 15 bp, Homo sapiens
tttgtgaggggagtg

SEQ ID NO: 291917 - DNA, 15 bp, Homo sapiens
ttttgtgaggggagt

SEQ ID NO: 291918 - DNA, 15 bp, Homo sapiens
gttttgtgaggggag

SEQ ID NO: 291919 - DNA, 15 bp, Homo sapiens
agttttgtgagggga

SEQ ID NO: 291920 - DNA, 15 bp, Homo sapiens
gagttttgtgagggg

SEQ ID NO: 291921 - DNA, 15 bp, Homo sapiens
agagttttgtgaggg

SEQ ID NO: 291922 - DNA, 15 bp, Homo sapiens
tagagttttgtgagg

SEQ ID NO: 291923 - DNA, 15 bp, Homo sapiens
atagagttttgtgag

SEQ ID NO: 291924 - DNA, 15 bp, Homo sapiens
tatagagttttgtga

SEQ ID NO: 291925 - DNA, 15 bp, Homo sapiens
ttatagagttttgtg

SEQ ID NO: 291926 - DNA, 15 bp, Homo sapiens
gttatagagttttgt

SEQ ID NO: 291927 - DNA, 15 bp, Homo sapiens
tgttatagagttttg

SEQ ID NO: 291928 - DNA, 15 bp, Homo sapiens
gtgttatagagtttt

SEQ ID NO: 291929 - DNA, 15 bp, Homo sapiens
tgtgttatagagttt

SEQ ID NO: 291930 - DNA, 15 bp, Homo sapiens
ctgtgttatagagtt

SEQ ID NO: 291931 - DNA, 15 bp, Homo sapiens
gctgtgttatagagt

SEQ ID NO: 291932 - DNA, 15 bp, Homo sapiens
tgctgtgttatagag

SEQ ID NO: 291933 - DNA, 15 bp, Homo sapiens
gtgctgtgttataga

SEQ ID NO: 291934 - DNA, 15 bp, Homo sapiens
agtgctgtgttatag

SEQ ID NO: 291935 - DNA, 15 bp, Homo sapiens
tagtgctgtgttata

SEQ ID NO: 291936 - DNA, 15 bp, Homo sapiens
atagtgctgtgttat

SEQ ID NO: 291937 - DNA, 15 bp, Homo sapiens
aatagtgctgtgtta

SEQ ID NO: 291938 - DNA, 15 bp, Homo sapiens
taatagtgctgtgtt

SEQ ID NO: 291939 - DNA, 15 bp, Homo sapiens
ataatagtgctgtgt

SEQ ID NO: 291940 - DNA, 15 bp, Homo sapiens
aataatagtgctgtg

SEQ ID NO: 291941 - DNA, 15 bp, Homo sapiens
taataatagtgctgt

SEQ ID NO: 291942 - DNA, 15 bp, Homo sapiens
gtaataatagtgctg

SEQ ID NO: 291943 - DNA, 15 bp, Homo sapiens
ggtaataatagtgct

SEQ ID NO: 291944 - DNA, 15 bp, Homo sapiens
gggtaataatagtgc

SEQ ID NO: 291945 - DNA, 15 bp, Homo sapiens
agggtaataatagtg

SEQ ID NO: 291946 - DNA, 15 bp, Homo sapiens
gagggtaataatagt

SEQ ID NO: 291947 - DNA, 15 bp, Homo sapiens
ggagggtaataatag

SEQ ID NO: 291948 - DNA, 15 bp, Homo sapiens
gggagggtaataata

SEQ ID NO: 291949 - DNA, 15 bp, Homo sapiens
ggggagggtaataat

SEQ ID NO: 291950 - DNA, 15 bp, Homo sapiens
tggggagggtaataa

SEQ ID NO: 291951 - DNA, 15 bp, Homo sapiens
atggggagggtaata

SEQ ID NO: 291952 - DNA, 15 bp, Homo sapiens
aatggggagggtaat

SEQ ID NO: 291953 - DNA, 15 bp, Homo sapiens
aaatggggagggtaa

SEQ ID NO: 291954 - DNA, 15 bp, Homo sapiens
aaaatggggagggta

SEQ ID NO: 291955 - DNA, 15 bp, Homo sapiens
taaaatggggagggt

SEQ ID NO: 291956 - DNA, 15 bp, Homo sapiens
gtaaaatggggaggg

SEQ ID NO: 291957 - DNA, 15 bp, Homo sapiens
tgtaaaatggggagg

SEQ ID NO: 291958 - DNA, 15 bp, Homo sapiens
ttgtaaaatggggag

SEQ ID NO: 291959 - DNA, 15 bp, Homo sapiens
tttgtaaaatgggga

SEQ ID NO: 291960 - DNA, 15 bp, Homo sapiens
atttgtaaaatgggg

SEQ ID NO: 291961 - DNA, 15 bp, Homo sapiens
tatttgtaaaatggg

SEQ ID NO: 291962 - DNA, 15 bp, Homo sapiens
ttatttgtaaaatgg

SEQ ID NO: 291963 - DNA, 15 bp, Homo sapiens
tttatttgtaaaatg

SEQ ID NO: 291964 - DNA, 15 bp, Homo sapiens
ctttatttgtaaaat

SEQ ID NO: 291965 - DNA, 15 bp, Homo sapiens
tctttatttgtaaaa

SEQ ID NO: 291966 - DNA, 15 bp, Homo sapiens
ttctttatttgtaaa

SEQ ID NO: 291967 - DNA, 15 bp, Homo sapiens
gttctttatttgtaa

SEQ ID NO: 291968 - DNA, 15 bp, Homo sapiens
agttctttatttgta

SEQ ID NO: 291969 - DNA, 15 bp, Homo sapiens
cagttctttatttgt

SEQ ID NO: 291970 - DNA, 15 bp, Homo sapiens
tcagttctttatttg

SEQ ID NO: 291971 - DNA, 15 bp, Homo sapiens
ttcagttctttattt

SEQ ID NO: 291972 - DNA, 15 bp, Homo sapiens
tttcagttctttatt

SEQ ID NO: 291973 - DNA, 15 bp, Homo sapiens
ctttcagttctttat

SEQ ID NO: 291974 - DNA, 15 bp, Homo sapiens
gctttcagttcttta

SEQ ID NO: 291975 - DNA, 15 bp, Homo sapiens
tgctttcagttcttt

SEQ ID NO: 291976 - DNA, 15 bp, Homo sapiens
atgctttcagttctt

SEQ ID NO: 291977 - DNA, 15 bp, Homo sapiens
catgctttcagttct

SEQ ID NO: 291978 - DNA, 15 bp, Homo sapiens
ccatgctttcagttc

SEQ ID NO: 291979 - DNA, 15 bp, Homo sapiens
tccatgctttcagtt

SEQ ID NO: 291980 - DNA, 15 bp, Homo sapiens
ttccatgctttcagt

SEQ ID NO: 291981 - DNA, 15 bp, Homo sapiens
cttccatgctttcag

SEQ ID NO: 291982 - DNA, 15 bp, Homo sapiens
ccttccatgctttca

SEQ ID NO: 291983 - DNA, 15 bp, Homo sapiens
accttccatgctttc

SEQ ID NO: 291984 - DNA, 15 bp, Homo sapiens
aaccttccatgcttt

SEQ ID NO: 291985 - DNA, 15 bp, Homo sapiens
gaaccttccatgctt

SEQ ID NO: 291986 - DNA, 15 bp, Homo sapiens
agaaccttccatgct

SEQ ID NO: 291987 - DNA, 15 bp, Homo sapiens
tagaaccttccatgc

SEQ ID NO: 291988 - DNA, 15 bp, Homo sapiens
gtagaaccttccatg

SEQ ID NO: 291989 - DNA, 15 bp, Homo sapiens
tgtagaaccttccat

SEQ ID NO: 291990 - DNA, 15 bp, Homo sapiens
ctgtagaaccttcca

SEQ ID NO: 291991 - DNA, 15 bp, Homo sapiens
actgtagaaccttcc

SEQ ID NO: 291992 - DNA, 15 bp, Homo sapiens
aactgtagaaccttc

SEQ ID NO: 291993 - DNA, 15 bp, Homo sapiens
aaactgtagaacctt

SEQ ID NO: 291994 - DNA, 15 bp, Homo sapiens
aaaactgtagaacct

SEQ ID NO: 291995 - DNA, 15 bp, Homo sapiens
gaaaactgtagaacc

SEQ ID NO: 291996 - DNA, 15 bp, Homo sapiens
ggaaaactgtagaac

SEQ ID NO: 291997 - DNA, 15 bp, Homo sapiens
gggaaaactgtagaa

SEQ ID NO: 291998 - DNA, 15 bp, Homo sapiens
tgggaaaactgtaga

SEQ ID NO: 291999 - DNA, 15 bp, Homo sapiens
ctgggaaaactgtag

SEQ ID NO: 292000 - DNA, 15 bp, Homo sapiens
tctgggaaaactgta

SEQ ID NO: 292001 - DNA, 15 bp, Homo sapiens
ttctgggaaaactgt

SEQ ID NO: 292002 - DNA, 15 bp, Homo sapiens
attctgggaaaactg

SEQ ID NO: 292003 - DNA, 15 bp, Homo sapiens
aattctgggaaaact

SEQ ID NO: 292004 - DNA, 15 bp, Homo sapiens
taattctgggaaaac

SEQ ID NO: 292005 - DNA, 15 bp, Homo sapiens
gtaattctgggaaaa

SEQ ID NO: 292006 - DNA, 15 bp, Homo sapiens
tgtaattctgggaaa

SEQ ID NO: 292007 - DNA, 15 bp, Homo sapiens
gtgtaattctgggaa

SEQ ID NO: 292008 - DNA, 15 bp, Homo sapiens
tgtgtaattctggga

SEQ ID NO: 292009 - DNA, 15 bp, Homo sapiens
ctgtgtaattctggg

SEQ ID NO: 292010 - DNA, 15 bp, Homo sapiens
gctgtgtaattctgg

SEQ ID NO: 292011 - DNA, 15 bp, Homo sapiens
agctgtgtaattctg

SEQ ID NO: 292012 - DNA, 15 bp, Homo sapiens
aagctgtgtaattct

SEQ ID NO: 292013 - DNA, 15 bp, Homo sapiens
taagctgtgtaattc

SEQ ID NO: 292014 - DNA, 15 bp, Homo sapiens
ataagctgtgtaatt

SEQ ID NO: 292015 - DNA, 15 bp, Homo sapiens
cataagctgtgtaat

SEQ ID NO: 292016 - DNA, 15 bp, Homo sapiens
tcataagctgtgtaa

SEQ ID NO: 292017 - DNA, 15 bp, Homo sapiens
ctcataagctgtgta

SEQ ID NO: 292018 - DNA, 15 bp, Homo sapiens
actcataagctgtgt

SEQ ID NO: 292019 - DNA, 15 bp, Homo sapiens
cactcataagctgtg

SEQ ID NO: 292020 - DNA, 15 bp, Homo sapiens
ccactcataagctgt

SEQ ID NO: 292021 - DNA, 15 bp, Homo sapiens
gccactcataagctg

SEQ ID NO: 292022 - DNA, 15 bp, Homo sapiens
tgccactcataagct

SEQ ID NO: 292023 - DNA, 15 bp, Homo sapiens
ctgccactcataagc

SEQ ID NO: 292024 - DNA, 15 bp, Homo sapiens
tctgccactcataag

SEQ ID NO: 292025 - DNA, 15 bp, Homo sapiens
ctctgccactcataa

SEQ ID NO: 292026 - DNA, 15 bp, Homo sapiens
actctgccactcata

SEQ ID NO: 292027 - DNA, 15 bp, Homo sapiens
cactctgccactcat

SEQ ID NO: 292028 - DNA, 15 bp, Homo sapiens
ccactctgccactca

SEQ ID NO: 292029 - DNA, 15 bp, Homo sapiens
cccactctgccactc

SEQ ID NO: 292030 - DNA, 15 bp, Homo sapiens
tcccactctgccact

SEQ ID NO: 292031 - DNA, 15 bp, Homo sapiens
ttcccactctgccac

SEQ ID NO: 292032 - DNA, 15 bp, Homo sapiens
attcccactctgcca

SEQ ID NO: 292033 - DNA, 15 bp, Homo sapiens
aattcccactctgcc

SEQ ID NO: 292034 - DNA, 15 bp, Homo sapiens
taattcccactctgc

SEQ ID NO: 292035 - DNA, 15 bp, Homo sapiens
ctaattcccactctg

SEQ ID NO: 292036 - DNA, 15 bp, Homo sapiens
tctaattcccactct

SEQ ID NO: 292037 - DNA, 15 bp, Homo sapiens
ttctaattcccactc

SEQ ID NO: 292038 - DNA, 15 bp, Homo sapiens
attctaattcccact

SEQ ID NO: 292039 - DNA, 15 bp, Homo sapiens
gattctaattcccac

SEQ ID NO: 292040 - DNA, 15 bp, Homo sapiens
ggattctaattccca

SEQ ID NO: 292041 - DNA, 15 bp, Homo sapiens
tggattctaattccc

SEQ ID NO: 292042 - DNA, 15 bp, Homo sapiens
ctggattctaattcc

SEQ ID NO: 292043 - DNA, 15 bp, Homo sapiens
cctggattctaattc

SEQ ID NO: 292044 - DNA, 15 bp, Homo sapiens
gcctggattctaatt

SEQ ID NO: 292045 - DNA, 15 bp, Homo sapiens
tgcctggattctaat

SEQ ID NO: 292046 - DNA, 15 bp, Homo sapiens
ttgcctggattctaa

SEQ ID NO: 292047 - DNA, 15 bp, Homo sapiens
attgcctggattcta

SEQ ID NO: 292048 - DNA, 15 bp, Homo sapiens
gattgcctggattct

SEQ ID NO: 292049 - DNA, 15 bp, Homo sapiens
agattgcctggattc

SEQ ID NO: 292050 - DNA, 15 bp, Homo sapiens
cagattgcctggatt

SEQ ID NO: 292051 - DNA, 15 bp, Homo sapiens
tcagattgcctggat

SEQ ID NO: 292052 - DNA, 15 bp, Homo sapiens
ttcagattgcctgga

SEQ ID NO: 292053 - DNA, 15 bp, Homo sapiens
attcagattgcctgg

SEQ ID NO: 292054 - DNA, 15 bp, Homo sapiens
gattcagattgcctg

SEQ ID NO: 292055 - DNA, 15 bp, Homo sapiens
ggattcagattgcct

SEQ ID NO: 292056 - DNA, 15 bp, Homo sapiens
tggattcagattgcc

SEQ ID NO: 292057 - DNA, 15 bp, Homo sapiens
atggattcagattgc

SEQ ID NO: 292058 - DNA, 15 bp, Homo sapiens
tatggattcagattg

SEQ ID NO: 292059 - DNA, 15 bp, Homo sapiens
ttatggattcagatt

SEQ ID NO: 292060 - DNA, 15 bp, Homo sapiens
attatggattcagat

SEQ ID NO: 292061 - DNA, 15 bp, Homo sapiens
gattatggattcaga

SEQ ID NO: 292062 - DNA, 15 bp, Homo sapiens
tgattatggattcag

SEQ ID NO: 292063 - DNA, 15 bp, Homo sapiens
atgattatggattca

SEQ ID NO: 292064 - DNA, 15 bp, Homo sapiens
catgattatggattc

SEQ ID NO: 292065 - DNA, 15 bp, Homo sapiens
gcatgattatggatt

SEQ ID NO: 292066 - DNA, 15 bp, Homo sapiens
agcatgattatggat

SEQ ID NO: 292067 - DNA, 15 bp, Homo sapiens
aagcatgattatgga

SEQ ID NO: 292068 - DNA, 15 bp, Homo sapiens
gaagcatgattatgg

SEQ ID NO: 292069 - DNA, 15 bp, Homo sapiens
agaagcatgattatg

SEQ ID NO: 292070 - DNA, 15 bp, Homo sapiens
tagaagcatgattat

SEQ ID NO: 292071 - DNA, 15 bp, Homo sapiens
ttagaagcatgatta

SEQ ID NO: 292072 - DNA, 15 bp, Homo sapiens
attagaagcatgatt

SEQ ID NO: 292073 - DNA, 15 bp, Homo sapiens
gattagaagcatgat

SEQ ID NO: 292074 - DNA, 15 bp, Homo sapiens
tgattagaagcatga

SEQ ID NO: 292075 - DNA, 15 bp, Homo sapiens
gtgattagaagcatg

SEQ ID NO: 292076 - DNA, 15 bp, Homo sapiens
agtgattagaagcat

SEQ ID NO: 292077 - DNA, 15 bp, Homo sapiens
gagtgattagaagca

SEQ ID NO: 292078 - DNA, 15 bp, Homo sapiens
agagtgattagaagc

SEQ ID NO: 292079 - DNA, 15 bp, Homo sapiens
gagagtgattagaag

SEQ ID NO: 292080 - DNA, 15 bp, Homo sapiens
agagagtgattagaa

SEQ ID NO: 292081 - DNA, 15 bp, Homo sapiens
gagagagtgattaga

SEQ ID NO: 292082 - DNA, 15 bp, Homo sapiens
tgagagagtgattag

SEQ ID NO: 292083 - DNA, 15 bp, Homo sapiens
ttgagagagtgatta

SEQ ID NO: 292084 - DNA, 15 bp, Homo sapiens
attgagagagtgatt

SEQ ID NO: 292085 - DNA, 15 bp, Homo sapiens
tattgagagagtgat

SEQ ID NO: 292086 - DNA, 15 bp, Homo sapiens
atattgagagagtga

SEQ ID NO: 292087 - DNA, 15 bp, Homo sapiens
aatattgagagagtg

SEQ ID NO: 292088 - DNA, 15 bp, Homo sapiens
caatattgagagagt

SEQ ID NO: 292089 - DNA, 15 bp, Homo sapiens
gcaatattgagagag

SEQ ID NO: 292090 - DNA, 15 bp, Homo sapiens
ggcaatattgagaga

SEQ ID NO: 292091 - DNA, 15 bp, Homo sapiens
aggcaatattgagag

SEQ ID NO: 292092 - DNA, 15 bp, Homo sapiens
aaggcaatattgaga

SEQ ID NO: 292093 - DNA, 15 bp, Homo sapiens
caaggcaatattgag

SEQ ID NO: 292094 - DNA, 15 bp, Homo sapiens
ccaaggcaatattga

SEQ ID NO: 292095 - DNA, 15 bp, Homo sapiens
tccaaggcaatattg

SEQ ID NO: 292096 - DNA, 15 bp, Homo sapiens
ctccaaggcaatatt

SEQ ID NO: 292097 - DNA, 15 bp, Homo sapiens
actccaaggcaatat

SEQ ID NO: 292098 - DNA, 15 bp, Homo sapiens
tactccaaggcaata

SEQ ID NO: 292099 - DNA, 15 bp, Homo sapiens
atactccaaggcaat

SEQ ID NO: 292100 - DNA, 15 bp, Homo sapiens
catactccaaggcaa

SEQ ID NO: 292101 - DNA, 15 bp, Homo sapiens
tcatactccaaggca

SEQ ID NO: 292102 - DNA, 15 bp, Homo sapiens
ctcatactccaaggc

SEQ ID NO: 292103 - DNA, 15 bp, Homo sapiens
gctcatactccaagg

SEQ ID NO: 292104 - DNA, 15 bp, Homo sapiens
agctcatactccaag

SEQ ID NO: 292105 - DNA, 15 bp, Homo sapiens
cagctcatactccaa

SEQ ID NO: 292106 - DNA, 15 bp, Homo sapiens
tcagctcatactcca

SEQ ID NO: 292107 - DNA, 15 bp, Homo sapiens
atcagctcatactcc

SEQ ID NO: 292108 - DNA, 15 bp, Homo sapiens
aatcagctcatactc

SEQ ID NO: 292109 - DNA, 15 bp, Homo sapiens
aaatcagctcatact

SEQ ID NO: 292110 - DNA, 15 bp, Homo sapiens
aaaatcagctcatac

SEQ ID NO: 292111 - DNA, 15 bp, Homo sapiens
caaaatcagctcata

SEQ ID NO: 292112 - DNA, 15 bp, Homo sapiens
tcaaaatcagctcat

SEQ ID NO: 292113 - DNA, 15 bp, Homo sapiens
ttcaaaatcagctca

SEQ ID NO: 292114 - DNA, 15 bp, Homo sapiens
tttcaaaatcagctc

SEQ ID NO: 292115 - DNA, 15 bp, Homo sapiens
atttcaaaatcagct

SEQ ID NO: 292116 - DNA, 15 bp, Homo sapiens
aatttcaaaatcagc

SEQ ID NO: 292117 - DNA, 15 bp, Homo sapiens
caatttcaaaatcag

SEQ ID NO: 292118 - DNA, 15 bp, Homo sapiens
ccaatttcaaaatca

SEQ ID NO: 292119 - DNA, 15 bp, Homo sapiens
tccaatttcaaaatc

SEQ ID NO: 292120 - DNA, 15 bp, Homo sapiens
atccaatttcaaaat

SEQ ID NO: 292121 - DNA, 15 bp, Homo sapiens
tatccaatttcaaaa

SEQ ID NO: 292122 - DNA, 15 bp, Homo sapiens
ttatccaatttcaaa

SEQ ID NO: 292123 - DNA, 15 bp, Homo sapiens
tttatccaatttcaa

SEQ ID NO: 292124 - DNA, 15 bp, Homo sapiens
atttatccaatttca

SEQ ID NO: 292125 - DNA, 15 bp, Homo sapiens
aatttatccaatttc

SEQ ID NO: 292126 - DNA, 15 bp, Homo sapiens
aaatttatccaattt

SEQ ID NO: 292127 - DNA, 15 bp, Homo sapiens
taaatttatccaatt

SEQ ID NO: 292128 - DNA, 15 bp, Homo sapiens
gtaaatttatccaat

SEQ ID NO: 292129 - DNA, 15 bp, Homo sapiens
agtaaatttatccaa

SEQ ID NO: 292130 - DNA, 15 bp, Homo sapiens
cagtaaatttatcca

SEQ ID NO: 292131 - DNA, 15 bp, Homo sapiens
acagtaaatttatcc

SEQ ID NO: 292132 - DNA, 15 bp, Homo sapiens
tacagtaaatttatc

SEQ ID NO: 292133 - DNA, 15 bp, Homo sapiens
atacagtaaatttat

SEQ ID NO: 292134 - DNA, 15 bp, Homo sapiens
aatacagtaaattta

SEQ ID NO: 292135 - DNA, 15 bp, Homo sapiens
taatacagtaaattt

SEQ ID NO: 292136 - DNA, 15 bp, Homo sapiens
ctaatacagtaaatt

SEQ ID NO: 292137 - DNA, 15 bp, Homo sapiens
tctaatacagtaaat

SEQ ID NO: 292138 - DNA, 15 bp, Homo sapiens
ttctaatacagtaaa

SEQ ID NO: 292139 - DNA, 15 bp, Homo sapiens
tttctaatacagtaa

SEQ ID NO: 292140 - DNA, 15 bp, Homo sapiens
gtttctaatacagta

SEQ ID NO: 292141 - DNA, 15 bp, Homo sapiens
gggtttctaatacag

SEQ ID NO: 292142 - DNA, 15 bp, Homo sapiens
tgggtttctaataca

SEQ ID NO: 292143 - DNA, 15 bp, Homo sapiens
ctgggtttctaatac

SEQ ID NO: 292144 - DNA, 15 bp, Homo sapiens
actgggtttctaata

SEQ ID NO: 292145 - DNA, 15 bp, Homo sapiens
cactgggtttctaat

SEQ ID NO: 292146 - DNA, 15 bp, Homo sapiens
gcactgggtttctaa

SEQ ID NO: 292147 - DNA, 15 bp, Homo sapiens
agcactgggtttcta

SEQ ID NO: 292148 - DNA, 15 bp, Homo sapiens
cagcactgggtttct

SEQ ID NO: 292149 - DNA, 15 bp, Homo sapiens
tcagcactgggtttc

SEQ ID NO: 292150 - DNA, 15 bp, Homo sapiens
atcagcactgggttt

SEQ ID NO: 292151 - DNA, 15 bp, Homo sapiens
catcagcactgggtt

SEQ ID NO: 292152 - DNA, 15 bp, Homo sapiens
acatcagcactgggt

SEQ ID NO: 292153 - DNA, 15 bp, Homo sapiens
aacatcagcactggg

SEQ ID NO: 292154 - DNA, 15 bp, Homo sapiens
aaacatcagcactgg

SEQ ID NO: 292155 - DNA, 15 bp, Homo sapiens
taaacatcagcactg

SEQ ID NO: 292156 - DNA, 15 bp, Homo sapiens
ttaaacatcagcact

SEQ ID NO: 292157 - DNA, 15 bp, Homo sapiens
tttaaacatcagcac

SEQ ID NO: 292158 - DNA, 15 bp, Homo sapiens
ttttaaacatcagca

SEQ ID NO: 292159 - DNA, 15 bp, Homo sapiens
attttaaacatcagc

SEQ ID NO: 292160 - DNA, 15 bp, Homo sapiens
tattttaaacatcag

SEQ ID NO: 292161 - DNA, 15 bp, Homo sapiens
atattttaaacatca

SEQ ID NO: 292162 - DNA, 15 bp, Homo sapiens
catattttaaacatc

SEQ ID NO: 292163 - DNA, 15 bp, Homo sapiens
tcatattttaaacat

SEQ ID NO: 292164 - DNA, 15 bp, Homo sapiens
ctcatattttaaaca

SEQ ID NO: 292165 - DNA, 15 bp, Homo sapiens
actcatattttaaac

SEQ ID NO: 292166 - DNA, 15 bp, Homo sapiens
cactcatattttaaa

SEQ ID NO: 292167 - DNA, 15 bp, Homo sapiens
tcactcatattttaa

SEQ ID NO: 292168 - DNA, 15 bp, Homo sapiens
ttcactcatatttta

SEQ ID NO: 292169 - DNA, 15 bp, Homo sapiens
gttcactcatatttt

SEQ ID NO: 292170 - DNA, 15 bp, Homo sapiens
agttcactcatattt

SEQ ID NO: 292171 - DNA, 15 bp, Homo sapiens
tagttcactcatatt

SEQ ID NO: 292172 - DNA, 15 bp, Homo sapiens
atagttcactcatat

SEQ ID NO: 292173 - DNA, 15 bp, Homo sapiens
catagttcactcata

SEQ ID NO: 292174 - DNA, 15 bp, Homo sapiens
gcatagttcactcat

SEQ ID NO: 292175 - DNA, 15 bp, Homo sapiens
agcatagttcactca

SEQ ID NO: 292176 - DNA, 15 bp, Homo sapiens
aagcatagttcactc

SEQ ID NO: 292177 - DNA, 15 bp, Homo sapiens
taagcatagttcact

SEQ ID NO: 292178 - DNA, 15 bp, Homo sapiens
ataagcatagttcac

SEQ ID NO: 292179 - DNA, 15 bp, Homo sapiens
cataagcatagttca

SEQ ID NO: 292180 - DNA, 15 bp, Homo sapiens
tcataagcatagttc

SEQ ID NO: 292181 - DNA, 15 bp, Homo sapiens
ttcataagcatagtt

SEQ ID NO: 292182 - DNA, 15 bp, Homo sapiens
attcataagcatagt

SEQ ID NO: 292183 - DNA, 15 bp, Homo sapiens
aattcataagcatag

SEQ ID NO: 292184 - DNA, 15 bp, Homo sapiens
gaattcataagcata

SEQ ID NO: 292185 - DNA, 15 bp, Homo sapiens
tgaattcataagcat

SEQ ID NO: 292186 - DNA, 15 bp, Homo sapiens
gtgaattcataagca

SEQ ID NO: 292187 - DNA, 15 bp, Homo sapiens
agtgaattcataagc

SEQ ID NO: 292188 - DNA, 15 bp, Homo sapiens
aagtgaattcataag

SEQ ID NO: 292189 - DNA, 15 bp, Homo sapiens
taagtgaattcataa

SEQ ID NO: 292190 - DNA, 15 bp, Homo sapiens
ttaagtgaattcata

SEQ ID NO: 292191 - DNA, 15 bp, Homo sapiens
gttaagtgaattcat

SEQ ID NO: 292192 - DNA, 15 bp, Homo sapiens
tgttaagtgaattca

SEQ ID NO: 292193 - DNA, 15 bp, Homo sapiens
atgttaagtgaattc

SEQ ID NO: 292194 - DNA, 15 bp, Homo sapiens
aatgttaagtgaatt

SEQ ID NO: 292195 - DNA, 15 bp, Homo sapiens
taatgttaagtgaat

SEQ ID NO: 292196 - DNA, 15 bp, Homo sapiens
ttaatgttaagtgaa

SEQ ID NO: 292197 - DNA, 15 bp, Homo sapiens
tttaatgttaagtga

SEQ ID NO: 292198 - DNA, 15 bp, Homo sapiens
ttttaatgttaagtg

SEQ ID NO: 292199 - DNA, 15 bp, Homo sapiens
gttttaatgttaagt

SEQ ID NO: 292200 - DNA, 15 bp, Homo sapiens
tgttttaatgttaag

SEQ ID NO: 292201 - DNA, 15 bp, Homo sapiens
ttgttttaatgttaa

SEQ ID NO: 292202 - DNA, 15 bp, Homo sapiens
gttgttttaatgtta

SEQ ID NO: 292203 - DNA, 15 bp, Homo sapiens
tgttgttttaatgtt

SEQ ID NO: 292204 - DNA, 15 bp, Homo sapiens
ctgttgttttaatgt

SEQ ID NO: 292205 - DNA, 15 bp, Homo sapiens
tctgttgttttaatg

SEQ ID NO: 292206 - DNA, 15 bp, Homo sapiens
ttctgttgttttaat

SEQ ID NO: 292207 - DNA, 15 bp, Homo sapiens
tttctgttgttttaa

SEQ ID NO: 292208 - DNA, 15 bp, Homo sapiens
ttttctgttgtttta

SEQ ID NO: 292209 - DNA, 15 bp, Homo sapiens
tttttctgttgtttt

SEQ ID NO: 292210 - DNA, 15 bp, Homo sapiens
atttttctgttgttt

SEQ ID NO: 292211 - DNA, 15 bp, Homo sapiens
aatttttctgttgtt

SEQ ID NO: 292212 - DNA, 15 bp, Homo sapiens
caatttttctgttgt

SEQ ID NO: 292213 - DNA, 15 bp, Homo sapiens
tcaatttttctgttg

SEQ ID NO: 292214 - DNA, 15 bp, Homo sapiens
ctcaatttttctgtt

SEQ ID NO: 292215 - DNA, 15 bp, Homo sapiens
cctcaatttttctgt

SEQ ID NO: 292216 - DNA, 15 bp, Homo sapiens
ccctcaatttttctg

SEQ ID NO: 292217 - DNA, 15 bp, Homo sapiens
tccctcaatttttct

SEQ ID NO: 292218 - DNA, 15 bp, Homo sapiens
atccctcaatttttc

SEQ ID NO: 292219 - DNA, 15 bp, Homo sapiens
tatccctcaattttt

SEQ ID NO: 292220 - DNA, 15 bp, Homo sapiens
ttatccctcaatttt

SEQ ID NO: 292221 - DNA, 15 bp, Homo sapiens
tttatccctcaattt

SEQ ID NO: 292222 - DNA, 15 bp, Homo sapiens
ttttatccctcaatt

SEQ ID NO: 292223 - DNA, 15 bp, Homo sapiens
tttttatccctcaat

SEQ ID NO: 292224 - DNA, 15 bp, Homo sapiens
atttttatccctcaa

SEQ ID NO: 292225 - DNA, 15 bp, Homo sapiens
catttttatccctca

SEQ ID NO: 292226 - DNA, 15 bp, Homo sapiens
ccatttttatccctc

SEQ ID NO: 292227 - DNA, 15 bp, Homo sapiens
accatttttatccct

SEQ ID NO: 292228 - DNA, 15 bp, Homo sapiens
caccatttttatccc

SEQ ID NO: 292229 - DNA, 15 bp, Homo sapiens
acaccatttttatcc

SEQ ID NO: 292230 - DNA, 15 bp, Homo sapiens
aacaccatttttatc

SEQ ID NO: 292231 - DNA, 15 bp, Homo sapiens
caacaccatttttat

SEQ ID NO: 292232 - DNA, 15 bp, Homo sapiens
tcaacaccattttta

SEQ ID NO: 292233 - DNA, 15 bp, Homo sapiens
atcaacaccattttt

SEQ ID NO: 292234 - DNA, 15 bp, Homo sapiens
tatcaacaccatttt

SEQ ID NO: 292235 - DNA, 15 bp, Homo sapiens
ttatcaacaccattt

SEQ ID NO: 292236 - DNA, 15 bp, Homo sapiens
tttatcaacaccatt

SEQ ID NO: 292237 - DNA, 15 bp, Homo sapiens
atttatcaacaccat

SEQ ID NO: 292238 - DNA, 15 bp, Homo sapiens
catttatcaacacca

SEQ ID NO: 292239 - DNA, 15 bp, Homo sapiens
tcatttatcaacacc

SEQ ID NO: 292240 - DNA, 15 bp, Homo sapiens
ctcatttatcaacac

SEQ ID NO: 292241 - DNA, 15 bp, Homo sapiens
actcatttatcaaca

SEQ ID NO: 292242 - DNA, 15 bp, Homo sapiens
gactcatttatcaac

SEQ ID NO: 292243 - DNA, 15 bp, Homo sapiens
agactcatttatcaa

SEQ ID NO: 292244 - DNA, 15 bp, Homo sapiens
cagactcatttatca

SEQ ID NO: 292245 - DNA, 15 bp, Homo sapiens
ccagactcatttatc

SEQ ID NO: 292246 - DNA, 15 bp, Homo sapiens
gccagactcatttat

SEQ ID NO: 292247 - DNA, 15 bp, Homo sapiens
tgccagactcattta

SEQ ID NO: 292248 - DNA, 15 bp, Homo sapiens
ctgccagactcattt

SEQ ID NO: 292249 - DNA, 15 bp, Homo sapiens
gctgccagactcatt

SEQ ID NO: 292250 - DNA, 15 bp, Homo sapiens
tgctgccagactcat

SEQ ID NO: 292251 - DNA, 15 bp, Homo sapiens
atgctgccagactca

SEQ ID NO: 292252 - DNA, 15 bp, Homo sapiens
tatgctgccagactc

SEQ ID NO: 292253 - DNA, 15 bp, Homo sapiens
ttatgctgccagact

SEQ ID NO: 292254 - DNA, 15 bp, Homo sapiens
gttatgctgccagac

SEQ ID NO: 292255 - DNA, 15 bp, Homo sapiens
ggttatgctgccaga

SEQ ID NO: 292256 - DNA, 15 bp, Homo sapiens
tggttatgctgccag

SEQ ID NO: 292257 - DNA, 15 bp, Homo sapiens
ttggttatgctgcca

SEQ ID NO: 292258 - DNA, 15 bp, Homo sapiens
cttggttatgctgcc

SEQ ID NO: 292259 - DNA, 15 bp, Homo sapiens
acttggttatgctgc

SEQ ID NO: 292260 - DNA, 15 bp, Homo sapiens
cacttggttatgctg

SEQ ID NO: 292261 - DNA, 15 bp, Homo sapiens
ccacttggttatgct

SEQ ID NO: 292262 - DNA, 15 bp, Homo sapiens
tccacttggttatgc

SEQ ID NO: 292263 - DNA, 15 bp, Homo sapiens
atccacttggttatg

SEQ ID NO: 292264 - DNA, 15 bp, Homo sapiens
aatccacttggttat

SEQ ID NO: 292265 - DNA, 15 bp, Homo sapiens
gaatccacttggtta

SEQ ID NO: 292266 - DNA, 15 bp, Homo sapiens
agaatccacttggtt

SEQ ID NO: 292267 - DNA, 15 bp, Homo sapiens
aagaatccacttggt

SEQ ID NO: 292268 - DNA, 15 bp, Homo sapiens
gaagaatccacttgg

SEQ ID NO: 292269 - DNA, 15 bp, Homo sapiens
tgaagaatccacttg

SEQ ID NO: 292270 - DNA, 15 bp, Homo sapiens
ttgaagaatccactt

SEQ ID NO: 292271 - DNA, 15 bp, Homo sapiens
cttgaagaatccact

SEQ ID NO: 292272 - DNA, 15 bp, Homo sapiens
ccttgaagaatccac

SEQ ID NO: 292273 - DNA, 15 bp, Homo sapiens
accttgaagaatcca

SEQ ID NO: 292274 - DNA, 15 bp, Homo sapiens
caccttgaagaatcc

SEQ ID NO: 292275 - DNA, 15 bp, Homo sapiens
acaccttgaagaatc

SEQ ID NO: 292276 - DNA, 15 bp, Homo sapiens
gacaccttgaagaat

SEQ ID NO: 292277 - DNA, 15 bp, Homo sapiens
ggacaccttgaagaa

SEQ ID NO: 292278 - DNA, 15 bp, Homo sapiens
tggacaccttgaaga

SEQ ID NO: 292279 - DNA, 15 bp, Homo sapiens
ttggacaccttgaag

SEQ ID NO: 292280 - DNA, 15 bp, Homo sapiens
cttggacaccttgaa

SEQ ID NO: 292281 - DNA, 15 bp, Homo sapiens
gcttggacaccttga

SEQ ID NO: 292282 - DNA, 15 bp, Homo sapiens
cgcttggacaccttg

SEQ ID NO: 292283 - DNA, 15 bp, Homo sapiens
ccgcttggacacctt

SEQ ID NO: 292284 - DNA, 15 bp, Homo sapiens
tccgcttggacacct

SEQ ID NO: 292285 - DNA, 15 bp, Homo sapiens
ttccgcttggacacc

SEQ ID NO: 292286 - DNA, 15 bp, Homo sapiens
tttccgcttggacac

SEQ ID NO: 292287 - DNA, 15 bp, Homo sapiens
ctttccgcttggaca

SEQ ID NO: 292288 - DNA, 15 bp, Homo sapiens
tctttccgcttggac

SEQ ID NO: 292289 - DNA, 15 bp, Homo sapiens
ctctttccgcttgga

SEQ ID NO: 292290 - DNA, 15 bp, Homo sapiens
tctctttccgcttgg

SEQ ID NO: 292291 - DNA, 15 bp, Homo sapiens
ttctctttccgcttg

SEQ ID NO: 292292 - DNA, 15 bp, Homo sapiens
cttctctttccgctt

SEQ ID NO: 292293 - DNA, 15 bp, Homo sapiens
ccttctctttccgct

SEQ ID NO: 292294 - DNA, 15 bp, Homo sapiens
tccttctctttccgc

SEQ ID NO: 292295 - DNA, 15 bp, Homo sapiens
gtccttctctttccg

SEQ ID NO: 292296 - DNA, 15 bp, Homo sapiens
ggtccttctctttcc

SEQ ID NO: 292297 - DNA, 15 bp, Homo sapiens
tggtccttctctttc

SEQ ID NO: 292298 - DNA, 15 bp, Homo sapiens
ttggtccttctcttt

SEQ ID NO: 292299 - DNA, 15 bp, Homo sapiens
tttggtccttctctt

SEQ ID NO: 292300 - DNA, 15 bp, Homo sapiens
ctttggtccttctct

SEQ ID NO: 292301 - DNA, 15 bp, Homo sapiens
gctttggtccttctc

SEQ ID NO: 292302 - DNA, 15 bp, Homo sapiens
ggctttggtccttct

SEQ ID NO: 292303 - DNA, 15 bp, Homo sapiens
gggctttggtccttc

SEQ ID NO: 292304 - DNA, 15 bp, Homo sapiens
ggggctttggtcctt

SEQ ID NO: 292305 - DNA, 15 bp, Homo sapiens
gggggctttggtcct

SEQ ID NO: 292306 - DNA, 15 bp, Homo sapiens
tgggggctttggtcc

SEQ ID NO: 292307 - DNA, 15 bp, Homo sapiens
gtgggggctttggtc

SEQ ID NO: 292308 - DNA, 15 bp, Homo sapiens
ggtgggggctttggt

SEQ ID NO: 292309 - DNA, 15 bp, Homo sapiens
tggtgggggctttgg

SEQ ID NO: 292310 - DNA, 15 bp, Homo sapiens
ttggtgggggctttg

SEQ ID NO: 292311 - DNA, 15 bp, Homo sapiens
cttggtgggggcttt

SEQ ID NO: 292312 - DNA, 15 bp, Homo sapiens
gcttggtgggggctt

SEQ ID NO: 292313 - DNA, 15 bp, Homo sapiens
agcttggtgggggct

SEQ ID NO: 292314 - DNA, 15 bp, Homo sapiens
cagcttggtgggggc

SEQ ID NO: 292315 - DNA, 15 bp, Homo sapiens
tcagcttggtggggg

SEQ ID NO: 292316 - DNA, 15 bp, Homo sapiens
atcagcttggtgggg

SEQ ID NO: 292317 - DNA, 15 bp, Homo sapiens
catcagcttggtggg

SEQ ID NO: 292318 - DNA, 15 bp, Homo sapiens
gcatcagcttggtgg

SEQ ID NO: 292319 - DNA, 15 bp, Homo sapiens
agcatcagcttggtg

SEQ ID NO: 292320 - DNA, 15 bp, Homo sapiens
tagcatcagcttggt

SEQ ID NO: 292321 - DNA, 15 bp, Homo sapiens
ttagcatcagcttgg

SEQ ID NO: 292322 - DNA, 15 bp, Homo sapiens
tttagcatcagcttg

SEQ ID NO: 292323 - DNA, 15 bp, Homo sapiens
ttttagcatcagctt

SEQ ID NO: 292324 - DNA, 15 bp, Homo sapiens
attttagcatcagct

SEQ ID NO: 292325 - DNA, 15 bp, Homo sapiens
cattttagcatcagc

SEQ ID NO: 292326 - DNA, 15 bp, Homo sapiens
acattttagcatcag

SEQ ID NO: 292327 - DNA, 15 bp, Homo sapiens
tacattttagcatca

SEQ ID NO: 292328 - DNA, 15 bp, Homo sapiens
atacattttagcatc

SEQ ID NO: 292329 - DNA, 15 bp, Homo sapiens
catacattttagcat

SEQ ID NO: 292330 - DNA, 15 bp, Homo sapiens
ccatacattttagca

SEQ ID NO: 292331 - DNA, 15 bp, Homo sapiens
tccatacattttagc

SEQ ID NO: 292332 - DNA, 15 bp, Homo sapiens
ttccatacattttag

SEQ ID NO: 292333 - DNA, 15 bp, Homo sapiens
tttccatacatttta

SEQ ID NO: 292334 - DNA, 15 bp, Homo sapiens
ttttccatacatttt

SEQ ID NO: 292335 - DNA, 15 bp, Homo sapiens
gttttccatacattt

SEQ ID NO: 292336 - DNA, 15 bp, Homo sapiens
tgttttccatacatt

SEQ ID NO: 292337 - DNA, 15 bp, Homo sapiens
atgttttccatacat

SEQ ID NO: 292338 - DNA, 15 bp, Homo sapiens
gatgttttccataca

SEQ ID NO: 292339 - DNA, 15 bp, Homo sapiens
agatgttttccatac

SEQ ID NO: 292340 - DNA, 15 bp, Homo sapiens
cagatgttttccata

SEQ ID NO: 292341 - DNA, 15 bp, Homo sapiens
tcagatgttttccat

SEQ ID NO: 292342 - DNA, 15 bp, Homo sapiens
ttcagatgttttcca

SEQ ID NO: 292343 - DNA, 15 bp, Homo sapiens
cttcagatgttttcc

SEQ ID NO: 292344 - DNA, 15 bp, Homo sapiens
ccttcagatgttttc

SEQ ID NO: 292345 - DNA, 15 bp, Homo sapiens
gccttcagatgtttt

SEQ ID NO: 292346 - DNA, 15 bp, Homo sapiens
tgccttcagatgttt

SEQ ID NO: 292347 - DNA, 15 bp, Homo sapiens
ttgccttcagatgtt

SEQ ID NO: 292348 - DNA, 15 bp, Homo sapiens
tttgccttcagatgt

SEQ ID NO: 292349 - DNA, 15 bp, Homo sapiens
ctttgccttcagatg

SEQ ID NO: 292350 - DNA, 15 bp, Homo sapiens
tctttgccttcagat

SEQ ID NO: 292351 - DNA, 15 bp, Homo sapiens
gtctttgccttcaga

SEQ ID NO: 292352 - DNA, 15 bp, Homo sapiens
agtctttgccttcag

SEQ ID NO: 292353 - DNA, 15 bp, Homo sapiens
aagtctttgccttca

SEQ ID NO: 292354 - DNA, 15 bp, Homo sapiens
gaagtctttgccttc

SEQ ID NO: 292355 - DNA, 15 bp, Homo sapiens
agaagtctttgcctt

SEQ ID NO: 292356 - DNA, 15 bp, Homo sapiens
tagaagtctttgcct

SEQ ID NO: 292357 - DNA, 15 bp, Homo sapiens
atagaagtctttgcc

SEQ ID NO: 292358 - DNA, 15 bp, Homo sapiens
tatagaagtctttgc

SEQ ID NO: 292359 - DNA, 15 bp, Homo sapiens
atatagaagtctttg

SEQ ID NO: 292360 - DNA, 15 bp, Homo sapiens
catatagaagtcttt

SEQ ID NO: 292361 - DNA, 15 bp, Homo sapiens
tcatatagaagtctt

SEQ ID NO: 292362 - DNA, 15 bp, Homo sapiens
atcatatagaagtct

SEQ ID NO: 292363 - DNA, 15 bp, Homo sapiens
aatcatatagaagtc

SEQ ID NO: 292364 - DNA, 15 bp, Homo sapiens
aaatcatatagaagt

SEQ ID NO: 292365 - DNA, 15 bp, Homo sapiens
taaatcatatagaag

SEQ ID NO: 292366 - DNA, 15 bp, Homo sapiens
ttaaatcatatagaa

SEQ ID NO: 292367 - DNA, 15 bp, Homo sapiens
attaaatcatataga

SEQ ID NO: 292368 - DNA, 15 bp, Homo sapiens
aattaaatcatatag

SEQ ID NO: 292369 - DNA, 15 bp, Homo sapiens
taattaaatcatata

SEQ ID NO: 292370 - DNA, 15 bp, Homo sapiens
ataattaaatcatat

SEQ ID NO: 292371 - DNA, 15 bp, Homo sapiens
gataattaaatcata

SEQ ID NO: 292372 - DNA, 15 bp, Homo sapiens
ggataattaaatcat

SEQ ID NO: 292373 - DNA, 15 bp, Homo sapiens
tggataattaaatca

SEQ ID NO: 292374 - DNA, 15 bp, Homo sapiens
atggataattaaatc

SEQ ID NO: 292375 - DNA, 15 bp, Homo sapiens
catggataattaaat

SEQ ID NO: 292376 - DNA, 15 bp, Homo sapiens
ccatggataattaaa

SEQ ID NO: 292377 - DNA, 15 bp, Homo sapiens
accatggataattaa

SEQ ID NO: 292378 - DNA, 15 bp, Homo sapiens
caccatggataatta

SEQ ID NO: 292379 - DNA, 15 bp, Homo sapiens
tcaccatggataatt

SEQ ID NO: 292380 - DNA, 15 bp, Homo sapiens
ctcaccatggataat

SEQ ID NO: 292381 - DNA, 15 bp, Homo sapiens
cctcaccatggataa

SEQ ID NO: 292382 - DNA, 15 bp, Homo sapiens
ccctcaccatggata

SEQ ID NO: 292383 - DNA, 15 bp, Homo sapiens
gccctcaccatggat

SEQ ID NO: 292384 - DNA, 15 bp, Homo sapiens
cgccctcaccatgga

SEQ ID NO: 292385 - DNA, 15 bp, Homo sapiens
ccgccctcaccatgg

SEQ ID NO: 292386 - DNA, 15 bp, Homo sapiens
cccgccctcaccatg

SEQ ID NO: 292387 - DNA, 15 bp, Homo sapiens
ccccgccctcaccat

SEQ ID NO: 292388 - DNA, 15 bp, Homo sapiens
tccccgccctcacca

SEQ ID NO: 292389 - DNA, 15 bp, Homo sapiens
ttccccgccctcacc

SEQ ID NO: 292390 - DNA, 15 bp, Homo sapiens
cttccccgccctcac

SEQ ID NO: 292391 - DNA, 15 bp, Homo sapiens
acttccccgccctca

SEQ ID NO: 292392 - DNA, 15 bp, Homo sapiens
aacttccccgccctc

SEQ ID NO: 292393 - DNA, 15 bp, Homo sapiens
taacttccccgccct

SEQ ID NO: 292394 - DNA, 15 bp, Homo sapiens
ttaacttccccgccc

SEQ ID NO: 292395 - DNA, 15 bp, Homo sapiens
tttaacttccccgcc

SEQ ID NO: 292396 - DNA, 15 bp, Homo sapiens
ttttaacttccccgc

SEQ ID NO: 292397 - DNA, 15 bp, Homo sapiens
tttttaacttccccg

SEQ ID NO: 292398 - DNA, 15 bp, Homo sapiens
ctttttaacttcccc

SEQ ID NO: 292399 - DNA, 15 bp, Homo sapiens
cctttttaacttccc

SEQ ID NO: 292400 - DNA, 15 bp, Homo sapiens
tcctttttaacttcc

SEQ ID NO: 292401 - DNA, 15 bp, Homo sapiens
ttcctttttaacttc

SEQ ID NO: 292402 - DNA, 15 bp, Homo sapiens
tttcctttttaactt

SEQ ID NO: 292403 - DNA, 15 bp, Homo sapiens
atttcctttttaact

SEQ ID NO: 292404 - DNA, 15 bp, Homo sapiens
catttcctttttaac

SEQ ID NO: 292405 - DNA, 15 bp, Homo sapiens
acatttcctttttaa

SEQ ID NO: 292406 - DNA, 15 bp, Homo sapiens
aacatttccttttta

SEQ ID NO: 292407 - DNA, 15 bp, Homo sapiens
aaacatttccttttt

SEQ ID NO: 292408 - DNA, 15 bp, Homo sapiens
aaaacatttcctttt

SEQ ID NO: 292409 - DNA, 15 bp, Homo sapiens
aaaaacatttccttt

SEQ ID NO: 292410 - DNA, 15 bp, Homo sapiens
gaaaaacatttcctt

SEQ ID NO: 292411 - DNA, 15 bp, Homo sapiens
ggaaaaacatttcct

SEQ ID NO: 292412 - DNA, 15 bp, Homo sapiens
aggaaaaacatttcc

SEQ ID NO: 292413 - DNA, 15 bp, Homo sapiens
aaggaaaaacatttc

SEQ ID NO: 292414 - DNA, 15 bp, Homo sapiens
taaggaaaaacattt

SEQ ID NO: 292415 - DNA, 15 bp, Homo sapiens
ataaggaaaaacatt

SEQ ID NO: 292416 - DNA, 15 bp, Homo sapiens
cataaggaaaaacat

SEQ ID NO: 292417 - DNA, 15 bp, Homo sapiens
tcataaggaaaaaca

SEQ ID NO: 292418 - DNA, 15 bp, Homo sapiens
atcataaggaaaaac

SEQ ID NO: 292419 - DNA, 15 bp, Homo sapiens
aatcataaggaaaaa

SEQ ID NO: 292420 - DNA, 15 bp, Homo sapiens
taatcataaggaaaa

SEQ ID NO: 292421 - DNA, 15 bp, Homo sapiens
ataatcataaggaaa

SEQ ID NO: 292422 - DNA, 15 bp, Homo sapiens
aataatcataaggaa

SEQ ID NO: 292423 - DNA, 15 bp, Homo sapiens
aaataatcataagga

SEQ ID NO: 292424 - DNA, 15 bp, Homo sapiens
caaataatcataagg

SEQ ID NO: 292425 - DNA, 15 bp, Homo sapiens
tcaaataatcataag

SEQ ID NO: 292426 - DNA, 15 bp, Homo sapiens
ttcaaataatcataa

SEQ ID NO: 292427 - DNA, 15 bp, Homo sapiens
attcaaataatcata

SEQ ID NO: 292428 - DNA, 15 bp, Homo sapiens
gattcaaataatcat

SEQ ID NO: 292429 - DNA, 15 bp, Homo sapiens
ggattcaaataatca

SEQ ID NO: 292430 - DNA, 15 bp, Homo sapiens
aggattcaaataatc

SEQ ID NO: 292431 - DNA, 15 bp, Homo sapiens
aaggattcaaataat

SEQ ID NO: 292432 - DNA, 15 bp, Homo sapiens
aaaggattcaaataa

SEQ ID NO: 292433 - DNA, 15 bp, Homo sapiens
gaaaggattcaaata

SEQ ID NO: 292434 - DNA, 15 bp, Homo sapiens
agaaaggattcaaat

SEQ ID NO: 292435 - DNA, 15 bp, Homo sapiens
gagaaaggattcaaa

SEQ ID NO: 292436 - DNA, 15 bp, Homo sapiens
agagaaaggattcaa

SEQ ID NO: 292437 - DNA, 15 bp, Homo sapiens
cagagaaaggattca

SEQ ID NO: 292438 - DNA, 15 bp, Homo sapiens
gcagagaaaggattc

SEQ ID NO: 292439 - DNA, 15 bp, Homo sapiens
agcagagaaaggatt

SEQ ID NO: 292440 - DNA, 15 bp, Homo sapiens
aagcagagaaaggat

SEQ ID NO: 292441 - DNA, 15 bp, Homo sapiens
aaagcagagaaagga

SEQ ID NO: 292442 - DNA, 15 bp, Homo sapiens
taaagcagagaaagg

SEQ ID NO: 292443 - DNA, 15 bp, Homo sapiens
ttaaagcagagaaag

SEQ ID NO: 292444 - DNA, 15 bp, Homo sapiens
gttaaagcagagaaa

SEQ ID NO: 292445 - DNA, 15 bp, Homo sapiens
ggttaaagcagagaa

SEQ ID NO: 292446 - DNA, 15 bp, Homo sapiens
aggttaaagcagaga

SEQ ID NO: 292447 - DNA, 15 bp, Homo sapiens
gaggttaaagcagag

SEQ ID NO: 292448 - DNA, 15 bp, Homo sapiens
agaggttaaagcaga

SEQ ID NO: 292449 - DNA, 15 bp, Homo sapiens
cagaggttaaagcag

SEQ ID NO: 292450 - DNA, 15 bp, Homo sapiens
tcagaggttaaagca

SEQ ID NO: 292451 - DNA, 15 bp, Homo sapiens
ttcagaggttaaagc

SEQ ID NO: 292452 - DNA, 15 bp, Homo sapiens
attcagaggttaaag

SEQ ID NO: 292453 - DNA, 15 bp, Homo sapiens
cattcagaggttaaa

SEQ ID NO: 292454 - DNA, 15 bp, Homo sapiens
acattcagaggttaa

SEQ ID NO: 292455 - DNA, 15 bp, Homo sapiens
cacattcagaggtta

SEQ ID NO: 292456 - DNA, 15 bp, Homo sapiens
ccacattcagaggtt

SEQ ID NO: 292457 - DNA, 15 bp, Homo sapiens
accacattcagaggt

SEQ ID NO: 292458 - DNA, 15 bp, Homo sapiens
aaccacattcagagg

SEQ ID NO: 292459 - DNA, 15 bp, Homo sapiens
gaaccacattcagag

SEQ ID NO: 292460 - DNA, 15 bp, Homo sapiens
ggaaccacattcaga

SEQ ID NO: 292461 - DNA, 15 bp, Homo sapiens
tggaaccacattcag

SEQ ID NO: 292462 - DNA, 15 bp, Homo sapiens
ctggaaccacattca

SEQ ID NO: 292463 - DNA, 15 bp, Homo sapiens
gctggaaccacattc

SEQ ID NO: 292464 - DNA, 15 bp, Homo sapiens
ggctggaaccacatt

SEQ ID NO: 292465 - DNA, 15 bp, Homo sapiens
aggctggaaccacat

SEQ ID NO: 292466 - DNA, 15 bp, Homo sapiens
caggctggaaccaca

SEQ ID NO: 292467 - DNA, 15 bp, Homo sapiens
tcaggctggaaccac

SEQ ID NO: 292468 - DNA, 15 bp, Homo sapiens
ttcaggctggaacca

SEQ ID NO: 292469 - DNA, 15 bp, Homo sapiens
attcaggctggaacc

SEQ ID NO: 292470 - DNA, 15 bp, Homo sapiens
gattcaggctggaac

SEQ ID NO: 292471 - DNA, 15 bp, Homo sapiens
agattcaggctggaa

SEQ ID NO: 292472 - DNA, 15 bp, Homo sapiens
cagattcaggctgga

SEQ ID NO: 292473 - DNA, 15 bp, Homo sapiens
tcagattcaggctgg

SEQ ID NO: 292474 - DNA, 15 bp, Homo sapiens
atcagattcaggctg

SEQ ID NO: 292475 - DNA, 15 bp, Homo sapiens
aatcagattcaggct

SEQ ID NO: 292476 - DNA, 15 bp, Homo sapiens
gaatcagattcaggc

SEQ ID NO: 292477 - DNA, 15 bp, Homo sapiens
ggaatcagattcagg

SEQ ID NO: 292478 - DNA, 15 bp, Homo sapiens
gggaatcagattcag

SEQ ID NO: 292479 - DNA, 15 bp, Homo sapiens
cgggaatcagattca

SEQ ID NO: 292480 - DNA, 15 bp, Homo sapiens
tcgggaatcagattc

SEQ ID NO: 292481 - DNA, 15 bp, Homo sapiens
ttcgggaatcagatt

SEQ ID NO: 292482 - DNA, 15 bp, Homo sapiens
attcgggaatcagat

SEQ ID NO: 292483 - DNA, 15 bp, Homo sapiens
gattcgggaatcaga

SEQ ID NO: 292484 - DNA, 15 bp, Homo sapiens
tgattcgggaatcag

SEQ ID NO: 292485 - DNA, 15 bp, Homo sapiens
ttgattcgggaatca

SEQ ID NO: 292486 - DNA, 15 bp, Homo sapiens
attgattcgggaatc

SEQ ID NO: 292487 - DNA, 15 bp, Homo sapiens
cattgattcgggaat

SEQ ID NO: 292488 - DNA, 15 bp, Homo sapiens
ccattgattcgggaa

SEQ ID NO: 292489 - DNA, 15 bp, Homo sapiens
accattgattcggga

SEQ ID NO: 292490 - DNA, 15 bp, Homo sapiens
caccattgattcggg

SEQ ID NO: 292491 - DNA, 15 bp, Homo sapiens
acaccattgattcgg

SEQ ID NO: 292492 - DNA, 15 bp, Homo sapiens
aacaccattgattcg

SEQ ID NO: 292493 - DNA, 15 bp, Homo sapiens
aaacaccattgattc

SEQ ID NO: 292494 - DNA, 15 bp, Homo sapiens
gaaacaccattgatt

SEQ ID NO: 292495 - DNA, 15 bp, Homo sapiens
ggaaacaccattgat

SEQ ID NO: 292496 - DNA, 15 bp, Homo sapiens
gggaaacaccattga

SEQ ID NO: 292497 - DNA, 15 bp, Homo sapiens
ggggaaacaccattg

SEQ ID NO: 292498 - DNA, 15 bp, Homo sapiens
tggggaaacaccatt

SEQ ID NO: 292499 - DNA, 15 bp, Homo sapiens
atggggaaacaccat

SEQ ID NO: 292500 - DNA, 15 bp, Homo sapiens
catggggaaacacca

SEQ ID NO: 292501 - DNA, 15 bp, Homo sapiens
ccatggggaaacacc

SEQ ID NO: 292502 - DNA, 15 bp, Homo sapiens
cccatggggaaacac

SEQ ID NO: 292503 - DNA, 15 bp, Homo sapiens
gcccatggggaaaca

SEQ ID NO: 292504 - DNA, 15 bp, Homo sapiens
agcccatggggaaac

SEQ ID NO: 292505 - DNA, 15 bp, Homo sapiens
aagcccatggggaaa

SEQ ID NO: 292506 - DNA, 15 bp, Homo sapiens
gaagcccatggggaa

SEQ ID NO: 292507 - DNA, 15 bp, Homo sapiens
agaagcccatgggga

SEQ ID NO: 292508 - DNA, 15 bp, Homo sapiens
gagaagcccatgggg

SEQ ID NO: 292509 - DNA, 15 bp, Homo sapiens
ggagaagcccatggg

SEQ ID NO: 292510 - DNA, 15 bp, Homo sapiens
aggagaagcccatgg

SEQ ID NO: 292511 - DNA, 15 bp, Homo sapiens
gaggagaagcccatg

SEQ ID NO: 292512 - DNA, 15 bp, Homo sapiens
tgaggagaagcccat

SEQ ID NO: 292513 - DNA, 15 bp, Homo sapiens
ctgaggagaagccca

SEQ ID NO: 292514 - DNA, 15 bp, Homo sapiens
gctgaggagaagccc

SEQ ID NO: 292515 - DNA, 15 bp, Homo sapiens
tgctgaggagaagcc

SEQ ID NO: 292516 - DNA, 15 bp, Homo sapiens
atgctgaggagaagc

SEQ ID NO: 292517 - DNA, 15 bp, Homo sapiens
aatgctgaggagaag

SEQ ID NO: 292518 - DNA, 15 bp, Homo sapiens
gaatgctgaggagaa

SEQ ID NO: 292519 - DNA, 15 bp, Homo sapiens
agaatgctgaggaga

SEQ ID NO: 292520 - DNA, 15 bp, Homo sapiens
cagaatgctgaggag

SEQ ID NO: 292521 - DNA, 15 bp, Homo sapiens
gcagaatgctgagga

SEQ ID NO: 292522 - DNA, 15 bp, Homo sapiens
tgcagaatgctgagg

SEQ ID NO: 292523 - DNA, 15 bp, Homo sapiens
gtgcagaatgctgag

SEQ ID NO: 292524 - DNA, 15 bp, Homo sapiens
agtgcagaatgctga

SEQ ID NO: 292525 - DNA, 15 bp, Homo sapiens
cagtgcagaatgctg

SEQ ID NO: 292526 - DNA, 15 bp, Homo sapiens
tcagtgcagaatgct

SEQ ID NO: 292527 - DNA, 15 bp, Homo sapiens
ctcagtgcagaatgc

SEQ ID NO: 292528 - DNA, 15 bp, Homo sapiens
gctcagtgcagaatg

SEQ ID NO: 292529 - DNA, 15 bp, Homo sapiens
agctcagtgcagaat

SEQ ID NO: 292530 - DNA, 15 bp, Homo sapiens
tagctcagtgcagaa

SEQ ID NO: 292531 - DNA, 15 bp, Homo sapiens
gtagctcagtgcaga

SEQ ID NO: 292532 - DNA, 15 bp, Homo sapiens
agtagctcagtgcag

SEQ ID NO: 292533 - DNA, 15 bp, Homo sapiens
gagtagctcagtgca

SEQ ID NO: 292534 - DNA, 15 bp, Homo sapiens
cgagtagctcagtgc

SEQ ID NO: 292535 - DNA, 15 bp, Homo sapiens
gcgagtagctcagtg

SEQ ID NO: 292536 - DNA, 15 bp, Homo sapiens
agcgagtagctcagt

SEQ ID NO: 292537 - DNA, 15 bp, Homo sapiens
aagcgagtagctcag

SEQ ID NO: 292538 - DNA, 15 bp, Homo sapiens
caagcgagtagctca

SEQ ID NO: 292539 - DNA, 15 bp, Homo sapiens
tcaagcgagtagctc

SEQ ID NO: 292540 - DNA, 15 bp, Homo sapiens
atcaagcgagtagct

SEQ ID NO: 292541 - DNA, 15 bp, Homo sapiens
gatcaagcgagtagc

SEQ ID NO: 292542 - DNA, 15 bp, Homo sapiens
ggatcaagcgagtag

SEQ ID NO: 292543 - DNA, 15 bp, Homo sapiens
tggatcaagcgagta

SEQ ID NO: 292544 - DNA, 15 bp, Homo sapiens
ctggatcaagcgagt

SEQ ID NO: 292545 - DNA, 15 bp, Homo sapiens
tctggatcaagcgag

SEQ ID NO: 292546 - DNA, 15 bp, Homo sapiens
atctggatcaagcga

SEQ ID NO: 292547 - DNA, 15 bp, Homo sapiens
catctggatcaagcg

SEQ ID NO: 292548 - DNA, 15 bp, Homo sapiens
gcatctggatcaagc

SEQ ID NO: 292549 - DNA, 15 bp, Homo sapiens
ggcatctggatcaag

SEQ ID NO: 292550 - DNA, 15 bp, Homo sapiens
aggcatctggatcaa

SEQ ID NO: 292551 - DNA, 15 bp, Homo sapiens
gaggcatctggatca

SEQ ID NO: 292552 - DNA, 15 bp, Homo sapiens
ggaggcatctggatc

SEQ ID NO: 292553 - DNA, 15 bp, Homo sapiens
cggaggcatctggat

SEQ ID NO: 292554 - DNA, 15 bp, Homo sapiens
ccggaggcatctgga

SEQ ID NO: 292555 - DNA, 15 bp, Homo sapiens
gccggaggcatctgg

SEQ ID NO: 292556 - DNA, 15 bp, Homo sapiens
ggccggaggcatctg

SEQ ID NO: 292557 - DNA, 15 bp, Homo sapiens
gggccggaggcatct

SEQ ID NO: 292558 - DNA, 15 bp, Homo sapiens
tgggccggaggcatc

SEQ ID NO: 292559 - DNA, 15 bp, Homo sapiens
gtgggccggaggcat

SEQ ID NO: 292560 - DNA, 15 bp, Homo sapiens
tgtgggccggaggca

SEQ ID NO: 292561 - DNA, 15 bp, Homo sapiens
ctgtgggccggaggc

SEQ ID NO: 292562 - DNA, 15 bp, Homo sapiens
actgtgggccggagg

SEQ ID NO: 292563 - DNA, 15 bp, Homo sapiens
aactgtgggccggag

SEQ ID NO: 292564 - DNA, 15 bp, Homo sapiens
gaactgtgggccgga

SEQ ID NO: 292565 - DNA, 15 bp, Homo sapiens
ggaactgtgggccgg

SEQ ID NO: 292566 - DNA, 15 bp, Homo sapiens
tggaactgtgggccg

SEQ ID NO: 292567 - DNA, 15 bp, Homo sapiens
gtggaactgtgggcc

SEQ ID NO: 292568 - DNA, 15 bp, Homo sapiens
ggtggaactgtgggc

SEQ ID NO: 292569 - DNA, 15 bp, Homo sapiens
tggtggaactgtggg

SEQ ID NO: 292570 - DNA, 15 bp, Homo sapiens
ctggtggaactgtgg

SEQ ID NO: 292571 - DNA, 15 bp, Homo sapiens
cctggtggaactgtg

SEQ ID NO: 292572 - DNA, 15 bp, Homo sapiens
gcctggtggaactgt

SEQ ID NO: 292573 - DNA, 15 bp, Homo sapiens
tgcctggtggaactg

SEQ ID NO: 292574 - DNA, 15 bp, Homo sapiens
ctgcctggtggaact

SEQ ID NO: 292575 - DNA, 15 bp, Homo sapiens
cctgcctggtggaac

SEQ ID NO: 292576 - DNA, 15 bp, Homo sapiens
acctgcctggtggaa

SEQ ID NO: 292577 - DNA, 15 bp, Homo sapiens
gacctgcctggtgga

SEQ ID NO: 292578 - DNA, 15 bp, Homo sapiens
cgacctgcctggtgg

SEQ ID NO: 292579 - DNA, 15 bp, Homo sapiens
ccgacctgcctggtg

SEQ ID NO: 292580 - DNA, 15 bp, Homo sapiens
accgacctgcctggt

SEQ ID NO: 292581 - DNA, 15 bp, Homo sapiens
caccgacctgcctgg

SEQ ID NO: 292582 - DNA, 15 bp, Homo sapiens
acaccgacctgcctg

SEQ ID NO: 292583 - DNA, 15 bp, Homo sapiens
gacaccgacctgcct

SEQ ID NO: 292584 - DNA, 15 bp, Homo sapiens
ggacaccgacctgcc

SEQ ID NO: 292585 - DNA, 15 bp, Homo sapiens
gggacaccgacctgc

SEQ ID NO: 292586 - DNA, 15 bp, Homo sapiens
ggggacaccgacctg

SEQ ID NO: 292587 - DNA, 15 bp, Homo sapiens
tggggacaccgacct

SEQ ID NO: 292588 - DNA, 15 bp, Homo sapiens
ctggggacaccgacc

SEQ ID NO: 292589 - DNA, 15 bp, Homo sapiens
gctggggacaccgac

SEQ ID NO: 292590 - DNA, 15 bp, Homo sapiens
tgctggggacaccga

SEQ ID NO: 292591 - DNA, 15 bp, Homo sapiens
gtgctggggacaccg

SEQ ID NO: 292592 - DNA, 15 bp, Homo sapiens
tgtgctggggacacc

SEQ ID NO: 292593 - DNA, 15 bp, Homo sapiens
gtgtgctggggacac

SEQ ID NO: 292594 - DNA, 15 bp, Homo sapiens
tgtgtgctggggaca

SEQ ID NO: 292595 - DNA, 15 bp, Homo sapiens
ctgtgtgctggggac

SEQ ID NO: 292596 - DNA, 15 bp, Homo sapiens
gctgtgtgctgggga

SEQ ID NO: 292597 - DNA, 15 bp, Homo sapiens
agctgtgtgctgggg

SEQ ID NO: 292598 - DNA, 15 bp, Homo sapiens
gagctgtgtgctggg

SEQ ID NO: 292599 - DNA, 15 bp, Homo sapiens
ggagctgtgtgctgg

SEQ ID NO: 292600 - DNA, 15 bp, Homo sapiens
aggagctgtgtgctg

SEQ ID NO: 292601 - DNA, 15 bp, Homo sapiens
gaggagctgtgtgct

SEQ ID NO: 292602 - DNA, 15 bp, Homo sapiens
agaggagctgtgtgc

SEQ ID NO: 292603 - DNA, 15 bp, Homo sapiens
cagaggagctgtgtg

SEQ ID NO: 292604 - DNA, 15 bp, Homo sapiens
gcagaggagctgtgt

SEQ ID NO: 292605 - DNA, 15 bp, Homo sapiens
agcagaggagctgtg

SEQ ID NO: 292606 - DNA, 15 bp, Homo sapiens
cagcagaggagctgt

SEQ ID NO: 292607 - DNA, 15 bp, Homo sapiens
tcagcagaggagctg

SEQ ID NO: 292608 - DNA, 15 bp, Homo sapiens
ctcagcagaggagct

SEQ ID NO: 292609 - DNA, 15 bp, Homo sapiens
actcagcagaggagc

SEQ ID NO: 292610 - DNA, 15 bp, Homo sapiens
gactcagcagaggag

SEQ ID NO: 292611 - DNA, 15 bp, Homo sapiens
agactcagcagagga

SEQ ID NO: 292612 - DNA, 15 bp, Homo sapiens
cagactcagcagagg

SEQ ID NO: 292613 - DNA, 15 bp, Homo sapiens
gcagactcagcagag

SEQ ID NO: 292614 - DNA, 15 bp, Homo sapiens
agcagactcagcaga

SEQ ID NO: 292615 - DNA, 15 bp, Homo sapiens
aagcagactcagcag

SEQ ID NO: 292616 - DNA, 15 bp, Homo sapiens
aaagcagactcagca

SEQ ID NO: 292617 - DNA, 15 bp, Homo sapiens
caaagcagactcagc

SEQ ID NO: 292618 - DNA, 15 bp, Homo sapiens
acaaagcagactcag

SEQ ID NO: 292619 - DNA, 15 bp, Homo sapiens
cacaaagcagactca

SEQ ID NO: 292620 - DNA, 15 bp, Homo sapiens
gcacaaagcagactc

SEQ ID NO: 292621 - DNA, 15 bp, Homo sapiens
agcacaaagcagact

SEQ ID NO: 292622 - DNA, 15 bp, Homo sapiens
aagcacaaagcagac

SEQ ID NO: 292623 - DNA, 15 bp, Homo sapiens
aaagcacaaagcaga

SEQ ID NO: 292624 - DNA, 15 bp, Homo sapiens
caaagcacaaagcag

SEQ ID NO: 292625 - DNA, 15 bp, Homo sapiens
gcaaagcacaaagca

SEQ ID NO: 292626 - DNA, 15 bp, Homo sapiens
ggcaaagcacaaagc

SEQ ID NO: 292627 - DNA, 15 bp, Homo sapiens
tggcaaagcacaaag

SEQ ID NO: 292628 - DNA, 15 bp, Homo sapiens
atggcaaagcacaaa

SEQ ID NO: 292629 - DNA, 15 bp, Homo sapiens
aatggcaaagcacaa

SEQ ID NO: 292630 - DNA, 15 bp, Homo sapiens
taatggcaaagcaca

SEQ ID NO: 292631 - DNA, 15 bp, Homo sapiens
ctaatggcaaagcac

SEQ ID NO: 292632 - DNA, 15 bp, Homo sapiens
actaatggcaaagca

SEQ ID NO: 292633 - DNA, 15 bp, Homo sapiens
aactaatggcaaagc

SEQ ID NO: 292634 - DNA, 15 bp, Homo sapiens
aaactaatggcaaag

SEQ ID NO: 292635 - DNA, 15 bp, Homo sapiens
caaactaatggcaaa

SEQ ID NO: 292636 - DNA, 15 bp, Homo sapiens
acaaactaatggcaa

SEQ ID NO: 292637 - DNA, 15 bp, Homo sapiens
cacaaactaatggca

SEQ ID NO: 292638 - DNA, 15 bp, Homo sapiens
acacaaactaatggc

SEQ ID NO: 292639 - DNA, 15 bp, Homo sapiens
aacacaaactaatgg

SEQ ID NO: 292640 - DNA, 15 bp, Homo sapiens
aaacacaaactaatg

SEQ ID NO: 292641 - DNA, 15 bp, Homo sapiens
gaaacacaaactaat

SEQ ID NO: 292642 - DNA, 15 bp, Homo sapiens
ggaaacacaaactaa

SEQ ID NO: 292643 - DNA, 15 bp, Homo sapiens
aggaaacacaaacta

SEQ ID NO: 292644 - DNA, 15 bp, Homo sapiens
caggaaacacaaact

SEQ ID NO: 292645 - DNA, 15 bp, Homo sapiens
acaggaaacacaaac

SEQ ID NO: 292646 - DNA, 15 bp, Homo sapiens
aacaggaaacacaaa

SEQ ID NO: 292647 - DNA, 15 bp, Homo sapiens
taacaggaaacacaa

SEQ ID NO: 292648 - DNA, 15 bp, Homo sapiens
ttaacaggaaacaca

SEQ ID NO: 292649 - DNA, 15 bp, Homo sapiens
cttaacaggaaacac

SEQ ID NO: 292650 - DNA, 15 bp, Homo sapiens
acttaacaggaaaca

SEQ ID NO: 292651 - DNA, 15 bp, Homo sapiens
tacttaacaggaaac

SEQ ID NO: 292652 - DNA, 15 bp, Homo sapiens
ttacttaacaggaaa

SEQ ID NO: 292653 - DNA, 15 bp, Homo sapiens
gttacttaacaggaa

SEQ ID NO: 292654 - DNA, 15 bp, Homo sapiens
tgttacttaacagga

SEQ ID NO: 292655 - DNA, 15 bp, Homo sapiens
atgttacttaacagg

SEQ ID NO: 292656 - DNA, 15 bp, Homo sapiens
aatgttacttaacag

SEQ ID NO: 292657 - DNA, 15 bp, Homo sapiens
gaatgttacttaaca

SEQ ID NO: 292658 - DNA, 15 bp, Homo sapiens
ggaatgttacttaac

SEQ ID NO: 292659 - DNA, 15 bp, Homo sapiens
aggaatgttacttaa

SEQ ID NO: 292660 - DNA, 15 bp, Homo sapiens
taggaatgttactta

SEQ ID NO: 292661 - DNA, 15 bp, Homo sapiens
gtaggaatgttactt

SEQ ID NO: 292662 - DNA, 15 bp, Homo sapiens
tgtaggaatgttact

SEQ ID NO: 292663 - DNA, 15 bp, Homo sapiens
gtgtaggaatgttac

SEQ ID NO: 292664 - DNA, 15 bp, Homo sapiens
tgtgtaggaatgtta

SEQ ID NO: 292665 - DNA, 15 bp, Homo sapiens
gtgtgtaggaatgtt

SEQ ID NO: 292666 - DNA, 15 bp, Homo sapiens
agtgtgtaggaatgt

SEQ ID NO: 292667 - DNA, 15 bp, Homo sapiens
cagtgtgtaggaatg

SEQ ID NO: 292668 - DNA, 15 bp, Homo sapiens
ccagtgtgtaggaat

SEQ ID NO: 292669 - DNA, 15 bp, Homo sapiens
accagtgtgtaggaa

SEQ ID NO: 292670 - DNA, 15 bp, Homo sapiens
caccagtgtgtagga

SEQ ID NO: 292671 - DNA, 15 bp, Homo sapiens
gcaccagtgtgtagg

SEQ ID NO: 292672 - DNA, 15 bp, Homo sapiens
ggcaccagtgtgtag

SEQ ID NO: 292673 - DNA, 15 bp, Homo sapiens
aggcaccagtgtgta

SEQ ID NO: 292674 - DNA, 15 bp, Homo sapiens
aaggcaccagtgtgt

SEQ ID NO: 292675 - DNA, 15 bp, Homo sapiens
taaggcaccagtgtg

SEQ ID NO: 292676 - DNA, 15 bp, Homo sapiens
ctaaggcaccagtgt

SEQ ID NO: 292677 - DNA, 15 bp, Homo sapiens
cctaaggcaccagtg

SEQ ID NO: 292678 - DNA, 15 bp, Homo sapiens
tcctaaggcaccagt

SEQ ID NO: 292679 - DNA, 15 bp, Homo sapiens
ttcctaaggcaccag

SEQ ID NO: 292680 - DNA, 15 bp, Homo sapiens
cttcctaaggcacca

SEQ ID NO: 292681 - DNA, 15 bp, Homo sapiens
acttcctaaggcacc

SEQ ID NO: 292682 - DNA, 15 bp, Homo sapiens
tacttcctaaggcac

SEQ ID NO: 292683 - DNA, 15 bp, Homo sapiens
ttacttcctaaggca

SEQ ID NO: 292684 - DNA, 15 bp, Homo sapiens
tttacttcctaaggc

SEQ ID NO: 292685 - DNA, 15 bp, Homo sapiens
ttttacttcctaagg

SEQ ID NO: 292686 - DNA, 15 bp, Homo sapiens
cttttacttcctaag

SEQ ID NO: 292687 - DNA, 15 bp, Homo sapiens
tcttttacttcctaa

SEQ ID NO: 292688 - DNA, 15 bp, Homo sapiens
ctcttttacttccta

SEQ ID NO: 292689 - DNA, 15 bp, Homo sapiens
actcttttacttcct

SEQ ID NO: 292690 - DNA, 15 bp, Homo sapiens
aactcttttacttcc

SEQ ID NO: 292691 - DNA, 15 bp, Homo sapiens
aaactcttttacttc

SEQ ID NO: 292692 - DNA, 15 bp, Homo sapiens
aaaactcttttactt

SEQ ID NO: 292693 - DNA, 15 bp, Homo sapiens
aaaaactcttttact

SEQ ID NO: 292694 - DNA, 15 bp, Homo sapiens
aaaaaactcttttac

SEQ ID NO: 292695 - DNA, 15 bp, Homo sapiens
caaaaaactctttta

SEQ ID NO: 292696 - DNA, 15 bp, Homo sapiens
acaaaaaactctttt

SEQ ID NO: 292697 - DNA, 15 bp, Homo sapiens
tacaaaaaactcttt

SEQ ID NO: 292698 - DNA, 15 bp, Homo sapiens
atacaaaaaactctt

SEQ ID NO: 292699 - DNA, 15 bp, Homo sapiens
aatacaaaaaactct

SEQ ID NO: 292700 - DNA, 15 bp, Homo sapiens
aaatacaaaaaactc

SEQ ID NO: 292701 - DNA, 15 bp, Homo sapiens
caaatacaaaaaact

SEQ ID NO: 292702 - DNA, 15 bp, Homo sapiens
ccaaatacaaaaaac

SEQ ID NO: 292703 - DNA, 15 bp, Homo sapiens
accaaatacaaaaaa

SEQ ID NO: 292704 - DNA, 15 bp, Homo sapiens
gaccaaatacaaaaa

SEQ ID NO: 292705 - DNA, 15 bp, Homo sapiens
agaccaaatacaaaa

SEQ ID NO: 292706 - DNA, 15 bp, Homo sapiens
aagaccaaatacaaa

SEQ ID NO: 292707 - DNA, 15 bp, Homo sapiens
taagaccaaatacaa

SEQ ID NO: 292708 - DNA, 15 bp, Homo sapiens
ttaagaccaaataca

SEQ ID NO: 292709 - DNA, 15 bp, Homo sapiens
tttaagaccaaatac

SEQ ID NO: 292710 - DNA, 15 bp, Homo sapiens
atttaagaccaaata

SEQ ID NO: 292711 - DNA, 15 bp, Homo sapiens
tatttaagaccaaat

SEQ ID NO: 292712 - DNA, 15 bp, Homo sapiens
ctatttaagaccaaa

SEQ ID NO: 292713 - DNA, 15 bp, Homo sapiens
cctatttaagaccaa

SEQ ID NO: 292714 - DNA, 15 bp, Homo sapiens
acctatttaagacca

SEQ ID NO: 292715 - DNA, 15 bp, Homo sapiens
cacctatttaagacc

SEQ ID NO: 292716 - DNA, 15 bp, Homo sapiens
gcacctatttaagac

SEQ ID NO: 292717 - DNA, 15 bp, Homo sapiens
tgcacctatttaaga

SEQ ID NO: 292718 - DNA, 15 bp, Homo sapiens
ttgcacctatttaag

SEQ ID NO: 292719 - DNA, 15 bp, Homo sapiens
tttgcacctatttaa

SEQ ID NO: 292720 - DNA, 15 bp, Homo sapiens
atttgcacctattta

SEQ ID NO: 292721 - DNA, 15 bp, Homo sapiens
gatttgcacctattt

SEQ ID NO: 292722 - DNA, 15 bp, Homo sapiens
ggatttgcacctatt

SEQ ID NO: 292723 - DNA, 15 bp, Homo sapiens
tggatttgcacctat

SEQ ID NO: 292724 - DNA, 15 bp, Homo sapiens
atggatttgcaccta

SEQ ID NO: 292725 - DNA, 15 bp, Homo sapiens
aatggatttgcacct

SEQ ID NO: 292726 - DNA, 15 bp, Homo sapiens
aaatggatttgcacc

SEQ ID NO: 292727 - DNA, 15 bp, Homo sapiens
gaaatggatttgcac

SEQ ID NO: 292728 - DNA, 15 bp, Homo sapiens
tgaaatggatttgca

SEQ ID NO: 292729 - DNA, 15 bp, Homo sapiens
ttgaaatggatttgc

SEQ ID NO: 292730 - DNA, 15 bp, Homo sapiens
gttgaaatggatttg

SEQ ID NO: 292731 - DNA, 15 bp, Homo sapiens
tgttgaaatggattt

SEQ ID NO: 292732 - DNA, 15 bp, Homo sapiens
ttgttgaaatggatt

SEQ ID NO: 292733 - DNA, 15 bp, Homo sapiens
attgttgaaatggat

SEQ ID NO: 292734 - DNA, 15 bp, Homo sapiens
tattgttgaaatgga

SEQ ID NO: 292735 - DNA, 15 bp, Homo sapiens
atattgttgaaatgg

SEQ ID NO: 292736 - DNA, 15 bp, Homo sapiens
gatattgttgaaatg

SEQ ID NO: 292737 - DNA, 15 bp, Homo sapiens
tgatattgttgaaat

SEQ ID NO: 292738 - DNA, 15 bp, Homo sapiens
ttgatattgttgaaa

SEQ ID NO: 292739 - DNA, 15 bp, Homo sapiens
tttgatattgttgaa

SEQ ID NO: 292740 - DNA, 15 bp, Homo sapiens
ttttgatattgttga

SEQ ID NO: 292741 - DNA, 15 bp, Homo sapiens
tttttgatattgttg

SEQ ID NO: 292742 - DNA, 15 bp, Homo sapiens
ctttttgatattgtt

SEQ ID NO: 292743 - DNA, 15 bp, Homo sapiens
gctttttgatattgt

SEQ ID NO: 292744 - DNA, 15 bp, Homo sapiens
tgctttttgatattg

SEQ ID NO: 292745 - DNA, 15 bp, Homo sapiens
ttgctttttgatatt

SEQ ID NO: 292746 - DNA, 15 bp, Homo sapiens
tttgctttttgatat

SEQ ID NO: 292747 - DNA, 15 bp, Homo sapiens
gtttgctttttgata

SEQ ID NO: 292748 - DNA, 15 bp, Homo sapiens
tgtttgctttttgat

SEQ ID NO: 292749 - DNA, 15 bp, Homo sapiens
atgtttgctttttga

SEQ ID NO: 292750 - DNA, 15 bp, Homo sapiens
aatgtttgctttttg

SEQ ID NO: 292751 - DNA, 15 bp, Homo sapiens
aaatgtttgcttttt

SEQ ID NO: 292752 - DNA, 15 bp, Homo sapiens
aaaatgtttgctttt

SEQ ID NO: 292753 - DNA, 15 bp, Homo sapiens
gaaaatgtttgcttt

SEQ ID NO: 292754 - DNA, 15 bp, Homo sapiens
tgaaaatgtttgctt

SEQ ID NO: 292755 - DNA, 15 bp, Homo sapiens
ttgaaaatgtttgct

SEQ ID NO: 292756 - DNA, 15 bp, Homo sapiens
tttgaaaatgtttgc

SEQ ID NO: 292757 - DNA, 15 bp, Homo sapiens
atttgaaaatgtttg

SEQ ID NO: 292758 - DNA, 15 bp, Homo sapiens
tatttgaaaatgttt

SEQ ID NO: 292759 - DNA, 15 bp, Homo sapiens
ttatttgaaaatgtt

SEQ ID NO: 292760 - DNA, 15 bp, Homo sapiens
cttatttgaaaatgt

SEQ ID NO: 292761 - DNA, 15 bp, Homo sapiens
gcttatttgaaaatg

SEQ ID NO: 292762 - DNA, 15 bp, Homo sapiens
agcttatttgaaaat

SEQ ID NO: 292763 - DNA, 15 bp, Homo sapiens
tagcttatttgaaaa

SEQ ID NO: 292764 - DNA, 15 bp, Homo sapiens
atagcttatttgaaa

SEQ ID NO: 292765 - DNA, 15 bp, Homo sapiens
tatagcttatttgaa

SEQ ID NO: 292766 - DNA, 15 bp, Homo sapiens
ttatagcttatttga

SEQ ID NO: 292767 - DNA, 15 bp, Homo sapiens
attatagcttatttg

SEQ ID NO: 292768 - DNA, 15 bp, Homo sapiens
tattatagcttattt

SEQ ID NO: 292769 - DNA, 15 bp, Homo sapiens
gtattatagcttatt

SEQ ID NO: 292770 - DNA, 15 bp, Homo sapiens
tgtattatagcttat

SEQ ID NO: 292771 - DNA, 15 bp, Homo sapiens
gtgtattatagctta

SEQ ID NO: 292772 - DNA, 15 bp, Homo sapiens
agtgtattatagctt

SEQ ID NO: 292773 - DNA, 15 bp, Homo sapiens
aagtgtattatagct

SEQ ID NO: 292774 - DNA, 15 bp, Homo sapiens
caagtgtattatagc

SEQ ID NO: 292775 - DNA, 15 bp, Homo sapiens
acaagtgtattatag

SEQ ID NO: 292776 - DNA, 15 bp, Homo sapiens
aacaagtgtattata

SEQ ID NO: 292777 - DNA, 15 bp, Homo sapiens
aaacaagtgtattat

SEQ ID NO: 292778 - DNA, 15 bp, Homo sapiens
taaacaagtgtatta

SEQ ID NO: 292779 - DNA, 15 bp, Homo sapiens
ataaacaagtgtatt

SEQ ID NO: 292780 - DNA, 15 bp, Homo sapiens
tataaacaagtgtat

SEQ ID NO: 292781 - DNA, 15 bp, Homo sapiens
atataaacaagtgta

SEQ ID NO: 292782 - DNA, 15 bp, Homo sapiens
tatataaacaagtgt

SEQ ID NO: 292783 - DNA, 15 bp, Homo sapiens
ttatataaacaagtg

SEQ ID NO: 292784 - DNA, 15 bp, Homo sapiens
attatataaacaagt

SEQ ID NO: 292785 - DNA, 15 bp, Homo sapiens
gattatataaacaag

SEQ ID NO: 292786 - DNA, 15 bp, Homo sapiens
agattatataaacaa

SEQ ID NO: 292787 - DNA, 15 bp, Homo sapiens
cagattatataaaca

SEQ ID NO: 292788 - DNA, 15 bp, Homo sapiens
acagattatataaac

SEQ ID NO: 292789 - DNA, 15 bp, Homo sapiens
tacagattatataaa

SEQ ID NO: 292790 - DNA, 15 bp, Homo sapiens
ctacagattatataa

SEQ ID NO: 292791 - DNA, 15 bp, Homo sapiens
tctacagattatata

SEQ ID NO: 292792 - DNA, 15 bp, Homo sapiens
ttctacagattatat

SEQ ID NO: 292793 - DNA, 15 bp, Homo sapiens
cttctacagattata

SEQ ID NO: 292794 - DNA, 15 bp, Homo sapiens
acttctacagattat

SEQ ID NO: 292795 - DNA, 15 bp, Homo sapiens
cacttctacagatta

SEQ ID NO: 292796 - DNA, 15 bp, Homo sapiens
ccacttctacagatt

SEQ ID NO: 292797 - DNA, 15 bp, Homo sapiens
tccacttctacagat

SEQ ID NO: 292798 - DNA, 15 bp, Homo sapiens
atccacttctacaga

SEQ ID NO: 292799 - DNA, 15 bp, Homo sapiens
aatccacttctacag

SEQ ID NO: 292800 - DNA, 15 bp, Homo sapiens
caatccacttctaca

SEQ ID NO: 292801 - DNA, 15 bp, Homo sapiens
tcaatccacttctac

SEQ ID NO: 292802 - DNA, 15 bp, Homo sapiens
ttcaatccacttcta

SEQ ID NO: 292803 - DNA, 15 bp, Homo sapiens
cttcaatccacttct

SEQ ID NO: 292804 - DNA, 15 bp, Homo sapiens
acttcaatccacttc

SEQ ID NO: 292805 - DNA, 15 bp, Homo sapiens
aacttcaatccactt

SEQ ID NO: 292806 - DNA, 15 bp, Homo sapiens
aaacttcaatccact

SEQ ID NO: 292807 - DNA, 15 bp, Homo sapiens
caaacttcaatccac

SEQ ID NO: 292808 - DNA, 15 bp, Homo sapiens
ccaaacttcaatcca

SEQ ID NO: 292809 - DNA, 15 bp, Homo sapiens
tccaaacttcaatcc

SEQ ID NO: 292810 - DNA, 15 bp, Homo sapiens
atccaaacttcaatc

SEQ ID NO: 292811 - DNA, 15 bp, Homo sapiens
catccaaacttcaat

SEQ ID NO: 292812 - DNA, 15 bp, Homo sapiens
tcatccaaacttcaa

SEQ ID NO: 292813 - DNA, 15 bp, Homo sapiens
ttcatccaaacttca

SEQ ID NO: 292814 - DNA, 15 bp, Homo sapiens
tttcatccaaacttc

SEQ ID NO: 292815 - DNA, 15 bp, Homo sapiens
ttttcatccaaactt

SEQ ID NO: 292816 - DNA, 15 bp, Homo sapiens
tttttcatccaaact

SEQ ID NO: 292817 - DNA, 15 bp, Homo sapiens
ctttttcatccaaac

SEQ ID NO: 292818 - DNA, 15 bp, Homo sapiens
gctttttcatccaaa

SEQ ID NO: 292819 - DNA, 15 bp, Homo sapiens
ggctttttcatccaa

SEQ ID NO: 292820 - DNA, 15 bp, Homo sapiens
aggctttttcatcca

SEQ ID NO: 292821 - DNA, 15 bp, Homo sapiens
gaggctttttcatcc

SEQ ID NO: 292822 - DNA, 15 bp, Homo sapiens
ggaggctttttcatc

SEQ ID NO: 292823 - DNA, 15 bp, Homo sapiens
aggaggctttttcat

SEQ ID NO: 292824 - DNA, 15 bp, Homo sapiens
gaggaggctttttca

SEQ ID NO: 292825 - DNA, 15 bp, Homo sapiens
agaggaggctttttc

SEQ ID NO: 292826 - DNA, 15 bp, Homo sapiens
cagaggaggcttttt

SEQ ID NO: 292827 - DNA, 15 bp, Homo sapiens
gcagaggaggctttt

SEQ ID NO: 292828 - DNA, 15 bp, Homo sapiens
ggcagaggaggcttt

SEQ ID NO: 292829 - DNA, 15 bp, Homo sapiens
gggcagaggaggctt

SEQ ID NO: 292830 - DNA, 15 bp, Homo sapiens
agggcagaggaggct

SEQ ID NO: 292831 - DNA, 15 bp, Homo sapiens
aagggcagaggaggc

SEQ ID NO: 292832 - DNA, 15 bp, Homo sapiens
aaagggcagaggagg

SEQ ID NO: 292833 - DNA, 15 bp, Homo sapiens
taaagggcagaggag

SEQ ID NO: 292834 - DNA, 15 bp, Homo sapiens
ctaaagggcagagga

SEQ ID NO: 292835 - DNA, 15 bp, Homo sapiens
tctaaagggcagagg

SEQ ID NO: 292836 - DNA, 15 bp, Homo sapiens
ttctaaagggcagag

SEQ ID NO: 292837 - DNA, 15 bp, Homo sapiens
attctaaagggcaga

SEQ ID NO: 292838 - DNA, 15 bp, Homo sapiens
cattctaaagggcag

SEQ ID NO: 292839 - DNA, 15 bp, Homo sapiens
tcattctaaagggca

SEQ ID NO: 292840 - DNA, 15 bp, Homo sapiens
ctcattctaaagggc

SEQ ID NO: 292841 - DNA, 15 bp, Homo sapiens
gctcattctaaaggg

SEQ ID NO: 292842 - DNA, 15 bp, Homo sapiens
tgctcattctaaagg

SEQ ID NO: 292843 - DNA, 15 bp, Homo sapiens
ttgctcattctaaag

SEQ ID NO: 292844 - DNA, 15 bp, Homo sapiens
cttgctcattctaaa

SEQ ID NO: 292845 - DNA, 15 bp, Homo sapiens
tcttgctcattctaa

SEQ ID NO: 292846 - DNA, 15 bp, Homo sapiens
ttcttgctcattcta

SEQ ID NO: 292847 - DNA, 15 bp, Homo sapiens
tttcttgctcattct

SEQ ID NO: 292848 - DNA, 15 bp, Homo sapiens
atttcttgctcattc

SEQ ID NO: 292849 - DNA, 15 bp, Homo sapiens
aatttcttgctcatt

SEQ ID NO: 292850 - DNA, 15 bp, Homo sapiens
taatttcttgctcat

SEQ ID NO: 292851 - DNA, 15 bp, Homo sapiens
ttaatttcttgctca

SEQ ID NO: 292852 - DNA, 15 bp, Homo sapiens
tttaatttcttgctc

SEQ ID NO: 292853 - DNA, 15 bp, Homo sapiens
atttaatttcttgct

SEQ ID NO: 292854 - DNA, 15 bp, Homo sapiens
aatttaatttcttgc

SEQ ID NO: 292855 - DNA, 15 bp, Homo sapiens
taatttaatttcttg

SEQ ID NO: 292856 - DNA, 15 bp, Homo sapiens
ataatttaatttctt

SEQ ID NO: 292857 - DNA, 15 bp, Homo sapiens
aataatttaatttct

SEQ ID NO: 292858 - DNA, 15 bp, Homo sapiens
aaataatttaatttc

SEQ ID NO: 292859 - DNA, 15 bp, Homo sapiens
caaataatttaattt

SEQ ID NO: 292860 - DNA, 15 bp, Homo sapiens
gcaaataatttaatt

SEQ ID NO: 292861 - DNA, 15 bp, Homo sapiens
agcaaataatttaat

SEQ ID NO: 292862 - DNA, 15 bp, Homo sapiens
aagcaaataatttaa

SEQ ID NO: 292863 - DNA, 15 bp, Homo sapiens
taagcaaataattta

SEQ ID NO: 292864 - DNA, 15 bp, Homo sapiens
ataagcaaataattt

SEQ ID NO: 292865 - DNA, 15 bp, Homo sapiens
cataagcaaataatt

SEQ ID NO: 292866 - DNA, 15 bp, Homo sapiens
tcataagcaaataat

SEQ ID NO: 292867 - DNA, 15 bp, Homo sapiens
ttcataagcaaataa

SEQ ID NO: 292868 - DNA, 15 bp, Homo sapiens
attcataagcaaata

SEQ ID NO: 292869 - DNA, 15 bp, Homo sapiens
cattcataagcaaat

SEQ ID NO: 292870 - DNA, 15 bp, Homo sapiens
tcattcataagcaaa

SEQ ID NO: 292871 - DNA, 15 bp, Homo sapiens
atcattcataagcaa

SEQ ID NO: 292872 - DNA, 15 bp, Homo sapiens
aatcattcataagca

SEQ ID NO: 292873 - DNA, 15 bp, Homo sapiens
aaatcattcataagc

SEQ ID NO: 292874 - DNA, 15 bp, Homo sapiens
aaaatcattcataag

SEQ ID NO: 292875 - DNA, 15 bp, Homo sapiens
aaaaatcattcataa

SEQ ID NO: 292876 - DNA, 15 bp, Homo sapiens
aaaaaatcattcata

SEQ ID NO: 292877 - DNA, 15 bp, Homo sapiens
aaaaaaatcattcat

SEQ ID NO: 292878 - DNA, 15 bp, Homo sapiens
taaaaaaatcattca

SEQ ID NO: 292879 - DNA, 15 bp, Homo sapiens
ctaaaaaaatcattc

SEQ ID NO: 292880 - DNA, 15 bp, Homo sapiens
actaaaaaaatcatt

SEQ ID NO: 292881 - DNA, 15 bp, Homo sapiens
tactaaaaaaatcat

SEQ ID NO: 292882 - DNA, 15 bp, Homo sapiens
gtactaaaaaaatca

SEQ ID NO: 292883 - DNA, 15 bp, Homo sapiens
tgtactaaaaaaatc

SEQ ID NO: 292884 - DNA, 15 bp, Homo sapiens
gtgtactaaaaaaat

SEQ ID NO: 292885 - DNA, 15 bp, Homo sapiens
agtgtactaaaaaaa

SEQ ID NO: 292886 - DNA, 15 bp, Homo sapiens
aagtgtactaaaaaa

SEQ ID NO: 292887 - DNA, 15 bp, Homo sapiens
aaagtgtactaaaaa

SEQ ID NO: 292888 - DNA, 15 bp, Homo sapiens
gaaagtgtactaaaa

SEQ ID NO: 292889 - DNA, 15 bp, Homo sapiens
agaaagtgtactaaa

SEQ ID NO: 292890 - DNA, 15 bp, Homo sapiens
cagaaagtgtactaa

SEQ ID NO: 292891 - DNA, 15 bp, Homo sapiens
acagaaagtgtacta

SEQ ID NO: 292892 - DNA, 15 bp, Homo sapiens
gacagaaagtgtact

SEQ ID NO: 292893 - DNA, 15 bp, Homo sapiens
agacagaaagtgtac

SEQ ID NO: 292894 - DNA, 15 bp, Homo sapiens
gagacagaaagtgta

SEQ ID NO: 292895 - DNA, 15 bp, Homo sapiens
agagacagaaagtgt

SEQ ID NO: 292896 - DNA, 15 bp, Homo sapiens
tagagacagaaagtg

SEQ ID NO: 292897 - DNA, 15 bp, Homo sapiens
ttagagacagaaagt

SEQ ID NO: 292898 - DNA, 15 bp, Homo sapiens
tttagagacagaaag

SEQ ID NO: 292899 - DNA, 15 bp, Homo sapiens
ttttagagacagaaa

SEQ ID NO: 292900 - DNA, 15 bp, Homo sapiens
attttagagacagaa

SEQ ID NO: 292901 - DNA, 15 bp, Homo sapiens
cattttagagacaga

SEQ ID NO: 292902 - DNA, 15 bp, Homo sapiens
acattttagagacag

SEQ ID NO: 292903 - DNA, 15 bp, Homo sapiens
aacattttagagaca

SEQ ID NO: 292904 - DNA, 15 bp, Homo sapiens
taacattttagagac

SEQ ID NO: 292905 - DNA, 15 bp, Homo sapiens
gtaacattttagaga

SEQ ID NO: 292906 - DNA, 15 bp, Homo sapiens
tgtaacattttagag

SEQ ID NO: 292907 - DNA, 15 bp, Homo sapiens
atgtaacattttaga

SEQ ID NO: 292908 - DNA, 15 bp, Homo sapiens
aatgtaacattttag

SEQ ID NO: 292909 - DNA, 15 bp, Homo sapiens
caatgtaacatttta

SEQ ID NO: 292910 - DNA, 15 bp, Homo sapiens
ccaatgtaacatttt

SEQ ID NO: 292911 - DNA, 15 bp, Homo sapiens
accaatgtaacattt

SEQ ID NO: 292912 - DNA, 15 bp, Homo sapiens
caccaatgtaacatt

SEQ ID NO: 292913 - DNA, 15 bp, Homo sapiens
gcaccaatgtaacat

SEQ ID NO: 292914 - DNA, 15 bp, Homo sapiens
tgcaccaatgtaaca

SEQ ID NO: 292915 - DNA, 15 bp, Homo sapiens
atgcaccaatgtaac

SEQ ID NO: 292916 - DNA, 15 bp, Homo sapiens
tatgcaccaatgtaa

SEQ ID NO: 292917 - DNA, 15 bp, Homo sapiens
atatgcaccaatgta

SEQ ID NO: 292918 - DNA, 15 bp, Homo sapiens
aatatgcaccaatgt

SEQ ID NO: 292919 - DNA, 15 bp, Homo sapiens
gaatatgcaccaatg

SEQ ID NO: 292920 - DNA, 15 bp, Homo sapiens
tgaatatgcaccaat

SEQ ID NO: 292921 - DNA, 15 bp, Homo sapiens
ctgaatatgcaccaa

SEQ ID NO: 292922 - DNA, 15 bp, Homo sapiens
cctgaatatgcacca

SEQ ID NO: 292923 - DNA, 15 bp, Homo sapiens
tcctgaatatgcacc

SEQ ID NO: 292924 - DNA, 15 bp, Homo sapiens
gtcctgaatatgcac

SEQ ID NO: 292925 - DNA, 15 bp, Homo sapiens
agtcctgaatatgca

SEQ ID NO: 292926 - DNA, 15 bp, Homo sapiens
tagtcctgaatatgc

SEQ ID NO: 292927 - DNA, 15 bp, Homo sapiens
ttagtcctgaatatg

SEQ ID NO: 292928 - DNA, 15 bp, Homo sapiens
attagtcctgaatat

SEQ ID NO: 292929 - DNA, 15 bp, Homo sapiens
tattagtcctgaata

SEQ ID NO: 292930 - DNA, 15 bp, Homo sapiens
ttattagtcctgaat

SEQ ID NO: 292931 - DNA, 15 bp, Homo sapiens
attattagtcctgaa

SEQ ID NO: 292932 - DNA, 15 bp, Homo sapiens
tattattagtcctga

SEQ ID NO: 292933 - DNA, 15 bp, Homo sapiens
atattattagtcctg

SEQ ID NO: 292934 - DNA, 15 bp, Homo sapiens
aatattattagtcct

SEQ ID NO: 292935 - DNA, 15 bp, Homo sapiens
taatattattagtcc

SEQ ID NO: 292936 - DNA, 15 bp, Homo sapiens
gtaatattattagtc

SEQ ID NO: 292937 - DNA, 15 bp, Homo sapiens
tgtaatattattagt

SEQ ID NO: 292938 - DNA, 15 bp, Homo sapiens
gtgtaatattattag

SEQ ID NO: 292939 - DNA, 15 bp, Homo sapiens
ggtgtaatattatta

SEQ ID NO: 292940 - DNA, 15 bp, Homo sapiens
tggtgtaatattatt

SEQ ID NO: 292941 - DNA, 15 bp, Homo sapiens
ttggtgtaatattat

SEQ ID NO: 292942 - DNA, 15 bp, Homo sapiens
tttggtgtaatatta

SEQ ID NO: 292943 - DNA, 15 bp, Homo sapiens
gtttggtgtaatatt

SEQ ID NO: 292944 - DNA, 15 bp, Homo sapiens
tgtttggtgtaatat

SEQ ID NO: 292945 - DNA, 15 bp, Homo sapiens
atgtttggtgtaata

SEQ ID NO: 292946 - DNA, 15 bp, Homo sapiens
aatgtttggtgtaat

SEQ ID NO: 292947 - DNA, 15 bp, Homo sapiens
taatgtttggtgtaa

SEQ ID NO: 292948 - DNA, 15 bp, Homo sapiens
ataatgtttggtgta

SEQ ID NO: 292949 - DNA, 15 bp, Homo sapiens
cataatgtttggtgt

SEQ ID NO: 292950 - DNA, 15 bp, Homo sapiens
ccataatgtttggtg

SEQ ID NO: 292951 - DNA, 15 bp, Homo sapiens
accataatgtttggt

SEQ ID NO: 292952 - DNA, 15 bp, Homo sapiens
aaccataatgtttgg

SEQ ID NO: 292953 - DNA, 15 bp, Homo sapiens
caaccataatgtttg

SEQ ID NO: 292954 - DNA, 15 bp, Homo sapiens
acaaccataatgttt

SEQ ID NO: 292955 - DNA, 15 bp, Homo sapiens
tacaaccataatgtt

SEQ ID NO: 292956 - DNA, 15 bp, Homo sapiens
atacaaccataatgt

SEQ ID NO: 292957 - DNA, 15 bp, Homo sapiens
gatacaaccataatg

SEQ ID NO: 292958 - DNA, 15 bp, Homo sapiens
agatacaaccataat

SEQ ID NO: 292959 - DNA, 15 bp, Homo sapiens
cagatacaaccataa

SEQ ID NO: 292960 - DNA, 15 bp, Homo sapiens
gcagatacaaccata

SEQ ID NO: 292961 - DNA, 15 bp, Homo sapiens
ggcagatacaaccat

SEQ ID NO: 292962 - DNA, 15 bp, Homo sapiens
tggcagatacaacca

SEQ ID NO: 292963 - DNA, 15 bp, Homo sapiens
ttggcagatacaacc

SEQ ID NO: 292964 - DNA, 15 bp, Homo sapiens
cttggcagatacaac

SEQ ID NO: 292965 - DNA, 15 bp, Homo sapiens
ccttggcagatacaa

SEQ ID NO: 292966 - DNA, 15 bp, Homo sapiens
accttggcagataca

SEQ ID NO: 292967 - DNA, 15 bp, Homo sapiens
caccttggcagatac

SEQ ID NO: 292968 - DNA, 15 bp, Homo sapiens
acaccttggcagata

SEQ ID NO: 292969 - DNA, 15 bp, Homo sapiens
cacaccttggcagat

SEQ ID NO: 292970 - DNA, 15 bp, Homo sapiens
ccacaccttggcaga

SEQ ID NO: 292971 - DNA, 15 bp, Homo sapiens
tccacaccttggcag

SEQ ID NO: 292972 - DNA, 15 bp, Homo sapiens
ttccacaccttggca

SEQ ID NO: 292973 - DNA, 15 bp, Homo sapiens
tttccacaccttggc

SEQ ID NO: 292974 - DNA, 15 bp, Homo sapiens
gtttccacaccttgg

SEQ ID NO: 292975 - DNA, 15 bp, Homo sapiens
agtttccacaccttg

SEQ ID NO: 292976 - DNA, 15 bp, Homo sapiens
gagtttccacacctt

SEQ ID NO: 292977 - DNA, 15 bp, Homo sapiens
tgagtttccacacct

SEQ ID NO: 292978 - DNA, 15 bp, Homo sapiens
atgagtttccacacc

SEQ ID NO: 292979 - DNA, 15 bp, Homo sapiens
aatgagtttccacac

SEQ ID NO: 292980 - DNA, 15 bp, Homo sapiens
aaatgagtttccaca

SEQ ID NO: 292981 - DNA, 15 bp, Homo sapiens
taaatgagtttccac

SEQ ID NO: 292982 - DNA, 15 bp, Homo sapiens
ataaatgagtttcca

SEQ ID NO: 292983 - DNA, 15 bp, Homo sapiens
aataaatgagtttcc

SEQ ID NO: 292984 - DNA, 15 bp, Homo sapiens
gaataaatgagtttc

SEQ ID NO: 292985 - DNA, 15 bp, Homo sapiens
tgaataaatgagttt

SEQ ID NO: 292986 - DNA, 15 bp, Homo sapiens
gtgaataaatgagtt

SEQ ID NO: 292987 - DNA, 15 bp, Homo sapiens
agtgaataaatgagt

SEQ ID NO: 292988 - DNA, 15 bp, Homo sapiens
aagtgaataaatgag

SEQ ID NO: 292989 - DNA, 15 bp, Homo sapiens
aaagtgaataaatga

SEQ ID NO: 292990 - DNA, 15 bp, Homo sapiens
aaaagtgaataaatg

SEQ ID NO: 292991 - DNA, 15 bp, Homo sapiens
gaaaagtgaataaat

SEQ ID NO: 292992 - DNA, 15 bp, Homo sapiens
agaaaagtgaataaa

SEQ ID NO: 292993 - DNA, 15 bp, Homo sapiens
aagaaaagtgaataa

SEQ ID NO: 292994 - DNA, 15 bp, Homo sapiens
gaagaaaagtgaata

SEQ ID NO: 292995 - DNA, 15 bp, Homo sapiens
cgaagaaaagtgaat

SEQ ID NO: 292996 - DNA, 15 bp, Homo sapiens
acgaagaaaagtgaa

SEQ ID NO: 292997 - DNA, 15 bp, Homo sapiens
gacgaagaaaagtga

SEQ ID NO: 292998 - DNA, 15 bp, Homo sapiens
ggacgaagaaaagtg

SEQ ID NO: 292999 - DNA, 15 bp, Homo sapiens
aggacgaagaaaagt

SEQ ID NO: 293000 - DNA, 15 bp, Homo sapiens
taggacgaagaaaag

SEQ ID NO: 293001 - DNA, 15 bp, Homo sapiens
ctaggacgaagaaaa

SEQ ID NO: 293002 - DNA, 15 bp, Homo sapiens
actaggacgaagaaa

SEQ ID NO: 293003 - DNA, 15 bp, Homo sapiens
gactaggacgaagaa

SEQ ID NO: 293004 - DNA, 15 bp, Homo sapiens
ggactaggacgaaga

SEQ ID NO: 293005 - DNA, 15 bp, Homo sapiens
tggactaggacgaag

SEQ ID NO: 293006 - DNA, 15 bp, Homo sapiens
gtggactaggacgaa

SEQ ID NO: 293007 - DNA, 15 bp, Homo sapiens
agtggactaggacga

SEQ ID NO: 293008 - DNA, 15 bp, Homo sapiens
aagtggactaggacg

SEQ ID NO: 293009 - DNA, 15 bp, Homo sapiens
taagtggactaggac

SEQ ID NO: 293010 - DNA, 15 bp, Homo sapiens
ctaagtggactagga

SEQ ID NO: 293011 - DNA, 15 bp, Homo sapiens
tctaagtggactagg

SEQ ID NO: 293012 - DNA, 15 bp, Homo sapiens
gtctaagtggactag

SEQ ID NO: 293013 - DNA, 15 bp, Homo sapiens
tgtctaagtggacta

SEQ ID NO: 293014 - DNA, 15 bp, Homo sapiens
atgtctaagtggact

SEQ ID NO: 293015 - DNA, 15 bp, Homo sapiens
aatgtctaagtggac

SEQ ID NO: 293016 - DNA, 15 bp, Homo sapiens
caatgtctaagtgga

SEQ ID NO: 293017 - DNA, 15 bp, Homo sapiens
acaatgtctaagtgg

SEQ ID NO: 293018 - DNA, 15 bp, Homo sapiens
gacaatgtctaagtg

SEQ ID NO: 293019 - DNA, 15 bp, Homo sapiens
agacaatgtctaagt

SEQ ID NO: 293020 - DNA, 15 bp, Homo sapiens
aagacaatgtctaag

SEQ ID NO: 293021 - DNA, 15 bp, Homo sapiens
caagacaatgtctaa

SEQ ID NO: 293022 - DNA, 15 bp, Homo sapiens
gcaagacaatgtcta

SEQ ID NO: 293023 - DNA, 15 bp, Homo sapiens
ggcaagacaatgtct

SEQ ID NO: 293024 - DNA, 15 bp, Homo sapiens
aggcaagacaatgtc

SEQ ID NO: 293025 - DNA, 15 bp, Homo sapiens
caggcaagacaatgt

SEQ ID NO: 293026 - DNA, 15 bp, Homo sapiens
acaggcaagacaatg

SEQ ID NO: 293027 - DNA, 15 bp, Homo sapiens
gacaggcaagacaat

SEQ ID NO: 293028 - DNA, 15 bp, Homo sapiens
ggacaggcaagacaa

SEQ ID NO: 293029 - DNA, 15 bp, Homo sapiens
gggacaggcaagaca

SEQ ID NO: 293030 - DNA, 15 bp, Homo sapiens
tgggacaggcaagac

SEQ ID NO: 293031 - DNA, 15 bp, Homo sapiens
atgggacaggcaaga

SEQ ID NO: 293032 - DNA, 15 bp, Homo sapiens
gatgggacaggcaag

SEQ ID NO: 293033 - DNA, 15 bp, Homo sapiens
tgatgggacaggcaa

SEQ ID NO: 293034 - DNA, 15 bp, Homo sapiens
ctgatgggacaggca

SEQ ID NO: 293035 - DNA, 15 bp, Homo sapiens
tctgatgggacaggc

SEQ ID NO: 293036 - DNA, 15 bp, Homo sapiens
ctctgatgggacagg

SEQ ID NO: 293037 - DNA, 15 bp, Homo sapiens
cctctgatgggacag

SEQ ID NO: 293038 - DNA, 15 bp, Homo sapiens
gcctctgatgggaca

SEQ ID NO: 293039 - DNA, 15 bp, Homo sapiens
tgcctctgatgggac

SEQ ID NO: 293040 - DNA, 15 bp, Homo sapiens
ctgcctctgatggga

SEQ ID NO: 293041 - DNA, 15 bp, Homo sapiens
gctgcctctgatggg

SEQ ID NO: 293042 - DNA, 15 bp, Homo sapiens
cgctgcctctgatgg

SEQ ID NO: 293043 - DNA, 15 bp, Homo sapiens
ccgctgcctctgatg

SEQ ID NO: 293044 - DNA, 15 bp, Homo sapiens
accgctgcctctgat

SEQ ID NO: 293045 - DNA, 15 bp, Homo sapiens
gaccgctgcctctga

SEQ ID NO: 293046 - DNA, 15 bp, Homo sapiens
ggaccgctgcctctg

SEQ ID NO: 293047 - DNA, 15 bp, Homo sapiens
gggaccgctgcctct

SEQ ID NO: 293048 - DNA, 15 bp, Homo sapiens
tgggaccgctgcctc

SEQ ID NO: 293049 - DNA, 15 bp, Homo sapiens
gtgggaccgctgcct

SEQ ID NO: 293050 - DNA, 15 bp, Homo sapiens
cgtgggaccgctgcc

SEQ ID NO: 293051 - DNA, 15 bp, Homo sapiens
gcgtgggaccgctgc

SEQ ID NO: 293052 - DNA, 15 bp, Homo sapiens
tgcgtgggaccgctg

SEQ ID NO: 293053 - DNA, 15 bp, Homo sapiens
ctgcgtgggaccgct

SEQ ID NO: 293054 - DNA, 15 bp, Homo sapiens
gctgcgtgggaccgc

SEQ ID NO: 293055 - DNA, 15 bp, Homo sapiens
ggctgcgtgggaccg

SEQ ID NO: 293056 - DNA, 15 bp, Homo sapiens
aggctgcgtgggacc

SEQ ID NO: 293057 - DNA, 15 bp, Homo sapiens
caggctgcgtgggac

SEQ ID NO: 293058 - DNA, 15 bp, Homo sapiens
acaggctgcgtggga

SEQ ID NO: 293059 - DNA, 15 bp, Homo sapiens
gacaggctgcgtggg

SEQ ID NO: 293060 - DNA, 15 bp, Homo sapiens
ggacaggctgcgtgg

SEQ ID NO: 293061 - DNA, 15 bp, Homo sapiens
aggacaggctgcgtg

SEQ ID NO: 293062 - DNA, 15 bp, Homo sapiens
aaggacaggctgcgt

SEQ ID NO: 293063 - DNA, 15 bp, Homo sapiens
caaggacaggctgcg

SEQ ID NO: 293064 - DNA, 15 bp, Homo sapiens
ccaaggacaggctgc

SEQ ID NO: 293065 - DNA, 15 bp, Homo sapiens
accaaggacaggctg

SEQ ID NO: 293066 - DNA, 15 bp, Homo sapiens
gaccaaggacaggct

SEQ ID NO: 293067 - DNA, 15 bp, Homo sapiens
tgaccaaggacaggc

SEQ ID NO: 293068 - DNA, 15 bp, Homo sapiens
gtgaccaaggacagg

SEQ ID NO: 293069 - DNA, 15 bp, Homo sapiens
tgtgaccaaggacag

SEQ ID NO: 293070 - DNA, 15 bp, Homo sapiens
ttgtgaccaaggaca

SEQ ID NO: 293071 - DNA, 15 bp, Homo sapiens
attgtgaccaaggac

SEQ ID NO: 293072 - DNA, 15 bp, Homo sapiens
cattgtgaccaagga

SEQ ID NO: 293073 - DNA, 15 bp, Homo sapiens
ccattgtgaccaagg

SEQ ID NO: 293074 - DNA, 15 bp, Homo sapiens
cccattgtgaccaag

SEQ ID NO: 293075 - DNA, 15 bp, Homo sapiens
ccccattgtgaccaa

SEQ ID NO: 293076 - DNA, 15 bp, Homo sapiens
tccccattgtgacca

SEQ ID NO: 293077 - DNA, 15 bp, Homo sapiens
gtccccattgtgacc

SEQ ID NO: 293078 - DNA, 15 bp, Homo sapiens
ggtccccattgtgac

SEQ ID NO: 293079 - DNA, 15 bp, Homo sapiens
aggtccccattgtga

SEQ ID NO: 293080 - DNA, 15 bp, Homo sapiens
caggtccccattgtg

SEQ ID NO: 293081 - DNA, 15 bp, Homo sapiens
acaggtccccattgt

SEQ ID NO: 293082 - DNA, 15 bp, Homo sapiens
gacaggtccccattg

SEQ ID NO: 293083 - DNA, 15 bp, Homo sapiens
tgacaggtccccatt

SEQ ID NO: 293084 - DNA, 15 bp, Homo sapiens
gtgacaggtccccat

SEQ ID NO: 293085 - DNA, 15 bp, Homo sapiens
agtgacaggtcccca

SEQ ID NO: 293086 - DNA, 15 bp, Homo sapiens
cagtgacaggtcccc

SEQ ID NO: 293087 - DNA, 15 bp, Homo sapiens
tcagtgacaggtccc

SEQ ID NO: 293088 - DNA, 15 bp, Homo sapiens
atcagtgacaggtcc

SEQ ID NO: 293089 - DNA, 15 bp, Homo sapiens
catcagtgacaggtc

SEQ ID NO: 293090 - DNA, 15 bp, Homo sapiens
gcatcagtgacaggt

SEQ ID NO: 293091 - DNA, 15 bp, Homo sapiens
agcatcagtgacagg

SEQ ID NO: 293092 - DNA, 15 bp, Homo sapiens
tagcatcagtgacag

SEQ ID NO: 293093 - DNA, 15 bp, Homo sapiens
ctagcatcagtgaca

SEQ ID NO: 293094 - DNA, 15 bp, Homo sapiens
cctagcatcagtgac

SEQ ID NO: 293095 - DNA, 15 bp, Homo sapiens
tcctagcatcagtga

SEQ ID NO: 293096 - DNA, 15 bp, Homo sapiens
ttcctagcatcagtg

SEQ ID NO: 293097 - DNA, 15 bp, Homo sapiens
cttcctagcatcagt

SEQ ID NO: 293098 - DNA, 15 bp, Homo sapiens
ccttcctagcatcag

SEQ ID NO: 293099 - DNA, 15 bp, Homo sapiens
tccttcctagcatca

SEQ ID NO: 293100 - DNA, 15 bp, Homo sapiens
gtccttcctagcatc

SEQ ID NO: 293101 - DNA, 15 bp, Homo sapiens
agtccttcctagcat

SEQ ID NO: 293102 - DNA, 15 bp, Homo sapiens
gagtccttcctagca

SEQ ID NO: 293103 - DNA, 15 bp, Homo sapiens
tgagtccttcctagc

SEQ ID NO: 293104 - DNA, 15 bp, Homo sapiens
ctgagtccttcctag

SEQ ID NO: 293105 - DNA, 15 bp, Homo sapiens
actgagtccttccta

SEQ ID NO: 293106 - DNA, 15 bp, Homo sapiens
tactgagtccttcct

SEQ ID NO: 293107 - DNA, 15 bp, Homo sapiens
ttactgagtccttcc

SEQ ID NO: 293108 - DNA, 15 bp, Homo sapiens
tttactgagtccttc

SEQ ID NO: 293109 - DNA, 15 bp, Homo sapiens
gtttactgagtcctt

SEQ ID NO: 293110 - DNA, 15 bp, Homo sapiens
agtttactgagtcct

SEQ ID NO: 293111 - DNA, 15 bp, Homo sapiens
tagtttactgagtcc

SEQ ID NO: 293112 - DNA, 15 bp, Homo sapiens
ctagtttactgagtc

SEQ ID NO: 293113 - DNA, 15 bp, Homo sapiens
cctagtttactgagt

SEQ ID NO: 293114 - DNA, 15 bp, Homo sapiens
acctagtttactgag

SEQ ID NO: 293115 - DNA, 15 bp, Homo sapiens
cacctagtttactga

SEQ ID NO: 293116 - DNA, 15 bp, Homo sapiens
acacctagtttactg

SEQ ID NO: 293117 - DNA, 15 bp, Homo sapiens
aacacctagtttact

SEQ ID NO: 293118 - DNA, 15 bp, Homo sapiens
taacacctagtttac

SEQ ID NO: 293119 - DNA, 15 bp, Homo sapiens
ttaacacctagttta

SEQ ID NO: 293120 - DNA, 15 bp, Homo sapiens
gttaacacctagttt

SEQ ID NO: 293121 - DNA, 15 bp, Homo sapiens
ggttaacacctagtt

SEQ ID NO: 293122 - DNA, 15 bp, Homo sapiens
tggttaacacctagt

SEQ ID NO: 293123 - DNA, 15 bp, Homo sapiens
ttggttaacacctag

SEQ ID NO: 293124 - DNA, 15 bp, Homo sapiens
attggttaacaccta

SEQ ID NO: 293125 - DNA, 15 bp, Homo sapiens
cattggttaacacct

SEQ ID NO: 293126 - DNA, 15 bp, Homo sapiens
tcattggttaacacc

SEQ ID NO: 293127 - DNA, 15 bp, Homo sapiens
gtcattggttaacac

SEQ ID NO: 293128 - DNA, 15 bp, Homo sapiens
tgtcattggttaaca

SEQ ID NO: 293129 - DNA, 15 bp, Homo sapiens
atgtcattggttaac

SEQ ID NO: 293130 - DNA, 15 bp, Homo sapiens
aatgtcattggttaa

SEQ ID NO: 293131 - DNA, 15 bp, Homo sapiens
aaatgtcattggtta

SEQ ID NO: 293132 - DNA, 15 bp, Homo sapiens
aaaatgtcattggtt

SEQ ID NO: 293133 - DNA, 15 bp, Homo sapiens
caaaatgtcattggt

SEQ ID NO: 293134 - DNA, 15 bp, Homo sapiens
acaaaatgtcattgg

SEQ ID NO: 293135 - DNA, 15 bp, Homo sapiens
aacaaaatgtcattg

SEQ ID NO: 293136 - DNA, 15 bp, Homo sapiens
taacaaaatgtcatt

SEQ ID NO: 293137 - DNA, 15 bp, Homo sapiens
ataacaaaatgtcat

SEQ ID NO: 293138 - DNA, 15 bp, Homo sapiens
gataacaaaatgtca

SEQ ID NO: 293139 - DNA, 15 bp, Homo sapiens
tgataacaaaatgtc

SEQ ID NO: 293140 - DNA, 15 bp, Homo sapiens
ttgataacaaaatgt

SEQ ID NO: 293141 - DNA, 15 bp, Homo sapiens
attgataacaaaatg

SEQ ID NO: 293142 - DNA, 15 bp, Homo sapiens
aattgataacaaaat

SEQ ID NO: 293143 - DNA, 15 bp, Homo sapiens
taattgataacaaaa

SEQ ID NO: 293144 - DNA, 15 bp, Homo sapiens
ttaattgataacaaa

SEQ ID NO: 293145 - DNA, 15 bp, Homo sapiens
tttaattgataacaa

SEQ ID NO: 293146 - DNA, 15 bp, Homo sapiens
atttaattgataaca

SEQ ID NO: 293147 - DNA, 15 bp, Homo sapiens
aatttaattgataac

SEQ ID NO: 293148 - DNA, 15 bp, Homo sapiens
taatttaattgataa

SEQ ID NO: 293149 - DNA, 15 bp, Homo sapiens
ttaatttaattgata

SEQ ID NO: 293150 - DNA, 15 bp, Homo sapiens
tttaatttaattgat

SEQ ID NO: 293151 - DNA, 15 bp, Homo sapiens
ttttaatttaattga

SEQ ID NO: 293152 - DNA, 15 bp, Homo sapiens
attttaatttaattg

SEQ ID NO: 293153 - DNA, 15 bp, Homo sapiens
aattttaatttaatt

SEQ ID NO: 293154 - DNA, 15 bp, Homo sapiens
gaattttaatttaat

SEQ ID NO: 293155 - DNA, 15 bp, Homo sapiens
agaattttaatttaa

SEQ ID NO: 293156 - DNA, 15 bp, Homo sapiens
tagaattttaattta

SEQ ID NO: 293157 - DNA, 15 bp, Homo sapiens
ctagaattttaattt

SEQ ID NO: 293158 - DNA, 15 bp, Homo sapiens
tctagaattttaatt

SEQ ID NO: 293159 - DNA, 15 bp, Homo sapiens
ttctagaattttaat

SEQ ID NO: 293160 - DNA, 15 bp, Homo sapiens
attctagaattttaa

SEQ ID NO: 293161 - DNA, 15 bp, Homo sapiens
gtaaaattctagaat

SEQ ID NO: 293162 - DNA, 15 bp, Homo sapiens
agtaaaattctagaa

SEQ ID NO: 293163 - DNA, 15 bp, Homo sapiens
cagtaaaattctaga

SEQ ID NO: 293164 - DNA, 15 bp, Homo sapiens
tcagtaaaattctag

SEQ ID NO: 293165 - DNA, 15 bp, Homo sapiens
ctcagtaaaattcta

SEQ ID NO: 293166 - DNA, 15 bp, Homo sapiens
tctcagtaaaattct

SEQ ID NO: 293167 - DNA, 15 bp, Homo sapiens
ttctcagtaaaattc

SEQ ID NO: 293168 - DNA, 15 bp, Homo sapiens
gttctcagtaaaatt

SEQ ID NO: 293169 - DNA, 15 bp, Homo sapiens
cgttctcagtaaaat

SEQ ID NO: 293170 - DNA, 15 bp, Homo sapiens
tcgttctcagtaaaa

SEQ ID NO: 293171 - DNA, 15 bp, Homo sapiens
atcgttctcagtaaa

SEQ ID NO: 293172 - DNA, 15 bp, Homo sapiens
tatcgttctcagtaa

SEQ ID NO: 293173 - DNA, 15 bp, Homo sapiens
atatcgttctcagta

SEQ ID NO: 293174 - DNA, 15 bp, Homo sapiens
tatatcgttctcagt

SEQ ID NO: 293175 - DNA, 15 bp, Homo sapiens
atatatcgttctcag

SEQ ID NO: 293176 - DNA, 15 bp, Homo sapiens
aatatatcgttctca

SEQ ID NO: 293177 - DNA, 15 bp, Homo sapiens
caatatatcgttctc

SEQ ID NO: 293178 - DNA, 15 bp, Homo sapiens
acaatatatcgttct

SEQ ID NO: 293179 - DNA, 15 bp, Homo sapiens
tacaatatatcgttc

SEQ ID NO: 293180 - DNA, 15 bp, Homo sapiens
ttacaatatatcgtt

SEQ ID NO: 293181 - DNA, 15 bp, Homo sapiens
gttacaatatatcgt

SEQ ID NO: 293182 - DNA, 15 bp, Homo sapiens
ggttacaatatatcg

SEQ ID NO: 293183 - DNA, 15 bp, Homo sapiens
tggttacaatatatc

SEQ ID NO: 293184 - DNA, 15 bp, Homo sapiens
ttggttacaatatat

SEQ ID NO: 293185 - DNA, 15 bp, Homo sapiens
tttggttacaatata

SEQ ID NO: 293186 - DNA, 15 bp, Homo sapiens
atttggttacaatat

SEQ ID NO: 293187 - DNA, 15 bp, Homo sapiens
aatttggttacaata

SEQ ID NO: 293188 - DNA, 15 bp, Homo sapiens
taatttggttacaat

SEQ ID NO: 293189 - DNA, 15 bp, Homo sapiens
ttaatttggttacaa

SEQ ID NO: 293190 - DNA, 15 bp, Homo sapiens
attaatttggttaca

SEQ ID NO: 293191 - DNA, 15 bp, Homo sapiens
aattaatttggttac

SEQ ID NO: 293192 - DNA, 15 bp, Homo sapiens
aaattaatttggtta

SEQ ID NO: 293193 - DNA, 15 bp, Homo sapiens
gaaattaatttggtt

SEQ ID NO: 293194 - DNA, 15 bp, Homo sapiens
agaaattaatttggt

SEQ ID NO: 293195 - DNA, 15 bp, Homo sapiens
aagaaattaatttgg

SEQ ID NO: 293196 - DNA, 15 bp, Homo sapiens
caagaaattaatttg

SEQ ID NO: 293197 - DNA, 15 bp, Homo sapiens
ccaagaaattaattt

SEQ ID NO: 293198 - DNA, 15 bp, Homo sapiens
accaagaaattaatt

SEQ ID NO: 293199 - DNA, 15 bp, Homo sapiens
caccaagaaattaat

SEQ ID NO: 293200 - DNA, 15 bp, Homo sapiens
ccaccaagaaattaa

SEQ ID NO: 293201 - DNA, 15 bp, Homo sapiens
cccaccaagaaatta

SEQ ID NO: 293202 - DNA, 15 bp, Homo sapiens
tcccaccaagaaatt

SEQ ID NO: 293203 - DNA, 15 bp, Homo sapiens
atcccaccaagaaat

SEQ ID NO: 293204 - DNA, 15 bp, Homo sapiens
tatcccaccaagaaa

SEQ ID NO: 293205 - DNA, 15 bp, Homo sapiens
atatcccaccaagaa

SEQ ID NO: 293206 - DNA, 15 bp, Homo sapiens
gatatcccaccaaga

SEQ ID NO: 293207 - DNA, 15 bp, Homo sapiens
agatatcccaccaag

SEQ ID NO: 293208 - DNA, 15 bp, Homo sapiens
aagatatcccaccaa

SEQ ID NO: 293209 - DNA, 15 bp, Homo sapiens
aaagatatcccacca

SEQ ID NO: 293210 - DNA, 15 bp, Homo sapiens
aaaagatatcccacc

SEQ ID NO: 293211 - DNA, 15 bp, Homo sapiens
caaaagatatcccac

SEQ ID NO: 293212 - DNA, 15 bp, Homo sapiens
ccaaaagatatccca

SEQ ID NO: 293213 - DNA, 15 bp, Homo sapiens
accaaaagatatccc

SEQ ID NO: 293214 - DNA, 15 bp, Homo sapiens
taccaaaagatatcc

SEQ ID NO: 293215 - DNA, 15 bp, Homo sapiens
gtaccaaaagatatc

SEQ ID NO: 293216 - DNA, 15 bp, Homo sapiens
tgtaccaaaagatat

SEQ ID NO: 293217 - DNA, 15 bp, Homo sapiens
atgtaccaaaagata

SEQ ID NO: 293218 - DNA, 15 bp, Homo sapiens
aatgtaccaaaagat

SEQ ID NO: 293219 - DNA, 15 bp, Homo sapiens
taatgtaccaaaaga

SEQ ID NO: 293220 - DNA, 15 bp, Homo sapiens
ttaatgtaccaaaag

SEQ ID NO: 293221 - DNA, 15 bp, Homo sapiens
gttaatgtaccaaaa

SEQ ID NO: 293222 - DNA, 15 bp, Homo sapiens
ggttaatgtaccaaa

SEQ ID NO: 293223 - DNA, 15 bp, Homo sapiens
tggttaatgtaccaa

SEQ ID NO: 293224 - DNA, 15 bp, Homo sapiens
ctggttaatgtacca

SEQ ID NO: 293225 - DNA, 15 bp, Homo sapiens
tctggttaatgtacc

SEQ ID NO: 293226 - DNA, 15 bp, Homo sapiens
ttctggttaatgtac

SEQ ID NO: 293227 - DNA, 15 bp, Homo sapiens
tttctggttaatgta

SEQ ID NO: 293228 - DNA, 15 bp, Homo sapiens
ttttctggttaatgt

SEQ ID NO: 293229 - DNA, 15 bp, Homo sapiens
tttttctggttaatg

SEQ ID NO: 293230 - DNA, 15 bp, Homo sapiens
ttttttctggttaat

SEQ ID NO: 293231 - DNA, 15 bp, Homo sapiens
tttttttctggttaa

SEQ ID NO: 293232 - DNA, 15 bp, Homo sapiens
atttttttctggtta

SEQ ID NO: 293233 - DNA, 15 bp, Homo sapiens
aatttttttctggtt

SEQ ID NO: 293234 - DNA, 15 bp, Homo sapiens
taatttttttctggt

SEQ ID NO: 293235 - DNA, 15 bp, Homo sapiens
ttaatttttttctgg

SEQ ID NO: 293236 - DNA, 15 bp, Homo sapiens
tttaatttttttctg

SEQ ID NO: 293237 - DNA, 15 bp, Homo sapiens
ttttaatttttttct

SEQ ID NO: 293238 - DNA, 15 bp, Homo sapiens
attttaatttttttc

SEQ ID NO: 293239 - DNA, 15 bp, Homo sapiens
tattttaattttttt

SEQ ID NO: 293240 - DNA, 15 bp, Homo sapiens
atattttaatttttt

SEQ ID NO: 293241 - DNA, 15 bp, Homo sapiens
aatattttaattttt

SEQ ID NO: 293242 - DNA, 15 bp, Homo sapiens
taatattttaatttt

SEQ ID NO: 293243 - DNA, 15 bp, Homo sapiens
ctaatattttaattt

SEQ ID NO: 293244 - DNA, 15 bp, Homo sapiens
gctaatattttaatt

SEQ ID NO: 293245 - DNA, 15 bp, Homo sapiens
agctaatattttaat

SEQ ID NO: 293246 - DNA, 15 bp, Homo sapiens
tccagctaatatttt

SEQ ID NO: 293247 - DNA, 15 bp, Homo sapiens
atccagctaatattt

SEQ ID NO: 293248 - DNA, 15 bp, Homo sapiens
catccagctaatatt

SEQ ID NO: 293249 - DNA, 15 bp, Homo sapiens
gcatccagctaatat

SEQ ID NO: 293250 - DNA, 15 bp, Homo sapiens
tgcatccagctaata

SEQ ID NO: 293251 - DNA, 15 bp, Homo sapiens
ctgcatccagctaat

SEQ ID NO: 293252 - DNA, 15 bp, Homo sapiens
actgcatccagctaa

SEQ ID NO: 293253 - DNA, 15 bp, Homo sapiens
cactgcatccagcta

SEQ ID NO: 293254 - DNA, 15 bp, Homo sapiens
ccactgcatccagct

SEQ ID NO: 293255 - DNA, 15 bp, Homo sapiens
gccactgcatccagc

SEQ ID NO: 293256 - DNA, 15 bp, Homo sapiens
agccactgcatccag

SEQ ID NO: 293257 - DNA, 15 bp, Homo sapiens
gagccactgcatcca

SEQ ID NO: 293258 - DNA, 15 bp, Homo sapiens
ggagccactgcatcc

SEQ ID NO: 293259 - DNA, 15 bp, Homo sapiens
gggagccactgcatc

SEQ ID NO: 293260 - DNA, 15 bp, Homo sapiens
cgggagccactgcat

SEQ ID NO: 293261 - DNA, 15 bp, Homo sapiens
gcgggagccactgca

SEQ ID NO: 293262 - DNA, 15 bp, Homo sapiens
ggcgggagccactgc

SEQ ID NO: 293263 - DNA, 15 bp, Homo sapiens
aggcgggagccactg

SEQ ID NO: 293264 - DNA, 15 bp, Homo sapiens
caggcgggagccact

SEQ ID NO: 293265 - DNA, 15 bp, Homo sapiens
gagctgggattacag

SEQ ID NO: 293266 - DNA, 15 bp, Homo sapiens
agagctgggattaca

SEQ ID NO: 293267 - DNA, 15 bp, Homo sapiens
aagagctgggattac

SEQ ID NO: 293268 - DNA, 15 bp, Homo sapiens
aaagagctgggatta

SEQ ID NO: 293269 - DNA, 15 bp, Homo sapiens
caaagagctgggatt

SEQ ID NO: 293270 - DNA, 15 bp, Homo sapiens
ccaaagagctgggat

SEQ ID NO: 293271 - DNA, 15 bp, Homo sapiens
cccaaagagctggga

SEQ ID NO: 293272 - DNA, 15 bp, Homo sapiens
tcccaaagagctggg

SEQ ID NO: 293273 - DNA, 15 bp, Homo sapiens
ctcccaaagagctgg

SEQ ID NO: 293274 - DNA, 15 bp, Homo sapiens
cctcccaaagagctg

SEQ ID NO: 293275 - DNA, 15 bp, Homo sapiens
gcctcccaaagagct

SEQ ID NO: 293276 - DNA, 15 bp, Homo sapiens
ggcctcccaaagagc

SEQ ID NO: 293277 - DNA, 15 bp, Homo sapiens
tggcctcccaaagag

SEQ ID NO: 293278 - DNA, 15 bp, Homo sapiens
atggcctcccaaaga

SEQ ID NO: 293279 - DNA, 15 bp, Homo sapiens
catggcctcccaaag

SEQ ID NO: 293280 - DNA, 15 bp, Homo sapiens
ccatggcctcccaaa

SEQ ID NO: 293281 - DNA, 15 bp, Homo sapiens
accatggcctcccaa

SEQ ID NO: 293282 - DNA, 15 bp, Homo sapiens
ttcaccatggcctcc

SEQ ID NO: 293283 - DNA, 15 bp, Homo sapiens
tttcaccatggcctc

SEQ ID NO: 293284 - DNA, 15 bp, Homo sapiens
gtttcaccatggcct

SEQ ID NO: 293285 - DNA, 15 bp, Homo sapiens
ggtttcaccatggcc

SEQ ID NO: 293286 - DNA, 15 bp, Homo sapiens
gggtttcaccatggc

SEQ ID NO: 293287 - DNA, 15 bp, Homo sapiens
ggggtttcaccatgg

SEQ ID NO: 293288 - DNA, 15 bp, Homo sapiens
tccaccacgcctggc

SEQ ID NO: 293289 - DNA, 15 bp, Homo sapiens
ctccaccacgcctgg

SEQ ID NO: 293290 - DNA, 15 bp, Homo sapiens
gctccaccacgcctg

SEQ ID NO: 293291 - DNA, 15 bp, Homo sapiens
tgctccaccacgcct

SEQ ID NO: 293292 - DNA, 15 bp, Homo sapiens
gtgctccaccacgcc

SEQ ID NO: 293293 - DNA, 15 bp, Homo sapiens
agtgctccaccacgc

SEQ ID NO: 293294 - DNA, 15 bp, Homo sapiens
gagtgctccaccacg

SEQ ID NO: 293295 - DNA, 15 bp, Homo sapiens
ggagtgctccaccac

SEQ ID NO: 293296 - DNA, 15 bp, Homo sapiens
aggagtgctccacca

SEQ ID NO: 293297 - DNA, 15 bp, Homo sapiens
caggagtgctccacc

SEQ ID NO: 293298 - DNA, 15 bp, Homo sapiens
acaggagtgctccac

SEQ ID NO: 293299 - DNA, 15 bp, Homo sapiens
tacaggagtgctcca

SEQ ID NO: 293300 - DNA, 15 bp, Homo sapiens
ctacaggagtgctcc

SEQ ID NO: 293301 - DNA, 15 bp, Homo sapiens
actacaggagtgctc

SEQ ID NO: 293302 - DNA, 15 bp, Homo sapiens
gactacaggagtgct

SEQ ID NO: 293303 - DNA, 15 bp, Homo sapiens
ggactacaggagtgc

SEQ ID NO: 293304 - DNA, 15 bp, Homo sapiens
gggactacaggagtg

SEQ ID NO: 293305 - DNA, 15 bp, Homo sapiens
tgggactacaggagt

SEQ ID NO: 293306 - DNA, 15 bp, Homo sapiens
aggttccagcaattc

SEQ ID NO: 293307 - DNA, 15 bp, Homo sapiens
caggttccagcaatt

SEQ ID NO: 293308 - DNA, 15 bp, Homo sapiens
ccaggttccagcaat

SEQ ID NO: 293309 - DNA, 15 bp, Homo sapiens
cccaggttccagcaa

SEQ ID NO: 293310 - DNA, 15 bp, Homo sapiens
tcccaggttccagca

SEQ ID NO: 293311 - DNA, 15 bp, Homo sapiens
ctcccaggttccagc

SEQ ID NO: 293312 - DNA, 15 bp, Homo sapiens
cctcccaggttccag

SEQ ID NO: 293313 - DNA, 15 bp, Homo sapiens
gcctcccaggttcca

SEQ ID NO: 293314 - DNA, 15 bp, Homo sapiens
cgcctcccaggttcc

SEQ ID NO: 293315 - DNA, 15 bp, Homo sapiens
tgcgatctcggctca

SEQ ID NO: 293316 - DNA, 15 bp, Homo sapiens
gtgcgatctcggctc

SEQ ID NO: 293317 - DNA, 15 bp, Homo sapiens
ggtgcgatctcggct

SEQ ID NO: 293318 - DNA, 15 bp, Homo sapiens
tggtgcgatctcggc

SEQ ID NO: 293319 - DNA, 15 bp, Homo sapiens
ttggtgcgatctcgg

SEQ ID NO: 293320 - DNA, 15 bp, Homo sapiens
attggtgcgatctcg

SEQ ID NO: 293321 - DNA, 15 bp, Homo sapiens
cattggtgcgatctc

SEQ ID NO: 293322 - DNA, 15 bp, Homo sapiens
gcattggtgcgatct

SEQ ID NO: 293323 - DNA, 15 bp, Homo sapiens
tgcattggtgcgatc

SEQ ID NO: 293324 - DNA, 15 bp, Homo sapiens
gtgcattggtgcgat

SEQ ID NO: 293325 - DNA, 15 bp, Homo sapiens
agtgcattggtgcga

SEQ ID NO: 293326 - DNA, 15 bp, Homo sapiens
gagtgcattggtgcg

SEQ ID NO: 293327 - DNA, 15 bp, Homo sapiens
ggagtgcattggtgc

SEQ ID NO: 293328 - DNA, 15 bp, Homo sapiens
tggagtgcattggtg

SEQ ID NO: 293329 - DNA, 15 bp, Homo sapiens
ctggagtgcattggt

SEQ ID NO: 293330 - DNA, 15 bp, Homo sapiens
cgtcaccaggctgga

SEQ ID NO: 293331 - DNA, 15 bp, Homo sapiens
ccgtcaccaggctgg

SEQ ID NO: 293332 - DNA, 15 bp, Homo sapiens
tccgtcaccaggctg

SEQ ID NO: 293333 - DNA, 15 bp, Homo sapiens
ctccgtcaccaggct

SEQ ID NO: 293334 - DNA, 15 bp, Homo sapiens
cctccgtcaccaggc

SEQ ID NO: 293335 - DNA, 15 bp, Homo sapiens
gcctccgtcaccagg

SEQ ID NO: 293336 - DNA, 15 bp, Homo sapiens
agcctccgtcaccag

SEQ ID NO: 293337 - DNA, 15 bp, Homo sapiens
gagcctccgtcacca

SEQ ID NO: 293338 - DNA, 15 bp, Homo sapiens
ggagcctccgtcacc

SEQ ID NO: 293339 - DNA, 15 bp, Homo sapiens
tggagcctccgtcac

SEQ ID NO: 293340 - DNA, 15 bp, Homo sapiens
atggagcctccgtca

SEQ ID NO: 293341 - DNA, 15 bp, Homo sapiens
gatggagcctccgtc

SEQ ID NO: 293342 - DNA, 15 bp, Homo sapiens
agatggagcctccgt

SEQ ID NO: 293343 - DNA, 15 bp, Homo sapiens
gagatggagcctccg

SEQ ID NO: 293344 - DNA, 15 bp, Homo sapiens
tgagatggagcctcc

SEQ ID NO: 293345 - DNA, 15 bp, Homo sapiens
ttgagatggagcctc

SEQ ID NO: 293346 - DNA, 15 bp, Homo sapiens
tttgagatggagcct

SEQ ID NO: 293347 - DNA, 15 bp, Homo sapiens
ttttgagatggagcc

SEQ ID NO: 293348 - DNA, 15 bp, Homo sapiens
tttttgagatggagc

SEQ ID NO: 293349 - DNA, 15 bp, Homo sapiens
atattttttgagatg

SEQ ID NO: 293350 - DNA, 15 bp, Homo sapiens
tatattttttgagat

SEQ ID NO: 293351 - DNA, 15 bp, Homo sapiens
atatattttttgaga

SEQ ID NO: 293352 - DNA, 15 bp, Homo sapiens
tatatattttttgag

SEQ ID NO: 293353 - DNA, 15 bp, Homo sapiens
atatatattttttga

SEQ ID NO: 293354 - DNA, 15 bp, Homo sapiens
atatatatatttttt

SEQ ID NO: 293355 - DNA, 15 bp, Homo sapiens
aatatatatattttt

SEQ ID NO: 293356 - DNA, 15 bp, Homo sapiens
taatatatatatttt

SEQ ID NO: 293357 - DNA, 15 bp, Homo sapiens
ttaatatatatattt

SEQ ID NO: 293358 - DNA, 15 bp, Homo sapiens
tttaatatatatatt

SEQ ID NO: 293359 - DNA, 15 bp, Homo sapiens
ttttaatatatatat

SEQ ID NO: 293360 - DNA, 15 bp, Homo sapiens
atattttaatatata

SEQ ID NO: 293361 - DNA, 15 bp, Homo sapiens
aatattttaatatat

SEQ ID NO: 293362 - DNA, 15 bp, Homo sapiens
taatattttaatata

SEQ ID NO: 293363 - DNA, 15 bp, Homo sapiens
ttaatattttaatat

SEQ ID NO: 293364 - DNA, 15 bp, Homo sapiens
tcttaatattttaat

SEQ ID NO: 293365 - DNA, 15 bp, Homo sapiens
atcttaatattttaa

SEQ ID NO: 293366 - DNA, 15 bp, Homo sapiens
aatcttaatatttta

SEQ ID NO: 293367 - DNA, 15 bp, Homo sapiens
taatcttaatatttt

SEQ ID NO: 293368 - DNA, 15 bp, Homo sapiens
ataatcttaatattt

SEQ ID NO: 293369 - DNA, 15 bp, Homo sapiens
aataatcttaatatt

SEQ ID NO: 293370 - DNA, 15 bp, Homo sapiens
aaataatcttaatat

SEQ ID NO: 293371 - DNA, 15 bp, Homo sapiens
aaaataatcttaata

SEQ ID NO: 293372 - DNA, 15 bp, Homo sapiens
gaaaataatcttaat

SEQ ID NO: 293373 - DNA, 15 bp, Homo sapiens
tatgaaaataatctt

SEQ ID NO: 293374 - DNA, 15 bp, Homo sapiens
atatgaaaataatct

SEQ ID NO: 293375 - DNA, 15 bp, Homo sapiens
aatatgaaaataatc

SEQ ID NO: 293376 - DNA, 15 bp, Homo sapiens
aaatatgaaaataat

SEQ ID NO: 293377 - DNA, 15 bp, Homo sapiens
aaaatatgaaaataa

SEQ ID NO: 293378 - DNA, 15 bp, Homo sapiens
aaaaatatgaaaata

SEQ ID NO: 293379 - DNA, 15 bp, Homo sapiens
aaaaaatatgaaaat

SEQ ID NO: 293380 - DNA, 15 bp, Homo sapiens
taaaaaatatgaaaa

SEQ ID NO: 293381 - DNA, 15 bp, Homo sapiens
tatttaaaaaatatg

SEQ ID NO: 293382 - DNA, 15 bp, Homo sapiens
ttatttaaaaaatat

SEQ ID NO: 293383 - DNA, 15 bp, Homo sapiens
cttatttaaaaaata

SEQ ID NO: 293384 - DNA, 15 bp, Homo sapiens
tcttatttaaaaaat

SEQ ID NO: 293385 - DNA, 15 bp, Homo sapiens
ctcttatttaaaaaa

SEQ ID NO: 293386 - DNA, 15 bp, Homo sapiens
tctcttatttaaaaa

SEQ ID NO: 293387 - DNA, 15 bp, Homo sapiens
ttctcttatttaaaa

SEQ ID NO: 293388 - DNA, 15 bp, Homo sapiens
gttctcttatttaaa

SEQ ID NO: 293389 - DNA, 15 bp, Homo sapiens
agttctcttatttaa

SEQ ID NO: 293390 - DNA, 15 bp, Homo sapiens
tagttctcttattta

SEQ ID NO: 293391 - DNA, 15 bp, Homo sapiens
atagttctcttattt

SEQ ID NO: 293392 - DNA, 15 bp, Homo sapiens
gatagttctcttatt

SEQ ID NO: 293393 - DNA, 15 bp, Homo sapiens
agatagttctcttat

SEQ ID NO: 293394 - DNA, 15 bp, Homo sapiens
aagatagttctctta

SEQ ID NO: 293395 - DNA, 15 bp, Homo sapiens
caagatagttctctt

SEQ ID NO: 293396 - DNA, 15 bp, Homo sapiens
tcaagatagttctct

SEQ ID NO: 293397 - DNA, 15 bp, Homo sapiens
gtcaagatagttctc

SEQ ID NO: 293398 - DNA, 15 bp, Homo sapiens
agtcaagatagttct

SEQ ID NO: 293399 - DNA, 15 bp, Homo sapiens
tagtcaagatagttc

SEQ ID NO: 293400 - DNA, 15 bp, Homo sapiens
atagtcaagatagtt

SEQ ID NO: 293401 - DNA, 15 bp, Homo sapiens
catagtcaagatagt

SEQ ID NO: 293402 - DNA, 15 bp, Homo sapiens
ccatagtcaagatag

SEQ ID NO: 293403 - DNA, 15 bp, Homo sapiens
tccatagtcaagata

SEQ ID NO: 293404 - DNA, 15 bp, Homo sapiens
atccatagtcaagat

SEQ ID NO: 293405 - DNA, 15 bp, Homo sapiens
aatccatagtcaaga

SEQ ID NO: 293406 - DNA, 15 bp, Homo sapiens
taatccatagtcaag

SEQ ID NO: 293407 - DNA, 15 bp, Homo sapiens
ataatccatagtcaa

SEQ ID NO: 293408 - DNA, 15 bp, Homo sapiens
tataatccatagtca

SEQ ID NO: 293409 - DNA, 15 bp, Homo sapiens
ctataatccatagtc

SEQ ID NO: 293410 - DNA, 15 bp, Homo sapiens
cctataatccatagt

SEQ ID NO: 293411 - DNA, 15 bp, Homo sapiens
tcctataatccatag

SEQ ID NO: 293412 - DNA, 15 bp, Homo sapiens
atcctataatccata

SEQ ID NO: 293413 - DNA, 15 bp, Homo sapiens
tatcctataatccat

SEQ ID NO: 293414 - DNA, 15 bp, Homo sapiens
ttatcctataatcca

SEQ ID NO: 293415 - DNA, 15 bp, Homo sapiens
tttatcctataatcc

SEQ ID NO: 293416 - DNA, 15 bp, Homo sapiens
ttttatcctataatc

SEQ ID NO: 293417 - DNA, 15 bp, Homo sapiens
tttttatcctataat

SEQ ID NO: 293418 - DNA, 15 bp, Homo sapiens
ttttttatcctataa

SEQ ID NO: 293419 - DNA, 15 bp, Homo sapiens
gttttttatcctata

SEQ ID NO: 293420 - DNA, 15 bp, Homo sapiens
tgttttttatcctat

SEQ ID NO: 293421 - DNA, 15 bp, Homo sapiens
gtgttttttatccta

SEQ ID NO: 293422 - DNA, 15 bp, Homo sapiens
tgtgttttttatcct

SEQ ID NO: 293423 - DNA, 15 bp, Homo sapiens
atgtgttttttatcc

SEQ ID NO: 293424 - DNA, 15 bp, Homo sapiens
gatgtgttttttatc

SEQ ID NO: 293425 - DNA, 15 bp, Homo sapiens
ggatgtgttttttat

SEQ ID NO: 293426 - DNA, 15 bp, Homo sapiens
aggatgtgtttttta

SEQ ID NO: 293427 - DNA, 15 bp, Homo sapiens
taggatgtgtttttt

SEQ ID NO: 293428 - DNA, 15 bp, Homo sapiens
ctaggatgtgttttt

SEQ ID NO: 293429 - DNA, 15 bp, Homo sapiens
actaggatgtgtttt

SEQ ID NO: 293430 - DNA, 15 bp, Homo sapiens
cactaggatgtgttt

SEQ ID NO: 293431 - DNA, 15 bp, Homo sapiens
tcactaggatgtgtt

SEQ ID NO: 293432 - DNA, 15 bp, Homo sapiens
ttcactaggatgtgt

SEQ ID NO: 293433 - DNA, 15 bp, Homo sapiens
tttcactaggatgtg

SEQ ID NO: 293434 - DNA, 15 bp, Homo sapiens
ttttcactaggatgt

SEQ ID NO: 293435 - DNA, 15 bp, Homo sapiens
cttttcactaggatg

SEQ ID NO: 293436 - DNA, 15 bp, Homo sapiens
acttttcactaggat

SEQ ID NO: 293437 - DNA, 15 bp, Homo sapiens
tacttttcactagga

SEQ ID NO: 293438 - DNA, 15 bp, Homo sapiens
atacttttcactagg

SEQ ID NO: 293439 - DNA, 15 bp, Homo sapiens
gatacttttcactag

SEQ ID NO: 293440 - DNA, 15 bp, Homo sapiens
agatacttttcacta

SEQ ID NO: 293441 - DNA, 15 bp, Homo sapiens
aagatacttttcact

SEQ ID NO: 293442 - DNA, 15 bp, Homo sapiens
taagatacttttcac

SEQ ID NO: 293443 - DNA, 15 bp, Homo sapiens
ttaagatacttttca

SEQ ID NO: 293444 - DNA, 15 bp, Homo sapiens
tttaagatacttttc

SEQ ID NO: 293445 - DNA, 15 bp, Homo sapiens
atttaagatactttt

SEQ ID NO: 293446 - DNA, 15 bp, Homo sapiens
tatttaagatacttt

SEQ ID NO: 293447 - DNA, 15 bp, Homo sapiens
ttatttaagatactt

SEQ ID NO: 293448 - DNA, 15 bp, Homo sapiens
cttatttaagatact

SEQ ID NO: 293449 - DNA, 15 bp, Homo sapiens
tcttatttaagatac

SEQ ID NO: 293450 - DNA, 15 bp, Homo sapiens
atcttatttaagata

SEQ ID NO: 293451 - DNA, 15 bp, Homo sapiens
catcttatttaagat

SEQ ID NO: 293452 - DNA, 15 bp, Homo sapiens
gcatcttatttaaga

SEQ ID NO: 293453 - DNA, 15 bp, Homo sapiens
ggcatcttatttaag

SEQ ID NO: 293454 - DNA, 15 bp, Homo sapiens
aggcatcttatttaa

SEQ ID NO: 293455 - DNA, 15 bp, Homo sapiens
aaggcatcttattta

SEQ ID NO: 293456 - DNA, 15 bp, Homo sapiens
aaaggcatcttattt

SEQ ID NO: 293457 - DNA, 15 bp, Homo sapiens
taaaggcatcttatt

SEQ ID NO: 293458 - DNA, 15 bp, Homo sapiens
gtaaaggcatcttat

SEQ ID NO: 293459 - DNA, 15 bp, Homo sapiens
agtaaaggcatctta

SEQ ID NO: 293460 - DNA, 15 bp, Homo sapiens
aagtaaaggcatctt

SEQ ID NO: 293461 - DNA, 15 bp, Homo sapiens
aaagtaaaggcatct

SEQ ID NO: 293462 - DNA, 15 bp, Homo sapiens
aaaagtaaaggcatc

SEQ ID NO: 293463 - DNA, 15 bp, Homo sapiens
caaaagtaaaggcat

SEQ ID NO: 293464 - DNA, 15 bp, Homo sapiens
acaaaagtaaaggca

SEQ ID NO: 293465 - DNA, 15 bp, Homo sapiens
cacaaaagtaaaggc

SEQ ID NO: 293466 - DNA, 15 bp, Homo sapiens
ccacaaaagtaaagg

SEQ ID NO: 293467 - DNA, 15 bp, Homo sapiens
gccacaaaagtaaag

SEQ ID NO: 293468 - DNA, 15 bp, Homo sapiens
tgccacaaaagtaaa

SEQ ID NO: 293469 - DNA, 15 bp, Homo sapiens
ctgccacaaaagtaa

SEQ ID NO: 293470 - DNA, 15 bp, Homo sapiens
cctgccacaaaagta

SEQ ID NO: 293471 - DNA, 15 bp, Homo sapiens
tcctgccacaaaagt

SEQ ID NO: 293472 - DNA, 15 bp, Homo sapiens
atcctgccacaaaag

SEQ ID NO: 293473 - DNA, 15 bp, Homo sapiens
tatcctgccacaaaa

SEQ ID NO: 293474 - DNA, 15 bp, Homo sapiens
ttatcctgccacaaa

SEQ ID NO: 293475 - DNA, 15 bp, Homo sapiens
cttatcctgccacaa

SEQ ID NO: 293476 - DNA, 15 bp, Homo sapiens
gcttatcctgccaca

SEQ ID NO: 293477 - DNA, 15 bp, Homo sapiens
agcttatcctgccac

SEQ ID NO: 293478 - DNA, 15 bp, Homo sapiens
cagcttatcctgcca

SEQ ID NO: 293479 - DNA, 15 bp, Homo sapiens
ccagcttatcctgcc

SEQ ID NO: 293480 - DNA, 15 bp, Homo sapiens
gccagcttatcctgc

SEQ ID NO: 293481 - DNA, 15 bp, Homo sapiens
ggccagcttatcctg

SEQ ID NO: 293482 - DNA, 15 bp, Homo sapiens
aggccagcttatcct

SEQ ID NO: 293483 - DNA, 15 bp, Homo sapiens
taggccagcttatcc

SEQ ID NO: 293484 - DNA, 15 bp, Homo sapiens
ttaggccagcttatc

SEQ ID NO: 293485 - DNA, 15 bp, Homo sapiens
cttaggccagcttat

SEQ ID NO: 293486 - DNA, 15 bp, Homo sapiens
gcttaggccagctta

SEQ ID NO: 293487 - DNA, 15 bp, Homo sapiens
agcttaggccagctt

SEQ ID NO: 293488 - DNA, 15 bp, Homo sapiens
cagcttaggccagct

SEQ ID NO: 293489 - DNA, 15 bp, Homo sapiens
tcagcttaggccagc

SEQ ID NO: 293490 - DNA, 15 bp, Homo sapiens
ttcagcttaggccag

SEQ ID NO: 293491 - DNA, 15 bp, Homo sapiens
cttcagcttaggcca

SEQ ID NO: 293492 - DNA, 15 bp, Homo sapiens
acttcagcttaggcc

SEQ ID NO: 293493 - DNA, 15 bp, Homo sapiens
gacttcagcttaggc

SEQ ID NO: 293494 - DNA, 15 bp, Homo sapiens
agacttcagcttagg

SEQ ID NO: 293495 - DNA, 15 bp, Homo sapiens
gagacttcagcttag

SEQ ID NO: 293496 - DNA, 15 bp, Homo sapiens
ggagacttcagctta

SEQ ID NO: 293497 - DNA, 15 bp, Homo sapiens
tggagacttcagctt

SEQ ID NO: 293498 - DNA, 15 bp, Homo sapiens
ttggagacttcagct

SEQ ID NO: 293499 - DNA, 15 bp, Homo sapiens
tttggagacttcagc

SEQ ID NO: 293500 - DNA, 15 bp, Homo sapiens
ttttggagacttcag

SEQ ID NO: 293501 - DNA, 15 bp, Homo sapiens
tttttggagacttca

SEQ ID NO: 293502 - DNA, 15 bp, Homo sapiens
ctttttggagacttc

SEQ ID NO: 293503 - DNA, 15 bp, Homo sapiens
tctttttggagactt

SEQ ID NO: 293504 - DNA, 15 bp, Homo sapiens
ttctttttggagact

SEQ ID NO: 293505 - DNA, 15 bp, Homo sapiens
tttctttttggagac

SEQ ID NO: 293506 - DNA, 15 bp, Homo sapiens
ctttctttttggaga

SEQ ID NO: 293507 - DNA, 15 bp, Homo sapiens
cctttctttttggag

SEQ ID NO: 293508 - DNA, 15 bp, Homo sapiens
tcctttctttttgga

SEQ ID NO: 293509 - DNA, 15 bp, Homo sapiens
ctcctttctttttgg

SEQ ID NO: 293510 - DNA, 15 bp, Homo sapiens
cctcctttctttttg

SEQ ID NO: 293511 - DNA, 15 bp, Homo sapiens
tcctcctttcttttt

SEQ ID NO: 293512 - DNA, 15 bp, Homo sapiens
gtcctcctttctttt

SEQ ID NO: 293513 - DNA, 15 bp, Homo sapiens
tgtcctcctttcttt

SEQ ID NO: 293514 - DNA, 15 bp, Homo sapiens
ctgtcctcctttctt

SEQ ID NO: 293515 - DNA, 15 bp, Homo sapiens
tctgtcctcctttct

SEQ ID NO: 293516 - DNA, 15 bp, Homo sapiens
ttctgtcctcctttc

SEQ ID NO: 293517 - DNA, 15 bp, Homo sapiens
tttctgtcctccttt

SEQ ID NO: 293518 - DNA, 15 bp, Homo sapiens
ttttctgtcctcctt

SEQ ID NO: 293519 - DNA, 15 bp, Homo sapiens
tttttctgtcctcct

SEQ ID NO: 293520 - DNA, 15 bp, Homo sapiens
ctttttctgtcctcc

SEQ ID NO: 293521 - DNA, 15 bp, Homo sapiens
tctttttctgtcctc

SEQ ID NO: 293522 - DNA, 15 bp, Homo sapiens
ttctttttctgtcct

SEQ ID NO: 293523 - DNA, 15 bp, Homo sapiens
tttctttttctgtcc

SEQ ID NO: 293524 - DNA, 15 bp, Homo sapiens
atttctttttctgtc

SEQ ID NO: 293525 - DNA, 15 bp, Homo sapiens
aatttctttttctgt

SEQ ID NO: 293526 - DNA, 15 bp, Homo sapiens
caatttctttttctg

SEQ ID NO: 293527 - DNA, 15 bp, Homo sapiens
ccaatttctttttct

SEQ ID NO: 293528 - DNA, 15 bp, Homo sapiens
accaatttctttttc

SEQ ID NO: 293529 - DNA, 15 bp, Homo sapiens
caccaatttcttttt

SEQ ID NO: 293530 - DNA, 15 bp, Homo sapiens
tcaccaatttctttt

SEQ ID NO: 293531 - DNA, 15 bp, Homo sapiens
ttcaccaatttcttt

SEQ ID NO: 293532 - DNA, 15 bp, Homo sapiens
tttcaccaatttctt

SEQ ID NO: 293533 - DNA, 15 bp, Homo sapiens
atttcaccaatttct

SEQ ID NO: 293534 - DNA, 15 bp, Homo sapiens
aatttcaccaatttc

SEQ ID NO: 293535 - DNA, 15 bp, Homo sapiens
aaatttcaccaattt

SEQ ID NO: 293536 - DNA, 15 bp, Homo sapiens
aaaatttcaccaatt

SEQ ID NO: 293537 - DNA, 15 bp, Homo sapiens
aaaaatttcaccaat

SEQ ID NO: 293538 - DNA, 15 bp, Homo sapiens
aaaaaatttcaccaa

SEQ ID NO: 293539 - DNA, 15 bp, Homo sapiens
aaaaaaatttcacca

SEQ ID NO: 293540 - DNA, 15 bp, Homo sapiens
aaaaaaaatttcacc

SEQ ID NO: 293541 - DNA, 15 bp, Homo sapiens
caaaaaaaatttcac

SEQ ID NO: 293542 - DNA, 15 bp, Homo sapiens
acaaaaaaaatttca

SEQ ID NO: 293543 - DNA, 15 bp, Homo sapiens
tacaaaaaaaatttc

SEQ ID NO: 293544 - DNA, 15 bp, Homo sapiens
atacaaaaaaaattt

SEQ ID NO: 293545 - DNA, 15 bp, Homo sapiens
tcatacaaaaaaaat

SEQ ID NO: 293546 - DNA, 15 bp, Homo sapiens
ttcatacaaaaaaaa

SEQ ID NO: 293547 - DNA, 15 bp, Homo sapiens
tttcatacaaaaaaa

SEQ ID NO: 293548 - DNA, 15 bp, Homo sapiens
ttttcatacaaaaaa

SEQ ID NO: 293549 - DNA, 15 bp, Homo sapiens
gttttcatacaaaaa

SEQ ID NO: 293550 - DNA, 15 bp, Homo sapiens
tgttttcatacaaaa

SEQ ID NO: 293551 - DNA, 15 bp, Homo sapiens
atgttttcatacaaa

SEQ ID NO: 293552 - DNA, 15 bp, Homo sapiens
tatgttttcatacaa

SEQ ID NO: 293553 - DNA, 15 bp, Homo sapiens
gtatgttttcataca

SEQ ID NO: 293554 - DNA, 15 bp, Homo sapiens
ggtatgttttcatac

SEQ ID NO: 293555 - DNA, 15 bp, Homo sapiens
aggtatgttttcata

SEQ ID NO: 293556 - DNA, 15 bp, Homo sapiens
caggtatgttttcat

SEQ ID NO: 293557 - DNA, 15 bp, Homo sapiens
acaggtatgttttca

SEQ ID NO: 293558 - DNA, 15 bp, Homo sapiens
cacaggtatgttttc

SEQ ID NO: 293559 - DNA, 15 bp, Homo sapiens
ccacaggtatgtttt

SEQ ID NO: 293560 - DNA, 15 bp, Homo sapiens
accacaggtatgttt

SEQ ID NO: 293561 - DNA, 15 bp, Homo sapiens
caccacaggtatgtt

SEQ ID NO: 293562 - DNA, 15 bp, Homo sapiens
gcaccacaggtatgt

SEQ ID NO: 293563 - DNA, 15 bp, Homo sapiens
tgcaccacaggtatg

SEQ ID NO: 293564 - DNA, 15 bp, Homo sapiens
ttgcaccacaggtat

SEQ ID NO: 293565 - DNA, 15 bp, Homo sapiens
tttgcaccacaggta

SEQ ID NO: 293566 - DNA, 15 bp, Homo sapiens
ttttgcaccacaggt

SEQ ID NO: 293567 - DNA, 15 bp, Homo sapiens
tttttgcaccacagg

SEQ ID NO: 293568 - DNA, 15 bp, Homo sapiens
atttttgcaccacag

SEQ ID NO: 293569 - DNA, 15 bp, Homo sapiens
tatttttgcaccaca

SEQ ID NO: 293570 - DNA, 15 bp, Homo sapiens
ttatttttgcaccac

SEQ ID NO: 293571 - DNA, 15 bp, Homo sapiens
attatttttgcacca

SEQ ID NO: 293572 - DNA, 15 bp, Homo sapiens
tattatttttgcacc

SEQ ID NO: 293573 - DNA, 15 bp, Homo sapiens
ctattatttttgcac

SEQ ID NO: 293574 - DNA, 15 bp, Homo sapiens
tctattatttttgca

SEQ ID NO: 293575 - DNA, 15 bp, Homo sapiens
atctattatttttgc

SEQ ID NO: 293576 - DNA, 15 bp, Homo sapiens
aatctattatttttg

SEQ ID NO: 293577 - DNA, 15 bp, Homo sapiens
aaatctattattttt

SEQ ID NO: 293578 - DNA, 15 bp, Homo sapiens
gaaatctattatttt

SEQ ID NO: 293579 - DNA, 15 bp, Homo sapiens
agaaatctattattt

SEQ ID NO: 293580 - DNA, 15 bp, Homo sapiens
gagaaatctattatt

SEQ ID NO: 293581 - DNA, 15 bp, Homo sapiens
tgagaaatctattat

SEQ ID NO: 293582 - DNA, 15 bp, Homo sapiens
atgagaaatctatta

SEQ ID NO: 293583 - DNA, 15 bp, Homo sapiens
aatgagaaatctatt

SEQ ID NO: 293584 - DNA, 15 bp, Homo sapiens
gaatgagaaatctat

SEQ ID NO: 293585 - DNA, 15 bp, Homo sapiens
tgaatgagaaatcta

SEQ ID NO: 293586 - DNA, 15 bp, Homo sapiens
ttgaatgagaaatct

SEQ ID NO: 293587 - DNA, 15 bp, Homo sapiens
tttgaatgagaaatc

SEQ ID NO: 293588 - DNA, 15 bp, Homo sapiens
gtttgaatgagaaat

SEQ ID NO: 293589 - DNA, 15 bp, Homo sapiens
tgtttgaatgagaaa

SEQ ID NO: 293590 - DNA, 15 bp, Homo sapiens
gtgtttgaatgagaa

SEQ ID NO: 293591 - DNA, 15 bp, Homo sapiens
agtgtttgaatgaga

SEQ ID NO: 293592 - DNA, 15 bp, Homo sapiens
cagtgtttgaatgag

SEQ ID NO: 293593 - DNA, 15 bp, Homo sapiens
tcagtgtttgaatga

SEQ ID NO: 293594 - DNA, 15 bp, Homo sapiens
ttcagtgtttgaatg

SEQ ID NO: 293595 - DNA, 15 bp, Homo sapiens
tttcagtgtttgaat

SEQ ID NO: 293596 - DNA, 15 bp, Homo sapiens
atttcagtgtttgaa

SEQ ID NO: 293597 - DNA, 15 bp, Homo sapiens
tatttcagtgtttga

SEQ ID NO: 293598 - DNA, 15 bp, Homo sapiens
ttatttcagtgtttg

SEQ ID NO: 293599 - DNA, 15 bp, Homo sapiens
attatttcagtgttt

SEQ ID NO: 293600 - DNA, 15 bp, Homo sapiens
tattatttcagtgtt

SEQ ID NO: 293601 - DNA, 15 bp, Homo sapiens
ttattatttcagtgt

SEQ ID NO: 293602 - DNA, 15 bp, Homo sapiens
cttattatttcagtg

SEQ ID NO: 293603 - DNA, 15 bp, Homo sapiens
tcttattatttcagt

SEQ ID NO: 293604 - DNA, 15 bp, Homo sapiens
gtcttattatttcag

SEQ ID NO: 293605 - DNA, 15 bp, Homo sapiens
ggtcttattatttca

SEQ ID NO: 293606 - DNA, 15 bp, Homo sapiens
tggtcttattatttc

SEQ ID NO: 293607 - DNA, 15 bp, Homo sapiens
atggtcttattattt

SEQ ID NO: 293608 - DNA, 15 bp, Homo sapiens
tatggtcttattatt

SEQ ID NO: 293609 - DNA, 15 bp, Homo sapiens
atatggtcttattat

SEQ ID NO: 293610 - DNA, 15 bp, Homo sapiens
aatatggtcttatta

SEQ ID NO: 293611 - DNA, 15 bp, Homo sapiens
taatatggtcttatt

SEQ ID NO: 293612 - DNA, 15 bp, Homo sapiens
gtaatatggtcttat

SEQ ID NO: 293613 - DNA, 15 bp, Homo sapiens
agtaatatggtctta

SEQ ID NO: 293614 - DNA, 15 bp, Homo sapiens
aagtaatatggtctt

SEQ ID NO: 293615 - DNA, 15 bp, Homo sapiens
caagtaatatggtct

SEQ ID NO: 293616 - DNA, 15 bp, Homo sapiens
acaagtaatatggtc

SEQ ID NO: 293617 - DNA, 15 bp, Homo sapiens
aacaagtaatatggt

SEQ ID NO: 293618 - DNA, 15 bp, Homo sapiens
aaacaagtaatatgg

SEQ ID NO: 293619 - DNA, 15 bp, Homo sapiens
aaaacaagtaatatg

SEQ ID NO: 293620 - DNA, 15 bp, Homo sapiens
aaaaacaagtaatat

SEQ ID NO: 293621 - DNA, 15 bp, Homo sapiens
gaaaaacaagtaata

SEQ ID NO: 293622 - DNA, 15 bp, Homo sapiens
tgaaaaacaagtaat

SEQ ID NO: 293623 - DNA, 15 bp, Homo sapiens
ctgaaaaacaagtaa

SEQ ID NO: 293624 - DNA, 15 bp, Homo sapiens
actgaaaaacaagta

SEQ ID NO: 293625 - DNA, 15 bp, Homo sapiens
gactgaaaaacaagt

SEQ ID NO: 293626 - DNA, 15 bp, Homo sapiens
agactgaaaaacaag

SEQ ID NO: 293627 - DNA, 15 bp, Homo sapiens
gagactgaaaaacaa

SEQ ID NO: 293628 - DNA, 15 bp, Homo sapiens
tgagactgaaaaaca

SEQ ID NO: 293629 - DNA, 15 bp, Homo sapiens
atgagactgaaaaac

SEQ ID NO: 293630 - DNA, 15 bp, Homo sapiens
tatgagactgaaaaa

SEQ ID NO: 293631 - DNA, 15 bp, Homo sapiens
atatgagactgaaaa

SEQ ID NO: 293632 - DNA, 15 bp, Homo sapiens
aatatgagactgaaa

SEQ ID NO: 293633 - DNA, 15 bp, Homo sapiens
aaatatgagactgaa

SEQ ID NO: 293634 - DNA, 15 bp, Homo sapiens
aaaatatgagactga

SEQ ID NO: 293635 - DNA, 15 bp, Homo sapiens
aaaaatatgagactg

SEQ ID NO: 293636 - DNA, 15 bp, Homo sapiens
gaaaaatatgagact

SEQ ID NO: 293637 - DNA, 15 bp, Homo sapiens
tgaaaaatatgagac

SEQ ID NO: 293638 - DNA, 15 bp, Homo sapiens
ctgaaaaatatgaga

SEQ ID NO: 293639 - DNA, 15 bp, Homo sapiens
actgaaaaatatgag

SEQ ID NO: 293640 - DNA, 15 bp, Homo sapiens
gactgaaaaatatga

SEQ ID NO: 293641 - DNA, 15 bp, Homo sapiens
ggactgaaaaatatg

SEQ ID NO: 293642 - DNA, 15 bp, Homo sapiens
gggactgaaaaatat

SEQ ID NO: 293643 - DNA, 15 bp, Homo sapiens
ggggactgaaaaata

SEQ ID NO: 293644 - DNA, 15 bp, Homo sapiens
aggggactgaaaaat

SEQ ID NO: 293645 - DNA, 15 bp, Homo sapiens
caggggactgaaaaa

SEQ ID NO: 293646 - DNA, 15 bp, Homo sapiens
ccaggggactgaaaa

SEQ ID NO: 293647 - DNA, 15 bp, Homo sapiens
accaggggactgaaa

SEQ ID NO: 293648 - DNA, 15 bp, Homo sapiens
caccaggggactgaa

SEQ ID NO: 293649 - DNA, 15 bp, Homo sapiens
acaccaggggactga

SEQ ID NO: 293650 - DNA, 15 bp, Homo sapiens
cacaccaggggactg

SEQ ID NO: 293651 - DNA, 15 bp, Homo sapiens
acacaccaggggact

SEQ ID NO: 293652 - DNA, 15 bp, Homo sapiens
cacacaccaggggac

SEQ ID NO: 293653 - DNA, 15 bp, Homo sapiens
ccacacaccagggga

SEQ ID NO: 293654 - DNA, 15 bp, Homo sapiens
tccacacaccagggg

SEQ ID NO: 293655 - DNA, 15 bp, Homo sapiens
atccacacaccaggg

SEQ ID NO: 293656 - DNA, 15 bp, Homo sapiens
aatccacacaccagg

SEQ ID NO: 293657 - DNA, 15 bp, Homo sapiens
gaatccacacaccag

SEQ ID NO: 293658 - DNA, 15 bp, Homo sapiens
agaatccacacacca

SEQ ID NO: 293659 - DNA, 15 bp, Homo sapiens
aagaatccacacacc

SEQ ID NO: 293660 - DNA, 15 bp, Homo sapiens
aaagaatccacacac

SEQ ID NO: 293661 - DNA, 15 bp, Homo sapiens
gaaagaatccacaca

SEQ ID NO: 293662 - DNA, 15 bp, Homo sapiens
agaaagaatccacac

SEQ ID NO: 293663 - DNA, 15 bp, Homo sapiens
tagaaagaatccaca

SEQ ID NO: 293664 - DNA, 15 bp, Homo sapiens
gtagaaagaatccac

SEQ ID NO: 293665 - DNA, 15 bp, Homo sapiens
tgtagaaagaatcca

SEQ ID NO: 293666 - DNA, 15 bp, Homo sapiens
gtgtagaaagaatcc

SEQ ID NO: 293667 - DNA, 15 bp, Homo sapiens
tgtgtagaaagaatc

SEQ ID NO: 293668 - DNA, 15 bp, Homo sapiens
ttgtgtagaaagaat

SEQ ID NO: 293669 - DNA, 15 bp, Homo sapiens
tttgtgtagaaagaa

SEQ ID NO: 293670 - DNA, 15 bp, Homo sapiens
gtttgtgtagaaaga

SEQ ID NO: 293671 - DNA, 15 bp, Homo sapiens
tgtttgtgtagaaag

SEQ ID NO: 293672 - DNA, 15 bp, Homo sapiens
ttgtttgtgtagaaa

SEQ ID NO: 293673 - DNA, 15 bp, Homo sapiens
tttgtttgtgtagaa

SEQ ID NO: 293674 - DNA, 15 bp, Homo sapiens
gtttgtttgtgtaga

SEQ ID NO: 293675 - DNA, 15 bp, Homo sapiens
tgtttgtttgtgtag

SEQ ID NO: 293676 - DNA, 15 bp, Homo sapiens
ctgtttgtttgtgta

SEQ ID NO: 293677 - DNA, 15 bp, Homo sapiens
gctgtttgtttgtgt

SEQ ID NO: 293678 - DNA, 15 bp, Homo sapiens
agctgtttgtttgtg

SEQ ID NO: 293679 - DNA, 15 bp, Homo sapiens
tagctgtttgtttgt

SEQ ID NO: 293680 - DNA, 15 bp, Homo sapiens
ctagctgtttgtttg

SEQ ID NO: 293681 - DNA, 15 bp, Homo sapiens
actagctgtttgttt

SEQ ID NO: 293682 - DNA, 15 bp, Homo sapiens
tactagctgtttgtt

SEQ ID NO: 293683 - DNA, 15 bp, Homo sapiens
gtactagctgtttgt

SEQ ID NO: 293684 - DNA, 15 bp, Homo sapiens
cgtactagctgtttg

SEQ ID NO: 293685 - DNA, 15 bp, Homo sapiens
acgtactagctgttt

SEQ ID NO: 293686 - DNA, 15 bp, Homo sapiens
cacgtactagctgtt

SEQ ID NO: 293687 - DNA, 15 bp, Homo sapiens
acacgtactagctgt

SEQ ID NO: 293688 - DNA, 15 bp, Homo sapiens
gacacgtactagctg

SEQ ID NO: 293689 - DNA, 15 bp, Homo sapiens
tgacacgtactagct

SEQ ID NO: 293690 - DNA, 15 bp, Homo sapiens
ttgacacgtactagc

SEQ ID NO: 293691 - DNA, 15 bp, Homo sapiens
attgacacgtactag

SEQ ID NO: 293692 - DNA, 15 bp, Homo sapiens
aattgacacgtacta

SEQ ID NO: 293693 - DNA, 15 bp, Homo sapiens
taattgacacgtact

SEQ ID NO: 293694 - DNA, 15 bp, Homo sapiens
ataattgacacgtac

SEQ ID NO: 293695 - DNA, 15 bp, Homo sapiens
cataattgacacgta

SEQ ID NO: 293696 - DNA, 15 bp, Homo sapiens
acataattgacacgt

SEQ ID NO: 293697 - DNA, 15 bp, Homo sapiens
tacataattgacacg

SEQ ID NO: 293698 - DNA, 15 bp, Homo sapiens
ttacataattgacac

SEQ ID NO: 293699 - DNA, 15 bp, Homo sapiens
tttacataattgaca

SEQ ID NO: 293700 - DNA, 15 bp, Homo sapiens
ttttacataattgac

SEQ ID NO: 293701 - DNA, 15 bp, Homo sapiens
attttacataattga

SEQ ID NO: 293702 - DNA, 15 bp, Homo sapiens
aattttacataattg

SEQ ID NO: 293703 - DNA, 15 bp, Homo sapiens
taattttacataatt

SEQ ID NO: 293704 - DNA, 15 bp, Homo sapiens
tataattttacataa

SEQ ID NO: 293705 - DNA, 15 bp, Homo sapiens
atataattttacata

SEQ ID NO: 293706 - DNA, 15 bp, Homo sapiens
aatataattttacat

SEQ ID NO: 293707 - DNA, 15 bp, Homo sapiens
taatataattttaca

SEQ ID NO: 293708 - DNA, 15 bp, Homo sapiens
gtaatataattttac

SEQ ID NO: 293709 - DNA, 15 bp, Homo sapiens
ggtaatataatttta

SEQ ID NO: 293710 - DNA, 15 bp, Homo sapiens
tggtaatataatttt

SEQ ID NO: 293711 - DNA, 15 bp, Homo sapiens
ttggtaatataattt

SEQ ID NO: 293712 - DNA, 15 bp, Homo sapiens
gttggtaatataatt

SEQ ID NO: 293713 - DNA, 15 bp, Homo sapiens
tgttggtaatataat

SEQ ID NO: 293714 - DNA, 15 bp, Homo sapiens
gtgttggtaatataa

SEQ ID NO: 293715 - DNA, 15 bp, Homo sapiens
agtgttggtaatata

SEQ ID NO: 293716 - DNA, 15 bp, Homo sapiens
gagtgttggtaatat

SEQ ID NO: 293717 - DNA, 15 bp, Homo sapiens
tgagtgttggtaata

SEQ ID NO: 293718 - DNA, 15 bp, Homo sapiens
ttgagtgttggtaat

SEQ ID NO: 293719 - DNA, 15 bp, Homo sapiens
cttgagtgttggtaa

SEQ ID NO: 293720 - DNA, 15 bp, Homo sapiens
gcttgagtgttggta

SEQ ID NO: 293721 - DNA, 15 bp, Homo sapiens
tgcttgagtgttggt

SEQ ID NO: 293722 - DNA, 15 bp, Homo sapiens
ttgcttgagtgttgg

SEQ ID NO: 293723 - DNA, 15 bp, Homo sapiens
tttgcttgagtgttg

SEQ ID NO: 293724 - DNA, 15 bp, Homo sapiens
ttttgcttgagtgtt

SEQ ID NO: 293725 - DNA, 15 bp, Homo sapiens
tttttgcttgagtgt

SEQ ID NO: 293726 - DNA, 15 bp, Homo sapiens
atttttgcttgagtg

SEQ ID NO: 293727 - DNA, 15 bp, Homo sapiens
catttttgcttgagt

SEQ ID NO: 293728 - DNA, 15 bp, Homo sapiens
acatttttgcttgag

SEQ ID NO: 293729 - DNA, 15 bp, Homo sapiens
aacatttttgcttga

SEQ ID NO: 293730 - DNA, 15 bp, Homo sapiens
aaacatttttgcttg

SEQ ID NO: 293731 - DNA, 15 bp, Homo sapiens
aaaacatttttgctt

SEQ ID NO: 293732 - DNA, 15 bp, Homo sapiens
caaaacatttttgct

SEQ ID NO: 293733 - DNA, 15 bp, Homo sapiens
ccaaaacatttttgc

SEQ ID NO: 293734 - DNA, 15 bp, Homo sapiens
cccaaaacatttttg

SEQ ID NO: 293735 - DNA, 15 bp, Homo sapiens
acccaaaacattttt

SEQ ID NO: 293736 - DNA, 15 bp, Homo sapiens
tacccaaaacatttt

SEQ ID NO: 293737 - DNA, 15 bp, Homo sapiens
atacccaaaacattt

SEQ ID NO: 293738 - DNA, 15 bp, Homo sapiens
tatacccaaaacatt

SEQ ID NO: 293739 - DNA, 15 bp, Homo sapiens
atatacccaaaacat

SEQ ID NO: 293740 - DNA, 15 bp, Homo sapiens
aatatacccaaaaca

SEQ ID NO: 293741 - DNA, 15 bp, Homo sapiens
gaatatacccaaaac

SEQ ID NO: 293742 - DNA, 15 bp, Homo sapiens
ggaatatacccaaaa

SEQ ID NO: 293743 - DNA, 15 bp, Homo sapiens
gggaatatacccaaa

SEQ ID NO: 293744 - DNA, 15 bp, Homo sapiens
ggggaatatacccaa

SEQ ID NO: 293745 - DNA, 15 bp, Homo sapiens
aggggaatataccca

SEQ ID NO: 293746 - DNA, 15 bp, Homo sapiens
taggggaatataccc

SEQ ID NO: 293747 - DNA, 15 bp, Homo sapiens
ttaggggaatatacc

SEQ ID NO: 293748 - DNA, 15 bp, Homo sapiens
tttaggggaatatac

SEQ ID NO: 293749 - DNA, 15 bp, Homo sapiens
ttttaggggaatata

SEQ ID NO: 293750 - DNA, 15 bp, Homo sapiens
attttaggggaatat

SEQ ID NO: 293751 - DNA, 15 bp, Homo sapiens
aattttaggggaata

SEQ ID NO: 293752 - DNA, 15 bp, Homo sapiens
caattttaggggaat

SEQ ID NO: 293753 - DNA, 15 bp, Homo sapiens
acaattttaggggaa

SEQ ID NO: 293754 - DNA, 15 bp, Homo sapiens
gacaattttagggga

SEQ ID NO: 293755 - DNA, 15 bp, Homo sapiens
ggacaattttagggg

SEQ ID NO: 293756 - DNA, 15 bp, Homo sapiens
aggacaattttaggg

SEQ ID NO: 293757 - DNA, 15 bp, Homo sapiens
aaggacaattttagg

SEQ ID NO: 293758 - DNA, 15 bp, Homo sapiens
aaaggacaattttag

SEQ ID NO: 293759 - DNA, 15 bp, Homo sapiens
caaaggacaatttta

SEQ ID NO: 293760 - DNA, 15 bp, Homo sapiens
gcaaaggacaatttt

SEQ ID NO: 293761 - DNA, 15 bp, Homo sapiens
tgcaaaggacaattt

SEQ ID NO: 293762 - DNA, 15 bp, Homo sapiens
ttgcaaaggacaatt

SEQ ID NO: 293763 - DNA, 15 bp, Homo sapiens
attgcaaaggacaat

SEQ ID NO: 293764 - DNA, 15 bp, Homo sapiens
cattgcaaaggacaa

SEQ ID NO: 293765 - DNA, 15 bp, Homo sapiens
ccattgcaaaggaca

SEQ ID NO: 293766 - DNA, 15 bp, Homo sapiens
cccattgcaaaggac

SEQ ID NO: 293767 - DNA, 15 bp, Homo sapiens
tcccattgcaaagga

SEQ ID NO: 293768 - DNA, 15 bp, Homo sapiens
ttcccattgcaaagg

SEQ ID NO: 293769 - DNA, 15 bp, Homo sapiens
tttcccattgcaaag

SEQ ID NO: 293770 - DNA, 15 bp, Homo sapiens
atttcccattgcaaa

SEQ ID NO: 293771 - DNA, 15 bp, Homo sapiens
gatttcccattgcaa

SEQ ID NO: 293772 - DNA, 15 bp, Homo sapiens
agatttcccattgca

SEQ ID NO: 293773 - DNA, 15 bp, Homo sapiens
aagatttcccattgc

SEQ ID NO: 293774 - DNA, 15 bp, Homo sapiens
aaagatttcccattg

SEQ ID NO: 293775 - DNA, 15 bp, Homo sapiens
aaaagatttcccatt

SEQ ID NO: 293776 - DNA, 15 bp, Homo sapiens
gaaaagatttcccat

SEQ ID NO: 293777 - DNA, 15 bp, Homo sapiens
tgaaaagatttccca

SEQ ID NO: 293778 - DNA, 15 bp, Homo sapiens
gtgaaaagatttccc

SEQ ID NO: 293779 - DNA, 15 bp, Homo sapiens
tgtgaaaagatttcc

SEQ ID NO: 293780 - DNA, 15 bp, Homo sapiens
atgtgaaaagatttc

SEQ ID NO: 293781 - DNA, 15 bp, Homo sapiens
aatgtgaaaagattt

SEQ ID NO: 293782 - DNA, 15 bp, Homo sapiens
caatgtgaaaagatt

SEQ ID NO: 293783 - DNA, 15 bp, Homo sapiens
tcaatgtgaaaagat

SEQ ID NO: 293784 - DNA, 15 bp, Homo sapiens
atcaatgtgaaaaga

SEQ ID NO: 293785 - DNA, 15 bp, Homo sapiens
tatcaatgtgaaaag

SEQ ID NO: 293786 - DNA, 15 bp, Homo sapiens
atatcaatgtgaaaa

SEQ ID NO: 293787 - DNA, 15 bp, Homo sapiens
aatatcaatgtgaaa

SEQ ID NO: 293788 - DNA, 15 bp, Homo sapiens
aaatatcaatgtgaa

SEQ ID NO: 293789 - DNA, 15 bp, Homo sapiens
taaatatcaatgtga

SEQ ID NO: 293790 - DNA, 15 bp, Homo sapiens
ctaaatatcaatgtg

SEQ ID NO: 293791 - DNA, 15 bp, Homo sapiens
tctaaatatcaatgt

SEQ ID NO: 293792 - DNA, 15 bp, Homo sapiens
ctctaaatatcaatg

SEQ ID NO: 293793 - DNA, 15 bp, Homo sapiens
cctctaaatatcaat

SEQ ID NO: 293794 - DNA, 15 bp, Homo sapiens
gcctctaaatatcaa

SEQ ID NO: 293795 - DNA, 15 bp, Homo sapiens
agcctctaaatatca

SEQ ID NO: 293796 - DNA, 15 bp, Homo sapiens
cagcctctaaatatc

SEQ ID NO: 293797 - DNA, 15 bp, Homo sapiens
ccagcctctaaatat

SEQ ID NO: 293798 - DNA, 15 bp, Homo sapiens
accagcctctaaata

SEQ ID NO: 293799 - DNA, 15 bp, Homo sapiens
aaccagcctctaaat

SEQ ID NO: 293800 - DNA, 15 bp, Homo sapiens
caaccagcctctaaa

SEQ ID NO: 293801 - DNA, 15 bp, Homo sapiens
ccaaccagcctctaa

SEQ ID NO: 293802 - DNA, 15 bp, Homo sapiens
tccaaccagcctcta

SEQ ID NO: 293803 - DNA, 15 bp, Homo sapiens
ctccaaccagcctct

SEQ ID NO: 293804 - DNA, 15 bp, Homo sapiens
actccaaccagcctc

SEQ ID NO: 293805 - DNA, 15 bp, Homo sapiens
tactccaaccagcct

SEQ ID NO: 293806 - DNA, 15 bp, Homo sapiens
atactccaaccagcc

SEQ ID NO: 293807 - DNA, 15 bp, Homo sapiens
aatactccaaccagc

SEQ ID NO: 293808 - DNA, 15 bp, Homo sapiens
aaatactccaaccag

SEQ ID NO: 293809 - DNA, 15 bp, Homo sapiens
gaaatactccaacca

SEQ ID NO: 293810 - DNA, 15 bp, Homo sapiens
ggaaatactccaacc

SEQ ID NO: 293811 - DNA, 15 bp, Homo sapiens
aggaaatactccaac

SEQ ID NO: 293812 - DNA, 15 bp, Homo sapiens
gaggaaatactccaa

SEQ ID NO: 293813 - DNA, 15 bp, Homo sapiens
ggaggaaatactcca

SEQ ID NO: 293814 - DNA, 15 bp, Homo sapiens
aggaggaaatactcc

SEQ ID NO: 293815 - DNA, 15 bp, Homo sapiens
caggaggaaatactc

SEQ ID NO: 293816 - DNA, 15 bp, Homo sapiens
tcaggaggaaatact

SEQ ID NO: 293817 - DNA, 15 bp, Homo sapiens
ttcaggaggaaatac

SEQ ID NO: 293818 - DNA, 15 bp, Homo sapiens
attcaggaggaaata

SEQ ID NO: 293819 - DNA, 15 bp, Homo sapiens
aattcaggaggaaat

SEQ ID NO: 293820 - DNA, 15 bp, Homo sapiens
aaattcaggaggaaa

SEQ ID NO: 293821 - DNA, 15 bp, Homo sapiens
caaattcaggaggaa

SEQ ID NO: 293822 - DNA, 15 bp, Homo sapiens
ccaaattcaggagga

SEQ ID NO: 293823 - DNA, 15 bp, Homo sapiens
cccaaattcaggagg

SEQ ID NO: 293824 - DNA, 15 bp, Homo sapiens
acccaaattcaggag

SEQ ID NO: 293825 - DNA, 15 bp, Homo sapiens
aacccaaattcagga

SEQ ID NO: 293826 - DNA, 15 bp, Homo sapiens
aaacccaaattcagg

SEQ ID NO: 293827 - DNA, 15 bp, Homo sapiens
aaaacccaaattcag

SEQ ID NO: 293828 - DNA, 15 bp, Homo sapiens
taaaacccaaattca

SEQ ID NO: 293829 - DNA, 15 bp, Homo sapiens
ctaaaacccaaattc

SEQ ID NO: 293830 - DNA, 15 bp, Homo sapiens
actaaaacccaaatt

SEQ ID NO: 293831 - DNA, 15 bp, Homo sapiens
cactaaaacccaaat

SEQ ID NO: 293832 - DNA, 15 bp, Homo sapiens
ccactaaaacccaaa

SEQ ID NO: 293833 - DNA, 15 bp, Homo sapiens
tccactaaaacccaa

SEQ ID NO: 293834 - DNA, 15 bp, Homo sapiens
ttccactaaaaccca

SEQ ID NO: 293835 - DNA, 15 bp, Homo sapiens
cttccactaaaaccc

SEQ ID NO: 293836 - DNA, 15 bp, Homo sapiens
ccttccactaaaacc

SEQ ID NO: 293837 - DNA, 15 bp, Homo sapiens
gccttccactaaaac

SEQ ID NO: 293838 - DNA, 15 bp, Homo sapiens
agccttccactaaaa

SEQ ID NO: 293839 - DNA, 15 bp, Homo sapiens
tagccttccactaaa

SEQ ID NO: 293840 - DNA, 15 bp, Homo sapiens
ctagccttccactaa

SEQ ID NO: 293841 - DNA, 15 bp, Homo sapiens
tctagccttccacta

SEQ ID NO: 293842 - DNA, 15 bp, Homo sapiens
gtctagccttccact

SEQ ID NO: 293843 - DNA, 15 bp, Homo sapiens
tgtctagccttccac

SEQ ID NO: 293844 - DNA, 15 bp, Homo sapiens
atgtctagccttcca

SEQ ID NO: 293845 - DNA, 15 bp, Homo sapiens
aatgtctagccttcc

SEQ ID NO: 293846 - DNA, 15 bp, Homo sapiens
taatgtctagccttc

SEQ ID NO: 293847 - DNA, 15 bp, Homo sapiens
ttaatgtctagcctt

SEQ ID NO: 293848 - DNA, 15 bp, Homo sapiens
attaatgtctagcct

SEQ ID NO: 293849 - DNA, 15 bp, Homo sapiens
aattaatgtctagcc

SEQ ID NO: 293850 - DNA, 15 bp, Homo sapiens
aaattaatgtctagc

SEQ ID NO: 293851 - DNA, 15 bp, Homo sapiens
caaattaatgtctag

SEQ ID NO: 293852 - DNA, 15 bp, Homo sapiens
tcaaattaatgtcta

SEQ ID NO: 293853 - DNA, 15 bp, Homo sapiens
ctcaaattaatgtct

SEQ ID NO: 293854 - DNA, 15 bp, Homo sapiens
tctcaaattaatgtc

SEQ ID NO: 293855 - DNA, 15 bp, Homo sapiens
ttctcaaattaatgt

SEQ ID NO: 293856 - DNA, 15 bp, Homo sapiens
cttctcaaattaatg

SEQ ID NO: 293857 - DNA, 15 bp, Homo sapiens
gcttctcaaattaat

SEQ ID NO: 293858 - DNA, 15 bp, Homo sapiens
agcttctcaaattaa

SEQ ID NO: 293859 - DNA, 15 bp, Homo sapiens
aagcttctcaaatta

SEQ ID NO: 293860 - DNA, 15 bp, Homo sapiens
aaagcttctcaaatt

SEQ ID NO: 293861 - DNA, 15 bp, Homo sapiens
caaagcttctcaaat

SEQ ID NO: 293862 - DNA, 15 bp, Homo sapiens
acaaagcttctcaaa

SEQ ID NO: 293863 - DNA, 15 bp, Homo sapiens
aacaaagcttctcaa

SEQ ID NO: 293864 - DNA, 15 bp, Homo sapiens
caacaaagcttctca

SEQ ID NO: 293865 - DNA, 15 bp, Homo sapiens
acaacaaagcttctc

SEQ ID NO: 293866 - DNA, 15 bp, Homo sapiens
aacaacaaagcttct

SEQ ID NO: 293867 - DNA, 15 bp, Homo sapiens
gaacaacaaagcttc

SEQ ID NO: 293868 - DNA, 15 bp, Homo sapiens
agaacaacaaagctt

SEQ ID NO: 293869 - DNA, 15 bp, Homo sapiens
gagaacaacaaagct

SEQ ID NO: 293870 - DNA, 15 bp, Homo sapiens
agagaacaacaaagc

SEQ ID NO: 293871 - DNA, 15 bp, Homo sapiens
aagagaacaacaaag

SEQ ID NO: 293872 - DNA, 15 bp, Homo sapiens
aaagagaacaacaaa

SEQ ID NO: 293873 - DNA, 15 bp, Homo sapiens
taaagagaacaacaa

SEQ ID NO: 293874 - DNA, 15 bp, Homo sapiens
ataaagagaacaaca

SEQ ID NO: 293875 - DNA, 15 bp, Homo sapiens
aataaagagaacaac

SEQ ID NO: 293876 - DNA, 15 bp, Homo sapiens
aaataaagagaacaa

SEQ ID NO: 293877 - DNA, 15 bp, Homo sapiens
caaataaagagaaca

SEQ ID NO: 293878 - DNA, 15 bp, Homo sapiens
gcaaataaagagaac

SEQ ID NO: 293879 - DNA, 15 bp, Homo sapiens
agcaaataaagagaa

SEQ ID NO: 293880 - DNA, 15 bp, Homo sapiens
cagcaaataaagaga

SEQ ID NO: 293881 - DNA, 15 bp, Homo sapiens
acagcaaataaagag

SEQ ID NO: 293882 - DNA, 15 bp, Homo sapiens
gacagcaaataaaga

SEQ ID NO: 293883 - DNA, 15 bp, Homo sapiens
tgacagcaaataaag

SEQ ID NO: 293884 - DNA, 15 bp, Homo sapiens
gtgacagcaaataaa

SEQ ID NO: 293885 - DNA, 15 bp, Homo sapiens
tgtgacagcaaataa

SEQ ID NO: 293886 - DNA, 15 bp, Homo sapiens
ctgtgacagcaaata

SEQ ID NO: 293887 - DNA, 15 bp, Homo sapiens
gctgtgacagcaaat

SEQ ID NO: 293888 - DNA, 15 bp, Homo sapiens
cgctgtgacagcaaa

SEQ ID NO: 293889 - DNA, 15 bp, Homo sapiens
ccgctgtgacagcaa

SEQ ID NO: 293890 - DNA, 15 bp, Homo sapiens
cccgctgtgacagca

SEQ ID NO: 293891 - DNA, 15 bp, Homo sapiens
tcccgctgtgacagc

SEQ ID NO: 293892 - DNA, 15 bp, Homo sapiens
ctcccgctgtgacag

SEQ ID NO: 293893 - DNA, 15 bp, Homo sapiens
tctcccgctgtgaca

SEQ ID NO: 293894 - DNA, 15 bp, Homo sapiens
ctctcccgctgtgac

SEQ ID NO: 293895 - DNA, 15 bp, Homo sapiens
cctctcccgctgtga

SEQ ID NO: 293896 - DNA, 15 bp, Homo sapiens
tcctctcccgctgtg

SEQ ID NO: 293897 - DNA, 15 bp, Homo sapiens
gtcctctcccgctgt

SEQ ID NO: 293898 - DNA, 15 bp, Homo sapiens
ggtcctctcccgctg

SEQ ID NO: 293899 - DNA, 15 bp, Homo sapiens
aggtcctctcccgct

SEQ ID NO: 293900 - DNA, 15 bp, Homo sapiens
caggtcctctcccgc

SEQ ID NO: 293901 - DNA, 15 bp, Homo sapiens
gcaggtcctctcccg

SEQ ID NO: 293902 - DNA, 15 bp, Homo sapiens
agcaggtcctctccc

SEQ ID NO: 293903 - DNA, 15 bp, Homo sapiens
cagcaggtcctctcc

SEQ ID NO: 293904 - DNA, 15 bp, Homo sapiens
ccagcaggtcctctc

SEQ ID NO: 293905 - DNA, 15 bp, Homo sapiens
gccagcaggtcctct

SEQ ID NO: 293906 - DNA, 15 bp, Homo sapiens
ggccagcaggtcctc

SEQ ID NO: 293907 - DNA, 15 bp, Homo sapiens
gggccagcaggtcct

SEQ ID NO: 293908 - DNA, 15 bp, Homo sapiens
ggggccagcaggtcc

SEQ ID NO: 293909 - DNA, 15 bp, Homo sapiens
tggggccagcaggtc

SEQ ID NO: 293910 - DNA, 15 bp, Homo sapiens
gtggggccagcaggt

SEQ ID NO: 293911 - DNA, 15 bp, Homo sapiens
ggtggggccagcagg

SEQ ID NO: 293912 - DNA, 15 bp, Homo sapiens
cggtggggccagcag

SEQ ID NO: 293913 - DNA, 15 bp, Homo sapiens
gcggtggggccagca

SEQ ID NO: 293914 - DNA, 15 bp, Homo sapiens
tgcggtggggccagc

SEQ ID NO: 293915 - DNA, 15 bp, Homo sapiens
gtgcggtggggccag

SEQ ID NO: 293916 - DNA, 15 bp, Homo sapiens
cgtgcggtggggcca

SEQ ID NO: 293917 - DNA, 15 bp, Homo sapiens
tcgtgcggtggggcc

SEQ ID NO: 293918 - DNA, 15 bp, Homo sapiens
gtcgtgcggtggggc

SEQ ID NO: 293919 - DNA, 15 bp, Homo sapiens
tgtcgtgcggtgggg

SEQ ID NO: 293920 - DNA, 15 bp, Homo sapiens
gtgtcgtgcggtggg

SEQ ID NO: 293921 - DNA, 15 bp, Homo sapiens
ggtgtcgtgcggtgg

SEQ ID NO: 293922 - DNA, 15 bp, Homo sapiens
tggtgtcgtgcggtg

SEQ ID NO: 293923 - DNA, 15 bp, Homo sapiens
ctggtgtcgtgcggt

SEQ ID NO: 293924 - DNA, 15 bp, Homo sapiens
gctggtgtcgtgcgg

SEQ ID NO: 293925 - DNA, 15 bp, Homo sapiens
tgctggtgtcgtgcg

SEQ ID NO: 293926 - DNA, 15 bp, Homo sapiens
gtgctggtgtcgtgc

SEQ ID NO: 293927 - DNA, 15 bp, Homo sapiens
cgtgctggtgtcgtg

SEQ ID NO: 293928 - DNA, 15 bp, Homo sapiens
ccgtgctggtgtcgt

SEQ ID NO: 293929 - DNA, 15 bp, Homo sapiens
tccgtgctggtgtcg

SEQ ID NO: 293930 - DNA, 15 bp, Homo sapiens
atccgtgctggtgtc

SEQ ID NO: 293931 - DNA, 15 bp, Homo sapiens
gatccgtgctggtgt

SEQ ID NO: 293932 - DNA, 15 bp, Homo sapiens
agatccgtgctggtg

SEQ ID NO: 293933 - DNA, 15 bp, Homo sapiens
gagatccgtgctggt

SEQ ID NO: 293934 - DNA, 15 bp, Homo sapiens
tgagatccgtgctgg

SEQ ID NO: 293935 - DNA, 15 bp, Homo sapiens
gtgagatccgtgctg

SEQ ID NO: 293936 - DNA, 15 bp, Homo sapiens
cgtgagatccgtgct

SEQ ID NO: 293937 - DNA, 15 bp, Homo sapiens
ccgtgagatccgtgc

SEQ ID NO: 293938 - DNA, 15 bp, Homo sapiens
tccgtgagatccgtg

SEQ ID NO: 293939 - DNA, 15 bp, Homo sapiens
ctccgtgagatccgt

SEQ ID NO: 293940 - DNA, 15 bp, Homo sapiens
cctccgtgagatccg

SEQ ID NO: 293941 - DNA, 15 bp, Homo sapiens
acctccgtgagatcc

SEQ ID NO: 293942 - DNA, 15 bp, Homo sapiens
gacctccgtgagatc

SEQ ID NO: 293943 - DNA, 15 bp, Homo sapiens
tgacctccgtgagat

SEQ ID NO: 293944 - DNA, 15 bp, Homo sapiens
atgacctccgtgaga

SEQ ID NO: 293945 - DNA, 15 bp, Homo sapiens
catgacctccgtgag

SEQ ID NO: 293946 - DNA, 15 bp, Homo sapiens
ccatgacctccgtga

SEQ ID NO: 293947 - DNA, 15 bp, Homo sapiens
tccatgacctccgtg

SEQ ID NO: 293948 - DNA, 15 bp, Homo sapiens
ctccatgacctccgt

SEQ ID NO: 293949 - DNA, 15 bp, Homo sapiens
gctccatgacctccg

SEQ ID NO: 293950 - DNA, 15 bp, Homo sapiens
tgctccatgacctcc

SEQ ID NO: 293951 - DNA, 15 bp, Homo sapiens
ctgctccatgacctc

SEQ ID NO: 293952 - DNA, 15 bp, Homo sapiens
tctgctccatgacct

SEQ ID NO: 293953 - DNA, 15 bp, Homo sapiens
atctgctccatgacc

SEQ ID NO: 293954 - DNA, 15 bp, Homo sapiens
aatctgctccatgac

SEQ ID NO: 293955 - DNA, 15 bp, Homo sapiens
gaatctgctccatga

SEQ ID NO: 293956 - DNA, 15 bp, Homo sapiens
tgaatctgctccatg

SEQ ID NO: 293957 - DNA, 15 bp, Homo sapiens
gtgaatctgctccat

SEQ ID NO: 293958 - DNA, 15 bp, Homo sapiens
tgtgaatctgctcca

SEQ ID NO: 293959 - DNA, 15 bp, Homo sapiens
ctgtgaatctgctcc

SEQ ID NO: 293960 - DNA, 15 bp, Homo sapiens
gctgtgaatctgctc

SEQ ID NO: 293961 - DNA, 15 bp, Homo sapiens
tgctgtgaatctgct

SEQ ID NO: 293962 - DNA, 15 bp, Homo sapiens
gtgctgtgaatctgc

SEQ ID NO: 293963 - DNA, 15 bp, Homo sapiens
cgtgctgtgaatctg

SEQ ID NO: 293964 - DNA, 15 bp, Homo sapiens
acgtgctgtgaatct

SEQ ID NO: 293965 - DNA, 15 bp, Homo sapiens
aacgtgctgtgaatc

SEQ ID NO: 293966 - DNA, 15 bp, Homo sapiens
aaacgtgctgtgaat

SEQ ID NO: 293967 - DNA, 15 bp, Homo sapiens
gaaacgtgctgtgaa

SEQ ID NO: 293968 - DNA, 15 bp, Homo sapiens
ggaaacgtgctgtga

SEQ ID NO: 293969 - DNA, 15 bp, Homo sapiens
tggaaacgtgctgtg

SEQ ID NO: 293970 - DNA, 15 bp, Homo sapiens
atggaaacgtgctgt

SEQ ID NO: 293971 - DNA, 15 bp, Homo sapiens
gatggaaacgtgctg

SEQ ID NO: 293972 - DNA, 15 bp, Homo sapiens
agatggaaacgtgct

SEQ ID NO: 293973 - DNA, 15 bp, Homo sapiens
aagatggaaacgtgc

SEQ ID NO: 293974 - DNA, 15 bp, Homo sapiens
caagatggaaacgtg

SEQ ID NO: 293975 - DNA, 15 bp, Homo sapiens
gcaagatggaaacgt

SEQ ID NO: 293976 - DNA, 15 bp, Homo sapiens
agcaagatggaaacg

SEQ ID NO: 293977 - DNA, 15 bp, Homo sapiens
cagcaagatggaaac

SEQ ID NO: 293978 - DNA, 15 bp, Homo sapiens
gcagcaagatggaaa

SEQ ID NO: 293979 - DNA, 15 bp, Homo sapiens
ggcagcaagatggaa

SEQ ID NO: 293980 - DNA, 15 bp, Homo sapiens
cggcagcaagatgga

SEQ ID NO: 293981 - DNA, 15 bp, Homo sapiens
acggcagcaagatgg

SEQ ID NO: 293982 - DNA, 15 bp, Homo sapiens
cacggcagcaagatg

SEQ ID NO: 293983 - DNA, 15 bp, Homo sapiens
tcacggcagcaagat

SEQ ID NO: 293984 - DNA, 15 bp, Homo sapiens
ctcacggcagcaaga

SEQ ID NO: 293985 - DNA, 15 bp, Homo sapiens
actcacggcagcaag

SEQ ID NO: 293986 - DNA, 15 bp, Homo sapiens
tactcacggcagcaa

SEQ ID NO: 293987 - DNA, 15 bp, Homo sapiens
atactcacggcagca

SEQ ID NO: 293988 - DNA, 15 bp, Homo sapiens
catactcacggcagc

SEQ ID NO: 293989 - DNA, 15 bp, Homo sapiens
tcatactcacggcag

SEQ ID NO: 293990 - DNA, 15 bp, Homo sapiens
ttcatactcacggca

SEQ ID NO: 293991 - DNA, 15 bp, Homo sapiens
tttcatactcacggc

SEQ ID NO: 293992 - DNA, 15 bp, Homo sapiens
ctttcatactcacgg

SEQ ID NO: 293993 - DNA, 15 bp, Homo sapiens
tctttcatactcacg

SEQ ID NO: 293994 - DNA, 15 bp, Homo sapiens
atctttcatactcac

SEQ ID NO: 293995 - DNA, 15 bp, Homo sapiens
aatctttcatactca

SEQ ID NO: 293996 - DNA, 15 bp, Homo sapiens
caatctttcatactc

SEQ ID NO: 293997 - DNA, 15 bp, Homo sapiens
gcaatctttcatact

SEQ ID NO: 293998 - DNA, 15 bp, Homo sapiens
tgcaatctttcatac

SEQ ID NO: 293999 - DNA, 15 bp, Homo sapiens
ctgcaatctttcata

SEQ ID NO: 294000 - DNA, 15 bp, Homo sapiens
gctgcaatctttcat

SEQ ID NO: 294001 - DNA, 15 bp, Homo sapiens
tgctgcaatctttca

SEQ ID NO: 294002 - DNA, 15 bp, Homo sapiens
gtgctgcaatctttc

SEQ ID NO: 294003 - DNA, 15 bp, Homo sapiens
ggtgctgcaatcttt

SEQ ID NO: 294004 - DNA, 15 bp, Homo sapiens
tggtgctgcaatctt

SEQ ID NO: 294005 - DNA, 15 bp, Homo sapiens
gtggtgctgcaatct

SEQ ID NO: 294006 - DNA, 15 bp, Homo sapiens
tgtggtgctgcaatc

SEQ ID NO: 294007 - DNA, 15 bp, Homo sapiens
ctgtggtgctgcaat

SEQ ID NO: 294008 - DNA, 15 bp, Homo sapiens
gctgtggtgctgcaa

SEQ ID NO: 294009 - DNA, 15 bp, Homo sapiens
agctgtggtgctgca

SEQ ID NO: 294010 - DNA, 15 bp, Homo sapiens
cagctgtggtgctgc

SEQ ID NO: 294011 - DNA, 15 bp, Homo sapiens
gcagctgtggtgctg

SEQ ID NO: 294012 - DNA, 15 bp, Homo sapiens
tgcagctgtggtgct

SEQ ID NO: 294013 - DNA, 15 bp, Homo sapiens
gtgcagctgtggtgc

SEQ ID NO: 294014 - DNA, 15 bp, Homo sapiens
cgtgcagctgtggtg

SEQ ID NO: 294015 - DNA, 15 bp, Homo sapiens
acgtgcagctgtggt

SEQ ID NO: 294016 - DNA, 15 bp, Homo sapiens
cacgtgcagctgtgg

SEQ ID NO: 294017 - DNA, 15 bp, Homo sapiens
acacgtgcagctgtg

SEQ ID NO: 294018 - DNA, 15 bp, Homo sapiens
aacacgtgcagctgt

SEQ ID NO: 294019 - DNA, 15 bp, Homo sapiens
gaacacgtgcagctg

SEQ ID NO: 294020 - DNA, 15 bp, Homo sapiens
ggaacacgtgcagct

SEQ ID NO: 294021 - DNA, 15 bp, Homo sapiens
aggaacacgtgcagc

SEQ ID NO: 294022 - DNA, 15 bp, Homo sapiens
aaggaacacgtgcag

SEQ ID NO: 294023 - DNA, 15 bp, Homo sapiens
gaaggaacacgtgca

SEQ ID NO: 294024 - DNA, 15 bp, Homo sapiens
ggaaggaacacgtgc

SEQ ID NO: 294025 - DNA, 15 bp, Homo sapiens
gggaaggaacacgtg

SEQ ID NO: 294026 - DNA, 15 bp, Homo sapiens
agggaaggaacacgt

SEQ ID NO: 294027 - DNA, 15 bp, Homo sapiens
aagggaaggaacacg

SEQ ID NO: 294028 - DNA, 15 bp, Homo sapiens
aaagggaaggaacac

SEQ ID NO: 294029 - DNA, 15 bp, Homo sapiens
gaaagggaaggaaca

SEQ ID NO: 294030 - DNA, 15 bp, Homo sapiens
agaaagggaaggaac

SEQ ID NO: 294031 - DNA, 15 bp, Homo sapiens
gagaaagggaaggaa

SEQ ID NO: 294032 - DNA, 15 bp, Homo sapiens
agagaaagggaagga

SEQ ID NO: 294033 - DNA, 15 bp, Homo sapiens
aagagaaagggaagg

SEQ ID NO: 294034 - DNA, 15 bp, Homo sapiens
aaagagaaagggaag

SEQ ID NO: 294035 - DNA, 15 bp, Homo sapiens
aaaagagaaagggaa

SEQ ID NO: 294036 - DNA, 15 bp, Homo sapiens
aaaaagagaaaggga

SEQ ID NO: 294037 - DNA, 15 bp, Homo sapiens
gaaaaagagaaaggg

SEQ ID NO: 294038 - DNA, 15 bp, Homo sapiens
agaaaaagagaaagg

SEQ ID NO: 294039 - DNA, 15 bp, Homo sapiens
gcagaaaaagagaaa

SEQ ID NO: 294040 - DNA, 15 bp, Homo sapiens
tgcagaaaaagagaa

SEQ ID NO: 294041 - DNA, 15 bp, Homo sapiens
atgcagaaaaagaga

SEQ ID NO: 294042 - DNA, 15 bp, Homo sapiens
catgcagaaaaagag

SEQ ID NO: 294043 - DNA, 15 bp, Homo sapiens
gcatgcagaaaaaga

SEQ ID NO: 294044 - DNA, 15 bp, Homo sapiens
cgcatgcagaaaaag

SEQ ID NO: 294045 - DNA, 15 bp, Homo sapiens
ccgcatgcagaaaaa

SEQ ID NO: 294046 - DNA, 15 bp, Homo sapiens
gccgcatgcagaaaa

SEQ ID NO: 294047 - DNA, 15 bp, Homo sapiens
ggccgcatgcagaaa

SEQ ID NO: 294048 - DNA, 15 bp, Homo sapiens
gggccgcatgcagaa

SEQ ID NO: 294049 - DNA, 15 bp, Homo sapiens
agggccgcatgcaga

SEQ ID NO: 294050 - DNA, 15 bp, Homo sapiens
aagggccgcatgcag

SEQ ID NO: 294051 - DNA, 15 bp, Homo sapiens
gaagggccgcatgca

SEQ ID NO: 294052 - DNA, 15 bp, Homo sapiens
cgaagggccgcatgc

SEQ ID NO: 294053 - DNA, 15 bp, Homo sapiens
gcgaagggccgcatg

SEQ ID NO: 294054 - DNA, 15 bp, Homo sapiens
ggcgaagggccgcat

SEQ ID NO: 294055 - DNA, 15 bp, Homo sapiens
aggcgaagggccgca

SEQ ID NO: 294056 - DNA, 15 bp, Homo sapiens
aaggcgaagggccgc

SEQ ID NO: 294057 - DNA, 15 bp, Homo sapiens
gaaggcgaagggccg

SEQ ID NO: 294058 - DNA, 15 bp, Homo sapiens
agaaggcgaagggcc

SEQ ID NO: 294059 - DNA, 15 bp, Homo sapiens
aagaaggcgaagggc

SEQ ID NO: 294060 - DNA, 15 bp, Homo sapiens
gaagaaggcgaaggg

SEQ ID NO: 294061 - DNA, 15 bp, Homo sapiens
ggaagaaggcgaagg

SEQ ID NO: 294062 - DNA, 15 bp, Homo sapiens
aggaagaaggcgaag

SEQ ID NO: 294063 - DNA, 15 bp, Homo sapiens
aaggaagaaggcgaa

SEQ ID NO: 294064 - DNA, 15 bp, Homo sapiens
taaggaagaaggcga

SEQ ID NO: 294065 - DNA, 15 bp, Homo sapiens
ttaaggaagaaggcg

SEQ ID NO: 294066 - DNA, 15 bp, Homo sapiens
cttaaggaagaaggc

SEQ ID NO: 294067 - DNA, 15 bp, Homo sapiens
tcttaaggaagaagg

SEQ ID NO: 294068 - DNA, 15 bp, Homo sapiens
atcttaaggaagaag

SEQ ID NO: 294069 - DNA, 15 bp, Homo sapiens
tatcttaaggaagaa

SEQ ID NO: 294070 - DNA, 15 bp, Homo sapiens
ttatcttaaggaaga

SEQ ID NO: 294071 - DNA, 15 bp, Homo sapiens
gttatcttaaggaag

SEQ ID NO: 294072 - DNA, 15 bp, Homo sapiens
tgttatcttaaggaa

SEQ ID NO: 294073 - DNA, 15 bp, Homo sapiens
ttgttatcttaagga

SEQ ID NO: 294074 - DNA, 15 bp, Homo sapiens
tttgttatcttaagg

SEQ ID NO: 294075 - DNA, 15 bp, Homo sapiens
ttttgttatcttaag

SEQ ID NO: 294076 - DNA, 15 bp, Homo sapiens
tttttgttatcttaa

SEQ ID NO: 294077 - DNA, 15 bp, Homo sapiens
gtttttgttatctta

SEQ ID NO: 294078 - DNA, 15 bp, Homo sapiens
ggtttttgttatctt

SEQ ID NO: 294079 - DNA, 15 bp, Homo sapiens
aggtttttgttatct

SEQ ID NO: 294080 - DNA, 15 bp, Homo sapiens
aaggtttttgttatc

SEQ ID NO: 294081 - DNA, 15 bp, Homo sapiens
taaggtttttgttat

SEQ ID NO: 294082 - DNA, 15 bp, Homo sapiens
ataaggtttttgtta

SEQ ID NO: 294083 - DNA, 15 bp, Homo sapiens
aataaggtttttgtt

SEQ ID NO: 294084 - DNA, 15 bp, Homo sapiens
taataaggtttttgt

SEQ ID NO: 294085 - DNA, 15 bp, Homo sapiens
gtaataaggtttttg

SEQ ID NO: 294086 - DNA, 15 bp, Homo sapiens
tgtaataaggttttt

SEQ ID NO: 294087 - DNA, 15 bp, Homo sapiens
ttgtaataaggtttt

SEQ ID NO: 294088 - DNA, 15 bp, Homo sapiens
tttgtaataaggttt

SEQ ID NO: 294089 - DNA, 15 bp, Homo sapiens
gtttgtaataaggtt

SEQ ID NO: 294090 - DNA, 15 bp, Homo sapiens
tgtttgtaataaggt

SEQ ID NO: 294091 - DNA, 15 bp, Homo sapiens
ctgtttgtaataagg

SEQ ID NO: 294092 - DNA, 15 bp, Homo sapiens
cctgtttgtaataag

SEQ ID NO: 294093 - DNA, 15 bp, Homo sapiens
tcctgtttgtaataa

SEQ ID NO: 294094 - DNA, 15 bp, Homo sapiens
gtcctgtttgtaata

SEQ ID NO: 294095 - DNA, 15 bp, Homo sapiens
agtcctgtttgtaat

SEQ ID NO: 294096 - DNA, 15 bp, Homo sapiens
cagtcctgtttgtaa

SEQ ID NO: 294097 - DNA, 15 bp, Homo sapiens
tcagtcctgtttgta

SEQ ID NO: 294098 - DNA, 15 bp, Homo sapiens
ttcagtcctgtttgt

SEQ ID NO: 294099 - DNA, 15 bp, Homo sapiens
attcagtcctgtttg

SEQ ID NO: 294100 - DNA, 15 bp, Homo sapiens
tattcagtcctgttt

SEQ ID NO: 294101 - DNA, 15 bp, Homo sapiens
atattcagtcctgtt

SEQ ID NO: 294102 - DNA, 15 bp, Homo sapiens
aatattcagtcctgt

SEQ ID NO: 294103 - DNA, 15 bp, Homo sapiens
taatattcagtcctg

SEQ ID NO: 294104 - DNA, 15 bp, Homo sapiens
ataatattcagtcct

SEQ ID NO: 294105 - DNA, 15 bp, Homo sapiens
aataatattcagtcc

SEQ ID NO: 294106 - DNA, 15 bp, Homo sapiens
aaataatattcagtc

SEQ ID NO: 294107 - DNA, 15 bp, Homo sapiens
caaataatattcagt

SEQ ID NO: 294108 - DNA, 15 bp, Homo sapiens
tcaaataatattcag

SEQ ID NO: 294109 - DNA, 15 bp, Homo sapiens
ttcaaataatattca

SEQ ID NO: 294110 - DNA, 15 bp, Homo sapiens
tttcaaataatattc

SEQ ID NO: 294111 - DNA, 15 bp, Homo sapiens
ttttcaaataatatt

SEQ ID NO: 294112 - DNA, 15 bp, Homo sapiens
attttcaaataatat

SEQ ID NO: 294113 - DNA, 15 bp, Homo sapiens
tattttcaaataata

SEQ ID NO: 294114 - DNA, 15 bp, Homo sapiens
ttattttcaaataat

SEQ ID NO: 294115 - DNA, 15 bp, Homo sapiens
cttattttcaaataa

SEQ ID NO: 294116 - DNA, 15 bp, Homo sapiens
ccttattttcaaata

SEQ ID NO: 294117 - DNA, 15 bp, Homo sapiens
gccttattttcaaat

SEQ ID NO: 294118 - DNA, 15 bp, Homo sapiens
tgccttattttcaaa

SEQ ID NO: 294119 - DNA, 15 bp, Homo sapiens
ttgccttattttcaa

SEQ ID NO: 294120 - DNA, 15 bp, Homo sapiens
tttgccttattttca

SEQ ID NO: 294121 - DNA, 15 bp, Homo sapiens
gtttgccttattttc

SEQ ID NO: 294122 - DNA, 15 bp, Homo sapiens
tgtttgccttatttt

SEQ ID NO: 294123 - DNA, 15 bp, Homo sapiens
atgtttgccttattt

SEQ ID NO: 294124 - DNA, 15 bp, Homo sapiens
aatgtttgccttatt

SEQ ID NO: 294125 - DNA, 15 bp, Homo sapiens
taatgtttgccttat

SEQ ID NO: 294126 - DNA, 15 bp, Homo sapiens
ataatgtttgcctta

SEQ ID NO: 294127 - DNA, 15 bp, Homo sapiens
tataatgtttgcctt

SEQ ID NO: 294128 - DNA, 15 bp, Homo sapiens
atataatgtttgcct

SEQ ID NO: 294129 - DNA, 15 bp, Homo sapiens
tatataatgtttgcc

SEQ ID NO: 294130 - DNA, 15 bp, Homo sapiens
ttatataatgtttgc

SEQ ID NO: 294131 - DNA, 15 bp, Homo sapiens
cttatataatgtttg

SEQ ID NO: 294132 - DNA, 15 bp, Homo sapiens
tcttatataatgttt

SEQ ID NO: 294133 - DNA, 15 bp, Homo sapiens
ttcttatataatgtt

SEQ ID NO: 294134 - DNA, 15 bp, Homo sapiens
tttcttatataatgt

SEQ ID NO: 294135 - DNA, 15 bp, Homo sapiens
ttttcttatataatg

SEQ ID NO: 294136 - DNA, 15 bp, Homo sapiens
attttcttatataat

SEQ ID NO: 294137 - DNA, 15 bp, Homo sapiens
cattttcttatataa

SEQ ID NO: 294138 - DNA, 15 bp, Homo sapiens
tcattttcttatata

SEQ ID NO: 294139 - DNA, 15 bp, Homo sapiens
ttcattttcttatat

SEQ ID NO: 294140 - DNA, 15 bp, Homo sapiens
cttcattttcttata

SEQ ID NO: 294141 - DNA, 15 bp, Homo sapiens
gcttcattttcttat

SEQ ID NO: 294142 - DNA, 15 bp, Homo sapiens
agcttcattttctta

SEQ ID NO: 294143 - DNA, 15 bp, Homo sapiens
gagcttcattttctt

SEQ ID NO: 294144 - DNA, 15 bp, Homo sapiens
tgagcttcattttct

SEQ ID NO: 294145 - DNA, 15 bp, Homo sapiens
ttgagcttcattttc

SEQ ID NO: 294146 - DNA, 15 bp, Homo sapiens
gttgagcttcatttt

SEQ ID NO: 294147 - DNA, 15 bp, Homo sapiens
ggttgagcttcattt

SEQ ID NO: 294148 - DNA, 15 bp, Homo sapiens
aggttgagcttcatt

SEQ ID NO: 294149 - DNA, 15 bp, Homo sapiens
taggttgagcttcat

SEQ ID NO: 294150 - DNA, 15 bp, Homo sapiens
ctaggttgagcttca

SEQ ID NO: 294151 - DNA, 15 bp, Homo sapiens
tctaggttgagcttc

SEQ ID NO: 294152 - DNA, 15 bp, Homo sapiens
atctaggttgagctt

SEQ ID NO: 294153 - DNA, 15 bp, Homo sapiens
tatctaggttgagct

SEQ ID NO: 294154 - DNA, 15 bp, Homo sapiens
gtatctaggttgagc

SEQ ID NO: 294155 - DNA, 15 bp, Homo sapiens
agtatctaggttgag

SEQ ID NO: 294156 - DNA, 15 bp, Homo sapiens
tagtatctaggttga

SEQ ID NO: 294157 - DNA, 15 bp, Homo sapiens
atagtatctaggttg

SEQ ID NO: 294158 - DNA, 15 bp, Homo sapiens
gatagtatctaggtt

SEQ ID NO: 294159 - DNA, 15 bp, Homo sapiens
tgatagtatctaggt

SEQ ID NO: 294160 - DNA, 15 bp, Homo sapiens
ttgatagtatctagg

SEQ ID NO: 294161 - DNA, 15 bp, Homo sapiens
cttgatagtatctag

SEQ ID NO: 294162 - DNA, 15 bp, Homo sapiens
acttgatagtatcta

SEQ ID NO: 294163 - DNA, 15 bp, Homo sapiens
tacttgatagtatct

SEQ ID NO: 294164 - DNA, 15 bp, Homo sapiens
ttacttgatagtatc

SEQ ID NO: 294165 - DNA, 15 bp, Homo sapiens
gttacttgatagtat

SEQ ID NO: 294166 - DNA, 15 bp, Homo sapiens
cgttacttgatagta

SEQ ID NO: 294167 - DNA, 15 bp, Homo sapiens
ccgttacttgatagt

SEQ ID NO: 294168 - DNA, 15 bp, Homo sapiens
cccgttacttgatag

SEQ ID NO: 294169 - DNA, 15 bp, Homo sapiens
ccccgttacttgata

SEQ ID NO: 294170 - DNA, 15 bp, Homo sapiens
cccccgttacttgat

SEQ ID NO: 294171 - DNA, 15 bp, Homo sapiens
acccccgttacttga

SEQ ID NO: 294172 - DNA, 15 bp, Homo sapiens
tacccccgttacttg

SEQ ID NO: 294173 - DNA, 15 bp, Homo sapiens
gtacccccgttactt

SEQ ID NO: 294174 - DNA, 15 bp, Homo sapiens
tgtacccccgttact

SEQ ID NO: 294175 - DNA, 15 bp, Homo sapiens
ctgtacccccgttac

SEQ ID NO: 294176 - DNA, 15 bp, Homo sapiens
actgtacccccgtta

SEQ ID NO: 294177 - DNA, 15 bp, Homo sapiens
gactgtacccccgtt

SEQ ID NO: 294178 - DNA, 15 bp, Homo sapiens
cgactgtacccccgt

SEQ ID NO: 294179 - DNA, 15 bp, Homo sapiens
gcgactgtacccccg

SEQ ID NO: 294180 - DNA, 15 bp, Homo sapiens
tgcgactgtaccccc

SEQ ID NO: 294181 - DNA, 15 bp, Homo sapiens
ttgcgactgtacccc

SEQ ID NO: 294182 - DNA, 15 bp, Homo sapiens
gttgcgactgtaccc

SEQ ID NO: 294183 - DNA, 15 bp, Homo sapiens
cgttgcgactgtacc

SEQ ID NO: 294184 - DNA, 15 bp, Homo sapiens
gcgttgcgactgtac

SEQ ID NO: 294185 - DNA, 15 bp, Homo sapiens
tgcgttgcgactgta

SEQ ID NO: 294186 - DNA, 15 bp, Homo sapiens
ttgcgttgcgactgt

SEQ ID NO: 294187 - DNA, 15 bp, Homo sapiens
attgcgttgcgactg

SEQ ID NO: 294188 - DNA, 15 bp, Homo sapiens
aattgcgttgcgact

SEQ ID NO: 294189 - DNA, 15 bp, Homo sapiens
gaattgcgttgcgac

SEQ ID NO: 294190 - DNA, 15 bp, Homo sapiens
agaattgcgttgcga

SEQ ID NO: 294191 - DNA, 15 bp, Homo sapiens
cagaattgcgttgcg

SEQ ID NO: 294192 - DNA, 15 bp, Homo sapiens
gcagaattgcgttgc

SEQ ID NO: 294193 - DNA, 15 bp, Homo sapiens
agcagaattgcgttg

SEQ ID NO: 294194 - DNA, 15 bp, Homo sapiens
gagcagaattgcgtt

SEQ ID NO: 294195 - DNA, 15 bp, Homo sapiens
agagcagaattgcgt

SEQ ID NO: 294196 - DNA, 15 bp, Homo sapiens
aagagcagaattgcg

SEQ ID NO: 294197 - DNA, 15 bp, Homo sapiens
aaagagcagaattgc

SEQ ID NO: 294198 - DNA, 15 bp, Homo sapiens
caaagagcagaattg

SEQ ID NO: 294199 - DNA, 15 bp, Homo sapiens
tcaaagagcagaatt

SEQ ID NO: 294200 - DNA, 15 bp, Homo sapiens
ctcaaagagcagaat

SEQ ID NO: 294201 - DNA, 15 bp, Homo sapiens
tctcaaagagcagaa

SEQ ID NO: 294202 - DNA, 15 bp, Homo sapiens
atctcaaagagcaga

SEQ ID NO: 294203 - DNA, 15 bp, Homo sapiens
aatctcaaagagcag

SEQ ID NO: 294204 - DNA, 15 bp, Homo sapiens
aaatctcaaagagca

SEQ ID NO: 294205 - DNA, 15 bp, Homo sapiens
aaaatctcaaagagc

SEQ ID NO: 294206 - DNA, 15 bp, Homo sapiens
aaaaatctcaaagag

SEQ ID NO: 294207 - DNA, 15 bp, Homo sapiens
gaaaaatctcaaaga

SEQ ID NO: 294208 - DNA, 15 bp, Homo sapiens
tgaaaaatctcaaag

SEQ ID NO: 294209 - DNA, 15 bp, Homo sapiens
ttgaaaaatctcaaa

SEQ ID NO: 294210 - DNA, 15 bp, Homo sapiens
attgaaaaatctcaa

SEQ ID NO: 294211 - DNA, 15 bp, Homo sapiens
tattgaaaaatctca

SEQ ID NO: 294212 - DNA, 15 bp, Homo sapiens
atattgaaaaatctc

SEQ ID NO: 294213 - DNA, 15 bp, Homo sapiens
catattgaaaaatct

SEQ ID NO: 294214 - DNA, 15 bp, Homo sapiens
gcatattgaaaaatc

SEQ ID NO: 294215 - DNA, 15 bp, Homo sapiens
ggcatattgaaaaat

SEQ ID NO: 294216 - DNA, 15 bp, Homo sapiens
aggcatattgaaaaa

SEQ ID NO: 294217 - DNA, 15 bp, Homo sapiens
caggcatattgaaaa

SEQ ID NO: 294218 - DNA, 15 bp, Homo sapiens
tcaggcatattgaaa

SEQ ID NO: 294219 - DNA, 15 bp, Homo sapiens
atcaggcatattgaa

SEQ ID NO: 294220 - DNA, 15 bp, Homo sapiens
catcaggcatattga

SEQ ID NO: 294221 - DNA, 15 bp, Homo sapiens
ccatcaggcatattg

SEQ ID NO: 294222 - DNA, 15 bp, Homo sapiens
cccatcaggcatatt

SEQ ID NO: 294223 - DNA, 15 bp, Homo sapiens
acccatcaggcatat

SEQ ID NO: 294224 - DNA, 15 bp, Homo sapiens
cacccatcaggcata

SEQ ID NO: 294225 - DNA, 15 bp, Homo sapiens
tcacccatcaggcat

SEQ ID NO: 294226 - DNA, 15 bp, Homo sapiens
atcacccatcaggca

SEQ ID NO: 294227 - DNA, 15 bp, Homo sapiens
tatcacccatcaggc

SEQ ID NO: 294228 - DNA, 15 bp, Homo sapiens
ttatcacccatcagg

SEQ ID NO: 294229 - DNA, 15 bp, Homo sapiens
tttatcacccatcag

SEQ ID NO: 294230 - DNA, 15 bp, Homo sapiens
ttttatcacccatca

SEQ ID NO: 294231 - DNA, 15 bp, Homo sapiens
attttatcacccatc

SEQ ID NO: 294232 - DNA, 15 bp, Homo sapiens
cattttatcacccat

SEQ ID NO: 294233 - DNA, 15 bp, Homo sapiens
tcattttatcaccca

SEQ ID NO: 294234 - DNA, 15 bp, Homo sapiens
ttcattttatcaccc

SEQ ID NO: 294235 - DNA, 15 bp, Homo sapiens
tttcattttatcacc

SEQ ID NO: 294236 - DNA, 15 bp, Homo sapiens
ctttcattttatcac

SEQ ID NO: 294237 - DNA, 15 bp, Homo sapiens
gctttcattttatca

SEQ ID NO: 294238 - DNA, 15 bp, Homo sapiens
tgctttcattttatc

SEQ ID NO: 294239 - DNA, 15 bp, Homo sapiens
ttgctttcattttat

SEQ ID NO: 294240 - DNA, 15 bp, Homo sapiens
tttgctttcatttta

SEQ ID NO: 294241 - DNA, 15 bp, Homo sapiens
atttgctttcatttt

SEQ ID NO: 294242 - DNA, 15 bp, Homo sapiens
tatttgctttcattt

SEQ ID NO: 294243 - DNA, 15 bp, Homo sapiens
ttatttgctttcatt

SEQ ID NO: 294244 - DNA, 15 bp, Homo sapiens
tttatttgctttcat

SEQ ID NO: 294245 - DNA, 15 bp, Homo sapiens
ttttatttgctttca

SEQ ID NO: 294246 - DNA, 15 bp, Homo sapiens
attttatttgctttc

SEQ ID NO: 294247 - DNA, 15 bp, Homo sapiens
tattttatttgcttt

SEQ ID NO: 294248 - DNA, 15 bp, Homo sapiens
ttattttatttgctt

SEQ ID NO: 294249 - DNA, 15 bp, Homo sapiens
attattttatttgct

SEQ ID NO: 294250 - DNA, 15 bp, Homo sapiens
tattattttatttgc

SEQ ID NO: 294251 - DNA, 15 bp, Homo sapiens
ttattattttatttg

SEQ ID NO: 294252 - DNA, 15 bp, Homo sapiens
cttattattttattt

SEQ ID NO: 294253 - DNA, 15 bp, Homo sapiens
acttattattttatt

SEQ ID NO: 294254 - DNA, 15 bp, Homo sapiens
gacttattattttat

SEQ ID NO: 294255 - DNA, 15 bp, Homo sapiens
agacttattatttta

SEQ ID NO: 294256 - DNA, 15 bp, Homo sapiens
cagacttattatttt

SEQ ID NO: 294257 - DNA, 15 bp, Homo sapiens
ccagacttattattt

SEQ ID NO: 294258 - DNA, 15 bp, Homo sapiens
accagacttattatt

SEQ ID NO: 294259 - DNA, 15 bp, Homo sapiens
aaccagacttattat

SEQ ID NO: 294260 - DNA, 15 bp, Homo sapiens
aaaccagacttatta

SEQ ID NO: 294261 - DNA, 15 bp, Homo sapiens
aaaaccagacttatt

SEQ ID NO: 294262 - DNA, 15 bp, Homo sapiens
taaaaccagacttat

SEQ ID NO: 294263 - DNA, 15 bp, Homo sapiens
ttaaaaccagactta

SEQ ID NO: 294264 - DNA, 15 bp, Homo sapiens
cttaaaaccagactt

SEQ ID NO: 294265 - DNA, 15 bp, Homo sapiens
tcttaaaaccagact

SEQ ID NO: 294266 - DNA, 15 bp, Homo sapiens
ttcttaaaaccagac

SEQ ID NO: 294267 - DNA, 15 bp, Homo sapiens
cttcttaaaaccaga

SEQ ID NO: 294268 - DNA, 15 bp, Homo sapiens
tcttcttaaaaccag

SEQ ID NO: 294269 - DNA, 15 bp, Homo sapiens
ttcttcttaaaacca

SEQ ID NO: 294270 - DNA, 15 bp, Homo sapiens
tttcttcttaaaacc

SEQ ID NO: 294271 - DNA, 15 bp, Homo sapiens
atttcttcttaaaac

SEQ ID NO: 294272 - DNA, 15 bp, Homo sapiens
aatttcttcttaaaa

SEQ ID NO: 294273 - DNA, 15 bp, Homo sapiens
taatttcttcttaaa

SEQ ID NO: 294274 - DNA, 15 bp, Homo sapiens
ataatttcttcttaa

SEQ ID NO: 294275 - DNA, 15 bp, Homo sapiens
gataatttcttctta

SEQ ID NO: 294276 - DNA, 15 bp, Homo sapiens
ggataatttcttctt

SEQ ID NO: 294277 - DNA, 15 bp, Homo sapiens
aggataatttcttct

SEQ ID NO: 294278 - DNA, 15 bp, Homo sapiens
gaggataatttcttc

SEQ ID NO: 294279 - DNA, 15 bp, Homo sapiens
agaggataatttctt

SEQ ID NO: 294280 - DNA, 15 bp, Homo sapiens
aagaggataatttct

SEQ ID NO: 294281 - DNA, 15 bp, Homo sapiens
gaagaggataatttc

SEQ ID NO: 294282 - DNA, 15 bp, Homo sapiens
cgaagaggataattt

SEQ ID NO: 294283 - DNA, 15 bp, Homo sapiens
tcgaagaggataatt

SEQ ID NO: 294284 - DNA, 15 bp, Homo sapiens
atcgaagaggataat

SEQ ID NO: 294285 - DNA, 15 bp, Homo sapiens
catcgaagaggataa

SEQ ID NO: 294286 - DNA, 15 bp, Homo sapiens
gcatcgaagaggata

SEQ ID NO: 294287 - DNA, 15 bp, Homo sapiens
tgcatcgaagaggat

SEQ ID NO: 294288 - DNA, 15 bp, Homo sapiens
ttgcatcgaagagga

SEQ ID NO: 294289 - DNA, 15 bp, Homo sapiens
cttgcatcgaagagg

SEQ ID NO: 294290 - DNA, 15 bp, Homo sapiens
gcttgcatcgaagag

SEQ ID NO: 294291 - DNA, 15 bp, Homo sapiens
agcttgcatcgaaga

SEQ ID NO: 294292 - DNA, 15 bp, Homo sapiens
tagcttgcatcgaag

SEQ ID NO: 294293 - DNA, 15 bp, Homo sapiens
atagcttgcatcgaa

SEQ ID NO: 294294 - DNA, 15 bp, Homo sapiens
gatagcttgcatcga

SEQ ID NO: 294295 - DNA, 15 bp, Homo sapiens
tgatagcttgcatcg

SEQ ID NO: 294296 - DNA, 15 bp, Homo sapiens
atgatagcttgcatc

SEQ ID NO: 294297 - DNA, 15 bp, Homo sapiens
tatgatagcttgcat

SEQ ID NO: 294298 - DNA, 15 bp, Homo sapiens
ttatgatagcttgca

SEQ ID NO: 294299 - DNA, 15 bp, Homo sapiens
cttatgatagcttgc

SEQ ID NO: 294300 - DNA, 15 bp, Homo sapiens
ccttatgatagcttg

SEQ ID NO: 294301 - DNA, 15 bp, Homo sapiens
tccttatgatagctt

SEQ ID NO: 294302 - DNA, 15 bp, Homo sapiens
ttccttatgatagct

SEQ ID NO: 294303 - DNA, 15 bp, Homo sapiens
gttccttatgatagc

SEQ ID NO: 294304 - DNA, 15 bp, Homo sapiens
tgttccttatgatag

SEQ ID NO: 294305 - DNA, 15 bp, Homo sapiens
gtgttccttatgata

SEQ ID NO: 294306 - DNA, 15 bp, Homo sapiens
tgtgttccttatgat

SEQ ID NO: 294307 - DNA, 15 bp, Homo sapiens
atgtgttccttatga

SEQ ID NO: 294308 - DNA, 15 bp, Homo sapiens
gatgtgttccttatg

SEQ ID NO: 294309 - DNA, 15 bp, Homo sapiens
agatgtgttccttat

SEQ ID NO: 294310 - DNA, 15 bp, Homo sapiens
aagatgtgttcctta

SEQ ID NO: 294311 - DNA, 15 bp, Homo sapiens
taagatgtgttcctt

SEQ ID NO: 294312 - DNA, 15 bp, Homo sapiens
ctaagatgtgttcct

SEQ ID NO: 294313 - DNA, 15 bp, Homo sapiens
actaagatgtgttcc

SEQ ID NO: 294314 - DNA, 15 bp, Homo sapiens
aactaagatgtgttc

SEQ ID NO: 294315 - DNA, 15 bp, Homo sapiens
gaactaagatgtgtt

SEQ ID NO: 294316 - DNA, 15 bp, Homo sapiens
tgaactaagatgtgt

SEQ ID NO: 294317 - DNA, 15 bp, Homo sapiens
ttgaactaagatgtg

SEQ ID NO: 294318 - DNA, 15 bp, Homo sapiens
tttgaactaagatgt

SEQ ID NO: 294319 - DNA, 15 bp, Homo sapiens
ctttgaactaagatg

SEQ ID NO: 294320 - DNA, 15 bp, Homo sapiens
tctttgaactaagat

SEQ ID NO: 294321 - DNA, 15 bp, Homo sapiens
ttctttgaactaaga

SEQ ID NO: 294322 - DNA, 15 bp, Homo sapiens
cttctttgaactaag

SEQ ID NO: 294323 - DNA, 15 bp, Homo sapiens
tcttctttgaactaa

SEQ ID NO: 294324 - DNA, 15 bp, Homo sapiens
ctcttctttgaacta

SEQ ID NO: 294325 - DNA, 15 bp, Homo sapiens
gctcttctttgaact

SEQ ID NO: 294326 - DNA, 15 bp, Homo sapiens
agctcttctttgaac

SEQ ID NO: 294327 - DNA, 15 bp, Homo sapiens
aagctcttctttgaa

SEQ ID NO: 294328 - DNA, 15 bp, Homo sapiens
aaagctcttctttga

SEQ ID NO: 294329 - DNA, 15 bp, Homo sapiens
gaaagctcttctttg

SEQ ID NO: 294330 - DNA, 15 bp, Homo sapiens
tgaaagctcttcttt

SEQ ID NO: 294331 - DNA, 15 bp, Homo sapiens
ctgaaagctcttctt

SEQ ID NO: 294332 - DNA, 15 bp, Homo sapiens
actgaaagctcttct

SEQ ID NO: 294333 - DNA, 15 bp, Homo sapiens
cactgaaagctcttc

SEQ ID NO: 294334 - DNA, 15 bp, Homo sapiens
ccactgaaagctctt

SEQ ID NO: 294335 - DNA, 15 bp, Homo sapiens
gccactgaaagctct

SEQ ID NO: 294336 - DNA, 15 bp, Homo sapiens
tgccactgaaagctc

SEQ ID NO: 294337 - DNA, 15 bp, Homo sapiens
atgccactgaaagct

SEQ ID NO: 294338 - DNA, 15 bp, Homo sapiens
catgccactgaaagc

SEQ ID NO: 294339 - DNA, 15 bp, Homo sapiens
gcatgccactgaaag

SEQ ID NO: 294340 - DNA, 15 bp, Homo sapiens
ggcatgccactgaaa

SEQ ID NO: 294341 - DNA, 15 bp, Homo sapiens
tggcatgccactgaa

SEQ ID NO: 294342 - DNA, 15 bp, Homo sapiens
ttggcatgccactga

SEQ ID NO: 294343 - DNA, 15 bp, Homo sapiens
tttggcatgccactg

SEQ ID NO: 294344 - DNA, 15 bp, Homo sapiens
gtttggcatgccact

SEQ ID NO: 294345 - DNA, 15 bp, Homo sapiens
tgtttggcatgccac

SEQ ID NO: 294346 - DNA, 15 bp, Homo sapiens
ttgtttggcatgcca

SEQ ID NO: 294347 - DNA, 15 bp, Homo sapiens
cttgtttggcatgcc

SEQ ID NO: 294348 - DNA, 15 bp, Homo sapiens
ccttgtttggcatgc

SEQ ID NO: 294349 - DNA, 15 bp, Homo sapiens
gccttgtttggcatg

SEQ ID NO: 294350 - DNA, 15 bp, Homo sapiens
tgccttgtttggcat

SEQ ID NO: 294351 - DNA, 15 bp, Homo sapiens
atgccttgtttggca

SEQ ID NO: 294352 - DNA, 15 bp, Homo sapiens
catgccttgtttggc

SEQ ID NO: 294353 - DNA, 15 bp, Homo sapiens
ccatgccttgtttgg

SEQ ID NO: 294354 - DNA, 15 bp, Homo sapiens
tccatgccttgtttg

SEQ ID NO: 294355 - DNA, 15 bp, Homo sapiens
ttccatgccttgttt

SEQ ID NO: 294356 - DNA, 15 bp, Homo sapiens
tttccatgccttgtt

SEQ ID NO: 294357 - DNA, 15 bp, Homo sapiens
gtttccatgccttgt

SEQ ID NO: 294358 - DNA, 15 bp, Homo sapiens
tgtttccatgccttg

SEQ ID NO: 294359 - DNA, 15 bp, Homo sapiens
ctgtttccatgcctt

SEQ ID NO: 294360 - DNA, 15 bp, Homo sapiens
gctgtttccatgcct

SEQ ID NO: 294361 - DNA, 15 bp, Homo sapiens
ggctgtttccatgcc

SEQ ID NO: 294362 - DNA, 15 bp, Homo sapiens
aggctgtttccatgc

SEQ ID NO: 294363 - DNA, 15 bp, Homo sapiens
aaggctgtttccatg

SEQ ID NO: 294364 - DNA, 15 bp, Homo sapiens
aaaggctgtttccat

SEQ ID NO: 294365 - DNA, 15 bp, Homo sapiens
gaaaggctgtttcca

SEQ ID NO: 294366 - DNA, 15 bp, Homo sapiens
agaaaggctgtttcc

SEQ ID NO: 294367 - DNA, 15 bp, Homo sapiens
tagaaaggctgtttc

SEQ ID NO: 294368 - DNA, 15 bp, Homo sapiens
ctagaaaggctgttt

SEQ ID NO: 294369 - DNA, 15 bp, Homo sapiens
actagaaaggctgtt

SEQ ID NO: 294370 - DNA, 15 bp, Homo sapiens
cactagaaaggctgt

SEQ ID NO: 294371 - DNA, 15 bp, Homo sapiens
acactagaaaggctg

SEQ ID NO: 294372 - DNA, 15 bp, Homo sapiens
tacactagaaaggct

SEQ ID NO: 294373 - DNA, 15 bp, Homo sapiens
ttacactagaaaggc

SEQ ID NO: 294374 - DNA, 15 bp, Homo sapiens
attacactagaaagg

SEQ ID NO: 294375 - DNA, 15 bp, Homo sapiens
aattacactagaaag

SEQ ID NO: 294376 - DNA, 15 bp, Homo sapiens
gaattacactagaaa

SEQ ID NO: 294377 - DNA, 15 bp, Homo sapiens
ggaattacactagaa

SEQ ID NO: 294378 - DNA, 15 bp, Homo sapiens
gggaattacactaga

SEQ ID NO: 294379 - DNA, 15 bp, Homo sapiens
agggaattacactag

SEQ ID NO: 294380 - DNA, 15 bp, Homo sapiens
gagggaattacacta

SEQ ID NO: 294381 - DNA, 15 bp, Homo sapiens
agagggaattacact

SEQ ID NO: 294382 - DNA, 15 bp, Homo sapiens
gagagggaattacac

SEQ ID NO: 294383 - DNA, 15 bp, Homo sapiens
agagagggaattaca

SEQ ID NO: 294384 - DNA, 15 bp, Homo sapiens
aagagagggaattac

SEQ ID NO: 294385 - DNA, 15 bp, Homo sapiens
aaagagagggaatta

SEQ ID NO: 294386 - DNA, 15 bp, Homo sapiens
aaaagagagggaatt

SEQ ID NO: 294387 - DNA, 15 bp, Homo sapiens
gaaaagagagggaat

SEQ ID NO: 294388 - DNA, 15 bp, Homo sapiens
agaaaagagagggaa

SEQ ID NO: 294389 - DNA, 15 bp, Homo sapiens
aagaaaagagaggga

SEQ ID NO: 294390 - DNA, 15 bp, Homo sapiens
gaagaaaagagaggg

SEQ ID NO: 294391 - DNA, 15 bp, Homo sapiens
tgaagaaaagagagg

SEQ ID NO: 294392 - DNA, 15 bp, Homo sapiens
ttgaagaaaagagag

SEQ ID NO: 294393 - DNA, 15 bp, Homo sapiens
gtttgaagaaaagag

SEQ ID NO: 294394 - DNA, 15 bp, Homo sapiens
tgtttgaagaaaaga

SEQ ID NO: 294395 - DNA, 15 bp, Homo sapiens
atgtttgaagaaaag

SEQ ID NO: 294396 - DNA, 15 bp, Homo sapiens
aatgtttgaagaaaa

SEQ ID NO: 294397 - DNA, 15 bp, Homo sapiens
caatgtttgaagaaa

SEQ ID NO: 294398 - DNA, 15 bp, Homo sapiens
acaatgtttgaagaa

SEQ ID NO: 294399 - DNA, 15 bp, Homo sapiens
aacaatgtttgaaga

SEQ ID NO: 294400 - DNA, 15 bp, Homo sapiens
gaacaatgtttgaag

SEQ ID NO: 294401 - DNA, 15 bp, Homo sapiens
agaacaatgtttgaa

SEQ ID NO: 294402 - DNA, 15 bp, Homo sapiens
gagaacaatgtttga

SEQ ID NO: 294403 - DNA, 15 bp, Homo sapiens
ggagaacaatgtttg

SEQ ID NO: 294404 - DNA, 15 bp, Homo sapiens
tggagaacaatgttt

SEQ ID NO: 294405 - DNA, 15 bp, Homo sapiens
ttggagaacaatgtt

SEQ ID NO: 294406 - DNA, 15 bp, Homo sapiens
attggagaacaatgt

SEQ ID NO: 294407 - DNA, 15 bp, Homo sapiens
cattggagaacaatg

SEQ ID NO: 294408 - DNA, 15 bp, Homo sapiens
acattggagaacaat

SEQ ID NO: 294409 - DNA, 15 bp, Homo sapiens
gacattggagaacaa

SEQ ID NO: 294410 - DNA, 15 bp, Homo sapiens
tgacattggagaaca

SEQ ID NO: 294411 - DNA, 15 bp, Homo sapiens
atgacattggagaac

SEQ ID NO: 294412 - DNA, 15 bp, Homo sapiens
gatgacattggagaa

SEQ ID NO: 294413 - DNA, 15 bp, Homo sapiens
tgatgacattggaga

SEQ ID NO: 294414 - DNA, 15 bp, Homo sapiens
ctgatgacattggag

SEQ ID NO: 294415 - DNA, 15 bp, Homo sapiens
tctgatgacattgga

SEQ ID NO: 294416 - DNA, 15 bp, Homo sapiens
gtctgatgacattgg

SEQ ID NO: 294417 - DNA, 15 bp, Homo sapiens
agtctgatgacattg

SEQ ID NO: 294418 - DNA, 15 bp, Homo sapiens
gagtctgatgacatt

SEQ ID NO: 294419 - DNA, 15 bp, Homo sapiens
ggagtctgatgacat

SEQ ID NO: 294420 - DNA, 15 bp, Homo sapiens
tggagtctgatgaca

SEQ ID NO: 294421 - DNA, 15 bp, Homo sapiens
ctggagtctgatgac

SEQ ID NO: 294422 - DNA, 15 bp, Homo sapiens
actggagtctgatga

SEQ ID NO: 294423 - DNA, 15 bp, Homo sapiens
cactggagtctgatg

SEQ ID NO: 294424 - DNA, 15 bp, Homo sapiens
gcactggagtctgat

SEQ ID NO: 294425 - DNA, 15 bp, Homo sapiens
tgcactggagtctga

SEQ ID NO: 294426 - DNA, 15 bp, Homo sapiens
ctgcactggagtctg

SEQ ID NO: 294427 - DNA, 15 bp, Homo sapiens
tctgcactggagtct

SEQ ID NO: 294428 - DNA, 15 bp, Homo sapiens
ttctgcactggagtc

SEQ ID NO: 294429 - DNA, 15 bp, Homo sapiens
tttctgcactggagt

SEQ ID NO: 294430 - DNA, 15 bp, Homo sapiens
ctttctgcactggag

SEQ ID NO: 294431 - DNA, 15 bp, Homo sapiens
cctttctgcactgga

SEQ ID NO: 294432 - DNA, 15 bp, Homo sapiens
ccctttctgcactgg

SEQ ID NO: 294433 - DNA, 15 bp, Homo sapiens
tccctttctgcactg

SEQ ID NO: 294434 - DNA, 15 bp, Homo sapiens
atccctttctgcact

SEQ ID NO: 294435 - DNA, 15 bp, Homo sapiens
aatccctttctgcac

SEQ ID NO: 294436 - DNA, 15 bp, Homo sapiens
caatccctttctgca

SEQ ID NO: 294437 - DNA, 15 bp, Homo sapiens
acaatccctttctgc

SEQ ID NO: 294438 - DNA, 15 bp, Homo sapiens
aacaatccctttctg

SEQ ID NO: 294439 - DNA, 15 bp, Homo sapiens
aaacaatccctttct

SEQ ID NO: 294440 - DNA, 15 bp, Homo sapiens
aaaacaatccctttc

SEQ ID NO: 294441 - DNA, 15 bp, Homo sapiens
gaaaacaatcccttt

SEQ ID NO: 294442 - DNA, 15 bp, Homo sapiens
tgaaaacaatccctt

SEQ ID NO: 294443 - DNA, 15 bp, Homo sapiens
ctgaaaacaatccct

SEQ ID NO: 294444 - DNA, 15 bp, Homo sapiens
tctgaaaacaatccc

SEQ ID NO: 294445 - DNA, 15 bp, Homo sapiens
atctgaaaacaatcc

SEQ ID NO: 294446 - DNA, 15 bp, Homo sapiens
aatctgaaaacaatc

SEQ ID NO: 294447 - DNA, 15 bp, Homo sapiens
aaatctgaaaacaat

SEQ ID NO: 294448 - DNA, 15 bp, Homo sapiens
aaaatctgaaaacaa

SEQ ID NO: 294449 - DNA, 15 bp, Homo sapiens
gaaaatctgaaaaca

SEQ ID NO: 294450 - DNA, 15 bp, Homo sapiens
ggaaaatctgaaaac

SEQ ID NO: 294451 - DNA, 15 bp, Homo sapiens
gggaaaatctgaaaa

SEQ ID NO: 294452 - DNA, 15 bp, Homo sapiens
agggaaaatctgaaa

SEQ ID NO: 294453 - DNA, 15 bp, Homo sapiens
aagggaaaatctgaa

SEQ ID NO: 294454 - DNA, 15 bp, Homo sapiens
aaagggaaaatctga

SEQ ID NO: 294455 - DNA, 15 bp, Homo sapiens
aaaagggaaaatctg

SEQ ID NO: 294456 - DNA, 15 bp, Homo sapiens
aaaaagggaaaatct

SEQ ID NO: 294457 - DNA, 15 bp, Homo sapiens
taaaaagggaaaatc

SEQ ID NO: 294458 - DNA, 15 bp, Homo sapiens
ataaaaagggaaaat

SEQ ID NO: 294459 - DNA, 15 bp, Homo sapiens
aataaaaagggaaaa

SEQ ID NO: 294460 - DNA, 15 bp, Homo sapiens
gaataaaaagggaaa

SEQ ID NO: 294461 - DNA, 15 bp, Homo sapiens
ggaataaaaagggaa

SEQ ID NO: 294462 - DNA, 15 bp, Homo sapiens
gggaataaaaaggga

SEQ ID NO: 294463 - DNA, 15 bp, Homo sapiens
cgggaataaaaaggg

SEQ ID NO: 294464 - DNA, 15 bp, Homo sapiens
gcgggaataaaaagg

SEQ ID NO: 294465 - DNA, 15 bp, Homo sapiens
agcgggaataaaaag

SEQ ID NO: 294466 - DNA, 15 bp, Homo sapiens
cagcgggaataaaaa

SEQ ID NO: 294467 - DNA, 15 bp, Homo sapiens
ccagcgggaataaaa

SEQ ID NO: 294468 - DNA, 15 bp, Homo sapiens
accagcgggaataaa

SEQ ID NO: 294469 - DNA, 15 bp, Homo sapiens
aaccagcgggaataa

SEQ ID NO: 294470 - DNA, 15 bp, Homo sapiens
aaaccagcgggaata

SEQ ID NO: 294471 - DNA, 15 bp, Homo sapiens
gaaaccagcgggaat

SEQ ID NO: 294472 - DNA, 15 bp, Homo sapiens
agaaaccagcgggaa

SEQ ID NO: 294473 - DNA, 15 bp, Homo sapiens
aagaaaccagcggga

SEQ ID NO: 294474 - DNA, 15 bp, Homo sapiens
aaagaaaccagcggg

SEQ ID NO: 294475 - DNA, 15 bp, Homo sapiens
aaaagaaaccagcgg

SEQ ID NO: 294476 - DNA, 15 bp, Homo sapiens
gaaaagaaaccagcg

SEQ ID NO: 294477 - DNA, 15 bp, Homo sapiens
agaaaagaaaccagc

SEQ ID NO: 294478 - DNA, 15 bp, Homo sapiens
gagaaaagaaaccag

SEQ ID NO: 294479 - DNA, 15 bp, Homo sapiens
tgagaaaagaaacca

SEQ ID NO: 294480 - DNA, 15 bp, Homo sapiens
atgagaaaagaaacc

SEQ ID NO: 294481 - DNA, 15 bp, Homo sapiens
catgagaaaagaaac

SEQ ID NO: 294482 - DNA, 15 bp, Homo sapiens
ccatgagaaaagaaa

SEQ ID NO: 294483 - DNA, 15 bp, Homo sapiens
tccatgagaaaagaa

SEQ ID NO: 294484 - DNA, 15 bp, Homo sapiens
ttccatgagaaaaga

SEQ ID NO: 294485 - DNA, 15 bp, Homo sapiens
attccatgagaaaag

SEQ ID NO: 294486 - DNA, 15 bp, Homo sapiens
tattccatgagaaaa

SEQ ID NO: 294487 - DNA, 15 bp, Homo sapiens
ttattccatgagaaa

SEQ ID NO: 294488 - DNA, 15 bp, Homo sapiens
tttattccatgagaa

SEQ ID NO: 294489 - DNA, 15 bp, Homo sapiens
ttttattccatgaga

SEQ ID NO: 294490 - DNA, 15 bp, Homo sapiens
attttattccatgag

SEQ ID NO: 294491 - DNA, 15 bp, Homo sapiens
tattttattccatga

SEQ ID NO: 294492 - DNA, 15 bp, Homo sapiens
ctattttattccatg

SEQ ID NO: 294493 - DNA, 15 bp, Homo sapiens
actattttattccat

SEQ ID NO: 294494 - DNA, 15 bp, Homo sapiens
gactattttattcca

SEQ ID NO: 294495 - DNA, 15 bp, Homo sapiens
tgactattttattcc

SEQ ID NO: 294496 - DNA, 15 bp, Homo sapiens
atgactattttattc

SEQ ID NO: 294497 - DNA, 15 bp, Homo sapiens
aatgactattttatt

SEQ ID NO: 294498 - DNA, 15 bp, Homo sapiens
caatgactattttat

SEQ ID NO: 294499 - DNA, 15 bp, Homo sapiens
acaatgactatttta

SEQ ID NO: 294500 - DNA, 15 bp, Homo sapiens
tacaatgactatttt

SEQ ID NO: 294501 - DNA, 15 bp, Homo sapiens
atacaatgactattt

SEQ ID NO: 294502 - DNA, 15 bp, Homo sapiens
tatacaatgactatt

SEQ ID NO: 294503 - DNA, 15 bp, Homo sapiens
ttatacaatgactat

SEQ ID NO: 294504 - DNA, 15 bp, Homo sapiens
tttatacaatgacta

SEQ ID NO: 294505 - DNA, 15 bp, Homo sapiens
ctttatacaatgact

SEQ ID NO: 294506 - DNA, 15 bp, Homo sapiens
cctttatacaatgac

SEQ ID NO: 294507 - DNA, 15 bp, Homo sapiens
gcctttatacaatga

SEQ ID NO: 294508 - DNA, 15 bp, Homo sapiens
ggcctttatacaatg

SEQ ID NO: 294509 - DNA, 15 bp, Homo sapiens
tggcctttatacaat

SEQ ID NO: 294510 - DNA, 15 bp, Homo sapiens
ttggcctttatacaa

SEQ ID NO: 294511 - DNA, 15 bp, Homo sapiens
tttggcctttataca

SEQ ID NO: 294512 - DNA, 15 bp, Homo sapiens
gtttggcctttatac

SEQ ID NO: 294513 - DNA, 15 bp, Homo sapiens
tgtttggcctttata

SEQ ID NO: 294514 - DNA, 15 bp, Homo sapiens
ttgtttggcctttat

SEQ ID NO: 294515 - DNA, 15 bp, Homo sapiens
attgtttggccttta

SEQ ID NO: 294516 - DNA, 15 bp, Homo sapiens
aattgtttggccttt

SEQ ID NO: 294517 - DNA, 15 bp, Homo sapiens
aaattgtttggcctt

SEQ ID NO: 294518 - DNA, 15 bp, Homo sapiens
taaattgtttggcct

SEQ ID NO: 294519 - DNA, 15 bp, Homo sapiens
ttaaattgtttggcc

SEQ ID NO: 294520 - DNA, 15 bp, Homo sapiens
cttaaattgtttggc

SEQ ID NO: 294521 - DNA, 15 bp, Homo sapiens
acttaaattgtttgg

SEQ ID NO: 294522 - DNA, 15 bp, Homo sapiens
gacttaaattgtttg

SEQ ID NO: 294523 - DNA, 15 bp, Homo sapiens
tgacttaaattgttt

SEQ ID NO: 294524 - DNA, 15 bp, Homo sapiens
atgacttaaattgtt

SEQ ID NO: 294525 - DNA, 15 bp, Homo sapiens
gatgacttaaattgt

SEQ ID NO: 294526 - DNA, 15 bp, Homo sapiens
tgatgacttaaattg

SEQ ID NO: 294527 - DNA, 15 bp, Homo sapiens
atgatgacttaaatt

SEQ ID NO: 294528 - DNA, 15 bp, Homo sapiens
tatgatgacttaaat

SEQ ID NO: 294529 - DNA, 15 bp, Homo sapiens
ctatgatgacttaaa

SEQ ID NO: 294530 - DNA, 15 bp, Homo sapiens
tctatgatgacttaa

SEQ ID NO: 294531 - DNA, 15 bp, Homo sapiens
atctatgatgactta

SEQ ID NO: 294532 - DNA, 15 bp, Homo sapiens
aatctatgatgactt

SEQ ID NO: 294533 - DNA, 15 bp, Homo sapiens
taatctatgatgact

SEQ ID NO: 294534 - DNA, 15 bp, Homo sapiens
ctaatctatgatgac

SEQ ID NO: 294535 - DNA, 15 bp, Homo sapiens
cctaatctatgatga

SEQ ID NO: 294536 - DNA, 15 bp, Homo sapiens
tcctaatctatgatg

SEQ ID NO: 294537 - DNA, 15 bp, Homo sapiens
atcctaatctatgat

SEQ ID NO: 294538 - DNA, 15 bp, Homo sapiens
gatcctaatctatga

SEQ ID NO: 294539 - DNA, 15 bp, Homo sapiens
ggatcctaatctatg

SEQ ID NO: 294540 - DNA, 15 bp, Homo sapiens
aggatcctaatctat

SEQ ID NO: 294541 - DNA, 15 bp, Homo sapiens
caggatcctaatcta

SEQ ID NO: 294542 - DNA, 15 bp, Homo sapiens
acaggatcctaatct

SEQ ID NO: 294543 - DNA, 15 bp, Homo sapiens
cacaggatcctaatc

SEQ ID NO: 294544 - DNA, 15 bp, Homo sapiens
tcacaggatcctaat

SEQ ID NO: 294545 - DNA, 15 bp, Homo sapiens
ttcacaggatcctaa

SEQ ID NO: 294546 - DNA, 15 bp, Homo sapiens
cttcacaggatccta

SEQ ID NO: 294547 - DNA, 15 bp, Homo sapiens
acttcacaggatcct

SEQ ID NO: 294548 - DNA, 15 bp, Homo sapiens
aacttcacaggatcc

SEQ ID NO: 294549 - DNA, 15 bp, Homo sapiens
aaacttcacaggatc

SEQ ID NO: 294550 - DNA, 15 bp, Homo sapiens
gaaacttcacaggat

SEQ ID NO: 294551 - DNA, 15 bp, Homo sapiens
ggaaacttcacagga

SEQ ID NO: 294552 - DNA, 15 bp, Homo sapiens
tggaaacttcacagg

SEQ ID NO: 294553 - DNA, 15 bp, Homo sapiens
atggaaacttcacag

SEQ ID NO: 294554 - DNA, 15 bp, Homo sapiens
gatggaaacttcaca

SEQ ID NO: 294555 - DNA, 15 bp, Homo sapiens
agatggaaacttcac

SEQ ID NO: 294556 - DNA, 15 bp, Homo sapiens
cagatggaaacttca

SEQ ID NO: 294557 - DNA, 15 bp, Homo sapiens
tcagatggaaacttc

SEQ ID NO: 294558 - DNA, 15 bp, Homo sapiens
ttcagatggaaactt

SEQ ID NO: 294559 - DNA, 15 bp, Homo sapiens
gttcagatggaaact

SEQ ID NO: 294560 - DNA, 15 bp, Homo sapiens
tgttcagatggaaac

SEQ ID NO: 294561 - DNA, 15 bp, Homo sapiens
ttgttcagatggaaa

SEQ ID NO: 294562 - DNA, 15 bp, Homo sapiens
gttgttcagatggaa

SEQ ID NO: 294563 - DNA, 15 bp, Homo sapiens
ggttgttcagatgga

SEQ ID NO: 294564 - DNA, 15 bp, Homo sapiens
tggttgttcagatgg

SEQ ID NO: 294565 - DNA, 15 bp, Homo sapiens
ttggttgttcagatg

SEQ ID NO: 294566 - DNA, 15 bp, Homo sapiens
cttggttgttcagat

SEQ ID NO: 294567 - DNA, 15 bp, Homo sapiens
tcttggttgttcaga

SEQ ID NO: 294568 - DNA, 15 bp, Homo sapiens
ctcttggttgttcag

SEQ ID NO: 294569 - DNA, 15 bp, Homo sapiens
gctcttggttgttca

SEQ ID NO: 294570 - DNA, 15 bp, Homo sapiens
ggctcttggttgttc

SEQ ID NO: 294571 - DNA, 15 bp, Homo sapiens
tggctcttggttgtt

SEQ ID NO: 294572 - DNA, 15 bp, Homo sapiens
ctggctcttggttgt

SEQ ID NO: 294573 - DNA, 15 bp, Homo sapiens
tctggctcttggttg

SEQ ID NO: 294574 - DNA, 15 bp, Homo sapiens
ttctggctcttggtt

SEQ ID NO: 294575 - DNA, 15 bp, Homo sapiens
tttctggctcttggt

SEQ ID NO: 294576 - DNA, 15 bp, Homo sapiens
ttttctggctcttgg

SEQ ID NO: 294577 - DNA, 15 bp, Homo sapiens
attttctggctcttg

SEQ ID NO: 294578 - DNA, 15 bp, Homo sapiens
tattttctggctctt

SEQ ID NO: 294579 - DNA, 15 bp, Homo sapiens
ttattttctggctct

SEQ ID NO: 294580 - DNA, 15 bp, Homo sapiens
gttattttctggctc

SEQ ID NO: 294581 - DNA, 15 bp, Homo sapiens
ggttattttctggct

SEQ ID NO: 294582 - DNA, 15 bp, Homo sapiens
tggttattttctggc

SEQ ID NO: 294583 - DNA, 15 bp, Homo sapiens
ttggttattttctgg

SEQ ID NO: 294584 - DNA, 15 bp, Homo sapiens
tttggttattttctg

SEQ ID NO: 294585 - DNA, 15 bp, Homo sapiens
atttggttattttct

SEQ ID NO: 294586 - DNA, 15 bp, Homo sapiens
aatttggttattttc

SEQ ID NO: 294587 - DNA, 15 bp, Homo sapiens
gaatttggttatttt

SEQ ID NO: 294588 - DNA, 15 bp, Homo sapiens
ggaatttggttattt

SEQ ID NO: 294589 - DNA, 15 bp, Homo sapiens
aggaatttggttatt

SEQ ID NO: 294590 - DNA, 15 bp, Homo sapiens
caggaatttggttat

SEQ ID NO: 294591 - DNA, 15 bp, Homo sapiens
ccaggaatttggtta

SEQ ID NO: 294592 - DNA, 15 bp, Homo sapiens
cccaggaatttggtt

SEQ ID NO: 294593 - DNA, 15 bp, Homo sapiens
ccccaggaatttggt

SEQ ID NO: 294594 - DNA, 15 bp, Homo sapiens
tccccaggaatttgg

SEQ ID NO: 294595 - DNA, 15 bp, Homo sapiens
ttccccaggaatttg

SEQ ID NO: 294596 - DNA, 15 bp, Homo sapiens
tttccccaggaattt

SEQ ID NO: 294597 - DNA, 15 bp, Homo sapiens
atttccccaggaatt

SEQ ID NO: 294598 - DNA, 15 bp, Homo sapiens
aatttccccaggaat

SEQ ID NO: 294599 - DNA, 15 bp, Homo sapiens
taatttccccaggaa

SEQ ID NO: 294600 - DNA, 15 bp, Homo sapiens
ataatttccccagga

SEQ ID NO: 294601 - DNA, 15 bp, Homo sapiens
tataatttccccagg

SEQ ID NO: 294602 - DNA, 15 bp, Homo sapiens
atataatttccccag

SEQ ID NO: 294603 - DNA, 15 bp, Homo sapiens
tatataatttcccca

SEQ ID NO: 294604 - DNA, 15 bp, Homo sapiens
ttatataatttcccc

SEQ ID NO: 294605 - DNA, 15 bp, Homo sapiens
attatataatttccc

SEQ ID NO: 294606 - DNA, 15 bp, Homo sapiens
tattatataatttcc

SEQ ID NO: 294607 - DNA, 15 bp, Homo sapiens
ttattatataatttc

SEQ ID NO: 294608 - DNA, 15 bp, Homo sapiens
attattatataattt

SEQ ID NO: 294609 - DNA, 15 bp, Homo sapiens
aattattatataatt

SEQ ID NO: 294610 - DNA, 15 bp, Homo sapiens
gaattattatataat

SEQ ID NO: 294611 - DNA, 15 bp, Homo sapiens
agaattattatataa

SEQ ID NO: 294612 - DNA, 15 bp, Homo sapiens
aagaattattatata

SEQ ID NO: 294613 - DNA, 15 bp, Homo sapiens
gtaagaattattata

SEQ ID NO: 294614 - DNA, 15 bp, Homo sapiens
agtaagaattattat

SEQ ID NO: 294615 - DNA, 15 bp, Homo sapiens
aagtaagaattatta

SEQ ID NO: 294616 - DNA, 15 bp, Homo sapiens
taagtaagaattatt

SEQ ID NO: 294617 - DNA, 15 bp, Homo sapiens
ataagtaagaattat

SEQ ID NO: 294618 - DNA, 15 bp, Homo sapiens
aataagtaagaatta

SEQ ID NO: 294619 - DNA, 15 bp, Homo sapiens
gaataagtaagaatt

SEQ ID NO: 294620 - DNA, 15 bp, Homo sapiens
tgaataagtaagaat

SEQ ID NO: 294621 - DNA, 15 bp, Homo sapiens
atgaataagtaagaa

SEQ ID NO: 294622 - DNA, 15 bp, Homo sapiens
aatgaataagtaaga

SEQ ID NO: 294623 - DNA, 15 bp, Homo sapiens
aaatgaataagtaag

SEQ ID NO: 294624 - DNA, 15 bp, Homo sapiens
aaaatgaataagtaa

SEQ ID NO: 294625 - DNA, 15 bp, Homo sapiens
aaaaatgaataagta

SEQ ID NO: 294626 - DNA, 15 bp, Homo sapiens
aaaaaatgaataagt

SEQ ID NO: 294627 - DNA, 15 bp, Homo sapiens
gaaaaaatgaataag

SEQ ID NO: 294628 - DNA, 15 bp, Homo sapiens
ggaaaaaatgaataa

SEQ ID NO: 294629 - DNA, 15 bp, Homo sapiens
tggaaaaaatgaata

SEQ ID NO: 294630 - DNA, 15 bp, Homo sapiens
ttggaaaaaatgaat

SEQ ID NO: 294631 - DNA, 15 bp, Homo sapiens
cttggaaaaaatgaa

SEQ ID NO: 294632 - DNA, 15 bp, Homo sapiens
acttggaaaaaatga

SEQ ID NO: 294633 - DNA, 15 bp, Homo sapiens
cacttggaaaaaatg

SEQ ID NO: 294634 - DNA, 15 bp, Homo sapiens
acacttggaaaaaat

SEQ ID NO: 294635 - DNA, 15 bp, Homo sapiens
aacacttggaaaaaa

SEQ ID NO: 294636 - DNA, 15 bp, Homo sapiens
aaacacttggaaaaa

SEQ ID NO: 294637 - DNA, 15 bp, Homo sapiens
aaaacacttggaaaa

SEQ ID NO: 294638 - DNA, 15 bp, Homo sapiens
caaaacacttggaaa

SEQ ID NO: 294639 - DNA, 15 bp, Homo sapiens
acaaaacacttggaa

SEQ ID NO: 294640 - DNA, 15 bp, Homo sapiens
gacaaaacacttgga

SEQ ID NO: 294641 - DNA, 15 bp, Homo sapiens
agacaaaacacttgg

SEQ ID NO: 294642 - DNA, 15 bp, Homo sapiens
aagacaaaacacttg

SEQ ID NO: 294643 - DNA, 15 bp, Homo sapiens
gaagacaaaacactt

SEQ ID NO: 294644 - DNA, 15 bp, Homo sapiens
tgaagacaaaacact

SEQ ID NO: 294645 - DNA, 15 bp, Homo sapiens
ctgaagacaaaacac

SEQ ID NO: 294646 - DNA, 15 bp, Homo sapiens
gctgaagacaaaaca

SEQ ID NO: 294647 - DNA, 15 bp, Homo sapiens
tgctgaagacaaaac

SEQ ID NO: 294648 - DNA, 15 bp, Homo sapiens
gtgctgaagacaaaa

SEQ ID NO: 294649 - DNA, 15 bp, Homo sapiens
ggtgctgaagacaaa

SEQ ID NO: 294650 - DNA, 15 bp, Homo sapiens
aggtgctgaagacaa

SEQ ID NO: 294651 - DNA, 15 bp, Homo sapiens
aaggtgctgaagaca

SEQ ID NO: 294652 - DNA, 15 bp, Homo sapiens
caaggtgctgaagac

SEQ ID NO: 294653 - DNA, 15 bp, Homo sapiens
gcaaggtgctgaaga

SEQ ID NO: 294654 - DNA, 15 bp, Homo sapiens
ggcaaggtgctgaag

SEQ ID NO: 294655 - DNA, 15 bp, Homo sapiens
tggcaaggtgctgaa

SEQ ID NO: 294656 - DNA, 15 bp, Homo sapiens
gtggcaaggtgctga

SEQ ID NO: 294657 - DNA, 15 bp, Homo sapiens
ggtggcaaggtgctg

SEQ ID NO: 294658 - DNA, 15 bp, Homo sapiens
aggtggcaaggtgct

SEQ ID NO: 294659 - DNA, 15 bp, Homo sapiens
aaggtggcaaggtgc

SEQ ID NO: 294660 - DNA, 15 bp, Homo sapiens
caaggtggcaaggtg

SEQ ID NO: 294661 - DNA, 15 bp, Homo sapiens
gcaaggtggcaaggt

SEQ ID NO: 294662 - DNA, 15 bp, Homo sapiens
tgcaaggtggcaagg

SEQ ID NO: 294663 - DNA, 15 bp, Homo sapiens
ttgcaaggtggcaag

SEQ ID NO: 294664 - DNA, 15 bp, Homo sapiens
attgcaaggtggcaa

SEQ ID NO: 294665 - DNA, 15 bp, Homo sapiens
aattgcaaggtggca

SEQ ID NO: 294666 - DNA, 15 bp, Homo sapiens
aaattgcaaggtggc

SEQ ID NO: 294667 - DNA, 15 bp, Homo sapiens
aaaattgcaaggtgg

SEQ ID NO: 294668 - DNA, 15 bp, Homo sapiens
caaaattgcaaggtg

SEQ ID NO: 294669 - DNA, 15 bp, Homo sapiens
ccaaaattgcaaggt

SEQ ID NO: 294670 - DNA, 15 bp, Homo sapiens
gccaaaattgcaagg

SEQ ID NO: 294671 - DNA, 15 bp, Homo sapiens
agccaaaattgcaag

SEQ ID NO: 294672 - DNA, 15 bp, Homo sapiens
cagccaaaattgcaa

SEQ ID NO: 294673 - DNA, 15 bp, Homo sapiens
tcagccaaaattgca

SEQ ID NO: 294674 - DNA, 15 bp, Homo sapiens
ctcagccaaaattgc

SEQ ID NO: 294675 - DNA, 15 bp, Homo sapiens
gctcagccaaaattg

SEQ ID NO: 294676 - DNA, 15 bp, Homo sapiens
agctcagccaaaatt

SEQ ID NO: 294677 - DNA, 15 bp, Homo sapiens
gagctcagccaaaat

SEQ ID NO: 294678 - DNA, 15 bp, Homo sapiens
agagctcagccaaaa

SEQ ID NO: 294679 - DNA, 15 bp, Homo sapiens
gagagctcagccaaa

SEQ ID NO: 294680 - DNA, 15 bp, Homo sapiens
tgagagctcagccaa

SEQ ID NO: 294681 - DNA, 15 bp, Homo sapiens
gtgagagctcagcca

SEQ ID NO: 294682 - DNA, 15 bp, Homo sapiens
ggtgagagctcagcc

SEQ ID NO: 294683 - DNA, 15 bp, Homo sapiens
aggtgagagctcagc

SEQ ID NO: 294684 - DNA, 15 bp, Homo sapiens
taggtgagagctcag

SEQ ID NO: 294685 - DNA, 15 bp, Homo sapiens
ttaggtgagagctca

SEQ ID NO: 294686 - DNA, 15 bp, Homo sapiens
tttaggtgagagctc

SEQ ID NO: 294687 - DNA, 15 bp, Homo sapiens
ttttaggtgagagct

SEQ ID NO: 294688 - DNA, 15 bp, Homo sapiens
gttttaggtgagagc

SEQ ID NO: 294689 - DNA, 15 bp, Homo sapiens
tgttttaggtgagag

SEQ ID NO: 294690 - DNA, 15 bp, Homo sapiens
gtgttttaggtgaga

SEQ ID NO: 294691 - DNA, 15 bp, Homo sapiens
agtgttttaggtgag

SEQ ID NO: 294692 - DNA, 15 bp, Homo sapiens
aagtgttttaggtga

SEQ ID NO: 294693 - DNA, 15 bp, Homo sapiens
gaagtgttttaggtg

SEQ ID NO: 294694 - DNA, 15 bp, Homo sapiens
agaagtgttttaggt

SEQ ID NO: 294695 - DNA, 15 bp, Homo sapiens
cagaagtgttttagg

SEQ ID NO: 294696 - DNA, 15 bp, Homo sapiens
ccagaagtgttttag

SEQ ID NO: 294697 - DNA, 15 bp, Homo sapiens
accagaagtgtttta

SEQ ID NO: 294698 - DNA, 15 bp, Homo sapiens
caccagaagtgtttt

SEQ ID NO: 294699 - DNA, 15 bp, Homo sapiens
acaccagaagtgttt

SEQ ID NO: 294700 - DNA, 15 bp, Homo sapiens
aacaccagaagtgtt

SEQ ID NO: 294701 - DNA, 15 bp, Homo sapiens
aaacaccagaagtgt

SEQ ID NO: 294702 - DNA, 15 bp, Homo sapiens
gaaacaccagaagtg

SEQ ID NO: 294703 - DNA, 15 bp, Homo sapiens
agaaacaccagaagt

SEQ ID NO: 294704 - DNA, 15 bp, Homo sapiens
tagaaacaccagaag

SEQ ID NO: 294705 - DNA, 15 bp, Homo sapiens
ctagaaacaccagaa

SEQ ID NO: 294706 - DNA, 15 bp, Homo sapiens
gctagaaacaccaga

SEQ ID NO: 294707 - DNA, 15 bp, Homo sapiens
tgctagaaacaccag

SEQ ID NO: 294708 - DNA, 15 bp, Homo sapiens
ctgctagaaacacca

SEQ ID NO: 294709 - DNA, 15 bp, Homo sapiens
tctgctagaaacacc

SEQ ID NO: 294710 - DNA, 15 bp, Homo sapiens
ttctgctagaaacac

SEQ ID NO: 294711 - DNA, 15 bp, Homo sapiens
attctgctagaaaca

SEQ ID NO: 294712 - DNA, 15 bp, Homo sapiens
tattctgctagaaac

SEQ ID NO: 294713 - DNA, 15 bp, Homo sapiens
atattctgctagaaa

SEQ ID NO: 294714 - DNA, 15 bp, Homo sapiens
tatattctgctagaa

SEQ ID NO: 294715 - DNA, 15 bp, Homo sapiens
atatattctgctaga

SEQ ID NO: 294716 - DNA, 15 bp, Homo sapiens
tatatattctgctag

SEQ ID NO: 294717 - DNA, 15 bp, Homo sapiens
gtatatattctgcta

SEQ ID NO: 294718 - DNA, 15 bp, Homo sapiens
tgtatatattctgct

SEQ ID NO: 294719 - DNA, 15 bp, Homo sapiens
atgtatatattctgc

SEQ ID NO: 294720 - DNA, 15 bp, Homo sapiens
tatgtatatattctg

SEQ ID NO: 294721 - DNA, 15 bp, Homo sapiens
gtatgtatatattct

SEQ ID NO: 294722 - DNA, 15 bp, Homo sapiens
tgtatgtatatattc

SEQ ID NO: 294723 - DNA, 15 bp, Homo sapiens
ttgtatgtatatatt

SEQ ID NO: 294724 - DNA, 15 bp, Homo sapiens
cttgtatgtatatat

SEQ ID NO: 294725 - DNA, 15 bp, Homo sapiens
acttgtatgtatata

SEQ ID NO: 294726 - DNA, 15 bp, Homo sapiens
tacttgtatgtatat

SEQ ID NO: 294727 - DNA, 15 bp, Homo sapiens
ttacttgtatgtata

SEQ ID NO: 294728 - DNA, 15 bp, Homo sapiens
tttacttgtatgtat

SEQ ID NO: 294729 - DNA, 15 bp, Homo sapiens
gtttacttgtatgta

SEQ ID NO: 294730 - DNA, 15 bp, Homo sapiens
agtttacttgtatgt

SEQ ID NO: 294731 - DNA, 15 bp, Homo sapiens
cagtttacttgtatg

SEQ ID NO: 294732 - DNA, 15 bp, Homo sapiens
acagtttacttgtat

SEQ ID NO: 294733 - DNA, 15 bp, Homo sapiens
tacagtttacttgta

SEQ ID NO: 294734 - DNA, 15 bp, Homo sapiens
atacagtttacttgt

SEQ ID NO: 294735 - DNA, 15 bp, Homo sapiens
tatacagtttacttg

SEQ ID NO: 294736 - DNA, 15 bp, Homo sapiens
atatacagtttactt

SEQ ID NO: 294737 - DNA, 15 bp, Homo sapiens
tatatacagtttact

SEQ ID NO: 294738 - DNA, 15 bp, Homo sapiens
atatatacagtttac

SEQ ID NO: 294739 - DNA, 15 bp, Homo sapiens
catatatacagttta

SEQ ID NO: 294740 - DNA, 15 bp, Homo sapiens
acatatatacagttt

SEQ ID NO: 294741 - DNA, 15 bp, Homo sapiens
tacatatatacagtt

SEQ ID NO: 294742 - DNA, 15 bp, Homo sapiens
atacatatatacagt

SEQ ID NO: 294743 - DNA, 15 bp, Homo sapiens
tatacatatatacag

SEQ ID NO: 294744 - DNA, 15 bp, Homo sapiens
gtatacatatataca

SEQ ID NO: 294745 - DNA, 15 bp, Homo sapiens
tgtatacatatatac

SEQ ID NO: 294746 - DNA, 15 bp, Homo sapiens
gtatatatatgtata

SEQ ID NO: 294747 - DNA, 15 bp, Homo sapiens
tgtatatatatgtat

SEQ ID NO: 294748 - DNA, 15 bp, Homo sapiens
gtgtatatatatgta

SEQ ID NO: 294749 - DNA, 15 bp, Homo sapiens
tgtgtatatatatgt

SEQ ID NO: 294750 - DNA, 15 bp, Homo sapiens
gtgtgtatatatatg

SEQ ID NO: 294751 - DNA, 15 bp, Homo sapiens
ttgtatgtgtgtgtg

SEQ ID NO: 294752 - DNA, 15 bp, Homo sapiens
tttgtatgtgtgtgt

SEQ ID NO: 294753 - DNA, 15 bp, Homo sapiens
atttgtatgtgtgtg

SEQ ID NO: 294754 - DNA, 15 bp, Homo sapiens
tatttgtatgtgtgt

SEQ ID NO: 294755 - DNA, 15 bp, Homo sapiens
atatttgtatgtgtg

SEQ ID NO: 294756 - DNA, 15 bp, Homo sapiens
tatatttgtatgtgt

SEQ ID NO: 294757 - DNA, 15 bp, Homo sapiens
atatatttgtatgtg

SEQ ID NO: 294758 - DNA, 15 bp, Homo sapiens
tatatatttgtatgt

SEQ ID NO: 294759 - DNA, 15 bp, Homo sapiens
ttatatatttgtatg

SEQ ID NO: 294760 - DNA, 15 bp, Homo sapiens
tttatatatttgtat

SEQ ID NO: 294761 - DNA, 15 bp, Homo sapiens
atttatatatttgta

SEQ ID NO: 294762 - DNA, 15 bp, Homo sapiens
catttatatatttgt

SEQ ID NO: 294763 - DNA, 15 bp, Homo sapiens
gcatttatatatttg

SEQ ID NO: 294764 - DNA, 15 bp, Homo sapiens
tgcatttatatattt

SEQ ID NO: 294765 - DNA, 15 bp, Homo sapiens
atgcatttatatatt

SEQ ID NO: 294766 - DNA, 15 bp, Homo sapiens
tatgcatttatatat

SEQ ID NO: 294767 - DNA, 15 bp, Homo sapiens
atatgcatttatata

SEQ ID NO: 294768 - DNA, 15 bp, Homo sapiens
tatatgcatttatat

SEQ ID NO: 294769 - DNA, 15 bp, Homo sapiens
ttatatgcatttata

SEQ ID NO: 294770 - DNA, 15 bp, Homo sapiens
tttatatgcatttat

SEQ ID NO: 294771 - DNA, 15 bp, Homo sapiens
atttatatgcattta

SEQ ID NO: 294772 - DNA, 15 bp, Homo sapiens
aatttatatgcattt

SEQ ID NO: 294773 - DNA, 15 bp, Homo sapiens
taatttatatgcatt

SEQ ID NO: 294774 - DNA, 15 bp, Homo sapiens
gtaatttatatgcat

SEQ ID NO: 294775 - DNA, 15 bp, Homo sapiens
agtaatttatatgca

SEQ ID NO: 294776 - DNA, 15 bp, Homo sapiens
aagtaatttatatgc

SEQ ID NO: 294777 - DNA, 15 bp, Homo sapiens
taagtaatttatatg

SEQ ID NO: 294778 - DNA, 15 bp, Homo sapiens
ctaagtaatttatat

SEQ ID NO: 294779 - DNA, 15 bp, Homo sapiens
actaagtaatttata

SEQ ID NO: 294780 - DNA, 15 bp, Homo sapiens
tactaagtaatttat

SEQ ID NO: 294781 - DNA, 15 bp, Homo sapiens
gtactaagtaattta

SEQ ID NO: 294782 - DNA, 15 bp, Homo sapiens
agtactaagtaattt

SEQ ID NO: 294783 - DNA, 15 bp, Homo sapiens
tagtactaagtaatt

SEQ ID NO: 294784 - DNA, 15 bp, Homo sapiens
atagtactaagtaat

SEQ ID NO: 294785 - DNA, 15 bp, Homo sapiens
tatagtactaagtaa

SEQ ID NO: 294786 - DNA, 15 bp, Homo sapiens
ttatagtactaagta

SEQ ID NO: 294787 - DNA, 15 bp, Homo sapiens
attatagtactaagt

SEQ ID NO: 294788 - DNA, 15 bp, Homo sapiens
aattatagtactaag

SEQ ID NO: 294789 - DNA, 15 bp, Homo sapiens
taattatagtactaa

SEQ ID NO: 294790 - DNA, 15 bp, Homo sapiens
ataattatagtacta

SEQ ID NO: 294791 - DNA, 15 bp, Homo sapiens
tataattatagtact

SEQ ID NO: 294792 - DNA, 15 bp, Homo sapiens
atataattatagtac

SEQ ID NO: 294793 - DNA, 15 bp, Homo sapiens
aatataattatagta

SEQ ID NO: 294794 - DNA, 15 bp, Homo sapiens
aaatataattatagt

SEQ ID NO: 294795 - DNA, 15 bp, Homo sapiens
aaaatataattatag

SEQ ID NO: 294796 - DNA, 15 bp, Homo sapiens
taaaatataattata

SEQ ID NO: 294797 - DNA, 15 bp, Homo sapiens
ttaaaatataattat

SEQ ID NO: 294798 - DNA, 15 bp, Homo sapiens
tttaaaatataatta

SEQ ID NO: 294799 - DNA, 15 bp, Homo sapiens
atttaaaatataatt

SEQ ID NO: 294800 - DNA, 15 bp, Homo sapiens
tatttaaaatataat

SEQ ID NO: 294801 - DNA, 15 bp, Homo sapiens
ttatttaaaatataa

SEQ ID NO: 294802 - DNA, 15 bp, Homo sapiens
attatttaaaatata

SEQ ID NO: 294803 - DNA, 15 bp, Homo sapiens
gattatttaaaatat

SEQ ID NO: 294804 - DNA, 15 bp, Homo sapiens
agattatttaaaata

SEQ ID NO: 294805 - DNA, 15 bp, Homo sapiens
aagattatttaaaat

SEQ ID NO: 294806 - DNA, 15 bp, Homo sapiens
aaagattatttaaaa

SEQ ID NO: 294807 - DNA, 15 bp, Homo sapiens
caaagattatttaaa

SEQ ID NO: 294808 - DNA, 15 bp, Homo sapiens
tcaaagattatttaa

SEQ ID NO: 294809 - DNA, 15 bp, Homo sapiens
gtcaaagattattta

SEQ ID NO: 294810 - DNA, 15 bp, Homo sapiens
tgtcaaagattattt

SEQ ID NO: 294811 - DNA, 15 bp, Homo sapiens
ctgtcaaagattatt

SEQ ID NO: 294812 - DNA, 15 bp, Homo sapiens
cctgtcaaagattat

SEQ ID NO: 294813 - DNA, 15 bp, Homo sapiens
tcctgtcaaagatta

SEQ ID NO: 294814 - DNA, 15 bp, Homo sapiens
atcctgtcaaagatt

SEQ ID NO: 294815 - DNA, 15 bp, Homo sapiens
aatcctgtcaaagat

SEQ ID NO: 294816 - DNA, 15 bp, Homo sapiens
aaatcctgtcaaaga

SEQ ID NO: 294817 - DNA, 15 bp, Homo sapiens
caaatcctgtcaaag

SEQ ID NO: 294818 - DNA, 15 bp, Homo sapiens
tcaaatcctgtcaaa

SEQ ID NO: 294819 - DNA, 15 bp, Homo sapiens
ttcaaatcctgtcaa

SEQ ID NO: 294820 - DNA, 15 bp, Homo sapiens
cttcaaatcctgtca

SEQ ID NO: 294821 - DNA, 15 bp, Homo sapiens
tcttcaaatcctgtc

SEQ ID NO: 294822 - DNA, 15 bp, Homo sapiens
gtcttcaaatcctgt

SEQ ID NO: 294823 - DNA, 15 bp, Homo sapiens
tgtcttcaaatcctg

SEQ ID NO: 294824 - DNA, 15 bp, Homo sapiens
atgtcttcaaatcct

SEQ ID NO: 294825 - DNA, 15 bp, Homo sapiens
aatgtcttcaaatcc

SEQ ID NO: 294826 - DNA, 15 bp, Homo sapiens
taatgtcttcaaatc

SEQ ID NO: 294827 - DNA, 15 bp, Homo sapiens
ataatgtcttcaaat

SEQ ID NO: 294828 - DNA, 15 bp, Homo sapiens
aataatgtcttcaaa

SEQ ID NO: 294829 - DNA, 15 bp, Homo sapiens
aaataatgtcttcaa

SEQ ID NO: 294830 - DNA, 15 bp, Homo sapiens
caaataatgtcttca

SEQ ID NO: 294831 - DNA, 15 bp, Homo sapiens
acaaataatgtcttc

SEQ ID NO: 294832 - DNA, 15 bp, Homo sapiens
tacaaataatgtctt

SEQ ID NO: 294833 - DNA, 15 bp, Homo sapiens
ttacaaataatgtct

SEQ ID NO: 294834 - DNA, 15 bp, Homo sapiens
attacaaataatgtc

SEQ ID NO: 294835 - DNA, 15 bp, Homo sapiens
aattacaaataatgt

SEQ ID NO: 294836 - DNA, 15 bp, Homo sapiens
aaattacaaataatg

SEQ ID NO: 294837 - DNA, 15 bp, Homo sapiens
aaaattacaaataat

SEQ ID NO: 294838 - DNA, 15 bp, Homo sapiens
taaaattacaaataa

SEQ ID NO: 294839 - DNA, 15 bp, Homo sapiens
ctaaaattacaaata

SEQ ID NO: 294840 - DNA, 15 bp, Homo sapiens
tctaaaattacaaat

SEQ ID NO: 294841 - DNA, 15 bp, Homo sapiens
ctctaaaattacaaa

SEQ ID NO: 294842 - DNA, 15 bp, Homo sapiens
tctctaaaattacaa

SEQ ID NO: 294843 - DNA, 15 bp, Homo sapiens
ctctctaaaattaca

SEQ ID NO: 294844 - DNA, 15 bp, Homo sapiens
tctctctaaaattac

SEQ ID NO: 294845 - DNA, 15 bp, Homo sapiens
atctctctaaaatta

SEQ ID NO: 294846 - DNA, 15 bp, Homo sapiens
aatctctctaaaatt

SEQ ID NO: 294847 - DNA, 15 bp, Homo sapiens
aaatctctctaaaat

SEQ ID NO: 294848 - DNA, 15 bp, Homo sapiens
taaatctctctaaaa

SEQ ID NO: 294849 - DNA, 15 bp, Homo sapiens
gtaaatctctctaaa

SEQ ID NO: 294850 - DNA, 15 bp, Homo sapiens
agtaaatctctctaa

SEQ ID NO: 294851 - DNA, 15 bp, Homo sapiens
gagtaaatctctcta

SEQ ID NO: 294852 - DNA, 15 bp, Homo sapiens
agagtaaatctctct

SEQ ID NO: 294853 - DNA, 15 bp, Homo sapiens
gagagtaaatctctc

SEQ ID NO: 294854 - DNA, 15 bp, Homo sapiens
tgagagtaaatctct

SEQ ID NO: 294855 - DNA, 15 bp, Homo sapiens
ttgagagtaaatctc

SEQ ID NO: 294856 - DNA, 15 bp, Homo sapiens
tttgagagtaaatct

SEQ ID NO: 294857 - DNA, 15 bp, Homo sapiens
gtttgagagtaaatc

SEQ ID NO: 294858 - DNA, 15 bp, Homo sapiens
agtttgagagtaaat

SEQ ID NO: 294859 - DNA, 15 bp, Homo sapiens
cagtttgagagtaaa

SEQ ID NO: 294860 - DNA, 15 bp, Homo sapiens
tcagtttgagagtaa

SEQ ID NO: 294861 - DNA, 15 bp, Homo sapiens
atcagtttgagagta

SEQ ID NO: 294862 - DNA, 15 bp, Homo sapiens
aatcagtttgagagt

SEQ ID NO: 294863 - DNA, 15 bp, Homo sapiens
aaatcagtttgagag

SEQ ID NO: 294864 - DNA, 15 bp, Homo sapiens
aaaatcagtttgaga

SEQ ID NO: 294865 - DNA, 15 bp, Homo sapiens
taaaatcagtttgag

SEQ ID NO: 294866 - DNA, 15 bp, Homo sapiens
ttaaaatcagtttga

SEQ ID NO: 294867 - DNA, 15 bp, Homo sapiens
tttaaaatcagtttg

SEQ ID NO: 294868 - DNA, 15 bp, Homo sapiens
atttaaaatcagttt

SEQ ID NO: 294869 - DNA, 15 bp, Homo sapiens
gatttaaaatcagtt

SEQ ID NO: 294870 - DNA, 15 bp, Homo sapiens
ggatttaaaatcagt

SEQ ID NO: 294871 - DNA, 15 bp, Homo sapiens
tggatttaaaatcag

SEQ ID NO: 294872 - DNA, 15 bp, Homo sapiens
ctggatttaaaatca

SEQ ID NO: 294873 - DNA, 15 bp, Homo sapiens
cctggatttaaaatc

SEQ ID NO: 294874 - DNA, 15 bp, Homo sapiens
ccctggatttaaaat

SEQ ID NO: 294875 - DNA, 15 bp, Homo sapiens
gccctggatttaaaa

SEQ ID NO: 294876 - DNA, 15 bp, Homo sapiens
tgccctggatttaaa

SEQ ID NO: 294877 - DNA, 15 bp, Homo sapiens
ctgccctggatttaa

SEQ ID NO: 294878 - DNA, 15 bp, Homo sapiens
actgccctggattta

SEQ ID NO: 294879 - DNA, 15 bp, Homo sapiens
gactgccctggattt

SEQ ID NO: 294880 - DNA, 15 bp, Homo sapiens
tgactgccctggatt

SEQ ID NO: 294881 - DNA, 15 bp, Homo sapiens
gtgactgccctggat

SEQ ID NO: 294882 - DNA, 15 bp, Homo sapiens
agtgactgccctgga

SEQ ID NO: 294883 - DNA, 15 bp, Homo sapiens
tagtgactgccctgg

SEQ ID NO: 294884 - DNA, 15 bp, Homo sapiens
ttagtgactgccctg

SEQ ID NO: 294885 - DNA, 15 bp, Homo sapiens
tttagtgactgccct

SEQ ID NO: 294886 - DNA, 15 bp, Homo sapiens
ttttagtgactgccc

SEQ ID NO: 294887 - DNA, 15 bp, Homo sapiens
attttagtgactgcc

SEQ ID NO: 294888 - DNA, 15 bp, Homo sapiens
tattttagtgactgc

SEQ ID NO: 294889 - DNA, 15 bp, Homo sapiens
ttattttagtgactg

SEQ ID NO: 294890 - DNA, 15 bp, Homo sapiens
cttattttagtgact

SEQ ID NO: 294891 - DNA, 15 bp, Homo sapiens
tcttattttagtgac

SEQ ID NO: 294892 - DNA, 15 bp, Homo sapiens
ttcttattttagtga

SEQ ID NO: 294893 - DNA, 15 bp, Homo sapiens
attcttattttagtg

SEQ ID NO: 294894 - DNA, 15 bp, Homo sapiens
aattcttattttagt

SEQ ID NO: 294895 - DNA, 15 bp, Homo sapiens
gaattcttattttag

SEQ ID NO: 294896 - DNA, 15 bp, Homo sapiens
tgaattcttatttta

SEQ ID NO: 294897 - DNA, 15 bp, Homo sapiens
atgaattcttatttt

SEQ ID NO: 294898 - DNA, 15 bp, Homo sapiens
catgaattcttattt

SEQ ID NO: 294899 - DNA, 15 bp, Homo sapiens
acatgaattcttatt

SEQ ID NO: 294900 - DNA, 15 bp, Homo sapiens
tacatgaattcttat

SEQ ID NO: 294901 - DNA, 15 bp, Homo sapiens
ttacatgaattctta

SEQ ID NO: 294902 - DNA, 15 bp, Homo sapiens
tttacatgaattctt

SEQ ID NO: 294903 - DNA, 15 bp, Homo sapiens
ctttacatgaattct

SEQ ID NO: 294904 - DNA, 15 bp, Homo sapiens
gctttacatgaattc

SEQ ID NO: 294905 - DNA, 15 bp, Homo sapiens
tgctttacatgaatt

SEQ ID NO: 294906 - DNA, 15 bp, Homo sapiens
atgctttacatgaat

SEQ ID NO: 294907 - DNA, 15 bp, Homo sapiens
tatgctttacatgaa

SEQ ID NO: 294908 - DNA, 15 bp, Homo sapiens
ctatgctttacatga

SEQ ID NO: 294909 - DNA, 15 bp, Homo sapiens
gctatgctttacatg

SEQ ID NO: 294910 - DNA, 15 bp, Homo sapiens
ggctatgctttacat

SEQ ID NO: 294911 - DNA, 15 bp, Homo sapiens
aggctatgctttaca

SEQ ID NO: 294912 - DNA, 15 bp, Homo sapiens
gaggctatgctttac

SEQ ID NO: 294913 - DNA, 15 bp, Homo sapiens
agaggctatgcttta

SEQ ID NO: 294914 - DNA, 15 bp, Homo sapiens
aagaggctatgcttt

SEQ ID NO: 294915 - DNA, 15 bp, Homo sapiens
taagaggctatgctt

SEQ ID NO: 294916 - DNA, 15 bp, Homo sapiens
ataagaggctatgct

SEQ ID NO: 294917 - DNA, 15 bp, Homo sapiens
aataagaggctatgc

SEQ ID NO: 294918 - DNA, 15 bp, Homo sapiens
aaataagaggctatg

SEQ ID NO: 294919 - DNA, 15 bp, Homo sapiens
aaaataagaggctat

SEQ ID NO: 294920 - DNA, 15 bp, Homo sapiens
taaaataagaggcta

SEQ ID NO: 294921 - DNA, 15 bp, Homo sapiens
gtaaaataagaggct

SEQ ID NO: 294922 - DNA, 15 bp, Homo sapiens
ggtaaaataagaggc

SEQ ID NO: 294923 - DNA, 15 bp, Homo sapiens
gggtaaaataagagg

SEQ ID NO: 294924 - DNA, 15 bp, Homo sapiens
agggtaaaataagag

SEQ ID NO: 294925 - DNA, 15 bp, Homo sapiens
aagggtaaaataaga

SEQ ID NO: 294926 - DNA, 15 bp, Homo sapiens
caagggtaaaataag

SEQ ID NO: 294927 - DNA, 15 bp, Homo sapiens
acaagggtaaaataa

SEQ ID NO: 294928 - DNA, 15 bp, Homo sapiens
gacaagggtaaaata

SEQ ID NO: 294929 - DNA, 15 bp, Homo sapiens
agacaagggtaaaat

SEQ ID NO: 294930 - DNA, 15 bp, Homo sapiens
cagacaagggtaaaa

SEQ ID NO: 294931 - DNA, 15 bp, Homo sapiens
acagacaagggtaaa

SEQ ID NO: 294932 - DNA, 15 bp, Homo sapiens
gacagacaagggtaa

SEQ ID NO: 294933 - DNA, 15 bp, Homo sapiens
tgacagacaagggta

SEQ ID NO: 294934 - DNA, 15 bp, Homo sapiens
atgacagacaagggt

SEQ ID NO: 294935 - DNA, 15 bp, Homo sapiens
gatgacagacaaggg

SEQ ID NO: 294936 - DNA, 15 bp, Homo sapiens
agatgacagacaagg

SEQ ID NO: 294937 - DNA, 15 bp, Homo sapiens
gagatgacagacaag

SEQ ID NO: 294938 - DNA, 15 bp, Homo sapiens
ggagatgacagacaa

SEQ ID NO: 294939 - DNA, 15 bp, Homo sapiens
aggagatgacagaca

SEQ ID NO: 294940 - DNA, 15 bp, Homo sapiens
aaggagatgacagac

SEQ ID NO: 294941 - DNA, 15 bp, Homo sapiens
taaggagatgacaga

SEQ ID NO: 294942 - DNA, 15 bp, Homo sapiens
ctaaggagatgacag

SEQ ID NO: 294943 - DNA, 15 bp, Homo sapiens
tctaaggagatgaca

SEQ ID NO: 294944 - DNA, 15 bp, Homo sapiens
ttctaaggagatgac

SEQ ID NO: 294945 - DNA, 15 bp, Homo sapiens
tttctaaggagatga

SEQ ID NO: 294946 - DNA, 15 bp, Homo sapiens
ttttctaaggagatg

SEQ ID NO: 294947 - DNA, 15 bp, Homo sapiens
attttctaaggagat

SEQ ID NO: 294948 - DNA, 15 bp, Homo sapiens
cattttctaaggaga

SEQ ID NO: 294949 - DNA, 15 bp, Homo sapiens
gcattttctaaggag

SEQ ID NO: 294950 - DNA, 15 bp, Homo sapiens
ggcattttctaagga

SEQ ID NO: 294951 - DNA, 15 bp, Homo sapiens
tggcattttctaagg

SEQ ID NO: 294952 - DNA, 15 bp, Homo sapiens
atggcattttctaag

SEQ ID NO: 294953 - DNA, 15 bp, Homo sapiens
gatggcattttctaa

SEQ ID NO: 294954 - DNA, 15 bp, Homo sapiens
ggatggcattttcta

SEQ ID NO: 294955 - DNA, 15 bp, Homo sapiens
gggatggcattttct

SEQ ID NO: 294956 - DNA, 15 bp, Homo sapiens
tgggatggcattttc

SEQ ID NO: 294957 - DNA, 15 bp, Homo sapiens
ctgggatggcatttt

SEQ ID NO: 294958 - DNA, 15 bp, Homo sapiens
cctgggatggcattt

SEQ ID NO: 294959 - DNA, 15 bp, Homo sapiens
gcctgggatggcatt

SEQ ID NO: 294960 - DNA, 15 bp, Homo sapiens
agcctgggatggcat

SEQ ID NO: 294961 - DNA, 15 bp, Homo sapiens
cagcctgggatggca

SEQ ID NO: 294962 - DNA, 15 bp, Homo sapiens
ccagcctgggatggc

SEQ ID NO: 294963 - DNA, 15 bp, Homo sapiens
cccagcctgggatgg

SEQ ID NO: 294964 - DNA, 15 bp, Homo sapiens
gcccagcctgggatg

SEQ ID NO: 294965 - DNA, 15 bp, Homo sapiens
tgcccagcctgggat

SEQ ID NO: 294966 - DNA, 15 bp, Homo sapiens
gtgcccagcctggga

SEQ ID NO: 294967 - DNA, 15 bp, Homo sapiens
cgtgcccagcctggg

SEQ ID NO: 294968 - DNA, 15 bp, Homo sapiens
ccgtgcccagcctgg

SEQ ID NO: 294969 - DNA, 15 bp, Homo sapiens
accgtgcccagcctg

SEQ ID NO: 294970 - DNA, 15 bp, Homo sapiens
caccgtgcccagcct

SEQ ID NO: 294971 - DNA, 15 bp, Homo sapiens
ccctcccaaagtgct

SEQ ID NO: 294972 - DNA, 15 bp, Homo sapiens
gccctcccaaagtgc

SEQ ID NO: 294973 - DNA, 15 bp, Homo sapiens
cgccctcccaaagtg

SEQ ID NO: 294974 - DNA, 15 bp, Homo sapiens
tcgccctcccaaagt

SEQ ID NO: 294975 - DNA, 15 bp, Homo sapiens
ctcgccctcccaaag

SEQ ID NO: 294976 - DNA, 15 bp, Homo sapiens
cctcgccctcccaaa

SEQ ID NO: 294977 - DNA, 15 bp, Homo sapiens
gcctcgccctcccaa

SEQ ID NO: 294978 - DNA, 15 bp, Homo sapiens
tgcctcgccctccca

SEQ ID NO: 294979 - DNA, 15 bp, Homo sapiens
ctgcctcgccctccc

SEQ ID NO: 294980 - DNA, 15 bp, Homo sapiens
cctgcctcgccctcc

SEQ ID NO: 294981 - DNA, 15 bp, Homo sapiens
acctgcctcgccctc

SEQ ID NO: 294982 - DNA, 15 bp, Homo sapiens
cacctgcctcgccct

SEQ ID NO: 294983 - DNA, 15 bp, Homo sapiens
ccacctgcctcgccc

SEQ ID NO: 294984 - DNA, 15 bp, Homo sapiens
tccacctgcctcgcc

SEQ ID NO: 294985 - DNA, 15 bp, Homo sapiens
atccacctgcctcgc

SEQ ID NO: 294986 - DNA, 15 bp, Homo sapiens
atgatccacctgcct

SEQ ID NO: 294987 - DNA, 15 bp, Homo sapiens
catgatccacctgcc

SEQ ID NO: 294988 - DNA, 15 bp, Homo sapiens
tcatgatccacctgc

SEQ ID NO: 294989 - DNA, 15 bp, Homo sapiens
ctcatgatccacctg

SEQ ID NO: 294990 - DNA, 15 bp, Homo sapiens
tctcatgatccacct

SEQ ID NO: 294991 - DNA, 15 bp, Homo sapiens
atctcatgatccacc

SEQ ID NO: 294992 - DNA, 15 bp, Homo sapiens
gatctcatgatccac

SEQ ID NO: 294993 - DNA, 15 bp, Homo sapiens
tgatctcatgatcca

SEQ ID NO: 294994 - DNA, 15 bp, Homo sapiens
ctgatctcatgatcc

SEQ ID NO: 294995 - DNA, 15 bp, Homo sapiens
cctgatctcatgatc

SEQ ID NO: 294996 - DNA, 15 bp, Homo sapiens
tcctgatctcatgat

SEQ ID NO: 294997 - DNA, 15 bp, Homo sapiens
ctcctgatctcatga

SEQ ID NO: 294998 - DNA, 15 bp, Homo sapiens
actcctgatctcatg

SEQ ID NO: 294999 - DNA, 15 bp, Homo sapiens
aactcctgatctcat

SEQ ID NO: 295000 - DNA, 15 bp, Homo sapiens
gaactcctgatctca

SEQ ID NO: 295001 - DNA, 15 bp, Homo sapiens
cgaactcctgatctc

SEQ ID NO: 295002 - DNA, 15 bp, Homo sapiens
tcgaactcctgatct

SEQ ID NO: 295003 - DNA, 15 bp, Homo sapiens
ctcgaactcctgatc

SEQ ID NO: 295004 - DNA, 15 bp, Homo sapiens
tctcgaactcctgat

SEQ ID NO: 295005 - DNA, 15 bp, Homo sapiens
actggtctcgaactc

SEQ ID NO: 295006 - DNA, 15 bp, Homo sapiens
gactggtctcgaact

SEQ ID NO: 295007 - DNA, 15 bp, Homo sapiens
agactggtctcgaac

SEQ ID NO: 295008 - DNA, 15 bp, Homo sapiens
cagactggtctcgaa

SEQ ID NO: 295009 - DNA, 15 bp, Homo sapiens
tcagactggtctcga

SEQ ID NO: 295010 - DNA, 15 bp, Homo sapiens
gtcagactggtctcg

SEQ ID NO: 295011 - DNA, 15 bp, Homo sapiens
ggtcagactggtctc

SEQ ID NO: 295012 - DNA, 15 bp, Homo sapiens
tggtcagactggtct

SEQ ID NO: 295013 - DNA, 15 bp, Homo sapiens
ttggtcagactggtc

SEQ ID NO: 295014 - DNA, 15 bp, Homo sapiens
gttggtcagactggt

SEQ ID NO: 295015 - DNA, 15 bp, Homo sapiens
tgttggtcagactgg

SEQ ID NO: 295016 - DNA, 15 bp, Homo sapiens
atgttggtcagactg

SEQ ID NO: 295017 - DNA, 15 bp, Homo sapiens
catgttggtcagact

SEQ ID NO: 295018 - DNA, 15 bp, Homo sapiens
ccatgttggtcagac

SEQ ID NO: 295019 - DNA, 15 bp, Homo sapiens
accatgttggtcaga

SEQ ID NO: 295020 - DNA, 15 bp, Homo sapiens
cgacagggtttcacc

SEQ ID NO: 295021 - DNA, 15 bp, Homo sapiens
gcgacagggtttcac

SEQ ID NO: 295022 - DNA, 15 bp, Homo sapiens
agcgacagggtttca

SEQ ID NO: 295023 - DNA, 15 bp, Homo sapiens
tagcgacagggtttc

SEQ ID NO: 295024 - DNA, 15 bp, Homo sapiens
gtagcgacagggttt

SEQ ID NO: 295025 - DNA, 15 bp, Homo sapiens
agtagcgacagggtt

SEQ ID NO: 295026 - DNA, 15 bp, Homo sapiens
tagtagcgacagggt

SEQ ID NO: 295027 - DNA, 15 bp, Homo sapiens
ttagtagcgacaggg

SEQ ID NO: 295028 - DNA, 15 bp, Homo sapiens
tttagtagcgacagg

SEQ ID NO: 295029 - DNA, 15 bp, Homo sapiens
ttttagtagcgacag

SEQ ID NO: 295030 - DNA, 15 bp, Homo sapiens
tttttagtagcgaca

SEQ ID NO: 295031 - DNA, 15 bp, Homo sapiens
atttttagtagcgac

SEQ ID NO: 295032 - DNA, 15 bp, Homo sapiens
tatttttagtagcga

SEQ ID NO: 295033 - DNA, 15 bp, Homo sapiens
gtatttttagtagcg

SEQ ID NO: 295034 - DNA, 15 bp, Homo sapiens
tgtatttttagtagc

SEQ ID NO: 295035 - DNA, 15 bp, Homo sapiens
ctttttgtattttta

SEQ ID NO: 295036 - DNA, 15 bp, Homo sapiens
actttttgtattttt

SEQ ID NO: 295037 - DNA, 15 bp, Homo sapiens
tactttttgtatttt

SEQ ID NO: 295038 - DNA, 15 bp, Homo sapiens
ctactttttgtattt

SEQ ID NO: 295039 - DNA, 15 bp, Homo sapiens
gctactttttgtatt

SEQ ID NO: 295040 - DNA, 15 bp, Homo sapiens
ggctactttttgtat

SEQ ID NO: 295041 - DNA, 15 bp, Homo sapiens
cggctactttttgta

SEQ ID NO: 295042 - DNA, 15 bp, Homo sapiens
ccggctactttttgt

SEQ ID NO: 295043 - DNA, 15 bp, Homo sapiens
cccggctactttttg

SEQ ID NO: 295044 - DNA, 15 bp, Homo sapiens
gcccggctacttttt

SEQ ID NO: 295045 - DNA, 15 bp, Homo sapiens
tgcccggctactttt

SEQ ID NO: 295046 - DNA, 15 bp, Homo sapiens
atgcccggctacttt

SEQ ID NO: 295047 - DNA, 15 bp, Homo sapiens
catgcccggctactt

SEQ ID NO: 295048 - DNA, 15 bp, Homo sapiens
ccatgcccggctact

SEQ ID NO: 295049 - DNA, 15 bp, Homo sapiens
accatgcccggctac

SEQ ID NO: 295050 - DNA, 15 bp, Homo sapiens
catgccaccatgccc

SEQ ID NO: 295051 - DNA, 15 bp, Homo sapiens
tgcatgccaccatgc

SEQ ID NO: 295052 - DNA, 15 bp, Homo sapiens
gtgcatgccaccatg

SEQ ID NO: 295053 - DNA, 15 bp, Homo sapiens
agtgcatgccaccat

SEQ ID NO: 295054 - DNA, 15 bp, Homo sapiens
aagtgcatgccacca

SEQ ID NO: 295055 - DNA, 15 bp, Homo sapiens
caagtgcatgccacc

SEQ ID NO: 295056 - DNA, 15 bp, Homo sapiens
acaagtgcatgccac

SEQ ID NO: 295057 - DNA, 15 bp, Homo sapiens
tacaagtgcatgcca

SEQ ID NO: 295058 - DNA, 15 bp, Homo sapiens
ttacaagtgcatgcc

SEQ ID NO: 295059 - DNA, 15 bp, Homo sapiens
attacaagtgcatgc

SEQ ID NO: 295060 - DNA, 15 bp, Homo sapiens
gattacaagtgcatg

SEQ ID NO: 295061 - DNA, 15 bp, Homo sapiens
ggattacaagtgcat

SEQ ID NO: 295062 - DNA, 15 bp, Homo sapiens
gggattacaagtgca

SEQ ID NO: 295063 - DNA, 15 bp, Homo sapiens
tgggattacaagtgc

SEQ ID NO: 295064 - DNA, 15 bp, Homo sapiens
ttgctgggattacaa

SEQ ID NO: 295065 - DNA, 15 bp, Homo sapiens
gttgctgggattaca

SEQ ID NO: 295066 - DNA, 15 bp, Homo sapiens
agttgctgggattac

SEQ ID NO: 295067 - DNA, 15 bp, Homo sapiens
gagttgctgggatta

SEQ ID NO: 295068 - DNA, 15 bp, Homo sapiens
tgagttgctgggatt

SEQ ID NO: 295069 - DNA, 15 bp, Homo sapiens
ctgagttgctgggat

SEQ ID NO: 295070 - DNA, 15 bp, Homo sapiens
cctgagttgctggga

SEQ ID NO: 295071 - DNA, 15 bp, Homo sapiens
tcctgagttgctggg

SEQ ID NO: 295072 - DNA, 15 bp, Homo sapiens
ctcctgagttgctgg

SEQ ID NO: 295073 - DNA, 15 bp, Homo sapiens
cctcctgagttgctg

SEQ ID NO: 295074 - DNA, 15 bp, Homo sapiens
acctcctgagttgct

SEQ ID NO: 295075 - DNA, 15 bp, Homo sapiens
aacctcctgagttgc

SEQ ID NO: 295076 - DNA, 15 bp, Homo sapiens
caacctcctgagttg

SEQ ID NO: 295077 - DNA, 15 bp, Homo sapiens
tgcctcaacctcctg

SEQ ID NO: 295078 - DNA, 15 bp, Homo sapiens
ctgcctcaacctcct

SEQ ID NO: 295079 - DNA, 15 bp, Homo sapiens
tacctcccaggttca

SEQ ID NO: 295080 - DNA, 15 bp, Homo sapiens
ctacctcccaggttc

SEQ ID NO: 295081 - DNA, 15 bp, Homo sapiens
tctacctcccaggtt

SEQ ID NO: 295082 - DNA, 15 bp, Homo sapiens
ctctacctcccaggt

SEQ ID NO: 295083 - DNA, 15 bp, Homo sapiens
cctctacctcccagg

SEQ ID NO: 295084 - DNA, 15 bp, Homo sapiens
acctctacctcccag

SEQ ID NO: 295085 - DNA, 15 bp, Homo sapiens
caacctctacctccc

SEQ ID NO: 295086 - DNA, 15 bp, Homo sapiens
gcaacctctacctcc

SEQ ID NO: 295087 - DNA, 15 bp, Homo sapiens
tgcaacctctacctc

SEQ ID NO: 295088 - DNA, 15 bp, Homo sapiens
ttgcaacctctacct

SEQ ID NO: 295089 - DNA, 15 bp, Homo sapiens
attgcaacctctacc

SEQ ID NO: 295090 - DNA, 15 bp, Homo sapiens
cattgcaacctctac

SEQ ID NO: 295091 - DNA, 15 bp, Homo sapiens
tcattgcaacctcta

SEQ ID NO: 295092 - DNA, 15 bp, Homo sapiens
ctcattgcaacctct

SEQ ID NO: 295093 - DNA, 15 bp, Homo sapiens
cgatctcggctcatt

SEQ ID NO: 295094 - DNA, 15 bp, Homo sapiens
acgatctcggctcat

SEQ ID NO: 295095 - DNA, 15 bp, Homo sapiens
ggtggcacgatctcg

SEQ ID NO: 295096 - DNA, 15 bp, Homo sapiens
cggtggcacgatctc

SEQ ID NO: 295097 - DNA, 15 bp, Homo sapiens
gcggtggcacgatct

SEQ ID NO: 295098 - DNA, 15 bp, Homo sapiens
tgcggtggcacgatc

SEQ ID NO: 295099 - DNA, 15 bp, Homo sapiens
gtgcggtggcacgat

SEQ ID NO: 295100 - DNA, 15 bp, Homo sapiens
agtgcggtggcacga

SEQ ID NO: 295101 - DNA, 15 bp, Homo sapiens
gagtgcggtggcacg

SEQ ID NO: 295102 - DNA, 15 bp, Homo sapiens
gctgtctcccaggct

SEQ ID NO: 295103 - DNA, 15 bp, Homo sapiens
cgctgtctcccaggc

SEQ ID NO: 295104 - DNA, 15 bp, Homo sapiens
acgctgtctcccagg

SEQ ID NO: 295105 - DNA, 15 bp, Homo sapiens
cacgctgtctcccag

SEQ ID NO: 295106 - DNA, 15 bp, Homo sapiens
tcacgctgtctccca

SEQ ID NO: 295107 - DNA, 15 bp, Homo sapiens
ctcacgctgtctccc

SEQ ID NO: 295108 - DNA, 15 bp, Homo sapiens
tctcacgctgtctcc

SEQ ID NO: 295109 - DNA, 15 bp, Homo sapiens
gtctcacgctgtctc

SEQ ID NO: 295110 - DNA, 15 bp, Homo sapiens
agtctcacgctgtct

SEQ ID NO: 295111 - DNA, 15 bp, Homo sapiens
aagtctcacgctgtc

SEQ ID NO: 295112 - DNA, 15 bp, Homo sapiens
gaagtctcacgctgt

SEQ ID NO: 295113 - DNA, 15 bp, Homo sapiens
ggaagtctcacgctg

SEQ ID NO: 295114 - DNA, 15 bp, Homo sapiens
aggaagtctcacgct

SEQ ID NO: 295115 - DNA, 15 bp, Homo sapiens
gaggaagtctcacgc

SEQ ID NO: 295116 - DNA, 15 bp, Homo sapiens
agaggaagtctcacg

SEQ ID NO: 295117 - DNA, 15 bp, Homo sapiens
gagaggaagtctcac

SEQ ID NO: 295118 - DNA, 15 bp, Homo sapiens
ggagaggaagtctca

SEQ ID NO: 295119 - DNA, 15 bp, Homo sapiens
tggagaggaagtctc

SEQ ID NO: 295120 - DNA, 15 bp, Homo sapiens
ttggagaggaagtct

SEQ ID NO: 295121 - DNA, 15 bp, Homo sapiens
tttggagaggaagtc

SEQ ID NO: 295122 - DNA, 15 bp, Homo sapiens
ttttggagaggaagt

SEQ ID NO: 295123 - DNA, 15 bp, Homo sapiens
tttttggagaggaag

SEQ ID NO: 295124 - DNA, 15 bp, Homo sapiens
ttttttggagaggaa

SEQ ID NO: 295125 - DNA, 15 bp, Homo sapiens
tttttttggagagga

SEQ ID NO: 295126 - DNA, 15 bp, Homo sapiens
ttttttttggagagg

SEQ ID NO: 295127 - DNA, 15 bp, Homo sapiens
tttttttttggagag

SEQ ID NO: 295128 - DNA, 15 bp, Homo sapiens
ttttttttttggaga

SEQ ID NO: 295129 - DNA, 15 bp, Homo sapiens
tttttttttttggag

SEQ ID NO: 295130 - DNA, 15 bp, Homo sapiens
ttttttttttttgga

SEQ ID NO: 295131 - DNA, 15 bp, Homo sapiens
ggctttttttttttt

SEQ ID NO: 295132 - DNA, 15 bp, Homo sapiens
atggctttttttttt

SEQ ID NO: 295133 - DNA, 15 bp, Homo sapiens
gatggcttttttttt

SEQ ID NO: 295134 - DNA, 15 bp, Homo sapiens
ggatggctttttttt

SEQ ID NO: 295135 - DNA, 15 bp, Homo sapiens
cggatggcttttttt

SEQ ID NO: 295136 - DNA, 15 bp, Homo sapiens
tcggatggctttttt

SEQ ID NO: 295137 - DNA, 15 bp, Homo sapiens
ttcggatggcttttt

SEQ ID NO: 295138 - DNA, 15 bp, Homo sapiens
tttcggatggctttt

SEQ ID NO: 295139 - DNA, 15 bp, Homo sapiens
atttcggatggcttt

SEQ ID NO: 295140 - DNA, 15 bp, Homo sapiens
catttcggatggctt

SEQ ID NO: 295141 - DNA, 15 bp, Homo sapiens
tcatttcggatggct

SEQ ID NO: 295142 - DNA, 15 bp, Homo sapiens
atcatttcggatggc

SEQ ID NO: 295143 - DNA, 15 bp, Homo sapiens
catcatttcggatgg

SEQ ID NO: 295144 - DNA, 15 bp, Homo sapiens
tcatcatttcggatg

SEQ ID NO: 295145 - DNA, 15 bp, Homo sapiens
ttcatcatttcggat

SEQ ID NO: 295146 - DNA, 15 bp, Homo sapiens
tttcatcatttcgga

SEQ ID NO: 295147 - DNA, 15 bp, Homo sapiens
ttttcatcatttcgg

SEQ ID NO: 295148 - DNA, 15 bp, Homo sapiens
tttttcatcatttcg

SEQ ID NO: 295149 - DNA, 15 bp, Homo sapiens
ctttttcatcatttc

SEQ ID NO: 295150 - DNA, 15 bp, Homo sapiens
tctttttcatcattt

SEQ ID NO: 295151 - DNA, 15 bp, Homo sapiens
ctctttttcatcatt

SEQ ID NO: 295152 - DNA, 15 bp, Homo sapiens
tctctttttcatcat

SEQ ID NO: 295153 - DNA, 15 bp, Homo sapiens
atctctttttcatca

SEQ ID NO: 295154 - DNA, 15 bp, Homo sapiens
aatctctttttcatc

SEQ ID NO: 295155 - DNA, 15 bp, Homo sapiens
gataatctctttttc

SEQ ID NO: 295156 - DNA, 15 bp, Homo sapiens
tgataatctcttttt

SEQ ID NO: 295157 - DNA, 15 bp, Homo sapiens
ttgataatctctttt

SEQ ID NO: 295158 - DNA, 15 bp, Homo sapiens
attgataatctcttt

SEQ ID NO: 295159 - DNA, 15 bp, Homo sapiens
aattgataatctctt

SEQ ID NO: 295160 - DNA, 15 bp, Homo sapiens
taattgataatctct

SEQ ID NO: 295161 - DNA, 15 bp, Homo sapiens
ataattgataatctc

SEQ ID NO: 295162 - DNA, 15 bp, Homo sapiens
gataattgataatct

SEQ ID NO: 295163 - DNA, 15 bp, Homo sapiens
tgataattgataatc

SEQ ID NO: 295164 - DNA, 15 bp, Homo sapiens
ctgataattgataat

SEQ ID NO: 295165 - DNA, 15 bp, Homo sapiens
cctgataattgataa

SEQ ID NO: 295166 - DNA, 15 bp, Homo sapiens
tcctgataattgata

SEQ ID NO: 295167 - DNA, 15 bp, Homo sapiens
ctcctgataattgat

SEQ ID NO: 295168 - DNA, 15 bp, Homo sapiens
actcctgataattga

SEQ ID NO: 295169 - DNA, 15 bp, Homo sapiens
cactcctgataattg

SEQ ID NO: 295170 - DNA, 15 bp, Homo sapiens
acactcctgataatt

SEQ ID NO: 295171 - DNA, 15 bp, Homo sapiens
tacactcctgataat

SEQ ID NO: 295172 - DNA, 15 bp, Homo sapiens
ctacactcctgataa

SEQ ID NO: 295173 - DNA, 15 bp, Homo sapiens
cctacactcctgata

SEQ ID NO: 295174 - DNA, 15 bp, Homo sapiens
acctacactcctgat

SEQ ID NO: 295175 - DNA, 15 bp, Homo sapiens
tacctacactcctga

SEQ ID NO: 295176 - DNA, 15 bp, Homo sapiens
ttacctacactcctg

SEQ ID NO: 295177 - DNA, 15 bp, Homo sapiens
tttacctacactcct

SEQ ID NO: 295178 - DNA, 15 bp, Homo sapiens
atttacctacactcc

SEQ ID NO: 295179 - DNA, 15 bp, Homo sapiens
tatttacctacactc

SEQ ID NO: 295180 - DNA, 15 bp, Homo sapiens
ttatttacctacact

SEQ ID NO: 295181 - DNA, 15 bp, Homo sapiens
cttatttacctacac

SEQ ID NO: 295182 - DNA, 15 bp, Homo sapiens
tcttatttacctaca

SEQ ID NO: 295183 - DNA, 15 bp, Homo sapiens
atcttatttacctac

SEQ ID NO: 295184 - DNA, 15 bp, Homo sapiens
tatcttatttaccta

SEQ ID NO: 295185 - DNA, 15 bp, Homo sapiens
atatcttatttacct

SEQ ID NO: 295186 - DNA, 15 bp, Homo sapiens
tatatcttatttacc

SEQ ID NO: 295187 - DNA, 15 bp, Homo sapiens
atatatcttatttac

SEQ ID NO: 295188 - DNA, 15 bp, Homo sapiens
aatatatcttattta

SEQ ID NO: 295189 - DNA, 15 bp, Homo sapiens
caatatatcttattt

SEQ ID NO: 295190 - DNA, 15 bp, Homo sapiens
tcaatatatcttatt

SEQ ID NO: 295191 - DNA, 15 bp, Homo sapiens
gtcaatatatcttat

SEQ ID NO: 295192 - DNA, 15 bp, Homo sapiens
agtcaatatatctta

SEQ ID NO: 295193 - DNA, 15 bp, Homo sapiens
aagtcaatatatctt

SEQ ID NO: 295194 - DNA, 15 bp, Homo sapiens
gaagtcaatatatct

SEQ ID NO: 295195 - DNA, 15 bp, Homo sapiens
tgaagtcaatatatc

SEQ ID NO: 295196 - DNA, 15 bp, Homo sapiens
atgaagtcaatatat

SEQ ID NO: 295197 - DNA, 15 bp, Homo sapiens
aatgaagtcaatata

SEQ ID NO: 295198 - DNA, 15 bp, Homo sapiens
aaatgaagtcaatat

SEQ ID NO: 295199 - DNA, 15 bp, Homo sapiens
taaatgaagtcaata

SEQ ID NO: 295200 - DNA, 15 bp, Homo sapiens
ttaaatgaagtcaat

SEQ ID NO: 295201 - DNA, 15 bp, Homo sapiens
tttaaatgaagtcaa

SEQ ID NO: 295202 - DNA, 15 bp, Homo sapiens
ctttaaatgaagtca

SEQ ID NO: 295203 - DNA, 15 bp, Homo sapiens
tctttaaatgaagtc

SEQ ID NO: 295204 - DNA, 15 bp, Homo sapiens
atctttaaatgaagt

SEQ ID NO: 295205 - DNA, 15 bp, Homo sapiens
aatctttaaatgaag

SEQ ID NO: 295206 - DNA, 15 bp, Homo sapiens
taatctttaaatgaa

SEQ ID NO: 295207 - DNA, 15 bp, Homo sapiens
ataatctttaaatga

SEQ ID NO: 295208 - DNA, 15 bp, Homo sapiens
aataatctttaaatg

SEQ ID NO: 295209 - DNA, 15 bp, Homo sapiens
taataatctttaaat

SEQ ID NO: 295210 - DNA, 15 bp, Homo sapiens
ataataatctttaaa

SEQ ID NO: 295211 - DNA, 15 bp, Homo sapiens
aataataatctttaa

SEQ ID NO: 295212 - DNA, 15 bp, Homo sapiens
aaataataatcttta

SEQ ID NO: 295213 - DNA, 15 bp, Homo sapiens
taaataataatcttt

SEQ ID NO: 295214 - DNA, 15 bp, Homo sapiens
gtaaataataatctt

SEQ ID NO: 295215 - DNA, 15 bp, Homo sapiens
agtaaataataatct

SEQ ID NO: 295216 - DNA, 15 bp, Homo sapiens
cagtaaataataatc

SEQ ID NO: 295217 - DNA, 15 bp, Homo sapiens
acagtaaataataat

SEQ ID NO: 295218 - DNA, 15 bp, Homo sapiens
tacagtaaataataa

SEQ ID NO: 295219 - DNA, 15 bp, Homo sapiens
atacagtaaataata

SEQ ID NO: 295220 - DNA, 15 bp, Homo sapiens
tatacagtaaataat

SEQ ID NO: 295221 - DNA, 15 bp, Homo sapiens
ctatacagtaaataa

SEQ ID NO: 295222 - DNA, 15 bp, Homo sapiens
tctatacagtaaata

SEQ ID NO: 295223 - DNA, 15 bp, Homo sapiens
ttctatacagtaaat

SEQ ID NO: 295224 - DNA, 15 bp, Homo sapiens
gttctatacagtaaa

SEQ ID NO: 295225 - DNA, 15 bp, Homo sapiens
agttctatacagtaa

SEQ ID NO: 295226 - DNA, 15 bp, Homo sapiens
aagttctatacagta

SEQ ID NO: 295227 - DNA, 15 bp, Homo sapiens
aaagttctatacagt

SEQ ID NO: 295228 - DNA, 15 bp, Homo sapiens
caaagttctatacag

SEQ ID NO: 295229 - DNA, 15 bp, Homo sapiens
acaaagttctataca

SEQ ID NO: 295230 - DNA, 15 bp, Homo sapiens
tacaaagttctatac

SEQ ID NO: 295231 - DNA, 15 bp, Homo sapiens
ttacaaagttctata

SEQ ID NO: 295232 - DNA, 15 bp, Homo sapiens
attacaaagttctat

SEQ ID NO: 295233 - DNA, 15 bp, Homo sapiens
aattacaaagttcta

SEQ ID NO: 295234 - DNA, 15 bp, Homo sapiens
aaattacaaagttct

SEQ ID NO: 295235 - DNA, 15 bp, Homo sapiens
aaaattacaaagttc

SEQ ID NO: 295236 - DNA, 15 bp, Homo sapiens
aaaaattacaaagtt

SEQ ID NO: 295237 - DNA, 15 bp, Homo sapiens
taaaaattacaaagt

SEQ ID NO: 295238 - DNA, 15 bp, Homo sapiens
ttaaaaattacaaag

SEQ ID NO: 295239 - DNA, 15 bp, Homo sapiens
tttaaaaattacaaa

SEQ ID NO: 295240 - DNA, 15 bp, Homo sapiens
ttttaaaaattacaa

SEQ ID NO: 295241 - DNA, 15 bp, Homo sapiens
attttaaaaattaca

SEQ ID NO: 295242 - DNA, 15 bp, Homo sapiens
tattttaaaaattac

SEQ ID NO: 295243 - DNA, 15 bp, Homo sapiens
gtattttaaaaatta

SEQ ID NO: 295244 - DNA, 15 bp, Homo sapiens
ggtattttaaaaatt

SEQ ID NO: 295245 - DNA, 15 bp, Homo sapiens
tggtattttaaaaat

SEQ ID NO: 295246 - DNA, 15 bp, Homo sapiens
atggtattttaaaaa

SEQ ID NO: 295247 - DNA, 15 bp, Homo sapiens
gatggtattttaaaa

SEQ ID NO: 295248 - DNA, 15 bp, Homo sapiens
tgatggtattttaaa

SEQ ID NO: 295249 - DNA, 15 bp, Homo sapiens
atgatggtattttaa

SEQ ID NO: 295250 - DNA, 15 bp, Homo sapiens
aatgatggtatttta

SEQ ID NO: 295251 - DNA, 15 bp, Homo sapiens
taatgatggtatttt

SEQ ID NO: 295252 - DNA, 15 bp, Homo sapiens
ctaatgatggtattt

SEQ ID NO: 295253 - DNA, 15 bp, Homo sapiens
gctaatgatggtatt

SEQ ID NO: 295254 - DNA, 15 bp, Homo sapiens
tgctaatgatggtat

SEQ ID NO: 295255 - DNA, 15 bp, Homo sapiens
ctgctaatgatggta

SEQ ID NO: 295256 - DNA, 15 bp, Homo sapiens
tctgctaatgatggt

SEQ ID NO: 295257 - DNA, 15 bp, Homo sapiens
ttctgctaatgatgg

SEQ ID NO: 295258 - DNA, 15 bp, Homo sapiens
attctgctaatgatg

SEQ ID NO: 295259 - DNA, 15 bp, Homo sapiens
cattctgctaatgat

SEQ ID NO: 295260 - DNA, 15 bp, Homo sapiens
acattctgctaatga

SEQ ID NO: 295261 - DNA, 15 bp, Homo sapiens
cacattctgctaatg

SEQ ID NO: 295262 - DNA, 15 bp, Homo sapiens
tcacattctgctaat

SEQ ID NO: 295263 - DNA, 15 bp, Homo sapiens
ttcacattctgctaa

SEQ ID NO: 295264 - DNA, 15 bp, Homo sapiens
tttcacattctgcta

SEQ ID NO: 295265 - DNA, 15 bp, Homo sapiens
ttttcacattctgct

SEQ ID NO: 295266 - DNA, 15 bp, Homo sapiens
gttttcacattctgc

SEQ ID NO: 295267 - DNA, 15 bp, Homo sapiens
tgttttcacattctg

SEQ ID NO: 295268 - DNA, 15 bp, Homo sapiens
ctgttttcacattct

SEQ ID NO: 295269 - DNA, 15 bp, Homo sapiens
gctgttttcacattc

SEQ ID NO: 295270 - DNA, 15 bp, Homo sapiens
agctgttttcacatt

SEQ ID NO: 295271 - DNA, 15 bp, Homo sapiens
tagctgttttcacat

SEQ ID NO: 295272 - DNA, 15 bp, Homo sapiens
atagctgttttcaca

SEQ ID NO: 295273 - DNA, 15 bp, Homo sapiens
aatagctgttttcac

SEQ ID NO: 295274 - DNA, 15 bp, Homo sapiens
aaatagctgttttca

SEQ ID NO: 295275 - DNA, 15 bp, Homo sapiens
taaatagctgttttc

SEQ ID NO: 295276 - DNA, 15 bp, Homo sapiens
ttaaatagctgtttt

SEQ ID NO: 295277 - DNA, 15 bp, Homo sapiens
tttaaatagctgttt

SEQ ID NO: 295278 - DNA, 15 bp, Homo sapiens
ttttaaatagctgtt

SEQ ID NO: 295279 - DNA, 15 bp, Homo sapiens
attttaaatagctgt

SEQ ID NO: 295280 - DNA, 15 bp, Homo sapiens
tattttaaatagctg

SEQ ID NO: 295281 - DNA, 15 bp, Homo sapiens
atattttaaatagct

SEQ ID NO: 295282 - DNA, 15 bp, Homo sapiens
tatattttaaatagc

SEQ ID NO: 295283 - DNA, 15 bp, Homo sapiens
atatattttaaatag

SEQ ID NO: 295284 - DNA, 15 bp, Homo sapiens
aatatattttaaata

SEQ ID NO: 295285 - DNA, 15 bp, Homo sapiens
aaatatattttaaat

SEQ ID NO: 295286 - DNA, 15 bp, Homo sapiens
gaaatatattttaaa

SEQ ID NO: 295287 - DNA, 15 bp, Homo sapiens
agaaatatattttaa

SEQ ID NO: 295288 - DNA, 15 bp, Homo sapiens
cagaaatatatttta

SEQ ID NO: 295289 - DNA, 15 bp, Homo sapiens
ccagaaatatatttt

SEQ ID NO: 295290 - DNA, 15 bp, Homo sapiens
gccagaaatatattt

SEQ ID NO: 295291 - DNA, 15 bp, Homo sapiens
ggccagaaatatatt

SEQ ID NO: 295292 - DNA, 15 bp, Homo sapiens
gggccagaaatatat

SEQ ID NO: 295293 - DNA, 15 bp, Homo sapiens
tgggccagaaatata

SEQ ID NO: 295294 - DNA, 15 bp, Homo sapiens
ctgggccagaaatat

SEQ ID NO: 295295 - DNA, 15 bp, Homo sapiens
cctgggccagaaata

SEQ ID NO: 295296 - DNA, 15 bp, Homo sapiens
acctgggccagaaat

SEQ ID NO: 295297 - DNA, 15 bp, Homo sapiens
cacctgggccagaaa

SEQ ID NO: 295298 - DNA, 15 bp, Homo sapiens
gcacctgggccagaa

SEQ ID NO: 295299 - DNA, 15 bp, Homo sapiens
cgcacctgggccaga

SEQ ID NO: 295300 - DNA, 15 bp, Homo sapiens
ccgcacctgggccag

SEQ ID NO: 295301 - DNA, 15 bp, Homo sapiens
accgcacctgggcca

SEQ ID NO: 295302 - DNA, 15 bp, Homo sapiens
caccgcacctgggcc

SEQ ID NO: 295303 - DNA, 15 bp, Homo sapiens
ccaccgcacctgggc

SEQ ID NO: 295304 - DNA, 15 bp, Homo sapiens
gccaccgcacctggg

SEQ ID NO: 295305 - DNA, 15 bp, Homo sapiens
aattacaggcatgag

SEQ ID NO: 295306 - DNA, 15 bp, Homo sapiens
gaattacaggcatga

SEQ ID NO: 295307 - DNA, 15 bp, Homo sapiens
tgctggaattacagg

SEQ ID NO: 295308 - DNA, 15 bp, Homo sapiens
atgctggaattacag

SEQ ID NO: 295309 - DNA, 15 bp, Homo sapiens
aatgctggaattaca

SEQ ID NO: 295310 - DNA, 15 bp, Homo sapiens
aaatgctggaattac

SEQ ID NO: 295311 - DNA, 15 bp, Homo sapiens
aaaatgctggaatta

SEQ ID NO: 295312 - DNA, 15 bp, Homo sapiens
caaaatgctggaatt

SEQ ID NO: 295313 - DNA, 15 bp, Homo sapiens
ccaaaatgctggaat

SEQ ID NO: 295314 - DNA, 15 bp, Homo sapiens
gccaaaatgctggaa

SEQ ID NO: 295315 - DNA, 15 bp, Homo sapiens
tgccaaaatgctgga

SEQ ID NO: 295316 - DNA, 15 bp, Homo sapiens
ctgccaaaatgctgg

SEQ ID NO: 295317 - DNA, 15 bp, Homo sapiens
cctgccaaaatgctg

SEQ ID NO: 295318 - DNA, 15 bp, Homo sapiens
gcctgccaaaatgct

SEQ ID NO: 295319 - DNA, 15 bp, Homo sapiens
agcctgccaaaatgc

SEQ ID NO: 295320 - DNA, 15 bp, Homo sapiens
cagcctgccaaaatg

SEQ ID NO: 295321 - DNA, 15 bp, Homo sapiens
tcagcctgccaaaat

SEQ ID NO: 295322 - DNA, 15 bp, Homo sapiens
ctcagcctgccaaaa

SEQ ID NO: 295323 - DNA, 15 bp, Homo sapiens
cctcagcctgccaaa

SEQ ID NO: 295324 - DNA, 15 bp, Homo sapiens
gcctcagcctgccaa

SEQ ID NO: 295325 - DNA, 15 bp, Homo sapiens
tgcctcagcctgcca

SEQ ID NO: 295326 - DNA, 15 bp, Homo sapiens
acctgcctcagcctg

SEQ ID NO: 295327 - DNA, 15 bp, Homo sapiens
atcaggctggtctca

SEQ ID NO: 295328 - DNA, 15 bp, Homo sapiens
aatcaggctggtctc

SEQ ID NO: 295329 - DNA, 15 bp, Homo sapiens
taatcaggctggtct

SEQ ID NO: 295330 - DNA, 15 bp, Homo sapiens
ttaatcaggctggtc

SEQ ID NO: 295331 - DNA, 15 bp, Homo sapiens
gttaatcaggctggt

SEQ ID NO: 295332 - DNA, 15 bp, Homo sapiens
tgttaatcaggctgg

SEQ ID NO: 295333 - DNA, 15 bp, Homo sapiens
atgttaatcaggctg

SEQ ID NO: 295334 - DNA, 15 bp, Homo sapiens
catgttaatcaggct

SEQ ID NO: 295335 - DNA, 15 bp, Homo sapiens
ccatgttaatcaggc

SEQ ID NO: 295336 - DNA, 15 bp, Homo sapiens
gccatgttaatcagg

SEQ ID NO: 295337 - DNA, 15 bp, Homo sapiens
tgccatgttaatcag

SEQ ID NO: 295338 - DNA, 15 bp, Homo sapiens
ttgccatgttaatca

SEQ ID NO: 295339 - DNA, 15 bp, Homo sapiens
tttgccatgttaatc

SEQ ID NO: 295340 - DNA, 15 bp, Homo sapiens
ttttgccatgttaat

SEQ ID NO: 295341 - DNA, 15 bp, Homo sapiens
gttttgccatgttaa

SEQ ID NO: 295342 - DNA, 15 bp, Homo sapiens
ggttttgccatgtta

SEQ ID NO: 295343 - DNA, 15 bp, Homo sapiens
tagggttttgccatg

SEQ ID NO: 295344 - DNA, 15 bp, Homo sapiens
atagggttttgccat

SEQ ID NO: 295345 - DNA, 15 bp, Homo sapiens
gatagggttttgcca

SEQ ID NO: 295346 - DNA, 15 bp, Homo sapiens
agatagggttttgcc

SEQ ID NO: 295347 - DNA, 15 bp, Homo sapiens
gagatagggttttgc

SEQ ID NO: 295348 - DNA, 15 bp, Homo sapiens
agagatagggttttg

SEQ ID NO: 295349 - DNA, 15 bp, Homo sapiens
tagagatagggtttt

SEQ ID NO: 295350 - DNA, 15 bp, Homo sapiens
ggtatttttagtaga

SEQ ID NO: 295351 - DNA, 15 bp, Homo sapiens
tggtatttttagtag

SEQ ID NO: 295352 - DNA, 15 bp, Homo sapiens
ttggtatttttagta

SEQ ID NO: 295353 - DNA, 15 bp, Homo sapiens
tttggtatttttagt

SEQ ID NO: 295354 - DNA, 15 bp, Homo sapiens
ttttggtatttttag

SEQ ID NO: 295355 - DNA, 15 bp, Homo sapiens
tttttggtattttta

SEQ ID NO: 295356 - DNA, 15 bp, Homo sapiens
ttttttggtattttt

SEQ ID NO: 295357 - DNA, 15 bp, Homo sapiens
tttttttggtatttt

SEQ ID NO: 295358 - DNA, 15 bp, Homo sapiens
atttttttggtattt

SEQ ID NO: 295359 - DNA, 15 bp, Homo sapiens
aatttttttggtatt

SEQ ID NO: 295360 - DNA, 15 bp, Homo sapiens
aaatttttttggtat

SEQ ID NO: 295361 - DNA, 15 bp, Homo sapiens
aaaatttttttggta

SEQ ID NO: 295362 - DNA, 15 bp, Homo sapiens
gaaaatttttttggt

SEQ ID NO: 295363 - DNA, 15 bp, Homo sapiens
ggaaaatttttttgg

SEQ ID NO: 295364 - DNA, 15 bp, Homo sapiens
tggaaaatttttttg

SEQ ID NO: 295365 - DNA, 15 bp, Homo sapiens
ctggaaaattttttt

SEQ ID NO: 295366 - DNA, 15 bp, Homo sapiens
cctggaaaatttttt

SEQ ID NO: 295367 - DNA, 15 bp, Homo sapiens
acctggaaaattttt

SEQ ID NO: 295368 - DNA, 15 bp, Homo sapiens
tacctggaaaatttt

SEQ ID NO: 295369 - DNA, 15 bp, Homo sapiens
atacctggaaaattt

SEQ ID NO: 295370 - DNA, 15 bp, Homo sapiens
catacctggaaaatt

SEQ ID NO: 295371 - DNA, 15 bp, Homo sapiens
ccatacctggaaaat

SEQ ID NO: 295372 - DNA, 15 bp, Homo sapiens
accatacctggaaaa

SEQ ID NO: 295373 - DNA, 15 bp, Homo sapiens
caccatacctggaaa

SEQ ID NO: 295374 - DNA, 15 bp, Homo sapiens
ccaccatacctggaa

SEQ ID NO: 295375 - DNA, 15 bp, Homo sapiens
gccaccatacctgga

SEQ ID NO: 295376 - DNA, 15 bp, Homo sapiens
tgccaccatacctgg

SEQ ID NO: 295377 - DNA, 15 bp, Homo sapiens
gtgccaccatacctg

SEQ ID NO: 295378 - DNA, 15 bp, Homo sapiens
tgtgccaccatacct

SEQ ID NO: 295379 - DNA, 15 bp, Homo sapiens
ttgtgccaccatacc

SEQ ID NO: 295380 - DNA, 15 bp, Homo sapiens
cttgtgccaccatac

SEQ ID NO: 295381 - DNA, 15 bp, Homo sapiens
gcttgtgccaccata

SEQ ID NO: 295382 - DNA, 15 bp, Homo sapiens
ggcttgtgccaccat

SEQ ID NO: 295383 - DNA, 15 bp, Homo sapiens
aggcttgtgccacca

SEQ ID NO: 295384 - DNA, 15 bp, Homo sapiens
caggcttgtgccacc

SEQ ID NO: 295385 - DNA, 15 bp, Homo sapiens
acaggcttgtgccac

SEQ ID NO: 295386 - DNA, 15 bp, Homo sapiens
tacaggcttgtgcca

SEQ ID NO: 295387 - DNA, 15 bp, Homo sapiens
ctacaggcttgtgcc

SEQ ID NO: 295388 - DNA, 15 bp, Homo sapiens
actacaggcttgtgc

SEQ ID NO: 295389 - DNA, 15 bp, Homo sapiens
aactacaggcttgtg

SEQ ID NO: 295390 - DNA, 15 bp, Homo sapiens
caactacaggcttgt

SEQ ID NO: 295391 - DNA, 15 bp, Homo sapiens
acaactacaggcttg

SEQ ID NO: 295392 - DNA, 15 bp, Homo sapiens
tacaactacaggctt

SEQ ID NO: 295393 - DNA, 15 bp, Homo sapiens
ctacaactacaggct

SEQ ID NO: 295394 - DNA, 15 bp, Homo sapiens
actacaactacaggc

SEQ ID NO: 295395 - DNA, 15 bp, Homo sapiens
gactacaactacagg

SEQ ID NO: 295396 - DNA, 15 bp, Homo sapiens
ggactacaactacag

SEQ ID NO: 295397 - DNA, 15 bp, Homo sapiens
aggactacaactaca

SEQ ID NO: 295398 - DNA, 15 bp, Homo sapiens
taggactacaactac

SEQ ID NO: 295399 - DNA, 15 bp, Homo sapiens
gtaggactacaacta

SEQ ID NO: 295400 - DNA, 15 bp, Homo sapiens
ggtaggactacaact

SEQ ID NO: 295401 - DNA, 15 bp, Homo sapiens
aggtaggactacaac

SEQ ID NO: 295402 - DNA, 15 bp, Homo sapiens
taggtaggactacaa

SEQ ID NO: 295403 - DNA, 15 bp, Homo sapiens
gtaggtaggactaca

SEQ ID NO: 295404 - DNA, 15 bp, Homo sapiens
agtaggtaggactac

SEQ ID NO: 295405 - DNA, 15 bp, Homo sapiens
aagtaggtaggacta

SEQ ID NO: 295406 - DNA, 15 bp, Homo sapiens
caagtaggtaggact

SEQ ID NO: 295407 - DNA, 15 bp, Homo sapiens
ccaagtaggtaggac

SEQ ID NO: 295408 - DNA, 15 bp, Homo sapiens
cccaagtaggtagga

SEQ ID NO: 295409 - DNA, 15 bp, Homo sapiens
tcccaagtaggtagg

SEQ ID NO: 295410 - DNA, 15 bp, Homo sapiens
ctcccaagtaggtag

SEQ ID NO: 295411 - DNA, 15 bp, Homo sapiens
cctcccaagtaggta

SEQ ID NO: 295412 - DNA, 15 bp, Homo sapiens
gcctcccaagtaggt

SEQ ID NO: 295413 - DNA, 15 bp, Homo sapiens
agcctcccaagtagg

SEQ ID NO: 295414 - DNA, 15 bp, Homo sapiens
atgcctcagcctccc

SEQ ID NO: 295415 - DNA, 15 bp, Homo sapiens
catgcctcagcctcc

SEQ ID NO: 295416 - DNA, 15 bp, Homo sapiens
tcatgcctcagcctc

SEQ ID NO: 295417 - DNA, 15 bp, Homo sapiens
ctcatgcctcagcct

SEQ ID NO: 295418 - DNA, 15 bp, Homo sapiens
tctcatgcctcagcc

SEQ ID NO: 295419 - DNA, 15 bp, Homo sapiens
ttctcatgcctcagc

SEQ ID NO: 295420 - DNA, 15 bp, Homo sapiens
attctcatgcctcag

SEQ ID NO: 295421 - DNA, 15 bp, Homo sapiens
gattctcatgcctca

SEQ ID NO: 295422 - DNA, 15 bp, Homo sapiens
cgattctcatgcctc

SEQ ID NO: 295423 - DNA, 15 bp, Homo sapiens
gcgattctcatgcct

SEQ ID NO: 295424 - DNA, 15 bp, Homo sapiens
agcgattctcatgcc

SEQ ID NO: 295425 - DNA, 15 bp, Homo sapiens
aagcgattctcatgc

SEQ ID NO: 295426 - DNA, 15 bp, Homo sapiens
caagcgattctcatg

SEQ ID NO: 295427 - DNA, 15 bp, Homo sapiens
tcaagcgattctcat

SEQ ID NO: 295428 - DNA, 15 bp, Homo sapiens
ttcaagcgattctca

SEQ ID NO: 295429 - DNA, 15 bp, Homo sapiens
ttcagcctcccaggt

SEQ ID NO: 295430 - DNA, 15 bp, Homo sapiens
cttcagcctcccagg

SEQ ID NO: 295431 - DNA, 15 bp, Homo sapiens
acttcagcctcccag

SEQ ID NO: 295432 - DNA, 15 bp, Homo sapiens
aacttcagcctccca

SEQ ID NO: 295433 - DNA, 15 bp, Homo sapiens
caacttcagcctccc

SEQ ID NO: 295434 - DNA, 15 bp, Homo sapiens
gcaacttcagcctcc

SEQ ID NO: 295435 - DNA, 15 bp, Homo sapiens
tgcaacttcagcctc

SEQ ID NO: 295436 - DNA, 15 bp, Homo sapiens
ctgcaacttcagcct

SEQ ID NO: 295437 - DNA, 15 bp, Homo sapiens
actgcaacttcagcc

SEQ ID NO: 295438 - DNA, 15 bp, Homo sapiens
cactgcaacttcagc

SEQ ID NO: 295439 - DNA, 15 bp, Homo sapiens
tcactgcaacttcag

SEQ ID NO: 295440 - DNA, 15 bp, Homo sapiens
ctcactgcaacttca

SEQ ID NO: 295441 - DNA, 15 bp, Homo sapiens
actcactgcaacttc

SEQ ID NO: 295442 - DNA, 15 bp, Homo sapiens
aactcactgcaactt

SEQ ID NO: 295443 - DNA, 15 bp, Homo sapiens
caactcactgcaact

SEQ ID NO: 295444 - DNA, 15 bp, Homo sapiens
tcaactcactgcaac

SEQ ID NO: 295445 - DNA, 15 bp, Homo sapiens
ctcaactcactgcaa

SEQ ID NO: 295446 - DNA, 15 bp, Homo sapiens
tctcaactcactgca

SEQ ID NO: 295447 - DNA, 15 bp, Homo sapiens
atctcaactcactgc

SEQ ID NO: 295448 - DNA, 15 bp, Homo sapiens
gatctcaactcactg

SEQ ID NO: 295449 - DNA, 15 bp, Homo sapiens
tgatctcaactcact

SEQ ID NO: 295450 - DNA, 15 bp, Homo sapiens
atgatctcaactcac

SEQ ID NO: 295451 - DNA, 15 bp, Homo sapiens
catgatctcaactca

SEQ ID NO: 295452 - DNA, 15 bp, Homo sapiens
gcatgatctcaactc

SEQ ID NO: 295453 - DNA, 15 bp, Homo sapiens
ggcatgatctcaact

SEQ ID NO: 295454 - DNA, 15 bp, Homo sapiens
tggcatgatctcaac

SEQ ID NO: 295455 - DNA, 15 bp, Homo sapiens
gtggcatgatctcaa

SEQ ID NO: 295456 - DNA, 15 bp, Homo sapiens
aagtgcagtggcatg

SEQ ID NO: 295457 - DNA, 15 bp, Homo sapiens
gaagtgcagtggcat

SEQ ID NO: 295458 - DNA, 15 bp, Homo sapiens
tgaagtgcagtggca

SEQ ID NO: 295459 - DNA, 15 bp, Homo sapiens
aggctgaagtgcagt

SEQ ID NO: 295460 - DNA, 15 bp, Homo sapiens
caggctgaagtgcag

SEQ ID NO: 295461 - DNA, 15 bp, Homo sapiens
ccaggctgaagtgca

SEQ ID NO: 295462 - DNA, 15 bp, Homo sapiens
cccaggctgaagtgc

SEQ ID NO: 295463 - DNA, 15 bp, Homo sapiens
gcccaggctgaagtg

SEQ ID NO: 295464 - DNA, 15 bp, Homo sapiens
tgcccaggctgaagt

SEQ ID NO: 295465 - DNA, 15 bp, Homo sapiens
ttgcccaggctgaag

SEQ ID NO: 295466 - DNA, 15 bp, Homo sapiens
gttgcccaggctgaa

SEQ ID NO: 295467 - DNA, 15 bp, Homo sapiens
tctctgttgcccagg

SEQ ID NO: 295468 - DNA, 15 bp, Homo sapiens
gtctctgttgcccag

SEQ ID NO: 295469 - DNA, 15 bp, Homo sapiens
agtctctgttgccca

SEQ ID NO: 295470 - DNA, 15 bp, Homo sapiens
gagtctctgttgccc

SEQ ID NO: 295471 - DNA, 15 bp, Homo sapiens
agagtctctgttgcc

SEQ ID NO: 295472 - DNA, 15 bp, Homo sapiens
tagagtctctgttgc

SEQ ID NO: 295473 - DNA, 15 bp, Homo sapiens
atagagtctctgttg

SEQ ID NO: 295474 - DNA, 15 bp, Homo sapiens
gatagagtctctgtt

SEQ ID NO: 295475 - DNA, 15 bp, Homo sapiens
agatagagtctctgt

SEQ ID NO: 295476 - DNA, 15 bp, Homo sapiens
gagatagagtctctg

SEQ ID NO: 295477 - DNA, 15 bp, Homo sapiens
tgagatagagtctct

SEQ ID NO: 295478 - DNA, 15 bp, Homo sapiens
ttgagatagagtctc

SEQ ID NO: 295479 - DNA, 15 bp, Homo sapiens
gttttgagatagagt

SEQ ID NO: 295480 - DNA, 15 bp, Homo sapiens
tgttttgagatagag

SEQ ID NO: 295481 - DNA, 15 bp, Homo sapiens
ttgttttgagataga

SEQ ID NO: 295482 - DNA, 15 bp, Homo sapiens
gttgttttgagatag

SEQ ID NO: 295483 - DNA, 15 bp, Homo sapiens
tgttgttttgagata

SEQ ID NO: 295484 - DNA, 15 bp, Homo sapiens
ttgttgttttgagat

SEQ ID NO: 295485 - DNA, 15 bp, Homo sapiens
gttgttgttttgaga

SEQ ID NO: 295486 - DNA, 15 bp, Homo sapiens
tgttgttgttttgag

SEQ ID NO: 295487 - DNA, 15 bp, Homo sapiens
ttgttgttgttttga

SEQ ID NO: 295488 - DNA, 15 bp, Homo sapiens
gttgttgttgttttg

SEQ ID NO: 295489 - DNA, 15 bp, Homo sapiens
tgttgttgttgtttt

SEQ ID NO: 295490 - DNA, 15 bp, Homo sapiens
ttttgttgttgttgt

SEQ ID NO: 295491 - DNA, 15 bp, Homo sapiens
ttattttgttgttgt

SEQ ID NO: 295492 - DNA, 15 bp, Homo sapiens
tttattttgttgttg

SEQ ID NO: 295493 - DNA, 15 bp, Homo sapiens
atttattttgttgtt

SEQ ID NO: 295494 - DNA, 15 bp, Homo sapiens
catttattttgttgt

SEQ ID NO: 295495 - DNA, 15 bp, Homo sapiens
tcatttattttgttg

SEQ ID NO: 295496 - DNA, 15 bp, Homo sapiens
ttcatttattttgtt

SEQ ID NO: 295497 - DNA, 15 bp, Homo sapiens
attcatttattttgt

SEQ ID NO: 295498 - DNA, 15 bp, Homo sapiens
tattcatttattttg

SEQ ID NO: 295499 - DNA, 15 bp, Homo sapiens
ttattcatttatttt

SEQ ID NO: 295500 - DNA, 15 bp, Homo sapiens
tttattcatttattt

SEQ ID NO: 295501 - DNA, 15 bp, Homo sapiens
atttattcatttatt

SEQ ID NO: 295502 - DNA, 15 bp, Homo sapiens
tatttattcatttat

SEQ ID NO: 295503 - DNA, 15 bp, Homo sapiens
ttatttattcattta

SEQ ID NO: 295504 - DNA, 15 bp, Homo sapiens
tttatttattcattt

SEQ ID NO: 295505 - DNA, 15 bp, Homo sapiens
ttttatttattcatt

SEQ ID NO: 295506 - DNA, 15 bp, Homo sapiens
gttttatttattcat

SEQ ID NO: 295507 - DNA, 15 bp, Homo sapiens
tgttttatttattca

SEQ ID NO: 295508 - DNA, 15 bp, Homo sapiens
atgttttatttattc

SEQ ID NO: 295509 - DNA, 15 bp, Homo sapiens
tatgttttatttatt

SEQ ID NO: 295510 - DNA, 15 bp, Homo sapiens
atatgttttatttat

SEQ ID NO: 295511 - DNA, 15 bp, Homo sapiens
tatatgttttattta

SEQ ID NO: 295512 - DNA, 15 bp, Homo sapiens
atatatgttttattt

SEQ ID NO: 295513 - DNA, 15 bp, Homo sapiens
aatatatgttttatt

SEQ ID NO: 295514 - DNA, 15 bp, Homo sapiens
aaatatatgttttat

SEQ ID NO: 295515 - DNA, 15 bp, Homo sapiens
gaaatatatgtttta

SEQ ID NO: 295516 - DNA, 15 bp, Homo sapiens
agaaatatatgtttt

SEQ ID NO: 295517 - DNA, 15 bp, Homo sapiens
aagaaatatatgttt

SEQ ID NO: 295518 - DNA, 15 bp, Homo sapiens
aaagaaatatatgtt

SEQ ID NO: 295519 - DNA, 15 bp, Homo sapiens
caaagaaatatatgt

SEQ ID NO: 295520 - DNA, 15 bp, Homo sapiens
acaaagaaatatatg

SEQ ID NO: 295521 - DNA, 15 bp, Homo sapiens
cacaaagaaatatat

SEQ ID NO: 295522 - DNA, 15 bp, Homo sapiens
tcacaaagaaatata

SEQ ID NO: 295523 - DNA, 15 bp, Homo sapiens
ttcacaaagaaatat

SEQ ID NO: 295524 - DNA, 15 bp, Homo sapiens
attcacaaagaaata

SEQ ID NO: 295525 - DNA, 15 bp, Homo sapiens
aattcacaaagaaat

SEQ ID NO: 295526 - DNA, 15 bp, Homo sapiens
aaattcacaaagaaa

SEQ ID NO: 295527 - DNA, 15 bp, Homo sapiens
aaaattcacaaagaa

SEQ ID NO: 295528 - DNA, 15 bp, Homo sapiens
gaaaattcacaaaga

SEQ ID NO: 295529 - DNA, 15 bp, Homo sapiens
tgaaaattcacaaag

SEQ ID NO: 295530 - DNA, 15 bp, Homo sapiens
ctgaaaattcacaaa

SEQ ID NO: 295531 - DNA, 15 bp, Homo sapiens
cctgaaaattcacaa

SEQ ID NO: 295532 - DNA, 15 bp, Homo sapiens
tcctgaaaattcaca

SEQ ID NO: 295533 - DNA, 15 bp, Homo sapiens
ttcctgaaaattcac

SEQ ID NO: 295534 - DNA, 15 bp, Homo sapiens
attcctgaaaattca

SEQ ID NO: 295535 - DNA, 15 bp, Homo sapiens
tattcctgaaaattc

SEQ ID NO: 295536 - DNA, 15 bp, Homo sapiens
atattcctgaaaatt

SEQ ID NO: 295537 - DNA, 15 bp, Homo sapiens
aatattcctgaaaat

SEQ ID NO: 295538 - DNA, 15 bp, Homo sapiens
aaatattcctgaaaa

SEQ ID NO: 295539 - DNA, 15 bp, Homo sapiens
caaatattcctgaaa

SEQ ID NO: 295540 - DNA, 15 bp, Homo sapiens
gcaaatattcctgaa

SEQ ID NO: 295541 - DNA, 15 bp, Homo sapiens
ggcaaatattcctga

SEQ ID NO: 295542 - DNA, 15 bp, Homo sapiens
aggcaaatattcctg

SEQ ID NO: 295543 - DNA, 15 bp, Homo sapiens
caggcaaatattcct

SEQ ID NO: 295544 - DNA, 15 bp, Homo sapiens
tcaggcaaatattcc

SEQ ID NO: 295545 - DNA, 15 bp, Homo sapiens
ttcaggcaaatattc

SEQ ID NO: 295546 - DNA, 15 bp, Homo sapiens
cttcaggcaaatatt

SEQ ID NO: 295547 - DNA, 15 bp, Homo sapiens
tcttcaggcaaatat

SEQ ID NO: 295548 - DNA, 15 bp, Homo sapiens
atcttcaggcaaata

SEQ ID NO: 295549 - DNA, 15 bp, Homo sapiens
aatcttcaggcaaat

SEQ ID NO: 295550 - DNA, 15 bp, Homo sapiens
taatcttcaggcaaa

SEQ ID NO: 295551 - DNA, 15 bp, Homo sapiens
ataatcttcaggcaa

SEQ ID NO: 295552 - DNA, 15 bp, Homo sapiens
tataatcttcaggca

SEQ ID NO: 295553 - DNA, 15 bp, Homo sapiens
atataatcttcaggc

SEQ ID NO: 295554 - DNA, 15 bp, Homo sapiens
aatataatcttcagg

SEQ ID NO: 295555 - DNA, 15 bp, Homo sapiens
taatataatcttcag

SEQ ID NO: 295556 - DNA, 15 bp, Homo sapiens
ataatataatcttca

SEQ ID NO: 295557 - DNA, 15 bp, Homo sapiens
cataatataatcttc

SEQ ID NO: 295558 - DNA, 15 bp, Homo sapiens
ccataatataatctt

SEQ ID NO: 295559 - DNA, 15 bp, Homo sapiens
accataatataatct

SEQ ID NO: 295560 - DNA, 15 bp, Homo sapiens
aaccataatataatc

SEQ ID NO: 295561 - DNA, 15 bp, Homo sapiens
aaaccataatataat

SEQ ID NO: 295562 - DNA, 15 bp, Homo sapiens
gaaaccataatataa

SEQ ID NO: 295563 - DNA, 15 bp, Homo sapiens
ggaaaccataatata

SEQ ID NO: 295564 - DNA, 15 bp, Homo sapiens
tggaaaccataatat

SEQ ID NO: 295565 - DNA, 15 bp, Homo sapiens
gtggaaaccataata

SEQ ID NO: 295566 - DNA, 15 bp, Homo sapiens
ggtggaaaccataat

SEQ ID NO: 295567 - DNA, 15 bp, Homo sapiens
tggtggaaaccataa
